United States Patent 11,492,591 (UNIVERSAL DONOR STEM CELLS AND RELATED METHODS) - sequence listing, part 19

SEQ ID NO: 604990 - DNA, 20 bp, Artificial
  CRISPR gRNA sequence
cgtagaaataaggaaggtta

SEQ ID NO: 604991 - DNA, 20 bp, Artificial
  CRISPR gRNA sequence
tagaaataaggaaggttaaa

SEQ ID NO: 604992 - DNA, 20 bp, Artificial
  CRISPR gRNA sequence
gatttcctatcctttcctta

SEQ ID NO: 604993 - DNA, 20 bp, Artificial
  CRISPR gRNA sequence
atcctttccttaaagaaaaa

SEQ ID NO: 604994 - DNA, 20 bp, Artificial
  CRISPR gRNA sequence
tcctttccttaaagaaaaaa

SEQ ID NO: 604995 - DNA, 20 bp, Artificial
  CRISPR gRNA sequence
tctctcattcactatacatt

SEQ ID NO: 604996 - DNA, 20 bp, Artificial
  CRISPR gRNA sequence
tcattcactatacattcagt

SEQ ID NO: 604997 - DNA, 20 bp, Artificial
  CRISPR gRNA sequence
gtgcccactaaacttttatt

SEQ ID NO: 604998 - DNA, 20 bp, Artificial
  CRISPR gRNA sequence
attaagcctttcttttcgtt

SEQ ID NO: 604999 - DNA, 20 bp, Artificial
  CRISPR gRNA sequence
agtctgttgatttgataaat

SEQ ID NO: 605000 - DNA, 20 bp, Artificial
  CRISPR gRNA sequence
ctgttgatttgataaatcag

SEQ ID NO: 605001 - DNA, 20 bp, Artificial
  CRISPR gRNA sequence
atcagaagattatctttgat

SEQ ID NO: 605002 - DNA, 20 bp, Artificial
  CRISPR gRNA sequence
tccttttgtgattgtttatt

SEQ ID NO: 605003 - DNA, 20 bp, Artificial
  CRISPR gRNA sequence
gtttattaagctatctgtcc

SEQ ID NO: 605004 - DNA, 20 bp, Artificial
  CRISPR gRNA sequence
agctatctgtccaagctttg

SEQ ID NO: 605005 - DNA, 20 bp, Artificial
  CRISPR gRNA sequence
atctgtccaagctttgaaga

SEQ ID NO: 605006 - DNA, 20 bp, Artificial
  CRISPR gRNA sequence
gctttgaagacagtctgcaa

SEQ ID NO: 605007 - DNA, 20 bp, Artificial
  CRISPR gRNA sequence
gtctgcaatggttcaaatct

SEQ ID NO: 605008 - DNA, 20 bp, Artificial
  CRISPR gRNA sequence
tcaaatctaagcattgccat

SEQ ID NO: 605009 - DNA, 20 bp, Artificial
  CRISPR gRNA sequence
atgtgtgtatacatgtctgt

SEQ ID NO: 605010 - DNA, 20 bp, Artificial
  CRISPR gRNA sequence
aatttatcattgtttaccca

SEQ ID NO: 605011 - DNA, 20 bp, Artificial
  CRISPR gRNA sequence
atttatcattgtttacccaa

SEQ ID NO: 605012 - DNA, 20 bp, Artificial
  CRISPR gRNA sequence
tgtttacccaaaggaataac

SEQ ID NO: 605013 - DNA, 20 bp, Artificial
  CRISPR gRNA sequence
ggaataactagctactgact

SEQ ID NO: 605014 - DNA, 20 bp, Artificial
  CRISPR gRNA sequence
atgaataaattaatatctct

SEQ ID NO: 605015 - DNA, 20 bp, Artificial
  CRISPR gRNA sequence
aaattaatatctctgagcct

SEQ ID NO: 605016 - DNA, 20 bp, Artificial
  CRISPR gRNA sequence
tcagttgacttacctgtaca

SEQ ID NO: 605017 - DNA, 20 bp, Artificial
  CRISPR gRNA sequence
ttgacttacctgtacaaagt

SEQ ID NO: 605018 - DNA, 20 bp, Artificial
  CRISPR gRNA sequence
tgagaatacttatatttttt

SEQ ID NO: 605019 - DNA, 20 bp, Artificial
  CRISPR gRNA sequence
cttatattttttaagattgt

SEQ ID NO: 605020 - DNA, 20 bp, Artificial
  CRISPR gRNA sequence
attttttaagattgttagat

SEQ ID NO: 605021 - DNA, 20 bp, Artificial
  CRISPR gRNA sequence
gttagattagttgtatattt

SEQ ID NO: 605022 - DNA, 20 bp, Artificial
  CRISPR gRNA sequence
gtatatttaagccccctcta

SEQ ID NO: 605023 - DNA, 20 bp, Artificial
  CRISPR gRNA sequence
taagccccctctacggtatt

SEQ ID NO: 605024 - DNA, 20 bp, Artificial
  CRISPR gRNA sequence
ctacggtatttagaacatgt

SEQ ID NO: 605025 - DNA, 20 bp, Artificial
  CRISPR gRNA sequence
tttagaacatgtgagtaacg

SEQ ID NO: 605026 - DNA, 20 bp, Artificial
  CRISPR gRNA sequence
ccattatcctgaccactata

SEQ ID NO: 605027 - DNA, 20 bp, Artificial
  CRISPR gRNA sequence
actatatggacttgatcctc

SEQ ID NO: 605028 - DNA, 20 bp, Artificial
  CRISPR gRNA sequence
tgatcctccagttatttcct

SEQ ID NO: 605029 - DNA, 20 bp, Artificial
  CRISPR gRNA sequence
gatcctccagttatttcctt

SEQ ID NO: 605030 - DNA, 20 bp, Artificial
  CRISPR gRNA sequence
ctgcttatctcacaatattc

SEQ ID NO: 605031 - DNA, 20 bp, Artificial
  CRISPR gRNA sequence
gcttatctcacaatattcga

SEQ ID NO: 605032 - DNA, 20 bp, Artificial
  CRISPR gRNA sequence
tcacaatattcgagagtaaa

SEQ ID NO: 605033 - DNA, 20 bp, Artificial
  CRISPR gRNA sequence
cacaatattcgagagtaaaa

SEQ ID NO: 605034 - DNA, 20 bp, Artificial
  CRISPR gRNA sequence
aaggaacctttttacaatga

SEQ ID NO: 605035 - DNA, 20 bp, Artificial
  CRISPR gRNA sequence
aggaacctttttacaatgaa

SEQ ID NO: 605036 - DNA, 20 bp, Artificial
  CRISPR gRNA sequence
tgctgttttgcttactgttg

SEQ ID NO: 605037 - DNA, 20 bp, Artificial
  CRISPR gRNA sequence
ctgttttgcttactgttgta

SEQ ID NO: 605038 - DNA, 20 bp, Artificial
  CRISPR gRNA sequence
ttttgcttactgttgtagag

SEQ ID NO: 605039 - DNA, 20 bp, Artificial
  CRISPR gRNA sequence
tgcttactgttgtagagcag

SEQ ID NO: 605040 - DNA, 20 bp, Artificial
  CRISPR gRNA sequence
tagagcagcagaatattact

SEQ ID NO: 605041 - DNA, 20 bp, Artificial
  CRISPR gRNA sequence
agagcagcagaatattactg

SEQ ID NO: 605042 - DNA, 20 bp, Artificial
  CRISPR gRNA sequence
gcagcagaatattactgagg

SEQ ID NO: 605043 - DNA, 20 bp, Artificial
  CRISPR gRNA sequence
ttctttttaaaaaaattttc

SEQ ID NO: 605044 - DNA, 20 bp, Artificial
  CRISPR gRNA sequence
tttaaaaaaattttctggta

SEQ ID NO: 605045 - DNA, 20 bp, Artificial
  CRISPR gRNA sequence
aaaaaattttctggtacagc

SEQ ID NO: 605046 - DNA, 20 bp, Artificial
  CRISPR gRNA sequence
ggtacagctggaaatatgac

SEQ ID NO: 605047 - DNA, 20 bp, Artificial
  CRISPR gRNA sequence
acagctggaaatatgacaag

SEQ ID NO: 605048 - DNA, 20 bp, Artificial
  CRISPR gRNA sequence
tggaaatatgacaagaagaa

SEQ ID NO: 605049 - DNA, 20 bp, Artificial
  CRISPR gRNA sequence
agaatagaacaattgattat

SEQ ID NO: 605050 - DNA, 20 bp, Artificial
  CRISPR gRNA sequence
atattattctataaattcaa

SEQ ID NO: 605051 - DNA, 20 bp, Artificial
  CRISPR gRNA sequence
tctataaattcaatagaatt

SEQ ID NO: 605052 - DNA, 20 bp, Artificial
  CRISPR gRNA sequence
cttcctttaaatgttatatt

SEQ ID NO: 605053 - DNA, 20 bp, Artificial
  CRISPR gRNA sequence
attcattttgctatatgctg

SEQ ID NO: 605054 - DNA, 20 bp, Artificial
  CRISPR gRNA sequence
tttttgtttaatttctaatg

SEQ ID NO: 605055 - DNA, 20 bp, Artificial
  CRISPR gRNA sequence
tttgtttaatttctaatgaa

SEQ ID NO: 605056 - DNA, 20 bp, Artificial
  CRISPR gRNA sequence
atttctaatgaagagttatt

SEQ ID NO: 605057 - DNA, 20 bp, Artificial
  CRISPR gRNA sequence
aagagttattgagattttat

SEQ ID NO: 605058 - DNA, 20 bp, Artificial
  CRISPR gRNA sequence
atttcctattgcttgtacat

SEQ ID NO: 605059 - DNA, 20 bp, Artificial
  CRISPR gRNA sequence
tttcctattgcttgtacatt

SEQ ID NO: 605060 - DNA, 20 bp, Artificial
  CRISPR gRNA sequence
tcctattgcttgtacattgg

SEQ ID NO: 605061 - DNA, 20 bp, Artificial
  CRISPR gRNA sequence
ttgtacattgggagcaaacc

SEQ ID NO: 605062 - DNA, 20 bp, Artificial
  CRISPR gRNA sequence
cattgggagcaaaccaagaa

SEQ ID NO: 605063 - DNA, 20 bp, Artificial
  CRISPR gRNA sequence
attgggagcaaaccaagaac

SEQ ID NO: 605064 - DNA, 20 bp, Artificial
  CRISPR gRNA sequence
aacaacctcccaacttgtct

SEQ ID NO: 605065 - DNA, 20 bp, Artificial
  CRISPR gRNA sequence
tggtgaattgtgaattgctc

SEQ ID NO: 605066 - DNA, 20 bp, Artificial
  CRISPR gRNA sequence
cttgtttgtattacatttaa

SEQ ID NO: 605067 - DNA, 20 bp, Artificial
  CRISPR gRNA sequence
ttgtattacatttaatggac

SEQ ID NO: 605068 - DNA, 20 bp, Artificial
  CRISPR gRNA sequence
tttaatggacaagtcctgta

SEQ ID NO: 605069 - DNA, 20 bp, Artificial
  CRISPR gRNA sequence
tggtactatacattttaatt

SEQ ID NO: 605070 - DNA, 20 bp, Artificial
  CRISPR gRNA sequence
ccactttctttttctatttc

SEQ ID NO: 605071 - DNA, 20 bp, Artificial
  CRISPR gRNA sequence
actttctttttctatttcaa

SEQ ID NO: 605072 - DNA, 20 bp, Artificial
  CRISPR gRNA sequence
agagcttattacctttgctc

SEQ ID NO: 605073 - DNA, 20 bp, Artificial
  CRISPR gRNA sequence
cttattacctttgctccagc

SEQ ID NO: 605074 - DNA, 20 bp, Artificial
  CRISPR gRNA sequence
cctttgctccagctggataa

SEQ ID NO: 605075 - DNA, 20 bp, Artificial
  CRISPR gRNA sequence
tgctccagctggataaaagt

SEQ ID NO: 605076 - DNA, 20 bp, Artificial
  CRISPR gRNA sequence
gctccagctggataaaagtt

SEQ ID NO: 605077 - DNA, 20 bp, Artificial
  CRISPR gRNA sequence
ctggataaaagttgggcaaa

SEQ ID NO: 605078 - DNA, 20 bp, Artificial
  CRISPR gRNA sequence
gataccctgacaactgccaa

SEQ ID NO: 605079 - DNA, 20 bp, Artificial
  CRISPR gRNA sequence
ctgccaacagcaccacgcct

SEQ ID NO: 605080 - DNA, 20 bp, Artificial
  CRISPR gRNA sequence
gcaccacgccttggttttcc

SEQ ID NO: 605081 - DNA, 20 bp, Artificial
  CRISPR gRNA sequence
caccacgccttggttttccc

SEQ ID NO: 605082 - DNA, 20 bp, Artificial
  CRISPR gRNA sequence
cgccttggttttcccgggta

SEQ ID NO: 605083 - DNA, 20 bp, Artificial
  CRISPR gRNA sequence
ttggttttcccgggtacaga

SEQ ID NO: 605084 - DNA, 20 bp, Artificial
  CRISPR gRNA sequence
gttttcccgggtacagaaag

SEQ ID NO: 605085 - DNA, 20 bp, Artificial
  CRISPR gRNA sequence
cagaaagtagtcaatatttc

SEQ ID NO: 605086 - DNA, 20 bp, Artificial
  CRISPR gRNA sequence
agaaagtagtcaatatttct

SEQ ID NO: 605087 - DNA, 20 bp, Artificial
  CRISPR gRNA sequence
tatgcatctgtcccatctca

SEQ ID NO: 605088 - DNA, 20 bp, Artificial
  CRISPR gRNA sequence
aagatgccgctcacaaattc

SEQ ID NO: 605089 - DNA, 20 bp, Artificial
  CRISPR gRNA sequence
cacaaattctagtttaaata

SEQ ID NO: 605090 - DNA, 20 bp, Artificial
  CRISPR gRNA sequence
tattgtatgtgcttctttcc

SEQ ID NO: 605091 - DNA, 20 bp, Artificial
  CRISPR gRNA sequence
tttcctggttttaccaaaac

SEQ ID NO: 605092 - DNA, 20 bp, Artificial
  CRISPR gRNA sequence
ttttaccaaaacaagtaaaa

SEQ ID NO: 605093 - DNA, 20 bp, Artificial
  CRISPR gRNA sequence
acaagtaaaaaagatccatg

SEQ ID NO: 605094 - DNA, 20 bp, Artificial
  CRISPR gRNA sequence
agtaaaaaagatccatgtag

SEQ ID NO: 605095 - DNA, 20 bp, Artificial
  CRISPR gRNA sequence
aaagatccatgtagcagatt

SEQ ID NO: 605096 - DNA, 20 bp, Artificial
  CRISPR gRNA sequence
aagatccatgtagcagattt

SEQ ID NO: 605097 - DNA, 20 bp, Artificial
  CRISPR gRNA sequence
atgtagcagatttaggtcta

SEQ ID NO: 605098 - DNA, 20 bp, Artificial
  CRISPR gRNA sequence
ttgcttcctgtttgcttgca

SEQ ID NO: 605099 - DNA, 20 bp, Artificial
  CRISPR gRNA sequence
ttgcatggtgacaatgttct

SEQ ID NO: 605100 - DNA, 20 bp, Artificial
  CRISPR gRNA sequence
ggtgacaatgttctaagtgc

SEQ ID NO: 605101 - DNA, 20 bp, Artificial
  CRISPR gRNA sequence
taagtgccagttttgaatac

SEQ ID NO: 605102 - DNA, 20 bp, Artificial
  CRISPR gRNA sequence
tgaatactagtaacctgtca

SEQ ID NO: 605103 - DNA, 20 bp, Artificial
  CRISPR gRNA sequence
actagtaacctgtcatggat

SEQ ID NO: 605104 - DNA, 20 bp, Artificial
  CRISPR gRNA sequence
catggatcagttatctgaaa

SEQ ID NO: 605105 - DNA, 20 bp, Artificial
  CRISPR gRNA sequence
ggatcagttatctgaaatgg

SEQ ID NO: 605106 - DNA, 20 bp, Artificial
  CRISPR gRNA sequence
gatcagttatctgaaatggc

SEQ ID NO: 605107 - DNA, 20 bp, Artificial
  CRISPR gRNA sequence
aatggcaggtttatttgtta

SEQ ID NO: 605108 - DNA, 20 bp, Artificial
  CRISPR gRNA sequence
atggcaggtttatttgttat

SEQ ID NO: 605109 - DNA, 20 bp, Artificial
  CRISPR gRNA sequence
ggcaggtttatttgttatgg

SEQ ID NO: 605110 - DNA, 20 bp, Artificial
  CRISPR gRNA sequence
gcaggtttatttgttatggg

SEQ ID NO: 605111 - DNA, 20 bp, Artificial
  CRISPR gRNA sequence
tgacattatttcctgtcctt

SEQ ID NO: 605112 - DNA, 20 bp, Artificial
  CRISPR gRNA sequence
attatttcctgtcctttaga

SEQ ID NO: 605113 - DNA, 20 bp, Artificial
  CRISPR gRNA sequence
tatttcctgtcctttagaca

SEQ ID NO: 605114 - DNA, 20 bp, Artificial
  CRISPR gRNA sequence
ctgtcctttagacagagcta

SEQ ID NO: 605115 - DNA, 20 bp, Artificial
  CRISPR gRNA sequence
cctttagacagagctaaagt

SEQ ID NO: 605116 - DNA, 20 bp, Artificial
  CRISPR gRNA sequence
acagagctaaagtgagaata

SEQ ID NO: 605117 - DNA, 20 bp, Artificial
  CRISPR gRNA sequence
gagctaaagtgagaataaag

SEQ ID NO: 605118 - DNA, 20 bp, Artificial
  CRISPR gRNA sequence
taaagtgagaataaagtagt

SEQ ID NO: 605119 - DNA, 20 bp, Artificial
  CRISPR gRNA sequence
gtgagaataaagtagtaaga

SEQ ID NO: 605120 - DNA, 20 bp, Artificial
  CRISPR gRNA sequence
aagaatgtttctttgcactc

SEQ ID NO: 605121 - DNA, 20 bp, Artificial
  CRISPR gRNA sequence
agaatgtttctttgcactct

SEQ ID NO: 605122 - DNA, 20 bp, Artificial
  CRISPR gRNA sequence
tttctttgcactctaggtgt

SEQ ID NO: 605123 - DNA, 20 bp, Artificial
  CRISPR gRNA sequence
tgctactgatttgattgcca

SEQ ID NO: 605124 - DNA, 20 bp, Artificial
  CRISPR gRNA sequence
attgccacagctactatcat

SEQ ID NO: 605125 - DNA, 20 bp, Artificial
  CRISPR gRNA sequence
agctactatcattagcatct

SEQ ID NO: 605126 - DNA, 20 bp, Artificial
  CRISPR gRNA sequence
ttagcatcttggaccaaaca

SEQ ID NO: 605127 - DNA, 20 bp, Artificial
  CRISPR gRNA sequence
tcttggaccaaacatggaac

SEQ ID NO: 605128 - DNA, 20 bp, Artificial
  CRISPR gRNA sequence
gtactatatttcatgtatga

SEQ ID NO: 605129 - DNA, 20 bp, Artificial
  CRISPR gRNA sequence
atttcatgtatgatggaata

SEQ ID NO: 605130 - DNA, 20 bp, Artificial
  CRISPR gRNA sequence
ttcatgtatgatggaataca

SEQ ID NO: 605131 - DNA, 20 bp, Artificial
  CRISPR gRNA sequence
gactgattaaaaatactctt

SEQ ID NO: 605132 - DNA, 20 bp, Artificial
  CRISPR gRNA sequence
actgattaaaaatactctta

SEQ ID NO: 605133 - DNA, 20 bp, Artificial
  CRISPR gRNA sequence
taaaaatactcttaaggtgc

SEQ ID NO: 605134 - DNA, 20 bp, Artificial
  CRISPR gRNA sequence
gtgctggattattcatttga

SEQ ID NO: 605135 - DNA, 20 bp, Artificial
  CRISPR gRNA sequence
atttgatagctgattgttat

SEQ ID NO: 605136 - DNA, 20 bp, Artificial
  CRISPR gRNA sequence
agctgattgttataagacgt

SEQ ID NO: 605137 - DNA, 20 bp, Artificial
  CRISPR gRNA sequence
gctgattgttataagacgtt

SEQ ID NO: 605138 - DNA, 20 bp, Artificial
  CRISPR gRNA sequence
ctgattgttataagacgtta

SEQ ID NO: 605139 - DNA, 20 bp, Artificial
  CRISPR gRNA sequence
tagggtcgtactttcctttg

SEQ ID NO: 605140 - DNA, 20 bp, Artificial
  CRISPR gRNA sequence
ttttaaaattaaatttaatt

SEQ ID NO: 605141 - DNA, 20 bp, Artificial
  CRISPR gRNA sequence
ttaaaattaaatttaatttg

SEQ ID NO: 605142 - DNA, 20 bp, Artificial
  CRISPR gRNA sequence
attaaatttaatttggagcc

SEQ ID NO: 605143 - DNA, 20 bp, Artificial
  CRISPR gRNA sequence
ttaaatttaatttggagcct

SEQ ID NO: 605144 - DNA, 20 bp, Artificial
  CRISPR gRNA sequence
atttaatttggagcctaggt

SEQ ID NO: 605145 - DNA, 20 bp, Artificial
  CRISPR gRNA sequence
tttaatttggagcctaggta

SEQ ID NO: 605146 - DNA, 20 bp, Artificial
  CRISPR gRNA sequence
taattttttttttgtaatct

SEQ ID NO: 605147 - DNA, 20 bp, Artificial
  CRISPR gRNA sequence
taatctcagaattatcttaa

SEQ ID NO: 605148 - DNA, 20 bp, Artificial
  CRISPR gRNA sequence
tctcagaattatcttaatag

SEQ ID NO: 605149 - DNA, 20 bp, Artificial
  CRISPR gRNA sequence
ctcagaattatcttaatagt

SEQ ID NO: 605150 - DNA, 20 bp, Artificial
  CRISPR gRNA sequence
agaattatcttaatagtagg

SEQ ID NO: 605151 - DNA, 20 bp, Artificial
  CRISPR gRNA sequence
atcttaatagtaggtagtgt

SEQ ID NO: 605152 - DNA, 20 bp, Artificial
  CRISPR gRNA sequence
tagtaggtagtgtcagttgc

SEQ ID NO: 605153 - DNA, 20 bp, Artificial
  CRISPR gRNA sequence
gccagaaaaacatcaatgtg

SEQ ID NO: 605154 - DNA, 20 bp, Artificial
  CRISPR gRNA sequence
ccagaaaaacatcaatgtga

SEQ ID NO: 605155 - DNA, 20 bp, Artificial
  CRISPR gRNA sequence
tgtatatcataattctttcc

SEQ ID NO: 605156 - DNA, 20 bp, Artificial
  CRISPR gRNA sequence
ttctttcctagtgttttctt

SEQ ID NO: 605157 - DNA, 20 bp, Artificial
  CRISPR gRNA sequence
tctttcctagtgttttcttt

SEQ ID NO: 605158 - DNA, 20 bp, Artificial
  CRISPR gRNA sequence
ttcctagtgttttctttagg

SEQ ID NO: 605159 - DNA, 20 bp, Artificial
  CRISPR gRNA sequence
tgttttctttaggcagacta

SEQ ID NO: 605160 - DNA, 20 bp, Artificial
  CRISPR gRNA sequence
tctaattctcattccttttc

SEQ ID NO: 605161 - DNA, 20 bp, Artificial
  CRISPR gRNA sequence
attccttttctggataacca

SEQ ID NO: 605162 - DNA, 20 bp, Artificial
  CRISPR gRNA sequence
ttccttttctggataaccat

SEQ ID NO: 605163 - DNA, 20 bp, Artificial
  CRISPR gRNA sequence
tttctggataaccataggta

SEQ ID NO: 605164 - DNA, 20 bp, Artificial
  CRISPR gRNA sequence
ttctggataaccataggtaa

SEQ ID NO: 605165 - DNA, 20 bp, Artificial
  CRISPR gRNA sequence
acttttaatttgacctctga

SEQ ID NO: 605166 - DNA, 20 bp, Artificial
  CRISPR gRNA sequence
tttaatttgacctctgaaag

SEQ ID NO: 605167 - DNA, 20 bp, Artificial
  CRISPR gRNA sequence
ttgacctctgaaagaagaaa

SEQ ID NO: 605168 - DNA, 20 bp, Artificial
  CRISPR gRNA sequence
gaaagaagaaaaagtttttc

SEQ ID NO: 605169 - DNA, 20 bp, Artificial
  CRISPR gRNA sequence
aaagaagaaaaagtttttcc

SEQ ID NO: 605170 - DNA, 20 bp, Artificial
  CRISPR gRNA sequence
aagaaaaagtttttccaggt

SEQ ID NO: 605171 - DNA, 20 bp, Artificial
  CRISPR gRNA sequence
gaaaaagtttttccaggttg

SEQ ID NO: 605172 - DNA, 20 bp, Artificial
  CRISPR gRNA sequence
ttccaggttggagaaataat

SEQ ID NO: 605173 - DNA, 20 bp, Artificial
  CRISPR gRNA sequence
ggagaaataatgagtaatgc

SEQ ID NO: 605174 - DNA, 20 bp, Artificial
  CRISPR gRNA sequence
aaataatgagtaatgctggt

SEQ ID NO: 605175 - DNA, 20 bp, Artificial
  CRISPR gRNA sequence
ataatgagtaatgctggtta

SEQ ID NO: 605176 - DNA, 20 bp, Artificial
  CRISPR gRNA sequence
ctcatcttcttctcaaatct

SEQ ID NO: 605177 - DNA, 20 bp, Artificial
  CRISPR gRNA sequence
atcttagtcactacctattc

SEQ ID NO: 605178 - DNA, 20 bp, Artificial
  CRISPR gRNA sequence
aactaatgaaaacattttta

SEQ ID NO: 605179 - DNA, 20 bp, Artificial
  CRISPR gRNA sequence
aaaacatttttatggtttct

SEQ ID NO: 605180 - DNA, 20 bp, Artificial
  CRISPR gRNA sequence
ggtttctgagatttttttta

SEQ ID NO: 605181 - DNA, 20 bp, Artificial
  CRISPR gRNA sequence
ttctgagattttttttaaag

SEQ ID NO: 605182 - DNA, 20 bp, Artificial
  CRISPR gRNA sequence
tctgagattttttttaaagc

SEQ ID NO: 605183 - DNA, 20 bp, Artificial
  CRISPR gRNA sequence
tttttttaaagcaggcttga

SEQ ID NO: 605184 - DNA, 20 bp, Artificial
  CRISPR gRNA sequence
aagcaggcttgaaagatatg

SEQ ID NO: 605185 - DNA, 20 bp, Artificial
  CRISPR gRNA sequence
taaaccaaattttaacatta

SEQ ID NO: 605186 - DNA, 20 bp, Artificial
  CRISPR gRNA sequence
aattttaacattatagacat

SEQ ID NO: 605187 - DNA, 20 bp, Artificial
  CRISPR gRNA sequence
cattgtaatatttttcctca

SEQ ID NO: 605188 - DNA, 20 bp, Artificial
  CRISPR gRNA sequence
attgtaatatttttcctcat

SEQ ID NO: 605189 - DNA, 20 bp, Artificial
  CRISPR gRNA sequence
aatatttttcctcataggta

SEQ ID NO: 605190 - DNA, 20 bp, Artificial
  CRISPR gRNA sequence
atatttttcctcataggtat

SEQ ID NO: 605191 - DNA, 20 bp, Artificial
  CRISPR gRNA sequence
tatttttcctcataggtata

SEQ ID NO: 605192 - DNA, 20 bp, Artificial
  CRISPR gRNA sequence
cctcataggtatagggaaaa

SEQ ID NO: 605193 - DNA, 20 bp, Artificial
  CRISPR gRNA sequence
ctcataggtatagggaaaat

SEQ ID NO: 605194 - DNA, 20 bp, Artificial
  CRISPR gRNA sequence
ggaaaataggtgattttgtt

SEQ ID NO: 605195 - DNA, 20 bp, Artificial
  CRISPR gRNA sequence
gtgattttgtttagtcaaca

SEQ ID NO: 605196 - DNA, 20 bp, Artificial
  CRISPR gRNA sequence
tgattttgtttagtcaacaa

SEQ ID NO: 605197 - DNA, 20 bp, Artificial
  CRISPR gRNA sequence
gattttgtttagtcaacaaa

SEQ ID NO: 605198 - DNA, 20 bp, Artificial
  CRISPR gRNA sequence
ttctctctctctttctacca

SEQ ID NO: 605199 - DNA, 20 bp, Artificial
  CRISPR gRNA sequence
tctctctctttctaccatgg

SEQ ID NO: 605200 - DNA, 20 bp, Artificial
  CRISPR gRNA sequence
tctttctaccatggcagccc

SEQ ID NO: 605201 - DNA, 20 bp, Artificial
  CRISPR gRNA sequence
ttctaccatggcagcccaag

SEQ ID NO: 605202 - DNA, 20 bp, Artificial
  CRISPR gRNA sequence
tctaccatggcagcccaagt

SEQ ID NO: 605203 - DNA, 20 bp, Artificial
  CRISPR gRNA sequence
ctaccatggcagcccaagta

SEQ ID NO: 605204 - DNA, 20 bp, Artificial
  CRISPR gRNA sequence
ccaagtagggttcaaccgtg

SEQ ID NO: 605205 - DNA, 20 bp, Artificial
  CRISPR gRNA sequence
caagtagggttcaaccgtgt

SEQ ID NO: 605206 - DNA, 20 bp, Artificial
  CRISPR gRNA sequence
gtagggttcaaccgtgtagg

SEQ ID NO: 605207 - DNA, 20 bp, Artificial
  CRISPR gRNA sequence
tagggttcaaccgtgtaggt

SEQ ID NO: 605208 - DNA, 20 bp, Artificial
  CRISPR gRNA sequence
aacattacgttgaaatcata

SEQ ID NO: 605209 - DNA, 20 bp, Artificial
  CRISPR gRNA sequence
acgttgaaatcataaagcac

SEQ ID NO: 605210 - DNA, 20 bp, Artificial
  CRISPR gRNA sequence
gaaatcataaagcactagaa

SEQ ID NO: 605211 - DNA, 20 bp, Artificial
  CRISPR gRNA sequence
gcactagaaaagcaaatacc

SEQ ID NO: 605212 - DNA, 20 bp, Artificial
  CRISPR gRNA sequence
tagaaaagcaaatacctaga

SEQ ID NO: 605213 - DNA, 20 bp, Artificial
  CRISPR gRNA sequence
gaaagtattatctgttctgt

SEQ ID NO: 605214 - DNA, 20 bp, Artificial
  CRISPR gRNA sequence
tgttctgtaagaaaaacaac

SEQ ID NO: 605215 - DNA, 20 bp, Artificial
  CRISPR gRNA sequence
aaacattttaatatattatt

SEQ ID NO: 605216 - DNA, 20 bp, Artificial
  CRISPR gRNA sequence
taatatattattgagtttgt

SEQ ID NO: 605217 - DNA, 20 bp, Artificial
  CRISPR gRNA sequence
gtttgttggatttataatat

SEQ ID NO: 605218 - DNA, 20 bp, Artificial
  CRISPR gRNA sequence
tttgttggatttataatatt

SEQ ID NO: 605219 - DNA, 20 bp, Artificial
  CRISPR gRNA sequence
attgggacttctctttatac

SEQ ID NO: 605220 - DNA, 20 bp, Artificial
  CRISPR gRNA sequence
cttctctttatacaagtacc

SEQ ID NO: 605221 - DNA, 20 bp, Artificial
  CRISPR gRNA sequence
acaagtacctggcctttaaa

SEQ ID NO: 605222 - DNA, 20 bp, Artificial
  CRISPR gRNA sequence
ctttaaaaagaaatactacc

SEQ ID NO: 605223 - DNA, 20 bp, Artificial
  CRISPR gRNA sequence
ttaaaaagaaatactaccta

SEQ ID NO: 605224 - DNA, 20 bp, Artificial
  CRISPR gRNA sequence
aaaagaaatactacctagag

SEQ ID NO: 605225 - DNA, 20 bp, Artificial
  CRISPR gRNA sequence
aatactacctagagtagcca

SEQ ID NO: 605226 - DNA, 20 bp, Artificial
  CRISPR gRNA sequence
atactacctagagtagccac

SEQ ID NO: 605227 - DNA, 20 bp, Artificial
  CRISPR gRNA sequence
caggtactgttaatgttgcc

SEQ ID NO: 605228 - DNA, 20 bp, Artificial
  CRISPR gRNA sequence
taatgttgccaagtattcct

SEQ ID NO: 605229 - DNA, 20 bp, Artificial
  CRISPR gRNA sequence
aagtattcctaagtatattg

SEQ ID NO: 605230 - DNA, 20 bp, Artificial
  CRISPR gRNA sequence
attcctaagtatattgtagt

SEQ ID NO: 605231 - DNA, 20 bp, Artificial
  CRISPR gRNA sequence
taagtatattgtagttagat

SEQ ID NO: 605232 - DNA, 20 bp, Artificial
  CRISPR gRNA sequence
tattgtagttagattagtgt

SEQ ID NO: 605233 - DNA, 20 bp, Artificial
  CRISPR gRNA sequence
attgtagttagattagtgtg

SEQ ID NO: 605234 - DNA, 20 bp, Artificial
  CRISPR gRNA sequence
ggaacttccttaaaaaattt

SEQ ID NO: 605235 - DNA, 20 bp, Artificial
  CRISPR gRNA sequence
aaatttaagtgtaaacctgt

SEQ ID NO: 605236 - DNA, 20 bp, Artificial
  CRISPR gRNA sequence
aatttaagtgtaaacctgta

SEQ ID NO: 605237 - DNA, 20 bp, Artificial
  CRISPR gRNA sequence
acctgtaaggttactcttat

SEQ ID NO: 605238 - DNA, 20 bp, Artificial
  CRISPR gRNA sequence
ctcttattggttgtttttca

SEQ ID NO: 605239 - DNA, 20 bp, Artificial
  CRISPR gRNA sequence
gttgtttttcatagtttatt

SEQ ID NO: 605240 - DNA, 20 bp, Artificial
  CRISPR gRNA sequence
tttatttagtgactattgca

SEQ ID NO: 605241 - DNA, 20 bp, Artificial
  CRISPR gRNA sequence
tgcacggtaatgctttgtat

SEQ ID NO: 605242 - DNA, 20 bp, Artificial
  CRISPR gRNA sequence
ctttgtattagatcaacatt

SEQ ID NO: 605243 - DNA, 20 bp, Artificial
  CRISPR gRNA sequence
gtattagatcaacattaagt

SEQ ID NO: 605244 - DNA, 20 bp, Artificial
  CRISPR gRNA sequence
atcaacattaagttagaatt

SEQ ID NO: 605245 - DNA, 20 bp, Artificial
  CRISPR gRNA sequence
aacattaagttagaattcag

SEQ ID NO: 605246 - DNA, 20 bp, Artificial
  CRISPR gRNA sequence
aattcagtggctgtattaaa

SEQ ID NO: 605247 - DNA, 20 bp, Artificial
  CRISPR gRNA sequence
gctgtattaaatagcctttt

SEQ ID NO: 605248 - DNA, 20 bp, Artificial
  CRISPR gRNA sequence
tattaaatagccttttaaga

SEQ ID NO: 605249 - DNA, 20 bp, Artificial
  CRISPR gRNA sequence
aagacagtatgttaaatacg

SEQ ID NO: 605250 - DNA, 20 bp, Artificial
  CRISPR gRNA sequence
ttaaatacgtggctttcacc

SEQ ID NO: 605251 - DNA, 20 bp, Artificial
  CRISPR gRNA sequence
taaatacgtggctttcacca

SEQ ID NO: 605252 - DNA, 20 bp, Artificial
  CRISPR gRNA sequence
aaatacgtggctttcaccaa

SEQ ID NO: 605253 - DNA, 20 bp, Artificial
  CRISPR gRNA sequence
aatacgtggctttcaccaag

SEQ ID NO: 605254 - DNA, 20 bp, Artificial
  CRISPR gRNA sequence
ctttcaccaaggggccccta

SEQ ID NO: 605255 - DNA, 20 bp, Artificial
  CRISPR gRNA sequence
aaggggcccctatggtattt

SEQ ID NO: 605256 - DNA, 20 bp, Artificial
  CRISPR gRNA sequence
tattttttaaaattcatacc

SEQ ID NO: 605257 - DNA, 20 bp, Artificial
  CRISPR gRNA sequence
attcatacctagtttgaatt

SEQ ID NO: 605258 - DNA, 20 bp, Artificial
  CRISPR gRNA sequence
gtttgaattgagattcatgt

SEQ ID NO: 605259 - DNA, 20 bp, Artificial
  CRISPR gRNA sequence
gtaagtgaaacaccattaat

SEQ ID NO: 605260 - DNA, 20 bp, Artificial
  CRISPR gRNA sequence
taagtgaaacaccattaata

SEQ ID NO: 605261 - DNA, 20 bp, Artificial
  CRISPR gRNA sequence
acaccattaataaggatttt

SEQ ID NO: 605262 - DNA, 20 bp, Artificial
  CRISPR gRNA sequence
ggatttttagttttaaattt

SEQ ID NO: 605263 - DNA, 20 bp, Artificial
  CRISPR gRNA sequence
tagtttgttttattataaaa

SEQ ID NO: 605264 - DNA, 20 bp, Artificial
  CRISPR gRNA sequence
tatctatcattcttaaaatc

SEQ ID NO: 605265 - DNA, 20 bp, Artificial
  CRISPR gRNA sequence
ttaaaatcaagtattcttta

SEQ ID NO: 605266 - DNA, 20 bp, Artificial
  CRISPR gRNA sequence
aaatcaagtattctttatag

SEQ ID NO: 605267 - DNA, 20 bp, Artificial
  CRISPR gRNA sequence
tagtagtcctacttaatatg

SEQ ID NO: 605268 - DNA, 20 bp, Artificial
  CRISPR gRNA sequence
cctacttaatatgcagtctg

SEQ ID NO: 605269 - DNA, 20 bp, Artificial
  CRISPR gRNA sequence
ctacttaatatgcagtctgt

SEQ ID NO: 605270 - DNA, 20 bp, Artificial
  CRISPR gRNA sequence
ttaatatgcagtctgtaggc

SEQ ID NO: 605271 - DNA, 20 bp, Artificial
  CRISPR gRNA sequence
tatgcagtctgtaggctgga

SEQ ID NO: 605272 - DNA, 20 bp, Artificial
  CRISPR gRNA sequence
ggctggaaagcatttgttac

SEQ ID NO: 605273 - DNA, 20 bp, Artificial
  CRISPR gRNA sequence
gtctgccttgaaattaaata

SEQ ID NO: 605274 - DNA, 20 bp, Artificial
  CRISPR gRNA sequence
tgccttgaaattaaatatag

SEQ ID NO: 605275 - DNA, 20 bp, Artificial
  CRISPR gRNA sequence
tgaaattaaatatagaagtt

SEQ ID NO: 605276 - DNA, 20 bp, Artificial
  CRISPR gRNA sequence
aatgcttaaaactgtcacca

SEQ ID NO: 605277 - DNA, 20 bp, Artificial
  CRISPR gRNA sequence
aaactgtcaccaaagtttga

SEQ ID NO: 605278 - DNA, 20 bp, Artificial
  CRISPR gRNA sequence
actgtcaccaaagtttgata

SEQ ID NO: 605279 - DNA, 20 bp, Artificial
  CRISPR gRNA sequence
gtttgatagagtaataaaaa

SEQ ID NO: 605280 - DNA, 20 bp, Artificial
  CRISPR gRNA sequence
tttgatagagtaataaaaat

SEQ ID NO: 605281 - DNA, 20 bp, Artificial
  CRISPR gRNA sequence
ttgatagagtaataaaaata

SEQ ID NO: 605282 - DNA, 20 bp, Artificial
  CRISPR gRNA sequence
tgatagagtaataaaaatag

SEQ ID NO: 605283 - DNA, 20 bp, Artificial
  CRISPR gRNA sequence
gatagagtaataaaaatagg

SEQ ID NO: 605284 - DNA, 20 bp, Artificial
  CRISPR gRNA sequence
attatacaaatgtgatgaat

SEQ ID NO: 605285 - DNA, 20 bp, Artificial
  CRISPR gRNA sequence
tagaaatttaaaaaaccaat

SEQ ID NO: 605286 - DNA, 20 bp, Artificial
  CRISPR gRNA sequence
aaaccaattggtccttccca

SEQ ID NO: 605287 - DNA, 20 bp, Artificial
  CRISPR gRNA sequence
ccaattggtccttcccacag

SEQ ID NO: 605288 - DNA, 20 bp, Artificial
  CRISPR gRNA sequence
caattggtccttcccacaga

SEQ ID NO: 605289 - DNA, 20 bp, Artificial
  CRISPR gRNA sequence
cacagaaggatatttcattt

SEQ ID NO: 605290 - DNA, 20 bp, Artificial
  CRISPR gRNA sequence
tcatttgagaaatatcactt

SEQ ID NO: 605291 - DNA, 20 bp, Artificial
  CRISPR gRNA sequence
aatatcactttagatgacat

SEQ ID NO: 605292 - DNA, 20 bp, Artificial
  CRISPR gRNA sequence
atcactttagatgacattag

SEQ ID NO: 605293 - DNA, 20 bp, Artificial
  CRISPR gRNA sequence
cactttagatgacattagaa

SEQ ID NO: 605294 - DNA, 20 bp, Artificial
  CRISPR gRNA sequence
agaagagttatccatgtgct

SEQ ID NO: 605295 - DNA, 20 bp, Artificial
  CRISPR gRNA sequence
gttatccatgtgcttagtgt

SEQ ID NO: 605296 - DNA, 20 bp, Artificial
  CRISPR gRNA sequence
tccatgtgcttagtgtcagt

SEQ ID NO: 605297 - DNA, 20 bp, Artificial
  CRISPR gRNA sequence
tatcaaaaacccacttatat

SEQ ID NO: 605298 - DNA, 20 bp, Artificial
  CRISPR gRNA sequence
acttatattagtaacttatg

SEQ ID NO: 605299 - DNA, 20 bp, Artificial
  CRISPR gRNA sequence
ataaccatatgatttttata

SEQ ID NO: 605300 - DNA, 20 bp, Artificial
  CRISPR gRNA sequence
gtaatctcaaatgaaaatga

SEQ ID NO: 605301 - DNA, 20 bp, Artificial
  CRISPR gRNA sequence
ccaattctttaatgaatcta

SEQ ID NO: 605302 - DNA, 20 bp, Artificial
  CRISPR gRNA sequence
attctttaatgaatctaaag

SEQ ID NO: 605303 - DNA, 20 bp, Artificial
  CRISPR gRNA sequence
ctttaatgaatctaaagcag

SEQ ID NO: 605304 - DNA, 20 bp, Artificial
  CRISPR gRNA sequence
ttaatgaatctaaagcagta

SEQ ID NO: 605305 - DNA, 20 bp, Artificial
  CRISPR gRNA sequence
agagcctttactcatatacc

SEQ ID NO: 605306 - DNA, 20 bp, Artificial
  CRISPR gRNA sequence
acctagtaataactatcatt

SEQ ID NO: 605307 - DNA, 20 bp, Artificial
  CRISPR gRNA sequence
taagtgcttacaatgtgcaa

SEQ ID NO: 605308 - DNA, 20 bp, Artificial
  CRISPR gRNA sequence
aagtgcttacaatgtgcaat

SEQ ID NO: 605309 - DNA, 20 bp, Artificial
  CRISPR gRNA sequence
agtgcttacaatgtgcaata

SEQ ID NO: 605310 - DNA, 20 bp, Artificial
  CRISPR gRNA sequence
tatcttatttaatcctctaa

SEQ ID NO: 605311 - DNA, 20 bp, Artificial
  CRISPR gRNA sequence
ttaatcctctaaaagcacaa

SEQ ID NO: 605312 - DNA, 20 bp, Artificial
  CRISPR gRNA sequence
taatcctctaaaagcacaac

SEQ ID NO: 605313 - DNA, 20 bp, Artificial
  CRISPR gRNA sequence
cctctaaaagcacaacggga

SEQ ID NO: 605314 - DNA, 20 bp, Artificial
  CRISPR gRNA sequence
ctctaaaagcacaacgggat

SEQ ID NO: 605315 - DNA, 20 bp, Artificial
  CRISPR gRNA sequence
gttccttattaccctcattt

SEQ ID NO: 605316 - DNA, 20 bp, Artificial
  CRISPR gRNA sequence
tccttattaccctcatttta

SEQ ID NO: 605317 - DNA, 20 bp, Artificial
  CRISPR gRNA sequence
accctcattttagagatgcc

SEQ ID NO: 605318 - DNA, 20 bp, Artificial
  CRISPR gRNA sequence
cattttagagatgccgagct

SEQ ID NO: 605319 - DNA, 20 bp, Artificial
  CRISPR gRNA sequence
attttagagatgccgagcta

SEQ ID NO: 605320 - DNA, 20 bp, Artificial
  CRISPR gRNA sequence
ttttagagatgccgagctaa

SEQ ID NO: 605321 - DNA, 20 bp, Artificial
  CRISPR gRNA sequence
agagatgccgagctaagggt

SEQ ID NO: 605322 - DNA, 20 bp, Artificial
  CRISPR gRNA sequence
agatgccgagctaagggtca

SEQ ID NO: 605323 - DNA, 20 bp, Artificial
  CRISPR gRNA sequence
atgccgagctaagggtcaga

SEQ ID NO: 605324 - DNA, 20 bp, Artificial
  CRISPR gRNA sequence
tgccgagctaagggtcagag

SEQ ID NO: 605325 - DNA, 20 bp, Artificial
  CRISPR gRNA sequence
agaggttaaaaatgtgctga

SEQ ID NO: 605326 - DNA, 20 bp, Artificial
  CRISPR gRNA sequence
aaaatgtgctgatggtcact

SEQ ID NO: 605327 - DNA, 20 bp, Artificial
  CRISPR gRNA sequence
ggtcactgagctaactaaaa

SEQ ID NO: 605328 - DNA, 20 bp, Artificial
  CRISPR gRNA sequence
tcacgttttttcttttaaat

SEQ ID NO: 605329 - DNA, 20 bp, Artificial
  CRISPR gRNA sequence
cacgttttttcttttaaatg

SEQ ID NO: 605330 - DNA, 20 bp, Artificial
  CRISPR gRNA sequence
cgttttttcttttaaatgag

SEQ ID NO: 605331 - DNA, 20 bp, Artificial
  CRISPR gRNA sequence
gttttttcttttaaatgagg

SEQ ID NO: 605332 - DNA, 20 bp, Artificial
  CRISPR gRNA sequence
gaggaggtaataacatgtac

SEQ ID NO: 605333 - DNA, 20 bp, Artificial
  CRISPR gRNA sequence
aggaggtaataacatgtact

SEQ ID NO: 605334 - DNA, 20 bp, Artificial
  CRISPR gRNA sequence
gtaataacatgtactgggta

SEQ ID NO: 605335 - DNA, 20 bp, Artificial
  CRISPR gRNA sequence
agaatgttgttttgtgcttg

SEQ ID NO: 605336 - DNA, 20 bp, Artificial
  CRISPR gRNA sequence
gaatgttgttttgtgcttgt

SEQ ID NO: 605337 - DNA, 20 bp, Artificial
  CRISPR gRNA sequence
ttgttttgtgcttgtaggta

SEQ ID NO: 605338 - DNA, 20 bp, Artificial
  CRISPR gRNA sequence
ctgtgtaccatgctgtatat

SEQ ID NO: 605339 - DNA, 20 bp, Artificial
  CRISPR gRNA sequence
tgtgtaccatgctgtatatg

SEQ ID NO: 605340 - DNA, 20 bp, Artificial
  CRISPR gRNA sequence
gctgtatatgaggaattatt

SEQ ID NO: 605341 - DNA, 20 bp, Artificial
  CRISPR gRNA sequence
tgtatatgaggaattattta

SEQ ID NO: 605342 - DNA, 20 bp, Artificial
  CRISPR gRNA sequence
tatgaggaattatttagagc

SEQ ID NO: 605343 - DNA, 20 bp, Artificial
  CRISPR gRNA sequence
gaggaattatttagagctag

SEQ ID NO: 605344 - DNA, 20 bp, Artificial
  CRISPR gRNA sequence
ggaattatttagagctagaa

SEQ ID NO: 605345 - DNA, 20 bp, Artificial
  CRISPR gRNA sequence
gaattatttagagctagaag

SEQ ID NO: 605346 - DNA, 20 bp, Artificial
  CRISPR gRNA sequence
tatttagagctagaagagga

SEQ ID NO: 605347 - DNA, 20 bp, Artificial
  CRISPR gRNA sequence
gagctagaagaggaaagctc

SEQ ID NO: 605348 - DNA, 20 bp, Artificial
  CRISPR gRNA sequence
agctcaagcatgcaaatctt

SEQ ID NO: 605349 - DNA, 20 bp, Artificial
  CRISPR gRNA sequence
gcatgcaaatcttcagtgct

SEQ ID NO: 605350 - DNA, 20 bp, Artificial
  CRISPR gRNA sequence
gcaaatcttcagtgctgagt

SEQ ID NO: 605351 - DNA, 20 bp, Artificial
  CRISPR gRNA sequence
tcttcagtgctgagttggta

SEQ ID NO: 605352 - DNA, 20 bp, Artificial
  CRISPR gRNA sequence
cttcagtgctgagttggtat

SEQ ID NO: 605353 - DNA, 20 bp, Artificial
  CRISPR gRNA sequence
ttcagtgctgagttggtata

SEQ ID NO: 605354 - DNA, 20 bp, Artificial
  CRISPR gRNA sequence
cagtgctgagttggtatagg

SEQ ID NO: 605355 - DNA, 20 bp, Artificial
  CRISPR gRNA sequence
gctgagttggtatagggagt

SEQ ID NO: 605356 - DNA, 20 bp, Artificial
  CRISPR gRNA sequence
gttggtatagggagtaagat

SEQ ID NO: 605357 - DNA, 20 bp, Artificial
  CRISPR gRNA sequence
ttggtatagggagtaagatg

SEQ ID NO: 605358 - DNA, 20 bp, Artificial
  CRISPR gRNA sequence
acgtacgttgctcttgatct

SEQ ID NO: 605359 - DNA, 20 bp, Artificial
  CRISPR gRNA sequence
gtacgttgctcttgatctca

SEQ ID NO: 605360 - DNA, 20 bp, Artificial
  CRISPR gRNA sequence
gttgatgatcacaaaaattt

SEQ ID NO: 605361 - DNA, 20 bp, Artificial
  CRISPR gRNA sequence
ttgatgatcacaaaaattta

SEQ ID NO: 605362 - DNA, 20 bp, Artificial
  CRISPR gRNA sequence
aatttaaggacatcatgttc

SEQ ID NO: 605363 - DNA, 20 bp, Artificial
  CRISPR gRNA sequence
tgttcaagttacacttgata

SEQ ID NO: 605364 - DNA, 20 bp, Artificial
  CRISPR gRNA sequence
ttacacttgatacagcttat

SEQ ID NO: 605365 - DNA, 20 bp, Artificial
  CRISPR gRNA sequence
acttgatacagcttataaga

SEQ ID NO: 605366 - DNA, 20 bp, Artificial
  CRISPR gRNA sequence
aaagaatcccttttcaaaaa

SEQ ID NO: 605367 - DNA, 20 bp, Artificial
  CRISPR gRNA sequence
gaatcccttttcaaaaaaag

SEQ ID NO: 605368 - DNA, 20 bp, Artificial
  CRISPR gRNA sequence
ccttttcaaaaaaagcagat

SEQ ID NO: 605369 - DNA, 20 bp, Artificial
  CRISPR gRNA sequence
gatgagatgtgatttttaaa

SEQ ID NO: 605370 - DNA, 20 bp, Artificial
  CRISPR gRNA sequence
ctctactcttcatatgtaca

SEQ ID NO: 605371 - DNA, 20 bp, Artificial
  CRISPR gRNA sequence
gtacatagatactcaacttt

SEQ ID NO: 605372 - DNA, 20 bp, Artificial
  CRISPR gRNA sequence
tacatagatactcaactttc

SEQ ID NO: 605373 - DNA, 20 bp, Artificial
  CRISPR gRNA sequence
aggaatcatgtatataatat

SEQ ID NO: 605374 - DNA, 20 bp, Artificial
  CRISPR gRNA sequence
tatataatattggcatctta

SEQ ID NO: 605375 - DNA, 20 bp, Artificial
  CRISPR gRNA sequence
tttgtttccttcaatctctt

SEQ ID NO: 605376 - DNA, 20 bp, Artificial
  CRISPR gRNA sequence
ctcttcagttatctttataa

SEQ ID NO: 605377 - DNA, 20 bp, Artificial
  CRISPR gRNA sequence
tcagttatctttataaaaga

SEQ ID NO: 605378 - DNA, 20 bp, Artificial
  CRISPR gRNA sequence
cagttatctttataaaagaa

SEQ ID NO: 605379 - DNA, 20 bp, Artificial
  CRISPR gRNA sequence
gttatctttataaaagaaag

SEQ ID NO: 605380 - DNA, 20 bp, Artificial
  CRISPR gRNA sequence
ttatctttataaaagaaagg

SEQ ID NO: 605381 - DNA, 20 bp, Artificial
  CRISPR gRNA sequence
ctttataaaagaaaggagga

SEQ ID NO: 605382 - DNA, 20 bp, Artificial
  CRISPR gRNA sequence
tttataaaagaaaggaggat

SEQ ID NO: 605383 - DNA, 20 bp, Artificial
  CRISPR gRNA sequence
ttataaaagaaaggaggatg

SEQ ID NO: 605384 - DNA, 20 bp, Artificial
  CRISPR gRNA sequence
tataaaagaaaggaggatgg

SEQ ID NO: 605385 - DNA, 20 bp, Artificial
  CRISPR gRNA sequence
ataaaagaaaggaggatggg

SEQ ID NO: 605386 - DNA, 20 bp, Artificial
  CRISPR gRNA sequence
aaaagaaaggaggatggggg

SEQ ID NO: 605387 - DNA, 20 bp, Artificial
  CRISPR gRNA sequence
aaagaaaggaggatgggggg

SEQ ID NO: 605388 - DNA, 20 bp, Artificial
  CRISPR gRNA sequence
agaaaggaggatggggggag

SEQ ID NO: 605389 - DNA, 20 bp, Artificial
  CRISPR gRNA sequence
gaaaggaggatggggggagg

SEQ ID NO: 605390 - DNA, 20 bp, Artificial
  CRISPR gRNA sequence
ggaggctgacttttgtcatg

SEQ ID NO: 605391 - DNA, 20 bp, Artificial
  CRISPR gRNA sequence
tcatgtagcttcctcaacta

SEQ ID NO: 605392 - DNA, 20 bp, Artificial
  CRISPR gRNA sequence
gcttcctcaactaaagcctt

SEQ ID NO: 605393 - DNA, 20 bp, Artificial
  CRISPR gRNA sequence
taaagccttcagatcttcat

SEQ ID NO: 605394 - DNA, 20 bp, Artificial
  CRISPR gRNA sequence
catcagtatatgaataaact

SEQ ID NO: 605395 - DNA, 20 bp, Artificial
  CRISPR gRNA sequence
tatgaataaactcagtttac

SEQ ID NO: 605396 - DNA, 20 bp, Artificial
  CRISPR gRNA sequence
gtaaaattctgtaaatcaac

SEQ ID NO: 605397 - DNA, 20 bp, Artificial
  CRISPR gRNA sequence
tttatcttgttttcttcatt

SEQ ID NO: 605398 - DNA, 20 bp, Artificial
  CRISPR gRNA sequence
tctgcctaataacctttgca

SEQ ID NO: 605399 - DNA, 20 bp, Artificial
  CRISPR gRNA sequence
ataacctttgcacagtgttt

SEQ ID NO: 605400 - DNA, 20 bp, Artificial
  CRISPR gRNA sequence
taacctttgcacagtgttta

SEQ ID NO: 605401 - DNA, 20 bp, Artificial
  CRISPR gRNA sequence
ttgcacagtgtttaaggatt

SEQ ID NO: 605402 - DNA, 20 bp, Artificial
  CRISPR gRNA sequence
tgcacagtgtttaaggattg

SEQ ID NO: 605403 - DNA, 20 bp, Artificial
  CRISPR gRNA sequence
gattgaggataaaaactatc

SEQ ID NO: 605404 - DNA, 20 bp, Artificial
  CRISPR gRNA sequence
attgaggataaaaactatca

SEQ ID NO: 605405 - DNA, 20 bp, Artificial
  CRISPR gRNA sequence
ttgaggataaaaactatcaa

SEQ ID NO: 605406 - DNA, 20 bp, Artificial
  CRISPR gRNA sequence
ggataaaaactatcaagggc

SEQ ID NO: 605407 - DNA, 20 bp, Artificial
  CRISPR gRNA sequence
aaaactatcaagggcaagat

SEQ ID NO: 605408 - DNA, 20 bp, Artificial
  CRISPR gRNA sequence
actatcaagggcaagattag

SEQ ID NO: 605409 - DNA, 20 bp, Artificial
  CRISPR gRNA sequence
tatcaagggcaagattagaa

SEQ ID NO: 605410 - DNA, 20 bp, Artificial
  CRISPR gRNA sequence
atcaagggcaagattagaag

SEQ ID NO: 605411 - DNA, 20 bp, Artificial
  CRISPR gRNA sequence
ctgattctctgctgcccttg

SEQ ID NO: 605412 - DNA, 20 bp, Artificial
  CRISPR gRNA sequence
tgattctctgctgcccttga

SEQ ID NO: 605413 - DNA, 20 bp, Artificial
  CRISPR gRNA sequence
tctgctgcccttgaaggcac

SEQ ID NO: 605414 - DNA, 20 bp, Artificial
  CRISPR gRNA sequence
cccttgaaggcactggataa

SEQ ID NO: 605415 - DNA, 20 bp, Artificial
  CRISPR gRNA sequence
cttgaaggcactggataatg

SEQ ID NO: 605416 - DNA, 20 bp, Artificial
  CRISPR gRNA sequence
gcactggataatggagaaac

SEQ ID NO: 605417 - DNA, 20 bp, Artificial
  CRISPR gRNA sequence
aaacaagtgcctgcatgtgt

SEQ ID NO: 605418 - DNA, 20 bp, Artificial
  CRISPR gRNA sequence
ctgcatgtgttggattttgt

SEQ ID NO: 605419 - DNA, 20 bp, Artificial
  CRISPR gRNA sequence
atgtgttggattttgttagt

SEQ ID NO: 605420 - DNA, 20 bp, Artificial
  CRISPR gRNA sequence
tggattttgttagttggatc

SEQ ID NO: 605421 - DNA, 20 bp, Artificial
  CRISPR gRNA sequence
ttgttagttggatctagctc

SEQ ID NO: 605422 - DNA, 20 bp, Artificial
  CRISPR gRNA sequence
ttagttggatctagctccag

SEQ ID NO: 605423 - DNA, 20 bp, Artificial
  CRISPR gRNA sequence
gctccagcagaatgacaact

SEQ ID NO: 605424 - DNA, 20 bp, Artificial
  CRISPR gRNA sequence
ctccagcagaatgacaactg

SEQ ID NO: 605425 - DNA, 20 bp, Artificial
  CRISPR gRNA sequence
aatgacaactgaggtcacgt

SEQ ID NO: 605426 - DNA, 20 bp, Artificial
  CRISPR gRNA sequence
ctgaggtcacgtcagcacct

SEQ ID NO: 605427 - DNA, 20 bp, Artificial
  CRISPR gRNA sequence
aggtcacgtcagcaccttgg

SEQ ID NO: 605428 - DNA, 20 bp, Artificial
  CRISPR gRNA sequence
ggtcacgtcagcaccttgga

SEQ ID NO: 605429 - DNA, 20 bp, Artificial
  CRISPR gRNA sequence
acgtcagcaccttggaaggc

SEQ ID NO: 605430 - DNA, 20 bp, Artificial
  CRISPR gRNA sequence
cgtcagcaccttggaaggcc

SEQ ID NO: 605431 - DNA, 20 bp, Artificial
  CRISPR gRNA sequence
cagcaccttggaaggccggg

SEQ ID NO: 605432 - DNA, 20 bp, Artificial
  CRISPR gRNA sequence
accttggaaggccgggaagc

SEQ ID NO: 605433 - DNA, 20 bp, Artificial
  CRISPR gRNA sequence
gaaggccgggaagctggaac

SEQ ID NO: 605434 - DNA, 20 bp, Artificial
  CRISPR gRNA sequence
aggccgggaagctggaactg

SEQ ID NO: 605435 - DNA, 20 bp, Artificial
  CRISPR gRNA sequence
ccgggaagctggaactggag

SEQ ID NO: 605436 - DNA, 20 bp, Artificial
  CRISPR gRNA sequence
aagctggaactggagcagct

SEQ ID NO: 605437 - DNA, 20 bp, Artificial
  CRISPR gRNA sequence
ggagcagctgagccaatccc

SEQ ID NO: 605438 - DNA, 20 bp, Artificial
  CRISPR gRNA sequence
tgagccaatccccagacaaa

SEQ ID NO: 605439 - DNA, 20 bp, Artificial
  CRISPR gRNA sequence
gagccaatccccagacaaac

SEQ ID NO: 605440 - DNA, 20 bp, Artificial
  CRISPR gRNA sequence
ccagacaaacaggttttaac

SEQ ID NO: 605441 - DNA, 20 bp, Artificial
  CRISPR gRNA sequence
cagacaaacaggttttaacc

SEQ ID NO: 605442 - DNA, 20 bp, Artificial
  CRISPR gRNA sequence
caaacaggttttaaccggga

SEQ ID NO: 605443 - DNA, 20 bp, Artificial
  CRISPR gRNA sequence
aacaggttttaaccgggaca

SEQ ID NO: 605444 - DNA, 20 bp, Artificial
  CRISPR gRNA sequence
ggttttaaccgggacagagt

SEQ ID NO: 605445 - DNA, 20 bp, Artificial
  CRISPR gRNA sequence
ttttaaccgggacagagtga

SEQ ID NO: 605446 - DNA, 20 bp, Artificial
  CRISPR gRNA sequence
agtgagagaatgctttgctt

SEQ ID NO: 605447 - DNA, 20 bp, Artificial
  CRISPR gRNA sequence
aaactgtctgcccatcacct

SEQ ID NO: 605448 - DNA, 20 bp, Artificial
  CRISPR gRNA sequence
aactgtctgcccatcaccta

SEQ ID NO: 605449 - DNA, 20 bp, Artificial
  CRISPR gRNA sequence
tgtctgcccatcacctaagg

SEQ ID NO: 605450 - DNA, 20 bp, Artificial
  CRISPR gRNA sequence
gctgtctgttcatttttgta

SEQ ID NO: 605451 - DNA, 20 bp, Artificial
  CRISPR gRNA sequence
ctgttcatttttgtatagaa

SEQ ID NO: 605452 - DNA, 20 bp, Artificial
  CRISPR gRNA sequence
catttttgtatagaaaagat

SEQ ID NO: 605453 - DNA, 20 bp, Artificial
  CRISPR gRNA sequence
gtatagaaaagattagttat

SEQ ID NO: 605454 - DNA, 20 bp, Artificial
  CRISPR gRNA sequence
tatagaaaagattagttatg

SEQ ID NO: 605455 - DNA, 20 bp, Artificial
  CRISPR gRNA sequence
gacttctttctctttatata

SEQ ID NO: 605456 - DNA, 20 bp, Artificial
  CRISPR gRNA sequence
ttctctttatatatggcaaa

SEQ ID NO: 605457 - DNA, 20 bp, Artificial
  CRISPR gRNA sequence
tatggcaaaaagtaattgca

SEQ ID NO: 605458 - DNA, 20 bp, Artificial
  CRISPR gRNA sequence
ggcaaaaagtaattgcaaag

SEQ ID NO: 605459 - DNA, 20 bp, Artificial
  CRISPR gRNA sequence
taattgcaaagtagttatgt

SEQ ID NO: 605460 - DNA, 20 bp, Artificial
  CRISPR gRNA sequence
aagtagttatgttagacttt

SEQ ID NO: 605461 - DNA, 20 bp, Artificial
  CRISPR gRNA sequence
tgagatttttttgttttctt

SEQ ID NO: 605462 - DNA, 20 bp, Artificial
  CRISPR gRNA sequence
ttttttgttttcttcagatt

SEQ ID NO: 605463 - DNA, 20 bp, Artificial
  CRISPR gRNA sequence
tttgttttcttcagattcag

SEQ ID NO: 605464 - DNA, 20 bp, Artificial
  CRISPR gRNA sequence
tttcttcagattcagaagca

SEQ ID NO: 605465 - DNA, 20 bp, Artificial
  CRISPR gRNA sequence
aaaatgttacttttgaaatt

SEQ ID NO: 605466 - DNA, 20 bp, Artificial
  CRISPR gRNA sequence
tgttacttttgaaattaaga

SEQ ID NO: 605467 - DNA, 20 bp, Artificial
  CRISPR gRNA sequence
ttgaaattaagatggtgtga

SEQ ID NO: 605468 - DNA, 20 bp, Artificial
  CRISPR gRNA sequence
aaattaagatggtgtgatgg

SEQ ID NO: 605469 - DNA, 20 bp, Artificial
  CRISPR gRNA sequence
aattaagatggtgtgatgga

SEQ ID NO: 605470 - DNA, 20 bp, Artificial
  CRISPR gRNA sequence
tgtgatggaaggaccattta

SEQ ID NO: 605471 - DNA, 20 bp, Artificial
  CRISPR gRNA sequence
ggaaggaccatttatggcat

SEQ ID NO: 605472 - DNA, 20 bp, Artificial
  CRISPR gRNA sequence
ggaccatttatggcattagt

SEQ ID NO: 605473 - DNA, 20 bp, Artificial
  CRISPR gRNA sequence
gaccatttatggcattagta

SEQ ID NO: 605474 - DNA, 20 bp, Artificial
  CRISPR gRNA sequence
accatttatggcattagtaa

SEQ ID NO: 605475 - DNA, 20 bp, Artificial
  CRISPR gRNA sequence
tgattaccatcattttgtgt

SEQ ID NO: 605476 - DNA, 20 bp, Artificial
  CRISPR gRNA sequence
gattaccatcattttgtgta

SEQ ID NO: 605477 - DNA, 20 bp, Artificial
  CRISPR gRNA sequence
tgaatgccaattaaatgtca

SEQ ID NO: 605478 - DNA, 20 bp, Artificial
  CRISPR gRNA sequence
gaatgccaattaaatgtcat

SEQ ID NO: 605479 - DNA, 20 bp, Artificial
  CRISPR gRNA sequence
attcaaacctcttttgattc

SEQ ID NO: 605480 - DNA, 20 bp, Artificial
  CRISPR gRNA sequence
ttcaaacctcttttgattcc

SEQ ID NO: 605481 - DNA, 20 bp, Artificial
  CRISPR gRNA sequence
caaacctcttttgattccag

SEQ ID NO: 605482 - DNA, 20 bp, Artificial
  CRISPR gRNA sequence
aaacctcttttgattccagg

SEQ ID NO: 605483 - DNA, 20 bp, Artificial
  CRISPR gRNA sequence
acctcttttgattccaggag

SEQ ID NO: 605484 - DNA, 20 bp, Artificial
  CRISPR gRNA sequence
ccaggaggagattttcttgt

SEQ ID NO: 605485 - DNA, 20 bp, Artificial
  CRISPR gRNA sequence
tttcttgtaagtcctaaaat

SEQ ID NO: 605486 - DNA, 20 bp, Artificial
  CRISPR gRNA sequence
aagtcctaaaattggaaact

SEQ ID NO: 605487 - DNA, 20 bp, Artificial
  CRISPR gRNA sequence
aaaattggaaacttggattc

SEQ ID NO: 605488 - DNA, 20 bp, Artificial
  CRISPR gRNA sequence
ggattctagtctcattttgc

SEQ ID NO: 605489 - DNA, 20 bp, Artificial
  CRISPR gRNA sequence
atttatttcttctcaatatg

SEQ ID NO: 605490 - DNA, 20 bp, Artificial
  CRISPR gRNA sequence
tttcttctcaatatgtagaa

SEQ ID NO: 605491 - DNA, 20 bp, Artificial
  CRISPR gRNA sequence
cttctcaatatgtagaatgg

SEQ ID NO: 605492 - DNA, 20 bp, Artificial
  CRISPR gRNA sequence
agaatggtggttctcaactt

SEQ ID NO: 605493 - DNA, 20 bp, Artificial
  CRISPR gRNA sequence
tctcaactttggctgcacat

SEQ ID NO: 605494 - DNA, 20 bp, Artificial
  CRISPR gRNA sequence
ggctgcacattagaatcatc

SEQ ID NO: 605495 - DNA, 20 bp, Artificial
  CRISPR gRNA sequence
tggatatgtttaaaaaatac

SEQ ID NO: 605496 - DNA, 20 bp, Artificial
  CRISPR gRNA sequence
ccataccaatttaataaaaa

SEQ ID NO: 605497 - DNA, 20 bp, Artificial
  CRISPR gRNA sequence
cataccaatttaataaaaat

SEQ ID NO: 605498 - DNA, 20 bp, Artificial
  CRISPR gRNA sequence
ataccaatttaataaaaata

SEQ ID NO: 605499 - DNA, 20 bp, Artificial
  CRISPR gRNA sequence
taccaatttaataaaaatag

SEQ ID NO: 605500 - DNA, 20 bp, Artificial
  CRISPR gRNA sequence
caatttaataaaaatagggg

SEQ ID NO: 605501 - DNA, 20 bp, Artificial
  CRISPR gRNA sequence
aatttaataaaaataggggt

SEQ ID NO: 605502 - DNA, 20 bp, Artificial
  CRISPR gRNA sequence
atttaataaaaataggggta

SEQ ID NO: 605503 - DNA, 20 bp, Artificial
  CRISPR gRNA sequence
ataaaaataggggtagggct

SEQ ID NO: 605504 - DNA, 20 bp, Artificial
  CRISPR gRNA sequence
taaaaataggggtagggctc

SEQ ID NO: 605505 - DNA, 20 bp, Artificial
  CRISPR gRNA sequence
taatgatttattaatttccc

SEQ ID NO: 605506 - DNA, 20 bp, Artificial
  CRISPR gRNA sequence
ccccagataattctgatgca

SEQ ID NO: 605507 - DNA, 20 bp, Artificial
  CRISPR gRNA sequence
gataattctgatgcacagtg

SEQ ID NO: 605508 - DNA, 20 bp, Artificial
  CRISPR gRNA sequence
ataattctgatgcacagtga

SEQ ID NO: 605509 - DNA, 20 bp, Artificial
  CRISPR gRNA sequence
tctgatgcacagtgaaggtc

SEQ ID NO: 605510 - DNA, 20 bp, Artificial
  CRISPR gRNA sequence
tgatgcacagtgaaggtcta

SEQ ID NO: 605511 - DNA, 20 bp, Artificial
  CRISPR gRNA sequence
acagtgaaggtctagagcca

SEQ ID NO: 605512 - DNA, 20 bp, Artificial
  CRISPR gRNA sequence
aaggtctagagccatggata

SEQ ID NO: 605513 - DNA, 20 bp, Artificial
  CRISPR gRNA sequence
ctaacttctgtgactttttt

SEQ ID NO: 605514 - DNA, 20 bp, Artificial
  CRISPR gRNA sequence
tttaatcactcttgtaaaaa

SEQ ID NO: 605515 - DNA, 20 bp, Artificial
  CRISPR gRNA sequence
aaaaagctttctctaattta

SEQ ID NO: 605516 - DNA, 20 bp, Artificial
  CRISPR gRNA sequence
aaaagctttctctaatttat

SEQ ID NO: 605517 - DNA, 20 bp, Artificial
  CRISPR gRNA sequence
aaagctttctctaatttata

SEQ ID NO: 605518 - DNA, 20 bp, Artificial
  CRISPR gRNA sequence
tagggtctttttcaaaaata

SEQ ID NO: 605519 - DNA, 20 bp, Artificial
  CRISPR gRNA sequence
ctttttcaaaaatatagaat

SEQ ID NO: 605520 - DNA, 20 bp, Artificial
  CRISPR gRNA sequence
tttcaaaaatatagaattag

SEQ ID NO: 605521 - DNA, 20 bp, Artificial
  CRISPR gRNA sequence
gatatacttctgttccttgc

SEQ ID NO: 605522 - DNA, 20 bp, Artificial
  CRISPR gRNA sequence
ttacattcaaccattaattt

SEQ ID NO: 605523 - DNA, 20 bp, Artificial
  CRISPR gRNA sequence
tacattcaaccattaattta

SEQ ID NO: 605524 - DNA, 20 bp, Artificial
  CRISPR gRNA sequence
ttcaaccattaatttaaggt

SEQ ID NO: 605525 - DNA, 20 bp, Artificial
  CRISPR gRNA sequence
tcaaccattaatttaaggta

SEQ ID NO: 605526 - DNA, 20 bp, Artificial
  CRISPR gRNA sequence
aaggtaaggatgtttgacaa

SEQ ID NO: 605527 - DNA, 20 bp, Artificial
  CRISPR gRNA sequence
ataaaatttgatttgtcaac

SEQ ID NO: 605528 - DNA, 20 bp, Artificial
  CRISPR gRNA sequence
tgtcaacaagtacatattga

SEQ ID NO: 605529 - DNA, 20 bp, Artificial
  CRISPR gRNA sequence
tcaacaagtacatattgata

SEQ ID NO: 605530 - DNA, 20 bp, Artificial
  CRISPR gRNA sequence
aacaagtacatattgataga

SEQ ID NO: 605531 - DNA, 20 bp, Artificial
  CRISPR gRNA sequence
aagtacatattgatagagag

SEQ ID NO: 605532 - DNA, 20 bp, Artificial
  CRISPR gRNA sequence
gtacatattgatagagagca

SEQ ID NO: 605533 - DNA, 20 bp, Artificial
  CRISPR gRNA sequence
tacatattgatagagagcag

SEQ ID NO: 605534 - DNA, 20 bp, Artificial
  CRISPR gRNA sequence
acatattgatagagagcaga

SEQ ID NO: 605535 - DNA, 20 bp, Artificial
  CRISPR gRNA sequence
catattgatagagagcagag

SEQ ID NO: 605536 - DNA, 20 bp, Artificial
  CRISPR gRNA sequence
atattgatagagagcagagg

SEQ ID NO: 605537 - DNA, 20 bp, Artificial
  CRISPR gRNA sequence
attgatagagagcagagggg

SEQ ID NO: 605538 - DNA, 20 bp, Artificial
  CRISPR gRNA sequence
tgatagagagcagaggggga

SEQ ID NO: 605539 - DNA, 20 bp, Artificial
  CRISPR gRNA sequence
agagagcagagggggagagc

SEQ ID NO: 605540 - DNA, 20 bp, Artificial
  CRISPR gRNA sequence
gagcagagggggagagctgg

SEQ ID NO: 605541 - DNA, 20 bp, Artificial
  CRISPR gRNA sequence
agagggggagagctggaagt

SEQ ID NO: 605542 - DNA, 20 bp, Artificial
  CRISPR gRNA sequence
gagggggagagctggaagtt

SEQ ID NO: 605543 - DNA, 20 bp, Artificial
  CRISPR gRNA sequence
agggggagagctggaagtta

SEQ ID NO: 605544 - DNA, 20 bp, Artificial
  CRISPR gRNA sequence
gggggagagctggaagttag

SEQ ID NO: 605545 - DNA, 20 bp, Artificial
  CRISPR gRNA sequence
gagagctggaagttagggga

SEQ ID NO: 605546 - DNA, 20 bp, Artificial
  CRISPR gRNA sequence
agagctggaagttaggggaa

SEQ ID NO: 605547 - DNA, 20 bp, Artificial
  CRISPR gRNA sequence
gagctggaagttaggggaaa

SEQ ID NO: 605548 - DNA, 20 bp, Artificial
  CRISPR gRNA sequence
ggaagttaggggaaagggaa

SEQ ID NO: 605549 - DNA, 20 bp, Artificial
  CRISPR gRNA sequence
cacttccgtgtgctgtgtgt

SEQ ID NO: 605550 - DNA, 20 bp, Artificial
  CRISPR gRNA sequence
acttccgtgtgctgtgtgtc

SEQ ID NO: 605551 - DNA, 20 bp, Artificial
  CRISPR gRNA sequence
tgatacaatcacccgtaata

SEQ ID NO: 605552 - DNA, 20 bp, Artificial
  CRISPR gRNA sequence
gatacaatcacccgtaatat

SEQ ID NO: 605553 - DNA, 20 bp, Artificial
  CRISPR gRNA sequence
tacaatcacccgtaatatag

SEQ ID NO: 605554 - DNA, 20 bp, Artificial
  CRISPR gRNA sequence
ctgcttatatatgatgaaat

SEQ ID NO: 605555 - DNA, 20 bp, Artificial
  CRISPR gRNA sequence
tatgatgaaatcagttctta

SEQ ID NO: 605556 - DNA, 20 bp, Artificial
  CRISPR gRNA sequence
tgatgaaatcagttcttaaa

SEQ ID NO: 605557 - DNA, 20 bp, Artificial
  CRISPR gRNA sequence
ttcttaaagagttattaatt

SEQ ID NO: 605558 - DNA, 20 bp, Artificial
  CRISPR gRNA sequence
taagtttaattatattttgt

SEQ ID NO: 605559 - DNA, 20 bp, Artificial
  CRISPR gRNA sequence
taattatattttgtaagtca

SEQ ID NO: 605560 - DNA, 20 bp, Artificial
  CRISPR gRNA sequence
tttgtaagtcatagaatctc

SEQ ID NO: 605561 - DNA, 20 bp, Artificial
  CRISPR gRNA sequence
ttgtaagtcatagaatctca

SEQ ID NO: 605562 - DNA, 20 bp, Artificial
  CRISPR gRNA sequence
tgtaagtcatagaatctcaa

SEQ ID NO: 605563 - DNA, 20 bp, Artificial
  CRISPR gRNA sequence
aagggtatgactgatcttaa

SEQ ID NO: 605564 - DNA, 20 bp, Artificial
  CRISPR gRNA sequence
catttgaataactcatctac

SEQ ID NO: 605565 - DNA, 20 bp, Artificial
  CRISPR gRNA sequence
taactcatctactggacata

SEQ ID NO: 605566 - DNA, 20 bp, Artificial
  CRISPR gRNA sequence
aactcatctactggacataa

SEQ ID NO: 605567 - DNA, 20 bp, Artificial
  CRISPR gRNA sequence
ggacataaaggctaaatgtg

SEQ ID NO: 605568 - DNA, 20 bp, Artificial
  CRISPR gRNA sequence
gacataaaggctaaatgtga

SEQ ID NO: 605569 - DNA, 20 bp, Artificial
  CRISPR gRNA sequence
atactttaacatatgaaatc

SEQ ID NO: 605570 - DNA, 20 bp, Artificial
  CRISPR gRNA sequence
actttaacatatgaaatcaa

SEQ ID NO: 605571 - DNA, 20 bp, Artificial
  CRISPR gRNA sequence
atgaaatcaagagtgaatgt

SEQ ID NO: 605572 - DNA, 20 bp, Artificial
  CRISPR gRNA sequence
tgaaatcaagagtgaatgtt

SEQ ID NO: 605573 - DNA, 20 bp, Artificial
  CRISPR gRNA sequence
agtgaatgttaggattttaa

SEQ ID NO: 605574 - DNA, 20 bp, Artificial
  CRISPR gRNA sequence
gattttaaaagtatgtcatc

SEQ ID NO: 605575 - DNA, 20 bp, Artificial
  CRISPR gRNA sequence
aagtatgtcatcaagaaata

SEQ ID NO: 605576 - DNA, 20 bp, Artificial
  CRISPR gRNA sequence
agtatgtcatcaagaaatat

SEQ ID NO: 605577 - DNA, 20 bp, Artificial
  CRISPR gRNA sequence
gtatgtcatcaagaaatatg

SEQ ID NO: 605578 - DNA, 20 bp, Artificial
  CRISPR gRNA sequence
caagaaatatggggaaaaaa

SEQ ID NO: 605579 - DNA, 20 bp, Artificial
  CRISPR gRNA sequence
aatatggggaaaaaatagcc

SEQ ID NO: 605580 - DNA, 20 bp, Artificial
  CRISPR gRNA sequence
tatggggaaaaaatagccca

SEQ ID NO: 605581 - DNA, 20 bp, Artificial
  CRISPR gRNA sequence
tggggaaaaaatagcccaga

SEQ ID NO: 605582 - DNA, 20 bp, Artificial
  CRISPR gRNA sequence
gggaaaaaatagcccagaga

SEQ ID NO: 605583 - DNA, 20 bp, Artificial
  CRISPR gRNA sequence
atagcccagagagagatatt

SEQ ID NO: 605584 - DNA, 20 bp, Artificial
  CRISPR gRNA sequence
atatttggtaatatgttata

SEQ ID NO: 605585 - DNA, 20 bp, Artificial
  CRISPR gRNA sequence
tatttggtaatatgttatac

SEQ ID NO: 605586 - DNA, 20 bp, Artificial
  CRISPR gRNA sequence
aatatgttatacaggttata

SEQ ID NO: 605587 - DNA, 20 bp, Artificial
  CRISPR gRNA sequence
cagtgtaactgtttgcttca

SEQ ID NO: 605588 - DNA, 20 bp, Artificial
  CRISPR gRNA sequence
actgtttgcttcatggtgtt

SEQ ID NO: 605589 - DNA, 20 bp, Artificial
  CRISPR gRNA sequence
tttattttatttttcaatta

SEQ ID NO: 605590 - DNA, 20 bp, Artificial
  CRISPR gRNA sequence
attttatttttcaattatgg

SEQ ID NO: 605591 - DNA, 20 bp, Artificial
  CRISPR gRNA sequence
tttatttttcaattatggca

SEQ ID NO: 605592 - DNA, 20 bp, Artificial
  CRISPR gRNA sequence
tttttcaattatggcagaga

SEQ ID NO: 605593 - DNA, 20 bp, Artificial
  CRISPR gRNA sequence
ttcaattatggcagagatag

SEQ ID NO: 605594 - DNA, 20 bp, Artificial
  CRISPR gRNA sequence
gagatagaagtttaattctt

SEQ ID NO: 605595 - DNA, 20 bp, Artificial
  CRISPR gRNA sequence
tccaactattgcatattttt

SEQ ID NO: 605596 - DNA, 20 bp, Artificial
  CRISPR gRNA sequence
catattttttagaatcacca

SEQ ID NO: 605597 - DNA, 20 bp, Artificial
  CRISPR gRNA sequence
ttagaatcaccatagttaac

SEQ ID NO: 605598 - DNA, 20 bp, Artificial
  CRISPR gRNA sequence
tagttaactagaatgattcc

SEQ ID NO: 605599 - DNA, 20 bp, Artificial
  CRISPR gRNA sequence
tgattcccagttgtactaat

SEQ ID NO: 605600 - DNA, 20 bp, Artificial
  CRISPR gRNA sequence
gttgtactaattagcataaa

SEQ ID NO: 605601 - DNA, 20 bp, Artificial
  CRISPR gRNA sequence
ctcattaaactgcatgccat

SEQ ID NO: 605602 - DNA, 20 bp, Artificial
  CRISPR gRNA sequence
acatttgatgtattatctct

SEQ ID NO: 605603 - DNA, 20 bp, Artificial
  CRISPR gRNA sequence
tctcttggtctttaaaaata

SEQ ID NO: 605604 - DNA, 20 bp, Artificial
  CRISPR gRNA sequence
tttaaaaatatagaaaataa

SEQ ID NO: 605605 - DNA, 20 bp, Artificial
  CRISPR gRNA sequence
aaatatagaaaataatagtt

SEQ ID NO: 605606 - DNA, 20 bp, Artificial
  CRISPR gRNA sequence
ttcaataattgattttaaat

SEQ ID NO: 605607 - DNA, 20 bp, Artificial
  CRISPR gRNA sequence
caaaaaaacttttgtaatct

SEQ ID NO: 605608 - DNA, 20 bp, Artificial
  CRISPR gRNA sequence
aaaaaaacttttgtaatctc

SEQ ID NO: 605609 - DNA, 20 bp, Artificial
  CRISPR gRNA sequence
caccatattataaatgatga

SEQ ID NO: 605610 - DNA, 20 bp, Artificial
  CRISPR gRNA sequence
tataaatgatgaaagctact

SEQ ID NO: 605611 - DNA, 20 bp, Artificial
  CRISPR gRNA sequence
taacatcaataacattgtat

SEQ ID NO: 605612 - DNA, 20 bp, Artificial
  CRISPR gRNA sequence
cattgtattggttttattga

SEQ ID NO: 605613 - DNA, 20 bp, Artificial
  CRISPR gRNA sequence
ttttattgatagcattacat

SEQ ID NO: 605614 - DNA, 20 bp, Artificial
  CRISPR gRNA sequence
ttggtaatgttgttttgaca

SEQ ID NO: 605615 - DNA, 20 bp, Artificial
  CRISPR gRNA sequence
ttttgacacagtactcatgc

SEQ ID NO: 605616 - DNA, 20 bp, Artificial
  CRISPR gRNA sequence
tttaaattgacacctcattt

SEQ ID NO: 605617 - DNA, 20 bp, Artificial
  CRISPR gRNA sequence
aattgacacctcattttgga

SEQ ID NO: 605618 - DNA, 20 bp, Artificial
  CRISPR gRNA sequence
tgacacctcattttggacgg

SEQ ID NO: 605619 - DNA, 20 bp, Artificial
  CRISPR gRNA sequence
ttggacggcagttttatata

SEQ ID NO: 605620 - DNA, 20 bp, Artificial
  CRISPR gRNA sequence
tggacggcagttttatatat

SEQ ID NO: 605621 - DNA, 20 bp, Artificial
  CRISPR gRNA sequence
cacctaataatgccttcttt

SEQ ID NO: 605622 - DNA, 20 bp, Artificial
  CRISPR gRNA sequence
ttctttgagacttcaatttt

SEQ ID NO: 605623 - DNA, 20 bp, Artificial
  CRISPR gRNA sequence
ttcaattttaagaaacctgt

SEQ ID NO: 605624 - DNA, 20 bp, Artificial
  CRISPR gRNA sequence
taagaaacctgttagaaatg

SEQ ID NO: 605625 - DNA, 20 bp, Artificial
  CRISPR gRNA sequence
aaacctgttagaaatgcaga

SEQ ID NO: 605626 - DNA, 20 bp, Artificial
  CRISPR gRNA sequence
gcagacagatttatccacaa

SEQ ID NO: 605627 - DNA, 20 bp, Artificial
  CRISPR gRNA sequence
gacagatttatccacaaaag

SEQ ID NO: 605628 - DNA, 20 bp, Artificial
  CRISPR gRNA sequence
ttatccacaaaagtagacac

SEQ ID NO: 605629 - DNA, 20 bp, Artificial
  CRISPR gRNA sequence
atccacaaaagtagacactg

SEQ ID NO: 605630 - DNA, 20 bp, Artificial
  CRISPR gRNA sequence
agacactggagtattattat

SEQ ID NO: 605631 - DNA, 20 bp, Artificial
  CRISPR gRNA sequence
ttattattggaaattacttt

SEQ ID NO: 605632 - DNA, 20 bp, Artificial
  CRISPR gRNA sequence
attggaaattactttcggta

SEQ ID NO: 605633 - DNA, 20 bp, Artificial
  CRISPR gRNA sequence
attactttcggtacagtgct

SEQ ID NO: 605634 - DNA, 20 bp, Artificial
  CRISPR gRNA sequence
ttactttcggtacagtgctt

SEQ ID NO: 605635 - DNA, 20 bp, Artificial
  CRISPR gRNA sequence
tacagtgcttaggtaaatca

SEQ ID NO: 605636 - DNA, 20 bp, Artificial
  CRISPR gRNA sequence
gtaaatcatggttattccat

SEQ ID NO: 605637 - DNA, 20 bp, Artificial
  CRISPR gRNA sequence
catggttattccataagctg

SEQ ID NO: 605638 - DNA, 20 bp, Artificial
  CRISPR gRNA sequence
tccataagctgaagtatata

SEQ ID NO: 605639 - DNA, 20 bp, Artificial
  CRISPR gRNA sequence
tcttaaaaattatgctgttg

SEQ ID NO: 605640 - DNA, 20 bp, Artificial
  CRISPR gRNA sequence
tgaagaatttcttaatgaca

SEQ ID NO: 605641 - DNA, 20 bp, Artificial
  CRISPR gRNA sequence
cttaatgacatggaaatgct

SEQ ID NO: 605642 - DNA, 20 bp, Artificial
  CRISPR gRNA sequence
ttaatgacatggaaatgctt

SEQ ID NO: 605643 - DNA, 20 bp, Artificial
  CRISPR gRNA sequence
tggaaatgcttaggttatta

SEQ ID NO: 605644 - DNA, 20 bp, Artificial
  CRISPR gRNA sequence
gaaatgcttaggttattata

SEQ ID NO: 605645 - DNA, 20 bp, Artificial
  CRISPR gRNA sequence
aatgcttaggttattataga

SEQ ID NO: 605646 - DNA, 20 bp, Artificial
  CRISPR gRNA sequence
atgcttaggttattatagag

SEQ ID NO: 605647 - DNA, 20 bp, Artificial
  CRISPR gRNA sequence
atagagaggtaaatacttta

SEQ ID NO: 605648 - DNA, 20 bp, Artificial
  CRISPR gRNA sequence
atacattatctgtttatcga

SEQ ID NO: 605649 - DNA, 20 bp, Artificial
  CRISPR gRNA sequence
aaatctcaaatttttttgaa

SEQ ID NO: 605650 - DNA, 20 bp, Artificial
  CRISPR gRNA sequence
acatgctaaaatgttaaaaa

SEQ ID NO: 605651 - DNA, 20 bp, Artificial
  CRISPR gRNA sequence
catgctaaaatgttaaaaat

SEQ ID NO: 605652 - DNA, 20 bp, Artificial
  CRISPR gRNA sequence
atgctaaaatgttaaaaata

SEQ ID NO: 605653 - DNA, 20 bp, Artificial
  CRISPR gRNA sequence
tgctaaaatgttaaaaatag

SEQ ID NO: 605654 - DNA, 20 bp, Artificial
  CRISPR gRNA sequence
taaaatgttaaaaatagggg

SEQ ID NO: 605655 - DNA, 20 bp, Artificial
  CRISPR gRNA sequence
aaaatgttaaaaataggggt

SEQ ID NO: 605656 - DNA, 20 bp, Artificial
  CRISPR gRNA sequence
gttaaaaataggggtaggtt

SEQ ID NO: 605657 - DNA, 20 bp, Artificial
  CRISPR gRNA sequence
ttaaaaataggggtaggttt

SEQ ID NO: 605658 - DNA, 20 bp, Artificial
  CRISPR gRNA sequence
ataggggtaggtttaggtac

SEQ ID NO: 605659 - DNA, 20 bp, Artificial
  CRISPR gRNA sequence
aatacctgtttttatataat

SEQ ID NO: 605660 - DNA, 20 bp, Artificial
  CRISPR gRNA sequence
atacctgtttttatataatg

SEQ ID NO: 605661 - DNA, 20 bp, Artificial
  CRISPR gRNA sequence
ggcattgttactttcataat

SEQ ID NO: 605662 - DNA, 20 bp, Artificial
  CRISPR gRNA sequence
gttactttcataatcagaaa

SEQ ID NO: 605663 - DNA, 20 bp, Artificial
  CRISPR gRNA sequence
tttcataatcagaaaaagaa

SEQ ID NO: 605664 - DNA, 20 bp, Artificial
  CRISPR gRNA sequence
cagaaaaagaatagaaaaca

SEQ ID NO: 605665 - DNA, 20 bp, Artificial
  CRISPR gRNA sequence
gaaaacaaagtttttaccta

SEQ ID NO: 605666 - DNA, 20 bp, Artificial
  CRISPR gRNA sequence
acaaagtttttacctatagt

SEQ ID NO: 605667 - DNA, 20 bp, Artificial
  CRISPR gRNA sequence
aagtttttacctatagttag

SEQ ID NO: 605668 - DNA, 20 bp, Artificial
  CRISPR gRNA sequence
tatagttagcagctttattt

SEQ ID NO: 605669 - DNA, 20 bp, Artificial
  CRISPR gRNA sequence
agttagcagctttattttgg

SEQ ID NO: 605670 - DNA, 20 bp, Artificial
  CRISPR gRNA sequence
gttagcagctttattttggt

SEQ ID NO: 605671 - DNA, 20 bp, Artificial
  CRISPR gRNA sequence
ttagcagctttattttggtg

SEQ ID NO: 605672 - DNA, 20 bp, Artificial
  CRISPR gRNA sequence
catgcttgatttgctattct

SEQ ID NO: 605673 - DNA, 20 bp, Artificial
  CRISPR gRNA sequence
ttgctattcttagacattct

SEQ ID NO: 605674 - DNA, 20 bp, Artificial
  CRISPR gRNA sequence
tagacattctaagacatctt

SEQ ID NO: 605675 - DNA, 20 bp, Artificial
  CRISPR gRNA sequence
gacattctaagacatcttta

SEQ ID NO: 605676 - DNA, 20 bp, Artificial
  CRISPR gRNA sequence
agtcaatatttcctattctc

SEQ ID NO: 605677 - DNA, 20 bp, Artificial
  CRISPR gRNA sequence
tttcctattctctggctatt

SEQ ID NO: 605678 - DNA, 20 bp, Artificial
  CRISPR gRNA sequence
tttcatgtgaaattcgcatc

SEQ ID NO: 605679 - DNA, 20 bp, Artificial
  CRISPR gRNA sequence
tgtgaaattcgcatcaagtt

SEQ ID NO: 605680 - DNA, 20 bp, Artificial
  CRISPR gRNA sequence
tgaaattcgcatcaagttta

SEQ ID NO: 605681 - DNA, 20 bp, Artificial
  CRISPR gRNA sequence
agtatgatgctctcttgatc

SEQ ID NO: 605682 - DNA, 20 bp, Artificial
  CRISPR gRNA sequence
ttgatcaagtaacatatcct

SEQ ID NO: 605683 - DNA, 20 bp, Artificial
  CRISPR gRNA sequence
agtaacatatccttagtgaa

SEQ ID NO: 605684 - DNA, 20 bp, Artificial
  CRISPR gRNA sequence
gtaacatatccttagtgaat

SEQ ID NO: 605685 - DNA, 20 bp, Artificial
  CRISPR gRNA sequence
tgaatgggtgctattttttt

SEQ ID NO: 605686 - DNA, 20 bp, Artificial
  CRISPR gRNA sequence
gtgctatttttttgagactt

SEQ ID NO: 605687 - DNA, 20 bp, Artificial
  CRISPR gRNA sequence
ttcagctataccctcttctc

SEQ ID NO: 605688 - DNA, 20 bp, Artificial
  CRISPR gRNA sequence
ctcttctccagtacctcttc

SEQ ID NO: 605689 - DNA, 20 bp, Artificial
  CRISPR gRNA sequence
tcttctccagtacctcttct

SEQ ID NO: 605690 - DNA, 20 bp, Artificial
  CRISPR gRNA sequence
gtacctcttctaggctcttt

SEQ ID NO: 605691 - DNA, 20 bp, Artificial
  CRISPR gRNA sequence
gctcttttggacatatcttc

SEQ ID NO: 605692 - DNA, 20 bp, Artificial
  CRISPR gRNA sequence
ctcttttggacatatcttct

SEQ ID NO: 605693 - DNA, 20 bp, Artificial
  CRISPR gRNA sequence
tcttctgggttaccttctat

SEQ ID NO: 605694 - DNA, 20 bp, Artificial
  CRISPR gRNA sequence
tctataagctgtataatatt

SEQ ID NO: 605695 - DNA, 20 bp, Artificial
  CRISPR gRNA sequence
ataagctgtataatatttag

SEQ ID NO: 605696 - DNA, 20 bp, Artificial
  CRISPR gRNA sequence
atttagtggttactgtaacc

SEQ ID NO: 605697 - DNA, 20 bp, Artificial
  CRISPR gRNA sequence
ttagtggttactgtaaccca

SEQ ID NO: 605698 - DNA, 20 bp, Artificial
  CRISPR gRNA sequence
tggttactgtaacccagaga

SEQ ID NO: 605699 - DNA, 20 bp, Artificial
  CRISPR gRNA sequence
ggttactgtaacccagagat

SEQ ID NO: 605700 - DNA, 20 bp, Artificial
  CRISPR gRNA sequence
atgactatcaattattgtta

SEQ ID NO: 605701 - DNA, 20 bp, Artificial
  CRISPR gRNA sequence
attgttaaagatactacaaa

SEQ ID NO: 605702 - DNA, 20 bp, Artificial
  CRISPR gRNA sequence
ttgttaaagatactacaaat

SEQ ID NO: 605703 - DNA, 20 bp, Artificial
  CRISPR gRNA sequence
atgggaatttttttttctcc

SEQ ID NO: 605704 - DNA, 20 bp, Artificial
  CRISPR gRNA sequence
aatatctataattacctcgt

SEQ ID NO: 605705 - DNA, 20 bp, Artificial
  CRISPR gRNA sequence
atctataattacctcgttag

SEQ ID NO: 605706 - DNA, 20 bp, Artificial
  CRISPR gRNA sequence
ataattacctcgttagtaga

SEQ ID NO: 605707 - DNA, 20 bp, Artificial
  CRISPR gRNA sequence
gtagatagaaacaatatcct

SEQ ID NO: 605708 - DNA, 20 bp, Artificial
  CRISPR gRNA sequence
tagaaacaatatccttagat

SEQ ID NO: 605709 - DNA, 20 bp, Artificial
  CRISPR gRNA sequence
atgagctacaaataccaaat

SEQ ID NO: 605710 - DNA, 20 bp, Artificial
  CRISPR gRNA sequence
tgagctacaaataccaaatt

SEQ ID NO: 605711 - DNA, 20 bp, Artificial
  CRISPR gRNA sequence
tcccctgaattttgcttctg

SEQ ID NO: 605712 - DNA, 20 bp, Artificial
  CRISPR gRNA sequence
aacaataacttatttttctt

SEQ ID NO: 605713 - DNA, 20 bp, Artificial
  CRISPR gRNA sequence
aacttatttttctttagttc

SEQ ID NO: 605714 - DNA, 20 bp, Artificial
  CRISPR gRNA sequence
tttctttagttctagtgaaa

SEQ ID NO: 605715 - DNA, 20 bp, Artificial
  CRISPR gRNA sequence
ttagttctagtgaaatagtg

SEQ ID NO: 605716 - DNA, 20 bp, Artificial
  CRISPR gRNA sequence
aaatagtgaagtgtgcttct

SEQ ID NO: 605717 - DNA, 20 bp, Artificial
  CRISPR gRNA sequence
ttaacacacatttctaccat

SEQ ID NO: 605718 - DNA, 20 bp, Artificial
  CRISPR gRNA sequence
atttctaccataagaaactt

SEQ ID NO: 605719 - DNA, 20 bp, Artificial
  CRISPR gRNA sequence
ataagaaacttcagtaaaac

SEQ ID NO: 605720 - DNA, 20 bp, Artificial
  CRISPR gRNA sequence
actagatttaaaaaatttga

SEQ ID NO: 605721 - DNA, 20 bp, Artificial
  CRISPR gRNA sequence
tttaatctttaaaatgttta

SEQ ID NO: 605722 - DNA, 20 bp, Artificial
  CRISPR gRNA sequence
aaatgtttatggtatacctg

SEQ ID NO: 605723 - DNA, 20 bp, Artificial
  CRISPR gRNA sequence
gtggttaaataacatatgca

SEQ ID NO: 605724 - DNA, 20 bp, Artificial
  CRISPR gRNA sequence
ttctatgtttaaactctttt

SEQ ID NO: 605725 - DNA, 20 bp, Artificial
  CRISPR gRNA sequence
tttaaactcttttcagtgtc

SEQ ID NO: 605726 - DNA, 20 bp, Artificial
  CRISPR gRNA sequence
agataaatctttatttttta

SEQ ID NO: 605727 - DNA, 20 bp, Artificial
  CRISPR gRNA sequence
ttttttaaagctcttcattg

SEQ ID NO: 605728 - DNA, 20 bp, Artificial
  CRISPR gRNA sequence
gattattcaaatctttttct

SEQ ID NO: 605729 - DNA, 20 bp, Artificial
  CRISPR gRNA sequence
ctttacatatgttcatttta

SEQ ID NO: 605730 - DNA, 20 bp, Artificial
  CRISPR gRNA sequence
ttttacagactattttaatt

SEQ ID NO: 605731 - DNA, 20 bp, Artificial
  CRISPR gRNA sequence
ttcagtgattcccatctaat

SEQ ID NO: 605732 - DNA, 20 bp, Artificial
  CRISPR gRNA sequence
ccatctaattggtcaaccac

SEQ ID NO: 605733 - DNA, 20 bp, Artificial
  CRISPR gRNA sequence
ttggtcaaccaccagtatga

SEQ ID NO: 605734 - DNA, 20 bp, Artificial
  CRISPR gRNA sequence
aaccaccagtatgatggtaa

SEQ ID NO: 605735 - DNA, 20 bp, Artificial
  CRISPR gRNA sequence
atgatggtaaaagttaccca

SEQ ID NO: 605736 - DNA, 20 bp, Artificial
  CRISPR gRNA sequence
gatggtaaaagttacccaaa

SEQ ID NO: 605737 - DNA, 20 bp, Artificial
  CRISPR gRNA sequence
aaagagtctaatatgcaccc

SEQ ID NO: 605738 - DNA, 20 bp, Artificial
  CRISPR gRNA sequence
gtctaatatgcaccccagtt

SEQ ID NO: 605739 - DNA, 20 bp, Artificial
  CRISPR gRNA sequence
tctaatatgcaccccagttt

SEQ ID NO: 605740 - DNA, 20 bp, Artificial
  CRISPR gRNA sequence
ctaatatgcaccccagtttg

SEQ ID NO: 605741 - DNA, 20 bp, Artificial
  CRISPR gRNA sequence
tcacgttttaaaatgaatct

SEQ ID NO: 605742 - DNA, 20 bp, Artificial
  CRISPR gRNA sequence
atatttaaaaatgatttatt

SEQ ID NO: 605743 - DNA, 20 bp, Artificial
  CRISPR gRNA sequence
tttaatttaatgatatgttt

SEQ ID NO: 605744 - DNA, 20 bp, Artificial
  CRISPR gRNA sequence
tttaatttactttatcctaa

SEQ ID NO: 605745 - DNA, 20 bp, Artificial
  CRISPR gRNA sequence
atttactttatcctaaaaga

SEQ ID NO: 605746 - DNA, 20 bp, Artificial
  CRISPR gRNA sequence
tatctatatgcacatttatt

SEQ ID NO: 605747 - DNA, 20 bp, Artificial
  CRISPR gRNA sequence
atctatatgcacatttattc

SEQ ID NO: 605748 - DNA, 20 bp, Artificial
  CRISPR gRNA sequence
ttttaatgttcacttactta

SEQ ID NO: 605749 - DNA, 20 bp, Artificial
  CRISPR gRNA sequence
ttaatgttcacttacttaaa

SEQ ID NO: 605750 - DNA, 20 bp, Artificial
  CRISPR gRNA sequence
catttatactgatatttgca

SEQ ID NO: 605751 - DNA, 20 bp, Artificial
  CRISPR gRNA sequence
tatttgcatagttttcccca

SEQ ID NO: 605752 - DNA, 20 bp, Artificial
  CRISPR gRNA sequence
tccccaaagtctgtaacttt

SEQ ID NO: 605753 - DNA, 20 bp, Artificial
  CRISPR gRNA sequence
aaagtctgtaactttgagtt

SEQ ID NO: 605754 - DNA, 20 bp, Artificial
  CRISPR gRNA sequence
ttgagttcagatctgaactt

SEQ ID NO: 605755 - DNA, 20 bp, Artificial
  CRISPR gRNA sequence
tgagttcagatctgaactta

SEQ ID NO: 605756 - DNA, 20 bp, Artificial
  CRISPR gRNA sequence
gaacttaaggtttgtacttt

SEQ ID NO: 605757 - DNA, 20 bp, Artificial
  CRISPR gRNA sequence
tgtacttttagttgccttta

SEQ ID NO: 605758 - DNA, 20 bp, Artificial
  CRISPR gRNA sequence
caactatgaataacattttc

SEQ ID NO: 605759 - DNA, 20 bp, Artificial
  CRISPR gRNA sequence
atataacactctcccctata

SEQ ID NO: 605760 - DNA, 20 bp, Artificial
  CRISPR gRNA sequence
ctctcccctatatggttctt

SEQ ID NO: 605761 - DNA, 20 bp, Artificial
  CRISPR gRNA sequence
gttcttcagacttgaaatct

SEQ ID NO: 605762 - DNA, 20 bp, Artificial
  CRISPR gRNA sequence
cagacttgaaatcttggaat

SEQ ID NO: 605763 - DNA, 20 bp, Artificial
  CRISPR gRNA sequence
atcagattacttaatattct

SEQ ID NO: 605764 - DNA, 20 bp, Artificial
  CRISPR gRNA sequence
ttaatattcttggcttctcc

SEQ ID NO: 605765 - DNA, 20 bp, Artificial
  CRISPR gRNA sequence
gcttctcctagtctgtcatc

SEQ ID NO: 605766 - DNA, 20 bp, Artificial
  CRISPR gRNA sequence
tatcttgttctttttccgtt

SEQ ID NO: 605767 - DNA, 20 bp, Artificial
  CRISPR gRNA sequence
tctgtcctctctcctcttgc

SEQ ID NO: 605768 - DNA, 20 bp, Artificial
  CRISPR gRNA sequence
ttgccagtccacatcttatc

SEQ ID NO: 605769 - DNA, 20 bp, Artificial
  CRISPR gRNA sequence
atctagcctttctttacctg

SEQ ID NO: 605770 - DNA, 20 bp, Artificial
  CRISPR gRNA sequence
acctgtggctgatatgcacc

SEQ ID NO: 605771 - DNA, 20 bp, Artificial
  CRISPR gRNA sequence
tgatatgcacccagcactta

SEQ ID NO: 605772 - DNA, 20 bp, Artificial
  CRISPR gRNA sequence
acttacagatatgattatac

SEQ ID NO: 605773 - DNA, 20 bp, Artificial
  CRISPR gRNA sequence
aatattaaaatgcttttgta

SEQ ID NO: 605774 - DNA, 20 bp, Artificial
  CRISPR gRNA sequence
atattaaaatgcttttgtac

SEQ ID NO: 605775 - DNA, 20 bp, Artificial
  CRISPR gRNA sequence
aaatgcttttgtacaggttt

SEQ ID NO: 605776 - DNA, 20 bp, Artificial
  CRISPR gRNA sequence
gcttttgtacaggtttgaga

SEQ ID NO: 605777 - DNA, 20 bp, Artificial
  CRISPR gRNA sequence
ttttgtacaggtttgagaaa

SEQ ID NO: 605778 - DNA, 20 bp, Artificial
  CRISPR gRNA sequence
tgagaaagagacttttcctc

SEQ ID NO: 605779 - DNA, 20 bp, Artificial
  CRISPR gRNA sequence
gacttttcctcaagtccatt

SEQ ID NO: 605780 - DNA, 20 bp, Artificial
  CRISPR gRNA sequence
acctgtactcccttcatccc

SEQ ID NO: 605781 - DNA, 20 bp, Artificial
  CRISPR gRNA sequence
ctgtactcccttcatcccaa

SEQ ID NO: 605782 - DNA, 20 bp, Artificial
  CRISPR gRNA sequence
ccttcatcccaagagctttg

SEQ ID NO: 605783 - DNA, 20 bp, Artificial
  CRISPR gRNA sequence
cttcatcccaagagctttgt

SEQ ID NO: 605784 - DNA, 20 bp, Artificial
  CRISPR gRNA sequence
ctgcttaatatgctgtcaac

SEQ ID NO: 605785 - DNA, 20 bp, Artificial
  CRISPR gRNA sequence
tatgctgtcaactggctaac

SEQ ID NO: 605786 - DNA, 20 bp, Artificial
  CRISPR gRNA sequence
tggctaaccagcctgtgtcc

SEQ ID NO: 605787 - DNA, 20 bp, Artificial
  CRISPR gRNA sequence
gtgtcccagcctgcgcatct

SEQ ID NO: 605788 - DNA, 20 bp, Artificial
  CRISPR gRNA sequence
cagcctgcgcatctcagcct

SEQ ID NO: 605789 - DNA, 20 bp, Artificial
  CRISPR gRNA sequence
tctcagcctcagtgtgccca

SEQ ID NO: 605790 - DNA, 20 bp, Artificial
  CRISPR gRNA sequence
tgcccatggatgttctctcc

SEQ ID NO: 605791 - DNA, 20 bp, Artificial
  CRISPR gRNA sequence
gcccatggatgttctctccc

SEQ ID NO: 605792 - DNA, 20 bp, Artificial
  CRISPR gRNA sequence
atggatgttctctcccaggc

SEQ ID NO: 605793 - DNA, 20 bp, Artificial
  CRISPR gRNA sequence
tggatgttctctcccaggct

SEQ ID NO: 605794 - DNA, 20 bp, Artificial
  CRISPR gRNA sequence
ggatgttctctcccaggcta

SEQ ID NO: 605795 - DNA, 20 bp, Artificial
  CRISPR gRNA sequence
gatgttctctcccaggctag

SEQ ID NO: 605796 - DNA, 20 bp, Artificial
  CRISPR gRNA sequence
atgttctctcccaggctagg

SEQ ID NO: 605797 - DNA, 20 bp, Artificial
  CRISPR gRNA sequence
tgttctctcccaggctaggg

SEQ ID NO: 605798 - DNA, 20 bp, Artificial
  CRISPR gRNA sequence
ctcccaggctaggggggtct

SEQ ID NO: 605799 - DNA, 20 bp, Artificial
  CRISPR gRNA sequence
aggggggtctcagattcttc

SEQ ID NO: 605800 - DNA, 20 bp, Artificial
  CRISPR gRNA sequence
ggggggtctcagattcttcc

SEQ ID NO: 605801 - DNA, 20 bp, Artificial
  CRISPR gRNA sequence
ggtctcagattcttccagga

SEQ ID NO: 605802 - DNA, 20 bp, Artificial
  CRISPR gRNA sequence
tcagattcttccaggaaaga

SEQ ID NO: 605803 - DNA, 20 bp, Artificial
  CRISPR gRNA sequence
ttccaggaaagatggtaccc

SEQ ID NO: 605804 - DNA, 20 bp, Artificial
  CRISPR gRNA sequence
gaaagatggtaccctggtgt

SEQ ID NO: 605805 - DNA, 20 bp, Artificial
  CRISPR gRNA sequence
tggtaccctggtgtcagtgc

SEQ ID NO: 605806 - DNA, 20 bp, Artificial
  CRISPR gRNA sequence
tggtgtcagtgctggtacac

SEQ ID NO: 605807 - DNA, 20 bp, Artificial
  CRISPR gRNA sequence
agtgctggtacaccagcaaa

SEQ ID NO: 605808 - DNA, 20 bp, Artificial
  CRISPR gRNA sequence
accagcaaatagtacttaca

SEQ ID NO: 605809 - DNA, 20 bp, Artificial
  CRISPR gRNA sequence
ccagcaaatagtacttacat

SEQ ID NO: 605810 - DNA, 20 bp, Artificial
  CRISPR gRNA sequence
agtacttacatgggcccctg

SEQ ID NO: 605811 - DNA, 20 bp, Artificial
  CRISPR gRNA sequence
tacatgggcccctgaagcta

SEQ ID NO: 605812 - DNA, 20 bp, Artificial
  CRISPR gRNA sequence
atgggcccctgaagctatgg

SEQ ID NO: 605813 - DNA, 20 bp, Artificial
  CRISPR gRNA sequence
aagctatggtagtctcttgc

SEQ ID NO: 605814 - DNA, 20 bp, Artificial
  CRISPR gRNA sequence
ctctctcttgctattgcttg

SEQ ID NO: 605815 - DNA, 20 bp, Artificial
  CRISPR gRNA sequence
tctctcttgctattgcttgt

SEQ ID NO: 605816 - DNA, 20 bp, Artificial
  CRISPR gRNA sequence
gctattgcttgtgggaactg

SEQ ID NO: 605817 - DNA, 20 bp, Artificial
  CRISPR gRNA sequence
tgcagcctctctgctgttgc

SEQ ID NO: 605818 - DNA, 20 bp, Artificial
  CRISPR gRNA sequence
tctctgctgttgccagttta

SEQ ID NO: 605819 - DNA, 20 bp, Artificial
  CRISPR gRNA sequence
ttatagaattgttaaatacg

SEQ ID NO: 605820 - DNA, 20 bp, Artificial
  CRISPR gRNA sequence
tatcaccctatctttactcc

SEQ ID NO: 605821 - DNA, 20 bp, Artificial
  CRISPR gRNA sequence
tatctttactccaagcttca

SEQ ID NO: 605822 - DNA, 20 bp, Artificial
  CRISPR gRNA sequence
tccaagcttcatagctgtta

SEQ ID NO: 605823 - DNA, 20 bp, Artificial
  CRISPR gRNA sequence
aagcttcatagctgttatgg

SEQ ID NO: 605824 - DNA, 20 bp, Artificial
  CRISPR gRNA sequence
tcatagctgttatggtagat

SEQ ID NO: 605825 - DNA, 20 bp, Artificial
  CRISPR gRNA sequence
tagctgttatggtagattag

SEQ ID NO: 605826 - DNA, 20 bp, Artificial
  CRISPR gRNA sequence
atggtagattagtagcccct

SEQ ID NO: 605827 - DNA, 20 bp, Artificial
  CRISPR gRNA sequence
ccttagttactctttacctc

SEQ ID NO: 605828 - DNA, 20 bp, Artificial
  CRISPR gRNA sequence
acttatccttctgacatact

SEQ ID NO: 605829 - DNA, 20 bp, Artificial
  CRISPR gRNA sequence
tccttctgacatactcagca

SEQ ID NO: 605830 - DNA, 20 bp, Artificial
  CRISPR gRNA sequence
tctgacatactcagcatagt

SEQ ID NO: 605831 - DNA, 20 bp, Artificial
  CRISPR gRNA sequence
cctaattttatcactcccct

SEQ ID NO: 605832 - DNA, 20 bp, Artificial
  CRISPR gRNA sequence
taattttatcactcccctaa

SEQ ID NO: 605833 - DNA, 20 bp, Artificial
  CRISPR gRNA sequence
tttatcactcccctaagaga

SEQ ID NO: 605834 - DNA, 20 bp, Artificial
  CRISPR gRNA sequence
aagagatggaaatttgaacc

SEQ ID NO: 605835 - DNA, 20 bp, Artificial
  CRISPR gRNA sequence
ctgttaatccatacctttct

SEQ ID NO: 605836 - DNA, 20 bp, Artificial
  CRISPR gRNA sequence
atacctttctcagatgaact

SEQ ID NO: 605837 - DNA, 20 bp, Artificial
  CRISPR gRNA sequence
tacctttctcagatgaactc

SEQ ID NO: 605838 - DNA, 20 bp, Artificial
  CRISPR gRNA sequence
tcaggtttaccttttcccac

SEQ ID NO: 605839 - DNA, 20 bp, Artificial
  CRISPR gRNA sequence
ttttcacatgttcacatctc

SEQ ID NO: 605840 - DNA, 20 bp, Artificial
  CRISPR gRNA sequence
ttcacatgttcacatctctg

SEQ ID NO: 605841 - DNA, 20 bp, Artificial
  CRISPR gRNA sequence
ctctggagttctctcttgtg

SEQ ID NO: 605842 - DNA, 20 bp, Artificial
  CRISPR gRNA sequence
tcaaatcaaacatttcctct

SEQ ID NO: 605843 - DNA, 20 bp, Artificial
  CRISPR gRNA sequence
ttatatctcgattatatttc

SEQ ID NO: 605844 - DNA, 20 bp, Artificial
  CRISPR gRNA sequence
cttttactaacttcccaaat

SEQ ID NO: 605845 - DNA, 20 bp, Artificial
  CRISPR gRNA sequence
taagaatgaccttctgttct

SEQ ID NO: 605846 - DNA, 20 bp, Artificial
  CRISPR gRNA sequence
ttctgttcttagaatccaca

SEQ ID NO: 605847 - DNA, 20 bp, Artificial
  CRISPR gRNA sequence
tgttcttagaatccacatag

SEQ ID NO: 605848 - DNA, 20 bp, Artificial
  CRISPR gRNA sequence
gcttatgtcttataatgtat

SEQ ID NO: 605849 - DNA, 20 bp, Artificial
  CRISPR gRNA sequence
taatgtattagttcccgaac

SEQ ID NO: 605850 - DNA, 20 bp, Artificial
  CRISPR gRNA sequence
gtattagttcccgaactaga

SEQ ID NO: 605851 - DNA, 20 bp, Artificial
  CRISPR gRNA sequence
gttcccgaactagaaagttc

SEQ ID NO: 605852 - DNA, 20 bp, Artificial
  CRISPR gRNA sequence
ttcccgaactagaaagttca

SEQ ID NO: 605853 - DNA, 20 bp, Artificial
  CRISPR gRNA sequence
ctagaaagttcaaggtcatg

SEQ ID NO: 605854 - DNA, 20 bp, Artificial
  CRISPR gRNA sequence
gttgatctttcttcccaact

SEQ ID NO: 605855 - DNA, 20 bp, Artificial
  CRISPR gRNA sequence
ttgatctttcttcccaactt

SEQ ID NO: 605856 - DNA, 20 bp, Artificial
  CRISPR gRNA sequence
acttaggaaacctttgtgca

SEQ ID NO: 605857 - DNA, 20 bp, Artificial
  CRISPR gRNA sequence
aaagcatgcgatgtacaatg

SEQ ID NO: 605858 - DNA, 20 bp, Artificial
  CRISPR gRNA sequence
gtacaatgaagatttcttcc

SEQ ID NO: 605859 - DNA, 20 bp, Artificial
  CRISPR gRNA sequence
agatttcttccaagacaata

SEQ ID NO: 605860 - DNA, 20 bp, Artificial
  CRISPR gRNA sequence
ttcttccaagacaataaagc

SEQ ID NO: 605861 - DNA, 20 bp, Artificial
  CRISPR gRNA sequence
ttccaagacaataaagctag

SEQ ID NO: 605862 - DNA, 20 bp, Artificial
  CRISPR gRNA sequence
aaagctagtggttctgttat

SEQ ID NO: 605863 - DNA, 20 bp, Artificial
  CRISPR gRNA sequence
aagctagtggttctgttatt

SEQ ID NO: 605864 - DNA, 20 bp, Artificial
  CRISPR gRNA sequence
gttctgttattgggtatttc

SEQ ID NO: 605865 - DNA, 20 bp, Artificial
  CRISPR gRNA sequence
tatctaataaaatatttctt

SEQ ID NO: 605866 - DNA, 20 bp, Artificial
  CRISPR gRNA sequence
atctaataaaatatttcttg

SEQ ID NO: 605867 - DNA, 20 bp, Artificial
  CRISPR gRNA sequence
atatttcttgaggcttactt

SEQ ID NO: 605868 - DNA, 20 bp, Artificial
  CRISPR gRNA sequence
tatttcttgaggcttacttt

SEQ ID NO: 605869 - DNA, 20 bp, Artificial
  CRISPR gRNA sequence
tcttgaggcttactttgggt

SEQ ID NO: 605870 - DNA, 20 bp, Artificial
  CRISPR gRNA sequence
cttgaggcttactttgggtc

SEQ ID NO: 605871 - DNA, 20 bp, Artificial
  CRISPR gRNA sequence
cttactttgggtcaggcact

SEQ ID NO: 605872 - DNA, 20 bp, Artificial
  CRISPR gRNA sequence
caggcactaagcttgctcta

SEQ ID NO: 605873 - DNA, 20 bp, Artificial
  CRISPR gRNA sequence
gcactaagcttgctctacag

SEQ ID NO: 605874 - DNA, 20 bp, Artificial
  CRISPR gRNA sequence
ctctacagcagtgaacaaaa

SEQ ID NO: 605875 - DNA, 20 bp, Artificial
  CRISPR gRNA sequence
cagcagtgaacaaaacagac

SEQ ID NO: 605876 - DNA, 20 bp, Artificial
  CRISPR gRNA sequence
agcagtgaacaaaacagaca

SEQ ID NO: 605877 - DNA, 20 bp, Artificial
  CRISPR gRNA sequence
cagacaaggctctatcctta

SEQ ID NO: 605878 - DNA, 20 bp, Artificial
  CRISPR gRNA sequence
gacaaggctctatccttata

SEQ ID NO: 605879 - DNA, 20 bp, Artificial
  CRISPR gRNA sequence
ctctatccttatagagctta

SEQ ID NO: 605880 - DNA, 20 bp, Artificial
  CRISPR gRNA sequence
cttatagagcttacagttga

SEQ ID NO: 605881 - DNA, 20 bp, Artificial
  CRISPR gRNA sequence
atagagcttacagttgaaag

SEQ ID NO: 605882 - DNA, 20 bp, Artificial
  CRISPR gRNA sequence
aaagaagacattaaaaatgt

SEQ ID NO: 605883 - DNA, 20 bp, Artificial
  CRISPR gRNA sequence
aaaaatgtaagcacatatat

SEQ ID NO: 605884 - DNA, 20 bp, Artificial
  CRISPR gRNA sequence
aagtatgtaataatttatat

SEQ ID NO: 605885 - DNA, 20 bp, Artificial
  CRISPR gRNA sequence
atgctgtaaaataaaaataa

SEQ ID NO: 605886 - DNA, 20 bp, Artificial
  CRISPR gRNA sequence
tgctgtaaaataaaaataat

SEQ ID NO: 605887 - DNA, 20 bp, Artificial
  CRISPR gRNA sequence
aataggacattataattaaa

SEQ ID NO: 605888 - DNA, 20 bp, Artificial
  CRISPR gRNA sequence
attataattaaaaagaacat

SEQ ID NO: 605889 - DNA, 20 bp, Artificial
  CRISPR gRNA sequence
ttataattaaaaagaacatc

SEQ ID NO: 605890 - DNA, 20 bp, Artificial
  CRISPR gRNA sequence
taaaaagaacatcgggtcct

SEQ ID NO: 605891 - DNA, 20 bp, Artificial
  CRISPR gRNA sequence
cttagtttatattgacgatt

SEQ ID NO: 605892 - DNA, 20 bp, Artificial
  CRISPR gRNA sequence
tagtttatattgacgattta

SEQ ID NO: 605893 - DNA, 20 bp, Artificial
  CRISPR gRNA sequence
ttatattgacgatttagagt

SEQ ID NO: 605894 - DNA, 20 bp, Artificial
  CRISPR gRNA sequence
agtaagtgaaatttaaacta

SEQ ID NO: 605895 - DNA, 20 bp, Artificial
  CRISPR gRNA sequence
taagtgaaatttaaactata

SEQ ID NO: 605896 - DNA, 20 bp, Artificial
  CRISPR gRNA sequence
aagtgaaatttaaactatag

SEQ ID NO: 605897 - DNA, 20 bp, Artificial
  CRISPR gRNA sequence
gtgaaatttaaactatagag

SEQ ID NO: 605898 - DNA, 20 bp, Artificial
  CRISPR gRNA sequence
tgaaatttaaactatagagg

SEQ ID NO: 605899 - DNA, 20 bp, Artificial
  CRISPR gRNA sequence
atttaaactatagaggaggt

SEQ ID NO: 605900 - DNA, 20 bp, Artificial
  CRISPR gRNA sequence
tttaaactatagaggaggta

SEQ ID NO: 605901 - DNA, 20 bp, Artificial
  CRISPR gRNA sequence
taaactatagaggaggtaag

SEQ ID NO: 605902 - DNA, 20 bp, Artificial
  CRISPR gRNA sequence
actatagaggaggtaaggag

SEQ ID NO: 605903 - DNA, 20 bp, Artificial
  CRISPR gRNA sequence
ctatagaggaggtaaggagt

SEQ ID NO: 605904 - DNA, 20 bp, Artificial
  CRISPR gRNA sequence
tatagaggaggtaaggagtg

SEQ ID NO: 605905 - DNA, 20 bp, Artificial
  CRISPR gRNA sequence
atagaggaggtaaggagtgg

SEQ ID NO: 605906 - DNA, 20 bp, Artificial
  CRISPR gRNA sequence
ggtaaggagtgggggccact

SEQ ID NO: 605907 - DNA, 20 bp, Artificial
  CRISPR gRNA sequence
aggagtgggggccactcaga

SEQ ID NO: 605908 - DNA, 20 bp, Artificial
  CRISPR gRNA sequence
agtgggggccactcagatag

SEQ ID NO: 605909 - DNA, 20 bp, Artificial
  CRISPR gRNA sequence
gggggccactcagatagcag

SEQ ID NO: 605910 - DNA, 20 bp, Artificial
  CRISPR gRNA sequence
gggccactcagatagcagta

SEQ ID NO: 605911 - DNA, 20 bp, Artificial
  CRISPR gRNA sequence
ctcagatagcagtagagtat

SEQ ID NO: 605912 - DNA, 20 bp, Artificial
  CRISPR gRNA sequence
cagatagcagtagagtatga

SEQ ID NO: 605913 - DNA, 20 bp, Artificial
  CRISPR gRNA sequence
gagaccattgtatatgtgca

SEQ ID NO: 605914 - DNA, 20 bp, Artificial
  CRISPR gRNA sequence
agaccattgtatatgtgcaa

SEQ ID NO: 605915 - DNA, 20 bp, Artificial
  CRISPR gRNA sequence
gtatatgtgcaaaggccccg

SEQ ID NO: 605916 - DNA, 20 bp, Artificial
  CRISPR gRNA sequence
tatgtgcaaaggccccgcag

SEQ ID NO: 605917 - DNA, 20 bp, Artificial
  CRISPR gRNA sequence
atgtgcaaaggccccgcagc

SEQ ID NO: 605918 - DNA, 20 bp, Artificial
  CRISPR gRNA sequence
aaaggccccgcagcaggaaa

SEQ ID NO: 605919 - DNA, 20 bp, Artificial
  CRISPR gRNA sequence
gccccgcagcaggaaaaagt

SEQ ID NO: 605920 - DNA, 20 bp, Artificial
  CRISPR gRNA sequence
cttttataatatgttcacca

SEQ ID NO: 605921 - DNA, 20 bp, Artificial
  CRISPR gRNA sequence
tatgttcaccaaagaactga

SEQ ID NO: 605922 - DNA, 20 bp, Artificial
  CRISPR gRNA sequence
gttcaccaaagaactgaaag

SEQ ID NO: 605923 - DNA, 20 bp, Artificial
  CRISPR gRNA sequence
ttcaccaaagaactgaaaga

SEQ ID NO: 605924 - DNA, 20 bp, Artificial
  CRISPR gRNA sequence
agaactgaaagaaggcctgt

SEQ ID NO: 605925 - DNA, 20 bp, Artificial
  CRISPR gRNA sequence
gaaggcctgtgagcctgcta

SEQ ID NO: 605926 - DNA, 20 bp, Artificial
  CRISPR gRNA sequence
aggcctgtgagcctgctatg

SEQ ID NO: 605927 - DNA, 20 bp, Artificial
  CRISPR gRNA sequence
ggcctgtgagcctgctatgg

SEQ ID NO: 605928 - DNA, 20 bp, Artificial
  CRISPR gRNA sequence
gcctgtgagcctgctatgga

SEQ ID NO: 605929 - DNA, 20 bp, Artificial
  CRISPR gRNA sequence
ctgtgagcctgctatggagg

SEQ ID NO: 605930 - DNA, 20 bp, Artificial
  CRISPR gRNA sequence
gagcctgctatggagggaga

SEQ ID NO: 605931 - DNA, 20 bp, Artificial
  CRISPR gRNA sequence
gcctgctatggagggagatg

SEQ ID NO: 605932 - DNA, 20 bp, Artificial
  CRISPR gRNA sequence
tgctatggagggagatggag

SEQ ID NO: 605933 - DNA, 20 bp, Artificial
  CRISPR gRNA sequence
ggagtggctcatgatgtatc

SEQ ID NO: 605934 - DNA, 20 bp, Artificial
  CRISPR gRNA sequence
agtggctcatgatgtatctg

SEQ ID NO: 605935 - DNA, 20 bp, Artificial
  CRISPR gRNA sequence
tggctcatgatgtatctgga

SEQ ID NO: 605936 - DNA, 20 bp, Artificial
  CRISPR gRNA sequence
ggctcatgatgtatctggag

SEQ ID NO: 605937 - DNA, 20 bp, Artificial
  CRISPR gRNA sequence
catgatgtatctggagaggt

SEQ ID NO: 605938 - DNA, 20 bp, Artificial
  CRISPR gRNA sequence
gatgtatctggagaggtgag

SEQ ID NO: 605939 - DNA, 20 bp, Artificial
  CRISPR gRNA sequence
atgtatctggagaggtgaga

SEQ ID NO: 605940 - DNA, 20 bp, Artificial
  CRISPR gRNA sequence
gtatctggagaggtgagaag

SEQ ID NO: 605941 - DNA, 20 bp, Artificial
  CRISPR gRNA sequence
gtaatatactttattttttt

SEQ ID NO: 605942 - DNA, 20 bp, Artificial
  CRISPR gRNA sequence
taatatactttatttttttg

SEQ ID NO: 605943 - DNA, 20 bp, Artificial
  CRISPR gRNA sequence
actttatttttttgaggatt

SEQ ID NO: 605944 - DNA, 20 bp, Artificial
  CRISPR gRNA sequence
ctttatttttttgaggattt

SEQ ID NO: 605945 - DNA, 20 bp, Artificial
  CRISPR gRNA sequence
tttatttttttgaggatttg

SEQ ID NO: 605946 - DNA, 20 bp, Artificial
  CRISPR gRNA sequence
atttttttgaggatttgggg

SEQ ID NO: 605947 - DNA, 20 bp, Artificial
  CRISPR gRNA sequence
gaggatttggggaagaattt

SEQ ID NO: 605948 - DNA, 20 bp, Artificial
  CRISPR gRNA sequence
attttggatttttatcctaa

SEQ ID NO: 605949 - DNA, 20 bp, Artificial
  CRISPR gRNA sequence
gcaacaaacaactattgaaa

SEQ ID NO: 605950 - DNA, 20 bp, Artificial
  CRISPR gRNA sequence
aatagtgttgaacactgact

SEQ ID NO: 605951 - DNA, 20 bp, Artificial
  CRISPR gRNA sequence
agtgttgaacactgacttgg

SEQ ID NO: 605952 - DNA, 20 bp, Artificial
  CRISPR gRNA sequence
aatttgatttatgatttttt

SEQ ID NO: 605953 - DNA, 20 bp, Artificial
  CRISPR gRNA sequence
atttgatttatgattttttt

SEQ ID NO: 605954 - DNA, 20 bp, Artificial
  CRISPR gRNA sequence
tttatgatttttttaggtgt

SEQ ID NO: 605955 - DNA, 20 bp, Artificial
  CRISPR gRNA sequence
ttatgatttttttaggtgtt

SEQ ID NO: 605956 - DNA, 20 bp, Artificial
  CRISPR gRNA sequence
tgatttttttaggtgttggg

SEQ ID NO: 605957 - DNA, 20 bp, Artificial
  CRISPR gRNA sequence
gatttttttaggtgttgggt

SEQ ID NO: 605958 - DNA, 20 bp, Artificial
  CRISPR gRNA sequence
atttttttaggtgttgggtg

SEQ ID NO: 605959 - DNA, 20 bp, Artificial
  CRISPR gRNA sequence
ttttttaggtgttgggtggg

SEQ ID NO: 605960 - DNA, 20 bp, Artificial
  CRISPR gRNA sequence
tttaggtgttgggtggggag

SEQ ID NO: 605961 - DNA, 20 bp, Artificial
  CRISPR gRNA sequence
taggtgttgggtggggagaa

SEQ ID NO: 605962 - DNA, 20 bp, Artificial
  CRISPR gRNA sequence
gtgttgggtggggagaagag

SEQ ID NO: 605963 - DNA, 20 bp, Artificial
  CRISPR gRNA sequence
gaagagcagatatttaaatc

SEQ ID NO: 605964 - DNA, 20 bp, Artificial
  CRISPR gRNA sequence
gagcagatatttaaatctag

SEQ ID NO: 605965 - DNA, 20 bp, Artificial
  CRISPR gRNA sequence
tattacttgaataactttct

SEQ ID NO: 605966 - DNA, 20 bp, Artificial
  CRISPR gRNA sequence
cttgaataactttcttagtt

SEQ ID NO: 605967 - DNA, 20 bp, Artificial
  CRISPR gRNA sequence
ctttcttagtttagcaaata

SEQ ID NO: 605968 - DNA, 20 bp, Artificial
  CRISPR gRNA sequence
ttcttagtttagcaaatata

SEQ ID NO: 605969 - DNA, 20 bp, Artificial
  CRISPR gRNA sequence
ttagtttagcaaatatagag

SEQ ID NO: 605970 - DNA, 20 bp, Artificial
  CRISPR gRNA sequence
tagtttagcaaatatagagc

SEQ ID NO: 605971 - DNA, 20 bp, Artificial
  CRISPR gRNA sequence
caggtacacaatcattgtca

SEQ ID NO: 605972 - DNA, 20 bp, Artificial
  CRISPR gRNA sequence
ggtacacaatcattgtcata

SEQ ID NO: 605973 - DNA, 20 bp, Artificial
  CRISPR gRNA sequence
acacaatcattgtcatagag

SEQ ID NO: 605974 - DNA, 20 bp, Artificial
  CRISPR gRNA sequence
aaactttctgacttcattaa

SEQ ID NO: 605975 - DNA, 20 bp, Artificial
  CRISPR gRNA sequence
ctttctgacttcattaatag

SEQ ID NO: 605976 - DNA, 20 bp, Artificial
  CRISPR gRNA sequence
atagaagtctgccactccct

SEQ ID NO: 605977 - DNA, 20 bp, Artificial
  CRISPR gRNA sequence
cacttgtattctgctctgta

SEQ ID NO: 605978 - DNA, 20 bp, Artificial
  CRISPR gRNA sequence
tgtattctgctctgtaaagc

SEQ ID NO: 605979 - DNA, 20 bp, Artificial
  CRISPR gRNA sequence
tgctctgtaaagctggttcc

SEQ ID NO: 605980 - DNA, 20 bp, Artificial
  CRISPR gRNA sequence
gctctgtaaagctggttcct

SEQ ID NO: 605981 - DNA, 20 bp, Artificial
  CRISPR gRNA sequence
ctctgtaaagctggttcctg

SEQ ID NO: 605982 - DNA, 20 bp, Artificial
  CRISPR gRNA sequence
ctgtaaagctggttcctggg

SEQ ID NO: 605983 - DNA, 20 bp, Artificial
  CRISPR gRNA sequence
tgtaaagctggttcctgggg

SEQ ID NO: 605984 - DNA, 20 bp, Artificial
  CRISPR gRNA sequence
taaagctggttcctggggag

SEQ ID NO: 605985 - DNA, 20 bp, Artificial
  CRISPR gRNA sequence
ctggttcctggggaggagat

SEQ ID NO: 605986 - DNA, 20 bp, Artificial
  CRISPR gRNA sequence
gggaggagatcagtttacac

SEQ ID NO: 605987 - DNA, 20 bp, Artificial
  CRISPR gRNA sequence
atcagtttacacaagatgtc

SEQ ID NO: 605988 - DNA, 20 bp, Artificial
  CRISPR gRNA sequence
acaagatgtccagcgccttc

SEQ ID NO: 605989 - DNA, 20 bp, Artificial
  CRISPR gRNA sequence
caagatgtccagcgccttct

SEQ ID NO: 605990 - DNA, 20 bp, Artificial
  CRISPR gRNA sequence
agatgtccagcgccttctgg

SEQ ID NO: 605991 - DNA, 20 bp, Artificial
  CRISPR gRNA sequence
atgtccagcgccttctggga

SEQ ID NO: 605992 - DNA, 20 bp, Artificial
  CRISPR gRNA sequence
ccagcgccttctgggagaga

SEQ ID NO: 605993 - DNA, 20 bp, Artificial
  CRISPR gRNA sequence
ggagagaaagaactaatacc

SEQ ID NO: 605994 - DNA, 20 bp, Artificial
  CRISPR gRNA sequence
atacctagtctctgctgaca

SEQ ID NO: 605995 - DNA, 20 bp, Artificial
  CRISPR gRNA sequence
acctagtctctgctgacata

SEQ ID NO: 605996 - DNA, 20 bp, Artificial
  CRISPR gRNA sequence
tctgctgacatagagctgtg

SEQ ID NO: 605997 - DNA, 20 bp, Artificial
  CRISPR gRNA sequence
gtgtggcactgactcaatcc

SEQ ID NO: 605998 - DNA, 20 bp, Artificial
  CRISPR gRNA sequence
actgactcaatcccagtctc

SEQ ID NO: 605999 - DNA, 20 bp, Artificial
  CRISPR gRNA sequence
actcaatcccagtctctgga

SEQ ID NO: 606000 - DNA, 20 bp, Artificial
  CRISPR gRNA sequence
ctcaatcccagtctctggaa

SEQ ID NO: 606001 - DNA, 20 bp, Artificial
  CRISPR gRNA sequence
tcaatcccagtctctggaaa

SEQ ID NO: 606002 - DNA, 20 bp, Artificial
  CRISPR gRNA sequence
cagtctctggaaagggcaat

SEQ ID NO: 606003 - DNA, 20 bp, Artificial
  CRISPR gRNA sequence
gcaatgagattcctgaaatg

SEQ ID NO: 606004 - DNA, 20 bp, Artificial
  CRISPR gRNA sequence
tcctgaaatgaagttacatt

SEQ ID NO: 606005 - DNA, 20 bp, Artificial
  CRISPR gRNA sequence
cctgaaatgaagttacattg

SEQ ID NO: 606006 - DNA, 20 bp, Artificial
  CRISPR gRNA sequence
aaatgaagttacattgagga

SEQ ID NO: 606007 - DNA, 20 bp, Artificial
  CRISPR gRNA sequence
gaagttacattgaggacaga

SEQ ID NO: 606008 - DNA, 20 bp, Artificial
  CRISPR gRNA sequence
aagttacattgaggacagaa

SEQ ID NO: 606009 - DNA, 20 bp, Artificial
  CRISPR gRNA sequence
agttacattgaggacagaaa

SEQ ID NO: 606010 - DNA, 20 bp, Artificial
  CRISPR gRNA sequence
gttacattgaggacagaaag

SEQ ID NO: 606011 - DNA, 20 bp, Artificial
  CRISPR gRNA sequence
acagaaaggggtaccccacc

SEQ ID NO: 606012 - DNA, 20 bp, Artificial
  CRISPR gRNA sequence
ccacctggcaaccaacattc

SEQ ID NO: 606013 - DNA, 20 bp, Artificial
  CRISPR gRNA sequence
acctggcaaccaacattcaa

SEQ ID NO: 606014 - DNA, 20 bp, Artificial
  CRISPR gRNA sequence
gagaaacccttttgaactca

SEQ ID NO: 606015 - DNA, 20 bp, Artificial
  CRISPR gRNA sequence
agaaacccttttgaactcat

SEQ ID NO: 606016 - DNA, 20 bp, Artificial
  CRISPR gRNA sequence
gaaacccttttgaactcatg

SEQ ID NO: 606017 - DNA, 20 bp, Artificial
  CRISPR gRNA sequence
tgaactcatggggctgatga

SEQ ID NO: 606018 - DNA, 20 bp, Artificial
  CRISPR gRNA sequence
aattttgtatatgctgtcat

SEQ ID NO: 606019 - DNA, 20 bp, Artificial
  CRISPR gRNA sequence
tgtatatgctgtcatcagtg

SEQ ID NO: 606020 - DNA, 20 bp, Artificial
  CRISPR gRNA sequence
tatgctgtcatcagtgtagt

SEQ ID NO: 606021 - DNA, 20 bp, Artificial
  CRISPR gRNA sequence
catcagtgtagttagtacct

SEQ ID NO: 606022 - DNA, 20 bp, Artificial
  CRISPR gRNA sequence
atcagtgtagttagtacctt

SEQ ID NO: 606023 - DNA, 20 bp, Artificial
  CRISPR gRNA sequence
tcagtgtagttagtacctta

SEQ ID NO: 606024 - DNA, 20 bp, Artificial
  CRISPR gRNA sequence
gtgtagttagtaccttaggg

SEQ ID NO: 606025 - DNA, 20 bp, Artificial
  CRISPR gRNA sequence
gttagtaccttagggaagaa

SEQ ID NO: 606026 - DNA, 20 bp, Artificial
  CRISPR gRNA sequence
gtaccttagggaagaacagc

SEQ ID NO: 606027 - DNA, 20 bp, Artificial
  CRISPR gRNA sequence
tagggaagaacagctggtaa

SEQ ID NO: 606028 - DNA, 20 bp, Artificial
  CRISPR gRNA sequence
ggaagaacagctggtaatgg

SEQ ID NO: 606029 - DNA, 20 bp, Artificial
  CRISPR gRNA sequence
ggtaatggtagttgcaaaca

SEQ ID NO: 606030 - DNA, 20 bp, Artificial
  CRISPR gRNA sequence
aatggtagttgcaaacacag

SEQ ID NO: 606031 - DNA, 20 bp, Artificial
  CRISPR gRNA sequence
ggtagttgcaaacacagaag

SEQ ID NO: 606032 - DNA, 20 bp, Artificial
  CRISPR gRNA sequence
tagttgcaaacacagaagta

SEQ ID NO: 606033 - DNA, 20 bp, Artificial
  CRISPR gRNA sequence
gaagtagagcacccttgact

SEQ ID NO: 606034 - DNA, 20 bp, Artificial
  CRISPR gRNA sequence
tagagcacccttgactgagc

SEQ ID NO: 606035 - DNA, 20 bp, Artificial
  CRISPR gRNA sequence
agagcacccttgactgagct

SEQ ID NO: 606036 - DNA, 20 bp, Artificial
  CRISPR gRNA sequence
cttgactgagctgggcacca

SEQ ID NO: 606037 - DNA, 20 bp, Artificial
  CRISPR gRNA sequence
ttgactgagctgggcaccaa

SEQ ID NO: 606038 - DNA, 20 bp, Artificial
  CRISPR gRNA sequence
gagctgggcaccaaaggaaa

SEQ ID NO: 606039 - DNA, 20 bp, Artificial
  CRISPR gRNA sequence
agctgggcaccaaaggaaac

SEQ ID NO: 606040 - DNA, 20 bp, Artificial
  CRISPR gRNA sequence
aggaaacaggatcatcactg

SEQ ID NO: 606041 - DNA, 20 bp, Artificial
  CRISPR gRNA sequence
gatcatcactgtggctcgaa

SEQ ID NO: 606042 - DNA, 20 bp, Artificial
  CRISPR gRNA sequence
atcatcactgtggctcgaac

SEQ ID NO: 606043 - DNA, 20 bp, Artificial
  CRISPR gRNA sequence
tcatcactgtggctcgaaca

SEQ ID NO: 606044 - DNA, 20 bp, Artificial
  CRISPR gRNA sequence
tcactgtggctcgaacaggg

SEQ ID NO: 606045 - DNA, 20 bp, Artificial
  CRISPR gRNA sequence
ctgtggctcgaacagggcgg

SEQ ID NO: 606046 - DNA, 20 bp, Artificial
  CRISPR gRNA sequence
tgtggctcgaacagggcggt

SEQ ID NO: 606047 - DNA, 20 bp, Artificial
  CRISPR gRNA sequence
gctcgaacagggcggtggga

SEQ ID NO: 606048 - DNA, 20 bp, Artificial
  CRISPR gRNA sequence
gcggtgggatggtaccatca

SEQ ID NO: 606049 - DNA, 20 bp, Artificial
  CRISPR gRNA sequence
cggtgggatggtaccatcac

SEQ ID NO: 606050 - DNA, 20 bp, Artificial
  CRISPR gRNA sequence
ggtgggatggtaccatcaca

SEQ ID NO: 606051 - DNA, 20 bp, Artificial
  CRISPR gRNA sequence
gtgggatggtaccatcacag

SEQ ID NO: 606052 - DNA, 20 bp, Artificial
  CRISPR gRNA sequence
tgggatggtaccatcacagg

SEQ ID NO: 606053 - DNA, 20 bp, Artificial
  CRISPR gRNA sequence
gggatggtaccatcacaggg

SEQ ID NO: 606054 - DNA, 20 bp, Artificial
  CRISPR gRNA sequence
acaggggggactaacattgt

SEQ ID NO: 606055 - DNA, 20 bp, Artificial
  CRISPR gRNA sequence
caggggggactaacattgtt

SEQ ID NO: 606056 - DNA, 20 bp, Artificial
  CRISPR gRNA sequence
ctaacattgttgggtgataa

SEQ ID NO: 606057 - DNA, 20 bp, Artificial
  CRISPR gRNA sequence
attgttgggtgataaaagac

SEQ ID NO: 606058 - DNA, 20 bp, Artificial
  CRISPR gRNA sequence
gttgggtgataaaagaccag

SEQ ID NO: 606059 - DNA, 20 bp, Artificial
  CRISPR gRNA sequence
aagaccagtagccttgtgaa

SEQ ID NO: 606060 - DNA, 20 bp, Artificial
  CRISPR gRNA sequence
accagtagccttgtgaatag

SEQ ID NO: 606061 - DNA, 20 bp, Artificial
  CRISPR gRNA sequence
tgtgaatagcagattaatta

SEQ ID NO: 606062 - DNA, 20 bp, Artificial
  CRISPR gRNA sequence
tggtttaccaactctctgcg

SEQ ID NO: 606063 - DNA, 20 bp, Artificial
  CRISPR gRNA sequence
taccaactctctgcgtggca

SEQ ID NO: 606064 - DNA, 20 bp, Artificial
  CRISPR gRNA sequence
tctctgcgtggcatggtatg

SEQ ID NO: 606065 - DNA, 20 bp, Artificial
  CRISPR gRNA sequence
gtggcatggtatgtagactg

SEQ ID NO: 606066 - DNA, 20 bp, Artificial
  CRISPR gRNA sequence
tggtatgtagactgaagttc

SEQ ID NO: 606067 - DNA, 20 bp, Artificial
  CRISPR gRNA sequence
ggtatgtagactgaagttct

SEQ ID NO: 606068 - DNA, 20 bp, Artificial
  CRISPR gRNA sequence
gtatgtagactgaagttctg

SEQ ID NO: 606069 - DNA, 20 bp, Artificial
  CRISPR gRNA sequence
gtagactgaagttctggggc

SEQ ID NO: 606070 - DNA, 20 bp, Artificial
  CRISPR gRNA sequence
actgaagttctggggcaagt

SEQ ID NO: 606071 - DNA, 20 bp, Artificial
  CRISPR gRNA sequence
tctggggcaagtgagaactc

SEQ ID NO: 606072 - DNA, 20 bp, Artificial
  CRISPR gRNA sequence
gggcaagtgagaactctagc

SEQ ID NO: 606073 - DNA, 20 bp, Artificial
  CRISPR gRNA sequence
actctagccagctatatttg

SEQ ID NO: 606074 - DNA, 20 bp, Artificial
  CRISPR gRNA sequence
accataactgtacattgaaa

SEQ ID NO: 606075 - DNA, 20 bp, Artificial
  CRISPR gRNA sequence
ataactgtacattgaaatgg

SEQ ID NO: 606076 - DNA, 20 bp, Artificial
  CRISPR gRNA sequence
aactgtacattgaaatggta

SEQ ID NO: 606077 - DNA, 20 bp, Artificial
  CRISPR gRNA sequence
actgtacattgaaatggtag

SEQ ID NO: 606078 - DNA, 20 bp, Artificial
  CRISPR gRNA sequence
tgtacattgaaatggtagag

SEQ ID NO: 606079 - DNA, 20 bp, Artificial
  CRISPR gRNA sequence
gtacattgaaatggtagagg

SEQ ID NO: 606080 - DNA, 20 bp, Artificial
  CRISPR gRNA sequence
aatggtagaggaggttatta

SEQ ID NO: 606081 - DNA, 20 bp, Artificial
  CRISPR gRNA sequence
agaggaggttattatggtta

SEQ ID NO: 606082 - DNA, 20 bp, Artificial
  CRISPR gRNA sequence
attatggttacagtttataa

SEQ ID NO: 606083 - DNA, 20 bp, Artificial
  CRISPR gRNA sequence
tggttacagtttataaaaga

SEQ ID NO: 606084 - DNA, 20 bp, Artificial
  CRISPR gRNA sequence
agtttataaaagatagctta

SEQ ID NO: 606085 - DNA, 20 bp, Artificial
  CRISPR gRNA sequence
gtttataaaagatagcttat

SEQ ID NO: 606086 - DNA, 20 bp, Artificial
  CRISPR gRNA sequence
ataaaagatagcttataggc

SEQ ID NO: 606087 - DNA, 20 bp, Artificial
  CRISPR gRNA sequence
taaaagatagcttataggcc

SEQ ID NO: 606088 - DNA, 20 bp, Artificial
  CRISPR gRNA sequence
gatagcttataggccaggca

SEQ ID NO: 606089 - DNA, 20 bp, Artificial
  CRISPR gRNA sequence
agcttataggccaggcacag

SEQ ID NO: 606090 - DNA, 20 bp, Artificial
  CRISPR gRNA sequence
agtggctcacactgtaatct

SEQ ID NO: 606091 - DNA, 20 bp, Artificial
  CRISPR gRNA sequence
acactgtaatctcagcattt

SEQ ID NO: 606092 - DNA, 20 bp, Artificial
  CRISPR gRNA sequence
cactgtaatctcagcatttt

SEQ ID NO: 606093 - DNA, 20 bp, Artificial
  CRISPR gRNA sequence
ctgtaatctcagcattttgg

SEQ ID NO: 606094 - DNA, 20 bp, Artificial
  CRISPR gRNA sequence
tgtaatctcagcattttggg

SEQ ID NO: 606095 - DNA, 20 bp, Artificial
  CRISPR gRNA sequence
tctcagcattttgggaggcc

SEQ ID NO: 606096 - DNA, 20 bp, Artificial
  CRISPR gRNA sequence
ctcagcattttgggaggcca

SEQ ID NO: 606097 - DNA, 20 bp, Artificial
  CRISPR gRNA sequence
agcattttgggaggccaagg

SEQ ID NO: 606098 - DNA, 20 bp, Artificial
  CRISPR gRNA sequence
gcattttgggaggccaaggc

SEQ ID NO: 606099 - DNA, 20 bp, Artificial
  CRISPR gRNA sequence
attttgggaggccaaggcag

SEQ ID NO: 606100 - DNA, 20 bp, Artificial
  CRISPR gRNA sequence
ccaaggcaggagaactgctt

SEQ ID NO: 606101 - DNA, 20 bp, Artificial
  CRISPR gRNA sequence
ggagaactgctttagtctca

SEQ ID NO: 606102 - DNA, 20 bp, Artificial
  CRISPR gRNA sequence
ttagtctcaaagttcaaaac

SEQ ID NO: 606103 - DNA, 20 bp, Artificial
  CRISPR gRNA sequence
ctcaaagttcaaaactagtc

SEQ ID NO: 606104 - DNA, 20 bp, Artificial
  CRISPR gRNA sequence
tcaaagttcaaaactagtct

SEQ ID NO: 606105 - DNA, 20 bp, Artificial
  CRISPR gRNA sequence
caaaactagtctgggcaaca

SEQ ID NO: 606106 - DNA, 20 bp, Artificial
  CRISPR gRNA sequence
aaaactagtctgggcaacat

SEQ ID NO: 606107 - DNA, 20 bp, Artificial
  CRISPR gRNA sequence
aaactagtctgggcaacata

SEQ ID NO: 606108 - DNA, 20 bp, Artificial
  CRISPR gRNA sequence
actagtctgggcaacatagg

SEQ ID NO: 606109 - DNA, 20 bp, Artificial
  CRISPR gRNA sequence
acaaaataattattttaaat

SEQ ID NO: 606110 - DNA, 20 bp, Artificial
  CRISPR gRNA sequence
aataattattttaaattagc

SEQ ID NO: 606111 - DNA, 20 bp, Artificial
  CRISPR gRNA sequence
ataattattttaaattagct

SEQ ID NO: 606112 - DNA, 20 bp, Artificial
  CRISPR gRNA sequence
tattttaaattagctaggtg

SEQ ID NO: 606113 - DNA, 20 bp, Artificial
  CRISPR gRNA sequence
tttaaattagctaggtgtgg

SEQ ID NO: 606114 - DNA, 20 bp, Artificial
  CRISPR gRNA sequence
ggtgtggtggtgtgcatatg

SEQ ID NO: 606115 - DNA, 20 bp, Artificial
  CRISPR gRNA sequence
gtggtgtgcatatgtggttc

SEQ ID NO: 606116 - DNA, 20 bp, Artificial
  CRISPR gRNA sequence
catatgtggttccagcgact

SEQ ID NO: 606117 - DNA, 20 bp, Artificial
  CRISPR gRNA sequence
atatgtggttccagcgactc

SEQ ID NO: 606118 - DNA, 20 bp, Artificial
  CRISPR gRNA sequence
atgtggttccagcgactcag

SEQ ID NO: 606119 - DNA, 20 bp, Artificial
  CRISPR gRNA sequence
ttccagcgactcaggagact

SEQ ID NO: 606120 - DNA, 20 bp, Artificial
  CRISPR gRNA sequence
tccagcgactcaggagactg

SEQ ID NO: 606121 - DNA, 20 bp, Artificial
  CRISPR gRNA sequence
cagcgactcaggagactgag

SEQ ID NO: 606122 - DNA, 20 bp, Artificial
  CRISPR gRNA sequence
agcgactcaggagactgagg

SEQ ID NO: 606123 - DNA, 20 bp, Artificial
  CRISPR gRNA sequence
gcgactcaggagactgagga

SEQ ID NO: 606124 - DNA, 20 bp, Artificial
  CRISPR gRNA sequence
actcaggagactgaggaggg

SEQ ID NO: 606125 - DNA, 20 bp, Artificial
  CRISPR gRNA sequence
ctgaggagggaagatcactt

SEQ ID NO: 606126 - DNA, 20 bp, Artificial
  CRISPR gRNA sequence
gagggaagatcacttaagcc

SEQ ID NO: 606127 - DNA, 20 bp, Artificial
  CRISPR gRNA sequence
agggaagatcacttaagccc

SEQ ID NO: 606128 - DNA, 20 bp, Artificial
  CRISPR gRNA sequence
gaagatcacttaagcccagg

SEQ ID NO: 606129 - DNA, 20 bp, Artificial
  CRISPR gRNA sequence
agcccaggaagtcgatgctg

SEQ ID NO: 606130 - DNA, 20 bp, Artificial
  CRISPR gRNA sequence
caggaagtcgatgctgcagt

SEQ ID NO: 606131 - DNA, 20 bp, Artificial
  CRISPR gRNA sequence
ttgattgtgctactgcactc

SEQ ID NO: 606132 - DNA, 20 bp, Artificial
  CRISPR gRNA sequence
tgtgctactgcactccagcc

SEQ ID NO: 606133 - DNA, 20 bp, Artificial
  CRISPR gRNA sequence
gtgctactgcactccagcct

SEQ ID NO: 606134 - DNA, 20 bp, Artificial
  CRISPR gRNA sequence
ctgcactccagcctgggcaa

SEQ ID NO: 606135 - DNA, 20 bp, Artificial
  CRISPR gRNA sequence
gcactccagcctgggcaaca

SEQ ID NO: 606136 - DNA, 20 bp, Artificial
  CRISPR gRNA sequence
tccagcctgggcaacagagt

SEQ ID NO: 606137 - DNA, 20 bp, Artificial
  CRISPR gRNA sequence
gtgagaccctgtctcaaaaa

SEQ ID NO: 606138 - DNA, 20 bp, Artificial
  CRISPR gRNA sequence
atgtgcatgtatacaaatac

SEQ ID NO: 606139 - DNA, 20 bp, Artificial
  CRISPR gRNA sequence
tactagtataataaataaaa

SEQ ID NO: 606140 - DNA, 20 bp, Artificial
  CRISPR gRNA sequence
tataataaacaaaaaataat

SEQ ID NO: 606141 - DNA, 20 bp, Artificial
  CRISPR gRNA sequence
gtaaataaattaaataaaaa

SEQ ID NO: 606142 - DNA, 20 bp, Artificial
  CRISPR gRNA sequence
aaattaaataaaaatagtat

SEQ ID NO: 606143 - DNA, 20 bp, Artificial
  CRISPR gRNA sequence
cacacgcacacacacacaca

SEQ ID NO: 606144 - DNA, 20 bp, Artificial
  CRISPR gRNA sequence
acagcttatactctctttca

SEQ ID NO: 606145 - DNA, 20 bp, Artificial
  CRISPR gRNA sequence
ttatactctctttcacagaa

SEQ ID NO: 606146 - DNA, 20 bp, Artificial
  CRISPR gRNA sequence
ctctctttcacagaatggat

SEQ ID NO: 606147 - DNA, 20 bp, Artificial
  CRISPR gRNA sequence
cagaatggattggaaaatgt

SEQ ID NO: 606148 - DNA, 20 bp, Artificial
  CRISPR gRNA sequence
agaatggattggaaaatgta

SEQ ID NO: 606149 - DNA, 20 bp, Artificial
  CRISPR gRNA sequence
gaatggattggaaaatgtaa

SEQ ID NO: 606150 - DNA, 20 bp, Artificial
  CRISPR gRNA sequence
tggattggaaaatgtaaggg

SEQ ID NO: 606151 - DNA, 20 bp, Artificial
  CRISPR gRNA sequence
ggaaaatgtaagggaagaaa

SEQ ID NO: 606152 - DNA, 20 bp, Artificial
  CRISPR gRNA sequence
gaaaatgtaagggaagaaat

SEQ ID NO: 606153 - DNA, 20 bp, Artificial
  CRISPR gRNA sequence
aaaatgtaagggaagaaatg

SEQ ID NO: 606154 - DNA, 20 bp, Artificial
  CRISPR gRNA sequence
atgtaagggaagaaatgggg

SEQ ID NO: 606155 - DNA, 20 bp, Artificial
  CRISPR gRNA sequence
aagggaagaaatggggaagc

SEQ ID NO: 606156 - DNA, 20 bp, Artificial
  CRISPR gRNA sequence
ggaagaaatggggaagctag

SEQ ID NO: 606157 - DNA, 20 bp, Artificial
  CRISPR gRNA sequence
aatggggaagctagtggcca

SEQ ID NO: 606158 - DNA, 20 bp, Artificial
  CRISPR gRNA sequence
tggggaagctagtggccatg

SEQ ID NO: 606159 - DNA, 20 bp, Artificial
  CRISPR gRNA sequence
gggaagctagtggccatgga

SEQ ID NO: 606160 - DNA, 20 bp, Artificial
  CRISPR gRNA sequence
ggaagctagtggccatggag

SEQ ID NO: 606161 - DNA, 20 bp, Artificial
  CRISPR gRNA sequence
ctagtggccatggagaggac

SEQ ID NO: 606162 - DNA, 20 bp, Artificial
  CRISPR gRNA sequence
ggagaggaccagcaataatt

SEQ ID NO: 606163 - DNA, 20 bp, Artificial
  CRISPR gRNA sequence
aataattaagtaaaatatat

SEQ ID NO: 606164 - DNA, 20 bp, Artificial
  CRISPR gRNA sequence
taagtaaaatatattagcac

SEQ ID NO: 606165 - DNA, 20 bp, Artificial
  CRISPR gRNA sequence
agtaaaatatattagcacta

SEQ ID NO: 606166 - DNA, 20 bp, Artificial
  CRISPR gRNA sequence
atatattagcactagagtga

SEQ ID NO: 606167 - DNA, 20 bp, Artificial
  CRISPR gRNA sequence
gcactagagtgacagttaca

SEQ ID NO: 606168 - DNA, 20 bp, Artificial
  CRISPR gRNA sequence
actagagtgacagttacaca

SEQ ID NO: 606169 - DNA, 20 bp, Artificial
  CRISPR gRNA sequence
gtgacagttacacagagaaa

SEQ ID NO: 606170 - DNA, 20 bp, Artificial
  CRISPR gRNA sequence
ttttcacatcttttctgcat

SEQ ID NO: 606171 - DNA, 20 bp, Artificial
  CRISPR gRNA sequence
tcccacatctttcataaatc

SEQ ID NO: 606172 - DNA, 20 bp, Artificial
  CRISPR gRNA sequence
tttccctgttgtttttctct

SEQ ID NO: 606173 - DNA, 20 bp, Artificial
  CRISPR gRNA sequence
tctctaattcctttcttctt

SEQ ID NO: 606174 - DNA, 20 bp, Artificial
  CRISPR gRNA sequence
taattcctttcttcttcaga

SEQ ID NO: 606175 - DNA, 20 bp, Artificial
  CRISPR gRNA sequence
ttcttcagacggatgatttc

SEQ ID NO: 606176 - DNA, 20 bp, Artificial
  CRISPR gRNA sequence
tgatttctggaatcaaaact

SEQ ID NO: 606177 - DNA, 20 bp, Artificial
  CRISPR gRNA sequence
ggaatcaaaactcagccatt

SEQ ID NO: 606178 - DNA, 20 bp, Artificial
  CRISPR gRNA sequence
gaatcaaaactcagccattg

SEQ ID NO: 606179 - DNA, 20 bp, Artificial
  CRISPR gRNA sequence
aatcaaaactcagccattga

SEQ ID NO: 606180 - DNA, 20 bp, Artificial
  CRISPR gRNA sequence
atcaaaactcagccattgag

SEQ ID NO: 606181 - DNA, 20 bp, Artificial
  CRISPR gRNA sequence
aactcagccattgaggggat

SEQ ID NO: 606182 - DNA, 20 bp, Artificial
  CRISPR gRNA sequence
actcagccattgaggggatc

SEQ ID NO: 606183 - DNA, 20 bp, Artificial
  CRISPR gRNA sequence
aggggatcaggtatccttgt

SEQ ID NO: 606184 - DNA, 20 bp, Artificial
  CRISPR gRNA sequence
tgtcagctgtgtgtcatgca

SEQ ID NO: 606185 - DNA, 20 bp, Artificial
  CRISPR gRNA sequence
gtcagctgtgtgtcatgcac

SEQ ID NO: 606186 - DNA, 20 bp, Artificial
  CRISPR gRNA sequence
gtttgataaacatgccttgc

SEQ ID NO: 606187 - DNA, 20 bp, Artificial
  CRISPR gRNA sequence
tcttttcaatcttgtgaaaa

SEQ ID NO: 606188 - DNA, 20 bp, Artificial
  CRISPR gRNA sequence
atcttgtgaaaatagcccta

SEQ ID NO: 606189 - DNA, 20 bp, Artificial
  CRISPR gRNA sequence
agccctatggcacacaacct

SEQ ID NO: 606190 - DNA, 20 bp, Artificial
  CRISPR gRNA sequence
acaacctgagatctgttttc

SEQ ID NO: 606191 - DNA, 20 bp, Artificial
  CRISPR gRNA sequence
tgtcattaatcaatactgtt

SEQ ID NO: 606192 - DNA, 20 bp, Artificial
  CRISPR gRNA sequence
gtcattaatcaatactgttt

SEQ ID NO: 606193 - DNA, 20 bp, Artificial
  CRISPR gRNA sequence
taatcaatactgtttgggtg

SEQ ID NO: 606194 - DNA, 20 bp, Artificial
  CRISPR gRNA sequence
tatttctccatttcgacctc

SEQ ID NO: 606195 - DNA, 20 bp, Artificial
  CRISPR gRNA sequence
ttcgacctcaagaacattat

SEQ ID NO: 606196 - DNA, 20 bp, Artificial
  CRISPR gRNA sequence
cgacctcaagaacattatga

SEQ ID NO: 606197 - DNA, 20 bp, Artificial
  CRISPR gRNA sequence
aacattatgagagctttctt

SEQ ID NO: 606198 - DNA, 20 bp, Artificial
  CRISPR gRNA sequence
atgagagctttcttcagata

SEQ ID NO: 606199 - DNA, 20 bp, Artificial
  CRISPR gRNA sequence
ctttcttcagatatggaatt

SEQ ID NO: 606200 - DNA, 20 bp, Artificial
  CRISPR gRNA sequence
ttcagatatggaattaagtt

SEQ ID NO: 606201 - DNA, 20 bp, Artificial
  CRISPR gRNA sequence
aattaagttcagaatgaaca

SEQ ID NO: 606202 - DNA, 20 bp, Artificial
  CRISPR gRNA sequence
agtccacatttttaaactac

SEQ ID NO: 606203 - DNA, 20 bp, Artificial
  CRISPR gRNA sequence
aacaataaaaatattatttt

SEQ ID NO: 606204 - DNA, 20 bp, Artificial
  CRISPR gRNA sequence
tatttttagtgaacccatat

SEQ ID NO: 606205 - DNA, 20 bp, Artificial
  CRISPR gRNA sequence
attggatcatactttttaaa

SEQ ID NO: 606206 - DNA, 20 bp, Artificial
  CRISPR gRNA sequence
acttaccttccaattttaat

SEQ ID NO: 606207 - DNA, 20 bp, Artificial
  CRISPR gRNA sequence
aattttaattggttcattgt

SEQ ID NO: 606208 - DNA, 20 bp, Artificial
  CRISPR gRNA sequence
cattgtaagcatatttatct

SEQ ID NO: 606209 - DNA, 20 bp, Artificial
  CRISPR gRNA sequence
gcctttaaaaatcgtaaaat

SEQ ID NO: 606210 - DNA, 20 bp, Artificial
  CRISPR gRNA sequence
tcgtaaaattagcccgtctc

SEQ ID NO: 606211 - DNA, 20 bp, Artificial
  CRISPR gRNA sequence
ttagcccgtctctggtcctc

SEQ ID NO: 606212 - DNA, 20 bp, Artificial
  CRISPR gRNA sequence
ggcacctttcctttcctctg

SEQ ID NO: 606213 - DNA, 20 bp, Artificial
  CRISPR gRNA sequence
gcacctttcctttcctctga

SEQ ID NO: 606214 - DNA, 20 bp, Artificial
  CRISPR gRNA sequence
acttcaaaatgttcttgctg

SEQ ID NO: 606215 - DNA, 20 bp, Artificial
  CRISPR gRNA sequence
tcacttctgcatctcctttc

SEQ ID NO: 606216 - DNA, 20 bp, Artificial
  CRISPR gRNA sequence
tcctaaaatatatctcatct

SEQ ID NO: 606217 - DNA, 20 bp, Artificial
  CRISPR gRNA sequence
tgagcctgtattaatttcct

SEQ ID NO: 606218 - DNA, 20 bp, Artificial
  CRISPR gRNA sequence
tttgctgtaacgaactacca

SEQ ID NO: 606219 - DNA, 20 bp, Artificial
  CRISPR gRNA sequence
tgtaacgaactaccacagac

SEQ ID NO: 606220 - DNA, 20 bp, Artificial
  CRISPR gRNA sequence
gtaacgaactaccacagact

SEQ ID NO: 606221 - DNA, 20 bp, Artificial
  CRISPR gRNA sequence
acgaactaccacagactggg

SEQ ID NO: 606222 - DNA, 20 bp, Artificial
  CRISPR gRNA sequence
agactgggtggcttaaacaa

SEQ ID NO: 606223 - DNA, 20 bp, Artificial
  CRISPR gRNA sequence
ctgggtggcttaaacaacag

SEQ ID NO: 606224 - DNA, 20 bp, Artificial
  CRISPR gRNA sequence
aacagaagtttattgcctca

SEQ ID NO: 606225 - DNA, 20 bp, Artificial
  CRISPR gRNA sequence
agtttattgcctcacagttc

SEQ ID NO: 606226 - DNA, 20 bp, Artificial
  CRISPR gRNA sequence
tttattgcctcacagttctg

SEQ ID NO: 606227 - DNA, 20 bp, Artificial
  CRISPR gRNA sequence
ttattgcctcacagttctgg

SEQ ID NO: 606228 - DNA, 20 bp, Artificial
  CRISPR gRNA sequence
tgcctcacagttctggaggc

SEQ ID NO: 606229 - DNA, 20 bp, Artificial
  CRISPR gRNA sequence
ctcacagttctggaggctgg

SEQ ID NO: 606230 - DNA, 20 bp, Artificial
  CRISPR gRNA sequence
gttctggaggctggaagtct

SEQ ID NO: 606231 - DNA, 20 bp, Artificial
  CRISPR gRNA sequence
gaggctggaagtctgagatt

SEQ ID NO: 606232 - DNA, 20 bp, Artificial
  CRISPR gRNA sequence
aggctggaagtctgagatta

SEQ ID NO: 606233 - DNA, 20 bp, Artificial
  CRISPR gRNA sequence
gaagtctgagattaaggtgt

SEQ ID NO: 606234 - DNA, 20 bp, Artificial
  CRISPR gRNA sequence
gtctgagattaaggtgtaag

SEQ ID NO: 606235 - DNA, 20 bp, Artificial
  CRISPR gRNA sequence
gattaaggtgtaagcagtat

SEQ ID NO: 606236 - DNA, 20 bp, Artificial
  CRISPR gRNA sequence
aagcagtattggtttcatgt

SEQ ID NO: 606237 - DNA, 20 bp, Artificial
  CRISPR gRNA sequence
agcagtattggtttcatgtg

SEQ ID NO: 606238 - DNA, 20 bp, Artificial
  CRISPR gRNA sequence
gcagtattggtttcatgtga

SEQ ID NO: 606239 - DNA, 20 bp, Artificial
  CRISPR gRNA sequence
tggtttcatgtgagggctgt

SEQ ID NO: 606240 - DNA, 20 bp, Artificial
  CRISPR gRNA sequence
ggtttcatgtgagggctgtg

SEQ ID NO: 606241 - DNA, 20 bp, Artificial
  CRISPR gRNA sequence
gtttcatgtgagggctgtga

SEQ ID NO: 606242 - DNA, 20 bp, Artificial
  CRISPR gRNA sequence
ttcatgtgagggctgtgagg

SEQ ID NO: 606243 - DNA, 20 bp, Artificial
  CRISPR gRNA sequence
tctgctatgtccctctcccc

SEQ ID NO: 606244 - DNA, 20 bp, Artificial
  CRISPR gRNA sequence
ccctctcccctggctgctga

SEQ ID NO: 606245 - DNA, 20 bp, Artificial
  CRISPR gRNA sequence
tgatggctgctgatattcct

SEQ ID NO: 606246 - DNA, 20 bp, Artificial
  CRISPR gRNA sequence
ctgatattccttggtgttcc

SEQ ID NO: 606247 - DNA, 20 bp, Artificial
  CRISPR gRNA sequence
catctttgccttcatgttca

SEQ ID NO: 606248 - DNA, 20 bp, Artificial
  CRISPR gRNA sequence
tctaaactttccctttttgt

SEQ ID NO: 606249 - DNA, 20 bp, Artificial
  CRISPR gRNA sequence
ctaaactttccctttttgta

SEQ ID NO: 606250 - DNA, 20 bp, Artificial
  CRISPR gRNA sequence
ttccctttttgtaaggacac

SEQ ID NO: 606251 - DNA, 20 bp, Artificial
  CRISPR gRNA sequence
tgtaaggacaccagtcacaa

SEQ ID NO: 606252 - DNA, 20 bp, Artificial
  CRISPR gRNA sequence
gacaccagtcacaatagatt

SEQ ID NO: 606253 - DNA, 20 bp, Artificial
  CRISPR gRNA sequence
acaccagtcacaatagatta

SEQ ID NO: 606254 - DNA, 20 bp, Artificial
  CRISPR gRNA sequence
caccagtcacaatagattaa

SEQ ID NO: 606255 - DNA, 20 bp, Artificial
  CRISPR gRNA sequence
attaagggctcaccctactc

SEQ ID NO: 606256 - DNA, 20 bp, Artificial
  CRISPR gRNA sequence
cattacatctgcaattttta

SEQ ID NO: 606257 - DNA, 20 bp, Artificial
  CRISPR gRNA sequence
ctgcaatttttaaagaaact

SEQ ID NO: 606258 - DNA, 20 bp, Artificial
  CRISPR gRNA sequence
aagaaacttagtttttaaat

SEQ ID NO: 606259 - DNA, 20 bp, Artificial
  CRISPR gRNA sequence
ttttaaattggcttgttttt

SEQ ID NO: 606260 - DNA, 20 bp, Artificial
  CRISPR gRNA sequence
ttggcttgttttttggtgaa

SEQ ID NO: 606261 - DNA, 20 bp, Artificial
  CRISPR gRNA sequence
ggcttgttttttggtgaaaa

SEQ ID NO: 606262 - DNA, 20 bp, Artificial
  CRISPR gRNA sequence
aattgtcttctgtctgtgta

SEQ ID NO: 606263 - DNA, 20 bp, Artificial
  CRISPR gRNA sequence
cttctgtctgtgtatagcca

SEQ ID NO: 606264 - DNA, 20 bp, Artificial
  CRISPR gRNA sequence
tgtatagccaaagcatcaaa

SEQ ID NO: 606265 - DNA, 20 bp, Artificial
  CRISPR gRNA sequence
aaatagaaatgtgaatgcca

SEQ ID NO: 606266 - DNA, 20 bp, Artificial
  CRISPR gRNA sequence
agaaatgtgaatgccaaagt

SEQ ID NO: 606267 - DNA, 20 bp, Artificial
  CRISPR gRNA sequence
atgtgaatgccaaagtaagt

SEQ ID NO: 606268 - DNA, 20 bp, Artificial
  CRISPR gRNA sequence
aatgccaaagtaagtgagcc

SEQ ID NO: 606269 - DNA, 20 bp, Artificial
  CRISPR gRNA sequence
tgccaaagtaagtgagcctg

SEQ ID NO: 606270 - DNA, 20 bp, Artificial
  CRISPR gRNA sequence
aaagtaagtgagcctggagt

SEQ ID NO: 606271 - DNA, 20 bp, Artificial
  CRISPR gRNA sequence
agtgagcctggagttagtga

SEQ ID NO: 606272 - DNA, 20 bp, Artificial
  CRISPR gRNA sequence
gcctggagttagtgacagaa

SEQ ID NO: 606273 - DNA, 20 bp, Artificial
  CRISPR gRNA sequence
cagaaaagaccatgtttgtt

SEQ ID NO: 606274 - DNA, 20 bp, Artificial
  CRISPR gRNA sequence
catgtttgtttagtctcctt

SEQ ID NO: 606275 - DNA, 20 bp, Artificial
  CRISPR gRNA sequence
ttagtctcctttagaaatgt

SEQ ID NO: 606276 - DNA, 20 bp, Artificial
  CRISPR gRNA sequence
agtctcctttagaaatgtta

SEQ ID NO: 606277 - DNA, 20 bp, Artificial
  CRISPR gRNA sequence
gtctcctttagaaatgttag

SEQ ID NO: 606278 - DNA, 20 bp, Artificial
  CRISPR gRNA sequence
ctttagaaatgttagaggaa

SEQ ID NO: 606279 - DNA, 20 bp, Artificial
  CRISPR gRNA sequence
tagaggaaaagaaaaaaaat

SEQ ID NO: 606280 - DNA, 20 bp, Artificial
  CRISPR gRNA sequence
aaaaaattggacttaaccta

SEQ ID NO: 606281 - DNA, 20 bp, Artificial
  CRISPR gRNA sequence
aaaaattggacttaacctaa

SEQ ID NO: 606282 - DNA, 20 bp, Artificial
  CRISPR gRNA sequence
aattggacttaacctaaagg

SEQ ID NO: 606283 - DNA, 20 bp, Artificial
  CRISPR gRNA sequence
cttaacctaaaggcagaacc

SEQ ID NO: 606284 - DNA, 20 bp, Artificial
  CRISPR gRNA sequence
aggcagaaccaagatgttta

SEQ ID NO: 606285 - DNA, 20 bp, Artificial
  CRISPR gRNA sequence
aagatgtttacagaccttac

SEQ ID NO: 606286 - DNA, 20 bp, Artificial
  CRISPR gRNA sequence
ccagccttgacttctgcata

SEQ ID NO: 606287 - DNA, 20 bp, Artificial
  CRISPR gRNA sequence
gcataaagacacatatactt

SEQ ID NO: 606288 - DNA, 20 bp, Artificial
  CRISPR gRNA sequence
aaagacacatatactttagt

SEQ ID NO: 606289 - DNA, 20 bp, Artificial
  CRISPR gRNA sequence
gacacatatactttagtgag

SEQ ID NO: 606290 - DNA, 20 bp, Artificial
  CRISPR gRNA sequence
tatactttagtgagcagatt

SEQ ID NO: 606291 - DNA, 20 bp, Artificial
  CRISPR gRNA sequence
ctttagtgagcagattgaga

SEQ ID NO: 606292 - DNA, 20 bp, Artificial
  CRISPR gRNA sequence
tagttctgactctctactac

SEQ ID NO: 606293 - DNA, 20 bp, Artificial
  CRISPR gRNA sequence
ctctctactactggccgcac

SEQ ID NO: 606294 - DNA, 20 bp, Artificial
  CRISPR gRNA sequence
accatgtacctgtgaccctc

SEQ ID NO: 606295 - DNA, 20 bp, Artificial
  CRISPR gRNA sequence
ccatgtacctgtgaccctct

SEQ ID NO: 606296 - DNA, 20 bp, Artificial
  CRISPR gRNA sequence
actgtcacctcacatatgtc

SEQ ID NO: 606297 - DNA, 20 bp, Artificial
  CRISPR gRNA sequence
atgtccagaaaccattctct

SEQ ID NO: 606298 - DNA, 20 bp, Artificial
  CRISPR gRNA sequence
cactgcccacatttctcccc

SEQ ID NO: 606299 - DNA, 20 bp, Artificial
  CRISPR gRNA sequence
ttcccaaatgtttgcatcca

SEQ ID NO: 606300 - DNA, 20 bp, Artificial
  CRISPR gRNA sequence
aaatgtttgcatccacagct

SEQ ID NO: 606301 - DNA, 20 bp, Artificial
  CRISPR gRNA sequence
aatgtttgcatccacagctc

SEQ ID NO: 606302 - DNA, 20 bp, Artificial
  CRISPR gRNA sequence
tgtttgcatccacagctcag

SEQ ID NO: 606303 - DNA, 20 bp, Artificial
  CRISPR gRNA sequence
gtttgcatccacagctcagg

SEQ ID NO: 606304 - DNA, 20 bp, Artificial
  CRISPR gRNA sequence
ccacagctcaggaggtccat

SEQ ID NO: 606305 - DNA, 20 bp, Artificial
  CRISPR gRNA sequence
gctcaggaggtccattggca

SEQ ID NO: 606306 - DNA, 20 bp, Artificial
  CRISPR gRNA sequence
cctttgttgttacttcctat

SEQ ID NO: 606307 - DNA, 20 bp, Artificial
  CRISPR gRNA sequence
ctttgttgttacttcctatc

SEQ ID NO: 606308 - DNA, 20 bp, Artificial
  CRISPR gRNA sequence
ttgttgttacttcctatcag

SEQ ID NO: 606309 - DNA, 20 bp, Artificial
  CRISPR gRNA sequence
acttcctatcaggagaaaat

SEQ ID NO: 606310 - DNA, 20 bp, Artificial
  CRISPR gRNA sequence
tcaggagaaaatcagtgctt

SEQ ID NO: 606311 - DNA, 20 bp, Artificial
  CRISPR gRNA sequence
agaaaatcagtgcttgagtc

SEQ ID NO: 606312 - DNA, 20 bp, Artificial
  CRISPR gRNA sequence
gaaaatcagtgcttgagtca

SEQ ID NO: 606313 - DNA, 20 bp, Artificial
  CRISPR gRNA sequence
gcttgagtcaaggatgcttc

SEQ ID NO: 606314 - DNA, 20 bp, Artificial
  CRISPR gRNA sequence
cttgagtcaaggatgcttct

SEQ ID NO: 606315 - DNA, 20 bp, Artificial
  CRISPR gRNA sequence
aaggatgcttctgggtgttt

SEQ ID NO: 606316 - DNA, 20 bp, Artificial
  CRISPR gRNA sequence
gatgcttctgggtgttttgg

SEQ ID NO: 606317 - DNA, 20 bp, Artificial
  CRISPR gRNA sequence
atgcttctgggtgttttggc

SEQ ID NO: 606318 - DNA, 20 bp, Artificial
  CRISPR gRNA sequence
gcttctgggtgttttggcag

SEQ ID NO: 606319 - DNA, 20 bp, Artificial
  CRISPR gRNA sequence
cttctgggtgttttggcagg

SEQ ID NO: 606320 - DNA, 20 bp, Artificial
  CRISPR gRNA sequence
tttggcaggaggtctctccc

SEQ ID NO: 606321 - DNA, 20 bp, Artificial
  CRISPR gRNA sequence
ggaggtctctccccagctgt

SEQ ID NO: 606322 - DNA, 20 bp, Artificial
  CRISPR gRNA sequence
gtgagtgatattgtattgtc

SEQ ID NO: 606323 - DNA, 20 bp, Artificial
  CRISPR gRNA sequence
tgagtgatattgtattgtct

SEQ ID NO: 606324 - DNA, 20 bp, Artificial
  CRISPR gRNA sequence
attgtattgtctgggcctta

SEQ ID NO: 606325 - DNA, 20 bp, Artificial
  CRISPR gRNA sequence
gtattgtctgggccttaaag

SEQ ID NO: 606326 - DNA, 20 bp, Artificial
  CRISPR gRNA sequence
gggccttaaagaagctctgc

SEQ ID NO: 606327 - DNA, 20 bp, Artificial
  CRISPR gRNA sequence
aaagaagctctgctagtgcc

SEQ ID NO: 606328 - DNA, 20 bp, Artificial
  CRISPR gRNA sequence
agaagctctgctagtgccca

SEQ ID NO: 606329 - DNA, 20 bp, Artificial
  CRISPR gRNA sequence
tctgctagtgcccagagtat

SEQ ID NO: 606330 - DNA, 20 bp, Artificial
  CRISPR gRNA sequence
ctgctagtgcccagagtatc

SEQ ID NO: 606331 - DNA, 20 bp, Artificial
  CRISPR gRNA sequence
ctagtgcccagagtatcagg

SEQ ID NO: 606332 - DNA, 20 bp, Artificial
  CRISPR gRNA sequence
agtgtctcttgatcaatttc

SEQ ID NO: 606333 - DNA, 20 bp, Artificial
  CRISPR gRNA sequence
tctggtcataatcttttttc

SEQ ID NO: 606334 - DNA, 20 bp, Artificial
  CRISPR gRNA sequence
ttttttccagaatttcattt

SEQ ID NO: 606335 - DNA, 20 bp, Artificial
  CRISPR gRNA sequence
atttcagttccatcattttt

SEQ ID NO: 606336 - DNA, 20 bp, Artificial
  CRISPR gRNA sequence
ggctgtcattcctttactgt

SEQ ID NO: 606337 - DNA, 20 bp, Artificial
  CRISPR gRNA sequence
ttactgtaagcatttaatct

SEQ ID NO: 606338 - DNA, 20 bp, Artificial
  CRISPR gRNA sequence
tactgtaagcatttaatctc

SEQ ID NO: 606339 - DNA, 20 bp, Artificial
  CRISPR gRNA sequence
gtaagcatttaatctcaggc

SEQ ID NO: 606340 - DNA, 20 bp, Artificial
  CRISPR gRNA sequence
taagcatttaatctcaggca

SEQ ID NO: 606341 - DNA, 20 bp, Artificial
  CRISPR gRNA sequence
agcatttaatctcaggcaag

SEQ ID NO: 606342 - DNA, 20 bp, Artificial
  CRISPR gRNA sequence
ctcaggcaaggagtccaatg

SEQ ID NO: 606343 - DNA, 20 bp, Artificial
  CRISPR gRNA sequence
gcaaggagtccaatgaagaa

SEQ ID NO: 606344 - DNA, 20 bp, Artificial
  CRISPR gRNA sequence
gtccaatgaagaacagatgc

SEQ ID NO: 606345 - DNA, 20 bp, Artificial
  CRISPR gRNA sequence
tccaatgaagaacagatgct

SEQ ID NO: 606346 - DNA, 20 bp, Artificial
  CRISPR gRNA sequence
actaacccttctccccctta

SEQ ID NO: 606347 - DNA, 20 bp, Artificial
  CRISPR gRNA sequence
cctcctccttctccccgtaa

SEQ ID NO: 606348 - DNA, 20 bp, Artificial
  CRISPR gRNA sequence
ccttctccccgtaacagaat

SEQ ID NO: 606349 - DNA, 20 bp, Artificial
  CRISPR gRNA sequence
cttctccccgtaacagaata

SEQ ID NO: 606350 - DNA, 20 bp, Artificial
  CRISPR gRNA sequence
ttctccccgtaacagaataa

SEQ ID NO: 606351 - DNA, 20 bp, Artificial
  CRISPR gRNA sequence
agggttgccatgcatgtaca

SEQ ID NO: 606352 - DNA, 20 bp, Artificial
  CRISPR gRNA sequence
gcatgtacatggttacaaac

SEQ ID NO: 606353 - DNA, 20 bp, Artificial
  CRISPR gRNA sequence
tacatggttacaaaccagat

SEQ ID NO: 606354 - DNA, 20 bp, Artificial
  CRISPR gRNA sequence
acatggttacaaaccagatt

SEQ ID NO: 606355 - DNA, 20 bp, Artificial
  CRISPR gRNA sequence
gttacaaaccagattgggcc

SEQ ID NO: 606356 - DNA, 20 bp, Artificial
  CRISPR gRNA sequence
tacaaaccagattgggcctg

SEQ ID NO: 606357 - DNA, 20 bp, Artificial
  CRISPR gRNA sequence
caaaccagattgggcctgga

SEQ ID NO: 606358 - DNA, 20 bp, Artificial
  CRISPR gRNA sequence
accagattgggcctggagag

SEQ ID NO: 606359 - DNA, 20 bp, Artificial
  CRISPR gRNA sequence
cagattgggcctggagagtg

SEQ ID NO: 606360 - DNA, 20 bp, Artificial
  CRISPR gRNA sequence
agattgggcctggagagtgg

SEQ ID NO: 606361 - DNA, 20 bp, Artificial
  CRISPR gRNA sequence
gagagtggaggttaaatttt

SEQ ID NO: 606362 - DNA, 20 bp, Artificial
  CRISPR gRNA sequence
atttttggcccatgatctgt

SEQ ID NO: 606363 - DNA, 20 bp, Artificial
  CRISPR gRNA sequence
ccaaaaatgttctattacaa

SEQ ID NO: 606364 - DNA, 20 bp, Artificial
  CRISPR gRNA sequence
aaaatgttctattacaaaag

SEQ ID NO: 606365 - DNA, 20 bp, Artificial
  CRISPR gRNA sequence
atgttctattacaaaagcag

SEQ ID NO: 606366 - DNA, 20 bp, Artificial
  CRISPR gRNA sequence
tacaaaagcagtggattttc

SEQ ID NO: 606367 - DNA, 20 bp, Artificial
  CRISPR gRNA sequence
aaagcagtggattttctagt

SEQ ID NO: 606368 - DNA, 20 bp, Artificial
  CRISPR gRNA sequence
tttctagttagaatcattct

SEQ ID NO: 606369 - DNA, 20 bp, Artificial
  CRISPR gRNA sequence
ttctagttagaatcattctt

SEQ ID NO: 606370 - DNA, 20 bp, Artificial
  CRISPR gRNA sequence
attgtgacactttgcatatt

SEQ ID NO: 606371 - DNA, 20 bp, Artificial
  CRISPR gRNA sequence
tttgcatatttggtgtactt

SEQ ID NO: 606372 - DNA, 20 bp, Artificial
  CRISPR gRNA sequence
ttgcatatttggtgtacttg

SEQ ID NO: 606373 - DNA, 20 bp, Artificial
  CRISPR gRNA sequence
tatttggtgtacttgaggaa

SEQ ID NO: 606374 - DNA, 20 bp, Artificial
  CRISPR gRNA sequence
tggtgtacttgaggaacagc

SEQ ID NO: 606375 - DNA, 20 bp, Artificial
  CRISPR gRNA sequence
ggtgtacttgaggaacagca

SEQ ID NO: 606376 - DNA, 20 bp, Artificial
  CRISPR gRNA sequence
gtgtacttgaggaacagcaa

SEQ ID NO: 606377 - DNA, 20 bp, Artificial
  CRISPR gRNA sequence
ttgaggaacagcaagggtac

SEQ ID NO: 606378 - DNA, 20 bp, Artificial
  CRISPR gRNA sequence
gaacagcaagggtaccagtt

SEQ ID NO: 606379 - DNA, 20 bp, Artificial
  CRISPR gRNA sequence
gcaagggtaccagtttggtt

SEQ ID NO: 606380 - DNA, 20 bp, Artificial
  CRISPR gRNA sequence
gtaccagtttggtttggtta

SEQ ID NO: 606381 - DNA, 20 bp, Artificial
  CRISPR gRNA sequence
ccagtttggtttggttacag

SEQ ID NO: 606382 - DNA, 20 bp, Artificial
  CRISPR gRNA sequence
gtttggttacagtggtctga

SEQ ID NO: 606383 - DNA, 20 bp, Artificial
  CRISPR gRNA sequence
ttggttacagtggtctgaaa

SEQ ID NO: 606384 - DNA, 20 bp, Artificial
  CRISPR gRNA sequence
tggttacagtggtctgaaag

SEQ ID NO: 606385 - DNA, 20 bp, Artificial
  CRISPR gRNA sequence
ggttacagtggtctgaaaga

SEQ ID NO: 606386 - DNA, 20 bp, Artificial
  CRISPR gRNA sequence
gttacagtggtctgaaagag

SEQ ID NO: 606387 - DNA, 20 bp, Artificial
  CRISPR gRNA sequence
tacagtggtctgaaagaggg

SEQ ID NO: 606388 - DNA, 20 bp, Artificial
  CRISPR gRNA sequence
cagtggtctgaaagagggga

SEQ ID NO: 606389 - DNA, 20 bp, Artificial
  CRISPR gRNA sequence
aaagaggggagagatctgta

SEQ ID NO: 606390 - DNA, 20 bp, Artificial
  CRISPR gRNA sequence
aagaggggagagatctgtat

SEQ ID NO: 606391 - DNA, 20 bp, Artificial
  CRISPR gRNA sequence
agaggggagagatctgtatg

SEQ ID NO: 606392 - DNA, 20 bp, Artificial
  CRISPR gRNA sequence
catatatttcataaattatc

SEQ ID NO: 606393 - DNA, 20 bp, Artificial
  CRISPR gRNA sequence
atatatttcataaattatct

SEQ ID NO: 606394 - DNA, 20 bp, Artificial
  CRISPR gRNA sequence
taaattatctgggtcccatg

SEQ ID NO: 606395 - DNA, 20 bp, Artificial
  CRISPR gRNA sequence
aattatctgggtcccatgtg

SEQ ID NO: 606396 - DNA, 20 bp, Artificial
  CRISPR gRNA sequence
ttatctgggtcccatgtgga

SEQ ID NO: 606397 - DNA, 20 bp, Artificial
  CRISPR gRNA sequence
tctgggtcccatgtggagag

SEQ ID NO: 606398 - DNA, 20 bp, Artificial
  CRISPR gRNA sequence
tcccatgtggagagtggaca

SEQ ID NO: 606399 - DNA, 20 bp, Artificial
  CRISPR gRNA sequence
cccatgtggagagtggacaa

SEQ ID NO: 606400 - DNA, 20 bp, Artificial
  CRISPR gRNA sequence
ccatgtggagagtggacaaa

SEQ ID NO: 606401 - DNA, 20 bp, Artificial
  CRISPR gRNA sequence
atgtggagagtggacaaagg

SEQ ID NO: 606402 - DNA, 20 bp, Artificial
  CRISPR gRNA sequence
gtggagagtggacaaaggga

SEQ ID NO: 606403 - DNA, 20 bp, Artificial
  CRISPR gRNA sequence
tggagagtggacaaagggag

SEQ ID NO: 606404 - DNA, 20 bp, Artificial
  CRISPR gRNA sequence
ggacaaagggagaggactgc

SEQ ID NO: 606405 - DNA, 20 bp, Artificial
  CRISPR gRNA sequence
aaagggagaggactgcaagc

SEQ ID NO: 606406 - DNA, 20 bp, Artificial
  CRISPR gRNA sequence
aagggagaggactgcaagca

SEQ ID NO: 606407 - DNA, 20 bp, Artificial
  CRISPR gRNA sequence
ctgcaagcaaggtgccctgt

SEQ ID NO: 606408 - DNA, 20 bp, Artificial
  CRISPR gRNA sequence
tgcaagcaaggtgccctgtg

SEQ ID NO: 606409 - DNA, 20 bp, Artificial
  CRISPR gRNA sequence
caagcaaggtgccctgtgag

SEQ ID NO: 606410 - DNA, 20 bp, Artificial
  CRISPR gRNA sequence
aagcaaggtgccctgtgagg

SEQ ID NO: 606411 - DNA, 20 bp, Artificial
  CRISPR gRNA sequence
ctgtgaggaggcctgcacaa

SEQ ID NO: 606412 - DNA, 20 bp, Artificial
  CRISPR gRNA sequence
aggaggcctgcacaaaagtg

SEQ ID NO: 606413 - DNA, 20 bp, Artificial
  CRISPR gRNA sequence
gaggcctgcacaaaagtgaa

SEQ ID NO: 606414 - DNA, 20 bp, Artificial
  CRISPR gRNA sequence
aggcctgcacaaaagtgaag

SEQ ID NO: 606415 - DNA, 20 bp, Artificial
  CRISPR gRNA sequence
gcacaaaagtgaagaggcct

SEQ ID NO: 606416 - DNA, 20 bp, Artificial
  CRISPR gRNA sequence
aagtgaagaggcctgagctg

SEQ ID NO: 606417 - DNA, 20 bp, Artificial
  CRISPR gRNA sequence
gaagaggcctgagctgaagt

SEQ ID NO: 606418 - DNA, 20 bp, Artificial
  CRISPR gRNA sequence
gaggcctgagctgaagtgag

SEQ ID NO: 606419 - DNA, 20 bp, Artificial
  CRISPR gRNA sequence
aggcctgagctgaagtgaga

SEQ ID NO: 606420 - DNA, 20 bp, Artificial
  CRISPR gRNA sequence
aagtgagaaggtctgcgtga

SEQ ID NO: 606421 - DNA, 20 bp, Artificial
  CRISPR gRNA sequence
cgtgaaagtgatttgtgtga

SEQ ID NO: 606422 - DNA, 20 bp, Artificial
  CRISPR gRNA sequence
aaagtgatttgtgtgaaaga

SEQ ID NO: 606423 - DNA, 20 bp, Artificial
  CRISPR gRNA sequence
gtgatttgtgtgaaagatgg

SEQ ID NO: 606424 - DNA, 20 bp, Artificial
  CRISPR gRNA sequence
aagatggtggtgtatccaac

SEQ ID NO: 606425 - DNA, 20 bp, Artificial
  CRISPR gRNA sequence
gatggtggtgtatccaacta

SEQ ID NO: 606426 - DNA, 20 bp, Artificial
  CRISPR gRNA sequence
ggtggtgtatccaactagag

SEQ ID NO: 606427 - DNA, 20 bp, Artificial
  CRISPR gRNA sequence
gtggtgtatccaactagagc

SEQ ID NO: 606428 - DNA, 20 bp, Artificial
  CRISPR gRNA sequence
ggtgtatccaactagagcag

SEQ ID NO: 606429 - DNA, 20 bp, Artificial
  CRISPR gRNA sequence
gtatccaactagagcaggag

SEQ ID NO: 606430 - DNA, 20 bp, Artificial
  CRISPR gRNA sequence
tccaactagagcaggagcag

SEQ ID NO: 606431 - DNA, 20 bp, Artificial
  CRISPR gRNA sequence
ccaactagagcaggagcagt

SEQ ID NO: 606432 - DNA, 20 bp, Artificial
  CRISPR gRNA sequence
caactagagcaggagcagtg

SEQ ID NO: 606433 - DNA, 20 bp, Artificial
  CRISPR gRNA sequence
aactagagcaggagcagtgg

SEQ ID NO: 606434 - DNA, 20 bp, Artificial
  CRISPR gRNA sequence
tagagcaggagcagtggggg

SEQ ID NO: 606435 - DNA, 20 bp, Artificial
  CRISPR gRNA sequence
gcaggagcagtgggggtggt

SEQ ID NO: 606436 - DNA, 20 bp, Artificial
  CRISPR gRNA sequence
ggagcagtgggggtggtgag

SEQ ID NO: 606437 - DNA, 20 bp, Artificial
  CRISPR gRNA sequence
gcagtgggggtggtgagaag

SEQ ID NO: 606438 - DNA, 20 bp, Artificial
  CRISPR gRNA sequence
ggtgagaagtggtcttttgt

SEQ ID NO: 606439 - DNA, 20 bp, Artificial
  CRISPR gRNA sequence
gagaagtggtcttttgtaag

SEQ ID NO: 606440 - DNA, 20 bp, Artificial
  CRISPR gRNA sequence
gaagtggtcttttgtaagta

SEQ ID NO: 606441 - DNA, 20 bp, Artificial
  CRISPR gRNA sequence
cttttgtaagtagagcctgt

SEQ ID NO: 606442 - DNA, 20 bp, Artificial
  CRISPR gRNA sequence
gagcctgttggacttgctga

SEQ ID NO: 606443 - DNA, 20 bp, Artificial
  CRISPR gRNA sequence
tgttggacttgctgatggat

SEQ ID NO: 606444 - DNA, 20 bp, Artificial
  CRISPR gRNA sequence
tggacttgctgatggattgg

SEQ ID NO: 606445 - DNA, 20 bp, Artificial
  CRISPR gRNA sequence
acttgctgatggattggaag

SEQ ID NO: 606446 - DNA, 20 bp, Artificial
  CRISPR gRNA sequence
atggattggaagcggcatgt

SEQ ID NO: 606447 - DNA, 20 bp, Artificial
  CRISPR gRNA sequence
tggattggaagcggcatgtg

SEQ ID NO: 606448 - DNA, 20 bp, Artificial
  CRISPR gRNA sequence
ggattggaagcggcatgtga

SEQ ID NO: 606449 - DNA, 20 bp, Artificial
  CRISPR gRNA sequence
gaagcggcatgtgagggaaa

SEQ ID NO: 606450 - DNA, 20 bp, Artificial
  CRISPR gRNA sequence
agcggcatgtgagggaaaaa

SEQ ID NO: 606451 - DNA, 20 bp, Artificial
  CRISPR gRNA sequence
gcggcatgtgagggaaaaag

SEQ ID NO: 606452 - DNA, 20 bp, Artificial
  CRISPR gRNA sequence
tgtgagggaaaaagaggtct

SEQ ID NO: 606453 - DNA, 20 bp, Artificial
  CRISPR gRNA sequence
gtgagggaaaaagaggtcta

SEQ ID NO: 606454 - DNA, 20 bp, Artificial
  CRISPR gRNA sequence
gagggaaaaagaggtctaag

SEQ ID NO: 606455 - DNA, 20 bp, Artificial
  CRISPR gRNA sequence
gaggtctaaggagtgactgc

SEQ ID NO: 606456 - DNA, 20 bp, Artificial
  CRISPR gRNA sequence
aaggagtgactgctagtgtt

SEQ ID NO: 606457 - DNA, 20 bp, Artificial
  CRISPR gRNA sequence
tgactgctagtgtttggctt

SEQ ID NO: 606458 - DNA, 20 bp, Artificial
  CRISPR gRNA sequence
ctgctagtgtttggcttaag

SEQ ID NO: 606459 - DNA, 20 bp, Artificial
  CRISPR gRNA sequence
agtgtttggcttaagtagcc

SEQ ID NO: 606460 - DNA, 20 bp, Artificial
  CRISPR gRNA sequence
ggcttaagtagcctggtgaa

SEQ ID NO: 606461 - DNA, 20 bp, Artificial
  CRISPR gRNA sequence
agtgatgtcacttactgact

SEQ ID NO: 606462 - DNA, 20 bp, Artificial
  CRISPR gRNA sequence
gtgatgtcacttactgactt

SEQ ID NO: 606463 - DNA, 20 bp, Artificial
  CRISPR gRNA sequence
tgatgtcacttactgacttg

SEQ ID NO: 606464 - DNA, 20 bp, Artificial
  CRISPR gRNA sequence
cttactgacttggggaaatg

SEQ ID NO: 606465 - DNA, 20 bp, Artificial
  CRISPR gRNA sequence
tactgacttggggaaatgaa

SEQ ID NO: 606466 - DNA, 20 bp, Artificial
  CRISPR gRNA sequence
atgaagagctctgttttgaa

SEQ ID NO: 606467 - DNA, 20 bp, Artificial
  CRISPR gRNA sequence
tgaagagctctgttttgaac

SEQ ID NO: 606468 - DNA, 20 bp, Artificial
  CRISPR gRNA sequence
agctctgttttgaacaggtg

SEQ ID NO: 606469 - DNA, 20 bp, Artificial
  CRISPR gRNA sequence
gttttgaacaggtgaagctt

SEQ ID NO: 606470 - DNA, 20 bp, Artificial
  CRISPR gRNA sequence
tttgaacaggtgaagcttga

SEQ ID NO: 606471 - DNA, 20 bp, Artificial
  CRISPR gRNA sequence
tgaagcttgagagtcattcc

SEQ ID NO: 606472 - DNA, 20 bp, Artificial
  CRISPR gRNA sequence
cattcctagaatctcaaatc

SEQ ID NO: 606473 - DNA, 20 bp, Artificial
  CRISPR gRNA sequence
ctagaatctcaaatcaagat

SEQ ID NO: 606474 - DNA, 20 bp, Artificial
  CRISPR gRNA sequence
gagtcttaatcaaaatgtct

SEQ ID NO: 606475 - DNA, 20 bp, Artificial
  CRISPR gRNA sequence
taatcaaaatgtcttagcca

SEQ ID NO: 606476 - DNA, 20 bp, Artificial
  CRISPR gRNA sequence
aatcaaaatgtcttagccaa

SEQ ID NO: 606477 - DNA, 20 bp, Artificial
  CRISPR gRNA sequence
atgtcttagccaaaggattc

SEQ ID NO: 606478 - DNA, 20 bp, Artificial
  CRISPR gRNA sequence
gtcttagccaaaggattcga

SEQ ID NO: 606479 - DNA, 20 bp, Artificial
  CRISPR gRNA sequence
tagccaaaggattcgagagc

SEQ ID NO: 606480 - DNA, 20 bp, Artificial
  CRISPR gRNA sequence
agccaaaggattcgagagcc

SEQ ID NO: 606481 - DNA, 20 bp, Artificial
  CRISPR gRNA sequence
cgagagccaggatgctcctg

SEQ ID NO: 606482 - DNA, 20 bp, Artificial
  CRISPR gRNA sequence
agagccaggatgctcctgca

SEQ ID NO: 606483 - DNA, 20 bp, Artificial
  CRISPR gRNA sequence
gccaggatgctcctgcagag

SEQ ID NO: 606484 - DNA, 20 bp, Artificial
  CRISPR gRNA sequence
cctgcagagtagtgcaatta

SEQ ID NO: 606485 - DNA, 20 bp, Artificial
  CRISPR gRNA sequence
ttatggtttcccttacaatg

SEQ ID NO: 606486 - DNA, 20 bp, Artificial
  CRISPR gRNA sequence
tggtttcccttacaatgcag

SEQ ID NO: 606487 - DNA, 20 bp, Artificial
  CRISPR gRNA sequence
gtttcccttacaatgcagca

SEQ ID NO: 606488 - DNA, 20 bp, Artificial
  CRISPR gRNA sequence
tacaatgcagcagagaacca

SEQ ID NO: 606489 - DNA, 20 bp, Artificial
  CRISPR gRNA sequence
agagaaccaaagctacccaa

SEQ ID NO: 606490 - DNA, 20 bp, Artificial
  CRISPR gRNA sequence
aagctacccaacagtttttt

SEQ ID NO: 606491 - DNA, 20 bp, Artificial
  CRISPR gRNA sequence
cccaacagttttttaagact

SEQ ID NO: 606492 - DNA, 20 bp, Artificial
  CRISPR gRNA sequence
agacttagtgtcctcactta

SEQ ID NO: 606493 - DNA, 20 bp, Artificial
  CRISPR gRNA sequence
gacttagtgtcctcacttat

SEQ ID NO: 606494 - DNA, 20 bp, Artificial
  CRISPR gRNA sequence
ttagtgtcctcacttatagg

SEQ ID NO: 606495 - DNA, 20 bp, Artificial
  CRISPR gRNA sequence
tagtgtcctcacttataggt

SEQ ID NO: 606496 - DNA, 20 bp, Artificial
  CRISPR gRNA sequence
agtgtcctcacttataggtg

SEQ ID NO: 606497 - DNA, 20 bp, Artificial
  CRISPR gRNA sequence
ggatatattacttatttcac

SEQ ID NO: 606498 - DNA, 20 bp, Artificial
  CRISPR gRNA sequence
gatatattacttatttcact

SEQ ID NO: 606499 - DNA, 20 bp, Artificial
  CRISPR gRNA sequence
ttatttcactgggttctttg

SEQ ID NO: 606500 - DNA, 20 bp, Artificial
  CRISPR gRNA sequence
tatttcactgggttctttga

SEQ ID NO: 606501 - DNA, 20 bp, Artificial
  CRISPR gRNA sequence
gggttctttgaaggtaacat

SEQ ID NO: 606502 - DNA, 20 bp, Artificial
  CRISPR gRNA sequence
tagataatgtttgtgaaact

SEQ ID NO: 606503 - DNA, 20 bp, Artificial
  CRISPR gRNA sequence
aactcagtgtaattcttgac

SEQ ID NO: 606504 - DNA, 20 bp, Artificial
  CRISPR gRNA sequence
tgtaattcttgacaagtaat

SEQ ID NO: 606505 - DNA, 20 bp, Artificial
  CRISPR gRNA sequence
attattgttgttattaattt

SEQ ID NO: 606506 - DNA, 20 bp, Artificial
  CRISPR gRNA sequence
tttatttatttatttatttt

SEQ ID NO: 606507 - DNA, 20 bp, Artificial
  CRISPR gRNA sequence
tttatttatttattttgaga

SEQ ID NO: 606508 - DNA, 20 bp, Artificial
  CRISPR gRNA sequence
tatttatttattttgagaca

SEQ ID NO: 606509 - DNA, 20 bp, Artificial
  CRISPR gRNA sequence
cagagtctcgctctgttgcc

SEQ ID NO: 606510 - DNA, 20 bp, Artificial
  CRISPR gRNA sequence
tctcgctctgttgcccagac

SEQ ID NO: 606511 - DNA, 20 bp, Artificial
  CRISPR gRNA sequence
tcgctctgttgcccagactg

SEQ ID NO: 606512 - DNA, 20 bp, Artificial
  CRISPR gRNA sequence
ctgttgcccagactggagtg

SEQ ID NO: 606513 - DNA, 20 bp, Artificial
  CRISPR gRNA sequence
ttgcccagactggagtgcag

SEQ ID NO: 606514 - DNA, 20 bp, Artificial
  CRISPR gRNA sequence
ggagtgcagtggcgcaatct

SEQ ID NO: 606515 - DNA, 20 bp, Artificial
  CRISPR gRNA sequence
tcactgcaacctccgccttc

SEQ ID NO: 606516 - DNA, 20 bp, Artificial
  CRISPR gRNA sequence
cactgcaacctccgccttct

SEQ ID NO: 606517 - DNA, 20 bp, Artificial
  CRISPR gRNA sequence
aacctccgccttctgggttc

SEQ ID NO: 606518 - DNA, 20 bp, Artificial
  CRISPR gRNA sequence
ttcaagcgattctcctgcct

SEQ ID NO: 606519 - DNA, 20 bp, Artificial
  CRISPR gRNA sequence
ttctcctgcctcagattccc

SEQ ID NO: 606520 - DNA, 20 bp, Artificial
  CRISPR gRNA sequence
tcctgcctcagattcccaag

SEQ ID NO: 606521 - DNA, 20 bp, Artificial
  CRISPR gRNA sequence
attcccaagtggtgtgatta

SEQ ID NO: 606522 - DNA, 20 bp, Artificial
  CRISPR gRNA sequence
cagccgcccaccactatgac

SEQ ID NO: 606523 - DNA, 20 bp, Artificial
  CRISPR gRNA sequence
gctaatttttatgtttttac

SEQ ID NO: 606524 - DNA, 20 bp, Artificial
  CRISPR gRNA sequence
taatttttatgtttttacta

SEQ ID NO: 606525 - DNA, 20 bp, Artificial
  CRISPR gRNA sequence
atttttatgtttttactaga

SEQ ID NO: 606526 - DNA, 20 bp, Artificial
  CRISPR gRNA sequence
tttttatgtttttactagag

SEQ ID NO: 606527 - DNA, 20 bp, Artificial
  CRISPR gRNA sequence
tttatgtttttactagagag

SEQ ID NO: 606528 - DNA, 20 bp, Artificial
  CRISPR gRNA sequence
ttatgtttttactagagagg

SEQ ID NO: 606529 - DNA, 20 bp, Artificial
  CRISPR gRNA sequence
gagaggaggtttcaccatgt

SEQ ID NO: 606530 - DNA, 20 bp, Artificial
  CRISPR gRNA sequence
ggaggtttcaccatgttggc

SEQ ID NO: 606531 - DNA, 20 bp, Artificial
  CRISPR gRNA sequence
gaggtttcaccatgttggcc

SEQ ID NO: 606532 - DNA, 20 bp, Artificial
  CRISPR gRNA sequence
tttcaccatgttggccaggc

SEQ ID NO: 606533 - DNA, 20 bp, Artificial
  CRISPR gRNA sequence
ttcaaatgatccccctgcct

SEQ ID NO: 606534 - DNA, 20 bp, Artificial
  CRISPR gRNA sequence
cctcagcctctcaaattgct

SEQ ID NO: 606535 - DNA, 20 bp, Artificial
  CRISPR gRNA sequence
ctctcaaattgctaagatta

SEQ ID NO: 606536 - DNA, 20 bp, Artificial
  CRISPR gRNA sequence
tctcaaattgctaagattac

SEQ ID NO: 606537 - DNA, 20 bp, Artificial
  CRISPR gRNA sequence
attgctaagattacaggtgt

SEQ ID NO: 606538 - DNA, 20 bp, Artificial
  CRISPR gRNA sequence
acaggtgtgagccactgtgc

SEQ ID NO: 606539 - DNA, 20 bp, Artificial
  CRISPR gRNA sequence
caggtgtgagccactgtgcc

SEQ ID NO: 606540 - DNA, 20 bp, Artificial
  CRISPR gRNA sequence
tgtgagccactgtgccaggc

SEQ ID NO: 606541 - DNA, 20 bp, Artificial
  CRISPR gRNA sequence
gtgagccactgtgccaggcc

SEQ ID NO: 606542 - DNA, 20 bp, Artificial
  CRISPR gRNA sequence
ggccaggaaaattattttta

SEQ ID NO: 606543 - DNA, 20 bp, Artificial
  CRISPR gRNA sequence
ttaaagctgtttttaaatat

SEQ ID NO: 606544 - DNA, 20 bp, Artificial
  CRISPR gRNA sequence
ctgtttttaaatatcagctt

SEQ ID NO: 606545 - DNA, 20 bp, Artificial
  CRISPR gRNA sequence
tatcagctttggaatgaaat

SEQ ID NO: 606546 - DNA, 20 bp, Artificial
  CRISPR gRNA sequence
attggatataaattaatact

SEQ ID NO: 606547 - DNA, 20 bp, Artificial
  CRISPR gRNA sequence
aaattaatacttagtatatc

SEQ ID NO: 606548 - DNA, 20 bp, Artificial
  CRISPR gRNA sequence
tagtatatccagaatctaca

SEQ ID NO: 606549 - DNA, 20 bp, Artificial
  CRISPR gRNA sequence
aagaacttaaacaaatttac

SEQ ID NO: 606550 - DNA, 20 bp, Artificial
  CRISPR gRNA sequence
aatcaaacaaccccatcaaa

SEQ ID NO: 606551 - DNA, 20 bp, Artificial
  CRISPR gRNA sequence
caaacaaccccatcaaaaag

SEQ ID NO: 606552 - DNA, 20 bp, Artificial
  CRISPR gRNA sequence
aaacaaccccatcaaaaagt

SEQ ID NO: 606553 - DNA, 20 bp, Artificial
  CRISPR gRNA sequence
accccatcaaaaagtgggca

SEQ ID NO: 606554 - DNA, 20 bp, Artificial
  CRISPR gRNA sequence
ccccatcaaaaagtgggcaa

SEQ ID NO: 606555 - DNA, 20 bp, Artificial
  CRISPR gRNA sequence
aagtgggcaaaggatatgaa

SEQ ID NO: 606556 - DNA, 20 bp, Artificial
  CRISPR gRNA sequence
tatgaacagacacttctcga

SEQ ID NO: 606557 - DNA, 20 bp, Artificial
  CRISPR gRNA sequence
gaacagacacttctcgaaag

SEQ ID NO: 606558 - DNA, 20 bp, Artificial
  CRISPR gRNA sequence
ctcgaaagaagacatttatg

SEQ ID NO: 606559 - DNA, 20 bp, Artificial
  CRISPR gRNA sequence
gaagacatttatgtagctga

SEQ ID NO: 606560 - DNA, 20 bp, Artificial
  CRISPR gRNA sequence
ttatgtagctgacagacaca

SEQ ID NO: 606561 - DNA, 20 bp, Artificial
  CRISPR gRNA sequence
ggaaaaatgctcatcatcac

SEQ ID NO: 606562 - DNA, 20 bp, Artificial
  CRISPR gRNA sequence
tgctcatcatcactggccat

SEQ ID NO: 606563 - DNA, 20 bp, Artificial
  CRISPR gRNA sequence
ctcatcatcactggccatca

SEQ ID NO: 606564 - DNA, 20 bp, Artificial
  CRISPR gRNA sequence
atgcaaatcaaaaccacaat

SEQ ID NO: 606565 - DNA, 20 bp, Artificial
  CRISPR gRNA sequence
aatgagataccatctcacac

SEQ ID NO: 606566 - DNA, 20 bp, Artificial
  CRISPR gRNA sequence
agataccatctcacaccagt

SEQ ID NO: 606567 - DNA, 20 bp, Artificial
  CRISPR gRNA sequence
ccatctcacaccagttagaa

SEQ ID NO: 606568 - DNA, 20 bp, Artificial
  CRISPR gRNA sequence
ttagaatggcgatcattaac

SEQ ID NO: 606569 - DNA, 20 bp, Artificial
  CRISPR gRNA sequence
aatggcgatcattaacaagt

SEQ ID NO: 606570 - DNA, 20 bp, Artificial
  CRISPR gRNA sequence
atggcgatcattaacaagtc

SEQ ID NO: 606571 - DNA, 20 bp, Artificial
  CRISPR gRNA sequence
atcattaacaagtcaggaaa

SEQ ID NO: 606572 - DNA, 20 bp, Artificial
  CRISPR gRNA sequence
attaacaagtcaggaaacag

SEQ ID NO: 606573 - DNA, 20 bp, Artificial
  CRISPR gRNA sequence
ttaacaagtcaggaaacagc

SEQ ID NO: 606574 - DNA, 20 bp, Artificial
  CRISPR gRNA sequence
agtcaggaaacagcaggtgc

SEQ ID NO: 606575 - DNA, 20 bp, Artificial
  CRISPR gRNA sequence
tcaggaaacagcaggtgctg

SEQ ID NO: 606576 - DNA, 20 bp, Artificial
  CRISPR gRNA sequence
aggaaacagcaggtgctgga

SEQ ID NO: 606577 - DNA, 20 bp, Artificial
  CRISPR gRNA sequence
ggaaacagcaggtgctggag

SEQ ID NO: 606578 - DNA, 20 bp, Artificial
  CRISPR gRNA sequence
agcaggtgctggagaggatg

SEQ ID NO: 606579 - DNA, 20 bp, Artificial
  CRISPR gRNA sequence
caggtgctggagaggatgtg

SEQ ID NO: 606580 - DNA, 20 bp, Artificial
  CRISPR gRNA sequence
ctggagaggatgtggagaaa

SEQ ID NO: 606581 - DNA, 20 bp, Artificial
  CRISPR gRNA sequence
tggagaggatgtggagaaat

SEQ ID NO: 606582 - DNA, 20 bp, Artificial
  CRISPR gRNA sequence
gaacacttttacactgttgc

SEQ ID NO: 606583 - DNA, 20 bp, Artificial
  CRISPR gRNA sequence
aacacttttacactgttgct

SEQ ID NO: 606584 - DNA, 20 bp, Artificial
  CRISPR gRNA sequence
ctgttgctgggactgtaaac

SEQ ID NO: 606585 - DNA, 20 bp, Artificial
  CRISPR gRNA sequence
gtaaactagttcaaccattg

SEQ ID NO: 606586 - DNA, 20 bp, Artificial
  CRISPR gRNA sequence
aactagttcaaccattgtgg

SEQ ID NO: 606587 - DNA, 20 bp, Artificial
  CRISPR gRNA sequence
agttcaaccattgtggaaga

SEQ ID NO: 606588 - DNA, 20 bp, Artificial
  CRISPR gRNA sequence
aaccattgtggaagacagtg

SEQ ID NO: 606589 - DNA, 20 bp, Artificial
  CRISPR gRNA sequence
aagacagtgtggcaattcct

SEQ ID NO: 606590 - DNA, 20 bp, Artificial
  CRISPR gRNA sequence
agacagtgtggcaattcctc

SEQ ID NO: 606591 - DNA, 20 bp, Artificial
  CRISPR gRNA sequence
gacagtgtggcaattcctca

SEQ ID NO: 606592 - DNA, 20 bp, Artificial
  CRISPR gRNA sequence
gtggcaattcctcagggatc

SEQ ID NO: 606593 - DNA, 20 bp, Artificial
  CRISPR gRNA sequence
attcctcagggatctagaac

SEQ ID NO: 606594 - DNA, 20 bp, Artificial
  CRISPR gRNA sequence
actagaaatatcatttgacc

SEQ ID NO: 606595 - DNA, 20 bp, Artificial
  CRISPR gRNA sequence
tgacccagccatcccattac

SEQ ID NO: 606596 - DNA, 20 bp, Artificial
  CRISPR gRNA sequence
gacccagccatcccattact

SEQ ID NO: 606597 - DNA, 20 bp, Artificial
  CRISPR gRNA sequence
cattactgggtatataccca

SEQ ID NO: 606598 - DNA, 20 bp, Artificial
  CRISPR gRNA sequence
attactgggtatatacccaa

SEQ ID NO: 606599 - DNA, 20 bp, Artificial
  CRISPR gRNA sequence
ttataaatcatgctgctata

SEQ ID NO: 606600 - DNA, 20 bp, Artificial
  CRISPR gRNA sequence
catgcacacgtgtgtttatt

SEQ ID NO: 606601 - DNA, 20 bp, Artificial
  CRISPR gRNA sequence
atgcacacgtgtgtttattg

SEQ ID NO: 606602 - DNA, 20 bp, Artificial
  CRISPR gRNA sequence
tattgaggcactattcacaa

SEQ ID NO: 606603 - DNA, 20 bp, Artificial
  CRISPR gRNA sequence
aggcactattcacaatagca

SEQ ID NO: 606604 - DNA, 20 bp, Artificial
  CRISPR gRNA sequence
tattcacaatagcaaagact

SEQ ID NO: 606605 - DNA, 20 bp, Artificial
  CRISPR gRNA sequence
gaaccaacccaaatgtccat

SEQ ID NO: 606606 - DNA, 20 bp, Artificial
  CRISPR gRNA sequence
acccaaatgtccatcagtga

SEQ ID NO: 606607 - DNA, 20 bp, Artificial
  CRISPR gRNA sequence
aatgtccatcagtgatagac

SEQ ID NO: 606608 - DNA, 20 bp, Artificial
  CRISPR gRNA sequence
catcagtgatagactggatt

SEQ ID NO: 606609 - DNA, 20 bp, Artificial
  CRISPR gRNA sequence
tagactggattaagaaaatg

SEQ ID NO: 606610 - DNA, 20 bp, Artificial
  CRISPR gRNA sequence
aatgtggcacatatacacca

SEQ ID NO: 606611 - DNA, 20 bp, Artificial
  CRISPR gRNA sequence
accatggaataaatactatg

SEQ ID NO: 606612 - DNA, 20 bp, Artificial
  CRISPR gRNA sequence
aatactatgcagccacgaaa

SEQ ID NO: 606613 - DNA, 20 bp, Artificial
  CRISPR gRNA sequence
atactatgcagccacgaaaa

SEQ ID NO: 606614 - DNA, 20 bp, Artificial
  CRISPR gRNA sequence
atgcagccacgaaaaaggat

SEQ ID NO: 606615 - DNA, 20 bp, Artificial
  CRISPR gRNA sequence
ggatgagttcatgtcctttg

SEQ ID NO: 606616 - DNA, 20 bp, Artificial
  CRISPR gRNA sequence
gatgagttcatgtcctttgt

SEQ ID NO: 606617 - DNA, 20 bp, Artificial
  CRISPR gRNA sequence
atgagttcatgtcctttgta

SEQ ID NO: 606618 - DNA, 20 bp, Artificial
  CRISPR gRNA sequence
tcatgtcctttgtagggaca

SEQ ID NO: 606619 - DNA, 20 bp, Artificial
  CRISPR gRNA sequence
cctttgtagggacatggatg

SEQ ID NO: 606620 - DNA, 20 bp, Artificial
  CRISPR gRNA sequence
tgtagggacatggatgaagc

SEQ ID NO: 606621 - DNA, 20 bp, Artificial
  CRISPR gRNA sequence
aagctggaaaccatcattat

SEQ ID NO: 606622 - DNA, 20 bp, Artificial
  CRISPR gRNA sequence
cattatgagcaaactatcgc

SEQ ID NO: 606623 - DNA, 20 bp, Artificial
  CRISPR gRNA sequence
attatgagcaaactatcgca

SEQ ID NO: 606624 - DNA, 20 bp, Artificial
  CRISPR gRNA sequence
tgagcaaactatcgcaagga

SEQ ID NO: 606625 - DNA, 20 bp, Artificial
  CRISPR gRNA sequence
acaccgcatgttctcactca

SEQ ID NO: 606626 - DNA, 20 bp, Artificial
  CRISPR gRNA sequence
caccgcatgttctcactcat

SEQ ID NO: 606627 - DNA, 20 bp, Artificial
  CRISPR gRNA sequence
cgcatgttctcactcatagg

SEQ ID NO: 606628 - DNA, 20 bp, Artificial
  CRISPR gRNA sequence
gcatgttctcactcataggt

SEQ ID NO: 606629 - DNA, 20 bp, Artificial
  CRISPR gRNA sequence
ataggtgggaactgaacaat

SEQ ID NO: 606630 - DNA, 20 bp, Artificial
  CRISPR gRNA sequence
aactgaacaatgagaacact

SEQ ID NO: 606631 - DNA, 20 bp, Artificial
  CRISPR gRNA sequence
acaatgagaacacttggaca

SEQ ID NO: 606632 - DNA, 20 bp, Artificial
  CRISPR gRNA sequence
caatgagaacacttggacac

SEQ ID NO: 606633 - DNA, 20 bp, Artificial
  CRISPR gRNA sequence
aatgagaacacttggacaca

SEQ ID NO: 606634 - DNA, 20 bp, Artificial
  CRISPR gRNA sequence
gagaacacttggacacaggg

SEQ ID NO: 606635 - DNA, 20 bp, Artificial
  CRISPR gRNA sequence
agaacacttggacacagggt

SEQ ID NO: 606636 - DNA, 20 bp, Artificial
  CRISPR gRNA sequence
gaacacttggacacagggtg

SEQ ID NO: 606637 - DNA, 20 bp, Artificial
  CRISPR gRNA sequence
gggtggggaacatcacacac

SEQ ID NO: 606638 - DNA, 20 bp, Artificial
  CRISPR gRNA sequence
ggtggggaacatcacacact

SEQ ID NO: 606639 - DNA, 20 bp, Artificial
  CRISPR gRNA sequence
gtggggaacatcacacactg

SEQ ID NO: 606640 - DNA, 20 bp, Artificial
  CRISPR gRNA sequence
tcacacactggggcctgtca

SEQ ID NO: 606641 - DNA, 20 bp, Artificial
  CRISPR gRNA sequence
cacacactggggcctgtcat

SEQ ID NO: 606642 - DNA, 20 bp, Artificial
  CRISPR gRNA sequence
acacactggggcctgtcatg

SEQ ID NO: 606643 - DNA, 20 bp, Artificial
  CRISPR gRNA sequence
ctggggcctgtcatggggtg

SEQ ID NO: 606644 - DNA, 20 bp, Artificial
  CRISPR gRNA sequence
tggggcctgtcatggggtgc

SEQ ID NO: 606645 - DNA, 20 bp, Artificial
  CRISPR gRNA sequence
ggggcctgtcatggggtgca

SEQ ID NO: 606646 - DNA, 20 bp, Artificial
  CRISPR gRNA sequence
ggcctgtcatggggtgcagg

SEQ ID NO: 606647 - DNA, 20 bp, Artificial
  CRISPR gRNA sequence
ctgtcatggggtgcagggag

SEQ ID NO: 606648 - DNA, 20 bp, Artificial
  CRISPR gRNA sequence
tgtcatggggtgcagggagt

SEQ ID NO: 606649 - DNA, 20 bp, Artificial
  CRISPR gRNA sequence
gtcatggggtgcagggagtg

SEQ ID NO: 606650 - DNA, 20 bp, Artificial
  CRISPR gRNA sequence
catggggtgcagggagtggg

SEQ ID NO: 606651 - DNA, 20 bp, Artificial
  CRISPR gRNA sequence
atggggtgcagggagtgggg

SEQ ID NO: 606652 - DNA, 20 bp, Artificial
  CRISPR gRNA sequence
tggggtgcagggagtgggga

SEQ ID NO: 606653 - DNA, 20 bp, Artificial
  CRISPR gRNA sequence
ggtgcagggagtggggaggg

SEQ ID NO: 606654 - DNA, 20 bp, Artificial
  CRISPR gRNA sequence
tgcagggagtggggagggta

SEQ ID NO: 606655 - DNA, 20 bp, Artificial
  CRISPR gRNA sequence
gcagggagtggggagggtag

SEQ ID NO: 606656 - DNA, 20 bp, Artificial
  CRISPR gRNA sequence
cagggagtggggagggtaga

SEQ ID NO: 606657 - DNA, 20 bp, Artificial
  CRISPR gRNA sequence
gagtggggagggtagaggga

SEQ ID NO: 606658 - DNA, 20 bp, Artificial
  CRISPR gRNA sequence
ggagggtagagggatagcat

SEQ ID NO: 606659 - DNA, 20 bp, Artificial
  CRISPR gRNA sequence
gagggtagagggatagcatt

SEQ ID NO: 606660 - DNA, 20 bp, Artificial
  CRISPR gRNA sequence
gggtagagggatagcattag

SEQ ID NO: 606661 - DNA, 20 bp, Artificial
  CRISPR gRNA sequence
atatacctaatgtaaatgat

SEQ ID NO: 606662 - DNA, 20 bp, Artificial
  CRISPR gRNA sequence
taatgtaaatgatgagttaa

SEQ ID NO: 606663 - DNA, 20 bp, Artificial
  CRISPR gRNA sequence
aatgtaaatgatgagttaac

SEQ ID NO: 606664 - DNA, 20 bp, Artificial
  CRISPR gRNA sequence
aaatgatgagttaacgggtg

SEQ ID NO: 606665 - DNA, 20 bp, Artificial
  CRISPR gRNA sequence
acgggtgcagcacaccaaca

SEQ ID NO: 606666 - DNA, 20 bp, Artificial
  CRISPR gRNA sequence
catgttgtgcacatgtaccc

SEQ ID NO: 606667 - DNA, 20 bp, Artificial
  CRISPR gRNA sequence
cacatgtaccctagaactta

SEQ ID NO: 606668 - DNA, 20 bp, Artificial
  CRISPR gRNA sequence
agtataattaaaaaataaat

SEQ ID NO: 606669 - DNA, 20 bp, Artificial
  CRISPR gRNA sequence
attaaaaaataaattagtaa

SEQ ID NO: 606670 - DNA, 20 bp, Artificial
  CRISPR gRNA sequence
aaaaataaattagtaatgga

SEQ ID NO: 606671 - DNA, 20 bp, Artificial
  CRISPR gRNA sequence
ggatagtcatttcacatgtg

SEQ ID NO: 606672 - DNA, 20 bp, Artificial
  CRISPR gRNA sequence
acaactttttctttttaaat

SEQ ID NO: 606673 - DNA, 20 bp, Artificial
  CRISPR gRNA sequence
atgagttgcatttttttcct

SEQ ID NO: 606674 - DNA, 20 bp, Artificial
  CRISPR gRNA sequence
tttttttcctcagaactaca

SEQ ID NO: 606675 - DNA, 20 bp, Artificial
  CRISPR gRNA sequence
gaactacaaagtattaaaat

SEQ ID NO: 606676 - DNA, 20 bp, Artificial
  CRISPR gRNA sequence
aactacaaagtattaaaatc

SEQ ID NO: 606677 - DNA, 20 bp, Artificial
  CRISPR gRNA sequence
tgaattttatgcgtacgtgt

SEQ ID NO: 606678 - DNA, 20 bp, Artificial
  CRISPR gRNA sequence
gaattttatgcgtacgtgtg

SEQ ID NO: 606679 - DNA, 20 bp, Artificial
  CRISPR gRNA sequence
ttctgaattataaatgtgat

SEQ ID NO: 606680 - DNA, 20 bp, Artificial
  CRISPR gRNA sequence
ataaatgtgattagtgacat

SEQ ID NO: 606681 - DNA, 20 bp, Artificial
  CRISPR gRNA sequence
gtaaatgtttgctgcctctt

SEQ ID NO: 606682 - DNA, 20 bp, Artificial
  CRISPR gRNA sequence
ccatgcctttatgcaaatca

SEQ ID NO: 606683 - DNA, 20 bp, Artificial
  CRISPR gRNA sequence
tatgcaaatcaaagttccca

SEQ ID NO: 606684 - DNA, 20 bp, Artificial
  CRISPR gRNA sequence
aaagttcccacagaaataat

SEQ ID NO: 606685 - DNA, 20 bp, Artificial
  CRISPR gRNA sequence
cagaaataatgagtcaaata

SEQ ID NO: 606686 - DNA, 20 bp, Artificial
  CRISPR gRNA sequence
taatgagtcaaatacagcaa

SEQ ID NO: 606687 - DNA, 20 bp, Artificial
  CRISPR gRNA sequence
aatgagtcaaatacagcaac

SEQ ID NO: 606688 - DNA, 20 bp, Artificial
  CRISPR gRNA sequence
gagtcaaatacagcaacagg

SEQ ID NO: 606689 - DNA, 20 bp, Artificial
  CRISPR gRNA sequence
gcaacaggcagtgtttaaat

SEQ ID NO: 606690 - DNA, 20 bp, Artificial
  CRISPR gRNA sequence
tttttttcctctgctctgct

SEQ ID NO: 606691 - DNA, 20 bp, Artificial
  CRISPR gRNA sequence
ttttttcctctgctctgctt

SEQ ID NO: 606692 - DNA, 20 bp, Artificial
  CRISPR gRNA sequence
tttactatacattgcatatc

SEQ ID NO: 606693 - DNA, 20 bp, Artificial
  CRISPR gRNA sequence
atcaagacctttgatttgct

SEQ ID NO: 606694 - DNA, 20 bp, Artificial
  CRISPR gRNA sequence
tcaagacctttgatttgctc

SEQ ID NO: 606695 - DNA, 20 bp, Artificial
  CRISPR gRNA sequence
taccttttgtttcaaaacct

SEQ ID NO: 606696 - DNA, 20 bp, Artificial
  CRISPR gRNA sequence
aaacctaagattaccacttt

SEQ ID NO: 606697 - DNA, 20 bp, Artificial
  CRISPR gRNA sequence
gattaccactttaagtgtac

SEQ ID NO: 606698 - DNA, 20 bp, Artificial
  CRISPR gRNA sequence
ctttaagtgtactggtattg

SEQ ID NO: 606699 - DNA, 20 bp, Artificial
  CRISPR gRNA sequence
taagtgtactggtattgtgg

SEQ ID NO: 606700 - DNA, 20 bp, Artificial
  CRISPR gRNA sequence
aagtgtactggtattgtgga

SEQ ID NO: 606701 - DNA, 20 bp, Artificial
  CRISPR gRNA sequence
attgtggaaggtgttttatt

SEQ ID NO: 606702 - DNA, 20 bp, Artificial
  CRISPR gRNA sequence
ggaaggtgttttattcagaa

SEQ ID NO: 606703 - DNA, 20 bp, Artificial
  CRISPR gRNA sequence
aaggtgttttattcagaata

SEQ ID NO: 606704 - DNA, 20 bp, Artificial
  CRISPR gRNA sequence
agaatagagtaaatatatat

SEQ ID NO: 606705 - DNA, 20 bp, Artificial
  CRISPR gRNA sequence
aatagagtaaatatatatta

SEQ ID NO: 606706 - DNA, 20 bp, Artificial
  CRISPR gRNA sequence
tattctccctattgcattaa

SEQ ID NO: 606707 - DNA, 20 bp, Artificial
  CRISPR gRNA sequence
attctccctattgcattaac

SEQ ID NO: 606708 - DNA, 20 bp, Artificial
  CRISPR gRNA sequence
ttctccctattgcattaaca

SEQ ID NO: 606709 - DNA, 20 bp, Artificial
  CRISPR gRNA sequence
ctccctattgcattaacagg

SEQ ID NO: 606710 - DNA, 20 bp, Artificial
  CRISPR gRNA sequence
cattaacagggagatcttta

SEQ ID NO: 606711 - DNA, 20 bp, Artificial
  CRISPR gRNA sequence
ttaacagggagatctttatg

SEQ ID NO: 606712 - DNA, 20 bp, Artificial
  CRISPR gRNA sequence
agggagatctttatggagca

SEQ ID NO: 606713 - DNA, 20 bp, Artificial
  CRISPR gRNA sequence
gggagatctttatggagcaa

SEQ ID NO: 606714 - DNA, 20 bp, Artificial
  CRISPR gRNA sequence
gatctttatggagcaaaggc

SEQ ID NO: 606715 - DNA, 20 bp, Artificial
  CRISPR gRNA sequence
cagatcacttaataaaacca

SEQ ID NO: 606716 - DNA, 20 bp, Artificial
  CRISPR gRNA sequence
taaaaccacagtctgttttt

SEQ ID NO: 606717 - DNA, 20 bp, Artificial
  CRISPR gRNA sequence
cacagtctgttttttggcaa

SEQ ID NO: 606718 - DNA, 20 bp, Artificial
  CRISPR gRNA sequence
tttggcaatagtgttgaacc

SEQ ID NO: 606719 - DNA, 20 bp, Artificial
  CRISPR gRNA sequence
tggcaatagtgttgaacctg

SEQ ID NO: 606720 - DNA, 20 bp, Artificial
  CRISPR gRNA sequence
ggcaatagtgttgaacctgg

SEQ ID NO: 606721 - DNA, 20 bp, Artificial
  CRISPR gRNA sequence
atagtgttgaacctggagga

SEQ ID NO: 606722 - DNA, 20 bp, Artificial
  CRISPR gRNA sequence
tgttgaacctggaggaaagc

SEQ ID NO: 606723 - DNA, 20 bp, Artificial
  CRISPR gRNA sequence
acctggaggaaagccagtct

SEQ ID NO: 606724 - DNA, 20 bp, Artificial
  CRISPR gRNA sequence
ggaggaaagccagtcttagc

SEQ ID NO: 606725 - DNA, 20 bp, Artificial
  CRISPR gRNA sequence
agtcttagccagtataacgt

SEQ ID NO: 606726 - DNA, 20 bp, Artificial
  CRISPR gRNA sequence
aacgttagattccattccat

SEQ ID NO: 606727 - DNA, 20 bp, Artificial
  CRISPR gRNA sequence
attccattccatcagcataa

SEQ ID NO: 606728 - DNA, 20 bp, Artificial
  CRISPR gRNA sequence
atcagcataatagttaataa

SEQ ID NO: 606729 - DNA, 20 bp, Artificial
  CRISPR gRNA sequence
agttaataatagttgattga

SEQ ID NO: 606730 - DNA, 20 bp, Artificial
  CRISPR gRNA sequence
gttaataatagttgattgac

SEQ ID NO: 606731 - DNA, 20 bp, Artificial
  CRISPR gRNA sequence
ttaataatagttgattgaca

SEQ ID NO: 606732 - DNA, 20 bp, Artificial
  CRISPR gRNA sequence
agttgattgacagggatgtg

SEQ ID NO: 606733 - DNA, 20 bp, Artificial
  CRISPR gRNA sequence
gttgattgacagggatgtga

SEQ ID NO: 606734 - DNA, 20 bp, Artificial
  CRISPR gRNA sequence
ttgattgacagggatgtgaa

SEQ ID NO: 606735 - DNA, 20 bp, Artificial
  CRISPR gRNA sequence
ccattccacactaaactctc

SEQ ID NO: 606736 - DNA, 20 bp, Artificial
  CRISPR gRNA sequence
cattccacactaaactctct

SEQ ID NO: 606737 - DNA, 20 bp, Artificial
  CRISPR gRNA sequence
attccacactaaactctcta

SEQ ID NO: 606738 - DNA, 20 bp, Artificial
  CRISPR gRNA sequence
attcctaaaattctttgctt

SEQ ID NO: 606739 - DNA, 20 bp, Artificial
  CRISPR gRNA sequence
taaaattctttgcttgagca

SEQ ID NO: 606740 - DNA, 20 bp, Artificial
  CRISPR gRNA sequence
ttctttgcttgagcacagcc

SEQ ID NO: 606741 - DNA, 20 bp, Artificial
  CRISPR gRNA sequence
tctttgcttgagcacagcca

SEQ ID NO: 606742 - DNA, 20 bp, Artificial
  CRISPR gRNA sequence
ctttgcttgagcacagccaa

SEQ ID NO: 606743 - DNA, 20 bp, Artificial
  CRISPR gRNA sequence
tgagcacagccaagggctgc

SEQ ID NO: 606744 - DNA, 20 bp, Artificial
  CRISPR gRNA sequence
acagccaagggctgctggac

SEQ ID NO: 606745 - DNA, 20 bp, Artificial
  CRISPR gRNA sequence
tggactagtgcctgactgtt

SEQ ID NO: 606746 - DNA, 20 bp, Artificial
  CRISPR gRNA sequence
gactagtgcctgactgtttg

SEQ ID NO: 606747 - DNA, 20 bp, Artificial
  CRISPR gRNA sequence
actagtgcctgactgtttgg

SEQ ID NO: 606748 - DNA, 20 bp, Artificial
  CRISPR gRNA sequence
gtgcctgactgtttggaggc

SEQ ID NO: 606749 - DNA, 20 bp, Artificial
  CRISPR gRNA sequence
gcctgactgtttggaggctg

SEQ ID NO: 606750 - DNA, 20 bp, Artificial
  CRISPR gRNA sequence
ctgactgtttggaggctgga

SEQ ID NO: 606751 - DNA, 20 bp, Artificial
  CRISPR gRNA sequence
actgtttggaggctggagag

SEQ ID NO: 606752 - DNA, 20 bp, Artificial
  CRISPR gRNA sequence
ctgtttggaggctggagagt

SEQ ID NO: 606753 - DNA, 20 bp, Artificial
  CRISPR gRNA sequence
tgtttggaggctggagagta

SEQ ID NO: 606754 - DNA, 20 bp, Artificial
  CRISPR gRNA sequence
gtttggaggctggagagtag

SEQ ID NO: 606755 - DNA, 20 bp, Artificial
  CRISPR gRNA sequence
tttggaggctggagagtagg

SEQ ID NO: 606756 - DNA, 20 bp, Artificial
  CRISPR gRNA sequence
agagtagggggtctctctga

SEQ ID NO: 606757 - DNA, 20 bp, Artificial
  CRISPR gRNA sequence
agtagggggtctctctgaaa

SEQ ID NO: 606758 - DNA, 20 bp, Artificial
  CRISPR gRNA sequence
ggtctctctgaaagagttcc

SEQ ID NO: 606759 - DNA, 20 bp, Artificial
  CRISPR gRNA sequence
gaaagagttcctagtccctg

SEQ ID NO: 606760 - DNA, 20 bp, Artificial
  CRISPR gRNA sequence
tagtccctgtagtcgttgct

SEQ ID NO: 606761 - DNA, 20 bp, Artificial
  CRISPR gRNA sequence
agtccctgtagtcgttgctg

SEQ ID NO: 606762 - DNA, 20 bp, Artificial
  CRISPR gRNA sequence
ccctgtagtcgttgctgagg

SEQ ID NO: 606763 - DNA, 20 bp, Artificial
  CRISPR gRNA sequence
tagtcgttgctgaggaagcc

SEQ ID NO: 606764 - DNA, 20 bp, Artificial
  CRISPR gRNA sequence
tgaggaagcctagcaatctc

SEQ ID NO: 606765 - DNA, 20 bp, Artificial
  CRISPR gRNA sequence
tagcaatctctggacatctt

SEQ ID NO: 606766 - DNA, 20 bp, Artificial
  CRISPR gRNA sequence
agcaatctctggacatcttt

SEQ ID NO: 606767 - DNA, 20 bp, Artificial
  CRISPR gRNA sequence
gcaatctctggacatcttta

SEQ ID NO: 606768 - DNA, 20 bp, Artificial
  CRISPR gRNA sequence
tggacatctttagggatatg

SEQ ID NO: 606769 - DNA, 20 bp, Artificial
  CRISPR gRNA sequence
atctttagggatatgcagta

SEQ ID NO: 606770 - DNA, 20 bp, Artificial
  CRISPR gRNA sequence
tctttagggatatgcagtaa

SEQ ID NO: 606771 - DNA, 20 bp, Artificial
  CRISPR gRNA sequence
tagggatatgcagtaaaggt

SEQ ID NO: 606772 - DNA, 20 bp, Artificial
  CRISPR gRNA sequence
atgcagtaaaggtgagcttc

SEQ ID NO: 606773 - DNA, 20 bp, Artificial
  CRISPR gRNA sequence
tgcagtaaaggtgagcttcc

SEQ ID NO: 606774 - DNA, 20 bp, Artificial
  CRISPR gRNA sequence
gtaaaggtgagcttccgggc

SEQ ID NO: 606775 - DNA, 20 bp, Artificial
  CRISPR gRNA sequence
cctgaactaccttaatacca

SEQ ID NO: 606776 - DNA, 20 bp, Artificial
  CRISPR gRNA sequence
ctgaactaccttaataccat

SEQ ID NO: 606777 - DNA, 20 bp, Artificial
  CRISPR gRNA sequence
ctaccttaataccatgggat

SEQ ID NO: 606778 - DNA, 20 bp, Artificial
  CRISPR gRNA sequence
taccttaataccatgggatc

SEQ ID NO: 606779 - DNA, 20 bp, Artificial
  CRISPR gRNA sequence
ggatcacttttgcttccctt

SEQ ID NO: 606780 - DNA, 20 bp, Artificial
  CRISPR gRNA sequence
acacacattcatcttgtcca

SEQ ID NO: 606781 - DNA, 20 bp, Artificial
  CRISPR gRNA sequence
tcatcttgtccacagaaatt

SEQ ID NO: 606782 - DNA, 20 bp, Artificial
  CRISPR gRNA sequence
atcttgtccacagaaattta

SEQ ID NO: 606783 - DNA, 20 bp, Artificial
  CRISPR gRNA sequence
cagaaatttagagcttattt

SEQ ID NO: 606784 - DNA, 20 bp, Artificial
  CRISPR gRNA sequence
ttgttaaaactatattttgt

SEQ ID NO: 606785 - DNA, 20 bp, Artificial
  CRISPR gRNA sequence
aactatattttgttggtatt

SEQ ID NO: 606786 - DNA, 20 bp, Artificial
  CRISPR gRNA sequence
attttgttggtatttagtac

SEQ ID NO: 606787 - DNA, 20 bp, Artificial
  CRISPR gRNA sequence
ggtatttagtactggtaaat

SEQ ID NO: 606788 - DNA, 20 bp, Artificial
  CRISPR gRNA sequence
tggtaaattagtaacatttg

SEQ ID NO: 606789 - DNA, 20 bp, Artificial
  CRISPR gRNA sequence
ttccaactcttttttctttt

SEQ ID NO: 606790 - DNA, 20 bp, Artificial
  CRISPR gRNA sequence
ctcttttttctttttggatg

SEQ ID NO: 606791 - DNA, 20 bp, Artificial
  CRISPR gRNA sequence
tcttttttctttttggatgt

SEQ ID NO: 606792 - DNA, 20 bp, Artificial
  CRISPR gRNA sequence
tttttggatgtaggtatttg

SEQ ID NO: 606793 - DNA, 20 bp, Artificial
  CRISPR gRNA sequence
ttttggatgtaggtatttgc

SEQ ID NO: 606794 - DNA, 20 bp, Artificial
  CRISPR gRNA sequence
caggatatgaactattcaaa

SEQ ID NO: 606795 - DNA, 20 bp, Artificial
  CRISPR gRNA sequence
atgaactattcaaacagtta

SEQ ID NO: 606796 - DNA, 20 bp, Artificial
  CRISPR gRNA sequence
ttcaaacagttacagcattc

SEQ ID NO: 606797 - DNA, 20 bp, Artificial
  CRISPR gRNA sequence
tcaaacagttacagcattcc

SEQ ID NO: 606798 - DNA, 20 bp, Artificial
  CRISPR gRNA sequence
caaacagttacagcattcca

SEQ ID NO: 606799 - DNA, 20 bp, Artificial
  CRISPR gRNA sequence
cattccagggattctttccc

SEQ ID NO: 606800 - DNA, 20 bp, Artificial
  CRISPR gRNA sequence
ctggattctacatgctcaca

SEQ ID NO: 606801 - DNA, 20 bp, Artificial
  CRISPR gRNA sequence
ggattctacatgctcacatg

SEQ ID NO: 606802 - DNA, 20 bp, Artificial
  CRISPR gRNA sequence
tggagttatatttgaatacc

SEQ ID NO: 606803 - DNA, 20 bp, Artificial
  CRISPR gRNA sequence
agttatatttgaataccaag

SEQ ID NO: 606804 - DNA, 20 bp, Artificial
  CRISPR gRNA sequence
tgttgaatattgctgaacat

SEQ ID NO: 606805 - DNA, 20 bp, Artificial
  CRISPR gRNA sequence
gttgaatattgctgaacata

SEQ ID NO: 606806 - DNA, 20 bp, Artificial
  CRISPR gRNA sequence
ttgctgaacataaggttcac

SEQ ID NO: 606807 - DNA, 20 bp, Artificial
  CRISPR gRNA sequence
gaacataaggttcactagta

SEQ ID NO: 606808 - DNA, 20 bp, Artificial
  CRISPR gRNA sequence
ggttcactagtacagtgttt

SEQ ID NO: 606809 - DNA, 20 bp, Artificial
  CRISPR gRNA sequence
gttcactagtacagtgtttt

SEQ ID NO: 606810 - DNA, 20 bp, Artificial
  CRISPR gRNA sequence
tgttttaggtgaaaattcaa

SEQ ID NO: 606811 - DNA, 20 bp, Artificial
  CRISPR gRNA sequence
aaattcaaaagtttttttcc

SEQ ID NO: 606812 - DNA, 20 bp, Artificial
  CRISPR gRNA sequence
aaaagtttttttccaagtcc

SEQ ID NO: 606813 - DNA, 20 bp, Artificial
  CRISPR gRNA sequence
gtccaagtaatttatgtttt

SEQ ID NO: 606814 - DNA, 20 bp, Artificial
  CRISPR gRNA sequence
caagtaatttatgtttttag

SEQ ID NO: 606815 - DNA, 20 bp, Artificial
  CRISPR gRNA sequence
agtaatttatgtttttagtg

SEQ ID NO: 606816 - DNA, 20 bp, Artificial
  CRISPR gRNA sequence
ggagtaatgattcctatact

SEQ ID NO: 606817 - DNA, 20 bp, Artificial
  CRISPR gRNA sequence
gtaatgattcctatactaag

SEQ ID NO: 606818 - DNA, 20 bp, Artificial
  CRISPR gRNA sequence
cagttttgttttctttaatt

SEQ ID NO: 606819 - DNA, 20 bp, Artificial
  CRISPR gRNA sequence
ttgttttctttaatttggtg

SEQ ID NO: 606820 - DNA, 20 bp, Artificial
  CRISPR gRNA sequence
tttctttaatttggtgaagt

SEQ ID NO: 606821 - DNA, 20 bp, Artificial
  CRISPR gRNA sequence
aatttggtgaagttagcatt

SEQ ID NO: 606822 - DNA, 20 bp, Artificial
  CRISPR gRNA sequence
ttagcatttggtgttgccct

SEQ ID NO: 606823 - DNA, 20 bp, Artificial
  CRISPR gRNA sequence
atttggtgttgccctcagtt

SEQ ID NO: 606824 - DNA, 20 bp, Artificial
  CRISPR gRNA sequence
tttggtgttgccctcagttt

SEQ ID NO: 606825 - DNA, 20 bp, Artificial
  CRISPR gRNA sequence
gtgttgccctcagtttgggt

SEQ ID NO: 606826 - DNA, 20 bp, Artificial
  CRISPR gRNA sequence
taccccacgtctcaccactg

SEQ ID NO: 606827 - DNA, 20 bp, Artificial
  CRISPR gRNA sequence
cttttaatcaccaccttctc

SEQ ID NO: 606828 - DNA, 20 bp, Artificial
  CRISPR gRNA sequence
atcaccaccttctcaagttt

SEQ ID NO: 606829 - DNA, 20 bp, Artificial
  CRISPR gRNA sequence
ccttctcaagtttaagaact

SEQ ID NO: 606830 - DNA, 20 bp, Artificial
  CRISPR gRNA sequence
ctcaagtttaagaacttggc

SEQ ID NO: 606831 - DNA, 20 bp, Artificial
  CRISPR gRNA sequence
caagtttaagaacttggcca

SEQ ID NO: 606832 - DNA, 20 bp, Artificial
  CRISPR gRNA sequence
gaacttggccagagtgatcc

SEQ ID NO: 606833 - DNA, 20 bp, Artificial
  CRISPR gRNA sequence
ttggccagagtgatcccgga

SEQ ID NO: 606834 - DNA, 20 bp, Artificial
  CRISPR gRNA sequence
cggaaagtctcaacattttc

SEQ ID NO: 606835 - DNA, 20 bp, Artificial
  CRISPR gRNA sequence
aagtctcaacattttccagt

SEQ ID NO: 606836 - DNA, 20 bp, Artificial
  CRISPR gRNA sequence
tcaacattttccagtgagta

SEQ ID NO: 606837 - DNA, 20 bp, Artificial
  CRISPR gRNA sequence
tgagtaaagtccatctcttt

SEQ ID NO: 606838 - DNA, 20 bp, Artificial
  CRISPR gRNA sequence
agtaaagtccatctcttttg

SEQ ID NO: 606839 - DNA, 20 bp, Artificial
  CRISPR gRNA sequence
tcttgacacctatcattaac

SEQ ID NO: 606840 - DNA, 20 bp, Artificial
  CRISPR gRNA sequence
cttgacacctatcattaaca

SEQ ID NO: 606841 - DNA, 20 bp, Artificial
  CRISPR gRNA sequence
aacaaggctgcaacctcctt

SEQ ID NO: 606842 - DNA, 20 bp, Artificial
  CRISPR gRNA sequence
acaaggctgcaacctcctta

SEQ ID NO: 606843 - DNA, 20 bp, Artificial
  CRISPR gRNA sequence
caacctccttaaggataatc

SEQ ID NO: 606844 - DNA, 20 bp, Artificial
  CRISPR gRNA sequence
ctccttaaggataatcgaga

SEQ ID NO: 606845 - DNA, 20 bp, Artificial
  CRISPR gRNA sequence
tccttaaggataatcgagaa

SEQ ID NO: 606846 - DNA, 20 bp, Artificial
  CRISPR gRNA sequence
cttaaggataatcgagaaag

SEQ ID NO: 606847 - DNA, 20 bp, Artificial
  CRISPR gRNA sequence
gacctgctcttctgtatgta

SEQ ID NO: 606848 - DNA, 20 bp, Artificial
  CRISPR gRNA sequence
tgtatgtatagcaaaacata

SEQ ID NO: 606849 - DNA, 20 bp, Artificial
  CRISPR gRNA sequence
tatgtatagcaaaacataaa

SEQ ID NO: 606850 - DNA, 20 bp, Artificial
  CRISPR gRNA sequence
atgtatagcaaaacataaag

SEQ ID NO: 606851 - DNA, 20 bp, Artificial
  CRISPR gRNA sequence
caaaacataaagaggttata

SEQ ID NO: 606852 - DNA, 20 bp, Artificial
  CRISPR gRNA sequence
aacataaagaggttatacag

SEQ ID NO: 606853 - DNA, 20 bp, Artificial
  CRISPR gRNA sequence
acataaagaggttatacagc

SEQ ID NO: 606854 - DNA, 20 bp, Artificial
  CRISPR gRNA sequence
ggttatacagcaggatgcga

SEQ ID NO: 606855 - DNA, 20 bp, Artificial
  CRISPR gRNA sequence
aggatgcgatagttcttaaa

SEQ ID NO: 606856 - DNA, 20 bp, Artificial
  CRISPR gRNA sequence
gatgcgatagttcttaaata

SEQ ID NO: 606857 - DNA, 20 bp, Artificial
  CRISPR gRNA sequence
aatagagtgcatgcattgtc

SEQ ID NO: 606858 - DNA, 20 bp, Artificial
  CRISPR gRNA sequence
agagtgcatgcattgtctgg

SEQ ID NO: 606859 - DNA, 20 bp, Artificial
  CRISPR gRNA sequence
gagtgcatgcattgtctggc

SEQ ID NO: 606860 - DNA, 20 bp, Artificial
  CRISPR gRNA sequence
gtgttgcctccttcattcta

SEQ ID NO: 606861 - DNA, 20 bp, Artificial
  CRISPR gRNA sequence
tcattctacagattatgtta

SEQ ID NO: 606862 - DNA, 20 bp, Artificial
  CRISPR gRNA sequence
cattctacagattatgttat

SEQ ID NO: 606863 - DNA, 20 bp, Artificial
  CRISPR gRNA sequence
acagattatgttatgggttt

SEQ ID NO: 606864 - DNA, 20 bp, Artificial
  CRISPR gRNA sequence
cagattatgttatgggtttc

SEQ ID NO: 606865 - DNA, 20 bp, Artificial
  CRISPR gRNA sequence
tgggtttcaggtgtttttct

SEQ ID NO: 606866 - DNA, 20 bp, Artificial
  CRISPR gRNA sequence
gggtttcaggtgtttttctc

SEQ ID NO: 606867 - DNA, 20 bp, Artificial
  CRISPR gRNA sequence
ttcaggtgtttttctcaggt

SEQ ID NO: 606868 - DNA, 20 bp, Artificial
  CRISPR gRNA sequence
aatgctgcaacaccttcact

SEQ ID NO: 606869 - DNA, 20 bp, Artificial
  CRISPR gRNA sequence
gctgcaacaccttcactgag

SEQ ID NO: 606870 - DNA, 20 bp, Artificial
  CRISPR gRNA sequence
ctcattcttttattacacca

SEQ ID NO: 606871 - DNA, 20 bp, Artificial
  CRISPR gRNA sequence
ttattacaccatggtgaaac

SEQ ID NO: 606872 - DNA, 20 bp, Artificial
  CRISPR gRNA sequence
ccagcactgccaactctcat

SEQ ID NO: 606873 - DNA, 20 bp, Artificial
  CRISPR gRNA sequence
tataaatgaaactttaaaaa

SEQ ID NO: 606874 - DNA, 20 bp, Artificial
  CRISPR gRNA sequence
gaaactttaaaaatagtttc

SEQ ID NO: 606875 - DNA, 20 bp, Artificial
  CRISPR gRNA sequence
ttaaaaatagtttctggaat

SEQ ID NO: 606876 - DNA, 20 bp, Artificial
  CRISPR gRNA sequence
tagtttctggaataagatca

SEQ ID NO: 606877 - DNA, 20 bp, Artificial
  CRISPR gRNA sequence
gaataagatcatggtgaata

SEQ ID NO: 606878 - DNA, 20 bp, Artificial
  CRISPR gRNA sequence
atggtgaataaagtcctaac

SEQ ID NO: 606879 - DNA, 20 bp, Artificial
  CRISPR gRNA sequence
ctaactagattttttaaaca

SEQ ID NO: 606880 - DNA, 20 bp, Artificial
  CRISPR gRNA sequence
ttgaaatacattaatatatt

SEQ ID NO: 606881 - DNA, 20 bp, Artificial
  CRISPR gRNA sequence
tacattaatatatttagtgt

SEQ ID NO: 606882 - DNA, 20 bp, Artificial
  CRISPR gRNA sequence
gtgttggtatgttaatatat

SEQ ID NO: 606883 - DNA, 20 bp, Artificial
  CRISPR gRNA sequence
atataagccatttataccct

SEQ ID NO: 606884 - DNA, 20 bp, Artificial
  CRISPR gRNA sequence
tttataccctaagatgtcaa

SEQ ID NO: 606885 - DNA, 20 bp, Artificial
  CRISPR gRNA sequence
aatagtgtcacttgccttgc

SEQ ID NO: 606886 - DNA, 20 bp, Artificial
  CRISPR gRNA sequence
acttgccttgctggcaaatt

SEQ ID NO: 606887 - DNA, 20 bp, Artificial
  CRISPR gRNA sequence
tggcaaatttggctcataat

SEQ ID NO: 606888 - DNA, 20 bp, Artificial
  CRISPR gRNA sequence
taataagaacatgtgtccaa

SEQ ID NO: 606889 - DNA, 20 bp, Artificial
  CRISPR gRNA sequence
aataagaacatgtgtccaaa

SEQ ID NO: 606890 - DNA, 20 bp, Artificial
  CRISPR gRNA sequence
aaaaatatttaattgctctt

SEQ ID NO: 606891 - DNA, 20 bp, Artificial
  CRISPR gRNA sequence
tctttagtgccttttaataa

SEQ ID NO: 606892 - DNA, 20 bp, Artificial
  CRISPR gRNA sequence
ttagtgccttttaataaaag

SEQ ID NO: 606893 - DNA, 20 bp, Artificial
  CRISPR gRNA sequence
tagtgccttttaataaaaga

SEQ ID NO: 606894 - DNA, 20 bp, Artificial
  CRISPR gRNA sequence
gtgccttttaataaaagaag

SEQ ID NO: 606895 - DNA, 20 bp, Artificial
  CRISPR gRNA sequence
ttttaacatcatctgtttct

SEQ ID NO: 606896 - DNA, 20 bp, Artificial
  CRISPR gRNA sequence
atctgtttctaagtgtttct

SEQ ID NO: 606897 - DNA, 20 bp, Artificial
  CRISPR gRNA sequence
agtgtttctaagtgttttaa

SEQ ID NO: 606898 - DNA, 20 bp, Artificial
  CRISPR gRNA sequence
tgtttctaagtgttttaaaa

SEQ ID NO: 606899 - DNA, 20 bp, Artificial
  CRISPR gRNA sequence
tctaagtgttttaaaagaga

SEQ ID NO: 606900 - DNA, 20 bp, Artificial
  CRISPR gRNA sequence
tttaaaagagaaagatgact

SEQ ID NO: 606901 - DNA, 20 bp, Artificial
  CRISPR gRNA sequence
ttaaaagagaaagatgactt

SEQ ID NO: 606902 - DNA, 20 bp, Artificial
  CRISPR gRNA sequence
taaaagagaaagatgacttg

SEQ ID NO: 606903 - DNA, 20 bp, Artificial
  CRISPR gRNA sequence
aagagaaagatgacttgggg

SEQ ID NO: 606904 - DNA, 20 bp, Artificial
  CRISPR gRNA sequence
ttttgaacattattgtgtgc

SEQ ID NO: 606905 - DNA, 20 bp, Artificial
  CRISPR gRNA sequence
tgtgtgccagccactgtgtt

SEQ ID NO: 606906 - DNA, 20 bp, Artificial
  CRISPR gRNA sequence
cagccactgtgttaagtgcc

SEQ ID NO: 606907 - DNA, 20 bp, Artificial
  CRISPR gRNA sequence
tgtgttaagtgcctggaatg

SEQ ID NO: 606908 - DNA, 20 bp, Artificial
  CRISPR gRNA sequence
tgttaagtgcctggaatgca

SEQ ID NO: 606909 - DNA, 20 bp, Artificial
  CRISPR gRNA sequence
cctggaatgcagagatgaat

SEQ ID NO: 606910 - DNA, 20 bp, Artificial
  CRISPR gRNA sequence
gagatgaataagattgttct

SEQ ID NO: 606911 - DNA, 20 bp, Artificial
  CRISPR gRNA sequence
agatgaataagattgttctt

SEQ ID NO: 606912 - DNA, 20 bp, Artificial
  CRISPR gRNA sequence
ataagattgttcttgggtca

SEQ ID NO: 606913 - DNA, 20 bp, Artificial
  CRISPR gRNA sequence
tgttcttgggtcatagcgta

SEQ ID NO: 606914 - DNA, 20 bp, Artificial
  CRISPR gRNA sequence
ggtcatagcgtacagcgtaa

SEQ ID NO: 606915 - DNA, 20 bp, Artificial
  CRISPR gRNA sequence
catagcgtacagcgtaatag

SEQ ID NO: 606916 - DNA, 20 bp, Artificial
  CRISPR gRNA sequence
gtacagcgtaatagaagtga

SEQ ID NO: 606917 - DNA, 20 bp, Artificial
  CRISPR gRNA sequence
tgacagttaaattatatttg

SEQ ID NO: 606918 - DNA, 20 bp, Artificial
  CRISPR gRNA sequence
gttaaattatatttgcggtg

SEQ ID NO: 606919 - DNA, 20 bp, Artificial
  CRISPR gRNA sequence
gtgtagattcactattctgt

SEQ ID NO: 606920 - DNA, 20 bp, Artificial
  CRISPR gRNA sequence
tgtagattcactattctgtt

SEQ ID NO: 606921 - DNA, 20 bp, Artificial
  CRISPR gRNA sequence
tagattcactattctgttag

SEQ ID NO: 606922 - DNA, 20 bp, Artificial
  CRISPR gRNA sequence
gccattaatttcaccaaaat

SEQ ID NO: 606923 - DNA, 20 bp, Artificial
  CRISPR gRNA sequence
ttaatttcaccaaaattgga

SEQ ID NO: 606924 - DNA, 20 bp, Artificial
  CRISPR gRNA sequence
tttcaccaaaattggacaga

SEQ ID NO: 606925 - DNA, 20 bp, Artificial
  CRISPR gRNA sequence
ttcaccaaaattggacagaa

SEQ ID NO: 606926 - DNA, 20 bp, Artificial
  CRISPR gRNA sequence
tcaccaaaattggacagaaa

SEQ ID NO: 606927 - DNA, 20 bp, Artificial
  CRISPR gRNA sequence
gacagaaagggatattcttt

SEQ ID NO: 606928 - DNA, 20 bp, Artificial
  CRISPR gRNA sequence
acagaaagggatattctttt

SEQ ID NO: 606929 - DNA, 20 bp, Artificial
  CRISPR gRNA sequence
ttaggaaatcacattgaaac

SEQ ID NO: 606930 - DNA, 20 bp, Artificial
  CRISPR gRNA sequence
aactggaccttgaatcatga

SEQ ID NO: 606931 - DNA, 20 bp, Artificial
  CRISPR gRNA sequence
ggaccttgaatcatgaaagc

SEQ ID NO: 606932 - DNA, 20 bp, Artificial
  CRISPR gRNA sequence
aatcatgaaagctagaaaat

SEQ ID NO: 606933 - DNA, 20 bp, Artificial
  CRISPR gRNA sequence
atcatgaaagctagaaaatg

SEQ ID NO: 606934 - DNA, 20 bp, Artificial
  CRISPR gRNA sequence
gctagaaaatgaggacaaat

SEQ ID NO: 606935 - DNA, 20 bp, Artificial
  CRISPR gRNA sequence
ctagaaaatgaggacaaatg

SEQ ID NO: 606936 - DNA, 20 bp, Artificial
  CRISPR gRNA sequence
aaatgaggacatccaatgca

SEQ ID NO: 606937 - DNA, 20 bp, Artificial
  CRISPR gRNA sequence
aatgaggacatccaatgcaa

SEQ ID NO: 606938 - DNA, 20 bp, Artificial
  CRISPR gRNA sequence
atgaggacatccaatgcaaa

SEQ ID NO: 606939 - DNA, 20 bp, Artificial
  CRISPR gRNA sequence
aatgcaaagggatactacat

SEQ ID NO: 606940 - DNA, 20 bp, Artificial
  CRISPR gRNA sequence
aaagggatactacatgagca

SEQ ID NO: 606941 - DNA, 20 bp, Artificial
  CRISPR gRNA sequence
agggatactacatgagcaaa

SEQ ID NO: 606942 - DNA, 20 bp, Artificial
  CRISPR gRNA sequence
ggatactacatgagcaaaga

SEQ ID NO: 606943 - DNA, 20 bp, Artificial
  CRISPR gRNA sequence
acatgagcaaagagagttgt

SEQ ID NO: 606944 - DNA, 20 bp, Artificial
  CRISPR gRNA sequence
agagagttgtaagtatgtga

SEQ ID NO: 606945 - DNA, 20 bp, Artificial
  CRISPR gRNA sequence
gagagttgtaagtatgtgat

SEQ ID NO: 606946 - DNA, 20 bp, Artificial
  CRISPR gRNA sequence
taagtatgtgatgggctcta

SEQ ID NO: 606947 - DNA, 20 bp, Artificial
  CRISPR gRNA sequence
aagtatgtgatgggctctaa

SEQ ID NO: 606948 - DNA, 20 bp, Artificial
  CRISPR gRNA sequence
gatgggctctaaaggttaca

SEQ ID NO: 606949 - DNA, 20 bp, Artificial
  CRISPR gRNA sequence
ttacaaagtacaacttcaac

SEQ ID NO: 606950 - DNA, 20 bp, Artificial
  CRISPR gRNA sequence
tacaaagtacaacttcaaca

SEQ ID NO: 606951 - DNA, 20 bp, Artificial
  CRISPR gRNA sequence
ttaatgttattttattcttt

SEQ ID NO: 606952 - DNA, 20 bp, Artificial
  CRISPR gRNA sequence
gttattttattctttcagat

SEQ ID NO: 606953 - DNA, 20 bp, Artificial
  CRISPR gRNA sequence
tattttattctttcagatta

SEQ ID NO: 606954 - DNA, 20 bp, Artificial
  CRISPR gRNA sequence
tttattctttcagattagag

SEQ ID NO: 606955 - DNA, 20 bp, Artificial
  CRISPR gRNA sequence
ttattctttcagattagaga

SEQ ID NO: 606956 - DNA, 20 bp, Artificial
  CRISPR gRNA sequence
taatattttttcatgtgtaa

SEQ ID NO: 606957 - DNA, 20 bp, Artificial
  CRISPR gRNA sequence
aatattttttcatgtgtaaa

SEQ ID NO: 606958 - DNA, 20 bp, Artificial
  CRISPR gRNA sequence
tttcatgtgtaaaaggcctt

SEQ ID NO: 606959 - DNA, 20 bp, Artificial
  CRISPR gRNA sequence
taatgctcatcacctgatat

SEQ ID NO: 606960 - DNA, 20 bp, Artificial
  CRISPR gRNA sequence
aatgctcatcacctgatatt

SEQ ID NO: 606961 - DNA, 20 bp, Artificial
  CRISPR gRNA sequence
cacctgatattgggacttaa

SEQ ID NO: 606962 - DNA, 20 bp, Artificial
  CRISPR gRNA sequence
atattgggacttaatagtaa

SEQ ID NO: 606963 - DNA, 20 bp, Artificial
  CRISPR gRNA sequence
aatagtaacagaaaatactt

SEQ ID NO: 606964 - DNA, 20 bp, Artificial
  CRISPR gRNA sequence
gtaacagaaaatacttaaga

SEQ ID NO: 606965 - DNA, 20 bp, Artificial
  CRISPR gRNA sequence
taacagaaaatacttaagaa

SEQ ID NO: 606966 - DNA, 20 bp, Artificial
  CRISPR gRNA sequence
aacagaaaatacttaagaaa

SEQ ID NO: 606967 - DNA, 20 bp, Artificial
  CRISPR gRNA sequence
cagaaaatacttaagaaagg

SEQ ID NO: 606968 - DNA, 20 bp, Artificial
  CRISPR gRNA sequence
gaaaatacttaagaaaggga

SEQ ID NO: 606969 - DNA, 20 bp, Artificial
  CRISPR gRNA sequence
acttaagaaagggagagttg

SEQ ID NO: 606970 - DNA, 20 bp, Artificial
  CRISPR gRNA sequence
cttaagaaagggagagttga

SEQ ID NO: 606971 - DNA, 20 bp, Artificial
  CRISPR gRNA sequence
ttttttttcaatttcttttt

SEQ ID NO: 606972 - DNA, 20 bp, Artificial
  CRISPR gRNA sequence
ttttttcaatttctttttta

SEQ ID NO: 606973 - DNA, 20 bp, Artificial
  CRISPR gRNA sequence
atttcttttttagagtgaca

SEQ ID NO: 606974 - DNA, 20 bp, Artificial
  CRISPR gRNA sequence
tatcatcttatgattttttt

SEQ ID NO: 606975 - DNA, 20 bp, Artificial
  CRISPR gRNA sequence
ttttttcagaaacctttttg

SEQ ID NO: 606976 - DNA, 20 bp, Artificial
  CRISPR gRNA sequence
gtagaccttgttacttctgt

SEQ ID NO: 606977 - DNA, 20 bp, Artificial
  CRISPR gRNA sequence
atgttcatttccttacccca

SEQ ID NO: 606978 - DNA, 20 bp, Artificial
  CRISPR gRNA sequence
ccataataaaaatgattact

SEQ ID NO: 606979 - DNA, 20 bp, Artificial
  CRISPR gRNA sequence
acttttctaacactgaccat

SEQ ID NO: 606980 - DNA, 20 bp, Artificial
  CRISPR gRNA sequence
aatgaaattaacattgctgt

SEQ ID NO: 606981 - DNA, 20 bp, Artificial
  CRISPR gRNA sequence
acattgctgtgagtaaactg

SEQ ID NO: 606982 - DNA, 20 bp, Artificial
  CRISPR gRNA sequence
gctgtgagtaaactgtagtt

SEQ ID NO: 606983 - DNA, 20 bp, Artificial
  CRISPR gRNA sequence
ctgtgagtaaactgtagttt

SEQ ID NO: 606984 - DNA, 20 bp, Artificial
  CRISPR gRNA sequence
gtgagtaaactgtagtttag

SEQ ID NO: 606985 - DNA, 20 bp, Artificial
  CRISPR gRNA sequence
tagtttaggagaatcttttg

SEQ ID NO: 606986 - DNA, 20 bp, Artificial
  CRISPR gRNA sequence
ttaggagaatcttttgtagt

SEQ ID NO: 606987 - DNA, 20 bp, Artificial
  CRISPR gRNA sequence
taggagaatcttttgtagtg

SEQ ID NO: 606988 - DNA, 20 bp, Artificial
  CRISPR gRNA sequence
gaatcttttgtagtgaggaa

SEQ ID NO: 606989 - DNA, 20 bp, Artificial
  CRISPR gRNA sequence
gaacagaactattatttatt

SEQ ID NO: 606990 - DNA, 20 bp, Artificial
  CRISPR gRNA sequence
tattgagtatccctatatgt

SEQ ID NO: 606991 - DNA, 20 bp, Artificial
  CRISPR gRNA sequence
attgagtatccctatatgtt

SEQ ID NO: 606992 - DNA, 20 bp, Artificial
  CRISPR gRNA sequence
ctatatgttaggtactgtgt

SEQ ID NO: 606993 - DNA, 20 bp, Artificial
  CRISPR gRNA sequence
tatatgttaggtactgtgtg

SEQ ID NO: 606994 - DNA, 20 bp, Artificial
  CRISPR gRNA sequence
ctgtgtgaggtactttcata

SEQ ID NO: 606995 - DNA, 20 bp, Artificial
  CRISPR gRNA sequence
tttactccttaaaacttccc

SEQ ID NO: 606996 - DNA, 20 bp, Artificial
  CRISPR gRNA sequence
ctccttaaaacttccctgga

SEQ ID NO: 606997 - DNA, 20 bp, Artificial
  CRISPR gRNA sequence
agttattatctcaaatttct

SEQ ID NO: 606998 - DNA, 20 bp, Artificial
  CRISPR gRNA sequence
attatctcaaatttctaagc

SEQ ID NO: 606999 - DNA, 20 bp, Artificial
  CRISPR gRNA sequence
ttatctcaaatttctaagcc

SEQ ID NO: 607000 - DNA, 20 bp, Artificial
  CRISPR gRNA sequence
tatctcaaatttctaagcca

SEQ ID NO: 607001 - DNA, 20 bp, Artificial
  CRISPR gRNA sequence
ctcaaatttctaagccaggg

SEQ ID NO: 607002 - DNA, 20 bp, Artificial
  CRISPR gRNA sequence
tctaagccagggaagcattc

SEQ ID NO: 607003 - DNA, 20 bp, Artificial
  CRISPR gRNA sequence
ctaagccagggaagcattcc

SEQ ID NO: 607004 - DNA, 20 bp, Artificial
  CRISPR gRNA sequence
taagccagggaagcattcca

SEQ ID NO: 607005 - DNA, 20 bp, Artificial
  CRISPR gRNA sequence
ggaagcattccagggaaact

SEQ ID NO: 607006 - DNA, 20 bp, Artificial
  CRISPR gRNA sequence
gaagcattccagggaaactg

SEQ ID NO: 607007 - DNA, 20 bp, Artificial
  CRISPR gRNA sequence
ctaatatgctctgtgatata

SEQ ID NO: 607008 - DNA, 20 bp, Artificial
  CRISPR gRNA sequence
tatgctctgtgatatacagc

SEQ ID NO: 607009 - DNA, 20 bp, Artificial
  CRISPR gRNA sequence
ctctgtgatatacagctggt

SEQ ID NO: 607010 - DNA, 20 bp, Artificial
  CRISPR gRNA sequence
gatatacagctggtaagtga

SEQ ID NO: 607011 - DNA, 20 bp, Artificial
  CRISPR gRNA sequence
atatacagctggtaagtgac

SEQ ID NO: 607012 - DNA, 20 bp, Artificial
  CRISPR gRNA sequence
cagctggtaagtgacaggtt

SEQ ID NO: 607013 - DNA, 20 bp, Artificial
  CRISPR gRNA sequence
agctggtaagtgacaggttt

SEQ ID NO: 607014 - DNA, 20 bp, Artificial
  CRISPR gRNA sequence
caggtttgggatgcaaaatc

SEQ ID NO: 607015 - DNA, 20 bp, Artificial
  CRISPR gRNA sequence
aggtttgggatgcaaaatca

SEQ ID NO: 607016 - DNA, 20 bp, Artificial
  CRISPR gRNA sequence
tttgggatgcaaaatcaagg

SEQ ID NO: 607017 - DNA, 20 bp, Artificial
  CRISPR gRNA sequence
atcatatgctcactttactg

SEQ ID NO: 607018 - DNA, 20 bp, Artificial
  CRISPR gRNA sequence
atgctcactttactgtagtt

SEQ ID NO: 607019 - DNA, 20 bp, Artificial
  CRISPR gRNA sequence
tcactttactgtagtttaga

SEQ ID NO: 607020 - DNA, 20 bp, Artificial
  CRISPR gRNA sequence
cactttactgtagtttagac

SEQ ID NO: 607021 - DNA, 20 bp, Artificial
  CRISPR gRNA sequence
gacaggtgtacttgaataat

SEQ ID NO: 607022 - DNA, 20 bp, Artificial
  CRISPR gRNA sequence
aggtgtacttgaataattgg

SEQ ID NO: 607023 - DNA, 20 bp, Artificial
  CRISPR gRNA sequence
ggtgtacttgaataattggc

SEQ ID NO: 607024 - DNA, 20 bp, Artificial
  CRISPR gRNA sequence
ttgaataattggcaggtgac

SEQ ID NO: 607025 - DNA, 20 bp, Artificial
  CRISPR gRNA sequence
aattggcaggtgacaagtgt

SEQ ID NO: 607026 - DNA, 20 bp, Artificial
  CRISPR gRNA sequence
gcaggtgacaagtgtcagtt

SEQ ID NO: 607027 - DNA, 20 bp, Artificial
  CRISPR gRNA sequence
caggtgacaagtgtcagttt

SEQ ID NO: 607028 - DNA, 20 bp, Artificial
  CRISPR gRNA sequence
tcagtttgggtatttaaact

SEQ ID NO: 607029 - DNA, 20 bp, Artificial
  CRISPR gRNA sequence
cagtttgggtatttaaactg

SEQ ID NO: 607030 - DNA, 20 bp, Artificial
  CRISPR gRNA sequence
tattctatccccaacctttt

SEQ ID NO: 607031 - DNA, 20 bp, Artificial
  CRISPR gRNA sequence
tccccaacctttttggcacc

SEQ ID NO: 607032 - DNA, 20 bp, Artificial
  CRISPR gRNA sequence
acctttttggcaccaagtac

SEQ ID NO: 607033 - DNA, 20 bp, Artificial
  CRISPR gRNA sequence
ggcaccaagtactggttttg

SEQ ID NO: 607034 - DNA, 20 bp, Artificial
  CRISPR gRNA sequence
accaagtactggttttgtgg

SEQ ID NO: 607035 - DNA, 20 bp, Artificial
  CRISPR gRNA sequence
tgtggaagacaatttttcca

SEQ ID NO: 607036 - DNA, 20 bp, Artificial
  CRISPR gRNA sequence
agacaatttttccacagcct

SEQ ID NO: 607037 - DNA, 20 bp, Artificial
  CRISPR gRNA sequence
gacaatttttccacagcctg

SEQ ID NO: 607038 - DNA, 20 bp, Artificial
  CRISPR gRNA sequence
acaatttttccacagcctga

SEQ ID NO: 607039 - DNA, 20 bp, Artificial
  CRISPR gRNA sequence
tttttccacagcctgagggt

SEQ ID NO: 607040 - DNA, 20 bp, Artificial
  CRISPR gRNA sequence
ttccacagcctgagggttag

SEQ ID NO: 607041 - DNA, 20 bp, Artificial
  CRISPR gRNA sequence
tccacagcctgagggttagt

SEQ ID NO: 607042 - DNA, 20 bp, Artificial
  CRISPR gRNA sequence
ccacagcctgagggttagtg

SEQ ID NO: 607043 - DNA, 20 bp, Artificial
  CRISPR gRNA sequence
cacagcctgagggttagtgg

SEQ ID NO: 607044 - DNA, 20 bp, Artificial
  CRISPR gRNA sequence
gcctgagggttagtggggga

SEQ ID NO: 607045 - DNA, 20 bp, Artificial
  CRISPR gRNA sequence
gggttagtgggggatggttt

SEQ ID NO: 607046 - DNA, 20 bp, Artificial
  CRISPR gRNA sequence
ggttagtgggggatggtttc

SEQ ID NO: 607047 - DNA, 20 bp, Artificial
  CRISPR gRNA sequence
ggatggtttcgggatgattc

SEQ ID NO: 607048 - DNA, 20 bp, Artificial
  CRISPR gRNA sequence
atggtttcgggatgattcaa

SEQ ID NO: 607049 - DNA, 20 bp, Artificial
  CRISPR gRNA sequence
ttctataactcatcataatg

SEQ ID NO: 607050 - DNA, 20 bp, Artificial
  CRISPR gRNA sequence
tcatcataatgtagaatctg

SEQ ID NO: 607051 - DNA, 20 bp, Artificial
  CRISPR gRNA sequence
atcataatgtagaatctgtg

SEQ ID NO: 607052 - DNA, 20 bp, Artificial
  CRISPR gRNA sequence
tgtagaatctgtggagtcct

SEQ ID NO: 607053 - DNA, 20 bp, Artificial
  CRISPR gRNA sequence
taagcttgttttcctgcaac

SEQ ID NO: 607054 - DNA, 20 bp, Artificial
  CRISPR gRNA sequence
cttgttttcctgcaactaga

SEQ ID NO: 607055 - DNA, 20 bp, Artificial
  CRISPR gRNA sequence
ttcctgcaactagatagtcc

SEQ ID NO: 607056 - DNA, 20 bp, Artificial
  CRISPR gRNA sequence
tgcaactagatagtcccaga

SEQ ID NO: 607057 - DNA, 20 bp, Artificial
  CRISPR gRNA sequence
ctagatagtcccagatagtc

SEQ ID NO: 607058 - DNA, 20 bp, Artificial
  CRISPR gRNA sequence
tagatagtcccagatagtct

SEQ ID NO: 607059 - DNA, 20 bp, Artificial
  CRISPR gRNA sequence
agatagtcccagatagtctg

SEQ ID NO: 607060 - DNA, 20 bp, Artificial
  CRISPR gRNA sequence
gatagtcccagatagtctgg

SEQ ID NO: 607061 - DNA, 20 bp, Artificial
  CRISPR gRNA sequence
cccagatagtctgggggtga

SEQ ID NO: 607062 - DNA, 20 bp, Artificial
  CRISPR gRNA sequence
ccagatagtctgggggtgat

SEQ ID NO: 607063 - DNA, 20 bp, Artificial
  CRISPR gRNA sequence
agatagtctgggggtgatgg

SEQ ID NO: 607064 - DNA, 20 bp, Artificial
  CRISPR gRNA sequence
agtctgggggtgatgggaga

SEQ ID NO: 607065 - DNA, 20 bp, Artificial
  CRISPR gRNA sequence
ggggtgatgggagacagtga

SEQ ID NO: 607066 - DNA, 20 bp, Artificial
  CRISPR gRNA sequence
gggagacagtgacagatcat

SEQ ID NO: 607067 - DNA, 20 bp, Artificial
  CRISPR gRNA sequence
ggagacagtgacagatcatc

SEQ ID NO: 607068 - DNA, 20 bp, Artificial
  CRISPR gRNA sequence
agtgacagatcatcaggcgt

SEQ ID NO: 607069 - DNA, 20 bp, Artificial
  CRISPR gRNA sequence
atcaggcgttagattctcat

SEQ ID NO: 607070 - DNA, 20 bp, Artificial
  CRISPR gRNA sequence
tcaggcgttagattctcata

SEQ ID NO: 607071 - DNA, 20 bp, Artificial
  CRISPR gRNA sequence
aggcgttagattctcataag

SEQ ID NO: 607072 - DNA, 20 bp, Artificial
  CRISPR gRNA sequence
gattctcataaggagcacac

SEQ ID NO: 607073 - DNA, 20 bp, Artificial
  CRISPR gRNA sequence
ctcataaggagcacacaagc

SEQ ID NO: 607074 - DNA, 20 bp, Artificial
  CRISPR gRNA sequence
gagcacacaagctagatctc

SEQ ID NO: 607075 - DNA, 20 bp, Artificial
  CRISPR gRNA sequence
agctagatctctggcatgtg

SEQ ID NO: 607076 - DNA, 20 bp, Artificial
  CRISPR gRNA sequence
ggcatgtgcagttcacaata

SEQ ID NO: 607077 - DNA, 20 bp, Artificial
  CRISPR gRNA sequence
cacaataaagttcgccatct

SEQ ID NO: 607078 - DNA, 20 bp, Artificial
  CRISPR gRNA sequence
acaataaagttcgccatctg

SEQ ID NO: 607079 - DNA, 20 bp, Artificial
  CRISPR gRNA sequence
taaagttcgccatctgaggc

SEQ ID NO: 607080 - DNA, 20 bp, Artificial
  CRISPR gRNA sequence
aaagttcgccatctgaggct

SEQ ID NO: 607081 - DNA, 20 bp, Artificial
  CRISPR gRNA sequence
tcgccatctgaggctgggcg

SEQ ID NO: 607082 - DNA, 20 bp, Artificial
  CRISPR gRNA sequence
gtgcttcacacttgtaatcc

SEQ ID NO: 607083 - DNA, 20 bp, Artificial
  CRISPR gRNA sequence
cacttgtaatcctagtactt

SEQ ID NO: 607084 - DNA, 20 bp, Artificial
  CRISPR gRNA sequence
acttgtaatcctagtacttt

SEQ ID NO: 607085 - DNA, 20 bp, Artificial
  CRISPR gRNA sequence
ttgtaatcctagtactttgg

SEQ ID NO: 607086 - DNA, 20 bp, Artificial
  CRISPR gRNA sequence
tgtaatcctagtactttggg

SEQ ID NO: 607087 - DNA, 20 bp, Artificial
  CRISPR gRNA sequence
tcctagtactttgggaggcc

SEQ ID NO: 607088 - DNA, 20 bp, Artificial
  CRISPR gRNA sequence
cctagtactttgggaggccg

SEQ ID NO: 607089 - DNA, 20 bp, Artificial
  CRISPR gRNA sequence
agtactttgggaggccgagg

SEQ ID NO: 607090 - DNA, 20 bp, Artificial
  CRISPR gRNA sequence
gtactttgggaggccgaggt

SEQ ID NO: 607091 - DNA, 20 bp, Artificial
  CRISPR gRNA sequence
ctttgggaggccgaggtggg

SEQ ID NO: 607092 - DNA, 20 bp, Artificial
  CRISPR gRNA sequence
ccgaggtgggcggatcacct

SEQ ID NO: 607093 - DNA, 20 bp, Artificial
  CRISPR gRNA sequence
cgaggtgggcggatcacctg

SEQ ID NO: 607094 - DNA, 20 bp, Artificial
  CRISPR gRNA sequence
tgggcggatcacctgaggtt

SEQ ID NO: 607095 - DNA, 20 bp, Artificial
  CRISPR gRNA sequence
ggcggatcacctgaggttga

SEQ ID NO: 607096 - DNA, 20 bp, Artificial
  CRISPR gRNA sequence
tcacctgaggttgagagttt

SEQ ID NO: 607097 - DNA, 20 bp, Artificial
  CRISPR gRNA sequence
tgaggttgagagtttgagac

SEQ ID NO: 607098 - DNA, 20 bp, Artificial
  CRISPR gRNA sequence
tgagaccagcctgaccaaca

SEQ ID NO: 607099 - DNA, 20 bp, Artificial
  CRISPR gRNA sequence
agaccagcctgaccaacata

SEQ ID NO: 607100 - DNA, 20 bp, Artificial
  CRISPR gRNA sequence
aaaaaaaaaaaaaaaaaaaa

SEQ ID NO: 607101 - DNA, 20 bp, Artificial
  CRISPR gRNA sequence
aaaaaaaaaaaaaaaaaagt

SEQ ID NO: 607102 - DNA, 20 bp, Artificial
  CRISPR gRNA sequence
aaaaaaaaaaaaagttagcc

SEQ ID NO: 607103 - DNA, 20 bp, Artificial
  CRISPR gRNA sequence
aaaaaaaagttagcctggtg

SEQ ID NO: 607104 - DNA, 20 bp, Artificial
  CRISPR gRNA sequence
aaaaagttagcctggtgtgg

SEQ ID NO: 607105 - DNA, 20 bp, Artificial
  CRISPR gRNA sequence
gtggcgcatgtctgtaatcc

SEQ ID NO: 607106 - DNA, 20 bp, Artificial
  CRISPR gRNA sequence
cgcatgtctgtaatcccagc

SEQ ID NO: 607107 - DNA, 20 bp, Artificial
  CRISPR gRNA sequence
gcatgtctgtaatcccagct

SEQ ID NO: 607108 - DNA, 20 bp, Artificial
  CRISPR gRNA sequence
tctgtaatcccagctaggct

SEQ ID NO: 607109 - DNA, 20 bp, Artificial
  CRISPR gRNA sequence
ctgtaatcccagctaggctg

SEQ ID NO: 607110 - DNA, 20 bp, Artificial
  CRISPR gRNA sequence
taatcccagctaggctgagg

SEQ ID NO: 607111 - DNA, 20 bp, Artificial
  CRISPR gRNA sequence
aatcccagctaggctgaggc

SEQ ID NO: 607112 - DNA, 20 bp, Artificial
  CRISPR gRNA sequence
tcccagctaggctgaggcag

SEQ ID NO: 607113 - DNA, 20 bp, Artificial
  CRISPR gRNA sequence
gcaggagaatcgcttgaaac

SEQ ID NO: 607114 - DNA, 20 bp, Artificial
  CRISPR gRNA sequence
caggagaatcgcttgaaact

SEQ ID NO: 607115 - DNA, 20 bp, Artificial
  CRISPR gRNA sequence
ggagaatcgcttgaaactgg

SEQ ID NO: 607116 - DNA, 20 bp, Artificial
  CRISPR gRNA sequence
gagaatcgcttgaaactggg

SEQ ID NO: 607117 - DNA, 20 bp, Artificial
  CRISPR gRNA sequence
aatcgcttgaaactgggagg

SEQ ID NO: 607118 - DNA, 20 bp, Artificial
  CRISPR gRNA sequence
tcgcttgaaactgggaggca

SEQ ID NO: 607119 - DNA, 20 bp, Artificial
  CRISPR gRNA sequence
cgcttgaaactgggaggcag

SEQ ID NO: 607120 - DNA, 20 bp, Artificial
  CRISPR gRNA sequence
aaactgggaggcagaggttg

SEQ ID NO: 607121 - DNA, 20 bp, Artificial
  CRISPR gRNA sequence
tgggaggcagaggttgtggt

SEQ ID NO: 607122 - DNA, 20 bp, Artificial
  CRISPR gRNA sequence
ggcagaggttgtggtgagcc

SEQ ID NO: 607123 - DNA, 20 bp, Artificial
  CRISPR gRNA sequence
aagattgcgccattgcactc

SEQ ID NO: 607124 - DNA, 20 bp, Artificial
  CRISPR gRNA sequence
tgcgccattgcactccagcc

SEQ ID NO: 607125 - DNA, 20 bp, Artificial
  CRISPR gRNA sequence
gcgccattgcactccagcct

SEQ ID NO: 607126 - DNA, 20 bp, Artificial
  CRISPR gRNA sequence
tgcactccagcctgggcaac

SEQ ID NO: 607127 - DNA, 20 bp, Artificial
  CRISPR gRNA sequence
cactccagcctgggcaacaa

SEQ ID NO: 607128 - DNA, 20 bp, Artificial
  CRISPR gRNA sequence
aaaaaaaaaaaaaaaaaaaa

SEQ ID NO: 607129 - DNA, 20 bp, Artificial
  CRISPR gRNA sequence
aaaaaaaaaaaaaaaaaaaa

SEQ ID NO: 607130 - DNA, 20 bp, Artificial
  CRISPR gRNA sequence
aaaaaggttcgccgtcctat

SEQ ID NO: 607131 - DNA, 20 bp, Artificial
  CRISPR gRNA sequence
ttcgccgtcctatgagaatc

SEQ ID NO: 607132 - DNA, 20 bp, Artificial
  CRISPR gRNA sequence
cctatgagaatctagtgcca

SEQ ID NO: 607133 - DNA, 20 bp, Artificial
  CRISPR gRNA sequence
tagtgccatagctgatctga

SEQ ID NO: 607134 - DNA, 20 bp, Artificial
  CRISPR gRNA sequence
agtgccatagctgatctgac

SEQ ID NO: 607135 - DNA, 20 bp, Artificial
  CRISPR gRNA sequence
tgccatagctgatctgacag

SEQ ID NO: 607136 - DNA, 20 bp, Artificial
  CRISPR gRNA sequence
gccatagctgatctgacagg

SEQ ID NO: 607137 - DNA, 20 bp, Artificial
  CRISPR gRNA sequence
atagctgatctgacaggagg

SEQ ID NO: 607138 - DNA, 20 bp, Artificial
  CRISPR gRNA sequence
agctgatctgacaggaggtg

SEQ ID NO: 607139 - DNA, 20 bp, Artificial
  CRISPR gRNA sequence
tctgacaggaggtggagctc

SEQ ID NO: 607140 - DNA, 20 bp, Artificial
  CRISPR gRNA sequence
gacaggaggtggagctcaag

SEQ ID NO: 607141 - DNA, 20 bp, Artificial
  CRISPR gRNA sequence
aggaggtggagctcaagcag

SEQ ID NO: 607142 - DNA, 20 bp, Artificial
  CRISPR gRNA sequence
tggagctcaagcagtagtat

SEQ ID NO: 607143 - DNA, 20 bp, Artificial
  CRISPR gRNA sequence
gagctcaagcagtagtatga

SEQ ID NO: 607144 - DNA, 20 bp, Artificial
  CRISPR gRNA sequence
tcaagcagtagtatgagaga

SEQ ID NO: 607145 - DNA, 20 bp, Artificial
  CRISPR gRNA sequence
caagcagtagtatgagagat

SEQ ID NO: 607146 - DNA, 20 bp, Artificial
  CRISPR gRNA sequence
gcagtagtatgagagatggg

SEQ ID NO: 607147 - DNA, 20 bp, Artificial
  CRISPR gRNA sequence
gatgggaagtgctgtaaata

SEQ ID NO: 607148 - DNA, 20 bp, Artificial
  CRISPR gRNA sequence
ggaagtgctgtaaatacaga

SEQ ID NO: 607149 - DNA, 20 bp, Artificial
  CRISPR gRNA sequence
aagtgctgtaaatacagatg

SEQ ID NO: 607150 - DNA, 20 bp, Artificial
  CRISPR gRNA sequence
ctcacctcctgctatgtgac

SEQ ID NO: 607151 - DNA, 20 bp, Artificial
  CRISPR gRNA sequence
ctatgtgaccagtttcctac

SEQ ID NO: 607152 - DNA, 20 bp, Artificial
  CRISPR gRNA sequence
agtttcctactggttcctac

SEQ ID NO: 607153 - DNA, 20 bp, Artificial
  CRISPR gRNA sequence
tactggttcctactggtccc

SEQ ID NO: 607154 - DNA, 20 bp, Artificial
  CRISPR gRNA sequence
gttcctactggtccctggcc

SEQ ID NO: 607155 - DNA, 20 bp, Artificial
  CRISPR gRNA sequence
ttcctactggtccctggcct

SEQ ID NO: 607156 - DNA, 20 bp, Artificial
  CRISPR gRNA sequence
tcctactggtccctggcctg

SEQ ID NO: 607157 - DNA, 20 bp, Artificial
  CRISPR gRNA sequence
ctggtccctggcctggggtt

SEQ ID NO: 607158 - DNA, 20 bp, Artificial
  CRISPR gRNA sequence
tggtccctggcctggggttt

SEQ ID NO: 607159 - DNA, 20 bp, Artificial
  CRISPR gRNA sequence
ggtccctggcctggggtttg

SEQ ID NO: 607160 - DNA, 20 bp, Artificial
  CRISPR gRNA sequence
gcctggggtttggggatgcc

SEQ ID NO: 607161 - DNA, 20 bp, Artificial
  CRISPR gRNA sequence
ggtttggggatgcctggcac

SEQ ID NO: 607162 - DNA, 20 bp, Artificial
  CRISPR gRNA sequence
atgcctggcactagaactta

SEQ ID NO: 607163 - DNA, 20 bp, Artificial
  CRISPR gRNA sequence
cctggcactagaacttatag

SEQ ID NO: 607164 - DNA, 20 bp, Artificial
  CRISPR gRNA sequence
ttgaacttcaaacattgcaa

SEQ ID NO: 607165 - DNA, 20 bp, Artificial
  CRISPR gRNA sequence
aacttcaaacattgcaaaag

SEQ ID NO: 607166 - DNA, 20 bp, Artificial
  CRISPR gRNA sequence
cttcaaacattgcaaaagca

SEQ ID NO: 607167 - DNA, 20 bp, Artificial
  CRISPR gRNA sequence
cagagtgttttcattactta

SEQ ID NO: 607168 - DNA, 20 bp, Artificial
  CRISPR gRNA sequence
agtgttttcattacttaaag

SEQ ID NO: 607169 - DNA, 20 bp, Artificial
  CRISPR gRNA sequence
cttaaagtagtgtttaattt

SEQ ID NO: 607170 - DNA, 20 bp, Artificial
  CRISPR gRNA sequence
ttttagcatgtcttactttc

SEQ ID NO: 607171 - DNA, 20 bp, Artificial
  CRISPR gRNA sequence
catgtcttactttctggcta

SEQ ID NO: 607172 - DNA, 20 bp, Artificial
  CRISPR gRNA sequence
tttctggctatagtttttaa

SEQ ID NO: 607173 - DNA, 20 bp, Artificial
  CRISPR gRNA sequence
taatagacttttcaactata

SEQ ID NO: 607174 - DNA, 20 bp, Artificial
  CRISPR gRNA sequence
tatatggctcattttaactg

SEQ ID NO: 607175 - DNA, 20 bp, Artificial
  CRISPR gRNA sequence
atatggctcattttaactga

SEQ ID NO: 607176 - DNA, 20 bp, Artificial
  CRISPR gRNA sequence
attttaactgaaggtttaaa

SEQ ID NO: 607177 - DNA, 20 bp, Artificial
  CRISPR gRNA sequence
aaaaagtcattttgttgtct

SEQ ID NO: 607178 - DNA, 20 bp, Artificial
  CRISPR gRNA sequence
aaagtcattttgttgtctca

SEQ ID NO: 607179 - DNA, 20 bp, Artificial
  CRISPR gRNA sequence
aagtcattttgttgtctcag

SEQ ID NO: 607180 - DNA, 20 bp, Artificial
  CRISPR gRNA sequence
gtataaaattaccatcaaat

SEQ ID NO: 607181 - DNA, 20 bp, Artificial
  CRISPR gRNA sequence
taaaattaccatcaaataag

SEQ ID NO: 607182 - DNA, 20 bp, Artificial
  CRISPR gRNA sequence
atcaaataagcagacatatg

SEQ ID NO: 607183 - DNA, 20 bp, Artificial
  CRISPR gRNA sequence
tcaaataagcagacatatga

SEQ ID NO: 607184 - DNA, 20 bp, Artificial
  CRISPR gRNA sequence
taagcagacatatgaaggaa

SEQ ID NO: 607185 - DNA, 20 bp, Artificial
  CRISPR gRNA sequence
agaaatataaaatgcttttc

SEQ ID NO: 607186 - DNA, 20 bp, Artificial
  CRISPR gRNA sequence
gttaaaaaccctgcaaacca

SEQ ID NO: 607187 - DNA, 20 bp, Artificial
  CRISPR gRNA sequence
tatattttgcaaacatattt

SEQ ID NO: 607188 - DNA, 20 bp, Artificial
  CRISPR gRNA sequence
attttgcaaacatattttag

SEQ ID NO: 607189 - DNA, 20 bp, Artificial
  CRISPR gRNA sequence
ttttgcaaacatattttaga

SEQ ID NO: 607190 - DNA, 20 bp, Artificial
  CRISPR gRNA sequence
aggaaaacttgaactgtcaa

SEQ ID NO: 607191 - DNA, 20 bp, Artificial
  CRISPR gRNA sequence
aaaacttgaactgtcaaaag

SEQ ID NO: 607192 - DNA, 20 bp, Artificial
  CRISPR gRNA sequence
caaaagtagtgaaatgtctc

SEQ ID NO: 607193 - DNA, 20 bp, Artificial
  CRISPR gRNA sequence
tgaaatgtctccagtgttta

SEQ ID NO: 607194 - DNA, 20 bp, Artificial
  CRISPR gRNA sequence
ccagtgtttatggatgtaat

SEQ ID NO: 607195 - DNA, 20 bp, Artificial
  CRISPR gRNA sequence
tatggatgtaataagtgaat

SEQ ID NO: 607196 - DNA, 20 bp, Artificial
  CRISPR gRNA sequence
accccatccaaaaaaattgt

SEQ ID NO: 607197 - DNA, 20 bp, Artificial
  CRISPR gRNA sequence
aaattgtcagtgaaatttat

SEQ ID NO: 607198 - DNA, 20 bp, Artificial
  CRISPR gRNA sequence
gagtctttttgctatctgta

SEQ ID NO: 607199 - DNA, 20 bp, Artificial
  CRISPR gRNA sequence
gtctttttgctatctgtatg

SEQ ID NO: 607200 - DNA, 20 bp, Artificial
  CRISPR gRNA sequence
ttttgctatctgtatggagt

SEQ ID NO: 607201 - DNA, 20 bp, Artificial
  CRISPR gRNA sequence
tgctatctgtatggagttgg

SEQ ID NO: 607202 - DNA, 20 bp, Artificial
  CRISPR gRNA sequence
tatctgtatggagttggcag

SEQ ID NO: 607203 - DNA, 20 bp, Artificial
  CRISPR gRNA sequence
atctgtatggagttggcagc

SEQ ID NO: 607204 - DNA, 20 bp, Artificial
  CRISPR gRNA sequence
cacacactcaccaaactttg

SEQ ID NO: 607205 - DNA, 20 bp, Artificial
  CRISPR gRNA sequence
acactcaccaaactttgaag

SEQ ID NO: 607206 - DNA, 20 bp, Artificial
  CRISPR gRNA sequence
actcaccaaactttgaagaa

SEQ ID NO: 607207 - DNA, 20 bp, Artificial
  CRISPR gRNA sequence
ttttaacccttgctttataa

SEQ ID NO: 607208 - DNA, 20 bp, Artificial
  CRISPR gRNA sequence
tttaacccttgctttataat

SEQ ID NO: 607209 - DNA, 20 bp, Artificial
  CRISPR gRNA sequence
acccttgctttataataggc

SEQ ID NO: 607210 - DNA, 20 bp, Artificial
  CRISPR gRNA sequence
ttcttcatattctgtatact

SEQ ID NO: 607211 - DNA, 20 bp, Artificial
  CRISPR gRNA sequence
ttctgtatactgagtgcctt

SEQ ID NO: 607212 - DNA, 20 bp, Artificial
  CRISPR gRNA sequence
cttgagtaatttgaatgata

SEQ ID NO: 607213 - DNA, 20 bp, Artificial
  CRISPR gRNA sequence
ttgagtaatttgaatgatat

SEQ ID NO: 607214 - DNA, 20 bp, Artificial
  CRISPR gRNA sequence
atattgactatatatgtgtt

SEQ ID NO: 607215 - DNA, 20 bp, Artificial
  CRISPR gRNA sequence
agttctaaatccaataaact

SEQ ID NO: 607216 - DNA, 20 bp, Artificial
  CRISPR gRNA sequence
ttctaaatccaataaactta

SEQ ID NO: 607217 - DNA, 20 bp, Artificial
  CRISPR gRNA sequence
ccaataaacttagagtttta

SEQ ID NO: 607218 - DNA, 20 bp, Artificial
  CRISPR gRNA sequence
ttagagttttaaagttgact

SEQ ID NO: 607219 - DNA, 20 bp, Artificial
  CRISPR gRNA sequence
agttttaaagttgacttagt

SEQ ID NO: 607220 - DNA, 20 bp, Artificial
  CRISPR gRNA sequence
ttttaaagttgacttagtca

SEQ ID NO: 607221 - DNA, 20 bp, Artificial
  CRISPR gRNA sequence
tttaaagttgacttagtcag

SEQ ID NO: 607222 - DNA, 20 bp, Artificial
  CRISPR gRNA sequence
ttaaagttgacttagtcaga

SEQ ID NO: 607223 - DNA, 20 bp, Artificial
  CRISPR gRNA sequence
gtttgcttcattgctaacat

SEQ ID NO: 607224 - DNA, 20 bp, Artificial
  CRISPR gRNA sequence
cttcattgctaacattagca

SEQ ID NO: 607225 - DNA, 20 bp, Artificial
  CRISPR gRNA sequence
cttgcattaatataacatca

SEQ ID NO: 607226 - DNA, 20 bp, Artificial
  CRISPR gRNA sequence
ttgcattaatataacatcac

SEQ ID NO: 607227 - DNA, 20 bp, Artificial
  CRISPR gRNA sequence
ttaatataacatcacaggat

SEQ ID NO: 607228 - DNA, 20 bp, Artificial
  CRISPR gRNA sequence
tataacatcacaggataagc

SEQ ID NO: 607229 - DNA, 20 bp, Artificial
  CRISPR gRNA sequence
tcacaggataagctagtaaa

SEQ ID NO: 607230 - DNA, 20 bp, Artificial
  CRISPR gRNA sequence
taagctagtaaaaagtacat

SEQ ID NO: 607231 - DNA, 20 bp, Artificial
  CRISPR gRNA sequence
aaaagtacattggtttataa

SEQ ID NO: 607232 - DNA, 20 bp, Artificial
  CRISPR gRNA sequence
agtacattggtttataaaag

SEQ ID NO: 607233 - DNA, 20 bp, Artificial
  CRISPR gRNA sequence
gtacattggtttataaaaga

SEQ ID NO: 607234 - DNA, 20 bp, Artificial
  CRISPR gRNA sequence
tacattggtttataaaagaa

SEQ ID NO: 607235 - DNA, 20 bp, Artificial
  CRISPR gRNA sequence
tgtatatttgctcatatttc

SEQ ID NO: 607236 - DNA, 20 bp, Artificial
  CRISPR gRNA sequence
tatttgctcatatttctaga

SEQ ID NO: 607237 - DNA, 20 bp, Artificial
  CRISPR gRNA sequence
gctgttttatttccttaatt

SEQ ID NO: 607238 - DNA, 20 bp, Artificial
  CRISPR gRNA sequence
aatttggctgtaaacttctt

SEQ ID NO: 607239 - DNA, 20 bp, Artificial
  CRISPR gRNA sequence
tttggctgtaaacttcttga

SEQ ID NO: 607240 - DNA, 20 bp, Artificial
  CRISPR gRNA sequence
gctgtaaacttcttgagagt

SEQ ID NO: 607241 - DNA, 20 bp, Artificial
  CRISPR gRNA sequence
ctgtaaacttcttgagagta

SEQ ID NO: 607242 - DNA, 20 bp, Artificial
  CRISPR gRNA sequence
ttgtatttattcctcaaact

SEQ ID NO: 607243 - DNA, 20 bp, Artificial
  CRISPR gRNA sequence
attcctcaaacttagcacaa

SEQ ID NO: 607244 - DNA, 20 bp, Artificial
  CRISPR gRNA sequence
cacaatagtttttctattgc

SEQ ID NO: 607245 - DNA, 20 bp, Artificial
  CRISPR gRNA sequence
gtttttctattgcaagcctt

SEQ ID NO: 607246 - DNA, 20 bp, Artificial
  CRISPR gRNA sequence
tgaaaaactgttttaacata

SEQ ID NO: 607247 - DNA, 20 bp, Artificial
  CRISPR gRNA sequence
atatagcacataacaatgta

SEQ ID NO: 607248 - DNA, 20 bp, Artificial
  CRISPR gRNA sequence
aacaatgtatagaacaaaac

SEQ ID NO: 607249 - DNA, 20 bp, Artificial
  CRISPR gRNA sequence
ttgacatgttatcaaaatcc

SEQ ID NO: 607250 - DNA, 20 bp, Artificial
  CRISPR gRNA sequence
cctagatatttcatcactat

SEQ ID NO: 607251 - DNA, 20 bp, Artificial
  CRISPR gRNA sequence
ctagatatttcatcactatt

SEQ ID NO: 607252 - DNA, 20 bp, Artificial
  CRISPR gRNA sequence
catcactattgggtaacttg

SEQ ID NO: 607253 - DNA, 20 bp, Artificial
  CRISPR gRNA sequence
actattgggtaacttgtagt

SEQ ID NO: 607254 - DNA, 20 bp, Artificial
  CRISPR gRNA sequence
cttgcctttaacttgatcat

SEQ ID NO: 607255 - DNA, 20 bp, Artificial
  CRISPR gRNA sequence
catgagtcccacttgctctt

SEQ ID NO: 607256 - DNA, 20 bp, Artificial
  CRISPR gRNA sequence
tgagtcccacttgctcttca

SEQ ID NO: 607257 - DNA, 20 bp, Artificial
  CRISPR gRNA sequence
gctcttcagagacctttctt

SEQ ID NO: 607258 - DNA, 20 bp, Artificial
  CRISPR gRNA sequence
ctcttcagagacctttcttt

SEQ ID NO: 607259 - DNA, 20 bp, Artificial
  CRISPR gRNA sequence
gacctttctttaggtctata

SEQ ID NO: 607260 - DNA, 20 bp, Artificial
  CRISPR gRNA sequence
agttcttattaaaatataac

SEQ ID NO: 607261 - DNA, 20 bp, Artificial
  CRISPR gRNA sequence
ttattaaaatataactagtt

SEQ ID NO: 607262 - DNA, 20 bp, Artificial
  CRISPR gRNA sequence
gttcttatttaaacttattt

SEQ ID NO: 607263 - DNA, 20 bp, Artificial
  CRISPR gRNA sequence
ttcttatttaaacttattta

SEQ ID NO: 607264 - DNA, 20 bp, Artificial
  CRISPR gRNA sequence
taaggacctccctgactttg

SEQ ID NO: 607265 - DNA, 20 bp, Artificial
  CRISPR gRNA sequence
gacctccctgactttgcagc

SEQ ID NO: 607266 - DNA, 20 bp, Artificial
  CRISPR gRNA sequence
ttacaattgaatatccttaa

SEQ ID NO: 607267 - DNA, 20 bp, Artificial
  CRISPR gRNA sequence
ttgaatatccttaatggact

SEQ ID NO: 607268 - DNA, 20 bp, Artificial
  CRISPR gRNA sequence
tccttaatggactcagattc

SEQ ID NO: 607269 - DNA, 20 bp, Artificial
  CRISPR gRNA sequence
cagattctggaccctacccc

SEQ ID NO: 607270 - DNA, 20 bp, Artificial
  CRISPR gRNA sequence
gattctggaccctaccccca

SEQ ID NO: 607271 - DNA, 20 bp, Artificial
  CRISPR gRNA sequence
attctggaccctacccccag

SEQ ID NO: 607272 - DNA, 20 bp, Artificial
  CRISPR gRNA sequence
accctacccccagaggatat

SEQ ID NO: 607273 - DNA, 20 bp, Artificial
  CRISPR gRNA sequence
ccctacccccagaggatatt

SEQ ID NO: 607274 - DNA, 20 bp, Artificial
  CRISPR gRNA sequence
ctacccccagaggatattag

SEQ ID NO: 607275 - DNA, 20 bp, Artificial
  CRISPR gRNA sequence
tacccccagaggatattagg

SEQ ID NO: 607276 - DNA, 20 bp, Artificial
  CRISPR gRNA sequence
acccccagaggatattagga

SEQ ID NO: 607277 - DNA, 20 bp, Artificial
  CRISPR gRNA sequence
cccccagaggatattaggag

SEQ ID NO: 607278 - DNA, 20 bp, Artificial
  CRISPR gRNA sequence
agaggatattaggaggggtg

SEQ ID NO: 607279 - DNA, 20 bp, Artificial
  CRISPR gRNA sequence
ggatattaggaggggtgtag

SEQ ID NO: 607280 - DNA, 20 bp, Artificial
  CRISPR gRNA sequence
ggaggggtgtagtagctcac

SEQ ID NO: 607281 - DNA, 20 bp, Artificial
  CRISPR gRNA sequence
ggtgtagtagctcactagtt

SEQ ID NO: 607282 - DNA, 20 bp, Artificial
  CRISPR gRNA sequence
tagctcactagtttagtaca

SEQ ID NO: 607283 - DNA, 20 bp, Artificial
  CRISPR gRNA sequence
tacacagtcacatttaatgt

SEQ ID NO: 607284 - DNA, 20 bp, Artificial
  CRISPR gRNA sequence
gtcacatttaatgtcagttc

SEQ ID NO: 607285 - DNA, 20 bp, Artificial
  CRISPR gRNA sequence
tgtcagttctggtctgacct

SEQ ID NO: 607286 - DNA, 20 bp, Artificial
  CRISPR gRNA sequence
ctggtctgaccttggtacct

SEQ ID NO: 607287 - DNA, 20 bp, Artificial
  CRISPR gRNA sequence
accttggtacctcggttcct

SEQ ID NO: 607288 - DNA, 20 bp, Artificial
  CRISPR gRNA sequence
ccttggtacctcggttcctc

SEQ ID NO: 607289 - DNA, 20 bp, Artificial
  CRISPR gRNA sequence
cttggtacctcggttcctca

SEQ ID NO: 607290 - DNA, 20 bp, Artificial
  CRISPR gRNA sequence
ttcctcagggcatgatttta

SEQ ID NO: 607291 - DNA, 20 bp, Artificial
  CRISPR gRNA sequence
atgattttatggtttgctct

SEQ ID NO: 607292 - DNA, 20 bp, Artificial
  CRISPR gRNA sequence
tgattttatggtttgctctc

SEQ ID NO: 607293 - DNA, 20 bp, Artificial
  CRISPR gRNA sequence
gattttatggtttgctctca

SEQ ID NO: 607294 - DNA, 20 bp, Artificial
  CRISPR gRNA sequence
tggtttgctctcagggtctt

SEQ ID NO: 607295 - DNA, 20 bp, Artificial
  CRISPR gRNA sequence
aaacccactttccccatgac

SEQ ID NO: 607296 - DNA, 20 bp, Artificial
  CRISPR gRNA sequence
gcacatgttattcccccttc

SEQ ID NO: 607297 - DNA, 20 bp, Artificial
  CRISPR gRNA sequence
cacatgttattcccccttct

SEQ ID NO: 607298 - DNA, 20 bp, Artificial
  CRISPR gRNA sequence
ttctgggatatcttcccacc

SEQ ID NO: 607299 - DNA, 20 bp, Artificial
  CRISPR gRNA sequence
atcttcccaccaagtgtgac

SEQ ID NO: 607300 - DNA, 20 bp, Artificial
  CRISPR gRNA sequence
ctggtgaaacttcatgtttc

SEQ ID NO: 607301 - DNA, 20 bp, Artificial
  CRISPR gRNA sequence
tggtgaaacttcatgtttca

SEQ ID NO: 607302 - DNA, 20 bp, Artificial
  CRISPR gRNA sequence
tgaaacttcatgtttcaagg

SEQ ID NO: 607303 - DNA, 20 bp, Artificial
  CRISPR gRNA sequence
tcatgtttcaaggtggaatt

SEQ ID NO: 607304 - DNA, 20 bp, Artificial
  CRISPR gRNA sequence
ggaattcagtcatcttcttt

SEQ ID NO: 607305 - DNA, 20 bp, Artificial
  CRISPR gRNA sequence
cttctttgagaaaccttccc

SEQ ID NO: 607306 - DNA, 20 bp, Artificial
  CRISPR gRNA sequence
tatatcttctccttatacct

SEQ ID NO: 607307 - DNA, 20 bp, Artificial
  CRISPR gRNA sequence
acctgagtccacacatctat

SEQ ID NO: 607308 - DNA, 20 bp, Artificial
  CRISPR gRNA sequence
tgttgactttctgtctatat

SEQ ID NO: 607309 - DNA, 20 bp, Artificial
  CRISPR gRNA sequence
ttctgtctatattggacttt

SEQ ID NO: 607310 - DNA, 20 bp, Artificial
  CRISPR gRNA sequence
attggactttgagctcattg

SEQ ID NO: 607311 - DNA, 20 bp, Artificial
  CRISPR gRNA sequence
gtagttcaataaatgtttaa

SEQ ID NO: 607312 - DNA, 20 bp, Artificial
  CRISPR gRNA sequence
agttcaataaatgtttaaaa

SEQ ID NO: 607313 - DNA, 20 bp, Artificial
  CRISPR gRNA sequence
ttacttctgtgactttgttt

SEQ ID NO: 607314 - DNA, 20 bp, Artificial
  CRISPR gRNA sequence
tcacctgtcctgcatctact

SEQ ID NO: 607315 - DNA, 20 bp, Artificial
  CRISPR gRNA sequence
acctgtcctgcatctacttg

SEQ ID NO: 607316 - DNA, 20 bp, Artificial
  CRISPR gRNA sequence
cctgtcctgcatctacttgg

SEQ ID NO: 607317 - DNA, 20 bp, Artificial
  CRISPR gRNA sequence
catctacttggaggatatta

SEQ ID NO: 607318 - DNA, 20 bp, Artificial
  CRISPR gRNA sequence
ttggaggatattatagatac

SEQ ID NO: 607319 - DNA, 20 bp, Artificial
  CRISPR gRNA sequence
tttttttttttcttctgttc

SEQ ID NO: 607320 - DNA, 20 bp, Artificial
  CRISPR gRNA sequence
tctggctaatatcctgattt

SEQ ID NO: 607321 - DNA, 20 bp, Artificial
  CRISPR gRNA sequence
gatttcagtgtacctacctt

SEQ ID NO: 607322 - DNA, 20 bp, Artificial
  CRISPR gRNA sequence
atttcagtgtacctaccttt

SEQ ID NO: 607323 - DNA, 20 bp, Artificial
  CRISPR gRNA sequence
cctacctttgggccatgctc

SEQ ID NO: 607324 - DNA, 20 bp, Artificial
  CRISPR gRNA sequence
tgctccagtttgttgattgc

SEQ ID NO: 607325 - DNA, 20 bp, Artificial
  CRISPR gRNA sequence
gctccagtttgttgattgct

SEQ ID NO: 607326 - DNA, 20 bp, Artificial
  CRISPR gRNA sequence
ttgattgctgggataaccac

SEQ ID NO: 607327 - DNA, 20 bp, Artificial
  CRISPR gRNA sequence
ttgctgggataaccactggc

SEQ ID NO: 607328 - DNA, 20 bp, Artificial
  CRISPR gRNA sequence
tggctagctctatatgctgt

SEQ ID NO: 607329 - DNA, 20 bp, Artificial
  CRISPR gRNA sequence
actacctcctatactcttcc

SEQ ID NO: 607330 - DNA, 20 bp, Artificial
  CRISPR gRNA sequence
ctacctcctatactcttccc

SEQ ID NO: 607331 - DNA, 20 bp, Artificial
  CRISPR gRNA sequence
tcctatactcttcccaggcc

SEQ ID NO: 607332 - DNA, 20 bp, Artificial
  CRISPR gRNA sequence
atgtttccacttgaccctca

SEQ ID NO: 607333 - DNA, 20 bp, Artificial
  CRISPR gRNA sequence
tgtttccacttgaccctcat

SEQ ID NO: 607334 - DNA, 20 bp, Artificial
  CRISPR gRNA sequence
atgggccttactcatcttcc

SEQ ID NO: 607335 - DNA, 20 bp, Artificial
  CRISPR gRNA sequence
ttactcatcttcctagactc

SEQ ID NO: 607336 - DNA, 20 bp, Artificial
  CRISPR gRNA sequence
tactcatcttcctagactct

SEQ ID NO: 607337 - DNA, 20 bp, Artificial
  CRISPR gRNA sequence
tcctagactctaggccttca

SEQ ID NO: 607338 - DNA, 20 bp, Artificial
  CRISPR gRNA sequence
agacctaacttaatacatgt

SEQ ID NO: 607339 - DNA, 20 bp, Artificial
  CRISPR gRNA sequence
atacatgttggacatataaa

SEQ ID NO: 607340 - DNA, 20 bp, Artificial
  CRISPR gRNA sequence
aactctaattgcttttttat

SEQ ID NO: 607341 - DNA, 20 bp, Artificial
  CRISPR gRNA sequence
tgcttttttattagttgtaa

SEQ ID NO: 607342 - DNA, 20 bp, Artificial
  CRISPR gRNA sequence
aaatttttttttctttatga

SEQ ID NO: 607343 - DNA, 20 bp, Artificial
  CRISPR gRNA sequence
aatttttttttctttatgaa

SEQ ID NO: 607344 - DNA, 20 bp, Artificial
  CRISPR gRNA sequence
atttttttttctttatgaaa

SEQ ID NO: 607345 - DNA, 20 bp, Artificial
  CRISPR gRNA sequence
tgaaagggatatttaatgat

SEQ ID NO: 607346 - DNA, 20 bp, Artificial
  CRISPR gRNA sequence
gaaagggatatttaatgatt

SEQ ID NO: 607347 - DNA, 20 bp, Artificial
  CRISPR gRNA sequence
gattaggactaatttaacaa

SEQ ID NO: 607348 - DNA, 20 bp, Artificial
  CRISPR gRNA sequence
attaggactaatttaacaat

SEQ ID NO: 607349 - DNA, 20 bp, Artificial
  CRISPR gRNA sequence
gactaatttaacaataggtc

SEQ ID NO: 607350 - DNA, 20 bp, Artificial
  CRISPR gRNA sequence
aatttaacaataggtcaaga

SEQ ID NO: 607351 - DNA, 20 bp, Artificial
  CRISPR gRNA sequence
acatttcatcccttattaaa

SEQ ID NO: 607352 - DNA, 20 bp, Artificial
  CRISPR gRNA sequence
tcatcccttattaaatggat

SEQ ID NO: 607353 - DNA, 20 bp, Artificial
  CRISPR gRNA sequence
atcccttattaaatggatta

SEQ ID NO: 607354 - DNA, 20 bp, Artificial
  CRISPR gRNA sequence
ccttattaaatggattagag

SEQ ID NO: 607355 - DNA, 20 bp, Artificial
  CRISPR gRNA sequence
cttattaaatggattagaga

SEQ ID NO: 607356 - DNA, 20 bp, Artificial
  CRISPR gRNA sequence
tattaaatggattagagaag

SEQ ID NO: 607357 - DNA, 20 bp, Artificial
  CRISPR gRNA sequence
aatggattagagaaggagct

SEQ ID NO: 607358 - DNA, 20 bp, Artificial
  CRISPR gRNA sequence
tagagaaggagcttagtaaa

SEQ ID NO: 607359 - DNA, 20 bp, Artificial
  CRISPR gRNA sequence
gttgcaattgtcaaacctat

SEQ ID NO: 607360 - DNA, 20 bp, Artificial
  CRISPR gRNA sequence
attgtcaaacctattagaat

SEQ ID NO: 607361 - DNA, 20 bp, Artificial
  CRISPR gRNA sequence
tcaaacctattagaattagt

SEQ ID NO: 607362 - DNA, 20 bp, Artificial
  CRISPR gRNA sequence
caaacctattagaattagtt

SEQ ID NO: 607363 - DNA, 20 bp, Artificial
  CRISPR gRNA sequence
ttagaattagttaggatttt

SEQ ID NO: 607364 - DNA, 20 bp, Artificial
  CRISPR gRNA sequence
aattagttaggattttgagt

SEQ ID NO: 607365 - DNA, 20 bp, Artificial
  CRISPR gRNA sequence
ttttgagtcagtgatatgtg

SEQ ID NO: 607366 - DNA, 20 bp, Artificial
  CRISPR gRNA sequence
cattaaaccatttcttgcca

SEQ ID NO: 607367 - DNA, 20 bp, Artificial
  CRISPR gRNA sequence
aaaccatttcttgccatggc

SEQ ID NO: 607368 - DNA, 20 bp, Artificial
  CRISPR gRNA sequence
gtcctttatcttaaatttgt

SEQ ID NO: 607369 - DNA, 20 bp, Artificial
  CRISPR gRNA sequence
ttaaatttgtcagtgattta

SEQ ID NO: 607370 - DNA, 20 bp, Artificial
  CRISPR gRNA sequence
gttcctttaaaaatattcac

SEQ ID NO: 607371 - DNA, 20 bp, Artificial
  CRISPR gRNA sequence
ctagatacatgaaaatttac

SEQ ID NO: 607372 - DNA, 20 bp, Artificial
  CRISPR gRNA sequence
catgaaaatttactagttgt

SEQ ID NO: 607373 - DNA, 20 bp, Artificial
  CRISPR gRNA sequence
agttgtaagaaaatatttaa

SEQ ID NO: 607374 - DNA, 20 bp, Artificial
  CRISPR gRNA sequence
aaaagtcttttctgaacatt

SEQ ID NO: 607375 - DNA, 20 bp, Artificial
  CRISPR gRNA sequence
agttctcatttattttgaac

SEQ ID NO: 607376 - DNA, 20 bp, Artificial
  CRISPR gRNA sequence
cattttacccatgtctctta

SEQ ID NO: 607377 - DNA, 20 bp, Artificial
  CRISPR gRNA sequence
ctcttacagtcatacattat

SEQ ID NO: 607378 - DNA, 20 bp, Artificial
  CRISPR gRNA sequence
cttacagtcatacattatta

SEQ ID NO: 607379 - DNA, 20 bp, Artificial
  CRISPR gRNA sequence
ttacagtcatacattattag

SEQ ID NO: 607380 - DNA, 20 bp, Artificial
  CRISPR gRNA sequence
tacagtcatacattattaga

SEQ ID NO: 607381 - DNA, 20 bp, Artificial
  CRISPR gRNA sequence
ttctatttcaaccattttca

SEQ ID NO: 607382 - DNA, 20 bp, Artificial
  CRISPR gRNA sequence
caaagttttctgaattataa

SEQ ID NO: 607383 - DNA, 20 bp, Artificial
  CRISPR gRNA sequence
tttctgaattataatagttg

SEQ ID NO: 607384 - DNA, 20 bp, Artificial
  CRISPR gRNA sequence
ttcctttaatgttgaaaatt

SEQ ID NO: 607385 - DNA, 20 bp, Artificial
  CRISPR gRNA sequence
atgttgaaaatttggatata

SEQ ID NO: 607386 - DNA, 20 bp, Artificial
  CRISPR gRNA sequence
gttgaaaatttggatatata

SEQ ID NO: 607387 - DNA, 20 bp, Artificial
  CRISPR gRNA sequence
gaaaatttggatatatagag

SEQ ID NO: 607388 - DNA, 20 bp, Artificial
  CRISPR gRNA sequence
aatttggatatatagagaag

SEQ ID NO: 607389 - DNA, 20 bp, Artificial
  CRISPR gRNA sequence
ttccctcccaaattatttta

SEQ ID NO: 607390 - DNA, 20 bp, Artificial
  CRISPR gRNA sequence
tttaaagtaatttccaactt

SEQ ID NO: 607391 - DNA, 20 bp, Artificial
  CRISPR gRNA sequence
aaagtaatttccaactttag

SEQ ID NO: 607392 - DNA, 20 bp, Artificial
  CRISPR gRNA sequence
actttagaagttcactgaca

SEQ ID NO: 607393 - DNA, 20 bp, Artificial
  CRISPR gRNA sequence
gacacagtatttgtaaatta

SEQ ID NO: 607394 - DNA, 20 bp, Artificial
  CRISPR gRNA sequence
acacagtatttgtaaattat

SEQ ID NO: 607395 - DNA, 20 bp, Artificial
  CRISPR gRNA sequence
cagtatttgtaaattatggg

SEQ ID NO: 607396 - DNA, 20 bp, Artificial
  CRISPR gRNA sequence
agtatttgtaaattatgggt

SEQ ID NO: 607397 - DNA, 20 bp, Artificial
  CRISPR gRNA sequence
tgtaaattatgggtgggcaa

SEQ ID NO: 607398 - DNA, 20 bp, Artificial
  CRISPR gRNA sequence
tccatattatcacatcataa

SEQ ID NO: 607399 - DNA, 20 bp, Artificial
  CRISPR gRNA sequence
acatcataacagaatatgac

SEQ ID NO: 607400 - DNA, 20 bp, Artificial
  CRISPR gRNA sequence
tctatctatctatctctata

SEQ ID NO: 607401 - DNA, 20 bp, Artificial
  CRISPR gRNA sequence
gattttttaaatatatactt

SEQ ID NO: 607402 - DNA, 20 bp, Artificial
  CRISPR gRNA sequence
attttttaaatatatacttc

SEQ ID NO: 607403 - DNA, 20 bp, Artificial
  CRISPR gRNA sequence
ttttttaaatatatacttca

SEQ ID NO: 607404 - DNA, 20 bp, Artificial
  CRISPR gRNA sequence
aatatatacttcagggtaaa

SEQ ID NO: 607405 - DNA, 20 bp, Artificial
  CRISPR gRNA sequence
atatacttcagggtaaatag

SEQ ID NO: 607406 - DNA, 20 bp, Artificial
  CRISPR gRNA sequence
cttcagggtaaatagaagct

SEQ ID NO: 607407 - DNA, 20 bp, Artificial
  CRISPR gRNA sequence
ttcagggtaaatagaagctc

SEQ ID NO: 607408 - DNA, 20 bp, Artificial
  CRISPR gRNA sequence
aggcttatctctttttctct

SEQ ID NO: 607409 - DNA, 20 bp, Artificial
  CRISPR gRNA sequence
ggcttatctctttttctctt

SEQ ID NO: 607410 - DNA, 20 bp, Artificial
  CRISPR gRNA sequence
cttatctctttttctcttag

SEQ ID NO: 607411 - DNA, 20 bp, Artificial
  CRISPR gRNA sequence
tatctctttttctcttagga

SEQ ID NO: 607412 - DNA, 20 bp, Artificial
  CRISPR gRNA sequence
ttttgttcctttgaactttg

SEQ ID NO: 607413 - DNA, 20 bp, Artificial
  CRISPR gRNA sequence
cctttgaactttgtagttgt

SEQ ID NO: 607414 - DNA, 20 bp, Artificial
  CRISPR gRNA sequence
aactttgtagttgtaagttg

SEQ ID NO: 607415 - DNA, 20 bp, Artificial
  CRISPR gRNA sequence
actttgtagttgtaagttgt

SEQ ID NO: 607416 - DNA, 20 bp, Artificial
  CRISPR gRNA sequence
tagttgtaagttgtgggaac

SEQ ID NO: 607417 - DNA, 20 bp, Artificial
  CRISPR gRNA sequence
taagttgtgggaactggaat

SEQ ID NO: 607418 - DNA, 20 bp, Artificial
  CRISPR gRNA sequence
aagttgtgggaactggaatt

SEQ ID NO: 607419 - DNA, 20 bp, Artificial
  CRISPR gRNA sequence
aattgggtacatgtgttttt

SEQ ID NO: 607420 - DNA, 20 bp, Artificial
  CRISPR gRNA sequence
gtacatgtgtttttaagtgt

SEQ ID NO: 607421 - DNA, 20 bp, Artificial
  CRISPR gRNA sequence
atttcttgctaaatattgct

SEQ ID NO: 607422 - DNA, 20 bp, Artificial
  CRISPR gRNA sequence
tcttgctaaatattgctcag

SEQ ID NO: 607423 - DNA, 20 bp, Artificial
  CRISPR gRNA sequence
aatattgctcagcagtttat

SEQ ID NO: 607424 - DNA, 20 bp, Artificial
  CRISPR gRNA sequence
tgctcagcagtttatcagat

SEQ ID NO: 607425 - DNA, 20 bp, Artificial
  CRISPR gRNA sequence
gctcagcagtttatcagatt

SEQ ID NO: 607426 - DNA, 20 bp, Artificial
  CRISPR gRNA sequence
agtttatcagattaggtaat

SEQ ID NO: 607427 - DNA, 20 bp, Artificial
  CRISPR gRNA sequence
taggtaattggtttcctaaa

SEQ ID NO: 607428 - DNA, 20 bp, Artificial
  CRISPR gRNA sequence
ttggtttcctaaaaagcttt

SEQ ID NO: 607429 - DNA, 20 bp, Artificial
  CRISPR gRNA sequence
gtttcctaaaaagcttttgg

SEQ ID NO: 607430 - DNA, 20 bp, Artificial
  CRISPR gRNA sequence
tttcctaaaaagcttttggc

SEQ ID NO: 607431 - DNA, 20 bp, Artificial
  CRISPR gRNA sequence
ttcctaaaaagcttttggca

SEQ ID NO: 607432 - DNA, 20 bp, Artificial
  CRISPR gRNA sequence
aaaagcttttggcagggttc

SEQ ID NO: 607433 - DNA, 20 bp, Artificial
  CRISPR gRNA sequence
aaagcttttggcagggttcc

SEQ ID NO: 607434 - DNA, 20 bp, Artificial
  CRISPR gRNA sequence
tttggcagggttccaggtga

SEQ ID NO: 607435 - DNA, 20 bp, Artificial
  CRISPR gRNA sequence
ttggcagggttccaggtgat

SEQ ID NO: 607436 - DNA, 20 bp, Artificial
  CRISPR gRNA sequence
ggcagggttccaggtgatag

SEQ ID NO: 607437 - DNA, 20 bp, Artificial
  CRISPR gRNA sequence
caggtgataggagaaatgaa

SEQ ID NO: 607438 - DNA, 20 bp, Artificial
  CRISPR gRNA sequence
aatgaaaagtgaattttgat

SEQ ID NO: 607439 - DNA, 20 bp, Artificial
  CRISPR gRNA sequence
atgaaaagtgaattttgatt

SEQ ID NO: 607440 - DNA, 20 bp, Artificial
  CRISPR gRNA sequence
tgaaaagtgaattttgattg

SEQ ID NO: 607441 - DNA, 20 bp, Artificial
  CRISPR gRNA sequence
gaaaagtgaattttgattgg

SEQ ID NO: 607442 - DNA, 20 bp, Artificial
  CRISPR gRNA sequence
aagtgaattttgattggggg

SEQ ID NO: 607443 - DNA, 20 bp, Artificial
  CRISPR gRNA sequence
agtgaattttgattgggggc

SEQ ID NO: 607444 - DNA, 20 bp, Artificial
  CRISPR gRNA sequence
ttttgattgggggcaggtga

SEQ ID NO: 607445 - DNA, 20 bp, Artificial
  CRISPR gRNA sequence
tttgattgggggcaggtgat

SEQ ID NO: 607446 - DNA, 20 bp, Artificial
  CRISPR gRNA sequence
attgggggcaggtgatagga

SEQ ID NO: 607447 - DNA, 20 bp, Artificial
  CRISPR gRNA sequence
gtgataggaaagcaaataca

SEQ ID NO: 607448 - DNA, 20 bp, Artificial
  CRISPR gRNA sequence
aggaaagcaaatacaaagtg

SEQ ID NO: 607449 - DNA, 20 bp, Artificial
  CRISPR gRNA sequence
aatacaaagtgtggttcatt

SEQ ID NO: 607450 - DNA, 20 bp, Artificial
  CRISPR gRNA sequence
atacaaagtgtggttcattt

SEQ ID NO: 607451 - DNA, 20 bp, Artificial
  CRISPR gRNA sequence
tacaaagtgtggttcattta

SEQ ID NO: 607452 - DNA, 20 bp, Artificial
  CRISPR gRNA sequence
ggttcatttagggtatgtca

SEQ ID NO: 607453 - DNA, 20 bp, Artificial
  CRISPR gRNA sequence
catttagggtatgtcataga

SEQ ID NO: 607454 - DNA, 20 bp, Artificial
  CRISPR gRNA sequence
tagggtatgtcatagaaagc

SEQ ID NO: 607455 - DNA, 20 bp, Artificial
  CRISPR gRNA sequence
agggtatgtcatagaaagct

SEQ ID NO: 607456 - DNA, 20 bp, Artificial
  CRISPR gRNA sequence
tagaaagctgggcatcaaac

SEQ ID NO: 607457 - DNA, 20 bp, Artificial
  CRISPR gRNA sequence
gaaagctgggcatcaaactg

SEQ ID NO: 607458 - DNA, 20 bp, Artificial
  CRISPR gRNA sequence
aaagctgggcatcaaactgg

SEQ ID NO: 607459 - DNA, 20 bp, Artificial
  CRISPR gRNA sequence
aagctgggcatcaaactgga

SEQ ID NO: 607460 - DNA, 20 bp, Artificial
  CRISPR gRNA sequence
ctgggcatcaaactggaggg

SEQ ID NO: 607461 - DNA, 20 bp, Artificial
  CRISPR gRNA sequence
caaactggagggtggaaaaa

SEQ ID NO: 607462 - DNA, 20 bp, Artificial
  CRISPR gRNA sequence
actggagggtggaaaaacag

SEQ ID NO: 607463 - DNA, 20 bp, Artificial
  CRISPR gRNA sequence
ctggagggtggaaaaacagt

SEQ ID NO: 607464 - DNA, 20 bp, Artificial
  CRISPR gRNA sequence
gaaaaacagtgggcactaat

SEQ ID NO: 607465 - DNA, 20 bp, Artificial
  CRISPR gRNA sequence
gggcactaattagatgcctt

SEQ ID NO: 607466 - DNA, 20 bp, Artificial
  CRISPR gRNA sequence
ggcactaattagatgcctta

SEQ ID NO: 607467 - DNA, 20 bp, Artificial
  CRISPR gRNA sequence
actaattagatgccttaagg

SEQ ID NO: 607468 - DNA, 20 bp, Artificial
  CRISPR gRNA sequence
ctaattagatgccttaaggt

SEQ ID NO: 607469 - DNA, 20 bp, Artificial
  CRISPR gRNA sequence
attagatgccttaaggtggg

SEQ ID NO: 607470 - DNA, 20 bp, Artificial
  CRISPR gRNA sequence
ccttaaggtgggtagcactt

SEQ ID NO: 607471 - DNA, 20 bp, Artificial
  CRISPR gRNA sequence
cttaaggtgggtagcacttt

SEQ ID NO: 607472 - DNA, 20 bp, Artificial
  CRISPR gRNA sequence
gggtagcactttgggaaaaa

SEQ ID NO: 607473 - DNA, 20 bp, Artificial
  CRISPR gRNA sequence
tagcactttgggaaaaatgg

SEQ ID NO: 607474 - DNA, 20 bp, Artificial
  CRISPR gRNA sequence
ggaaaaatggaagttgctgc

SEQ ID NO: 607475 - DNA, 20 bp, Artificial
  CRISPR gRNA sequence
gaaaaatggaagttgctgct

SEQ ID NO: 607476 - DNA, 20 bp, Artificial
  CRISPR gRNA sequence
aagttgctgctaggaaaaca

SEQ ID NO: 607477 - DNA, 20 bp, Artificial
  CRISPR gRNA sequence
gttgctgctaggaaaacata

SEQ ID NO: 607478 - DNA, 20 bp, Artificial
  CRISPR gRNA sequence
ctgctaggaaaacatagaga

SEQ ID NO: 607479 - DNA, 20 bp, Artificial
  CRISPR gRNA sequence
aacatagagaaagtaaaaat

SEQ ID NO: 607480 - DNA, 20 bp, Artificial
  CRISPR gRNA sequence
acatagagaaagtaaaaatc

SEQ ID NO: 607481 - DNA, 20 bp, Artificial
  CRISPR gRNA sequence
atagagaaagtaaaaatcag

SEQ ID NO: 607482 - DNA, 20 bp, Artificial
  CRISPR gRNA sequence
agtaaaaatcaggagatgac

SEQ ID NO: 607483 - DNA, 20 bp, Artificial
  CRISPR gRNA sequence
attttaatcatatttttact

SEQ ID NO: 607484 - DNA, 20 bp, Artificial
  CRISPR gRNA sequence
ttttaatcatatttttactt

SEQ ID NO: 607485 - DNA, 20 bp, Artificial
  CRISPR gRNA sequence
aatcatatttttacttgggc

SEQ ID NO: 607486 - DNA, 20 bp, Artificial
  CRISPR gRNA sequence
aaatgtatcctgcccaactg

SEQ ID NO: 607487 - DNA, 20 bp, Artificial
  CRISPR gRNA sequence
tgtatcctgcccaactgtgg

SEQ ID NO: 607488 - DNA, 20 bp, Artificial
  CRISPR gRNA sequence
gtatcctgcccaactgtggt

SEQ ID NO: 607489 - DNA, 20 bp, Artificial
  CRISPR gRNA sequence
caactgtggtgggacaacac

SEQ ID NO: 607490 - DNA, 20 bp, Artificial
  CRISPR gRNA sequence
acaacacaagctttctctct

SEQ ID NO: 607491 - DNA, 20 bp, Artificial
  CRISPR gRNA sequence
acacaagctttctctcttgg

SEQ ID NO: 607492 - DNA, 20 bp, Artificial
  CRISPR gRNA sequence
tttctctcttggtagtatac

SEQ ID NO: 607493 - DNA, 20 bp, Artificial
  CRISPR gRNA sequence
ggtagtatacaagaaattta

SEQ ID NO: 607494 - DNA, 20 bp, Artificial
  CRISPR gRNA sequence
tagtatacaagaaatttatg

SEQ ID NO: 607495 - DNA, 20 bp, Artificial
  CRISPR gRNA sequence
atacaagaaatttatggaga

SEQ ID NO: 607496 - DNA, 20 bp, Artificial
  CRISPR gRNA sequence
aaatttatggagatggttta

SEQ ID NO: 607497 - DNA, 20 bp, Artificial
  CRISPR gRNA sequence
ttatggagatggtttataga

SEQ ID NO: 607498 - DNA, 20 bp, Artificial
  CRISPR gRNA sequence
atggagatggtttatagatg

SEQ ID NO: 607499 - DNA, 20 bp, Artificial
  CRISPR gRNA sequence
ttcttttctattgtgtcacc

SEQ ID NO: 607500 - DNA, 20 bp, Artificial
  CRISPR gRNA sequence
tcttttctattgtgtcacct

SEQ ID NO: 607501 - DNA, 20 bp, Artificial
  CRISPR gRNA sequence
ctattgtgtcacctaggctt

SEQ ID NO: 607502 - DNA, 20 bp, Artificial
  CRISPR gRNA sequence
gtgtcacctaggcttcagta

SEQ ID NO: 607503 - DNA, 20 bp, Artificial
  CRISPR gRNA sequence
tcacctaggcttcagtacag

SEQ ID NO: 607504 - DNA, 20 bp, Artificial
  CRISPR gRNA sequence
tcagtacagtggcacaatca

SEQ ID NO: 607505 - DNA, 20 bp, Artificial
  CRISPR gRNA sequence
ggcacaatcatggcttactc

SEQ ID NO: 607506 - DNA, 20 bp, Artificial
  CRISPR gRNA sequence
ttactccagccttgaactcc

SEQ ID NO: 607507 - DNA, 20 bp, Artificial
  CRISPR gRNA sequence
tactccagccttgaactcct

SEQ ID NO: 607508 - DNA, 20 bp, Artificial
  CRISPR gRNA sequence
agccttgaactcctgggctg

SEQ ID NO: 607509 - DNA, 20 bp, Artificial
  CRISPR gRNA sequence
ctgaagcaatactcctgtcc

SEQ ID NO: 607510 - DNA, 20 bp, Artificial
  CRISPR gRNA sequence
tactcctgtcccagtccccc

SEQ ID NO: 607511 - DNA, 20 bp, Artificial
  CRISPR gRNA sequence
tcctgtcccagtcccccaag

SEQ ID NO: 607512 - DNA, 20 bp, Artificial
  CRISPR gRNA sequence
gtcccagtcccccaagtagt

SEQ ID NO: 607513 - DNA, 20 bp, Artificial
  CRISPR gRNA sequence
tcccagtcccccaagtagtt

SEQ ID NO: 607514 - DNA, 20 bp, Artificial
  CRISPR gRNA sequence
caaacacgcactaccacacc

SEQ ID NO: 607515 - DNA, 20 bp, Artificial
  CRISPR gRNA sequence
tacattttaaattttttgta

SEQ ID NO: 607516 - DNA, 20 bp, Artificial
  CRISPR gRNA sequence
ttttaaattttttgtataga

SEQ ID NO: 607517 - DNA, 20 bp, Artificial
  CRISPR gRNA sequence
tttaaattttttgtatagat

SEQ ID NO: 607518 - DNA, 20 bp, Artificial
  CRISPR gRNA sequence
tgggatcccactatgttgcc

SEQ ID NO: 607519 - DNA, 20 bp, Artificial
  CRISPR gRNA sequence
gggatcccactatgttgccc

SEQ ID NO: 607520 - DNA, 20 bp, Artificial
  CRISPR gRNA sequence
tgcccaggctcgtcttgaac

SEQ ID NO: 607521 - DNA, 20 bp, Artificial
  CRISPR gRNA sequence
ccaggctcgtcttgaaccag

SEQ ID NO: 607522 - DNA, 20 bp, Artificial
  CRISPR gRNA sequence
caggctcgtcttgaaccagt

SEQ ID NO: 607523 - DNA, 20 bp, Artificial
  CRISPR gRNA sequence
cgtcttgaaccagtgggctc

SEQ ID NO: 607524 - DNA, 20 bp, Artificial
  CRISPR gRNA sequence
gtgggctcaagtgatctacc

SEQ ID NO: 607525 - DNA, 20 bp, Artificial
  CRISPR gRNA sequence
tgggctcaagtgatctaccc

SEQ ID NO: 607526 - DNA, 20 bp, Artificial
  CRISPR gRNA sequence
tacccaggctcccaaactgt

SEQ ID NO: 607527 - DNA, 20 bp, Artificial
  CRISPR gRNA sequence
acccaggctcccaaactgtt

SEQ ID NO: 607528 - DNA, 20 bp, Artificial
  CRISPR gRNA sequence
ctcccaaactgttgggacta

SEQ ID NO: 607529 - DNA, 20 bp, Artificial
  CRISPR gRNA sequence
tcccaaactgttgggactac

SEQ ID NO: 607530 - DNA, 20 bp, Artificial
  CRISPR gRNA sequence
actgttgggactacaggcat

SEQ ID NO: 607531 - DNA, 20 bp, Artificial
  CRISPR gRNA sequence
atgagccatgacacccaacc

SEQ ID NO: 607532 - DNA, 20 bp, Artificial
  CRISPR gRNA sequence
ccaaccaagactcttcttta

SEQ ID NO: 607533 - DNA, 20 bp, Artificial
  CRISPR gRNA sequence
ccccttctccctcaacaaaa

SEQ ID NO: 607534 - DNA, 20 bp, Artificial
  CRISPR gRNA sequence
ccttctccctcaacaaaaaa

SEQ ID NO: 607535 - DNA, 20 bp, Artificial
  CRISPR gRNA sequence
ctcaacaaaaaagagaaaat

SEQ ID NO: 607536 - DNA, 20 bp, Artificial
  CRISPR gRNA sequence
acaaaaaagagaaaattaga

SEQ ID NO: 607537 - DNA, 20 bp, Artificial
  CRISPR gRNA sequence
aaattagacagcaacaacaa

SEQ ID NO: 607538 - DNA, 20 bp, Artificial
  CRISPR gRNA sequence
ttagacagcaacaacaatag

SEQ ID NO: 607539 - DNA, 20 bp, Artificial
  CRISPR gRNA sequence
caacaacaaatgctgtattt

SEQ ID NO: 607540 - DNA, 20 bp, Artificial
  CRISPR gRNA sequence
aacaacaaatgctgtattta

SEQ ID NO: 607541 - DNA, 20 bp, Artificial
  CRISPR gRNA sequence
atttaaggtttatttttcaa

SEQ ID NO: 607542 - DNA, 20 bp, Artificial
  CRISPR gRNA sequence
tagatttaacgtcacaatga

SEQ ID NO: 607543 - DNA, 20 bp, Artificial
  CRISPR gRNA sequence
agatttaacgtcacaatgat

SEQ ID NO: 607544 - DNA, 20 bp, Artificial
  CRISPR gRNA sequence
ttaacgtcacaatgatgggc

SEQ ID NO: 607545 - DNA, 20 bp, Artificial
  CRISPR gRNA sequence
gtcatatcaacctgacatat

SEQ ID NO: 607546 - DNA, 20 bp, Artificial
  CRISPR gRNA sequence
atatcaacctgacatatcag

SEQ ID NO: 607547 - DNA, 20 bp, Artificial
  CRISPR gRNA sequence
caacctgacatatcagaagt

SEQ ID NO: 607548 - DNA, 20 bp, Artificial
  CRISPR gRNA sequence
catgccactattgtttctca

SEQ ID NO: 607549 - DNA, 20 bp, Artificial
  CRISPR gRNA sequence
atgccactattgtttctcat

SEQ ID NO: 607550 - DNA, 20 bp, Artificial
  CRISPR gRNA sequence
actattgtttctcataggtt

SEQ ID NO: 607551 - DNA, 20 bp, Artificial
  CRISPR gRNA sequence
gtttctcataggtttggaaa

SEQ ID NO: 607552 - DNA, 20 bp, Artificial
  CRISPR gRNA sequence
aggtttggaaacagaaaact

SEQ ID NO: 607553 - DNA, 20 bp, Artificial
  CRISPR gRNA sequence
gtttggaaacagaaaactca

SEQ ID NO: 607554 - DNA, 20 bp, Artificial
  CRISPR gRNA sequence
ttggaaacagaaaactcaga

SEQ ID NO: 607555 - DNA, 20 bp, Artificial
  CRISPR gRNA sequence
gaaacagaaaactcagagag

SEQ ID NO: 607556 - DNA, 20 bp, Artificial
  CRISPR gRNA sequence
agaaaactcagagagcagtt

SEQ ID NO: 607557 - DNA, 20 bp, Artificial
  CRISPR gRNA sequence
gagcagtttggttgtgaaca

SEQ ID NO: 607558 - DNA, 20 bp, Artificial
  CRISPR gRNA sequence
agtttggttgtgaacacagt

SEQ ID NO: 607559 - DNA, 20 bp, Artificial
  CRISPR gRNA sequence
gtgaacacagttggttaaca

SEQ ID NO: 607560 - DNA, 20 bp, Artificial
  CRISPR gRNA sequence
tgaacacagttggttaacat

SEQ ID NO: 607561 - DNA, 20 bp, Artificial
  CRISPR gRNA sequence
aacacagttggttaacatgg

SEQ ID NO: 607562 - DNA, 20 bp, Artificial
  CRISPR gRNA sequence
cacagttggttaacatggga

SEQ ID NO: 607563 - DNA, 20 bp, Artificial
  CRISPR gRNA sequence
agttggttaacatgggagag

SEQ ID NO: 607564 - DNA, 20 bp, Artificial
  CRISPR gRNA sequence
atgggagagaagaatcactt

SEQ ID NO: 607565 - DNA, 20 bp, Artificial
  CRISPR gRNA sequence
agagaagaatcactttggtt

SEQ ID NO: 607566 - DNA, 20 bp, Artificial
  CRISPR gRNA sequence
gaagaatcactttggtttgg

SEQ ID NO: 607567 - DNA, 20 bp, Artificial
  CRISPR gRNA sequence
aagaatcactttggtttggc

SEQ ID NO: 607568 - DNA, 20 bp, Artificial
  CRISPR gRNA sequence
tttggtttggcaggaaatga

SEQ ID NO: 607569 - DNA, 20 bp, Artificial
  CRISPR gRNA sequence
ggtttggcaggaaatgacag

SEQ ID NO: 607570 - DNA, 20 bp, Artificial
  CRISPR gRNA sequence
cagcagaatttctttctata

SEQ ID NO: 607571 - DNA, 20 bp, Artificial
  CRISPR gRNA sequence
cagaatttctttctatatgg

SEQ ID NO: 607572 - DNA, 20 bp, Artificial
  CRISPR gRNA sequence
agaatttctttctatatggt

SEQ ID NO: 607573 - DNA, 20 bp, Artificial
  CRISPR gRNA sequence
tatatggtgggttgtccatc

SEQ ID NO: 607574 - DNA, 20 bp, Artificial
  CRISPR gRNA sequence
tctggtctgtccatgctaat

SEQ ID NO: 607575 - DNA, 20 bp, Artificial
  CRISPR gRNA sequence
gtctgtccatgctaatgaga

SEQ ID NO: 607576 - DNA, 20 bp, Artificial
  CRISPR gRNA sequence
tgctaatgagacagataaat

SEQ ID NO: 607577 - DNA, 20 bp, Artificial
  CRISPR gRNA sequence
taaatgagaactgtcaaaat

SEQ ID NO: 607578 - DNA, 20 bp, Artificial
  CRISPR gRNA sequence
aaatgagaactgtcaaaatt

SEQ ID NO: 607579 - DNA, 20 bp, Artificial
  CRISPR gRNA sequence
tgagaactgtcaaaattagg

SEQ ID NO: 607580 - DNA, 20 bp, Artificial
  CRISPR gRNA sequence
aaaatgtaaaattacccttc

SEQ ID NO: 607581 - DNA, 20 bp, Artificial
  CRISPR gRNA sequence
ccttctggactcacttttca

SEQ ID NO: 607582 - DNA, 20 bp, Artificial
  CRISPR gRNA sequence
cttctggactcacttttcaa

SEQ ID NO: 607583 - DNA, 20 bp, Artificial
  CRISPR gRNA sequence
ttctggactcacttttcaaa

SEQ ID NO: 607584 - DNA, 20 bp, Artificial
  CRISPR gRNA sequence
actcacttttcaaagggatg

SEQ ID NO: 607585 - DNA, 20 bp, Artificial
  CRISPR gRNA sequence
ttcaaagggatgaagaaaca

SEQ ID NO: 607586 - DNA, 20 bp, Artificial
  CRISPR gRNA sequence
ggatgaagaaacacagtatt

SEQ ID NO: 607587 - DNA, 20 bp, Artificial
  CRISPR gRNA sequence
atgaagaaacacagtattta

SEQ ID NO: 607588 - DNA, 20 bp, Artificial
  CRISPR gRNA sequence
tgaagaaacacagtatttag

SEQ ID NO: 607589 - DNA, 20 bp, Artificial
  CRISPR gRNA sequence
gaagaaacacagtatttaga

SEQ ID NO: 607590 - DNA, 20 bp, Artificial
  CRISPR gRNA sequence
aacacagtatttagagggca

SEQ ID NO: 607591 - DNA, 20 bp, Artificial
  CRISPR gRNA sequence
caaagcaaaaaacaaaacct

SEQ ID NO: 607592 - DNA, 20 bp, Artificial
  CRISPR gRNA sequence
ctgctcttcaacttacttat

SEQ ID NO: 607593 - DNA, 20 bp, Artificial
  CRISPR gRNA sequence
taattctgttttctgcgatt

SEQ ID NO: 607594 - DNA, 20 bp, Artificial
  CRISPR gRNA sequence
cagttttcttgtacgtttac

SEQ ID NO: 607595 - DNA, 20 bp, Artificial
  CRISPR gRNA sequence
agttttcttgtacgtttact

SEQ ID NO: 607596 - DNA, 20 bp, Artificial
  CRISPR gRNA sequence
gttttcttgtacgtttactg

SEQ ID NO: 607597 - DNA, 20 bp, Artificial
  CRISPR gRNA sequence
acgtttactggggataataa

SEQ ID NO: 607598 - DNA, 20 bp, Artificial
  CRISPR gRNA sequence
atagcacctacttcatattc

SEQ ID NO: 607599 - DNA, 20 bp, Artificial
  CRISPR gRNA sequence
ctacttcatattctagtgtg

SEQ ID NO: 607600 - DNA, 20 bp, Artificial
  CRISPR gRNA sequence
ttctagtgtgaagatctatt

SEQ ID NO: 607601 - DNA, 20 bp, Artificial
  CRISPR gRNA sequence
agtgtgaagatctattgaga

SEQ ID NO: 607602 - DNA, 20 bp, Artificial
  CRISPR gRNA sequence
gtgaagatctattgagatgg

SEQ ID NO: 607603 - DNA, 20 bp, Artificial
  CRISPR gRNA sequence
ctgaactaaataaactgttt

SEQ ID NO: 607604 - DNA, 20 bp, Artificial
  CRISPR gRNA sequence
taaataaactgtttaagtat

SEQ ID NO: 607605 - DNA, 20 bp, Artificial
  CRISPR gRNA sequence
acattataatataactcata

SEQ ID NO: 607606 - DNA, 20 bp, Artificial
  CRISPR gRNA sequence
ataatataactcataaagaa

SEQ ID NO: 607607 - DNA, 20 bp, Artificial
  CRISPR gRNA sequence
aatataactcataaagaaaa

SEQ ID NO: 607608 - DNA, 20 bp, Artificial
  CRISPR gRNA sequence
agagtttctcataacctctg

SEQ ID NO: 607609 - DNA, 20 bp, Artificial
  CRISPR gRNA sequence
gagtttctcataacctctgt

SEQ ID NO: 607610 - DNA, 20 bp, Artificial
  CRISPR gRNA sequence
taggatactgattttgtttc

SEQ ID NO: 607611 - DNA, 20 bp, Artificial
  CRISPR gRNA sequence
atactgattttgtttctgga

SEQ ID NO: 607612 - DNA, 20 bp, Artificial
  CRISPR gRNA sequence
ttttgtttctggaaagaata

SEQ ID NO: 607613 - DNA, 20 bp, Artificial
  CRISPR gRNA sequence
agtaattgttgctgtgaatt

SEQ ID NO: 607614 - DNA, 20 bp, Artificial
  CRISPR gRNA sequence
ttgagaactaatttaatgtt

SEQ ID NO: 607615 - DNA, 20 bp, Artificial
  CRISPR gRNA sequence
aactaatttaatgttaagaa

SEQ ID NO: 607616 - DNA, 20 bp, Artificial
  CRISPR gRNA sequence
actaatttaatgttaagaaa

SEQ ID NO: 607617 - DNA, 20 bp, Artificial
  CRISPR gRNA sequence
ctaatttaatgttaagaaaa

SEQ ID NO: 607618 - DNA, 20 bp, Artificial
  CRISPR gRNA sequence
atttaatgttaagaaaaggg

SEQ ID NO: 607619 - DNA, 20 bp, Artificial
  CRISPR gRNA sequence
agaaaaacctttgttaaaaa

SEQ ID NO: 607620 - DNA, 20 bp, Artificial
  CRISPR gRNA sequence
aaacctttgttaaaaataga

SEQ ID NO: 607621 - DNA, 20 bp, Artificial
  CRISPR gRNA sequence
tacatttttaacattttcaa

SEQ ID NO: 607622 - DNA, 20 bp, Artificial
  CRISPR gRNA sequence
atttttaacattttcaacag

SEQ ID NO: 607623 - DNA, 20 bp, Artificial
  CRISPR gRNA sequence
atattactgtctacattttt

SEQ ID NO: 607624 - DNA, 20 bp, Artificial
  CRISPR gRNA sequence
tctacatttttaagttttct

SEQ ID NO: 607625 - DNA, 20 bp, Artificial
  CRISPR gRNA sequence
ttaagttttcttagcaattt

SEQ ID NO: 607626 - DNA, 20 bp, Artificial
  CRISPR gRNA sequence
tctacccttctaaaataata

SEQ ID NO: 607627 - DNA, 20 bp, Artificial
  CRISPR gRNA sequence
ttcatgaattgtttttttta

SEQ ID NO: 607628 - DNA, 20 bp, Artificial
  CRISPR gRNA sequence
tcatgaattgttttttttaa

SEQ ID NO: 607629 - DNA, 20 bp, Artificial
  CRISPR gRNA sequence
acataatctgtttacacttg

SEQ ID NO: 607630 - DNA, 20 bp, Artificial
  CRISPR gRNA sequence
ataatctgtttacacttgaa

SEQ ID NO: 607631 - DNA, 20 bp, Artificial
  CRISPR gRNA sequence
ctgtttacacttgaagagtt

SEQ ID NO: 607632 - DNA, 20 bp, Artificial
  CRISPR gRNA sequence
tgtttacacttgaagagttg

SEQ ID NO: 607633 - DNA, 20 bp, Artificial
  CRISPR gRNA sequence
cacttgaagagttgaggata

SEQ ID NO: 607634 - DNA, 20 bp, Artificial
  CRISPR gRNA sequence
acttgaagagttgaggatac

SEQ ID NO: 607635 - DNA, 20 bp, Artificial
  CRISPR gRNA sequence
acaggaatatgtgcgtttat

SEQ ID NO: 607636 - DNA, 20 bp, Artificial
  CRISPR gRNA sequence
ggaatatgtgcgtttatcag

SEQ ID NO: 607637 - DNA, 20 bp, Artificial
  CRISPR gRNA sequence
gaatatgtgcgtttatcagt

SEQ ID NO: 607638 - DNA, 20 bp, Artificial
  CRISPR gRNA sequence
gcgtttatcagtgggatcct

SEQ ID NO: 607639 - DNA, 20 bp, Artificial
  CRISPR gRNA sequence
tttatcagtgggatccttag

SEQ ID NO: 607640 - DNA, 20 bp, Artificial
  CRISPR gRNA sequence
ttatcagtgggatccttagt

SEQ ID NO: 607641 - DNA, 20 bp, Artificial
  CRISPR gRNA sequence
ggatccttagtaggatcata

SEQ ID NO: 607642 - DNA, 20 bp, Artificial
  CRISPR gRNA sequence
agtaggatcataaagctctt

SEQ ID NO: 607643 - DNA, 20 bp, Artificial
  CRISPR gRNA sequence
ggatcataaagctcttaaga

SEQ ID NO: 607644 - DNA, 20 bp, Artificial
  CRISPR gRNA sequence
cataaagctcttaagacgga

SEQ ID NO: 607645 - DNA, 20 bp, Artificial
  CRISPR gRNA sequence
ataaagctcttaagacggaa

SEQ ID NO: 607646 - DNA, 20 bp, Artificial
  CRISPR gRNA sequence
actctaacccacttgtgtta

SEQ ID NO: 607647 - DNA, 20 bp, Artificial
  CRISPR gRNA sequence
cttgtgttatagattaaaca

SEQ ID NO: 607648 - DNA, 20 bp, Artificial
  CRISPR gRNA sequence
tgttatagattaaacaaagc

SEQ ID NO: 607649 - DNA, 20 bp, Artificial
  CRISPR gRNA sequence
gattaaacaaagctagattt

SEQ ID NO: 607650 - DNA, 20 bp, Artificial
  CRISPR gRNA sequence
ttaaacaaagctagatttta

SEQ ID NO: 607651 - DNA, 20 bp, Artificial
  CRISPR gRNA sequence
aaacaaagctagattttaga

SEQ ID NO: 607652 - DNA, 20 bp, Artificial
  CRISPR gRNA sequence
ctagattttagagagaaata

SEQ ID NO: 607653 - DNA, 20 bp, Artificial
  CRISPR gRNA sequence
attttagagagaaatataga

SEQ ID NO: 607654 - DNA, 20 bp, Artificial
  CRISPR gRNA sequence
taaacatgattaaaaaaaat

SEQ ID NO: 607655 - DNA, 20 bp, Artificial
  CRISPR gRNA sequence
gattaaaaaaaataagtaca

SEQ ID NO: 607656 - DNA, 20 bp, Artificial
  CRISPR gRNA sequence
aaaaaaataagtacatagaa

SEQ ID NO: 607657 - DNA, 20 bp, Artificial
  CRISPR gRNA sequence
aaaaaataagtacatagaat

SEQ ID NO: 607658 - DNA, 20 bp, Artificial
  CRISPR gRNA sequence
aataagtacatagaataggc

SEQ ID NO: 607659 - DNA, 20 bp, Artificial
  CRISPR gRNA sequence
ataagtacatagaataggcc

SEQ ID NO: 607660 - DNA, 20 bp, Artificial
  CRISPR gRNA sequence
tacatagaataggccgggtg

SEQ ID NO: 607661 - DNA, 20 bp, Artificial
  CRISPR gRNA sequence
atagaataggccgggtgcgg

SEQ ID NO: 607662 - DNA, 20 bp, Artificial
  CRISPR gRNA sequence
gtggctcacacctgtaatcc

SEQ ID NO: 607663 - DNA, 20 bp, Artificial
  CRISPR gRNA sequence
cacctgtaatcccagtactt

SEQ ID NO: 607664 - DNA, 20 bp, Artificial
  CRISPR gRNA sequence
acctgtaatcccagtacttt

SEQ ID NO: 607665 - DNA, 20 bp, Artificial
  CRISPR gRNA sequence
ctgtaatcccagtactttgg

SEQ ID NO: 607666 - DNA, 20 bp, Artificial
  CRISPR gRNA sequence
tgtaatcccagtactttggg

SEQ ID NO: 607667 - DNA, 20 bp, Artificial
  CRISPR gRNA sequence
tcccagtactttgggaggcc

SEQ ID NO: 607668 - DNA, 20 bp, Artificial
  CRISPR gRNA sequence
cccagtactttgggaggccg

SEQ ID NO: 607669 - DNA, 20 bp, Artificial
  CRISPR gRNA sequence
cagtactttgggaggccgag

SEQ ID NO: 607670 - DNA, 20 bp, Artificial
  CRISPR gRNA sequence
agtactttgggaggccgagg

SEQ ID NO: 607671 - DNA, 20 bp, Artificial
  CRISPR gRNA sequence
gtactttgggaggccgagga

SEQ ID NO: 607672 - DNA, 20 bp, Artificial
  CRISPR gRNA sequence
ctttgggaggccgaggaggg

SEQ ID NO: 607673 - DNA, 20 bp, Artificial
  CRISPR gRNA sequence
ggccgaggagggtggatcac

SEQ ID NO: 607674 - DNA, 20 bp, Artificial
  CRISPR gRNA sequence
gccgaggagggtggatcacg

SEQ ID NO: 607675 - DNA, 20 bp, Artificial
  CRISPR gRNA sequence
aggagggtggatcacgaggt

SEQ ID NO: 607676 - DNA, 20 bp, Artificial
  CRISPR gRNA sequence
ggagggtggatcacgaggtc

SEQ ID NO: 607677 - DNA, 20 bp, Artificial
  CRISPR gRNA sequence
agggtggatcacgaggtcag

SEQ ID NO: 607678 - DNA, 20 bp, Artificial
  CRISPR gRNA sequence
gatcacgaggtcaggagatc

SEQ ID NO: 607679 - DNA, 20 bp, Artificial
  CRISPR gRNA sequence
tcaggagatcgagaccatcc

SEQ ID NO: 607680 - DNA, 20 bp, Artificial
  CRISPR gRNA sequence
cgagaccatcctggctaaca

SEQ ID NO: 607681 - DNA, 20 bp, Artificial
  CRISPR gRNA sequence
tactaaaaatacacaaaaat

SEQ ID NO: 607682 - DNA, 20 bp, Artificial
  CRISPR gRNA sequence
aaaaatacacaaaaattagc

SEQ ID NO: 607683 - DNA, 20 bp, Artificial
  CRISPR gRNA sequence
acacaaaaattagccggaca

SEQ ID NO: 607684 - DNA, 20 bp, Artificial
  CRISPR gRNA sequence
caaaaattagccggacatgg

SEQ ID NO: 607685 - DNA, 20 bp, Artificial
  CRISPR gRNA sequence
aaattagccggacatggtgg

SEQ ID NO: 607686 - DNA, 20 bp, Artificial
  CRISPR gRNA sequence
aattagccggacatggtggc

SEQ ID NO: 607687 - DNA, 20 bp, Artificial
  CRISPR gRNA sequence
gacatggtggcgggcgcctg

SEQ ID NO: 607688 - DNA, 20 bp, Artificial
  CRISPR gRNA sequence
gtggcgggcgcctgtagtcc

SEQ ID NO: 607689 - DNA, 20 bp, Artificial
  CRISPR gRNA sequence
cgcctgtagtcccagctact

SEQ ID NO: 607690 - DNA, 20 bp, Artificial
  CRISPR gRNA sequence
gcctgtagtcccagctactt

SEQ ID NO: 607691 - DNA, 20 bp, Artificial
  CRISPR gRNA sequence
ctgtagtcccagctacttgg

SEQ ID NO: 607692 - DNA, 20 bp, Artificial
  CRISPR gRNA sequence
tgtagtcccagctacttggg

SEQ ID NO: 607693 - DNA, 20 bp, Artificial
  CRISPR gRNA sequence
gtcccagctacttgggaggc

SEQ ID NO: 607694 - DNA, 20 bp, Artificial
  CRISPR gRNA sequence
tcccagctacttgggaggct

SEQ ID NO: 607695 - DNA, 20 bp, Artificial
  CRISPR gRNA sequence
cccagctacttgggaggctg

SEQ ID NO: 607696 - DNA, 20 bp, Artificial
  CRISPR gRNA sequence
agctacttgggaggctgggg

SEQ ID NO: 607697 - DNA, 20 bp, Artificial
  CRISPR gRNA sequence
gctacttgggaggctggggc

SEQ ID NO: 607698 - DNA, 20 bp, Artificial
  CRISPR gRNA sequence
tacttgggaggctggggcag

SEQ ID NO: 607699 - DNA, 20 bp, Artificial
  CRISPR gRNA sequence
gggaggctggggcaggagaa

SEQ ID NO: 607700 - DNA, 20 bp, Artificial
  CRISPR gRNA sequence
gcaggagaatggcgtgaacc

SEQ ID NO: 607701 - DNA, 20 bp, Artificial
  CRISPR gRNA sequence
caggagaatggcgtgaacct

SEQ ID NO: 607702 - DNA, 20 bp, Artificial
  CRISPR gRNA sequence
ggagaatggcgtgaacctgg

SEQ ID NO: 607703 - DNA, 20 bp, Artificial
  CRISPR gRNA sequence
gagaatggcgtgaacctggg

SEQ ID NO: 607704 - DNA, 20 bp, Artificial
  CRISPR gRNA sequence
aatggcgtgaacctgggagg

SEQ ID NO: 607705 - DNA, 20 bp, Artificial
  CRISPR gRNA sequence
tggcgtgaacctgggaggtg

SEQ ID NO: 607706 - DNA, 20 bp, Artificial
  CRISPR gRNA sequence
aacctgggaggtggagcttg

SEQ ID NO: 607707 - DNA, 20 bp, Artificial
  CRISPR gRNA sequence
tgggaggtggagcttgcagt

SEQ ID NO: 607708 - DNA, 20 bp, Artificial
  CRISPR gRNA sequence
gaaattgcaccactgcactc

SEQ ID NO: 607709 - DNA, 20 bp, Artificial
  CRISPR gRNA sequence
tgcaccactgcactccagcc

SEQ ID NO: 607710 - DNA, 20 bp, Artificial
  CRISPR gRNA sequence
gcaccactgcactccagcct

SEQ ID NO: 607711 - DNA, 20 bp, Artificial
  CRISPR gRNA sequence
cactgcactccagcctgggc

SEQ ID NO: 607712 - DNA, 20 bp, Artificial
  CRISPR gRNA sequence
ctgcactccagcctgggcga

SEQ ID NO: 607713 - DNA, 20 bp, Artificial
  CRISPR gRNA sequence
gcactccagcctgggcgaga

SEQ ID NO: 607714 - DNA, 20 bp, Artificial
  CRISPR gRNA sequence
tccagcctgggcgagagagc

SEQ ID NO: 607715 - DNA, 20 bp, Artificial
  CRISPR gRNA sequence
aaaaaaaaaaaaaaaaaaaa

SEQ ID NO: 607716 - DNA, 20 bp, Artificial
  CRISPR gRNA sequence
aaaaaaaaaaaaaaagtaca

SEQ ID NO: 607717 - DNA, 20 bp, Artificial
  CRISPR gRNA sequence
aaaaaaaaaagtacatagaa

SEQ ID NO: 607718 - DNA, 20 bp, Artificial
  CRISPR gRNA sequence
aaaagtacatagaatagtat

SEQ ID NO: 607719 - DNA, 20 bp, Artificial
  CRISPR gRNA sequence
acatagaatagtatcagaac

SEQ ID NO: 607720 - DNA, 20 bp, Artificial
  CRISPR gRNA sequence
tagaatagtatcagaactgg

SEQ ID NO: 607721 - DNA, 20 bp, Artificial
  CRISPR gRNA sequence
gtatcagaactggaagccca

SEQ ID NO: 607722 - DNA, 20 bp, Artificial
  CRISPR gRNA sequence
tatcagaactggaagcccaa

SEQ ID NO: 607723 - DNA, 20 bp, Artificial
  CRISPR gRNA sequence
aatttaaaaaacaaattgca

SEQ ID NO: 607724 - DNA, 20 bp, Artificial
  CRISPR gRNA sequence
aaacaaattgcaaagatgtt

SEQ ID NO: 607725 - DNA, 20 bp, Artificial
  CRISPR gRNA sequence
aagattgtttcccattttta

SEQ ID NO: 607726 - DNA, 20 bp, Artificial
  CRISPR gRNA sequence
tcattcattttgttgattga

SEQ ID NO: 607727 - DNA, 20 bp, Artificial
  CRISPR gRNA sequence
ttgattgacagcattcacta

SEQ ID NO: 607728 - DNA, 20 bp, Artificial
  CRISPR gRNA sequence
tgacagcattcactatagat

SEQ ID NO: 607729 - DNA, 20 bp, Artificial
  CRISPR gRNA sequence
acagcattcactatagataa

SEQ ID NO: 607730 - DNA, 20 bp, Artificial
  CRISPR gRNA sequence
cagcattcactatagataag

SEQ ID NO: 607731 - DNA, 20 bp, Artificial
  CRISPR gRNA sequence
cattcactatagataagagg

SEQ ID NO: 607732 - DNA, 20 bp, Artificial
  CRISPR gRNA sequence
tatagataagaggtagttca

SEQ ID NO: 607733 - DNA, 20 bp, Artificial
  CRISPR gRNA sequence
agataagaggtagttcatgg

SEQ ID NO: 607734 - DNA, 20 bp, Artificial
  CRISPR gRNA sequence
taagaggtagttcatggcag

SEQ ID NO: 607735 - DNA, 20 bp, Artificial
  CRISPR gRNA sequence
agtggtttaatataaattat

SEQ ID NO: 607736 - DNA, 20 bp, Artificial
  CRISPR gRNA sequence
tggtttaatataaattatta

SEQ ID NO: 607737 - DNA, 20 bp, Artificial
  CRISPR gRNA sequence
tattagagaaaatttaaata

SEQ ID NO: 607738 - DNA, 20 bp, Artificial
  CRISPR gRNA sequence
agagaaaatttaaatacaga

SEQ ID NO: 607739 - DNA, 20 bp, Artificial
  CRISPR gRNA sequence
aatttaaatacagaaagttc

SEQ ID NO: 607740 - DNA, 20 bp, Artificial
  CRISPR gRNA sequence
agaaattcatatttctgtga

SEQ ID NO: 607741 - DNA, 20 bp, Artificial
  CRISPR gRNA sequence
catatttctgtgatggaaaa

SEQ ID NO: 607742 - DNA, 20 bp, Artificial
  CRISPR gRNA sequence
ttctgtgatggaaaaaagac

SEQ ID NO: 607743 - DNA, 20 bp, Artificial
  CRISPR gRNA sequence
agactagtattattttactt

SEQ ID NO: 607744 - DNA, 20 bp, Artificial
  CRISPR gRNA sequence
gtattattttacttgagcta

SEQ ID NO: 607745 - DNA, 20 bp, Artificial
  CRISPR gRNA sequence
tataacacttgtgcttttca

SEQ ID NO: 607746 - DNA, 20 bp, Artificial
  CRISPR gRNA sequence
gcttttcatggatacatttt

SEQ ID NO: 607747 - DNA, 20 bp, Artificial
  CRISPR gRNA sequence
taagaaccactgatttaaac

SEQ ID NO: 607748 - DNA, 20 bp, Artificial
  CRISPR gRNA sequence
tcactattatcatattcatt

SEQ ID NO: 607749 - DNA, 20 bp, Artificial
  CRISPR gRNA sequence
ttatcatattcatttggtgt

SEQ ID NO: 607750 - DNA, 20 bp, Artificial
  CRISPR gRNA sequence
gtgttagaattctgtaaatg

SEQ ID NO: 607751 - DNA, 20 bp, Artificial
  CRISPR gRNA sequence
aattctgtaaatgtagaatt

SEQ ID NO: 607752 - DNA, 20 bp, Artificial
  CRISPR gRNA sequence
taaatgtagaattaagtcac

SEQ ID NO: 607753 - DNA, 20 bp, Artificial
  CRISPR gRNA sequence
cactagaaaatccttaaaat

SEQ ID NO: 607754 - DNA, 20 bp, Artificial
  CRISPR gRNA sequence
aaaataagccttctctatac

SEQ ID NO: 607755 - DNA, 20 bp, Artificial
  CRISPR gRNA sequence
agccttctctataccagatt

SEQ ID NO: 607756 - DNA, 20 bp, Artificial
  CRISPR gRNA sequence
tcagtgaatttcatgtatat

SEQ ID NO: 607757 - DNA, 20 bp, Artificial
  CRISPR gRNA sequence
tgaatttcatgtatataaga

SEQ ID NO: 607758 - DNA, 20 bp, Artificial
  CRISPR gRNA sequence
atataagatggataattatt

SEQ ID NO: 607759 - DNA, 20 bp, Artificial
  CRISPR gRNA sequence
taagatggataattattaag

SEQ ID NO: 607760 - DNA, 20 bp, Artificial
  CRISPR gRNA sequence
attattaagcagcttgcata

SEQ ID NO: 607761 - DNA, 20 bp, Artificial
  CRISPR gRNA sequence
gcttgcataaagatattcca

SEQ ID NO: 607762 - DNA, 20 bp, Artificial
  CRISPR gRNA sequence
aagatattccacagtccttt

SEQ ID NO: 607763 - DNA, 20 bp, Artificial
  CRISPR gRNA sequence
gtgtaacaatcttttattct

SEQ ID NO: 607764 - DNA, 20 bp, Artificial
  CRISPR gRNA sequence
tgtaacaatcttttattctg

SEQ ID NO: 607765 - DNA, 20 bp, Artificial
  CRISPR gRNA sequence
ccttgaaatgatttatatat

SEQ ID NO: 607766 - DNA, 20 bp, Artificial
  CRISPR gRNA sequence
atatattagttgtatgtctt

SEQ ID NO: 607767 - DNA, 20 bp, Artificial
  CRISPR gRNA sequence
tgtatgtcttcagactcact

SEQ ID NO: 607768 - DNA, 20 bp, Artificial
  CRISPR gRNA sequence
ttttatttatttattttttt

SEQ ID NO: 607769 - DNA, 20 bp, Artificial
  CRISPR gRNA sequence
ttatttatttattttttttg

SEQ ID NO: 607770 - DNA, 20 bp, Artificial
  CRISPR gRNA sequence
ttatttattttttttggaga

SEQ ID NO: 607771 - DNA, 20 bp, Artificial
  CRISPR gRNA sequence
atttattttttttggagacg

SEQ ID NO: 607772 - DNA, 20 bp, Artificial
  CRISPR gRNA sequence
ttttttttggagacggagtc

SEQ ID NO: 607773 - DNA, 20 bp, Artificial
  CRISPR gRNA sequence
cggagtctggctttgtcgcc

SEQ ID NO: 607774 - DNA, 20 bp, Artificial
  CRISPR gRNA sequence
ggagtctggctttgtcgccc

SEQ ID NO: 607775 - DNA, 20 bp, Artificial
  CRISPR gRNA sequence
tctggctttgtcgcccaggc

SEQ ID NO: 607776 - DNA, 20 bp, Artificial
  CRISPR gRNA sequence
tggctttgtcgcccaggctg

SEQ ID NO: 607777 - DNA, 20 bp, Artificial
  CRISPR gRNA sequence
ttgtcgcccaggctggagtg

SEQ ID NO: 607778 - DNA, 20 bp, Artificial
  CRISPR gRNA sequence
tcgcccaggctggagtgcag

SEQ ID NO: 607779 - DNA, 20 bp, Artificial
  CRISPR gRNA sequence
ggcgcgatctccgctcacgc

SEQ ID NO: 607780 - DNA, 20 bp, Artificial
  CRISPR gRNA sequence
ctcacgcaagctccgcctcc

SEQ ID NO: 607781 - DNA, 20 bp, Artificial
  CRISPR gRNA sequence
tcacgcaagctccgcctcct

SEQ ID NO: 607782 - DNA, 20 bp, Artificial
  CRISPR gRNA sequence
ttcacgcccttctcctgcct

SEQ ID NO: 607783 - DNA, 20 bp, Artificial
  CRISPR gRNA sequence
ccttctcctgcctcagcctc

SEQ ID NO: 607784 - DNA, 20 bp, Artificial
  CRISPR gRNA sequence
ttctcctgcctcagcctccg

SEQ ID NO: 607785 - DNA, 20 bp, Artificial
  CRISPR gRNA sequence
tcctgcctcagcctccggag

SEQ ID NO: 607786 - DNA, 20 bp, Artificial
  CRISPR gRNA sequence
gcctcagcctccggagtagc

SEQ ID NO: 607787 - DNA, 20 bp, Artificial
  CRISPR gRNA sequence
gctggactttcatttcttaa

SEQ ID NO: 607788 - DNA, 20 bp, Artificial
  CRISPR gRNA sequence
catttcttaatagtgaattg

SEQ ID NO: 607789 - DNA, 20 bp, Artificial
  CRISPR gRNA sequence
taatagtgaattgtagaatt

SEQ ID NO: 607790 - DNA, 20 bp, Artificial
  CRISPR gRNA sequence
tgaattgtagaatttggatg

SEQ ID NO: 607791 - DNA, 20 bp, Artificial
  CRISPR gRNA sequence
tagaatttggatgtagaatt

SEQ ID NO: 607792 - DNA, 20 bp, Artificial
  CRISPR gRNA sequence
aatttggatgtagaatttgg

SEQ ID NO: 607793 - DNA, 20 bp, Artificial
  CRISPR gRNA sequence
tggatgtagaatttggaagt

SEQ ID NO: 607794 - DNA, 20 bp, Artificial
  CRISPR gRNA sequence
ttggaagttggacatctctc

SEQ ID NO: 607795 - DNA, 20 bp, Artificial
  CRISPR gRNA sequence
taatttatcctaaacaattg

SEQ ID NO: 607796 - DNA, 20 bp, Artificial
  CRISPR gRNA sequence
aattgaagataaatattcca

SEQ ID NO: 607797 - DNA, 20 bp, Artificial
  CRISPR gRNA sequence
gataaatattccatggtatt

SEQ ID NO: 607798 - DNA, 20 bp, Artificial
  CRISPR gRNA sequence
atattccatggtattaagta

SEQ ID NO: 607799 - DNA, 20 bp, Artificial
  CRISPR gRNA sequence
tattccatggtattaagtat

SEQ ID NO: 607800 - DNA, 20 bp, Artificial
  CRISPR gRNA sequence
attccatggtattaagtata

SEQ ID NO: 607801 - DNA, 20 bp, Artificial
  CRISPR gRNA sequence
tccaaaaatattataataac

SEQ ID NO: 607802 - DNA, 20 bp, Artificial
  CRISPR gRNA sequence
aaaaatattataataactag

SEQ ID NO: 607803 - DNA, 20 bp, Artificial
  CRISPR gRNA sequence
tgaatatatgaatttacgtt

SEQ ID NO: 607804 - DNA, 20 bp, Artificial
  CRISPR gRNA sequence
aatatatgaatttacgtttg

SEQ ID NO: 607805 - DNA, 20 bp, Artificial
  CRISPR gRNA sequence
aatttacgtttggagttaaa

SEQ ID NO: 607806 - DNA, 20 bp, Artificial
  CRISPR gRNA sequence
tatttcatttaatttaaata

SEQ ID NO: 607807 - DNA, 20 bp, Artificial
  CRISPR gRNA sequence
taaataaagtacaactgctg

SEQ ID NO: 607808 - DNA, 20 bp, Artificial
  CRISPR gRNA sequence
taaagtacaactgctgaaga

SEQ ID NO: 607809 - DNA, 20 bp, Artificial
  CRISPR gRNA sequence
aactgctgaagatagatcga

SEQ ID NO: 607810 - DNA, 20 bp, Artificial
  CRISPR gRNA sequence
tagatcgatagatgttatat

SEQ ID NO: 607811 - DNA, 20 bp, Artificial
  CRISPR gRNA sequence
accatgtttaatttttgtgt

SEQ ID NO: 607812 - DNA, 20 bp, Artificial
  CRISPR gRNA sequence
ccatgtttaatttttgtgtt

SEQ ID NO: 607813 - DNA, 20 bp, Artificial
  CRISPR gRNA sequence
acacattatttgtgtttaaa

SEQ ID NO: 607814 - DNA, 20 bp, Artificial
  CRISPR gRNA sequence
tcttgtttatattacatgtt

SEQ ID NO: 607815 - DNA, 20 bp, Artificial
  CRISPR gRNA sequence
cttgtttatattacatgttt

SEQ ID NO: 607816 - DNA, 20 bp, Artificial
  CRISPR gRNA sequence
gaattttgtgtttattattt

SEQ ID NO: 607817 - DNA, 20 bp, Artificial
  CRISPR gRNA sequence
tgtttattattttagaaaat

SEQ ID NO: 607818 - DNA, 20 bp, Artificial
  CRISPR gRNA sequence
ttttagaaaatgagattata

SEQ ID NO: 607819 - DNA, 20 bp, Artificial
  CRISPR gRNA sequence
tagaaaatgagattatatag

SEQ ID NO: 607820 - DNA, 20 bp, Artificial
  CRISPR gRNA sequence
attatatagtagttttgttt

SEQ ID NO: 607821 - DNA, 20 bp, Artificial
  CRISPR gRNA sequence
gtagttttgtttcggtgttt

SEQ ID NO: 607822 - DNA, 20 bp, Artificial
  CRISPR gRNA sequence
tttcggtgttttagaataaa

SEQ ID NO: 607823 - DNA, 20 bp, Artificial
  CRISPR gRNA sequence
ataaatggaatttctataaa

SEQ ID NO: 607824 - DNA, 20 bp, Artificial
  CRISPR gRNA sequence
aaatggaatttctataaaaa

SEQ ID NO: 607825 - DNA, 20 bp, Artificial
  CRISPR gRNA sequence
gagttttctatttttttttc

SEQ ID NO: 607826 - DNA, 20 bp, Artificial
  CRISPR gRNA sequence
ttttctatttttttttctag

SEQ ID NO: 607827 - DNA, 20 bp, Artificial
  CRISPR gRNA sequence
ttttttttctagtggaaaac

SEQ ID NO: 607828 - DNA, 20 bp, Artificial
  CRISPR gRNA sequence
tttttttctagtggaaaact

SEQ ID NO: 607829 - DNA, 20 bp, Artificial
  CRISPR gRNA sequence
tctagtggaaaactaggtga

SEQ ID NO: 607830 - DNA, 20 bp, Artificial
  CRISPR gRNA sequence
ggtgcatatgactttatccc

SEQ ID NO: 607831 - DNA, 20 bp, Artificial
  CRISPR gRNA sequence
gtgcatatgactttatccct

SEQ ID NO: 607832 - DNA, 20 bp, Artificial
  CRISPR gRNA sequence
tatgactttatccctaggaa

SEQ ID NO: 607833 - DNA, 20 bp, Artificial
  CRISPR gRNA sequence
tttatccctaggaaaagcat

SEQ ID NO: 607834 - DNA, 20 bp, Artificial
  CRISPR gRNA sequence
gaaaagcattagttttgtaa

SEQ ID NO: 607835 - DNA, 20 bp, Artificial
  CRISPR gRNA sequence
aaaagcattagttttgtaat

SEQ ID NO: 607836 - DNA, 20 bp, Artificial
  CRISPR gRNA sequence
aaagcattagttttgtaatg

SEQ ID NO: 607837 - DNA, 20 bp, Artificial
  CRISPR gRNA sequence
ttttgtaatggggtttcatg

SEQ ID NO: 607838 - DNA, 20 bp, Artificial
  CRISPR gRNA sequence
tgtttaaaaaaaatcctgtt

SEQ ID NO: 607839 - DNA, 20 bp, Artificial
  CRISPR gRNA sequence
tgtttagtttacatgatgtg

SEQ ID NO: 607840 - DNA, 20 bp, Artificial
  CRISPR gRNA sequence
gtttagtttacatgatgtgt

SEQ ID NO: 607841 - DNA, 20 bp, Artificial
  CRISPR gRNA sequence
agtttacatgatgtgtagga

SEQ ID NO: 607842 - DNA, 20 bp, Artificial
  CRISPR gRNA sequence
catgatgtgtaggaaagcgt

SEQ ID NO: 607843 - DNA, 20 bp, Artificial
  CRISPR gRNA sequence
atgatgtgtaggaaagcgtt

SEQ ID NO: 607844 - DNA, 20 bp, Artificial
  CRISPR gRNA sequence
attatttgtttttttacaat

SEQ ID NO: 607845 - DNA, 20 bp, Artificial
  CRISPR gRNA sequence
caatcagtgatttaaaaaca

SEQ ID NO: 607846 - DNA, 20 bp, Artificial
  CRISPR gRNA sequence
tgatttaaaaacatagtcat

SEQ ID NO: 607847 - DNA, 20 bp, Artificial
  CRISPR gRNA sequence
atgtgccattaacctaaatt

SEQ ID NO: 607848 - DNA, 20 bp, Artificial
  CRISPR gRNA sequence
tgccattaacctaaatttgg

SEQ ID NO: 607849 - DNA, 20 bp, Artificial
  CRISPR gRNA sequence
ccattaacctaaatttggta

SEQ ID NO: 607850 - DNA, 20 bp, Artificial
  CRISPR gRNA sequence
aacctaaatttggtagagtg

SEQ ID NO: 607851 - DNA, 20 bp, Artificial
  CRISPR gRNA sequence
ctaaatttggtagagtgtgg

SEQ ID NO: 607852 - DNA, 20 bp, Artificial
  CRISPR gRNA sequence
aatttggtagagtgtggtgg

SEQ ID NO: 607853 - DNA, 20 bp, Artificial
  CRISPR gRNA sequence
gtgtggtggtggtgtattct

SEQ ID NO: 607854 - DNA, 20 bp, Artificial
  CRISPR gRNA sequence
tttgcttatgattattttat

SEQ ID NO: 607855 - DNA, 20 bp, Artificial
  CRISPR gRNA sequence
ttctttgataatattattcc

SEQ ID NO: 607856 - DNA, 20 bp, Artificial
  CRISPR gRNA sequence
tctttgataatattattccc

SEQ ID NO: 607857 - DNA, 20 bp, Artificial
  CRISPR gRNA sequence
ttgataatattattcccagg

SEQ ID NO: 607858 - DNA, 20 bp, Artificial
  CRISPR gRNA sequence
gataatattattcccaggca

SEQ ID NO: 607859 - DNA, 20 bp, Artificial
  CRISPR gRNA sequence
aatcttctttccatattctt

SEQ ID NO: 607860 - DNA, 20 bp, Artificial
  CRISPR gRNA sequence
atattctttagtttgaatgt

SEQ ID NO: 607861 - DNA, 20 bp, Artificial
  CRISPR gRNA sequence
gtcagtgcttgtataatatc

SEQ ID NO: 607862 - DNA, 20 bp, Artificial
  CRISPR gRNA sequence
gtgcttgtataatatcaaga

SEQ ID NO: 607863 - DNA, 20 bp, Artificial
  CRISPR gRNA sequence
gcttgtataatatcaagata

SEQ ID NO: 607864 - DNA, 20 bp, Artificial
  CRISPR gRNA sequence
cttgtataatatcaagatag

SEQ ID NO: 607865 - DNA, 20 bp, Artificial
  CRISPR gRNA sequence
tcttcatttctcacccaaac

SEQ ID NO: 607866 - DNA, 20 bp, Artificial
  CRISPR gRNA sequence
cttcatttctcacccaaacg

SEQ ID NO: 607867 - DNA, 20 bp, Artificial
  CRISPR gRNA sequence
atttctcacccaaacgagga

SEQ ID NO: 607868 - DNA, 20 bp, Artificial
  CRISPR gRNA sequence
cgaggatggttaaaatacac

SEQ ID NO: 607869 - DNA, 20 bp, Artificial
  CRISPR gRNA sequence
gaggatggttaaaatacact

SEQ ID NO: 607870 - DNA, 20 bp, Artificial
  CRISPR gRNA sequence
gtttaacataaactacttaa

SEQ ID NO: 607871 - DNA, 20 bp, Artificial
  CRISPR gRNA sequence
ctacttaatggttattgtgt

SEQ ID NO: 607872 - DNA, 20 bp, Artificial
  CRISPR gRNA sequence
attaatcaaatgtttccttt

SEQ ID NO: 607873 - DNA, 20 bp, Artificial
  CRISPR gRNA sequence
ttaatcaaatgtttcctttg

SEQ ID NO: 607874 - DNA, 20 bp, Artificial
  CRISPR gRNA sequence
aatgtttcctttgaggattc

SEQ ID NO: 607875 - DNA, 20 bp, Artificial
  CRISPR gRNA sequence
gaggattctagttttgttaa

SEQ ID NO: 607876 - DNA, 20 bp, Artificial
  CRISPR gRNA sequence
agaaaacttctgtgtgacct

SEQ ID NO: 607877 - DNA, 20 bp, Artificial
  CRISPR gRNA sequence
agaaaattaatacttgtatt

SEQ ID NO: 607878 - DNA, 20 bp, Artificial
  CRISPR gRNA sequence
ttgtattcagattctcaaat

SEQ ID NO: 607879 - DNA, 20 bp, Artificial
  CRISPR gRNA sequence
gtattcagattctcaaatga

SEQ ID NO: 607880 - DNA, 20 bp, Artificial
  CRISPR gRNA sequence
gttgataaataatatttatt

SEQ ID NO: 607881 - DNA, 20 bp, Artificial
  CRISPR gRNA sequence
ttgataaataatatttattt

SEQ ID NO: 607882 - DNA, 20 bp, Artificial
  CRISPR gRNA sequence
atatttatttaggtgacatt

SEQ ID NO: 607883 - DNA, 20 bp, Artificial
  CRISPR gRNA sequence
atttatttaggtgacatttg

SEQ ID NO: 607884 - DNA, 20 bp, Artificial
  CRISPR gRNA sequence
cattatgacaacatccacat

SEQ ID NO: 607885 - DNA, 20 bp, Artificial
  CRISPR gRNA sequence
attatgacaacatccacatt

SEQ ID NO: 607886 - DNA, 20 bp, Artificial
  CRISPR gRNA sequence
ttatgacaacatccacattg

SEQ ID NO: 607887 - DNA, 20 bp, Artificial
  CRISPR gRNA sequence
tatgacaacatccacattgg

SEQ ID NO: 607888 - DNA, 20 bp, Artificial
  CRISPR gRNA sequence
acattgggggaactcaaata

SEQ ID NO: 607889 - DNA, 20 bp, Artificial
  CRISPR gRNA sequence
cattgggggaactcaaatat

SEQ ID NO: 607890 - DNA, 20 bp, Artificial
  CRISPR gRNA sequence
ggggaactcaaatataggat

SEQ ID NO: 607891 - DNA, 20 bp, Artificial
  CRISPR gRNA sequence
agatatatattttttctact

SEQ ID NO: 607892 - DNA, 20 bp, Artificial
  CRISPR gRNA sequence
ttctactgagtataacttga

SEQ ID NO: 607893 - DNA, 20 bp, Artificial
  CRISPR gRNA sequence
gagtataacttgaaagtact

SEQ ID NO: 607894 - DNA, 20 bp, Artificial
  CRISPR gRNA sequence
tggaatttgtatttatttct

SEQ ID NO: 607895 - DNA, 20 bp, Artificial
  CRISPR gRNA sequence
ttggttcattttaaatatta

SEQ ID NO: 607896 - DNA, 20 bp, Artificial
  CRISPR gRNA sequence
aaatattatggcaaaaacca

SEQ ID NO: 607897 - DNA, 20 bp, Artificial
  CRISPR gRNA sequence
ggcaaaaaccacagttactt

SEQ ID NO: 607898 - DNA, 20 bp, Artificial
  CRISPR gRNA sequence
ttggcatcaacctaatattt

SEQ ID NO: 607899 - DNA, 20 bp, Artificial
  CRISPR gRNA sequence
tcagctgataccctaatttg

SEQ ID NO: 607900 - DNA, 20 bp, Artificial
  CRISPR gRNA sequence
cctaatttgaagtattgcaa

SEQ ID NO: 607901 - DNA, 20 bp, Artificial
  CRISPR gRNA sequence
atttgaagtattgcaatggc

SEQ ID NO: 607902 - DNA, 20 bp, Artificial
  CRISPR gRNA sequence
ctaatgaacataaacacata

SEQ ID NO: 607903 - DNA, 20 bp, Artificial
  CRISPR gRNA sequence
acacatacagcatgtgccaa

SEQ ID NO: 607904 - DNA, 20 bp, Artificial
  CRISPR gRNA sequence
gccaatagattgtttctcta

SEQ ID NO: 607905 - DNA, 20 bp, Artificial
  CRISPR gRNA sequence
aatagattgtttctctaaag

SEQ ID NO: 607906 - DNA, 20 bp, Artificial
  CRISPR gRNA sequence
tgtttctctaaagcagcgat

SEQ ID NO: 607907 - DNA, 20 bp, Artificial
  CRISPR gRNA sequence
ctaaagcagcgattagcttt

SEQ ID NO: 607908 - DNA, 20 bp, Artificial
  CRISPR gRNA sequence
agcttttagaaaacttttcc

SEQ ID NO: 607909 - DNA, 20 bp, Artificial
  CRISPR gRNA sequence
tttagaaaacttttcccagt

SEQ ID NO: 607910 - DNA, 20 bp, Artificial
  CRISPR gRNA sequence
tcatatttaatgttaataaa

SEQ ID NO: 607911 - DNA, 20 bp, Artificial
  CRISPR gRNA sequence
catatttaatgttaataaat

SEQ ID NO: 607912 - DNA, 20 bp, Artificial
  CRISPR gRNA sequence
ttaatgttaataaatgggaa

SEQ ID NO: 607913 - DNA, 20 bp, Artificial
  CRISPR gRNA sequence
taatgttaataaatgggaat

SEQ ID NO: 607914 - DNA, 20 bp, Artificial
  CRISPR gRNA sequence
acatgtgttgaaataacgat

SEQ ID NO: 607915 - DNA, 20 bp, Artificial
  CRISPR gRNA sequence
catgtgttgaaataacgata

SEQ ID NO: 607916 - DNA, 20 bp, Artificial
  CRISPR gRNA sequence
aataacgataaggccatatt

SEQ ID NO: 607917 - DNA, 20 bp, Artificial
  CRISPR gRNA sequence
acgataaggccatattaagc

SEQ ID NO: 607918 - DNA, 20 bp, Artificial
  CRISPR gRNA sequence
ataaggccatattaagccag

SEQ ID NO: 607919 - DNA, 20 bp, Artificial
  CRISPR gRNA sequence
gccatattaagccagcagaa

SEQ ID NO: 607920 - DNA, 20 bp, Artificial
  CRISPR gRNA sequence
aaactttaactgaatgaaat

SEQ ID NO: 607921 - DNA, 20 bp, Artificial
  CRISPR gRNA sequence
aactttaactgaatgaaata

SEQ ID NO: 607922 - DNA, 20 bp, Artificial
  CRISPR gRNA sequence
tttaactgaatgaaataagg

SEQ ID NO: 607923 - DNA, 20 bp, Artificial
  CRISPR gRNA sequence
ctgaatgaaataaggtagta

SEQ ID NO: 607924 - DNA, 20 bp, Artificial
  CRISPR gRNA sequence
aaataaggtagtatagactt

SEQ ID NO: 607925 - DNA, 20 bp, Artificial
  CRISPR gRNA sequence
ttcagcatttctcttttatt

SEQ ID NO: 607926 - DNA, 20 bp, Artificial
  CRISPR gRNA sequence
ctcttttattgagactgtct

SEQ ID NO: 607927 - DNA, 20 bp, Artificial
  CRISPR gRNA sequence
agactgtctcagtatctgta

SEQ ID NO: 607928 - DNA, 20 bp, Artificial
  CRISPR gRNA sequence
ctcagtatctgtatagtgta

SEQ ID NO: 607929 - DNA, 20 bp, Artificial
  CRISPR gRNA sequence
tatctgtatagtgtatagcc

SEQ ID NO: 607930 - DNA, 20 bp, Artificial
  CRISPR gRNA sequence
atctgtatagtgtatagcca

SEQ ID NO: 607931 - DNA, 20 bp, Artificial
  CRISPR gRNA sequence
tatagtgtatagccaaggaa

SEQ ID NO: 607932 - DNA, 20 bp, Artificial
  CRISPR gRNA sequence
atagccaaggaacagtttga

SEQ ID NO: 607933 - DNA, 20 bp, Artificial
  CRISPR gRNA sequence
gaacagtttgaaagccactt

SEQ ID NO: 607934 - DNA, 20 bp, Artificial
  CRISPR gRNA sequence
gccactttagaattgtcttc

SEQ ID NO: 607935 - DNA, 20 bp, Artificial
  CRISPR gRNA sequence
tttagaattgtcttctagaa

SEQ ID NO: 607936 - DNA, 20 bp, Artificial
  CRISPR gRNA sequence
cttctagaaaagtacacaca

SEQ ID NO: 607937 - DNA, 20 bp, Artificial
  CRISPR gRNA sequence
tagttgaaatctgaaataac

SEQ ID NO: 607938 - DNA, 20 bp, Artificial
  CRISPR gRNA sequence
ttgaaatctgaaataactgg

SEQ ID NO: 607939 - DNA, 20 bp, Artificial
  CRISPR gRNA sequence
aatctgaaataactggaagt

SEQ ID NO: 607940 - DNA, 20 bp, Artificial
  CRISPR gRNA sequence
aataactggaagttagtttt

SEQ ID NO: 607941 - DNA, 20 bp, Artificial
  CRISPR gRNA sequence
aagaaaacaaaccgcctttt

SEQ ID NO: 607942 - DNA, 20 bp, Artificial
  CRISPR gRNA sequence
agaaaacaaaccgccttttc

SEQ ID NO: 607943 - DNA, 20 bp, Artificial
  CRISPR gRNA sequence
aggatccatgcttgtctgtc

SEQ ID NO: 607944 - DNA, 20 bp, Artificial
  CRISPR gRNA sequence
tctgtctagcctgaataatt

SEQ ID NO: 607945 - DNA, 20 bp, Artificial
  CRISPR gRNA sequence
ctgtctagcctgaataattt

SEQ ID NO: 607946 - DNA, 20 bp, Artificial
  CRISPR gRNA sequence
aaattcatcatcatattaat

SEQ ID NO: 607947 - DNA, 20 bp, Artificial
  CRISPR gRNA sequence
aattcatcatcatattaata

SEQ ID NO: 607948 - DNA, 20 bp, Artificial
  CRISPR gRNA sequence
tttgatgaatcaaattttta

SEQ ID NO: 607949 - DNA, 20 bp, Artificial
  CRISPR gRNA sequence
caaatttttatagaatgttt

SEQ ID NO: 607950 - DNA, 20 bp, Artificial
  CRISPR gRNA sequence
aatttttatagaatgtttaa

SEQ ID NO: 607951 - DNA, 20 bp, Artificial
  CRISPR gRNA sequence
ttttatagaatgtttaagag

SEQ ID NO: 607952 - DNA, 20 bp, Artificial
  CRISPR gRNA sequence
tttatagaatgtttaagaga

SEQ ID NO: 607953 - DNA, 20 bp, Artificial
  CRISPR gRNA sequence
tttcctaaatgaaataattg

SEQ ID NO: 607954 - DNA, 20 bp, Artificial
  CRISPR gRNA sequence
tgaaataattgcagaaaatt

SEQ ID NO: 607955 - DNA, 20 bp, Artificial
  CRISPR gRNA sequence
aatttggcattctattactg

SEQ ID NO: 607956 - DNA, 20 bp, Artificial
  CRISPR gRNA sequence
tctattactgtagcaaaact

SEQ ID NO: 607957 - DNA, 20 bp, Artificial
  CRISPR gRNA sequence
tactgtagcaaaacttggca

SEQ ID NO: 607958 - DNA, 20 bp, Artificial
  CRISPR gRNA sequence
gcaaaacttggcaaagacca

SEQ ID NO: 607959 - DNA, 20 bp, Artificial
  CRISPR gRNA sequence
acttggcaaagaccaaagta

SEQ ID NO: 607960 - DNA, 20 bp, Artificial
  CRISPR gRNA sequence
gcaaagaccaaagtacagaa

SEQ ID NO: 607961 - DNA, 20 bp, Artificial
  CRISPR gRNA sequence
ccaaagtacagaacagaatc

SEQ ID NO: 607962 - DNA, 20 bp, Artificial
  CRISPR gRNA sequence
cagaacagaatctagattct

SEQ ID NO: 607963 - DNA, 20 bp, Artificial
  CRISPR gRNA sequence
tcttagtgaaatttgaatca

SEQ ID NO: 607964 - DNA, 20 bp, Artificial
  CRISPR gRNA sequence
tttgaatcacagcttctatg

SEQ ID NO: 607965 - DNA, 20 bp, Artificial
  CRISPR gRNA sequence
tctatgtggtaatgcaatgt

SEQ ID NO: 607966 - DNA, 20 bp, Artificial
  CRISPR gRNA sequence
cttctaaaaaatatgtatgt

SEQ ID NO: 607967 - DNA, 20 bp, Artificial
  CRISPR gRNA sequence
tgtaagcaaaatccattgat

SEQ ID NO: 607968 - DNA, 20 bp, Artificial
  CRISPR gRNA sequence
aaaatccattgattggattt

SEQ ID NO: 607969 - DNA, 20 bp, Artificial
  CRISPR gRNA sequence
aatccattgattggatttaa

SEQ ID NO: 607970 - DNA, 20 bp, Artificial
  CRISPR gRNA sequence
attggatttaagagttttgt

SEQ ID NO: 607971 - DNA, 20 bp, Artificial
  CRISPR gRNA sequence
ttggatttaagagttttgtt

SEQ ID NO: 607972 - DNA, 20 bp, Artificial
  CRISPR gRNA sequence
attctaactaatgttccatc

SEQ ID NO: 607973 - DNA, 20 bp, Artificial
  CRISPR gRNA sequence
atatttgacataaatatgta

SEQ ID NO: 607974 - DNA, 20 bp, Artificial
  CRISPR gRNA sequence
gcctgataacttttcaatga

SEQ ID NO: 607975 - DNA, 20 bp, Artificial
  CRISPR gRNA sequence
gaccacatatacaacatata

SEQ ID NO: 607976 - DNA, 20 bp, Artificial
  CRISPR gRNA sequence
cacatatacaacatatacag

SEQ ID NO: 607977 - DNA, 20 bp, Artificial
  CRISPR gRNA sequence
tgatgccataatattataaa

SEQ ID NO: 607978 - DNA, 20 bp, Artificial
  CRISPR gRNA sequence
gatgccataatattataaat

SEQ ID NO: 607979 - DNA, 20 bp, Artificial
  CRISPR gRNA sequence
atgccataatattataaata

SEQ ID NO: 607980 - DNA, 20 bp, Artificial
  CRISPR gRNA sequence
attataaatagggtattttt

SEQ ID NO: 607981 - DNA, 20 bp, Artificial
  CRISPR gRNA sequence
atacattttctgtgtatatg

SEQ ID NO: 607982 - DNA, 20 bp, Artificial
  CRISPR gRNA sequence
tgtgtatatgtagataccat

SEQ ID NO: 607983 - DNA, 20 bp, Artificial
  CRISPR gRNA sequence
gtgtatatgtagataccatt

SEQ ID NO: 607984 - DNA, 20 bp, Artificial
  CRISPR gRNA sequence
gttacaattgcctacgtatt

SEQ ID NO: 607985 - DNA, 20 bp, Artificial
  CRISPR gRNA sequence
aattgcctacgtattcagta

SEQ ID NO: 607986 - DNA, 20 bp, Artificial
  CRISPR gRNA sequence
cagtacagtaacatgctgtg

SEQ ID NO: 607987 - DNA, 20 bp, Artificial
  CRISPR gRNA sequence
agtacagtaacatgctgtgc

SEQ ID NO: 607988 - DNA, 20 bp, Artificial
  CRISPR gRNA sequence
taacatgctgtgcaggtttg

SEQ ID NO: 607989 - DNA, 20 bp, Artificial
  CRISPR gRNA sequence
tgctgtgcaggtttgtagct

SEQ ID NO: 607990 - DNA, 20 bp, Artificial
  CRISPR gRNA sequence
gctgtgcaggtttgtagctt

SEQ ID NO: 607991 - DNA, 20 bp, Artificial
  CRISPR gRNA sequence
ggtttgtagcttaggaacaa

SEQ ID NO: 607992 - DNA, 20 bp, Artificial
  CRISPR gRNA sequence
gtttgtagcttaggaacaac

SEQ ID NO: 607993 - DNA, 20 bp, Artificial
  CRISPR gRNA sequence
aacaggcaatatataccata

SEQ ID NO: 607994 - DNA, 20 bp, Artificial
  CRISPR gRNA sequence
gcaatatataccatacggcc

SEQ ID NO: 607995 - DNA, 20 bp, Artificial
  CRISPR gRNA sequence
caatatataccatacggcct

SEQ ID NO: 607996 - DNA, 20 bp, Artificial
  CRISPR gRNA sequence
taccatacggcctaggtatg

SEQ ID NO: 607997 - DNA, 20 bp, Artificial
  CRISPR gRNA sequence
catacggcctaggtatgaag

SEQ ID NO: 607998 - DNA, 20 bp, Artificial
  CRISPR gRNA sequence
atacggcctaggtatgaagt

SEQ ID NO: 607999 - DNA, 20 bp, Artificial
  CRISPR gRNA sequence
atgaagtaggctatcctatc

SEQ ID NO: 608000 - DNA, 20 bp, Artificial
  CRISPR gRNA sequence
gatttgtgatgtacacttga

SEQ ID NO: 608001 - DNA, 20 bp, Artificial
  CRISPR gRNA sequence
tgtacacttgatagtgttca

SEQ ID NO: 608002 - DNA, 20 bp, Artificial
  CRISPR gRNA sequence
acttgatagtgttcacagct

SEQ ID NO: 608003 - DNA, 20 bp, Artificial
  CRISPR gRNA sequence
cttgatagtgttcacagcta

SEQ ID NO: 608004 - DNA, 20 bp, Artificial
  CRISPR gRNA sequence
acagctaaggacacatttct

SEQ ID NO: 608005 - DNA, 20 bp, Artificial
  CRISPR gRNA sequence
agctaaggacacatttctca

SEQ ID NO: 608006 - DNA, 20 bp, Artificial
  CRISPR gRNA sequence
tttctcagagcacattcctg

SEQ ID NO: 608007 - DNA, 20 bp, Artificial
  CRISPR gRNA sequence
tcagagcacattcctgtagt

SEQ ID NO: 608008 - DNA, 20 bp, Artificial
  CRISPR gRNA sequence
cagagcacattcctgtagtt

SEQ ID NO: 608009 - DNA, 20 bp, Artificial
  CRISPR gRNA sequence
acattcctgtagttaggtga

SEQ ID NO: 608010 - DNA, 20 bp, Artificial
  CRISPR gRNA sequence
tgatagttgattttatgtaa

SEQ ID NO: 608011 - DNA, 20 bp, Artificial
  CRISPR gRNA sequence
tgtaatagttataaacatgt

SEQ ID NO: 608012 - DNA, 20 bp, Artificial
  CRISPR gRNA sequence
ataatatattttccttgact

SEQ ID NO: 608013 - DNA, 20 bp, Artificial
  CRISPR gRNA sequence
ttccttgacttagttttata

SEQ ID NO: 608014 - DNA, 20 bp, Artificial
  CRISPR gRNA sequence
tccttgacttagttttatat

SEQ ID NO: 608015 - DNA, 20 bp, Artificial
  CRISPR gRNA sequence
ccttgacttagttttatatg

SEQ ID NO: 608016 - DNA, 20 bp, Artificial
  CRISPR gRNA sequence
tagttttatatggggttaaa

SEQ ID NO: 608017 - DNA, 20 bp, Artificial
  CRISPR gRNA sequence
ttatatggggttaaaaagta

SEQ ID NO: 608018 - DNA, 20 bp, Artificial
  CRISPR gRNA sequence
tatatggggttaaaaagtaa

SEQ ID NO: 608019 - DNA, 20 bp, Artificial
  CRISPR gRNA sequence
atatggggttaaaaagtaaa

SEQ ID NO: 608020 - DNA, 20 bp, Artificial
  CRISPR gRNA sequence
tgctactctgttcatgtttt

SEQ ID NO: 608021 - DNA, 20 bp, Artificial
  CRISPR gRNA sequence
actctgttcatgtttttagt

SEQ ID NO: 608022 - DNA, 20 bp, Artificial
  CRISPR gRNA sequence
tctgttcatgtttttagtta

SEQ ID NO: 608023 - DNA, 20 bp, Artificial
  CRISPR gRNA sequence
ttcatgtttttagttagaga

SEQ ID NO: 608024 - DNA, 20 bp, Artificial
  CRISPR gRNA sequence
gagatggatgtgtctcttca

SEQ ID NO: 608025 - DNA, 20 bp, Artificial
  CRISPR gRNA sequence
catttgtatgatatttaaat

SEQ ID NO: 608026 - DNA, 20 bp, Artificial
  CRISPR gRNA sequence
tgatatttaaatcagtgctc

SEQ ID NO: 608027 - DNA, 20 bp, Artificial
  CRISPR gRNA sequence
aatgaatattgtcactttct

SEQ ID NO: 608028 - DNA, 20 bp, Artificial
  CRISPR gRNA sequence
tattgtcactttctcagttt

SEQ ID NO: 608029 - DNA, 20 bp, Artificial
  CRISPR gRNA sequence
ttgtcactttctcagtttga

SEQ ID NO: 608030 - DNA, 20 bp, Artificial
  CRISPR gRNA sequence
tgtcactttctcagtttgag

SEQ ID NO: 608031 - DNA, 20 bp, Artificial
  CRISPR gRNA sequence
actttctcagtttgagagga

SEQ ID NO: 608032 - DNA, 20 bp, Artificial
  CRISPR gRNA sequence
gaggatagtaaaatacattc

SEQ ID NO: 608033 - DNA, 20 bp, Artificial
  CRISPR gRNA sequence
aggatagtaaaatacattca

SEQ ID NO: 608034 - DNA, 20 bp, Artificial
  CRISPR gRNA sequence
ggatagtaaaatacattcaa

SEQ ID NO: 608035 - DNA, 20 bp, Artificial
  CRISPR gRNA sequence
gtaaaatacattcaagggac

SEQ ID NO: 608036 - DNA, 20 bp, Artificial
  CRISPR gRNA sequence
taaaatacattcaagggacc

SEQ ID NO: 608037 - DNA, 20 bp, Artificial
  CRISPR gRNA sequence
aaaatacattcaagggacca

SEQ ID NO: 608038 - DNA, 20 bp, Artificial
  CRISPR gRNA sequence
ggaccagggaaatatgatta

SEQ ID NO: 608039 - DNA, 20 bp, Artificial
  CRISPR gRNA sequence
gaccagggaaatatgattat

SEQ ID NO: 608040 - DNA, 20 bp, Artificial
  CRISPR gRNA sequence
ccagggaaatatgattatag

SEQ ID NO: 608041 - DNA, 20 bp, Artificial
  CRISPR gRNA sequence
ggaaatatgattataggagc

SEQ ID NO: 608042 - DNA, 20 bp, Artificial
  CRISPR gRNA sequence
gaaatatgattataggagct

SEQ ID NO: 608043 - DNA, 20 bp, Artificial
  CRISPR gRNA sequence
attataggagctgggtcaaa

SEQ ID NO: 608044 - DNA, 20 bp, Artificial
  CRISPR gRNA sequence
ttataggagctgggtcaaat

SEQ ID NO: 608045 - DNA, 20 bp, Artificial
  CRISPR gRNA sequence
gagctgggtcaaataggtac

SEQ ID NO: 608046 - DNA, 20 bp, Artificial
  CRISPR gRNA sequence
gtcaaataggtacaagtttc

SEQ ID NO: 608047 - DNA, 20 bp, Artificial
  CRISPR gRNA sequence
aggtacaagtttctggatcc

SEQ ID NO: 608048 - DNA, 20 bp, Artificial
  CRISPR gRNA sequence
ggtacaagtttctggatccc

SEQ ID NO: 608049 - DNA, 20 bp, Artificial
  CRISPR gRNA sequence
gtacaagtttctggatccca

SEQ ID NO: 608050 - DNA, 20 bp, Artificial
  CRISPR gRNA sequence
ggatcccagggattgtgaaa

SEQ ID NO: 608051 - DNA, 20 bp, Artificial
  CRISPR gRNA sequence
aatttatctttttctacttc

SEQ ID NO: 608052 - DNA, 20 bp, Artificial
  CRISPR gRNA sequence
tctacttctggatgttactt

SEQ ID NO: 608053 - DNA, 20 bp, Artificial
  CRISPR gRNA sequence
tacttctggatgttacttta

SEQ ID NO: 608054 - DNA, 20 bp, Artificial
  CRISPR gRNA sequence
cattctgaatttttaaaatt

SEQ ID NO: 608055 - DNA, 20 bp, Artificial
  CRISPR gRNA sequence
attctgaatttttaaaattt

SEQ ID NO: 608056 - DNA, 20 bp, Artificial
  CRISPR gRNA sequence
tttttaaaatttaggttatt

SEQ ID NO: 608057 - DNA, 20 bp, Artificial
  CRISPR gRNA sequence
tttaaaatttaggttattta

SEQ ID NO: 608058 - DNA, 20 bp, Artificial
  CRISPR gRNA sequence
atttaggttatttagagatg

SEQ ID NO: 608059 - DNA, 20 bp, Artificial
  CRISPR gRNA sequence
ttaggttatttagagatgtg

SEQ ID NO: 608060 - DNA, 20 bp, Artificial
  CRISPR gRNA sequence
taggttatttagagatgtgg

SEQ ID NO: 608061 - DNA, 20 bp, Artificial
  CRISPR gRNA sequence
atttagagatgtggaggttg

SEQ ID NO: 608062 - DNA, 20 bp, Artificial
  CRISPR gRNA sequence
agagatgtggaggttgcagt

SEQ ID NO: 608063 - DNA, 20 bp, Artificial
  CRISPR gRNA sequence
tgtggaggttgcagtgagcc

SEQ ID NO: 608064 - DNA, 20 bp, Artificial
  CRISPR gRNA sequence
aagatcgtgccactgcactc

SEQ ID NO: 608065 - DNA, 20 bp, Artificial
  CRISPR gRNA sequence
gtgccactgcactccagacc

SEQ ID NO: 608066 - DNA, 20 bp, Artificial
  CRISPR gRNA sequence
ctgcactccagacctggcga

SEQ ID NO: 608067 - DNA, 20 bp, Artificial
  CRISPR gRNA sequence
gcactccagacctggcgaca

SEQ ID NO: 608068 - DNA, 20 bp, Artificial
  CRISPR gRNA sequence
tccagacctggcgacagagc

SEQ ID NO: 608069 - DNA, 20 bp, Artificial
  CRISPR gRNA sequence
cagagcaagactccatctca

SEQ ID NO: 608070 - DNA, 20 bp, Artificial
  CRISPR gRNA sequence
acaaaaattatgttattcat

SEQ ID NO: 608071 - DNA, 20 bp, Artificial
  CRISPR gRNA sequence
atgttattcataagttttta

SEQ ID NO: 608072 - DNA, 20 bp, Artificial
  CRISPR gRNA sequence
tttatggacttctgattcgt

SEQ ID NO: 608073 - DNA, 20 bp, Artificial
  CRISPR gRNA sequence
atggacttctgattcgttgg

SEQ ID NO: 608074 - DNA, 20 bp, Artificial
  CRISPR gRNA sequence
tgattcgttggaagttaaca

SEQ ID NO: 608075 - DNA, 20 bp, Artificial
  CRISPR gRNA sequence
ttaatatatgctttacattt

SEQ ID NO: 608076 - DNA, 20 bp, Artificial
  CRISPR gRNA sequence
tatatgctttacattttgga

SEQ ID NO: 608077 - DNA, 20 bp, Artificial
  CRISPR gRNA sequence
atatgctttacattttggaa

SEQ ID NO: 608078 - DNA, 20 bp, Artificial
  CRISPR gRNA sequence
ctttacattttggaaaggtg

SEQ ID NO: 608079 - DNA, 20 bp, Artificial
  CRISPR gRNA sequence
tttttctgttgtttttcttg

SEQ ID NO: 608080 - DNA, 20 bp, Artificial
  CRISPR gRNA sequence
ttgtagtgttacctctttca

SEQ ID NO: 608081 - DNA, 20 bp, Artificial
  CRISPR gRNA sequence
tgtagtgttacctctttcaa

SEQ ID NO: 608082 - DNA, 20 bp, Artificial
  CRISPR gRNA sequence
ctttttatatttatgaaaca

SEQ ID NO: 608083 - DNA, 20 bp, Artificial
  CRISPR gRNA sequence
aacatagatcatgtcaataa

SEQ ID NO: 608084 - DNA, 20 bp, Artificial
  CRISPR gRNA sequence
tcatttgtttaatattttcc

SEQ ID NO: 608085 - DNA, 20 bp, Artificial
  CRISPR gRNA sequence
tttgtttaatattttcctgg

SEQ ID NO: 608086 - DNA, 20 bp, Artificial
  CRISPR gRNA sequence
atttttgtatacttcttctg

SEQ ID NO: 608087 - DNA, 20 bp, Artificial
  CRISPR gRNA sequence
tacttcttctgtggtaaata

SEQ ID NO: 608088 - DNA, 20 bp, Artificial
  CRISPR gRNA sequence
cttcttctgtggtaaatatg

SEQ ID NO: 608089 - DNA, 20 bp, Artificial
  CRISPR gRNA sequence
ttctgtggtaaatatggagt

SEQ ID NO: 608090 - DNA, 20 bp, Artificial
  CRISPR gRNA sequence
atatggagttagtttatttc

SEQ ID NO: 608091 - DNA, 20 bp, Artificial
  CRISPR gRNA sequence
gtttatttctggttacttat

SEQ ID NO: 608092 - DNA, 20 bp, Artificial
  CRISPR gRNA sequence
tttatttctggttacttatt

SEQ ID NO: 608093 - DNA, 20 bp, Artificial
  CRISPR gRNA sequence
tggttacttattgggaaact

SEQ ID NO: 608094 - DNA, 20 bp, Artificial
  CRISPR gRNA sequence
cactgaactccatcactaac

SEQ ID NO: 608095 - DNA, 20 bp, Artificial
  CRISPR gRNA sequence
tgaactccatcactaaccag

SEQ ID NO: 608096 - DNA, 20 bp, Artificial
  CRISPR gRNA sequence
actccatcactaaccagcag

SEQ ID NO: 608097 - DNA, 20 bp, Artificial
  CRISPR gRNA sequence
cactaaccagcagtagaacc

SEQ ID NO: 608098 - DNA, 20 bp, Artificial
  CRISPR gRNA sequence
actaaccagcagtagaacct

SEQ ID NO: 608099 - DNA, 20 bp, Artificial
  CRISPR gRNA sequence
gaacctaggaatcttacttc

SEQ ID NO: 608100 - DNA, 20 bp, Artificial
  CRISPR gRNA sequence
taggaatcttacttctagtt

SEQ ID NO: 608101 - DNA, 20 bp, Artificial
  CRISPR gRNA sequence
cttacttctagttcagtgat

SEQ ID NO: 608102 - DNA, 20 bp, Artificial
  CRISPR gRNA sequence
gtgattggtttattgtatct

SEQ ID NO: 608103 - DNA, 20 bp, Artificial
  CRISPR gRNA sequence
gtttattgtatctcagtttc

SEQ ID NO: 608104 - DNA, 20 bp, Artificial
  CRISPR gRNA sequence
tgtatctcagtttctagtac

SEQ ID NO: 608105 - DNA, 20 bp, Artificial
  CRISPR gRNA sequence
tagtaccagattaactatat

SEQ ID NO: 608106 - DNA, 20 bp, Artificial
  CRISPR gRNA sequence
ttttatttgtgatgtttttc

SEQ ID NO: 608107 - DNA, 20 bp, Artificial
  CRISPR gRNA sequence
tttatttgtgatgtttttca

SEQ ID NO: 608108 - DNA, 20 bp, Artificial
  CRISPR gRNA sequence
tatttgtgatgtttttcaag

SEQ ID NO: 608109 - DNA, 20 bp, Artificial
  CRISPR gRNA sequence
ttgtgatgtttttcaaggag

SEQ ID NO: 608110 - DNA, 20 bp, Artificial
  CRISPR gRNA sequence
gtttttcaaggagtggaaaa

SEQ ID NO: 608111 - DNA, 20 bp, Artificial
  CRISPR gRNA sequence
tccacttcccccaaatcaca

SEQ ID NO: 608112 - DNA, 20 bp, Artificial
  CRISPR gRNA sequence
cccccaaatcacaaagaata

SEQ ID NO: 608113 - DNA, 20 bp, Artificial
  CRISPR gRNA sequence
atatggacttatgacgtatt

SEQ ID NO: 608114 - DNA, 20 bp, Artificial
  CRISPR gRNA sequence
tggacttatgacgtattaag

SEQ ID NO: 608115 - DNA, 20 bp, Artificial
  CRISPR gRNA sequence
tgacgtattaagtagacctt

SEQ ID NO: 608116 - DNA, 20 bp, Artificial
  CRISPR gRNA sequence
gacgtattaagtagacctta

SEQ ID NO: 608117 - DNA, 20 bp, Artificial
  CRISPR gRNA sequence
aagtagaccttaaggttttt

SEQ ID NO: 608118 - DNA, 20 bp, Artificial
  CRISPR gRNA sequence
ccttctgctttcttgcatcc

SEQ ID NO: 608119 - DNA, 20 bp, Artificial
  CRISPR gRNA sequence
agacaatactgtacttatac

SEQ ID NO: 608120 - DNA, 20 bp, Artificial
  CRISPR gRNA sequence
atactgtacttatactggat

SEQ ID NO: 608121 - DNA, 20 bp, Artificial
  CRISPR gRNA sequence
gcattattaaatgaatgaaa

SEQ ID NO: 608122 - DNA, 20 bp, Artificial
  CRISPR gRNA sequence
cattattaaatgaatgaaaa

SEQ ID NO: 608123 - DNA, 20 bp, Artificial
  CRISPR gRNA sequence
attattaaatgaatgaaaaa

SEQ ID NO: 608124 - DNA, 20 bp, Artificial
  CRISPR gRNA sequence
acattgattgaccatcattt

SEQ ID NO: 608125 - DNA, 20 bp, Artificial
  CRISPR gRNA sequence
attgattgaccatcatttga

SEQ ID NO: 608126 - DNA, 20 bp, Artificial
  CRISPR gRNA sequence
accatcatttgagagtattg

SEQ ID NO: 608127 - DNA, 20 bp, Artificial
  CRISPR gRNA sequence
atcatttgagagtattgaag

SEQ ID NO: 608128 - DNA, 20 bp, Artificial
  CRISPR gRNA sequence
tgagagtattgaagaagctt

SEQ ID NO: 608129 - DNA, 20 bp, Artificial
  CRISPR gRNA sequence
gagtattgaagaagcttaag

SEQ ID NO: 608130 - DNA, 20 bp, Artificial
  CRISPR gRNA sequence
gcagaataaaatttataaaa

SEQ ID NO: 608131 - DNA, 20 bp, Artificial
  CRISPR gRNA sequence
tttataaaacagcataaatt

SEQ ID NO: 608132 - DNA, 20 bp, Artificial
  CRISPR gRNA sequence
aaattcagtctctaactgaa

SEQ ID NO: 608133 - DNA, 20 bp, Artificial
  CRISPR gRNA sequence
aattcagtctctaactgaat

SEQ ID NO: 608134 - DNA, 20 bp, Artificial
  CRISPR gRNA sequence
gtctctaactgaatgggttc

SEQ ID NO: 608135 - DNA, 20 bp, Artificial
  CRISPR gRNA sequence
ctgaatgggttccagtgcct

SEQ ID NO: 608136 - DNA, 20 bp, Artificial
  CRISPR gRNA sequence
tgaatttttatttcttcttc

SEQ ID NO: 608137 - DNA, 20 bp, Artificial
  CRISPR gRNA sequence
gaatttttatttcttcttct

SEQ ID NO: 608138 - DNA, 20 bp, Artificial
  CRISPR gRNA sequence
ggccatacttaatttttatt

SEQ ID NO: 608139 - DNA, 20 bp, Artificial
  CRISPR gRNA sequence
tattgagttgctgtgtttaa

SEQ ID NO: 608140 - DNA, 20 bp, Artificial
  CRISPR gRNA sequence
ttgctgtgtttaacagtttt

SEQ ID NO: 608141 - DNA, 20 bp, Artificial
  CRISPR gRNA sequence
tgtttaacagttttcagcaa

SEQ ID NO: 608142 - DNA, 20 bp, Artificial
  CRISPR gRNA sequence
aaagcttaaaataaaaacac

SEQ ID NO: 608143 - DNA, 20 bp, Artificial
  CRISPR gRNA sequence
aaaaacactagaaaaatata

SEQ ID NO: 608144 - DNA, 20 bp, Artificial
  CRISPR gRNA sequence
gtttaatgtacctaatatgc

SEQ ID NO: 608145 - DNA, 20 bp, Artificial
  CRISPR gRNA sequence
tttaatgtacctaatatgca

SEQ ID NO: 608146 - DNA, 20 bp, Artificial
  CRISPR gRNA sequence
cctaatatgcaaggcttgat

SEQ ID NO: 608147 - DNA, 20 bp, Artificial
  CRISPR gRNA sequence
ctaatatgcaaggcttgata

SEQ ID NO: 608148 - DNA, 20 bp, Artificial
  CRISPR gRNA sequence
ttgataaggtgccctataaa

SEQ ID NO: 608149 - DNA, 20 bp, Artificial
  CRISPR gRNA sequence
tgataaggtgccctataaat

SEQ ID NO: 608150 - DNA, 20 bp, Artificial
  CRISPR gRNA sequence
gataaggtgccctataaatg

SEQ ID NO: 608151 - DNA, 20 bp, Artificial
  CRISPR gRNA sequence
aatggggaaacaaataaata

SEQ ID NO: 608152 - DNA, 20 bp, Artificial
  CRISPR gRNA sequence
aatatggtcctttctcttaa

SEQ ID NO: 608153 - DNA, 20 bp, Artificial
  CRISPR gRNA sequence
tcttaacagacttaactttc

SEQ ID NO: 608154 - DNA, 20 bp, Artificial
  CRISPR gRNA sequence
ttaacagacttaactttcaa

SEQ ID NO: 608155 - DNA, 20 bp, Artificial
  CRISPR gRNA sequence
caagagtgctgaaattcact

SEQ ID NO: 608156 - DNA, 20 bp, Artificial
  CRISPR gRNA sequence
aagagtgctgaaattcacta

SEQ ID NO: 608157 - DNA, 20 bp, Artificial
  CRISPR gRNA sequence
aaattcactaaggcttataa

SEQ ID NO: 608158 - DNA, 20 bp, Artificial
  CRISPR gRNA sequence
cttataaaagtttgtaacta

SEQ ID NO: 608159 - DNA, 20 bp, Artificial
  CRISPR gRNA sequence
taaaagtttgtaactaaagt

SEQ ID NO: 608160 - DNA, 20 bp, Artificial
  CRISPR gRNA sequence
ttgtaactaaagtcagtatg

SEQ ID NO: 608161 - DNA, 20 bp, Artificial
  CRISPR gRNA sequence
aactaaagtcagtatgtaga

SEQ ID NO: 608162 - DNA, 20 bp, Artificial
  CRISPR gRNA sequence
actaaagtcagtatgtagaa

SEQ ID NO: 608163 - DNA, 20 bp, Artificial
  CRISPR gRNA sequence
tgccttgtctatctttgaat

SEQ ID NO: 608164 - DNA, 20 bp, Artificial
  CRISPR gRNA sequence
ctatctttgaatgagctgct

SEQ ID NO: 608165 - DNA, 20 bp, Artificial
  CRISPR gRNA sequence
ttggtgacattattccacta

SEQ ID NO: 608166 - DNA, 20 bp, Artificial
  CRISPR gRNA sequence
tggtgacattattccactac

SEQ ID NO: 608167 - DNA, 20 bp, Artificial
  CRISPR gRNA sequence
ggtgacattattccactaca

SEQ ID NO: 608168 - DNA, 20 bp, Artificial
  CRISPR gRNA sequence
cattattccactacagggat

SEQ ID NO: 608169 - DNA, 20 bp, Artificial
  CRISPR gRNA sequence
acagggataagttcaatacc

SEQ ID NO: 608170 - DNA, 20 bp, Artificial
  CRISPR gRNA sequence
ggataagttcaatacccagt

SEQ ID NO: 608171 - DNA, 20 bp, Artificial
  CRISPR gRNA sequence
gataatgataataaaatctg

SEQ ID NO: 608172 - DNA, 20 bp, Artificial
  CRISPR gRNA sequence
ataataaaatctgcagattg

SEQ ID NO: 608173 - DNA, 20 bp, Artificial
  CRISPR gRNA sequence
tgtataacactgtgtatttt

SEQ ID NO: 608174 - DNA, 20 bp, Artificial
  CRISPR gRNA sequence
taacactgtgtattttcagc

SEQ ID NO: 608175 - DNA, 20 bp, Artificial
  CRISPR gRNA sequence
gttttactcaatatatttgc

SEQ ID NO: 608176 - DNA, 20 bp, Artificial
  CRISPR gRNA sequence
atatttgctggcgacaaaat

SEQ ID NO: 608177 - DNA, 20 bp, Artificial
  CRISPR gRNA sequence
ggcgacaaaatgagttttta

SEQ ID NO: 608178 - DNA, 20 bp, Artificial
  CRISPR gRNA sequence
caaaatgagtttttaaagaa

SEQ ID NO: 608179 - DNA, 20 bp, Artificial
  CRISPR gRNA sequence
gagtttttaaagaaaagaat

SEQ ID NO: 608180 - DNA, 20 bp, Artificial
  CRISPR gRNA sequence
aaagaaaagaattagctgac

SEQ ID NO: 608181 - DNA, 20 bp, Artificial
  CRISPR gRNA sequence
attagctgactagtaacatt

SEQ ID NO: 608182 - DNA, 20 bp, Artificial
  CRISPR gRNA sequence
ttagctgactagtaacattt

SEQ ID NO: 608183 - DNA, 20 bp, Artificial
  CRISPR gRNA sequence
tagctgactagtaacattta

SEQ ID NO: 608184 - DNA, 20 bp, Artificial
  CRISPR gRNA sequence
gctgactagtaacatttagg

SEQ ID NO: 608185 - DNA, 20 bp, Artificial
  CRISPR gRNA sequence
gtaacatttagggagatcat

SEQ ID NO: 608186 - DNA, 20 bp, Artificial
  CRISPR gRNA sequence
agggagatcatcagtcgaaa

SEQ ID NO: 608187 - DNA, 20 bp, Artificial
  CRISPR gRNA sequence
aacagaaaaaaaaaaaaaca

SEQ ID NO: 608188 - DNA, 20 bp, Artificial
  CRISPR gRNA sequence
acagaaaaaaaaaaaaacaa

SEQ ID NO: 608189 - DNA, 20 bp, Artificial
  CRISPR gRNA sequence
aaaaaaaaaaaaacaaagga

SEQ ID NO: 608190 - DNA, 20 bp, Artificial
  CRISPR gRNA sequence
aaaaaaaaaaaacaaaggaa

SEQ ID NO: 608191 - DNA, 20 bp, Artificial
  CRISPR gRNA sequence
taatcttttttttgaccaat

SEQ ID NO: 608192 - DNA, 20 bp, Artificial
  CRISPR gRNA sequence
tttttttgaccaattagtga

SEQ ID NO: 608193 - DNA, 20 bp, Artificial
  CRISPR gRNA sequence
aattagtgacagaaatttcc

SEQ ID NO: 608194 - DNA, 20 bp, Artificial
  CRISPR gRNA sequence
cctttcttatatttcatcgt

SEQ ID NO: 608195 - DNA, 20 bp, Artificial
  CRISPR gRNA sequence
tcatcgttagctgatttgat

SEQ ID NO: 608196 - DNA, 20 bp, Artificial
  CRISPR gRNA sequence
catcgttagctgatttgatt

SEQ ID NO: 608197 - DNA, 20 bp, Artificial
  CRISPR gRNA sequence
cgttagctgatttgattggg

SEQ ID NO: 608198 - DNA, 20 bp, Artificial
  CRISPR gRNA sequence
ttagctgatttgattgggaa

SEQ ID NO: 608199 - DNA, 20 bp, Artificial
  CRISPR gRNA sequence
tgatttgattgggaagagaa

SEQ ID NO: 608200 - DNA, 20 bp, Artificial
  CRISPR gRNA sequence
atttgattgggaagagaaaa

SEQ ID NO: 608201 - DNA, 20 bp, Artificial
  CRISPR gRNA sequence
taattttacccctgtcatgc

SEQ ID NO: 608202 - DNA, 20 bp, Artificial
  CRISPR gRNA sequence
aattttacccctgtcatgct

SEQ ID NO: 608203 - DNA, 20 bp, Artificial
  CRISPR gRNA sequence
ttacccctgtcatgctgggc

SEQ ID NO: 608204 - DNA, 20 bp, Artificial
  CRISPR gRNA sequence
gagaattcactgtttcaaaa

SEQ ID NO: 608205 - DNA, 20 bp, Artificial
  CRISPR gRNA sequence
tgtttcaaaacagaactgac

SEQ ID NO: 608206 - DNA, 20 bp, Artificial
  CRISPR gRNA sequence
actgacaagtgaatttcatt

SEQ ID NO: 608207 - DNA, 20 bp, Artificial
  CRISPR gRNA sequence
tttcattaagactgataata

SEQ ID NO: 608208 - DNA, 20 bp, Artificial
  CRISPR gRNA sequence
agactgataatatggcaaca

SEQ ID NO: 608209 - DNA, 20 bp, Artificial
  CRISPR gRNA sequence
ataatatggcaacatagtga

SEQ ID NO: 608210 - DNA, 20 bp, Artificial
  CRISPR gRNA sequence
tgaaagcttgcaactattat

SEQ ID NO: 608211 - DNA, 20 bp, Artificial
  CRISPR gRNA sequence
ttgcaactattatcagcatg

SEQ ID NO: 608212 - DNA, 20 bp, Artificial
  CRISPR gRNA sequence
agcatgaagaaattttaacc

SEQ ID NO: 608213 - DNA, 20 bp, Artificial
  CRISPR gRNA sequence
caatgttctattacttgtca

SEQ ID NO: 608214 - DNA, 20 bp, Artificial
  CRISPR gRNA sequence
agcgatcttgtatctaatga

SEQ ID NO: 608215 - DNA, 20 bp, Artificial
  CRISPR gRNA sequence
tctaatgatggtgaatataa

SEQ ID NO: 608216 - DNA, 20 bp, Artificial
  CRISPR gRNA sequence
ctaatgatggtgaatataat

SEQ ID NO: 608217 - DNA, 20 bp, Artificial
  CRISPR gRNA sequence
atggtgaatataatgggttg

SEQ ID NO: 608218 - DNA, 20 bp, Artificial
  CRISPR gRNA sequence
ggtgaatataatgggttgaa

SEQ ID NO: 608219 - DNA, 20 bp, Artificial
  CRISPR gRNA sequence
gtgaatataatgggttgaag

SEQ ID NO: 608220 - DNA, 20 bp, Artificial
  CRISPR gRNA sequence
gggttgaagaggtttcattt

SEQ ID NO: 608221 - DNA, 20 bp, Artificial
  CRISPR gRNA sequence
ggttgaagaggtttcatttt

SEQ ID NO: 608222 - DNA, 20 bp, Artificial
  CRISPR gRNA sequence
gtgtttcattttaatatttt

SEQ ID NO: 608223 - DNA, 20 bp, Artificial
  CRISPR gRNA sequence
tgtttcattttaatattttt

SEQ ID NO: 608224 - DNA, 20 bp, Artificial
  CRISPR gRNA sequence
tttaggttttgcttgcattg

SEQ ID NO: 608225 - DNA, 20 bp, Artificial
  CRISPR gRNA sequence
ttaggttttgcttgcattgt

SEQ ID NO: 608226 - DNA, 20 bp, Artificial
  CRISPR gRNA sequence
taggttttgcttgcattgta

SEQ ID NO: 608227 - DNA, 20 bp, Artificial
  CRISPR gRNA sequence
tttgcttgcattgtagggct

SEQ ID NO: 608228 - DNA, 20 bp, Artificial
  CRISPR gRNA sequence
gcattgtagggctaagttca

SEQ ID NO: 608229 - DNA, 20 bp, Artificial
  CRISPR gRNA sequence
ggctaagttcatagtgaaaa

SEQ ID NO: 608230 - DNA, 20 bp, Artificial
  CRISPR gRNA sequence
aattttgtttatatttgtcg

SEQ ID NO: 608231 - DNA, 20 bp, Artificial
  CRISPR gRNA sequence
gtttatatttgtcgtggaaa

SEQ ID NO: 608232 - DNA, 20 bp, Artificial
  CRISPR gRNA sequence
tttatatttgtcgtggaaac

SEQ ID NO: 608233 - DNA, 20 bp, Artificial
  CRISPR gRNA sequence
tatttgtcgtggaaacaggc

SEQ ID NO: 608234 - DNA, 20 bp, Artificial
  CRISPR gRNA sequence
atttgtcgtggaaacaggct

SEQ ID NO: 608235 - DNA, 20 bp, Artificial
  CRISPR gRNA sequence
tgtcgtggaaacaggctagg

SEQ ID NO: 608236 - DNA, 20 bp, Artificial
  CRISPR gRNA sequence
ggaaacaggctaggaagtat

SEQ ID NO: 608237 - DNA, 20 bp, Artificial
  CRISPR gRNA sequence
acaggctaggaagtattagt

SEQ ID NO: 608238 - DNA, 20 bp, Artificial
  CRISPR gRNA sequence
atactgacatgtatcttcaa

SEQ ID NO: 608239 - DNA, 20 bp, Artificial
  CRISPR gRNA sequence
aaatattctgctttctgata

SEQ ID NO: 608240 - DNA, 20 bp, Artificial
  CRISPR gRNA sequence
aatattctgctttctgataa

SEQ ID NO: 608241 - DNA, 20 bp, Artificial
  CRISPR gRNA sequence
atattctgctttctgataaa

SEQ ID NO: 608242 - DNA, 20 bp, Artificial
  CRISPR gRNA sequence
ctttctgataaagggatata

SEQ ID NO: 608243 - DNA, 20 bp, Artificial
  CRISPR gRNA sequence
tctgataaagggatatatgg

SEQ ID NO: 608244 - DNA, 20 bp, Artificial
  CRISPR gRNA sequence
ctgataaagggatatatggt

SEQ ID NO: 608245 - DNA, 20 bp, Artificial
  CRISPR gRNA sequence
tgataaagggatatatggta

SEQ ID NO: 608246 - DNA, 20 bp, Artificial
  CRISPR gRNA sequence
gggatatatggtagggctac

SEQ ID NO: 608247 - DNA, 20 bp, Artificial
  CRISPR gRNA sequence
atggtagggctacaagtcct

SEQ ID NO: 608248 - DNA, 20 bp, Artificial
  CRISPR gRNA sequence
agggctacaagtccttagtt

SEQ ID NO: 608249 - DNA, 20 bp, Artificial
  CRISPR gRNA sequence
gggctacaagtccttagttc

SEQ ID NO: 608250 - DNA, 20 bp, Artificial
  CRISPR gRNA sequence
agtccttagttcaggaattt

SEQ ID NO: 608251 - DNA, 20 bp, Artificial
  CRISPR gRNA sequence
gaatttaagtgaattgctgt

SEQ ID NO: 608252 - DNA, 20 bp, Artificial
  CRISPR gRNA sequence
tttatacttctccttccaca

SEQ ID NO: 608253 - DNA, 20 bp, Artificial
  CRISPR gRNA sequence
tacttctccttccacacaga

SEQ ID NO: 608254 - DNA, 20 bp, Artificial
  CRISPR gRNA sequence
tccacacagacagacacttg

SEQ ID NO: 608255 - DNA, 20 bp, Artificial
  CRISPR gRNA sequence
acacagacagacacttgtag

SEQ ID NO: 608256 - DNA, 20 bp, Artificial
  CRISPR gRNA sequence
cacagacagacacttgtagt

SEQ ID NO: 608257 - DNA, 20 bp, Artificial
  CRISPR gRNA sequence
ttgtctccacctaatataaa

SEQ ID NO: 608258 - DNA, 20 bp, Artificial
  CRISPR gRNA sequence
cctaatataaacagaatatg

SEQ ID NO: 608259 - DNA, 20 bp, Artificial
  CRISPR gRNA sequence
atataaacagaatatgaagt

SEQ ID NO: 608260 - DNA, 20 bp, Artificial
  CRISPR gRNA sequence
tataaacagaatatgaagtt

SEQ ID NO: 608261 - DNA, 20 bp, Artificial
  CRISPR gRNA sequence
agaatatgaagttaggacta

SEQ ID NO: 608262 - DNA, 20 bp, Artificial
  CRISPR gRNA sequence
cttgattgttactgtatctt

SEQ ID NO: 608263 - DNA, 20 bp, Artificial
  CRISPR gRNA sequence
gttactgtatctttagtgct

SEQ ID NO: 608264 - DNA, 20 bp, Artificial
  CRISPR gRNA sequence
actgtatctttagtgcttag

SEQ ID NO: 608265 - DNA, 20 bp, Artificial
  CRISPR gRNA sequence
ttagtgcttagcagtgtgtc

SEQ ID NO: 608266 - DNA, 20 bp, Artificial
  CRISPR gRNA sequence
tagcagtgtgtccggtacaa

SEQ ID NO: 608267 - DNA, 20 bp, Artificial
  CRISPR gRNA sequence
ttaccccataaatatttgtt

SEQ ID NO: 608268 - DNA, 20 bp, Artificial
  CRISPR gRNA sequence
ccataaatatttgttgagtg

SEQ ID NO: 608269 - DNA, 20 bp, Artificial
  CRISPR gRNA sequence
cataaatatttgttgagtga

SEQ ID NO: 608270 - DNA, 20 bp, Artificial
  CRISPR gRNA sequence
acattttatcaccttgaaac

SEQ ID NO: 608271 - DNA, 20 bp, Artificial
  CRISPR gRNA sequence
cattttatcaccttgaaacc

SEQ ID NO: 608272 - DNA, 20 bp, Artificial
  CRISPR gRNA sequence
caccttgaaaccgggcgtaa

SEQ ID NO: 608273 - DNA, 20 bp, Artificial
  CRISPR gRNA sequence
tgaaaccgggcgtaaaagcc

SEQ ID NO: 608274 - DNA, 20 bp, Artificial
  CRISPR gRNA sequence
cattcaattccttttctctg

SEQ ID NO: 608275 - DNA, 20 bp, Artificial
  CRISPR gRNA sequence
tcacttgtttgcctattact

SEQ ID NO: 608276 - DNA, 20 bp, Artificial
  CRISPR gRNA sequence
ttgcctattacttagtaaat

SEQ ID NO: 608277 - DNA, 20 bp, Artificial
  CRISPR gRNA sequence
tatttttattccgtaatatt

SEQ ID NO: 608278 - DNA, 20 bp, Artificial
  CRISPR gRNA sequence
attccgtaatattcagatat

SEQ ID NO: 608279 - DNA, 20 bp, Artificial
  CRISPR gRNA sequence
ctaataaatatttgtttgta

SEQ ID NO: 608280 - DNA, 20 bp, Artificial
  CRISPR gRNA sequence
atatttgtttgtatagtatc

SEQ ID NO: 608281 - DNA, 20 bp, Artificial
  CRISPR gRNA sequence
agtatctagtaaaatataaa

SEQ ID NO: 608282 - DNA, 20 bp, Artificial
  CRISPR gRNA sequence
aatataaatggccccattaa

SEQ ID NO: 608283 - DNA, 20 bp, Artificial
  CRISPR gRNA sequence
aatggccccattaatggaaa

SEQ ID NO: 608284 - DNA, 20 bp, Artificial
  CRISPR gRNA sequence
actttgaattcccatatttg

SEQ ID NO: 608285 - DNA, 20 bp, Artificial
  CRISPR gRNA sequence
agaaacattttcccccaact

SEQ ID NO: 608286 - DNA, 20 bp, Artificial
  CRISPR gRNA sequence
ccccaacttggtttctttta

SEQ ID NO: 608287 - DNA, 20 bp, Artificial
  CRISPR gRNA sequence
aacttggtttcttttatagc

SEQ ID NO: 608288 - DNA, 20 bp, Artificial
  CRISPR gRNA sequence
tagccagtgatatacataat

SEQ ID NO: 608289 - DNA, 20 bp, Artificial
  CRISPR gRNA sequence
agccagtgatatacataatg

SEQ ID NO: 608290 - DNA, 20 bp, Artificial
  CRISPR gRNA sequence
gccagtgatatacataatga

SEQ ID NO: 608291 - DNA, 20 bp, Artificial
  CRISPR gRNA sequence
atatacataatgagggtatt

SEQ ID NO: 608292 - DNA, 20 bp, Artificial
  CRISPR gRNA sequence
acataatgagggtatttggc

SEQ ID NO: 608293 - DNA, 20 bp, Artificial
  CRISPR gRNA sequence
atgagggtatttggctggtt

SEQ ID NO: 608294 - DNA, 20 bp, Artificial
  CRISPR gRNA sequence
atttggctggttcagacaca

SEQ ID NO: 608295 - DNA, 20 bp, Artificial
  CRISPR gRNA sequence
tattattcaacattgtgatg

SEQ ID NO: 608296 - DNA, 20 bp, Artificial
  CRISPR gRNA sequence
tgtgatgtggtcctgatcct

SEQ ID NO: 608297 - DNA, 20 bp, Artificial
  CRISPR gRNA sequence
aaaatgaaactaatacttat

SEQ ID NO: 608298 - DNA, 20 bp, Artificial
  CRISPR gRNA sequence
tgaaactaatacttattgga

SEQ ID NO: 608299 - DNA, 20 bp, Artificial
  CRISPR gRNA sequence
acttattggaaagatttgtt

SEQ ID NO: 608300 - DNA, 20 bp, Artificial
  CRISPR gRNA sequence
agatttgtttggtaattaaa

SEQ ID NO: 608301 - DNA, 20 bp, Artificial
  CRISPR gRNA sequence
taattaaatggctaatgttg

SEQ ID NO: 608302 - DNA, 20 bp, Artificial
  CRISPR gRNA sequence
aattaaatggctaatgttga

SEQ ID NO: 608303 - DNA, 20 bp, Artificial
  CRISPR gRNA sequence
ccaactaaatgcaccttcac

SEQ ID NO: 608304 - DNA, 20 bp, Artificial
  CRISPR gRNA sequence
aatgcaccttcactagatgt

SEQ ID NO: 608305 - DNA, 20 bp, Artificial
  CRISPR gRNA sequence
tgctaccaatttcacaaaac

SEQ ID NO: 608306 - DNA, 20 bp, Artificial
  CRISPR gRNA sequence
aatttcacaaaactagccca

SEQ ID NO: 608307 - DNA, 20 bp, Artificial
  CRISPR gRNA sequence
cacagaataataaattcctg

SEQ ID NO: 608308 - DNA, 20 bp, Artificial
  CRISPR gRNA sequence
ataaattcctgtggccctat

SEQ ID NO: 608309 - DNA, 20 bp, Artificial
  CRISPR gRNA sequence
tcctgtggccctattggccc

SEQ ID NO: 608310 - DNA, 20 bp, Artificial
  CRISPR gRNA sequence
ggccctggattttaaccttt

SEQ ID NO: 608311 - DNA, 20 bp, Artificial
  CRISPR gRNA sequence
gccctggattttaaccttta

SEQ ID NO: 608312 - DNA, 20 bp, Artificial
  CRISPR gRNA sequence
ccctggattttaacctttaa

SEQ ID NO: 608313 - DNA, 20 bp, Artificial
  CRISPR gRNA sequence
ggccttaaacctttcttttc

SEQ ID NO: 608314 - DNA, 20 bp, Artificial
  CRISPR gRNA sequence
cttaaacctttcttttccag

SEQ ID NO: 608315 - DNA, 20 bp, Artificial
  CRISPR gRNA sequence
ttttccagcagtattatttt

SEQ ID NO: 608316 - DNA, 20 bp, Artificial
  CRISPR gRNA sequence
ttccagcagtattattttga

SEQ ID NO: 608317 - DNA, 20 bp, Artificial
  CRISPR gRNA sequence
cagtattattttgagagacc

SEQ ID NO: 608318 - DNA, 20 bp, Artificial
  CRISPR gRNA sequence
actctcctgtcttttccttt

SEQ ID NO: 608319 - DNA, 20 bp, Artificial
  CRISPR gRNA sequence
caaacactgtattttgcact

SEQ ID NO: 608320 - DNA, 20 bp, Artificial
  CRISPR gRNA sequence
actgagaccgtgctcccatg

SEQ ID NO: 608321 - DNA, 20 bp, Artificial
  CRISPR gRNA sequence
gttctgtactgtccttgtct

SEQ ID NO: 608322 - DNA, 20 bp, Artificial
  CRISPR gRNA sequence
ctgagaactgcttaccttgt

SEQ ID NO: 608323 - DNA, 20 bp, Artificial
  CRISPR gRNA sequence
tgagaactgcttaccttgtt

SEQ ID NO: 608324 - DNA, 20 bp, Artificial
  CRISPR gRNA sequence
ggtttgtctgtatccccaac

SEQ ID NO: 608325 - DNA, 20 bp, Artificial
  CRISPR gRNA sequence
tgtatccccaaccagactat

SEQ ID NO: 608326 - DNA, 20 bp, Artificial
  CRISPR gRNA sequence
gactataagcctgtcttgtc

SEQ ID NO: 608327 - DNA, 20 bp, Artificial
  CRISPR gRNA sequence
gcctgtcttgtctagtccta

SEQ ID NO: 608328 - DNA, 20 bp, Artificial
  CRISPR gRNA sequence
cctatagatccaatacttaa

SEQ ID NO: 608329 - DNA, 20 bp, Artificial
  CRISPR gRNA sequence
atccaatacttaacagtgtc

SEQ ID NO: 608330 - DNA, 20 bp, Artificial
  CRISPR gRNA sequence
gtatactgtactctataaat

SEQ ID NO: 608331 - DNA, 20 bp, Artificial
  CRISPR gRNA sequence
tatttgtttttctgttatta

SEQ ID NO: 608332 - DNA, 20 bp, Artificial
  CRISPR gRNA sequence
atttgtttttctgttattat

SEQ ID NO: 608333 - DNA, 20 bp, Artificial
  CRISPR gRNA sequence
gtttttctgttattatggga

SEQ ID NO: 608334 - DNA, 20 bp, Artificial
  CRISPR gRNA sequence
ttattatgggaaagtgatga

SEQ ID NO: 608335 - DNA, 20 bp, Artificial
  CRISPR gRNA sequence
tatgggaaagtgatgatggc

SEQ ID NO: 608336 - DNA, 20 bp, Artificial
  CRISPR gRNA sequence
tgggaaagtgatgatggcaa

SEQ ID NO: 608337 - DNA, 20 bp, Artificial
  CRISPR gRNA sequence
gggaaagtgatgatggcaag

SEQ ID NO: 608338 - DNA, 20 bp, Artificial
  CRISPR gRNA sequence
ggaaagtgatgatggcaaga

SEQ ID NO: 608339 - DNA, 20 bp, Artificial
  CRISPR gRNA sequence
caagagggaatcctgaaaat

SEQ ID NO: 608340 - DNA, 20 bp, Artificial
  CRISPR gRNA sequence
atcagtgaattccctgatcc

SEQ ID NO: 608341 - DNA, 20 bp, Artificial
  CRISPR gRNA sequence
cctgatcctggaatacaatc

SEQ ID NO: 608342 - DNA, 20 bp, Artificial
  CRISPR gRNA sequence
atacaatccagtgacttccc

SEQ ID NO: 608343 - DNA, 20 bp, Artificial
  CRISPR gRNA sequence
agtccacactctttatatat

SEQ ID NO: 608344 - DNA, 20 bp, Artificial
  CRISPR gRNA sequence
actctttatatattagatgt

SEQ ID NO: 608345 - DNA, 20 bp, Artificial
  CRISPR gRNA sequence
ctttatatattagatgtaag

SEQ ID NO: 608346 - DNA, 20 bp, Artificial
  CRISPR gRNA sequence
atattagatgtaagtagtaa

SEQ ID NO: 608347 - DNA, 20 bp, Artificial
  CRISPR gRNA sequence
tattagatgtaagtagtaac

SEQ ID NO: 608348 - DNA, 20 bp, Artificial
  CRISPR gRNA sequence
ttagatgtaagtagtaacag

SEQ ID NO: 608349 - DNA, 20 bp, Artificial
  CRISPR gRNA sequence
aacaggagttttaatatgta

SEQ ID NO: 608350 - DNA, 20 bp, Artificial
  CRISPR gRNA sequence
acaggagttttaatatgtaa

SEQ ID NO: 608351 - DNA, 20 bp, Artificial
  CRISPR gRNA sequence
ggagttttaatatgtaaagg

SEQ ID NO: 608352 - DNA, 20 bp, Artificial
  CRISPR gRNA sequence
gttttaatatgtaaaggaag

SEQ ID NO: 608353 - DNA, 20 bp, Artificial
  CRISPR gRNA sequence
aatatgtaaaggaagaagct

SEQ ID NO: 608354 - DNA, 20 bp, Artificial
  CRISPR gRNA sequence
gctaagttttctatctgtaa

SEQ ID NO: 608355 - DNA, 20 bp, Artificial
  CRISPR gRNA sequence
tatctgtaaaagctattctt

SEQ ID NO: 608356 - DNA, 20 bp, Artificial
  CRISPR gRNA sequence
atctgtaaaagctattcttc

SEQ ID NO: 608357 - DNA, 20 bp, Artificial
  CRISPR gRNA sequence
cttaatttaattttgctatg

SEQ ID NO: 608358 - DNA, 20 bp, Artificial
  CRISPR gRNA sequence
ttaattttgctatgtagtta

SEQ ID NO: 608359 - DNA, 20 bp, Artificial
  CRISPR gRNA sequence
tgctatgtagttaaagataa

SEQ ID NO: 608360 - DNA, 20 bp, Artificial
  CRISPR gRNA sequence
gttaaagataatggcattta

SEQ ID NO: 608361 - DNA, 20 bp, Artificial
  CRISPR gRNA sequence
ttaacttgatctcttaataa

SEQ ID NO: 608362 - DNA, 20 bp, Artificial
  CRISPR gRNA sequence
taacttgatctcttaataat

SEQ ID NO: 608363 - DNA, 20 bp, Artificial
  CRISPR gRNA sequence
ggcatctctttcccataact

SEQ ID NO: 608364 - DNA, 20 bp, Artificial
  CRISPR gRNA sequence
ctctttcccataactaagca

SEQ ID NO: 608365 - DNA, 20 bp, Artificial
  CRISPR gRNA sequence
catattatttgaaaaactat

SEQ ID NO: 608366 - DNA, 20 bp, Artificial
  CRISPR gRNA sequence
atattatttgaaaaactatc

SEQ ID NO: 608367 - DNA, 20 bp, Artificial
  CRISPR gRNA sequence
taaactgataattcttgtgt

SEQ ID NO: 608368 - DNA, 20 bp, Artificial
  CRISPR gRNA sequence
ctgataattcttgtgtcagc

SEQ ID NO: 608369 - DNA, 20 bp, Artificial
  CRISPR gRNA sequence
ataattcttgtgtcagctgg

SEQ ID NO: 608370 - DNA, 20 bp, Artificial
  CRISPR gRNA sequence
ttgtgtcagctggaagttta

SEQ ID NO: 608371 - DNA, 20 bp, Artificial
  CRISPR gRNA sequence
ctggaagtttaaagcttcct

SEQ ID NO: 608372 - DNA, 20 bp, Artificial
  CRISPR gRNA sequence
gtttaaagcttcctgagttt

SEQ ID NO: 608373 - DNA, 20 bp, Artificial
  CRISPR gRNA sequence
tttaaagcttcctgagttta

SEQ ID NO: 608374 - DNA, 20 bp, Artificial
  CRISPR gRNA sequence
aaagcttcctgagtttaagg

SEQ ID NO: 608375 - DNA, 20 bp, Artificial
  CRISPR gRNA sequence
cttcctgagtttaaggaagt

SEQ ID NO: 608376 - DNA, 20 bp, Artificial
  CRISPR gRNA sequence
aagttagttcaaatttctga

SEQ ID NO: 608377 - DNA, 20 bp, Artificial
  CRISPR gRNA sequence
agttagttcaaatttctgaa

SEQ ID NO: 608378 - DNA, 20 bp, Artificial
  CRISPR gRNA sequence
aaggaatttttttttcctct

SEQ ID NO: 608379 - DNA, 20 bp, Artificial
  CRISPR gRNA sequence
tttttttcctctgagtgtga

SEQ ID NO: 608380 - DNA, 20 bp, Artificial
  CRISPR gRNA sequence
tctgagtgtgaaagtcaaac

SEQ ID NO: 608381 - DNA, 20 bp, Artificial
  CRISPR gRNA sequence
ctcaaaatgcatgaaaataa

SEQ ID NO: 608382 - DNA, 20 bp, Artificial
  CRISPR gRNA sequence
caaaatgcatgaaaataatg

SEQ ID NO: 608383 - DNA, 20 bp, Artificial
  CRISPR gRNA sequence
atgaaaataatggagtgtgt

SEQ ID NO: 608384 - DNA, 20 bp, Artificial
  CRISPR gRNA sequence
tgaaaataatggagtgtgtt

SEQ ID NO: 608385 - DNA, 20 bp, Artificial
  CRISPR gRNA sequence
tggagtgtgttaggtgttta

SEQ ID NO: 608386 - DNA, 20 bp, Artificial
  CRISPR gRNA sequence
ttaaaaatatcgcacaatta

SEQ ID NO: 608387 - DNA, 20 bp, Artificial
  CRISPR gRNA sequence
taaaaatatcgcacaattaa

SEQ ID NO: 608388 - DNA, 20 bp, Artificial
  CRISPR gRNA sequence
aaatatcgcacaattaaagg

SEQ ID NO: 608389 - DNA, 20 bp, Artificial
  CRISPR gRNA sequence
aatatcgcacaattaaaggc

SEQ ID NO: 608390 - DNA, 20 bp, Artificial
  CRISPR gRNA sequence
aaggcaggctaccttgccac

SEQ ID NO: 608391 - DNA, 20 bp, Artificial
  CRISPR gRNA sequence
aggcaggctaccttgccact

SEQ ID NO: 608392 - DNA, 20 bp, Artificial
  CRISPR gRNA sequence
taccttgccactaggtaaat

SEQ ID NO: 608393 - DNA, 20 bp, Artificial
  CRISPR gRNA sequence
taggtaaattagtcatgcaa

SEQ ID NO: 608394 - DNA, 20 bp, Artificial
  CRISPR gRNA sequence
aggtaaattagtcatgcaat

SEQ ID NO: 608395 - DNA, 20 bp, Artificial
  CRISPR gRNA sequence
tgcaataggtttaatctact

SEQ ID NO: 608396 - DNA, 20 bp, Artificial
  CRISPR gRNA sequence
aggtttaatctacttagaaa

SEQ ID NO: 608397 - DNA, 20 bp, Artificial
  CRISPR gRNA sequence
ctacttagaaatagcactgt

SEQ ID NO: 608398 - DNA, 20 bp, Artificial
  CRISPR gRNA sequence
tacttagaaatagcactgtg

SEQ ID NO: 608399 - DNA, 20 bp, Artificial
  CRISPR gRNA sequence
ttagaaatagcactgtgagg

SEQ ID NO: 608400 - DNA, 20 bp, Artificial
  CRISPR gRNA sequence
ggaagaaaataaaattaatt

SEQ ID NO: 608401 - DNA, 20 bp, Artificial
  CRISPR gRNA sequence
aataaaattaattcagctga

SEQ ID NO: 608402 - DNA, 20 bp, Artificial
  CRISPR gRNA sequence
attaattcagctgatagtgt

SEQ ID NO: 608403 - DNA, 20 bp, Artificial
  CRISPR gRNA sequence
cagctgatagtgtcagatca

SEQ ID NO: 608404 - DNA, 20 bp, Artificial
  CRISPR gRNA sequence
tgatagtgtcagatcatgga

SEQ ID NO: 608405 - DNA, 20 bp, Artificial
  CRISPR gRNA sequence
gtgtcagatcatggaaagaa

SEQ ID NO: 608406 - DNA, 20 bp, Artificial
  CRISPR gRNA sequence
atggaaagaaaagaaaaaaa

SEQ ID NO: 608407 - DNA, 20 bp, Artificial
  CRISPR gRNA sequence
aacatattgctaactttgtt

SEQ ID NO: 608408 - DNA, 20 bp, Artificial
  CRISPR gRNA sequence
acatattgctaactttgttc

SEQ ID NO: 608409 - DNA, 20 bp, Artificial
  CRISPR gRNA sequence
tgctaactttgttcaggttg

SEQ ID NO: 608410 - DNA, 20 bp, Artificial
  CRISPR gRNA sequence
tgcagcttttgtgtttcatt

SEQ ID NO: 608411 - DNA, 20 bp, Artificial
  CRISPR gRNA sequence
gcagcttttgtgtttcattt

SEQ ID NO: 608412 - DNA, 20 bp, Artificial
  CRISPR gRNA sequence
tttgtgtttcatttaggttt

SEQ ID NO: 608413 - DNA, 20 bp, Artificial
  CRISPR gRNA sequence
atttaggtttcagcttgtcc

SEQ ID NO: 608414 - DNA, 20 bp, Artificial
  CRISPR gRNA sequence
tttaggtttcagcttgtccc

SEQ ID NO: 608415 - DNA, 20 bp, Artificial
  CRISPR gRNA sequence
taggtttcagcttgtcccag

SEQ ID NO: 608416 - DNA, 20 bp, Artificial
  CRISPR gRNA sequence
aggtttcagcttgtcccagg

SEQ ID NO: 608417 - DNA, 20 bp, Artificial
  CRISPR gRNA sequence
ggaggtgttgctatactgtg

SEQ ID NO: 608418 - DNA, 20 bp, Artificial
  CRISPR gRNA sequence
gaggtgttgctatactgtga

SEQ ID NO: 608419 - DNA, 20 bp, Artificial
  CRISPR gRNA sequence
ttgctatactgtgaaggtgt

SEQ ID NO: 608420 - DNA, 20 bp, Artificial
  CRISPR gRNA sequence
tgctatactgtgaaggtgtt

SEQ ID NO: 608421 - DNA, 20 bp, Artificial
  CRISPR gRNA sequence
tatactgtgaaggtgttagg

SEQ ID NO: 608422 - DNA, 20 bp, Artificial
  CRISPR gRNA sequence
tgtgaaggtgttaggcagtg

SEQ ID NO: 608423 - DNA, 20 bp, Artificial
  CRISPR gRNA sequence
ggtgttaggcagtgtagtaa

SEQ ID NO: 608424 - DNA, 20 bp, Artificial
  CRISPR gRNA sequence
taggcagtgtagtaatggaa

SEQ ID NO: 608425 - DNA, 20 bp, Artificial
  CRISPR gRNA sequence
aggcagtgtagtaatggaac

SEQ ID NO: 608426 - DNA, 20 bp, Artificial
  CRISPR gRNA sequence
gcagtgtagtaatggaacag

SEQ ID NO: 608427 - DNA, 20 bp, Artificial
  CRISPR gRNA sequence
taatggaacaggagataaaa

SEQ ID NO: 608428 - DNA, 20 bp, Artificial
  CRISPR gRNA sequence
tggaacaggagataaaatgg

SEQ ID NO: 608429 - DNA, 20 bp, Artificial
  CRISPR gRNA sequence
ggaacaggagataaaatgga

SEQ ID NO: 608430 - DNA, 20 bp, Artificial
  CRISPR gRNA sequence
acataaaatgtctcatcatt

SEQ ID NO: 608431 - DNA, 20 bp, Artificial
  CRISPR gRNA sequence
tctcatcatttggaccttcc

SEQ ID NO: 608432 - DNA, 20 bp, Artificial
  CRISPR gRNA sequence
tcatcatttggaccttcctg

SEQ ID NO: 608433 - DNA, 20 bp, Artificial
  CRISPR gRNA sequence
tggaccttcctggagaaaca

SEQ ID NO: 608434 - DNA, 20 bp, Artificial
  CRISPR gRNA sequence
gaaacatagcttgaatttct

SEQ ID NO: 608435 - DNA, 20 bp, Artificial
  CRISPR gRNA sequence
acatagcttgaatttctgag

SEQ ID NO: 608436 - DNA, 20 bp, Artificial
  CRISPR gRNA sequence
agcttgaatttctgagtggt

SEQ ID NO: 608437 - DNA, 20 bp, Artificial
  CRISPR gRNA sequence
gtggtcagcttgacatttta

SEQ ID NO: 608438 - DNA, 20 bp, Artificial
  CRISPR gRNA sequence
gtcagcttgacattttaaag

SEQ ID NO: 608439 - DNA, 20 bp, Artificial
  CRISPR gRNA sequence
gcttgacattttaaagcagt

SEQ ID NO: 608440 - DNA, 20 bp, Artificial
  CRISPR gRNA sequence
tgacattttaaagcagtgag

SEQ ID NO: 608441 - DNA, 20 bp, Artificial
  CRISPR gRNA sequence
agaagttgtgtcattatttc

SEQ ID NO: 608442 - DNA, 20 bp, Artificial
  CRISPR gRNA sequence
tcattatttctagaatacta

SEQ ID NO: 608443 - DNA, 20 bp, Artificial
  CRISPR gRNA sequence
ttatttctagaatactacag

SEQ ID NO: 608444 - DNA, 20 bp, Artificial
  CRISPR gRNA sequence
ttctagaatactacagtagt

SEQ ID NO: 608445 - DNA, 20 bp, Artificial
  CRISPR gRNA sequence
ctagaatactacagtagtta

SEQ ID NO: 608446 - DNA, 20 bp, Artificial
  CRISPR gRNA sequence
tagaatactacagtagttag

SEQ ID NO: 608447 - DNA, 20 bp, Artificial
  CRISPR gRNA sequence
actacagtagttagaggaaa

SEQ ID NO: 608448 - DNA, 20 bp, Artificial
  CRISPR gRNA sequence
agttagaggaaaaagattta

SEQ ID NO: 608449 - DNA, 20 bp, Artificial
  CRISPR gRNA sequence
aaaagatttaaagttcattg

SEQ ID NO: 608450 - DNA, 20 bp, Artificial
  CRISPR gRNA sequence
ttcattgcggtaattgctgt

SEQ ID NO: 608451 - DNA, 20 bp, Artificial
  CRISPR gRNA sequence
tcattgcggtaattgctgtc

SEQ ID NO: 608452 - DNA, 20 bp, Artificial
  CRISPR gRNA sequence
taattgctgtcaggtgcttt

SEQ ID NO: 608453 - DNA, 20 bp, Artificial
  CRISPR gRNA sequence
tgctgtcaggtgcttttagt

SEQ ID NO: 608454 - DNA, 20 bp, Artificial
  CRISPR gRNA sequence
agcatgtgctgccttgaaca

SEQ ID NO: 608455 - DNA, 20 bp, Artificial
  CRISPR gRNA sequence
gcatgtgctgccttgaacaa

SEQ ID NO: 608456 - DNA, 20 bp, Artificial
  CRISPR gRNA sequence
cttgaacaaaggcaacctgc

SEQ ID NO: 608457 - DNA, 20 bp, Artificial
  CRISPR gRNA sequence
ttgaacaaaggcaacctgct

SEQ ID NO: 608458 - DNA, 20 bp, Artificial
  CRISPR gRNA sequence
gaacaaaggcaacctgctag

SEQ ID NO: 608459 - DNA, 20 bp, Artificial
  CRISPR gRNA sequence
gcaacctgctaggagtgtga

SEQ ID NO: 608460 - DNA, 20 bp, Artificial
  CRISPR gRNA sequence
acctgctaggagtgtgaaag

SEQ ID NO: 608461 - DNA, 20 bp, Artificial
  CRISPR gRNA sequence
gctaggagtgtgaaagaaga

SEQ ID NO: 608462 - DNA, 20 bp, Artificial
  CRISPR gRNA sequence
aggagtgtgaaagaagacag

SEQ ID NO: 608463 - DNA, 20 bp, Artificial
  CRISPR gRNA sequence
ggagtgtgaaagaagacagt

SEQ ID NO: 608464 - DNA, 20 bp, Artificial
  CRISPR gRNA sequence
tgaaagaagacagtgggctt

SEQ ID NO: 608465 - DNA, 20 bp, Artificial
  CRISPR gRNA sequence
aagaagacagtgggctttgg

SEQ ID NO: 608466 - DNA, 20 bp, Artificial
  CRISPR gRNA sequence
gacagtgggctttggaagat

SEQ ID NO: 608467 - DNA, 20 bp, Artificial
  CRISPR gRNA sequence
cagtgggctttggaagatga

SEQ ID NO: 608468 - DNA, 20 bp, Artificial
  CRISPR gRNA sequence
agatgagagtgacaaaaacg

SEQ ID NO: 608469 - DNA, 20 bp, Artificial
  CRISPR gRNA sequence
gagtgacaaaaacgtagatt

SEQ ID NO: 608470 - DNA, 20 bp, Artificial
  CRISPR gRNA sequence
agtgacaaaaacgtagattc

SEQ ID NO: 608471 - DNA, 20 bp, Artificial
  CRISPR gRNA sequence
aaataattgcattcatttta

SEQ ID NO: 608472 - DNA, 20 bp, Artificial
  CRISPR gRNA sequence
aataattgcattcattttaa

SEQ ID NO: 608473 - DNA, 20 bp, Artificial
  CRISPR gRNA sequence
aattgcattcattttaaagg

SEQ ID NO: 608474 - DNA, 20 bp, Artificial
  CRISPR gRNA sequence
tgcattcattttaaaggtgg

SEQ ID NO: 608475 - DNA, 20 bp, Artificial
  CRISPR gRNA sequence
attcattttaaaggtggaag

SEQ ID NO: 608476 - DNA, 20 bp, Artificial
  CRISPR gRNA sequence
aagattaaaataacttttaa

SEQ ID NO: 608477 - DNA, 20 bp, Artificial
  CRISPR gRNA sequence
aatggttattcatatgttta

SEQ ID NO: 608478 - DNA, 20 bp, Artificial
  CRISPR gRNA sequence
ttcatatgtttatagccttt

SEQ ID NO: 608479 - DNA, 20 bp, Artificial
  CRISPR gRNA sequence
ttatagcctttgagaaaaca

SEQ ID NO: 608480 - DNA, 20 bp, Artificial
  CRISPR gRNA sequence
ctttgagaaaacaaagactt

SEQ ID NO: 608481 - DNA, 20 bp, Artificial
  CRISPR gRNA sequence
tttgagaaaacaaagacttt

SEQ ID NO: 608482 - DNA, 20 bp, Artificial
  CRISPR gRNA sequence
actaataccttacataattt

SEQ ID NO: 608483 - DNA, 20 bp, Artificial
  CRISPR gRNA sequence
cttacataatttcagtaaca

SEQ ID NO: 608484 - DNA, 20 bp, Artificial
  CRISPR gRNA sequence
tacataatttcagtaacaaa

SEQ ID NO: 608485 - DNA, 20 bp, Artificial
  CRISPR gRNA sequence
gtaacaaagagtacaaaacc

SEQ ID NO: 608486 - DNA, 20 bp, Artificial
  CRISPR gRNA sequence
acaaagagtacaaaacctgg

SEQ ID NO: 608487 - DNA, 20 bp, Artificial
  CRISPR gRNA sequence
agagtacaaaacctggtggc

SEQ ID NO: 608488 - DNA, 20 bp, Artificial
  CRISPR gRNA sequence
acctggtggctagcttgtca

SEQ ID NO: 608489 - DNA, 20 bp, Artificial
  CRISPR gRNA sequence
cctggtggctagcttgtcac

SEQ ID NO: 608490 - DNA, 20 bp, Artificial
  CRISPR gRNA sequence
ctggtggctagcttgtcaca

SEQ ID NO: 608491 - DNA, 20 bp, Artificial
  CRISPR gRNA sequence
gctagcttgtcacagggatc

SEQ ID NO: 608492 - DNA, 20 bp, Artificial
  CRISPR gRNA sequence
ctagcttgtcacagggatca

SEQ ID NO: 608493 - DNA, 20 bp, Artificial
  CRISPR gRNA sequence
gcttgtcacagggatcaagg

SEQ ID NO: 608494 - DNA, 20 bp, Artificial
  CRISPR gRNA sequence
gtcacagggatcaaggtagc

SEQ ID NO: 608495 - DNA, 20 bp, Artificial
  CRISPR gRNA sequence
atcaaggtagctggtatcac

SEQ ID NO: 608496 - DNA, 20 bp, Artificial
  CRISPR gRNA sequence
tcaaggtagctggtatcact

SEQ ID NO: 608497 - DNA, 20 bp, Artificial
  CRISPR gRNA sequence
ggtagctggtatcactaggc

SEQ ID NO: 608498 - DNA, 20 bp, Artificial
  CRISPR gRNA sequence
gtagctggtatcactaggct

SEQ ID NO: 608499 - DNA, 20 bp, Artificial
  CRISPR gRNA sequence
ggctaggcacaatccatgtg

SEQ ID NO: 608500 - DNA, 20 bp, Artificial
  CRISPR gRNA sequence
cacaatccatgtgaagtgct

SEQ ID NO: 608501 - DNA, 20 bp, Artificial
  CRISPR gRNA sequence
acaatccatgtgaagtgctg

SEQ ID NO: 608502 - DNA, 20 bp, Artificial
  CRISPR gRNA sequence
tgaggtgatccctactgtaa

SEQ ID NO: 608503 - DNA, 20 bp, Artificial
  CRISPR gRNA sequence
tgtaacagcattcccctccc

SEQ ID NO: 608504 - DNA, 20 bp, Artificial
  CRISPR gRNA sequence
gaaacctgcaatttgcctct

SEQ ID NO: 608505 - DNA, 20 bp, Artificial
  CRISPR gRNA sequence
tgcaatttgcctcttagtcc

SEQ ID NO: 608506 - DNA, 20 bp, Artificial
  CRISPR gRNA sequence
atttgcctcttagtcccaga

SEQ ID NO: 608507 - DNA, 20 bp, Artificial
  CRISPR gRNA sequence
tttgcctcttagtcccagat

SEQ ID NO: 608508 - DNA, 20 bp, Artificial
  CRISPR gRNA sequence
ttgcctcttagtcccagatg

SEQ ID NO: 608509 - DNA, 20 bp, Artificial
  CRISPR gRNA sequence
gcctcttagtcccagatggg

SEQ ID NO: 608510 - DNA, 20 bp, Artificial
  CRISPR gRNA sequence
cctcttagtcccagatgggg

SEQ ID NO: 608511 - DNA, 20 bp, Artificial
  CRISPR gRNA sequence
atggggaggaaactcccaaa

SEQ ID NO: 608512 - DNA, 20 bp, Artificial
  CRISPR gRNA sequence
ggaaactcccaaacagccgc

SEQ ID NO: 608513 - DNA, 20 bp, Artificial
  CRISPR gRNA sequence
cagccgcaagccatacataa

SEQ ID NO: 608514 - DNA, 20 bp, Artificial
  CRISPR gRNA sequence
ccgcaagccatacataatgg

SEQ ID NO: 608515 - DNA, 20 bp, Artificial
  CRISPR gRNA sequence
cgcaagccatacataatggc

SEQ ID NO: 608516 - DNA, 20 bp, Artificial
  CRISPR gRNA sequence
gcaagccatacataatggca

SEQ ID NO: 608517 - DNA, 20 bp, Artificial
  CRISPR gRNA sequence
tggcagggttcacatcctga

SEQ ID NO: 608518 - DNA, 20 bp, Artificial
  CRISPR gRNA sequence
ggcagggttcacatcctgac

SEQ ID NO: 608519 - DNA, 20 bp, Artificial
  CRISPR gRNA sequence
gcagggttcacatcctgacg

SEQ ID NO: 608520 - DNA, 20 bp, Artificial
  CRISPR gRNA sequence
ttcacatcctgacggggaca

SEQ ID NO: 608521 - DNA, 20 bp, Artificial
  CRISPR gRNA sequence
acatcctgacggggacaaag

SEQ ID NO: 608522 - DNA, 20 bp, Artificial
  CRISPR gRNA sequence
atcctgacggggacaaagta

SEQ ID NO: 608523 - DNA, 20 bp, Artificial
  CRISPR gRNA sequence
acggggacaaagtagagaaa

SEQ ID NO: 608524 - DNA, 20 bp, Artificial
  CRISPR gRNA sequence
ggggacaaagtagagaaaaa

SEQ ID NO: 608525 - DNA, 20 bp, Artificial
  CRISPR gRNA sequence
agtagagaaaaagagaaatt

SEQ ID NO: 608526 - DNA, 20 bp, Artificial
  CRISPR gRNA sequence
agagaaaaagagaaattcag

SEQ ID NO: 608527 - DNA, 20 bp, Artificial
  CRISPR gRNA sequence
agaaaaagagaaattcagaa

SEQ ID NO: 608528 - DNA, 20 bp, Artificial
  CRISPR gRNA sequence
gagtcttcataacattattt

SEQ ID NO: 608529 - DNA, 20 bp, Artificial
  CRISPR gRNA sequence
ttcataacattatttgagtc

SEQ ID NO: 608530 - DNA, 20 bp, Artificial
  CRISPR gRNA sequence
tcataacattatttgagtca

SEQ ID NO: 608531 - DNA, 20 bp, Artificial
  CRISPR gRNA sequence
aggactttatgctttttgtg

SEQ ID NO: 608532 - DNA, 20 bp, Artificial
  CRISPR gRNA sequence
ggactttatgctttttgtga

SEQ ID NO: 608533 - DNA, 20 bp, Artificial
  CRISPR gRNA sequence
tatgctttttgtgaaggttg

SEQ ID NO: 608534 - DNA, 20 bp, Artificial
  CRISPR gRNA sequence
gcacttcttttttcttttta

SEQ ID NO: 608535 - DNA, 20 bp, Artificial
  CRISPR gRNA sequence
ttttttctttttaaagtttt

SEQ ID NO: 608536 - DNA, 20 bp, Artificial
  CRISPR gRNA sequence
tgtgtgtgttttctccctcc

SEQ ID NO: 608537 - DNA, 20 bp, Artificial
  CRISPR gRNA sequence
gttttctccctcctggatac

SEQ ID NO: 608538 - DNA, 20 bp, Artificial
  CRISPR gRNA sequence
tactagccaacattcaactg

SEQ ID NO: 608539 - DNA, 20 bp, Artificial
  CRISPR gRNA sequence
actagccaacattcaactga

SEQ ID NO: 608540 - DNA, 20 bp, Artificial
  CRISPR gRNA sequence
attcaactgaaggaaacaca

SEQ ID NO: 608541 - DNA, 20 bp, Artificial
  CRISPR gRNA sequence
ttcaactgaaggaaacacat

SEQ ID NO: 608542 - DNA, 20 bp, Artificial
  CRISPR gRNA sequence
tcaactgaaggaaacacatg

SEQ ID NO: 608543 - DNA, 20 bp, Artificial
  CRISPR gRNA sequence
ctgaaggaaacacatgggga

SEQ ID NO: 608544 - DNA, 20 bp, Artificial
  CRISPR gRNA sequence
cattgcactatcttttgctt

SEQ ID NO: 608545 - DNA, 20 bp, Artificial
  CRISPR gRNA sequence
tgcactatcttttgcttaag

SEQ ID NO: 608546 - DNA, 20 bp, Artificial
  CRISPR gRNA sequence
ctaacatttattgcttaata

SEQ ID NO: 608547 - DNA, 20 bp, Artificial
  CRISPR gRNA sequence
catcctgcacacataccaac

SEQ ID NO: 608548 - DNA, 20 bp, Artificial
  CRISPR gRNA sequence
atcctgcacacataccaact

SEQ ID NO: 608549 - DNA, 20 bp, Artificial
  CRISPR gRNA sequence
acacataccaactaggtttc

SEQ ID NO: 608550 - DNA, 20 bp, Artificial
  CRISPR gRNA sequence
atgcttttacctatgaccct

SEQ ID NO: 608551 - DNA, 20 bp, Artificial
  CRISPR gRNA sequence
ctcagaaacacctgaacaca

SEQ ID NO: 608552 - DNA, 20 bp, Artificial
  CRISPR gRNA sequence
aacacctgaacacatagaat

SEQ ID NO: 608553 - DNA, 20 bp, Artificial
  CRISPR gRNA sequence
acacctgaacacatagaatt

SEQ ID NO: 608554 - DNA, 20 bp, Artificial
  CRISPR gRNA sequence
cacatagaattaggcatgcc

SEQ ID NO: 608555 - DNA, 20 bp, Artificial
  CRISPR gRNA sequence
gtttcaaatatgtgatctaa

SEQ ID NO: 608556 - DNA, 20 bp, Artificial
  CRISPR gRNA sequence
tttcaaatatgtgatctaaa

SEQ ID NO: 608557 - DNA, 20 bp, Artificial
  CRISPR gRNA sequence
caaatatgtgatctaaaagg

SEQ ID NO: 608558 - DNA, 20 bp, Artificial
  CRISPR gRNA sequence
taaaaggtagatctttaccc

SEQ ID NO: 608559 - DNA, 20 bp, Artificial
  CRISPR gRNA sequence
atttatactattacttataa

SEQ ID NO: 608560 - DNA, 20 bp, Artificial
  CRISPR gRNA sequence
attacacaaattgttattta

SEQ ID NO: 608561 - DNA, 20 bp, Artificial
  CRISPR gRNA sequence
tgttatttatggaaaactta

SEQ ID NO: 608562 - DNA, 20 bp, Artificial
  CRISPR gRNA sequence
tttatggaaaacttaaagaa

SEQ ID NO: 608563 - DNA, 20 bp, Artificial
  CRISPR gRNA sequence
ggaaaacttaaagaatagtc

SEQ ID NO: 608564 - DNA, 20 bp, Artificial
  CRISPR gRNA sequence
ctggttgtattctgtaatca

SEQ ID NO: 608565 - DNA, 20 bp, Artificial
  CRISPR gRNA sequence
ttgtattctgtaatcataga

SEQ ID NO: 608566 - DNA, 20 bp, Artificial
  CRISPR gRNA sequence
gtaatcatagatagatacca

SEQ ID NO: 608567 - DNA, 20 bp, Artificial
  CRISPR gRNA sequence
tagatagataccatagattg

SEQ ID NO: 608568 - DNA, 20 bp, Artificial
  CRISPR gRNA sequence
agatagataccatagattga

SEQ ID NO: 608569 - DNA, 20 bp, Artificial
  CRISPR gRNA sequence
gatagataccatagattgaa

SEQ ID NO: 608570 - DNA, 20 bp, Artificial
  CRISPR gRNA sequence
ccatagattgaagggacctt

SEQ ID NO: 608571 - DNA, 20 bp, Artificial
  CRISPR gRNA sequence
gaccttaagatccttaacct

SEQ ID NO: 608572 - DNA, 20 bp, Artificial
  CRISPR gRNA sequence
accttaagatccttaacctc

SEQ ID NO: 608573 - DNA, 20 bp, Artificial
  CRISPR gRNA sequence
ttaagatccttaacctcagg

SEQ ID NO: 608574 - DNA, 20 bp, Artificial
  CRISPR gRNA sequence
taagatccttaacctcaggc

SEQ ID NO: 608575 - DNA, 20 bp, Artificial
  CRISPR gRNA sequence
gatccttaacctcaggcagg

SEQ ID NO: 608576 - DNA, 20 bp, Artificial
  CRISPR gRNA sequence
atccttaacctcaggcaggt

SEQ ID NO: 608577 - DNA, 20 bp, Artificial
  CRISPR gRNA sequence
cctcaggcaggtaggctttt

SEQ ID NO: 608578 - DNA, 20 bp, Artificial
  CRISPR gRNA sequence
agcattttacctgcacaaat

SEQ ID NO: 608579 - DNA, 20 bp, Artificial
  CRISPR gRNA sequence
attttacctgcacaaatcgg

SEQ ID NO: 608580 - DNA, 20 bp, Artificial
  CRISPR gRNA sequence
gtagcattacctttatttca

SEQ ID NO: 608581 - DNA, 20 bp, Artificial
  CRISPR gRNA sequence
attacctttatttcacagaa

SEQ ID NO: 608582 - DNA, 20 bp, Artificial
  CRISPR gRNA sequence
ttacctttatttcacagaaa

SEQ ID NO: 608583 - DNA, 20 bp, Artificial
  CRISPR gRNA sequence
cctttatttcacagaaaagg

SEQ ID NO: 608584 - DNA, 20 bp, Artificial
  CRISPR gRNA sequence
atttcacagaaaaggaagct

SEQ ID NO: 608585 - DNA, 20 bp, Artificial
  CRISPR gRNA sequence
gaaaaggaagctaagcccct

SEQ ID NO: 608586 - DNA, 20 bp, Artificial
  CRISPR gRNA sequence
aaggaagctaagccccttag

SEQ ID NO: 608587 - DNA, 20 bp, Artificial
  CRISPR gRNA sequence
aggaagctaagccccttaga

SEQ ID NO: 608588 - DNA, 20 bp, Artificial
  CRISPR gRNA sequence
gaaggtaacttgtacaattc

SEQ ID NO: 608589 - DNA, 20 bp, Artificial
  CRISPR gRNA sequence
aaggtaacttgtacaattcc

SEQ ID NO: 608590 - DNA, 20 bp, Artificial
  CRISPR gRNA sequence
ttgtacaattccaggtgaca

SEQ ID NO: 608591 - DNA, 20 bp, Artificial
  CRISPR gRNA sequence
ggtgacatagatgtgatctt

SEQ ID NO: 608592 - DNA, 20 bp, Artificial
  CRISPR gRNA sequence
gatcttcagtgctaaatcac

SEQ ID NO: 608593 - DNA, 20 bp, Artificial
  CRISPR gRNA sequence
agtgctaaatcaccagttaa

SEQ ID NO: 608594 - DNA, 20 bp, Artificial
  CRISPR gRNA sequence
gctaaatcaccagttaatag

SEQ ID NO: 608595 - DNA, 20 bp, Artificial
  CRISPR gRNA sequence
ttaatagaagaaataaaacc

SEQ ID NO: 608596 - DNA, 20 bp, Artificial
  CRISPR gRNA sequence
ttttgatctacttacctgac

SEQ ID NO: 608597 - DNA, 20 bp, Artificial
  CRISPR gRNA sequence
gatctacttacctgaccaga

SEQ ID NO: 608598 - DNA, 20 bp, Artificial
  CRISPR gRNA sequence
ttacctgaccagaaagcatc

SEQ ID NO: 608599 - DNA, 20 bp, Artificial
  CRISPR gRNA sequence
gaaagcatcaagtattctaa

SEQ ID NO: 608600 - DNA, 20 bp, Artificial
  CRISPR gRNA sequence
agcatcaagtattctaaaag

SEQ ID NO: 608601 - DNA, 20 bp, Artificial
  CRISPR gRNA sequence
ctaaaagaagtatttttaaa

SEQ ID NO: 608602 - DNA, 20 bp, Artificial
  CRISPR gRNA sequence
agaagtatttttaaatggat

SEQ ID NO: 608603 - DNA, 20 bp, Artificial
  CRISPR gRNA sequence
gaagtatttttaaatggata

SEQ ID NO: 608604 - DNA, 20 bp, Artificial
  CRISPR gRNA sequence
atgtaatatcatacatacac

SEQ ID NO: 608605 - DNA, 20 bp, Artificial
  CRISPR gRNA sequence
catacatacacaagtgttaa

SEQ ID NO: 608606 - DNA, 20 bp, Artificial
  CRISPR gRNA sequence
catacacaagtgttaaaaga

SEQ ID NO: 608607 - DNA, 20 bp, Artificial
  CRISPR gRNA sequence
tctgtctactttgctttcta

SEQ ID NO: 608608 - DNA, 20 bp, Artificial
  CRISPR gRNA sequence
actttgctttctatggtgca

SEQ ID NO: 608609 - DNA, 20 bp, Artificial
  CRISPR gRNA sequence
ttaatatgtttcacatactt

SEQ ID NO: 608610 - DNA, 20 bp, Artificial
  CRISPR gRNA sequence
gtttcacatactttagttat

SEQ ID NO: 608611 - DNA, 20 bp, Artificial
  CRISPR gRNA sequence
catactttagttatgagctt

SEQ ID NO: 608612 - DNA, 20 bp, Artificial
  CRISPR gRNA sequence
ctttagttatgagctttaga

SEQ ID NO: 608613 - DNA, 20 bp, Artificial
  CRISPR gRNA sequence
gctttagaaagctgtttaaa

SEQ ID NO: 608614 - DNA, 20 bp, Artificial
  CRISPR gRNA sequence
aagctgtttaaatggtgatt

SEQ ID NO: 608615 - DNA, 20 bp, Artificial
  CRISPR gRNA sequence
tttaaatggtgatttagaaa

SEQ ID NO: 608616 - DNA, 20 bp, Artificial
  CRISPR gRNA sequence
taaatggtgatttagaaatg

SEQ ID NO: 608617 - DNA, 20 bp, Artificial
  CRISPR gRNA sequence
agataactcattgaataacc

SEQ ID NO: 608618 - DNA, 20 bp, Artificial
  CRISPR gRNA sequence
tcattgaataaccaagactt

SEQ ID NO: 608619 - DNA, 20 bp, Artificial
  CRISPR gRNA sequence
agacttcagttcacaaatac

SEQ ID NO: 608620 - DNA, 20 bp, Artificial
  CRISPR gRNA sequence
gacttcagttcacaaataca

SEQ ID NO: 608621 - DNA, 20 bp, Artificial
  CRISPR gRNA sequence
tcagttcacaaatacaagga

SEQ ID NO: 608622 - DNA, 20 bp, Artificial
  CRISPR gRNA sequence
atacaaggatggcatgctta

SEQ ID NO: 608623 - DNA, 20 bp, Artificial
  CRISPR gRNA sequence
ttaaagtaactacttacaat

SEQ ID NO: 608624 - DNA, 20 bp, Artificial
  CRISPR gRNA sequence
aagtaactacttacaatgag

SEQ ID NO: 608625 - DNA, 20 bp, Artificial
  CRISPR gRNA sequence
gagaagttatctttttgaat

SEQ ID NO: 608626 - DNA, 20 bp, Artificial
  CRISPR gRNA sequence
ttttgaattagtgatcttat

SEQ ID NO: 608627 - DNA, 20 bp, Artificial
  CRISPR gRNA sequence
tatgctctatattttgcact

SEQ ID NO: 608628 - DNA, 20 bp, Artificial
  CRISPR gRNA sequence
atgctctatattttgcactg

SEQ ID NO: 608629 - DNA, 20 bp, Artificial
  CRISPR gRNA sequence
tattttgcactgaggtttta

SEQ ID NO: 608630 - DNA, 20 bp, Artificial
  CRISPR gRNA sequence
tttgcactgaggttttatag

SEQ ID NO: 608631 - DNA, 20 bp, Artificial
  CRISPR gRNA sequence
tttatagtagctgaatattc

SEQ ID NO: 608632 - DNA, 20 bp, Artificial
  CRISPR gRNA sequence
agtagctgaatattctggca

SEQ ID NO: 608633 - DNA, 20 bp, Artificial
  CRISPR gRNA sequence
agctgaatattctggcatgg

SEQ ID NO: 608634 - DNA, 20 bp, Artificial
  CRISPR gRNA sequence
aatattctggcatggtggtg

SEQ ID NO: 608635 - DNA, 20 bp, Artificial
  CRISPR gRNA sequence
atattctggcatggtggtgt

SEQ ID NO: 608636 - DNA, 20 bp, Artificial
  CRISPR gRNA sequence
tattctggcatggtggtgtg

SEQ ID NO: 608637 - DNA, 20 bp, Artificial
  CRISPR gRNA sequence
attgctcattaaatatttta

SEQ ID NO: 608638 - DNA, 20 bp, Artificial
  CRISPR gRNA sequence
attaaatattttacagtgca

SEQ ID NO: 608639 - DNA, 20 bp, Artificial
  CRISPR gRNA sequence
tagttgcttatatatataaa

SEQ ID NO: 608640 - DNA, 20 bp, Artificial
  CRISPR gRNA sequence
tgcttatatatataaaaaga

SEQ ID NO: 608641 - DNA, 20 bp, Artificial
  CRISPR gRNA sequence
tctatatgcatacctttcac

SEQ ID NO: 608642 - DNA, 20 bp, Artificial
  CRISPR gRNA sequence
acctttcactagtgccataa

SEQ ID NO: 608643 - DNA, 20 bp, Artificial
  CRISPR gRNA sequence
tttcactagtgccataaaag

SEQ ID NO: 608644 - DNA, 20 bp, Artificial
  CRISPR gRNA sequence
ttcactagtgccataaaagc

SEQ ID NO: 608645 - DNA, 20 bp, Artificial
  CRISPR gRNA sequence
tcactagtgccataaaagca

SEQ ID NO: 608646 - DNA, 20 bp, Artificial
  CRISPR gRNA sequence
tcttgttcactactgcttcg

SEQ ID NO: 608647 - DNA, 20 bp, Artificial
  CRISPR gRNA sequence
cactactgcttcgtggtgcc

SEQ ID NO: 608648 - DNA, 20 bp, Artificial
  CRISPR gRNA sequence
ctgcttcgtggtgcctggta

SEQ ID NO: 608649 - DNA, 20 bp, Artificial
  CRISPR gRNA sequence
gcttcgtggtgcctggtaca

SEQ ID NO: 608650 - DNA, 20 bp, Artificial
  CRISPR gRNA sequence
tcgtggtgcctggtacagag

SEQ ID NO: 608651 - DNA, 20 bp, Artificial
  CRISPR gRNA sequence
cgtggtgcctggtacagagc

SEQ ID NO: 608652 - DNA, 20 bp, Artificial
  CRISPR gRNA sequence
cctggtacagagcaggtgct

SEQ ID NO: 608653 - DNA, 20 bp, Artificial
  CRISPR gRNA sequence
gtacagagcaggtgctcagt

SEQ ID NO: 608654 - DNA, 20 bp, Artificial
  CRISPR gRNA sequence
gtaattttgaatgatttctt

SEQ ID NO: 608655 - DNA, 20 bp, Artificial
  CRISPR gRNA sequence
aattttgaatgatttcttaa

SEQ ID NO: 608656 - DNA, 20 bp, Artificial
  CRISPR gRNA sequence
tcttaagagttcttcatact

SEQ ID NO: 608657 - DNA, 20 bp, Artificial
  CRISPR gRNA sequence
tacttggttgtcctattaat

SEQ ID NO: 608658 - DNA, 20 bp, Artificial
  CRISPR gRNA sequence
ttgtcctattaataagttaa

SEQ ID NO: 608659 - DNA, 20 bp, Artificial
  CRISPR gRNA sequence
ttttgaaattactgccattc

SEQ ID NO: 608660 - DNA, 20 bp, Artificial
  CRISPR gRNA sequence
gctcaattttaaatgctctg

SEQ ID NO: 608661 - DNA, 20 bp, Artificial
  CRISPR gRNA sequence
ttttaaatgctctgtggttt

SEQ ID NO: 608662 - DNA, 20 bp, Artificial
  CRISPR gRNA sequence
tttaaatgctctgtggtttt

SEQ ID NO: 608663 - DNA, 20 bp, Artificial
  CRISPR gRNA sequence
tctattgtatattatccatt

SEQ ID NO: 608664 - DNA, 20 bp, Artificial
  CRISPR gRNA sequence
tccattgagtgtatccattc

SEQ ID NO: 608665 - DNA, 20 bp, Artificial
  CRISPR gRNA sequence
tgtatccattctggaaaaaa

SEQ ID NO: 608666 - DNA, 20 bp, Artificial
  CRISPR gRNA sequence
ttcatgcttgcccctatctt

SEQ ID NO: 608667 - DNA, 20 bp, Artificial
  CRISPR gRNA sequence
cccctatcttgagtgccatc

SEQ ID NO: 608668 - DNA, 20 bp, Artificial
  CRISPR gRNA sequence
atctagttcttcttttatat

SEQ ID NO: 608669 - DNA, 20 bp, Artificial
  CRISPR gRNA sequence
tataagtcatatccaacttt

SEQ ID NO: 608670 - DNA, 20 bp, Artificial
  CRISPR gRNA sequence
tacatgccatttccttcata

SEQ ID NO: 608671 - DNA, 20 bp, Artificial
  CRISPR gRNA sequence
atcttccctgtacttccatg

SEQ ID NO: 608672 - DNA, 20 bp, Artificial
  CRISPR gRNA sequence
ccatgtagtaaacataaccc

SEQ ID NO: 608673 - DNA, 20 bp, Artificial
  CRISPR gRNA sequence
acttatgaaatgctttcaca

SEQ ID NO: 608674 - DNA, 20 bp, Artificial
  CRISPR gRNA sequence
tttcacatagatatattaat

SEQ ID NO: 608675 - DNA, 20 bp, Artificial
  CRISPR gRNA sequence
cacatagatatattaataag

SEQ ID NO: 608676 - DNA, 20 bp, Artificial
  CRISPR gRNA sequence
tagatatattaataagaagc

SEQ ID NO: 608677 - DNA, 20 bp, Artificial
  CRISPR gRNA sequence
atatattaataagaagcaag

SEQ ID NO: 608678 - DNA, 20 bp, Artificial
  CRISPR gRNA sequence
aataagaagcaagtagttcc

SEQ ID NO: 608679 - DNA, 20 bp, Artificial
  CRISPR gRNA sequence
atacaattttatttaatact

SEQ ID NO: 608680 - DNA, 20 bp, Artificial
  CRISPR gRNA sequence
tacaattttatttaatactc

SEQ ID NO: 608681 - DNA, 20 bp, Artificial
  CRISPR gRNA sequence
tttaatactcaggacaaccc

SEQ ID NO: 608682 - DNA, 20 bp, Artificial
  CRISPR gRNA sequence
ttaatactcaggacaaccct

SEQ ID NO: 608683 - DNA, 20 bp, Artificial
  CRISPR gRNA sequence
aatactcaggacaaccctag

SEQ ID NO: 608684 - DNA, 20 bp, Artificial
  CRISPR gRNA sequence
atactcaggacaaccctagg

SEQ ID NO: 608685 - DNA, 20 bp, Artificial
  CRISPR gRNA sequence
ctcaggacaaccctaggagg

SEQ ID NO: 608686 - DNA, 20 bp, Artificial
  CRISPR gRNA sequence
ttgtcattattttgatttta

SEQ ID NO: 608687 - DNA, 20 bp, Artificial
  CRISPR gRNA sequence
attattttgattttatagat

SEQ ID NO: 608688 - DNA, 20 bp, Artificial
  CRISPR gRNA sequence
tagatgagaaaattgaaact

SEQ ID NO: 608689 - DNA, 20 bp, Artificial
  CRISPR gRNA sequence
agatgagaaaattgaaactt

SEQ ID NO: 608690 - DNA, 20 bp, Artificial
  CRISPR gRNA sequence
aattgaaacttaggtttcct

SEQ ID NO: 608691 - DNA, 20 bp, Artificial
  CRISPR gRNA sequence
attgaaacttaggtttccta

SEQ ID NO: 608692 - DNA, 20 bp, Artificial
  CRISPR gRNA sequence
gacttataaatgaacgaacc

SEQ ID NO: 608693 - DNA, 20 bp, Artificial
  CRISPR gRNA sequence
acgaacctggccttaaactc

SEQ ID NO: 608694 - DNA, 20 bp, Artificial
  CRISPR gRNA sequence
cgaacctggccttaaactcc

SEQ ID NO: 608695 - DNA, 20 bp, Artificial
  CRISPR gRNA sequence
gaacctggccttaaactcca

SEQ ID NO: 608696 - DNA, 20 bp, Artificial
  CRISPR gRNA sequence
ggccttaaactccagggtgc

SEQ ID NO: 608697 - DNA, 20 bp, Artificial
  CRISPR gRNA sequence
aaactccagggtgctggacc

SEQ ID NO: 608698 - DNA, 20 bp, Artificial
  CRISPR gRNA sequence
actccagggtgctggaccta

SEQ ID NO: 608699 - DNA, 20 bp, Artificial
  CRISPR gRNA sequence
gagcccttgctctttaacca

SEQ ID NO: 608700 - DNA, 20 bp, Artificial
  CRISPR gRNA sequence
agcccttgctctttaaccac

SEQ ID NO: 608701 - DNA, 20 bp, Artificial
  CRISPR gRNA sequence
gcccttgctctttaaccaca

SEQ ID NO: 608702 - DNA, 20 bp, Artificial
  CRISPR gRNA sequence
agggctatgttgcttgcttt

SEQ ID NO: 608703 - DNA, 20 bp, Artificial
  CRISPR gRNA sequence
taagtgattgcatgcttttc

SEQ ID NO: 608704 - DNA, 20 bp, Artificial
  CRISPR gRNA sequence
gcatgcttttccagtcttca

SEQ ID NO: 608705 - DNA, 20 bp, Artificial
  CRISPR gRNA sequence
cagtcttcacagttttaatg

SEQ ID NO: 608706 - DNA, 20 bp, Artificial
  CRISPR gRNA sequence
gtcttcacagttttaatgta

SEQ ID NO: 608707 - DNA, 20 bp, Artificial
  CRISPR gRNA sequence
tcttcacagttttaatgtag

SEQ ID NO: 608708 - DNA, 20 bp, Artificial
  CRISPR gRNA sequence
gatattatcttcacttcata

SEQ ID NO: 608709 - DNA, 20 bp, Artificial
  CRISPR gRNA sequence
attatcttcacttcatacag

SEQ ID NO: 608710 - DNA, 20 bp, Artificial
  CRISPR gRNA sequence
ttatcttcacttcatacagt

SEQ ID NO: 608711 - DNA, 20 bp, Artificial
  CRISPR gRNA sequence
tcttcacttcatacagtagg

SEQ ID NO: 608712 - DNA, 20 bp, Artificial
  CRISPR gRNA sequence
tcacttcatacagtaggaag

SEQ ID NO: 608713 - DNA, 20 bp, Artificial
  CRISPR gRNA sequence
cacttcatacagtaggaagc

SEQ ID NO: 608714 - DNA, 20 bp, Artificial
  CRISPR gRNA sequence
acttcatacagtaggaagca

SEQ ID NO: 608715 - DNA, 20 bp, Artificial
  CRISPR gRNA sequence
ttcatacagtaggaagcagg

SEQ ID NO: 608716 - DNA, 20 bp, Artificial
  CRISPR gRNA sequence
tacagtaggaagcagggagc

SEQ ID NO: 608717 - DNA, 20 bp, Artificial
  CRISPR gRNA sequence
gtaggaagcagggagctagc

SEQ ID NO: 608718 - DNA, 20 bp, Artificial
  CRISPR gRNA sequence
ggaagcagggagctagcaag

SEQ ID NO: 608719 - DNA, 20 bp, Artificial
  CRISPR gRNA sequence
gtggcttccaacatttatat

SEQ ID NO: 608720 - DNA, 20 bp, Artificial
  CRISPR gRNA sequence
cttccaacatttatataagt

SEQ ID NO: 608721 - DNA, 20 bp, Artificial
  CRISPR gRNA sequence
tataagtaagcatttaaaca

SEQ ID NO: 608722 - DNA, 20 bp, Artificial
  CRISPR gRNA sequence
taaacatagatgttataatc

SEQ ID NO: 608723 - DNA, 20 bp, Artificial
  CRISPR gRNA sequence
tccatgatttaaatacttca

SEQ ID NO: 608724 - DNA, 20 bp, Artificial
  CRISPR gRNA sequence
ccatgatttaaatacttcat

SEQ ID NO: 608725 - DNA, 20 bp, Artificial
  CRISPR gRNA sequence
taaaatgctcattcattcat

SEQ ID NO: 608726 - DNA, 20 bp, Artificial
  CRISPR gRNA sequence
aaaatgctcattcattcatt

SEQ ID NO: 608727 - DNA, 20 bp, Artificial
  CRISPR gRNA sequence
aatgctcattcattcattag

SEQ ID NO: 608728 - DNA, 20 bp, Artificial
  CRISPR gRNA sequence
gctcattcattcattaggag

SEQ ID NO: 608729 - DNA, 20 bp, Artificial
  CRISPR gRNA sequence
attcattaggagtagaaaac

SEQ ID NO: 608730 - DNA, 20 bp, Artificial
  CRISPR gRNA sequence
ttcattaggagtagaaaact

SEQ ID NO: 608731 - DNA, 20 bp, Artificial
  CRISPR gRNA sequence
aggagtagaaaactaggtat

SEQ ID NO: 608732 - DNA, 20 bp, Artificial
  CRISPR gRNA sequence
aactaggtatgagcattgta

SEQ ID NO: 608733 - DNA, 20 bp, Artificial
  CRISPR gRNA sequence
taggtatgagcattgtaaag

SEQ ID NO: 608734 - DNA, 20 bp, Artificial
  CRISPR gRNA sequence
gtatgagcattgtaaagaag

SEQ ID NO: 608735 - DNA, 20 bp, Artificial
  CRISPR gRNA sequence
aaactgctgctgctacattg

SEQ ID NO: 608736 - DNA, 20 bp, Artificial
  CRISPR gRNA sequence
gctgctacattgtggaaaat

SEQ ID NO: 608737 - DNA, 20 bp, Artificial
  CRISPR gRNA sequence
cattgtggaaaataagtatc

SEQ ID NO: 608738 - DNA, 20 bp, Artificial
  CRISPR gRNA sequence
taattccccttaatcaccac

SEQ ID NO: 608739 - DNA, 20 bp, Artificial
  CRISPR gRNA sequence
ttctctttctcactacttga

SEQ ID NO: 608740 - DNA, 20 bp, Artificial
  CRISPR gRNA sequence
cactacttgatagatcttac

SEQ ID NO: 608741 - DNA, 20 bp, Artificial
  CRISPR gRNA sequence
aactgaccaatcctgcatct

SEQ ID NO: 608742 - DNA, 20 bp, Artificial
  CRISPR gRNA sequence
actgaccaatcctgcatctg

SEQ ID NO: 608743 - DNA, 20 bp, Artificial
  CRISPR gRNA sequence
ctgaccaatcctgcatctga

SEQ ID NO: 608744 - DNA, 20 bp, Artificial
  CRISPR gRNA sequence
ctgcatctgagggccaaatg

SEQ ID NO: 608745 - DNA, 20 bp, Artificial
  CRISPR gRNA sequence
cagactctgtttatttgact

SEQ ID NO: 608746 - DNA, 20 bp, Artificial
  CRISPR gRNA sequence
tctgtttatttgactcagac

SEQ ID NO: 608747 - DNA, 20 bp, Artificial
  CRISPR gRNA sequence
gtttatttgactcagaccag

SEQ ID NO: 608748 - DNA, 20 bp, Artificial
  CRISPR gRNA sequence
tttgactcagaccagtagta

SEQ ID NO: 608749 - DNA, 20 bp, Artificial
  CRISPR gRNA sequence
gaccagtagtacagtgttta

SEQ ID NO: 608750 - DNA, 20 bp, Artificial
  CRISPR gRNA sequence
cagtagtacagtgtttatgg

SEQ ID NO: 608751 - DNA, 20 bp, Artificial
  CRISPR gRNA sequence
gtacagtgtttatggaagaa

SEQ ID NO: 608752 - DNA, 20 bp, Artificial
  CRISPR gRNA sequence
cagtgtttatggaagaacag

SEQ ID NO: 608753 - DNA, 20 bp, Artificial
  CRISPR gRNA sequence
agtgtttatggaagaacagc

SEQ ID NO: 608754 - DNA, 20 bp, Artificial
  CRISPR gRNA sequence
gtgtttatggaagaacagca

SEQ ID NO: 608755 - DNA, 20 bp, Artificial
  CRISPR gRNA sequence
ttatggaagaacagcaggga

SEQ ID NO: 608756 - DNA, 20 bp, Artificial
  CRISPR gRNA sequence
cagcagggaaagaacttttg

SEQ ID NO: 608757 - DNA, 20 bp, Artificial
  CRISPR gRNA sequence
cgatgtcaatgtgtatgacc

SEQ ID NO: 608758 - DNA, 20 bp, Artificial
  CRISPR gRNA sequence
gatgtcaatgtgtatgaccc

SEQ ID NO: 608759 - DNA, 20 bp, Artificial
  CRISPR gRNA sequence
atgtcaatgtgtatgaccca

SEQ ID NO: 608760 - DNA, 20 bp, Artificial
  CRISPR gRNA sequence
gacccagggatgtttgaacc

SEQ ID NO: 608761 - DNA, 20 bp, Artificial
  CRISPR gRNA sequence
acccagggatgtttgaacct

SEQ ID NO: 608762 - DNA, 20 bp, Artificial
  CRISPR gRNA sequence
cccagggatgtttgaacctg

SEQ ID NO: 608763 - DNA, 20 bp, Artificial
  CRISPR gRNA sequence
ggatgtttgaacctggggta

SEQ ID NO: 608764 - DNA, 20 bp, Artificial
  CRISPR gRNA sequence
cctggggtatggaaacctgt

SEQ ID NO: 608765 - DNA, 20 bp, Artificial
  CRISPR gRNA sequence
ctggggtatggaaacctgtt

SEQ ID NO: 608766 - DNA, 20 bp, Artificial
  CRISPR gRNA sequence
gttcccctgttgcttcactt

SEQ ID NO: 608767 - DNA, 20 bp, Artificial
  CRISPR gRNA sequence
tcccctgttgcttcacttca

SEQ ID NO: 608768 - DNA, 20 bp, Artificial
  CRISPR gRNA sequence
gttgcttcacttcagagacc

SEQ ID NO: 608769 - DNA, 20 bp, Artificial
  CRISPR gRNA sequence
ttcacttcagagacccggta

SEQ ID NO: 608770 - DNA, 20 bp, Artificial
  CRISPR gRNA sequence
gagacccggtaaagctgctg

SEQ ID NO: 608771 - DNA, 20 bp, Artificial
  CRISPR gRNA sequence
tgaagtgtgttgcactgctt

SEQ ID NO: 608772 - DNA, 20 bp, Artificial
  CRISPR gRNA sequence
ctccctctgttgccgttgcc

SEQ ID NO: 608773 - DNA, 20 bp, Artificial
  CRISPR gRNA sequence
ctgttgccgttgcccagtga

SEQ ID NO: 608774 - DNA, 20 bp, Artificial
  CRISPR gRNA sequence
cttccttatctctttctgtt

SEQ ID NO: 608775 - DNA, 20 bp, Artificial
  CRISPR gRNA sequence
atctctttctgttgagccgc

SEQ ID NO: 608776 - DNA, 20 bp, Artificial
  CRISPR gRNA sequence
tctttctgttgagccgccag

SEQ ID NO: 608777 - DNA, 20 bp, Artificial
  CRISPR gRNA sequence
cttgccttctgaccttgttt

SEQ ID NO: 608778 - DNA, 20 bp, Artificial
  CRISPR gRNA sequence
tgaccttgtttaagcgtcct

SEQ ID NO: 608779 - DNA, 20 bp, Artificial
  CRISPR gRNA sequence
taagcgtccttagtgacctc

SEQ ID NO: 608780 - DNA, 20 bp, Artificial
  CRISPR gRNA sequence
aagcgtccttagtgacctct

SEQ ID NO: 608781 - DNA, 20 bp, Artificial
  CRISPR gRNA sequence
gtgacctctgggaatccttg

SEQ ID NO: 608782 - DNA, 20 bp, Artificial
  CRISPR gRNA sequence
tgacctctgggaatccttgt

SEQ ID NO: 608783 - DNA, 20 bp, Artificial
  CRISPR gRNA sequence
ggaatccttgtgggtccctt

SEQ ID NO: 608784 - DNA, 20 bp, Artificial
  CRISPR gRNA sequence
gaatccttgtgggtcccttt

SEQ ID NO: 608785 - DNA, 20 bp, Artificial
  CRISPR gRNA sequence
cctttgggaacatacccact

SEQ ID NO: 608786 - DNA, 20 bp, Artificial
  CRISPR gRNA sequence
tgggaacatacccactcagc

SEQ ID NO: 608787 - DNA, 20 bp, Artificial
  CRISPR gRNA sequence
cagctggattttacttctta

SEQ ID NO: 608788 - DNA, 20 bp, Artificial
  CRISPR gRNA sequence
ctggattttacttcttacag

SEQ ID NO: 608789 - DNA, 20 bp, Artificial
  CRISPR gRNA sequence
attttacttcttacagaagt

SEQ ID NO: 608790 - DNA, 20 bp, Artificial
  CRISPR gRNA sequence
ttttacttcttacagaagtt

SEQ ID NO: 608791 - DNA, 20 bp, Artificial
  CRISPR gRNA sequence
cttcttacagaagttaggtt

SEQ ID NO: 608792 - DNA, 20 bp, Artificial
  CRISPR gRNA sequence
tttgtactgctcttattaaa

SEQ ID NO: 608793 - DNA, 20 bp, Artificial
  CRISPR gRNA sequence
cacaatgtaatttgcttcac

SEQ ID NO: 608794 - DNA, 20 bp, Artificial
  CRISPR gRNA sequence
tttgcttcacaagcctctta

SEQ ID NO: 608795 - DNA, 20 bp, Artificial
  CRISPR gRNA sequence
aagcctcttacagttacgtt

SEQ ID NO: 608796 - DNA, 20 bp, Artificial
  CRISPR gRNA sequence
cctcttacagttacgttaag

SEQ ID NO: 608797 - DNA, 20 bp, Artificial
  CRISPR gRNA sequence
ttacagttacgttaagcaga

SEQ ID NO: 608798 - DNA, 20 bp, Artificial
  CRISPR gRNA sequence
agcagatggttgccaaacac

SEQ ID NO: 608799 - DNA, 20 bp, Artificial
  CRISPR gRNA sequence
ggttgccaaacaccagttca

SEQ ID NO: 608800 - DNA, 20 bp, Artificial
  CRISPR gRNA sequence
tgccaaacaccagttcaaag

SEQ ID NO: 608801 - DNA, 20 bp, Artificial
  CRISPR gRNA sequence
tatgaaataaaatccacgct

SEQ ID NO: 608802 - DNA, 20 bp, Artificial
  CRISPR gRNA sequence
atgaaataaaatccacgctc

SEQ ID NO: 608803 - DNA, 20 bp, Artificial
  CRISPR gRNA sequence
aaatccacgctcaggaaatt

SEQ ID NO: 608804 - DNA, 20 bp, Artificial
  CRISPR gRNA sequence
tccacgctcaggaaatttgg

SEQ ID NO: 608805 - DNA, 20 bp, Artificial
  CRISPR gRNA sequence
ctcaggaaatttggcagtgt

SEQ ID NO: 608806 - DNA, 20 bp, Artificial
  CRISPR gRNA sequence
ggaaatttggcagtgtaagc

SEQ ID NO: 608807 - DNA, 20 bp, Artificial
  CRISPR gRNA sequence
aagctggtcttcttccaaaa

SEQ ID NO: 608808 - DNA, 20 bp, Artificial
  CRISPR gRNA sequence
agctggtcttcttccaaaac

SEQ ID NO: 608809 - DNA, 20 bp, Artificial
  CRISPR gRNA sequence
tcttccaaaacaggcttact

SEQ ID NO: 608810 - DNA, 20 bp, Artificial
  CRISPR gRNA sequence
agacaactttctctttacct

SEQ ID NO: 608811 - DNA, 20 bp, Artificial
  CRISPR gRNA sequence
actttctctttacctcagac

SEQ ID NO: 608812 - DNA, 20 bp, Artificial
  CRISPR gRNA sequence
gctacacctgtattccactg

SEQ ID NO: 608813 - DNA, 20 bp, Artificial
  CRISPR gRNA sequence
tacacctgtattccactgtg

SEQ ID NO: 608814 - DNA, 20 bp, Artificial
  CRISPR gRNA sequence
ctgtggagtaaaaaacatat

SEQ ID NO: 608815 - DNA, 20 bp, Artificial
  CRISPR gRNA sequence
agattgtatacactgattca

SEQ ID NO: 608816 - DNA, 20 bp, Artificial
  CRISPR gRNA sequence
gattgtatacactgattcaa

SEQ ID NO: 608817 - DNA, 20 bp, Artificial
  CRISPR gRNA sequence
ttttttttctttactattac

SEQ ID NO: 608818 - DNA, 20 bp, Artificial
  CRISPR gRNA sequence
attactagctactttgcttt

SEQ ID NO: 608819 - DNA, 20 bp, Artificial
  CRISPR gRNA sequence
ctactttgcttttggcatca

SEQ ID NO: 608820 - DNA, 20 bp, Artificial
  CRISPR gRNA sequence
tactttgcttttggcatcat

SEQ ID NO: 608821 - DNA, 20 bp, Artificial
  CRISPR gRNA sequence
actttgcttttggcatcata

SEQ ID NO: 608822 - DNA, 20 bp, Artificial
  CRISPR gRNA sequence
cttttggcatcatagggaaa

SEQ ID NO: 608823 - DNA, 20 bp, Artificial
  CRISPR gRNA sequence
tggcatcatagggaaatagc

SEQ ID NO: 608824 - DNA, 20 bp, Artificial
  CRISPR gRNA sequence
atagggaaatagcaagaatt

SEQ ID NO: 608825 - DNA, 20 bp, Artificial
  CRISPR gRNA sequence
aatagcaagaatttggtcat

SEQ ID NO: 608826 - DNA, 20 bp, Artificial
  CRISPR gRNA sequence
agaatttggtcatcagttct

SEQ ID NO: 608827 - DNA, 20 bp, Artificial
  CRISPR gRNA sequence
tggtcatcagttctgagttc

SEQ ID NO: 608828 - DNA, 20 bp, Artificial
  CRISPR gRNA sequence
tcagttctgagttccagtca

SEQ ID NO: 608829 - DNA, 20 bp, Artificial
  CRISPR gRNA sequence
tgtgttacttcactgatttt

SEQ ID NO: 608830 - DNA, 20 bp, Artificial
  CRISPR gRNA sequence
acttcactgattttaagctt

SEQ ID NO: 608831 - DNA, 20 bp, Artificial
  CRISPR gRNA sequence
agtttcctcatttgtaaaat

SEQ ID NO: 608832 - DNA, 20 bp, Artificial
  CRISPR gRNA sequence
gtttcctcatttgtaaaatg

SEQ ID NO: 608833 - DNA, 20 bp, Artificial
  CRISPR gRNA sequence
ggataaaattacgtacttca

SEQ ID NO: 608834 - DNA, 20 bp, Artificial
  CRISPR gRNA sequence
ataaaattacgtacttcatg

SEQ ID NO: 608835 - DNA, 20 bp, Artificial
  CRISPR gRNA sequence
aaattacgtacttcatggag

SEQ ID NO: 608836 - DNA, 20 bp, Artificial
  CRISPR gRNA sequence
agtggctattttgattaatt

SEQ ID NO: 608837 - DNA, 20 bp, Artificial
  CRISPR gRNA sequence
aaattctttcctgtcattaa

SEQ ID NO: 608838 - DNA, 20 bp, Artificial
  CRISPR gRNA sequence
catgtgtatttgatttatgt

SEQ ID NO: 608839 - DNA, 20 bp, Artificial
  CRISPR gRNA sequence
atgtgtatttgatttatgtg

SEQ ID NO: 608840 - DNA, 20 bp, Artificial
  CRISPR gRNA sequence
aggtcttcgtaatttaaaaa

SEQ ID NO: 608841 - DNA, 20 bp, Artificial
  CRISPR gRNA sequence
cagaaatatcatacgtaaat

SEQ ID NO: 608842 - DNA, 20 bp, Artificial
  CRISPR gRNA sequence
aaatatcatacgtaaatcag

SEQ ID NO: 608843 - DNA, 20 bp, Artificial
  CRISPR gRNA sequence
catacgtaaatcagcagcac

SEQ ID NO: 608844 - DNA, 20 bp, Artificial
  CRISPR gRNA sequence
ctggttcaacaaatacatat

SEQ ID NO: 608845 - DNA, 20 bp, Artificial
  CRISPR gRNA sequence
tggttcaacaaatacatatt

SEQ ID NO: 608846 - DNA, 20 bp, Artificial
  CRISPR gRNA sequence
attgggtgctttgtatgtgt

SEQ ID NO: 608847 - DNA, 20 bp, Artificial
  CRISPR gRNA sequence
ttgggtgctttgtatgtgta

SEQ ID NO: 608848 - DNA, 20 bp, Artificial
  CRISPR gRNA sequence
gtgctttgtatgtgtaagga

SEQ ID NO: 608849 - DNA, 20 bp, Artificial
  CRISPR gRNA sequence
tgattttacaactatgaata

SEQ ID NO: 608850 - DNA, 20 bp, Artificial
  CRISPR gRNA sequence
gattttacaactatgaataa

SEQ ID NO: 608851 - DNA, 20 bp, Artificial
  CRISPR gRNA sequence
tttacaactatgaataaagg

SEQ ID NO: 608852 - DNA, 20 bp, Artificial
  CRISPR gRNA sequence
taaaggcagtatttcctctc

SEQ ID NO: 608853 - DNA, 20 bp, Artificial
  CRISPR gRNA sequence
aaaggcagtatttcctctca

SEQ ID NO: 608854 - DNA, 20 bp, Artificial
  CRISPR gRNA sequence
ctctcaaggaccttacacta

SEQ ID NO: 608855 - DNA, 20 bp, Artificial
  CRISPR gRNA sequence
tctcaaggaccttacactat

SEQ ID NO: 608856 - DNA, 20 bp, Artificial
  CRISPR gRNA sequence
caaggaccttacactatagg

SEQ ID NO: 608857 - DNA, 20 bp, Artificial
  CRISPR gRNA sequence
accttacactataggcagtg

SEQ ID NO: 608858 - DNA, 20 bp, Artificial
  CRISPR gRNA sequence
cttacactataggcagtgta

SEQ ID NO: 608859 - DNA, 20 bp, Artificial
  CRISPR gRNA sequence
ttacactataggcagtgtag

SEQ ID NO: 608860 - DNA, 20 bp, Artificial
  CRISPR gRNA sequence
actataggcagtgtagaggt

SEQ ID NO: 608861 - DNA, 20 bp, Artificial
  CRISPR gRNA sequence
ctataggcagtgtagaggta

SEQ ID NO: 608862 - DNA, 20 bp, Artificial
  CRISPR gRNA sequence
gatgaaatcactgtaatgta

SEQ ID NO: 608863 - DNA, 20 bp, Artificial
  CRISPR gRNA sequence
aatcactgtaatgtaaagtg

SEQ ID NO: 608864 - DNA, 20 bp, Artificial
  CRISPR gRNA sequence
gtaaagtgaagtaaatttca

SEQ ID NO: 608865 - DNA, 20 bp, Artificial
  CRISPR gRNA sequence
taaagtgaagtaaatttcat

SEQ ID NO: 608866 - DNA, 20 bp, Artificial
  CRISPR gRNA sequence
aagtgaagtaaatttcatag

SEQ ID NO: 608867 - DNA, 20 bp, Artificial
  CRISPR gRNA sequence
tgaagtaaatttcataggag

SEQ ID NO: 608868 - DNA, 20 bp, Artificial
  CRISPR gRNA sequence
taggagaagaactttttgct

SEQ ID NO: 608869 - DNA, 20 bp, Artificial
  CRISPR gRNA sequence
tcagaaaacactcatgaaaa

SEQ ID NO: 608870 - DNA, 20 bp, Artificial
  CRISPR gRNA sequence
cagaaaacactcatgaaaaa

SEQ ID NO: 608871 - DNA, 20 bp, Artificial
  CRISPR gRNA sequence
aaaacactcatgaaaaaagg

SEQ ID NO: 608872 - DNA, 20 bp, Artificial
  CRISPR gRNA sequence
acactcatgaaaaaaggtag

SEQ ID NO: 608873 - DNA, 20 bp, Artificial
  CRISPR gRNA sequence
catgaaaaaaggtagcagat

SEQ ID NO: 608874 - DNA, 20 bp, Artificial
  CRISPR gRNA sequence
taatgatgtgctaattttta

SEQ ID NO: 608875 - DNA, 20 bp, Artificial
  CRISPR gRNA sequence
tgtgctaatttttatagaaa

SEQ ID NO: 608876 - DNA, 20 bp, Artificial
  CRISPR gRNA sequence
gtgctaatttttatagaaat

SEQ ID NO: 608877 - DNA, 20 bp, Artificial
  CRISPR gRNA sequence
tgctaatttttatagaaata

SEQ ID NO: 608878 - DNA, 20 bp, Artificial
  CRISPR gRNA sequence
gctaatttttatagaaatag

SEQ ID NO: 608879 - DNA, 20 bp, Artificial
  CRISPR gRNA sequence
aatttttatagaaatagggg

SEQ ID NO: 608880 - DNA, 20 bp, Artificial
  CRISPR gRNA sequence
tagaaataggggaagtatcc

SEQ ID NO: 608881 - DNA, 20 bp, Artificial
  CRISPR gRNA sequence
ggaagtatcccagaaaataa

SEQ ID NO: 608882 - DNA, 20 bp, Artificial
  CRISPR gRNA sequence
agtatcccagaaaataaaag

SEQ ID NO: 608883 - DNA, 20 bp, Artificial
  CRISPR gRNA sequence
gtatcccagaaaataaaagc

SEQ ID NO: 608884 - DNA, 20 bp, Artificial
  CRISPR gRNA sequence
gaaaataaaagcaggtgctt

SEQ ID NO: 608885 - DNA, 20 bp, Artificial
  CRISPR gRNA sequence
tgagaaaaaacaaaaaaacc

SEQ ID NO: 608886 - DNA, 20 bp, Artificial
  CRISPR gRNA sequence
aaaaaacaaaaaaacctagt

SEQ ID NO: 608887 - DNA, 20 bp, Artificial
  CRISPR gRNA sequence
aaacaaaaaaacctagtaag

SEQ ID NO: 608888 - DNA, 20 bp, Artificial
  CRISPR gRNA sequence
acaaaaaaacctagtaagta

SEQ ID NO: 608889 - DNA, 20 bp, Artificial
  CRISPR gRNA sequence
gagatgtataaatgtgtttc

SEQ ID NO: 608890 - DNA, 20 bp, Artificial
  CRISPR gRNA sequence
aaatgtgtttctggaaaact

SEQ ID NO: 608891 - DNA, 20 bp, Artificial
  CRISPR gRNA sequence
aatgtgtttctggaaaactg

SEQ ID NO: 608892 - DNA, 20 bp, Artificial
  CRISPR gRNA sequence
tgtttctggaaaactgagga

SEQ ID NO: 608893 - DNA, 20 bp, Artificial
  CRISPR gRNA sequence
ttctggaaaactgaggacag

SEQ ID NO: 608894 - DNA, 20 bp, Artificial
  CRISPR gRNA sequence
actgaggacagtggtttcac

SEQ ID NO: 608895 - DNA, 20 bp, Artificial
  CRISPR gRNA sequence
ggacagtggtttcactggaa

SEQ ID NO: 608896 - DNA, 20 bp, Artificial
  CRISPR gRNA sequence
gacagtggtttcactggaaa

SEQ ID NO: 608897 - DNA, 20 bp, Artificial
  CRISPR gRNA sequence
ggtttcactggaaaaggcat

SEQ ID NO: 608898 - DNA, 20 bp, Artificial
  CRISPR gRNA sequence
gaaaaggcatgagtaactaa

SEQ ID NO: 608899 - DNA, 20 bp, Artificial
  CRISPR gRNA sequence
atgagtaactaaaagactca

SEQ ID NO: 608900 - DNA, 20 bp, Artificial
  CRISPR gRNA sequence
tgagtaactaaaagactcat

SEQ ID NO: 608901 - DNA, 20 bp, Artificial
  CRISPR gRNA sequence
taaaagactcataggacata

SEQ ID NO: 608902 - DNA, 20 bp, Artificial
  CRISPR gRNA sequence
actcataggacatatggctg

SEQ ID NO: 608903 - DNA, 20 bp, Artificial
  CRISPR gRNA sequence
ctcataggacatatggctga

SEQ ID NO: 608904 - DNA, 20 bp, Artificial
  CRISPR gRNA sequence
catatggctgaaggatatga

SEQ ID NO: 608905 - DNA, 20 bp, Artificial
  CRISPR gRNA sequence
atatggctgaaggatatgat

SEQ ID NO: 608906 - DNA, 20 bp, Artificial
  CRISPR gRNA sequence
gatatgatgggactacactt

SEQ ID NO: 608907 - DNA, 20 bp, Artificial
  CRISPR gRNA sequence
atacctttgtatttaatgtg

SEQ ID NO: 608908 - DNA, 20 bp, Artificial
  CRISPR gRNA sequence
tacctttgtatttaatgtgt

SEQ ID NO: 608909 - DNA, 20 bp, Artificial
  CRISPR gRNA sequence
ctttgtatttaatgtgtagg

SEQ ID NO: 608910 - DNA, 20 bp, Artificial
  CRISPR gRNA sequence
tgtatttaatgtgtaggcag

SEQ ID NO: 608911 - DNA, 20 bp, Artificial
  CRISPR gRNA sequence
gtatttaatgtgtaggcagt

SEQ ID NO: 608912 - DNA, 20 bp, Artificial
  CRISPR gRNA sequence
tttaatgtgtaggcagtagg

SEQ ID NO: 608913 - DNA, 20 bp, Artificial
  CRISPR gRNA sequence
taggcagtaggcagttcttg

SEQ ID NO: 608914 - DNA, 20 bp, Artificial
  CRISPR gRNA sequence
aggcagttcttgaagacatt

SEQ ID NO: 608915 - DNA, 20 bp, Artificial
  CRISPR gRNA sequence
cagttcttgaagacatttag

SEQ ID NO: 608916 - DNA, 20 bp, Artificial
  CRISPR gRNA sequence
gttcttgaagacatttagaa

SEQ ID NO: 608917 - DNA, 20 bp, Artificial
  CRISPR gRNA sequence
gagtaatatgaactctgcaa

SEQ ID NO: 608918 - DNA, 20 bp, Artificial
  CRISPR gRNA sequence
agtaatatgaactctgcaat

SEQ ID NO: 608919 - DNA, 20 bp, Artificial
  CRISPR gRNA sequence
aatatgaactctgcaatagg

SEQ ID NO: 608920 - DNA, 20 bp, Artificial
  CRISPR gRNA sequence
attaatctaacaactgaata

SEQ ID NO: 608921 - DNA, 20 bp, Artificial
  CRISPR gRNA sequence
acaactgaatatagatgaat

SEQ ID NO: 608922 - DNA, 20 bp, Artificial
  CRISPR gRNA sequence
caactgaatatagatgaatt

SEQ ID NO: 608923 - DNA, 20 bp, Artificial
  CRISPR gRNA sequence
aactgaatatagatgaattg

SEQ ID NO: 608924 - DNA, 20 bp, Artificial
  CRISPR gRNA sequence
actgaatatagatgaattgg

SEQ ID NO: 608925 - DNA, 20 bp, Artificial
  CRISPR gRNA sequence
tgaatatagatgaattgggg

SEQ ID NO: 608926 - DNA, 20 bp, Artificial
  CRISPR gRNA sequence
atatagatgaattgggggag

SEQ ID NO: 608927 - DNA, 20 bp, Artificial
  CRISPR gRNA sequence
atagatgaattgggggagaa

SEQ ID NO: 608928 - DNA, 20 bp, Artificial
  CRISPR gRNA sequence
tgaattgggggagaagagtg

SEQ ID NO: 608929 - DNA, 20 bp, Artificial
  CRISPR gRNA sequence
gggggagaagagtgtggcaa

SEQ ID NO: 608930 - DNA, 20 bp, Artificial
  CRISPR gRNA sequence
aagagtgtggcaaaagtttg

SEQ ID NO: 608931 - DNA, 20 bp, Artificial
  CRISPR gRNA sequence
agagtgtggcaaaagtttga

SEQ ID NO: 608932 - DNA, 20 bp, Artificial
  CRISPR gRNA sequence
tgtggcaaaagtttgaagga

SEQ ID NO: 608933 - DNA, 20 bp, Artificial
  CRISPR gRNA sequence
tggcaaaagtttgaaggaaa

SEQ ID NO: 608934 - DNA, 20 bp, Artificial
  CRISPR gRNA sequence
aaagtttgaaggaaagagac

SEQ ID NO: 608935 - DNA, 20 bp, Artificial
  CRISPR gRNA sequence
tttgaaggaaagagaccagt

SEQ ID NO: 608936 - DNA, 20 bp, Artificial
  CRISPR gRNA sequence
aaggaaagagaccagttaga

SEQ ID NO: 608937 - DNA, 20 bp, Artificial
  CRISPR gRNA sequence
gaaagtttctgatattgttc

SEQ ID NO: 608938 - DNA, 20 bp, Artificial
  CRISPR gRNA sequence
aaagtttctgatattgttcc

SEQ ID NO: 608939 - DNA, 20 bp, Artificial
  CRISPR gRNA sequence
tttctgatattgttccaggt

SEQ ID NO: 608940 - DNA, 20 bp, Artificial
  CRISPR gRNA sequence
tctgatattgttccaggtga

SEQ ID NO: 608941 - DNA, 20 bp, Artificial
  CRISPR gRNA sequence
ctgatattgttccaggtgag

SEQ ID NO: 608942 - DNA, 20 bp, Artificial
  CRISPR gRNA sequence
ttgttccaggtgagaggtca

SEQ ID NO: 608943 - DNA, 20 bp, Artificial
  CRISPR gRNA sequence
tgttccaggtgagaggtcat

SEQ ID NO: 608944 - DNA, 20 bp, Artificial
  CRISPR gRNA sequence
gttccaggtgagaggtcatg

SEQ ID NO: 608945 - DNA, 20 bp, Artificial
  CRISPR gRNA sequence
gagaggtcatggggatctta

SEQ ID NO: 608946 - DNA, 20 bp, Artificial
  CRISPR gRNA sequence
aggtcatggggatcttaaag

SEQ ID NO: 608947 - DNA, 20 bp, Artificial
  CRISPR gRNA sequence
ttaaagtagttgtattgccc

SEQ ID NO: 608948 - DNA, 20 bp, Artificial
  CRISPR gRNA sequence
aagtagttgtattgcccaag

SEQ ID NO: 608949 - DNA, 20 bp, Artificial
  CRISPR gRNA sequence
tgcccaagaagatgcaaaaa

SEQ ID NO: 608950 - DNA, 20 bp, Artificial
  CRISPR gRNA sequence
agatgcaaaaacagatgtgc

SEQ ID NO: 608951 - DNA, 20 bp, Artificial
  CRISPR gRNA sequence
aaaaacagatgtgcaagaca

SEQ ID NO: 608952 - DNA, 20 bp, Artificial
  CRISPR gRNA sequence
aacagatgtgcaagacatag

SEQ ID NO: 608953 - DNA, 20 bp, Artificial
  CRISPR gRNA sequence
catagaagatattgaacctt

SEQ ID NO: 608954 - DNA, 20 bp, Artificial
  CRISPR gRNA sequence
atagaagatattgaaccttt

SEQ ID NO: 608955 - DNA, 20 bp, Artificial
  CRISPR gRNA sequence
gatattgaacctttaggact

SEQ ID NO: 608956 - DNA, 20 bp, Artificial
  CRISPR gRNA sequence
caaatgaaatcattcatcga

SEQ ID NO: 608957 - DNA, 20 bp, Artificial
  CRISPR gRNA sequence
aaatgaaatcattcatcgaa

SEQ ID NO: 608958 - DNA, 20 bp, Artificial
  CRISPR gRNA sequence
gaaatcattcatcgaaaggt

SEQ ID NO: 608959 - DNA, 20 bp, Artificial
  CRISPR gRNA sequence
attcatcgaaaggttggata

SEQ ID NO: 608960 - DNA, 20 bp, Artificial
  CRISPR gRNA sequence
ttcatcgaaaggttggataa

SEQ ID NO: 608961 - DNA, 20 bp, Artificial
  CRISPR gRNA sequence
tcatcgaaaggttggataaa

SEQ ID NO: 608962 - DNA, 20 bp, Artificial
  CRISPR gRNA sequence
cgaaaggttggataaaggga

SEQ ID NO: 608963 - DNA, 20 bp, Artificial
  CRISPR gRNA sequence
taaagggatagactgctgtt

SEQ ID NO: 608964 - DNA, 20 bp, Artificial
  CRISPR gRNA sequence
ggatagactgctgtttggct

SEQ ID NO: 608965 - DNA, 20 bp, Artificial
  CRISPR gRNA sequence
gatagactgctgtttggctg

SEQ ID NO: 608966 - DNA, 20 bp, Artificial
  CRISPR gRNA sequence
ggctgaggcatttctattta

SEQ ID NO: 608967 - DNA, 20 bp, Artificial
  CRISPR gRNA sequence
tgaggcatttctatttaaag

SEQ ID NO: 608968 - DNA, 20 bp, Artificial
  CRISPR gRNA sequence
gaggcatttctatttaaagt

SEQ ID NO: 608969 - DNA, 20 bp, Artificial
  CRISPR gRNA sequence
attgtataattctcatgaac

SEQ ID NO: 608970 - DNA, 20 bp, Artificial
  CRISPR gRNA sequence
actagttgtccgccaaaaaa

SEQ ID NO: 608971 - DNA, 20 bp, Artificial
  CRISPR gRNA sequence
aaaaatagaaactccgtctg

SEQ ID NO: 608972 - DNA, 20 bp, Artificial
  CRISPR gRNA sequence
aaaatagaaactccgtctgt

SEQ ID NO: 608973 - DNA, 20 bp, Artificial
  CRISPR gRNA sequence
actccgtctgtgggccacaa

SEQ ID NO: 608974 - DNA, 20 bp, Artificial
  CRISPR gRNA sequence
ccacaatggtgctactgtgt

SEQ ID NO: 608975 - DNA, 20 bp, Artificial
  CRISPR gRNA sequence
tgctactgtgttagctaata

SEQ ID NO: 608976 - DNA, 20 bp, Artificial
  CRISPR gRNA sequence
gctactgtgttagctaataa

SEQ ID NO: 608977 - DNA, 20 bp, Artificial
  CRISPR gRNA sequence
tgatgatgtgcacgctatac

SEQ ID NO: 608978 - DNA, 20 bp, Artificial
  CRISPR gRNA sequence
gatgatgtgcacgctataca

SEQ ID NO: 608979 - DNA, 20 bp, Artificial
  CRISPR gRNA sequence
gcacgctatacaaggtttca

SEQ ID NO: 608980 - DNA, 20 bp, Artificial
  CRISPR gRNA sequence
acgctatacaaggtttcatg

SEQ ID NO: 608981 - DNA, 20 bp, Artificial
  CRISPR gRNA sequence
acaaggtttcatggagtgtg

SEQ ID NO: 608982 - DNA, 20 bp, Artificial
  CRISPR gRNA sequence
caaggtttcatggagtgtgc

SEQ ID NO: 608983 - DNA, 20 bp, Artificial
  CRISPR gRNA sequence
catggagtgtgcaggatcat

SEQ ID NO: 608984 - DNA, 20 bp, Artificial
  CRISPR gRNA sequence
atggagtgtgcaggatcatc

SEQ ID NO: 608985 - DNA, 20 bp, Artificial
  CRISPR gRNA sequence
gagtgtgcaggatcatcagg

SEQ ID NO: 608986 - DNA, 20 bp, Artificial
  CRISPR gRNA sequence
gtgcaggatcatcaggaagt

SEQ ID NO: 608987 - DNA, 20 bp, Artificial
  CRISPR gRNA sequence
tttacattttttttccatga

SEQ ID NO: 608988 - DNA, 20 bp, Artificial
  CRISPR gRNA sequence
acattttttttccatgaaag

SEQ ID NO: 608989 - DNA, 20 bp, Artificial
  CRISPR gRNA sequence
cattttttttccatgaaagt

SEQ ID NO: 608990 - DNA, 20 bp, Artificial
  CRISPR gRNA sequence
attttttttccatgaaagta

SEQ ID NO: 608991 - DNA, 20 bp, Artificial
  CRISPR gRNA sequence
tttttttccatgaaagtagg

SEQ ID NO: 608992 - DNA, 20 bp, Artificial
  CRISPR gRNA sequence
ttttttccatgaaagtaggg

SEQ ID NO: 608993 - DNA, 20 bp, Artificial
  CRISPR gRNA sequence
aaagtagggaggaaactttt

SEQ ID NO: 608994 - DNA, 20 bp, Artificial
  CRISPR gRNA sequence
ttggtctttattttgttgcc

SEQ ID NO: 608995 - DNA, 20 bp, Artificial
  CRISPR gRNA sequence
tgccaagatctgtttaaatg

SEQ ID NO: 608996 - DNA, 20 bp, Artificial
  CRISPR gRNA sequence
aattctacattaccaactca

SEQ ID NO: 608997 - DNA, 20 bp, Artificial
  CRISPR gRNA sequence
attctacattaccaactcac

SEQ ID NO: 608998 - DNA, 20 bp, Artificial
  CRISPR gRNA sequence
tttatatcaataattgacac

SEQ ID NO: 608999 - DNA, 20 bp, Artificial
  CRISPR gRNA sequence
actgtcaaaacttgaccaca

SEQ ID NO: 609000 - DNA, 20 bp, Artificial
  CRISPR gRNA sequence
ctgtcaaaacttgaccacaa

SEQ ID NO: 609001 - DNA, 20 bp, Artificial
  CRISPR gRNA sequence
tgctatccttcataaactat

SEQ ID NO: 609002 - DNA, 20 bp, Artificial
  CRISPR gRNA sequence
tccttcataaactattggtt

SEQ ID NO: 609003 - DNA, 20 bp, Artificial
  CRISPR gRNA sequence
cttcataaactattggttta

SEQ ID NO: 609004 - DNA, 20 bp, Artificial
  CRISPR gRNA sequence
aacctaccaccgataattca

SEQ ID NO: 609005 - DNA, 20 bp, Artificial
  CRISPR gRNA sequence
ctaccaccgataattcatag

SEQ ID NO: 609006 - DNA, 20 bp, Artificial
  CRISPR gRNA sequence
taccaccgataattcatagc

SEQ ID NO: 609007 - DNA, 20 bp, Artificial
  CRISPR gRNA sequence
ccgataattcatagcaggac

SEQ ID NO: 609008 - DNA, 20 bp, Artificial
  CRISPR gRNA sequence
cgataattcatagcaggaca

SEQ ID NO: 609009 - DNA, 20 bp, Artificial
  CRISPR gRNA sequence
ataattcatagcaggacaag

SEQ ID NO: 609010 - DNA, 20 bp, Artificial
  CRISPR gRNA sequence
tcatagcaggacaaggagta

SEQ ID NO: 609011 - DNA, 20 bp, Artificial
  CRISPR gRNA sequence
agaaattaatgttaaaaaaa

SEQ ID NO: 609012 - DNA, 20 bp, Artificial
  CRISPR gRNA sequence
aaattaatgttaaaaaaata

SEQ ID NO: 609013 - DNA, 20 bp, Artificial
  CRISPR gRNA sequence
attaatgttaaaaaaataga

SEQ ID NO: 609014 - DNA, 20 bp, Artificial
  CRISPR gRNA sequence
ttaatgttaaaaaaatagag

SEQ ID NO: 609015 - DNA, 20 bp, Artificial
  CRISPR gRNA sequence
aatgttaaaaaaatagagag

SEQ ID NO: 609016 - DNA, 20 bp, Artificial
  CRISPR gRNA sequence
atgttaaaaaaatagagagg

SEQ ID NO: 609017 - DNA, 20 bp, Artificial
  CRISPR gRNA sequence
gttaaaaaaatagagaggag

SEQ ID NO: 609018 - DNA, 20 bp, Artificial
  CRISPR gRNA sequence
ttaaaaaaatagagaggagg

SEQ ID NO: 609019 - DNA, 20 bp, Artificial
  CRISPR gRNA sequence
aaaatagagaggaggaggaa

SEQ ID NO: 609020 - DNA, 20 bp, Artificial
  CRISPR gRNA sequence
aggaaaagattgaatattga

SEQ ID NO: 609021 - DNA, 20 bp, Artificial
  CRISPR gRNA sequence
ttgaatattgacagattctt

SEQ ID NO: 609022 - DNA, 20 bp, Artificial
  CRISPR gRNA sequence
ttgacagattcttcagcaac

SEQ ID NO: 609023 - DNA, 20 bp, Artificial
  CRISPR gRNA sequence
tgacagattcttcagcaact

SEQ ID NO: 609024 - DNA, 20 bp, Artificial
  CRISPR gRNA sequence
cagcaactaggtgtactgca

SEQ ID NO: 609025 - DNA, 20 bp, Artificial
  CRISPR gRNA sequence
catggacatacccttgacaa

SEQ ID NO: 609026 - DNA, 20 bp, Artificial
  CRISPR gRNA sequence
acatacccttgacaacagca

SEQ ID NO: 609027 - DNA, 20 bp, Artificial
  CRISPR gRNA sequence
aaagcaaattttaaaattat

SEQ ID NO: 609028 - DNA, 20 bp, Artificial
  CRISPR gRNA sequence
aagcaaattttaaaattatg

SEQ ID NO: 609029 - DNA, 20 bp, Artificial
  CRISPR gRNA sequence
caaattttaaaattatgagg

SEQ ID NO: 609030 - DNA, 20 bp, Artificial
  CRISPR gRNA sequence
aattatgaggtagttgtttt

SEQ ID NO: 609031 - DNA, 20 bp, Artificial
  CRISPR gRNA sequence
atgaggtagttgttttgagt

SEQ ID NO: 609032 - DNA, 20 bp, Artificial
  CRISPR gRNA sequence
tttgagtgagacatgcatcc

SEQ ID NO: 609033 - DNA, 20 bp, Artificial
  CRISPR gRNA sequence
gacatgcatcccagttttga

SEQ ID NO: 609034 - DNA, 20 bp, Artificial
  CRISPR gRNA sequence
tgcatcccagttttgataga

SEQ ID NO: 609035 - DNA, 20 bp, Artificial
  CRISPR gRNA sequence
gatagaaagtcataattcaa

SEQ ID NO: 609036 - DNA, 20 bp, Artificial
  CRISPR gRNA sequence
aaagtcataattcaatagtt

SEQ ID NO: 609037 - DNA, 20 bp, Artificial
  CRISPR gRNA sequence
taattcaatagtttggttta

SEQ ID NO: 609038 - DNA, 20 bp, Artificial
  CRISPR gRNA sequence
catttctttatctgaccatt

SEQ ID NO: 609039 - DNA, 20 bp, Artificial
  CRISPR gRNA sequence
atttctttatctgaccattc

SEQ ID NO: 609040 - DNA, 20 bp, Artificial
  CRISPR gRNA sequence
tatctgaccattcgggactt

SEQ ID NO: 609041 - DNA, 20 bp, Artificial
  CRISPR gRNA sequence
ccattcgggacttaagtttc

SEQ ID NO: 609042 - DNA, 20 bp, Artificial
  CRISPR gRNA sequence
tttctggtatcctcttcaac

SEQ ID NO: 609043 - DNA, 20 bp, Artificial
  CRISPR gRNA sequence
ctggtatcctcttcaactgg

SEQ ID NO: 609044 - DNA, 20 bp, Artificial
  CRISPR gRNA sequence
tcctcttcaactggtggaca

SEQ ID NO: 609045 - DNA, 20 bp, Artificial
  CRISPR gRNA sequence
aactggtggacatagtttta

SEQ ID NO: 609046 - DNA, 20 bp, Artificial
  CRISPR gRNA sequence
catagttttacagctaccgt

SEQ ID NO: 609047 - DNA, 20 bp, Artificial
  CRISPR gRNA sequence
cctaaatataatactaatgt

SEQ ID NO: 609048 - DNA, 20 bp, Artificial
  CRISPR gRNA sequence
atgtaagttacttgtttcat

SEQ ID NO: 609049 - DNA, 20 bp, Artificial
  CRISPR gRNA sequence
gtaagttacttgtttcattg

SEQ ID NO: 609050 - DNA, 20 bp, Artificial
  CRISPR gRNA sequence
aagttacttgtttcattgga

SEQ ID NO: 609051 - DNA, 20 bp, Artificial
  CRISPR gRNA sequence
tacttgtttcattggagagc

SEQ ID NO: 609052 - DNA, 20 bp, Artificial
  CRISPR gRNA sequence
ggagagccagtatcatgtca

SEQ ID NO: 609053 - DNA, 20 bp, Artificial
  CRISPR gRNA sequence
gagccagtatcatgtcatag

SEQ ID NO: 609054 - DNA, 20 bp, Artificial
  CRISPR gRNA sequence
agccagtatcatgtcataga

SEQ ID NO: 609055 - DNA, 20 bp, Artificial
  CRISPR gRNA sequence
agtatcatgtcatagaagga

SEQ ID NO: 609056 - DNA, 20 bp, Artificial
  CRISPR gRNA sequence
tcatgtcatagaaggatgga

SEQ ID NO: 609057 - DNA, 20 bp, Artificial
  CRISPR gRNA sequence
catgtcatagaaggatggat

SEQ ID NO: 609058 - DNA, 20 bp, Artificial
  CRISPR gRNA sequence
tagaaggatggataggctac

SEQ ID NO: 609059 - DNA, 20 bp, Artificial
  CRISPR gRNA sequence
atggataggctacgagtcaa

SEQ ID NO: 609060 - DNA, 20 bp, Artificial
  CRISPR gRNA sequence
aaagatcttgaattgatatc

SEQ ID NO: 609061 - DNA, 20 bp, Artificial
  CRISPR gRNA sequence
actaacttgtatcctttcaa

SEQ ID NO: 609062 - DNA, 20 bp, Artificial
  CRISPR gRNA sequence
gccacttaacaaccatgctt

SEQ ID NO: 609063 - DNA, 20 bp, Artificial
  CRISPR gRNA sequence
catgcttcagtgtttatctg

SEQ ID NO: 609064 - DNA, 20 bp, Artificial
  CRISPR gRNA sequence
tggctacccttcctacaatg

SEQ ID NO: 609065 - DNA, 20 bp, Artificial
  CRISPR gRNA sequence
tcctacaatgcagtcattct

SEQ ID NO: 609066 - DNA, 20 bp, Artificial
  CRISPR gRNA sequence
agtcattctgagtatcaaaa

SEQ ID NO: 609067 - DNA, 20 bp, Artificial
  CRISPR gRNA sequence
agtatcaaaaaagaatatgt

SEQ ID NO: 609068 - DNA, 20 bp, Artificial
  CRISPR gRNA sequence
atcattactattatcattaa

SEQ ID NO: 609069 - DNA, 20 bp, Artificial
  CRISPR gRNA sequence
tcattactattatcattaaa

SEQ ID NO: 609070 - DNA, 20 bp, Artificial
  CRISPR gRNA sequence
ttaaaaggattctaaatctg

SEQ ID NO: 609071 - DNA, 20 bp, Artificial
  CRISPR gRNA sequence
attctaaatctgtagtctac

SEQ ID NO: 609072 - DNA, 20 bp, Artificial
  CRISPR gRNA sequence
tctaaatctgtagtctacca

SEQ ID NO: 609073 - DNA, 20 bp, Artificial
  CRISPR gRNA sequence
ctaccagagattattttatc

SEQ ID NO: 609074 - DNA, 20 bp, Artificial
  CRISPR gRNA sequence
tttatctagcctgctgtttt

SEQ ID NO: 609075 - DNA, 20 bp, Artificial
  CRISPR gRNA sequence
ctgctgttttcagaaacatc

SEQ ID NO: 609076 - DNA, 20 bp, Artificial
  CRISPR gRNA sequence
tgttatttccccccatattt

SEQ ID NO: 609077 - DNA, 20 bp, Artificial
  CRISPR gRNA sequence
atttccccccatattttaga

SEQ ID NO: 609078 - DNA, 20 bp, Artificial
  CRISPR gRNA sequence
ccccatattttagatggtac

SEQ ID NO: 609079 - DNA, 20 bp, Artificial
  CRISPR gRNA sequence
catattttagatggtactag

SEQ ID NO: 609080 - DNA, 20 bp, Artificial
  CRISPR gRNA sequence
tttagatggtactagtggct

SEQ ID NO: 609081 - DNA, 20 bp, Artificial
  CRISPR gRNA sequence
gatggtactagtggctgagt

SEQ ID NO: 609082 - DNA, 20 bp, Artificial
  CRISPR gRNA sequence
atggtactagtggctgagtc

SEQ ID NO: 609083 - DNA, 20 bp, Artificial
  CRISPR gRNA sequence
tcaggataaacaaatttccc

SEQ ID NO: 609084 - DNA, 20 bp, Artificial
  CRISPR gRNA sequence
caggataaacaaatttccca

SEQ ID NO: 609085 - DNA, 20 bp, Artificial
  CRISPR gRNA sequence
atttcccaaggtcccataac

SEQ ID NO: 609086 - DNA, 20 bp, Artificial
  CRISPR gRNA sequence
aggtcccataacaagttaaa

SEQ ID NO: 609087 - DNA, 20 bp, Artificial
  CRISPR gRNA sequence
tcccataacaagttaaatgg

SEQ ID NO: 609088 - DNA, 20 bp, Artificial
  CRISPR gRNA sequence
cataacaagttaaatggcag

SEQ ID NO: 609089 - DNA, 20 bp, Artificial
  CRISPR gRNA sequence
taacaagttaaatggcagaa

SEQ ID NO: 609090 - DNA, 20 bp, Artificial
  CRISPR gRNA sequence
aacaagttaaatggcagaag

SEQ ID NO: 609091 - DNA, 20 bp, Artificial
  CRISPR gRNA sequence
aagttaaatggcagaagagg

SEQ ID NO: 609092 - DNA, 20 bp, Artificial
  CRISPR gRNA sequence
ttaaatggcagaagaggtgg

SEQ ID NO: 609093 - DNA, 20 bp, Artificial
  CRISPR gRNA sequence
aaatggcagaagaggtggta

SEQ ID NO: 609094 - DNA, 20 bp, Artificial
  CRISPR gRNA sequence
agaagaggtggtagagaccc

SEQ ID NO: 609095 - DNA, 20 bp, Artificial
  CRISPR gRNA sequence
agaccctggttttctgcctt

SEQ ID NO: 609096 - DNA, 20 bp, Artificial
  CRISPR gRNA sequence
gaccctggttttctgccttc

SEQ ID NO: 609097 - DNA, 20 bp, Artificial
  CRISPR gRNA sequence
tggttttctgccttcaggtg

SEQ ID NO: 609098 - DNA, 20 bp, Artificial
  CRISPR gRNA sequence
ggttttctgccttcaggtgc

SEQ ID NO: 609099 - DNA, 20 bp, Artificial
  CRISPR gRNA sequence
gttttctgccttcaggtgca

SEQ ID NO: 609100 - DNA, 20 bp, Artificial
  CRISPR gRNA sequence
taactttactacactattgt

SEQ ID NO: 609101 - DNA, 20 bp, Artificial
  CRISPR gRNA sequence
cactattgttggaataataa

SEQ ID NO: 609102 - DNA, 20 bp, Artificial
  CRISPR gRNA sequence
ttggaataataacagtattt

SEQ ID NO: 609103 - DNA, 20 bp, Artificial
  CRISPR gRNA sequence
aataacagtatttcagaaat

SEQ ID NO: 609104 - DNA, 20 bp, Artificial
  CRISPR gRNA sequence
aaatcagtactgtcttgatc

SEQ ID NO: 609105 - DNA, 20 bp, Artificial
  CRISPR gRNA sequence
atcagtactgtcttgatctg

SEQ ID NO: 609106 - DNA, 20 bp, Artificial
  CRISPR gRNA sequence
gtcttgatctggagtaactc

SEQ ID NO: 609107 - DNA, 20 bp, Artificial
  CRISPR gRNA sequence
ttgatctggagtaactccag

SEQ ID NO: 609108 - DNA, 20 bp, Artificial
  CRISPR gRNA sequence
tgatctggagtaactccagt

SEQ ID NO: 609109 - DNA, 20 bp, Artificial
  CRISPR gRNA sequence
ggagtaactccagtgggttt

SEQ ID NO: 609110 - DNA, 20 bp, Artificial
  CRISPR gRNA sequence
ggtttaagaaatacataata

SEQ ID NO: 609111 - DNA, 20 bp, Artificial
  CRISPR gRNA sequence
cataatatagctatattgaa

SEQ ID NO: 609112 - DNA, 20 bp, Artificial
  CRISPR gRNA sequence
taatatagctatattgaaca

SEQ ID NO: 609113 - DNA, 20 bp, Artificial
  CRISPR gRNA sequence
tatagctatattgaacagag

SEQ ID NO: 609114 - DNA, 20 bp, Artificial
  CRISPR gRNA sequence
gctatattgaacagagaaga

SEQ ID NO: 609115 - DNA, 20 bp, Artificial
  CRISPR gRNA sequence
tatattgaacagagaagaaa

SEQ ID NO: 609116 - DNA, 20 bp, Artificial
  CRISPR gRNA sequence
atattgaacagagaagaaag

SEQ ID NO: 609117 - DNA, 20 bp, Artificial
  CRISPR gRNA sequence
tgaacagagaagaaagagga

SEQ ID NO: 609118 - DNA, 20 bp, Artificial
  CRISPR gRNA sequence
aacagagaagaaagaggatg

SEQ ID NO: 609119 - DNA, 20 bp, Artificial
  CRISPR gRNA sequence
cagagaagaaagaggatgga

SEQ ID NO: 609120 - DNA, 20 bp, Artificial
  CRISPR gRNA sequence
aagaaagaggatggagagaa

SEQ ID NO: 609121 - DNA, 20 bp, Artificial
  CRISPR gRNA sequence
aagaggatggagagaaaagt

SEQ ID NO: 609122 - DNA, 20 bp, Artificial
  CRISPR gRNA sequence
agaggatggagagaaaagtg

SEQ ID NO: 609123 - DNA, 20 bp, Artificial
  CRISPR gRNA sequence
aagtgaggtgatgtgatata

SEQ ID NO: 609124 - DNA, 20 bp, Artificial
  CRISPR gRNA sequence
ggtgatgtgatatacagatt

SEQ ID NO: 609125 - DNA, 20 bp, Artificial
  CRISPR gRNA sequence
tacagatttagaatgctacc

SEQ ID NO: 609126 - DNA, 20 bp, Artificial
  CRISPR gRNA sequence
agatttagaatgctacccag

SEQ ID NO: 609127 - DNA, 20 bp, Artificial
  CRISPR gRNA sequence
tttagaatgctacccagaag

SEQ ID NO: 609128 - DNA, 20 bp, Artificial
  CRISPR gRNA sequence
aatgctacccagaagtggct

SEQ ID NO: 609129 - DNA, 20 bp, Artificial
  CRISPR gRNA sequence
acccagaagtggctcagctg

SEQ ID NO: 609130 - DNA, 20 bp, Artificial
  CRISPR gRNA sequence
gaagtggctcagctgcagct

SEQ ID NO: 609131 - DNA, 20 bp, Artificial
  CRISPR gRNA sequence
cagctgcagctcagtgacac

SEQ ID NO: 609132 - DNA, 20 bp, Artificial
  CRISPR gRNA sequence
agctcagtgacaccagtgtc

SEQ ID NO: 609133 - DNA, 20 bp, Artificial
  CRISPR gRNA sequence
gtttataaaacaaattcttt

SEQ ID NO: 609134 - DNA, 20 bp, Artificial
  CRISPR gRNA sequence
tttataaaacaaattcttta

SEQ ID NO: 609135 - DNA, 20 bp, Artificial
  CRISPR gRNA sequence
aattctttaaggatgttgtg

SEQ ID NO: 609136 - DNA, 20 bp, Artificial
  CRISPR gRNA sequence
ttgtgaagaaactgtttttc

SEQ ID NO: 609137 - DNA, 20 bp, Artificial
  CRISPR gRNA sequence
ctcatccatttatttatcca

SEQ ID NO: 609138 - DNA, 20 bp, Artificial
  CRISPR gRNA sequence
atttatttatccacagtcaa

SEQ ID NO: 609139 - DNA, 20 bp, Artificial
  CRISPR gRNA sequence
tttatttatccacagtcaaa

SEQ ID NO: 609140 - DNA, 20 bp, Artificial
  CRISPR gRNA sequence
acattgcatgaaattttgct

SEQ ID NO: 609141 - DNA, 20 bp, Artificial
  CRISPR gRNA sequence
cattgcatgaaattttgctg

SEQ ID NO: 609142 - DNA, 20 bp, Artificial
  CRISPR gRNA sequence
gattgcatatacctttgttg

SEQ ID NO: 609143 - DNA, 20 bp, Artificial
  CRISPR gRNA sequence
gtggttttactttaattgtt

SEQ ID NO: 609144 - DNA, 20 bp, Artificial
  CRISPR gRNA sequence
actttaattgtttagactgt

SEQ ID NO: 609145 - DNA, 20 bp, Artificial
  CRISPR gRNA sequence
ttagactgttggtaaattct

SEQ ID NO: 609146 - DNA, 20 bp, Artificial
  CRISPR gRNA sequence
gtaaattcttagtaaataat

SEQ ID NO: 609147 - DNA, 20 bp, Artificial
  CRISPR gRNA sequence
taaattcttagtaaataatt

SEQ ID NO: 609148 - DNA, 20 bp, Artificial
  CRISPR gRNA sequence
aataattgggctttacatca

SEQ ID NO: 609149 - DNA, 20 bp, Artificial
  CRISPR gRNA sequence
ggctttacatcacagttttg

SEQ ID NO: 609150 - DNA, 20 bp, Artificial
  CRISPR gRNA sequence
gctttacatcacagttttga

SEQ ID NO: 609151 - DNA, 20 bp, Artificial
  CRISPR gRNA sequence
ttcctaacacattatttaaa

SEQ ID NO: 609152 - DNA, 20 bp, Artificial
  CRISPR gRNA sequence
cacattatttaaacagctgt

SEQ ID NO: 609153 - DNA, 20 bp, Artificial
  CRISPR gRNA sequence
acattatttaaacagctgtt

SEQ ID NO: 609154 - DNA, 20 bp, Artificial
  CRISPR gRNA sequence
cagctgttgggatattaaca

SEQ ID NO: 609155 - DNA, 20 bp, Artificial
  CRISPR gRNA sequence
aacatggatttaatcatgtt

SEQ ID NO: 609156 - DNA, 20 bp, Artificial
  CRISPR gRNA sequence
tcatgtttggtgtttctgtt

SEQ ID NO: 609157 - DNA, 20 bp, Artificial
  CRISPR gRNA sequence
gtttggtgtttctgtttaga

SEQ ID NO: 609158 - DNA, 20 bp, Artificial
  CRISPR gRNA sequence
tctgtttagaaagtttacgt

SEQ ID NO: 609159 - DNA, 20 bp, Artificial
  CRISPR gRNA sequence
tgtttagaaagtttacgtga

SEQ ID NO: 609160 - DNA, 20 bp, Artificial
  CRISPR gRNA sequence
tttagaaagtttacgtgaga

SEQ ID NO: 609161 - DNA, 20 bp, Artificial
  CRISPR gRNA sequence
tagaaagtttacgtgagaga

SEQ ID NO: 609162 - DNA, 20 bp, Artificial
  CRISPR gRNA sequence
tacgtgagagagagttatat

SEQ ID NO: 609163 - DNA, 20 bp, Artificial
  CRISPR gRNA sequence
gagagagagttatattagtg

SEQ ID NO: 609164 - DNA, 20 bp, Artificial
  CRISPR gRNA sequence
agagagttatattagtgtag

SEQ ID NO: 609165 - DNA, 20 bp, Artificial
  CRISPR gRNA sequence
aagcaacttcaataaattat

SEQ ID NO: 609166 - DNA, 20 bp, Artificial
  CRISPR gRNA sequence
aacttcaataaattattaga

SEQ ID NO: 609167 - DNA, 20 bp, Artificial
  CRISPR gRNA sequence
aaattattagatagccatat

SEQ ID NO: 609168 - DNA, 20 bp, Artificial
  CRISPR gRNA sequence
gatagccatattggttcaat

SEQ ID NO: 609169 - DNA, 20 bp, Artificial
  CRISPR gRNA sequence
agtgtatataacaccatttc

SEQ ID NO: 609170 - DNA, 20 bp, Artificial
  CRISPR gRNA sequence
ataacaccatttcaagtgtc

SEQ ID NO: 609171 - DNA, 20 bp, Artificial
  CRISPR gRNA sequence
accatttcaagtgtctggca

SEQ ID NO: 609172 - DNA, 20 bp, Artificial
  CRISPR gRNA sequence
ttcaagtgtctggcatagac

SEQ ID NO: 609173 - DNA, 20 bp, Artificial
  CRISPR gRNA sequence
tcaagtgtctggcatagact

SEQ ID NO: 609174 - DNA, 20 bp, Artificial
  CRISPR gRNA sequence
tgggaaatgttcatgcttat

SEQ ID NO: 609175 - DNA, 20 bp, Artificial
  CRISPR gRNA sequence
tataagttataaaatccctt

SEQ ID NO: 609176 - DNA, 20 bp, Artificial
  CRISPR gRNA sequence
taagtgcccacttgaattgc

SEQ ID NO: 609177 - DNA, 20 bp, Artificial
  CRISPR gRNA sequence
aagtgcccacttgaattgcc

SEQ ID NO: 609178 - DNA, 20 bp, Artificial
  CRISPR gRNA sequence
agtgcccacttgaattgcca

SEQ ID NO: 609179 - DNA, 20 bp, Artificial
  CRISPR gRNA sequence
ccacttgaattgccagggaa

SEQ ID NO: 609180 - DNA, 20 bp, Artificial
  CRISPR gRNA sequence
acagaaaccaaccatataaa

SEQ ID NO: 609181 - DNA, 20 bp, Artificial
  CRISPR gRNA sequence
gaaatacactttttttcatt

SEQ ID NO: 609182 - DNA, 20 bp, Artificial
  CRISPR gRNA sequence
tacactttttttcatttggt

SEQ ID NO: 609183 - DNA, 20 bp, Artificial
  CRISPR gRNA sequence
ctttttttcatttggtaagt

SEQ ID NO: 609184 - DNA, 20 bp, Artificial
  CRISPR gRNA sequence
tttcatttggtaagtaagaa

SEQ ID NO: 609185 - DNA, 20 bp, Artificial
  CRISPR gRNA sequence
taaaattaaaatatacactt

SEQ ID NO: 609186 - DNA, 20 bp, Artificial
  CRISPR gRNA sequence
tttggcaactaaacaaaaat

SEQ ID NO: 609187 - DNA, 20 bp, Artificial
  CRISPR gRNA sequence
aaaataagtcaccaatttca

SEQ ID NO: 609188 - DNA, 20 bp, Artificial
  CRISPR gRNA sequence
caatttcatagaaattaaac

SEQ ID NO: 609189 - DNA, 20 bp, Artificial
  CRISPR gRNA sequence
ttcatagaaattaaactaga

SEQ ID NO: 609190 - DNA, 20 bp, Artificial
  CRISPR gRNA sequence
aagcttattttatactctat

SEQ ID NO: 609191 - DNA, 20 bp, Artificial
  CRISPR gRNA sequence
aataaatacatcactttaaa

SEQ ID NO: 609192 - DNA, 20 bp, Artificial
  CRISPR gRNA sequence
taaatacatcactttaaata

SEQ ID NO: 609193 - DNA, 20 bp, Artificial
  CRISPR gRNA sequence
atccctctgcattattttcc

SEQ ID NO: 609194 - DNA, 20 bp, Artificial
  CRISPR gRNA sequence
ctctgcattattttcctggt

SEQ ID NO: 609195 - DNA, 20 bp, Artificial
  CRISPR gRNA sequence
tctgcattattttcctggtt

SEQ ID NO: 609196 - DNA, 20 bp, Artificial
  CRISPR gRNA sequence
aaacttgactaacttgtttg

SEQ ID NO: 609197 - DNA, 20 bp, Artificial
  CRISPR gRNA sequence
tgactaacttgtttgtagat

SEQ ID NO: 609198 - DNA, 20 bp, Artificial
  CRISPR gRNA sequence
ctaacttgtttgtagattag

SEQ ID NO: 609199 - DNA, 20 bp, Artificial
  CRISPR gRNA sequence
tgtttgtagattagtagaat

SEQ ID NO: 609200 - DNA, 20 bp, Artificial
  CRISPR gRNA sequence
gtttgtagattagtagaatc

SEQ ID NO: 609201 - DNA, 20 bp, Artificial
  CRISPR gRNA sequence
atcaggtcatattaataata

SEQ ID NO: 609202 - DNA, 20 bp, Artificial
  CRISPR gRNA sequence
aataataaagttttaacttg

SEQ ID NO: 609203 - DNA, 20 bp, Artificial
  CRISPR gRNA sequence
ataaagttttaacttgtaga

SEQ ID NO: 609204 - DNA, 20 bp, Artificial
  CRISPR gRNA sequence
atgtcttaaattgatatttt

SEQ ID NO: 609205 - DNA, 20 bp, Artificial
  CRISPR gRNA sequence
tcagttctcattactatgta

SEQ ID NO: 609206 - DNA, 20 bp, Artificial
  CRISPR gRNA sequence
attactatgtatggtgtttc

SEQ ID NO: 609207 - DNA, 20 bp, Artificial
  CRISPR gRNA sequence
aacttgacatttaaaaatta

SEQ ID NO: 609208 - DNA, 20 bp, Artificial
  CRISPR gRNA sequence
ttgacatttaaaaattatag

SEQ ID NO: 609209 - DNA, 20 bp, Artificial
  CRISPR gRNA sequence
gaaaataaaattctaatgat

SEQ ID NO: 609210 - DNA, 20 bp, Artificial
  CRISPR gRNA sequence
aaaataaaattctaatgatg

SEQ ID NO: 609211 - DNA, 20 bp, Artificial
  CRISPR gRNA sequence
aaataaaattctaatgatga

SEQ ID NO: 609212 - DNA, 20 bp, Artificial
  CRISPR gRNA sequence
taaaattctaatgatgaggg

SEQ ID NO: 609213 - DNA, 20 bp, Artificial
  CRISPR gRNA sequence
atatatttatcatgcatata

SEQ ID NO: 609214 - DNA, 20 bp, Artificial
  CRISPR gRNA sequence
tcttaaaaattttaaaaatt

SEQ ID NO: 609215 - DNA, 20 bp, Artificial
  CRISPR gRNA sequence
attgagaattcatattattg

SEQ ID NO: 609216 - DNA, 20 bp, Artificial
  CRISPR gRNA sequence
ttattgaagaaataaatttc

SEQ ID NO: 609217 - DNA, 20 bp, Artificial
  CRISPR gRNA sequence
catatgctgtcttgcacaaa

SEQ ID NO: 609218 - DNA, 20 bp, Artificial
  CRISPR gRNA sequence
atatgctgtcttgcacaaat

SEQ ID NO: 609219 - DNA, 20 bp, Artificial
  CRISPR gRNA sequence
cacaaatgggtgactttgtg

SEQ ID NO: 609220 - DNA, 20 bp, Artificial
  CRISPR gRNA sequence
tgggtgactttgtgaagtta

SEQ ID NO: 609221 - DNA, 20 bp, Artificial
  CRISPR gRNA sequence
ttgtgaagttatagcataaa

SEQ ID NO: 609222 - DNA, 20 bp, Artificial
  CRISPR gRNA sequence
tgaagttatagcataaaaag

SEQ ID NO: 609223 - DNA, 20 bp, Artificial
  CRISPR gRNA sequence
ttatagcataaaaagtagta

SEQ ID NO: 609224 - DNA, 20 bp, Artificial
  CRISPR gRNA sequence
aagtagtaaagtaaaatgtc

SEQ ID NO: 609225 - DNA, 20 bp, Artificial
  CRISPR gRNA sequence
agtagtaaagtaaaatgtcc

SEQ ID NO: 609226 - DNA, 20 bp, Artificial
  CRISPR gRNA sequence
agtaaaatgtccaggtttta

SEQ ID NO: 609227 - DNA, 20 bp, Artificial
  CRISPR gRNA sequence
aaaatgtccaggttttaaag

SEQ ID NO: 609228 - DNA, 20 bp, Artificial
  CRISPR gRNA sequence
ttttacatttatatattgtt

SEQ ID NO: 609229 - DNA, 20 bp, Artificial
  CRISPR gRNA sequence
ctaactcatgaactctttta

SEQ ID NO: 609230 - DNA, 20 bp, Artificial
  CRISPR gRNA sequence
aactcttttatggccatttt

SEQ ID NO: 609231 - DNA, 20 bp, Artificial
  CRISPR gRNA sequence
ctcttttatggccatttttg

SEQ ID NO: 609232 - DNA, 20 bp, Artificial
  CRISPR gRNA sequence
tacatactcttgtgttaata

SEQ ID NO: 609233 - DNA, 20 bp, Artificial
  CRISPR gRNA sequence
acatactcttgtgttaatat

SEQ ID NO: 609234 - DNA, 20 bp, Artificial
  CRISPR gRNA sequence
ttaatatgggttacttattt

SEQ ID NO: 609235 - DNA, 20 bp, Artificial
  CRISPR gRNA sequence
gggttacttatttaagttaa

SEQ ID NO: 609236 - DNA, 20 bp, Artificial
  CRISPR gRNA sequence
taatagtattttttttgctt

SEQ ID NO: 609237 - DNA, 20 bp, Artificial
  CRISPR gRNA sequence
ctttactattattattgaca

SEQ ID NO: 609238 - DNA, 20 bp, Artificial
  CRISPR gRNA sequence
tattattattgacaaagtat

SEQ ID NO: 609239 - DNA, 20 bp, Artificial
  CRISPR gRNA sequence
attattattgacaaagtatt

SEQ ID NO: 609240 - DNA, 20 bp, Artificial
  CRISPR gRNA sequence
ttattgacaaagtattaggc

SEQ ID NO: 609241 - DNA, 20 bp, Artificial
  CRISPR gRNA sequence
ttgacaaagtattaggcaag

SEQ ID NO: 609242 - DNA, 20 bp, Artificial
  CRISPR gRNA sequence
acaaagtattaggcaagtag

SEQ ID NO: 609243 - DNA, 20 bp, Artificial
  CRISPR gRNA sequence
gatacttaataaatatttac

SEQ ID NO: 609244 - DNA, 20 bp, Artificial
  CRISPR gRNA sequence
tactggtttaatgatttttt

SEQ ID NO: 609245 - DNA, 20 bp, Artificial
  CRISPR gRNA sequence
ctggtttaatgattttttaa

SEQ ID NO: 609246 - DNA, 20 bp, Artificial
  CRISPR gRNA sequence
aatgattttttaagagaatt

SEQ ID NO: 609247 - DNA, 20 bp, Artificial
  CRISPR gRNA sequence
gtgctgtctttgttctttat

SEQ ID NO: 609248 - DNA, 20 bp, Artificial
  CRISPR gRNA sequence
gtctttgttctttattggct

SEQ ID NO: 609249 - DNA, 20 bp, Artificial
  CRISPR gRNA sequence
tctttgttctttattggcta

SEQ ID NO: 609250 - DNA, 20 bp, Artificial
  CRISPR gRNA sequence
ttgttctttattggctaagg

SEQ ID NO: 609251 - DNA, 20 bp, Artificial
  CRISPR gRNA sequence
ctttattggctaaggtagat

SEQ ID NO: 609252 - DNA, 20 bp, Artificial
  CRISPR gRNA sequence
tgagttctataaatgaatgt

SEQ ID NO: 609253 - DNA, 20 bp, Artificial
  CRISPR gRNA sequence
gagttctataaatgaatgta

SEQ ID NO: 609254 - DNA, 20 bp, Artificial
  CRISPR gRNA sequence
tatccttttcattcttatgt

SEQ ID NO: 609255 - DNA, 20 bp, Artificial
  CRISPR gRNA sequence
ttcttatgtgagtaaaattt

SEQ ID NO: 609256 - DNA, 20 bp, Artificial
  CRISPR gRNA sequence
ttttttttttttactttttc

SEQ ID NO: 609257 - DNA, 20 bp, Artificial
  CRISPR gRNA sequence
ttttactttttcaagtacaa

SEQ ID NO: 609258 - DNA, 20 bp, Artificial
  CRISPR gRNA sequence
tactttttcaagtacaatgg

SEQ ID NO: 609259 - DNA, 20 bp, Artificial
  CRISPR gRNA sequence
tttcaagtacaatggtggca

SEQ ID NO: 609260 - DNA, 20 bp, Artificial
  CRISPR gRNA sequence
atgtccattatgacattgat

SEQ ID NO: 609261 - DNA, 20 bp, Artificial
  CRISPR gRNA sequence
ttaaattaatttgtttttaa

SEQ ID NO: 609262 - DNA, 20 bp, Artificial
  CRISPR gRNA sequence
taacatgattttgctccatt

SEQ ID NO: 609263 - DNA, 20 bp, Artificial
  CRISPR gRNA sequence
gattttgctccatttggttt

SEQ ID NO: 609264 - DNA, 20 bp, Artificial
  CRISPR gRNA sequence
tatacctgtttacctgtgta

SEQ ID NO: 609265 - DNA, 20 bp, Artificial
  CRISPR gRNA sequence
atacctgtttacctgtgtaa

SEQ ID NO: 609266 - DNA, 20 bp, Artificial
  CRISPR gRNA sequence
cctgtgtaaaggcctttatt

SEQ ID NO: 609267 - DNA, 20 bp, Artificial
  CRISPR gRNA sequence
ttatccttttattatcatat

SEQ ID NO: 609268 - DNA, 20 bp, Artificial
  CRISPR gRNA sequence
attatcatattagtgaatta

SEQ ID NO: 609269 - DNA, 20 bp, Artificial
  CRISPR gRNA sequence
ttatcatattagtgaattaa

SEQ ID NO: 609270 - DNA, 20 bp, Artificial
  CRISPR gRNA sequence
catattagtgaattaaaggc

SEQ ID NO: 609271 - DNA, 20 bp, Artificial
  CRISPR gRNA sequence
tagtgaattaaaggcaagtc

SEQ ID NO: 609272 - DNA, 20 bp, Artificial
  CRISPR gRNA sequence
tccattcactattatgtatc

SEQ ID NO: 609273 - DNA, 20 bp, Artificial
  CRISPR gRNA sequence
attcactattatgtatctgg

SEQ ID NO: 609274 - DNA, 20 bp, Artificial
  CRISPR gRNA sequence
tggaagcaatgactattgtg

SEQ ID NO: 609275 - DNA, 20 bp, Artificial
  CRISPR gRNA sequence
tattgtgaagcctttgattg

SEQ ID NO: 609276 - DNA, 20 bp, Artificial
  CRISPR gRNA sequence
ttgtgaagcctttgattgta

SEQ ID NO: 609277 - DNA, 20 bp, Artificial
  CRISPR gRNA sequence
gtgaagcctttgattgtaga

SEQ ID NO: 609278 - DNA, 20 bp, Artificial
  CRISPR gRNA sequence
gcctttgattgtagagagcc

SEQ ID NO: 609279 - DNA, 20 bp, Artificial
  CRISPR gRNA sequence
tgattgtagagagcctagaa

SEQ ID NO: 609280 - DNA, 20 bp, Artificial
  CRISPR gRNA sequence
agagcctagaatggttactg

SEQ ID NO: 609281 - DNA, 20 bp, Artificial
  CRISPR gRNA sequence
gagcctagaatggttactga

SEQ ID NO: 609282 - DNA, 20 bp, Artificial
  CRISPR gRNA sequence
ttttataattgaaaattgtt

SEQ ID NO: 609283 - DNA, 20 bp, Artificial
  CRISPR gRNA sequence
gcttgaaattcactttaaaa

SEQ ID NO: 609284 - DNA, 20 bp, Artificial
  CRISPR gRNA sequence
ttgaaattcactttaaaaaa

SEQ ID NO: 609285 - DNA, 20 bp, Artificial
  CRISPR gRNA sequence
ttaaaaaagagtatctgtgc

SEQ ID NO: 609286 - DNA, 20 bp, Artificial
  CRISPR gRNA sequence
ctttacttcttgtaatttgt

SEQ ID NO: 609287 - DNA, 20 bp, Artificial
  CRISPR gRNA sequence
tacttcttgtaatttgtaag

SEQ ID NO: 609288 - DNA, 20 bp, Artificial
  CRISPR gRNA sequence
gtaagtggaattgcttaaac

SEQ ID NO: 609289 - DNA, 20 bp, Artificial
  CRISPR gRNA sequence
taagtggaattgcttaaact

SEQ ID NO: 609290 - DNA, 20 bp, Artificial
  CRISPR gRNA sequence
gcttaaactaggtgttttta

SEQ ID NO: 609291 - DNA, 20 bp, Artificial
  CRISPR gRNA sequence
ctaggtgtttttatggcatc

SEQ ID NO: 609292 - DNA, 20 bp, Artificial
  CRISPR gRNA sequence
atggcatcaagattacattc

SEQ ID NO: 609293 - DNA, 20 bp, Artificial
  CRISPR gRNA sequence
tacattctagtgtttataaa

SEQ ID NO: 609294 - DNA, 20 bp, Artificial
  CRISPR gRNA sequence
gtttataaatagtattttga

SEQ ID NO: 609295 - DNA, 20 bp, Artificial
  CRISPR gRNA sequence
aatagtattttgaaagcata

SEQ ID NO: 609296 - DNA, 20 bp, Artificial
  CRISPR gRNA sequence
agtattttgaaagcataaag

SEQ ID NO: 609297 - DNA, 20 bp, Artificial
  CRISPR gRNA sequence
attttgaaagcataaagaag

SEQ ID NO: 609298 - DNA, 20 bp, Artificial
  CRISPR gRNA sequence
tttgaaagcataaagaagaa

SEQ ID NO: 609299 - DNA, 20 bp, Artificial
  CRISPR gRNA sequence
ttgaaagcataaagaagaag

SEQ ID NO: 609300 - DNA, 20 bp, Artificial
  CRISPR gRNA sequence
tgaaagcataaagaagaaga

SEQ ID NO: 609301 - DNA, 20 bp, Artificial
  CRISPR gRNA sequence
gaaagcataaagaagaagag

SEQ ID NO: 609302 - DNA, 20 bp, Artificial
  CRISPR gRNA sequence
cataaagaagaagaggggaa

SEQ ID NO: 609303 - DNA, 20 bp, Artificial
  CRISPR gRNA sequence
atgaaaatgtttatatcctg

SEQ ID NO: 609304 - DNA, 20 bp, Artificial
  CRISPR gRNA sequence
tcctgaagcttttttttgtt

SEQ ID NO: 609305 - DNA, 20 bp, Artificial
  CRISPR gRNA sequence
tttttgtttggaaaaatatg

SEQ ID NO: 609306 - DNA, 20 bp, Artificial
  CRISPR gRNA sequence
tttatcatgaaatatcttca

SEQ ID NO: 609307 - DNA, 20 bp, Artificial
  CRISPR gRNA sequence
ctacataaacttgaccataa

SEQ ID NO: 609308 - DNA, 20 bp, Artificial
  CRISPR gRNA sequence
ttccttgtgttcacaaacct

SEQ ID NO: 609309 - DNA, 20 bp, Artificial
  CRISPR gRNA sequence
aacctgagtctactaaaata

SEQ ID NO: 609310 - DNA, 20 bp, Artificial
  CRISPR gRNA sequence
ctactaaaatatggatgtaa

SEQ ID NO: 609311 - DNA, 20 bp, Artificial
  CRISPR gRNA sequence
ttataaatataaatgctaaa

SEQ ID NO: 609312 - DNA, 20 bp, Artificial
  CRISPR gRNA sequence
taaatataaatgctaaatag

SEQ ID NO: 609313 - DNA, 20 bp, Artificial
  CRISPR gRNA sequence
tagaagtgccattacaactg

SEQ ID NO: 609314 - DNA, 20 bp, Artificial
  CRISPR gRNA sequence
tgccattacaactgaagtat

SEQ ID NO: 609315 - DNA, 20 bp, Artificial
  CRISPR gRNA sequence
tatccccttttcattgctaa

SEQ ID NO: 609316 - DNA, 20 bp, Artificial
  CRISPR gRNA sequence
tcattgctaacagtttgttc

SEQ ID NO: 609317 - DNA, 20 bp, Artificial
  CRISPR gRNA sequence
attaaaccattattgcttat

SEQ ID NO: 609318 - DNA, 20 bp, Artificial
  CRISPR gRNA sequence
ataacgtgtgtacatttcca

SEQ ID NO: 609319 - DNA, 20 bp, Artificial
  CRISPR gRNA sequence
acatttccacagatatgccc

SEQ ID NO: 609320 - DNA, 20 bp, Artificial
  CRISPR gRNA sequence
ttacattctttatttcatat

SEQ ID NO: 609321 - DNA, 20 bp, Artificial
  CRISPR gRNA sequence
acattctttatttcatatca

SEQ ID NO: 609322 - DNA, 20 bp, Artificial
  CRISPR gRNA sequence
ttatttcatatcagagaaac

SEQ ID NO: 609323 - DNA, 20 bp, Artificial
  CRISPR gRNA sequence
caagcttgaaaaataactct

SEQ ID NO: 609324 - DNA, 20 bp, Artificial
  CRISPR gRNA sequence
gaaaaataactcttggtatt

SEQ ID NO: 609325 - DNA, 20 bp, Artificial
  CRISPR gRNA sequence
cttggtattgagaattgtaa

SEQ ID NO: 609326 - DNA, 20 bp, Artificial
  CRISPR gRNA sequence
ttcattttactcaaatgaac

SEQ ID NO: 609327 - DNA, 20 bp, Artificial
  CRISPR gRNA sequence
tgaacaagttttcatcttta

SEQ ID NO: 609328 - DNA, 20 bp, Artificial
  CRISPR gRNA sequence
catctttatagcccatttat

SEQ ID NO: 609329 - DNA, 20 bp, Artificial
  CRISPR gRNA sequence
atctttatagcccatttatg

SEQ ID NO: 609330 - DNA, 20 bp, Artificial
  CRISPR gRNA sequence
tctaatttcaaatatttgaa

SEQ ID NO: 609331 - DNA, 20 bp, Artificial
  CRISPR gRNA sequence
tttcaaatatttgaaaagta

SEQ ID NO: 609332 - DNA, 20 bp, Artificial
  CRISPR gRNA sequence
gcactctgaatattattgta

SEQ ID NO: 609333 - DNA, 20 bp, Artificial
  CRISPR gRNA sequence
ctctgaatattattgtacag

SEQ ID NO: 609334 - DNA, 20 bp, Artificial
  CRISPR gRNA sequence
tattattgtacagtggttaa

SEQ ID NO: 609335 - DNA, 20 bp, Artificial
  CRISPR gRNA sequence
ggttaatagttgtaattcaa

SEQ ID NO: 609336 - DNA, 20 bp, Artificial
  CRISPR gRNA sequence
tagttgtaattcaatagttg

SEQ ID NO: 609337 - DNA, 20 bp, Artificial
  CRISPR gRNA sequence
tcaatagttgtggcatcata

SEQ ID NO: 609338 - DNA, 20 bp, Artificial
  CRISPR gRNA sequence
agttgtggcatcatatagtg

SEQ ID NO: 609339 - DNA, 20 bp, Artificial
  CRISPR gRNA sequence
agctacgaatattataacaa

SEQ ID NO: 609340 - DNA, 20 bp, Artificial
  CRISPR gRNA sequence
caaaagtcttatatatatat

SEQ ID NO: 609341 - DNA, 20 bp, Artificial
  CRISPR gRNA sequence
tatatatataagttataatt

SEQ ID NO: 609342 - DNA, 20 bp, Artificial
  CRISPR gRNA sequence
ttataatttagaatacactt

SEQ ID NO: 609343 - DNA, 20 bp, Artificial
  CRISPR gRNA sequence
acttacatttaatcattaat

SEQ ID NO: 609344 - DNA, 20 bp, Artificial
  CRISPR gRNA sequence
tcattaataagttaaaatat

SEQ ID NO: 609345 - DNA, 20 bp, Artificial
  CRISPR gRNA sequence
cattaataagttaaaatatt

SEQ ID NO: 609346 - DNA, 20 bp, Artificial
  CRISPR gRNA sequence
ttaattgcaaacatcttaaa

SEQ ID NO: 609347 - DNA, 20 bp, Artificial
  CRISPR gRNA sequence
taaatagtgaaaataaacca

SEQ ID NO: 609348 - DNA, 20 bp, Artificial
  CRISPR gRNA sequence
aaatagtgaaaataaaccat

SEQ ID NO: 609349 - DNA, 20 bp, Artificial
  CRISPR gRNA sequence
atagtgaaaataaaccatgg

SEQ ID NO: 609350 - DNA, 20 bp, Artificial
  CRISPR gRNA sequence
agtgaaaataaaccatggga

SEQ ID NO: 609351 - DNA, 20 bp, Artificial
  CRISPR gRNA sequence
aaccatgggagagtttctat

SEQ ID NO: 609352 - DNA, 20 bp, Artificial
  CRISPR gRNA sequence
catgggagagtttctatgag

SEQ ID NO: 609353 - DNA, 20 bp, Artificial
  CRISPR gRNA sequence
tgggagagtttctatgagtg

SEQ ID NO: 609354 - DNA, 20 bp, Artificial
  CRISPR gRNA sequence
gagaaaacttttctatgtaa

SEQ ID NO: 609355 - DNA, 20 bp, Artificial
  CRISPR gRNA sequence
aacttttctatgtaatagtt

SEQ ID NO: 609356 - DNA, 20 bp, Artificial
  CRISPR gRNA sequence
tatgtaatagttaagattca

SEQ ID NO: 609357 - DNA, 20 bp, Artificial
  CRISPR gRNA sequence
aagaataattgcttttattc

SEQ ID NO: 609358 - DNA, 20 bp, Artificial
  CRISPR gRNA sequence
ctagaatttcaacctaattg

SEQ ID NO: 609359 - DNA, 20 bp, Artificial
  CRISPR gRNA sequence
aatttcaacctaattgtagt

SEQ ID NO: 609360 - DNA, 20 bp, Artificial
  CRISPR gRNA sequence
tcaacctaattgtagtgaga

SEQ ID NO: 609361 - DNA, 20 bp, Artificial
  CRISPR gRNA sequence
caacctaattgtagtgagat

SEQ ID NO: 609362 - DNA, 20 bp, Artificial
  CRISPR gRNA sequence
aattgtagtgagatgggtga

SEQ ID NO: 609363 - DNA, 20 bp, Artificial
  CRISPR gRNA sequence
tagtgagatgggtgaaagat

SEQ ID NO: 609364 - DNA, 20 bp, Artificial
  CRISPR gRNA sequence
gggtgaaagattagttacac

SEQ ID NO: 609365 - DNA, 20 bp, Artificial
  CRISPR gRNA sequence
ggtgaaagattagttacact

SEQ ID NO: 609366 - DNA, 20 bp, Artificial
  CRISPR gRNA sequence
attgatttactgtataaata

SEQ ID NO: 609367 - DNA, 20 bp, Artificial
  CRISPR gRNA sequence
attctaaacatacttcttta

SEQ ID NO: 609368 - DNA, 20 bp, Artificial
  CRISPR gRNA sequence
atacttctttatagtattgt

SEQ ID NO: 609369 - DNA, 20 bp, Artificial
  CRISPR gRNA sequence
acttctttatagtattgtta

SEQ ID NO: 609370 - DNA, 20 bp, Artificial
  CRISPR gRNA sequence
tttatagtattgttagagaa

SEQ ID NO: 609371 - DNA, 20 bp, Artificial
  CRISPR gRNA sequence
tgttagagaatagattacta

SEQ ID NO: 609372 - DNA, 20 bp, Artificial
  CRISPR gRNA sequence
ttactatttcttgtctattt

SEQ ID NO: 609373 - DNA, 20 bp, Artificial
  CRISPR gRNA sequence
tttcttgtctatttcggttt

SEQ ID NO: 609374 - DNA, 20 bp, Artificial
  CRISPR gRNA sequence
attttttctgtatttatttg

SEQ ID NO: 609375 - DNA, 20 bp, Artificial
  CRISPR gRNA sequence
atttgtagtatattcttcta

SEQ ID NO: 609376 - DNA, 20 bp, Artificial
  CRISPR gRNA sequence
tatattcttctatagataaa

SEQ ID NO: 609377 - DNA, 20 bp, Artificial
  CRISPR gRNA sequence
tttaatttcccaattaaact

SEQ ID NO: 609378 - DNA, 20 bp, Artificial
  CRISPR gRNA sequence
aatttcccaattaaacttag

SEQ ID NO: 609379 - DNA, 20 bp, Artificial
  CRISPR gRNA sequence
taaacttagtagtgtaatgt

SEQ ID NO: 609380 - DNA, 20 bp, Artificial
  CRISPR gRNA sequence
gtcatattcttcataattct

SEQ ID NO: 609381 - DNA, 20 bp, Artificial
  CRISPR gRNA sequence
tgagctattttgaaatttaa

SEQ ID NO: 609382 - DNA, 20 bp, Artificial
  CRISPR gRNA sequence
tttgaaatttaaaagactca

SEQ ID NO: 609383 - DNA, 20 bp, Artificial
  CRISPR gRNA sequence
atttaaaagactcatagttt

SEQ ID NO: 609384 - DNA, 20 bp, Artificial
  CRISPR gRNA sequence
tttaaaagactcatagtttc

SEQ ID NO: 609385 - DNA, 20 bp, Artificial
  CRISPR gRNA sequence
aggttctaaaactacacttt

SEQ ID NO: 609386 - DNA, 20 bp, Artificial
  CRISPR gRNA sequence
gtatttcttcattcctgaaa

SEQ ID NO: 609387 - DNA, 20 bp, Artificial
  CRISPR gRNA sequence
tgatacactttatgcacact

SEQ ID NO: 609388 - DNA, 20 bp, Artificial
  CRISPR gRNA sequence
tacactttatgcacactaag

SEQ ID NO: 609389 - DNA, 20 bp, Artificial
  CRISPR gRNA sequence
tatgcacactaagtggtata

SEQ ID NO: 609390 - DNA, 20 bp, Artificial
  CRISPR gRNA sequence
gtataaagtcatgctgtata

SEQ ID NO: 609391 - DNA, 20 bp, Artificial
  CRISPR gRNA sequence
ctgtataaagttacactttt

SEQ ID NO: 609392 - DNA, 20 bp, Artificial
  CRISPR gRNA sequence
ttcttaattttaattttaaa

SEQ ID NO: 609393 - DNA, 20 bp, Artificial
  CRISPR gRNA sequence
ttttaaatggcaattatgaa

SEQ ID NO: 609394 - DNA, 20 bp, Artificial
  CRISPR gRNA sequence
gaatggaatataacactata

SEQ ID NO: 609395 - DNA, 20 bp, Artificial
  CRISPR gRNA sequence
aatggaatataacactatat

SEQ ID NO: 609396 - DNA, 20 bp, Artificial
  CRISPR gRNA sequence
acactatatgggataaccaa

SEQ ID NO: 609397 - DNA, 20 bp, Artificial
  CRISPR gRNA sequence
gcatttcgcattgattttaa

SEQ ID NO: 609398 - DNA, 20 bp, Artificial
  CRISPR gRNA sequence
attttaaaagtctcccttac

SEQ ID NO: 609399 - DNA, 20 bp, Artificial
  CRISPR gRNA sequence
ccttaccagaaaaaatacca

SEQ ID NO: 609400 - DNA, 20 bp, Artificial
  CRISPR gRNA sequence
taccagaaaaaataccatgg

SEQ ID NO: 609401 - DNA, 20 bp, Artificial
  CRISPR gRNA sequence
aataccatggaagaattact

SEQ ID NO: 609402 - DNA, 20 bp, Artificial
  CRISPR gRNA sequence
tggaagaattacttagatta

SEQ ID NO: 609403 - DNA, 20 bp, Artificial
  CRISPR gRNA sequence
atggaaaaacctgttgatgc

SEQ ID NO: 609404 - DNA, 20 bp, Artificial
  CRISPR gRNA sequence
aaacctgttgatgcaagata

SEQ ID NO: 609405 - DNA, 20 bp, Artificial
  CRISPR gRNA sequence
ttgatgcaagatatagaatc

SEQ ID NO: 609406 - DNA, 20 bp, Artificial
  CRISPR gRNA sequence
tgatgcaagatatagaatcc

SEQ ID NO: 609407 - DNA, 20 bp, Artificial
  CRISPR gRNA sequence
atgcaagatatagaatccag

SEQ ID NO: 609408 - DNA, 20 bp, Artificial
  CRISPR gRNA sequence
gaatccaggagccataactg

SEQ ID NO: 609409 - DNA, 20 bp, Artificial
  CRISPR gRNA sequence
aaaaattcaacatgtgaaat

SEQ ID NO: 609410 - DNA, 20 bp, Artificial
  CRISPR gRNA sequence
atatgccaaaaaatgccctt

SEQ ID NO: 609411 - DNA, 20 bp, Artificial
  CRISPR gRNA sequence
ccaaaaaatgcccttgagta

SEQ ID NO: 609412 - DNA, 20 bp, Artificial
  CRISPR gRNA sequence
aaaaaatgcccttgagtaaa

SEQ ID NO: 609413 - DNA, 20 bp, Artificial
  CRISPR gRNA sequence
ataaaccaaaatgtttgcaa

SEQ ID NO: 609414 - DNA, 20 bp, Artificial
  CRISPR gRNA sequence
gcaaaagatatcataaacac

SEQ ID NO: 609415 - DNA, 20 bp, Artificial
  CRISPR gRNA sequence
caaaagatatcataaacact

SEQ ID NO: 609416 - DNA, 20 bp, Artificial
  CRISPR gRNA sequence
gatatcataaacactgggct

SEQ ID NO: 609417 - DNA, 20 bp, Artificial
  CRISPR gRNA sequence
gctaagttccttaatatata

SEQ ID NO: 609418 - DNA, 20 bp, Artificial
  CRISPR gRNA sequence
taagttccttaatatataaa

SEQ ID NO: 609419 - DNA, 20 bp, Artificial
  CRISPR gRNA sequence
atataaagagcatttaaatt

SEQ ID NO: 609420 - DNA, 20 bp, Artificial
  CRISPR gRNA sequence
aaagagcatttaaattcagt

SEQ ID NO: 609421 - DNA, 20 bp, Artificial
  CRISPR gRNA sequence
gcatttaaattcagtgagaa

SEQ ID NO: 609422 - DNA, 20 bp, Artificial
  CRISPR gRNA sequence
agaaaagactgacaacctga

SEQ ID NO: 609423 - DNA, 20 bp, Artificial
  CRISPR gRNA sequence
ctgacaacctgatagaaaaa

SEQ ID NO: 609424 - DNA, 20 bp, Artificial
  CRISPR gRNA sequence
tgacaacctgatagaaaaat

SEQ ID NO: 609425 - DNA, 20 bp, Artificial
  CRISPR gRNA sequence
caacctgatagaaaaatggg

SEQ ID NO: 609426 - DNA, 20 bp, Artificial
  CRISPR gRNA sequence
caactttgataaataattct

SEQ ID NO: 609427 - DNA, 20 bp, Artificial
  CRISPR gRNA sequence
aataattctgagaaaaaata

SEQ ID NO: 609428 - DNA, 20 bp, Artificial
  CRISPR gRNA sequence
aaataaagaacgtttcaaca

SEQ ID NO: 609429 - DNA, 20 bp, Artificial
  CRISPR gRNA sequence
agaacgtttcaacatggaaa

SEQ ID NO: 609430 - DNA, 20 bp, Artificial
  CRISPR gRNA sequence
taaaaaccataataaaatac

SEQ ID NO: 609431 - DNA, 20 bp, Artificial
  CRISPR gRNA sequence
aaataccagttttaatctgt

SEQ ID NO: 609432 - DNA, 20 bp, Artificial
  CRISPR gRNA sequence
gttttaatctgtcagattga

SEQ ID NO: 609433 - DNA, 20 bp, Artificial
  CRISPR gRNA sequence
gtcagattgacagaactatg

SEQ ID NO: 609434 - DNA, 20 bp, Artificial
  CRISPR gRNA sequence
ttgtaaaataatgtctgtaa

SEQ ID NO: 609435 - DNA, 20 bp, Artificial
  CRISPR gRNA sequence
aaaataatgtctgtaatagc

SEQ ID NO: 609436 - DNA, 20 bp, Artificial
  CRISPR gRNA sequence
tgtctgtaatagcaagaaac

SEQ ID NO: 609437 - DNA, 20 bp, Artificial
  CRISPR gRNA sequence
tcaaatttccaatgattaac

SEQ ID NO: 609438 - DNA, 20 bp, Artificial
  CRISPR gRNA sequence
actggatgaacaaatgatgc

SEQ ID NO: 609439 - DNA, 20 bp, Artificial
  CRISPR gRNA sequence
atgatgctagatttataaaa

SEQ ID NO: 609440 - DNA, 20 bp, Artificial
  CRISPR gRNA sequence
ctagatttataaaatggatt

SEQ ID NO: 609441 - DNA, 20 bp, Artificial
  CRISPR gRNA sequence
taaaatggattcagactatt

SEQ ID NO: 609442 - DNA, 20 bp, Artificial
  CRISPR gRNA sequence
gaatttgaaaattatgatac

SEQ ID NO: 609443 - DNA, 20 bp, Artificial
  CRISPR gRNA sequence
ttatgatactggttgctttt

SEQ ID NO: 609444 - DNA, 20 bp, Artificial
  CRISPR gRNA sequence
gatactggttgcttttgaga

SEQ ID NO: 609445 - DNA, 20 bp, Artificial
  CRISPR gRNA sequence
atactggttgcttttgagat

SEQ ID NO: 609446 - DNA, 20 bp, Artificial
  CRISPR gRNA sequence
tactggttgcttttgagata

SEQ ID NO: 609447 - DNA, 20 bp, Artificial
  CRISPR gRNA sequence
gcttttgagatagggcctga

SEQ ID NO: 609448 - DNA, 20 bp, Artificial
  CRISPR gRNA sequence
ttgagatagggcctgaaaga

SEQ ID NO: 609449 - DNA, 20 bp, Artificial
  CRISPR gRNA sequence
gatagggcctgaaagatagt

SEQ ID NO: 609450 - DNA, 20 bp, Artificial
  CRISPR gRNA sequence
ggcctgaaagatagtgagct

SEQ ID NO: 609451 - DNA, 20 bp, Artificial
  CRISPR gRNA sequence
gatagtgagcttggttacaa

SEQ ID NO: 609452 - DNA, 20 bp, Artificial
  CRISPR gRNA sequence
ttttttctttgccatgttta

SEQ ID NO: 609453 - DNA, 20 bp, Artificial
  CRISPR gRNA sequence
tttttctttgccatgtttat

SEQ ID NO: 609454 - DNA, 20 bp, Artificial
  CRISPR gRNA sequence
atgggttctttaaacataca

SEQ ID NO: 609455 - DNA, 20 bp, Artificial
  CRISPR gRNA sequence
gttctttaaacatacaaagc

SEQ ID NO: 609456 - DNA, 20 bp, Artificial
  CRISPR gRNA sequence
aaacatacaaagcaagttta

SEQ ID NO: 609457 - DNA, 20 bp, Artificial
  CRISPR gRNA sequence
tttaaagcaataaaactctt

SEQ ID NO: 609458 - DNA, 20 bp, Artificial
  CRISPR gRNA sequence
aagcaataaaactcttaagt

SEQ ID NO: 609459 - DNA, 20 bp, Artificial
  CRISPR gRNA sequence
cttaagttagtaaaacatct

SEQ ID NO: 609460 - DNA, 20 bp, Artificial
  CRISPR gRNA sequence
ctatataccacaacattctt

SEQ ID NO: 609461 - DNA, 20 bp, Artificial
  CRISPR gRNA sequence
cacaacattcttgagcatgc

SEQ ID NO: 609462 - DNA, 20 bp, Artificial
  CRISPR gRNA sequence
ttgagcatgctggcaatata

SEQ ID NO: 609463 - DNA, 20 bp, Artificial
  CRISPR gRNA sequence
gcatgctggcaatataaaga

SEQ ID NO: 609464 - DNA, 20 bp, Artificial
  CRISPR gRNA sequence
tcccaactctttttaaaaac

SEQ ID NO: 609465 - DNA, 20 bp, Artificial
  CRISPR gRNA sequence
aactctttttaaaaactagt

SEQ ID NO: 609466 - DNA, 20 bp, Artificial
  CRISPR gRNA sequence
actctttttaaaaactagta

SEQ ID NO: 609467 - DNA, 20 bp, Artificial
  CRISPR gRNA sequence
ctctttttaaaaactagtaa

SEQ ID NO: 609468 - DNA, 20 bp, Artificial
  CRISPR gRNA sequence
ctttttaaaaactagtaagg

SEQ ID NO: 609469 - DNA, 20 bp, Artificial
  CRISPR gRNA sequence
agggagtaacaatttgtaaa

SEQ ID NO: 609470 - DNA, 20 bp, Artificial
  CRISPR gRNA sequence
gggagtaacaatttgtaaat

SEQ ID NO: 609471 - DNA, 20 bp, Artificial
  CRISPR gRNA sequence
ggagtaacaatttgtaaata

SEQ ID NO: 609472 - DNA, 20 bp, Artificial
  CRISPR gRNA sequence
aaatagggtaaaactcaata

SEQ ID NO: 609473 - DNA, 20 bp, Artificial
  CRISPR gRNA sequence
agggtaaaactcaatatagt

SEQ ID NO: 609474 - DNA, 20 bp, Artificial
  CRISPR gRNA sequence
caatatagttggtactctgt

SEQ ID NO: 609475 - DNA, 20 bp, Artificial
  CRISPR gRNA sequence
agttggtactctgttagaaa

SEQ ID NO: 609476 - DNA, 20 bp, Artificial
  CRISPR gRNA sequence
gttggtactctgttagaaat

SEQ ID NO: 609477 - DNA, 20 bp, Artificial
  CRISPR gRNA sequence
tactctgttagaaatgggtc

SEQ ID NO: 609478 - DNA, 20 bp, Artificial
  CRISPR gRNA sequence
actctgttagaaatgggtcc

SEQ ID NO: 609479 - DNA, 20 bp, Artificial
  CRISPR gRNA sequence
ctgttagaaatgggtccagg

SEQ ID NO: 609480 - DNA, 20 bp, Artificial
  CRISPR gRNA sequence
tgttagaaatgggtccagga

SEQ ID NO: 609481 - DNA, 20 bp, Artificial
  CRISPR gRNA sequence
gaaggatgcatatcactttg

SEQ ID NO: 609482 - DNA, 20 bp, Artificial
  CRISPR gRNA sequence
gcatatcactttgtagatct

SEQ ID NO: 609483 - DNA, 20 bp, Artificial
  CRISPR gRNA sequence
atatcactttgtagatctca

SEQ ID NO: 609484 - DNA, 20 bp, Artificial
  CRISPR gRNA sequence
tcactttgtagatctcagag

SEQ ID NO: 609485 - DNA, 20 bp, Artificial
  CRISPR gRNA sequence
cagagtagtttatgtaccat

SEQ ID NO: 609486 - DNA, 20 bp, Artificial
  CRISPR gRNA sequence
ttcataaaaaccctatgaaa

SEQ ID NO: 609487 - DNA, 20 bp, Artificial
  CRISPR gRNA sequence
cataaaaaccctatgaaata

SEQ ID NO: 609488 - DNA, 20 bp, Artificial
  CRISPR gRNA sequence
gaaatagagcactatatatc

SEQ ID NO: 609489 - DNA, 20 bp, Artificial
  CRISPR gRNA sequence
aaatagagcactatatatcc

SEQ ID NO: 609490 - DNA, 20 bp, Artificial
  CRISPR gRNA sequence
actatatatccaggaaaaaa

SEQ ID NO: 609491 - DNA, 20 bp, Artificial
  CRISPR gRNA sequence
atatccaggaaaaaaaagat

SEQ ID NO: 609492 - DNA, 20 bp, Artificial
  CRISPR gRNA sequence
atttactcatttaatgctca

SEQ ID NO: 609493 - DNA, 20 bp, Artificial
  CRISPR gRNA sequence
tttaatgctcacagcaacca

SEQ ID NO: 609494 - DNA, 20 bp, Artificial
  CRISPR gRNA sequence
ttaatgctcacagcaaccat

SEQ ID NO: 609495 - DNA, 20 bp, Artificial
  CRISPR gRNA sequence
atgctcacagcaaccatagg

SEQ ID NO: 609496 - DNA, 20 bp, Artificial
  CRISPR gRNA sequence
tcacagcaaccataggaagt

SEQ ID NO: 609497 - DNA, 20 bp, Artificial
  CRISPR gRNA sequence
attatcatccccgttttata

SEQ ID NO: 609498 - DNA, 20 bp, Artificial
  CRISPR gRNA sequence
ttatcatccccgttttataa

SEQ ID NO: 609499 - DNA, 20 bp, Artificial
  CRISPR gRNA sequence
tccccgttttataaaggaca

SEQ ID NO: 609500 - DNA, 20 bp, Artificial
  CRISPR gRNA sequence
gacatggtgaaattaaacct

SEQ ID NO: 609501 - DNA, 20 bp, Artificial
  CRISPR gRNA sequence
tgttctgctcgaactttatt

SEQ ID NO: 609502 - DNA, 20 bp, Artificial
  CRISPR gRNA sequence
cgaactttattcagtaatct

SEQ ID NO: 609503 - DNA, 20 bp, Artificial
  CRISPR gRNA sequence
catctgtactttgcaaacat

SEQ ID NO: 609504 - DNA, 20 bp, Artificial
  CRISPR gRNA sequence
tactttgcaaacatgagact

SEQ ID NO: 609505 - DNA, 20 bp, Artificial
  CRISPR gRNA sequence
tgagactcagtttaaataat

SEQ ID NO: 609506 - DNA, 20 bp, Artificial
  CRISPR gRNA sequence
tcagtttaaataattagttc

SEQ ID NO: 609507 - DNA, 20 bp, Artificial
  CRISPR gRNA sequence
ttagttcaagattataatgc

SEQ ID NO: 609508 - DNA, 20 bp, Artificial
  CRISPR gRNA sequence
atgccagtacttttctacca

SEQ ID NO: 609509 - DNA, 20 bp, Artificial
  CRISPR gRNA sequence
gccagtacttttctaccaca

SEQ ID NO: 609510 - DNA, 20 bp, Artificial
  CRISPR gRNA sequence
ctaccacagagccattttga

SEQ ID NO: 609511 - DNA, 20 bp, Artificial
  CRISPR gRNA sequence
atagtgcaccctcttgtgat

SEQ ID NO: 609512 - DNA, 20 bp, Artificial
  CRISPR gRNA sequence
taagtactaatgacaaatca

SEQ ID NO: 609513 - DNA, 20 bp, Artificial
  CRISPR gRNA sequence
atgacaaatcacagactgtg

SEQ ID NO: 609514 - DNA, 20 bp, Artificial
  CRISPR gRNA sequence
acagactgtgtggtttctct

SEQ ID NO: 609515 - DNA, 20 bp, Artificial
  CRISPR gRNA sequence
tggtttctctaagaaaacaa

SEQ ID NO: 609516 - DNA, 20 bp, Artificial
  CRISPR gRNA sequence
aagaaaacaacggcaatgaa

SEQ ID NO: 609517 - DNA, 20 bp, Artificial
  CRISPR gRNA sequence
tgaaaatatttcctctaatc

SEQ ID NO: 609518 - DNA, 20 bp, Artificial
  CRISPR gRNA sequence
aaatatttcctctaatcaag

SEQ ID NO: 609519 - DNA, 20 bp, Artificial
  CRISPR gRNA sequence
ctaatcaagtagtaccaaat

SEQ ID NO: 609520 - DNA, 20 bp, Artificial
  CRISPR gRNA sequence
accaaataagttgttttgct

SEQ ID NO: 609521 - DNA, 20 bp, Artificial
  CRISPR gRNA sequence
taactttgatatgacttctt

SEQ ID NO: 609522 - DNA, 20 bp, Artificial
  CRISPR gRNA sequence
taagaaattttctatattac

SEQ ID NO: 609523 - DNA, 20 bp, Artificial
  CRISPR gRNA sequence
aaaaaactgatactcactta

SEQ ID NO: 609524 - DNA, 20 bp, Artificial
  CRISPR gRNA sequence
gcttgtttctgctttatgaa

SEQ ID NO: 609525 - DNA, 20 bp, Artificial
  CRISPR gRNA sequence
gctttatgaaaagactctgt

SEQ ID NO: 609526 - DNA, 20 bp, Artificial
  CRISPR gRNA sequence
aaaagactctgtcagcaatc

SEQ ID NO: 609527 - DNA, 20 bp, Artificial
  CRISPR gRNA sequence
tctgtcagcaatccagaatg

SEQ ID NO: 609528 - DNA, 20 bp, Artificial
  CRISPR gRNA sequence
ctgtcagcaatccagaatga

SEQ ID NO: 609529 - DNA, 20 bp, Artificial
  CRISPR gRNA sequence
acaaaattccaacttttctg

SEQ ID NO: 609530 - DNA, 20 bp, Artificial
  CRISPR gRNA sequence
caaaattccaacttttctgt

SEQ ID NO: 609531 - DNA, 20 bp, Artificial
  CRISPR gRNA sequence
tctgtgggatgatccaaaaa

SEQ ID NO: 609532 - DNA, 20 bp, Artificial
  CRISPR gRNA sequence
gatgatccaaaaacagcaaa

SEQ ID NO: 609533 - DNA, 20 bp, Artificial
  CRISPR gRNA sequence
gatccaaaaacagcaaacag

SEQ ID NO: 609534 - DNA, 20 bp, Artificial
  CRISPR gRNA sequence
atccaaaaacagcaaacaga

SEQ ID NO: 609535 - DNA, 20 bp, Artificial
  CRISPR gRNA sequence
gaaggcattaaatttcttaa

SEQ ID NO: 609536 - DNA, 20 bp, Artificial
  CRISPR gRNA sequence
ggcattaaatttcttaacag

SEQ ID NO: 609537 - DNA, 20 bp, Artificial
  CRISPR gRNA sequence
ttaaatttcttaacagtggc

SEQ ID NO: 609538 - DNA, 20 bp, Artificial
  CRISPR gRNA sequence
tgctatgccattactgtgat

SEQ ID NO: 609539 - DNA, 20 bp, Artificial
  CRISPR gRNA sequence
tactgtgattagctgctttt

SEQ ID NO: 609540 - DNA, 20 bp, Artificial
  CRISPR gRNA sequence
tagctgctttttggtgtgca

SEQ ID NO: 609541 - DNA, 20 bp, Artificial
  CRISPR gRNA sequence
gctttttggtgtgcatagat

SEQ ID NO: 609542 - DNA, 20 bp, Artificial
  CRISPR gRNA sequence
tttttggtgtgcatagatta

SEQ ID NO: 609543 - DNA, 20 bp, Artificial
  CRISPR gRNA sequence
tggtgtgcatagattagagt

SEQ ID NO: 609544 - DNA, 20 bp, Artificial
  CRISPR gRNA sequence
ttttcaaacaacatgttcca

SEQ ID NO: 609545 - DNA, 20 bp, Artificial
  CRISPR gRNA sequence
tttcaaacaacatgttccat

SEQ ID NO: 609546 - DNA, 20 bp, Artificial
  CRISPR gRNA sequence
atgttccataggtaattttt

SEQ ID NO: 609547 - DNA, 20 bp, Artificial
  CRISPR gRNA sequence
tccataggtaattttttaga

SEQ ID NO: 609548 - DNA, 20 bp, Artificial
  CRISPR gRNA sequence
aattttttagatagaaaaaa

SEQ ID NO: 609549 - DNA, 20 bp, Artificial
  CRISPR gRNA sequence
attttttagatagaaaaaat

SEQ ID NO: 609550 - DNA, 20 bp, Artificial
  CRISPR gRNA sequence
ttttagatagaaaaaatagg

SEQ ID NO: 609551 - DNA, 20 bp, Artificial
  CRISPR gRNA sequence
ttagatagaaaaaataggca

SEQ ID NO: 609552 - DNA, 20 bp, Artificial
  CRISPR gRNA sequence
aaaaataggcagagtaactt

SEQ ID NO: 609553 - DNA, 20 bp, Artificial
  CRISPR gRNA sequence
aaataggcagagtaacttaa

SEQ ID NO: 609554 - DNA, 20 bp, Artificial
  CRISPR gRNA sequence
agagtaacttaagagcatgt

SEQ ID NO: 609555 - DNA, 20 bp, Artificial
  CRISPR gRNA sequence
gagtaacttaagagcatgtg

SEQ ID NO: 609556 - DNA, 20 bp, Artificial
  CRISPR gRNA sequence
gtctgtgtactacatttata

SEQ ID NO: 609557 - DNA, 20 bp, Artificial
  CRISPR gRNA sequence
cgaaactgaatatatgtgtt

SEQ ID NO: 609558 - DNA, 20 bp, Artificial
  CRISPR gRNA sequence
atatgtgtttagtttgattt

SEQ ID NO: 609559 - DNA, 20 bp, Artificial
  CRISPR gRNA sequence
attttagaacattgccttga

SEQ ID NO: 609560 - DNA, 20 bp, Artificial
  CRISPR gRNA sequence
cagtgtatcttcatatgtca

SEQ ID NO: 609561 - DNA, 20 bp, Artificial
  CRISPR gRNA sequence
catatgtcaaagacatttgc

SEQ ID NO: 609562 - DNA, 20 bp, Artificial
  CRISPR gRNA sequence
tcaaagacatttgctggatt

SEQ ID NO: 609563 - DNA, 20 bp, Artificial
  CRISPR gRNA sequence
attgtttctcttgccctgtt

SEQ ID NO: 609564 - DNA, 20 bp, Artificial
  CRISPR gRNA sequence
gtttctcttgccctgttcag

SEQ ID NO: 609565 - DNA, 20 bp, Artificial
  CRISPR gRNA sequence
tctcttgccctgttcagaag

SEQ ID NO: 609566 - DNA, 20 bp, Artificial
  CRISPR gRNA sequence
ctcttgccctgttcagaagc

SEQ ID NO: 609567 - DNA, 20 bp, Artificial
  CRISPR gRNA sequence
gttcagaagcaggtttatac

SEQ ID NO: 609568 - DNA, 20 bp, Artificial
  CRISPR gRNA sequence
acaagtactctgatgtgaaa

SEQ ID NO: 609569 - DNA, 20 bp, Artificial
  CRISPR gRNA sequence
aagtactctgatgtgaaaca

SEQ ID NO: 609570 - DNA, 20 bp, Artificial
  CRISPR gRNA sequence
gatgtgaaacagagaatatg

SEQ ID NO: 609571 - DNA, 20 bp, Artificial
  CRISPR gRNA sequence
tacataatgatcattaaatt

SEQ ID NO: 609572 - DNA, 20 bp, Artificial
  CRISPR gRNA sequence
cataatgatcattaaattaa

SEQ ID NO: 609573 - DNA, 20 bp, Artificial
  CRISPR gRNA sequence
ataatgatcattaaattaag

SEQ ID NO: 609574 - DNA, 20 bp, Artificial
  CRISPR gRNA sequence
aatgatcattaaattaagag

SEQ ID NO: 609575 - DNA, 20 bp, Artificial
  CRISPR gRNA sequence
atgatcattaaattaagagg

SEQ ID NO: 609576 - DNA, 20 bp, Artificial
  CRISPR gRNA sequence
cattaaattaagaggaggca

SEQ ID NO: 609577 - DNA, 20 bp, Artificial
  CRISPR gRNA sequence
aattaagaggaggcatagtt

SEQ ID NO: 609578 - DNA, 20 bp, Artificial
  CRISPR gRNA sequence
gaggcatagttcagtgtgtt

SEQ ID NO: 609579 - DNA, 20 bp, Artificial
  CRISPR gRNA sequence
tttcttccataatcctatct

SEQ ID NO: 609580 - DNA, 20 bp, Artificial
  CRISPR gRNA sequence
ccataatcctatctcagtcc

SEQ ID NO: 609581 - DNA, 20 bp, Artificial
  CRISPR gRNA sequence
cataatcctatctcagtcct

SEQ ID NO: 609582 - DNA, 20 bp, Artificial
  CRISPR gRNA sequence
taatcctatctcagtcctag

SEQ ID NO: 609583 - DNA, 20 bp, Artificial
  CRISPR gRNA sequence
tatctcagtcctaggagtct

SEQ ID NO: 609584 - DNA, 20 bp, Artificial
  CRISPR gRNA sequence
agtcctaggagtcttagtga

SEQ ID NO: 609585 - DNA, 20 bp, Artificial
  CRISPR gRNA sequence
agtcttagtgacagactcaa

SEQ ID NO: 609586 - DNA, 20 bp, Artificial
  CRISPR gRNA sequence
acagactcaaaagccaatac

SEQ ID NO: 609587 - DNA, 20 bp, Artificial
  CRISPR gRNA sequence
cagactcaaaagccaatacc

SEQ ID NO: 609588 - DNA, 20 bp, Artificial
  CRISPR gRNA sequence
attaaaaaaacttgtttaaa

SEQ ID NO: 609589 - DNA, 20 bp, Artificial
  CRISPR gRNA sequence
tgtttaaaaagcaaatgtct

SEQ ID NO: 609590 - DNA, 20 bp, Artificial
  CRISPR gRNA sequence
aaaagcaaatgtctaagtga

SEQ ID NO: 609591 - DNA, 20 bp, Artificial
  CRISPR gRNA sequence
agtgaaagaaacaaatatgt

SEQ ID NO: 609592 - DNA, 20 bp, Artificial
  CRISPR gRNA sequence
gtgaaagaaacaaatatgtg

SEQ ID NO: 609593 - DNA, 20 bp, Artificial
  CRISPR gRNA sequence
gaaacaaatatgtgaggaaa

SEQ ID NO: 609594 - DNA, 20 bp, Artificial
  CRISPR gRNA sequence
aaatagtcattctgtttacc

SEQ ID NO: 609595 - DNA, 20 bp, Artificial
  CRISPR gRNA sequence
atagtcattctgtttaccta

SEQ ID NO: 609596 - DNA, 20 bp, Artificial
  CRISPR gRNA sequence
tgtttacctagagttttcct

SEQ ID NO: 609597 - DNA, 20 bp, Artificial
  CRISPR gRNA sequence
gacatttcactaaaatatca

SEQ ID NO: 609598 - DNA, 20 bp, Artificial
  CRISPR gRNA sequence
cactaaaatatcatagaaca

SEQ ID NO: 609599 - DNA, 20 bp, Artificial
  CRISPR gRNA sequence
gaacacagtatgtattaaca

SEQ ID NO: 609600 - DNA, 20 bp, Artificial
  CRISPR gRNA sequence
atatatcattttcatccatt

SEQ ID NO: 609601 - DNA, 20 bp, Artificial
  CRISPR gRNA sequence
tatcattttcatccatttag

SEQ ID NO: 609602 - DNA, 20 bp, Artificial
  CRISPR gRNA sequence
atcattttcatccatttagt

SEQ ID NO: 609603 - DNA, 20 bp, Artificial
  CRISPR gRNA sequence
ccatttagtaggatgacaat

SEQ ID NO: 609604 - DNA, 20 bp, Artificial
  CRISPR gRNA sequence
tttagtaggatgacaatgag

SEQ ID NO: 609605 - DNA, 20 bp, Artificial
  CRISPR gRNA sequence
taggatgacaatgagtagaa

SEQ ID NO: 609606 - DNA, 20 bp, Artificial
  CRISPR gRNA sequence
ggatgacaatgagtagaaaa

SEQ ID NO: 609607 - DNA, 20 bp, Artificial
  CRISPR gRNA sequence
caatgagtagaaaagagatg

SEQ ID NO: 609608 - DNA, 20 bp, Artificial
  CRISPR gRNA sequence
aatgagtagaaaagagatgt

SEQ ID NO: 609609 - DNA, 20 bp, Artificial
  CRISPR gRNA sequence
agtagaaaagagatgtaggt

SEQ ID NO: 609610 - DNA, 20 bp, Artificial
  CRISPR gRNA sequence
attttcttcttttcaaatta

SEQ ID NO: 609611 - DNA, 20 bp, Artificial
  CRISPR gRNA sequence
ttttcaaattacagcaaatt

SEQ ID NO: 609612 - DNA, 20 bp, Artificial
  CRISPR gRNA sequence
aaattacagcaaattcagta

SEQ ID NO: 609613 - DNA, 20 bp, Artificial
  CRISPR gRNA sequence
tacagcaaattcagtaaagc

SEQ ID NO: 609614 - DNA, 20 bp, Artificial
  CRISPR gRNA sequence
attcagtaaagctagaaatg

SEQ ID NO: 609615 - DNA, 20 bp, Artificial
  CRISPR gRNA sequence
tcagtaaagctagaaatgca

SEQ ID NO: 609616 - DNA, 20 bp, Artificial
  CRISPR gRNA sequence
gctagaaatgcagagtgatg

SEQ ID NO: 609617 - DNA, 20 bp, Artificial
  CRISPR gRNA sequence
tagaaatgcagagtgatgaa

SEQ ID NO: 609618 - DNA, 20 bp, Artificial
  CRISPR gRNA sequence
cagagtgatgaagagtgtga

SEQ ID NO: 609619 - DNA, 20 bp, Artificial
  CRISPR gRNA sequence
agagtgatgaagagtgtgac

SEQ ID NO: 609620 - DNA, 20 bp, Artificial
  CRISPR gRNA sequence
gagtgtgacaggaaacccct

SEQ ID NO: 609621 - DNA, 20 bp, Artificial
  CRISPR gRNA sequence
caggaaacccctgagccgtg

SEQ ID NO: 609622 - DNA, 20 bp, Artificial
  CRISPR gRNA sequence
aacccctgagccgtgaagat

SEQ ID NO: 609623 - DNA, 20 bp, Artificial
  CRISPR gRNA sequence
ctgagccgtgaagatgagat

SEQ ID NO: 609624 - DNA, 20 bp, Artificial
  CRISPR gRNA sequence
tgagccgtgaagatgagatc

SEQ ID NO: 609625 - DNA, 20 bp, Artificial
  CRISPR gRNA sequence
gagccgtgaagatgagatca

SEQ ID NO: 609626 - DNA, 20 bp, Artificial
  CRISPR gRNA sequence
agccgtgaagatgagatcag

SEQ ID NO: 609627 - DNA, 20 bp, Artificial
  CRISPR gRNA sequence
atgagatcaggggccatgat

SEQ ID NO: 609628 - DNA, 20 bp, Artificial
  CRISPR gRNA sequence
tgagatcaggggccatgatg

SEQ ID NO: 609629 - DNA, 20 bp, Artificial
  CRISPR gRNA sequence
gagatcaggggccatgatga

SEQ ID NO: 609630 - DNA, 20 bp, Artificial
  CRISPR gRNA sequence
atcaggggccatgatgaggg

SEQ ID NO: 609631 - DNA, 20 bp, Artificial
  CRISPR gRNA sequence
aggggccatgatgagggtag

SEQ ID NO: 609632 - DNA, 20 bp, Artificial
  CRISPR gRNA sequence
ccatgatgagggtagcagcc

SEQ ID NO: 609633 - DNA, 20 bp, Artificial
  CRISPR gRNA sequence
tgatgagggtagcagcctag

SEQ ID NO: 609634 - DNA, 20 bp, Artificial
  CRISPR gRNA sequence
gcctagaagaacccctaatt

SEQ ID NO: 609635 - DNA, 20 bp, Artificial
  CRISPR gRNA sequence
ctagaagaacccctaattga

SEQ ID NO: 609636 - DNA, 20 bp, Artificial
  CRISPR gRNA sequence
gaagaacccctaattgagag

SEQ ID NO: 609637 - DNA, 20 bp, Artificial
  CRISPR gRNA sequence
aacccctaattgagagcagc

SEQ ID NO: 609638 - DNA, 20 bp, Artificial
  CRISPR gRNA sequence
acccctaattgagagcagcg

SEQ ID NO: 609639 - DNA, 20 bp, Artificial
  CRISPR gRNA sequence
cctaattgagagcagcgagg

SEQ ID NO: 609640 - DNA, 20 bp, Artificial
  CRISPR gRNA sequence
agcagcgaggtggctgacaa

SEQ ID NO: 609641 - DNA, 20 bp, Artificial
  CRISPR gRNA sequence
gcagcgaggtggctgacaac

SEQ ID NO: 609642 - DNA, 20 bp, Artificial
  CRISPR gRNA sequence
cgaggtggctgacaacagga

SEQ ID NO: 609643 - DNA, 20 bp, Artificial
  CRISPR gRNA sequence
tggctgacaacaggaaagtc

SEQ ID NO: 609644 - DNA, 20 bp, Artificial
  CRISPR gRNA sequence
ggctgacaacaggaaagtcc

SEQ ID NO: 609645 - DNA, 20 bp, Artificial
  CRISPR gRNA sequence
ctgacaacaggaaagtccag

SEQ ID NO: 609646 - DNA, 20 bp, Artificial
  CRISPR gRNA sequence
caggaaagtccaggagcttc

SEQ ID NO: 609647 - DNA, 20 bp, Artificial
  CRISPR gRNA sequence
aggaaagtccaggagcttca

SEQ ID NO: 609648 - DNA, 20 bp, Artificial
  CRISPR gRNA sequence
aagtccaggagcttcaaggc

SEQ ID NO: 609649 - DNA, 20 bp, Artificial
  CRISPR gRNA sequence
agtccaggagcttcaaggcg

SEQ ID NO: 609650 - DNA, 20 bp, Artificial
  CRISPR gRNA sequence
gtccaggagcttcaaggcga

SEQ ID NO: 609651 - DNA, 20 bp, Artificial
  CRISPR gRNA sequence
ccaggagcttcaaggcgagg

SEQ ID NO: 609652 - DNA, 20 bp, Artificial
  CRISPR gRNA sequence
caggagcttcaaggcgaggg

SEQ ID NO: 609653 - DNA, 20 bp, Artificial
  CRISPR gRNA sequence
ttcaaggcgagggaggaatc

SEQ ID NO: 609654 - DNA, 20 bp, Artificial
  CRISPR gRNA sequence
ggaggaatccggcttccgaa

SEQ ID NO: 609655 - DNA, 20 bp, Artificial
  CRISPR gRNA sequence
aaactgaaatgtgacgtctg

SEQ ID NO: 609656 - DNA, 20 bp, Artificial
  CRISPR gRNA sequence
gaaatgtgacgtctgtggca

SEQ ID NO: 609657 - DNA, 20 bp, Artificial
  CRISPR gRNA sequence
gtctgtggcatggtttgcat

SEQ ID NO: 609658 - DNA, 20 bp, Artificial
  CRISPR gRNA sequence
tctgtggcatggtttgcatt

SEQ ID NO: 609659 - DNA, 20 bp, Artificial
  CRISPR gRNA sequence
cattgggcccaatgtgctta

SEQ ID NO: 609660 - DNA, 20 bp, Artificial
  CRISPR gRNA sequence
aatgtgcttatggtacataa

SEQ ID NO: 609661 - DNA, 20 bp, Artificial
  CRISPR gRNA sequence
atgtgcttatggtacataaa

SEQ ID NO: 609662 - DNA, 20 bp, Artificial
  CRISPR gRNA sequence
gtgcttatggtacataaaag

SEQ ID NO: 609663 - DNA, 20 bp, Artificial
  CRISPR gRNA sequence
gtacataaaaggagtcacac

SEQ ID NO: 609664 - DNA, 20 bp, Artificial
  CRISPR gRNA sequence
ataaaaggagtcacactggt

SEQ ID NO: 609665 - DNA, 20 bp, Artificial
  CRISPR gRNA sequence
aaaggagtcacactggtaag

SEQ ID NO: 609666 - DNA, 20 bp, Artificial
  CRISPR gRNA sequence
tcacactggtaagcagctga

SEQ ID NO: 609667 - DNA, 20 bp, Artificial
  CRISPR gRNA sequence
tattctctttcctttttatt

SEQ ID NO: 609668 - DNA, 20 bp, Artificial
  CRISPR gRNA sequence
attctctttcctttttattc

SEQ ID NO: 609669 - DNA, 20 bp, Artificial
  CRISPR gRNA sequence
ttctctttcctttttattca

SEQ ID NO: 609670 - DNA, 20 bp, Artificial
  CRISPR gRNA sequence
tctctttcctttttattcag

SEQ ID NO: 609671 - DNA, 20 bp, Artificial
  CRISPR gRNA sequence
ctttcctttttattcagggg

SEQ ID NO: 609672 - DNA, 20 bp, Artificial
  CRISPR gRNA sequence
tcctttttattcaggggtgg

SEQ ID NO: 609673 - DNA, 20 bp, Artificial
  CRISPR gRNA sequence
tttttattcaggggtggcag

SEQ ID NO: 609674 - DNA, 20 bp, Artificial
  CRISPR gRNA sequence
agtggtgaaaactacctttt

SEQ ID NO: 609675 - DNA, 20 bp, Artificial
  CRISPR gRNA sequence
ctaccttttcagaattctgc

SEQ ID NO: 609676 - DNA, 20 bp, Artificial
  CRISPR gRNA sequence
tttcagaattctgctagtat

SEQ ID NO: 609677 - DNA, 20 bp, Artificial
  CRISPR gRNA sequence
attctgctagtattggattg

SEQ ID NO: 609678 - DNA, 20 bp, Artificial
  CRISPR gRNA sequence
agtattggattgcagaaaaa

SEQ ID NO: 609679 - DNA, 20 bp, Artificial
  CRISPR gRNA sequence
tattggattgcagaaaaaca

SEQ ID NO: 609680 - DNA, 20 bp, Artificial
  CRISPR gRNA sequence
ttggattgcagaaaaacaga

SEQ ID NO: 609681 - DNA, 20 bp, Artificial
  CRISPR gRNA sequence
gattgcagaaaaacagagag

SEQ ID NO: 609682 - DNA, 20 bp, Artificial
  CRISPR gRNA sequence
cagaaaaacagagagtagcc

SEQ ID NO: 609683 - DNA, 20 bp, Artificial
  CRISPR gRNA sequence
agaaaaacagagagtagcct

SEQ ID NO: 609684 - DNA, 20 bp, Artificial
  CRISPR gRNA sequence
gtagcctgggtcttgacttc

SEQ ID NO: 609685 - DNA, 20 bp, Artificial
  CRISPR gRNA sequence
ttccagccttcaaatctgaa

SEQ ID NO: 609686 - DNA, 20 bp, Artificial
  CRISPR gRNA sequence
ttcaaatctgaatagcatat

SEQ ID NO: 609687 - DNA, 20 bp, Artificial
  CRISPR gRNA sequence
atctgaatagcatatcagaa

SEQ ID NO: 609688 - DNA, 20 bp, Artificial
  CRISPR gRNA sequence
tgaatagcatatcagaaaag

SEQ ID NO: 609689 - DNA, 20 bp, Artificial
  CRISPR gRNA sequence
agcatatcagaaaagaagtt

SEQ ID NO: 609690 - DNA, 20 bp, Artificial
  CRISPR gRNA sequence
gcatatcagaaaagaagttt

SEQ ID NO: 609691 - DNA, 20 bp, Artificial
  CRISPR gRNA sequence
cagaaaagaagtttgggatt

SEQ ID NO: 609692 - DNA, 20 bp, Artificial
  CRISPR gRNA sequence
agtttgggattcagtttcca

SEQ ID NO: 609693 - DNA, 20 bp, Artificial
  CRISPR gRNA sequence
agtttccacagttcttaata

SEQ ID NO: 609694 - DNA, 20 bp, Artificial
  CRISPR gRNA sequence
taatatagcaataatatgat

SEQ ID NO: 609695 - DNA, 20 bp, Artificial
  CRISPR gRNA sequence
aatatagcaataatatgata

SEQ ID NO: 609696 - DNA, 20 bp, Artificial
  CRISPR gRNA sequence
atatagcaataatatgataa

SEQ ID NO: 609697 - DNA, 20 bp, Artificial
  CRISPR gRNA sequence
ataatatgataagggttcaa

SEQ ID NO: 609698 - DNA, 20 bp, Artificial
  CRISPR gRNA sequence
taatatgataagggttcaaa

SEQ ID NO: 609699 - DNA, 20 bp, Artificial
  CRISPR gRNA sequence
tgataagggttcaaaaggta

SEQ ID NO: 609700 - DNA, 20 bp, Artificial
  CRISPR gRNA sequence
gataagggttcaaaaggtat

SEQ ID NO: 609701 - DNA, 20 bp, Artificial
  CRISPR gRNA sequence
taagggttcaaaaggtatag

SEQ ID NO: 609702 - DNA, 20 bp, Artificial
  CRISPR gRNA sequence
tacatattttaccataccca

SEQ ID NO: 609703 - DNA, 20 bp, Artificial
  CRISPR gRNA sequence
acatattttaccatacccat

SEQ ID NO: 609704 - DNA, 20 bp, Artificial
  CRISPR gRNA sequence
tattttaccatacccatggg

SEQ ID NO: 609705 - DNA, 20 bp, Artificial
  CRISPR gRNA sequence
attttaccatacccatgggc

SEQ ID NO: 609706 - DNA, 20 bp, Artificial
  CRISPR gRNA sequence
atacccatgggcaggtaata

SEQ ID NO: 609707 - DNA, 20 bp, Artificial
  CRISPR gRNA sequence
gggcaggtaatatagtttgc

SEQ ID NO: 609708 - DNA, 20 bp, Artificial
  CRISPR gRNA sequence
ggtaatatagtttgctagat

SEQ ID NO: 609709 - DNA, 20 bp, Artificial
  CRISPR gRNA sequence
taatatagtttgctagataa

SEQ ID NO: 609710 - DNA, 20 bp, Artificial
  CRISPR gRNA sequence
taagagtttatactacaaaa

SEQ ID NO: 609711 - DNA, 20 bp, Artificial
  CRISPR gRNA sequence
tggcactcatgcatttatgt

SEQ ID NO: 609712 - DNA, 20 bp, Artificial
  CRISPR gRNA sequence
tgaataattttcactttatc

SEQ ID NO: 609713 - DNA, 20 bp, Artificial
  CRISPR gRNA sequence
gatctctgcctatcctacca

SEQ ID NO: 609714 - DNA, 20 bp, Artificial
  CRISPR gRNA sequence
atctctgcctatcctaccac

SEQ ID NO: 609715 - DNA, 20 bp, Artificial
  CRISPR gRNA sequence
gcctatcctaccacaggtct

SEQ ID NO: 609716 - DNA, 20 bp, Artificial
  CRISPR gRNA sequence
tatcctaccacaggtctcag

SEQ ID NO: 609717 - DNA, 20 bp, Artificial
  CRISPR gRNA sequence
cctaccacaggtctcagtag

SEQ ID NO: 609718 - DNA, 20 bp, Artificial
  CRISPR gRNA sequence
ctaccacaggtctcagtagc

SEQ ID NO: 609719 - DNA, 20 bp, Artificial
  CRISPR gRNA sequence
ccacaggtctcagtagcagg

SEQ ID NO: 609720 - DNA, 20 bp, Artificial
  CRISPR gRNA sequence
cacaggtctcagtagcaggc

SEQ ID NO: 609721 - DNA, 20 bp, Artificial
  CRISPR gRNA sequence
gtagcaggcaggtgcttttg

SEQ ID NO: 609722 - DNA, 20 bp, Artificial
  CRISPR gRNA sequence
aggcaggtgcttttgtagtt

SEQ ID NO: 609723 - DNA, 20 bp, Artificial
  CRISPR gRNA sequence
ggcaggtgcttttgtagttc

SEQ ID NO: 609724 - DNA, 20 bp, Artificial
  CRISPR gRNA sequence
gcaggtgcttttgtagttca

SEQ ID NO: 609725 - DNA, 20 bp, Artificial
  CRISPR gRNA sequence
tgccatctttctgtaattgt

SEQ ID NO: 609726 - DNA, 20 bp, Artificial
  CRISPR gRNA sequence
ttgttggttataactcctgc

SEQ ID NO: 609727 - DNA, 20 bp, Artificial
  CRISPR gRNA sequence
tgttggttataactcctgca

SEQ ID NO: 609728 - DNA, 20 bp, Artificial
  CRISPR gRNA sequence
aactcctgcaaggatatatg

SEQ ID NO: 609729 - DNA, 20 bp, Artificial
  CRISPR gRNA sequence
actcctgcaaggatatatgt

SEQ ID NO: 609730 - DNA, 20 bp, Artificial
  CRISPR gRNA sequence
gtaggattgaatatgacaaa

SEQ ID NO: 609731 - DNA, 20 bp, Artificial
  CRISPR gRNA sequence
ggattgaatatgacaaatag

SEQ ID NO: 609732 - DNA, 20 bp, Artificial
  CRISPR gRNA sequence
tgaatatgacaaatagtggc

SEQ ID NO: 609733 - DNA, 20 bp, Artificial
  CRISPR gRNA sequence
gacaaatagtggctggtgtg

SEQ ID NO: 609734 - DNA, 20 bp, Artificial
  CRISPR gRNA sequence
acaaatagtggctggtgtgt

SEQ ID NO: 609735 - DNA, 20 bp, Artificial
  CRISPR gRNA sequence
atagtggctggtgtgtaggt

SEQ ID NO: 609736 - DNA, 20 bp, Artificial
  CRISPR gRNA sequence
taggttggaatatgtaattc

SEQ ID NO: 609737 - DNA, 20 bp, Artificial
  CRISPR gRNA sequence
aggttggaatatgtaattct

SEQ ID NO: 609738 - DNA, 20 bp, Artificial
  CRISPR gRNA sequence
tggaatatgtaattctggga

SEQ ID NO: 609739 - DNA, 20 bp, Artificial
  CRISPR gRNA sequence
gaatatgtaattctgggata

SEQ ID NO: 609740 - DNA, 20 bp, Artificial
  CRISPR gRNA sequence
atgtaattctgggatagagt

SEQ ID NO: 609741 - DNA, 20 bp, Artificial
  CRISPR gRNA sequence
tgtaattctgggatagagtg

SEQ ID NO: 609742 - DNA, 20 bp, Artificial
  CRISPR gRNA sequence
tctgggatagagtgaggaaa

SEQ ID NO: 609743 - DNA, 20 bp, Artificial
  CRISPR gRNA sequence
tagagtgaggaaaaagccca

SEQ ID NO: 609744 - DNA, 20 bp, Artificial
  CRISPR gRNA sequence
tactatatttttaaacattt

SEQ ID NO: 609745 - DNA, 20 bp, Artificial
  CRISPR gRNA sequence
ctatatttttaaacatttga

SEQ ID NO: 609746 - DNA, 20 bp, Artificial
  CRISPR gRNA sequence
tatatttttaaacatttgag

SEQ ID NO: 609747 - DNA, 20 bp, Artificial
  CRISPR gRNA sequence
ttaaacatttgagaggtgaa

SEQ ID NO: 609748 - DNA, 20 bp, Artificial
  CRISPR gRNA sequence
tttgtgaaaactaaccaaat

SEQ ID NO: 609749 - DNA, 20 bp, Artificial
  CRISPR gRNA sequence
gtgaaaactaaccaaatgag

SEQ ID NO: 609750 - DNA, 20 bp, Artificial
  CRISPR gRNA sequence
tgaaaactaaccaaatgaga

SEQ ID NO: 609751 - DNA, 20 bp, Artificial
  CRISPR gRNA sequence
gccaatttttttttcttaaa

SEQ ID NO: 609752 - DNA, 20 bp, Artificial
  CRISPR gRNA sequence
ttttttttcttaaaaagcaa

SEQ ID NO: 609753 - DNA, 20 bp, Artificial
  CRISPR gRNA sequence
tcttaaaaagcaacagaaat

SEQ ID NO: 609754 - DNA, 20 bp, Artificial
  CRISPR gRNA sequence
aaaaagcaacagaaatgaga

SEQ ID NO: 609755 - DNA, 20 bp, Artificial
  CRISPR gRNA sequence
agcaacagaaatgagatagt

SEQ ID NO: 609756 - DNA, 20 bp, Artificial
  CRISPR gRNA sequence
aacagaaatgagatagtaag

SEQ ID NO: 609757 - DNA, 20 bp, Artificial
  CRISPR gRNA sequence
gaaatgagatagtaagtggt

SEQ ID NO: 609758 - DNA, 20 bp, Artificial
  CRISPR gRNA sequence
tgagatagtaagtggtaagc

SEQ ID NO: 609759 - DNA, 20 bp, Artificial
  CRISPR gRNA sequence
gagatagtaagtggtaagct

SEQ ID NO: 609760 - DNA, 20 bp, Artificial
  CRISPR gRNA sequence
gatagtaagtggtaagctag

SEQ ID NO: 609761 - DNA, 20 bp, Artificial
  CRISPR gRNA sequence
atagtaagtggtaagctagg

SEQ ID NO: 609762 - DNA, 20 bp, Artificial
  CRISPR gRNA sequence
atcgttgactcttaacaaaa

SEQ ID NO: 609763 - DNA, 20 bp, Artificial
  CRISPR gRNA sequence
actcttaacaaaaaagattc

SEQ ID NO: 609764 - DNA, 20 bp, Artificial
  CRISPR gRNA sequence
attcaagttcatatgaaaat

SEQ ID NO: 609765 - DNA, 20 bp, Artificial
  CRISPR gRNA sequence
tcatatgaaaattggtttaa

SEQ ID NO: 609766 - DNA, 20 bp, Artificial
  CRISPR gRNA sequence
aattggtttaatggtaatga

SEQ ID NO: 609767 - DNA, 20 bp, Artificial
  CRISPR gRNA sequence
atggctttcactataatgca

SEQ ID NO: 609768 - DNA, 20 bp, Artificial
  CRISPR gRNA sequence
gctttcactataatgcaaag

SEQ ID NO: 609769 - DNA, 20 bp, Artificial
  CRISPR gRNA sequence
cactataatgcaaagtagtg

SEQ ID NO: 609770 - DNA, 20 bp, Artificial
  CRISPR gRNA sequence
atgcaaagtagtgtagtgta

SEQ ID NO: 609771 - DNA, 20 bp, Artificial
  CRISPR gRNA sequence
atattaataactaatattct

SEQ ID NO: 609772 - DNA, 20 bp, Artificial
  CRISPR gRNA sequence
attaataactaatattctca

SEQ ID NO: 609773 - DNA, 20 bp, Artificial
  CRISPR gRNA sequence
agttttaaaatatacttttt

SEQ ID NO: 609774 - DNA, 20 bp, Artificial
  CRISPR gRNA sequence
tttaaaatatacttttttgg

SEQ ID NO: 609775 - DNA, 20 bp, Artificial
  CRISPR gRNA sequence
atcacaataaatttatttaa

SEQ ID NO: 609776 - DNA, 20 bp, Artificial
  CRISPR gRNA sequence
ttaaaagttttatttctaaa

SEQ ID NO: 609777 - DNA, 20 bp, Artificial
  CRISPR gRNA sequence
attacgtgcttaaaacatta

SEQ ID NO: 609778 - DNA, 20 bp, Artificial
  CRISPR gRNA sequence
gcttaaaacattaaagatac

SEQ ID NO: 609779 - DNA, 20 bp, Artificial
  CRISPR gRNA sequence
cttaaaacattaaagataca

SEQ ID NO: 609780 - DNA, 20 bp, Artificial
  CRISPR gRNA sequence
aaaacattaaagatacaagg

SEQ ID NO: 609781 - DNA, 20 bp, Artificial
  CRISPR gRNA sequence
aaacattaaagatacaaggt

SEQ ID NO: 609782 - DNA, 20 bp, Artificial
  CRISPR gRNA sequence
taaagatacaaggtaggtca

SEQ ID NO: 609783 - DNA, 20 bp, Artificial
  CRISPR gRNA sequence
aacctttcataatacacatg

SEQ ID NO: 609784 - DNA, 20 bp, Artificial
  CRISPR gRNA sequence
tcataatacacatgaagaaa

SEQ ID NO: 609785 - DNA, 20 bp, Artificial
  CRISPR gRNA sequence
atacacatgaagaaatagtc

SEQ ID NO: 609786 - DNA, 20 bp, Artificial
  CRISPR gRNA sequence
tttgtccattatcccttatg

SEQ ID NO: 609787 - DNA, 20 bp, Artificial
  CRISPR gRNA sequence
ttgtccattatcccttatgt

SEQ ID NO: 609788 - DNA, 20 bp, Artificial
  CRISPR gRNA sequence
cattatcccttatgtaggta

SEQ ID NO: 609789 - DNA, 20 bp, Artificial
  CRISPR gRNA sequence
attatcccttatgtaggtaa

SEQ ID NO: 609790 - DNA, 20 bp, Artificial
  CRISPR gRNA sequence
tgtaggtaaaggcattgctg

SEQ ID NO: 609791 - DNA, 20 bp, Artificial
  CRISPR gRNA sequence
ggtaaaggcattgctgaagc

SEQ ID NO: 609792 - DNA, 20 bp, Artificial
  CRISPR gRNA sequence
ggcattgctgaagctagaac

SEQ ID NO: 609793 - DNA, 20 bp, Artificial
  CRISPR gRNA sequence
gcattgctgaagctagaacc

SEQ ID NO: 609794 - DNA, 20 bp, Artificial
  CRISPR gRNA sequence
cattgctgaagctagaacca

SEQ ID NO: 609795 - DNA, 20 bp, Artificial
  CRISPR gRNA sequence
gggttttctgatgcccatac

SEQ ID NO: 609796 - DNA, 20 bp, Artificial
  CRISPR gRNA sequence
atgcccatactggttttgtt

SEQ ID NO: 609797 - DNA, 20 bp, Artificial
  CRISPR gRNA sequence
tgttcagacacactattgct

SEQ ID NO: 609798 - DNA, 20 bp, Artificial
  CRISPR gRNA sequence
cacactattgcttggtatgt

SEQ ID NO: 609799 - DNA, 20 bp, Artificial
  CRISPR gRNA sequence
gcttggtatgtcagtatacc

SEQ ID NO: 609800 - DNA, 20 bp, Artificial
  CRISPR gRNA sequence
gtataccaagaatttattat

SEQ ID NO: 609801 - DNA, 20 bp, Artificial
  CRISPR gRNA sequence
tataccaagaatttattata

SEQ ID NO: 609802 - DNA, 20 bp, Artificial
  CRISPR gRNA sequence
ataaggtatgactgtaaact

SEQ ID NO: 609803 - DNA, 20 bp, Artificial
  CRISPR gRNA sequence
taaggtatgactgtaaacta

SEQ ID NO: 609804 - DNA, 20 bp, Artificial
  CRISPR gRNA sequence
ggctgatatcttaaaaatta

SEQ ID NO: 609805 - DNA, 20 bp, Artificial
  CRISPR gRNA sequence
gatatcttaaaaattacagt

SEQ ID NO: 609806 - DNA, 20 bp, Artificial
  CRISPR gRNA sequence
atcttaaaaattacagtgag

SEQ ID NO: 609807 - DNA, 20 bp, Artificial
  CRISPR gRNA sequence
gagaagttatacattaaaat

SEQ ID NO: 609808 - DNA, 20 bp, Artificial
  CRISPR gRNA sequence
gttatcataatcaaaatcat

SEQ ID NO: 609809 - DNA, 20 bp, Artificial
  CRISPR gRNA sequence
ataatcaaaatcatcagctt

SEQ ID NO: 609810 - DNA, 20 bp, Artificial
  CRISPR gRNA sequence
atatacttattccaatcata

SEQ ID NO: 609811 - DNA, 20 bp, Artificial
  CRISPR gRNA sequence
ttttttatctcctttttaaa

SEQ ID NO: 609812 - DNA, 20 bp, Artificial
  CRISPR gRNA sequence
tttaaaaatatttatattac

SEQ ID NO: 609813 - DNA, 20 bp, Artificial
  CRISPR gRNA sequence
aacttttttctttaattttt

SEQ ID NO: 609814 - DNA, 20 bp, Artificial
  CRISPR gRNA sequence
tctttaatttttaagtgtct

SEQ ID NO: 609815 - DNA, 20 bp, Artificial
  CRISPR gRNA sequence
aatttttaagtgtcttagaa

SEQ ID NO: 609816 - DNA, 20 bp, Artificial
  CRISPR gRNA sequence
atttttaagtgtcttagaaa

SEQ ID NO: 609817 - DNA, 20 bp, Artificial
  CRISPR gRNA sequence
agtgtcttagaaaaggttga

SEQ ID NO: 609818 - DNA, 20 bp, Artificial
  CRISPR gRNA sequence
ttagaaaaggttgaaagatc

SEQ ID NO: 609819 - DNA, 20 bp, Artificial
  CRISPR gRNA sequence
aaaggttgaaagatcaagct

SEQ ID NO: 609820 - DNA, 20 bp, Artificial
  CRISPR gRNA sequence
cttggtatctatttgataaa

SEQ ID NO: 609821 - DNA, 20 bp, Artificial
  CRISPR gRNA sequence
tatctatttgataaaaagta

SEQ ID NO: 609822 - DNA, 20 bp, Artificial
  CRISPR gRNA sequence
atctatttgataaaaagtaa

SEQ ID NO: 609823 - DNA, 20 bp, Artificial
  CRISPR gRNA sequence
tctatttgataaaaagtaaa

SEQ ID NO: 609824 - DNA, 20 bp, Artificial
  CRISPR gRNA sequence
ttgataaaaagtaaagggaa

SEQ ID NO: 609825 - DNA, 20 bp, Artificial
  CRISPR gRNA sequence
tcatgaactaattctaacga

SEQ ID NO: 609826 - DNA, 20 bp, Artificial
  CRISPR gRNA sequence
ctaacgacagttctaaaaac

SEQ ID NO: 609827 - DNA, 20 bp, Artificial
  CRISPR gRNA sequence
ttctaaaaacaagttccaca

SEQ ID NO: 609828 - DNA, 20 bp, Artificial
  CRISPR gRNA sequence
ttataatatattcattatgt

SEQ ID NO: 609829 - DNA, 20 bp, Artificial
  CRISPR gRNA sequence
ataatatattcattatgtaa

SEQ ID NO: 609830 - DNA, 20 bp, Artificial
  CRISPR gRNA sequence
tatgtaagagtgattgtatt

SEQ ID NO: 609831 - DNA, 20 bp, Artificial
  CRISPR gRNA sequence
atgtaagagtgattgtatta

SEQ ID NO: 609832 - DNA, 20 bp, Artificial
  CRISPR gRNA sequence
taagagtgattgtattaagg

SEQ ID NO: 609833 - DNA, 20 bp, Artificial
  CRISPR gRNA sequence
aatgtgtaacttctcctatc

SEQ ID NO: 609834 - DNA, 20 bp, Artificial
  CRISPR gRNA sequence
agtaaaatacaaacaaaaca

SEQ ID NO: 609835 - DNA, 20 bp, Artificial
  CRISPR gRNA sequence
aaatacaaacaaaacacagt

SEQ ID NO: 609836 - DNA, 20 bp, Artificial
  CRISPR gRNA sequence
acaaaacacagtcagtctaa

SEQ ID NO: 609837 - DNA, 20 bp, Artificial
  CRISPR gRNA sequence
cagtcagtctaatggctttt

SEQ ID NO: 609838 - DNA, 20 bp, Artificial
  CRISPR gRNA sequence
tgcatgcaatgttaaatttt

SEQ ID NO: 609839 - DNA, 20 bp, Artificial
  CRISPR gRNA sequence
gctaaaaaataaactaaaaa

SEQ ID NO: 609840 - DNA, 20 bp, Artificial
  CRISPR gRNA sequence
aataaactaaaaacagtatt

SEQ ID NO: 609841 - DNA, 20 bp, Artificial
  CRISPR gRNA sequence
aaactaaaaacagtatttag

SEQ ID NO: 609842 - DNA, 20 bp, Artificial
  CRISPR gRNA sequence
gatcttttatgttctgaatt

SEQ ID NO: 609843 - DNA, 20 bp, Artificial
  CRISPR gRNA sequence
ttctgaattaagaaaattca

SEQ ID NO: 609844 - DNA, 20 bp, Artificial
  CRISPR gRNA sequence
attaagaaaattcaaagaac

SEQ ID NO: 609845 - DNA, 20 bp, Artificial
  CRISPR gRNA sequence
taagaaaattcaaagaacca

SEQ ID NO: 609846 - DNA, 20 bp, Artificial
  CRISPR gRNA sequence
aaattcaaagaaccagagta

SEQ ID NO: 609847 - DNA, 20 bp, Artificial
  CRISPR gRNA sequence
aagaaccagagtacagtttt

SEQ ID NO: 609848 - DNA, 20 bp, Artificial
  CRISPR gRNA sequence
agtacagtttttagaaaatt

SEQ ID NO: 609849 - DNA, 20 bp, Artificial
  CRISPR gRNA sequence
gtacagtttttagaaaattt

SEQ ID NO: 609850 - DNA, 20 bp, Artificial
  CRISPR gRNA sequence
tttagaaaatttaggttaat

SEQ ID NO: 609851 - DNA, 20 bp, Artificial
  CRISPR gRNA sequence
ggttaatcagtgattcactg

SEQ ID NO: 609852 - DNA, 20 bp, Artificial
  CRISPR gRNA sequence
gtagctacaataatattcat

SEQ ID NO: 609853 - DNA, 20 bp, Artificial
  CRISPR gRNA sequence
tagctacaataatattcatg

SEQ ID NO: 609854 - DNA, 20 bp, Artificial
  CRISPR gRNA sequence
actgtccttttgttatttac

SEQ ID NO: 609855 - DNA, 20 bp, Artificial
  CRISPR gRNA sequence
ccttttgttatttactagtg

SEQ ID NO: 609856 - DNA, 20 bp, Artificial
  CRISPR gRNA sequence
tttgttatttactagtgtgg

SEQ ID NO: 609857 - DNA, 20 bp, Artificial
  CRISPR gRNA sequence
tgttatttactagtgtggta

SEQ ID NO: 609858 - DNA, 20 bp, Artificial
  CRISPR gRNA sequence
atttttgaaaataatctaat

SEQ ID NO: 609859 - DNA, 20 bp, Artificial
  CRISPR gRNA sequence
ataatctaattggcataata

SEQ ID NO: 609860 - DNA, 20 bp, Artificial
  CRISPR gRNA sequence
ggcataataaagtttataaa

SEQ ID NO: 609861 - DNA, 20 bp, Artificial
  CRISPR gRNA sequence
aaagtttataaacagttata

SEQ ID NO: 609862 - DNA, 20 bp, Artificial
  CRISPR gRNA sequence
atacagatttccacaaatcc

SEQ ID NO: 609863 - DNA, 20 bp, Artificial
  CRISPR gRNA sequence
tacagatttccacaaatcct

SEQ ID NO: 609864 - DNA, 20 bp, Artificial
  CRISPR gRNA sequence
tccacaaatcctaggaatac

SEQ ID NO: 609865 - DNA, 20 bp, Artificial
  CRISPR gRNA sequence
gagactcactcaactcataa

SEQ ID NO: 609866 - DNA, 20 bp, Artificial
  CRISPR gRNA sequence
ctcactcaactcataacagc

SEQ ID NO: 609867 - DNA, 20 bp, Artificial
  CRISPR gRNA sequence
tcactcaactcataacagca

SEQ ID NO: 609868 - DNA, 20 bp, Artificial
  CRISPR gRNA sequence
actcaactcataacagcaag

SEQ ID NO: 609869 - DNA, 20 bp, Artificial
  CRISPR gRNA sequence
taacagcaaggagtatgtta

SEQ ID NO: 609870 - DNA, 20 bp, Artificial
  CRISPR gRNA sequence
cactatctttttttgtcaat

SEQ ID NO: 609871 - DNA, 20 bp, Artificial
  CRISPR gRNA sequence
ttttgtcaatcagtgtttat

SEQ ID NO: 609872 - DNA, 20 bp, Artificial
  CRISPR gRNA sequence
ttgtcaatcagtgtttattg

SEQ ID NO: 609873 - DNA, 20 bp, Artificial
  CRISPR gRNA sequence
gcaaattattatactttctt

SEQ ID NO: 609874 - DNA, 20 bp, Artificial
  CRISPR gRNA sequence
tattatactttcttcagatc

SEQ ID NO: 609875 - DNA, 20 bp, Artificial
  CRISPR gRNA sequence
tcagatctagatttttctta

SEQ ID NO: 609876 - DNA, 20 bp, Artificial
  CRISPR gRNA sequence
tagatttttcttaaagttaa

SEQ ID NO: 609877 - DNA, 20 bp, Artificial
  CRISPR gRNA sequence
ttaaagttaatagccattta

SEQ ID NO: 609878 - DNA, 20 bp, Artificial
  CRISPR gRNA sequence
aaagttaatagccatttacg

SEQ ID NO: 609879 - DNA, 20 bp, Artificial
  CRISPR gRNA sequence
gttaatagccatttacggag

SEQ ID NO: 609880 - DNA, 20 bp, Artificial
  CRISPR gRNA sequence
ctttgtcaactttgaaattg

SEQ ID NO: 609881 - DNA, 20 bp, Artificial
  CRISPR gRNA sequence
tggacatgatatcattaaac

SEQ ID NO: 609882 - DNA, 20 bp, Artificial
  CRISPR gRNA sequence
tcaacatatttctgatgatc

SEQ ID NO: 609883 - DNA, 20 bp, Artificial
  CRISPR gRNA sequence
atgatccagtttatacatct

SEQ ID NO: 609884 - DNA, 20 bp, Artificial
  CRISPR gRNA sequence
caccactttaataccatttt

SEQ ID NO: 609885 - DNA, 20 bp, Artificial
  CRISPR gRNA sequence
ctttaataccattttgagac

SEQ ID NO: 609886 - DNA, 20 bp, Artificial
  CRISPR gRNA sequence
aataccattttgagactaga

SEQ ID NO: 609887 - DNA, 20 bp, Artificial
  CRISPR gRNA sequence
tgcatttctttaatttaaac

SEQ ID NO: 609888 - DNA, 20 bp, Artificial
  CRISPR gRNA sequence
tctttaatttaaactagatt

SEQ ID NO: 609889 - DNA, 20 bp, Artificial
  CRISPR gRNA sequence
aaactagattgagaaaaatg

SEQ ID NO: 609890 - DNA, 20 bp, Artificial
  CRISPR gRNA sequence
tagattgagaaaaatgtagt

SEQ ID NO: 609891 - DNA, 20 bp, Artificial
  CRISPR gRNA sequence
agaaaaatgtagtcagaatc

SEQ ID NO: 609892 - DNA, 20 bp, Artificial
  CRISPR gRNA sequence
tgtagtcagaatctagtcat

SEQ ID NO: 609893 - DNA, 20 bp, Artificial
  CRISPR gRNA sequence
ttctccttaataccatgaac

SEQ ID NO: 609894 - DNA, 20 bp, Artificial
  CRISPR gRNA sequence
ccatgaactagtctgcattt

SEQ ID NO: 609895 - DNA, 20 bp, Artificial
  CRISPR gRNA sequence
attgtttatctctcatatta

SEQ ID NO: 609896 - DNA, 20 bp, Artificial
  CRISPR gRNA sequence
taaaaccttataatgccttt

SEQ ID NO: 609897 - DNA, 20 bp, Artificial
  CRISPR gRNA sequence
cctttgagaaacatatattt

SEQ ID NO: 609898 - DNA, 20 bp, Artificial
  CRISPR gRNA sequence
aacatatattttagtgtttt

SEQ ID NO: 609899 - DNA, 20 bp, Artificial
  CRISPR gRNA sequence
attttagtgtttttagttca

SEQ ID NO: 609900 - DNA, 20 bp, Artificial
  CRISPR gRNA sequence
tctaatataatttttttttt

SEQ ID NO: 609901 - DNA, 20 bp, Artificial
  CRISPR gRNA sequence
atataattttttttttgagt

SEQ ID NO: 609902 - DNA, 20 bp, Artificial
  CRISPR gRNA sequence
ataattttttttttgagttg

SEQ ID NO: 609903 - DNA, 20 bp, Artificial
  CRISPR gRNA sequence
tggagtcttgctctgtcgcc

SEQ ID NO: 609904 - DNA, 20 bp, Artificial
  CRISPR gRNA sequence
ggagtcttgctctgtcgccc

SEQ ID NO: 609905 - DNA, 20 bp, Artificial
  CRISPR gRNA sequence
tcttgctctgtcgcccaggc

SEQ ID NO: 609906 - DNA, 20 bp, Artificial
  CRISPR gRNA sequence
ttgctctgtcgcccaggctg

SEQ ID NO: 609907 - DNA, 20 bp, Artificial
  CRISPR gRNA sequence
ctgtcgcccaggctggagtg

SEQ ID NO: 609908 - DNA, 20 bp, Artificial
  CRISPR gRNA sequence
tcgcccaggctggagtgtag

SEQ ID NO: 609909 - DNA, 20 bp, Artificial
  CRISPR gRNA sequence
ggagtgtagtggtgcaatct

SEQ ID NO: 609910 - DNA, 20 bp, Artificial
  CRISPR gRNA sequence
tcactgcaccctccacctcc

SEQ ID NO: 609911 - DNA, 20 bp, Artificial
  CRISPR gRNA sequence
cactgcaccctccacctcct

SEQ ID NO: 609912 - DNA, 20 bp, Artificial
  CRISPR gRNA sequence
accctccacctcctgggttc

SEQ ID NO: 609913 - DNA, 20 bp, Artificial
  CRISPR gRNA sequence
ttcaagcgatcctcctgcct

SEQ ID NO: 609914 - DNA, 20 bp, Artificial
  CRISPR gRNA sequence
tcctcctgcctcagcctcca

SEQ ID NO: 609915 - DNA, 20 bp, Artificial
  CRISPR gRNA sequence
tcctgcctcagcctccaaag

SEQ ID NO: 609916 - DNA, 20 bp, Artificial
  CRISPR gRNA sequence
gcctcagcctccaaagtagc

SEQ ID NO: 609917 - DNA, 20 bp, Artificial
  CRISPR gRNA sequence
gaattacatgtgcccaccac

SEQ ID NO: 609918 - DNA, 20 bp, Artificial
  CRISPR gRNA sequence
aattacatgtgcccaccacc

SEQ ID NO: 609919 - DNA, 20 bp, Artificial
  CRISPR gRNA sequence
catgtgcccaccaccaggcc

SEQ ID NO: 609920 - DNA, 20 bp, Artificial
  CRISPR gRNA sequence
ccagctaatttctgtatttt

SEQ ID NO: 609921 - DNA, 20 bp, Artificial
  CRISPR gRNA sequence
gctaatttctgtatttttag

SEQ ID NO: 609922 - DNA, 20 bp, Artificial
  CRISPR gRNA sequence
taatttctgtatttttagta

SEQ ID NO: 609923 - DNA, 20 bp, Artificial
  CRISPR gRNA sequence
ttctgtatttttagtagaga

SEQ ID NO: 609924 - DNA, 20 bp, Artificial
  CRISPR gRNA sequence
tctgtatttttagtagagac

SEQ ID NO: 609925 - DNA, 20 bp, Artificial
  CRISPR gRNA sequence
ctgtatttttagtagagaca

SEQ ID NO: 609926 - DNA, 20 bp, Artificial
  CRISPR gRNA sequence
gagacagggtttcaccatgt

SEQ ID NO: 609927 - DNA, 20 bp, Artificial
  CRISPR gRNA sequence
tggtctcaaactcctgacct

SEQ ID NO: 609928 - DNA, 20 bp, Artificial
  CRISPR gRNA sequence
ctcagttgttccacccaccc

SEQ ID NO: 609929 - DNA, 20 bp, Artificial
  CRISPR gRNA sequence
ccacccaccctagcctctca

SEQ ID NO: 609930 - DNA, 20 bp, Artificial
  CRISPR gRNA sequence
accctagcctctcaaagtgc

SEQ ID NO: 609931 - DNA, 20 bp, Artificial
  CRISPR gRNA sequence
ccctagcctctcaaagtgct

SEQ ID NO: 609932 - DNA, 20 bp, Artificial
  CRISPR gRNA sequence
ctctcaaagtgctgggatta

SEQ ID NO: 609933 - DNA, 20 bp, Artificial
  CRISPR gRNA sequence
tctcaaagtgctgggattac

SEQ ID NO: 609934 - DNA, 20 bp, Artificial
  CRISPR gRNA sequence
agtgctgggattacaggcgt

SEQ ID NO: 609935 - DNA, 20 bp, Artificial
  CRISPR gRNA sequence
caggcgtgagccaccgtgcc

SEQ ID NO: 609936 - DNA, 20 bp, Artificial
  CRISPR gRNA sequence
agcctctaatataaaattga

SEQ ID NO: 609937 - DNA, 20 bp, Artificial
  CRISPR gRNA sequence
tataaaattgatagtgaaaa

SEQ ID NO: 609938 - DNA, 20 bp, Artificial
  CRISPR gRNA sequence
tccaattcattacaatatca

SEQ ID NO: 609939 - DNA, 20 bp, Artificial
  CRISPR gRNA sequence
caattcattacaatatcatg

SEQ ID NO: 609940 - DNA, 20 bp, Artificial
  CRISPR gRNA sequence
attacaatatcatggagcat

SEQ ID NO: 609941 - DNA, 20 bp, Artificial
  CRISPR gRNA sequence
ttctctgtcatactctacta

SEQ ID NO: 609942 - DNA, 20 bp, Artificial
  CRISPR gRNA sequence
ctctactaaagtaccaattg

SEQ ID NO: 609943 - DNA, 20 bp, Artificial
  CRISPR gRNA sequence
caattgcagtgtcttattaa

SEQ ID NO: 609944 - DNA, 20 bp, Artificial
  CRISPR gRNA sequence
atggtttcattttattgatt

SEQ ID NO: 609945 - DNA, 20 bp, Artificial
  CRISPR gRNA sequence
ttgatttggtattgctactt

SEQ ID NO: 609946 - DNA, 20 bp, Artificial
  CRISPR gRNA sequence
tttggtattgctactttagt

SEQ ID NO: 609947 - DNA, 20 bp, Artificial
  CRISPR gRNA sequence
ttgctactttagtaagtaat

SEQ ID NO: 609948 - DNA, 20 bp, Artificial
  CRISPR gRNA sequence
tgctactttagtaagtaatc

SEQ ID NO: 609949 - DNA, 20 bp, Artificial
  CRISPR gRNA sequence
taatcaggtaatattgtcat

SEQ ID NO: 609950 - DNA, 20 bp, Artificial
  CRISPR gRNA sequence
aatattgtcatcggatactc

SEQ ID NO: 609951 - DNA, 20 bp, Artificial
  CRISPR gRNA sequence
atattgtcatcggatactcc

SEQ ID NO: 609952 - DNA, 20 bp, Artificial
  CRISPR gRNA sequence
atactccaggcactcttcac

SEQ ID NO: 609953 - DNA, 20 bp, Artificial
  CRISPR gRNA sequence
tactccaggcactcttcact

SEQ ID NO: 609954 - DNA, 20 bp, Artificial
  CRISPR gRNA sequence
ggcactcttcactgggaata

SEQ ID NO: 609955 - DNA, 20 bp, Artificial
  CRISPR gRNA sequence
cactcttcactgggaatata

SEQ ID NO: 609956 - DNA, 20 bp, Artificial
  CRISPR gRNA sequence
ctcttcactgggaatataga

SEQ ID NO: 609957 - DNA, 20 bp, Artificial
  CRISPR gRNA sequence
ttcactgggaatatagagag

SEQ ID NO: 609958 - DNA, 20 bp, Artificial
  CRISPR gRNA sequence
cactgggaatatagagagaa

SEQ ID NO: 609959 - DNA, 20 bp, Artificial
  CRISPR gRNA sequence
tagagagaagagtaaacaaa

SEQ ID NO: 609960 - DNA, 20 bp, Artificial
  CRISPR gRNA sequence
agagagaagagtaaacaaat

SEQ ID NO: 609961 - DNA, 20 bp, Artificial
  CRISPR gRNA sequence
gagagaagagtaaacaaata

SEQ ID NO: 609962 - DNA, 20 bp, Artificial
  CRISPR gRNA sequence
gaagagtaaacaaataggga

SEQ ID NO: 609963 - DNA, 20 bp, Artificial
  CRISPR gRNA sequence
atgcatgaacacatatcgat

SEQ ID NO: 609964 - DNA, 20 bp, Artificial
  CRISPR gRNA sequence
tcgattggacattatacata

SEQ ID NO: 609965 - DNA, 20 bp, Artificial
  CRISPR gRNA sequence
tctactcccatcttgtaact

SEQ ID NO: 609966 - DNA, 20 bp, Artificial
  CRISPR gRNA sequence
ccatcttgtaactcagtttt

SEQ ID NO: 609967 - DNA, 20 bp, Artificial
  CRISPR gRNA sequence
gcaccgtattttgtacattg

SEQ ID NO: 609968 - DNA, 20 bp, Artificial
  CRISPR gRNA sequence
ttgtacattgcagctttgtg

SEQ ID NO: 609969 - DNA, 20 bp, Artificial
  CRISPR gRNA sequence
tgcagccatcctcttgctca

SEQ ID NO: 609970 - DNA, 20 bp, Artificial
  CRISPR gRNA sequence
gcagccatcctcttgctcaa

SEQ ID NO: 609971 - DNA, 20 bp, Artificial
  CRISPR gRNA sequence
tcctcttgctcaaaggcact

SEQ ID NO: 609972 - DNA, 20 bp, Artificial
  CRISPR gRNA sequence
tcttgctcaaaggcactcag

SEQ ID NO: 609973 - DNA, 20 bp, Artificial
  CRISPR gRNA sequence
aaggcactcagcagatgctt

SEQ ID NO: 609974 - DNA, 20 bp, Artificial
  CRISPR gRNA sequence
cttgagattctgcatatttg

SEQ ID NO: 609975 - DNA, 20 bp, Artificial
  CRISPR gRNA sequence
ttgagattctgcatatttgt

SEQ ID NO: 609976 - DNA, 20 bp, Artificial
  CRISPR gRNA sequence
gtaggttgttccacccaaca

SEQ ID NO: 609977 - DNA, 20 bp, Artificial
  CRISPR gRNA sequence
taggttgttccacccaacat

SEQ ID NO: 609978 - DNA, 20 bp, Artificial
  CRISPR gRNA sequence
ggttgttccacccaacatag

SEQ ID NO: 609979 - DNA, 20 bp, Artificial
  CRISPR gRNA sequence
cctctgtctttgattcacca

SEQ ID NO: 609980 - DNA, 20 bp, Artificial
  CRISPR gRNA sequence
tgtctttgattcaccaaagc

SEQ ID NO: 609981 - DNA, 20 bp, Artificial
  CRISPR gRNA sequence
tttaattgaatatttaaatg

SEQ ID NO: 609982 - DNA, 20 bp, Artificial
  CRISPR gRNA sequence
ttaattgaatatttaaatgc

SEQ ID NO: 609983 - DNA, 20 bp, Artificial
  CRISPR gRNA sequence
tgaatatttaaatgcaggtc

SEQ ID NO: 609984 - DNA, 20 bp, Artificial
  CRISPR gRNA sequence
tttaaatgcaggtctagaaa

SEQ ID NO: 609985 - DNA, 20 bp, Artificial
  CRISPR gRNA sequence
ttaaatgcaggtctagaaat

SEQ ID NO: 609986 - DNA, 20 bp, Artificial
  CRISPR gRNA sequence
tctagaaataggtgtttatg

SEQ ID NO: 609987 - DNA, 20 bp, Artificial
  CRISPR gRNA sequence
ctagaaataggtgtttatga

SEQ ID NO: 609988 - DNA, 20 bp, Artificial
  CRISPR gRNA sequence
tacataaaatattgaaatat

SEQ ID NO: 609989 - DNA, 20 bp, Artificial
  CRISPR gRNA sequence
aaataatatataatctcacc

SEQ ID NO: 609990 - DNA, 20 bp, Artificial
  CRISPR gRNA sequence
acccagtcaataaataaaaa

SEQ ID NO: 609991 - DNA, 20 bp, Artificial
  CRISPR gRNA sequence
gtcaataaataaaaatggac

SEQ ID NO: 609992 - DNA, 20 bp, Artificial
  CRISPR gRNA sequence
aataaataaaaatggaccag

SEQ ID NO: 609993 - DNA, 20 bp, Artificial
  CRISPR gRNA sequence
taaaaataaaaacaaaacaa

SEQ ID NO: 609994 - DNA, 20 bp, Artificial
  CRISPR gRNA sequence
taaaaacaaaacaacagatt

SEQ ID NO: 609995 - DNA, 20 bp, Artificial
  CRISPR gRNA sequence
caaaacaacagattgagata

SEQ ID NO: 609996 - DNA, 20 bp, Artificial
  CRISPR gRNA sequence
cagattgagatatggacatg

SEQ ID NO: 609997 - DNA, 20 bp, Artificial
  CRISPR gRNA sequence
agattgagatatggacatga

SEQ ID NO: 609998 - DNA, 20 bp, Artificial
  CRISPR gRNA sequence
cttaattattttcctcgatc

SEQ ID NO: 609999 - DNA, 20 bp, Artificial
  CRISPR gRNA sequence
tttcctcgatccagttttgt

SEQ ID NO: 610000 - DNA, 20 bp, Artificial
  CRISPR gRNA sequence
tcgatccagttttgttagtc

SEQ ID NO: 610001 - DNA, 20 bp, Artificial
  CRISPR gRNA sequence
gtctagatttttgtgcctac

SEQ ID NO: 610002 - DNA, 20 bp, Artificial
  CRISPR gRNA sequence
tctagatttttgtgcctacc

SEQ ID NO: 610003 - DNA, 20 bp, Artificial
  CRISPR gRNA sequence
ctagatttttgtgcctacca

SEQ ID NO: 610004 - DNA, 20 bp, Artificial
  CRISPR gRNA sequence
tagatttttgtgcctaccag

SEQ ID NO: 610005 - DNA, 20 bp, Artificial
  CRISPR gRNA sequence
tttttgtgcctaccagggga

SEQ ID NO: 610006 - DNA, 20 bp, Artificial
  CRISPR gRNA sequence
gtgcctaccaggggaaagat

SEQ ID NO: 610007 - DNA, 20 bp, Artificial
  CRISPR gRNA sequence
aggggaaagattagtcatta

SEQ ID NO: 610008 - DNA, 20 bp, Artificial
  CRISPR gRNA sequence
aacaaactacttaatgtttt

SEQ ID NO: 610009 - DNA, 20 bp, Artificial
  CRISPR gRNA sequence
actacttaatgttttcagct

SEQ ID NO: 610010 - DNA, 20 bp, Artificial
  CRISPR gRNA sequence
cttggattgctccattaatg

SEQ ID NO: 610011 - DNA, 20 bp, Artificial
  CRISPR gRNA sequence
gattgctccattaatgtagt

SEQ ID NO: 610012 - DNA, 20 bp, Artificial
  CRISPR gRNA sequence
aatgtagttagtaaatttgt

SEQ ID NO: 610013 - DNA, 20 bp, Artificial
  CRISPR gRNA sequence
tttgctttgatatacatatg

SEQ ID NO: 610014 - DNA, 20 bp, Artificial
  CRISPR gRNA sequence
aacatgattaatattttttt

SEQ ID NO: 610015 - DNA, 20 bp, Artificial
  CRISPR gRNA sequence
attaatatttttttcagaca

SEQ ID NO: 610016 - DNA, 20 bp, Artificial
  CRISPR gRNA sequence
aaagtctaaactgactcaaa

SEQ ID NO: 610017 - DNA, 20 bp, Artificial
  CRISPR gRNA sequence
aagtctaaactgactcaaaa

SEQ ID NO: 610018 - DNA, 20 bp, Artificial
  CRISPR gRNA sequence
agtctaaactgactcaaaaa

SEQ ID NO: 610019 - DNA, 20 bp, Artificial
  CRISPR gRNA sequence
tcaaaaagggcacattgatg

SEQ ID NO: 610020 - DNA, 20 bp, Artificial
  CRISPR gRNA sequence
acattgatgcagtccattta

SEQ ID NO: 610021 - DNA, 20 bp, Artificial
  CRISPR gRNA sequence
ttaaagaacaaattatttac

SEQ ID NO: 610022 - DNA, 20 bp, Artificial
  CRISPR gRNA sequence
attatttacaagaaataatt

SEQ ID NO: 610023 - DNA, 20 bp, Artificial
  CRISPR gRNA sequence
aattgagatatgttgtttta

SEQ ID NO: 610024 - DNA, 20 bp, Artificial
  CRISPR gRNA sequence
tatgttgttttaaagtttca

SEQ ID NO: 610025 - DNA, 20 bp, Artificial
  CRISPR gRNA sequence
ttgttttaaagtttcataga

SEQ ID NO: 610026 - DNA, 20 bp, Artificial
  CRISPR gRNA sequence
ttaaagtttcatagacagta

SEQ ID NO: 610027 - DNA, 20 bp, Artificial
  CRISPR gRNA sequence
aaagtttcatagacagtatg

SEQ ID NO: 610028 - DNA, 20 bp, Artificial
  CRISPR gRNA sequence
ttgcatatgtaccatttgca

SEQ ID NO: 610029 - DNA, 20 bp, Artificial
  CRISPR gRNA sequence
gcatatgtaccatttgcata

SEQ ID NO: 610030 - DNA, 20 bp, Artificial
  CRISPR gRNA sequence
tgtaccatttgcatagagaa

SEQ ID NO: 610031 - DNA, 20 bp, Artificial
  CRISPR gRNA sequence
ccatttgcatagagaaaaga

SEQ ID NO: 610032 - DNA, 20 bp, Artificial
  CRISPR gRNA sequence
tgaatcttttacttaattat

SEQ ID NO: 610033 - DNA, 20 bp, Artificial
  CRISPR gRNA sequence
tacacttattctgtaatgcc

SEQ ID NO: 610034 - DNA, 20 bp, Artificial
  CRISPR gRNA sequence
acacttattctgtaatgcct

SEQ ID NO: 610035 - DNA, 20 bp, Artificial
  CRISPR gRNA sequence
ttattctgtaatgcctaggc

SEQ ID NO: 610036 - DNA, 20 bp, Artificial
  CRISPR gRNA sequence
tattctgtaatgcctaggcc

SEQ ID NO: 610037 - DNA, 20 bp, Artificial
  CRISPR gRNA sequence
taccccacgacattcaataa

SEQ ID NO: 610038 - DNA, 20 bp, Artificial
  CRISPR gRNA sequence
accccacgacattcaataaa

SEQ ID NO: 610039 - DNA, 20 bp, Artificial
  CRISPR gRNA sequence
ccccacgacattcaataaaa

SEQ ID NO: 610040 - DNA, 20 bp, Artificial
  CRISPR gRNA sequence
aaagggttgctaatgtttta

SEQ ID NO: 610041 - DNA, 20 bp, Artificial
  CRISPR gRNA sequence
aaataactttatcaaaaatt

SEQ ID NO: 610042 - DNA, 20 bp, Artificial
  CRISPR gRNA sequence
attcactttttatttgttat

SEQ ID NO: 610043 - DNA, 20 bp, Artificial
  CRISPR gRNA sequence
actttttatttgttattaga

SEQ ID NO: 610044 - DNA, 20 bp, Artificial
  CRISPR gRNA sequence
tatttgttattagacagata

SEQ ID NO: 610045 - DNA, 20 bp, Artificial
  CRISPR gRNA sequence
atggatattacttctatatt

SEQ ID NO: 610046 - DNA, 20 bp, Artificial
  CRISPR gRNA sequence
ttctatatttggattattcc

SEQ ID NO: 610047 - DNA, 20 bp, Artificial
  CRISPR gRNA sequence
aatataactatgtatacttt

SEQ ID NO: 610048 - DNA, 20 bp, Artificial
  CRISPR gRNA sequence
gttttaatccttgtttctaa

SEQ ID NO: 610049 - DNA, 20 bp, Artificial
  CRISPR gRNA sequence
tttctaacagtattgtcttt

SEQ ID NO: 610050 - DNA, 20 bp, Artificial
  CRISPR gRNA sequence
ttctaacagtattgtctttg

SEQ ID NO: 610051 - DNA, 20 bp, Artificial
  CRISPR gRNA sequence
tctaacagtattgtctttga

SEQ ID NO: 610052 - DNA, 20 bp, Artificial
  CRISPR gRNA sequence
attatgattccaactaactt

SEQ ID NO: 610053 - DNA, 20 bp, Artificial
  CRISPR gRNA sequence
gattccaactaactttagtt

SEQ ID NO: 610054 - DNA, 20 bp, Artificial
  CRISPR gRNA sequence
agtttggaacacaataaaac

SEQ ID NO: 610055 - DNA, 20 bp, Artificial
  CRISPR gRNA sequence
ttggaacacaataaaacaag

SEQ ID NO: 610056 - DNA, 20 bp, Artificial
  CRISPR gRNA sequence
aattatcttttcatataatc

SEQ ID NO: 610057 - DNA, 20 bp, Artificial
  CRISPR gRNA sequence
tcatataatcaagacatcaa

SEQ ID NO: 610058 - DNA, 20 bp, Artificial
  CRISPR gRNA sequence
catataatcaagacatcaac

SEQ ID NO: 610059 - DNA, 20 bp, Artificial
  CRISPR gRNA sequence
tataatcaagacatcaacag

SEQ ID NO: 610060 - DNA, 20 bp, Artificial
  CRISPR gRNA sequence
atcaagacatcaacaggagt

SEQ ID NO: 610061 - DNA, 20 bp, Artificial
  CRISPR gRNA sequence
tcaagacatcaacaggagtt

SEQ ID NO: 610062 - DNA, 20 bp, Artificial
  CRISPR gRNA sequence
aggagttaggcaaataaaat

SEQ ID NO: 610063 - DNA, 20 bp, Artificial
  CRISPR gRNA sequence
ggagttaggcaaataaaatg

SEQ ID NO: 610064 - DNA, 20 bp, Artificial
  CRISPR gRNA sequence
ttaggcaaataaaatgagga

SEQ ID NO: 610065 - DNA, 20 bp, Artificial
  CRISPR gRNA sequence
aatgaggaaagccataaaat

SEQ ID NO: 610066 - DNA, 20 bp, Artificial
  CRISPR gRNA sequence
aattagtatccaaatgtaaa

SEQ ID NO: 610067 - DNA, 20 bp, Artificial
  CRISPR gRNA sequence
aaatgtaaaaagcatctatc

SEQ ID NO: 610068 - DNA, 20 bp, Artificial
  CRISPR gRNA sequence
attcaaatcaatatctccca

SEQ ID NO: 610069 - DNA, 20 bp, Artificial
  CRISPR gRNA sequence
cccttttctcttaccaaaaa

SEQ ID NO: 610070 - DNA, 20 bp, Artificial
  CRISPR gRNA sequence
ccttttctcttaccaaaaaa

SEQ ID NO: 610071 - DNA, 20 bp, Artificial
  CRISPR gRNA sequence
tttctcttaccaaaaaaagg

SEQ ID NO: 610072 - DNA, 20 bp, Artificial
  CRISPR gRNA sequence
ttctttacttcccatgtcct

SEQ ID NO: 610073 - DNA, 20 bp, Artificial
  CRISPR gRNA sequence
tctttacttcccatgtcctt

SEQ ID NO: 610074 - DNA, 20 bp, Artificial
  CRISPR gRNA sequence
atgtccttgggaacttacca

SEQ ID NO: 610075 - DNA, 20 bp, Artificial
  CRISPR gRNA sequence
gaacttaccaaagacttcca

SEQ ID NO: 610076 - DNA, 20 bp, Artificial
  CRISPR gRNA sequence
catagtatgacttccacact

SEQ ID NO: 610077 - DNA, 20 bp, Artificial
  CRISPR gRNA sequence
atgacttccacactcagcaa

SEQ ID NO: 610078 - DNA, 20 bp, Artificial
  CRISPR gRNA sequence
tgacttccacactcagcaac

SEQ ID NO: 610079 - DNA, 20 bp, Artificial
  CRISPR gRNA sequence
cagcaacaggacaatatttc

SEQ ID NO: 610080 - DNA, 20 bp, Artificial
  CRISPR gRNA sequence
acaatatttccagatatacc

SEQ ID NO: 610081 - DNA, 20 bp, Artificial
  CRISPR gRNA sequence
tttgtttattctacgccatt

SEQ ID NO: 610082 - DNA, 20 bp, Artificial
  CRISPR gRNA sequence
ttgtttattctacgccattt

SEQ ID NO: 610083 - DNA, 20 bp, Artificial
  CRISPR gRNA sequence
tgtttattctacgccatttg

SEQ ID NO: 610084 - DNA, 20 bp, Artificial
  CRISPR gRNA sequence
tggggatgatcatataaatt

SEQ ID NO: 610085 - DNA, 20 bp, Artificial
  CRISPR gRNA sequence
ggatgatcatataaattcag

SEQ ID NO: 610086 - DNA, 20 bp, Artificial
  CRISPR gRNA sequence
agaagtaatttcttattaaa

SEQ ID NO: 610087 - DNA, 20 bp, Artificial
  CRISPR gRNA sequence
tttcttattaaaaagatttg

SEQ ID NO: 610088 - DNA, 20 bp, Artificial
  CRISPR gRNA sequence
taaaaagatttgaagatatc

SEQ ID NO: 610089 - DNA, 20 bp, Artificial
  CRISPR gRNA sequence
aaaagatttgaagatatcta

SEQ ID NO: 610090 - DNA, 20 bp, Artificial
  CRISPR gRNA sequence
ttaatcgcataaaactcaat

SEQ ID NO: 610091 - DNA, 20 bp, Artificial
  CRISPR gRNA sequence
taatcgcataaaactcaatt

SEQ ID NO: 610092 - DNA, 20 bp, Artificial
  CRISPR gRNA sequence
ttttaaaattctttttaaaa

SEQ ID NO: 610093 - DNA, 20 bp, Artificial
  CRISPR gRNA sequence
aaaagatattgtttcatttt

SEQ ID NO: 610094 - DNA, 20 bp, Artificial
  CRISPR gRNA sequence
atattgtttcatttttagac

SEQ ID NO: 610095 - DNA, 20 bp, Artificial
  CRISPR gRNA sequence
ttagactagcattatttttg

SEQ ID NO: 610096 - DNA, 20 bp, Artificial
  CRISPR gRNA sequence
agaatgaactactctaaatt

SEQ ID NO: 610097 - DNA, 20 bp, Artificial
  CRISPR gRNA sequence
gaatgaactactctaaatta

SEQ ID NO: 610098 - DNA, 20 bp, Artificial
  CRISPR gRNA sequence
atatttcaactcaaacattg

SEQ ID NO: 610099 - DNA, 20 bp, Artificial
  CRISPR gRNA sequence
tatttcaactcaaacattgt

SEQ ID NO: 610100 - DNA, 20 bp, Artificial
  CRISPR gRNA sequence
tttcaactcaaacattgtag

SEQ ID NO: 610101 - DNA, 20 bp, Artificial
  CRISPR gRNA sequence
ttcaactcaaacattgtagg

SEQ ID NO: 610102 - DNA, 20 bp, Artificial
  CRISPR gRNA sequence
caaacattgtaggaggttta

SEQ ID NO: 610103 - DNA, 20 bp, Artificial
  CRISPR gRNA sequence
aaacattgtaggaggtttaa

SEQ ID NO: 610104 - DNA, 20 bp, Artificial
  CRISPR gRNA sequence
gtaggaggtttaaaggaaat

SEQ ID NO: 610105 - DNA, 20 bp, Artificial
  CRISPR gRNA sequence
aggaggtttaaaggaaattg

SEQ ID NO: 610106 - DNA, 20 bp, Artificial
  CRISPR gRNA sequence
ggtttaaaggaaattggagt

SEQ ID NO: 610107 - DNA, 20 bp, Artificial
  CRISPR gRNA sequence
aaattggagtcagcatgcta

SEQ ID NO: 610108 - DNA, 20 bp, Artificial
  CRISPR gRNA sequence
aattggagtcagcatgctat

SEQ ID NO: 610109 - DNA, 20 bp, Artificial
  CRISPR gRNA sequence
ttggagtcagcatgctatag

SEQ ID NO: 610110 - DNA, 20 bp, Artificial
  CRISPR gRNA sequence
tgctataggagtattatcta

SEQ ID NO: 610111 - DNA, 20 bp, Artificial
  CRISPR gRNA sequence
gctataggagtattatctaa

SEQ ID NO: 610112 - DNA, 20 bp, Artificial
  CRISPR gRNA sequence
ataggagtattatctaaagg

SEQ ID NO: 610113 - DNA, 20 bp, Artificial
  CRISPR gRNA sequence
ttcaaattgttcaccacact

SEQ ID NO: 610114 - DNA, 20 bp, Artificial
  CRISPR gRNA sequence
ttagtaatttaactcttgta

SEQ ID NO: 610115 - DNA, 20 bp, Artificial
  CRISPR gRNA sequence
taacgaatttgttacttgct

SEQ ID NO: 610116 - DNA, 20 bp, Artificial
  CRISPR gRNA sequence
aacgaatttgttacttgctt

SEQ ID NO: 610117 - DNA, 20 bp, Artificial
  CRISPR gRNA sequence
cttgcttgggaaaccttacg

SEQ ID NO: 610118 - DNA, 20 bp, Artificial
  CRISPR gRNA sequence
cttacgtagacatattttaa

SEQ ID NO: 610119 - DNA, 20 bp, Artificial
  CRISPR gRNA sequence
taaaagtaaaatcaaatttt

SEQ ID NO: 610120 - DNA, 20 bp, Artificial
  CRISPR gRNA sequence
aaagtaaaatcaaatttttg

SEQ ID NO: 610121 - DNA, 20 bp, Artificial
  CRISPR gRNA sequence
aatcaaatttttggagtgaa

SEQ ID NO: 610122 - DNA, 20 bp, Artificial
  CRISPR gRNA sequence
tttaaaaatttaatttgtga

SEQ ID NO: 610123 - DNA, 20 bp, Artificial
  CRISPR gRNA sequence
aaaaatttaatttgtgaaag

SEQ ID NO: 610124 - DNA, 20 bp, Artificial
  CRISPR gRNA sequence
catctttccttttattacta

SEQ ID NO: 610125 - DNA, 20 bp, Artificial
  CRISPR gRNA sequence
ctttccttttattactatgg

SEQ ID NO: 610126 - DNA, 20 bp, Artificial
  CRISPR gRNA sequence
tttccttttattactatggc

SEQ ID NO: 610127 - DNA, 20 bp, Artificial
  CRISPR gRNA sequence
ttccttttattactatggca

SEQ ID NO: 610128 - DNA, 20 bp, Artificial
  CRISPR gRNA sequence
tccttttattactatggcag

SEQ ID NO: 610129 - DNA, 20 bp, Artificial
  CRISPR gRNA sequence
tttattactatggcaggggt

SEQ ID NO: 610130 - DNA, 20 bp, Artificial
  CRISPR gRNA sequence
ttattactatggcaggggtt

SEQ ID NO: 610131 - DNA, 20 bp, Artificial
  CRISPR gRNA sequence
attactatggcaggggttgg

SEQ ID NO: 610132 - DNA, 20 bp, Artificial
  CRISPR gRNA sequence
actatggcaggggttgggag

SEQ ID NO: 610133 - DNA, 20 bp, Artificial
  CRISPR gRNA sequence
tggaaaattcttgatttaaa

SEQ ID NO: 610134 - DNA, 20 bp, Artificial
  CRISPR gRNA sequence
attcttgatttaaaaagttg

SEQ ID NO: 610135 - DNA, 20 bp, Artificial
  CRISPR gRNA sequence
gttgcagcctgtgattccat

SEQ ID NO: 610136 - DNA, 20 bp, Artificial
  CRISPR gRNA sequence
ttgcagcctgtgattccatt

SEQ ID NO: 610137 - DNA, 20 bp, Artificial
  CRISPR gRNA sequence
agcctgtgattccattagga

SEQ ID NO: 610138 - DNA, 20 bp, Artificial
  CRISPR gRNA sequence
cctgtgattccattaggaaa

SEQ ID NO: 610139 - DNA, 20 bp, Artificial
  CRISPR gRNA sequence
ggaaagagaatcaaataatc

SEQ ID NO: 610140 - DNA, 20 bp, Artificial
  CRISPR gRNA sequence
aagttgtatattgtgtgtaa

SEQ ID NO: 610141 - DNA, 20 bp, Artificial
  CRISPR gRNA sequence
tattgtgtgtaaaagtaaaa

SEQ ID NO: 610142 - DNA, 20 bp, Artificial
  CRISPR gRNA sequence
tttattttaaaaccttatgt

SEQ ID NO: 610143 - DNA, 20 bp, Artificial
  CRISPR gRNA sequence
attttaaaaccttatgttgg

SEQ ID NO: 610144 - DNA, 20 bp, Artificial
  CRISPR gRNA sequence
tatgttggaagactttatat

SEQ ID NO: 610145 - DNA, 20 bp, Artificial
  CRISPR gRNA sequence
atgttggaagactttatatg

SEQ ID NO: 610146 - DNA, 20 bp, Artificial
  CRISPR gRNA sequence
gttggaagactttatatgag

SEQ ID NO: 610147 - DNA, 20 bp, Artificial
  CRISPR gRNA sequence
agactttatatgaggagata

SEQ ID NO: 610148 - DNA, 20 bp, Artificial
  CRISPR gRNA sequence
tgaggagatatagatcttac

SEQ ID NO: 610149 - DNA, 20 bp, Artificial
  CRISPR gRNA sequence
gaggagatatagatcttacc

SEQ ID NO: 610150 - DNA, 20 bp, Artificial
  CRISPR gRNA sequence
cttaccaggttaatcaaact

SEQ ID NO: 610151 - DNA, 20 bp, Artificial
  CRISPR gRNA sequence
accaggttaatcaaactaag

SEQ ID NO: 610152 - DNA, 20 bp, Artificial
  CRISPR gRNA sequence
aaactaagaagataccactt

SEQ ID NO: 610153 - DNA, 20 bp, Artificial
  CRISPR gRNA sequence
aactaagaagataccactta

SEQ ID NO: 610154 - DNA, 20 bp, Artificial
  CRISPR gRNA sequence
actaagaagataccacttaa

SEQ ID NO: 610155 - DNA, 20 bp, Artificial
  CRISPR gRNA sequence
ttaagggaactttaacatta

SEQ ID NO: 610156 - DNA, 20 bp, Artificial
  CRISPR gRNA sequence
tcaatccaatattatcaata

SEQ ID NO: 610157 - DNA, 20 bp, Artificial
  CRISPR gRNA sequence
caatccaatattatcaatat

SEQ ID NO: 610158 - DNA, 20 bp, Artificial
  CRISPR gRNA sequence
tataggacctcttgtacatg

SEQ ID NO: 610159 - DNA, 20 bp, Artificial
  CRISPR gRNA sequence
ctcttgtacatgtagctcat

SEQ ID NO: 610160 - DNA, 20 bp, Artificial
  CRISPR gRNA sequence
cttgtacatgtagctcataa

SEQ ID NO: 610161 - DNA, 20 bp, Artificial
  CRISPR gRNA sequence
catgtagctcataagagctc

SEQ ID NO: 610162 - DNA, 20 bp, Artificial
  CRISPR gRNA sequence
ataagagctccagatttctt

SEQ ID NO: 610163 - DNA, 20 bp, Artificial
  CRISPR gRNA sequence
cttaacccccaccacaccca

SEQ ID NO: 610164 - DNA, 20 bp, Artificial
  CRISPR gRNA sequence
acccacagattacacctttt

SEQ ID NO: 610165 - DNA, 20 bp, Artificial
  CRISPR gRNA sequence
tcccaaaacactaaatacta

SEQ ID NO: 610166 - DNA, 20 bp, Artificial
  CRISPR gRNA sequence
cactaaatactacagaattt

SEQ ID NO: 610167 - DNA, 20 bp, Artificial
  CRISPR gRNA sequence
taccaatttttaaatttatc

SEQ ID NO: 610168 - DNA, 20 bp, Artificial
  CRISPR gRNA sequence
accaatttttaaatttatct

SEQ ID NO: 610169 - DNA, 20 bp, Artificial
  CRISPR gRNA sequence
tttataacaaatctatatga

SEQ ID NO: 610170 - DNA, 20 bp, Artificial
  CRISPR gRNA sequence
ctatatgatagaattttcaa

SEQ ID NO: 610171 - DNA, 20 bp, Artificial
  CRISPR gRNA sequence
gaattttcaatagctgctgc

SEQ ID NO: 610172 - DNA, 20 bp, Artificial
  CRISPR gRNA sequence
tttcaatagctgctgccaga

SEQ ID NO: 610173 - DNA, 20 bp, Artificial
  CRISPR gRNA sequence
ctgctgccagaaagtgacca

SEQ ID NO: 610174 - DNA, 20 bp, Artificial
  CRISPR gRNA sequence
tttatcttatttatacctct

SEQ ID NO: 610175 - DNA, 20 bp, Artificial
  CRISPR gRNA sequence
ctcttagctttctttaataa

SEQ ID NO: 610176 - DNA, 20 bp, Artificial
  CRISPR gRNA sequence
tctttaataaaagaatcatt

SEQ ID NO: 610177 - DNA, 20 bp, Artificial
  CRISPR gRNA sequence
attgagtttgcattatgtca

SEQ ID NO: 610178 - DNA, 20 bp, Artificial
  CRISPR gRNA sequence
ttgagtttgcattatgtcaa

SEQ ID NO: 610179 - DNA, 20 bp, Artificial
  CRISPR gRNA sequence
tgagtttgcattatgtcaaa

SEQ ID NO: 610180 - DNA, 20 bp, Artificial
  CRISPR gRNA sequence
tcaaagggccaaaaaacctt

SEQ ID NO: 610181 - DNA, 20 bp, Artificial
  CRISPR gRNA sequence
attcattattatgtgtgttt

SEQ ID NO: 610182 - DNA, 20 bp, Artificial
  CRISPR gRNA sequence
tattatgtgtgtttcagtta

SEQ ID NO: 610183 - DNA, 20 bp, Artificial
  CRISPR gRNA sequence
gaaacatgacatttcaatgt

SEQ ID NO: 610184 - DNA, 20 bp, Artificial
  CRISPR gRNA sequence
ttttgaaaaactattaaaat

SEQ ID NO: 610185 - DNA, 20 bp, Artificial
  CRISPR gRNA sequence
ttagaatcatcatctaactg

SEQ ID NO: 610186 - DNA, 20 bp, Artificial
  CRISPR gRNA sequence
tagaatcatcatctaactgc

SEQ ID NO: 610187 - DNA, 20 bp, Artificial
  CRISPR gRNA sequence
tcatcatctaactgcaggta

SEQ ID NO: 610188 - DNA, 20 bp, Artificial
  CRISPR gRNA sequence
tctaactgcaggtaaagaaa

SEQ ID NO: 610189 - DNA, 20 bp, Artificial
  CRISPR gRNA sequence
ctgcaggtaaagaaatggtc

SEQ ID NO: 610190 - DNA, 20 bp, Artificial
  CRISPR gRNA sequence
aaatggtccagttcaaccaa

SEQ ID NO: 610191 - DNA, 20 bp, Artificial
  CRISPR gRNA sequence
aatggtccagttcaaccaaa

SEQ ID NO: 610192 - DNA, 20 bp, Artificial
  CRISPR gRNA sequence
atggtccagttcaaccaaaa

SEQ ID NO: 610193 - DNA, 20 bp, Artificial
  CRISPR gRNA sequence
tgttctttttattctaaact

SEQ ID NO: 610194 - DNA, 20 bp, Artificial
  CRISPR gRNA sequence
ttctttttattctaaactta

SEQ ID NO: 610195 - DNA, 20 bp, Artificial
  CRISPR gRNA sequence
ttattctaaacttagagctt

SEQ ID NO: 610196 - DNA, 20 bp, Artificial
  CRISPR gRNA sequence
ttttatttcatgtatatctt

SEQ ID NO: 610197 - DNA, 20 bp, Artificial
  CRISPR gRNA sequence
ttcatgtatatctttagtga

SEQ ID NO: 610198 - DNA, 20 bp, Artificial
  CRISPR gRNA sequence
tcatgtatatctttagtgat

SEQ ID NO: 610199 - DNA, 20 bp, Artificial
  CRISPR gRNA sequence
gataggtgaatttaaaataa

SEQ ID NO: 610200 - DNA, 20 bp, Artificial
  CRISPR gRNA sequence
aaataatagcattttcttta

SEQ ID NO: 610201 - DNA, 20 bp, Artificial
  CRISPR gRNA sequence
cattttctttatggtttgat

SEQ ID NO: 610202 - DNA, 20 bp, Artificial
  CRISPR gRNA sequence
attttctttatggtttgata

SEQ ID NO: 610203 - DNA, 20 bp, Artificial
  CRISPR gRNA sequence
atcaatttgatcctacttgc

SEQ ID NO: 610204 - DNA, 20 bp, Artificial
  CRISPR gRNA sequence
gtttttatatttgatgacat

SEQ ID NO: 610205 - DNA, 20 bp, Artificial
  CRISPR gRNA sequence
ttatatttgatgacattggt

SEQ ID NO: 610206 - DNA, 20 bp, Artificial
  CRISPR gRNA sequence
atttgatgacattggtgagt

SEQ ID NO: 610207 - DNA, 20 bp, Artificial
  CRISPR gRNA sequence
gacattggtgagtcagttga

SEQ ID NO: 610208 - DNA, 20 bp, Artificial
  CRISPR gRNA sequence
ggtgagtcagttgatggcaa

SEQ ID NO: 610209 - DNA, 20 bp, Artificial
  CRISPR gRNA sequence
aacagaccaaacttataatt

SEQ ID NO: 610210 - DNA, 20 bp, Artificial
  CRISPR gRNA sequence
acagaccaaacttataattg

SEQ ID NO: 610211 - DNA, 20 bp, Artificial
  CRISPR gRNA sequence
attgaggcttaaaaacttca

SEQ ID NO: 610212 - DNA, 20 bp, Artificial
  CRISPR gRNA sequence
taaaaacttcatagcaatat

SEQ ID NO: 610213 - DNA, 20 bp, Artificial
  CRISPR gRNA sequence
cttcatagcaatatcagtaa

SEQ ID NO: 610214 - DNA, 20 bp, Artificial
  CRISPR gRNA sequence
caatatcagtaatagaaaaa

SEQ ID NO: 610215 - DNA, 20 bp, Artificial
  CRISPR gRNA sequence
aatatcagtaatagaaaaac

SEQ ID NO: 610216 - DNA, 20 bp, Artificial
  CRISPR gRNA sequence
atatcagtaatagaaaaacg

SEQ ID NO: 610217 - DNA, 20 bp, Artificial
  CRISPR gRNA sequence
atcagtaatagaaaaacggg

SEQ ID NO: 610218 - DNA, 20 bp, Artificial
  CRISPR gRNA sequence
taatagaaaaacggggagaa

SEQ ID NO: 610219 - DNA, 20 bp, Artificial
  CRISPR gRNA sequence
aaagattcctttcaaataat

SEQ ID NO: 610220 - DNA, 20 bp, Artificial
  CRISPR gRNA sequence
agtttcacaaaaaacatgta

SEQ ID NO: 610221 - DNA, 20 bp, Artificial
  CRISPR gRNA sequence
gtttcacaaaaaacatgtac

SEQ ID NO: 610222 - DNA, 20 bp, Artificial
  CRISPR gRNA sequence
aaacatgtacaggacatgtc

SEQ ID NO: 610223 - DNA, 20 bp, Artificial
  CRISPR gRNA sequence
tctggatgaataattttatt

SEQ ID NO: 610224 - DNA, 20 bp, Artificial
  CRISPR gRNA sequence
tttatttggaaattttgcta

SEQ ID NO: 610225 - DNA, 20 bp, Artificial
  CRISPR gRNA sequence
ttatttggaaattttgctaa

SEQ ID NO: 610226 - DNA, 20 bp, Artificial
  CRISPR gRNA sequence
tttgctaaaggttttactat

SEQ ID NO: 610227 - DNA, 20 bp, Artificial
  CRISPR gRNA sequence
aaggttttactattagtgac

SEQ ID NO: 610228 - DNA, 20 bp, Artificial
  CRISPR gRNA sequence
aggttttactattagtgacc

SEQ ID NO: 610229 - DNA, 20 bp, Artificial
  CRISPR gRNA sequence
gttttactattagtgaccag

SEQ ID NO: 610230 - DNA, 20 bp, Artificial
  CRISPR gRNA sequence
tattagtgaccaggagaatc

SEQ ID NO: 610231 - DNA, 20 bp, Artificial
  CRISPR gRNA sequence
accaggagaatcaagaaacc

SEQ ID NO: 610232 - DNA, 20 bp, Artificial
  CRISPR gRNA sequence
tttgaaaatcttgtactaat

SEQ ID NO: 610233 - DNA, 20 bp, Artificial
  CRISPR gRNA sequence
cttgtactaatgagctttgt

SEQ ID NO: 610234 - DNA, 20 bp, Artificial
  CRISPR gRNA sequence
tactaatgagctttgtaagc

SEQ ID NO: 610235 - DNA, 20 bp, Artificial
  CRISPR gRNA sequence
ggttcatttgctgtaccttt

SEQ ID NO: 610236 - DNA, 20 bp, Artificial
  CRISPR gRNA sequence
ttagttgcccctttccatat

SEQ ID NO: 610237 - DNA, 20 bp, Artificial
  CRISPR gRNA sequence
cctttccatatcagctaaat

SEQ ID NO: 610238 - DNA, 20 bp, Artificial
  CRISPR gRNA sequence
ctttccatatcagctaaatg

SEQ ID NO: 610239 - DNA, 20 bp, Artificial
  CRISPR gRNA sequence
tttccatatcagctaaatga

SEQ ID NO: 610240 - DNA, 20 bp, Artificial
  CRISPR gRNA sequence
tatcagctaaatgagggaat

SEQ ID NO: 610241 - DNA, 20 bp, Artificial
  CRISPR gRNA sequence
taaatgagggaattagactg

SEQ ID NO: 610242 - DNA, 20 bp, Artificial
  CRISPR gRNA sequence
aaatgagggaattagactga

SEQ ID NO: 610243 - DNA, 20 bp, Artificial
  CRISPR gRNA sequence
attagactgaaggtctcttt

SEQ ID NO: 610244 - DNA, 20 bp, Artificial
  CRISPR gRNA sequence
caaattttctgccaatttta

SEQ ID NO: 610245 - DNA, 20 bp, Artificial
  CRISPR gRNA sequence
aattttctgccaattttaaa

SEQ ID NO: 610246 - DNA, 20 bp, Artificial
  CRISPR gRNA sequence
ttctgccaattttaaagaga

SEQ ID NO: 610247 - DNA, 20 bp, Artificial
  CRISPR gRNA sequence
ccaattttaaagagatagca

SEQ ID NO: 610248 - DNA, 20 bp, Artificial
  CRISPR gRNA sequence
ttaaagagatagcatggtaa

SEQ ID NO: 610249 - DNA, 20 bp, Artificial
  CRISPR gRNA sequence
agagatagcatggtaaaaga

SEQ ID NO: 610250 - DNA, 20 bp, Artificial
  CRISPR gRNA sequence
agatagcatggtaaaagaaa

SEQ ID NO: 610251 - DNA, 20 bp, Artificial
  CRISPR gRNA sequence
catggtaaaagaaagagaac

SEQ ID NO: 610252 - DNA, 20 bp, Artificial
  CRISPR gRNA sequence
agaaagagaacaagattttg

SEQ ID NO: 610253 - DNA, 20 bp, Artificial
  CRISPR gRNA sequence
gattttgtagccaaactgac

SEQ ID NO: 610254 - DNA, 20 bp, Artificial
  CRISPR gRNA sequence
attttgtagccaaactgacc

SEQ ID NO: 610255 - DNA, 20 bp, Artificial
  CRISPR gRNA sequence
ttctcaccttgactactttc

SEQ ID NO: 610256 - DNA, 20 bp, Artificial
  CRISPR gRNA sequence
tctagctctgtgtaacaaaa

SEQ ID NO: 610257 - DNA, 20 bp, Artificial
  CRISPR gRNA sequence
taacaaaatagtttgatcta

SEQ ID NO: 610258 - DNA, 20 bp, Artificial
  CRISPR gRNA sequence
aacctaattattgtcattgt

SEQ ID NO: 610259 - DNA, 20 bp, Artificial
  CRISPR gRNA sequence
taattattgtcattgtaaga

SEQ ID NO: 610260 - DNA, 20 bp, Artificial
  CRISPR gRNA sequence
aattattgtcattgtaagaa

SEQ ID NO: 610261 - DNA, 20 bp, Artificial
  CRISPR gRNA sequence
gaaaggattgaaatattcta

SEQ ID NO: 610262 - DNA, 20 bp, Artificial
  CRISPR gRNA sequence
ggattgaaatattctatgga

SEQ ID NO: 610263 - DNA, 20 bp, Artificial
  CRISPR gRNA sequence
gaaagcatccaattgtgtgt

SEQ ID NO: 610264 - DNA, 20 bp, Artificial
  CRISPR gRNA sequence
aaagcatccaattgtgtgta

SEQ ID NO: 610265 - DNA, 20 bp, Artificial
  CRISPR gRNA sequence
caattgtgtgtaaggcccta

SEQ ID NO: 610266 - DNA, 20 bp, Artificial
  CRISPR gRNA sequence
tgtgtaaggccctaaagtga

SEQ ID NO: 610267 - DNA, 20 bp, Artificial
  CRISPR gRNA sequence
gctattattgttattcttct

SEQ ID NO: 610268 - DNA, 20 bp, Artificial
  CRISPR gRNA sequence
ttattcttctgagtcaatga

SEQ ID NO: 610269 - DNA, 20 bp, Artificial
  CRISPR gRNA sequence
tattcttctgagtcaatgat

SEQ ID NO: 610270 - DNA, 20 bp, Artificial
  CRISPR gRNA sequence
tttgtcacatttatacataa

SEQ ID NO: 610271 - DNA, 20 bp, Artificial
  CRISPR gRNA sequence
ttgtcacatttatacataaa

SEQ ID NO: 610272 - DNA, 20 bp, Artificial
  CRISPR gRNA sequence
tgtcacatttatacataaaa

SEQ ID NO: 610273 - DNA, 20 bp, Artificial
  CRISPR gRNA sequence
gtcacatttatacataaaag

SEQ ID NO: 610274 - DNA, 20 bp, Artificial
  CRISPR gRNA sequence
catttatacataaaagggga

SEQ ID NO: 610275 - DNA, 20 bp, Artificial
  CRISPR gRNA sequence
gatcatttgatgtaaaactt

SEQ ID NO: 610276 - DNA, 20 bp, Artificial
  CRISPR gRNA sequence
tgatgtaaaacttaagactt

SEQ ID NO: 610277 - DNA, 20 bp, Artificial
  CRISPR gRNA sequence
ctttggtaactgtattgaca

SEQ ID NO: 610278 - DNA, 20 bp, Artificial
  CRISPR gRNA sequence
tgtattgacaaagcaaattc

SEQ ID NO: 610279 - DNA, 20 bp, Artificial
  CRISPR gRNA sequence
gtattgacaaagcaaattct

SEQ ID NO: 610280 - DNA, 20 bp, Artificial
  CRISPR gRNA sequence
ttgacaaagcaaattctggg

SEQ ID NO: 610281 - DNA, 20 bp, Artificial
  CRISPR gRNA sequence
ctgggcagataaatgtttaa

SEQ ID NO: 610282 - DNA, 20 bp, Artificial
  CRISPR gRNA sequence
taaatgtttaaaagacttat

SEQ ID NO: 610283 - DNA, 20 bp, Artificial
  CRISPR gRNA sequence
aaatgtttaaaagacttatg

SEQ ID NO: 610284 - DNA, 20 bp, Artificial
  CRISPR gRNA sequence
aatgtttaaaagacttatga

SEQ ID NO: 610285 - DNA, 20 bp, Artificial
  CRISPR gRNA sequence
tgtttaaaagacttatgagg

SEQ ID NO: 610286 - DNA, 20 bp, Artificial
  CRISPR gRNA sequence
atgagggagatgaacatttt

SEQ ID NO: 610287 - DNA, 20 bp, Artificial
  CRISPR gRNA sequence
ggagatgaacatttttagca

SEQ ID NO: 610288 - DNA, 20 bp, Artificial
  CRISPR gRNA sequence
agatgaacatttttagcata

SEQ ID NO: 610289 - DNA, 20 bp, Artificial
  CRISPR gRNA sequence
acatttttagcatagagaac

SEQ ID NO: 610290 - DNA, 20 bp, Artificial
  CRISPR gRNA sequence
ttagcatagagaactggctt

SEQ ID NO: 610291 - DNA, 20 bp, Artificial
  CRISPR gRNA sequence
agagaactggctttggttaa

SEQ ID NO: 610292 - DNA, 20 bp, Artificial
  CRISPR gRNA sequence
gaactggctttggttaacag

SEQ ID NO: 610293 - DNA, 20 bp, Artificial
  CRISPR gRNA sequence
tggctttggttaacagtgga

SEQ ID NO: 610294 - DNA, 20 bp, Artificial
  CRISPR gRNA sequence
gttaacagtggatggcaaat

SEQ ID NO: 610295 - DNA, 20 bp, Artificial
  CRISPR gRNA sequence
ttagtcacttgcacataccc

SEQ ID NO: 610296 - DNA, 20 bp, Artificial
  CRISPR gRNA sequence
cccatttcttctccttactg

SEQ ID NO: 610297 - DNA, 20 bp, Artificial
  CRISPR gRNA sequence
ccatttcttctccttactgc

SEQ ID NO: 610298 - DNA, 20 bp, Artificial
  CRISPR gRNA sequence
aacgccccttccactgtaac

SEQ ID NO: 610299 - DNA, 20 bp, Artificial
  CRISPR gRNA sequence
cccttccactgtaaccagtg

SEQ ID NO: 610300 - DNA, 20 bp, Artificial
  CRISPR gRNA sequence
cttccactgtaaccagtgtg

SEQ ID NO: 610301 - DNA, 20 bp, Artificial
  CRISPR gRNA sequence
agtgtggagcttcttttact

SEQ ID NO: 610302 - DNA, 20 bp, Artificial
  CRISPR gRNA sequence
gtggagcttcttttactcag

SEQ ID NO: 610303 - DNA, 20 bp, Artificial
  CRISPR gRNA sequence
tggagcttcttttactcaga

SEQ ID NO: 610304 - DNA, 20 bp, Artificial
  CRISPR gRNA sequence
ggagcttcttttactcagaa

SEQ ID NO: 610305 - DNA, 20 bp, Artificial
  CRISPR gRNA sequence
actcagaagggcaaccttct

SEQ ID NO: 610306 - DNA, 20 bp, Artificial
  CRISPR gRNA sequence
gcaaccttctgagacacata

SEQ ID NO: 610307 - DNA, 20 bp, Artificial
  CRISPR gRNA sequence
agacacataaagttacactc

SEQ ID NO: 610308 - DNA, 20 bp, Artificial
  CRISPR gRNA sequence
acacataaagttacactctg

SEQ ID NO: 610309 - DNA, 20 bp, Artificial
  CRISPR gRNA sequence
acataaagttacactctgga

SEQ ID NO: 610310 - DNA, 20 bp, Artificial
  CRISPR gRNA sequence
taaagttacactctggagag

SEQ ID NO: 610311 - DNA, 20 bp, Artificial
  CRISPR gRNA sequence
ccgttcaaatgtcctttctg

SEQ ID NO: 610312 - DNA, 20 bp, Artificial
  CRISPR gRNA sequence
cctttctgtagctacgcctg

SEQ ID NO: 610313 - DNA, 20 bp, Artificial
  CRISPR gRNA sequence
ttctgtagctacgcctgtag

SEQ ID NO: 610314 - DNA, 20 bp, Artificial
  CRISPR gRNA sequence
tgtagctacgcctgtagaag

SEQ ID NO: 610315 - DNA, 20 bp, Artificial
  CRISPR gRNA sequence
gtagctacgcctgtagaaga

SEQ ID NO: 610316 - DNA, 20 bp, Artificial
  CRISPR gRNA sequence
tagctacgcctgtagaagaa

SEQ ID NO: 610317 - DNA, 20 bp, Artificial
  CRISPR gRNA sequence
tagaagaagggacgccctca

SEQ ID NO: 610318 - DNA, 20 bp, Artificial
  CRISPR gRNA sequence
agaagaagggacgccctcac

SEQ ID NO: 610319 - DNA, 20 bp, Artificial
  CRISPR gRNA sequence
gacgccctcacaggacacct

SEQ ID NO: 610320 - DNA, 20 bp, Artificial
  CRISPR gRNA sequence
acgccctcacaggacacctc

SEQ ID NO: 610321 - DNA, 20 bp, Artificial
  CRISPR gRNA sequence
ggacacctcaggacccattc

SEQ ID NO: 610322 - DNA, 20 bp, Artificial
  CRISPR gRNA sequence
acctcaggacccattctggt

SEQ ID NO: 610323 - DNA, 20 bp, Artificial
  CRISPR gRNA sequence
gtaagtgtcaccaactcctt

SEQ ID NO: 610324 - DNA, 20 bp, Artificial
  CRISPR gRNA sequence
agtgtcaccaactccttgag

SEQ ID NO: 610325 - DNA, 20 bp, Artificial
  CRISPR gRNA sequence
caccaactccttgagaagaa

SEQ ID NO: 610326 - DNA, 20 bp, Artificial
  CRISPR gRNA sequence
ccttgagaagaaaagtaaaa

SEQ ID NO: 610327 - DNA, 20 bp, Artificial
  CRISPR gRNA sequence
cttgagaagaaaagtaaaac

SEQ ID NO: 610328 - DNA, 20 bp, Artificial
  CRISPR gRNA sequence
aaaagtaaaacaggaaaact

SEQ ID NO: 610329 - DNA, 20 bp, Artificial
  CRISPR gRNA sequence
agtaaaacaggaaaacttag

SEQ ID NO: 610330 - DNA, 20 bp, Artificial
  CRISPR gRNA sequence
taaaacaggaaaacttagaa

SEQ ID NO: 610331 - DNA, 20 bp, Artificial
  CRISPR gRNA sequence
agaagagtactattgaatga

SEQ ID NO: 610332 - DNA, 20 bp, Artificial
  CRISPR gRNA sequence
actattgaatgatagtaaca

SEQ ID NO: 610333 - DNA, 20 bp, Artificial
  CRISPR gRNA sequence
agtaacatggctttgttatg

SEQ ID NO: 610334 - DNA, 20 bp, Artificial
  CRISPR gRNA sequence
acatggctttgttatgtagt

SEQ ID NO: 610335 - DNA, 20 bp, Artificial
  CRISPR gRNA sequence
ttatgtagtcggtaatgacc

SEQ ID NO: 610336 - DNA, 20 bp, Artificial
  CRISPR gRNA sequence
gaccaagacaatcttgttat

SEQ ID NO: 610337 - DNA, 20 bp, Artificial
  CRISPR gRNA sequence
taaataattgataaatcttg

SEQ ID NO: 610338 - DNA, 20 bp, Artificial
  CRISPR gRNA sequence
aaataattgataaatcttgc

SEQ ID NO: 610339 - DNA, 20 bp, Artificial
  CRISPR gRNA sequence
atgcatgtatctttcatttt

SEQ ID NO: 610340 - DNA, 20 bp, Artificial
  CRISPR gRNA sequence
tctttcatttttagacttta

SEQ ID NO: 610341 - DNA, 20 bp, Artificial
  CRISPR gRNA sequence
catttttagactttacggct

SEQ ID NO: 610342 - DNA, 20 bp, Artificial
  CRISPR gRNA sequence
ttttagactttacggcttgg

SEQ ID NO: 610343 - DNA, 20 bp, Artificial
  CRISPR gRNA sequence
agactttacggcttggcaga

SEQ ID NO: 610344 - DNA, 20 bp, Artificial
  CRISPR gRNA sequence
gactttacggcttggcagaa

SEQ ID NO: 610345 - DNA, 20 bp, Artificial
  CRISPR gRNA sequence
ctttacggcttggcagaaag

SEQ ID NO: 610346 - DNA, 20 bp, Artificial
  CRISPR gRNA sequence
gaaaggagcactgtcaactg

SEQ ID NO: 610347 - DNA, 20 bp, Artificial
  CRISPR gRNA sequence
aaggagcactgtcaactgaa

SEQ ID NO: 610348 - DNA, 20 bp, Artificial
  CRISPR gRNA sequence
agtatcttacttcaatatat

SEQ ID NO: 610349 - DNA, 20 bp, Artificial
  CRISPR gRNA sequence
ttacttcaatatattagaat

SEQ ID NO: 610350 - DNA, 20 bp, Artificial
  CRISPR gRNA sequence
aatatattagaataagaaaa

SEQ ID NO: 610351 - DNA, 20 bp, Artificial
  CRISPR gRNA sequence
aattttaaaattttacaatt

SEQ ID NO: 610352 - DNA, 20 bp, Artificial
  CRISPR gRNA sequence
aaattttacaattaagaatg

SEQ ID NO: 610353 - DNA, 20 bp, Artificial
  CRISPR gRNA sequence
aattaagaatgcagtcatta

SEQ ID NO: 610354 - DNA, 20 bp, Artificial
  CRISPR gRNA sequence
gcagtcattatggttaatcc

SEQ ID NO: 610355 - DNA, 20 bp, Artificial
  CRISPR gRNA sequence
cattatggttaatccaagat

SEQ ID NO: 610356 - DNA, 20 bp, Artificial
  CRISPR gRNA sequence
tggttaatccaagataagtg

SEQ ID NO: 610357 - DNA, 20 bp, Artificial
  CRISPR gRNA sequence
atccaagataagtgaagatc

SEQ ID NO: 610358 - DNA, 20 bp, Artificial
  CRISPR gRNA sequence
gtgaagatccagtataatat

SEQ ID NO: 610359 - DNA, 20 bp, Artificial
  CRISPR gRNA sequence
tataatatcagttatgtttc

SEQ ID NO: 610360 - DNA, 20 bp, Artificial
  CRISPR gRNA sequence
agttatgtttcgagttactg

SEQ ID NO: 610361 - DNA, 20 bp, Artificial
  CRISPR gRNA sequence
ttatgtttcgagttactgta

SEQ ID NO: 610362 - DNA, 20 bp, Artificial
  CRISPR gRNA sequence
tatgtttcgagttactgtag

SEQ ID NO: 610363 - DNA, 20 bp, Artificial
  CRISPR gRNA sequence
ctgattttttttgactgata

SEQ ID NO: 610364 - DNA, 20 bp, Artificial
  CRISPR gRNA sequence
tttttgactgatacagtgct

SEQ ID NO: 610365 - DNA, 20 bp, Artificial
  CRISPR gRNA sequence
ttttgactgatacagtgctc

SEQ ID NO: 610366 - DNA, 20 bp, Artificial
  CRISPR gRNA sequence
gactgatacagtgctcaggc

SEQ ID NO: 610367 - DNA, 20 bp, Artificial
  CRISPR gRNA sequence
actgatacagtgctcaggct

SEQ ID NO: 610368 - DNA, 20 bp, Artificial
  CRISPR gRNA sequence
tgctcaggctgggatctctg

SEQ ID NO: 610369 - DNA, 20 bp, Artificial
  CRISPR gRNA sequence
tttaaacttgaaaatatact

SEQ ID NO: 610370 - DNA, 20 bp, Artificial
  CRISPR gRNA sequence
tgaaaatatactcagaaaat

SEQ ID NO: 610371 - DNA, 20 bp, Artificial
  CRISPR gRNA sequence
actcagaaaattggcttttc

SEQ ID NO: 610372 - DNA, 20 bp, Artificial
  CRISPR gRNA sequence
tttaactctccttgtatctt

SEQ ID NO: 610373 - DNA, 20 bp, Artificial
  CRISPR gRNA sequence
tatctttagctctcaaacaa

SEQ ID NO: 610374 - DNA, 20 bp, Artificial
  CRISPR gRNA sequence
agctctcaaacaatagtcat

SEQ ID NO: 610375 - DNA, 20 bp, Artificial
  CRISPR gRNA sequence
gctctcaaacaatagtcatt

SEQ ID NO: 610376 - DNA, 20 bp, Artificial
  CRISPR gRNA sequence
cataaatcatttaaaaaatg

SEQ ID NO: 610377 - DNA, 20 bp, Artificial
  CRISPR gRNA sequence
tgtagaatatgacaaattct

SEQ ID NO: 610378 - DNA, 20 bp, Artificial
  CRISPR gRNA sequence
gtagaatatgacaaattctt

SEQ ID NO: 610379 - DNA, 20 bp, Artificial
  CRISPR gRNA sequence
tgacaaattcttgggaataa

SEQ ID NO: 610380 - DNA, 20 bp, Artificial
  CRISPR gRNA sequence
aaaataaatttaatgttttt

SEQ ID NO: 610381 - DNA, 20 bp, Artificial
  CRISPR gRNA sequence
ttaatgtttttaagaaatgc

SEQ ID NO: 610382 - DNA, 20 bp, Artificial
  CRISPR gRNA sequence
tgccagaatataacacataa

SEQ ID NO: 610383 - DNA, 20 bp, Artificial
  CRISPR gRNA sequence
ccagaatataacacataaaa

SEQ ID NO: 610384 - DNA, 20 bp, Artificial
  CRISPR gRNA sequence
atataacacataaaagagaa

SEQ ID NO: 610385 - DNA, 20 bp, Artificial
  CRISPR gRNA sequence
ataaaagagaaaagaatgat

SEQ ID NO: 610386 - DNA, 20 bp, Artificial
  CRISPR gRNA sequence
aatgaatctcatttgacttt

SEQ ID NO: 610387 - DNA, 20 bp, Artificial
  CRISPR gRNA sequence
tagcataaattttcataacc

SEQ ID NO: 610388 - DNA, 20 bp, Artificial
  CRISPR gRNA sequence
cataaattttcataaccaag

SEQ ID NO: 610389 - DNA, 20 bp, Artificial
  CRISPR gRNA sequence
ttttcataaccaagaagtta

SEQ ID NO: 610390 - DNA, 20 bp, Artificial
  CRISPR gRNA sequence
tttcataaccaagaagttaa

SEQ ID NO: 610391 - DNA, 20 bp, Artificial
  CRISPR gRNA sequence
cataaccaagaagttaaagg

SEQ ID NO: 610392 - DNA, 20 bp, Artificial
  CRISPR gRNA sequence
ttaaaggtggaaaattaata

SEQ ID NO: 610393 - DNA, 20 bp, Artificial
  CRISPR gRNA sequence
aattaatatagaatactctc

SEQ ID NO: 610394 - DNA, 20 bp, Artificial
  CRISPR gRNA sequence
aatatagaatactctcaagc

SEQ ID NO: 610395 - DNA, 20 bp, Artificial
  CRISPR gRNA sequence
taaattttaattttaatatg

SEQ ID NO: 610396 - DNA, 20 bp, Artificial
  CRISPR gRNA sequence
attttaatatgaagatatga

SEQ ID NO: 610397 - DNA, 20 bp, Artificial
  CRISPR gRNA sequence
ttaatatgaagatatgatgg

SEQ ID NO: 610398 - DNA, 20 bp, Artificial
  CRISPR gRNA sequence
tctacattgacaaatcgtat

SEQ ID NO: 610399 - DNA, 20 bp, Artificial
  CRISPR gRNA sequence
tacattgacaaatcgtatta

SEQ ID NO: 610400 - DNA, 20 bp, Artificial
  CRISPR gRNA sequence
cattgacaaatcgtattaga

SEQ ID NO: 610401 - DNA, 20 bp, Artificial
  CRISPR gRNA sequence
aaatcgtattagagagtgct

SEQ ID NO: 610402 - DNA, 20 bp, Artificial
  CRISPR gRNA sequence
aatcgtattagagagtgctg

SEQ ID NO: 610403 - DNA, 20 bp, Artificial
  CRISPR gRNA sequence
ttagagagtgctgaggttgt

SEQ ID NO: 610404 - DNA, 20 bp, Artificial
  CRISPR gRNA sequence
catttttcctttttatcctt

SEQ ID NO: 610405 - DNA, 20 bp, Artificial
  CRISPR gRNA sequence
atttttcctttttatcctta

SEQ ID NO: 610406 - DNA, 20 bp, Artificial
  CRISPR gRNA sequence
tttatccttaaggctgtact

SEQ ID NO: 610407 - DNA, 20 bp, Artificial
  CRISPR gRNA sequence
taaacattaactcttaaatt

SEQ ID NO: 610408 - DNA, 20 bp, Artificial
  CRISPR gRNA sequence
aaacattaactcttaaattt

SEQ ID NO: 610409 - DNA, 20 bp, Artificial
  CRISPR gRNA sequence
aacattaactcttaaatttg

SEQ ID NO: 610410 - DNA, 20 bp, Artificial
  CRISPR gRNA sequence
attaactcttaaatttgggg

SEQ ID NO: 610411 - DNA, 20 bp, Artificial
  CRISPR gRNA sequence
acacgaaaacaaaatatttt

SEQ ID NO: 610412 - DNA, 20 bp, Artificial
  CRISPR gRNA sequence
tatatttttctttcctccct

SEQ ID NO: 610413 - DNA, 20 bp, Artificial
  CRISPR gRNA sequence
tttctttcctccctgagtta

SEQ ID NO: 610414 - DNA, 20 bp, Artificial
  CRISPR gRNA sequence
ttctttcctccctgagttaa

SEQ ID NO: 610415 - DNA, 20 bp, Artificial
  CRISPR gRNA sequence
gctatcaaaattatatctta

SEQ ID NO: 610416 - DNA, 20 bp, Artificial
  CRISPR gRNA sequence
atcaaaattatatcttaaag

SEQ ID NO: 610417 - DNA, 20 bp, Artificial
  CRISPR gRNA sequence
aagcagtgttttcttatgaa

SEQ ID NO: 610418 - DNA, 20 bp, Artificial
  CRISPR gRNA sequence
tctttattgaaatatacttc

SEQ ID NO: 610419 - DNA, 20 bp, Artificial
  CRISPR gRNA sequence
ctttattgaaatatacttct

SEQ ID NO: 610420 - DNA, 20 bp, Artificial
  CRISPR gRNA sequence
aatatacttctaggacatga

SEQ ID NO: 610421 - DNA, 20 bp, Artificial
  CRISPR gRNA sequence
atatacttctaggacatgat

SEQ ID NO: 610422 - DNA, 20 bp, Artificial
  CRISPR gRNA sequence
gacatgataggcatttccat

SEQ ID NO: 610423 - DNA, 20 bp, Artificial
  CRISPR gRNA sequence
cattagcttgtcatgtactc

SEQ ID NO: 610424 - DNA, 20 bp, Artificial
  CRISPR gRNA sequence
agcttgtcatgtactctagc

SEQ ID NO: 610425 - DNA, 20 bp, Artificial
  CRISPR gRNA sequence
cttgtcatgtactctagcca

SEQ ID NO: 610426 - DNA, 20 bp, Artificial
  CRISPR gRNA sequence
gccagagttaaattattatt

SEQ ID NO: 610427 - DNA, 20 bp, Artificial
  CRISPR gRNA sequence
tccaaacattatataacaaa

SEQ ID NO: 610428 - DNA, 20 bp, Artificial
  CRISPR gRNA sequence
aatagatcttcgtgaacata

SEQ ID NO: 610429 - DNA, 20 bp, Artificial
  CRISPR gRNA sequence
tcatgttgtttttaatatca

SEQ ID NO: 610430 - DNA, 20 bp, Artificial
  CRISPR gRNA sequence
gttatctgtcttcataaaca

SEQ ID NO: 610431 - DNA, 20 bp, Artificial
  CRISPR gRNA sequence
tgtcttcataaacaaagaca

SEQ ID NO: 610432 - DNA, 20 bp, Artificial
  CRISPR gRNA sequence
atcgtgctcattttgcaatt

SEQ ID NO: 610433 - DNA, 20 bp, Artificial
  CRISPR gRNA sequence
attttgcaatttagtatatc

SEQ ID NO: 610434 - DNA, 20 bp, Artificial
  CRISPR gRNA sequence
atatcaagttatgatttttg

SEQ ID NO: 610435 - DNA, 20 bp, Artificial
  CRISPR gRNA sequence
gatttttgcagatatataaa

SEQ ID NO: 610436 - DNA, 20 bp, Artificial
  CRISPR gRNA sequence
ataaatagatatattcaaat

SEQ ID NO: 610437 - DNA, 20 bp, Artificial
  CRISPR gRNA sequence
taaatagatatattcaaatt

SEQ ID NO: 610438 - DNA, 20 bp, Artificial
  CRISPR gRNA sequence
atattcaaattgggtaattc

SEQ ID NO: 610439 - DNA, 20 bp, Artificial
  CRISPR gRNA sequence
attcaaattgggtaattcaa

SEQ ID NO: 610440 - DNA, 20 bp, Artificial
  CRISPR gRNA sequence
tcaaattgggtaattcaaga

SEQ ID NO: 610441 - DNA, 20 bp, Artificial
  CRISPR gRNA sequence
ggtaattcaagagagtttaa

SEQ ID NO: 610442 - DNA, 20 bp, Artificial
  CRISPR gRNA sequence
taattcaagagagtttaatg

SEQ ID NO: 610443 - DNA, 20 bp, Artificial
  CRISPR gRNA sequence
gagtttaatggagtccctat

SEQ ID NO: 610444 - DNA, 20 bp, Artificial
  CRISPR gRNA sequence
gtttaatggagtccctattg

SEQ ID NO: 610445 - DNA, 20 bp, Artificial
  CRISPR gRNA sequence
ttaatggagtccctattgga

SEQ ID NO: 610446 - DNA, 20 bp, Artificial
  CRISPR gRNA sequence
taatggagtccctattggag

SEQ ID NO: 610447 - DNA, 20 bp, Artificial
  CRISPR gRNA sequence
aatggagtccctattggaga

SEQ ID NO: 610448 - DNA, 20 bp, Artificial
  CRISPR gRNA sequence
atggagtccctattggagag

SEQ ID NO: 610449 - DNA, 20 bp, Artificial
  CRISPR gRNA sequence
tggagtccctattggagagg

SEQ ID NO: 610450 - DNA, 20 bp, Artificial
  CRISPR gRNA sequence
cctattggagagggggcatc

SEQ ID NO: 610451 - DNA, 20 bp, Artificial
  CRISPR gRNA sequence
catccagctactgcatcacc

SEQ ID NO: 610452 - DNA, 20 bp, Artificial
  CRISPR gRNA sequence
tccagctactgcatcaccaa

SEQ ID NO: 610453 - DNA, 20 bp, Artificial
  CRISPR gRNA sequence
aattcaatcatgcttccaat

SEQ ID NO: 610454 - DNA, 20 bp, Artificial
  CRISPR gRNA sequence
ccaattggaatctaaaatac

SEQ ID NO: 610455 - DNA, 20 bp, Artificial
  CRISPR gRNA sequence
atccctaattttcttcataa

SEQ ID NO: 610456 - DNA, 20 bp, Artificial
  CRISPR gRNA sequence
ctaattttcttcataataga

SEQ ID NO: 610457 - DNA, 20 bp, Artificial
  CRISPR gRNA sequence
ataatagatagaacataaaa

SEQ ID NO: 610458 - DNA, 20 bp, Artificial
  CRISPR gRNA sequence
aatagatagaacataaaaca

SEQ ID NO: 610459 - DNA, 20 bp, Artificial
  CRISPR gRNA sequence
aacataaaacagagttgcta

SEQ ID NO: 610460 - DNA, 20 bp, Artificial
  CRISPR gRNA sequence
gctacagtttttgctcctct

SEQ ID NO: 610461 - DNA, 20 bp, Artificial
  CRISPR gRNA sequence
tttttgctcctctaagttgc

SEQ ID NO: 610462 - DNA, 20 bp, Artificial
  CRISPR gRNA sequence
tgctcctctaagttgccaga

SEQ ID NO: 610463 - DNA, 20 bp, Artificial
  CRISPR gRNA sequence
aagctcaaaattgatcatta

SEQ ID NO: 610464 - DNA, 20 bp, Artificial
  CRISPR gRNA sequence
ccccttactcttactctgtt

SEQ ID NO: 610465 - DNA, 20 bp, Artificial
  CRISPR gRNA sequence
tcttactctgtttagcacat

SEQ ID NO: 610466 - DNA, 20 bp, Artificial
  CRISPR gRNA sequence
gtttagcacatcggctaaat

SEQ ID NO: 610467 - DNA, 20 bp, Artificial
  CRISPR gRNA sequence
tttagcacatcggctaaata

SEQ ID NO: 610468 - DNA, 20 bp, Artificial
  CRISPR gRNA sequence
aaataaggttctttatctga

SEQ ID NO: 610469 - DNA, 20 bp, Artificial
  CRISPR gRNA sequence
aataaggttctttatctgat

SEQ ID NO: 610470 - DNA, 20 bp, Artificial
  CRISPR gRNA sequence
gataggtgactaaaatttta

SEQ ID NO: 610471 - DNA, 20 bp, Artificial
  CRISPR gRNA sequence
ataggtgactaaaattttat

SEQ ID NO: 610472 - DNA, 20 bp, Artificial
  CRISPR gRNA sequence
actaaaattttataggttct

SEQ ID NO: 610473 - DNA, 20 bp, Artificial
  CRISPR gRNA sequence
ttttataggttctgagtctt

SEQ ID NO: 610474 - DNA, 20 bp, Artificial
  CRISPR gRNA sequence
tataggttctgagtcttcgg

SEQ ID NO: 610475 - DNA, 20 bp, Artificial
  CRISPR gRNA sequence
ttttcaataaccaaaattat

SEQ ID NO: 610476 - DNA, 20 bp, Artificial
  CRISPR gRNA sequence
tttcaataaccaaaattatg

SEQ ID NO: 610477 - DNA, 20 bp, Artificial
  CRISPR gRNA sequence
aataaccaaaattatgaggt

SEQ ID NO: 610478 - DNA, 20 bp, Artificial
  CRISPR gRNA sequence
ttatgaggtaagtatttcta

SEQ ID NO: 610479 - DNA, 20 bp, Artificial
  CRISPR gRNA sequence
atgaggtaagtatttctaaa

SEQ ID NO: 610480 - DNA, 20 bp, Artificial
  CRISPR gRNA sequence
gtatttctaaagagatgccc

SEQ ID NO: 610481 - DNA, 20 bp, Artificial
  CRISPR gRNA sequence
gatgccccagtaaatcccct

SEQ ID NO: 610482 - DNA, 20 bp, Artificial
  CRISPR gRNA sequence
cagtaaatcccctgagttcc

SEQ ID NO: 610483 - DNA, 20 bp, Artificial
  CRISPR gRNA sequence
aatcccctgagttccaagca

SEQ ID NO: 610484 - DNA, 20 bp, Artificial
  CRISPR gRNA sequence
ttcttcttgtcctcattgta

SEQ ID NO: 610485 - DNA, 20 bp, Artificial
  CRISPR gRNA sequence
ttgtcctcattgtatagcaa

SEQ ID NO: 610486 - DNA, 20 bp, Artificial
  CRISPR gRNA sequence
gcaacagctccaaatcattc

SEQ ID NO: 610487 - DNA, 20 bp, Artificial
  CRISPR gRNA sequence
acagctccaaatcattctgg

SEQ ID NO: 610488 - DNA, 20 bp, Artificial
  CRISPR gRNA sequence
tccaaatcattctggtagtc

SEQ ID NO: 610489 - DNA, 20 bp, Artificial
  CRISPR gRNA sequence
tggtagtctggaaaaattat

SEQ ID NO: 610490 - DNA, 20 bp, Artificial
  CRISPR gRNA sequence
agtctggaaaaattataagc

SEQ ID NO: 610491 - DNA, 20 bp, Artificial
  CRISPR gRNA sequence
taagccagtccctgtttatt

SEQ ID NO: 610492 - DNA, 20 bp, Artificial
  CRISPR gRNA sequence
gccagtccctgtttatttag

SEQ ID NO: 610493 - DNA, 20 bp, Artificial
  CRISPR gRNA sequence
gcagcttgacatgcccaaaa

SEQ ID NO: 610494 - DNA, 20 bp, Artificial
  CRISPR gRNA sequence
cttgacatgcccaaaatagc

SEQ ID NO: 610495 - DNA, 20 bp, Artificial
  CRISPR gRNA sequence
acatgcccaaaatagctagt

SEQ ID NO: 610496 - DNA, 20 bp, Artificial
  CRISPR gRNA sequence
aaatagctagtgagtattct

SEQ ID NO: 610497 - DNA, 20 bp, Artificial
  CRISPR gRNA sequence
attctcagcttccaatacaa

SEQ ID NO: 610498 - DNA, 20 bp, Artificial
  CRISPR gRNA sequence
ttctcagcttccaatacaac

SEQ ID NO: 610499 - DNA, 20 bp, Artificial
  CRISPR gRNA sequence
agcttccaatacaacaggac

SEQ ID NO: 610500 - DNA, 20 bp, Artificial
  CRISPR gRNA sequence
aggaccagatctctgaaacc

SEQ ID NO: 610501 - DNA, 20 bp, Artificial
  CRISPR gRNA sequence
gaccagatctctgaaacctg

SEQ ID NO: 610502 - DNA, 20 bp, Artificial
  CRISPR gRNA sequence
tggagaaaacattcttcttt

SEQ ID NO: 610503 - DNA, 20 bp, Artificial
  CRISPR gRNA sequence
ggagaaaacattcttctttt

SEQ ID NO: 610504 - DNA, 20 bp, Artificial
  CRISPR gRNA sequence
acattcttcttttgggaact

SEQ ID NO: 610505 - DNA, 20 bp, Artificial
  CRISPR gRNA sequence
tctccaaaaccaccaatctg

SEQ ID NO: 610506 - DNA, 20 bp, Artificial
  CRISPR gRNA sequence
ctccaaaaccaccaatctga

SEQ ID NO: 610507 - DNA, 20 bp, Artificial
  CRISPR gRNA sequence
aaccaccaatctgaaggttt

SEQ ID NO: 610508 - DNA, 20 bp, Artificial
  CRISPR gRNA sequence
accaccaatctgaaggtttc

SEQ ID NO: 610509 - DNA, 20 bp, Artificial
  CRISPR gRNA sequence
aatctgaaggtttcaggaca

SEQ ID NO: 610510 - DNA, 20 bp, Artificial
  CRISPR gRNA sequence
tctgaaggtttcaggacaca

SEQ ID NO: 610511 - DNA, 20 bp, Artificial
  CRISPR gRNA sequence
gtttcaggacacagagtaaa

SEQ ID NO: 610512 - DNA, 20 bp, Artificial
  CRISPR gRNA sequence
cagagtaaaaagcctttaaa

SEQ ID NO: 610513 - DNA, 20 bp, Artificial
  CRISPR gRNA sequence
agagtaaaaagcctttaaat

SEQ ID NO: 610514 - DNA, 20 bp, Artificial
  CRISPR gRNA sequence
aatgggttatttgatgttat

SEQ ID NO: 610515 - DNA, 20 bp, Artificial
  CRISPR gRNA sequence
tgggttatttgatgttatta

SEQ ID NO: 610516 - DNA, 20 bp, Artificial
  CRISPR gRNA sequence
gttatttgatgttattagag

SEQ ID NO: 610517 - DNA, 20 bp, Artificial
  CRISPR gRNA sequence
taccttaacctctttgttct

SEQ ID NO: 610518 - DNA, 20 bp, Artificial
  CRISPR gRNA sequence
gttctcagactcatgccttc

SEQ ID NO: 610519 - DNA, 20 bp, Artificial
  CRISPR gRNA sequence
agactcatgccttctggcta

SEQ ID NO: 610520 - DNA, 20 bp, Artificial
  CRISPR gRNA sequence
actcatgccttctggctatg

SEQ ID NO: 610521 - DNA, 20 bp, Artificial
  CRISPR gRNA sequence
ctcatgccttctggctatgg

SEQ ID NO: 610522 - DNA, 20 bp, Artificial
  CRISPR gRNA sequence
catgccttctggctatggag

SEQ ID NO: 610523 - DNA, 20 bp, Artificial
  CRISPR gRNA sequence
ggctatggaggagatgatgt

SEQ ID NO: 610524 - DNA, 20 bp, Artificial
  CRISPR gRNA sequence
tggccatatataatatcctg

SEQ ID NO: 610525 - DNA, 20 bp, Artificial
  CRISPR gRNA sequence
gaacacacccaaactcctcc

SEQ ID NO: 610526 - DNA, 20 bp, Artificial
  CRISPR gRNA sequence
acacccaaactcctcccagc

SEQ ID NO: 610527 - DNA, 20 bp, Artificial
  CRISPR gRNA sequence
ccatacatgaaccactcctt

SEQ ID NO: 610528 - DNA, 20 bp, Artificial
  CRISPR gRNA sequence
tacatgaaccactcctttgg

SEQ ID NO: 610529 - DNA, 20 bp, Artificial
  CRISPR gRNA sequence
acatgaaccactcctttggt

SEQ ID NO: 610530 - DNA, 20 bp, Artificial
  CRISPR gRNA sequence
ggccatttcaccactccatg

SEQ ID NO: 610531 - DNA, 20 bp, Artificial
  CRISPR gRNA sequence
atttcaccactccatgtagc

SEQ ID NO: 610532 - DNA, 20 bp, Artificial
  CRISPR gRNA sequence
tgtagccagctgattctgtg

SEQ ID NO: 610533 - DNA, 20 bp, Artificial
  CRISPR gRNA sequence
tgattctgtgtggtgataca

SEQ ID NO: 610534 - DNA, 20 bp, Artificial
  CRISPR gRNA sequence
gattctgtgtggtgatacat

SEQ ID NO: 610535 - DNA, 20 bp, Artificial
  CRISPR gRNA sequence
attctgtgtggtgatacatg

SEQ ID NO: 610536 - DNA, 20 bp, Artificial
  CRISPR gRNA sequence
tgtatgacccatgcattcta

SEQ ID NO: 610537 - DNA, 20 bp, Artificial
  CRISPR gRNA sequence
tgtatttgtcttgccataaa

SEQ ID NO: 610538 - DNA, 20 bp, Artificial
  CRISPR gRNA sequence
gtatttgtcttgccataaaa

SEQ ID NO: 610539 - DNA, 20 bp, Artificial
  CRISPR gRNA sequence
atttgtcttgccataaaaag

SEQ ID NO: 610540 - DNA, 20 bp, Artificial
  CRISPR gRNA sequence
tgccataaaaaggagtttcc

SEQ ID NO: 610541 - DNA, 20 bp, Artificial
  CRISPR gRNA sequence
aaaaaggagtttcctggttg

SEQ ID NO: 610542 - DNA, 20 bp, Artificial
  CRISPR gRNA sequence
aaaaggagtttcctggttga

SEQ ID NO: 610543 - DNA, 20 bp, Artificial
  CRISPR gRNA sequence
aggagtttcctggttgaagg

SEQ ID NO: 610544 - DNA, 20 bp, Artificial
  CRISPR gRNA sequence
tttcctggttgaaggcagta

SEQ ID NO: 610545 - DNA, 20 bp, Artificial
  CRISPR gRNA sequence
ctggttgaaggcagtatagc

SEQ ID NO: 610546 - DNA, 20 bp, Artificial
  CRISPR gRNA sequence
tggttgaaggcagtatagca

SEQ ID NO: 610547 - DNA, 20 bp, Artificial
  CRISPR gRNA sequence
ggcagtatagcaaggaatac

SEQ ID NO: 610548 - DNA, 20 bp, Artificial
  CRISPR gRNA sequence
gcagtatagcaaggaataca

SEQ ID NO: 610549 - DNA, 20 bp, Artificial
  CRISPR gRNA sequence
cagtatagcaaggaatacaa

SEQ ID NO: 610550 - DNA, 20 bp, Artificial
  CRISPR gRNA sequence
gcaaggaatacaagggtaat

SEQ ID NO: 610551 - DNA, 20 bp, Artificial
  CRISPR gRNA sequence
ggaatacaagggtaattggt

SEQ ID NO: 610552 - DNA, 20 bp, Artificial
  CRISPR gRNA sequence
gaatacaagggtaattggta

SEQ ID NO: 610553 - DNA, 20 bp, Artificial
  CRISPR gRNA sequence
attctgttaaatccatattt

SEQ ID NO: 610554 - DNA, 20 bp, Artificial
  CRISPR gRNA sequence
ttctgttaaatccatatttg

SEQ ID NO: 610555 - DNA, 20 bp, Artificial
  CRISPR gRNA sequence
tctgttaaatccatatttga

SEQ ID NO: 610556 - DNA, 20 bp, Artificial
  CRISPR gRNA sequence
tgttaaatccatatttgagg

SEQ ID NO: 610557 - DNA, 20 bp, Artificial
  CRISPR gRNA sequence
gggagcttgcaaaaatattg

SEQ ID NO: 610558 - DNA, 20 bp, Artificial
  CRISPR gRNA sequence
gagcttgcaaaaatattgaa

SEQ ID NO: 610559 - DNA, 20 bp, Artificial
  CRISPR gRNA sequence
ttgcaaaaatattgaagaga

SEQ ID NO: 610560 - DNA, 20 bp, Artificial
  CRISPR gRNA sequence
tgcaaaaatattgaagagaa

SEQ ID NO: 610561 - DNA, 20 bp, Artificial
  CRISPR gRNA sequence
gcaaaaatattgaagagaaa

SEQ ID NO: 610562 - DNA, 20 bp, Artificial
  CRISPR gRNA sequence
aaaatattgaagagaaaggg

SEQ ID NO: 610563 - DNA, 20 bp, Artificial
  CRISPR gRNA sequence
aaatattgaagagaaaggga

SEQ ID NO: 610564 - DNA, 20 bp, Artificial
  CRISPR gRNA sequence
aaagggaaggcatatcctat

SEQ ID NO: 610565 - DNA, 20 bp, Artificial
  CRISPR gRNA sequence
aagggaaggcatatcctatt

SEQ ID NO: 610566 - DNA, 20 bp, Artificial
  CRISPR gRNA sequence
tatttctgcctcttccatgt

SEQ ID NO: 610567 - DNA, 20 bp, Artificial
  CRISPR gRNA sequence
tctgcctcttccatgttgga

SEQ ID NO: 610568 - DNA, 20 bp, Artificial
  CRISPR gRNA sequence
tgcctcttccatgttggaaa

SEQ ID NO: 610569 - DNA, 20 bp, Artificial
  CRISPR gRNA sequence
cctgcctgccactacttgct

SEQ ID NO: 610570 - DNA, 20 bp, Artificial
  CRISPR gRNA sequence
cttgcttggttgatctctct

SEQ ID NO: 610571 - DNA, 20 bp, Artificial
  CRISPR gRNA sequence
ttgcttggttgatctctctc

SEQ ID NO: 610572 - DNA, 20 bp, Artificial
  CRISPR gRNA sequence
tggttgatctctctcaggaa

SEQ ID NO: 610573 - DNA, 20 bp, Artificial
  CRISPR gRNA sequence
tctcaggaatggtgccatat

SEQ ID NO: 610574 - DNA, 20 bp, Artificial
  CRISPR gRNA sequence
ctcaggaatggtgccatatc

SEQ ID NO: 610575 - DNA, 20 bp, Artificial
  CRISPR gRNA sequence
tcaggaatggtgccatatca

SEQ ID NO: 610576 - DNA, 20 bp, Artificial
  CRISPR gRNA sequence
atggtgccatatcagggtct

SEQ ID NO: 610577 - DNA, 20 bp, Artificial
  CRISPR gRNA sequence
ccatatcagggtctcagcac

SEQ ID NO: 610578 - DNA, 20 bp, Artificial
  CRISPR gRNA sequence
tctcagcactggaaaattgt

SEQ ID NO: 610579 - DNA, 20 bp, Artificial
  CRISPR gRNA sequence
gcactggaaaattgtgagct

SEQ ID NO: 610580 - DNA, 20 bp, Artificial
  CRISPR gRNA sequence
ctggaaaattgtgagctcag

SEQ ID NO: 610581 - DNA, 20 bp, Artificial
  CRISPR gRNA sequence
gaaaattgtgagctcagcag

SEQ ID NO: 610582 - DNA, 20 bp, Artificial
  CRISPR gRNA sequence
aattgtgagctcagcagtgg

SEQ ID NO: 610583 - DNA, 20 bp, Artificial
  CRISPR gRNA sequence
tgtgagctcagcagtggtgg

SEQ ID NO: 610584 - DNA, 20 bp, Artificial
  CRISPR gRNA sequence
agcagtggtggtagttaaat

SEQ ID NO: 610585 - DNA, 20 bp, Artificial
  CRISPR gRNA sequence
ggtggtagttaaatcagtca

SEQ ID NO: 610586 - DNA, 20 bp, Artificial
  CRISPR gRNA sequence
tggtagttaaatcagtcata

SEQ ID NO: 610587 - DNA, 20 bp, Artificial
  CRISPR gRNA sequence
tagttaaatcagtcatagag

SEQ ID NO: 610588 - DNA, 20 bp, Artificial
  CRISPR gRNA sequence
gttaaatcagtcatagagaa

SEQ ID NO: 610589 - DNA, 20 bp, Artificial
  CRISPR gRNA sequence
ttaaatcagtcatagagaag

SEQ ID NO: 610590 - DNA, 20 bp, Artificial
  CRISPR gRNA sequence
aatcagtcatagagaagagg

SEQ ID NO: 610591 - DNA, 20 bp, Artificial
  CRISPR gRNA sequence
catgtaattgaatctgttca

SEQ ID NO: 610592 - DNA, 20 bp, Artificial
  CRISPR gRNA sequence
cccattgtcactttgtacat

SEQ ID NO: 610593 - DNA, 20 bp, Artificial
  CRISPR gRNA sequence
actttgtacattggcccact

SEQ ID NO: 610594 - DNA, 20 bp, Artificial
  CRISPR gRNA sequence
tgtacattggcccactgaga

SEQ ID NO: 610595 - DNA, 20 bp, Artificial
  CRISPR gRNA sequence
ttggcccactgagaaagtac

SEQ ID NO: 610596 - DNA, 20 bp, Artificial
  CRISPR gRNA sequence
tggcccactgagaaagtacc

SEQ ID NO: 610597 - DNA, 20 bp, Artificial
  CRISPR gRNA sequence
ccactgagaaagtaccaggt

SEQ ID NO: 610598 - DNA, 20 bp, Artificial
  CRISPR gRNA sequence
gagaaagtaccaggtaagcc

SEQ ID NO: 610599 - DNA, 20 bp, Artificial
  CRISPR gRNA sequence
agtaccaggtaagcctggta

SEQ ID NO: 610600 - DNA, 20 bp, Artificial
  CRISPR gRNA sequence
taccaggtaagcctggtaaa

SEQ ID NO: 610601 - DNA, 20 bp, Artificial
  CRISPR gRNA sequence
gtaagcctggtaaagagtct

SEQ ID NO: 610602 - DNA, 20 bp, Artificial
  CRISPR gRNA sequence
gtaaagagtctgagattcat

SEQ ID NO: 610603 - DNA, 20 bp, Artificial
  CRISPR gRNA sequence
attcatgagattaccccctt

SEQ ID NO: 610604 - DNA, 20 bp, Artificial
  CRISPR gRNA sequence
tacccccttcagattactaa

SEQ ID NO: 610605 - DNA, 20 bp, Artificial
  CRISPR gRNA sequence
attactaacagccttcacta

SEQ ID NO: 610606 - DNA, 20 bp, Artificial
  CRISPR gRNA sequence
tcactacagtgaatgccctc

SEQ ID NO: 610607 - DNA, 20 bp, Artificial
  CRISPR gRNA sequence
actacagtgaatgccctctg

SEQ ID NO: 610608 - DNA, 20 bp, Artificial
  CRISPR gRNA sequence
tacagtgaatgccctctgga

SEQ ID NO: 610609 - DNA, 20 bp, Artificial
  CRISPR gRNA sequence
ccctctggagagaatttaca

SEQ ID NO: 610610 - DNA, 20 bp, Artificial
  CRISPR gRNA sequence
tacattttgtaccaattctg

SEQ ID NO: 610611 - DNA, 20 bp, Artificial
  CRISPR gRNA sequence
acattttgtaccaattctga

SEQ ID NO: 610612 - DNA, 20 bp, Artificial
  CRISPR gRNA sequence
atatcctcataactcttccc

SEQ ID NO: 610613 - DNA, 20 bp, Artificial
  CRISPR gRNA sequence
ttccctagactttctgtcac

SEQ ID NO: 610614 - DNA, 20 bp, Artificial
  CRISPR gRNA sequence
tcgtccaattttgttctttg

SEQ ID NO: 610615 - DNA, 20 bp, Artificial
  CRISPR gRNA sequence
ctttgaagtccttgaccata

SEQ ID NO: 610616 - DNA, 20 bp, Artificial
  CRISPR gRNA sequence
actatctcttcttccatgca

SEQ ID NO: 610617 - DNA, 20 bp, Artificial
  CRISPR gRNA sequence
cttcttccatgcaaagtgtg

SEQ ID NO: 610618 - DNA, 20 bp, Artificial
  CRISPR gRNA sequence
aagtgtgcagttaaatgtac

SEQ ID NO: 610619 - DNA, 20 bp, Artificial
  CRISPR gRNA sequence
gtactagctgaatgaaattc

SEQ ID NO: 610620 - DNA, 20 bp, Artificial
  CRISPR gRNA sequence
ctgaatgaaattctggctgc

SEQ ID NO: 610621 - DNA, 20 bp, Artificial
  CRISPR gRNA sequence
aatgaaattctggctgctgg

SEQ ID NO: 610622 - DNA, 20 bp, Artificial
  CRISPR gRNA sequence
atgaaattctggctgctggt

SEQ ID NO: 610623 - DNA, 20 bp, Artificial
  CRISPR gRNA sequence
aattctggctgctggtggga

SEQ ID NO: 610624 - DNA, 20 bp, Artificial
  CRISPR gRNA sequence
gtgggatagccactgtattt

SEQ ID NO: 610625 - DNA, 20 bp, Artificial
  CRISPR gRNA sequence
tgggatagccactgtatttc

SEQ ID NO: 610626 - DNA, 20 bp, Artificial
  CRISPR gRNA sequence
gggatagccactgtatttca

SEQ ID NO: 610627 - DNA, 20 bp, Artificial
  CRISPR gRNA sequence
atttcagggccctctccctt

SEQ ID NO: 610628 - DNA, 20 bp, Artificial
  CRISPR gRNA sequence
tcagggccctctcccttaag

SEQ ID NO: 610629 - DNA, 20 bp, Artificial
  CRISPR gRNA sequence
aagtggacctgtaaacacca

SEQ ID NO: 610630 - DNA, 20 bp, Artificial
  CRISPR gRNA sequence
acctgtaaacaccatagtca

SEQ ID NO: 610631 - DNA, 20 bp, Artificial
  CRISPR gRNA sequence
gtaaacaccatagtcatagc

SEQ ID NO: 610632 - DNA, 20 bp, Artificial
  CRISPR gRNA sequence
tcatagctggtattgaattc

SEQ ID NO: 610633 - DNA, 20 bp, Artificial
  CRISPR gRNA sequence
cagacattctatttacaaac

SEQ ID NO: 610634 - DNA, 20 bp, Artificial
  CRISPR gRNA sequence
actgtttcatcctcatcaac

SEQ ID NO: 610635 - DNA, 20 bp, Artificial
  CRISPR gRNA sequence
atcctcatcaactagtcact

SEQ ID NO: 610636 - DNA, 20 bp, Artificial
  CRISPR gRNA sequence
agtcactgagaataccccat

SEQ ID NO: 610637 - DNA, 20 bp, Artificial
  CRISPR gRNA sequence
gtcactgagaataccccatg

SEQ ID NO: 610638 - DNA, 20 bp, Artificial
  CRISPR gRNA sequence
accccatgaggccatacata

SEQ ID NO: 610639 - DNA, 20 bp, Artificial
  CRISPR gRNA sequence
ccccatgaggccatacatac

SEQ ID NO: 610640 - DNA, 20 bp, Artificial
  CRISPR gRNA sequence
gaggccatacatacgggttg

SEQ ID NO: 610641 - DNA, 20 bp, Artificial
  CRISPR gRNA sequence
tacatacgggttgaagcaaa

SEQ ID NO: 610642 - DNA, 20 bp, Artificial
  CRISPR gRNA sequence
cgggttgaagcaaaaagatt

SEQ ID NO: 610643 - DNA, 20 bp, Artificial
  CRISPR gRNA sequence
gttgaagcaaaaagattgag

SEQ ID NO: 610644 - DNA, 20 bp, Artificial
  CRISPR gRNA sequence
gaagcaaaaagattgagaag

SEQ ID NO: 610645 - DNA, 20 bp, Artificial
  CRISPR gRNA sequence
gcaaaaagattgagaagcag

SEQ ID NO: 610646 - DNA, 20 bp, Artificial
  CRISPR gRNA sequence
aaaagattgagaagcagtag

SEQ ID NO: 610647 - DNA, 20 bp, Artificial
  CRISPR gRNA sequence
agattgagaagcagtagtag

SEQ ID NO: 610648 - DNA, 20 bp, Artificial
  CRISPR gRNA sequence
gattgagaagcagtagtagc

SEQ ID NO: 610649 - DNA, 20 bp, Artificial
  CRISPR gRNA sequence
gaagcagtagtagcaggtat

SEQ ID NO: 610650 - DNA, 20 bp, Artificial
  CRISPR gRNA sequence
aagcagtagtagcaggtatt

SEQ ID NO: 610651 - DNA, 20 bp, Artificial
  CRISPR gRNA sequence
agcagtagtagcaggtatta

SEQ ID NO: 610652 - DNA, 20 bp, Artificial
  CRISPR gRNA sequence
agcaggtattagggacctct

SEQ ID NO: 610653 - DNA, 20 bp, Artificial
  CRISPR gRNA sequence
ctctgagctacttgctcata

SEQ ID NO: 610654 - DNA, 20 bp, Artificial
  CRISPR gRNA sequence
acttgctcatacagtatact

SEQ ID NO: 610655 - DNA, 20 bp, Artificial
  CRISPR gRNA sequence
cttgctcatacagtatactt

SEQ ID NO: 610656 - DNA, 20 bp, Artificial
  CRISPR gRNA sequence
tatacttgggcttcctcaac

SEQ ID NO: 610657 - DNA, 20 bp, Artificial
  CRISPR gRNA sequence
tgggcttcctcaactagcat

SEQ ID NO: 610658 - DNA, 20 bp, Artificial
  CRISPR gRNA sequence
gcttcctcaactagcataag

SEQ ID NO: 610659 - DNA, 20 bp, Artificial
  CRISPR gRNA sequence
cttcctcaactagcataaga

SEQ ID NO: 610660 - DNA, 20 bp, Artificial
  CRISPR gRNA sequence
caactagcataagaaggctg

SEQ ID NO: 610661 - DNA, 20 bp, Artificial
  CRISPR gRNA sequence
aactagcataagaaggctgc

SEQ ID NO: 610662 - DNA, 20 bp, Artificial
  CRISPR gRNA sequence
actagcataagaaggctgca

SEQ ID NO: 610663 - DNA, 20 bp, Artificial
  CRISPR gRNA sequence
agcataagaaggctgcaggg

SEQ ID NO: 610664 - DNA, 20 bp, Artificial
  CRISPR gRNA sequence
gcataagaaggctgcaggga

SEQ ID NO: 610665 - DNA, 20 bp, Artificial
  CRISPR gRNA sequence
gcagggaaggaaaatatacc

SEQ ID NO: 610666 - DNA, 20 bp, Artificial
  CRISPR gRNA sequence
cagggaaggaaaatatacca

SEQ ID NO: 610667 - DNA, 20 bp, Artificial
  CRISPR gRNA sequence
acatttttgatatgttgaat

SEQ ID NO: 610668 - DNA, 20 bp, Artificial
  CRISPR gRNA sequence
atgttgaattagataacacc

SEQ ID NO: 610669 - DNA, 20 bp, Artificial
  CRISPR gRNA sequence
aacacctagttcatgatgca

SEQ ID NO: 610670 - DNA, 20 bp, Artificial
  CRISPR gRNA sequence
ctagttcatgatgcacggtt

SEQ ID NO: 610671 - DNA, 20 bp, Artificial
  CRISPR gRNA sequence
tagttcatgatgcacggttt

SEQ ID NO: 610672 - DNA, 20 bp, Artificial
  CRISPR gRNA sequence
ttgggctacattgtcattcc

SEQ ID NO: 610673 - DNA, 20 bp, Artificial
  CRISPR gRNA sequence
cattgtcattccgagtccta

SEQ ID NO: 610674 - DNA, 20 bp, Artificial
  CRISPR gRNA sequence
tcattccgagtcctatggcc

SEQ ID NO: 610675 - DNA, 20 bp, Artificial
  CRISPR gRNA sequence
gagtcctatggcccagtaca

SEQ ID NO: 610676 - DNA, 20 bp, Artificial
  CRISPR gRNA sequence
ccagtacacagtcttaacca

SEQ ID NO: 610677 - DNA, 20 bp, Artificial
  CRISPR gRNA sequence
cagtcttaaccaaagttcat

SEQ ID NO: 610678 - DNA, 20 bp, Artificial
  CRISPR gRNA sequence
cttaaccaaagttcattagc

SEQ ID NO: 610679 - DNA, 20 bp, Artificial
  CRISPR gRNA sequence
accaaagttcattagcaagt

SEQ ID NO: 610680 - DNA, 20 bp, Artificial
  CRISPR gRNA sequence
ccaaagttcattagcaagta

SEQ ID NO: 610681 - DNA, 20 bp, Artificial
  CRISPR gRNA sequence
aaagttcattagcaagtaag

SEQ ID NO: 610682 - DNA, 20 bp, Artificial
  CRISPR gRNA sequence
gttcattagcaagtaaggag

SEQ ID NO: 610683 - DNA, 20 bp, Artificial
  CRISPR gRNA sequence
gtaaggagtggcttttcaaa

SEQ ID NO: 610684 - DNA, 20 bp, Artificial
  CRISPR gRNA sequence
aaggagtggcttttcaaatg

SEQ ID NO: 610685 - DNA, 20 bp, Artificial
  CRISPR gRNA sequence
gtggcttttcaaatggagat

SEQ ID NO: 610686 - DNA, 20 bp, Artificial
  CRISPR gRNA sequence
aaatggagattagttattgt

SEQ ID NO: 610687 - DNA, 20 bp, Artificial
  CRISPR gRNA sequence
tgtctttactataaaaccac

SEQ ID NO: 610688 - DNA, 20 bp, Artificial
  CRISPR gRNA sequence
gtctttactataaaaccacg

SEQ ID NO: 610689 - DNA, 20 bp, Artificial
  CRISPR gRNA sequence
tctttactataaaaccacga

SEQ ID NO: 610690 - DNA, 20 bp, Artificial
  CRISPR gRNA sequence
ccacgagggatctacacact

SEQ ID NO: 610691 - DNA, 20 bp, Artificial
  CRISPR gRNA sequence
cacgagggatctacacactg

SEQ ID NO: 610692 - DNA, 20 bp, Artificial
  CRISPR gRNA sequence
cacactgaggcttccattga

SEQ ID NO: 610693 - DNA, 20 bp, Artificial
  CRISPR gRNA sequence
cactgaggcttccattgaca

SEQ ID NO: 610694 - DNA, 20 bp, Artificial
  CRISPR gRNA sequence
ccattgacagagatgtcata

SEQ ID NO: 610695 - DNA, 20 bp, Artificial
  CRISPR gRNA sequence
tacagcatctccatttgcca

SEQ ID NO: 610696 - DNA, 20 bp, Artificial
  CRISPR gRNA sequence
tcattgcatctgctgaatct

SEQ ID NO: 610697 - DNA, 20 bp, Artificial
  CRISPR gRNA sequence
attgcatctgctgaatctta

SEQ ID NO: 610698 - DNA, 20 bp, Artificial
  CRISPR gRNA sequence
ctgctgaatcttagagtcaa

SEQ ID NO: 610699 - DNA, 20 bp, Artificial
  CRISPR gRNA sequence
ctgaatcttagagtcaaaag

SEQ ID NO: 610700 - DNA, 20 bp, Artificial
  CRISPR gRNA sequence
gaatcttagagtcaaaagta

SEQ ID NO: 610701 - DNA, 20 bp, Artificial
  CRISPR gRNA sequence
aatcttagagtcaaaagtag

SEQ ID NO: 610702 - DNA, 20 bp, Artificial
  CRISPR gRNA sequence
atcttagagtcaaaagtaga

SEQ ID NO: 610703 - DNA, 20 bp, Artificial
  CRISPR gRNA sequence
cttagagtcaaaagtagagg

SEQ ID NO: 610704 - DNA, 20 bp, Artificial
  CRISPR gRNA sequence
agtagagggagctttcatca

SEQ ID NO: 610705 - DNA, 20 bp, Artificial
  CRISPR gRNA sequence
agagggagctttcatcatgg

SEQ ID NO: 610706 - DNA, 20 bp, Artificial
  CRISPR gRNA sequence
gagggagctttcatcatggc

SEQ ID NO: 610707 - DNA, 20 bp, Artificial
  CRISPR gRNA sequence
agggagctttcatcatggca

SEQ ID NO: 610708 - DNA, 20 bp, Artificial
  CRISPR gRNA sequence
catcatggcagggtatgatg

SEQ ID NO: 610709 - DNA, 20 bp, Artificial
  CRISPR gRNA sequence
tgtagatccttttcttgccc

SEQ ID NO: 610710 - DNA, 20 bp, Artificial
  CRISPR gRNA sequence
gtagatccttttcttgcccc

SEQ ID NO: 610711 - DNA, 20 bp, Artificial
  CRISPR gRNA sequence
gccccaggctgctctcaaaa

SEQ ID NO: 610712 - DNA, 20 bp, Artificial
  CRISPR gRNA sequence
caggctgctctcaaaatgga

SEQ ID NO: 610713 - DNA, 20 bp, Artificial
  CRISPR gRNA sequence
ctctcaaaatggacagcctg

SEQ ID NO: 610714 - DNA, 20 bp, Artificial
  CRISPR gRNA sequence
tggacagcctgtggattacc

SEQ ID NO: 610715 - DNA, 20 bp, Artificial
  CRISPR gRNA sequence
attacctagtatatgcacca

SEQ ID NO: 610716 - DNA, 20 bp, Artificial
  CRISPR gRNA sequence
acctagtatatgcaccacag

SEQ ID NO: 610717 - DNA, 20 bp, Artificial
  CRISPR gRNA sequence
cacagaagtatacccaaata

SEQ ID NO: 610718 - DNA, 20 bp, Artificial
  CRISPR gRNA sequence
tctatgttgcttctaaaatc

SEQ ID NO: 610719 - DNA, 20 bp, Artificial
  CRISPR gRNA sequence
tatgttgcttctaaaatcta

SEQ ID NO: 610720 - DNA, 20 bp, Artificial
  CRISPR gRNA sequence
tgttgcttctaaaatctaga

SEQ ID NO: 610721 - DNA, 20 bp, Artificial
  CRISPR gRNA sequence
gttgcttctaaaatctagag

SEQ ID NO: 610722 - DNA, 20 bp, Artificial
  CRISPR gRNA sequence
ttttgtgcttcattttcacg

SEQ ID NO: 610723 - DNA, 20 bp, Artificial
  CRISPR gRNA sequence
tttgtgcttcattttcacga

SEQ ID NO: 610724 - DNA, 20 bp, Artificial
  CRISPR gRNA sequence
gtgcttcattttcacgaagg

SEQ ID NO: 610725 - DNA, 20 bp, Artificial
  CRISPR gRNA sequence
tgcttcattttcacgaagga

SEQ ID NO: 610726 - DNA, 20 bp, Artificial
  CRISPR gRNA sequence
cattttcacgaaggaaggtg

SEQ ID NO: 610727 - DNA, 20 bp, Artificial
  CRISPR gRNA sequence
attttcacgaaggaaggtgc

SEQ ID NO: 610728 - DNA, 20 bp, Artificial
  CRISPR gRNA sequence
ttttcacgaaggaaggtgca

SEQ ID NO: 610729 - DNA, 20 bp, Artificial
  CRISPR gRNA sequence
acgaaggaaggtgcagggtg

SEQ ID NO: 610730 - DNA, 20 bp, Artificial
  CRISPR gRNA sequence
cagcaatttctcacttacaa

SEQ ID NO: 610731 - DNA, 20 bp, Artificial
  CRISPR gRNA sequence
gcaatttctcacttacaatg

SEQ ID NO: 610732 - DNA, 20 bp, Artificial
  CRISPR gRNA sequence
caatttctcacttacaatgg

SEQ ID NO: 610733 - DNA, 20 bp, Artificial
  CRISPR gRNA sequence
ttacaatggaggatctattt

SEQ ID NO: 610734 - DNA, 20 bp, Artificial
  CRISPR gRNA sequence
aggatctatttcagcatgca

SEQ ID NO: 610735 - DNA, 20 bp, Artificial
  CRISPR gRNA sequence
ctatttcagcatgcacagat

SEQ ID NO: 610736 - DNA, 20 bp, Artificial
  CRISPR gRNA sequence
tttcagcatgcacagatcag

SEQ ID NO: 610737 - DNA, 20 bp, Artificial
  CRISPR gRNA sequence
taaaattttaccaatgctga

SEQ ID NO: 610738 - DNA, 20 bp, Artificial
  CRISPR gRNA sequence
tgaaagtccctgaactttct

SEQ ID NO: 610739 - DNA, 20 bp, Artificial
  CRISPR gRNA sequence
aaagtccctgaactttcttg

SEQ ID NO: 610740 - DNA, 20 bp, Artificial
  CRISPR gRNA sequence
ggagtttatctcctattcta

SEQ ID NO: 610741 - DNA, 20 bp, Artificial
  CRISPR gRNA sequence
tatagcatatatctcttact

SEQ ID NO: 610742 - DNA, 20 bp, Artificial
  CRISPR gRNA sequence
atagcatatatctcttactg

SEQ ID NO: 610743 - DNA, 20 bp, Artificial
  CRISPR gRNA sequence
tatctcttactgaggcatct

SEQ ID NO: 610744 - DNA, 20 bp, Artificial
  CRISPR gRNA sequence
atctcttactgaggcatctc

SEQ ID NO: 610745 - DNA, 20 bp, Artificial
  CRISPR gRNA sequence
atttactatatcctgctccc

SEQ ID NO: 610746 - DNA, 20 bp, Artificial
  CRISPR gRNA sequence
atcctgctcccaagttcact

SEQ ID NO: 610747 - DNA, 20 bp, Artificial
  CRISPR gRNA sequence
atgtcatgaatataatattc

SEQ ID NO: 610748 - DNA, 20 bp, Artificial
  CRISPR gRNA sequence
tattccagcttgatgttttt

SEQ ID NO: 610749 - DNA, 20 bp, Artificial
  CRISPR gRNA sequence
ttgatgttttttggaatgtc

SEQ ID NO: 610750 - DNA, 20 bp, Artificial
  CRISPR gRNA sequence
tttggaatgtcaagatgaac

SEQ ID NO: 610751 - DNA, 20 bp, Artificial
  CRISPR gRNA sequence
caagatgaacaagatttctc

SEQ ID NO: 610752 - DNA, 20 bp, Artificial
  CRISPR gRNA sequence
ctccagactatgttatgaca

SEQ ID NO: 610753 - DNA, 20 bp, Artificial
  CRISPR gRNA sequence
ccagactatgttatgacaaa

SEQ ID NO: 610754 - DNA, 20 bp, Artificial
  CRISPR gRNA sequence
agactatgttatgacaaaga

SEQ ID NO: 610755 - DNA, 20 bp, Artificial
  CRISPR gRNA sequence
ctatgttatgacaaagagag

SEQ ID NO: 610756 - DNA, 20 bp, Artificial
  CRISPR gRNA sequence
atgttatgacaaagagagca

SEQ ID NO: 610757 - DNA, 20 bp, Artificial
  CRISPR gRNA sequence
caaagagagcagagttgacc

SEQ ID NO: 610758 - DNA, 20 bp, Artificial
  CRISPR gRNA sequence
agcagagttgacctagcctt

SEQ ID NO: 610759 - DNA, 20 bp, Artificial
  CRISPR gRNA sequence
gcagagttgacctagcctta

SEQ ID NO: 610760 - DNA, 20 bp, Artificial
  CRISPR gRNA sequence
agttgacctagccttaaggt

SEQ ID NO: 610761 - DNA, 20 bp, Artificial
  CRISPR gRNA sequence
ttgacctagccttaaggtaa

SEQ ID NO: 610762 - DNA, 20 bp, Artificial
  CRISPR gRNA sequence
gacctagccttaaggtaaga

SEQ ID NO: 610763 - DNA, 20 bp, Artificial
  CRISPR gRNA sequence
gccttaaggtaagagagtaa

SEQ ID NO: 610764 - DNA, 20 bp, Artificial
  CRISPR gRNA sequence
gtaaaagtatgttgctcctc

SEQ ID NO: 610765 - DNA, 20 bp, Artificial
  CRISPR gRNA sequence
tatgttgctcctctagtgtg

SEQ ID NO: 610766 - DNA, 20 bp, Artificial
  CRISPR gRNA sequence
atgttgctcctctagtgtga

SEQ ID NO: 610767 - DNA, 20 bp, Artificial
  CRISPR gRNA sequence
tgttgctcctctagtgtgaa

SEQ ID NO: 610768 - DNA, 20 bp, Artificial
  CRISPR gRNA sequence
gttatacaaattaccttaaa

SEQ ID NO: 610769 - DNA, 20 bp, Artificial
  CRISPR gRNA sequence
aattaccttaaacagaaatc

SEQ ID NO: 610770 - DNA, 20 bp, Artificial
  CRISPR gRNA sequence
caagttcattgcttcatacc

SEQ ID NO: 610771 - DNA, 20 bp, Artificial
  CRISPR gRNA sequence
cattgcttcatacctagtgt

SEQ ID NO: 610772 - DNA, 20 bp, Artificial
  CRISPR gRNA sequence
tgcttcatacctagtgtcag

SEQ ID NO: 610773 - DNA, 20 bp, Artificial
  CRISPR gRNA sequence
gtggctatgttaatatgctc

SEQ ID NO: 610774 - DNA, 20 bp, Artificial
  CRISPR gRNA sequence
tatgttaatatgctccagta

SEQ ID NO: 610775 - DNA, 20 bp, Artificial
  CRISPR gRNA sequence
atgctccagtaaagattgta

SEQ ID NO: 610776 - DNA, 20 bp, Artificial
  CRISPR gRNA sequence
tacagctaaaactgcatcta

SEQ ID NO: 610777 - DNA, 20 bp, Artificial
  CRISPR gRNA sequence
gctaaaactgcatctacagt

SEQ ID NO: 610778 - DNA, 20 bp, Artificial
  CRISPR gRNA sequence
gttagcattatgaaatgatt

SEQ ID NO: 610779 - DNA, 20 bp, Artificial
  CRISPR gRNA sequence
tctgcatcaatgccatgcct

SEQ ID NO: 610780 - DNA, 20 bp, Artificial
  CRISPR gRNA sequence
ccatgccttagcctaataaa

SEQ ID NO: 610781 - DNA, 20 bp, Artificial
  CRISPR gRNA sequence
agcctaataaacagtttaaa

SEQ ID NO: 610782 - DNA, 20 bp, Artificial
  CRISPR gRNA sequence
gcctaataaacagtttaaat

SEQ ID NO: 610783 - DNA, 20 bp, Artificial
  CRISPR gRNA sequence
aaacagtttaaatgggtgta

SEQ ID NO: 610784 - DNA, 20 bp, Artificial
  CRISPR gRNA sequence
ttatcacccctaacatcttt

SEQ ID NO: 610785 - DNA, 20 bp, Artificial
  CRISPR gRNA sequence
aacatctttcagttttctga

SEQ ID NO: 610786 - DNA, 20 bp, Artificial
  CRISPR gRNA sequence
tactgtctgttattcatcca

SEQ ID NO: 610787 - DNA, 20 bp, Artificial
  CRISPR gRNA sequence
catagaattattatttcttt

SEQ ID NO: 610788 - DNA, 20 bp, Artificial
  CRISPR gRNA sequence
tttcttttagtttgctgtct

SEQ ID NO: 610789 - DNA, 20 bp, Artificial
  CRISPR gRNA sequence
ttcttttagtttgctgtctt

SEQ ID NO: 610790 - DNA, 20 bp, Artificial
  CRISPR gRNA sequence
cttttagtttgctgtcttgg

SEQ ID NO: 610791 - DNA, 20 bp, Artificial
  CRISPR gRNA sequence
tttagtttgctgtcttggga

SEQ ID NO: 610792 - DNA, 20 bp, Artificial
  CRISPR gRNA sequence
ttagtttgctgtcttgggag

SEQ ID NO: 610793 - DNA, 20 bp, Artificial
  CRISPR gRNA sequence
tgctgtcttgggagaggtga

SEQ ID NO: 610794 - DNA, 20 bp, Artificial
  CRISPR gRNA sequence
cttgggagaggtgatagttg

SEQ ID NO: 610795 - DNA, 20 bp, Artificial
  CRISPR gRNA sequence
ttgggagaggtgatagttgt

SEQ ID NO: 610796 - DNA, 20 bp, Artificial
  CRISPR gRNA sequence
tgggagaggtgatagttgta

SEQ ID NO: 610797 - DNA, 20 bp, Artificial
  CRISPR gRNA sequence
tagggctacgctgtccaata

SEQ ID NO: 610798 - DNA, 20 bp, Artificial
  CRISPR gRNA sequence
ggctacgctgtccaatatgg

SEQ ID NO: 610799 - DNA, 20 bp, Artificial
  CRISPR gRNA sequence
ctgtccaatatggtagccac

SEQ ID NO: 610800 - DNA, 20 bp, Artificial
  CRISPR gRNA sequence
tggtagccactagcctcatg

SEQ ID NO: 610801 - DNA, 20 bp, Artificial
  CRISPR gRNA sequence
ggttactaaacacctaaata

SEQ ID NO: 610802 - DNA, 20 bp, Artificial
  CRISPR gRNA sequence
actaaacacctaaatatggc

SEQ ID NO: 610803 - DNA, 20 bp, Artificial
  CRISPR gRNA sequence
tttttcttgtttttttacta

SEQ ID NO: 610804 - DNA, 20 bp, Artificial
  CRISPR gRNA sequence
atattaactatacctcaatg

SEQ ID NO: 610805 - DNA, 20 bp, Artificial
  CRISPR gRNA sequence
tatacctcaatgaagttgtt

SEQ ID NO: 610806 - DNA, 20 bp, Artificial
  CRISPR gRNA sequence
atacctcaatgaagttgttg

SEQ ID NO: 610807 - DNA, 20 bp, Artificial
  CRISPR gRNA sequence
tacctcaatgaagttgttga

SEQ ID NO: 610808 - DNA, 20 bp, Artificial
  CRISPR gRNA sequence
acctcaatgaagttgttgag

SEQ ID NO: 610809 - DNA, 20 bp, Artificial
  CRISPR gRNA sequence
cctcaatgaagttgttgagg

SEQ ID NO: 610810 - DNA, 20 bp, Artificial
  CRISPR gRNA sequence
tcaatgaagttgttgagggg

SEQ ID NO: 610811 - DNA, 20 bp, Artificial
  CRISPR gRNA sequence
caatgaagttgttgaggggg

SEQ ID NO: 610812 - DNA, 20 bp, Artificial
  CRISPR gRNA sequence
aatgaagttgttgaggggga

SEQ ID NO: 610813 - DNA, 20 bp, Artificial
  CRISPR gRNA sequence
tgaagttgttgagggggagg

SEQ ID NO: 610814 - DNA, 20 bp, Artificial
  CRISPR gRNA sequence
agttgttgagggggagggag

SEQ ID NO: 610815 - DNA, 20 bp, Artificial
  CRISPR gRNA sequence
gccccactaccaaaaactaa

SEQ ID NO: 610816 - DNA, 20 bp, Artificial
  CRISPR gRNA sequence
ctaccaaaaactaatggtct

SEQ ID NO: 610817 - DNA, 20 bp, Artificial
  CRISPR gRNA sequence
ttagtattgtccattgtatt

SEQ ID NO: 610818 - DNA, 20 bp, Artificial
  CRISPR gRNA sequence
aattctataacccttcaaat

SEQ ID NO: 610819 - DNA, 20 bp, Artificial
  CRISPR gRNA sequence
taacccttcaaatcagattc

SEQ ID NO: 610820 - DNA, 20 bp, Artificial
  CRISPR gRNA sequence
acccttcaaatcagattctg

SEQ ID NO: 610821 - DNA, 20 bp, Artificial
  CRISPR gRNA sequence
ttcaaatcagattctggagt

SEQ ID NO: 610822 - DNA, 20 bp, Artificial
  CRISPR gRNA sequence
cagattctggagttggtctt

SEQ ID NO: 610823 - DNA, 20 bp, Artificial
  CRISPR gRNA sequence
tcttcagccttatttgcctt

SEQ ID NO: 610824 - DNA, 20 bp, Artificial
  CRISPR gRNA sequence
cttcagccttatttgccttg

SEQ ID NO: 610825 - DNA, 20 bp, Artificial
  CRISPR gRNA sequence
ccttatttgccttgaggctt

SEQ ID NO: 610826 - DNA, 20 bp, Artificial
  CRISPR gRNA sequence
tatttgccttgaggcttaag

SEQ ID NO: 610827 - DNA, 20 bp, Artificial
  CRISPR gRNA sequence
gccttgaggcttaagtggat

SEQ ID NO: 610828 - DNA, 20 bp, Artificial
  CRISPR gRNA sequence
ccttgaggcttaagtggata

SEQ ID NO: 610829 - DNA, 20 bp, Artificial
  CRISPR gRNA sequence
cttgaggcttaagtggataa

SEQ ID NO: 610830 - DNA, 20 bp, Artificial
  CRISPR gRNA sequence
gtggataagggaccctttta

SEQ ID NO: 610831 - DNA, 20 bp, Artificial
  CRISPR gRNA sequence
ttttgcctgtattctgactt

SEQ ID NO: 610832 - DNA, 20 bp, Artificial
  CRISPR gRNA sequence
gtattctgacttgagtattc

SEQ ID NO: 610833 - DNA, 20 bp, Artificial
  CRISPR gRNA sequence
tattctgacttgagtattcc

SEQ ID NO: 610834 - DNA, 20 bp, Artificial
  CRISPR gRNA sequence
acttgagtattccaggcact

SEQ ID NO: 610835 - DNA, 20 bp, Artificial
  CRISPR gRNA sequence
ttccacctttgtgtgctcct

SEQ ID NO: 610836 - DNA, 20 bp, Artificial
  CRISPR gRNA sequence
tccacctttgtgtgctcctt

SEQ ID NO: 610837 - DNA, 20 bp, Artificial
  CRISPR gRNA sequence
ccacctttgtgtgctcctta

SEQ ID NO: 610838 - DNA, 20 bp, Artificial
  CRISPR gRNA sequence
tgtgtgctccttagggccat

SEQ ID NO: 610839 - DNA, 20 bp, Artificial
  CRISPR gRNA sequence
atacactaccattgctgctt

SEQ ID NO: 610840 - DNA, 20 bp, Artificial
  CRISPR gRNA sequence
actaccattgctgctttagc

SEQ ID NO: 610841 - DNA, 20 bp, Artificial
  CRISPR gRNA sequence
tgctttagcaagtaatgcca

SEQ ID NO: 610842 - DNA, 20 bp, Artificial
  CRISPR gRNA sequence
aagtaatgccatggctccca

SEQ ID NO: 610843 - DNA, 20 bp, Artificial
  CRISPR gRNA sequence
acatccttccatgctaccac

SEQ ID NO: 610844 - DNA, 20 bp, Artificial
  CRISPR gRNA sequence
aatttgaataatcatcttgc

SEQ ID NO: 610845 - DNA, 20 bp, Artificial
  CRISPR gRNA sequence
catcttgccagcacatgcct

SEQ ID NO: 610846 - DNA, 20 bp, Artificial
  CRISPR gRNA sequence
tgtcccattaactctgtgat

SEQ ID NO: 610847 - DNA, 20 bp, Artificial
  CRISPR gRNA sequence
gtcccattaactctgtgata

SEQ ID NO: 610848 - DNA, 20 bp, Artificial
  CRISPR gRNA sequence
cccattaactctgtgataag

SEQ ID NO: 610849 - DNA, 20 bp, Artificial
  CRISPR gRNA sequence
ccattaactctgtgataagg

SEQ ID NO: 610850 - DNA, 20 bp, Artificial
  CRISPR gRNA sequence
tccttgaattccattttgac

SEQ ID NO: 610851 - DNA, 20 bp, Artificial
  CRISPR gRNA sequence
cttgaattccattttgactg

SEQ ID NO: 610852 - DNA, 20 bp, Artificial
  CRISPR gRNA sequence
ttccattttgactggagctt

SEQ ID NO: 610853 - DNA, 20 bp, Artificial
  CRISPR gRNA sequence
tccattttgactggagcttt

SEQ ID NO: 610854 - DNA, 20 bp, Artificial
  CRISPR gRNA sequence
ctttgggccatttctgatat

SEQ ID NO: 610855 - DNA, 20 bp, Artificial
  CRISPR gRNA sequence
tgatatcagtaactctttat

SEQ ID NO: 610856 - DNA, 20 bp, Artificial
  CRISPR gRNA sequence
atcagtaactctttatcagt

SEQ ID NO: 610857 - DNA, 20 bp, Artificial
  CRISPR gRNA sequence
tcagtaactctttatcagtc

SEQ ID NO: 610858 - DNA, 20 bp, Artificial
  CRISPR gRNA sequence
ttatcagtcaggatcctgac

SEQ ID NO: 610859 - DNA, 20 bp, Artificial
  CRISPR gRNA sequence
tcaggatcctgacaagaaaa

SEQ ID NO: 610860 - DNA, 20 bp, Artificial
  CRISPR gRNA sequence
gatcctgacaagaaaacagt

SEQ ID NO: 610861 - DNA, 20 bp, Artificial
  CRISPR gRNA sequence
aagaaaacagtaagacactc

SEQ ID NO: 610862 - DNA, 20 bp, Artificial
  CRISPR gRNA sequence
aaaacagtaagacactcaag

SEQ ID NO: 610863 - DNA, 20 bp, Artificial
  CRISPR gRNA sequence
aaacagtaagacactcaagt

SEQ ID NO: 610864 - DNA, 20 bp, Artificial
  CRISPR gRNA sequence
aacagtaagacactcaagtg

SEQ ID NO: 610865 - DNA, 20 bp, Artificial
  CRISPR gRNA sequence
acactcaagtggggaaaatt

SEQ ID NO: 610866 - DNA, 20 bp, Artificial
  CRISPR gRNA sequence
cactcaagtggggaaaattt

SEQ ID NO: 610867 - DNA, 20 bp, Artificial
  CRISPR gRNA sequence
actcaagtggggaaaatttg

SEQ ID NO: 610868 - DNA, 20 bp, Artificial
  CRISPR gRNA sequence
aaatttggggacatgcatga

SEQ ID NO: 610869 - DNA, 20 bp, Artificial
  CRISPR gRNA sequence
tgaaagacaaatattcacaa

SEQ ID NO: 610870 - DNA, 20 bp, Artificial
  CRISPR gRNA sequence
gacaaatattcacaaaagaa

SEQ ID NO: 610871 - DNA, 20 bp, Artificial
  CRISPR gRNA sequence
aatattcacaaaagaatggt

SEQ ID NO: 610872 - DNA, 20 bp, Artificial
  CRISPR gRNA sequence
atattcacaaaagaatggtt

SEQ ID NO: 610873 - DNA, 20 bp, Artificial
  CRISPR gRNA sequence
acaaaagaatggttaggaat

SEQ ID NO: 610874 - DNA, 20 bp, Artificial
  CRISPR gRNA sequence
caaaagaatggttaggaata

SEQ ID NO: 610875 - DNA, 20 bp, Artificial
  CRISPR gRNA sequence
aaaagaatggttaggaataa

SEQ ID NO: 610876 - DNA, 20 bp, Artificial
  CRISPR gRNA sequence
agaatggttaggaataaggg

SEQ ID NO: 610877 - DNA, 20 bp, Artificial
  CRISPR gRNA sequence
gaataagggtagtctacaaa

SEQ ID NO: 610878 - DNA, 20 bp, Artificial
  CRISPR gRNA sequence
aagggtagtctacaaaaaga

SEQ ID NO: 610879 - DNA, 20 bp, Artificial
  CRISPR gRNA sequence
gtagtctacaaaaagatggc

SEQ ID NO: 610880 - DNA, 20 bp, Artificial
  CRISPR gRNA sequence
tagtctacaaaaagatggct

SEQ ID NO: 610881 - DNA, 20 bp, Artificial
  CRISPR gRNA sequence
caaaaagatggctgggttta

SEQ ID NO: 610882 - DNA, 20 bp, Artificial
  CRISPR gRNA sequence
aaagatggctgggtttacag

SEQ ID NO: 610883 - DNA, 20 bp, Artificial
  CRISPR gRNA sequence
gatggctgggtttacagtag

SEQ ID NO: 610884 - DNA, 20 bp, Artificial
  CRISPR gRNA sequence
atggctgggtttacagtagt

SEQ ID NO: 610885 - DNA, 20 bp, Artificial
  CRISPR gRNA sequence
gctgggtttacagtagtagg

SEQ ID NO: 610886 - DNA, 20 bp, Artificial
  CRISPR gRNA sequence
agtagtaggaagccatttac

SEQ ID NO: 610887 - DNA, 20 bp, Artificial
  CRISPR gRNA sequence
aggaagccatttactagctc

SEQ ID NO: 610888 - DNA, 20 bp, Artificial
  CRISPR gRNA sequence
atttactagctctagcctga

SEQ ID NO: 610889 - DNA, 20 bp, Artificial
  CRISPR gRNA sequence
ttactagctctagcctgaaa

SEQ ID NO: 610890 - DNA, 20 bp, Artificial
  CRISPR gRNA sequence
tagctctagcctgaaagaga

SEQ ID NO: 610891 - DNA, 20 bp, Artificial
  CRISPR gRNA sequence
agctctagcctgaaagagaa

SEQ ID NO: 610892 - DNA, 20 bp, Artificial
  CRISPR gRNA sequence
gctctagcctgaaagagaaa

SEQ ID NO: 610893 - DNA, 20 bp, Artificial
  CRISPR gRNA sequence
ctctagcctgaaagagaaag

SEQ ID NO: 610894 - DNA, 20 bp, Artificial
  CRISPR gRNA sequence
cctgaaagagaaaggggatc

SEQ ID NO: 610895 - DNA, 20 bp, Artificial
  CRISPR gRNA sequence
tgaaagagaaaggggatcta

SEQ ID NO: 610896 - DNA, 20 bp, Artificial
  CRISPR gRNA sequence
gaaagagaaaggggatctag

SEQ ID NO: 610897 - DNA, 20 bp, Artificial
  CRISPR gRNA sequence
aaaggggatctagaggtcac

SEQ ID NO: 610898 - DNA, 20 bp, Artificial
  CRISPR gRNA sequence
atctagaggtcactggaatt

SEQ ID NO: 610899 - DNA, 20 bp, Artificial
  CRISPR gRNA sequence
ctagaggtcactggaattaa

SEQ ID NO: 610900 - DNA, 20 bp, Artificial
  CRISPR gRNA sequence
gtcactggaattaagagaaa

SEQ ID NO: 610901 - DNA, 20 bp, Artificial
  CRISPR gRNA sequence
tcactggaattaagagaaat

SEQ ID NO: 610902 - DNA, 20 bp, Artificial
  CRISPR gRNA sequence
tggaattaagagaaatagga

SEQ ID NO: 610903 - DNA, 20 bp, Artificial
  CRISPR gRNA sequence
ggaattaagagaaataggaa

SEQ ID NO: 610904 - DNA, 20 bp, Artificial
  CRISPR gRNA sequence
gaattaagagaaataggaaa

SEQ ID NO: 610905 - DNA, 20 bp, Artificial
  CRISPR gRNA sequence
gagaaataggaaagggtctt

SEQ ID NO: 610906 - DNA, 20 bp, Artificial
  CRISPR gRNA sequence
gggtcttgagcactgacctt

SEQ ID NO: 610907 - DNA, 20 bp, Artificial
  CRISPR gRNA sequence
tcttgagcactgaccttcgg

SEQ ID NO: 610908 - DNA, 20 bp, Artificial
  CRISPR gRNA sequence
tgagcactgaccttcggtag

SEQ ID NO: 610909 - DNA, 20 bp, Artificial
  CRISPR gRNA sequence
tgaccttcggtagaagaatg

SEQ ID NO: 610910 - DNA, 20 bp, Artificial
  CRISPR gRNA sequence
gcctttgctaacctgtgact

SEQ ID NO: 610911 - DNA, 20 bp, Artificial
  CRISPR gRNA sequence
cctttgctaacctgtgactt

SEQ ID NO: 610912 - DNA, 20 bp, Artificial
  CRISPR gRNA sequence
ctttgctaacctgtgacttg

SEQ ID NO: 610913 - DNA, 20 bp, Artificial
  CRISPR gRNA sequence
acctcactctttccaccctt

SEQ ID NO: 610914 - DNA, 20 bp, Artificial
  CRISPR gRNA sequence
tccacccttcagtctcttac

SEQ ID NO: 610915 - DNA, 20 bp, Artificial
  CRISPR gRNA sequence
tcacattgactaaacttaac

SEQ ID NO: 610916 - DNA, 20 bp, Artificial
  CRISPR gRNA sequence
cattgactaaacttaaccag

SEQ ID NO: 610917 - DNA, 20 bp, Artificial
  CRISPR gRNA sequence
gactaaacttaaccagaagc

SEQ ID NO: 610918 - DNA, 20 bp, Artificial
  CRISPR gRNA sequence
ctaaacttaaccagaagcca

SEQ ID NO: 610919 - DNA, 20 bp, Artificial
  CRISPR gRNA sequence
taaacttaaccagaagccag

SEQ ID NO: 610920 - DNA, 20 bp, Artificial
  CRISPR gRNA sequence
aaccagaagccagaggacaa

SEQ ID NO: 610921 - DNA, 20 bp, Artificial
  CRISPR gRNA sequence
ccagaagccagaggacaacg

SEQ ID NO: 610922 - DNA, 20 bp, Artificial
  CRISPR gRNA sequence
acaacggagccaattgatta

SEQ ID NO: 610923 - DNA, 20 bp, Artificial
  CRISPR gRNA sequence
tgattaaagccaataaaaat

SEQ ID NO: 610924 - DNA, 20 bp, Artificial
  CRISPR gRNA sequence
ccaataaaaattagcttttg

SEQ ID NO: 610925 - DNA, 20 bp, Artificial
  CRISPR gRNA sequence
caataaaaattagcttttgc

SEQ ID NO: 610926 - DNA, 20 bp, Artificial
  CRISPR gRNA sequence
ataaaaattagcttttgcgg

SEQ ID NO: 610927 - DNA, 20 bp, Artificial
  CRISPR gRNA sequence
aaaattagcttttgcgggag

SEQ ID NO: 610928 - DNA, 20 bp, Artificial
  CRISPR gRNA sequence
aattagcttttgcgggagca

SEQ ID NO: 610929 - DNA, 20 bp, Artificial
  CRISPR gRNA sequence
gcttttgcgggagcagagca

SEQ ID NO: 610930 - DNA, 20 bp, Artificial
  CRISPR gRNA sequence
tttgcgggagcagagcaaag

SEQ ID NO: 610931 - DNA, 20 bp, Artificial
  CRISPR gRNA sequence
gggagcagagcaaagaagtg

SEQ ID NO: 610932 - DNA, 20 bp, Artificial
  CRISPR gRNA sequence
gagcaaagaagtgtggaaaa

SEQ ID NO: 610933 - DNA, 20 bp, Artificial
  CRISPR gRNA sequence
agaagtgtggaaaatggcta

SEQ ID NO: 610934 - DNA, 20 bp, Artificial
  CRISPR gRNA sequence
agtgtggaaaatggctatgg

SEQ ID NO: 610935 - DNA, 20 bp, Artificial
  CRISPR gRNA sequence
aaatggctatggcagccaaa

SEQ ID NO: 610936 - DNA, 20 bp, Artificial
  CRISPR gRNA sequence
atggctatggcagccaaaca

SEQ ID NO: 610937 - DNA, 20 bp, Artificial
  CRISPR gRNA sequence
gccaaacagagaatgtgcca

SEQ ID NO: 610938 - DNA, 20 bp, Artificial
  CRISPR gRNA sequence
ccacagattaactaaaattt

SEQ ID NO: 610939 - DNA, 20 bp, Artificial
  CRISPR gRNA sequence
attaactaaaatttaagaac

SEQ ID NO: 610940 - DNA, 20 bp, Artificial
  CRISPR gRNA sequence
gaactagtgcttaaaattac

SEQ ID NO: 610941 - DNA, 20 bp, Artificial
  CRISPR gRNA sequence
agtgcttaaaattactagta

SEQ ID NO: 610942 - DNA, 20 bp, Artificial
  CRISPR gRNA sequence
tgcttaaaattactagtata

SEQ ID NO: 610943 - DNA, 20 bp, Artificial
  CRISPR gRNA sequence
ttaaaattactagtatagag

SEQ ID NO: 610944 - DNA, 20 bp, Artificial
  CRISPR gRNA sequence
taaaattactagtatagagc

SEQ ID NO: 610945 - DNA, 20 bp, Artificial
  CRISPR gRNA sequence
aaaattactagtatagagca

SEQ ID NO: 610946 - DNA, 20 bp, Artificial
  CRISPR gRNA sequence
aaattactagtatagagcag

SEQ ID NO: 610947 - DNA, 20 bp, Artificial
  CRISPR gRNA sequence
agcaggggtcctcaacctcc

SEQ ID NO: 610948 - DNA, 20 bp, Artificial
  CRISPR gRNA sequence
ggtcctcaacctcctggctg

SEQ ID NO: 610949 - DNA, 20 bp, Artificial
  CRISPR gRNA sequence
tcaacctcctggctgcagac

SEQ ID NO: 610950 - DNA, 20 bp, Artificial
  CRISPR gRNA sequence
tcctggctgcagaccagtac

SEQ ID NO: 610951 - DNA, 20 bp, Artificial
  CRISPR gRNA sequence
tgcagaccagtaccagtcac

SEQ ID NO: 610952 - DNA, 20 bp, Artificial
  CRISPR gRNA sequence
gcagaccagtaccagtcact

SEQ ID NO: 610953 - DNA, 20 bp, Artificial
  CRISPR gRNA sequence
gaccagtaccagtcactggg

SEQ ID NO: 610954 - DNA, 20 bp, Artificial
  CRISPR gRNA sequence
tgggtggcctcttacaaatt

SEQ ID NO: 610955 - DNA, 20 bp, Artificial
  CRISPR gRNA sequence
ctcttacaaattgagccgca

SEQ ID NO: 610956 - DNA, 20 bp, Artificial
  CRISPR gRNA sequence
ttacaaattgagccgcatag

SEQ ID NO: 610957 - DNA, 20 bp, Artificial
  CRISPR gRNA sequence
tacaaattgagccgcatagc

SEQ ID NO: 610958 - DNA, 20 bp, Artificial
  CRISPR gRNA sequence
caaattgagccgcatagcag

SEQ ID NO: 610959 - DNA, 20 bp, Artificial
  CRISPR gRNA sequence
aaattgagccgcatagcagg

SEQ ID NO: 610960 - DNA, 20 bp, Artificial
  CRISPR gRNA sequence
tgagccgcatagcaggaggt

SEQ ID NO: 610961 - DNA, 20 bp, Artificial
  CRISPR gRNA sequence
gccgcatagcaggaggtgag

SEQ ID NO: 610962 - DNA, 20 bp, Artificial
  CRISPR gRNA sequence
gcatagcaggaggtgagcag

SEQ ID NO: 610963 - DNA, 20 bp, Artificial
  CRISPR gRNA sequence
agcaggaggtgagcagcagt

SEQ ID NO: 610964 - DNA, 20 bp, Artificial
  CRISPR gRNA sequence
ggaggtgagcagcagtgagc

SEQ ID NO: 610965 - DNA, 20 bp, Artificial
  CRISPR gRNA sequence
gtgagcaagcattactgcct

SEQ ID NO: 610966 - DNA, 20 bp, Artificial
  CRISPR gRNA sequence
gcctgagctcctcttcctgt

SEQ ID NO: 610967 - DNA, 20 bp, Artificial
  CRISPR gRNA sequence
agctcctcttcctgtcagat

SEQ ID NO: 610968 - DNA, 20 bp, Artificial
  CRISPR gRNA sequence
tcttcctgtcagatcagtga

SEQ ID NO: 610969 - DNA, 20 bp, Artificial
  CRISPR gRNA sequence
tgtcagatcagtgacagcat

SEQ ID NO: 610970 - DNA, 20 bp, Artificial
  CRISPR gRNA sequence
gtgacagcattagattctca

SEQ ID NO: 610971 - DNA, 20 bp, Artificial
  CRISPR gRNA sequence
tgacagcattagattctcat

SEQ ID NO: 610972 - DNA, 20 bp, Artificial
  CRISPR gRNA sequence
ctattgtgaactgcgcatgc

SEQ ID NO: 610973 - DNA, 20 bp, Artificial
  CRISPR gRNA sequence
tattgtgaactgcgcatgca

SEQ ID NO: 610974 - DNA, 20 bp, Artificial
  CRISPR gRNA sequence
attgtgaactgcgcatgcaa

SEQ ID NO: 610975 - DNA, 20 bp, Artificial
  CRISPR gRNA sequence
gcgcatgcaagggacctact

SEQ ID NO: 610976 - DNA, 20 bp, Artificial
  CRISPR gRNA sequence
ctacttggtgtgctccttat

SEQ ID NO: 610977 - DNA, 20 bp, Artificial
  CRISPR gRNA sequence
aatctaatgcctgatgatct

SEQ ID NO: 610978 - DNA, 20 bp, Artificial
  CRISPR gRNA sequence
atctaatgcctgatgatctg

SEQ ID NO: 610979 - DNA, 20 bp, Artificial
  CRISPR gRNA sequence
taatgcctgatgatctgagg

SEQ ID NO: 610980 - DNA, 20 bp, Artificial
  CRISPR gRNA sequence
cctgatgatctgaggtggaa

SEQ ID NO: 610981 - DNA, 20 bp, Artificial
  CRISPR gRNA sequence
cccccaccacctgtcatttg

SEQ ID NO: 610982 - DNA, 20 bp, Artificial
  CRISPR gRNA sequence
aaaactgtcttccatgaaac

SEQ ID NO: 610983 - DNA, 20 bp, Artificial
  CRISPR gRNA sequence
tcttccatgaaactggtccc

SEQ ID NO: 610984 - DNA, 20 bp, Artificial
  CRISPR gRNA sequence
tccatgaaactggtccctgg

SEQ ID NO: 610985 - DNA, 20 bp, Artificial
  CRISPR gRNA sequence
aactggtccctggtggtgaa

SEQ ID NO: 610986 - DNA, 20 bp, Artificial
  CRISPR gRNA sequence
actggtccctggtggtgaaa

SEQ ID NO: 610987 - DNA, 20 bp, Artificial
  CRISPR gRNA sequence
gtccctggtggtgaaaaggt

SEQ ID NO: 610988 - DNA, 20 bp, Artificial
  CRISPR gRNA sequence
tccctggtggtgaaaaggtt

SEQ ID NO: 610989 - DNA, 20 bp, Artificial
  CRISPR gRNA sequence
aaggttgggaactgctgata

SEQ ID NO: 610990 - DNA, 20 bp, Artificial
  CRISPR gRNA sequence
ggttgggaactgctgatata

SEQ ID NO: 610991 - DNA, 20 bp, Artificial
  CRISPR gRNA sequence
aactgctgatatagagtatt

SEQ ID NO: 610992 - DNA, 20 bp, Artificial
  CRISPR gRNA sequence
actgctgatatagagtatta

SEQ ID NO: 610993 - DNA, 20 bp, Artificial
  CRISPR gRNA sequence
ctgctgatatagagtattaa

SEQ ID NO: 610994 - DNA, 20 bp, Artificial
  CRISPR gRNA sequence
tgctgatatagagtattaag

SEQ ID NO: 610995 - DNA, 20 bp, Artificial
  CRISPR gRNA sequence
gtttttatgaatattattat

SEQ ID NO: 610996 - DNA, 20 bp, Artificial
  CRISPR gRNA sequence
tttatgaatattattattgg

SEQ ID NO: 610997 - DNA, 20 bp, Artificial
  CRISPR gRNA sequence
tgaatattattattggtaga

SEQ ID NO: 610998 - DNA, 20 bp, Artificial
  CRISPR gRNA sequence
ttattattggtagaaagtat

SEQ ID NO: 610999 - DNA, 20 bp, Artificial
  CRISPR gRNA sequence
attagcctccctttttcctc

SEQ ID NO: 611000 - DNA, 20 bp, Artificial
  CRISPR gRNA sequence
ttagcctccctttttcctcc

SEQ ID NO: 611001 - DNA, 20 bp, Artificial
  CRISPR gRNA sequence
tgtattgttatttatcatgt

SEQ ID NO: 611002 - DNA, 20 bp, Artificial
  CRISPR gRNA sequence
catttctgcttcctatattg

SEQ ID NO: 611003 - DNA, 20 bp, Artificial
  CRISPR gRNA sequence
ttctcatcttgattttcatt

SEQ ID NO: 611004 - DNA, 20 bp, Artificial
  CRISPR gRNA sequence
tcatcttgattttcatttag

SEQ ID NO: 611005 - DNA, 20 bp, Artificial
  CRISPR gRNA sequence
catcttgattttcatttagt

SEQ ID NO: 611006 - DNA, 20 bp, Artificial
  CRISPR gRNA sequence
ttgattttcatttagtaggt

SEQ ID NO: 611007 - DNA, 20 bp, Artificial
  CRISPR gRNA sequence
tttagtaggttggtaacaac

SEQ ID NO: 611008 - DNA, 20 bp, Artificial
  CRISPR gRNA sequence
taggttggtaacaacaagcc

SEQ ID NO: 611009 - DNA, 20 bp, Artificial
  CRISPR gRNA sequence
tggtaacaacaagcccagca

SEQ ID NO: 611010 - DNA, 20 bp, Artificial
  CRISPR gRNA sequence
gcatgaatacattactgtga

SEQ ID NO: 611011 - DNA, 20 bp, Artificial
  CRISPR gRNA sequence
cattactgtgatagatgtta

SEQ ID NO: 611012 - DNA, 20 bp, Artificial
  CRISPR gRNA sequence
tgtgatagatgttacagttt

SEQ ID NO: 611013 - DNA, 20 bp, Artificial
  CRISPR gRNA sequence
aaaatactttgaaaaatatc

SEQ ID NO: 611014 - DNA, 20 bp, Artificial
  CRISPR gRNA sequence
tctggaatacaatatgtatt

SEQ ID NO: 611015 - DNA, 20 bp, Artificial
  CRISPR gRNA sequence
aatatgtattaagtaaatac

SEQ ID NO: 611016 - DNA, 20 bp, Artificial
  CRISPR gRNA sequence
atatgtattaagtaaatact

SEQ ID NO: 611017 - DNA, 20 bp, Artificial
  CRISPR gRNA sequence
tatgtattaagtaaatacta

SEQ ID NO: 611018 - DNA, 20 bp, Artificial
  CRISPR gRNA sequence
atgtattaagtaaatactag

SEQ ID NO: 611019 - DNA, 20 bp, Artificial
  CRISPR gRNA sequence
accttgcatgatccctgtac

SEQ ID NO: 611020 - DNA, 20 bp, Artificial
  CRISPR gRNA sequence
ccttgcatgatccctgtaca

SEQ ID NO: 611021 - DNA, 20 bp, Artificial
  CRISPR gRNA sequence
tgcatgatccctgtacaagg

SEQ ID NO: 611022 - DNA, 20 bp, Artificial
  CRISPR gRNA sequence
caaggtggtatttttctgct

SEQ ID NO: 611023 - DNA, 20 bp, Artificial
  CRISPR gRNA sequence
aaggtggtatttttctgctt

SEQ ID NO: 611024 - DNA, 20 bp, Artificial
  CRISPR gRNA sequence
taggaactcttcttgtcctc

SEQ ID NO: 611025 - DNA, 20 bp, Artificial
  CRISPR gRNA sequence
ggaactcttcttgtcctcta

SEQ ID NO: 611026 - DNA, 20 bp, Artificial
  CRISPR gRNA sequence
gaactcttcttgtcctctag

SEQ ID NO: 611027 - DNA, 20 bp, Artificial
  CRISPR gRNA sequence
cttgtcctctagaggacacc

SEQ ID NO: 611028 - DNA, 20 bp, Artificial
  CRISPR gRNA sequence
gtcctctagaggacaccaag

SEQ ID NO: 611029 - DNA, 20 bp, Artificial
  CRISPR gRNA sequence
gaggacaccaagtagtgtct

SEQ ID NO: 611030 - DNA, 20 bp, Artificial
  CRISPR gRNA sequence
gtgtcttggtttttattgca

SEQ ID NO: 611031 - DNA, 20 bp, Artificial
  CRISPR gRNA sequence
tgtcttggtttttattgcat

SEQ ID NO: 611032 - DNA, 20 bp, Artificial
  CRISPR gRNA sequence
tggtttttattgcataggcc

SEQ ID NO: 611033 - DNA, 20 bp, Artificial
  CRISPR gRNA sequence
tttttattgcataggcctgg

SEQ ID NO: 611034 - DNA, 20 bp, Artificial
  CRISPR gRNA sequence
tattgcataggcctggtagt

SEQ ID NO: 611035 - DNA, 20 bp, Artificial
  CRISPR gRNA sequence
attgcataggcctggtagtt

SEQ ID NO: 611036 - DNA, 20 bp, Artificial
  CRISPR gRNA sequence
tggtagttaggttatttatc

SEQ ID NO: 611037 - DNA, 20 bp, Artificial
  CRISPR gRNA sequence
ttatttatctggaatttctt

SEQ ID NO: 611038 - DNA, 20 bp, Artificial
  CRISPR gRNA sequence
ggaatttcttgagctttccc

SEQ ID NO: 611039 - DNA, 20 bp, Artificial
  CRISPR gRNA sequence
tttcttgagctttccctaga

SEQ ID NO: 611040 - DNA, 20 bp, Artificial
  CRISPR gRNA sequence
cttgagctttccctagacag

SEQ ID NO: 611041 - DNA, 20 bp, Artificial
  CRISPR gRNA sequence
tagacagtagacactgtact

SEQ ID NO: 611042 - DNA, 20 bp, Artificial
  CRISPR gRNA sequence
actgtactaagcattttcca

SEQ ID NO: 611043 - DNA, 20 bp, Artificial
  CRISPR gRNA sequence
aaaacctttttatctaacat

SEQ ID NO: 611044 - DNA, 20 bp, Artificial
  CRISPR gRNA sequence
ttttatctaacataagcaaa

SEQ ID NO: 611045 - DNA, 20 bp, Artificial
  CRISPR gRNA sequence
ttatctaacataagcaaaaa

SEQ ID NO: 611046 - DNA, 20 bp, Artificial
  CRISPR gRNA sequence
acataagcaaaaagagattg

SEQ ID NO: 611047 - DNA, 20 bp, Artificial
  CRISPR gRNA sequence
aaaaagagattgtagattaa

SEQ ID NO: 611048 - DNA, 20 bp, Artificial
  CRISPR gRNA sequence
gattgtagattaatagcaat

SEQ ID NO: 611049 - DNA, 20 bp, Artificial
  CRISPR gRNA sequence
tagattaatagcaataagtc

SEQ ID NO: 611050 - DNA, 20 bp, Artificial
  CRISPR gRNA sequence
tagcaataagtctagtaaca

SEQ ID NO: 611051 - DNA, 20 bp, Artificial
  CRISPR gRNA sequence
gtctagtaacatggaaaatg

SEQ ID NO: 611052 - DNA, 20 bp, Artificial
  CRISPR gRNA sequence
atggaaaatgcagttttgaa

SEQ ID NO: 611053 - DNA, 20 bp, Artificial
  CRISPR gRNA sequence
tgttatttatttttttattt

SEQ ID NO: 611054 - DNA, 20 bp, Artificial
  CRISPR gRNA sequence
gttatttatttttttattta

SEQ ID NO: 611055 - DNA, 20 bp, Artificial
  CRISPR gRNA sequence
ttatttttttatttaaggcc

SEQ ID NO: 611056 - DNA, 20 bp, Artificial
  CRISPR gRNA sequence
aaggccaagctcttttcttt

SEQ ID NO: 611057 - DNA, 20 bp, Artificial
  CRISPR gRNA sequence
ccaagctcttttctttcagt

SEQ ID NO: 611058 - DNA, 20 bp, Artificial
  CRISPR gRNA sequence
ttttctttcagtgagaaatt

SEQ ID NO: 611059 - DNA, 20 bp, Artificial
  CRISPR gRNA sequence
tgagaaatttggttgttgaa

SEQ ID NO: 611060 - DNA, 20 bp, Artificial
  CRISPR gRNA sequence
tgaatagcatgtaatttttc

SEQ ID NO: 611061 - DNA, 20 bp, Artificial
  CRISPR gRNA sequence
tacccataacacattatctt

SEQ ID NO: 611062 - DNA, 20 bp, Artificial
  CRISPR gRNA sequence
attatctttagttacatttt

SEQ ID NO: 611063 - DNA, 20 bp, Artificial
  CRISPR gRNA sequence
gttacattttcagtgtcttt

SEQ ID NO: 611064 - DNA, 20 bp, Artificial
  CRISPR gRNA sequence
tcagtgtctttaagaactta

SEQ ID NO: 611065 - DNA, 20 bp, Artificial
  CRISPR gRNA sequence
aagaacttaaagatcctgtg

SEQ ID NO: 611066 - DNA, 20 bp, Artificial
  CRISPR gRNA sequence
aacttaaagatcctgtgaag

SEQ ID NO: 611067 - DNA, 20 bp, Artificial
  CRISPR gRNA sequence
taaagatcctgtgaagcagt

SEQ ID NO: 611068 - DNA, 20 bp, Artificial
  CRISPR gRNA sequence
cagacttctattcattttta

SEQ ID NO: 611069 - DNA, 20 bp, Artificial
  CRISPR gRNA sequence
tttgcccacattcacttctt

SEQ ID NO: 611070 - DNA, 20 bp, Artificial
  CRISPR gRNA sequence
ttctttagaaatatttttat

SEQ ID NO: 611071 - DNA, 20 bp, Artificial
  CRISPR gRNA sequence
atctttattgaatcttttca

SEQ ID NO: 611072 - DNA, 20 bp, Artificial
  CRISPR gRNA sequence
tttattgaatcttttcaaag

SEQ ID NO: 611073 - DNA, 20 bp, Artificial
  CRISPR gRNA sequence
cttttcaaagtggtaaaatt

SEQ ID NO: 611074 - DNA, 20 bp, Artificial
  CRISPR gRNA sequence
agtggtaaaatttggtttca

SEQ ID NO: 611075 - DNA, 20 bp, Artificial
  CRISPR gRNA sequence
aaaatttggtttcatagaaa

SEQ ID NO: 611076 - DNA, 20 bp, Artificial
  CRISPR gRNA sequence
tctttttgtaattatttcgt

SEQ ID NO: 611077 - DNA, 20 bp, Artificial
  CRISPR gRNA sequence
tatttcgttggaaataatta

SEQ ID NO: 611078 - DNA, 20 bp, Artificial
  CRISPR gRNA sequence
ttcgttggaaataattatag

SEQ ID NO: 611079 - DNA, 20 bp, Artificial
  CRISPR gRNA sequence
tcgttggaaataattatagc

SEQ ID NO: 611080 - DNA, 20 bp, Artificial
  CRISPR gRNA sequence
aataattatagcaggtaaac

SEQ ID NO: 611081 - DNA, 20 bp, Artificial
  CRISPR gRNA sequence
agcaggtaaactggcataaa

SEQ ID NO: 611082 - DNA, 20 bp, Artificial
  CRISPR gRNA sequence
gcaggtaaactggcataaat

SEQ ID NO: 611083 - DNA, 20 bp, Artificial
  CRISPR gRNA sequence
ggcataaataggttttgcta

SEQ ID NO: 611084 - DNA, 20 bp, Artificial
  CRISPR gRNA sequence
ctacagtcatacctgactct

SEQ ID NO: 611085 - DNA, 20 bp, Artificial
  CRISPR gRNA sequence
actcttagtgactacacata

SEQ ID NO: 611086 - DNA, 20 bp, Artificial
  CRISPR gRNA sequence
tacacatacagctcaactgc

SEQ ID NO: 611087 - DNA, 20 bp, Artificial
  CRISPR gRNA sequence
acatacagctcaactgctag

SEQ ID NO: 611088 - DNA, 20 bp, Artificial
  CRISPR gRNA sequence
tcaactgctagaagtatact

SEQ ID NO: 611089 - DNA, 20 bp, Artificial
  CRISPR gRNA sequence
aagtatactcggacgtacca

SEQ ID NO: 611090 - DNA, 20 bp, Artificial
  CRISPR gRNA sequence
tatactcggacgtaccaaag

SEQ ID NO: 611091 - DNA, 20 bp, Artificial
  CRISPR gRNA sequence
cgtaccaaagaagaacgtat

SEQ ID NO: 611092 - DNA, 20 bp, Artificial
  CRISPR gRNA sequence
aagaagaacgtatgagctcc

SEQ ID NO: 611093 - DNA, 20 bp, Artificial
  CRISPR gRNA sequence
acgtatgagctccaagaatt

SEQ ID NO: 611094 - DNA, 20 bp, Artificial
  CRISPR gRNA sequence
ctccaagaattcagtgtttt

SEQ ID NO: 611095 - DNA, 20 bp, Artificial
  CRISPR gRNA sequence
cagtgtttttggttatccat

SEQ ID NO: 611096 - DNA, 20 bp, Artificial
  CRISPR gRNA sequence
atccattagtatgttttaca

SEQ ID NO: 611097 - DNA, 20 bp, Artificial
  CRISPR gRNA sequence
ccattagtatgttttacaaa

SEQ ID NO: 611098 - DNA, 20 bp, Artificial
  CRISPR gRNA sequence
agtatgttttacaaagagaa

SEQ ID NO: 611099 - DNA, 20 bp, Artificial
  CRISPR gRNA sequence
tatgttttacaaagagaatg

SEQ ID NO: 611100 - DNA, 20 bp, Artificial
  CRISPR gRNA sequence
tgttttacaaagagaatgga

SEQ ID NO: 611101 - DNA, 20 bp, Artificial
  CRISPR gRNA sequence
gttttacaaagagaatggag

SEQ ID NO: 611102 - DNA, 20 bp, Artificial
  CRISPR gRNA sequence
ttacaaagagaatggagagg

SEQ ID NO: 611103 - DNA, 20 bp, Artificial
  CRISPR gRNA sequence
tacaaagagaatggagaggc

SEQ ID NO: 611104 - DNA, 20 bp, Artificial
  CRISPR gRNA sequence
tggagaggcaggttcattat

SEQ ID NO: 611105 - DNA, 20 bp, Artificial
  CRISPR gRNA sequence
attatgagaacctctcactt

SEQ ID NO: 611106 - DNA, 20 bp, Artificial
  CRISPR gRNA sequence
ggttattcctattgtacact

SEQ ID NO: 611107 - DNA, 20 bp, Artificial
  CRISPR gRNA sequence
gttattcctattgtacactg

SEQ ID NO: 611108 - DNA, 20 bp, Artificial
  CRISPR gRNA sequence
attcctattgtacactgagg

SEQ ID NO: 611109 - DNA, 20 bp, Artificial
  CRISPR gRNA sequence
tattgtacactgaggcagaa

SEQ ID NO: 611110 - DNA, 20 bp, Artificial
  CRISPR gRNA sequence
tgtacactgaggcagaaaag

SEQ ID NO: 611111 - DNA, 20 bp, Artificial
  CRISPR gRNA sequence
gaggcagaaaagaagtcaca

SEQ ID NO: 611112 - DNA, 20 bp, Artificial
  CRISPR gRNA sequence
aggcagaaaagaagtcacac

SEQ ID NO: 611113 - DNA, 20 bp, Artificial
  CRISPR gRNA sequence
cagaaaagaagtcacacagg

SEQ ID NO: 611114 - DNA, 20 bp, Artificial
  CRISPR gRNA sequence
gaagtcacacaggcagaccc

SEQ ID NO: 611115 - DNA, 20 bp, Artificial
  CRISPR gRNA sequence
gcagaccctggatttaaact

SEQ ID NO: 611116 - DNA, 20 bp, Artificial
  CRISPR gRNA sequence
cagaccctggatttaaacta

SEQ ID NO: 611117 - DNA, 20 bp, Artificial
  CRISPR gRNA sequence
accctggatttaaactaagg

SEQ ID NO: 611118 - DNA, 20 bp, Artificial
  CRISPR gRNA sequence
tgtgctcatcacaccctgct

SEQ ID NO: 611119 - DNA, 20 bp, Artificial
  CRISPR gRNA sequence
ctgctaagtgataaatgaca

SEQ ID NO: 611120 - DNA, 20 bp, Artificial
  CRISPR gRNA sequence
gctcgtatgtttattctata

SEQ ID NO: 611121 - DNA, 20 bp, Artificial
  CRISPR gRNA sequence
ataaagctttaactctactg

SEQ ID NO: 611122 - DNA, 20 bp, Artificial
  CRISPR gRNA sequence
gaaaaaaaaaatgtgctgtc

SEQ ID NO: 611123 - DNA, 20 bp, Artificial
  CRISPR gRNA sequence
aaaaaaaatgtgctgtctag

SEQ ID NO: 611124 - DNA, 20 bp, Artificial
  CRISPR gRNA sequence
aaaatgtgctgtctagaagt

SEQ ID NO: 611125 - DNA, 20 bp, Artificial
  CRISPR gRNA sequence
aaatgtgctgtctagaagtc

SEQ ID NO: 611126 - DNA, 20 bp, Artificial
  CRISPR gRNA sequence
atgtgctgtctagaagtcag

SEQ ID NO: 611127 - DNA, 20 bp, Artificial
  CRISPR gRNA sequence
tgtctagaagtcaggagatc

SEQ ID NO: 611128 - DNA, 20 bp, Artificial
  CRISPR gRNA sequence
gtctagaagtcaggagatca

SEQ ID NO: 611129 - DNA, 20 bp, Artificial
  CRISPR gRNA sequence
agtcaggagatcaaggcatg

SEQ ID NO: 611130 - DNA, 20 bp, Artificial
  CRISPR gRNA sequence
gtcaggagatcaaggcatgt

SEQ ID NO: 611131 - DNA, 20 bp, Artificial
  CRISPR gRNA sequence
agatcaaggcatgtgggttt

SEQ ID NO: 611132 - DNA, 20 bp, Artificial
  CRISPR gRNA sequence
gatcaaggcatgtgggtttt

SEQ ID NO: 611133 - DNA, 20 bp, Artificial
  CRISPR gRNA sequence
atcaaggcatgtgggtttta

SEQ ID NO: 611134 - DNA, 20 bp, Artificial
  CRISPR gRNA sequence
aaggcatgtgggttttaggg

SEQ ID NO: 611135 - DNA, 20 bp, Artificial
  CRISPR gRNA sequence
agggtggccttgctgcaaat

SEQ ID NO: 611136 - DNA, 20 bp, Artificial
  CRISPR gRNA sequence
gccttgctgcaaattagcta

SEQ ID NO: 611137 - DNA, 20 bp, Artificial
  CRISPR gRNA sequence
ccttgctgcaaattagctat

SEQ ID NO: 611138 - DNA, 20 bp, Artificial
  CRISPR gRNA sequence
attagctatgggacgttgtc

SEQ ID NO: 611139 - DNA, 20 bp, Artificial
  CRISPR gRNA sequence
aatttactctttaaatctcc

SEQ ID NO: 611140 - DNA, 20 bp, Artificial
  CRISPR gRNA sequence
aatgtgttatcttttctccc

SEQ ID NO: 611141 - DNA, 20 bp, Artificial
  CRISPR gRNA sequence
tctccctggattttgctaat

SEQ ID NO: 611142 - DNA, 20 bp, Artificial
  CRISPR gRNA sequence
gtcactactaccacacctta

SEQ ID NO: 611143 - DNA, 20 bp, Artificial
  CRISPR gRNA sequence
cactactaccacaccttaaa

SEQ ID NO: 611144 - DNA, 20 bp, Artificial
  CRISPR gRNA sequence
tactaccacaccttaaagag

SEQ ID NO: 611145 - DNA, 20 bp, Artificial
  CRISPR gRNA sequence
gtttgtttgtttgtttgttt

SEQ ID NO: 611146 - DNA, 20 bp, Artificial
  CRISPR gRNA sequence
tttgttttagtattttgccc

SEQ ID NO: 611147 - DNA, 20 bp, Artificial
  CRISPR gRNA sequence
gccctagtttattttaaaat

SEQ ID NO: 611148 - DNA, 20 bp, Artificial
  CRISPR gRNA sequence
tgaaaccgaattaacatctt

SEQ ID NO: 611149 - DNA, 20 bp, Artificial
  CRISPR gRNA sequence
gaaaccgaattaacatctta

SEQ ID NO: 611150 - DNA, 20 bp, Artificial
  CRISPR gRNA sequence
aacatcttaaggtttatatt

SEQ ID NO: 611151 - DNA, 20 bp, Artificial
  CRISPR gRNA sequence
aggtttatattgagtcttca

SEQ ID NO: 611152 - DNA, 20 bp, Artificial
  CRISPR gRNA sequence
gtctgatatcctacatctga

SEQ ID NO: 611153 - DNA, 20 bp, Artificial
  CRISPR gRNA sequence
tcctacatctgatagccttg

SEQ ID NO: 611154 - DNA, 20 bp, Artificial
  CRISPR gRNA sequence
ctgatagccttgaagtgtct

SEQ ID NO: 611155 - DNA, 20 bp, Artificial
  CRISPR gRNA sequence
tagccttgaagtgtctaaga

SEQ ID NO: 611156 - DNA, 20 bp, Artificial
  CRISPR gRNA sequence
tgaaatgtaaatgacatttt

SEQ ID NO: 611157 - DNA, 20 bp, Artificial
  CRISPR gRNA sequence
aatgtaaatgacattttaag

SEQ ID NO: 611158 - DNA, 20 bp, Artificial
  CRISPR gRNA sequence
atgtaaatgacattttaaga

SEQ ID NO: 611159 - DNA, 20 bp, Artificial
  CRISPR gRNA sequence
tgtaaatgacattttaagaa

SEQ ID NO: 611160 - DNA, 20 bp, Artificial
  CRISPR gRNA sequence
gtaaatgacattttaagaag

SEQ ID NO: 611161 - DNA, 20 bp, Artificial
  CRISPR gRNA sequence
aatgacattttaagaagggg

SEQ ID NO: 611162 - DNA, 20 bp, Artificial
  CRISPR gRNA sequence
atgacattttaagaagggga

SEQ ID NO: 611163 - DNA, 20 bp, Artificial
  CRISPR gRNA sequence
gacattttaagaaggggaag

SEQ ID NO: 611164 - DNA, 20 bp, Artificial
  CRISPR gRNA sequence
attttaagaaggggaaggag

SEQ ID NO: 611165 - DNA, 20 bp, Artificial
  CRISPR gRNA sequence
tttaagaaggggaaggagaa

SEQ ID NO: 611166 - DNA, 20 bp, Artificial
  CRISPR gRNA sequence
ttaagaaggggaaggagaag

SEQ ID NO: 611167 - DNA, 20 bp, Artificial
  CRISPR gRNA sequence
taagaaggggaaggagaaga

SEQ ID NO: 611168 - DNA, 20 bp, Artificial
  CRISPR gRNA sequence
aaggggaaggagaagaggga

SEQ ID NO: 611169 - DNA, 20 bp, Artificial
  CRISPR gRNA sequence
aggggaaggagaagagggaa

SEQ ID NO: 611170 - DNA, 20 bp, Artificial
  CRISPR gRNA sequence
ggggaaggagaagagggaaa

SEQ ID NO: 611171 - DNA, 20 bp, Artificial
  CRISPR gRNA sequence
gggaaggagaagagggaaag

SEQ ID NO: 611172 - DNA, 20 bp, Artificial
  CRISPR gRNA sequence
gaaggagaagagggaaaggg

SEQ ID NO: 611173 - DNA, 20 bp, Artificial
  CRISPR gRNA sequence
attgaaatgttttatgaaca

SEQ ID NO: 611174 - DNA, 20 bp, Artificial
  CRISPR gRNA sequence
aatgttttatgaacaaagat

SEQ ID NO: 611175 - DNA, 20 bp, Artificial
  CRISPR gRNA sequence
ttatgaacaaagatcagcta

SEQ ID NO: 611176 - DNA, 20 bp, Artificial
  CRISPR gRNA sequence
caaagatcagctaaagatta

SEQ ID NO: 611177 - DNA, 20 bp, Artificial
  CRISPR gRNA sequence
atcagctaaagattacagtc

SEQ ID NO: 611178 - DNA, 20 bp, Artificial
  CRISPR gRNA sequence
taaagattacagtcaagttg

SEQ ID NO: 611179 - DNA, 20 bp, Artificial
  CRISPR gRNA sequence
gattacagtcaagttgtggc

SEQ ID NO: 611180 - DNA, 20 bp, Artificial
  CRISPR gRNA sequence
attacagtcaagttgtggcc

SEQ ID NO: 611181 - DNA, 20 bp, Artificial
  CRISPR gRNA sequence
agtcaagttgtggccgggca

SEQ ID NO: 611182 - DNA, 20 bp, Artificial
  CRISPR gRNA sequence
caagttgtggccgggcacgg

SEQ ID NO: 611183 - DNA, 20 bp, Artificial
  CRISPR gRNA sequence
cacctgtaatcctaacactt

SEQ ID NO: 611184 - DNA, 20 bp, Artificial
  CRISPR gRNA sequence
acctgtaatcctaacacttt

SEQ ID NO: 611185 - DNA, 20 bp, Artificial
  CRISPR gRNA sequence
ctgtaatcctaacactttgg

SEQ ID NO: 611186 - DNA, 20 bp, Artificial
  CRISPR gRNA sequence
tgtaatcctaacactttggg

SEQ ID NO: 611187 - DNA, 20 bp, Artificial
  CRISPR gRNA sequence
tcctaacactttgggaggcc

SEQ ID NO: 611188 - DNA, 20 bp, Artificial
  CRISPR gRNA sequence
cctaacactttgggaggccg

SEQ ID NO: 611189 - DNA, 20 bp, Artificial
  CRISPR gRNA sequence
aacactttgggaggccgagg

SEQ ID NO: 611190 - DNA, 20 bp, Artificial
  CRISPR gRNA sequence
acactttgggaggccgaggt

SEQ ID NO: 611191 - DNA, 20 bp, Artificial
  CRISPR gRNA sequence
ctttgggaggccgaggtggg

SEQ ID NO: 611192 - DNA, 20 bp, Artificial
  CRISPR gRNA sequence
ggccgaggtgggcggatcat

SEQ ID NO: 611193 - DNA, 20 bp, Artificial
  CRISPR gRNA sequence
gccgaggtgggcggatcatg

SEQ ID NO: 611194 - DNA, 20 bp, Artificial
  CRISPR gRNA sequence
aggtgggcggatcatgaggt

SEQ ID NO: 611195 - DNA, 20 bp, Artificial
  CRISPR gRNA sequence
ggtgggcggatcatgaggtc

SEQ ID NO: 611196 - DNA, 20 bp, Artificial
  CRISPR gRNA sequence
tgggcggatcatgaggtcag

SEQ ID NO: 611197 - DNA, 20 bp, Artificial
  CRISPR gRNA sequence
gatcatgaggtcaggagatc

SEQ ID NO: 611198 - DNA, 20 bp, Artificial
  CRISPR gRNA sequence
tcaggagatcgagaccattc

SEQ ID NO: 611199 - DNA, 20 bp, Artificial
  CRISPR gRNA sequence
cgagaccattctggttaaca

SEQ ID NO: 611200 - DNA, 20 bp, Artificial
  CRISPR gRNA sequence
taaaaatacaaaaaattatc

SEQ ID NO: 611201 - DNA, 20 bp, Artificial
  CRISPR gRNA sequence
aaaaatacaaaaaattatct

SEQ ID NO: 611202 - DNA, 20 bp, Artificial
  CRISPR gRNA sequence
aaaaaattatctgggcgtga

SEQ ID NO: 611203 - DNA, 20 bp, Artificial
  CRISPR gRNA sequence
ggcgtgatagcacacgcctg

SEQ ID NO: 611204 - DNA, 20 bp, Artificial
  CRISPR gRNA sequence
atagcacacgcctgtagtcc

SEQ ID NO: 611205 - DNA, 20 bp, Artificial
  CRISPR gRNA sequence
cgcctgtagtcccagctact

SEQ ID NO: 611206 - DNA, 20 bp, Artificial
  CRISPR gRNA sequence
gcctgtagtcccagctactc

SEQ ID NO: 611207 - DNA, 20 bp, Artificial
  CRISPR gRNA sequence
ctgtagtcccagctactcgg

SEQ ID NO: 611208 - DNA, 20 bp, Artificial
  CRISPR gRNA sequence
tgtagtcccagctactcggg

SEQ ID NO: 611209 - DNA, 20 bp, Artificial
  CRISPR gRNA sequence
tcccagctactcgggaggct

SEQ ID NO: 611210 - DNA, 20 bp, Artificial
  CRISPR gRNA sequence
cccagctactcgggaggctg

SEQ ID NO: 611211 - DNA, 20 bp, Artificial
  CRISPR gRNA sequence
agctactcgggaggctgagg

SEQ ID NO: 611212 - DNA, 20 bp, Artificial
  CRISPR gRNA sequence
gctactcgggaggctgaggc

SEQ ID NO: 611213 - DNA, 20 bp, Artificial
  CRISPR gRNA sequence
tactcgggaggctgaggcag

SEQ ID NO: 611214 - DNA, 20 bp, Artificial
  CRISPR gRNA sequence
actcgggaggctgaggcagg

SEQ ID NO: 611215 - DNA, 20 bp, Artificial
  CRISPR gRNA sequence
gcaggaggattgcttgatcc

SEQ ID NO: 611216 - DNA, 20 bp, Artificial
  CRISPR gRNA sequence
caggaggattgcttgatccc

SEQ ID NO: 611217 - DNA, 20 bp, Artificial
  CRISPR gRNA sequence
ggaggattgcttgatcccgg

SEQ ID NO: 611218 - DNA, 20 bp, Artificial
  CRISPR gRNA sequence
gaggattgcttgatcccggg

SEQ ID NO: 611219 - DNA, 20 bp, Artificial
  CRISPR gRNA sequence
gattgcttgatcccgggagg

SEQ ID NO: 611220 - DNA, 20 bp, Artificial
  CRISPR gRNA sequence
tgatcccgggaggcggacac

SEQ ID NO: 611221 - DNA, 20 bp, Artificial
  CRISPR gRNA sequence
ccgggaggcggacaccagcc

SEQ ID NO: 611222 - DNA, 20 bp, Artificial
  CRISPR gRNA sequence
cgggaggcggacaccagcct

SEQ ID NO: 611223 - DNA, 20 bp, Artificial
  CRISPR gRNA sequence
gcggacaccagcctgggtga

SEQ ID NO: 611224 - DNA, 20 bp, Artificial
  CRISPR gRNA sequence
ggacaccagcctgggtgaca

SEQ ID NO: 611225 - DNA, 20 bp, Artificial
  CRISPR gRNA sequence
cctcccaccccccccaaaaa

SEQ ID NO: 611226 - DNA, 20 bp, Artificial
  CRISPR gRNA sequence
ccccccccaaaaaaagatta

SEQ ID NO: 611227 - DNA, 20 bp, Artificial
  CRISPR gRNA sequence
cccaaaaaaagattacagtc

SEQ ID NO: 611228 - DNA, 20 bp, Artificial
  CRISPR gRNA sequence
aaagattacagtcaagttat

SEQ ID NO: 611229 - DNA, 20 bp, Artificial
  CRISPR gRNA sequence
agtcaagttattagcccact

SEQ ID NO: 611230 - DNA, 20 bp, Artificial
  CRISPR gRNA sequence
aagttattagcccactgaga

SEQ ID NO: 611231 - DNA, 20 bp, Artificial
  CRISPR gRNA sequence
gcacttttaaaaacatgtcc

SEQ ID NO: 611232 - DNA, 20 bp, Artificial
  CRISPR gRNA sequence
acttttaaaaacatgtccca

SEQ ID NO: 611233 - DNA, 20 bp, Artificial
  CRISPR gRNA sequence
tcccagagatacattacata

SEQ ID NO: 611234 - DNA, 20 bp, Artificial
  CRISPR gRNA sequence
agatacattacataaagtta

SEQ ID NO: 611235 - DNA, 20 bp, Artificial
  CRISPR gRNA sequence
gatacattacataaagttat

SEQ ID NO: 611236 - DNA, 20 bp, Artificial
  CRISPR gRNA sequence
ataaagttataggaaaataa

SEQ ID NO: 611237 - DNA, 20 bp, Artificial
  CRISPR gRNA sequence
taaagttataggaaaataaa

SEQ ID NO: 611238 - DNA, 20 bp, Artificial
  CRISPR gRNA sequence
tataggaaaataaaaggtat

SEQ ID NO: 611239 - DNA, 20 bp, Artificial
  CRISPR gRNA sequence
tacttgaaactcttgctatt

SEQ ID NO: 611240 - DNA, 20 bp, Artificial
  CRISPR gRNA sequence
tcttgctattcagtaatctt

SEQ ID NO: 611241 - DNA, 20 bp, Artificial
  CRISPR gRNA sequence
cttcatgtgaacttttaaca

SEQ ID NO: 611242 - DNA, 20 bp, Artificial
  CRISPR gRNA sequence
gaacttttaacatagtattt

SEQ ID NO: 611243 - DNA, 20 bp, Artificial
  CRISPR gRNA sequence
agtgacttttttttttttct

SEQ ID NO: 611244 - DNA, 20 bp, Artificial
  CRISPR gRNA sequence
acttttttttttttctgaga

SEQ ID NO: 611245 - DNA, 20 bp, Artificial
  CRISPR gRNA sequence
cttttttttttttctgagac

SEQ ID NO: 611246 - DNA, 20 bp, Artificial
  CRISPR gRNA sequence
ttttttttttttctgagaca

SEQ ID NO: 611247 - DNA, 20 bp, Artificial
  CRISPR gRNA sequence
tgagacagggtctcactctg

SEQ ID NO: 611248 - DNA, 20 bp, Artificial
  CRISPR gRNA sequence
cagggtctcactctgtggcc

SEQ ID NO: 611249 - DNA, 20 bp, Artificial
  CRISPR gRNA sequence
agggtctcactctgtggccc

SEQ ID NO: 611250 - DNA, 20 bp, Artificial
  CRISPR gRNA sequence
tctcactctgtggcccaggc

SEQ ID NO: 611251 - DNA, 20 bp, Artificial
  CRISPR gRNA sequence
tcactctgtggcccaggctg

SEQ ID NO: 611252 - DNA, 20 bp, Artificial
  CRISPR gRNA sequence
ctgtggcccaggctggagtg

SEQ ID NO: 611253 - DNA, 20 bp, Artificial
  CRISPR gRNA sequence
tggcccaggctggagtgcag

SEQ ID NO: 611254 - DNA, 20 bp, Artificial
  CRISPR gRNA sequence
ggagtgcagtggcgtgatct

SEQ ID NO: 611255 - DNA, 20 bp, Artificial
  CRISPR gRNA sequence
tcactgcaacctccgcctcc

SEQ ID NO: 611256 - DNA, 20 bp, Artificial
  CRISPR gRNA sequence
cactgcaacctccgcctcct

SEQ ID NO: 611257 - DNA, 20 bp, Artificial
  CRISPR gRNA sequence
aacctccgcctcctgggttt

SEQ ID NO: 611258 - DNA, 20 bp, Artificial
  CRISPR gRNA sequence
ctccgcctcctgggtttaag

SEQ ID NO: 611259 - DNA, 20 bp, Artificial
  CRISPR gRNA sequence
tttaagtggttcccccgcct

SEQ ID NO: 611260 - DNA, 20 bp, Artificial
  CRISPR gRNA sequence
ttcccccgcctcagcctccc

SEQ ID NO: 611261 - DNA, 20 bp, Artificial
  CRISPR gRNA sequence
ccccgcctcagcctcccaag

SEQ ID NO: 611262 - DNA, 20 bp, Artificial
  CRISPR gRNA sequence
gcctcagcctcccaagtagc

SEQ ID NO: 611263 - DNA, 20 bp, Artificial
  CRISPR gRNA sequence
ctcccaagtagctggaatta

SEQ ID NO: 611264 - DNA, 20 bp, Artificial
  CRISPR gRNA sequence
tcccaagtagctggaattac

SEQ ID NO: 611265 - DNA, 20 bp, Artificial
  CRISPR gRNA sequence
ccaactaatttttgtatttt

SEQ ID NO: 611266 - DNA, 20 bp, Artificial
  CRISPR gRNA sequence
actaatttttgtatttttag

SEQ ID NO: 611267 - DNA, 20 bp, Artificial
  CRISPR gRNA sequence
taatttttgtatttttagta

SEQ ID NO: 611268 - DNA, 20 bp, Artificial
  CRISPR gRNA sequence
ttttgtatttttagtagaga

SEQ ID NO: 611269 - DNA, 20 bp, Artificial
  CRISPR gRNA sequence
tttgtatttttagtagagac

SEQ ID NO: 611270 - DNA, 20 bp, Artificial
  CRISPR gRNA sequence
ttgtatttttagtagagacg

SEQ ID NO: 611271 - DNA, 20 bp, Artificial
  CRISPR gRNA sequence
gagacggggtttcaccgtgt

SEQ ID NO: 611272 - DNA, 20 bp, Artificial
  CRISPR gRNA sequence
cggggtttcaccgtgttggc

SEQ ID NO: 611273 - DNA, 20 bp, Artificial
  CRISPR gRNA sequence
ggggtttcaccgtgttggcc

SEQ ID NO: 611274 - DNA, 20 bp, Artificial
  CRISPR gRNA sequence
tttcaccgtgttggccaggc

SEQ ID NO: 611275 - DNA, 20 bp, Artificial
  CRISPR gRNA sequence
tggtcttgaactcctgacct

SEQ ID NO: 611276 - DNA, 20 bp, Artificial
  CRISPR gRNA sequence
ggtcttgaactcctgacctc

SEQ ID NO: 611277 - DNA, 20 bp, Artificial
  CRISPR gRNA sequence
ctcaggtgattcgcctgcct

SEQ ID NO: 611278 - DNA, 20 bp, Artificial
  CRISPR gRNA sequence
tcgcctgcctcagcctccca

SEQ ID NO: 611279 - DNA, 20 bp, Artificial
  CRISPR gRNA sequence
gcctcagcctcccaaagtgc

SEQ ID NO: 611280 - DNA, 20 bp, Artificial
  CRISPR gRNA sequence
cctcagcctcccaaagtgct

SEQ ID NO: 611281 - DNA, 20 bp, Artificial
  CRISPR gRNA sequence
ctcccaaagtgctgggatta

SEQ ID NO: 611282 - DNA, 20 bp, Artificial
  CRISPR gRNA sequence
tcccaaagtgctgggattac

SEQ ID NO: 611283 - DNA, 20 bp, Artificial
  CRISPR gRNA sequence
agtgctgggattacaggcgt

SEQ ID NO: 611284 - DNA, 20 bp, Artificial
  CRISPR gRNA sequence
gagccactgcgcccaccctt

SEQ ID NO: 611285 - DNA, 20 bp, Artificial
  CRISPR gRNA sequence
gctacaaaaatgatttttat

SEQ ID NO: 611286 - DNA, 20 bp, Artificial
  CRISPR gRNA sequence
gatttttattagttttgtct

SEQ ID NO: 611287 - DNA, 20 bp, Artificial
  CRISPR gRNA sequence
tagttttgtctcagattttt

SEQ ID NO: 611288 - DNA, 20 bp, Artificial
  CRISPR gRNA sequence
tctcagatttttcagtttta

SEQ ID NO: 611289 - DNA, 20 bp, Artificial
  CRISPR gRNA sequence
ctcagatttttcagttttat

SEQ ID NO: 611290 - DNA, 20 bp, Artificial
  CRISPR gRNA sequence
ttcagttttataggtgatta

SEQ ID NO: 611291 - DNA, 20 bp, Artificial
  CRISPR gRNA sequence
tttattatacctaatactct

SEQ ID NO: 611292 - DNA, 20 bp, Artificial
  CRISPR gRNA sequence
ttattatacctaatactctg

SEQ ID NO: 611293 - DNA, 20 bp, Artificial
  CRISPR gRNA sequence
tattatacctaatactctga

SEQ ID NO: 611294 - DNA, 20 bp, Artificial
  CRISPR gRNA sequence
attatacctaatactctgag

SEQ ID NO: 611295 - DNA, 20 bp, Artificial
  CRISPR gRNA sequence
tacctaatactctgagggga

SEQ ID NO: 611296 - DNA, 20 bp, Artificial
  CRISPR gRNA sequence
gaggggatagtgtttaaatt

SEQ ID NO: 611297 - DNA, 20 bp, Artificial
  CRISPR gRNA sequence
atagtgtttaaattaagccc

SEQ ID NO: 611298 - DNA, 20 bp, Artificial
  CRISPR gRNA sequence
attaagccctggacccctat

SEQ ID NO: 611299 - DNA, 20 bp, Artificial
  CRISPR gRNA sequence
ctattagtcaaaataatatt

SEQ ID NO: 611300 - DNA, 20 bp, Artificial
  CRISPR gRNA sequence
acttgttattttaaaaattc

SEQ ID NO: 611301 - DNA, 20 bp, Artificial
  CRISPR gRNA sequence
cttgttattttaaaaattct

SEQ ID NO: 611302 - DNA, 20 bp, Artificial
  CRISPR gRNA sequence
tgttattttaaaaattctag

SEQ ID NO: 611303 - DNA, 20 bp, Artificial
  CRISPR gRNA sequence
gttattttaaaaattctagg

SEQ ID NO: 611304 - DNA, 20 bp, Artificial
  CRISPR gRNA sequence
ttaaaaattctaggaggaaa

SEQ ID NO: 611305 - DNA, 20 bp, Artificial
  CRISPR gRNA sequence
aattacatgttttttctaat

SEQ ID NO: 611306 - DNA, 20 bp, Artificial
  CRISPR gRNA sequence
gttttttctaattagcattt

SEQ ID NO: 611307 - DNA, 20 bp, Artificial
  CRISPR gRNA sequence
ttttttctaattagcatttc

SEQ ID NO: 611308 - DNA, 20 bp, Artificial
  CRISPR gRNA sequence
cttatgctgtacccaaatta

SEQ ID NO: 611309 - DNA, 20 bp, Artificial
  CRISPR gRNA sequence
ttatgctgtacccaaattaa

SEQ ID NO: 611310 - DNA, 20 bp, Artificial
  CRISPR gRNA sequence
cccaaattaaaggtttaaaa

SEQ ID NO: 611311 - DNA, 20 bp, Artificial
  CRISPR gRNA sequence
aaattaaaggtttaaaacag

SEQ ID NO: 611312 - DNA, 20 bp, Artificial
  CRISPR gRNA sequence
attaaaggtttaaaacagaa

SEQ ID NO: 611313 - DNA, 20 bp, Artificial
  CRISPR gRNA sequence
agtgtataattttaatatat

SEQ ID NO: 611314 - DNA, 20 bp, Artificial
  CRISPR gRNA sequence
atttctttttataaattata

SEQ ID NO: 611315 - DNA, 20 bp, Artificial
  CRISPR gRNA sequence
ttctttttataaattataaa

SEQ ID NO: 611316 - DNA, 20 bp, Artificial
  CRISPR gRNA sequence
attataaagagaaaaatgat

SEQ ID NO: 611317 - DNA, 20 bp, Artificial
  CRISPR gRNA sequence
taaagagaaaaatgatgagt

SEQ ID NO: 611318 - DNA, 20 bp, Artificial
  CRISPR gRNA sequence
tgagtaagaatgtgtctcca

SEQ ID NO: 611319 - DNA, 20 bp, Artificial
  CRISPR gRNA sequence
agtaagaatgtgtctccata

SEQ ID NO: 611320 - DNA, 20 bp, Artificial
  CRISPR gRNA sequence
gtaagaatgtgtctccatag

SEQ ID NO: 611321 - DNA, 20 bp, Artificial
  CRISPR gRNA sequence
taagaatgtgtctccataga

SEQ ID NO: 611322 - DNA, 20 bp, Artificial
  CRISPR gRNA sequence
aagaatgtgtctccatagag

SEQ ID NO: 611323 - DNA, 20 bp, Artificial
  CRISPR gRNA sequence
tagaggggaacaacacatac

SEQ ID NO: 611324 - DNA, 20 bp, Artificial
  CRISPR gRNA sequence
agaggggaacaacacatact

SEQ ID NO: 611325 - DNA, 20 bp, Artificial
  CRISPR gRNA sequence
gaggggaacaacacatactg

SEQ ID NO: 611326 - DNA, 20 bp, Artificial
  CRISPR gRNA sequence
caacacatactggggcctat

SEQ ID NO: 611327 - DNA, 20 bp, Artificial
  CRISPR gRNA sequence
acacatactggggcctattg

SEQ ID NO: 611328 - DNA, 20 bp, Artificial
  CRISPR gRNA sequence
acatactggggcctattgga

SEQ ID NO: 611329 - DNA, 20 bp, Artificial
  CRISPR gRNA sequence
tactggggcctattggagag

SEQ ID NO: 611330 - DNA, 20 bp, Artificial
  CRISPR gRNA sequence
ctggggcctattggagagta

SEQ ID NO: 611331 - DNA, 20 bp, Artificial
  CRISPR gRNA sequence
tggggcctattggagagtag

SEQ ID NO: 611332 - DNA, 20 bp, Artificial
  CRISPR gRNA sequence
ggggcctattggagagtaga

SEQ ID NO: 611333 - DNA, 20 bp, Artificial
  CRISPR gRNA sequence
gcctattggagagtagaggg

SEQ ID NO: 611334 - DNA, 20 bp, Artificial
  CRISPR gRNA sequence
cctattggagagtagagggt

SEQ ID NO: 611335 - DNA, 20 bp, Artificial
  CRISPR gRNA sequence
ggagagtagagggtgggacg

SEQ ID NO: 611336 - DNA, 20 bp, Artificial
  CRISPR gRNA sequence
gagagtagagggtgggacga

SEQ ID NO: 611337 - DNA, 20 bp, Artificial
  CRISPR gRNA sequence
gagtagagggtgggacgaag

SEQ ID NO: 611338 - DNA, 20 bp, Artificial
  CRISPR gRNA sequence
gtagagggtgggacgaagga

SEQ ID NO: 611339 - DNA, 20 bp, Artificial
  CRISPR gRNA sequence
ggtgggacgaaggagagaat

SEQ ID NO: 611340 - DNA, 20 bp, Artificial
  CRISPR gRNA sequence
gtgggacgaaggagagaatc

SEQ ID NO: 611341 - DNA, 20 bp, Artificial
  CRISPR gRNA sequence
gggacgaaggagagaatcag

SEQ ID NO: 611342 - DNA, 20 bp, Artificial
  CRISPR gRNA sequence
aatcaggagaaaataactaa

SEQ ID NO: 611343 - DNA, 20 bp, Artificial
  CRISPR gRNA sequence
gagaaaataactaatggtgc

SEQ ID NO: 611344 - DNA, 20 bp, Artificial
  CRISPR gRNA sequence
atggtgctagccttaatacc

SEQ ID NO: 611345 - DNA, 20 bp, Artificial
  CRISPR gRNA sequence
aaaaaaaaaacccatgacac

SEQ ID NO: 611346 - DNA, 20 bp, Artificial
  CRISPR gRNA sequence
tacctctgaacttaaaataa

SEQ ID NO: 611347 - DNA, 20 bp, Artificial
  CRISPR gRNA sequence
taaaataaaagttaaaaaaa

SEQ ID NO: 611348 - DNA, 20 bp, Artificial
  CRISPR gRNA sequence
aaaaaacagaatgcatctca

SEQ ID NO: 611349 - DNA, 20 bp, Artificial
  CRISPR gRNA sequence
aaaacagaatgcatctcata

SEQ ID NO: 611350 - DNA, 20 bp, Artificial
  CRISPR gRNA sequence
gtctcaaaatatttttctac

SEQ ID NO: 611351 - DNA, 20 bp, Artificial
  CRISPR gRNA sequence
ccagatgaaaaattcaattt

SEQ ID NO: 611352 - DNA, 20 bp, Artificial
  CRISPR gRNA sequence
tgaaaaattcaattttggct

SEQ ID NO: 611353 - DNA, 20 bp, Artificial
  CRISPR gRNA sequence
attttggctaagaattatac

SEQ ID NO: 611354 - DNA, 20 bp, Artificial
  CRISPR gRNA sequence
ggctaagaattatactggtt

SEQ ID NO: 611355 - DNA, 20 bp, Artificial
  CRISPR gRNA sequence
aattatgtattgctcaaaaa

SEQ ID NO: 611356 - DNA, 20 bp, Artificial
  CRISPR gRNA sequence
ttaaaaatcttaatttccca

SEQ ID NO: 611357 - DNA, 20 bp, Artificial
  CRISPR gRNA sequence
tgtctcttataaatctaaaa

SEQ ID NO: 611358 - DNA, 20 bp, Artificial
  CRISPR gRNA sequence
aaaaaagccaaatacttatt

SEQ ID NO: 611359 - DNA, 20 bp, Artificial
  CRISPR gRNA sequence
aaaagccaaatacttattaa

SEQ ID NO: 611360 - DNA, 20 bp, Artificial
  CRISPR gRNA sequence
attaagagaaccatatattt

SEQ ID NO: 611361 - DNA, 20 bp, Artificial
  CRISPR gRNA sequence
aagatacttgttctaaaact

SEQ ID NO: 611362 - DNA, 20 bp, Artificial
  CRISPR gRNA sequence
taaaactaagttatttttca

SEQ ID NO: 611363 - DNA, 20 bp, Artificial
  CRISPR gRNA sequence
gttatttttcaaagatttat

SEQ ID NO: 611364 - DNA, 20 bp, Artificial
  CRISPR gRNA sequence
tttataagtaaaatgtcctt

SEQ ID NO: 611365 - DNA, 20 bp, Artificial
  CRISPR gRNA sequence
taagtaaaatgtccttaagt

SEQ ID NO: 611366 - DNA, 20 bp, Artificial
  CRISPR gRNA sequence
atgtccttaagtaagaaaat

SEQ ID NO: 611367 - DNA, 20 bp, Artificial
  CRISPR gRNA sequence
cttaagtaagaaaataagta

SEQ ID NO: 611368 - DNA, 20 bp, Artificial
  CRISPR gRNA sequence
ttaagtaagaaaataagtaa

SEQ ID NO: 611369 - DNA, 20 bp, Artificial
  CRISPR gRNA sequence
tttttgttcatcctcatttt

SEQ ID NO: 611370 - DNA, 20 bp, Artificial
  CRISPR gRNA sequence
caataatgctattaaattct

SEQ ID NO: 611371 - DNA, 20 bp, Artificial
  CRISPR gRNA sequence
ttaaattctaagtaaaacct

SEQ ID NO: 611372 - DNA, 20 bp, Artificial
  CRISPR gRNA sequence
acctcagctttcaattgaac

SEQ ID NO: 611373 - DNA, 20 bp, Artificial
  CRISPR gRNA sequence
ctttcaattgaaccagcatt

SEQ ID NO: 611374 - DNA, 20 bp, Artificial
  CRISPR gRNA sequence
aaataactactttgtaaaat

SEQ ID NO: 611375 - DNA, 20 bp, Artificial
  CRISPR gRNA sequence
ttatctgtatcacataactt

SEQ ID NO: 611376 - DNA, 20 bp, Artificial
  CRISPR gRNA sequence
atctgtatcacataactttg

SEQ ID NO: 611377 - DNA, 20 bp, Artificial
  CRISPR gRNA sequence
gtatcacataactttggagt

SEQ ID NO: 611378 - DNA, 20 bp, Artificial
  CRISPR gRNA sequence
atcacataactttggagtaa

SEQ ID NO: 611379 - DNA, 20 bp, Artificial
  CRISPR gRNA sequence
cacataactttggagtaaga

SEQ ID NO: 611380 - DNA, 20 bp, Artificial
  CRISPR gRNA sequence
ctttggagtaagagagattt

SEQ ID NO: 611381 - DNA, 20 bp, Artificial
  CRISPR gRNA sequence
tttggagtaagagagatttg

SEQ ID NO: 611382 - DNA, 20 bp, Artificial
  CRISPR gRNA sequence
tgaggaaccttacaatgtca

SEQ ID NO: 611383 - DNA, 20 bp, Artificial
  CRISPR gRNA sequence
atgtcaaagttcttttgact

SEQ ID NO: 611384 - DNA, 20 bp, Artificial
  CRISPR gRNA sequence
tgtcaaagttcttttgactt

SEQ ID NO: 611385 - DNA, 20 bp, Artificial
  CRISPR gRNA sequence
gtcaaagttcttttgactta

SEQ ID NO: 611386 - DNA, 20 bp, Artificial
  CRISPR gRNA sequence
tatcttacttccaaacactt

SEQ ID NO: 611387 - DNA, 20 bp, Artificial
  CRISPR gRNA sequence
atcttacttccaaacacttt

SEQ ID NO: 611388 - DNA, 20 bp, Artificial
  CRISPR gRNA sequence
acactactttgtgacctact

SEQ ID NO: 611389 - DNA, 20 bp, Artificial
  CRISPR gRNA sequence
actcagtgtttgacaatttt

SEQ ID NO: 611390 - DNA, 20 bp, Artificial
  CRISPR gRNA sequence
ttgacaattttcagcttatg

SEQ ID NO: 611391 - DNA, 20 bp, Artificial
  CRISPR gRNA sequence
tgttgtttatgtctaattgt

SEQ ID NO: 611392 - DNA, 20 bp, Artificial
  CRISPR gRNA sequence
tatgtctaattgtcagttta

SEQ ID NO: 611393 - DNA, 20 bp, Artificial
  CRISPR gRNA sequence
aagctattctgttccataaa

SEQ ID NO: 611394 - DNA, 20 bp, Artificial
  CRISPR gRNA sequence
agctattctgttccataaaa

SEQ ID NO: 611395 - DNA, 20 bp, Artificial
  CRISPR gRNA sequence
tctgttccataaaaaggaac

SEQ ID NO: 611396 - DNA, 20 bp, Artificial
  CRISPR gRNA sequence
tccataaaaaggaactggac

SEQ ID NO: 611397 - DNA, 20 bp, Artificial
  CRISPR gRNA sequence
tcccaactaaaaaacatttt

SEQ ID NO: 611398 - DNA, 20 bp, Artificial
  CRISPR gRNA sequence
ttttagtatatatatatata

SEQ ID NO: 611399 - DNA, 20 bp, Artificial
  CRISPR gRNA sequence
atggactatctttatttttc

SEQ ID NO: 611400 - DNA, 20 bp, Artificial
  CRISPR gRNA sequence
ctttatttttcaagtcccta

SEQ ID NO: 611401 - DNA, 20 bp, Artificial
  CRISPR gRNA sequence
tttcaagtccctatagttcc

SEQ ID NO: 611402 - DNA, 20 bp, Artificial
  CRISPR gRNA sequence
ttcaagtccctatagttcca

SEQ ID NO: 611403 - DNA, 20 bp, Artificial
  CRISPR gRNA sequence
ctatattttatccacaaaaa

SEQ ID NO: 611404 - DNA, 20 bp, Artificial
  CRISPR gRNA sequence
ttttatccacaaaaatagct

SEQ ID NO: 611405 - DNA, 20 bp, Artificial
  CRISPR gRNA sequence
gaaatattgaatgcttatac

SEQ ID NO: 611406 - DNA, 20 bp, Artificial
  CRISPR gRNA sequence
ttttaaaaatcccaattaaa

SEQ ID NO: 611407 - DNA, 20 bp, Artificial
  CRISPR gRNA sequence
aaaatcccaattaaatagcc

SEQ ID NO: 611408 - DNA, 20 bp, Artificial
  CRISPR gRNA sequence
agcctagtttatattttgtt

SEQ ID NO: 611409 - DNA, 20 bp, Artificial
  CRISPR gRNA sequence
gttatgccttcacctattat

SEQ ID NO: 611410 - DNA, 20 bp, Artificial
  CRISPR gRNA sequence
attatgagaaaattcctgta

SEQ ID NO: 611411 - DNA, 20 bp, Artificial
  CRISPR gRNA sequence
atttccacatttatctttaa

SEQ ID NO: 611412 - DNA, 20 bp, Artificial
  CRISPR gRNA sequence
tcaaactaacatgcattttt

SEQ ID NO: 611413 - DNA, 20 bp, Artificial
  CRISPR gRNA sequence
caaactaacatgcattttta

SEQ ID NO: 611414 - DNA, 20 bp, Artificial
  CRISPR gRNA sequence
aggtatatgctacatgccct

SEQ ID NO: 611415 - DNA, 20 bp, Artificial
  CRISPR gRNA sequence
gtatatgctacatgccctca

SEQ ID NO: 611416 - DNA, 20 bp, Artificial
  CRISPR gRNA sequence
ctacatgccctcagagaaac

SEQ ID NO: 611417 - DNA, 20 bp, Artificial
  CRISPR gRNA sequence
atgccctcagagaaactggt

SEQ ID NO: 611418 - DNA, 20 bp, Artificial
  CRISPR gRNA sequence
ctcagagaaactggtaagac

SEQ ID NO: 611419 - DNA, 20 bp, Artificial
  CRISPR gRNA sequence
gagaaactggtaagacaaga

SEQ ID NO: 611420 - DNA, 20 bp, Artificial
  CRISPR gRNA sequence
aaaaaaaaaaaattaccatg

SEQ ID NO: 611421 - DNA, 20 bp, Artificial
  CRISPR gRNA sequence
aaaaaaattaccatgtggct

SEQ ID NO: 611422 - DNA, 20 bp, Artificial
  CRISPR gRNA sequence
attaccatgtggcttggatc

SEQ ID NO: 611423 - DNA, 20 bp, Artificial
  CRISPR gRNA sequence
ccatgtggcttggatcaaga

SEQ ID NO: 611424 - DNA, 20 bp, Artificial
  CRISPR gRNA sequence
atgtggcttggatcaagatg

SEQ ID NO: 611425 - DNA, 20 bp, Artificial
  CRISPR gRNA sequence
atctttgaccatattgttta

SEQ ID NO: 611426 - DNA, 20 bp, Artificial
  CRISPR gRNA sequence
ttaaagaaacaacataatgt

SEQ ID NO: 611427 - DNA, 20 bp, Artificial
  CRISPR gRNA sequence
caacataatgttagttgctc

SEQ ID NO: 611428 - DNA, 20 bp, Artificial
  CRISPR gRNA sequence
tgctctagttttaaatctca

SEQ ID NO: 611429 - DNA, 20 bp, Artificial
  CRISPR gRNA sequence
agttttaaatctcatagaaa

SEQ ID NO: 611430 - DNA, 20 bp, Artificial
  CRISPR gRNA sequence
atagtctcttaatttgtcat

SEQ ID NO: 611431 - DNA, 20 bp, Artificial
  CRISPR gRNA sequence
agtctcttaatttgtcatga

SEQ ID NO: 611432 - DNA, 20 bp, Artificial
  CRISPR gRNA sequence
ctcttaatttgtcatgagag

SEQ ID NO: 611433 - DNA, 20 bp, Artificial
  CRISPR gRNA sequence
acgcattgttgtctcttact

SEQ ID NO: 611434 - DNA, 20 bp, Artificial
  CRISPR gRNA sequence
cgcattgttgtctcttacta

SEQ ID NO: 611435 - DNA, 20 bp, Artificial
  CRISPR gRNA sequence
tctttaaattgacaactgat

SEQ ID NO: 611436 - DNA, 20 bp, Artificial
  CRISPR gRNA sequence
caactgatcagtgatttcat

SEQ ID NO: 611437 - DNA, 20 bp, Artificial
  CRISPR gRNA sequence
atcagtgatttcataagcta

SEQ ID NO: 611438 - DNA, 20 bp, Artificial
  CRISPR gRNA sequence
aagtattttctaatgtactg

SEQ ID NO: 611439 - DNA, 20 bp, Artificial
  CRISPR gRNA sequence
tactctcttttataatacac

SEQ ID NO: 611440 - DNA, 20 bp, Artificial
  CRISPR gRNA sequence
ttatcttcccttcttctttt

SEQ ID NO: 611441 - DNA, 20 bp, Artificial
  CRISPR gRNA sequence
ccttcttcttttgagtgttg

SEQ ID NO: 611442 - DNA, 20 bp, Artificial
  CRISPR gRNA sequence
tttttttttgtaatgacttc

SEQ ID NO: 611443 - DNA, 20 bp, Artificial
  CRISPR gRNA sequence
tgtaatgacttccagaaaaa

SEQ ID NO: 611444 - DNA, 20 bp, Artificial
  CRISPR gRNA sequence
aagtacataaataacttctt

SEQ ID NO: 611445 - DNA, 20 bp, Artificial
  CRISPR gRNA sequence
tcatgcaaaatgttttgtat

SEQ ID NO: 611446 - DNA, 20 bp, Artificial
  CRISPR gRNA sequence
gcaaaatgttttgtataaga

SEQ ID NO: 611447 - DNA, 20 bp, Artificial
  CRISPR gRNA sequence
caaaatgttttgtataagat

SEQ ID NO: 611448 - DNA, 20 bp, Artificial
  CRISPR gRNA sequence
atgttttgtataagatggga

SEQ ID NO: 611449 - DNA, 20 bp, Artificial
  CRISPR gRNA sequence
gtataagatgggatagctgc

SEQ ID NO: 611450 - DNA, 20 bp, Artificial
  CRISPR gRNA sequence
agctgcaagttatacacctt

SEQ ID NO: 611451 - DNA, 20 bp, Artificial
  CRISPR gRNA sequence
tatacacctttggatattaa

SEQ ID NO: 611452 - DNA, 20 bp, Artificial
  CRISPR gRNA sequence
acacctttggatattaatag

SEQ ID NO: 611453 - DNA, 20 bp, Artificial
  CRISPR gRNA sequence
ttggatattaatagtagtga

SEQ ID NO: 611454 - DNA, 20 bp, Artificial
  CRISPR gRNA sequence
taatagtagtgatagttttg

SEQ ID NO: 611455 - DNA, 20 bp, Artificial
  CRISPR gRNA sequence
gatagttttgtggaatgatt

SEQ ID NO: 611456 - DNA, 20 bp, Artificial
  CRISPR gRNA sequence
atagttttgtggaatgattg

SEQ ID NO: 611457 - DNA, 20 bp, Artificial
  CRISPR gRNA sequence
ggacaaaaatttctgaaaat

SEQ ID NO: 611458 - DNA, 20 bp, Artificial
  CRISPR gRNA sequence
gacaaaaatttctgaaaatt

SEQ ID NO: 611459 - DNA, 20 bp, Artificial
  CRISPR gRNA sequence
atttctgaaaattaggtact

SEQ ID NO: 611460 - DNA, 20 bp, Artificial
  CRISPR gRNA sequence
ctgaaaattaggtacttggc

SEQ ID NO: 611461 - DNA, 20 bp, Artificial
  CRISPR gRNA sequence
aaaattaggtacttggccag

SEQ ID NO: 611462 - DNA, 20 bp, Artificial
  CRISPR gRNA sequence
ggccagaagattatgataat

SEQ ID NO: 611463 - DNA, 20 bp, Artificial
  CRISPR gRNA sequence
tatttacattattttaaaac

SEQ ID NO: 611464 - DNA, 20 bp, Artificial
  CRISPR gRNA sequence
acattattttaaaaccagac

SEQ ID NO: 611465 - DNA, 20 bp, Artificial
  CRISPR gRNA sequence
tattttaaaaccagaccagc

SEQ ID NO: 611466 - DNA, 20 bp, Artificial
  CRISPR gRNA sequence
aaaaccagaccagctggaca

SEQ ID NO: 611467 - DNA, 20 bp, Artificial
  CRISPR gRNA sequence
accagaccagctggacacgg

SEQ ID NO: 611468 - DNA, 20 bp, Artificial
  CRISPR gRNA sequence
gacacggtggctcacgcctg

SEQ ID NO: 611469 - DNA, 20 bp, Artificial
  CRISPR gRNA sequence
gtggctcacgcctgtagtct

SEQ ID NO: 611470 - DNA, 20 bp, Artificial
  CRISPR gRNA sequence
cgcctgtagtctcagcactt

SEQ ID NO: 611471 - DNA, 20 bp, Artificial
  CRISPR gRNA sequence
gcctgtagtctcagcacttt

SEQ ID NO: 611472 - DNA, 20 bp, Artificial
  CRISPR gRNA sequence
ctgtagtctcagcactttgg

SEQ ID NO: 611473 - DNA, 20 bp, Artificial
  CRISPR gRNA sequence
tgtagtctcagcactttggg

SEQ ID NO: 611474 - DNA, 20 bp, Artificial
  CRISPR gRNA sequence
tctcagcactttgggaggcc

SEQ ID NO: 611475 - DNA, 20 bp, Artificial
  CRISPR gRNA sequence
agcactttgggaggccgaga

SEQ ID NO: 611476 - DNA, 20 bp, Artificial
  CRISPR gRNA sequence
gcactttgggaggccgagac

SEQ ID NO: 611477 - DNA, 20 bp, Artificial
  CRISPR gRNA sequence
ctttgggaggccgagacggg

SEQ ID NO: 611478 - DNA, 20 bp, Artificial
  CRISPR gRNA sequence
ggccgagacgggcagatcac

SEQ ID NO: 611479 - DNA, 20 bp, Artificial
  CRISPR gRNA sequence
gccgagacgggcagatcacg

SEQ ID NO: 611480 - DNA, 20 bp, Artificial
  CRISPR gRNA sequence
agacgggcagatcacgaggc

SEQ ID NO: 611481 - DNA, 20 bp, Artificial
  CRISPR gRNA sequence
gacgggcagatcacgaggcc

SEQ ID NO: 611482 - DNA, 20 bp, Artificial
  CRISPR gRNA sequence
cgggcagatcacgaggccag

SEQ ID NO: 611483 - DNA, 20 bp, Artificial
  CRISPR gRNA sequence
gatcacgaggccaggagatc

SEQ ID NO: 611484 - DNA, 20 bp, Artificial
  CRISPR gRNA sequence
ccaggagatcgagaccatcc

SEQ ID NO: 611485 - DNA, 20 bp, Artificial
  CRISPR gRNA sequence
cgagaccatcctggctaaca

SEQ ID NO: 611486 - DNA, 20 bp, Artificial
  CRISPR gRNA sequence
tactcaaaatacaaaaaaat

SEQ ID NO: 611487 - DNA, 20 bp, Artificial
  CRISPR gRNA sequence
caaaatacaaaaaaattagc

SEQ ID NO: 611488 - DNA, 20 bp, Artificial
  CRISPR gRNA sequence
aaaatacaaaaaaattagct

SEQ ID NO: 611489 - DNA, 20 bp, Artificial
  CRISPR gRNA sequence
acaaaaaaattagctgggcg

SEQ ID NO: 611490 - DNA, 20 bp, Artificial
  CRISPR gRNA sequence
aaaaaattagctgggcgtgg

SEQ ID NO: 611491 - DNA, 20 bp, Artificial
  CRISPR gRNA sequence
aaattagctgggcgtggtgg

SEQ ID NO: 611492 - DNA, 20 bp, Artificial
  CRISPR gRNA sequence
aattagctgggcgtggtggc

SEQ ID NO: 611493 - DNA, 20 bp, Artificial
  CRISPR gRNA sequence
ggcgtggtggcaggcccctg

SEQ ID NO: 611494 - DNA, 20 bp, Artificial
  CRISPR gRNA sequence
gtggcaggcccctgtagttc

SEQ ID NO: 611495 - DNA, 20 bp, Artificial
  CRISPR gRNA sequence
ggcccctgtagttccagcta

SEQ ID NO: 611496 - DNA, 20 bp, Artificial
  CRISPR gRNA sequence
gcccctgtagttccagctac

SEQ ID NO: 611497 - DNA, 20 bp, Artificial
  CRISPR gRNA sequence
ccctgtagttccagctacgg

SEQ ID NO: 611498 - DNA, 20 bp, Artificial
  CRISPR gRNA sequence
cctgtagttccagctacggg

SEQ ID NO: 611499 - DNA, 20 bp, Artificial
  CRISPR gRNA sequence
agttccagctacgggaggct

SEQ ID NO: 611500 - DNA, 20 bp, Artificial
  CRISPR gRNA sequence
gttccagctacgggaggctg

SEQ ID NO: 611501 - DNA, 20 bp, Artificial
  CRISPR gRNA sequence
ccagctacgggaggctgagg

SEQ ID NO: 611502 - DNA, 20 bp, Artificial
  CRISPR gRNA sequence
cagctacgggaggctgaggc

SEQ ID NO: 611503 - DNA, 20 bp, Artificial
  CRISPR gRNA sequence
gctacgggaggctgaggcag

SEQ ID NO: 611504 - DNA, 20 bp, Artificial
  CRISPR gRNA sequence
gggaggctgaggcaggagaa

SEQ ID NO: 611505 - DNA, 20 bp, Artificial
  CRISPR gRNA sequence
gcaggagaacggcgtgcatc

SEQ ID NO: 611506 - DNA, 20 bp, Artificial
  CRISPR gRNA sequence
caggagaacggcgtgcatct

SEQ ID NO: 611507 - DNA, 20 bp, Artificial
  CRISPR gRNA sequence
ggagaacggcgtgcatctgg

SEQ ID NO: 611508 - DNA, 20 bp, Artificial
  CRISPR gRNA sequence
gagaacggcgtgcatctggg

SEQ ID NO: 611509 - DNA, 20 bp, Artificial
  CRISPR gRNA sequence
aacggcgtgcatctgggagg

SEQ ID NO: 611510 - DNA, 20 bp, Artificial
  CRISPR gRNA sequence
cggcgtgcatctgggaggcg

SEQ ID NO: 611511 - DNA, 20 bp, Artificial
  CRISPR gRNA sequence
catctgggaggcggagcttg

SEQ ID NO: 611512 - DNA, 20 bp, Artificial
  CRISPR gRNA sequence
gaggcggagcttgtagtgaa

SEQ ID NO: 611513 - DNA, 20 bp, Artificial
  CRISPR gRNA sequence
ggcggagcttgtagtgaaca

SEQ ID NO: 611514 - DNA, 20 bp, Artificial
  CRISPR gRNA sequence
gagatcctgccactgcactc

SEQ ID NO: 611515 - DNA, 20 bp, Artificial
  CRISPR gRNA sequence
cctgccactgcactccagcc

SEQ ID NO: 611516 - DNA, 20 bp, Artificial
  CRISPR gRNA sequence
ctgccactgcactccagcct

SEQ ID NO: 611517 - DNA, 20 bp, Artificial
  CRISPR gRNA sequence
ctgcactccagcctgggtga

SEQ ID NO: 611518 - DNA, 20 bp, Artificial
  CRISPR gRNA sequence
gcactccagcctgggtgaca

SEQ ID NO: 611519 - DNA, 20 bp, Artificial
  CRISPR gRNA sequence
tccagcctgggtgacagagt

SEQ ID NO: 611520 - DNA, 20 bp, Artificial
  CRISPR gRNA sequence
agtgagactctgtctcaaaa

SEQ ID NO: 611521 - DNA, 20 bp, Artificial
  CRISPR gRNA sequence
gactctgtctcaaaaaagaa

SEQ ID NO: 611522 - DNA, 20 bp, Artificial
  CRISPR gRNA sequence
tgtctcaaaaaagaaaagaa

SEQ ID NO: 611523 - DNA, 20 bp, Artificial
  CRISPR gRNA sequence
caaaaaagaaaagaaaagaa

SEQ ID NO: 611524 - DNA, 20 bp, Artificial
  CRISPR gRNA sequence
gaaaagaaaacaaaacaaaa

SEQ ID NO: 611525 - DNA, 20 bp, Artificial
  CRISPR gRNA sequence
atgacttttttttttttttt

SEQ ID NO: 611526 - DNA, 20 bp, Artificial
  CRISPR gRNA sequence
tgacttttttttttttttta

SEQ ID NO: 611527 - DNA, 20 bp, Artificial
  CRISPR gRNA sequence
tttttttttttttttaagga

SEQ ID NO: 611528 - DNA, 20 bp, Artificial
  CRISPR gRNA sequence
aacattgaattaaattatgc

SEQ ID NO: 611529 - DNA, 20 bp, Artificial
  CRISPR gRNA sequence
tgaattaaattatgctggtt

SEQ ID NO: 611530 - DNA, 20 bp, Artificial
  CRISPR gRNA sequence
gctggtttagaaattgaatc

SEQ ID NO: 611531 - DNA, 20 bp, Artificial
  CRISPR gRNA sequence
tttagaaattgaatccagtg

SEQ ID NO: 611532 - DNA, 20 bp, Artificial
  CRISPR gRNA sequence
ccagtgcagctcattcataa

SEQ ID NO: 611533 - DNA, 20 bp, Artificial
  CRISPR gRNA sequence
cagctcattcataatagtga

SEQ ID NO: 611534 - DNA, 20 bp, Artificial
  CRISPR gRNA sequence
tagtgatggtgcattaaatg

SEQ ID NO: 611535 - DNA, 20 bp, Artificial
  CRISPR gRNA sequence
atgtagtataatttgtcttg

SEQ ID NO: 611536 - DNA, 20 bp, Artificial
  CRISPR gRNA sequence
tgtagtataatttgtcttgc

SEQ ID NO: 611537 - DNA, 20 bp, Artificial
  CRISPR gRNA sequence
ttgtcttgcaggcttctcat

SEQ ID NO: 611538 - DNA, 20 bp, Artificial
  CRISPR gRNA sequence
tcttgcaggcttctcatgag

SEQ ID NO: 611539 - DNA, 20 bp, Artificial
  CRISPR gRNA sequence
cttgcaggcttctcatgaga

SEQ ID NO: 611540 - DNA, 20 bp, Artificial
  CRISPR gRNA sequence
gaactattttaaactgattg

SEQ ID NO: 611541 - DNA, 20 bp, Artificial
  CRISPR gRNA sequence
ttttaaactgattgtagacc

SEQ ID NO: 611542 - DNA, 20 bp, Artificial
  CRISPR gRNA sequence
ctgattgtagacctggcacc

SEQ ID NO: 611543 - DNA, 20 bp, Artificial
  CRISPR gRNA sequence
ctggcacctggcccactttc

SEQ ID NO: 611544 - DNA, 20 bp, Artificial
  CRISPR gRNA sequence
tggcacctggcccactttct

SEQ ID NO: 611545 - DNA, 20 bp, Artificial
  CRISPR gRNA sequence
cactttctgggtgatctccc

SEQ ID NO: 611546 - DNA, 20 bp, Artificial
  CRISPR gRNA sequence
gtgtgaactttccctaccct

SEQ ID NO: 611547 - DNA, 20 bp, Artificial
  CRISPR gRNA sequence
ttagcccctcctttccttcc

SEQ ID NO: 611548 - DNA, 20 bp, Artificial
  CRISPR gRNA sequence
agcccctcctttccttcctg

SEQ ID NO: 611549 - DNA, 20 bp, Artificial
  CRISPR gRNA sequence
gcccctcctttccttcctgg

SEQ ID NO: 611550 - DNA, 20 bp, Artificial
  CRISPR gRNA sequence
cctcctttccttcctggagg

SEQ ID NO: 611551 - DNA, 20 bp, Artificial
  CRISPR gRNA sequence
tccttcctggaggtggctga

SEQ ID NO: 611552 - DNA, 20 bp, Artificial
  CRISPR gRNA sequence
cttcctggaggtggctgata

SEQ ID NO: 611553 - DNA, 20 bp, Artificial
  CRISPR gRNA sequence
ttcctggaggtggctgatag

SEQ ID NO: 611554 - DNA, 20 bp, Artificial
  CRISPR gRNA sequence
ctggaggtggctgatagagg

SEQ ID NO: 611555 - DNA, 20 bp, Artificial
  CRISPR gRNA sequence
gattatactgataattacac

SEQ ID NO: 611556 - DNA, 20 bp, Artificial
  CRISPR gRNA sequence
tatactgataattacacaag

SEQ ID NO: 611557 - DNA, 20 bp, Artificial
  CRISPR gRNA sequence
gataattacacaagcagtgt

SEQ ID NO: 611558 - DNA, 20 bp, Artificial
  CRISPR gRNA sequence
aattctgatactgatgcctt

SEQ ID NO: 611559 - DNA, 20 bp, Artificial
  CRISPR gRNA sequence
atgctttgcaataaacactg

SEQ ID NO: 611560 - DNA, 20 bp, Artificial
  CRISPR gRNA sequence
tttgcaataaacactgaaga

SEQ ID NO: 611561 - DNA, 20 bp, Artificial
  CRISPR gRNA sequence
ttgcaataaacactgaagaa

SEQ ID NO: 611562 - DNA, 20 bp, Artificial
  CRISPR gRNA sequence
gcaataaacactgaagaaag

SEQ ID NO: 611563 - DNA, 20 bp, Artificial
  CRISPR gRNA sequence
taaacactgaagaaaggaga

SEQ ID NO: 611564 - DNA, 20 bp, Artificial
  CRISPR gRNA sequence
aaacactgaagaaaggagat

SEQ ID NO: 611565 - DNA, 20 bp, Artificial
  CRISPR gRNA sequence
gactcttaaaacacacactt

SEQ ID NO: 611566 - DNA, 20 bp, Artificial
  CRISPR gRNA sequence
actcttaaaacacacacttg

SEQ ID NO: 611567 - DNA, 20 bp, Artificial
  CRISPR gRNA sequence
cctactcattgaaatttacc

SEQ ID NO: 611568 - DNA, 20 bp, Artificial
  CRISPR gRNA sequence
actcattgaaatttacctag

SEQ ID NO: 611569 - DNA, 20 bp, Artificial
  CRISPR gRNA sequence
ctcattgaaatttacctaga

SEQ ID NO: 611570 - DNA, 20 bp, Artificial
  CRISPR gRNA sequence
gaaatttacctagaaggtaa

SEQ ID NO: 611571 - DNA, 20 bp, Artificial
  CRISPR gRNA sequence
tagaaggtaaaagccacttt

SEQ ID NO: 611572 - DNA, 20 bp, Artificial
  CRISPR gRNA sequence
aggtaaaagccactttcagt

SEQ ID NO: 611573 - DNA, 20 bp, Artificial
  CRISPR gRNA sequence
ggtaaaagccactttcagtc

SEQ ID NO: 611574 - DNA, 20 bp, Artificial
  CRISPR gRNA sequence
aaagccactttcagtcaggc

SEQ ID NO: 611575 - DNA, 20 bp, Artificial
  CRISPR gRNA sequence
ctttcagtcaggccggctgt

SEQ ID NO: 611576 - DNA, 20 bp, Artificial
  CRISPR gRNA sequence
cagtcaggccggctgtaaga

SEQ ID NO: 611577 - DNA, 20 bp, Artificial
  CRISPR gRNA sequence
acagcccatttgatttccac

SEQ ID NO: 611578 - DNA, 20 bp, Artificial
  CRISPR gRNA sequence
cagcccatttgatttccacc

SEQ ID NO: 611579 - DNA, 20 bp, Artificial
  CRISPR gRNA sequence
cccatttgatttccaccagg

SEQ ID NO: 611580 - DNA, 20 bp, Artificial
  CRISPR gRNA sequence
acgcctctttccccctaccc

SEQ ID NO: 611581 - DNA, 20 bp, Artificial
  CRISPR gRNA sequence
ttcgttattgtttctaataa

SEQ ID NO: 611582 - DNA, 20 bp, Artificial
  CRISPR gRNA sequence
ttattgtttctaataaaaga

SEQ ID NO: 611583 - DNA, 20 bp, Artificial
  CRISPR gRNA sequence
aaagaaagtaaaacttttaa

SEQ ID NO: 611584 - DNA, 20 bp, Artificial
  CRISPR gRNA sequence
atcacatcttttatgaattg

SEQ ID NO: 611585 - DNA, 20 bp, Artificial
  CRISPR gRNA sequence
acatcttttatgaattgtag

SEQ ID NO: 611586 - DNA, 20 bp, Artificial
  CRISPR gRNA sequence
tgtagtagtcatgcttcttt

SEQ ID NO: 611587 - DNA, 20 bp, Artificial
  CRISPR gRNA sequence
cttctttcagaccctatttc

SEQ ID NO: 611588 - DNA, 20 bp, Artificial
  CRISPR gRNA sequence
ctttcagaccctatttctag

SEQ ID NO: 611589 - DNA, 20 bp, Artificial
  CRISPR gRNA sequence
tttcagaccctatttctaga

SEQ ID NO: 611590 - DNA, 20 bp, Artificial
  CRISPR gRNA sequence
tatttctagaaggaattaat

SEQ ID NO: 611591 - DNA, 20 bp, Artificial
  CRISPR gRNA sequence
ctttcttttataattctatg

SEQ ID NO: 611592 - DNA, 20 bp, Artificial
  CRISPR gRNA sequence
ctatgcagctcttttcactt

SEQ ID NO: 611593 - DNA, 20 bp, Artificial
  CRISPR gRNA sequence
agctcttttcactttggtgc

SEQ ID NO: 611594 - DNA, 20 bp, Artificial
  CRISPR gRNA sequence
tcactttggtgcaagtcatt

SEQ ID NO: 611595 - DNA, 20 bp, Artificial
  CRISPR gRNA sequence
ctttggtgcaagtcatttag

SEQ ID NO: 611596 - DNA, 20 bp, Artificial
  CRISPR gRNA sequence
tttagaagatcaatttattg

SEQ ID NO: 611597 - DNA, 20 bp, Artificial
  CRISPR gRNA sequence
ttagaagatcaatttattgt

SEQ ID NO: 611598 - DNA, 20 bp, Artificial
  CRISPR gRNA sequence
gaagatcaatttattgtagg

SEQ ID NO: 611599 - DNA, 20 bp, Artificial
  CRISPR gRNA sequence
tttccttcctcctttattat

SEQ ID NO: 611600 - DNA, 20 bp, Artificial
  CRISPR gRNA sequence
ttccttcctcctttattatc

SEQ ID NO: 611601 - DNA, 20 bp, Artificial
  CRISPR gRNA sequence
ccttcctcctttattatcag

SEQ ID NO: 611602 - DNA, 20 bp, Artificial
  CRISPR gRNA sequence
ctttattatcaggagttcta

SEQ ID NO: 611603 - DNA, 20 bp, Artificial
  CRISPR gRNA sequence
tatcaggagttctaaagaaa

SEQ ID NO: 611604 - DNA, 20 bp, Artificial
  CRISPR gRNA sequence
ggagttctaaagaaatggac

SEQ ID NO: 611605 - DNA, 20 bp, Artificial
  CRISPR gRNA sequence
aaagaaatggacaagattct

SEQ ID NO: 611606 - DNA, 20 bp, Artificial
  CRISPR gRNA sequence
tctacactgtcctcattcca

SEQ ID NO: 611607 - DNA, 20 bp, Artificial
  CRISPR gRNA sequence
cattccaaagcttgctacca

SEQ ID NO: 611608 - DNA, 20 bp, Artificial
  CRISPR gRNA sequence
ccacagttttgtaccctgca

SEQ ID NO: 611609 - DNA, 20 bp, Artificial
  CRISPR gRNA sequence
ttttgtaccctgcatggatt

SEQ ID NO: 611610 - DNA, 20 bp, Artificial
  CRISPR gRNA sequence
taccctgcatggatttagtg

SEQ ID NO: 611611 - DNA, 20 bp, Artificial
  CRISPR gRNA sequence
ctgcatggatttagtgtgga

SEQ ID NO: 611612 - DNA, 20 bp, Artificial
  CRISPR gRNA sequence
agtgtggacagtcttaactt

SEQ ID NO: 611613 - DNA, 20 bp, Artificial
  CRISPR gRNA sequence
cattttcccttccacaccat

SEQ ID NO: 611614 - DNA, 20 bp, Artificial
  CRISPR gRNA sequence
ccttccacaccatgagtctg

SEQ ID NO: 611615 - DNA, 20 bp, Artificial
  CRISPR gRNA sequence
cttccacaccatgagtctgc

SEQ ID NO: 611616 - DNA, 20 bp, Artificial
  CRISPR gRNA sequence
acaccatgagtctgcaggcc

SEQ ID NO: 611617 - DNA, 20 bp, Artificial
  CRISPR gRNA sequence
gtctgcaggcctggcatgtt

SEQ ID NO: 611618 - DNA, 20 bp, Artificial
  CRISPR gRNA sequence
gcatgtttggaactccacaa

SEQ ID NO: 611619 - DNA, 20 bp, Artificial
  CRISPR gRNA sequence
tgtttggaactccacaacag

SEQ ID NO: 611620 - DNA, 20 bp, Artificial
  CRISPR gRNA sequence
ttggaactccacaacagaag

SEQ ID NO: 611621 - DNA, 20 bp, Artificial
  CRISPR gRNA sequence
ggaactccacaacagaagtg

SEQ ID NO: 611622 - DNA, 20 bp, Artificial
  CRISPR gRNA sequence
aactccacaacagaagtgga

SEQ ID NO: 611623 - DNA, 20 bp, Artificial
  CRISPR gRNA sequence
actccacaacagaagtggag

SEQ ID NO: 611624 - DNA, 20 bp, Artificial
  CRISPR gRNA sequence
cgcaaactttattactcacc

SEQ ID NO: 611625 - DNA, 20 bp, Artificial
  CRISPR gRNA sequence
tttattactcacctagtatc

SEQ ID NO: 611626 - DNA, 20 bp, Artificial
  CRISPR gRNA sequence
attactcacctagtatccag

SEQ ID NO: 611627 - DNA, 20 bp, Artificial
  CRISPR gRNA sequence
ttactcacctagtatccaga

SEQ ID NO: 611628 - DNA, 20 bp, Artificial
  CRISPR gRNA sequence
tactcacctagtatccagaa

SEQ ID NO: 611629 - DNA, 20 bp, Artificial
  CRISPR gRNA sequence
tccagaagggcatgacacac

SEQ ID NO: 611630 - DNA, 20 bp, Artificial
  CRISPR gRNA sequence
ccagaagggcatgacacact

SEQ ID NO: 611631 - DNA, 20 bp, Artificial
  CRISPR gRNA sequence
gacttgtgtgtgtgtgtgtg

SEQ ID NO: 611632 - DNA, 20 bp, Artificial
  CRISPR gRNA sequence
tgtgtgtggtgtgttttgtt

SEQ ID NO: 611633 - DNA, 20 bp, Artificial
  CRISPR gRNA sequence
cctacttgatctgtgtatgt

SEQ ID NO: 611634 - DNA, 20 bp, Artificial
  CRISPR gRNA sequence
tgatctgtgtatgtgagtca

SEQ ID NO: 611635 - DNA, 20 bp, Artificial
  CRISPR gRNA sequence
caaagaaacctgttcatcca

SEQ ID NO: 611636 - DNA, 20 bp, Artificial
  CRISPR gRNA sequence
actatcttgccaaatactgt

SEQ ID NO: 611637 - DNA, 20 bp, Artificial
  CRISPR gRNA sequence
actgtaagaaaactctcaaa

SEQ ID NO: 611638 - DNA, 20 bp, Artificial
  CRISPR gRNA sequence
gtaagaaaactctcaaatgg

SEQ ID NO: 611639 - DNA, 20 bp, Artificial
  CRISPR gRNA sequence
actctcaaatggtagaaaat

SEQ ID NO: 611640 - DNA, 20 bp, Artificial
  CRISPR gRNA sequence
tggtagaaaatcagacaaat

SEQ ID NO: 611641 - DNA, 20 bp, Artificial
  CRISPR gRNA sequence
agaaaatcagacaaataaga

SEQ ID NO: 611642 - DNA, 20 bp, Artificial
  CRISPR gRNA sequence
aaataagaaagataaaaacc

SEQ ID NO: 611643 - DNA, 20 bp, Artificial
  CRISPR gRNA sequence
aaccaagtatcattcatcat

SEQ ID NO: 611644 - DNA, 20 bp, Artificial
  CRISPR gRNA sequence
ataagcatgtaaaatatatt

SEQ ID NO: 611645 - DNA, 20 bp, Artificial
  CRISPR gRNA sequence
atatatttagaatataatta

SEQ ID NO: 611646 - DNA, 20 bp, Artificial
  CRISPR gRNA sequence
atataattaaagttttatgt

SEQ ID NO: 611647 - DNA, 20 bp, Artificial
  CRISPR gRNA sequence
tataattaaagttttatgta

SEQ ID NO: 611648 - DNA, 20 bp, Artificial
  CRISPR gRNA sequence
taaagttttatgtaaggtat

SEQ ID NO: 611649 - DNA, 20 bp, Artificial
  CRISPR gRNA sequence
gtaaggtatcagaaatctat

SEQ ID NO: 611650 - DNA, 20 bp, Artificial
  CRISPR gRNA sequence
aaggtatcagaaatctatca

SEQ ID NO: 611651 - DNA, 20 bp, Artificial
  CRISPR gRNA sequence
gtatcagaaatctatcagag

SEQ ID NO: 611652 - DNA, 20 bp, Artificial
  CRISPR gRNA sequence
atcagaaatctatcagagtg

SEQ ID NO: 611653 - DNA, 20 bp, Artificial
  CRISPR gRNA sequence
tggagtccttttaaattgta

SEQ ID NO: 611654 - DNA, 20 bp, Artificial
  CRISPR gRNA sequence
aatatgatgataatgattat

SEQ ID NO: 611655 - DNA, 20 bp, Artificial
  CRISPR gRNA sequence
tgataatgattataagcaac

SEQ ID NO: 611656 - DNA, 20 bp, Artificial
  CRISPR gRNA sequence
atgattataagcaactggat

SEQ ID NO: 611657 - DNA, 20 bp, Artificial
  CRISPR gRNA sequence
aagcaactggataagaataa

SEQ ID NO: 611658 - DNA, 20 bp, Artificial
  CRISPR gRNA sequence
agcaactggataagaataaa

SEQ ID NO: 611659 - DNA, 20 bp, Artificial
  CRISPR gRNA sequence
tggataagaataaaaggtcc

SEQ ID NO: 611660 - DNA, 20 bp, Artificial
  CRISPR gRNA sequence
agaataaaaggtcctagatc

SEQ ID NO: 611661 - DNA, 20 bp, Artificial
  CRISPR gRNA sequence
gtcctagatccagcatctca

SEQ ID NO: 611662 - DNA, 20 bp, Artificial
  CRISPR gRNA sequence
ctagatccagcatctcaaag

SEQ ID NO: 611663 - DNA, 20 bp, Artificial
  CRISPR gRNA sequence
agatccagcatctcaaagaa

SEQ ID NO: 611664 - DNA, 20 bp, Artificial
  CRISPR gRNA sequence
atattgattgaatgaattaa

SEQ ID NO: 611665 - DNA, 20 bp, Artificial
  CRISPR gRNA sequence
tgattgaatgaattaatgga

SEQ ID NO: 611666 - DNA, 20 bp, Artificial
  CRISPR gRNA sequence
ttgaatattcttatattaac

SEQ ID NO: 611667 - DNA, 20 bp, Artificial
  CRISPR gRNA sequence
atattcttatattaactaga

SEQ ID NO: 611668 - DNA, 20 bp, Artificial
  CRISPR gRNA sequence
tattcttatattaactagaa

SEQ ID NO: 611669 - DNA, 20 bp, Artificial
  CRISPR gRNA sequence
tattaactagaaaggtttta

SEQ ID NO: 611670 - DNA, 20 bp, Artificial
  CRISPR gRNA sequence
agaaaggttttaaagattca

SEQ ID NO: 611671 - DNA, 20 bp, Artificial
  CRISPR gRNA sequence
aaaggttttaaagattcatg

SEQ ID NO: 611672 - DNA, 20 bp, Artificial
  CRISPR gRNA sequence
aaggttttaaagattcatgg

SEQ ID NO: 611673 - DNA, 20 bp, Artificial
  CRISPR gRNA sequence
taaagattcatggaggtcaa

SEQ ID NO: 611674 - DNA, 20 bp, Artificial
  CRISPR gRNA sequence
agattcatggaggtcaatgg

SEQ ID NO: 611675 - DNA, 20 bp, Artificial
  CRISPR gRNA sequence
catggaggtcaatggtggtt

SEQ ID NO: 611676 - DNA, 20 bp, Artificial
  CRISPR gRNA sequence
tggtggttgagtatgtttcc

SEQ ID NO: 611677 - DNA, 20 bp, Artificial
  CRISPR gRNA sequence
tatgtttcctagtacatgat

SEQ ID NO: 611678 - DNA, 20 bp, Artificial
  CRISPR gRNA sequence
tcctagtacatgataagtat

SEQ ID NO: 611679 - DNA, 20 bp, Artificial
  CRISPR gRNA sequence
attacaaaaattaaaaatta

SEQ ID NO: 611680 - DNA, 20 bp, Artificial
  CRISPR gRNA sequence
ttacaaaaattaaaaattat

SEQ ID NO: 611681 - DNA, 20 bp, Artificial
  CRISPR gRNA sequence
aaattatgggtatatttaat

SEQ ID NO: 611682 - DNA, 20 bp, Artificial
  CRISPR gRNA sequence
ataagttcttattttgtgac

SEQ ID NO: 611683 - DNA, 20 bp, Artificial
  CRISPR gRNA sequence
tttgtgacaagcattatgtt

SEQ ID NO: 611684 - DNA, 20 bp, Artificial
  CRISPR gRNA sequence
ttgtgacaagcattatgtta

SEQ ID NO: 611685 - DNA, 20 bp, Artificial
  CRISPR gRNA sequence
tgtgacaagcattatgttaa

SEQ ID NO: 611686 - DNA, 20 bp, Artificial
  CRISPR gRNA sequence
atgttaagggccttattttg

SEQ ID NO: 611687 - DNA, 20 bp, Artificial
  CRISPR gRNA sequence
aagggccttattttgcagat

SEQ ID NO: 611688 - DNA, 20 bp, Artificial
  CRISPR gRNA sequence
ggccttattttgcagataag

SEQ ID NO: 611689 - DNA, 20 bp, Artificial
  CRISPR gRNA sequence
ccttattttgcagataagta

SEQ ID NO: 611690 - DNA, 20 bp, Artificial
  CRISPR gRNA sequence
ttttgcagataagtagagtc

SEQ ID NO: 611691 - DNA, 20 bp, Artificial
  CRISPR gRNA sequence
gataagtagagtcaagttta

SEQ ID NO: 611692 - DNA, 20 bp, Artificial
  CRISPR gRNA sequence
agtagagtcaagtttaaaga

SEQ ID NO: 611693 - DNA, 20 bp, Artificial
  CRISPR gRNA sequence
tagagtcaagtttaaagaaa

SEQ ID NO: 611694 - DNA, 20 bp, Artificial
  CRISPR gRNA sequence
tgttacctaatgtcctcacg

SEQ ID NO: 611695 - DNA, 20 bp, Artificial
  CRISPR gRNA sequence
atattacatgtatgcctcct

SEQ ID NO: 611696 - DNA, 20 bp, Artificial
  CRISPR gRNA sequence
gtatgcctcctcagcttata

SEQ ID NO: 611697 - DNA, 20 bp, Artificial
  CRISPR gRNA sequence
tatttttcttttattttcca

SEQ ID NO: 611698 - DNA, 20 bp, Artificial
  CRISPR gRNA sequence
ttcttttattttccatggtt

SEQ ID NO: 611699 - DNA, 20 bp, Artificial
  CRISPR gRNA sequence
gtttggcaacaatgtattat

SEQ ID NO: 611700 - DNA, 20 bp, Artificial
  CRISPR gRNA sequence
gcaacaatgtattattggat

SEQ ID NO: 611701 - DNA, 20 bp, Artificial
  CRISPR gRNA sequence
aacacacacatacacaccca

SEQ ID NO: 611702 - DNA, 20 bp, Artificial
  CRISPR gRNA sequence
cacccacagcacaataaaac

SEQ ID NO: 611703 - DNA, 20 bp, Artificial
  CRISPR gRNA sequence
tataaacaaaaatctatcat

SEQ ID NO: 611704 - DNA, 20 bp, Artificial
  CRISPR gRNA sequence
ataaacaaaaatctatcatg

SEQ ID NO: 611705 - DNA, 20 bp, Artificial
  CRISPR gRNA sequence
aaaatctatcatgaggcttg

SEQ ID NO: 611706 - DNA, 20 bp, Artificial
  CRISPR gRNA sequence
tcatgaggcttgaagacata

SEQ ID NO: 611707 - DNA, 20 bp, Artificial
  CRISPR gRNA sequence
tgaggcttgaagacatatag

SEQ ID NO: 611708 - DNA, 20 bp, Artificial
  CRISPR gRNA sequence
cttgaagacatatagcagct

SEQ ID NO: 611709 - DNA, 20 bp, Artificial
  CRISPR gRNA sequence
gaacaaaataaatctaacaa

SEQ ID NO: 611710 - DNA, 20 bp, Artificial
  CRISPR gRNA sequence
atagtataaattatatttgt

SEQ ID NO: 611711 - DNA, 20 bp, Artificial
  CRISPR gRNA sequence
agtataaattatatttgtga

SEQ ID NO: 611712 - DNA, 20 bp, Artificial
  CRISPR gRNA sequence
ttaaaaattatgatctgata

SEQ ID NO: 611713 - DNA, 20 bp, Artificial
  CRISPR gRNA sequence
aacttccaatatactcatga

SEQ ID NO: 611714 - DNA, 20 bp, Artificial
  CRISPR gRNA sequence
ccaatatactcatgaaagct

SEQ ID NO: 611715 - DNA, 20 bp, Artificial
  CRISPR gRNA sequence
actcatgaaagctgagatat

SEQ ID NO: 611716 - DNA, 20 bp, Artificial
  CRISPR gRNA sequence
gaaagctgagatataagctc

SEQ ID NO: 611717 - DNA, 20 bp, Artificial
  CRISPR gRNA sequence
agctctggtctgtctgaatc

SEQ ID NO: 611718 - DNA, 20 bp, Artificial
  CRISPR gRNA sequence
gctctggtctgtctgaatct

SEQ ID NO: 611719 - DNA, 20 bp, Artificial
  CRISPR gRNA sequence
ctctggtctgtctgaatcta

SEQ ID NO: 611720 - DNA, 20 bp, Artificial
  CRISPR gRNA sequence
gaatctagggtctctgctct

SEQ ID NO: 611721 - DNA, 20 bp, Artificial
  CRISPR gRNA sequence
ctgcttcccaatctattctc

SEQ ID NO: 611722 - DNA, 20 bp, Artificial
  CRISPR gRNA sequence
ttcccaatctattctccaga

SEQ ID NO: 611723 - DNA, 20 bp, Artificial
  CRISPR gRNA sequence
tctattctccagatagcaac

SEQ ID NO: 611724 - DNA, 20 bp, Artificial
  CRISPR gRNA sequence
ctcttcttaaaatattttaa

SEQ ID NO: 611725 - DNA, 20 bp, Artificial
  CRISPR gRNA sequence
taaaatcaaactactaatca

SEQ ID NO: 611726 - DNA, 20 bp, Artificial
  CRISPR gRNA sequence
aaactactaatcatggccat

SEQ ID NO: 611727 - DNA, 20 bp, Artificial
  CRISPR gRNA sequence
ctactaatcatggccattgg

SEQ ID NO: 611728 - DNA, 20 bp, Artificial
  CRISPR gRNA sequence
tactactttacgcctcactc

SEQ ID NO: 611729 - DNA, 20 bp, Artificial
  CRISPR gRNA sequence
actactttacgcctcactct

SEQ ID NO: 611730 - DNA, 20 bp, Artificial
  CRISPR gRNA sequence
ctctgggttctttgcaaccc

SEQ ID NO: 611731 - DNA, 20 bp, Artificial
  CRISPR gRNA sequence
tctgggttctttgcaacccg

SEQ ID NO: 611732 - DNA, 20 bp, Artificial
  CRISPR gRNA sequence
tcctactgtttttgaactaa

SEQ ID NO: 611733 - DNA, 20 bp, Artificial
  CRISPR gRNA sequence
tttgaactaatggatgatcc

SEQ ID NO: 611734 - DNA, 20 bp, Artificial
  CRISPR gRNA sequence
gaactaatggatgatcctag

SEQ ID NO: 611735 - DNA, 20 bp, Artificial
  CRISPR gRNA sequence
atcctagaagtcaacacctt

SEQ ID NO: 611736 - DNA, 20 bp, Artificial
  CRISPR gRNA sequence
aacaccttcagcgttttccc

SEQ ID NO: 611737 - DNA, 20 bp, Artificial
  CRISPR gRNA sequence
tcagcgttttcccaagatct

SEQ ID NO: 611738 - DNA, 20 bp, Artificial
  CRISPR gRNA sequence
gttttcccaagatcttggca

SEQ ID NO: 611739 - DNA, 20 bp, Artificial
  CRISPR gRNA sequence
atagttgccttattatcttt

SEQ ID NO: 611740 - DNA, 20 bp, Artificial
  CRISPR gRNA sequence
ccttattatctttcagatgt

SEQ ID NO: 611741 - DNA, 20 bp, Artificial
  CRISPR gRNA sequence
aaatgtcatctctttgaaaa

SEQ ID NO: 611742 - DNA, 20 bp, Artificial
  CRISPR gRNA sequence
tgtcatctctttgaaaatag

SEQ ID NO: 611743 - DNA, 20 bp, Artificial
  CRISPR gRNA sequence
ttgaaaatagtggcatccat

SEQ ID NO: 611744 - DNA, 20 bp, Artificial
  CRISPR gRNA sequence
ggcatccataagcaacctac

SEQ ID NO: 611745 - DNA, 20 bp, Artificial
  CRISPR gRNA sequence
atccataagcaacctaccag

SEQ ID NO: 611746 - DNA, 20 bp, Artificial
  CRISPR gRNA sequence
acctaccagaagcatcccct

SEQ ID NO: 611747 - DNA, 20 bp, Artificial
  CRISPR gRNA sequence
gctatctctatcttaataaa

SEQ ID NO: 611748 - DNA, 20 bp, Artificial
  CRISPR gRNA sequence
tcttaataaaaagcttgaat

SEQ ID NO: 611749 - DNA, 20 bp, Artificial
  CRISPR gRNA sequence
aaagcttgaatcagaatctg

SEQ ID NO: 611750 - DNA, 20 bp, Artificial
  CRISPR gRNA sequence
atcagaatctgtggttatgt

SEQ ID NO: 611751 - DNA, 20 bp, Artificial
  CRISPR gRNA sequence
tctgtggttatgttggtgtt

SEQ ID NO: 611752 - DNA, 20 bp, Artificial
  CRISPR gRNA sequence
atcccacctcactcgaatgt

SEQ ID NO: 611753 - DNA, 20 bp, Artificial
  CRISPR gRNA sequence
cactcgaatgtaagctctgt

SEQ ID NO: 611754 - DNA, 20 bp, Artificial
  CRISPR gRNA sequence
atgtaagctctgtgagattg

SEQ ID NO: 611755 - DNA, 20 bp, Artificial
  CRISPR gRNA sequence
tctgtgagattgtggactgc

SEQ ID NO: 611756 - DNA, 20 bp, Artificial
  CRISPR gRNA sequence
ggactgcaagactgtctttg

SEQ ID NO: 611757 - DNA, 20 bp, Artificial
  CRISPR gRNA sequence
actgcaagactgtctttgtg

SEQ ID NO: 611758 - DNA, 20 bp, Artificial
  CRISPR gRNA sequence
tgtggagcttacattttaat

SEQ ID NO: 611759 - DNA, 20 bp, Artificial
  CRISPR gRNA sequence
gtggagcttacattttaata

SEQ ID NO: 611760 - DNA, 20 bp, Artificial
  CRISPR gRNA sequence
tggagcttacattttaataa

SEQ ID NO: 611761 - DNA, 20 bp, Artificial
  CRISPR gRNA sequence
ggagcttacattttaataag

SEQ ID NO: 611762 - DNA, 20 bp, Artificial
  CRISPR gRNA sequence
agcttacattttaataaggg

SEQ ID NO: 611763 - DNA, 20 bp, Artificial
  CRISPR gRNA sequence
tacattttaataaggggaga

SEQ ID NO: 611764 - DNA, 20 bp, Artificial
  CRISPR gRNA sequence
acattttaataaggggagac

SEQ ID NO: 611765 - DNA, 20 bp, Artificial
  CRISPR gRNA sequence
tttaataaggggagacgggc

SEQ ID NO: 611766 - DNA, 20 bp, Artificial
  CRISPR gRNA sequence
aaggggagacgggcaagaat

SEQ ID NO: 611767 - DNA, 20 bp, Artificial
  CRISPR gRNA sequence
taaaaaatcatataatatgt

SEQ ID NO: 611768 - DNA, 20 bp, Artificial
  CRISPR gRNA sequence
aaaatcatataatatgttag

SEQ ID NO: 611769 - DNA, 20 bp, Artificial
  CRISPR gRNA sequence
ttagaagatgttgactgcta

SEQ ID NO: 611770 - DNA, 20 bp, Artificial
  CRISPR gRNA sequence
tagaagatgttgactgctac

SEQ ID NO: 611771 - DNA, 20 bp, Artificial
  CRISPR gRNA sequence
agaagatgttgactgctaca

SEQ ID NO: 611772 - DNA, 20 bp, Artificial
  CRISPR gRNA sequence
gactgctacagggaaaaaaa

SEQ ID NO: 611773 - DNA, 20 bp, Artificial
  CRISPR gRNA sequence
ttgatcatttattgtgtgtt

SEQ ID NO: 611774 - DNA, 20 bp, Artificial
  CRISPR gRNA sequence
tattgtgtgttaagtacctt

SEQ ID NO: 611775 - DNA, 20 bp, Artificial
  CRISPR gRNA sequence
agtaccttgagttttccata

SEQ ID NO: 611776 - DNA, 20 bp, Artificial
  CRISPR gRNA sequence
ttaaaaaaaatatatactca

SEQ ID NO: 611777 - DNA, 20 bp, Artificial
  CRISPR gRNA sequence
tatactcacagaaatgctgt

SEQ ID NO: 611778 - DNA, 20 bp, Artificial
  CRISPR gRNA sequence
ctcacagaaatgctgtgagt

SEQ ID NO: 611779 - DNA, 20 bp, Artificial
  CRISPR gRNA sequence
tcacagaaatgctgtgagtt

SEQ ID NO: 611780 - DNA, 20 bp, Artificial
  CRISPR gRNA sequence
tttcctaatttaacgtaacc

SEQ ID NO: 611781 - DNA, 20 bp, Artificial
  CRISPR gRNA sequence
ttcctaatttaacgtaacct

SEQ ID NO: 611782 - DNA, 20 bp, Artificial
  CRISPR gRNA sequence
acctaggcttcacacacaac

SEQ ID NO: 611783 - DNA, 20 bp, Artificial
  CRISPR gRNA sequence
gcttcacacacaactggcat

SEQ ID NO: 611784 - DNA, 20 bp, Artificial
  CRISPR gRNA sequence
cttcacacacaactggcatt

SEQ ID NO: 611785 - DNA, 20 bp, Artificial
  CRISPR gRNA sequence
ttcacacacaactggcatta

SEQ ID NO: 611786 - DNA, 20 bp, Artificial
  CRISPR gRNA sequence
cacacaactggcattagggt

SEQ ID NO: 611787 - DNA, 20 bp, Artificial
  CRISPR gRNA sequence
tggcattagggttagaattt

SEQ ID NO: 611788 - DNA, 20 bp, Artificial
  CRISPR gRNA sequence
agggttagaatttgagatcc

SEQ ID NO: 611789 - DNA, 20 bp, Artificial
  CRISPR gRNA sequence
ttagaatttgagatccaagt

SEQ ID NO: 611790 - DNA, 20 bp, Artificial
  CRISPR gRNA sequence
ccaagtaagaaaccacattc

SEQ ID NO: 611791 - DNA, 20 bp, Artificial
  CRISPR gRNA sequence
tctttatatgaatattccat

SEQ ID NO: 611792 - DNA, 20 bp, Artificial
  CRISPR gRNA sequence
tatatgaatattccataagt

SEQ ID NO: 611793 - DNA, 20 bp, Artificial
  CRISPR gRNA sequence
tatgaatattccataagtta

SEQ ID NO: 611794 - DNA, 20 bp, Artificial
  CRISPR gRNA sequence
aatattccataagttagagc

SEQ ID NO: 611795 - DNA, 20 bp, Artificial
  CRISPR gRNA sequence
tgcttctgaattgattattt

SEQ ID NO: 611796 - DNA, 20 bp, Artificial
  CRISPR gRNA sequence
gcttctgaattgattatttt

SEQ ID NO: 611797 - DNA, 20 bp, Artificial
  CRISPR gRNA sequence
ttctgaattgattattttgg

SEQ ID NO: 611798 - DNA, 20 bp, Artificial
  CRISPR gRNA sequence
caaattatttgcttactcat

SEQ ID NO: 611799 - DNA, 20 bp, Artificial
  CRISPR gRNA sequence
atttgcttactcataagcct

SEQ ID NO: 611800 - DNA, 20 bp, Artificial
  CRISPR gRNA sequence
aagcctgagttcttgtaata

SEQ ID NO: 611801 - DNA, 20 bp, Artificial
  CRISPR gRNA sequence
ctgagttcttgtaatataga

SEQ ID NO: 611802 - DNA, 20 bp, Artificial
  CRISPR gRNA sequence
gttcttgtaatatagaaagt

SEQ ID NO: 611803 - DNA, 20 bp, Artificial
  CRISPR gRNA sequence
taatatagaaagtcagatga

SEQ ID NO: 611804 - DNA, 20 bp, Artificial
  CRISPR gRNA sequence
aatatagaaagtcagatgaa

SEQ ID NO: 611805 - DNA, 20 bp, Artificial
  CRISPR gRNA sequence
agtcagatgaaaggaaatac

SEQ ID NO: 611806 - DNA, 20 bp, Artificial
  CRISPR gRNA sequence
ccttactttattgcacttca

SEQ ID NO: 611807 - DNA, 20 bp, Artificial
  CRISPR gRNA sequence
ctgcgttttttacaaattga

SEQ ID NO: 611808 - DNA, 20 bp, Artificial
  CRISPR gRNA sequence
ttttacaaattgaaagtttg

SEQ ID NO: 611809 - DNA, 20 bp, Artificial
  CRISPR gRNA sequence
tttgtggtaaccctaattcc

SEQ ID NO: 611810 - DNA, 20 bp, Artificial
  CRISPR gRNA sequence
tggtaaccctaattccaagc

SEQ ID NO: 611811 - DNA, 20 bp, Artificial
  CRISPR gRNA sequence
aaccctaattccaagcaagt

SEQ ID NO: 611812 - DNA, 20 bp, Artificial
  CRISPR gRNA sequence
tgttattattataactgttt

SEQ ID NO: 611813 - DNA, 20 bp, Artificial
  CRISPR gRNA sequence
gttattattataactgtttt

SEQ ID NO: 611814 - DNA, 20 bp, Artificial
  CRISPR gRNA sequence
taccacgaaccacacctata

SEQ ID NO: 611815 - DNA, 20 bp, Artificial
  CRISPR gRNA sequence
accacgaaccacacctatac

SEQ ID NO: 611816 - DNA, 20 bp, Artificial
  CRISPR gRNA sequence
cgaaccacacctatacaggc

SEQ ID NO: 611817 - DNA, 20 bp, Artificial
  CRISPR gRNA sequence
tgtgttgataaatgttgtgt

SEQ ID NO: 611818 - DNA, 20 bp, Artificial
  CRISPR gRNA sequence
gctctgactgcttcaccaac

SEQ ID NO: 611819 - DNA, 20 bp, Artificial
  CRISPR gRNA sequence
tgactgcttcaccaactggc

SEQ ID NO: 611820 - DNA, 20 bp, Artificial
  CRISPR gRNA sequence
ctgtccctctgtccctcacc

SEQ ID NO: 611821 - DNA, 20 bp, Artificial
  CRISPR gRNA sequence
aaatgcaaaaatactgaaat

SEQ ID NO: 611822 - DNA, 20 bp, Artificial
  CRISPR gRNA sequence
aatgcaaaaatactgaaatt

SEQ ID NO: 611823 - DNA, 20 bp, Artificial
  CRISPR gRNA sequence
gccacttaataactgtacaa

SEQ ID NO: 611824 - DNA, 20 bp, Artificial
  CRISPR gRNA sequence
ataactgtacaatggcctct

SEQ ID NO: 611825 - DNA, 20 bp, Artificial
  CRISPR gRNA sequence
acaatggcctctaagtgttc

SEQ ID NO: 611826 - DNA, 20 bp, Artificial
  CRISPR gRNA sequence
gcctctaagtgttcaagtta

SEQ ID NO: 611827 - DNA, 20 bp, Artificial
  CRISPR gRNA sequence
cctctaagtgttcaagttaa

SEQ ID NO: 611828 - DNA, 20 bp, Artificial
  CRISPR gRNA sequence
ctaagtgttcaagttaaagg

SEQ ID NO: 611829 - DNA, 20 bp, Artificial
  CRISPR gRNA sequence
catttctcactttaaatcaa

SEQ ID NO: 611830 - DNA, 20 bp, Artificial
  CRISPR gRNA sequence
tctcactttaaatcaaaagc

SEQ ID NO: 611831 - DNA, 20 bp, Artificial
  CRISPR gRNA sequence
aatcaaaagctagaaatgat

SEQ ID NO: 611832 - DNA, 20 bp, Artificial
  CRISPR gRNA sequence
atcaaaagctagaaatgatg

SEQ ID NO: 611833 - DNA, 20 bp, Artificial
  CRISPR gRNA sequence
aagctagaaatgatgaggct

SEQ ID NO: 611834 - DNA, 20 bp, Artificial
  CRISPR gRNA sequence
tagaaatgatgaggcttagt

SEQ ID NO: 611835 - DNA, 20 bp, Artificial
  CRISPR gRNA sequence
agaaatgatgaggcttagtg

SEQ ID NO: 611836 - DNA, 20 bp, Artificial
  CRISPR gRNA sequence
aatgatgaggcttagtgagg

SEQ ID NO: 611837 - DNA, 20 bp, Artificial
  CRISPR gRNA sequence
atgatgaggcttagtgagga

SEQ ID NO: 611838 - DNA, 20 bp, Artificial
  CRISPR gRNA sequence
tagtgaggaaggtatgtcaa

SEQ ID NO: 611839 - DNA, 20 bp, Artificial
  CRISPR gRNA sequence
agtgaggaaggtatgtcaac

SEQ ID NO: 611840 - DNA, 20 bp, Artificial
  CRISPR gRNA sequence
caacaggcaaaacatgccaa

SEQ ID NO: 611841 - DNA, 20 bp, Artificial
  CRISPR gRNA sequence
aggcaaaacatgccaaaaga

SEQ ID NO: 611842 - DNA, 20 bp, Artificial
  CRISPR gRNA sequence
ggcaaaacatgccaaaagat

SEQ ID NO: 611843 - DNA, 20 bp, Artificial
  CRISPR gRNA sequence
gataggcctcctgtgccaaa

SEQ ID NO: 611844 - DNA, 20 bp, Artificial
  CRISPR gRNA sequence
acagccacattgtgaatgca

SEQ ID NO: 611845 - DNA, 20 bp, Artificial
  CRISPR gRNA sequence
cagccacattgtgaatgcaa

SEQ ID NO: 611846 - DNA, 20 bp, Artificial
  CRISPR gRNA sequence
atgcaaaggaaatgttattg

SEQ ID NO: 611847 - DNA, 20 bp, Artificial
  CRISPR gRNA sequence
gaaaatttaaaatgctactc

SEQ ID NO: 611848 - DNA, 20 bp, Artificial
  CRISPR gRNA sequence
tgctactccagtgaacacac

SEQ ID NO: 611849 - DNA, 20 bp, Artificial
  CRISPR gRNA sequence
ccagtgaacacacaagtgat

SEQ ID NO: 611850 - DNA, 20 bp, Artificial
  CRISPR gRNA sequence
tgaacacacaagtgataaga

SEQ ID NO: 611851 - DNA, 20 bp, Artificial
  CRISPR gRNA sequence
aactgccttacttctgatta

SEQ ID NO: 611852 - DNA, 20 bp, Artificial
  CRISPR gRNA sequence
ctgccttacttctgattatg

SEQ ID NO: 611853 - DNA, 20 bp, Artificial
  CRISPR gRNA sequence
cttacttctgattatggaga

SEQ ID NO: 611854 - DNA, 20 bp, Artificial
  CRISPR gRNA sequence
tctgattatggagaaagttt

SEQ ID NO: 611855 - DNA, 20 bp, Artificial
  CRISPR gRNA sequence
gattatggagaaagtttcag

SEQ ID NO: 611856 - DNA, 20 bp, Artificial
  CRISPR gRNA sequence
tggagaaagtttcagtggtc

SEQ ID NO: 611857 - DNA, 20 bp, Artificial
  CRISPR gRNA sequence
gaaagtttcagtggtctgga

SEQ ID NO: 611858 - DNA, 20 bp, Artificial
  CRISPR gRNA sequence
agtttcagtggtctggatag

SEQ ID NO: 611859 - DNA, 20 bp, Artificial
  CRISPR gRNA sequence
gtctggatagaagatcaaac

SEQ ID NO: 611860 - DNA, 20 bp, Artificial
  CRISPR gRNA sequence
cacaacattctcttaaatca

SEQ ID NO: 611861 - DNA, 20 bp, Artificial
  CRISPR gRNA sequence
ttaaatcaaagcctaatcct

SEQ ID NO: 611862 - DNA, 20 bp, Artificial
  CRISPR gRNA sequence
taaatcaaagcctaatcctg

SEQ ID NO: 611863 - DNA, 20 bp, Artificial
  CRISPR gRNA sequence
atcaaagcctaatcctgagg

SEQ ID NO: 611864 - DNA, 20 bp, Artificial
  CRISPR gRNA sequence
taacaatattcaattttctg

SEQ ID NO: 611865 - DNA, 20 bp, Artificial
  CRISPR gRNA sequence
aacaatattcaattttctga

SEQ ID NO: 611866 - DNA, 20 bp, Artificial
  CRISPR gRNA sequence
ttcaattttctgaaggccac

SEQ ID NO: 611867 - DNA, 20 bp, Artificial
  CRISPR gRNA sequence
ttctgaaggccacgagatgt

SEQ ID NO: 611868 - DNA, 20 bp, Artificial
  CRISPR gRNA sequence
tctgaaggccacgagatgtg

SEQ ID NO: 611869 - DNA, 20 bp, Artificial
  CRISPR gRNA sequence
cacgagatgtgaggaaactg

SEQ ID NO: 611870 - DNA, 20 bp, Artificial
  CRISPR gRNA sequence
gagatgtgaggaaactgcag

SEQ ID NO: 611871 - DNA, 20 bp, Artificial
  CRISPR gRNA sequence
gtgaggaaactgcagaagaa

SEQ ID NO: 611872 - DNA, 20 bp, Artificial
  CRISPR gRNA sequence
ggaaactgcagaagaaaagt

SEQ ID NO: 611873 - DNA, 20 bp, Artificial
  CRISPR gRNA sequence
aactgcagaagaaaagttgg

SEQ ID NO: 611874 - DNA, 20 bp, Artificial
  CRISPR gRNA sequence
gcagaagaaaagttggaagc

SEQ ID NO: 611875 - DNA, 20 bp, Artificial
  CRISPR gRNA sequence
gaagaaaagttggaagctag

SEQ ID NO: 611876 - DNA, 20 bp, Artificial
  CRISPR gRNA sequence
agaaaagttggaagctagca

SEQ ID NO: 611877 - DNA, 20 bp, Artificial
  CRISPR gRNA sequence
gaaaagttggaagctagcag

SEQ ID NO: 611878 - DNA, 20 bp, Artificial
  CRISPR gRNA sequence
agttggaagctagcagaggt

SEQ ID NO: 611879 - DNA, 20 bp, Artificial
  CRISPR gRNA sequence
gctagcagaggttggttcat

SEQ ID NO: 611880 - DNA, 20 bp, Artificial
  CRISPR gRNA sequence
ctagcagaggttggttcatg

SEQ ID NO: 611881 - DNA, 20 bp, Artificial
  CRISPR gRNA sequence
gaggttggttcatgaggttt

SEQ ID NO: 611882 - DNA, 20 bp, Artificial
  CRISPR gRNA sequence
aggttggttcatgaggttta

SEQ ID NO: 611883 - DNA, 20 bp, Artificial
  CRISPR gRNA sequence
tggttcatgaggtttaagga

SEQ ID NO: 611884 - DNA, 20 bp, Artificial
  CRISPR gRNA sequence
ttcatgaggtttaaggaaag

SEQ ID NO: 611885 - DNA, 20 bp, Artificial
  CRISPR gRNA sequence
aagccatctctataacataa

SEQ ID NO: 611886 - DNA, 20 bp, Artificial
  CRISPR gRNA sequence
tctctataacataaaagtgc

SEQ ID NO: 611887 - DNA, 20 bp, Artificial
  CRISPR gRNA sequence
ctctataacataaaagtgca

SEQ ID NO: 611888 - DNA, 20 bp, Artificial
  CRISPR gRNA sequence
ataacataaaagtgcaaggt

SEQ ID NO: 611889 - DNA, 20 bp, Artificial
  CRISPR gRNA sequence
taacataaaagtgcaaggtg

SEQ ID NO: 611890 - DNA, 20 bp, Artificial
  CRISPR gRNA sequence
cataaaagtgcaaggtgagg

SEQ ID NO: 611891 - DNA, 20 bp, Artificial
  CRISPR gRNA sequence
aaagtgcaaggtgaggcagc

SEQ ID NO: 611892 - DNA, 20 bp, Artificial
  CRISPR gRNA sequence
tgaggcagcaagtgctgatg

SEQ ID NO: 611893 - DNA, 20 bp, Artificial
  CRISPR gRNA sequence
aggcagcaagtgctgatgta

SEQ ID NO: 611894 - DNA, 20 bp, Artificial
  CRISPR gRNA sequence
ggcagcaagtgctgatgtag

SEQ ID NO: 611895 - DNA, 20 bp, Artificial
  CRISPR gRNA sequence
aagtgctgatgtagaggcta

SEQ ID NO: 611896 - DNA, 20 bp, Artificial
  CRISPR gRNA sequence
agaggctacagtaattcatc

SEQ ID NO: 611897 - DNA, 20 bp, Artificial
  CRISPR gRNA sequence
ggctacagtaattcatccag

SEQ ID NO: 611898 - DNA, 20 bp, Artificial
  CRISPR gRNA sequence
agtaattcatccagaagaac

SEQ ID NO: 611899 - DNA, 20 bp, Artificial
  CRISPR gRNA sequence
ttcatccagaagaactagct

SEQ ID NO: 611900 - DNA, 20 bp, Artificial
  CRISPR gRNA sequence
actagctaagctaattaatg

SEQ ID NO: 611901 - DNA, 20 bp, Artificial
  CRISPR gRNA sequence
ctagctaagctaattaatga

SEQ ID NO: 611902 - DNA, 20 bp, Artificial
  CRISPR gRNA sequence
gctaagctaattaatgaagg

SEQ ID NO: 611903 - DNA, 20 bp, Artificial
  CRISPR gRNA sequence
atgaaggtggttgtgataaa

SEQ ID NO: 611904 - DNA, 20 bp, Artificial
  CRISPR gRNA sequence
aaggtggttgtgataaatgg

SEQ ID NO: 611905 - DNA, 20 bp, Artificial
  CRISPR gRNA sequence
ggtggttgtgataaatggca

SEQ ID NO: 611906 - DNA, 20 bp, Artificial
  CRISPR gRNA sequence
tgtgataaatggcagagttt

SEQ ID NO: 611907 - DNA, 20 bp, Artificial
  CRISPR gRNA sequence
taaatggcagagtttcagtg

SEQ ID NO: 611908 - DNA, 20 bp, Artificial
  CRISPR gRNA sequence
gagtttcagtgtagacaaaa

SEQ ID NO: 611909 - DNA, 20 bp, Artificial
  CRISPR gRNA sequence
tagacaaaacagccttctat

SEQ ID NO: 611910 - DNA, 20 bp, Artificial
  CRISPR gRNA sequence
acaaaacagccttctattag

SEQ ID NO: 611911 - DNA, 20 bp, Artificial
  CRISPR gRNA sequence
aaacagccttctattagaag

SEQ ID NO: 611912 - DNA, 20 bp, Artificial
  CRISPR gRNA sequence
acagccttctattagaagaa

SEQ ID NO: 611913 - DNA, 20 bp, Artificial
  CRISPR gRNA sequence
cagccttctattagaagaag

SEQ ID NO: 611914 - DNA, 20 bp, Artificial
  CRISPR gRNA sequence
tattagaagaagaggccatc

SEQ ID NO: 611915 - DNA, 20 bp, Artificial
  CRISPR gRNA sequence
ttagaagaagaggccatcta

SEQ ID NO: 611916 - DNA, 20 bp, Artificial
  CRISPR gRNA sequence
agaagaagaggccatctaga

SEQ ID NO: 611917 - DNA, 20 bp, Artificial
  CRISPR gRNA sequence
gaagaagaggccatctagag

SEQ ID NO: 611918 - DNA, 20 bp, Artificial
  CRISPR gRNA sequence
agaagaggccatctagagag

SEQ ID NO: 611919 - DNA, 20 bp, Artificial
  CRISPR gRNA sequence
agaggccatctagagaggag

SEQ ID NO: 611920 - DNA, 20 bp, Artificial
  CRISPR gRNA sequence
gccatctagagaggagaagt

SEQ ID NO: 611921 - DNA, 20 bp, Artificial
  CRISPR gRNA sequence
agagaggagaagtcagtgcc

SEQ ID NO: 611922 - DNA, 20 bp, Artificial
  CRISPR gRNA sequence
gagaggagaagtcagtgcct

SEQ ID NO: 611923 - DNA, 20 bp, Artificial
  CRISPR gRNA sequence
gaagtcagtgcctgggttaa

SEQ ID NO: 611924 - DNA, 20 bp, Artificial
  CRISPR gRNA sequence
tgcctgggttaaaagcttca

SEQ ID NO: 611925 - DNA, 20 bp, Artificial
  CRISPR gRNA sequence
gcctgggttaaaagcttcaa

SEQ ID NO: 611926 - DNA, 20 bp, Artificial
  CRISPR gRNA sequence
gggttaaaagcttcaaagga

SEQ ID NO: 611927 - DNA, 20 bp, Artificial
  CRISPR gRNA sequence
ggttaaaagcttcaaaggac

SEQ ID NO: 611928 - DNA, 20 bp, Artificial
  CRISPR gRNA sequence
aaaggacaggctgactctct

SEQ ID NO: 611929 - DNA, 20 bp, Artificial
  CRISPR gRNA sequence
ggacaggctgactctcttgg

SEQ ID NO: 611930 - DNA, 20 bp, Artificial
  CRISPR gRNA sequence
gacaggctgactctcttggt

SEQ ID NO: 611931 - DNA, 20 bp, Artificial
  CRISPR gRNA sequence
actctcttggtaggacaatg

SEQ ID NO: 611932 - DNA, 20 bp, Artificial
  CRISPR gRNA sequence
tcttggtaggacaatgcagc

SEQ ID NO: 611933 - DNA, 20 bp, Artificial
  CRISPR gRNA sequence
acaatgcagctggtgactta

SEQ ID NO: 611934 - DNA, 20 bp, Artificial
  CRISPR gRNA sequence
cagctggtgacttaaagttg

SEQ ID NO: 611935 - DNA, 20 bp, Artificial
  CRISPR gRNA sequence
ttgaccattccaaaaattct

SEQ ID NO: 611936 - DNA, 20 bp, Artificial
  CRISPR gRNA sequence
tgaccattccaaaaattcta

SEQ ID NO: 611937 - DNA, 20 bp, Artificial
  CRISPR gRNA sequence
ccaaaaattctaaggtcctt

SEQ ID NO: 611938 - DNA, 20 bp, Artificial
  CRISPR gRNA sequence
ctctgcctgtgctctataaa

SEQ ID NO: 611939 - DNA, 20 bp, Artificial
  CRISPR gRNA sequence
cctgtgctctataaatggaa

SEQ ID NO: 611940 - DNA, 20 bp, Artificial
  CRISPR gRNA sequence
gctctataaatggaacagca

SEQ ID NO: 611941 - DNA, 20 bp, Artificial
  CRISPR gRNA sequence
ataaatggaacagcaaagtc

SEQ ID NO: 611942 - DNA, 20 bp, Artificial
  CRISPR gRNA sequence
taaatggaacagcaaagtct

SEQ ID NO: 611943 - DNA, 20 bp, Artificial
  CRISPR gRNA sequence
gaacagcaaagtctgggtga

SEQ ID NO: 611944 - DNA, 20 bp, Artificial
  CRISPR gRNA sequence
cagcacatttgtttacaata

SEQ ID NO: 611945 - DNA, 20 bp, Artificial
  CRISPR gRNA sequence
catttgtttacaatatggtt

SEQ ID NO: 611946 - DNA, 20 bp, Artificial
  CRISPR gRNA sequence
tacaatatggtttagtgaat

SEQ ID NO: 611947 - DNA, 20 bp, Artificial
  CRISPR gRNA sequence
tagtgaataagcctattgtt

SEQ ID NO: 611948 - DNA, 20 bp, Artificial
  CRISPR gRNA sequence
cctattgtttagacactgct

SEQ ID NO: 611949 - DNA, 20 bp, Artificial
  CRISPR gRNA sequence
aaattcctttcaaaatatta

SEQ ID NO: 611950 - DNA, 20 bp, Artificial
  CRISPR gRNA sequence
ttgtcacccaaaacttctga

SEQ ID NO: 611951 - DNA, 20 bp, Artificial
  CRISPR gRNA sequence
gtcacccaaaacttctgatg

SEQ ID NO: 611952 - DNA, 20 bp, Artificial
  CRISPR gRNA sequence
aacttctgatggagatgtac

SEQ ID NO: 611953 - DNA, 20 bp, Artificial
  CRISPR gRNA sequence
ttctgatggagatgtacaag

SEQ ID NO: 611954 - DNA, 20 bp, Artificial
  CRISPR gRNA sequence
gcagattaatgttgttttca

SEQ ID NO: 611955 - DNA, 20 bp, Artificial
  CRISPR gRNA sequence
tgttttcatggctgttaata

SEQ ID NO: 611956 - DNA, 20 bp, Artificial
  CRISPR gRNA sequence
ttaatacagcatatattctt

SEQ ID NO: 611957 - DNA, 20 bp, Artificial
  CRISPR gRNA sequence
atattcttcagcccacgctc

SEQ ID NO: 611958 - DNA, 20 bp, Artificial
  CRISPR gRNA sequence
tattcttcagcccacgctca

SEQ ID NO: 611959 - DNA, 20 bp, Artificial
  CRISPR gRNA sequence
attcttcagcccacgctcaa

SEQ ID NO: 611960 - DNA, 20 bp, Artificial
  CRISPR gRNA sequence
aagggttaatttaaactttc

SEQ ID NO: 611961 - DNA, 20 bp, Artificial
  CRISPR gRNA sequence
actttcaagtcttattactt

SEQ ID NO: 611962 - DNA, 20 bp, Artificial
  CRISPR gRNA sequence
acttaagacatacattttat

SEQ ID NO: 611963 - DNA, 20 bp, Artificial
  CRISPR gRNA sequence
cttaagacatacattttata

SEQ ID NO: 611964 - DNA, 20 bp, Artificial
  CRISPR gRNA sequence
agacatacattttataaggc

SEQ ID NO: 611965 - DNA, 20 bp, Artificial
  CRISPR gRNA sequence
acatacattttataaggcta

SEQ ID NO: 611966 - DNA, 20 bp, Artificial
  CRISPR gRNA sequence
catacattttataaggctag

SEQ ID NO: 611967 - DNA, 20 bp, Artificial
  CRISPR gRNA sequence
ttataaggctagaggtgcca

SEQ ID NO: 611968 - DNA, 20 bp, Artificial
  CRISPR gRNA sequence
aaggctagaggtgccataga

SEQ ID NO: 611969 - DNA, 20 bp, Artificial
  CRISPR gRNA sequence
atagacagtgatttctatga

SEQ ID NO: 611970 - DNA, 20 bp, Artificial
  CRISPR gRNA sequence
agtgatttctatgatggatg

SEQ ID NO: 611971 - DNA, 20 bp, Artificial
  CRISPR gRNA sequence
gtgatttctatgatggatgt

SEQ ID NO: 611972 - DNA, 20 bp, Artificial
  CRISPR gRNA sequence
ttctatgatggatgtgggca

SEQ ID NO: 611973 - DNA, 20 bp, Artificial
  CRISPR gRNA sequence
aaagtaaactgaaaaccttc

SEQ ID NO: 611974 - DNA, 20 bp, Artificial
  CRISPR gRNA sequence
taaactgaaaaccttctgga

SEQ ID NO: 611975 - DNA, 20 bp, Artificial
  CRISPR gRNA sequence
aaactgaaaaccttctggaa

SEQ ID NO: 611976 - DNA, 20 bp, Artificial
  CRISPR gRNA sequence
aaaaccttctggaaaggatt

SEQ ID NO: 611977 - DNA, 20 bp, Artificial
  CRISPR gRNA sequence
ctggaaaggattcagaattc

SEQ ID NO: 611978 - DNA, 20 bp, Artificial
  CRISPR gRNA sequence
tcagaattctagatgtcatt

SEQ ID NO: 611979 - DNA, 20 bp, Artificial
  CRISPR gRNA sequence
agaacatttgtgattcatct

SEQ ID NO: 611980 - DNA, 20 bp, Artificial
  CRISPR gRNA sequence
acatttgtgattcatctgag

SEQ ID NO: 611981 - DNA, 20 bp, Artificial
  CRISPR gRNA sequence
catttgtgattcatctgaga

SEQ ID NO: 611982 - DNA, 20 bp, Artificial
  CRISPR gRNA sequence
gtgattcatctgagaaggtc

SEQ ID NO: 611983 - DNA, 20 bp, Artificial
  CRISPR gRNA sequence
tgagaaggtcaagatattaa

SEQ ID NO: 611984 - DNA, 20 bp, Artificial
  CRISPR gRNA sequence
gagaaggtcaagatattaac

SEQ ID NO: 611985 - DNA, 20 bp, Artificial
  CRISPR gRNA sequence
gaaggtcaagatattaacag

SEQ ID NO: 611986 - DNA, 20 bp, Artificial
  CRISPR gRNA sequence
gtcaagatattaacaggagt

SEQ ID NO: 611987 - DNA, 20 bp, Artificial
  CRISPR gRNA sequence
tcaagatattaacaggagtt

SEQ ID NO: 611988 - DNA, 20 bp, Artificial
  CRISPR gRNA sequence
tattaacaggagttgggaaa

SEQ ID NO: 611989 - DNA, 20 bp, Artificial
  CRISPR gRNA sequence
aaaagttgatttcaacctca

SEQ ID NO: 611990 - DNA, 20 bp, Artificial
  CRISPR gRNA sequence
tcaacctcatggatgacttt

SEQ ID NO: 611991 - DNA, 20 bp, Artificial
  CRISPR gRNA sequence
caacctcatggatgactttc

SEQ ID NO: 611992 - DNA, 20 bp, Artificial
  CRISPR gRNA sequence
acctcatggatgactttcag

SEQ ID NO: 611993 - DNA, 20 bp, Artificial
  CRISPR gRNA sequence
cctcatggatgactttcagg

SEQ ID NO: 611994 - DNA, 20 bp, Artificial
  CRISPR gRNA sequence
tggatgactttcaggaggtt

SEQ ID NO: 611995 - DNA, 20 bp, Artificial
  CRISPR gRNA sequence
ggatgactttcaggaggttc

SEQ ID NO: 611996 - DNA, 20 bp, Artificial
  CRISPR gRNA sequence
tttcaggaggttcaggactt

SEQ ID NO: 611997 - DNA, 20 bp, Artificial
  CRISPR gRNA sequence
caggaggttcaggacttcag

SEQ ID NO: 611998 - DNA, 20 bp, Artificial
  CRISPR gRNA sequence
gttcaggacttcagtggata

SEQ ID NO: 611999 - DNA, 20 bp, Artificial
  CRISPR gRNA sequence
ttcaggacttcagtggataa

SEQ ID NO: 612000 - DNA, 20 bp, Artificial
  CRISPR gRNA sequence
ttcagtggataaaggaactg

SEQ ID NO: 612001 - DNA, 20 bp, Artificial
  CRISPR gRNA sequence
taaaggaactgcagatgtga

SEQ ID NO: 612002 - DNA, 20 bp, Artificial
  CRISPR gRNA sequence
aactgcagatgtgatagaaa

SEQ ID NO: 612003 - DNA, 20 bp, Artificial
  CRISPR gRNA sequence
gatagaaacagcaacataac

SEQ ID NO: 612004 - DNA, 20 bp, Artificial
  CRISPR gRNA sequence
tagaaacagcaacataacta

SEQ ID NO: 612005 - DNA, 20 bp, Artificial
  CRISPR gRNA sequence
aacagcaacataactagagt

SEQ ID NO: 612006 - DNA, 20 bp, Artificial
  CRISPR gRNA sequence
agcaacataactagagttag

SEQ ID NO: 612007 - DNA, 20 bp, Artificial
  CRISPR gRNA sequence
aacataactagagttagaag

SEQ ID NO: 612008 - DNA, 20 bp, Artificial
  CRISPR gRNA sequence
cataactagagttagaagtg

SEQ ID NO: 612009 - DNA, 20 bp, Artificial
  CRISPR gRNA sequence
agagttagaagtggagcctg

SEQ ID NO: 612010 - DNA, 20 bp, Artificial
  CRISPR gRNA sequence
aagatgtgactgaattactg

SEQ ID NO: 612011 - DNA, 20 bp, Artificial
  CRISPR gRNA sequence
gtctcgttataaaatgtgaa

SEQ ID NO: 612012 - DNA, 20 bp, Artificial
  CRISPR gRNA sequence
ttataaaatgtgaatggatg

SEQ ID NO: 612013 - DNA, 20 bp, Artificial
  CRISPR gRNA sequence
ataaaatgtgaatggatgaa

SEQ ID NO: 612014 - DNA, 20 bp, Artificial
  CRISPR gRNA sequence
tgaagagttgcttcttacaa

SEQ ID NO: 612015 - DNA, 20 bp, Artificial
  CRISPR gRNA sequence
gaagagttgcttcttacaat

SEQ ID NO: 612016 - DNA, 20 bp, Artificial
  CRISPR gRNA sequence
gttgcttcttacaatgggca

SEQ ID NO: 612017 - DNA, 20 bp, Artificial
  CRISPR gRNA sequence
cttcttacaatgggcaaaga

SEQ ID NO: 612018 - DNA, 20 bp, Artificial
  CRISPR gRNA sequence
cttacaatgggcaaagaaag

SEQ ID NO: 612019 - DNA, 20 bp, Artificial
  CRISPR gRNA sequence
ggcaaagaaagtggtttctt

SEQ ID NO: 612020 - DNA, 20 bp, Artificial
  CRISPR gRNA sequence
tttcttgagatcgaatcttc

SEQ ID NO: 612021 - DNA, 20 bp, Artificial
  CRISPR gRNA sequence
tgagatcgaatcttctagtg

SEQ ID NO: 612022 - DNA, 20 bp, Artificial
  CRISPR gRNA sequence
gaatattgttgaaatgacaa

SEQ ID NO: 612023 - DNA, 20 bp, Artificial
  CRISPR gRNA sequence
atattgttgaaatgacaaca

SEQ ID NO: 612024 - DNA, 20 bp, Artificial
  CRISPR gRNA sequence
tattgttgaaatgacaacag

SEQ ID NO: 612025 - DNA, 20 bp, Artificial
  CRISPR gRNA sequence
tgaaatgacaacagaggatt

SEQ ID NO: 612026 - DNA, 20 bp, Artificial
  CRISPR gRNA sequence
tttggaatattacataaact

SEQ ID NO: 612027 - DNA, 20 bp, Artificial
  CRISPR gRNA sequence
ttacataaacttagttgaca

SEQ ID NO: 612028 - DNA, 20 bp, Artificial
  CRISPR gRNA sequence
cataaacttagttgacaaag

SEQ ID NO: 612029 - DNA, 20 bp, Artificial
  CRISPR gRNA sequence
aaacttagttgacaaagcag

SEQ ID NO: 612030 - DNA, 20 bp, Artificial
  CRISPR gRNA sequence
cttagttgacaaagcagtag

SEQ ID NO: 612031 - DNA, 20 bp, Artificial
  CRISPR gRNA sequence
tagttgacaaagcagtagca

SEQ ID NO: 612032 - DNA, 20 bp, Artificial
  CRISPR gRNA sequence
acaaagcagtagcagagttt

SEQ ID NO: 612033 - DNA, 20 bp, Artificial
  CRISPR gRNA sequence
aaagcagtagcagagtttga

SEQ ID NO: 612034 - DNA, 20 bp, Artificial
  CRISPR gRNA sequence
agcagtagcagagtttgaga

SEQ ID NO: 612035 - DNA, 20 bp, Artificial
  CRISPR gRNA sequence
agagttgaatccaattttga

SEQ ID NO: 612036 - DNA, 20 bp, Artificial
  CRISPR gRNA sequence
ttttgaaagaaattctactc

SEQ ID NO: 612037 - DNA, 20 bp, Artificial
  CRISPR gRNA sequence
tttgaaagaaattctactct

SEQ ID NO: 612038 - DNA, 20 bp, Artificial
  CRISPR gRNA sequence
ctgggtaaaatcgtatcaaa

SEQ ID NO: 612039 - DNA, 20 bp, Artificial
  CRISPR gRNA sequence
tcaaatagcatcacatgcta

SEQ ID NO: 612040 - DNA, 20 bp, Artificial
  CRISPR gRNA sequence
aaatagcatcacatgctaca

SEQ ID NO: 612041 - DNA, 20 bp, Artificial
  CRISPR gRNA sequence
tagcatcacatgctacagag

SEQ ID NO: 612042 - DNA, 20 bp, Artificial
  CRISPR gRNA sequence
tacagagaagtcctttgtga

SEQ ID NO: 612043 - DNA, 20 bp, Artificial
  CRISPR gRNA sequence
acagagaagtcctttgtgaa

SEQ ID NO: 612044 - DNA, 20 bp, Artificial
  CRISPR gRNA sequence
gagaagtcctttgtgaaagg

SEQ ID NO: 612045 - DNA, 20 bp, Artificial
  CRISPR gRNA sequence
aaaggaagtgttgactgatg

SEQ ID NO: 612046 - DNA, 20 bp, Artificial
  CRISPR gRNA sequence
cttcattgttgccttatgtt

SEQ ID NO: 612047 - DNA, 20 bp, Artificial
  CRISPR gRNA sequence
ttcattgttgccttatgtta

SEQ ID NO: 612048 - DNA, 20 bp, Artificial
  CRISPR gRNA sequence
aggaattgccacatccatcc

SEQ ID NO: 612049 - DNA, 20 bp, Artificial
  CRISPR gRNA sequence
tcccagccttcaacaaccac

SEQ ID NO: 612050 - DNA, 20 bp, Artificial
  CRISPR gRNA sequence
caaccaccagccttatcaat

SEQ ID NO: 612051 - DNA, 20 bp, Artificial
  CRISPR gRNA sequence
ccaccagccttatcaatcag

SEQ ID NO: 612052 - DNA, 20 bp, Artificial
  CRISPR gRNA sequence
aatcagtagccatcgacatc

SEQ ID NO: 612053 - DNA, 20 bp, Artificial
  CRISPR gRNA sequence
atcagtagccatcgacatca

SEQ ID NO: 612054 - DNA, 20 bp, Artificial
  CRISPR gRNA sequence
aaggcaacaccctcctccac

SEQ ID NO: 612055 - DNA, 20 bp, Artificial
  CRISPR gRNA sequence
gcaacaccctcctccaccag

SEQ ID NO: 612056 - DNA, 20 bp, Artificial
  CRISPR gRNA sequence
caccctcctccaccagtgga

SEQ ID NO: 612057 - DNA, 20 bp, Artificial
  CRISPR gRNA sequence
tccaccagtggaaagatgat

SEQ ID NO: 612058 - DNA, 20 bp, Artificial
  CRISPR gRNA sequence
gtggaaagatgatgagtctg

SEQ ID NO: 612059 - DNA, 20 bp, Artificial
  CRISPR gRNA sequence
tggaaagatgatgagtctga

SEQ ID NO: 612060 - DNA, 20 bp, Artificial
  CRISPR gRNA sequence
agatgatgagtctgaaggct

SEQ ID NO: 612061 - DNA, 20 bp, Artificial
  CRISPR gRNA sequence
gaaggctcagattatcttta

SEQ ID NO: 612062 - DNA, 20 bp, Artificial
  CRISPR gRNA sequence
agtgtatgtgtatgtatgtg

SEQ ID NO: 612063 - DNA, 20 bp, Artificial
  CRISPR gRNA sequence
atgtgtatgtatgtgcagtg

SEQ ID NO: 612064 - DNA, 20 bp, Artificial
  CRISPR gRNA sequence
tgtatgtatgtgcagtgcag

SEQ ID NO: 612065 - DNA, 20 bp, Artificial
  CRISPR gRNA sequence
ggtgcaatcacaactgactg

SEQ ID NO: 612066 - DNA, 20 bp, Artificial
  CRISPR gRNA sequence
tgactgtagccttgactgtc

SEQ ID NO: 612067 - DNA, 20 bp, Artificial
  CRISPR gRNA sequence
gactgtagccttgactgtct

SEQ ID NO: 612068 - DNA, 20 bp, Artificial
  CRISPR gRNA sequence
agccttgactgtctgggctc

SEQ ID NO: 612069 - DNA, 20 bp, Artificial
  CRISPR gRNA sequence
ctcaagtgatcctcccacct

SEQ ID NO: 612070 - DNA, 20 bp, Artificial
  CRISPR gRNA sequence
atcctcccacctcagcctct

SEQ ID NO: 612071 - DNA, 20 bp, Artificial
  CRISPR gRNA sequence
cctcagcctctcagcctccc

SEQ ID NO: 612072 - DNA, 20 bp, Artificial
  CRISPR gRNA sequence
ctctcagcctcccgagtaac

SEQ ID NO: 612073 - DNA, 20 bp, Artificial
  CRISPR gRNA sequence
tctcagcctcccgagtaact

SEQ ID NO: 612074 - DNA, 20 bp, Artificial
  CRISPR gRNA sequence
tcccgagtaactgggaccac

SEQ ID NO: 612075 - DNA, 20 bp, Artificial
  CRISPR gRNA sequence
tggtgcatgctaccacaccc

SEQ ID NO: 612076 - DNA, 20 bp, Artificial
  CRISPR gRNA sequence
cacaccctggctaattttgc

SEQ ID NO: 612077 - DNA, 20 bp, Artificial
  CRISPR gRNA sequence
tgctagttttgtattgttta

SEQ ID NO: 612078 - DNA, 20 bp, Artificial
  CRISPR gRNA sequence
ctagttttgtattgtttata

SEQ ID NO: 612079 - DNA, 20 bp, Artificial
  CRISPR gRNA sequence
tttgtattgtttatagagat

SEQ ID NO: 612080 - DNA, 20 bp, Artificial
  CRISPR gRNA sequence
tgagatttcatcatgttgcc

SEQ ID NO: 612081 - DNA, 20 bp, Artificial
  CRISPR gRNA sequence
gagatttcatcatgttgccc

SEQ ID NO: 612082 - DNA, 20 bp, Artificial
  CRISPR gRNA sequence
tttcatcatgttgcccaggc

SEQ ID NO: 612083 - DNA, 20 bp, Artificial
  CRISPR gRNA sequence
tcatgttgcccaggctggtc

SEQ ID NO: 612084 - DNA, 20 bp, Artificial
  CRISPR gRNA sequence
ccaggctggtctagaactcc

SEQ ID NO: 612085 - DNA, 20 bp, Artificial
  CRISPR gRNA sequence
caggctggtctagaactcct

SEQ ID NO: 612086 - DNA, 20 bp, Artificial
  CRISPR gRNA sequence
ggtctagaactcctgggctt

SEQ ID NO: 612087 - DNA, 20 bp, Artificial
  CRISPR gRNA sequence
cctcctgcctccacttccca

SEQ ID NO: 612088 - DNA, 20 bp, Artificial
  CRISPR gRNA sequence
ttcccaaagtgcttgtatta

SEQ ID NO: 612089 - DNA, 20 bp, Artificial
  CRISPR gRNA sequence
tcccaaagtgcttgtattac

SEQ ID NO: 612090 - DNA, 20 bp, Artificial
  CRISPR gRNA sequence
agtgcttgtattacaggtgt

SEQ ID NO: 612091 - DNA, 20 bp, Artificial
  CRISPR gRNA sequence
caggtgtgagccactgcacc

SEQ ID NO: 612092 - DNA, 20 bp, Artificial
  CRISPR gRNA sequence
gccactgcacctggcctctt

SEQ ID NO: 612093 - DNA, 20 bp, Artificial
  CRISPR gRNA sequence
ctggcctctttagcattttt

SEQ ID NO: 612094 - DNA, 20 bp, Artificial
  CRISPR gRNA sequence
gcctctttagcattttttag

SEQ ID NO: 612095 - DNA, 20 bp, Artificial
  CRISPR gRNA sequence
tttagcattttttagcagca

SEQ ID NO: 612096 - DNA, 20 bp, Artificial
  CRISPR gRNA sequence
agcaaagtatttttaaaatt

SEQ ID NO: 612097 - DNA, 20 bp, Artificial
  CRISPR gRNA sequence
gcaaagtatttttaaaatta

SEQ ID NO: 612098 - DNA, 20 bp, Artificial
  CRISPR gRNA sequence
caattctgttgcacacttaa

SEQ ID NO: 612099 - DNA, 20 bp, Artificial
  CRISPR gRNA sequence
gttgcacacttaatagatta

SEQ ID NO: 612100 - DNA, 20 bp, Artificial
  CRISPR gRNA sequence
tataaacataacttctatct

SEQ ID NO: 612101 - DNA, 20 bp, Artificial
  CRISPR gRNA sequence
atctgagtgacccactttat

SEQ ID NO: 612102 - DNA, 20 bp, Artificial
  CRISPR gRNA sequence
tctgagtgacccactttatc

SEQ ID NO: 612103 - DNA, 20 bp, Artificial
  CRISPR gRNA sequence
ggatatattctttattgtga

SEQ ID NO: 612104 - DNA, 20 bp, Artificial
  CRISPR gRNA sequence
gatatattctttattgtgat

SEQ ID NO: 612105 - DNA, 20 bp, Artificial
  CRISPR gRNA sequence
atatattctttattgtgatg

SEQ ID NO: 612106 - DNA, 20 bp, Artificial
  CRISPR gRNA sequence
tattctttattgtgatgggg

SEQ ID NO: 612107 - DNA, 20 bp, Artificial
  CRISPR gRNA sequence
actcaacctgcaatatctcc

SEQ ID NO: 612108 - DNA, 20 bp, Artificial
  CRISPR gRNA sequence
gcaatatctccaagatatgc

SEQ ID NO: 612109 - DNA, 20 bp, Artificial
  CRISPR gRNA sequence
atatctccaagatatgccag

SEQ ID NO: 612110 - DNA, 20 bp, Artificial
  CRISPR gRNA sequence
attaattgaaatctcattaa

SEQ ID NO: 612111 - DNA, 20 bp, Artificial
  CRISPR gRNA sequence
ttaattgaaatctcattaaa

SEQ ID NO: 612112 - DNA, 20 bp, Artificial
  CRISPR gRNA sequence
attgaaatctcattaaaagg

SEQ ID NO: 612113 - DNA, 20 bp, Artificial
  CRISPR gRNA sequence
tgaaatctcattaaaaggaa

SEQ ID NO: 612114 - DNA, 20 bp, Artificial
  CRISPR gRNA sequence
aaggaagagtctatataatt

SEQ ID NO: 612115 - DNA, 20 bp, Artificial
  CRISPR gRNA sequence
attcatttaatctgtatgcc

SEQ ID NO: 612116 - DNA, 20 bp, Artificial
  CRISPR gRNA sequence
tatgcctagtaaattcttac

SEQ ID NO: 612117 - DNA, 20 bp, Artificial
  CRISPR gRNA sequence
gcacatttgtaataatgaaa

SEQ ID NO: 612118 - DNA, 20 bp, Artificial
  CRISPR gRNA sequence
ctgctgtttcccttgtgtct

SEQ ID NO: 612119 - DNA, 20 bp, Artificial
  CRISPR gRNA sequence
gattttactgtaccatctcc

SEQ ID NO: 612120 - DNA, 20 bp, Artificial
  CRISPR gRNA sequence
ttgcacctttatactttctc

SEQ ID NO: 612121 - DNA, 20 bp, Artificial
  CRISPR gRNA sequence
aatgacttatgttacactta

SEQ ID NO: 612122 - DNA, 20 bp, Artificial
  CRISPR gRNA sequence
ttatgttacacttacagtga

SEQ ID NO: 612123 - DNA, 20 bp, Artificial
  CRISPR gRNA sequence
tgttacacttacagtgaaag

SEQ ID NO: 612124 - DNA, 20 bp, Artificial
  CRISPR gRNA sequence
acacttacagtgaaagaagt

SEQ ID NO: 612125 - DNA, 20 bp, Artificial
  CRISPR gRNA sequence
gtgaaagaagtgagcatccc

SEQ ID NO: 612126 - DNA, 20 bp, Artificial
  CRISPR gRNA sequence
tgaaagaagtgagcatccct

SEQ ID NO: 612127 - DNA, 20 bp, Artificial
  CRISPR gRNA sequence
gaaagaagtgagcatcccta

SEQ ID NO: 612128 - DNA, 20 bp, Artificial
  CRISPR gRNA sequence
aaagaagtgagcatccctag

SEQ ID NO: 612129 - DNA, 20 bp, Artificial
  CRISPR gRNA sequence
gagcatccctaggggttaaa

SEQ ID NO: 612130 - DNA, 20 bp, Artificial
  CRISPR gRNA sequence
tgattatatatgccacattt

SEQ ID NO: 612131 - DNA, 20 bp, Artificial
  CRISPR gRNA sequence
gattatatatgccacatttt

SEQ ID NO: 612132 - DNA, 20 bp, Artificial
  CRISPR gRNA sequence
tatatatgccacattttagg

SEQ ID NO: 612133 - DNA, 20 bp, Artificial
  CRISPR gRNA sequence
tatgccacattttaggcagc

SEQ ID NO: 612134 - DNA, 20 bp, Artificial
  CRISPR gRNA sequence
tgatatgtatatatttttaa

SEQ ID NO: 612135 - DNA, 20 bp, Artificial
  CRISPR gRNA sequence
tatgtatatatttttaacag

SEQ ID NO: 612136 - DNA, 20 bp, Artificial
  CRISPR gRNA sequence
ttaacagaagtgtaaaaatt

SEQ ID NO: 612137 - DNA, 20 bp, Artificial
  CRISPR gRNA sequence
aacagaagtgtaaaaattta

SEQ ID NO: 612138 - DNA, 20 bp, Artificial
  CRISPR gRNA sequence
cagaagtgtaaaaatttaga

SEQ ID NO: 612139 - DNA, 20 bp, Artificial
  CRISPR gRNA sequence
tgtaaaaatttagagagatt

SEQ ID NO: 612140 - DNA, 20 bp, Artificial
  CRISPR gRNA sequence
ttattgtttaattattttat

SEQ ID NO: 612141 - DNA, 20 bp, Artificial
  CRISPR gRNA sequence
ttattagcaatgttcaaaat

SEQ ID NO: 612142 - DNA, 20 bp, Artificial
  CRISPR gRNA sequence
aagcaataaaatattttatg

SEQ ID NO: 612143 - DNA, 20 bp, Artificial
  CRISPR gRNA sequence
aataaaatattttatgtggt

SEQ ID NO: 612144 - DNA, 20 bp, Artificial
  CRISPR gRNA sequence
ataaaatattttatgtggta

SEQ ID NO: 612145 - DNA, 20 bp, Artificial
  CRISPR gRNA sequence
tttatgtggtaaggaaatgc

SEQ ID NO: 612146 - DNA, 20 bp, Artificial
  CRISPR gRNA sequence
ttatgtggtaaggaaatgct

SEQ ID NO: 612147 - DNA, 20 bp, Artificial
  CRISPR gRNA sequence
tatgtggtaaggaaatgctg

SEQ ID NO: 612148 - DNA, 20 bp, Artificial
  CRISPR gRNA sequence
gtggtaaggaaatgctgggg

SEQ ID NO: 612149 - DNA, 20 bp, Artificial
  CRISPR gRNA sequence
cccattttgcttccttattt

SEQ ID NO: 612150 - DNA, 20 bp, Artificial
  CRISPR gRNA sequence
ccattttgcttccttatttt

SEQ ID NO: 612151 - DNA, 20 bp, Artificial
  CRISPR gRNA sequence
gcttccttattttaggtgtt

SEQ ID NO: 612152 - DNA, 20 bp, Artificial
  CRISPR gRNA sequence
ttattttaggtgttaagttc

SEQ ID NO: 612153 - DNA, 20 bp, Artificial
  CRISPR gRNA sequence
gtgttaagttcaagaaatct

SEQ ID NO: 612154 - DNA, 20 bp, Artificial
  CRISPR gRNA sequence
tgttaagttcaagaaatctg

SEQ ID NO: 612155 - DNA, 20 bp, Artificial
  CRISPR gRNA sequence
tgaggaaatgtgttaactta

SEQ ID NO: 612156 - DNA, 20 bp, Artificial
  CRISPR gRNA sequence
aatgtgttaacttaaagtga

SEQ ID NO: 612157 - DNA, 20 bp, Artificial
  CRISPR gRNA sequence
gttaacttaaagtgatagaa

SEQ ID NO: 612158 - DNA, 20 bp, Artificial
  CRISPR gRNA sequence
aacttaaagtgatagaaaag

SEQ ID NO: 612159 - DNA, 20 bp, Artificial
  CRISPR gRNA sequence
aaaagtagatgccaacaact

SEQ ID NO: 612160 - DNA, 20 bp, Artificial
  CRISPR gRNA sequence
ttataaaaataatcttacat

SEQ ID NO: 612161 - DNA, 20 bp, Artificial
  CRISPR gRNA sequence
aattgtgactatttttcttc

SEQ ID NO: 612162 - DNA, 20 bp, Artificial
  CRISPR gRNA sequence
ttgtgactatttttcttcca

SEQ ID NO: 612163 - DNA, 20 bp, Artificial
  CRISPR gRNA sequence
agagtgcccaaaacaataaa

SEQ ID NO: 612164 - DNA, 20 bp, Artificial
  CRISPR gRNA sequence
gtgcccaaaacaataaaaag

SEQ ID NO: 612165 - DNA, 20 bp, Artificial
  CRISPR gRNA sequence
atgtctgtgattttacttta

SEQ ID NO: 612166 - DNA, 20 bp, Artificial
  CRISPR gRNA sequence
tgtctgtgattttactttaa

SEQ ID NO: 612167 - DNA, 20 bp, Artificial
  CRISPR gRNA sequence
tttttatatacaatttttcc

SEQ ID NO: 612168 - DNA, 20 bp, Artificial
  CRISPR gRNA sequence
ctggtgtttgtgtcctgtat

SEQ ID NO: 612169 - DNA, 20 bp, Artificial
  CRISPR gRNA sequence
tgtgtcctgtataagatttt

SEQ ID NO: 612170 - DNA, 20 bp, Artificial
  CRISPR gRNA sequence
ttattacattataaaacaaa

SEQ ID NO: 612171 - DNA, 20 bp, Artificial
  CRISPR gRNA sequence
ataaaacaaatggcaatatt

SEQ ID NO: 612172 - DNA, 20 bp, Artificial
  CRISPR gRNA sequence
aacaaatggcaatatttgga

SEQ ID NO: 612173 - DNA, 20 bp, Artificial
  CRISPR gRNA sequence
atttggatggttaataatgt

SEQ ID NO: 612174 - DNA, 20 bp, Artificial
  CRISPR gRNA sequence
ggttaataatgttagctctg

SEQ ID NO: 612175 - DNA, 20 bp, Artificial
  CRISPR gRNA sequence
taatgttagctctgtggatg

SEQ ID NO: 612176 - DNA, 20 bp, Artificial
  CRISPR gRNA sequence
aatgttagctctgtggatgc

SEQ ID NO: 612177 - DNA, 20 bp, Artificial
  CRISPR gRNA sequence
ggaatgacatttgtctcgtt

SEQ ID NO: 612178 - DNA, 20 bp, Artificial
  CRISPR gRNA sequence
ctcgttcagtgctgtatcta

SEQ ID NO: 612179 - DNA, 20 bp, Artificial
  CRISPR gRNA sequence
agtgctgtatctacagcacc

SEQ ID NO: 612180 - DNA, 20 bp, Artificial
  CRISPR gRNA sequence
tatctacagcacctagaacg

SEQ ID NO: 612181 - DNA, 20 bp, Artificial
  CRISPR gRNA sequence
cagcacctagaacgtggaca

SEQ ID NO: 612182 - DNA, 20 bp, Artificial
  CRISPR gRNA sequence
agaacgtggacatggaatac

SEQ ID NO: 612183 - DNA, 20 bp, Artificial
  CRISPR gRNA sequence
aacgtggacatggaatactg

SEQ ID NO: 612184 - DNA, 20 bp, Artificial
  CRISPR gRNA sequence
acgtggacatggaatactgg

SEQ ID NO: 612185 - DNA, 20 bp, Artificial
  CRISPR gRNA sequence
atggaatactggaggtgctc

SEQ ID NO: 612186 - DNA, 20 bp, Artificial
  CRISPR gRNA sequence
tgctcaagaaatttatgtta

SEQ ID NO: 612187 - DNA, 20 bp, Artificial
  CRISPR gRNA sequence
gctcaagaaatttatgttaa

SEQ ID NO: 612188 - DNA, 20 bp, Artificial
  CRISPR gRNA sequence
gaaatttatgttaaaggaac

SEQ ID NO: 612189 - DNA, 20 bp, Artificial
  CRISPR gRNA sequence
agatgtctttgctcaacacc

SEQ ID NO: 612190 - DNA, 20 bp, Artificial
  CRISPR gRNA sequence
acacctggcacatcctgtta

SEQ ID NO: 612191 - DNA, 20 bp, Artificial
  CRISPR gRNA sequence
cctggcacatcctgttaaag

SEQ ID NO: 612192 - DNA, 20 bp, Artificial
  CRISPR gRNA sequence
tggcacatcctgttaaagaa

SEQ ID NO: 612193 - DNA, 20 bp, Artificial
  CRISPR gRNA sequence
tcctgttaaagaagagtaaa

SEQ ID NO: 612194 - DNA, 20 bp, Artificial
  CRISPR gRNA sequence
aagagtaaacagtattaaca

SEQ ID NO: 612195 - DNA, 20 bp, Artificial
  CRISPR gRNA sequence
taaacagtattaacacagcc

SEQ ID NO: 612196 - DNA, 20 bp, Artificial
  CRISPR gRNA sequence
agtattaacacagcctggcg

SEQ ID NO: 612197 - DNA, 20 bp, Artificial
  CRISPR gRNA sequence
attaacacagcctggcgcag

SEQ ID NO: 612198 - DNA, 20 bp, Artificial
  CRISPR gRNA sequence
gtggcacacgcctgtaatcc

SEQ ID NO: 612199 - DNA, 20 bp, Artificial
  CRISPR gRNA sequence
cgcctgtaatcccagcactt

SEQ ID NO: 612200 - DNA, 20 bp, Artificial
  CRISPR gRNA sequence
gcctgtaatcccagcacttt

SEQ ID NO: 612201 - DNA, 20 bp, Artificial
  CRISPR gRNA sequence
ctgtaatcccagcactttgg

SEQ ID NO: 612202 - DNA, 20 bp, Artificial
  CRISPR gRNA sequence
tgtaatcccagcactttggg

SEQ ID NO: 612203 - DNA, 20 bp, Artificial
  CRISPR gRNA sequence
tcccagcactttgggaggct

SEQ ID NO: 612204 - DNA, 20 bp, Artificial
  CRISPR gRNA sequence
cccagcactttgggaggctg

SEQ ID NO: 612205 - DNA, 20 bp, Artificial
  CRISPR gRNA sequence
agcactttgggaggctgagg

SEQ ID NO: 612206 - DNA, 20 bp, Artificial
  CRISPR gRNA sequence
gcactttgggaggctgaggc

SEQ ID NO: 612207 - DNA, 20 bp, Artificial
  CRISPR gRNA sequence
ctttgggaggctgaggcggg

SEQ ID NO: 612208 - DNA, 20 bp, Artificial
  CRISPR gRNA sequence
ctgaggcgggcggatcactt

SEQ ID NO: 612209 - DNA, 20 bp, Artificial
  CRISPR gRNA sequence
tgaggcgggcggatcacttg

SEQ ID NO: 612210 - DNA, 20 bp, Artificial
  CRISPR gRNA sequence
gcgggcggatcacttgaggt

SEQ ID NO: 612211 - DNA, 20 bp, Artificial
  CRISPR gRNA sequence
cgggcggatcacttgaggtc

SEQ ID NO: 612212 - DNA, 20 bp, Artificial
  CRISPR gRNA sequence
ggcggatcacttgaggtcag

SEQ ID NO: 612213 - DNA, 20 bp, Artificial
  CRISPR gRNA sequence
tcacttgaggtcaggagttc

SEQ ID NO: 612214 - DNA, 20 bp, Artificial
  CRISPR gRNA sequence
tgaggtcaggagttcaagac

SEQ ID NO: 612215 - DNA, 20 bp, Artificial
  CRISPR gRNA sequence
tcaggagttcaagaccagcc

SEQ ID NO: 612216 - DNA, 20 bp, Artificial
  CRISPR gRNA sequence
caagaccagcctggccaacg

SEQ ID NO: 612217 - DNA, 20 bp, Artificial
  CRISPR gRNA sequence
tctactaaaaatacaaaaat

SEQ ID NO: 612218 - DNA, 20 bp, Artificial
  CRISPR gRNA sequence
ctaaaaatacaaaaattagc

SEQ ID NO: 612219 - DNA, 20 bp, Artificial
  CRISPR gRNA sequence
atacaaaaattagccagacg

SEQ ID NO: 612220 - DNA, 20 bp, Artificial
  CRISPR gRNA sequence
caaaaattagccagacgtgg

SEQ ID NO: 612221 - DNA, 20 bp, Artificial
  CRISPR gRNA sequence
gacgtggtggcacgtgcctg

SEQ ID NO: 612222 - DNA, 20 bp, Artificial
  CRISPR gRNA sequence
gtggcacgtgcctgtagtcc

SEQ ID NO: 612223 - DNA, 20 bp, Artificial
  CRISPR gRNA sequence
tgcctgtagtcccagctact

SEQ ID NO: 612224 - DNA, 20 bp, Artificial
  CRISPR gRNA sequence
gcctgtagtcccagctactc

SEQ ID NO: 612225 - DNA, 20 bp, Artificial
  CRISPR gRNA sequence
ctgtagtcccagctactcag

SEQ ID NO: 612226 - DNA, 20 bp, Artificial
  CRISPR gRNA sequence
tgtagtcccagctactcagg

SEQ ID NO: 612227 - DNA, 20 bp, Artificial
  CRISPR gRNA sequence
tcccagctactcaggaggct

SEQ ID NO: 612228 - DNA, 20 bp, Artificial
  CRISPR gRNA sequence
cccagctactcaggaggctg

SEQ ID NO: 612229 - DNA, 20 bp, Artificial
  CRISPR gRNA sequence
gctactcaggaggctgaggc

SEQ ID NO: 612230 - DNA, 20 bp, Artificial
  CRISPR gRNA sequence
tactcaggaggctgaggctg

SEQ ID NO: 612231 - DNA, 20 bp, Artificial
  CRISPR gRNA sequence
gctggagaatcatttgaacc

SEQ ID NO: 612232 - DNA, 20 bp, Artificial
  CRISPR gRNA sequence
ctggagaatcatttgaaccc

SEQ ID NO: 612233 - DNA, 20 bp, Artificial
  CRISPR gRNA sequence
ggagaatcatttgaacccag

SEQ ID NO: 612234 - DNA, 20 bp, Artificial
  CRISPR gRNA sequence
gagaatcatttgaacccagg

SEQ ID NO: 612235 - DNA, 20 bp, Artificial
  CRISPR gRNA sequence
aatcatttgaacccaggagg

SEQ ID NO: 612236 - DNA, 20 bp, Artificial
  CRISPR gRNA sequence
tcatttgaacccaggaggtg

SEQ ID NO: 612237 - DNA, 20 bp, Artificial
  CRISPR gRNA sequence
catttgaacccaggaggtgg

SEQ ID NO: 612238 - DNA, 20 bp, Artificial
  CRISPR gRNA sequence
aacccaggaggtggaggttg

SEQ ID NO: 612239 - DNA, 20 bp, Artificial
  CRISPR gRNA sequence
ggtggaggttgcagtgatcc

SEQ ID NO: 612240 - DNA, 20 bp, Artificial
  CRISPR gRNA sequence
gtggaggttgcagtgatccg

SEQ ID NO: 612241 - DNA, 20 bp, Artificial
  CRISPR gRNA sequence
gaggttgcagtgatccgagg

SEQ ID NO: 612242 - DNA, 20 bp, Artificial
  CRISPR gRNA sequence
gcagtgatccgaggtggcac

SEQ ID NO: 612243 - DNA, 20 bp, Artificial
  CRISPR gRNA sequence
accagtgcactcctgccctc

SEQ ID NO: 612244 - DNA, 20 bp, Artificial
  CRISPR gRNA sequence
tgcactcctgccctccagtc

SEQ ID NO: 612245 - DNA, 20 bp, Artificial
  CRISPR gRNA sequence
gcactcctgccctccagtct

SEQ ID NO: 612246 - DNA, 20 bp, Artificial
  CRISPR gRNA sequence
ctgccctccagtctgggcga

SEQ ID NO: 612247 - DNA, 20 bp, Artificial
  CRISPR gRNA sequence
gccctccagtctgggcgaca

SEQ ID NO: 612248 - DNA, 20 bp, Artificial
  CRISPR gRNA sequence
tccagtctgggcgacagagc

SEQ ID NO: 612249 - DNA, 20 bp, Artificial
  CRISPR gRNA sequence
ccaaacaaaaaaaaaaaaaa

SEQ ID NO: 612250 - DNA, 20 bp, Artificial
  CRISPR gRNA sequence
aaaaaaaaaaaaaagaaaaa

SEQ ID NO: 612251 - DNA, 20 bp, Artificial
  CRISPR gRNA sequence
aagaaaaatagtactaatgc

SEQ ID NO: 612252 - DNA, 20 bp, Artificial
  CRISPR gRNA sequence
cctcttttattgtcataatg

SEQ ID NO: 612253 - DNA, 20 bp, Artificial
  CRISPR gRNA sequence
tcataatgcagtgttcttca

SEQ ID NO: 612254 - DNA, 20 bp, Artificial
  CRISPR gRNA sequence
atatttacttgcgaaattaa

SEQ ID NO: 612255 - DNA, 20 bp, Artificial
  CRISPR gRNA sequence
ataaaaaattgtactatatt

SEQ ID NO: 612256 - DNA, 20 bp, Artificial
  CRISPR gRNA sequence
tgtactatatttagtttttt

SEQ ID NO: 612257 - DNA, 20 bp, Artificial
  CRISPR gRNA sequence
ttagtttttttggaaaacgt

SEQ ID NO: 612258 - DNA, 20 bp, Artificial
  CRISPR gRNA sequence
tagtttttttggaaaacgtt

SEQ ID NO: 612259 - DNA, 20 bp, Artificial
  CRISPR gRNA sequence
tggaaaacgttgggttaaat

SEQ ID NO: 612260 - DNA, 20 bp, Artificial
  CRISPR gRNA sequence
tgtttgcttttttgttattg

SEQ ID NO: 612261 - DNA, 20 bp, Artificial
  CRISPR gRNA sequence
tattgaagctaaacatccaa

SEQ ID NO: 612262 - DNA, 20 bp, Artificial
  CRISPR gRNA sequence
catatacattgtaaatctct

SEQ ID NO: 612263 - DNA, 20 bp, Artificial
  CRISPR gRNA sequence
gcattaaatatactgtctca

SEQ ID NO: 612264 - DNA, 20 bp, Artificial
  CRISPR gRNA sequence
ccccccaccctcaactactt

SEQ ID NO: 612265 - DNA, 20 bp, Artificial
  CRISPR gRNA sequence
ctactttagtaaactgtcct

SEQ ID NO: 612266 - DNA, 20 bp, Artificial
  CRISPR gRNA sequence
actttagtaaactgtcctta

SEQ ID NO: 612267 - DNA, 20 bp, Artificial
  CRISPR gRNA sequence
tttagtaaactgtccttaga

SEQ ID NO: 612268 - DNA, 20 bp, Artificial
  CRISPR gRNA sequence
aactgtccttagagagataa

SEQ ID NO: 612269 - DNA, 20 bp, Artificial
  CRISPR gRNA sequence
tttactgtaatgatttttga

SEQ ID NO: 612270 - DNA, 20 bp, Artificial
  CRISPR gRNA sequence
tcctgaaatgatttcatata

SEQ ID NO: 612271 - DNA, 20 bp, Artificial
  CRISPR gRNA sequence
ctgaaatgatttcatataaa

SEQ ID NO: 612272 - DNA, 20 bp, Artificial
  CRISPR gRNA sequence
tataaagagattctctttga

SEQ ID NO: 612273 - DNA, 20 bp, Artificial
  CRISPR gRNA sequence
ttgaaagatatctcactttt

SEQ ID NO: 612274 - DNA, 20 bp, Artificial
  CRISPR gRNA sequence
tgaaagatatctcacttttc

SEQ ID NO: 612275 - DNA, 20 bp, Artificial
  CRISPR gRNA sequence
aagatatctcacttttcagg

SEQ ID NO: 612276 - DNA, 20 bp, Artificial
  CRISPR gRNA sequence
gatatctcacttttcaggta

SEQ ID NO: 612277 - DNA, 20 bp, Artificial
  CRISPR gRNA sequence
tttcattaaaaaaataaacc

SEQ ID NO: 612278 - DNA, 20 bp, Artificial
  CRISPR gRNA sequence
tcattaaaaaaataaaccta

SEQ ID NO: 612279 - DNA, 20 bp, Artificial
  CRISPR gRNA sequence
aaaataaacctagagtcatt

SEQ ID NO: 612280 - DNA, 20 bp, Artificial
  CRISPR gRNA sequence
tagagtcattaagacttcta

SEQ ID NO: 612281 - DNA, 20 bp, Artificial
  CRISPR gRNA sequence
cattaagacttctaaagatt

SEQ ID NO: 612282 - DNA, 20 bp, Artificial
  CRISPR gRNA sequence
tctaaagatttagaaaaaaa

SEQ ID NO: 612283 - DNA, 20 bp, Artificial
  CRISPR gRNA sequence
aaagatttagaaaaaaaaag

SEQ ID NO: 612284 - DNA, 20 bp, Artificial
  CRISPR gRNA sequence
aagatttagaaaaaaaaagt

SEQ ID NO: 612285 - DNA, 20 bp, Artificial
  CRISPR gRNA sequence
ttagaaaaaaaaagtaggtg

SEQ ID NO: 612286 - DNA, 20 bp, Artificial
  CRISPR gRNA sequence
atttctaaaaaattccatat

SEQ ID NO: 612287 - DNA, 20 bp, Artificial
  CRISPR gRNA sequence
tttctaaaaaattccatatc

SEQ ID NO: 612288 - DNA, 20 bp, Artificial
  CRISPR gRNA sequence
ctaaaaaattccatatcagg

SEQ ID NO: 612289 - DNA, 20 bp, Artificial
  CRISPR gRNA sequence
cagaattttaaaacttaaaa

SEQ ID NO: 612290 - DNA, 20 bp, Artificial
  CRISPR gRNA sequence
ttttaaaacttaaaacagta

SEQ ID NO: 612291 - DNA, 20 bp, Artificial
  CRISPR gRNA sequence
acagtaaagaaatcacaacg

SEQ ID NO: 612292 - DNA, 20 bp, Artificial
  CRISPR gRNA sequence
cagtaaagaaatcacaacgt

SEQ ID NO: 612293 - DNA, 20 bp, Artificial
  CRISPR gRNA sequence
ctaccaacaattttgaccac

SEQ ID NO: 612294 - DNA, 20 bp, Artificial
  CRISPR gRNA sequence
aaacctctaaacctcaaaaa

SEQ ID NO: 612295 - DNA, 20 bp, Artificial
  CRISPR gRNA sequence
ctaaacctcaaaaaaagcat

SEQ ID NO: 612296 - DNA, 20 bp, Artificial
  CRISPR gRNA sequence
caaaaaaagcataagtcaaa

SEQ ID NO: 612297 - DNA, 20 bp, Artificial
  CRISPR gRNA sequence
aaaaaaagcataagtcaaat

SEQ ID NO: 612298 - DNA, 20 bp, Artificial
  CRISPR gRNA sequence
aaagcataagtcaaataggt

SEQ ID NO: 612299 - DNA, 20 bp, Artificial
  CRISPR gRNA sequence
ataagtcaaataggtaagtc

SEQ ID NO: 612300 - DNA, 20 bp, Artificial
  CRISPR gRNA sequence
aaataggtaagtcaagaaat

SEQ ID NO: 612301 - DNA, 20 bp, Artificial
  CRISPR gRNA sequence
gtaagtcaagaaataagtca

SEQ ID NO: 612302 - DNA, 20 bp, Artificial
  CRISPR gRNA sequence
taagtcaagaaataagtcaa

SEQ ID NO: 612303 - DNA, 20 bp, Artificial
  CRISPR gRNA sequence
gtcaaaggcgttaatatata

SEQ ID NO: 612304 - DNA, 20 bp, Artificial
  CRISPR gRNA sequence
caaaggcgttaatatataca

SEQ ID NO: 612305 - DNA, 20 bp, Artificial
  CRISPR gRNA sequence
caatttctgatcaatttatt

SEQ ID NO: 612306 - DNA, 20 bp, Artificial
  CRISPR gRNA sequence
ttctgatcaatttattcaga

SEQ ID NO: 612307 - DNA, 20 bp, Artificial
  CRISPR gRNA sequence
caatttattcagaaagacaa

SEQ ID NO: 612308 - DNA, 20 bp, Artificial
  CRISPR gRNA sequence
tttattcagaaagacaaaag

SEQ ID NO: 612309 - DNA, 20 bp, Artificial
  CRISPR gRNA sequence
ttcagaaagacaaaagcagt

SEQ ID NO: 612310 - DNA, 20 bp, Artificial
  CRISPR gRNA sequence
gtaagaccataatttaaaaa

SEQ ID NO: 612311 - DNA, 20 bp, Artificial
  CRISPR gRNA sequence
taagaccataatttaaaaat

SEQ ID NO: 612312 - DNA, 20 bp, Artificial
  CRISPR gRNA sequence
ccataatttaaaaataggtg

SEQ ID NO: 612313 - DNA, 20 bp, Artificial
  CRISPR gRNA sequence
cataatttaaaaataggtga

SEQ ID NO: 612314 - DNA, 20 bp, Artificial
  CRISPR gRNA sequence
aaataggtgaaggcatgaaa

SEQ ID NO: 612315 - DNA, 20 bp, Artificial
  CRISPR gRNA sequence
gcatgaaatagatcatttga

SEQ ID NO: 612316 - DNA, 20 bp, Artificial
  CRISPR gRNA sequence
catgaaatagatcatttgaa

SEQ ID NO: 612317 - DNA, 20 bp, Artificial
  CRISPR gRNA sequence
aaatagatcatttgaaagga

SEQ ID NO: 612318 - DNA, 20 bp, Artificial
  CRISPR gRNA sequence
atatttcgtttcactaatgc

SEQ ID NO: 612319 - DNA, 20 bp, Artificial
  CRISPR gRNA sequence
tttcactaatgcaagtgtaa

SEQ ID NO: 612320 - DNA, 20 bp, Artificial
  CRISPR gRNA sequence
acaaattacattttattacc

SEQ ID NO: 612321 - DNA, 20 bp, Artificial
  CRISPR gRNA sequence
ttacattttattacctagct

SEQ ID NO: 612322 - DNA, 20 bp, Artificial
  CRISPR gRNA sequence
cagtgtttcccaaactttct

SEQ ID NO: 612323 - DNA, 20 bp, Artificial
  CRISPR gRNA sequence
ttcttggttcattgtgactg

SEQ ID NO: 612324 - DNA, 20 bp, Artificial
  CRISPR gRNA sequence
gtgtcttaataattttgtca

SEQ ID NO: 612325 - DNA, 20 bp, Artificial
  CRISPR gRNA sequence
taattttgtcaaagttcatt

SEQ ID NO: 612326 - DNA, 20 bp, Artificial
  CRISPR gRNA sequence
aattttgtcaaagttcattt

SEQ ID NO: 612327 - DNA, 20 bp, Artificial
  CRISPR gRNA sequence
attttgtcaaagttcattta

SEQ ID NO: 612328 - DNA, 20 bp, Artificial
  CRISPR gRNA sequence
caaagttcatttagggctaa

SEQ ID NO: 612329 - DNA, 20 bp, Artificial
  CRISPR gRNA sequence
gggctaaaagtaatactgaa

SEQ ID NO: 612330 - DNA, 20 bp, Artificial
  CRISPR gRNA sequence
ctgaaaagtttcattttatt

SEQ ID NO: 612331 - DNA, 20 bp, Artificial
  CRISPR gRNA sequence
aaaagtttcattttattaag

SEQ ID NO: 612332 - DNA, 20 bp, Artificial
  CRISPR gRNA sequence
gtttcattttattaagtagt

SEQ ID NO: 612333 - DNA, 20 bp, Artificial
  CRISPR gRNA sequence
tttcattttattaagtagta

SEQ ID NO: 612334 - DNA, 20 bp, Artificial
  CRISPR gRNA sequence
ctaacaactttttatccatt

SEQ ID NO: 612335 - DNA, 20 bp, Artificial
  CRISPR gRNA sequence
taacaactttttatccattt

SEQ ID NO: 612336 - DNA, 20 bp, Artificial
  CRISPR gRNA sequence
atataaattgaaacccaaaa

SEQ ID NO: 612337 - DNA, 20 bp, Artificial
  CRISPR gRNA sequence
tataaattgaaacccaaaac

SEQ ID NO: 612338 - DNA, 20 bp, Artificial
  CRISPR gRNA sequence
ataaattgaaacccaaaaca

SEQ ID NO: 612339 - DNA, 20 bp, Artificial
  CRISPR gRNA sequence
tttgttttgttttttcatct

SEQ ID NO: 612340 - DNA, 20 bp, Artificial
  CRISPR gRNA sequence
ttttgttttttcatcttaga

SEQ ID NO: 612341 - DNA, 20 bp, Artificial
  CRISPR gRNA sequence
tttttcatcttagatggcca

SEQ ID NO: 612342 - DNA, 20 bp, Artificial
  CRISPR gRNA sequence
tggccacagttacttactaa

SEQ ID NO: 612343 - DNA, 20 bp, Artificial
  CRISPR gRNA sequence
ggccacagttacttactaat

SEQ ID NO: 612344 - DNA, 20 bp, Artificial
  CRISPR gRNA sequence
acagttacttactaatggga

SEQ ID NO: 612345 - DNA, 20 bp, Artificial
  CRISPR gRNA sequence
aatgggatggtatgccttgt

SEQ ID NO: 612346 - DNA, 20 bp, Artificial
  CRISPR gRNA sequence
atgggatggtatgccttgtt

SEQ ID NO: 612347 - DNA, 20 bp, Artificial
  CRISPR gRNA sequence
tgccttgttgggcataccat

SEQ ID NO: 612348 - DNA, 20 bp, Artificial
  CRISPR gRNA sequence
ttgttgggcataccattagt

SEQ ID NO: 612349 - DNA, 20 bp, Artificial
  CRISPR gRNA sequence
accattagtaagtgaaatcg

SEQ ID NO: 612350 - DNA, 20 bp, Artificial
  CRISPR gRNA sequence
aaatcgaagactgattatat

SEQ ID NO: 612351 - DNA, 20 bp, Artificial
  CRISPR gRNA sequence
tcgaagactgattatatgag

SEQ ID NO: 612352 - DNA, 20 bp, Artificial
  CRISPR gRNA sequence
atatgagaagatcaataaaa

SEQ ID NO: 612353 - DNA, 20 bp, Artificial
  CRISPR gRNA sequence
caataaaatagataaacctc

SEQ ID NO: 612354 - DNA, 20 bp, Artificial
  CRISPR gRNA sequence
aaaatagataaacctctagc

SEQ ID NO: 612355 - DNA, 20 bp, Artificial
  CRISPR gRNA sequence
gcaagatcaatcaatattaa

SEQ ID NO: 612356 - DNA, 20 bp, Artificial
  CRISPR gRNA sequence
tattaaaagaacacataatt

SEQ ID NO: 612357 - DNA, 20 bp, Artificial
  CRISPR gRNA sequence
acacataatttggcatcatc

SEQ ID NO: 612358 - DNA, 20 bp, Artificial
  CRISPR gRNA sequence
gcatcatctagaataaaaac

SEQ ID NO: 612359 - DNA, 20 bp, Artificial
  CRISPR gRNA sequence
ggaaatcactaaaaatcctg

SEQ ID NO: 612360 - DNA, 20 bp, Artificial
  CRISPR gRNA sequence
actaaaaatcctgtagccat

SEQ ID NO: 612361 - DNA, 20 bp, Artificial
  CRISPR gRNA sequence
taaaaatcctgtagccattg

SEQ ID NO: 612362 - DNA, 20 bp, Artificial
  CRISPR gRNA sequence
aaaaatcctgtagccattgg

SEQ ID NO: 612363 - DNA, 20 bp, Artificial
  CRISPR gRNA sequence
tagccattggaggcataata

SEQ ID NO: 612364 - DNA, 20 bp, Artificial
  CRISPR gRNA sequence
agccattggaggcataatat

SEQ ID NO: 612365 - DNA, 20 bp, Artificial
  CRISPR gRNA sequence
gccattggaggcataatatg

SEQ ID NO: 612366 - DNA, 20 bp, Artificial
  CRISPR gRNA sequence
gaacaactttatgtcaaatt

SEQ ID NO: 612367 - DNA, 20 bp, Artificial
  CRISPR gRNA sequence
aactttatgtcaaattcagc

SEQ ID NO: 612368 - DNA, 20 bp, Artificial
  CRISPR gRNA sequence
cagctagatgaaataaaaaa

SEQ ID NO: 612369 - DNA, 20 bp, Artificial
  CRISPR gRNA sequence
agaaattattgactctcatt

SEQ ID NO: 612370 - DNA, 20 bp, Artificial
  CRISPR gRNA sequence
gaaattattgactctcattc

SEQ ID NO: 612371 - DNA, 20 bp, Artificial
  CRISPR gRNA sequence
attattgactctcattcagg

SEQ ID NO: 612372 - DNA, 20 bp, Artificial
  CRISPR gRNA sequence
gaagaaatatacactctgaa

SEQ ID NO: 612373 - DNA, 20 bp, Artificial
  CRISPR gRNA sequence
tgaatagcccacatttattc

SEQ ID NO: 612374 - DNA, 20 bp, Artificial
  CRISPR gRNA sequence
gaatagcccacatttattcc

SEQ ID NO: 612375 - DNA, 20 bp, Artificial
  CRISPR gRNA sequence
tattccaggaattgaaattg

SEQ ID NO: 612376 - DNA, 20 bp, Artificial
  CRISPR gRNA sequence
aagttaaaaaccttcccaca

SEQ ID NO: 612377 - DNA, 20 bp, Artificial
  CRISPR gRNA sequence
ccttcccacaaagaaaactc

SEQ ID NO: 612378 - DNA, 20 bp, Artificial
  CRISPR gRNA sequence
aaaactccagatgacttcac

SEQ ID NO: 612379 - DNA, 20 bp, Artificial
  CRISPR gRNA sequence
gtaaattctgtcaaatattt

SEQ ID NO: 612380 - DNA, 20 bp, Artificial
  CRISPR gRNA sequence
taaattctgtcaaatattta

SEQ ID NO: 612381 - DNA, 20 bp, Artificial
  CRISPR gRNA sequence
atttaaggaaaatgtaattt

SEQ ID NO: 612382 - DNA, 20 bp, Artificial
  CRISPR gRNA sequence
gtaatttaagaaaaacacta

SEQ ID NO: 612383 - DNA, 20 bp, Artificial
  CRISPR gRNA sequence
taatttaagaaaaacactaa

SEQ ID NO: 612384 - DNA, 20 bp, Artificial
  CRISPR gRNA sequence
actaaaggaacaaattcctc

SEQ ID NO: 612385 - DNA, 20 bp, Artificial
  CRISPR gRNA sequence
gaacaaattcctccagacaa

SEQ ID NO: 612386 - DNA, 20 bp, Artificial
  CRISPR gRNA sequence
aattcctccagacaatagaa

SEQ ID NO: 612387 - DNA, 20 bp, Artificial
  CRISPR gRNA sequence
attcctccagacaatagaaa

SEQ ID NO: 612388 - DNA, 20 bp, Artificial
  CRISPR gRNA sequence
ttcctccagacaatagaaaa

SEQ ID NO: 612389 - DNA, 20 bp, Artificial
  CRISPR gRNA sequence
cctccagacaatagaaaagg

SEQ ID NO: 612390 - DNA, 20 bp, Artificial
  CRISPR gRNA sequence
ctccagacaatagaaaaggg

SEQ ID NO: 612391 - DNA, 20 bp, Artificial
  CRISPR gRNA sequence
ccagacaatagaaaagggag

SEQ ID NO: 612392 - DNA, 20 bp, Artificial
  CRISPR gRNA sequence
cagacaatagaaaagggagg

SEQ ID NO: 612393 - DNA, 20 bp, Artificial
  CRISPR gRNA sequence
agacaatagaaaagggagga

SEQ ID NO: 612394 - DNA, 20 bp, Artificial
  CRISPR gRNA sequence
acaatagaaaagggaggagg

SEQ ID NO: 612395 - DNA, 20 bp, Artificial
  CRISPR gRNA sequence
caatagaaaagggaggaggg

SEQ ID NO: 612396 - DNA, 20 bp, Artificial
  CRISPR gRNA sequence
tccaaacaaattattatatt

SEQ ID NO: 612397 - DNA, 20 bp, Artificial
  CRISPR gRNA sequence
ttactctgacaccaaaatca

SEQ ID NO: 612398 - DNA, 20 bp, Artificial
  CRISPR gRNA sequence
accaaaatcaaagacattac

SEQ ID NO: 612399 - DNA, 20 bp, Artificial
  CRISPR gRNA sequence
aagaaaaaaatactgcataa

SEQ ID NO: 612400 - DNA, 20 bp, Artificial
  CRISPR gRNA sequence
taacggtattcttcatgatg

SEQ ID NO: 612401 - DNA, 20 bp, Artificial
  CRISPR gRNA sequence
tcttcatgatgcagatgcaa

SEQ ID NO: 612402 - DNA, 20 bp, Artificial
  CRISPR gRNA sequence
aaattttaacacattgaatc

SEQ ID NO: 612403 - DNA, 20 bp, Artificial
  CRISPR gRNA sequence
ttgaatctggaatatataaa

SEQ ID NO: 612404 - DNA, 20 bp, Artificial
  CRISPR gRNA sequence
tgaatctggaatatataaaa

SEQ ID NO: 612405 - DNA, 20 bp, Artificial
  CRISPR gRNA sequence
aaggataatatatcatgacc

SEQ ID NO: 612406 - DNA, 20 bp, Artificial
  CRISPR gRNA sequence
gataatatatcatgaccaag

SEQ ID NO: 612407 - DNA, 20 bp, Artificial
  CRISPR gRNA sequence
ataatatatcatgaccaagt

SEQ ID NO: 612408 - DNA, 20 bp, Artificial
  CRISPR gRNA sequence
tgaccaagtgggatttatct

SEQ ID NO: 612409 - DNA, 20 bp, Artificial
  CRISPR gRNA sequence
gaccaagtgggatttatctt

SEQ ID NO: 612410 - DNA, 20 bp, Artificial
  CRISPR gRNA sequence
ggatttatcttaggaattta

SEQ ID NO: 612411 - DNA, 20 bp, Artificial
  CRISPR gRNA sequence
ttatcttaggaatttaaagt

SEQ ID NO: 612412 - DNA, 20 bp, Artificial
  CRISPR gRNA sequence
atttaaagttggtttaacat

SEQ ID NO: 612413 - DNA, 20 bp, Artificial
  CRISPR gRNA sequence
tttaaagttggtttaacatt

SEQ ID NO: 612414 - DNA, 20 bp, Artificial
  CRISPR gRNA sequence
aatgtaattttccatattaa

SEQ ID NO: 612415 - DNA, 20 bp, Artificial
  CRISPR gRNA sequence
tccatattaacagactaaaa

SEQ ID NO: 612416 - DNA, 20 bp, Artificial
  CRISPR gRNA sequence
attaacagactaaaaaagaa

SEQ ID NO: 612417 - DNA, 20 bp, Artificial
  CRISPR gRNA sequence
gactaaaaaagaaaagattt

SEQ ID NO: 612418 - DNA, 20 bp, Artificial
  CRISPR gRNA sequence
aagattttagtctgtcttta

SEQ ID NO: 612419 - DNA, 20 bp, Artificial
  CRISPR gRNA sequence
ttagtctgtctttaaagttt

SEQ ID NO: 612420 - DNA, 20 bp, Artificial
  CRISPR gRNA sequence
tgtctttaaagtttcagaaa

SEQ ID NO: 612421 - DNA, 20 bp, Artificial
  CRISPR gRNA sequence
aaaaagtatttgacataatt

SEQ ID NO: 612422 - DNA, 20 bp, Artificial
  CRISPR gRNA sequence
tataaaaattctctgcaact

SEQ ID NO: 612423 - DNA, 20 bp, Artificial
  CRISPR gRNA sequence
aaaaattctctgcaactgag

SEQ ID NO: 612424 - DNA, 20 bp, Artificial
  CRISPR gRNA sequence
ttctctgcaactgagtagaa

SEQ ID NO: 612425 - DNA, 20 bp, Artificial
  CRISPR gRNA sequence
aaagaacttcctcatcatga

SEQ ID NO: 612426 - DNA, 20 bp, Artificial
  CRISPR gRNA sequence
catgatggttatcatttgat

SEQ ID NO: 612427 - DNA, 20 bp, Artificial
  CRISPR gRNA sequence
tatcatttgatgagtgtaat

SEQ ID NO: 612428 - DNA, 20 bp, Artificial
  CRISPR gRNA sequence
atgagtgtaataagaaaata

SEQ ID NO: 612429 - DNA, 20 bp, Artificial
  CRISPR gRNA sequence
aataagaaaatatggacact

SEQ ID NO: 612430 - DNA, 20 bp, Artificial
  CRISPR gRNA sequence
ataagaaaatatggacactt

SEQ ID NO: 612431 - DNA, 20 bp, Artificial
  CRISPR gRNA sequence
cttaggttgatgccatatct

SEQ ID NO: 612432 - DNA, 20 bp, Artificial
  CRISPR gRNA sequence
gtgaaatgatgtaataaaca

SEQ ID NO: 612433 - DNA, 20 bp, Artificial
  CRISPR gRNA sequence
aaatatttctttgacatact

SEQ ID NO: 612434 - DNA, 20 bp, Artificial
  CRISPR gRNA sequence
tcaaatgtatttctatatgc

SEQ ID NO: 612435 - DNA, 20 bp, Artificial
  CRISPR gRNA sequence
caaatgtatttctatatgct

SEQ ID NO: 612436 - DNA, 20 bp, Artificial
  CRISPR gRNA sequence
ttctatatgctaggaatgaa

SEQ ID NO: 612437 - DNA, 20 bp, Artificial
  CRISPR gRNA sequence
atatgctaggaatgaacagt

SEQ ID NO: 612438 - DNA, 20 bp, Artificial
  CRISPR gRNA sequence
aggaatgaacagttggacat

SEQ ID NO: 612439 - DNA, 20 bp, Artificial
  CRISPR gRNA sequence
aacagttggacattggaatt

SEQ ID NO: 612440 - DNA, 20 bp, Artificial
  CRISPR gRNA sequence
gttggacattggaatttaga

SEQ ID NO: 612441 - DNA, 20 bp, Artificial
  CRISPR gRNA sequence
cccaaaatgtatgaaatact

SEQ ID NO: 612442 - DNA, 20 bp, Artificial
  CRISPR gRNA sequence
caaaatgtatgaaatactta

SEQ ID NO: 612443 - DNA, 20 bp, Artificial
  CRISPR gRNA sequence
gaaatacttagagttaaatt

SEQ ID NO: 612444 - DNA, 20 bp, Artificial
  CRISPR gRNA sequence
ttaaattaagtaatatgtgt

SEQ ID NO: 612445 - DNA, 20 bp, Artificial
  CRISPR gRNA sequence
taaaatcataacacattgct

SEQ ID NO: 612446 - DNA, 20 bp, Artificial
  CRISPR gRNA sequence
cacattgctgagataaatta

SEQ ID NO: 612447 - DNA, 20 bp, Artificial
  CRISPR gRNA sequence
attaaagacttcaataaatg

SEQ ID NO: 612448 - DNA, 20 bp, Artificial
  CRISPR gRNA sequence
taaagacttcaataaatgca

SEQ ID NO: 612449 - DNA, 20 bp, Artificial
  CRISPR gRNA sequence
acttcaataaatgcagagat

SEQ ID NO: 612450 - DNA, 20 bp, Artificial
  CRISPR gRNA sequence
gagacattatcatgatttaa

SEQ ID NO: 612451 - DNA, 20 bp, Artificial
  CRISPR gRNA sequence
ttatcatgatttaaaagatt

SEQ ID NO: 612452 - DNA, 20 bp, Artificial
  CRISPR gRNA sequence
ttaaaagattcagtattgtt

SEQ ID NO: 612453 - DNA, 20 bp, Artificial
  CRISPR gRNA sequence
attcagtattgttaagatgt

SEQ ID NO: 612454 - DNA, 20 bp, Artificial
  CRISPR gRNA sequence
tgttggtttctcctgaaatc

SEQ ID NO: 612455 - DNA, 20 bp, Artificial
  CRISPR gRNA sequence
tctcctgaaatcgagtctgt

SEQ ID NO: 612456 - DNA, 20 bp, Artificial
  CRISPR gRNA sequence
tgaaatcgagtctgtcagtt

SEQ ID NO: 612457 - DNA, 20 bp, Artificial
  CRISPR gRNA sequence
gaaatcgagtctgtcagttc

SEQ ID NO: 612458 - DNA, 20 bp, Artificial
  CRISPR gRNA sequence
aaatcgagtctgtcagttca

SEQ ID NO: 612459 - DNA, 20 bp, Artificial
  CRISPR gRNA sequence
ctgtcagttcagggcaattt

SEQ ID NO: 612460 - DNA, 20 bp, Artificial
  CRISPR gRNA sequence
atttcagtcaaaatcccaac

SEQ ID NO: 612461 - DNA, 20 bp, Artificial
  CRISPR gRNA sequence
aatcccaacaagctttttaa

SEQ ID NO: 612462 - DNA, 20 bp, Artificial
  CRISPR gRNA sequence
acaagctttttaacagaaat

SEQ ID NO: 612463 - DNA, 20 bp, Artificial
  CRISPR gRNA sequence
aactgattacaaactttgtt

SEQ ID NO: 612464 - DNA, 20 bp, Artificial
  CRISPR gRNA sequence
acaaactttgtttggaaatg

SEQ ID NO: 612465 - DNA, 20 bp, Artificial
  CRISPR gRNA sequence
ttggaaatgtagacctaaaa

SEQ ID NO: 612466 - DNA, 20 bp, Artificial
  CRISPR gRNA sequence
atagccaaaataattttgaa

SEQ ID NO: 612467 - DNA, 20 bp, Artificial
  CRISPR gRNA sequence
taattttgaaaagccaaatt

SEQ ID NO: 612468 - DNA, 20 bp, Artificial
  CRISPR gRNA sequence
ctgattccaaatctattcct

SEQ ID NO: 612469 - DNA, 20 bp, Artificial
  CRISPR gRNA sequence
attcctaagacttgctctgt

SEQ ID NO: 612470 - DNA, 20 bp, Artificial
  CRISPR gRNA sequence
aagacttgctctgttggttt

SEQ ID NO: 612471 - DNA, 20 bp, Artificial
  CRISPR gRNA sequence
ttgctctgttggtttaagta

SEQ ID NO: 612472 - DNA, 20 bp, Artificial
  CRISPR gRNA sequence
tgttggtttaagtatagaca

SEQ ID NO: 612473 - DNA, 20 bp, Artificial
  CRISPR gRNA sequence
ttggtttaagtatagacata

SEQ ID NO: 612474 - DNA, 20 bp, Artificial
  CRISPR gRNA sequence
tggtttaagtatagacatag

SEQ ID NO: 612475 - DNA, 20 bp, Artificial
  CRISPR gRNA sequence
agtatagacatagaggttaa

SEQ ID NO: 612476 - DNA, 20 bp, Artificial
  CRISPR gRNA sequence
agacatagaggttaatggaa

SEQ ID NO: 612477 - DNA, 20 bp, Artificial
  CRISPR gRNA sequence
tagaggttaatggaatggaa

SEQ ID NO: 612478 - DNA, 20 bp, Artificial
  CRISPR gRNA sequence
gaggttaatggaatggaata

SEQ ID NO: 612479 - DNA, 20 bp, Artificial
  CRISPR gRNA sequence
taatggaatggaatagagtc

SEQ ID NO: 612480 - DNA, 20 bp, Artificial
  CRISPR gRNA sequence
aatggaatagagtccagaaa

SEQ ID NO: 612481 - DNA, 20 bp, Artificial
  CRISPR gRNA sequence
tccagaaatagaacccaaat

SEQ ID NO: 612482 - DNA, 20 bp, Artificial
  CRISPR gRNA sequence
gaaatagaacccaaattggt

SEQ ID NO: 612483 - DNA, 20 bp, Artificial
  CRISPR gRNA sequence
tggtcagttgattttcaaca

SEQ ID NO: 612484 - DNA, 20 bp, Artificial
  CRISPR gRNA sequence
ggtcagttgattttcaacaa

SEQ ID NO: 612485 - DNA, 20 bp, Artificial
  CRISPR gRNA sequence
tgattttcaacaaaggtact

SEQ ID NO: 612486 - DNA, 20 bp, Artificial
  CRISPR gRNA sequence
caaaggtactgagataattt

SEQ ID NO: 612487 - DNA, 20 bp, Artificial
  CRISPR gRNA sequence
aaaggtactgagataattta

SEQ ID NO: 612488 - DNA, 20 bp, Artificial
  CRISPR gRNA sequence
aaggtactgagataatttaa

SEQ ID NO: 612489 - DNA, 20 bp, Artificial
  CRISPR gRNA sequence
aggtactgagataatttaag

SEQ ID NO: 612490 - DNA, 20 bp, Artificial
  CRISPR gRNA sequence
ggtactgagataatttaagg

SEQ ID NO: 612491 - DNA, 20 bp, Artificial
  CRISPR gRNA sequence
gtactgagataatttaaggg

SEQ ID NO: 612492 - DNA, 20 bp, Artificial
  CRISPR gRNA sequence
tgagataatttaagggggga

SEQ ID NO: 612493 - DNA, 20 bp, Artificial
  CRISPR gRNA sequence
gagataatttaaggggggaa

SEQ ID NO: 612494 - DNA, 20 bp, Artificial
  CRISPR gRNA sequence
aggataatattttctataaa

SEQ ID NO: 612495 - DNA, 20 bp, Artificial
  CRISPR gRNA sequence
ggataatattttctataaat

SEQ ID NO: 612496 - DNA, 20 bp, Artificial
  CRISPR gRNA sequence
atattttctataaatgggtc

SEQ ID NO: 612497 - DNA, 20 bp, Artificial
  CRISPR gRNA sequence
acccatatttttgaaaaaaa

SEQ ID NO: 612498 - DNA, 20 bp, Artificial
  CRISPR gRNA sequence
atttttgaaaaaaatggtct

SEQ ID NO: 612499 - DNA, 20 bp, Artificial
  CRISPR gRNA sequence
ttatgccatatataaaaatt

SEQ ID NO: 612500 - DNA, 20 bp, Artificial
  CRISPR gRNA sequence
atataaaaattaagttgaaa

SEQ ID NO: 612501 - DNA, 20 bp, Artificial
  CRISPR gRNA sequence
aaattaagttgaaatagcca

SEQ ID NO: 612502 - DNA, 20 bp, Artificial
  CRISPR gRNA sequence
ccatagacttttgacaacta

SEQ ID NO: 612503 - DNA, 20 bp, Artificial
  CRISPR gRNA sequence
atattctgcaatatgtgaac

SEQ ID NO: 612504 - DNA, 20 bp, Artificial
  CRISPR gRNA sequence
tagtatatacttattatata

SEQ ID NO: 612505 - DNA, 20 bp, Artificial
  CRISPR gRNA sequence
tatacttattatatatagta

SEQ ID NO: 612506 - DNA, 20 bp, Artificial
  CRISPR gRNA sequence
agtacagacacatatttctt

SEQ ID NO: 612507 - DNA, 20 bp, Artificial
  CRISPR gRNA sequence
tacagacacatatttcttga

SEQ ID NO: 612508 - DNA, 20 bp, Artificial
  CRISPR gRNA sequence
acagacacatatttcttgag

SEQ ID NO: 612509 - DNA, 20 bp, Artificial
  CRISPR gRNA sequence
acacatatttcttgagaggt

SEQ ID NO: 612510 - DNA, 20 bp, Artificial
  CRISPR gRNA sequence
cacatatttcttgagaggta

SEQ ID NO: 612511 - DNA, 20 bp, Artificial
  CRISPR gRNA sequence
acatatttcttgagaggtaa

SEQ ID NO: 612512 - DNA, 20 bp, Artificial
  CRISPR gRNA sequence
taagggacaaacatccaaat

SEQ ID NO: 612513 - DNA, 20 bp, Artificial
  CRISPR gRNA sequence
agggacaaacatccaaatta

SEQ ID NO: 612514 - DNA, 20 bp, Artificial
  CRISPR gRNA sequence
aacatccaaattagagactt

SEQ ID NO: 612515 - DNA, 20 bp, Artificial
  CRISPR gRNA sequence
ccaaattagagactttagac

SEQ ID NO: 612516 - DNA, 20 bp, Artificial
  CRISPR gRNA sequence
aaattagagactttagacca

SEQ ID NO: 612517 - DNA, 20 bp, Artificial
  CRISPR gRNA sequence
agagacatacgctcatattt

SEQ ID NO: 612518 - DNA, 20 bp, Artificial
  CRISPR gRNA sequence
acgctcatatttcagaattt

SEQ ID NO: 612519 - DNA, 20 bp, Artificial
  CRISPR gRNA sequence
tttcagaatttcagaacatc

SEQ ID NO: 612520 - DNA, 20 bp, Artificial
  CRISPR gRNA sequence
ttcagaatttcagaacatca

SEQ ID NO: 612521 - DNA, 20 bp, Artificial
  CRISPR gRNA sequence
agaacatcaaggacaaactg

SEQ ID NO: 612522 - DNA, 20 bp, Artificial
  CRISPR gRNA sequence
aaggacaaactgaagttact

SEQ ID NO: 612523 - DNA, 20 bp, Artificial
  CRISPR gRNA sequence
ggacaaactgaagttactaa

SEQ ID NO: 612524 - DNA, 20 bp, Artificial
  CRISPR gRNA sequence
ctgaagttactaagagcttt

SEQ ID NO: 612525 - DNA, 20 bp, Artificial
  CRISPR gRNA sequence
actaagagctttcagacaaa

SEQ ID NO: 612526 - DNA, 20 bp, Artificial
  CRISPR gRNA sequence
ctaagagctttcagacaaac

SEQ ID NO: 612527 - DNA, 20 bp, Artificial
  CRISPR gRNA sequence
agacaaacaggccacatata

SEQ ID NO: 612528 - DNA, 20 bp, Artificial
  CRISPR gRNA sequence
atttatataatacttttaaa

SEQ ID NO: 612529 - DNA, 20 bp, Artificial
  CRISPR gRNA sequence
atacttttaaaaagaaactt

SEQ ID NO: 612530 - DNA, 20 bp, Artificial
  CRISPR gRNA sequence
acttttaaaaagaaactttg

SEQ ID NO: 612531 - DNA, 20 bp, Artificial
  CRISPR gRNA sequence
cttttaaaaagaaactttgg

SEQ ID NO: 612532 - DNA, 20 bp, Artificial
  CRISPR gRNA sequence
taaaaagaaactttggaggt

SEQ ID NO: 612533 - DNA, 20 bp, Artificial
  CRISPR gRNA sequence
aaagaaactttggaggttag

SEQ ID NO: 612534 - DNA, 20 bp, Artificial
  CRISPR gRNA sequence
aactttggaggttagtagcc

SEQ ID NO: 612535 - DNA, 20 bp, Artificial
  CRISPR gRNA sequence
gttagtagcccagtgaaaaa

SEQ ID NO: 612536 - DNA, 20 bp, Artificial
  CRISPR gRNA sequence
ttagtagcccagtgaaaaaa

SEQ ID NO: 612537 - DNA, 20 bp, Artificial
  CRISPR gRNA sequence
aaaaaaggcttcaaaatgtt

SEQ ID NO: 612538 - DNA, 20 bp, Artificial
  CRISPR gRNA sequence
aaaaggcttcaaaatgttaa

SEQ ID NO: 612539 - DNA, 20 bp, Artificial
  CRISPR gRNA sequence
tcaaaatgttaagagaaaat

SEQ ID NO: 612540 - DNA, 20 bp, Artificial
  CRISPR gRNA sequence
agagaaaatgagtttcaacc

SEQ ID NO: 612541 - DNA, 20 bp, Artificial
  CRISPR gRNA sequence
tggaaattctaaacccaacg

SEQ ID NO: 612542 - DNA, 20 bp, Artificial
  CRISPR gRNA sequence
gaaattctaaacccaacgaa

SEQ ID NO: 612543 - DNA, 20 bp, Artificial
  CRISPR gRNA sequence
aaattctaaacccaacgaag

SEQ ID NO: 612544 - DNA, 20 bp, Artificial
  CRISPR gRNA sequence
acccaacgaagaggaaaaca

SEQ ID NO: 612545 - DNA, 20 bp, Artificial
  CRISPR gRNA sequence
cccaacgaagaggaaaacat

SEQ ID NO: 612546 - DNA, 20 bp, Artificial
  CRISPR gRNA sequence
gaagaggaaaacatgggatt

SEQ ID NO: 612547 - DNA, 20 bp, Artificial
  CRISPR gRNA sequence
aagaggaaaacatgggattc

SEQ ID NO: 612548 - DNA, 20 bp, Artificial
  CRISPR gRNA sequence
aggaaaacatgggattcagg

SEQ ID NO: 612549 - DNA, 20 bp, Artificial
  CRISPR gRNA sequence
aaaacatgggattcaggcag

SEQ ID NO: 612550 - DNA, 20 bp, Artificial
  CRISPR gRNA sequence
acatgggattcaggcagcag

SEQ ID NO: 612551 - DNA, 20 bp, Artificial
  CRISPR gRNA sequence
ggcagcagaagactaatcat

SEQ ID NO: 612552 - DNA, 20 bp, Artificial
  CRISPR gRNA sequence
gcagcagaagactaatcatg

SEQ ID NO: 612553 - DNA, 20 bp, Artificial
  CRISPR gRNA sequence
cagcagaagactaatcatga

SEQ ID NO: 612554 - DNA, 20 bp, Artificial
  CRISPR gRNA sequence
agcagaagactaatcatgag

SEQ ID NO: 612555 - DNA, 20 bp, Artificial
  CRISPR gRNA sequence
gcagaagactaatcatgagg

SEQ ID NO: 612556 - DNA, 20 bp, Artificial
  CRISPR gRNA sequence
gactaatcatgagggggaca

SEQ ID NO: 612557 - DNA, 20 bp, Artificial
  CRISPR gRNA sequence
actaatcatgagggggacaa

SEQ ID NO: 612558 - DNA, 20 bp, Artificial
  CRISPR gRNA sequence
atcatgagggggacaaagga

SEQ ID NO: 612559 - DNA, 20 bp, Artificial
  CRISPR gRNA sequence
agggggacaaaggaaagttc

SEQ ID NO: 612560 - DNA, 20 bp, Artificial
  CRISPR gRNA sequence
taacaactctgtaataaacc

SEQ ID NO: 612561 - DNA, 20 bp, Artificial
  CRISPR gRNA sequence
aacaactctgtaataaaccc

SEQ ID NO: 612562 - DNA, 20 bp, Artificial
  CRISPR gRNA sequence
acaactctgtaataaaccca

SEQ ID NO: 612563 - DNA, 20 bp, Artificial
  CRISPR gRNA sequence
taataaacccagggtaccat

SEQ ID NO: 612564 - DNA, 20 bp, Artificial
  CRISPR gRNA sequence
agggtaccatcagttccaac

SEQ ID NO: 612565 - DNA, 20 bp, Artificial
  CRISPR gRNA sequence
ggtaccatcagttccaactg

SEQ ID NO: 612566 - DNA, 20 bp, Artificial
  CRISPR gRNA sequence
ccatcagttccaactggaga

SEQ ID NO: 612567 - DNA, 20 bp, Artificial
  CRISPR gRNA sequence
catcagttccaactggagaa

SEQ ID NO: 612568 - DNA, 20 bp, Artificial
  CRISPR gRNA sequence
atcagttccaactggagaaa

SEQ ID NO: 612569 - DNA, 20 bp, Artificial
  CRISPR gRNA sequence
tcagttccaactggagaaag

SEQ ID NO: 612570 - DNA, 20 bp, Artificial
  CRISPR gRNA sequence
actggagaaaggggtgccaa

SEQ ID NO: 612571 - DNA, 20 bp, Artificial
  CRISPR gRNA sequence
aaaggggtgccaatggttgt

SEQ ID NO: 612572 - DNA, 20 bp, Artificial
  CRISPR gRNA sequence
ggggtgccaatggttgtgag

SEQ ID NO: 612573 - DNA, 20 bp, Artificial
  CRISPR gRNA sequence
gggtgccaatggttgtgaga

SEQ ID NO: 612574 - DNA, 20 bp, Artificial
  CRISPR gRNA sequence
gccaatggttgtgagaaggc

SEQ ID NO: 612575 - DNA, 20 bp, Artificial
  CRISPR gRNA sequence
caatggttgtgagaaggcaa

SEQ ID NO: 612576 - DNA, 20 bp, Artificial
  CRISPR gRNA sequence
aatggttgtgagaaggcaag

SEQ ID NO: 612577 - DNA, 20 bp, Artificial
  CRISPR gRNA sequence
gttgtgagaaggcaagagga

SEQ ID NO: 612578 - DNA, 20 bp, Artificial
  CRISPR gRNA sequence
tgagaaggcaagaggaaagt

SEQ ID NO: 612579 - DNA, 20 bp, Artificial
  CRISPR gRNA sequence
aggcaagaggaaagtgagac

SEQ ID NO: 612580 - DNA, 20 bp, Artificial
  CRISPR gRNA sequence
aagaggaaagtgagactggc

SEQ ID NO: 612581 - DNA, 20 bp, Artificial
  CRISPR gRNA sequence
agaggaaagtgagactggca

SEQ ID NO: 612582 - DNA, 20 bp, Artificial
  CRISPR gRNA sequence
aaggacctatgacattgttc

SEQ ID NO: 612583 - DNA, 20 bp, Artificial
  CRISPR gRNA sequence
atgacattgttctggactct

SEQ ID NO: 612584 - DNA, 20 bp, Artificial
  CRISPR gRNA sequence
tgttctggactctgagttat

SEQ ID NO: 612585 - DNA, 20 bp, Artificial
  CRISPR gRNA sequence
ctggactctgagttatcagt

SEQ ID NO: 612586 - DNA, 20 bp, Artificial
  CRISPR gRNA sequence
tggactctgagttatcagta

SEQ ID NO: 612587 - DNA, 20 bp, Artificial
  CRISPR gRNA sequence
ctgagttatcagtaaggtgt

SEQ ID NO: 612588 - DNA, 20 bp, Artificial
  CRISPR gRNA sequence
tcagtaaggtgtgagaacct

SEQ ID NO: 612589 - DNA, 20 bp, Artificial
  CRISPR gRNA sequence
agtaaggtgtgagaacctca

SEQ ID NO: 612590 - DNA, 20 bp, Artificial
  CRISPR gRNA sequence
gtaaggtgtgagaacctcag

SEQ ID NO: 612591 - DNA, 20 bp, Artificial
  CRISPR gRNA sequence
aggtgtgagaacctcagagg

SEQ ID NO: 612592 - DNA, 20 bp, Artificial
  CRISPR gRNA sequence
ggtgtgagaacctcagagga

SEQ ID NO: 612593 - DNA, 20 bp, Artificial
  CRISPR gRNA sequence
gtgtgagaacctcagaggaa

SEQ ID NO: 612594 - DNA, 20 bp, Artificial
  CRISPR gRNA sequence
tgtgagaacctcagaggaag

SEQ ID NO: 612595 - DNA, 20 bp, Artificial
  CRISPR gRNA sequence
agaacctcagaggaaggggt

SEQ ID NO: 612596 - DNA, 20 bp, Artificial
  CRISPR gRNA sequence
acctcagaggaaggggtaag

SEQ ID NO: 612597 - DNA, 20 bp, Artificial
  CRISPR gRNA sequence
gaggaaggggtaagtggcac

SEQ ID NO: 612598 - DNA, 20 bp, Artificial
  CRISPR gRNA sequence
ggggtaagtggcactggata

SEQ ID NO: 612599 - DNA, 20 bp, Artificial
  CRISPR gRNA sequence
ggcactggatacagaaacac

SEQ ID NO: 612600 - DNA, 20 bp, Artificial
  CRISPR gRNA sequence
agaaacacaagcaaaataaa

SEQ ID NO: 612601 - DNA, 20 bp, Artificial
  CRISPR gRNA sequence
acacaagcaaaataaaaagt

SEQ ID NO: 612602 - DNA, 20 bp, Artificial
  CRISPR gRNA sequence
agtgagacgattattaactc

SEQ ID NO: 612603 - DNA, 20 bp, Artificial
  CRISPR gRNA sequence
gtgagacgattattaactct

SEQ ID NO: 612604 - DNA, 20 bp, Artificial
  CRISPR gRNA sequence
ttaactctaggaaaaattaa

SEQ ID NO: 612605 - DNA, 20 bp, Artificial
  CRISPR gRNA sequence
aaattaaaagctgcacaaaa

SEQ ID NO: 612606 - DNA, 20 bp, Artificial
  CRISPR gRNA sequence
aattaaaagctgcacaaaaa

SEQ ID NO: 612607 - DNA, 20 bp, Artificial
  CRISPR gRNA sequence
aaggaaatgtaatcactgtt

SEQ ID NO: 612608 - DNA, 20 bp, Artificial
  CRISPR gRNA sequence
gtaatcactgttgagccaaa

SEQ ID NO: 612609 - DNA, 20 bp, Artificial
  CRISPR gRNA sequence
attaatatttctatgactac

SEQ ID NO: 612610 - DNA, 20 bp, Artificial
  CRISPR gRNA sequence
tccatttctatactattaat

SEQ ID NO: 612611 - DNA, 20 bp, Artificial
  CRISPR gRNA sequence
aatgattatgtaactattga

SEQ ID NO: 612612 - DNA, 20 bp, Artificial
  CRISPR gRNA sequence
atgtaactattgaaagacca

SEQ ID NO: 612613 - DNA, 20 bp, Artificial
  CRISPR gRNA sequence
taactattgaaagaccacag

SEQ ID NO: 612614 - DNA, 20 bp, Artificial
  CRISPR gRNA sequence
tattgaaagaccacagaagt

SEQ ID NO: 612615 - DNA, 20 bp, Artificial
  CRISPR gRNA sequence
agaccacagaagtgagaatt

SEQ ID NO: 612616 - DNA, 20 bp, Artificial
  CRISPR gRNA sequence
accacagaagtgagaattga

SEQ ID NO: 612617 - DNA, 20 bp, Artificial
  CRISPR gRNA sequence
ccacagaagtgagaattgag

SEQ ID NO: 612618 - DNA, 20 bp, Artificial
  CRISPR gRNA sequence
cacagaagtgagaattgaga

SEQ ID NO: 612619 - DNA, 20 bp, Artificial
  CRISPR gRNA sequence
agaattgagagggtgtttgt

SEQ ID NO: 612620 - DNA, 20 bp, Artificial
  CRISPR gRNA sequence
aattgagagggtgtttgtaa

SEQ ID NO: 612621 - DNA, 20 bp, Artificial
  CRISPR gRNA sequence
ttgagagggtgtttgtaaga

SEQ ID NO: 612622 - DNA, 20 bp, Artificial
  CRISPR gRNA sequence
agagctgaatccttaactac

SEQ ID NO: 612623 - DNA, 20 bp, Artificial
  CRISPR gRNA sequence
gagctgaatccttaactacc

SEQ ID NO: 612624 - DNA, 20 bp, Artificial
  CRISPR gRNA sequence
tgaatccttaactaccagga

SEQ ID NO: 612625 - DNA, 20 bp, Artificial
  CRISPR gRNA sequence
aatccttaactaccaggaca

SEQ ID NO: 612626 - DNA, 20 bp, Artificial
  CRISPR gRNA sequence
ccttaactaccaggacagag

SEQ ID NO: 612627 - DNA, 20 bp, Artificial
  CRISPR gRNA sequence
ctaccaggacagagaagcaa

SEQ ID NO: 612628 - DNA, 20 bp, Artificial
  CRISPR gRNA sequence
aaaataacccacatattatt

SEQ ID NO: 612629 - DNA, 20 bp, Artificial
  CRISPR gRNA sequence
aatatgaatataatcaccaa

SEQ ID NO: 612630 - DNA, 20 bp, Artificial
  CRISPR gRNA sequence
atgaatataatcaccaaaag

SEQ ID NO: 612631 - DNA, 20 bp, Artificial
  CRISPR gRNA sequence
tgaatataatcaccaaaaga

SEQ ID NO: 612632 - DNA, 20 bp, Artificial
  CRISPR gRNA sequence
aatataatcaccaaaagaag

SEQ ID NO: 612633 - DNA, 20 bp, Artificial
  CRISPR gRNA sequence
ccaaaagaaggagctgaaaa

SEQ ID NO: 612634 - DNA, 20 bp, Artificial
  CRISPR gRNA sequence
agctgaaaatggttgctttt

SEQ ID NO: 612635 - DNA, 20 bp, Artificial
  CRISPR gRNA sequence
gctgaaaatggttgcttttt

SEQ ID NO: 612636 - DNA, 20 bp, Artificial
  CRISPR gRNA sequence
ttgctttttgggattttgat

SEQ ID NO: 612637 - DNA, 20 bp, Artificial
  CRISPR gRNA sequence
gggattttgattagattgct

SEQ ID NO: 612638 - DNA, 20 bp, Artificial
  CRISPR gRNA sequence
ggattttgattagattgctt

SEQ ID NO: 612639 - DNA, 20 bp, Artificial
  CRISPR gRNA sequence
gattttgattagattgcttg

SEQ ID NO: 612640 - DNA, 20 bp, Artificial
  CRISPR gRNA sequence
attttgattagattgcttgg

SEQ ID NO: 612641 - DNA, 20 bp, Artificial
  CRISPR gRNA sequence
ttgattagattgcttggggg

SEQ ID NO: 612642 - DNA, 20 bp, Artificial
  CRISPR gRNA sequence
tgattagattgcttgggggc

SEQ ID NO: 612643 - DNA, 20 bp, Artificial
  CRISPR gRNA sequence
ttagattgcttgggggcagg

SEQ ID NO: 612644 - DNA, 20 bp, Artificial
  CRISPR gRNA sequence
tagattgcttgggggcaggt

SEQ ID NO: 612645 - DNA, 20 bp, Artificial
  CRISPR gRNA sequence
agattgcttgggggcaggta

SEQ ID NO: 612646 - DNA, 20 bp, Artificial
  CRISPR gRNA sequence
ttgcttgggggcaggtaggg

SEQ ID NO: 612647 - DNA, 20 bp, Artificial
  CRISPR gRNA sequence
tgggggcaggtagggcagca

SEQ ID NO: 612648 - DNA, 20 bp, Artificial
  CRISPR gRNA sequence
gggggcaggtagggcagcat

SEQ ID NO: 612649 - DNA, 20 bp, Artificial
  CRISPR gRNA sequence
ggggcaggtagggcagcatg

SEQ ID NO: 612650 - DNA, 20 bp, Artificial
  CRISPR gRNA sequence
gcaggtagggcagcatgggg

SEQ ID NO: 612651 - DNA, 20 bp, Artificial
  CRISPR gRNA sequence
aggtagggcagcatggggaa

SEQ ID NO: 612652 - DNA, 20 bp, Artificial
  CRISPR gRNA sequence
gtatttcattaaatgccact

SEQ ID NO: 612653 - DNA, 20 bp, Artificial
  CRISPR gRNA sequence
tatttcattaaatgccactt

SEQ ID NO: 612654 - DNA, 20 bp, Artificial
  CRISPR gRNA sequence
ggactatttgatttttttta

SEQ ID NO: 612655 - DNA, 20 bp, Artificial
  CRISPR gRNA sequence
gactatttgattttttttat

SEQ ID NO: 612656 - DNA, 20 bp, Artificial
  CRISPR gRNA sequence
tttatgggcatatctaacta

SEQ ID NO: 612657 - DNA, 20 bp, Artificial
  CRISPR gRNA sequence
gcatatctaactatggtaaa

SEQ ID NO: 612658 - DNA, 20 bp, Artificial
  CRISPR gRNA sequence
aataatcattaacgtaataa

SEQ ID NO: 612659 - DNA, 20 bp, Artificial
  CRISPR gRNA sequence
tcattaacgtaataaaagaa

SEQ ID NO: 612660 - DNA, 20 bp, Artificial
  CRISPR gRNA sequence
cattaacgtaataaaagaaa

SEQ ID NO: 612661 - DNA, 20 bp, Artificial
  CRISPR gRNA sequence
cgtaataaaagaaaaggact

SEQ ID NO: 612662 - DNA, 20 bp, Artificial
  CRISPR gRNA sequence
agaaaaggactcagaatgct

SEQ ID NO: 612663 - DNA, 20 bp, Artificial
  CRISPR gRNA sequence
gctgagcaaactgaataatt

SEQ ID NO: 612664 - DNA, 20 bp, Artificial
  CRISPR gRNA sequence
attcagcattaccataaatc

SEQ ID NO: 612665 - DNA, 20 bp, Artificial
  CRISPR gRNA sequence
attaccataaatctagaatc

SEQ ID NO: 612666 - DNA, 20 bp, Artificial
  CRISPR gRNA sequence
ttaccataaatctagaatct

SEQ ID NO: 612667 - DNA, 20 bp, Artificial
  CRISPR gRNA sequence
accataaatctagaatctgg

SEQ ID NO: 612668 - DNA, 20 bp, Artificial
  CRISPR gRNA sequence
taaatctagaatctgggaga

SEQ ID NO: 612669 - DNA, 20 bp, Artificial
  CRISPR gRNA sequence
tgggagaaagtgttacctaa

SEQ ID NO: 612670 - DNA, 20 bp, Artificial
  CRISPR gRNA sequence
gagaaagtgttacctaacag

SEQ ID NO: 612671 - DNA, 20 bp, Artificial
  CRISPR gRNA sequence
aaaatatcatttcataataa

SEQ ID NO: 612672 - DNA, 20 bp, Artificial
  CRISPR gRNA sequence
aaatatcatttcataataat

SEQ ID NO: 612673 - DNA, 20 bp, Artificial
  CRISPR gRNA sequence
aatatcatttcataataatg

SEQ ID NO: 612674 - DNA, 20 bp, Artificial
  CRISPR gRNA sequence
aatgttcaaaatatattgtt

SEQ ID NO: 612675 - DNA, 20 bp, Artificial
  CRISPR gRNA sequence
aatatattgttcagtaaaat

SEQ ID NO: 612676 - DNA, 20 bp, Artificial
  CRISPR gRNA sequence
atattgttcagtaaaataag

SEQ ID NO: 612677 - DNA, 20 bp, Artificial
  CRISPR gRNA sequence
tattgttcagtaaaataagc

SEQ ID NO: 612678 - DNA, 20 bp, Artificial
  CRISPR gRNA sequence
ataagcaggttataaaataa

SEQ ID NO: 612679 - DNA, 20 bp, Artificial
  CRISPR gRNA sequence
tgcatgcattaaaaaaatgc

SEQ ID NO: 612680 - DNA, 20 bp, Artificial
  CRISPR gRNA sequence
catgcattaaaaaaatgcaa

SEQ ID NO: 612681 - DNA, 20 bp, Artificial
  CRISPR gRNA sequence
atgcattaaaaaaatgcaag

SEQ ID NO: 612682 - DNA, 20 bp, Artificial
  CRISPR gRNA sequence
aaaaatgcaagaggataata

SEQ ID NO: 612683 - DNA, 20 bp, Artificial
  CRISPR gRNA sequence
aggataatacagaaatacca

SEQ ID NO: 612684 - DNA, 20 bp, Artificial
  CRISPR gRNA sequence
taatacagaaataccaaaga

SEQ ID NO: 612685 - DNA, 20 bp, Artificial
  CRISPR gRNA sequence
atttctaaatgatataatta

SEQ ID NO: 612686 - DNA, 20 bp, Artificial
  CRISPR gRNA sequence
gatataattatggattttac

SEQ ID NO: 612687 - DNA, 20 bp, Artificial
  CRISPR gRNA sequence
gaatattttacatttgaaat

SEQ ID NO: 612688 - DNA, 20 bp, Artificial
  CRISPR gRNA sequence
attttacatttgaaattaga

SEQ ID NO: 612689 - DNA, 20 bp, Artificial
  CRISPR gRNA sequence
tttacatttgaaattagaaa

SEQ ID NO: 612690 - DNA, 20 bp, Artificial
  CRISPR gRNA sequence
ttgaaattagaaagagattt

SEQ ID NO: 612691 - DNA, 20 bp, Artificial
  CRISPR gRNA sequence
gagatttaagaaaaactaat

SEQ ID NO: 612692 - DNA, 20 bp, Artificial
  CRISPR gRNA sequence
taagaaaaactaatgagaaa

SEQ ID NO: 612693 - DNA, 20 bp, Artificial
  CRISPR gRNA sequence
taatgagaaaaagctattta

SEQ ID NO: 612694 - DNA, 20 bp, Artificial
  CRISPR gRNA sequence
atgagaaaaagctatttaaa

SEQ ID NO: 612695 - DNA, 20 bp, Artificial
  CRISPR gRNA sequence
aaaaagctatttaaagagtt

SEQ ID NO: 612696 - DNA, 20 bp, Artificial
  CRISPR gRNA sequence
ttcataaaaactccacttat

SEQ ID NO: 612697 - DNA, 20 bp, Artificial
  CRISPR gRNA sequence
cacttattagttctttctat

SEQ ID NO: 612698 - DNA, 20 bp, Artificial
  CRISPR gRNA sequence
attagttctttctatgagca

SEQ ID NO: 612699 - DNA, 20 bp, Artificial
  CRISPR gRNA sequence
aagcaccctgctaaactctt

SEQ ID NO: 612700 - DNA, 20 bp, Artificial
  CRISPR gRNA sequence
caccctgctaaactcttcgg

SEQ ID NO: 612701 - DNA, 20 bp, Artificial
  CRISPR gRNA sequence
taaactcttcggaagttaca

SEQ ID NO: 612702 - DNA, 20 bp, Artificial
  CRISPR gRNA sequence
cggaagttacaaagacacat

SEQ ID NO: 612703 - DNA, 20 bp, Artificial
  CRISPR gRNA sequence
tattgttataatttctcaaa

SEQ ID NO: 612704 - DNA, 20 bp, Artificial
  CRISPR gRNA sequence
attgttataatttctcaaaa

SEQ ID NO: 612705 - DNA, 20 bp, Artificial
  CRISPR gRNA sequence
tataatttctcaaaaaggtc

SEQ ID NO: 612706 - DNA, 20 bp, Artificial
  CRISPR gRNA sequence
aaaaaggtcaagatctaaca

SEQ ID NO: 612707 - DNA, 20 bp, Artificial
  CRISPR gRNA sequence
aaaggtcaagatctaacatg

SEQ ID NO: 612708 - DNA, 20 bp, Artificial
  CRISPR gRNA sequence
tctaacatggagatgaaaat

SEQ ID NO: 612709 - DNA, 20 bp, Artificial
  CRISPR gRNA sequence
gaaaattagtgtgtaaatac

SEQ ID NO: 612710 - DNA, 20 bp, Artificial
  CRISPR gRNA sequence
gtgtgtaaataccagtataa

SEQ ID NO: 612711 - DNA, 20 bp, Artificial
  CRISPR gRNA sequence
aaataccagtataaaagtca

SEQ ID NO: 612712 - DNA, 20 bp, Artificial
  CRISPR gRNA sequence
ataaaagtcacagataatat

SEQ ID NO: 612713 - DNA, 20 bp, Artificial
  CRISPR gRNA sequence
aagtcacagataatataaga

SEQ ID NO: 612714 - DNA, 20 bp, Artificial
  CRISPR gRNA sequence
gataatataagatagaatga

SEQ ID NO: 612715 - DNA, 20 bp, Artificial
  CRISPR gRNA sequence
taatataagatagaatgata

SEQ ID NO: 612716 - DNA, 20 bp, Artificial
  CRISPR gRNA sequence
aagatagaatgatagagtgt

SEQ ID NO: 612717 - DNA, 20 bp, Artificial
  CRISPR gRNA sequence
atagaatgatagagtgttgg

SEQ ID NO: 612718 - DNA, 20 bp, Artificial
  CRISPR gRNA sequence
tagagtgttggaagtgttct

SEQ ID NO: 612719 - DNA, 20 bp, Artificial
  CRISPR gRNA sequence
gttggaagtgttctaagcat

SEQ ID NO: 612720 - DNA, 20 bp, Artificial
  CRISPR gRNA sequence
ttggaagtgttctaagcatg

SEQ ID NO: 612721 - DNA, 20 bp, Artificial
  CRISPR gRNA sequence
tggaagtgttctaagcatga

SEQ ID NO: 612722 - DNA, 20 bp, Artificial
  CRISPR gRNA sequence
tctaagcatgagggtcaata

SEQ ID NO: 612723 - DNA, 20 bp, Artificial
  CRISPR gRNA sequence
ctaagcatgagggtcaatac

SEQ ID NO: 612724 - DNA, 20 bp, Artificial
  CRISPR gRNA sequence
catgagggtcaatacaggaa

SEQ ID NO: 612725 - DNA, 20 bp, Artificial
  CRISPR gRNA sequence
tcaatacaggaatagttctt

SEQ ID NO: 612726 - DNA, 20 bp, Artificial
  CRISPR gRNA sequence
tacaggaatagttctttagt

SEQ ID NO: 612727 - DNA, 20 bp, Artificial
  CRISPR gRNA sequence
ggaatagttctttagtgaga

SEQ ID NO: 612728 - DNA, 20 bp, Artificial
  CRISPR gRNA sequence
tgagaaagatcacgttaaaa

SEQ ID NO: 612729 - DNA, 20 bp, Artificial
  CRISPR gRNA sequence
aagatcacgttaaaatggaa

SEQ ID NO: 612730 - DNA, 20 bp, Artificial
  CRISPR gRNA sequence
gatcacgttaaaatggaaca

SEQ ID NO: 612731 - DNA, 20 bp, Artificial
  CRISPR gRNA sequence
cgttaaaatggaacagagtt

SEQ ID NO: 612732 - DNA, 20 bp, Artificial
  CRISPR gRNA sequence
gttaaaatggaacagagtta

SEQ ID NO: 612733 - DNA, 20 bp, Artificial
  CRISPR gRNA sequence
taaaatggaacagagttaag

SEQ ID NO: 612734 - DNA, 20 bp, Artificial
  CRISPR gRNA sequence
aaaatggaacagagttaagg

SEQ ID NO: 612735 - DNA, 20 bp, Artificial
  CRISPR gRNA sequence
tggaacagagttaaggaggt

SEQ ID NO: 612736 - DNA, 20 bp, Artificial
  CRISPR gRNA sequence
aacagagttaaggaggttgg

SEQ ID NO: 612737 - DNA, 20 bp, Artificial
  CRISPR gRNA sequence
agagttaaggaggttggaag

SEQ ID NO: 612738 - DNA, 20 bp, Artificial
  CRISPR gRNA sequence
agttaaggaggttggaagtg

SEQ ID NO: 612739 - DNA, 20 bp, Artificial
  CRISPR gRNA sequence
gttaaggaggttggaagtgg

SEQ ID NO: 612740 - DNA, 20 bp, Artificial
  CRISPR gRNA sequence
ttaaggaggttggaagtgga

SEQ ID NO: 612741 - DNA, 20 bp, Artificial
  CRISPR gRNA sequence
aggttggaagtggagggatg

SEQ ID NO: 612742 - DNA, 20 bp, Artificial
  CRISPR gRNA sequence
gttggaagtggagggatgtg

SEQ ID NO: 612743 - DNA, 20 bp, Artificial
  CRISPR gRNA sequence
ttggaagtggagggatgtgg

SEQ ID NO: 612744 - DNA, 20 bp, Artificial
  CRISPR gRNA sequence
ggagggatgtggaggatttc

SEQ ID NO: 612745 - DNA, 20 bp, Artificial
  CRISPR gRNA sequence
agggatgtggaggatttcaa

SEQ ID NO: 612746 - DNA, 20 bp, Artificial
  CRISPR gRNA sequence
gggatgtggaggatttcaag

SEQ ID NO: 612747 - DNA, 20 bp, Artificial
  CRISPR gRNA sequence
atgtggaggatttcaagagg

SEQ ID NO: 612748 - DNA, 20 bp, Artificial
  CRISPR gRNA sequence
tcaagaggtagaaatcatgt

SEQ ID NO: 612749 - DNA, 20 bp, Artificial
  CRISPR gRNA sequence
caagaggtagaaatcatgtg

SEQ ID NO: 612750 - DNA, 20 bp, Artificial
  CRISPR gRNA sequence
gaaatcatgtgaggcaatta

SEQ ID NO: 612751 - DNA, 20 bp, Artificial
  CRISPR gRNA sequence
ttacagcaacaaacaaaact

SEQ ID NO: 612752 - DNA, 20 bp, Artificial
  CRISPR gRNA sequence
cagcaacaaacaaaactcag

SEQ ID NO: 612753 - DNA, 20 bp, Artificial
  CRISPR gRNA sequence
acaaacaaaactcagaagtg

SEQ ID NO: 612754 - DNA, 20 bp, Artificial
  CRISPR gRNA sequence
caaacaaaactcagaagtgt

SEQ ID NO: 612755 - DNA, 20 bp, Artificial
  CRISPR gRNA sequence
aactcagaagtgtaggtgta

SEQ ID NO: 612756 - DNA, 20 bp, Artificial
  CRISPR gRNA sequence
aggtgtaaagtaattttgac

SEQ ID NO: 612757 - DNA, 20 bp, Artificial
  CRISPR gRNA sequence
ggtgtaaagtaattttgact

SEQ ID NO: 612758 - DNA, 20 bp, Artificial
  CRISPR gRNA sequence
gtgtaaagtaattttgactg

SEQ ID NO: 612759 - DNA, 20 bp, Artificial
  CRISPR gRNA sequence
aagtaattttgactggggcc

SEQ ID NO: 612760 - DNA, 20 bp, Artificial
  CRISPR gRNA sequence
agtaattttgactggggcct

SEQ ID NO: 612761 - DNA, 20 bp, Artificial
  CRISPR gRNA sequence
gtaattttgactggggcctg

SEQ ID NO: 612762 - DNA, 20 bp, Artificial
  CRISPR gRNA sequence
attttgactggggcctgggg

SEQ ID NO: 612763 - DNA, 20 bp, Artificial
  CRISPR gRNA sequence
ttttgactggggcctggggt

SEQ ID NO: 612764 - DNA, 20 bp, Artificial
  CRISPR gRNA sequence
ttgactggggcctggggtag

SEQ ID NO: 612765 - DNA, 20 bp, Artificial
  CRISPR gRNA sequence
actggggcctggggtaggag

SEQ ID NO: 612766 - DNA, 20 bp, Artificial
  CRISPR gRNA sequence
ctggggcctggggtaggagt

SEQ ID NO: 612767 - DNA, 20 bp, Artificial
  CRISPR gRNA sequence
taggagtgggatgtgtgctt

SEQ ID NO: 612768 - DNA, 20 bp, Artificial
  CRISPR gRNA sequence
aggagtgggatgtgtgcttt

SEQ ID NO: 612769 - DNA, 20 bp, Artificial
  CRISPR gRNA sequence
tgggatgtgtgctttgggac

SEQ ID NO: 612770 - DNA, 20 bp, Artificial
  CRISPR gRNA sequence
atgtgtgctttgggaccaga

SEQ ID NO: 612771 - DNA, 20 bp, Artificial
  CRISPR gRNA sequence
tgctttgggaccagatggta

SEQ ID NO: 612772 - DNA, 20 bp, Artificial
  CRISPR gRNA sequence
gctttgggaccagatggtat

SEQ ID NO: 612773 - DNA, 20 bp, Artificial
  CRISPR gRNA sequence
ctttgggaccagatggtata

SEQ ID NO: 612774 - DNA, 20 bp, Artificial
  CRISPR gRNA sequence
tggtatagggtgctgaatgc

SEQ ID NO: 612775 - DNA, 20 bp, Artificial
  CRISPR gRNA sequence
ggtatagggtgctgaatgcc

SEQ ID NO: 612776 - DNA, 20 bp, Artificial
  CRISPR gRNA sequence
agggtgctgaatgccaggta

SEQ ID NO: 612777 - DNA, 20 bp, Artificial
  CRISPR gRNA sequence
gggtgctgaatgccaggtaa

SEQ ID NO: 612778 - DNA, 20 bp, Artificial
  CRISPR gRNA sequence
ggtgctgaatgccaggtaaa

SEQ ID NO: 612779 - DNA, 20 bp, Artificial
  CRISPR gRNA sequence
caggtaaagggatttcaact

SEQ ID NO: 612780 - DNA, 20 bp, Artificial
  CRISPR gRNA sequence
cttagttcaataaaacttaa

SEQ ID NO: 612781 - DNA, 20 bp, Artificial
  CRISPR gRNA sequence
taaaacttaacagttattga

SEQ ID NO: 612782 - DNA, 20 bp, Artificial
  CRISPR gRNA sequence
taacagttattgaaagttgt

SEQ ID NO: 612783 - DNA, 20 bp, Artificial
  CRISPR gRNA sequence
acagttattgaaagttgttg

SEQ ID NO: 612784 - DNA, 20 bp, Artificial
  CRISPR gRNA sequence
agttattgaaagttgttgga

SEQ ID NO: 612785 - DNA, 20 bp, Artificial
  CRISPR gRNA sequence
ttattgaaagttgttggaga

SEQ ID NO: 612786 - DNA, 20 bp, Artificial
  CRISPR gRNA sequence
tattgaaagttgttggagag

SEQ ID NO: 612787 - DNA, 20 bp, Artificial
  CRISPR gRNA sequence
aggaataaaataattacaca

SEQ ID NO: 612788 - DNA, 20 bp, Artificial
  CRISPR gRNA sequence
ggaataaaataattacacac

SEQ ID NO: 612789 - DNA, 20 bp, Artificial
  CRISPR gRNA sequence
ataaaataattacacacggg

SEQ ID NO: 612790 - DNA, 20 bp, Artificial
  CRISPR gRNA sequence
aaaataattacacacgggaa

SEQ ID NO: 612791 - DNA, 20 bp, Artificial
  CRISPR gRNA sequence
taattacacacgggaagaga

SEQ ID NO: 612792 - DNA, 20 bp, Artificial
  CRISPR gRNA sequence
gggaagagaaagcctatttg

SEQ ID NO: 612793 - DNA, 20 bp, Artificial
  CRISPR gRNA sequence
ctatttgaagtctattatgc

SEQ ID NO: 612794 - DNA, 20 bp, Artificial
  CRISPR gRNA sequence
tatttgaagtctattatgcc

SEQ ID NO: 612795 - DNA, 20 bp, Artificial
  CRISPR gRNA sequence
gaagtctattatgccaggcc

SEQ ID NO: 612796 - DNA, 20 bp, Artificial
  CRISPR gRNA sequence
aagtctattatgccaggccc

SEQ ID NO: 612797 - DNA, 20 bp, Artificial
  CRISPR gRNA sequence
ctattatgccaggcccaggt

SEQ ID NO: 612798 - DNA, 20 bp, Artificial
  CRISPR gRNA sequence
ggcccaggtgagcaataatg

SEQ ID NO: 612799 - DNA, 20 bp, Artificial
  CRISPR gRNA sequence
gcccaggtgagcaataatga

SEQ ID NO: 612800 - DNA, 20 bp, Artificial
  CRISPR gRNA sequence
gcaataatgaaggcctgaac

SEQ ID NO: 612801 - DNA, 20 bp, Artificial
  CRISPR gRNA sequence
caataatgaaggcctgaact

SEQ ID NO: 612802 - DNA, 20 bp, Artificial
  CRISPR gRNA sequence
tgaactaggacgttgattgt

SEQ ID NO: 612803 - DNA, 20 bp, Artificial
  CRISPR gRNA sequence
acgttgattgtgagaatgaa

SEQ ID NO: 612804 - DNA, 20 bp, Artificial
  CRISPR gRNA sequence
ttgattgtgagaatgaaaag

SEQ ID NO: 612805 - DNA, 20 bp, Artificial
  CRISPR gRNA sequence
tgattgtgagaatgaaaaga

SEQ ID NO: 612806 - DNA, 20 bp, Artificial
  CRISPR gRNA sequence
gattgtgagaatgaaaagaa

SEQ ID NO: 612807 - DNA, 20 bp, Artificial
  CRISPR gRNA sequence
tgaaaagaagggatcaactt

SEQ ID NO: 612808 - DNA, 20 bp, Artificial
  CRISPR gRNA sequence
caacttgagaatcattttac

SEQ ID NO: 612809 - DNA, 20 bp, Artificial
  CRISPR gRNA sequence
tgagaatcattttacgagtc

SEQ ID NO: 612810 - DNA, 20 bp, Artificial
  CRISPR gRNA sequence
cattttacgagtccagtata

SEQ ID NO: 612811 - DNA, 20 bp, Artificial
  CRISPR gRNA sequence
cgagtccagtatatagaatt

SEQ ID NO: 612812 - DNA, 20 bp, Artificial
  CRISPR gRNA sequence
gtccagtatatagaatttag

SEQ ID NO: 612813 - DNA, 20 bp, Artificial
  CRISPR gRNA sequence
tatagaatttagcagctatt

SEQ ID NO: 612814 - DNA, 20 bp, Artificial
  CRISPR gRNA sequence
agaatttagcagctatttgg

SEQ ID NO: 612815 - DNA, 20 bp, Artificial
  CRISPR gRNA sequence
atttagcagctatttggaag

SEQ ID NO: 612816 - DNA, 20 bp, Artificial
  CRISPR gRNA sequence
tttagcagctatttggaagt

SEQ ID NO: 612817 - DNA, 20 bp, Artificial
  CRISPR gRNA sequence
cagctatttggaagtaggaa

SEQ ID NO: 612818 - DNA, 20 bp, Artificial
  CRISPR gRNA sequence
gctatttggaagtaggaaaa

SEQ ID NO: 612819 - DNA, 20 bp, Artificial
  CRISPR gRNA sequence
ctatttggaagtaggaaaag

SEQ ID NO: 612820 - DNA, 20 bp, Artificial
  CRISPR gRNA sequence
tttggaagtaggaaaagagg

SEQ ID NO: 612821 - DNA, 20 bp, Artificial
  CRISPR gRNA sequence
ggaagtaggaaaagaggtag

SEQ ID NO: 612822 - DNA, 20 bp, Artificial
  CRISPR gRNA sequence
gaagtaggaaaagaggtaga

SEQ ID NO: 612823 - DNA, 20 bp, Artificial
  CRISPR gRNA sequence
ggaaaagaggtagaaggtaa

SEQ ID NO: 612824 - DNA, 20 bp, Artificial
  CRISPR gRNA sequence
aaagaggtagaaggtaacag

SEQ ID NO: 612825 - DNA, 20 bp, Artificial
  CRISPR gRNA sequence
gaggtagaaggtaacagaag

SEQ ID NO: 612826 - DNA, 20 bp, Artificial
  CRISPR gRNA sequence
aggtagaaggtaacagaagt

SEQ ID NO: 612827 - DNA, 20 bp, Artificial
  CRISPR gRNA sequence
ggtgcattgttgtgaatctt

SEQ ID NO: 612828 - DNA, 20 bp, Artificial
  CRISPR gRNA sequence
ttgttgtgaatcttgagtat

SEQ ID NO: 612829 - DNA, 20 bp, Artificial
  CRISPR gRNA sequence
gtgaatcttgagtattagaa

SEQ ID NO: 612830 - DNA, 20 bp, Artificial
  CRISPR gRNA sequence
aatcttgagtattagaacag

SEQ ID NO: 612831 - DNA, 20 bp, Artificial
  CRISPR gRNA sequence
tattagaacagtggtaacac

SEQ ID NO: 612832 - DNA, 20 bp, Artificial
  CRISPR gRNA sequence
gaacagtggtaacactagca

SEQ ID NO: 612833 - DNA, 20 bp, Artificial
  CRISPR gRNA sequence
cagtggtaacactagcaaag

SEQ ID NO: 612834 - DNA, 20 bp, Artificial
  CRISPR gRNA sequence
agtggtaacactagcaaaga

SEQ ID NO: 612835 - DNA, 20 bp, Artificial
  CRISPR gRNA sequence
gtggtaacactagcaaagaa

SEQ ID NO: 612836 - DNA, 20 bp, Artificial
  CRISPR gRNA sequence
gtaacactagcaaagaaggg

SEQ ID NO: 612837 - DNA, 20 bp, Artificial
  CRISPR gRNA sequence
cactagcaaagaagggcagt

SEQ ID NO: 612838 - DNA, 20 bp, Artificial
  CRISPR gRNA sequence
aaagaagggcagtcagaaca

SEQ ID NO: 612839 - DNA, 20 bp, Artificial
  CRISPR gRNA sequence
agaagggcagtcagaacaaa

SEQ ID NO: 612840 - DNA, 20 bp, Artificial
  CRISPR gRNA sequence
gaagggcagtcagaacaaag

SEQ ID NO: 612841 - DNA, 20 bp, Artificial
  CRISPR gRNA sequence
aagggcagtcagaacaaaga

SEQ ID NO: 612842 - DNA, 20 bp, Artificial
  CRISPR gRNA sequence
gggcagtcagaacaaagagg

SEQ ID NO: 612843 - DNA, 20 bp, Artificial
  CRISPR gRNA sequence
agaacaaagagggagttttg

SEQ ID NO: 612844 - DNA, 20 bp, Artificial
  CRISPR gRNA sequence
aacaaagagggagttttgtg

SEQ ID NO: 612845 - DNA, 20 bp, Artificial
  CRISPR gRNA sequence
acaaagagggagttttgtgg

SEQ ID NO: 612846 - DNA, 20 bp, Artificial
  CRISPR gRNA sequence
aagagggagttttgtggagg

SEQ ID NO: 612847 - DNA, 20 bp, Artificial
  CRISPR gRNA sequence
gggagttttgtggaggaaga

SEQ ID NO: 612848 - DNA, 20 bp, Artificial
  CRISPR gRNA sequence
tttgtggaggaagatagttt

SEQ ID NO: 612849 - DNA, 20 bp, Artificial
  CRISPR gRNA sequence
ttgtggaggaagatagtttt

SEQ ID NO: 612850 - DNA, 20 bp, Artificial
  CRISPR gRNA sequence
ggtatcttgaatgtttgatt

SEQ ID NO: 612851 - DNA, 20 bp, Artificial
  CRISPR gRNA sequence
ttgaatgtttgatttggttt

SEQ ID NO: 612852 - DNA, 20 bp, Artificial
  CRISPR gRNA sequence
tgaatgtttgatttggtttt

SEQ ID NO: 612853 - DNA, 20 bp, Artificial
  CRISPR gRNA sequence
gaatgtttgatttggttttg

SEQ ID NO: 612854 - DNA, 20 bp, Artificial
  CRISPR gRNA sequence
aatgtttgatttggttttgg

SEQ ID NO: 612855 - DNA, 20 bp, Artificial
  CRISPR gRNA sequence
ggttttgggggaatatccat

SEQ ID NO: 612856 - DNA, 20 bp, Artificial
  CRISPR gRNA sequence
gttttgggggaatatccatg

SEQ ID NO: 612857 - DNA, 20 bp, Artificial
  CRISPR gRNA sequence
tgggggaatatccatgaggc

SEQ ID NO: 612858 - DNA, 20 bp, Artificial
  CRISPR gRNA sequence
atccatgaggcaagactcaa

SEQ ID NO: 612859 - DNA, 20 bp, Artificial
  CRISPR gRNA sequence
tccatgaggcaagactcaaa

SEQ ID NO: 612860 - DNA, 20 bp, Artificial
  CRISPR gRNA sequence
atgaggcaagactcaaaagg

SEQ ID NO: 612861 - DNA, 20 bp, Artificial
  CRISPR gRNA sequence
aagactcaaaaggcagttgc

SEQ ID NO: 612862 - DNA, 20 bp, Artificial
  CRISPR gRNA sequence
tcaaaaggcagttgcaagta

SEQ ID NO: 612863 - DNA, 20 bp, Artificial
  CRISPR gRNA sequence
cagttgcaagtatggatttg

SEQ ID NO: 612864 - DNA, 20 bp, Artificial
  CRISPR gRNA sequence
ttgcaagtatggatttgaag

SEQ ID NO: 612865 - DNA, 20 bp, Artificial
  CRISPR gRNA sequence
atggatttgaagtagtcatt

SEQ ID NO: 612866 - DNA, 20 bp, Artificial
  CRISPR gRNA sequence
tgtattatcaatttaaaatt

SEQ ID NO: 612867 - DNA, 20 bp, Artificial
  CRISPR gRNA sequence
aatttaaaattgagtaaaac

SEQ ID NO: 612868 - DNA, 20 bp, Artificial
  CRISPR gRNA sequence
acaagatctctctcctcatg

SEQ ID NO: 612869 - DNA, 20 bp, Artificial
  CRISPR gRNA sequence
tcctcatgaagctcatcgtt

SEQ ID NO: 612870 - DNA, 20 bp, Artificial
  CRISPR gRNA sequence
atgaagctcatcgtttggac

SEQ ID NO: 612871 - DNA, 20 bp, Artificial
  CRISPR gRNA sequence
tgaagctcatcgtttggact

SEQ ID NO: 612872 - DNA, 20 bp, Artificial
  CRISPR gRNA sequence
gaagctcatcgtttggacta

SEQ ID NO: 612873 - DNA, 20 bp, Artificial
  CRISPR gRNA sequence
gtttggactagggaaataaa

SEQ ID NO: 612874 - DNA, 20 bp, Artificial
  CRISPR gRNA sequence
tttggactagggaaataaat

SEQ ID NO: 612875 - DNA, 20 bp, Artificial
  CRISPR gRNA sequence
ggaaataaataggtatccga

SEQ ID NO: 612876 - DNA, 20 bp, Artificial
  CRISPR gRNA sequence
tccgatggttaattacaaca

SEQ ID NO: 612877 - DNA, 20 bp, Artificial
  CRISPR gRNA sequence
aattacaacacagttgttat

SEQ ID NO: 612878 - DNA, 20 bp, Artificial
  CRISPR gRNA sequence
tgttataagtaatgcatcaa

SEQ ID NO: 612879 - DNA, 20 bp, Artificial
  CRISPR gRNA sequence
ttataagtaatgcatcaaca

SEQ ID NO: 612880 - DNA, 20 bp, Artificial
  CRISPR gRNA sequence
atgcatcaacagagtacgaa

SEQ ID NO: 612881 - DNA, 20 bp, Artificial
  CRISPR gRNA sequence
gcatcaacagagtacgaaca

SEQ ID NO: 612882 - DNA, 20 bp, Artificial
  CRISPR gRNA sequence
gagtacgaacagagttctgt

SEQ ID NO: 612883 - DNA, 20 bp, Artificial
  CRISPR gRNA sequence
gtacgaacagagttctgtga

SEQ ID NO: 612884 - DNA, 20 bp, Artificial
  CRISPR gRNA sequence
cgaacagagttctgtgagag

SEQ ID NO: 612885 - DNA, 20 bp, Artificial
  CRISPR gRNA sequence
aacagagttctgtgagagca

SEQ ID NO: 612886 - DNA, 20 bp, Artificial
  CRISPR gRNA sequence
acagagttctgtgagagcag

SEQ ID NO: 612887 - DNA, 20 bp, Artificial
  CRISPR gRNA sequence
agagttctgtgagagcagag

SEQ ID NO: 612888 - DNA, 20 bp, Artificial
  CRISPR gRNA sequence
ttctgtgagagcagaggaga

SEQ ID NO: 612889 - DNA, 20 bp, Artificial
  CRISPR gRNA sequence
tgtcctgatgctcttcgttt

SEQ ID NO: 612890 - DNA, 20 bp, Artificial
  CRISPR gRNA sequence
gatgctcttcgttttggttg

SEQ ID NO: 612891 - DNA, 20 bp, Artificial
  CRISPR gRNA sequence
atgctcttcgttttggttgt

SEQ ID NO: 612892 - DNA, 20 bp, Artificial
  CRISPR gRNA sequence
tgctcttcgttttggttgta

SEQ ID NO: 612893 - DNA, 20 bp, Artificial
  CRISPR gRNA sequence
tcttcgttttggttgtaggg

SEQ ID NO: 612894 - DNA, 20 bp, Artificial
  CRISPR gRNA sequence
cttcgttttggttgtaggga

SEQ ID NO: 612895 - DNA, 20 bp, Artificial
  CRISPR gRNA sequence
ttcgttttggttgtagggaa

SEQ ID NO: 612896 - DNA, 20 bp, Artificial
  CRISPR gRNA sequence
ttgtagggaagggattcact

SEQ ID NO: 612897 - DNA, 20 bp, Artificial
  CRISPR gRNA sequence
gggattcactcagacattga

SEQ ID NO: 612898 - DNA, 20 bp, Artificial
  CRISPR gRNA sequence
cagacattgaaagatgtaca

SEQ ID NO: 612899 - DNA, 20 bp, Artificial
  CRISPR gRNA sequence
cattgaaagatgtacatggc

SEQ ID NO: 612900 - DNA, 20 bp, Artificial
  CRISPR gRNA sequence
gaaagatgtacatggccagt

SEQ ID NO: 612901 - DNA, 20 bp, Artificial
  CRISPR gRNA sequence
aagatgtacatggccagttg

SEQ ID NO: 612902 - DNA, 20 bp, Artificial
  CRISPR gRNA sequence
ccagttggagcttacaaaca

SEQ ID NO: 612903 - DNA, 20 bp, Artificial
  CRISPR gRNA sequence
cagttggagcttacaaacat

SEQ ID NO: 612904 - DNA, 20 bp, Artificial
  CRISPR gRNA sequence
aaattattcttgacctgatg

SEQ ID NO: 612905 - DNA, 20 bp, Artificial
  CRISPR gRNA sequence
tgtggatgtttcataaaaat

SEQ ID NO: 612906 - DNA, 20 bp, Artificial
  CRISPR gRNA sequence
ataaaaatgagcacttcatt

SEQ ID NO: 612907 - DNA, 20 bp, Artificial
  CRISPR gRNA sequence
aaaaatgagcacttcattta

SEQ ID NO: 612908 - DNA, 20 bp, Artificial
  CRISPR gRNA sequence
aaatgagcacttcatttaga

SEQ ID NO: 612909 - DNA, 20 bp, Artificial
  CRISPR gRNA sequence
agcacttcatttagagagca

SEQ ID NO: 612910 - DNA, 20 bp, Artificial
  CRISPR gRNA sequence
cacttcatttagagagcaaa

SEQ ID NO: 612911 - DNA, 20 bp, Artificial
  CRISPR gRNA sequence
acttcatttagagagcaaag

SEQ ID NO: 612912 - DNA, 20 bp, Artificial
  CRISPR gRNA sequence
cttcatttagagagcaaaga

SEQ ID NO: 612913 - DNA, 20 bp, Artificial
  CRISPR gRNA sequence
tcatttagagagcaaagagg

SEQ ID NO: 612914 - DNA, 20 bp, Artificial
  CRISPR gRNA sequence
aagagggagaacattgtact

SEQ ID NO: 612915 - DNA, 20 bp, Artificial
  CRISPR gRNA sequence
tgtactgagaacaatatctg

SEQ ID NO: 612916 - DNA, 20 bp, Artificial
  CRISPR gRNA sequence
gtactgagaacaatatctga

SEQ ID NO: 612917 - DNA, 20 bp, Artificial
  CRISPR gRNA sequence
tactgagaacaatatctgaa

SEQ ID NO: 612918 - DNA, 20 bp, Artificial
  CRISPR gRNA sequence
gatgcatataacatatttgc

SEQ ID NO: 612919 - DNA, 20 bp, Artificial
  CRISPR gRNA sequence
catataacatatttgcaagt

SEQ ID NO: 612920 - DNA, 20 bp, Artificial
  CRISPR gRNA sequence
atataacatatttgcaagtt

SEQ ID NO: 612921 - DNA, 20 bp, Artificial
  CRISPR gRNA sequence
ttgcaagttaggaaaaaact

SEQ ID NO: 612922 - DNA, 20 bp, Artificial
  CRISPR gRNA sequence
caagttaggaaaaaactgag

SEQ ID NO: 612923 - DNA, 20 bp, Artificial
  CRISPR gRNA sequence
gttaggaaaaaactgagaag

SEQ ID NO: 612924 - DNA, 20 bp, Artificial
  CRISPR gRNA sequence
ggaaaaaactgagaagcagt

SEQ ID NO: 612925 - DNA, 20 bp, Artificial
  CRISPR gRNA sequence
gaaaaaactgagaagcagtg

SEQ ID NO: 612926 - DNA, 20 bp, Artificial
  CRISPR gRNA sequence
aaaaaactgagaagcagtga

SEQ ID NO: 612927 - DNA, 20 bp, Artificial
  CRISPR gRNA sequence
agaagcagtgagggcgaatg

SEQ ID NO: 612928 - DNA, 20 bp, Artificial
  CRISPR gRNA sequence
gaagcagtgagggcgaatgt

SEQ ID NO: 612929 - DNA, 20 bp, Artificial
  CRISPR gRNA sequence
gcgaatgtaggatctgatct

SEQ ID NO: 612930 - DNA, 20 bp, Artificial
  CRISPR gRNA sequence
tctgatctcagacgctaaaa

SEQ ID NO: 612931 - DNA, 20 bp, Artificial
  CRISPR gRNA sequence
ctgatctcagacgctaaaac

SEQ ID NO: 612932 - DNA, 20 bp, Artificial
  CRISPR gRNA sequence
gatctcagacgctaaaacag

SEQ ID NO: 612933 - DNA, 20 bp, Artificial
  CRISPR gRNA sequence
gacgctaaaacaggagaccc

SEQ ID NO: 612934 - DNA, 20 bp, Artificial
  CRISPR gRNA sequence
aaacaggagacccaagacac

SEQ ID NO: 612935 - DNA, 20 bp, Artificial
  CRISPR gRNA sequence
aggagacccaagacacaaga

SEQ ID NO: 612936 - DNA, 20 bp, Artificial
  CRISPR gRNA sequence
caagacacaagaaagcttga

SEQ ID NO: 612937 - DNA, 20 bp, Artificial
  CRISPR gRNA sequence
gacacaagaaagcttgatag

SEQ ID NO: 612938 - DNA, 20 bp, Artificial
  CRISPR gRNA sequence
aagaaagcttgatagtggcc

SEQ ID NO: 612939 - DNA, 20 bp, Artificial
  CRISPR gRNA sequence
gaaagcttgatagtggccaa

SEQ ID NO: 612940 - DNA, 20 bp, Artificial
  CRISPR gRNA sequence
cttgatagtggccaagagat

SEQ ID NO: 612941 - DNA, 20 bp, Artificial
  CRISPR gRNA sequence
ttgatagtggccaagagatt

SEQ ID NO: 612942 - DNA, 20 bp, Artificial
  CRISPR gRNA sequence
atagtggccaagagattagg

SEQ ID NO: 612943 - DNA, 20 bp, Artificial
  CRISPR gRNA sequence
tggccaagagattaggaaga

SEQ ID NO: 612944 - DNA, 20 bp, Artificial
  CRISPR gRNA sequence
gccaagagattaggaagaca

SEQ ID NO: 612945 - DNA, 20 bp, Artificial
  CRISPR gRNA sequence
ccaagagattaggaagacag

SEQ ID NO: 612946 - DNA, 20 bp, Artificial
  CRISPR gRNA sequence
ggaagacagaggattaataa

SEQ ID NO: 612947 - DNA, 20 bp, Artificial
  CRISPR gRNA sequence
agaggattaataaaagccta

SEQ ID NO: 612948 - DNA, 20 bp, Artificial
  CRISPR gRNA sequence
ttaataaaagcctatggatt

SEQ ID NO: 612949 - DNA, 20 bp, Artificial
  CRISPR gRNA sequence
agcctatggatttagtgatt

SEQ ID NO: 612950 - DNA, 20 bp, Artificial
  CRISPR gRNA sequence
cctatggatttagtgattca

SEQ ID NO: 612951 - DNA, 20 bp, Artificial
  CRISPR gRNA sequence
tttcaaaaatgtttcaataa

SEQ ID NO: 612952 - DNA, 20 bp, Artificial
  CRISPR gRNA sequence
caaaaatgtttcaataatag

SEQ ID NO: 612953 - DNA, 20 bp, Artificial
  CRISPR gRNA sequence
tgtttcaataatagcagaaa

SEQ ID NO: 612954 - DNA, 20 bp, Artificial
  CRISPR gRNA sequence
atagcagaaaaagtccgctt

SEQ ID NO: 612955 - DNA, 20 bp, Artificial
  CRISPR gRNA sequence
cagaaaaagtccgcttcagt

SEQ ID NO: 612956 - DNA, 20 bp, Artificial
  CRISPR gRNA sequence
cttcagttggtaacaatatg

SEQ ID NO: 612957 - DNA, 20 bp, Artificial
  CRISPR gRNA sequence
taataactattataaaaata

SEQ ID NO: 612958 - DNA, 20 bp, Artificial
  CRISPR gRNA sequence
aataactattataaaaataa

SEQ ID NO: 612959 - DNA, 20 bp, Artificial
  CRISPR gRNA sequence
aactattataaaaataaagg

SEQ ID NO: 612960 - DNA, 20 bp, Artificial
  CRISPR gRNA sequence
aaataaaggtagtgaaatat

SEQ ID NO: 612961 - DNA, 20 bp, Artificial
  CRISPR gRNA sequence
attaattatgtattacttta

SEQ ID NO: 612962 - DNA, 20 bp, Artificial
  CRISPR gRNA sequence
tttaaagataaactcatgta

SEQ ID NO: 612963 - DNA, 20 bp, Artificial
  CRISPR gRNA sequence
tgtacagataaacacatgta

SEQ ID NO: 612964 - DNA, 20 bp, Artificial
  CRISPR gRNA sequence
gtacagataaacacatgtat

SEQ ID NO: 612965 - DNA, 20 bp, Artificial
  CRISPR gRNA sequence
tacagataaacacatgtata

SEQ ID NO: 612966 - DNA, 20 bp, Artificial
  CRISPR gRNA sequence
cagataaacacatgtatagg

SEQ ID NO: 612967 - DNA, 20 bp, Artificial
  CRISPR gRNA sequence
taaacacatgtatagggagt

SEQ ID NO: 612968 - DNA, 20 bp, Artificial
  CRISPR gRNA sequence
tttttatgaactttattttt

SEQ ID NO: 612969 - DNA, 20 bp, Artificial
  CRISPR gRNA sequence
tgaactttatttttaagaaa

SEQ ID NO: 612970 - DNA, 20 bp, Artificial
  CRISPR gRNA sequence
ttttaagaaatagtatgaaa

SEQ ID NO: 612971 - DNA, 20 bp, Artificial
  CRISPR gRNA sequence
aagaaatagtatgaaatgga

SEQ ID NO: 612972 - DNA, 20 bp, Artificial
  CRISPR gRNA sequence
agtatgaaatggatagaaaa

SEQ ID NO: 612973 - DNA, 20 bp, Artificial
  CRISPR gRNA sequence
atggatagaaaatggtcttg

SEQ ID NO: 612974 - DNA, 20 bp, Artificial
  CRISPR gRNA sequence
ggatagaaaatggtcttgtg

SEQ ID NO: 612975 - DNA, 20 bp, Artificial
  CRISPR gRNA sequence
agaaaatggtcttgtggaga

SEQ ID NO: 612976 - DNA, 20 bp, Artificial
  CRISPR gRNA sequence
aaatggtcttgtggagatag

SEQ ID NO: 612977 - DNA, 20 bp, Artificial
  CRISPR gRNA sequence
atggtcttgtggagatagca

SEQ ID NO: 612978 - DNA, 20 bp, Artificial
  CRISPR gRNA sequence
tagcagagccattgaatttg

SEQ ID NO: 612979 - DNA, 20 bp, Artificial
  CRISPR gRNA sequence
agcagagccattgaatttgc

SEQ ID NO: 612980 - DNA, 20 bp, Artificial
  CRISPR gRNA sequence
gcagagccattgaatttgca

SEQ ID NO: 612981 - DNA, 20 bp, Artificial
  CRISPR gRNA sequence
attgaatttgcagggattgt

SEQ ID NO: 612982 - DNA, 20 bp, Artificial
  CRISPR gRNA sequence
atgtctgaaaacaattttca

SEQ ID NO: 612983 - DNA, 20 bp, Artificial
  CRISPR gRNA sequence
tgtctgaaaacaattttcaa

SEQ ID NO: 612984 - DNA, 20 bp, Artificial
  CRISPR gRNA sequence
tctgaaaacaattttcaaag

SEQ ID NO: 612985 - DNA, 20 bp, Artificial
  CRISPR gRNA sequence
gaaaacaattttcaaaggag

SEQ ID NO: 612986 - DNA, 20 bp, Artificial
  CRISPR gRNA sequence
acaattttcaaaggagtagt

SEQ ID NO: 612987 - DNA, 20 bp, Artificial
  CRISPR gRNA sequence
caattttcaaaggagtagta

SEQ ID NO: 612988 - DNA, 20 bp, Artificial
  CRISPR gRNA sequence
aattttcaaaggagtagtaa

SEQ ID NO: 612989 - DNA, 20 bp, Artificial
  CRISPR gRNA sequence
tttcaaaggagtagtaaggg

SEQ ID NO: 612990 - DNA, 20 bp, Artificial
  CRISPR gRNA sequence
ggagtagtaagggcagaatg

SEQ ID NO: 612991 - DNA, 20 bp, Artificial
  CRISPR gRNA sequence
agggcagaatgtagactttg

SEQ ID NO: 612992 - DNA, 20 bp, Artificial
  CRISPR gRNA sequence
gggcagaatgtagactttga

SEQ ID NO: 612993 - DNA, 20 bp, Artificial
  CRISPR gRNA sequence
gcagaatgtagactttgaag

SEQ ID NO: 612994 - DNA, 20 bp, Artificial
  CRISPR gRNA sequence
atgtagactttgaaggagct

SEQ ID NO: 612995 - DNA, 20 bp, Artificial
  CRISPR gRNA sequence
ctttgaaggagctaagtata

SEQ ID NO: 612996 - DNA, 20 bp, Artificial
  CRISPR gRNA sequence
ttgaaggagctaagtatata

SEQ ID NO: 612997 - DNA, 20 bp, Artificial
  CRISPR gRNA sequence
tgaaggagctaagtatatag

SEQ ID NO: 612998 - DNA, 20 bp, Artificial
  CRISPR gRNA sequence
tagaggaaaataaatgacta

SEQ ID NO: 612999 - DNA, 20 bp, Artificial
  CRISPR gRNA sequence
agaggaaaataaatgactac

SEQ ID NO: 613000 - DNA, 20 bp, Artificial
  CRISPR gRNA sequence
aaataaatgactacaggtct

SEQ ID NO: 613001 - DNA, 20 bp, Artificial
  CRISPR gRNA sequence
tataatgactactttttctt

SEQ ID NO: 613002 - DNA, 20 bp, Artificial
  CRISPR gRNA sequence
tgaaatgttcctacttcaaa

SEQ ID NO: 613003 - DNA, 20 bp, Artificial
  CRISPR gRNA sequence
cttgttcaaccttttcaaac

SEQ ID NO: 613004 - DNA, 20 bp, Artificial
  CRISPR gRNA sequence
taaatgtctgtctgcctcac

SEQ ID NO: 613005 - DNA, 20 bp, Artificial
  CRISPR gRNA sequence
tgtctgcctcaccagactgt

SEQ ID NO: 613006 - DNA, 20 bp, Artificial
  CRISPR gRNA sequence
accagactgtcagttgcata

SEQ ID NO: 613007 - DNA, 20 bp, Artificial
  CRISPR gRNA sequence
gactgtcagttgcatacgga

SEQ ID NO: 613008 - DNA, 20 bp, Artificial
  CRISPR gRNA sequence
actgtcagttgcatacggat

SEQ ID NO: 613009 - DNA, 20 bp, Artificial
  CRISPR gRNA sequence
ttgcatacggataggcacca

SEQ ID NO: 613010 - DNA, 20 bp, Artificial
  CRISPR gRNA sequence
tgcatacggataggcaccat

SEQ ID NO: 613011 - DNA, 20 bp, Artificial
  CRISPR gRNA sequence
ttgttttccactttacattt

SEQ ID NO: 613012 - DNA, 20 bp, Artificial
  CRISPR gRNA sequence
actttacattttagcctcat

SEQ ID NO: 613013 - DNA, 20 bp, Artificial
  CRISPR gRNA sequence
cattttagcctcatgagcat

SEQ ID NO: 613014 - DNA, 20 bp, Artificial
  CRISPR gRNA sequence
gcctcatgagcattggtaca

SEQ ID NO: 613015 - DNA, 20 bp, Artificial
  CRISPR gRNA sequence
tcatgagcattggtacatag

SEQ ID NO: 613016 - DNA, 20 bp, Artificial
  CRISPR gRNA sequence
tagtctgttattgaatgaat

SEQ ID NO: 613017 - DNA, 20 bp, Artificial
  CRISPR gRNA sequence
gtctgttattgaatgaatga

SEQ ID NO: 613018 - DNA, 20 bp, Artificial
  CRISPR gRNA sequence
ctgttattgaatgaatgaga

SEQ ID NO: 613019 - DNA, 20 bp, Artificial
  CRISPR gRNA sequence
tgttattgaatgaatgagag

SEQ ID NO: 613020 - DNA, 20 bp, Artificial
  CRISPR gRNA sequence
tgaatgaatgagagaggtaa

SEQ ID NO: 613021 - DNA, 20 bp, Artificial
  CRISPR gRNA sequence
gaatgaatgagagaggtaaa

SEQ ID NO: 613022 - DNA, 20 bp, Artificial
  CRISPR gRNA sequence
gaatgagagaggtaaaagga

SEQ ID NO: 613023 - DNA, 20 bp, Artificial
  CRISPR gRNA sequence
gtaaaaggatagattgtctc

SEQ ID NO: 613024 - DNA, 20 bp, Artificial
  CRISPR gRNA sequence
aaaaggatagattgtctcca

SEQ ID NO: 613025 - DNA, 20 bp, Artificial
  CRISPR gRNA sequence
tgtctccagagcaaatttat

SEQ ID NO: 613026 - DNA, 20 bp, Artificial
  CRISPR gRNA sequence
cagagcaaatttattggaaa

SEQ ID NO: 613027 - DNA, 20 bp, Artificial
  CRISPR gRNA sequence
caaatttattggaaatagaa

SEQ ID NO: 613028 - DNA, 20 bp, Artificial
  CRISPR gRNA sequence
attggaaatagaatagtttt

SEQ ID NO: 613029 - DNA, 20 bp, Artificial
  CRISPR gRNA sequence
ccaacatgtcacctaataat

SEQ ID NO: 613030 - DNA, 20 bp, Artificial
  CRISPR gRNA sequence
caacatgtcacctaataatt

SEQ ID NO: 613031 - DNA, 20 bp, Artificial
  CRISPR gRNA sequence
tcacctaataattgggttgc

SEQ ID NO: 613032 - DNA, 20 bp, Artificial
  CRISPR gRNA sequence
taataattgggttgctggaa

SEQ ID NO: 613033 - DNA, 20 bp, Artificial
  CRISPR gRNA sequence
attgggttgctggaatagaa

SEQ ID NO: 613034 - DNA, 20 bp, Artificial
  CRISPR gRNA sequence
tgggttgctggaatagaatg

SEQ ID NO: 613035 - DNA, 20 bp, Artificial
  CRISPR gRNA sequence
gctggaatagaatggagatg

SEQ ID NO: 613036 - DNA, 20 bp, Artificial
  CRISPR gRNA sequence
tggaatagaatggagatgaa

SEQ ID NO: 613037 - DNA, 20 bp, Artificial
  CRISPR gRNA sequence
atagaatggagatgaagagt

SEQ ID NO: 613038 - DNA, 20 bp, Artificial
  CRISPR gRNA sequence
tagaatggagatgaagagtt

SEQ ID NO: 613039 - DNA, 20 bp, Artificial
  CRISPR gRNA sequence
agatgaagagttgggaaaat

SEQ ID NO: 613040 - DNA, 20 bp, Artificial
  CRISPR gRNA sequence
gatgaagagttgggaaaatt

SEQ ID NO: 613041 - DNA, 20 bp, Artificial
  CRISPR gRNA sequence
atgaagagttgggaaaatta

SEQ ID NO: 613042 - DNA, 20 bp, Artificial
  CRISPR gRNA sequence
gaaaattagggttatacatt

SEQ ID NO: 613043 - DNA, 20 bp, Artificial
  CRISPR gRNA sequence
agggttatacatttagaaca

SEQ ID NO: 613044 - DNA, 20 bp, Artificial
  CRISPR gRNA sequence
atttagaacaaagcccaact

SEQ ID NO: 613045 - DNA, 20 bp, Artificial
  CRISPR gRNA sequence
agcccaactcagatccctgt

SEQ ID NO: 613046 - DNA, 20 bp, Artificial
  CRISPR gRNA sequence
atccctgttggactcaatga

SEQ ID NO: 613047 - DNA, 20 bp, Artificial
  CRISPR gRNA sequence
tccctgttggactcaatgat

SEQ ID NO: 613048 - DNA, 20 bp, Artificial
  CRISPR gRNA sequence
ttggactcaatgatgggatg

SEQ ID NO: 613049 - DNA, 20 bp, Artificial
  CRISPR gRNA sequence
ggactcaatgatgggatgaa

SEQ ID NO: 613050 - DNA, 20 bp, Artificial
  CRISPR gRNA sequence
gactcaatgatgggatgaag

SEQ ID NO: 613051 - DNA, 20 bp, Artificial
  CRISPR gRNA sequence
tcaatgatgggatgaagagg

SEQ ID NO: 613052 - DNA, 20 bp, Artificial
  CRISPR gRNA sequence
caatgatgggatgaagagga

SEQ ID NO: 613053 - DNA, 20 bp, Artificial
  CRISPR gRNA sequence
atgatgggatgaagaggaag

SEQ ID NO: 613054 - DNA, 20 bp, Artificial
  CRISPR gRNA sequence
gaaggagtgatgctttaaaa

SEQ ID NO: 613055 - DNA, 20 bp, Artificial
  CRISPR gRNA sequence
aggagtgatgctttaaaata

SEQ ID NO: 613056 - DNA, 20 bp, Artificial
  CRISPR gRNA sequence
ggagtgatgctttaaaatag

SEQ ID NO: 613057 - DNA, 20 bp, Artificial
  CRISPR gRNA sequence
ctttaaaatagaggacaaaa

SEQ ID NO: 613058 - DNA, 20 bp, Artificial
  CRISPR gRNA sequence
tttaaaatagaggacaaaat

SEQ ID NO: 613059 - DNA, 20 bp, Artificial
  CRISPR gRNA sequence
taaaatagaggacaaaatgg

SEQ ID NO: 613060 - DNA, 20 bp, Artificial
  CRISPR gRNA sequence
aatagaggacaaaatgggag

SEQ ID NO: 613061 - DNA, 20 bp, Artificial
  CRISPR gRNA sequence
aaatgggagaagctgaaata

SEQ ID NO: 613062 - DNA, 20 bp, Artificial
  CRISPR gRNA sequence
tgggagaagctgaaataaag

SEQ ID NO: 613063 - DNA, 20 bp, Artificial
  CRISPR gRNA sequence
agaagctgaaataaagcaga

SEQ ID NO: 613064 - DNA, 20 bp, Artificial
  CRISPR gRNA sequence
gaagctgaaataaagcagat

SEQ ID NO: 613065 - DNA, 20 bp, Artificial
  CRISPR gRNA sequence
ctgaaataaagcagatggga

SEQ ID NO: 613066 - DNA, 20 bp, Artificial
  CRISPR gRNA sequence
aaagcagatgggatagtaat

SEQ ID NO: 613067 - DNA, 20 bp, Artificial
  CRISPR gRNA sequence
agcagatgggatagtaatga

SEQ ID NO: 613068 - DNA, 20 bp, Artificial
  CRISPR gRNA sequence
agatgggatagtaatgagag

SEQ ID NO: 613069 - DNA, 20 bp, Artificial
  CRISPR gRNA sequence
atagtaatgagagtagtaaa

SEQ ID NO: 613070 - DNA, 20 bp, Artificial
  CRISPR gRNA sequence
taatgagagtagtaaaaagt

SEQ ID NO: 613071 - DNA, 20 bp, Artificial
  CRISPR gRNA sequence
tgagagtagtaaaaagtgag

SEQ ID NO: 613072 - DNA, 20 bp, Artificial
  CRISPR gRNA sequence
acatgtctcttccttcttat

SEQ ID NO: 613073 - DNA, 20 bp, Artificial
  CRISPR gRNA sequence
catgtctcttccttcttatc

SEQ ID NO: 613074 - DNA, 20 bp, Artificial
  CRISPR gRNA sequence
tctcttccttcttatcaggt

SEQ ID NO: 613075 - DNA, 20 bp, Artificial
  CRISPR gRNA sequence
ttccttcttatcaggtgagt

SEQ ID NO: 613076 - DNA, 20 bp, Artificial
  CRISPR gRNA sequence
tccttcttatcaggtgagtt

SEQ ID NO: 613077 - DNA, 20 bp, Artificial
  CRISPR gRNA sequence
atcaggtgagttgggacttt

SEQ ID NO: 613078 - DNA, 20 bp, Artificial
  CRISPR gRNA sequence
caggtgagttgggactttta

SEQ ID NO: 613079 - DNA, 20 bp, Artificial
  CRISPR gRNA sequence
aggtgagttgggacttttag

SEQ ID NO: 613080 - DNA, 20 bp, Artificial
  CRISPR gRNA sequence
ggtgagttgggacttttaga

SEQ ID NO: 613081 - DNA, 20 bp, Artificial
  CRISPR gRNA sequence
tgggacttttagagggttgt

SEQ ID NO: 613082 - DNA, 20 bp, Artificial
  CRISPR gRNA sequence
cttttagagggttgtgagcc

SEQ ID NO: 613083 - DNA, 20 bp, Artificial
  CRISPR gRNA sequence
ttttagagggttgtgagcca

SEQ ID NO: 613084 - DNA, 20 bp, Artificial
  CRISPR gRNA sequence
tttagagggttgtgagccaa

SEQ ID NO: 613085 - DNA, 20 bp, Artificial
  CRISPR gRNA sequence
ttagagggttgtgagccaag

SEQ ID NO: 613086 - DNA, 20 bp, Artificial
  CRISPR gRNA sequence
gggttgtgagccaaggggaa

SEQ ID NO: 613087 - DNA, 20 bp, Artificial
  CRISPR gRNA sequence
aaccatgtttcaattaaatt

SEQ ID NO: 613088 - DNA, 20 bp, Artificial
  CRISPR gRNA sequence
catgtttcaattaaattgag

SEQ ID NO: 613089 - DNA, 20 bp, Artificial
  CRISPR gRNA sequence
atgtttcaattaaattgaga

SEQ ID NO: 613090 - DNA, 20 bp, Artificial
  CRISPR gRNA sequence
gaaggtataatgattgctta

SEQ ID NO: 613091 - DNA, 20 bp, Artificial
  CRISPR gRNA sequence
taatgattgcttacagaaat

SEQ ID NO: 613092 - DNA, 20 bp, Artificial
  CRISPR gRNA sequence
aatgattgcttacagaaata

SEQ ID NO: 613093 - DNA, 20 bp, Artificial
  CRISPR gRNA sequence
atgattgcttacagaaataa

SEQ ID NO: 613094 - DNA, 20 bp, Artificial
  CRISPR gRNA sequence
tgattgcttacagaaataag

SEQ ID NO: 613095 - DNA, 20 bp, Artificial
  CRISPR gRNA sequence
ttgcttacagaaataagggg

SEQ ID NO: 613096 - DNA, 20 bp, Artificial
  CRISPR gRNA sequence
ttacagaaataaggggaaga

SEQ ID NO: 613097 - DNA, 20 bp, Artificial
  CRISPR gRNA sequence
gaaataaggggaagaaagta

SEQ ID NO: 613098 - DNA, 20 bp, Artificial
  CRISPR gRNA sequence
aaataaggggaagaaagtat

SEQ ID NO: 613099 - DNA, 20 bp, Artificial
  CRISPR gRNA sequence
ataaggggaagaaagtatag

SEQ ID NO: 613100 - DNA, 20 bp, Artificial
  CRISPR gRNA sequence
agtataggagaatatgctca

SEQ ID NO: 613101 - DNA, 20 bp, Artificial
  CRISPR gRNA sequence
agaatatgctcatagtacaa

SEQ ID NO: 613102 - DNA, 20 bp, Artificial
  CRISPR gRNA sequence
aatatgctcatagtacaaca

SEQ ID NO: 613103 - DNA, 20 bp, Artificial
  CRISPR gRNA sequence
atatgctcatagtacaacag

SEQ ID NO: 613104 - DNA, 20 bp, Artificial
  CRISPR gRNA sequence
acagaggcatcataatgtga

SEQ ID NO: 613105 - DNA, 20 bp, Artificial
  CRISPR gRNA sequence
cagaggcatcataatgtgat

SEQ ID NO: 613106 - DNA, 20 bp, Artificial
  CRISPR gRNA sequence
taatgtgatgggactaatac

SEQ ID NO: 613107 - DNA, 20 bp, Artificial
  CRISPR gRNA sequence
aatgtgatgggactaatacc

SEQ ID NO: 613108 - DNA, 20 bp, Artificial
  CRISPR gRNA sequence
atgtgatgggactaatacca

SEQ ID NO: 613109 - DNA, 20 bp, Artificial
  CRISPR gRNA sequence
tgatgggactaataccaggg

SEQ ID NO: 613110 - DNA, 20 bp, Artificial
  CRISPR gRNA sequence
gactaataccagggaagacc

SEQ ID NO: 613111 - DNA, 20 bp, Artificial
  CRISPR gRNA sequence
ggaagacccggaaatgactg

SEQ ID NO: 613112 - DNA, 20 bp, Artificial
  CRISPR gRNA sequence
agacccggaaatgactgaag

SEQ ID NO: 613113 - DNA, 20 bp, Artificial
  CRISPR gRNA sequence
gaaatgactgaagtagttta

SEQ ID NO: 613114 - DNA, 20 bp, Artificial
  CRISPR gRNA sequence
atgactgaagtagtttacag

SEQ ID NO: 613115 - DNA, 20 bp, Artificial
  CRISPR gRNA sequence
tgactgaagtagtttacagc

SEQ ID NO: 613116 - DNA, 20 bp, Artificial
  CRISPR gRNA sequence
agtagtttacagcgggctat

SEQ ID NO: 613117 - DNA, 20 bp, Artificial
  CRISPR gRNA sequence
cgggctattagcttcaatgt

SEQ ID NO: 613118 - DNA, 20 bp, Artificial
  CRISPR gRNA sequence
cttcaatgtaagtgcttaat

SEQ ID NO: 613119 - DNA, 20 bp, Artificial
  CRISPR gRNA sequence
agtgcttaataagtattaat

SEQ ID NO: 613120 - DNA, 20 bp, Artificial
  CRISPR gRNA sequence
aattggttaataaacttgtt

SEQ ID NO: 613121 - DNA, 20 bp, Artificial
  CRISPR gRNA sequence
tataaattcattactatttc

SEQ ID NO: 613122 - DNA, 20 bp, Artificial
  CRISPR gRNA sequence
taaattcattactatttcta

SEQ ID NO: 613123 - DNA, 20 bp, Artificial
  CRISPR gRNA sequence
ctatttctagagaaatatta

SEQ ID NO: 613124 - DNA, 20 bp, Artificial
  CRISPR gRNA sequence
tttctagagaaatattacag

SEQ ID NO: 613125 - DNA, 20 bp, Artificial
  CRISPR gRNA sequence
ttacagaagaacccaaaact

SEQ ID NO: 613126 - DNA, 20 bp, Artificial
  CRISPR gRNA sequence
ccaaaactgagtaatgctaa

SEQ ID NO: 613127 - DNA, 20 bp, Artificial
  CRISPR gRNA sequence
tgagtaatgctaatagtaaa

SEQ ID NO: 613128 - DNA, 20 bp, Artificial
  CRISPR gRNA sequence
aacagatactttttgttatg

SEQ ID NO: 613129 - DNA, 20 bp, Artificial
  CRISPR gRNA sequence
tgttatgtagtcccatatct

SEQ ID NO: 613130 - DNA, 20 bp, Artificial
  CRISPR gRNA sequence
attacatgtaaatttattta

SEQ ID NO: 613131 - DNA, 20 bp, Artificial
  CRISPR gRNA sequence
tttatttatagtatttacac

SEQ ID NO: 613132 - DNA, 20 bp, Artificial
  CRISPR gRNA sequence
gtatttacactagatgattt

SEQ ID NO: 613133 - DNA, 20 bp, Artificial
  CRISPR gRNA sequence
gtatttttaatgctgtcaca

SEQ ID NO: 613134 - DNA, 20 bp, Artificial
  CRISPR gRNA sequence
atgctgtcacatggtgatac

SEQ ID NO: 613135 - DNA, 20 bp, Artificial
  CRISPR gRNA sequence
atggtgatacaagttctgca

SEQ ID NO: 613136 - DNA, 20 bp, Artificial
  CRISPR gRNA sequence
caagttctgcacagtattct

SEQ ID NO: 613137 - DNA, 20 bp, Artificial
  CRISPR gRNA sequence
cagtattctcagctacttcc

SEQ ID NO: 613138 - DNA, 20 bp, Artificial
  CRISPR gRNA sequence
agctacttcccagaaatcca

SEQ ID NO: 613139 - DNA, 20 bp, Artificial
  CRISPR gRNA sequence
aaatccatggttccaaaaaa

SEQ ID NO: 613140 - DNA, 20 bp, Artificial
  CRISPR gRNA sequence
tccatggttccaaaaaatag

SEQ ID NO: 613141 - DNA, 20 bp, Artificial
  CRISPR gRNA sequence
tggttccaaaaaatagaagc

SEQ ID NO: 613142 - DNA, 20 bp, Artificial
  CRISPR gRNA sequence
aaaatagaagctggtttgcc

SEQ ID NO: 613143 - DNA, 20 bp, Artificial
  CRISPR gRNA sequence
tccataaataacttttatga

SEQ ID NO: 613144 - DNA, 20 bp, Artificial
  CRISPR gRNA sequence
tgtacctcaattacaatcta

SEQ ID NO: 613145 - DNA, 20 bp, Artificial
  CRISPR gRNA sequence
gtacctcaattacaatctaa

SEQ ID NO: 613146 - DNA, 20 bp, Artificial
  CRISPR gRNA sequence
tcaattacaatctaaaggtt

SEQ ID NO: 613147 - DNA, 20 bp, Artificial
  CRISPR gRNA sequence
tacaatctaaaggtttggtg

SEQ ID NO: 613148 - DNA, 20 bp, Artificial
  CRISPR gRNA sequence
ggtgtagctttctttttcat

SEQ ID NO: 613149 - DNA, 20 bp, Artificial
  CRISPR gRNA sequence
agctttctttttcatcagta

SEQ ID NO: 613150 - DNA, 20 bp, Artificial
  CRISPR gRNA sequence
catcagtacagtgaaacttt

SEQ ID NO: 613151 - DNA, 20 bp, Artificial
  CRISPR gRNA sequence
atcagtacagtgaaactttc

SEQ ID NO: 613152 - DNA, 20 bp, Artificial
  CRISPR gRNA sequence
agtacagtgaaactttcagg

SEQ ID NO: 613153 - DNA, 20 bp, Artificial
  CRISPR gRNA sequence
atgaataccttgccttgtta

SEQ ID NO: 613154 - DNA, 20 bp, Artificial
  CRISPR gRNA sequence
cttgccttgttatagtattt

SEQ ID NO: 613155 - DNA, 20 bp, Artificial
  CRISPR gRNA sequence
atttcagttcctcttgtgac

SEQ ID NO: 613156 - DNA, 20 bp, Artificial
  CRISPR gRNA sequence
tcctcttgtgaccagtgtca

SEQ ID NO: 613157 - DNA, 20 bp, Artificial
  CRISPR gRNA sequence
ttgtgaccagtgtcatagca

SEQ ID NO: 613158 - DNA, 20 bp, Artificial
  CRISPR gRNA sequence
tgtgaccagtgtcatagcat

SEQ ID NO: 613159 - DNA, 20 bp, Artificial
  CRISPR gRNA sequence
gtgtcatagcatgggtttat

SEQ ID NO: 613160 - DNA, 20 bp, Artificial
  CRISPR gRNA sequence
gcatgggtttataagttaac

SEQ ID NO: 613161 - DNA, 20 bp, Artificial
  CRISPR gRNA sequence
atgggtttataagttaactg

SEQ ID NO: 613162 - DNA, 20 bp, Artificial
  CRISPR gRNA sequence
gtttataagttaactggagt

SEQ ID NO: 613163 - DNA, 20 bp, Artificial
  CRISPR gRNA sequence
tttataagttaactggagtt

SEQ ID NO: 613164 - DNA, 20 bp, Artificial
  CRISPR gRNA sequence
ttataagttaactggagtta

SEQ ID NO: 613165 - DNA, 20 bp, Artificial
  CRISPR gRNA sequence
ggagttagggatgctatctt

SEQ ID NO: 613166 - DNA, 20 bp, Artificial
  CRISPR gRNA sequence
tgctatctttggtcatgaaa

SEQ ID NO: 613167 - DNA, 20 bp, Artificial
  CRISPR gRNA sequence
ctatctttggtcatgaaaaa

SEQ ID NO: 613168 - DNA, 20 bp, Artificial
  CRISPR gRNA sequence
agagttgtctgttattctct

SEQ ID NO: 613169 - DNA, 20 bp, Artificial
  CRISPR gRNA sequence
gcaaaactaaataattcctc

SEQ ID NO: 613170 - DNA, 20 bp, Artificial
  CRISPR gRNA sequence
caaaactaaataattcctct

SEQ ID NO: 613171 - DNA, 20 bp, Artificial
  CRISPR gRNA sequence
aaactaaataattcctctgg

SEQ ID NO: 613172 - DNA, 20 bp, Artificial
  CRISPR gRNA sequence
taattcctctgggagtcaaa

SEQ ID NO: 613173 - DNA, 20 bp, Artificial
  CRISPR gRNA sequence
attcctctgggagtcaaata

SEQ ID NO: 613174 - DNA, 20 bp, Artificial
  CRISPR gRNA sequence
ctgggagtcaaatagagaca

SEQ ID NO: 613175 - DNA, 20 bp, Artificial
  CRISPR gRNA sequence
tgggagtcaaatagagacac

SEQ ID NO: 613176 - DNA, 20 bp, Artificial
  CRISPR gRNA sequence
gtcaaatagagacacgggcc

SEQ ID NO: 613177 - DNA, 20 bp, Artificial
  CRISPR gRNA sequence
agacacgggcctggatcaca

SEQ ID NO: 613178 - DNA, 20 bp, Artificial
  CRISPR gRNA sequence
tcacacggtgctttactatt

SEQ ID NO: 613179 - DNA, 20 bp, Artificial
  CRISPR gRNA sequence
cacacggtgctttactattg

SEQ ID NO: 613180 - DNA, 20 bp, Artificial
  CRISPR gRNA sequence
acacggtgctttactattga

SEQ ID NO: 613181 - DNA, 20 bp, Artificial
  CRISPR gRNA sequence
tgctttactattgagggctt

SEQ ID NO: 613182 - DNA, 20 bp, Artificial
  CRISPR gRNA sequence
tactattgagggctttggca

SEQ ID NO: 613183 - DNA, 20 bp, Artificial
  CRISPR gRNA sequence
gggctttggcacagaccacc

SEQ ID NO: 613184 - DNA, 20 bp, Artificial
  CRISPR gRNA sequence
ggctttggcacagaccacct

SEQ ID NO: 613185 - DNA, 20 bp, Artificial
  CRISPR gRNA sequence
gctttggcacagaccacctg

SEQ ID NO: 613186 - DNA, 20 bp, Artificial
  CRISPR gRNA sequence
ttctgtattcattcaaaacc

SEQ ID NO: 613187 - DNA, 20 bp, Artificial
  CRISPR gRNA sequence
ctgtattcattcaaaaccaa

SEQ ID NO: 613188 - DNA, 20 bp, Artificial
  CRISPR gRNA sequence
tcattcaaaaccaagagtca

SEQ ID NO: 613189 - DNA, 20 bp, Artificial
  CRISPR gRNA sequence
tgctctgtgatgtccttatg

SEQ ID NO: 613190 - DNA, 20 bp, Artificial
  CRISPR gRNA sequence
ctctgtgatgtccttatgaa

SEQ ID NO: 613191 - DNA, 20 bp, Artificial
  CRISPR gRNA sequence
ttaaaacatgcttctttcca

SEQ ID NO: 613192 - DNA, 20 bp, Artificial
  CRISPR gRNA sequence
aaaacatgcttctttccata

SEQ ID NO: 613193 - DNA, 20 bp, Artificial
  CRISPR gRNA sequence
atttttcttctttgtttttt

SEQ ID NO: 613194 - DNA, 20 bp, Artificial
  CRISPR gRNA sequence
tttttcttctttgtttttta

SEQ ID NO: 613195 - DNA, 20 bp, Artificial
  CRISPR gRNA sequence
ttttttttaactgaacatct

SEQ ID NO: 613196 - DNA, 20 bp, Artificial
  CRISPR gRNA sequence
tgaacatcttagtattttaa

SEQ ID NO: 613197 - DNA, 20 bp, Artificial
  CRISPR gRNA sequence
agtattttaacagatgtatt

SEQ ID NO: 613198 - DNA, 20 bp, Artificial
  CRISPR gRNA sequence
tgtattgagataatgacact

SEQ ID NO: 613199 - DNA, 20 bp, Artificial
  CRISPR gRNA sequence
agataatgacactgagataa

SEQ ID NO: 613200 - DNA, 20 bp, Artificial
  CRISPR gRNA sequence
acactgagataatggctccc

SEQ ID NO: 613201 - DNA, 20 bp, Artificial
  CRISPR gRNA sequence
gataatggctccctagctat

SEQ ID NO: 613202 - DNA, 20 bp, Artificial
  CRISPR gRNA sequence
ataatggctccctagctatt

SEQ ID NO: 613203 - DNA, 20 bp, Artificial
  CRISPR gRNA sequence
taatggctccctagctatta

SEQ ID NO: 613204 - DNA, 20 bp, Artificial
  CRISPR gRNA sequence
ataattcatttccttaatgt

SEQ ID NO: 613205 - DNA, 20 bp, Artificial
  CRISPR gRNA sequence
ttccttaatgtgagatgttt

SEQ ID NO: 613206 - DNA, 20 bp, Artificial
  CRISPR gRNA sequence
tgtgtaataatcctgactca

SEQ ID NO: 613207 - DNA, 20 bp, Artificial
  CRISPR gRNA sequence
taatcctgactcaaagcacc

SEQ ID NO: 613208 - DNA, 20 bp, Artificial
  CRISPR gRNA sequence
tcctgactcaaagcacctag

SEQ ID NO: 613209 - DNA, 20 bp, Artificial
  CRISPR gRNA sequence
cctgactcaaagcacctagt

SEQ ID NO: 613210 - DNA, 20 bp, Artificial
  CRISPR gRNA sequence
gcacctagtaggttaattct

SEQ ID NO: 613211 - DNA, 20 bp, Artificial
  CRISPR gRNA sequence
gttaattcttggtattataa

SEQ ID NO: 613212 - DNA, 20 bp, Artificial
  CRISPR gRNA sequence
ttggtattataaaagctgat

SEQ ID NO: 613213 - DNA, 20 bp, Artificial
  CRISPR gRNA sequence
tggtattataaaagctgatg

SEQ ID NO: 613214 - DNA, 20 bp, Artificial
  CRISPR gRNA sequence
ggtattataaaagctgatga

SEQ ID NO: 613215 - DNA, 20 bp, Artificial
  CRISPR gRNA sequence
tattataaaagctgatgagg

SEQ ID NO: 613216 - DNA, 20 bp, Artificial
  CRISPR gRNA sequence
caaaattttgcatgtgtgaa

SEQ ID NO: 613217 - DNA, 20 bp, Artificial
  CRISPR gRNA sequence
atgtgtgaatagttgttacc

SEQ ID NO: 613218 - DNA, 20 bp, Artificial
  CRISPR gRNA sequence
tgtgtgaatagttgttacca

SEQ ID NO: 613219 - DNA, 20 bp, Artificial
  CRISPR gRNA sequence
aatagttgttaccaaggtga

SEQ ID NO: 613220 - DNA, 20 bp, Artificial
  CRISPR gRNA sequence
atagttgttaccaaggtgaa

SEQ ID NO: 613221 - DNA, 20 bp, Artificial
  CRISPR gRNA sequence
ttgttaccaaggtgaaagga

SEQ ID NO: 613222 - DNA, 20 bp, Artificial
  CRISPR gRNA sequence
tgttaccaaggtgaaaggaa

SEQ ID NO: 613223 - DNA, 20 bp, Artificial
  CRISPR gRNA sequence
tgtactttttctcaccactt

SEQ ID NO: 613224 - DNA, 20 bp, Artificial
  CRISPR gRNA sequence
tgagttctttttaatcttct

SEQ ID NO: 613225 - DNA, 20 bp, Artificial
  CRISPR gRNA sequence
ttttaatcttcttggtaccc

SEQ ID NO: 613226 - DNA, 20 bp, Artificial
  CRISPR gRNA sequence
ttattaaactgtgacatttc

SEQ ID NO: 613227 - DNA, 20 bp, Artificial
  CRISPR gRNA sequence
atttcaagttgttgcatttt

SEQ ID NO: 613228 - DNA, 20 bp, Artificial
  CRISPR gRNA sequence
attctctgcccttacccgaa

SEQ ID NO: 613229 - DNA, 20 bp, Artificial
  CRISPR gRNA sequence
accacaactcttgatgtatc

SEQ ID NO: 613230 - DNA, 20 bp, Artificial
  CRISPR gRNA sequence
ccacaactcttgatgtatct

SEQ ID NO: 613231 - DNA, 20 bp, Artificial
  CRISPR gRNA sequence
actcctgatttgtcttgaat

SEQ ID NO: 613232 - DNA, 20 bp, Artificial
  CRISPR gRNA sequence
gatttgtcttgaatgagtca

SEQ ID NO: 613233 - DNA, 20 bp, Artificial
  CRISPR gRNA sequence
gtcttgaatgagtcaaagct

SEQ ID NO: 613234 - DNA, 20 bp, Artificial
  CRISPR gRNA sequence
cttgaatgagtcaaagctga

SEQ ID NO: 613235 - DNA, 20 bp, Artificial
  CRISPR gRNA sequence
aatgagtcaaagctgagagt

SEQ ID NO: 613236 - DNA, 20 bp, Artificial
  CRISPR gRNA sequence
aagctgagagtcagtgtatt

SEQ ID NO: 613237 - DNA, 20 bp, Artificial
  CRISPR gRNA sequence
gctgagagtcagtgtattaa

SEQ ID NO: 613238 - DNA, 20 bp, Artificial
  CRISPR gRNA sequence
agagtcagtgtattaagagt

SEQ ID NO: 613239 - DNA, 20 bp, Artificial
  CRISPR gRNA sequence
attaagagtgagataatttg

SEQ ID NO: 613240 - DNA, 20 bp, Artificial
  CRISPR gRNA sequence
ataatttgaagactgatcac

SEQ ID NO: 613241 - DNA, 20 bp, Artificial
  CRISPR gRNA sequence
taatttgaagactgatcacc

SEQ ID NO: 613242 - DNA, 20 bp, Artificial
  CRISPR gRNA sequence
agactgatcaccaggccctc

SEQ ID NO: 613243 - DNA, 20 bp, Artificial
  CRISPR gRNA sequence
gactgatcaccaggccctca

SEQ ID NO: 613244 - DNA, 20 bp, Artificial
  CRISPR gRNA sequence
atcaccaggccctcaaggtc

SEQ ID NO: 613245 - DNA, 20 bp, Artificial
  CRISPR gRNA sequence
ggccctcaaggtctagaata

SEQ ID NO: 613246 - DNA, 20 bp, Artificial
  CRISPR gRNA sequence
ctcaaggtctagaatacagt

SEQ ID NO: 613247 - DNA, 20 bp, Artificial
  CRISPR gRNA sequence
caaggtctagaatacagtca

SEQ ID NO: 613248 - DNA, 20 bp, Artificial
  CRISPR gRNA sequence
gtctagaatacagtcagagc

SEQ ID NO: 613249 - DNA, 20 bp, Artificial
  CRISPR gRNA sequence
gtcagagcaagaatttgatt

SEQ ID NO: 613250 - DNA, 20 bp, Artificial
  CRISPR gRNA sequence
ttcagtatttcccctgttgc

SEQ ID NO: 613251 - DNA, 20 bp, Artificial
  CRISPR gRNA sequence
cagtatttcccctgttgcca

SEQ ID NO: 613252 - DNA, 20 bp, Artificial
  CRISPR gRNA sequence
agtatttcccctgttgccag

SEQ ID NO: 613253 - DNA, 20 bp, Artificial
  CRISPR gRNA sequence
ctgtcttcttgtctttgtct

SEQ ID NO: 613254 - DNA, 20 bp, Artificial
  CRISPR gRNA sequence
tcttcttgtctttgtcttgg

SEQ ID NO: 613255 - DNA, 20 bp, Artificial
  CRISPR gRNA sequence
ttatcttttcttaccaaaat

SEQ ID NO: 613256 - DNA, 20 bp, Artificial
  CRISPR gRNA sequence
cttaccaaaattggaatgta

SEQ ID NO: 613257 - DNA, 20 bp, Artificial
  CRISPR gRNA sequence
ttaccaaaattggaatgtaa

SEQ ID NO: 613258 - DNA, 20 bp, Artificial
  CRISPR gRNA sequence
accaaaattggaatgtaaag

SEQ ID NO: 613259 - DNA, 20 bp, Artificial
  CRISPR gRNA sequence
ccaaaattggaatgtaaagg

SEQ ID NO: 613260 - DNA, 20 bp, Artificial
  CRISPR gRNA sequence
aaattggaatgtaaaggagg

SEQ ID NO: 613261 - DNA, 20 bp, Artificial
  CRISPR gRNA sequence
attggaatgtaaaggaggaa

SEQ ID NO: 613262 - DNA, 20 bp, Artificial
  CRISPR gRNA sequence
tgtaaaggaggaagagattt

SEQ ID NO: 613263 - DNA, 20 bp, Artificial
  CRISPR gRNA sequence
tttaagtctgaaaattatat

SEQ ID NO: 613264 - DNA, 20 bp, Artificial
  CRISPR gRNA sequence
aattatatgagtgcttcctc

SEQ ID NO: 613265 - DNA, 20 bp, Artificial
  CRISPR gRNA sequence
tgcttcctccagactatcaa

SEQ ID NO: 613266 - DNA, 20 bp, Artificial
  CRISPR gRNA sequence
tcctccagactatcaaaagt

SEQ ID NO: 613267 - DNA, 20 bp, Artificial
  CRISPR gRNA sequence
attttgctttgaatgttgat

SEQ ID NO: 613268 - DNA, 20 bp, Artificial
  CRISPR gRNA sequence
ttgaatgttgatgagactaa

SEQ ID NO: 613269 - DNA, 20 bp, Artificial
  CRISPR gRNA sequence
actaacagcacactgacctt

SEQ ID NO: 613270 - DNA, 20 bp, Artificial
  CRISPR gRNA sequence
ctgaccttgagttctcttca

SEQ ID NO: 613271 - DNA, 20 bp, Artificial
  CRISPR gRNA sequence
accttgagttctcttcacag

SEQ ID NO: 613272 - DNA, 20 bp, Artificial
  CRISPR gRNA sequence
ccttgagttctcttcacagt

SEQ ID NO: 613273 - DNA, 20 bp, Artificial
  CRISPR gRNA sequence
tcacagtgggtaaacctcac

SEQ ID NO: 613274 - DNA, 20 bp, Artificial
  CRISPR gRNA sequence
cctcacaagtgcaactactg

SEQ ID NO: 613275 - DNA, 20 bp, Artificial
  CRISPR gRNA sequence
aagtgcaactactgtggacg

SEQ ID NO: 613276 - DNA, 20 bp, Artificial
  CRISPR gRNA sequence
actactgtggacgaagctac

SEQ ID NO: 613277 - DNA, 20 bp, Artificial
  CRISPR gRNA sequence
actgtggacgaagctacaag

SEQ ID NO: 613278 - DNA, 20 bp, Artificial
  CRISPR gRNA sequence
ggacgaagctacaagcagcg

SEQ ID NO: 613279 - DNA, 20 bp, Artificial
  CRISPR gRNA sequence
ctacaagcagcgcagttcac

SEQ ID NO: 613280 - DNA, 20 bp, Artificial
  CRISPR gRNA sequence
acaagcagcgcagttcactg

SEQ ID NO: 613281 - DNA, 20 bp, Artificial
  CRISPR gRNA sequence
caagcagcgcagttcactgg

SEQ ID NO: 613282 - DNA, 20 bp, Artificial
  CRISPR gRNA sequence
agcagcgcagttcactggag

SEQ ID NO: 613283 - DNA, 20 bp, Artificial
  CRISPR gRNA sequence
gcagttcactggaggagcac

SEQ ID NO: 613284 - DNA, 20 bp, Artificial
  CRISPR gRNA sequence
cagttcactggaggagcaca

SEQ ID NO: 613285 - DNA, 20 bp, Artificial
  CRISPR gRNA sequence
aacgctgccacaactatctc

SEQ ID NO: 613286 - DNA, 20 bp, Artificial
  CRISPR gRNA sequence
cacaactatctccagaatgt

SEQ ID NO: 613287 - DNA, 20 bp, Artificial
  CRISPR gRNA sequence
ctatctccagaatgtcagca

SEQ ID NO: 613288 - DNA, 20 bp, Artificial
  CRISPR gRNA sequence
atctccagaatgtcagcatg

SEQ ID NO: 613289 - DNA, 20 bp, Artificial
  CRISPR gRNA sequence
tctccagaatgtcagcatgg

SEQ ID NO: 613290 - DNA, 20 bp, Artificial
  CRISPR gRNA sequence
aatgtcagcatggaggctgc

SEQ ID NO: 613291 - DNA, 20 bp, Artificial
  CRISPR gRNA sequence
atgtcagcatggaggctgct

SEQ ID NO: 613292 - DNA, 20 bp, Artificial
  CRISPR gRNA sequence
tcagcatggaggctgctggg

SEQ ID NO: 613293 - DNA, 20 bp, Artificial
  CRISPR gRNA sequence
cagcatggaggctgctgggc

SEQ ID NO: 613294 - DNA, 20 bp, Artificial
  CRISPR gRNA sequence
gaggctgctgggcaggtcat

SEQ ID NO: 613295 - DNA, 20 bp, Artificial
  CRISPR gRNA sequence
gggcaggtcatgagtcacca

SEQ ID NO: 613296 - DNA, 20 bp, Artificial
  CRISPR gRNA sequence
caggtcatgagtcaccatgg

SEQ ID NO: 613297 - DNA, 20 bp, Artificial
  CRISPR gRNA sequence
aggtcatgagtcaccatggt

SEQ ID NO: 613298 - DNA, 20 bp, Artificial
  CRISPR gRNA sequence
tcatgagtcaccatggtggg

SEQ ID NO: 613299 - DNA, 20 bp, Artificial
  CRISPR gRNA sequence
tcaccatggtgggtagaaac

SEQ ID NO: 613300 - DNA, 20 bp, Artificial
  CRISPR gRNA sequence
atttccccctactgcttttg

SEQ ID NO: 613301 - DNA, 20 bp, Artificial
  CRISPR gRNA sequence
tgcttttgtagttcaacatg

SEQ ID NO: 613302 - DNA, 20 bp, Artificial
  CRISPR gRNA sequence
tatgctgtttaaaactattt

SEQ ID NO: 613303 - DNA, 20 bp, Artificial
  CRISPR gRNA sequence
tagatcactttaacttaaat

SEQ ID NO: 613304 - DNA, 20 bp, Artificial
  CRISPR gRNA sequence
cactttaacttaaatgagtt

SEQ ID NO: 613305 - DNA, 20 bp, Artificial
  CRISPR gRNA sequence
aacttaaatgagttgagctt

SEQ ID NO: 613306 - DNA, 20 bp, Artificial
  CRISPR gRNA sequence
acttaaatgagttgagcttt

SEQ ID NO: 613307 - DNA, 20 bp, Artificial
  CRISPR gRNA sequence
atttctgataatgtttgaat

SEQ ID NO: 613308 - DNA, 20 bp, Artificial
  CRISPR gRNA sequence
aaccaacctttcatatacca

SEQ ID NO: 613309 - DNA, 20 bp, Artificial
  CRISPR gRNA sequence
accaacctttcatataccaa

SEQ ID NO: 613310 - DNA, 20 bp, Artificial
  CRISPR gRNA sequence
aacctttcatataccaaagg

SEQ ID NO: 613311 - DNA, 20 bp, Artificial
  CRISPR gRNA sequence
acctttcatataccaaagga

SEQ ID NO: 613312 - DNA, 20 bp, Artificial
  CRISPR gRNA sequence
ttctttttcatttttctaac

SEQ ID NO: 613313 - DNA, 20 bp, Artificial
  CRISPR gRNA sequence
ttttcatttttctaaccaga

SEQ ID NO: 613314 - DNA, 20 bp, Artificial
  CRISPR gRNA sequence
catttttctaaccagatagt

SEQ ID NO: 613315 - DNA, 20 bp, Artificial
  CRISPR gRNA sequence
tttttctaaccagatagtta

SEQ ID NO: 613316 - DNA, 20 bp, Artificial
  CRISPR gRNA sequence
agttagagctgattccacat

SEQ ID NO: 613317 - DNA, 20 bp, Artificial
  CRISPR gRNA sequence
gctgattccacattagtctg

SEQ ID NO: 613318 - DNA, 20 bp, Artificial
  CRISPR gRNA sequence
ctgattccacattagtctgt

SEQ ID NO: 613319 - DNA, 20 bp, Artificial
  CRISPR gRNA sequence
ttagtctgtaggctgcctaa

SEQ ID NO: 613320 - DNA, 20 bp, Artificial
  CRISPR gRNA sequence
ggctgcctaaaagaatgaat

SEQ ID NO: 613321 - DNA, 20 bp, Artificial
  CRISPR gRNA sequence
ttatttgaatattttcatct

SEQ ID NO: 613322 - DNA, 20 bp, Artificial
  CRISPR gRNA sequence
tatttgaatattttcatctc

SEQ ID NO: 613323 - DNA, 20 bp, Artificial
  CRISPR gRNA sequence
tgaatattttcatctcaggt

SEQ ID NO: 613324 - DNA, 20 bp, Artificial
  CRISPR gRNA sequence
tttcatctcaggtaagtgat

SEQ ID NO: 613325 - DNA, 20 bp, Artificial
  CRISPR gRNA sequence
taatttgaaatttctccaat

SEQ ID NO: 613326 - DNA, 20 bp, Artificial
  CRISPR gRNA sequence
atcggccctttaatttttat

SEQ ID NO: 613327 - DNA, 20 bp, Artificial
  CRISPR gRNA sequence
ctacaatgtgcaaaacaatc

SEQ ID NO: 613328 - DNA, 20 bp, Artificial
  CRISPR gRNA sequence
aaaacaatctagaccaacat

SEQ ID NO: 613329 - DNA, 20 bp, Artificial
  CRISPR gRNA sequence
ctccacaaaaaacattctcc

SEQ ID NO: 613330 - DNA, 20 bp, Artificial
  CRISPR gRNA sequence
cctgatctctaaatacacta

SEQ ID NO: 613331 - DNA, 20 bp, Artificial
  CRISPR gRNA sequence
gatctctaaatacactacgg

SEQ ID NO: 613332 - DNA, 20 bp, Artificial
  CRISPR gRNA sequence
atctctaaatacactacggc

SEQ ID NO: 613333 - DNA, 20 bp, Artificial
  CRISPR gRNA sequence
tctaaatacactacggcagg

SEQ ID NO: 613334 - DNA, 20 bp, Artificial
  CRISPR gRNA sequence
ctaaatacactacggcaggt

SEQ ID NO: 613335 - DNA, 20 bp, Artificial
  CRISPR gRNA sequence
aatacactacggcaggtagg

SEQ ID NO: 613336 - DNA, 20 bp, Artificial
  CRISPR gRNA sequence
atacactacggcaggtagga

SEQ ID NO: 613337 - DNA, 20 bp, Artificial
  CRISPR gRNA sequence
caggtaggaaggcaatccct

SEQ ID NO: 613338 - DNA, 20 bp, Artificial
  CRISPR gRNA sequence
aggtaggaaggcaatcccta

SEQ ID NO: 613339 - DNA, 20 bp, Artificial
  CRISPR gRNA sequence
aataattctctgttcctgaa

SEQ ID NO: 613340 - DNA, 20 bp, Artificial
  CRISPR gRNA sequence
gaaaagttaattttaataat

SEQ ID NO: 613341 - DNA, 20 bp, Artificial
  CRISPR gRNA sequence
ttttaataatcagccttata

SEQ ID NO: 613342 - DNA, 20 bp, Artificial
  CRISPR gRNA sequence
tttaataatcagccttatat

SEQ ID NO: 613343 - DNA, 20 bp, Artificial
  CRISPR gRNA sequence
tataggaaaataatgaattt

SEQ ID NO: 613344 - DNA, 20 bp, Artificial
  CRISPR gRNA sequence
aataatgaatttcagttctt

SEQ ID NO: 613345 - DNA, 20 bp, Artificial
  CRISPR gRNA sequence
gtctatcttgtcttactaat

SEQ ID NO: 613346 - DNA, 20 bp, Artificial
  CRISPR gRNA sequence
aattagatttgtctactgat

SEQ ID NO: 613347 - DNA, 20 bp, Artificial
  CRISPR gRNA sequence
tgataagttttatttataca

SEQ ID NO: 613348 - DNA, 20 bp, Artificial
  CRISPR gRNA sequence
agacaaaaatctcaacttat

SEQ ID NO: 613349 - DNA, 20 bp, Artificial
  CRISPR gRNA sequence
tattttattttatttttttt

SEQ ID NO: 613350 - DNA, 20 bp, Artificial
  CRISPR gRNA sequence
ttattttattttttttgaga

SEQ ID NO: 613351 - DNA, 20 bp, Artificial
  CRISPR gRNA sequence
tggactctcactttgccacc

SEQ ID NO: 613352 - DNA, 20 bp, Artificial
  CRISPR gRNA sequence
ggactctcactttgccaccc

SEQ ID NO: 613353 - DNA, 20 bp, Artificial
  CRISPR gRNA sequence
tctcactttgccacccaggc

SEQ ID NO: 613354 - DNA, 20 bp, Artificial
  CRISPR gRNA sequence
tcactttgccacccaggctg

SEQ ID NO: 613355 - DNA, 20 bp, Artificial
  CRISPR gRNA sequence
ttgccacccaggctggagtg

SEQ ID NO: 613356 - DNA, 20 bp, Artificial
  CRISPR gRNA sequence
ccacccaggctggagtgcag

SEQ ID NO: 613357 - DNA, 20 bp, Artificial
  CRISPR gRNA sequence
ggagtgcagtggcacgatct

SEQ ID NO: 613358 - DNA, 20 bp, Artificial
  CRISPR gRNA sequence
caccacaacctctgcctccc

SEQ ID NO: 613359 - DNA, 20 bp, Artificial
  CRISPR gRNA sequence
aacctctgcctccccggttc

SEQ ID NO: 613360 - DNA, 20 bp, Artificial
  CRISPR gRNA sequence
ttcaagcgattctcctgctt

SEQ ID NO: 613361 - DNA, 20 bp, Artificial
  CRISPR gRNA sequence
ttctcctgcttcagcctgcc

SEQ ID NO: 613362 - DNA, 20 bp, Artificial
  CRISPR gRNA sequence
gcttcagcctgccaagtaac

SEQ ID NO: 613363 - DNA, 20 bp, Artificial
  CRISPR gRNA sequence
cttcagcctgccaagtaact

SEQ ID NO: 613364 - DNA, 20 bp, Artificial
  CRISPR gRNA sequence
ctgccaagtaactgggatta

SEQ ID NO: 613365 - DNA, 20 bp, Artificial
  CRISPR gRNA sequence
tgccaagtaactgggattac

SEQ ID NO: 613366 - DNA, 20 bp, Artificial
  CRISPR gRNA sequence
ggattacaggcatgtaccac

SEQ ID NO: 613367 - DNA, 20 bp, Artificial
  CRISPR gRNA sequence
gattacaggcatgtaccacc

SEQ ID NO: 613368 - DNA, 20 bp, Artificial
  CRISPR gRNA sequence
caggcatgtaccaccaggcc

SEQ ID NO: 613369 - DNA, 20 bp, Artificial
  CRISPR gRNA sequence
catgtaccaccaggcctggc

SEQ ID NO: 613370 - DNA, 20 bp, Artificial
  CRISPR gRNA sequence
ctggctagtttttgtatttt

SEQ ID NO: 613371 - DNA, 20 bp, Artificial
  CRISPR gRNA sequence
gctagtttttgtatttttag

SEQ ID NO: 613372 - DNA, 20 bp, Artificial
  CRISPR gRNA sequence
tagtttttgtatttttagta

SEQ ID NO: 613373 - DNA, 20 bp, Artificial
  CRISPR gRNA sequence
ttttgtatttttagtagaga

SEQ ID NO: 613374 - DNA, 20 bp, Artificial
  CRISPR gRNA sequence
tttgtatttttagtagagac

SEQ ID NO: 613375 - DNA, 20 bp, Artificial
  CRISPR gRNA sequence
ttgtatttttagtagagacg

SEQ ID NO: 613376 - DNA, 20 bp, Artificial
  CRISPR gRNA sequence
gagacggggtttcgccatgt

SEQ ID NO: 613377 - DNA, 20 bp, Artificial
  CRISPR gRNA sequence
cggggtttcgccatgttggc

SEQ ID NO: 613378 - DNA, 20 bp, Artificial
  CRISPR gRNA sequence
ggggtttcgccatgttggcc

SEQ ID NO: 613379 - DNA, 20 bp, Artificial
  CRISPR gRNA sequence
tttcgccatgttggccaggc

SEQ ID NO: 613380 - DNA, 20 bp, Artificial
  CRISPR gRNA sequence
tggtctcaaactcctgacct

SEQ ID NO: 613381 - DNA, 20 bp, Artificial
  CRISPR gRNA sequence
ggtctcaaactcctgacctc

SEQ ID NO: 613382 - DNA, 20 bp, Artificial
  CRISPR gRNA sequence
tcaaactcctgacctcaggt

SEQ ID NO: 613383 - DNA, 20 bp, Artificial
  CRISPR gRNA sequence
ctgcccgccttgccttccca

SEQ ID NO: 613384 - DNA, 20 bp, Artificial
  CRISPR gRNA sequence
gccttgccttcccaaagttc

SEQ ID NO: 613385 - DNA, 20 bp, Artificial
  CRISPR gRNA sequence
ccttgccttcccaaagttct

SEQ ID NO: 613386 - DNA, 20 bp, Artificial
  CRISPR gRNA sequence
ttcccaaagttctgggatta

SEQ ID NO: 613387 - DNA, 20 bp, Artificial
  CRISPR gRNA sequence
tcccaaagttctgggattac

SEQ ID NO: 613388 - DNA, 20 bp, Artificial
  CRISPR gRNA sequence
caggtgtgaaccattgcacc

SEQ ID NO: 613389 - DNA, 20 bp, Artificial
  CRISPR gRNA sequence
tgtatatcttttatttaaaa

SEQ ID NO: 613390 - DNA, 20 bp, Artificial
  CRISPR gRNA sequence
gtatatcttttatttaaaaa

SEQ ID NO: 613391 - DNA, 20 bp, Artificial
  CRISPR gRNA sequence
ttatttaaaaaaggtttgcc

SEQ ID NO: 613392 - DNA, 20 bp, Artificial
  CRISPR gRNA sequence
aaggtttgcccagtattaaa

SEQ ID NO: 613393 - DNA, 20 bp, Artificial
  CRISPR gRNA sequence
ttgcccagtattaaatggta

SEQ ID NO: 613394 - DNA, 20 bp, Artificial
  CRISPR gRNA sequence
ccagtattaaatggtatagt

SEQ ID NO: 613395 - DNA, 20 bp, Artificial
  CRISPR gRNA sequence
cagtattaaatggtatagtt

SEQ ID NO: 613396 - DNA, 20 bp, Artificial
  CRISPR gRNA sequence
agtattaaatggtatagttg

SEQ ID NO: 613397 - DNA, 20 bp, Artificial
  CRISPR gRNA sequence
ggtatagttggggattgcga

SEQ ID NO: 613398 - DNA, 20 bp, Artificial
  CRISPR gRNA sequence
aaatataaatatctatgtat

SEQ ID NO: 613399 - DNA, 20 bp, Artificial
  CRISPR gRNA sequence
tctatgtattggcttataca

SEQ ID NO: 613400 - DNA, 20 bp, Artificial
  CRISPR gRNA sequence
tgtattggcttatacatagc

SEQ ID NO: 613401 - DNA, 20 bp, Artificial
  CRISPR gRNA sequence
gtattggcttatacatagcc

SEQ ID NO: 613402 - DNA, 20 bp, Artificial
  CRISPR gRNA sequence
ggcttatacatagccaggtc

SEQ ID NO: 613403 - DNA, 20 bp, Artificial
  CRISPR gRNA sequence
gcttatacatagccaggtca

SEQ ID NO: 613404 - DNA, 20 bp, Artificial
  CRISPR gRNA sequence
gccaggtcaaggattatttc

SEQ ID NO: 613405 - DNA, 20 bp, Artificial
  CRISPR gRNA sequence
ccaggtcaaggattatttct

SEQ ID NO: 613406 - DNA, 20 bp, Artificial
  CRISPR gRNA sequence
caggtcaaggattatttctg

SEQ ID NO: 613407 - DNA, 20 bp, Artificial
  CRISPR gRNA sequence
ggggttttctgtttgtttta

SEQ ID NO: 613408 - DNA, 20 bp, Artificial
  CRISPR gRNA sequence
ggttttctgtttgttttata

SEQ ID NO: 613409 - DNA, 20 bp, Artificial
  CRISPR gRNA sequence
gttttatagagtatatacta

SEQ ID NO: 613410 - DNA, 20 bp, Artificial
  CRISPR gRNA sequence
tactatggaactgtgtttgt

SEQ ID NO: 613411 - DNA, 20 bp, Artificial
  CRISPR gRNA sequence
atggaactgtgtttgttgga

SEQ ID NO: 613412 - DNA, 20 bp, Artificial
  CRISPR gRNA sequence
aactgtgtttgttggacagc

SEQ ID NO: 613413 - DNA, 20 bp, Artificial
  CRISPR gRNA sequence
gctagtgattatgtgttgtt

SEQ ID NO: 613414 - DNA, 20 bp, Artificial
  CRISPR gRNA sequence
gtgattatgtgttgttgagt

SEQ ID NO: 613415 - DNA, 20 bp, Artificial
  CRISPR gRNA sequence
tgattatgtgttgttgagtt

SEQ ID NO: 613416 - DNA, 20 bp, Artificial
  CRISPR gRNA sequence
cttgttatcctgaacaactg

SEQ ID NO: 613417 - DNA, 20 bp, Artificial
  CRISPR gRNA sequence
acaactgaagcatttccttc

SEQ ID NO: 613418 - DNA, 20 bp, Artificial
  CRISPR gRNA sequence
cttctagtttctataatcta

SEQ ID NO: 613419 - DNA, 20 bp, Artificial
  CRISPR gRNA sequence
aattctattgatttgtgatc

SEQ ID NO: 613420 - DNA, 20 bp, Artificial
  CRISPR gRNA sequence
tacaaacctatctgtgtatc

SEQ ID NO: 613421 - DNA, 20 bp, Artificial
  CRISPR gRNA sequence
cctatctgtgtatcaagtct

SEQ ID NO: 613422 - DNA, 20 bp, Artificial
  CRISPR gRNA sequence
cttggtaaatttgatatttc

SEQ ID NO: 613423 - DNA, 20 bp, Artificial
  CRISPR gRNA sequence
tatttcaagcttgcattacc

SEQ ID NO: 613424 - DNA, 20 bp, Artificial
  CRISPR gRNA sequence
atttcaagcttgcattacct

SEQ ID NO: 613425 - DNA, 20 bp, Artificial
  CRISPR gRNA sequence
attacctgggctgatgatga

SEQ ID NO: 613426 - DNA, 20 bp, Artificial
  CRISPR gRNA sequence
ctgggctgatgatgatagca

SEQ ID NO: 613427 - DNA, 20 bp, Artificial
  CRISPR gRNA sequence
tgggctgatgatgatagcat

SEQ ID NO: 613428 - DNA, 20 bp, Artificial
  CRISPR gRNA sequence
gatgatgatagcataggatc

SEQ ID NO: 613429 - DNA, 20 bp, Artificial
  CRISPR gRNA sequence
atagcataggatctggaaca

SEQ ID NO: 613430 - DNA, 20 bp, Artificial
  CRISPR gRNA sequence
agcataggatctggaacata

SEQ ID NO: 613431 - DNA, 20 bp, Artificial
  CRISPR gRNA sequence
ggaacatagagattacaaaa

SEQ ID NO: 613432 - DNA, 20 bp, Artificial
  CRISPR gRNA sequence
gattacaaaatggtgcgtct

SEQ ID NO: 613433 - DNA, 20 bp, Artificial
  CRISPR gRNA sequence
ttacaaaatggtgcgtctcg

SEQ ID NO: 613434 - DNA, 20 bp, Artificial
  CRISPR gRNA sequence
ggagtctgccaaacctgctc

SEQ ID NO: 613435 - DNA, 20 bp, Artificial
  CRISPR gRNA sequence
tgctctggctacttcgtgtc

SEQ ID NO: 613436 - DNA, 20 bp, Artificial
  CRISPR gRNA sequence
gctctggctacttcgtgtct

SEQ ID NO: 613437 - DNA, 20 bp, Artificial
  CRISPR gRNA sequence
gtgtctgggtgtgtcactca

SEQ ID NO: 613438 - DNA, 20 bp, Artificial
  CRISPR gRNA sequence
tgtctgggtgtgtcactcat

SEQ ID NO: 613439 - DNA, 20 bp, Artificial
  CRISPR gRNA sequence
tgggtgtgtcactcataggc

SEQ ID NO: 613440 - DNA, 20 bp, Artificial
  CRISPR gRNA sequence
gggtgtgtcactcataggct

SEQ ID NO: 613441 - DNA, 20 bp, Artificial
  CRISPR gRNA sequence
gtcactcataggctgggttt

SEQ ID NO: 613442 - DNA, 20 bp, Artificial
  CRISPR gRNA sequence
tcactcataggctgggtttg

SEQ ID NO: 613443 - DNA, 20 bp, Artificial
  CRISPR gRNA sequence
gtttgaggattaaatgtgac

SEQ ID NO: 613444 - DNA, 20 bp, Artificial
  CRISPR gRNA sequence
tgtaataaatgcccaataaa

SEQ ID NO: 613445 - DNA, 20 bp, Artificial
  CRISPR gRNA sequence
ttgctttactgttaacattt

SEQ ID NO: 613446 - DNA, 20 bp, Artificial
  CRISPR gRNA sequence
aacattaaataactgaataa

SEQ ID NO: 613447 - DNA, 20 bp, Artificial
  CRISPR gRNA sequence
cctataaatttgttatttac

SEQ ID NO: 613448 - DNA, 20 bp, Artificial
  CRISPR gRNA sequence
ataaatttgttatttaccag

SEQ ID NO: 613449 - DNA, 20 bp, Artificial
  CRISPR gRNA sequence
ttatttaccagcagtaactt

SEQ ID NO: 613450 - DNA, 20 bp, Artificial
  CRISPR gRNA sequence
accagcagtaacttaagcat

SEQ ID NO: 613451 - DNA, 20 bp, Artificial
  CRISPR gRNA sequence
agcagtaacttaagcattag

SEQ ID NO: 613452 - DNA, 20 bp, Artificial
  CRISPR gRNA sequence
actgttactatttaaattga

SEQ ID NO: 613453 - DNA, 20 bp, Artificial
  CRISPR gRNA sequence
ctatttaaattgatggattt

SEQ ID NO: 613454 - DNA, 20 bp, Artificial
  CRISPR gRNA sequence
tatttaaattgatggattta

SEQ ID NO: 613455 - DNA, 20 bp, Artificial
  CRISPR gRNA sequence
atttaaattgatggatttaa

SEQ ID NO: 613456 - DNA, 20 bp, Artificial
  CRISPR gRNA sequence
gatggatttaagggtaaatt

SEQ ID NO: 613457 - DNA, 20 bp, Artificial
  CRISPR gRNA sequence
atggatttaagggtaaattg

SEQ ID NO: 613458 - DNA, 20 bp, Artificial
  CRISPR gRNA sequence
atttaagggtaaattgaggc

SEQ ID NO: 613459 - DNA, 20 bp, Artificial
  CRISPR gRNA sequence
taagggtaaattgaggctgg

SEQ ID NO: 613460 - DNA, 20 bp, Artificial
  CRISPR gRNA sequence
aaattgaggctggaagctga

SEQ ID NO: 613461 - DNA, 20 bp, Artificial
  CRISPR gRNA sequence
ttgaggctggaagctgatgg

SEQ ID NO: 613462 - DNA, 20 bp, Artificial
  CRISPR gRNA sequence
gctggaagctgatggaagct

SEQ ID NO: 613463 - DNA, 20 bp, Artificial
  CRISPR gRNA sequence
ctggaagctgatggaagctt

SEQ ID NO: 613464 - DNA, 20 bp, Artificial
  CRISPR gRNA sequence
tggaagctgatggaagcttg

SEQ ID NO: 613465 - DNA, 20 bp, Artificial
  CRISPR gRNA sequence
ggaagctgatggaagcttgg

SEQ ID NO: 613466 - DNA, 20 bp, Artificial
  CRISPR gRNA sequence
atcttccccaaaacacctta

SEQ ID NO: 613467 - DNA, 20 bp, Artificial
  CRISPR gRNA sequence
acaccttatggcattgctac

SEQ ID NO: 613468 - DNA, 20 bp, Artificial
  CRISPR gRNA sequence
tatattatattctcccattg

SEQ ID NO: 613469 - DNA, 20 bp, Artificial
  CRISPR gRNA sequence
attgcagttctgacatttga

SEQ ID NO: 613470 - DNA, 20 bp, Artificial
  CRISPR gRNA sequence
atttattatttttgcattcc

SEQ ID NO: 613471 - DNA, 20 bp, Artificial
  CRISPR gRNA sequence
tttgcattcctagttattta

SEQ ID NO: 613472 - DNA, 20 bp, Artificial
  CRISPR gRNA sequence
tattgcatacatactcctaa

SEQ ID NO: 613473 - DNA, 20 bp, Artificial
  CRISPR gRNA sequence
catactcctaaaagactata

SEQ ID NO: 613474 - DNA, 20 bp, Artificial
  CRISPR gRNA sequence
cctaaaagactatatggtaa

SEQ ID NO: 613475 - DNA, 20 bp, Artificial
  CRISPR gRNA sequence
ctaaaagactatatggtaat

SEQ ID NO: 613476 - DNA, 20 bp, Artificial
  CRISPR gRNA sequence
taaaagactatatggtaata

SEQ ID NO: 613477 - DNA, 20 bp, Artificial
  CRISPR gRNA sequence
aaagactatatggtaatagg

SEQ ID NO: 613478 - DNA, 20 bp, Artificial
  CRISPR gRNA sequence
aagactatatggtaataggg

SEQ ID NO: 613479 - DNA, 20 bp, Artificial
  CRISPR gRNA sequence
atcaacattgaattatctgt

SEQ ID NO: 613480 - DNA, 20 bp, Artificial
  CRISPR gRNA sequence
aacattgaattatctgttgg

SEQ ID NO: 613481 - DNA, 20 bp, Artificial
  CRISPR gRNA sequence
ctgttggcagattgaacttt

SEQ ID NO: 613482 - DNA, 20 bp, Artificial
  CRISPR gRNA sequence
gttggcagattgaactttta

SEQ ID NO: 613483 - DNA, 20 bp, Artificial
  CRISPR gRNA sequence
tgctaacgaaaaatttaaac

SEQ ID NO: 613484 - DNA, 20 bp, Artificial
  CRISPR gRNA sequence
aatttaaacaagtatatttt

SEQ ID NO: 613485 - DNA, 20 bp, Artificial
  CRISPR gRNA sequence
tttaaacaagtatattttga

SEQ ID NO: 613486 - DNA, 20 bp, Artificial
  CRISPR gRNA sequence
aaacaagtatattttgagag

SEQ ID NO: 613487 - DNA, 20 bp, Artificial
  CRISPR gRNA sequence
agtatattttgagagaagca

SEQ ID NO: 613488 - DNA, 20 bp, Artificial
  CRISPR gRNA sequence
agatatgtcccctaaacaac

SEQ ID NO: 613489 - DNA, 20 bp, Artificial
  CRISPR gRNA sequence
gatatgtcccctaaacaact

SEQ ID NO: 613490 - DNA, 20 bp, Artificial
  CRISPR gRNA sequence
atatgtcccctaaacaactg

SEQ ID NO: 613491 - DNA, 20 bp, Artificial
  CRISPR gRNA sequence
cccctaaacaactggggcct

SEQ ID NO: 613492 - DNA, 20 bp, Artificial
  CRISPR gRNA sequence
cagtcttaccccctattccc

SEQ ID NO: 613493 - DNA, 20 bp, Artificial
  CRISPR gRNA sequence
cccctattccccagattgct

SEQ ID NO: 613494 - DNA, 20 bp, Artificial
  CRISPR gRNA sequence
ccagattgcttagccctccg

SEQ ID NO: 613495 - DNA, 20 bp, Artificial
  CRISPR gRNA sequence
cagattgcttagccctccgt

SEQ ID NO: 613496 - DNA, 20 bp, Artificial
  CRISPR gRNA sequence
tgcttagccctccgtaggca

SEQ ID NO: 613497 - DNA, 20 bp, Artificial
  CRISPR gRNA sequence
gcttagccctccgtaggcac

SEQ ID NO: 613498 - DNA, 20 bp, Artificial
  CRISPR gRNA sequence
ccgtaggcacaggcccttta

SEQ ID NO: 613499 - DNA, 20 bp, Artificial
  CRISPR gRNA sequence
cgtaggcacaggccctttac

SEQ ID NO: 613500 - DNA, 20 bp, Artificial
  CRISPR gRNA sequence
aggcacaggccctttacagg

SEQ ID NO: 613501 - DNA, 20 bp, Artificial
  CRISPR gRNA sequence
gccctttacaggtggtgctg

SEQ ID NO: 613502 - DNA, 20 bp, Artificial
  CRISPR gRNA sequence
tttacaggtggtgctgaagc

SEQ ID NO: 613503 - DNA, 20 bp, Artificial
  CRISPR gRNA sequence
gtggtgctgaagctggaacc

SEQ ID NO: 613504 - DNA, 20 bp, Artificial
  CRISPR gRNA sequence
gtgctgaagctggaaccaag

SEQ ID NO: 613505 - DNA, 20 bp, Artificial
  CRISPR gRNA sequence
tgctgaagctggaaccaagt

SEQ ID NO: 613506 - DNA, 20 bp, Artificial
  CRISPR gRNA sequence
gctgaagctggaaccaagtg

SEQ ID NO: 613507 - DNA, 20 bp, Artificial
  CRISPR gRNA sequence
ctgaagctggaaccaagtgg

SEQ ID NO: 613508 - DNA, 20 bp, Artificial
  CRISPR gRNA sequence
agctggaaccaagtggggga

SEQ ID NO: 613509 - DNA, 20 bp, Artificial
  CRISPR gRNA sequence
tggaaccaagtgggggaaag

SEQ ID NO: 613510 - DNA, 20 bp, Artificial
  CRISPR gRNA sequence
ggaaccaagtgggggaaagt

SEQ ID NO: 613511 - DNA, 20 bp, Artificial
  CRISPR gRNA sequence
ccaagtgggggaaagtggga

SEQ ID NO: 613512 - DNA, 20 bp, Artificial
  CRISPR gRNA sequence
caagtgggggaaagtgggaa

SEQ ID NO: 613513 - DNA, 20 bp, Artificial
  CRISPR gRNA sequence
aagtgggggaaagtgggaaa

SEQ ID NO: 613514 - DNA, 20 bp, Artificial
  CRISPR gRNA sequence
agtgggggaaagtgggaaag

SEQ ID NO: 613515 - DNA, 20 bp, Artificial
  CRISPR gRNA sequence
gggggaaagtgggaaagggg

SEQ ID NO: 613516 - DNA, 20 bp, Artificial
  CRISPR gRNA sequence
ggggaaagtgggaaaggggt

SEQ ID NO: 613517 - DNA, 20 bp, Artificial
  CRISPR gRNA sequence
gggaaagtgggaaaggggta

SEQ ID NO: 613518 - DNA, 20 bp, Artificial
  CRISPR gRNA sequence
ggaaagtgggaaaggggtag

SEQ ID NO: 613519 - DNA, 20 bp, Artificial
  CRISPR gRNA sequence
tgggaaaggggtaggggcac

SEQ ID NO: 613520 - DNA, 20 bp, Artificial
  CRISPR gRNA sequence
gggaaaggggtaggggcact

SEQ ID NO: 613521 - DNA, 20 bp, Artificial
  CRISPR gRNA sequence
aaaggggtaggggcactggg

SEQ ID NO: 613522 - DNA, 20 bp, Artificial
  CRISPR gRNA sequence
aaggggtaggggcactgggt

SEQ ID NO: 613523 - DNA, 20 bp, Artificial
  CRISPR gRNA sequence
gggtaggggcactgggtagg

SEQ ID NO: 613524 - DNA, 20 bp, Artificial
  CRISPR gRNA sequence
gtaggggcactgggtaggta

SEQ ID NO: 613525 - DNA, 20 bp, Artificial
  CRISPR gRNA sequence
ggggcactgggtaggtagag

SEQ ID NO: 613526 - DNA, 20 bp, Artificial
  CRISPR gRNA sequence
ggcactgggtaggtagagca

SEQ ID NO: 613527 - DNA, 20 bp, Artificial
  CRISPR gRNA sequence
gcactgggtaggtagagcag

SEQ ID NO: 613528 - DNA, 20 bp, Artificial
  CRISPR gRNA sequence
cactgggtaggtagagcaga

SEQ ID NO: 613529 - DNA, 20 bp, Artificial
  CRISPR gRNA sequence
tagagcagagggtaaaacca

SEQ ID NO: 613530 - DNA, 20 bp, Artificial
  CRISPR gRNA sequence
gagcagagggtaaaaccaaa

SEQ ID NO: 613531 - DNA, 20 bp, Artificial
  CRISPR gRNA sequence
agcagagggtaaaaccaaag

SEQ ID NO: 613532 - DNA, 20 bp, Artificial
  CRISPR gRNA sequence
cagagggtaaaaccaaagag

SEQ ID NO: 613533 - DNA, 20 bp, Artificial
  CRISPR gRNA sequence
agggtaaaaccaaagaggag

SEQ ID NO: 613534 - DNA, 20 bp, Artificial
  CRISPR gRNA sequence
gggtaaaaccaaagaggaga

SEQ ID NO: 613535 - DNA, 20 bp, Artificial
  CRISPR gRNA sequence
ggtaaaaccaaagaggagaa

SEQ ID NO: 613536 - DNA, 20 bp, Artificial
  CRISPR gRNA sequence
accaaagaggagaagggatt

SEQ ID NO: 613537 - DNA, 20 bp, Artificial
  CRISPR gRNA sequence
ccaaagaggagaagggattg

SEQ ID NO: 613538 - DNA, 20 bp, Artificial
  CRISPR gRNA sequence
caaagaggagaagggattga

SEQ ID NO: 613539 - DNA, 20 bp, Artificial
  CRISPR gRNA sequence
agaggagaagggattgaggg

SEQ ID NO: 613540 - DNA, 20 bp, Artificial
  CRISPR gRNA sequence
gtagcttctgataccattta

SEQ ID NO: 613541 - DNA, 20 bp, Artificial
  CRISPR gRNA sequence
aaacaaatattcttaaatac

SEQ ID NO: 613542 - DNA, 20 bp, Artificial
  CRISPR gRNA sequence
ggatatcattttaaccacat

SEQ ID NO: 613543 - DNA, 20 bp, Artificial
  CRISPR gRNA sequence
atttcataccatactttttc

SEQ ID NO: 613544 - DNA, 20 bp, Artificial
  CRISPR gRNA sequence
tttcataccatactttttct

SEQ ID NO: 613545 - DNA, 20 bp, Artificial
  CRISPR gRNA sequence
gtttgttataacaataattt

SEQ ID NO: 613546 - DNA, 20 bp, Artificial
  CRISPR gRNA sequence
tctgttgttaacatgcctaa

SEQ ID NO: 613547 - DNA, 20 bp, Artificial
  CRISPR gRNA sequence
ctgttgttaacatgcctaat

SEQ ID NO: 613548 - DNA, 20 bp, Artificial
  CRISPR gRNA sequence
taacatgcctaatgggaaat

SEQ ID NO: 613549 - DNA, 20 bp, Artificial
  CRISPR gRNA sequence
taatgggaaattggccatac

SEQ ID NO: 613550 - DNA, 20 bp, Artificial
  CRISPR gRNA sequence
aatgggaaattggccatacg

SEQ ID NO: 613551 - DNA, 20 bp, Artificial
  CRISPR gRNA sequence
gggaaattggccatacgagg

SEQ ID NO: 613552 - DNA, 20 bp, Artificial
  CRISPR gRNA sequence
ggaaattggccatacgaggt

SEQ ID NO: 613553 - DNA, 20 bp, Artificial
  CRISPR gRNA sequence
aaattggccatacgaggtag

SEQ ID NO: 613554 - DNA, 20 bp, Artificial
  CRISPR gRNA sequence
taggagttgataaatactgt

SEQ ID NO: 613555 - DNA, 20 bp, Artificial
  CRISPR gRNA sequence
ggagttgataaatactgtaa

SEQ ID NO: 613556 - DNA, 20 bp, Artificial
  CRISPR gRNA sequence
aatactgtaagagaaaaaca

SEQ ID NO: 613557 - DNA, 20 bp, Artificial
  CRISPR gRNA sequence
atggttctgtaaaatgctgc

SEQ ID NO: 613558 - DNA, 20 bp, Artificial
  CRISPR gRNA sequence
ggttctgtaaaatgctgcta

SEQ ID NO: 613559 - DNA, 20 bp, Artificial
  CRISPR gRNA sequence
taacatacgtctcatataaa

SEQ ID NO: 613560 - DNA, 20 bp, Artificial
  CRISPR gRNA sequence
tacgtctcatataaatagct

SEQ ID NO: 613561 - DNA, 20 bp, Artificial
  CRISPR gRNA sequence
ggcatatgtctctttttaaa

SEQ ID NO: 613562 - DNA, 20 bp, Artificial
  CRISPR gRNA sequence
ttatttgttttccttttttg

SEQ ID NO: 613563 - DNA, 20 bp, Artificial
  CRISPR gRNA sequence
tttgttttccttttttgtgg

SEQ ID NO: 613564 - DNA, 20 bp, Artificial
  CRISPR gRNA sequence
tccttttttgtggtagatat

SEQ ID NO: 613565 - DNA, 20 bp, Artificial
  CRISPR gRNA sequence
cttttttgtggtagatatga

SEQ ID NO: 613566 - DNA, 20 bp, Artificial
  CRISPR gRNA sequence
tatgagagttgctgtcattt

SEQ ID NO: 613567 - DNA, 20 bp, Artificial
  CRISPR gRNA sequence
gctgtcattttggttgccat

SEQ ID NO: 613568 - DNA, 20 bp, Artificial
  CRISPR gRNA sequence
tttttaaaaaatatctgaca

SEQ ID NO: 613569 - DNA, 20 bp, Artificial
  CRISPR gRNA sequence
tctgacatagttatatttcc

SEQ ID NO: 613570 - DNA, 20 bp, Artificial
  CRISPR gRNA sequence
ttttccctgtgttgttcttc

SEQ ID NO: 613571 - DNA, 20 bp, Artificial
  CRISPR gRNA sequence
cctgtgttgttcttctagta

SEQ ID NO: 613572 - DNA, 20 bp, Artificial
  CRISPR gRNA sequence
ttctagtatggaatttttta

SEQ ID NO: 613573 - DNA, 20 bp, Artificial
  CRISPR gRNA sequence
tctagtatggaattttttaa

SEQ ID NO: 613574 - DNA, 20 bp, Artificial
  CRISPR gRNA sequence
tatggaattttttaaaggaa

SEQ ID NO: 613575 - DNA, 20 bp, Artificial
  CRISPR gRNA sequence
tggaattttttaaaggaaaa

SEQ ID NO: 613576 - DNA, 20 bp, Artificial
  CRISPR gRNA sequence
ggaattttttaaaggaaaag

SEQ ID NO: 613577 - DNA, 20 bp, Artificial
  CRISPR gRNA sequence
agaggcattttcactttact

SEQ ID NO: 613578 - DNA, 20 bp, Artificial
  CRISPR gRNA sequence
ttactcagaaaacatttatc

SEQ ID NO: 613579 - DNA, 20 bp, Artificial
  CRISPR gRNA sequence
actcagaaaacatttatcaa

SEQ ID NO: 613580 - DNA, 20 bp, Artificial
  CRISPR gRNA sequence
tcaagagcttactatgtgcc

SEQ ID NO: 613581 - DNA, 20 bp, Artificial
  CRISPR gRNA sequence
ttactatgtgccaagttata

SEQ ID NO: 613582 - DNA, 20 bp, Artificial
  CRISPR gRNA sequence
ccaagttatatagaacattc

SEQ ID NO: 613583 - DNA, 20 bp, Artificial
  CRISPR gRNA sequence
caagttatatagaacattct

SEQ ID NO: 613584 - DNA, 20 bp, Artificial
  CRISPR gRNA sequence
aagttatatagaacattctg

SEQ ID NO: 613585 - DNA, 20 bp, Artificial
  CRISPR gRNA sequence
ttctggggtataaaaataaa

SEQ ID NO: 613586 - DNA, 20 bp, Artificial
  CRISPR gRNA sequence
ggtataaaaataaatggacc

SEQ ID NO: 613587 - DNA, 20 bp, Artificial
  CRISPR gRNA sequence
cttttaatacacttacttta

SEQ ID NO: 613588 - DNA, 20 bp, Artificial
  CRISPR gRNA sequence
aatacacttactttatagtc

SEQ ID NO: 613589 - DNA, 20 bp, Artificial
  CRISPR gRNA sequence
acacttactttatagtctgg

SEQ ID NO: 613590 - DNA, 20 bp, Artificial
  CRISPR gRNA sequence
cacttactttatagtctggt

SEQ ID NO: 613591 - DNA, 20 bp, Artificial
  CRISPR gRNA sequence
aataaaataaaatgaaacaa

SEQ ID NO: 613592 - DNA, 20 bp, Artificial
  CRISPR gRNA sequence
aatgaaacaaaagctctaat

SEQ ID NO: 613593 - DNA, 20 bp, Artificial
  CRISPR gRNA sequence
atgaaacaaaagctctaata

SEQ ID NO: 613594 - DNA, 20 bp, Artificial
  CRISPR gRNA sequence
ctctaataaggatgcataca

SEQ ID NO: 613595 - DNA, 20 bp, Artificial
  CRISPR gRNA sequence
aggatgcatacacagttctc

SEQ ID NO: 613596 - DNA, 20 bp, Artificial
  CRISPR gRNA sequence
ggatgcatacacagttctct

SEQ ID NO: 613597 - DNA, 20 bp, Artificial
  CRISPR gRNA sequence
tacacagttctctgggaaca

SEQ ID NO: 613598 - DNA, 20 bp, Artificial
  CRISPR gRNA sequence
gttctctgggaacatagatg

SEQ ID NO: 613599 - DNA, 20 bp, Artificial
  CRISPR gRNA sequence
atgtagaattaacctaactc

SEQ ID NO: 613600 - DNA, 20 bp, Artificial
  CRISPR gRNA sequence
gaattaacctaactctggaa

SEQ ID NO: 613601 - DNA, 20 bp, Artificial
  CRISPR gRNA sequence
aacctaactctggaaaagtc

SEQ ID NO: 613602 - DNA, 20 bp, Artificial
  CRISPR gRNA sequence
cctaactctggaaaagtcaa

SEQ ID NO: 613603 - DNA, 20 bp, Artificial
  CRISPR gRNA sequence
taactctggaaaagtcaaga

SEQ ID NO: 613604 - DNA, 20 bp, Artificial
  CRISPR gRNA sequence
aactctggaaaagtcaagag

SEQ ID NO: 613605 - DNA, 20 bp, Artificial
  CRISPR gRNA sequence
caagagaggcttcttacatg

SEQ ID NO: 613606 - DNA, 20 bp, Artificial
  CRISPR gRNA sequence
aagagaggcttcttacatgc

SEQ ID NO: 613607 - DNA, 20 bp, Artificial
  CRISPR gRNA sequence
gagaggcttcttacatgcag

SEQ ID NO: 613608 - DNA, 20 bp, Artificial
  CRISPR gRNA sequence
ggagtgttcaatccaaacat

SEQ ID NO: 613609 - DNA, 20 bp, Artificial
  CRISPR gRNA sequence
gagtgttcaatccaaacatg

SEQ ID NO: 613610 - DNA, 20 bp, Artificial
  CRISPR gRNA sequence
agtgttcaatccaaacatga

SEQ ID NO: 613611 - DNA, 20 bp, Artificial
  CRISPR gRNA sequence
tcaatccaaacatgagggat

SEQ ID NO: 613612 - DNA, 20 bp, Artificial
  CRISPR gRNA sequence
tgagtaaaaattgcatatat

SEQ ID NO: 613613 - DNA, 20 bp, Artificial
  CRISPR gRNA sequence
gagtaaaaattgcatatatc

SEQ ID NO: 613614 - DNA, 20 bp, Artificial
  CRISPR gRNA sequence
taaaaattgcatatatcagg

SEQ ID NO: 613615 - DNA, 20 bp, Artificial
  CRISPR gRNA sequence
aaaaattgcatatatcaggc

SEQ ID NO: 613616 - DNA, 20 bp, Artificial
  CRISPR gRNA sequence
tgcatatatcaggcaggata

SEQ ID NO: 613617 - DNA, 20 bp, Artificial
  CRISPR gRNA sequence
catatatcaggcaggataca

SEQ ID NO: 613618 - DNA, 20 bp, Artificial
  CRISPR gRNA sequence
gatacagagaatgtatattc

SEQ ID NO: 613619 - DNA, 20 bp, Artificial
  CRISPR gRNA sequence
atacagagaatgtatattca

SEQ ID NO: 613620 - DNA, 20 bp, Artificial
  CRISPR gRNA sequence
acagagaatgtatattcaag

SEQ ID NO: 613621 - DNA, 20 bp, Artificial
  CRISPR gRNA sequence
aatgtatattcaaggagaaa

SEQ ID NO: 613622 - DNA, 20 bp, Artificial
  CRISPR gRNA sequence
tgtatattcaaggagaaaaa

SEQ ID NO: 613623 - DNA, 20 bp, Artificial
  CRISPR gRNA sequence
gtatattcaaggagaaaaag

SEQ ID NO: 613624 - DNA, 20 bp, Artificial
  CRISPR gRNA sequence
ttcaaggagaaaaagaggct

SEQ ID NO: 613625 - DNA, 20 bp, Artificial
  CRISPR gRNA sequence
caaggagaaaaagaggcttg

SEQ ID NO: 613626 - DNA, 20 bp, Artificial
  CRISPR gRNA sequence
aaagaggcttggagatataa

SEQ ID NO: 613627 - DNA, 20 bp, Artificial
  CRISPR gRNA sequence
gagatataaaagataattaa

SEQ ID NO: 613628 - DNA, 20 bp, Artificial
  CRISPR gRNA sequence
ttaacagcttccctgatgtt

SEQ ID NO: 613629 - DNA, 20 bp, Artificial
  CRISPR gRNA sequence
cctgatgttgagtgtaactg

SEQ ID NO: 613630 - DNA, 20 bp, Artificial
  CRISPR gRNA sequence
gttgagtgtaactgcagttt

SEQ ID NO: 613631 - DNA, 20 bp, Artificial
  CRISPR gRNA sequence
ttgagtgtaactgcagttta

SEQ ID NO: 613632 - DNA, 20 bp, Artificial
  CRISPR gRNA sequence
gagtgtaactgcagtttaag

SEQ ID NO: 613633 - DNA, 20 bp, Artificial
  CRISPR gRNA sequence
tgtaactgcagtttaaggag

SEQ ID NO: 613634 - DNA, 20 bp, Artificial
  CRISPR gRNA sequence
aactgcagtttaaggagtgg

SEQ ID NO: 613635 - DNA, 20 bp, Artificial
  CRISPR gRNA sequence
actgcagtttaaggagtggt

SEQ ID NO: 613636 - DNA, 20 bp, Artificial
  CRISPR gRNA sequence
ttaaggagtggtaggaaatg

SEQ ID NO: 613637 - DNA, 20 bp, Artificial
  CRISPR gRNA sequence
aggaaatgaagcttctgaat

SEQ ID NO: 613638 - DNA, 20 bp, Artificial
  CRISPR gRNA sequence
aaatgaagcttctgaattag

SEQ ID NO: 613639 - DNA, 20 bp, Artificial
  CRISPR gRNA sequence
aatgaagcttctgaattagt

SEQ ID NO: 613640 - DNA, 20 bp, Artificial
  CRISPR gRNA sequence
aattagtaggttgtgatgca

SEQ ID NO: 613641 - DNA, 20 bp, Artificial
  CRISPR gRNA sequence
agtaggttgtgatgcaaaga

SEQ ID NO: 613642 - DNA, 20 bp, Artificial
  CRISPR gRNA sequence
taggttgtgatgcaaagaca

SEQ ID NO: 613643 - DNA, 20 bp, Artificial
  CRISPR gRNA sequence
aagacagagtcttctctgct

SEQ ID NO: 613644 - DNA, 20 bp, Artificial
  CRISPR gRNA sequence
cagagtcttctctgctaagc

SEQ ID NO: 613645 - DNA, 20 bp, Artificial
  CRISPR gRNA sequence
gaatttcattgtgtaactga

SEQ ID NO: 613646 - DNA, 20 bp, Artificial
  CRISPR gRNA sequence
aatttcattgtgtaactgat

SEQ ID NO: 613647 - DNA, 20 bp, Artificial
  CRISPR gRNA sequence
atttcattgtgtaactgatg

SEQ ID NO: 613648 - DNA, 20 bp, Artificial
  CRISPR gRNA sequence
tttcattgtgtaactgatgg

SEQ ID NO: 613649 - DNA, 20 bp, Artificial
  CRISPR gRNA sequence
ttcattgtgtaactgatggg

SEQ ID NO: 613650 - DNA, 20 bp, Artificial
  CRISPR gRNA sequence
tgtaactgatggggggccac

SEQ ID NO: 613651 - DNA, 20 bp, Artificial
  CRISPR gRNA sequence
gtaactgatggggggccact

SEQ ID NO: 613652 - DNA, 20 bp, Artificial
  CRISPR gRNA sequence
taactgatggggggccacta

SEQ ID NO: 613653 - DNA, 20 bp, Artificial
  CRISPR gRNA sequence
taaccaaatttgttattaat

SEQ ID NO: 613654 - DNA, 20 bp, Artificial
  CRISPR gRNA sequence
aaccaaatttgttattaatg

SEQ ID NO: 613655 - DNA, 20 bp, Artificial
  CRISPR gRNA sequence
attaatgaggtaatcaaatc

SEQ ID NO: 613656 - DNA, 20 bp, Artificial
  CRISPR gRNA sequence
tcaagaaaaatgtctccaat

SEQ ID NO: 613657 - DNA, 20 bp, Artificial
  CRISPR gRNA sequence
caagaaaaatgtctccaatg

SEQ ID NO: 613658 - DNA, 20 bp, Artificial
  CRISPR gRNA sequence
atacatgataaatgcctacc

SEQ ID NO: 613659 - DNA, 20 bp, Artificial
  CRISPR gRNA sequence
tacatgataaatgcctacct

SEQ ID NO: 613660 - DNA, 20 bp, Artificial
  CRISPR gRNA sequence
acatgataaatgcctacctg

SEQ ID NO: 613661 - DNA, 20 bp, Artificial
  CRISPR gRNA sequence
tgataaatgcctacctgggg

SEQ ID NO: 613662 - DNA, 20 bp, Artificial
  CRISPR gRNA sequence
gataaatgcctacctggggc

SEQ ID NO: 613663 - DNA, 20 bp, Artificial
  CRISPR gRNA sequence
ataaatgcctacctggggca

SEQ ID NO: 613664 - DNA, 20 bp, Artificial
  CRISPR gRNA sequence
taaatgcctacctggggcag

SEQ ID NO: 613665 - DNA, 20 bp, Artificial
  CRISPR gRNA sequence
aaatgcctacctggggcagg

SEQ ID NO: 613666 - DNA, 20 bp, Artificial
  CRISPR gRNA sequence
cctacctggggcagggggta

SEQ ID NO: 613667 - DNA, 20 bp, Artificial
  CRISPR gRNA sequence
tggggcagggggtatggtgt

SEQ ID NO: 613668 - DNA, 20 bp, Artificial
  CRISPR gRNA sequence
ggggcagggggtatggtgtg

SEQ ID NO: 613669 - DNA, 20 bp, Artificial
  CRISPR gRNA sequence
ggcagggggtatggtgtgag

SEQ ID NO: 613670 - DNA, 20 bp, Artificial
  CRISPR gRNA sequence
cagggggtatggtgtgagga

SEQ ID NO: 613671 - DNA, 20 bp, Artificial
  CRISPR gRNA sequence
ggtatggtgtgaggagagac

SEQ ID NO: 613672 - DNA, 20 bp, Artificial
  CRISPR gRNA sequence
ctggaaatgacaatgccaaa

SEQ ID NO: 613673 - DNA, 20 bp, Artificial
  CRISPR gRNA sequence
atgacaatgccaaaaagaaa

SEQ ID NO: 613674 - DNA, 20 bp, Artificial
  CRISPR gRNA sequence
atgccaaaaagaaaaagatg

SEQ ID NO: 613675 - DNA, 20 bp, Artificial
  CRISPR gRNA sequence
gccaaaaagaaaaagatgaa

SEQ ID NO: 613676 - DNA, 20 bp, Artificial
  CRISPR gRNA sequence
ccaaaaagaaaaagatgaag

SEQ ID NO: 613677 - DNA, 20 bp, Artificial
  CRISPR gRNA sequence
aaaagatgaagaggcaactg

SEQ ID NO: 613678 - DNA, 20 bp, Artificial
  CRISPR gRNA sequence
agatgaagaggcaactgcag

SEQ ID NO: 613679 - DNA, 20 bp, Artificial
  CRISPR gRNA sequence
atgaagaggcaactgcagaa

SEQ ID NO: 613680 - DNA, 20 bp, Artificial
  CRISPR gRNA sequence
aggcaactgcagaagagaac

SEQ ID NO: 613681 - DNA, 20 bp, Artificial
  CRISPR gRNA sequence
ggcaactgcagaagagaaca

SEQ ID NO: 613682 - DNA, 20 bp, Artificial
  CRISPR gRNA sequence
gagaacaaggtgaaatattg

SEQ ID NO: 613683 - DNA, 20 bp, Artificial
  CRISPR gRNA sequence
tgaaatattgaagacatatt

SEQ ID NO: 613684 - DNA, 20 bp, Artificial
  CRISPR gRNA sequence
gaaatattgaagacatattt

SEQ ID NO: 613685 - DNA, 20 bp, Artificial
  CRISPR gRNA sequence
aatattgaagacatatttag

SEQ ID NO: 613686 - DNA, 20 bp, Artificial
  CRISPR gRNA sequence
atattgaagacatatttagg

SEQ ID NO: 613687 - DNA, 20 bp, Artificial
  CRISPR gRNA sequence
ttgaagacatatttaggagg

SEQ ID NO: 613688 - DNA, 20 bp, Artificial
  CRISPR gRNA sequence
atttaggaggtagaataaaa

SEQ ID NO: 613689 - DNA, 20 bp, Artificial
  CRISPR gRNA sequence
gaggtagaataaaatggtct

SEQ ID NO: 613690 - DNA, 20 bp, Artificial
  CRISPR gRNA sequence
agaataaaatggtcttagaa

SEQ ID NO: 613691 - DNA, 20 bp, Artificial
  CRISPR gRNA sequence
tggtcttagaaaagttgatt

SEQ ID NO: 613692 - DNA, 20 bp, Artificial
  CRISPR gRNA sequence
tagaaaagttgattgagttt

SEQ ID NO: 613693 - DNA, 20 bp, Artificial
  CRISPR gRNA sequence
agaaaagttgattgagtttg

SEQ ID NO: 613694 - DNA, 20 bp, Artificial
  CRISPR gRNA sequence
gttgattgagtttgaggaaa

SEQ ID NO: 613695 - DNA, 20 bp, Artificial
  CRISPR gRNA sequence
ttgattgagtttgaggaaaa

SEQ ID NO: 613696 - DNA, 20 bp, Artificial
  CRISPR gRNA sequence
gattgagtttgaggaaaaag

SEQ ID NO: 613697 - DNA, 20 bp, Artificial
  CRISPR gRNA sequence
attgagtttgaggaaaaagg

SEQ ID NO: 613698 - DNA, 20 bp, Artificial
  CRISPR gRNA sequence
aggaggaatatcatgactca

SEQ ID NO: 613699 - DNA, 20 bp, Artificial
  CRISPR gRNA sequence
aatatcatgactcatagttt

SEQ ID NO: 613700 - DNA, 20 bp, Artificial
  CRISPR gRNA sequence
tagttttggaaataataatt

SEQ ID NO: 613701 - DNA, 20 bp, Artificial
  CRISPR gRNA sequence
ataataattgagttttatga

SEQ ID NO: 613702 - DNA, 20 bp, Artificial
  CRISPR gRNA sequence
atataattaaattatttaat

SEQ ID NO: 613703 - DNA, 20 bp, Artificial
  CRISPR gRNA sequence
tataattaaattatttaatt

SEQ ID NO: 613704 - DNA, 20 bp, Artificial
  CRISPR gRNA sequence
attatttaattgggtttgat

SEQ ID NO: 613705 - DNA, 20 bp, Artificial
  CRISPR gRNA sequence
gatgagcttatttattttat

SEQ ID NO: 613706 - DNA, 20 bp, Artificial
  CRISPR gRNA sequence
atgagcttatttattttatt

SEQ ID NO: 613707 - DNA, 20 bp, Artificial
  CRISPR gRNA sequence
ttatttattttattgggttt

SEQ ID NO: 613708 - DNA, 20 bp, Artificial
  CRISPR gRNA sequence
tatttattttattgggtttt

SEQ ID NO: 613709 - DNA, 20 bp, Artificial
  CRISPR gRNA sequence
atttattttattgggtttta

SEQ ID NO: 613710 - DNA, 20 bp, Artificial
  CRISPR gRNA sequence
tattttattgggttttaggg

SEQ ID NO: 613711 - DNA, 20 bp, Artificial
  CRISPR gRNA sequence
gattatttatcttatttaat

SEQ ID NO: 613712 - DNA, 20 bp, Artificial
  CRISPR gRNA sequence
attatttatcttatttaatt

SEQ ID NO: 613713 - DNA, 20 bp, Artificial
  CRISPR gRNA sequence
tcttatttaattaggtttta

SEQ ID NO: 613714 - DNA, 20 bp, Artificial
  CRISPR gRNA sequence
tatttaattaggttttatgg

SEQ ID NO: 613715 - DNA, 20 bp, Artificial
  CRISPR gRNA sequence
tatctttatgttgctttttc

SEQ ID NO: 613716 - DNA, 20 bp, Artificial
  CRISPR gRNA sequence
gttgctttttcaagtctgct

SEQ ID NO: 613717 - DNA, 20 bp, Artificial
  CRISPR gRNA sequence
tttcaagtctgcttagcttg

SEQ ID NO: 613718 - DNA, 20 bp, Artificial
  CRISPR gRNA sequence
ttcaagtctgcttagcttga

SEQ ID NO: 613719 - DNA, 20 bp, Artificial
  CRISPR gRNA sequence
gtctgcttagcttgaaggaa

SEQ ID NO: 613720 - DNA, 20 bp, Artificial
  CRISPR gRNA sequence
acctgttttacctaaaccta

SEQ ID NO: 613721 - DNA, 20 bp, Artificial
  CRISPR gRNA sequence
aaacctaaagacaaaaatga

SEQ ID NO: 613722 - DNA, 20 bp, Artificial
  CRISPR gRNA sequence
aagacaaaaatgaaagtgca

SEQ ID NO: 613723 - DNA, 20 bp, Artificial
  CRISPR gRNA sequence
acaaaaatgaaagtgcaaag

SEQ ID NO: 613724 - DNA, 20 bp, Artificial
  CRISPR gRNA sequence
aaaatgaaagtgcaaagcag

SEQ ID NO: 613725 - DNA, 20 bp, Artificial
  CRISPR gRNA sequence
aaatgaaagtgcaaagcaga

SEQ ID NO: 613726 - DNA, 20 bp, Artificial
  CRISPR gRNA sequence
gaaagtgcaaagcagaagga

SEQ ID NO: 613727 - DNA, 20 bp, Artificial
  CRISPR gRNA sequence
gtgcaaagcagaaggatagc

SEQ ID NO: 613728 - DNA, 20 bp, Artificial
  CRISPR gRNA sequence
ttaaaatctatatatattgt

SEQ ID NO: 613729 - DNA, 20 bp, Artificial
  CRISPR gRNA sequence
taaaatctatatatattgtt

SEQ ID NO: 613730 - DNA, 20 bp, Artificial
  CRISPR gRNA sequence
ggtttatgctttgaattgtt

SEQ ID NO: 613731 - DNA, 20 bp, Artificial
  CRISPR gRNA sequence
gtttatgctttgaattgttt

SEQ ID NO: 613732 - DNA, 20 bp, Artificial
  CRISPR gRNA sequence
atgctttgaattgtttagga

SEQ ID NO: 613733 - DNA, 20 bp, Artificial
  CRISPR gRNA sequence
tgctttgaattgtttaggaa

SEQ ID NO: 613734 - DNA, 20 bp, Artificial
  CRISPR gRNA sequence
gctttgaattgtttaggaaa

SEQ ID NO: 613735 - DNA, 20 bp, Artificial
  CRISPR gRNA sequence
tttgaattgtttaggaaagg

SEQ ID NO: 613736 - DNA, 20 bp, Artificial
  CRISPR gRNA sequence
ttgaattgtttaggaaaggg

SEQ ID NO: 613737 - DNA, 20 bp, Artificial
  CRISPR gRNA sequence
gaaagggaggttctttttca

SEQ ID NO: 613738 - DNA, 20 bp, Artificial
  CRISPR gRNA sequence
ggaggttctttttcacagta

SEQ ID NO: 613739 - DNA, 20 bp, Artificial
  CRISPR gRNA sequence
aggttctttttcacagtata

SEQ ID NO: 613740 - DNA, 20 bp, Artificial
  CRISPR gRNA sequence
ggttctttttcacagtatag

SEQ ID NO: 613741 - DNA, 20 bp, Artificial
  CRISPR gRNA sequence
tcacagtatagaggcattat

SEQ ID NO: 613742 - DNA, 20 bp, Artificial
  CRISPR gRNA sequence
cacagtatagaggcattatt

SEQ ID NO: 613743 - DNA, 20 bp, Artificial
  CRISPR gRNA sequence
tattgggcacccccaaactt

SEQ ID NO: 613744 - DNA, 20 bp, Artificial
  CRISPR gRNA sequence
gcacccccaaactttggaat

SEQ ID NO: 613745 - DNA, 20 bp, Artificial
  CRISPR gRNA sequence
cttttttgacttatttctat

SEQ ID NO: 613746 - DNA, 20 bp, Artificial
  CRISPR gRNA sequence
ttttttgacttatttctatt

SEQ ID NO: 613747 - DNA, 20 bp, Artificial
  CRISPR gRNA sequence
ttctattgggtgacatcatt

SEQ ID NO: 613748 - DNA, 20 bp, Artificial
  CRISPR gRNA sequence
atatctctcttgtatcataa

SEQ ID NO: 613749 - DNA, 20 bp, Artificial
  CRISPR gRNA sequence
tatctctcttgtatcataaa

SEQ ID NO: 613750 - DNA, 20 bp, Artificial
  CRISPR gRNA sequence
tcttgtatcataaaaggtat

SEQ ID NO: 613751 - DNA, 20 bp, Artificial
  CRISPR gRNA sequence
ttgtatcataaaaggtatta

SEQ ID NO: 613752 - DNA, 20 bp, Artificial
  CRISPR gRNA sequence
tattagagacacaaatacaa

SEQ ID NO: 613753 - DNA, 20 bp, Artificial
  CRISPR gRNA sequence
tacaacagaatgcaacccct

SEQ ID NO: 613754 - DNA, 20 bp, Artificial
  CRISPR gRNA sequence
acaacagaatgcaacccctg

SEQ ID NO: 613755 - DNA, 20 bp, Artificial
  CRISPR gRNA sequence
caacccctgaggttatttac

SEQ ID NO: 613756 - DNA, 20 bp, Artificial
  CRISPR gRNA sequence
tgaggttatttaccagctat

SEQ ID NO: 613757 - DNA, 20 bp, Artificial
  CRISPR gRNA sequence
ggttatttaccagctattgg

SEQ ID NO: 613758 - DNA, 20 bp, Artificial
  CRISPR gRNA sequence
atttaccagctattggaaga

SEQ ID NO: 613759 - DNA, 20 bp, Artificial
  CRISPR gRNA sequence
ccagctattggaagatagac

SEQ ID NO: 613760 - DNA, 20 bp, Artificial
  CRISPR gRNA sequence
gaccagtaaaacaacaatta

SEQ ID NO: 613761 - DNA, 20 bp, Artificial
  CRISPR gRNA sequence
caattatagtactatgtgat

SEQ ID NO: 613762 - DNA, 20 bp, Artificial
  CRISPR gRNA sequence
gtactatgtgataagcatta

SEQ ID NO: 613763 - DNA, 20 bp, Artificial
  CRISPR gRNA sequence
actatgtgataagcattatg

SEQ ID NO: 613764 - DNA, 20 bp, Artificial
  CRISPR gRNA sequence
tgtgataagcattatggaga

SEQ ID NO: 613765 - DNA, 20 bp, Artificial
  CRISPR gRNA sequence
tgataagcattatggagaca

SEQ ID NO: 613766 - DNA, 20 bp, Artificial
  CRISPR gRNA sequence
ataagcattatggagacaga

SEQ ID NO: 613767 - DNA, 20 bp, Artificial
  CRISPR gRNA sequence
taagcattatggagacagag

SEQ ID NO: 613768 - DNA, 20 bp, Artificial
  CRISPR gRNA sequence
cagagaggacatacctaaat

SEQ ID NO: 613769 - DNA, 20 bp, Artificial
  CRISPR gRNA sequence
agaggacatacctaaatcag

SEQ ID NO: 613770 - DNA, 20 bp, Artificial
  CRISPR gRNA sequence
cctaaatcagcagaacatcc

SEQ ID NO: 613771 - DNA, 20 bp, Artificial
  CRISPR gRNA sequence
taaatcagcagaacatccaa

SEQ ID NO: 613772 - DNA, 20 bp, Artificial
  CRISPR gRNA sequence
aaatcagcagaacatccaag

SEQ ID NO: 613773 - DNA, 20 bp, Artificial
  CRISPR gRNA sequence
aacatccaagaggaatttcc

SEQ ID NO: 613774 - DNA, 20 bp, Artificial
  CRISPR gRNA sequence
acatccaagaggaatttccc

SEQ ID NO: 613775 - DNA, 20 bp, Artificial
  CRISPR gRNA sequence
aagaggaatttcccgggatt

SEQ ID NO: 613776 - DNA, 20 bp, Artificial
  CRISPR gRNA sequence
gaatttcccgggattgagct

SEQ ID NO: 613777 - DNA, 20 bp, Artificial
  CRISPR gRNA sequence
ggattgagcttagttttaaa

SEQ ID NO: 613778 - DNA, 20 bp, Artificial
  CRISPR gRNA sequence
caaaaatgtgaactaataaa

SEQ ID NO: 613779 - DNA, 20 bp, Artificial
  CRISPR gRNA sequence
aaaatgtgaactaataaatg

SEQ ID NO: 613780 - DNA, 20 bp, Artificial
  CRISPR gRNA sequence
atgtgaactaataaatggag

SEQ ID NO: 613781 - DNA, 20 bp, Artificial
  CRISPR gRNA sequence
tgtgaactaataaatggaga

SEQ ID NO: 613782 - DNA, 20 bp, Artificial
  CRISPR gRNA sequence
gtgaactaataaatggagaa

SEQ ID NO: 613783 - DNA, 20 bp, Artificial
  CRISPR gRNA sequence
atggagaagggtgtttcctg

SEQ ID NO: 613784 - DNA, 20 bp, Artificial
  CRISPR gRNA sequence
agaagggtgtttcctgcaga

SEQ ID NO: 613785 - DNA, 20 bp, Artificial
  CRISPR gRNA sequence
tatgtgaacaactaccaatg

SEQ ID NO: 613786 - DNA, 20 bp, Artificial
  CRISPR gRNA sequence
aatgtagcatctaaaacact

SEQ ID NO: 613787 - DNA, 20 bp, Artificial
  CRISPR gRNA sequence
atgtagcatctaaaacactt

SEQ ID NO: 613788 - DNA, 20 bp, Artificial
  CRISPR gRNA sequence
tgtagcatctaaaacacttg

SEQ ID NO: 613789 - DNA, 20 bp, Artificial
  CRISPR gRNA sequence
tacctccatgtgtgtttgta

SEQ ID NO: 613790 - DNA, 20 bp, Artificial
  CRISPR gRNA sequence
cctccatgtgtgtttgtaaa

SEQ ID NO: 613791 - DNA, 20 bp, Artificial
  CRISPR gRNA sequence
tgtgtgtttgtaaagagatg

SEQ ID NO: 613792 - DNA, 20 bp, Artificial
  CRISPR gRNA sequence
gtgtttgtaaagagatgtgg

SEQ ID NO: 613793 - DNA, 20 bp, Artificial
  CRISPR gRNA sequence
tgtttgtaaagagatgtggt

SEQ ID NO: 613794 - DNA, 20 bp, Artificial
  CRISPR gRNA sequence
gtttgtaaagagatgtggta

SEQ ID NO: 613795 - DNA, 20 bp, Artificial
  CRISPR gRNA sequence
ttgtaaagagatgtggtagg

SEQ ID NO: 613796 - DNA, 20 bp, Artificial
  CRISPR gRNA sequence
tgtaaagagatgtggtaggg

SEQ ID NO: 613797 - DNA, 20 bp, Artificial
  CRISPR gRNA sequence
taaagagatgtggtagggag

SEQ ID NO: 613798 - DNA, 20 bp, Artificial
  CRISPR gRNA sequence
aaagagatgtggtagggagg

SEQ ID NO: 613799 - DNA, 20 bp, Artificial
  CRISPR gRNA sequence
agagatgtggtagggaggag

SEQ ID NO: 613800 - DNA, 20 bp, Artificial
  CRISPR gRNA sequence
agatgtggtagggaggagga

SEQ ID NO: 613801 - DNA, 20 bp, Artificial
  CRISPR gRNA sequence
gatgtggtagggaggaggag

SEQ ID NO: 613802 - DNA, 20 bp, Artificial
  CRISPR gRNA sequence
gtggtagggaggaggagagg

SEQ ID NO: 613803 - DNA, 20 bp, Artificial
  CRISPR gRNA sequence
gtagggaggaggagaggcag

SEQ ID NO: 613804 - DNA, 20 bp, Artificial
  CRISPR gRNA sequence
gaggaggagaggcagaagac

SEQ ID NO: 613805 - DNA, 20 bp, Artificial
  CRISPR gRNA sequence
agaggcagaagactggatga

SEQ ID NO: 613806 - DNA, 20 bp, Artificial
  CRISPR gRNA sequence
gaggcagaagactggatgaa

SEQ ID NO: 613807 - DNA, 20 bp, Artificial
  CRISPR gRNA sequence
gcagaagactggatgaaagg

SEQ ID NO: 613808 - DNA, 20 bp, Artificial
  CRISPR gRNA sequence
ctggatgaaaggaagaaatc

SEQ ID NO: 613809 - DNA, 20 bp, Artificial
  CRISPR gRNA sequence
tggatgaaaggaagaaatct

SEQ ID NO: 613810 - DNA, 20 bp, Artificial
  CRISPR gRNA sequence
aagaaatctaggattttcca

SEQ ID NO: 613811 - DNA, 20 bp, Artificial
  CRISPR gRNA sequence
agaaatctaggattttccac

SEQ ID NO: 613812 - DNA, 20 bp, Artificial
  CRISPR gRNA sequence
taggattttccacaggtgac

SEQ ID NO: 613813 - DNA, 20 bp, Artificial
  CRISPR gRNA sequence
ttttccacaggtgaccagca

SEQ ID NO: 613814 - DNA, 20 bp, Artificial
  CRISPR gRNA sequence
caggtgaccagcatggctga

SEQ ID NO: 613815 - DNA, 20 bp, Artificial
  CRISPR gRNA sequence
ggtgaccagcatggctgatg

SEQ ID NO: 613816 - DNA, 20 bp, Artificial
  CRISPR gRNA sequence
agcatggctgatggagtaaa

SEQ ID NO: 613817 - DNA, 20 bp, Artificial
  CRISPR gRNA sequence
atggctgatggagtaaatag

SEQ ID NO: 613818 - DNA, 20 bp, Artificial
  CRISPR gRNA sequence
gagtaaatagtagtgtcatt

SEQ ID NO: 613819 - DNA, 20 bp, Artificial
  CRISPR gRNA sequence
agtagtgtcattcagtgata

SEQ ID NO: 613820 - DNA, 20 bp, Artificial
  CRISPR gRNA sequence
tcattcagtgatatggtaat

SEQ ID NO: 613821 - DNA, 20 bp, Artificial
  CRISPR gRNA sequence
ttcagtgatatggtaattag

SEQ ID NO: 613822 - DNA, 20 bp, Artificial
  CRISPR gRNA sequence
tggtaattagtagtgtcatt

SEQ ID NO: 613823 - DNA, 20 bp, Artificial
  CRISPR gRNA sequence
agtagtgtcattcagtgata

SEQ ID NO: 613824 - DNA, 20 bp, Artificial
  CRISPR gRNA sequence
tcattcagtgatatggtaat

SEQ ID NO: 613825 - DNA, 20 bp, Artificial
  CRISPR gRNA sequence
cattcagtgatatggtaatt

SEQ ID NO: 613826 - DNA, 20 bp, Artificial
  CRISPR gRNA sequence
tgatatggtaattaggaaaa

SEQ ID NO: 613827 - DNA, 20 bp, Artificial
  CRISPR gRNA sequence
tatggtaattaggaaaatag

SEQ ID NO: 613828 - DNA, 20 bp, Artificial
  CRISPR gRNA sequence
gtaattaggaaaatagaaga

SEQ ID NO: 613829 - DNA, 20 bp, Artificial
  CRISPR gRNA sequence
ttaggaaaatagaagaaaga

SEQ ID NO: 613830 - DNA, 20 bp, Artificial
  CRISPR gRNA sequence
taggaaaatagaagaaagaa

SEQ ID NO: 613831 - DNA, 20 bp, Artificial
  CRISPR gRNA sequence
atagaagaaagaaaggtaaa

SEQ ID NO: 613832 - DNA, 20 bp, Artificial
  CRISPR gRNA sequence
agaagaaagaaaggtaaatg

SEQ ID NO: 613833 - DNA, 20 bp, Artificial
  CRISPR gRNA sequence
tcttttatgtctccatgaaa

SEQ ID NO: 613834 - DNA, 20 bp, Artificial
  CRISPR gRNA sequence
cttttatgtctccatgaaat

SEQ ID NO: 613835 - DNA, 20 bp, Artificial
  CRISPR gRNA sequence
aataggcaaataaaactgtc

SEQ ID NO: 613836 - DNA, 20 bp, Artificial
  CRISPR gRNA sequence
ataggcaaataaaactgtct

SEQ ID NO: 613837 - DNA, 20 bp, Artificial
  CRISPR gRNA sequence
ggcaaataaaactgtctagg

SEQ ID NO: 613838 - DNA, 20 bp, Artificial
  CRISPR gRNA sequence
ctaggaagatgttaaatata

SEQ ID NO: 613839 - DNA, 20 bp, Artificial
  CRISPR gRNA sequence
atgttaaatatatagatctc

SEQ ID NO: 613840 - DNA, 20 bp, Artificial
  CRISPR gRNA sequence
tatatagatctcaagctctt

SEQ ID NO: 613841 - DNA, 20 bp, Artificial
  CRISPR gRNA sequence
tatagatctcaagctcttga

SEQ ID NO: 613842 - DNA, 20 bp, Artificial
  CRISPR gRNA sequence
atagatctcaagctcttgag

SEQ ID NO: 613843 - DNA, 20 bp, Artificial
  CRISPR gRNA sequence
tagatctcaagctcttgaga

SEQ ID NO: 613844 - DNA, 20 bp, Artificial
  CRISPR gRNA sequence
agatctcaagctcttgagag

SEQ ID NO: 613845 - DNA, 20 bp, Artificial
  CRISPR gRNA sequence
caagctcttgagaggggtct

SEQ ID NO: 613846 - DNA, 20 bp, Artificial
  CRISPR gRNA sequence
gctcttgagaggggtctgag

SEQ ID NO: 613847 - DNA, 20 bp, Artificial
  CRISPR gRNA sequence
ctcttgagaggggtctgagt

SEQ ID NO: 613848 - DNA, 20 bp, Artificial
  CRISPR gRNA sequence
aggggtctgagtaggaaaca

SEQ ID NO: 613849 - DNA, 20 bp, Artificial
  CRISPR gRNA sequence
ctgagtaggaaacaaagatg

SEQ ID NO: 613850 - DNA, 20 bp, Artificial
  CRISPR gRNA sequence
tgagtaggaaacaaagatgc

SEQ ID NO: 613851 - DNA, 20 bp, Artificial
  CRISPR gRNA sequence
aggatccatcataatttatg

SEQ ID NO: 613852 - DNA, 20 bp, Artificial
  CRISPR gRNA sequence
atccatcataatttatgtag

SEQ ID NO: 613853 - DNA, 20 bp, Artificial
  CRISPR gRNA sequence
atttatgtagtggcccaacg

SEQ ID NO: 613854 - DNA, 20 bp, Artificial
  CRISPR gRNA sequence
tatgtagtggcccaacgtag

SEQ ID NO: 613855 - DNA, 20 bp, Artificial
  CRISPR gRNA sequence
ccaacgtagtagtttttaat

SEQ ID NO: 613856 - DNA, 20 bp, Artificial
  CRISPR gRNA sequence
caacgtagtagtttttaata

SEQ ID NO: 613857 - DNA, 20 bp, Artificial
  CRISPR gRNA sequence
tagtttttaataaggcaata

SEQ ID NO: 613858 - DNA, 20 bp, Artificial
  CRISPR gRNA sequence
tttaataaggcaatacggat

SEQ ID NO: 613859 - DNA, 20 bp, Artificial
  CRISPR gRNA sequence
taaggcaatacggataagta

SEQ ID NO: 613860 - DNA, 20 bp, Artificial
  CRISPR gRNA sequence
aggcaatacggataagtaca

SEQ ID NO: 613861 - DNA, 20 bp, Artificial
  CRISPR gRNA sequence
aatacggataagtacagagt

SEQ ID NO: 613862 - DNA, 20 bp, Artificial
  CRISPR gRNA sequence
taagtacagagtgagacatc

SEQ ID NO: 613863 - DNA, 20 bp, Artificial
  CRISPR gRNA sequence
gtacagagtgagacatcaag

SEQ ID NO: 613864 - DNA, 20 bp, Artificial
  CRISPR gRNA sequence
tacagagtgagacatcaaga

SEQ ID NO: 613865 - DNA, 20 bp, Artificial
  CRISPR gRNA sequence
agtgagacatcaagaaggcc

SEQ ID NO: 613866 - DNA, 20 bp, Artificial
  CRISPR gRNA sequence
caagaaggccaagaacacac

SEQ ID NO: 613867 - DNA, 20 bp, Artificial
  CRISPR gRNA sequence
gaaggccaagaacacactag

SEQ ID NO: 613868 - DNA, 20 bp, Artificial
  CRISPR gRNA sequence
aaggccaagaacacactagc

SEQ ID NO: 613869 - DNA, 20 bp, Artificial
  CRISPR gRNA sequence
agcaggaaaaaaatttcatg

SEQ ID NO: 613870 - DNA, 20 bp, Artificial
  CRISPR gRNA sequence
gaaaaaaatttcatgaagat

SEQ ID NO: 613871 - DNA, 20 bp, Artificial
  CRISPR gRNA sequence
aaaatttcatgaagatgagt

SEQ ID NO: 613872 - DNA, 20 bp, Artificial
  CRISPR gRNA sequence
aatttcatgaagatgagtaa

SEQ ID NO: 613873 - DNA, 20 bp, Artificial
  CRISPR gRNA sequence
ttcatgaagatgagtaagag

SEQ ID NO: 613874 - DNA, 20 bp, Artificial
  CRISPR gRNA sequence
catgaagatgagtaagagca

SEQ ID NO: 613875 - DNA, 20 bp, Artificial
  CRISPR gRNA sequence
gaagatgagtaagagcagag

SEQ ID NO: 613876 - DNA, 20 bp, Artificial
  CRISPR gRNA sequence
aagatgagtaagagcagagt

SEQ ID NO: 613877 - DNA, 20 bp, Artificial
  CRISPR gRNA sequence
gtaagagcagagtaggaaca

SEQ ID NO: 613878 - DNA, 20 bp, Artificial
  CRISPR gRNA sequence
gagcagagtaggaacatgga

SEQ ID NO: 613879 - DNA, 20 bp, Artificial
  CRISPR gRNA sequence
gcagagtaggaacatggaaa

SEQ ID NO: 613880 - DNA, 20 bp, Artificial
  CRISPR gRNA sequence
acatggaaagagtgatttca

SEQ ID NO: 613881 - DNA, 20 bp, Artificial
  CRISPR gRNA sequence
tggaaagagtgatttcacag

SEQ ID NO: 613882 - DNA, 20 bp, Artificial
  CRISPR gRNA sequence
gagtgatttcacagaagcca

SEQ ID NO: 613883 - DNA, 20 bp, Artificial
  CRISPR gRNA sequence
gatttcacagaagccaaagc

SEQ ID NO: 613884 - DNA, 20 bp, Artificial
  CRISPR gRNA sequence
acagaagccaaagcaagtgt

SEQ ID NO: 613885 - DNA, 20 bp, Artificial
  CRISPR gRNA sequence
cagcactgccaaatgctgtc

SEQ ID NO: 613886 - DNA, 20 bp, Artificial
  CRISPR gRNA sequence
atgctgtcaagaaaataact

SEQ ID NO: 613887 - DNA, 20 bp, Artificial
  CRISPR gRNA sequence
aaataactaagataactgta

SEQ ID NO: 613888 - DNA, 20 bp, Artificial
  CRISPR gRNA sequence
taactgtaaagttttttttt

SEQ ID NO: 613889 - DNA, 20 bp, Artificial
  CRISPR gRNA sequence
gtaaagttttttttttagat

SEQ ID NO: 613890 - DNA, 20 bp, Artificial
  CRISPR gRNA sequence
taaagttttttttttagatc

SEQ ID NO: 613891 - DNA, 20 bp, Artificial
  CRISPR gRNA sequence
tttttttagatcgggtaaca

SEQ ID NO: 613892 - DNA, 20 bp, Artificial
  CRISPR gRNA sequence
tttttagatcgggtaacacg

SEQ ID NO: 613893 - DNA, 20 bp, Artificial
  CRISPR gRNA sequence
ggagaaaatttgcaacaata

SEQ ID NO: 613894 - DNA, 20 bp, Artificial
  CRISPR gRNA sequence
gaaaatttgcaacaatatag

SEQ ID NO: 613895 - DNA, 20 bp, Artificial
  CRISPR gRNA sequence
ttcctccttctcttgataac

SEQ ID NO: 613896 - DNA, 20 bp, Artificial
  CRISPR gRNA sequence
cctccttctcttgataacaa

SEQ ID NO: 613897 - DNA, 20 bp, Artificial
  CRISPR gRNA sequence
caagagtgcccatttacctt

SEQ ID NO: 613898 - DNA, 20 bp, Artificial
  CRISPR gRNA sequence
agagtgcccatttaccttta

SEQ ID NO: 613899 - DNA, 20 bp, Artificial
  CRISPR gRNA sequence
gagaactttcctgttgcatg

SEQ ID NO: 613900 - DNA, 20 bp, Artificial
  CRISPR gRNA sequence
tttcctgttgcatgtagctg

SEQ ID NO: 613901 - DNA, 20 bp, Artificial
  CRISPR gRNA sequence
cctgttgcatgtagctgtgg

SEQ ID NO: 613902 - DNA, 20 bp, Artificial
  CRISPR gRNA sequence
ctgttgcatgtagctgtggt

SEQ ID NO: 613903 - DNA, 20 bp, Artificial
  CRISPR gRNA sequence
tgtagctgtggtgggaccct

SEQ ID NO: 613904 - DNA, 20 bp, Artificial
  CRISPR gRNA sequence
ctgtggtgggaccctcagtc

SEQ ID NO: 613905 - DNA, 20 bp, Artificial
  CRISPR gRNA sequence
tgtggtgggaccctcagtcc

SEQ ID NO: 613906 - DNA, 20 bp, Artificial
  CRISPR gRNA sequence
gtactctgccctctcctgct

SEQ ID NO: 613907 - DNA, 20 bp, Artificial
  CRISPR gRNA sequence
tactctgccctctcctgctc

SEQ ID NO: 613908 - DNA, 20 bp, Artificial
  CRISPR gRNA sequence
ctctgccctctcctgctcag

SEQ ID NO: 613909 - DNA, 20 bp, Artificial
  CRISPR gRNA sequence
gccctctcctgctcaggagc

SEQ ID NO: 613910 - DNA, 20 bp, Artificial
  CRISPR gRNA sequence
gctagacatgtgatctaacc

SEQ ID NO: 613911 - DNA, 20 bp, Artificial
  CRISPR gRNA sequence
ctagacatgtgatctaacct

SEQ ID NO: 613912 - DNA, 20 bp, Artificial
  CRISPR gRNA sequence
gtgatctaacctaggtccct

SEQ ID NO: 613913 - DNA, 20 bp, Artificial
  CRISPR gRNA sequence
taacctaggtccctcagact

SEQ ID NO: 613914 - DNA, 20 bp, Artificial
  CRISPR gRNA sequence
tcagacttggaatttgaatt

SEQ ID NO: 613915 - DNA, 20 bp, Artificial
  CRISPR gRNA sequence
cagacttggaatttgaattt

SEQ ID NO: 613916 - DNA, 20 bp, Artificial
  CRISPR gRNA sequence
ttgaatttgggtgaactgtt

SEQ ID NO: 613917 - DNA, 20 bp, Artificial
  CRISPR gRNA sequence
tgaactgtttggtttttcaa

SEQ ID NO: 613918 - DNA, 20 bp, Artificial
  CRISPR gRNA sequence
ggtttttcaaaagaatacat

SEQ ID NO: 613919 - DNA, 20 bp, Artificial
  CRISPR gRNA sequence
gtttttcaaaagaatacatt

SEQ ID NO: 613920 - DNA, 20 bp, Artificial
  CRISPR gRNA sequence
atacattgggaatacactta

SEQ ID NO: 613921 - DNA, 20 bp, Artificial
  CRISPR gRNA sequence
cacttatggttttgccgtta

SEQ ID NO: 613922 - DNA, 20 bp, Artificial
  CRISPR gRNA sequence
tggttatcaacgtgatgaaa

SEQ ID NO: 613923 - DNA, 20 bp, Artificial
  CRISPR gRNA sequence
gtgatgaaacagtgatctaa

SEQ ID NO: 613924 - DNA, 20 bp, Artificial
  CRISPR gRNA sequence
atggaattatgtttttatct

SEQ ID NO: 613925 - DNA, 20 bp, Artificial
  CRISPR gRNA sequence
ttggttataacctcaaatat

SEQ ID NO: 613926 - DNA, 20 bp, Artificial
  CRISPR gRNA sequence
tggttataacctcaaatata

SEQ ID NO: 613927 - DNA, 20 bp, Artificial
  CRISPR gRNA sequence
taacctcaaatataaggtca

SEQ ID NO: 613928 - DNA, 20 bp, Artificial
  CRISPR gRNA sequence
acctcaaatataaggtcaaa

SEQ ID NO: 613929 - DNA, 20 bp, Artificial
  CRISPR gRNA sequence
cctcaaatataaggtcaaag

SEQ ID NO: 613930 - DNA, 20 bp, Artificial
  CRISPR gRNA sequence
ataaggtcaaagaggatgtt

SEQ ID NO: 613931 - DNA, 20 bp, Artificial
  CRISPR gRNA sequence
aaagaggatgtttggttata

SEQ ID NO: 613932 - DNA, 20 bp, Artificial
  CRISPR gRNA sequence
ggttataaagtttgttcaaa

SEQ ID NO: 613933 - DNA, 20 bp, Artificial
  CRISPR gRNA sequence
gttataaagtttgttcaaac

SEQ ID NO: 613934 - DNA, 20 bp, Artificial
  CRISPR gRNA sequence
ttataaagtttgttcaaaca

SEQ ID NO: 613935 - DNA, 20 bp, Artificial
  CRISPR gRNA sequence
tataaagtttgttcaaacag

SEQ ID NO: 613936 - DNA, 20 bp, Artificial
  CRISPR gRNA sequence
aaagtttgttcaaacagggg

SEQ ID NO: 613937 - DNA, 20 bp, Artificial
  CRISPR gRNA sequence
aacaggggaagttaccttat

SEQ ID NO: 613938 - DNA, 20 bp, Artificial
  CRISPR gRNA sequence
ttaccttattggtatatctt

SEQ ID NO: 613939 - DNA, 20 bp, Artificial
  CRISPR gRNA sequence
ttattggtatatctttagcc

SEQ ID NO: 613940 - DNA, 20 bp, Artificial
  CRISPR gRNA sequence
tatgtgattaatgcattatt

SEQ ID NO: 613941 - DNA, 20 bp, Artificial
  CRISPR gRNA sequence
taatgcattattgagatatc

SEQ ID NO: 613942 - DNA, 20 bp, Artificial
  CRISPR gRNA sequence
atgcattattgagatatcta

SEQ ID NO: 613943 - DNA, 20 bp, Artificial
  CRISPR gRNA sequence
gagaatttgttttatgtttc

SEQ ID NO: 613944 - DNA, 20 bp, Artificial
  CRISPR gRNA sequence
tgtttctagcaatgtataca

SEQ ID NO: 613945 - DNA, 20 bp, Artificial
  CRISPR gRNA sequence
atacacagaaatattttgat

SEQ ID NO: 613946 - DNA, 20 bp, Artificial
  CRISPR gRNA sequence
atattttgatgagttgcacc

SEQ ID NO: 613947 - DNA, 20 bp, Artificial
  CRISPR gRNA sequence
gagttgcacccagatccatg

SEQ ID NO: 613948 - DNA, 20 bp, Artificial
  CRISPR gRNA sequence
tccatgaagcaaaacaaaat

SEQ ID NO: 613949 - DNA, 20 bp, Artificial
  CRISPR gRNA sequence
gaagcaaaacaaaatcagat

SEQ ID NO: 613950 - DNA, 20 bp, Artificial
  CRISPR gRNA sequence
atcagattggttacataatt

SEQ ID NO: 613951 - DNA, 20 bp, Artificial
  CRISPR gRNA sequence
tcagattggttacataatta

SEQ ID NO: 613952 - DNA, 20 bp, Artificial
  CRISPR gRNA sequence
ataattaaggaaaaatgtat

SEQ ID NO: 613953 - DNA, 20 bp, Artificial
  CRISPR gRNA sequence
taattaaggaaaaatgtatc

SEQ ID NO: 613954 - DNA, 20 bp, Artificial
  CRISPR gRNA sequence
tgtatcaggtctttacccaa

SEQ ID NO: 613955 - DNA, 20 bp, Artificial
  CRISPR gRNA sequence
atcaggtctttacccaatgg

SEQ ID NO: 613956 - DNA, 20 bp, Artificial
  CRISPR gRNA sequence
accttacaaatatgtctgac

SEQ ID NO: 613957 - DNA, 20 bp, Artificial
  CRISPR gRNA sequence
atgtctgactggtttacaaa

SEQ ID NO: 613958 - DNA, 20 bp, Artificial
  CRISPR gRNA sequence
atgctcaaaatacctctaca

SEQ ID NO: 613959 - DNA, 20 bp, Artificial
  CRISPR gRNA sequence
gctcaaaatacctctacaaa

SEQ ID NO: 613960 - DNA, 20 bp, Artificial
  CRISPR gRNA sequence
caaaatacctctacaaagag

SEQ ID NO: 613961 - DNA, 20 bp, Artificial
  CRISPR gRNA sequence
tacctctacaaagagtagta

SEQ ID NO: 613962 - DNA, 20 bp, Artificial
  CRISPR gRNA sequence
caaagagtagtatagcgtaa

SEQ ID NO: 613963 - DNA, 20 bp, Artificial
  CRISPR gRNA sequence
agtagtatagcgtaatggtt

SEQ ID NO: 613964 - DNA, 20 bp, Artificial
  CRISPR gRNA sequence
gtatagcgtaatggttgagc

SEQ ID NO: 613965 - DNA, 20 bp, Artificial
  CRISPR gRNA sequence
tatagcgtaatggttgagcc

SEQ ID NO: 613966 - DNA, 20 bp, Artificial
  CRISPR gRNA sequence
gtaatggttgagccaggctc

SEQ ID NO: 613967 - DNA, 20 bp, Artificial
  CRISPR gRNA sequence
aatggttgagccaggctctg

SEQ ID NO: 613968 - DNA, 20 bp, Artificial
  CRISPR gRNA sequence
gttgagccaggctctggagc

SEQ ID NO: 613969 - DNA, 20 bp, Artificial
  CRISPR gRNA sequence
aggctctggagccagactcc

SEQ ID NO: 613970 - DNA, 20 bp, Artificial
  CRISPR gRNA sequence
ctctggagccagactcctag

SEQ ID NO: 613971 - DNA, 20 bp, Artificial
  CRISPR gRNA sequence
taataacattctctactaac

SEQ ID NO: 613972 - DNA, 20 bp, Artificial
  CRISPR gRNA sequence
actaactagatgtaaaccct

SEQ ID NO: 613973 - DNA, 20 bp, Artificial
  CRISPR gRNA sequence
ctaactagatgtaaaccctg

SEQ ID NO: 613974 - DNA, 20 bp, Artificial
  CRISPR gRNA sequence
aggaaattacttaacatctc

SEQ ID NO: 613975 - DNA, 20 bp, Artificial
  CRISPR gRNA sequence
ggaaattacttaacatctct

SEQ ID NO: 613976 - DNA, 20 bp, Artificial
  CRISPR gRNA sequence
tctttctgttctcatctgta

SEQ ID NO: 613977 - DNA, 20 bp, Artificial
  CRISPR gRNA sequence
ctgttctcatctgtacagtg

SEQ ID NO: 613978 - DNA, 20 bp, Artificial
  CRISPR gRNA sequence
tctcatctgtacagtgaaga

SEQ ID NO: 613979 - DNA, 20 bp, Artificial
  CRISPR gRNA sequence
atggtattacacctatttca

SEQ ID NO: 613980 - DNA, 20 bp, Artificial
  CRISPR gRNA sequence
ggtattacacctatttcatg

SEQ ID NO: 613981 - DNA, 20 bp, Artificial
  CRISPR gRNA sequence
cacctatttcatggagtttc

SEQ ID NO: 613982 - DNA, 20 bp, Artificial
  CRISPR gRNA sequence
taaattaattattaaatgca

SEQ ID NO: 613983 - DNA, 20 bp, Artificial
  CRISPR gRNA sequence
ttaaatgcaaagccttaaaa

SEQ ID NO: 613984 - DNA, 20 bp, Artificial
  CRISPR gRNA sequence
caaagccttaaaacagcaca

SEQ ID NO: 613985 - DNA, 20 bp, Artificial
  CRISPR gRNA sequence
ttaaaacagcacacagcaca

SEQ ID NO: 613986 - DNA, 20 bp, Artificial
  CRISPR gRNA sequence
acacagcacatagtatacgt

SEQ ID NO: 613987 - DNA, 20 bp, Artificial
  CRISPR gRNA sequence
agttattattattgccgatg

SEQ ID NO: 613988 - DNA, 20 bp, Artificial
  CRISPR gRNA sequence
tattattattgccgatgtgg

SEQ ID NO: 613989 - DNA, 20 bp, Artificial
  CRISPR gRNA sequence
attgccgatgtggtagaaac

SEQ ID NO: 613990 - DNA, 20 bp, Artificial
  CRISPR gRNA sequence
agatcaatttttgacatgaa

SEQ ID NO: 613991 - DNA, 20 bp, Artificial
  CRISPR gRNA sequence
gatcaatttttgacatgaaa

SEQ ID NO: 613992 - DNA, 20 bp, Artificial
  CRISPR gRNA sequence
atcaatttttgacatgaaaa

SEQ ID NO: 613993 - DNA, 20 bp, Artificial
  CRISPR gRNA sequence
acatgaaaagggctattgta

SEQ ID NO: 613994 - DNA, 20 bp, Artificial
  CRISPR gRNA sequence
tgaaaagggctattgtaaag

SEQ ID NO: 613995 - DNA, 20 bp, Artificial
  CRISPR gRNA sequence
ggctattgtaaagtagaaat

SEQ ID NO: 613996 - DNA, 20 bp, Artificial
  CRISPR gRNA sequence
ttgtaaagtagaaattagat

SEQ ID NO: 613997 - DNA, 20 bp, Artificial
  CRISPR gRNA sequence
tctgccaaaatcatcatttt

SEQ ID NO: 613998 - DNA, 20 bp, Artificial
  CRISPR gRNA sequence
tcatcattttcagttcacat

SEQ ID NO: 613999 - DNA, 20 bp, Artificial
  CRISPR gRNA sequence
cacatgagcttcattgaact

SEQ ID NO: 614000 - DNA, 20 bp, Artificial
  CRISPR gRNA sequence
acatgagcttcattgaactc

SEQ ID NO: 614001 - DNA, 20 bp, Artificial
  CRISPR gRNA sequence
cgggacaaatcatctgaatt

SEQ ID NO: 614002 - DNA, 20 bp, Artificial
  CRISPR gRNA sequence
gggacaaatcatctgaattg

SEQ ID NO: 614003 - DNA, 20 bp, Artificial
  CRISPR gRNA sequence
acaaatcatctgaattgagg

SEQ ID NO: 614004 - DNA, 20 bp, Artificial
  CRISPR gRNA sequence
catctgaattgaggtggatg

SEQ ID NO: 614005 - DNA, 20 bp, Artificial
  CRISPR gRNA sequence
gaattgaggtggatgtggtg

SEQ ID NO: 614006 - DNA, 20 bp, Artificial
  CRISPR gRNA sequence
aattgaggtggatgtggtgt

SEQ ID NO: 614007 - DNA, 20 bp, Artificial
  CRISPR gRNA sequence
gaggtggatgtggtgtggga

SEQ ID NO: 614008 - DNA, 20 bp, Artificial
  CRISPR gRNA sequence
tgtgggacagttcccacacc

SEQ ID NO: 614009 - DNA, 20 bp, Artificial
  CRISPR gRNA sequence
gtgggacagttcccacaccc

SEQ ID NO: 614010 - DNA, 20 bp, Artificial
  CRISPR gRNA sequence
ccacacccaggtttcgtttt

SEQ ID NO: 614011 - DNA, 20 bp, Artificial
  CRISPR gRNA sequence
tgcgttcaaatatgaaaatt

SEQ ID NO: 614012 - DNA, 20 bp, Artificial
  CRISPR gRNA sequence
gcgttcaaatatgaaaattc

SEQ ID NO: 614013 - DNA, 20 bp, Artificial
  CRISPR gRNA sequence
cgttcaaatatgaaaattca

SEQ ID NO: 614014 - DNA, 20 bp, Artificial
  CRISPR gRNA sequence
tgaaaattcagggtgaaact

SEQ ID NO: 614015 - DNA, 20 bp, Artificial
  CRISPR gRNA sequence
aaaattcagggtgaaactta

SEQ ID NO: 614016 - DNA, 20 bp, Artificial
  CRISPR gRNA sequence
gaaacttagagcaaaactgc

SEQ ID NO: 614017 - DNA, 20 bp, Artificial
  CRISPR gRNA sequence
aaacttagagcaaaactgcc

SEQ ID NO: 614018 - DNA, 20 bp, Artificial
  CRISPR gRNA sequence
agagcaaaactgccaggttt

SEQ ID NO: 614019 - DNA, 20 bp, Artificial
  CRISPR gRNA sequence
aggttttggactactcattt

SEQ ID NO: 614020 - DNA, 20 bp, Artificial
  CRISPR gRNA sequence
ctactcatttcagaacaaat

SEQ ID NO: 614021 - DNA, 20 bp, Artificial
  CRISPR gRNA sequence
caaattagcatatttaattt

SEQ ID NO: 614022 - DNA, 20 bp, Artificial
  CRISPR gRNA sequence
aaattagcatatttaatttt

SEQ ID NO: 614023 - DNA, 20 bp, Artificial
  CRISPR gRNA sequence
aattagcatatttaattttg

SEQ ID NO: 614024 - DNA, 20 bp, Artificial
  CRISPR gRNA sequence
attagcatatttaattttgg

SEQ ID NO: 614025 - DNA, 20 bp, Artificial
  CRISPR gRNA sequence
ttgggggcaaacccgttaac

SEQ ID NO: 614026 - DNA, 20 bp, Artificial
  CRISPR gRNA sequence
aacccgttaaccagttttgc

SEQ ID NO: 614027 - DNA, 20 bp, Artificial
  CRISPR gRNA sequence
aaccagttttgctagttttt

SEQ ID NO: 614028 - DNA, 20 bp, Artificial
  CRISPR gRNA sequence
cttgccaaattctttcattt

SEQ ID NO: 614029 - DNA, 20 bp, Artificial
  CRISPR gRNA sequence
aattctttcattttggatct

SEQ ID NO: 614030 - DNA, 20 bp, Artificial
  CRISPR gRNA sequence
gtctgacatattttcatctt

SEQ ID NO: 614031 - DNA, 20 bp, Artificial
  CRISPR gRNA sequence
tttcatctttggtccatact

SEQ ID NO: 614032 - DNA, 20 bp, Artificial
  CRISPR gRNA sequence
tccatacttggactgctttt

SEQ ID NO: 614033 - DNA, 20 bp, Artificial
  CRISPR gRNA sequence
tattgttatttctaataatg

SEQ ID NO: 614034 - DNA, 20 bp, Artificial
  CRISPR gRNA sequence
gttatttctaataatgtagt

SEQ ID NO: 614035 - DNA, 20 bp, Artificial
  CRISPR gRNA sequence
aaatccatcatccaaacaaa

SEQ ID NO: 614036 - DNA, 20 bp, Artificial
  CRISPR gRNA sequence
catcatccaaacaaaaagtt

SEQ ID NO: 614037 - DNA, 20 bp, Artificial
  CRISPR gRNA sequence
acaatttgtatctcattacc

SEQ ID NO: 614038 - DNA, 20 bp, Artificial
  CRISPR gRNA sequence
ctgactccccttacgtgaat

SEQ ID NO: 614039 - DNA, 20 bp, Artificial
  CRISPR gRNA sequence
ttacttttgtgtcacttttt

SEQ ID NO: 614040 - DNA, 20 bp, Artificial
  CRISPR gRNA sequence
acttttttagttgttactaa

SEQ ID NO: 614041 - DNA, 20 bp, Artificial
  CRISPR gRNA sequence
ttttttagttgttactaaaa

SEQ ID NO: 614042 - DNA, 20 bp, Artificial
  CRISPR gRNA sequence
atgttttatacataatatct

SEQ ID NO: 614043 - DNA, 20 bp, Artificial
  CRISPR gRNA sequence
tgttttatacataatatctt

SEQ ID NO: 614044 - DNA, 20 bp, Artificial
  CRISPR gRNA sequence
tgataacatcattaatgata

SEQ ID NO: 614045 - DNA, 20 bp, Artificial
  CRISPR gRNA sequence
acatcattaatgatatagtg

SEQ ID NO: 614046 - DNA, 20 bp, Artificial
  CRISPR gRNA sequence
tgatctgtttccttgttcct

SEQ ID NO: 614047 - DNA, 20 bp, Artificial
  CRISPR gRNA sequence
gcacaatcccttgctattca

SEQ ID NO: 614048 - DNA, 20 bp, Artificial
  CRISPR gRNA sequence
aatcccttgctattcatagc

SEQ ID NO: 614049 - DNA, 20 bp, Artificial
  CRISPR gRNA sequence
tcccttgctattcatagcca

SEQ ID NO: 614050 - DNA, 20 bp, Artificial
  CRISPR gRNA sequence
cccttgctattcatagccag

SEQ ID NO: 614051 - DNA, 20 bp, Artificial
  CRISPR gRNA sequence
agaggacttcttattaaatg

SEQ ID NO: 614052 - DNA, 20 bp, Artificial
  CRISPR gRNA sequence
caatttttttgacccatcta

SEQ ID NO: 614053 - DNA, 20 bp, Artificial
  CRISPR gRNA sequence
aatttttttgacccatctat

SEQ ID NO: 614054 - DNA, 20 bp, Artificial
  CRISPR gRNA sequence
tctataggttaatcaaaact

SEQ ID NO: 614055 - DNA, 20 bp, Artificial
  CRISPR gRNA sequence
taggttaatcaaaacttgga

SEQ ID NO: 614056 - DNA, 20 bp, Artificial
  CRISPR gRNA sequence
tgtttcattttcttcaaaat

SEQ ID NO: 614057 - DNA, 20 bp, Artificial
  CRISPR gRNA sequence
cttcaaaattggtaacctat

SEQ ID NO: 614058 - DNA, 20 bp, Artificial
  CRISPR gRNA sequence
cacttatttttgtgtctgcc

SEQ ID NO: 614059 - DNA, 20 bp, Artificial
  CRISPR gRNA sequence
cttatttttgtgtctgccaa

SEQ ID NO: 614060 - DNA, 20 bp, Artificial
  CRISPR gRNA sequence
ttatttttgtgtctgccaag

SEQ ID NO: 614061 - DNA, 20 bp, Artificial
  CRISPR gRNA sequence
aagaggatccccttataaat

SEQ ID NO: 614062 - DNA, 20 bp, Artificial
  CRISPR gRNA sequence
agactacatttttttgtaca

SEQ ID NO: 614063 - DNA, 20 bp, Artificial
  CRISPR gRNA sequence
ctacatttttttgtacacag

SEQ ID NO: 614064 - DNA, 20 bp, Artificial
  CRISPR gRNA sequence
tacatttttttgtacacagt

SEQ ID NO: 614065 - DNA, 20 bp, Artificial
  CRISPR gRNA sequence
ggactatcttatacaaatga

SEQ ID NO: 614066 - DNA, 20 bp, Artificial
  CRISPR gRNA sequence
gactatcttatacaaatgaa

SEQ ID NO: 614067 - DNA, 20 bp, Artificial
  CRISPR gRNA sequence
tcttatacaaatgaaaggat

SEQ ID NO: 614068 - DNA, 20 bp, Artificial
  CRISPR gRNA sequence
ttatacaaatgaaaggatca

SEQ ID NO: 614069 - DNA, 20 bp, Artificial
  CRISPR gRNA sequence
atcagagtaaatcattttta

SEQ ID NO: 614070 - DNA, 20 bp, Artificial
  CRISPR gRNA sequence
tcagagtaaatcatttttac

SEQ ID NO: 614071 - DNA, 20 bp, Artificial
  CRISPR gRNA sequence
cagagtaaatcatttttaca

SEQ ID NO: 614072 - DNA, 20 bp, Artificial
  CRISPR gRNA sequence
ttttacagggcatactgaac

SEQ ID NO: 614073 - DNA, 20 bp, Artificial
  CRISPR gRNA sequence
cagggcatactgaacaagta

SEQ ID NO: 614074 - DNA, 20 bp, Artificial
  CRISPR gRNA sequence
tgaacaagtaaagttattct

SEQ ID NO: 614075 - DNA, 20 bp, Artificial
  CRISPR gRNA sequence
aaagttattctaagaaatga

SEQ ID NO: 614076 - DNA, 20 bp, Artificial
  CRISPR gRNA sequence
attctaagaaatgaaagctt

SEQ ID NO: 614077 - DNA, 20 bp, Artificial
  CRISPR gRNA sequence
ttctaagaaatgaaagcttt

SEQ ID NO: 614078 - DNA, 20 bp, Artificial
  CRISPR gRNA sequence
gaaagctttaggtttccaaa

SEQ ID NO: 614079 - DNA, 20 bp, Artificial
  CRISPR gRNA sequence
tttaggtttccaaacagtac

SEQ ID NO: 614080 - DNA, 20 bp, Artificial
  CRISPR gRNA sequence
tttccaaacagtactggcac

SEQ ID NO: 614081 - DNA, 20 bp, Artificial
  CRISPR gRNA sequence
agtactggcacaagtgcaac

SEQ ID NO: 614082 - DNA, 20 bp, Artificial
  CRISPR gRNA sequence
tactggcacaagtgcaactg

SEQ ID NO: 614083 - DNA, 20 bp, Artificial
  CRISPR gRNA sequence
ggcacaagtgcaactggaga

SEQ ID NO: 614084 - DNA, 20 bp, Artificial
  CRISPR gRNA sequence
agaaagcaacaataaacaac

SEQ ID NO: 614085 - DNA, 20 bp, Artificial
  CRISPR gRNA sequence
aacaataaacaacaagtaat

SEQ ID NO: 614086 - DNA, 20 bp, Artificial
  CRISPR gRNA sequence
aataagttatgttctttcct

SEQ ID NO: 614087 - DNA, 20 bp, Artificial
  CRISPR gRNA sequence
tcaactgattcgccttgtct

SEQ ID NO: 614088 - DNA, 20 bp, Artificial
  CRISPR gRNA sequence
tatccttaattaaacatcct

SEQ ID NO: 614089 - DNA, 20 bp, Artificial
  CRISPR gRNA sequence
atccttaattaaacatcctt

SEQ ID NO: 614090 - DNA, 20 bp, Artificial
  CRISPR gRNA sequence
cttaattaaacatccttggg

SEQ ID NO: 614091 - DNA, 20 bp, Artificial
  CRISPR gRNA sequence
actcaaaaaacaactgtttt

SEQ ID NO: 614092 - DNA, 20 bp, Artificial
  CRISPR gRNA sequence
tttgtctgcactatgaatgt

SEQ ID NO: 614093 - DNA, 20 bp, Artificial
  CRISPR gRNA sequence
cactatgaatgtcagtgtct

SEQ ID NO: 614094 - DNA, 20 bp, Artificial
  CRISPR gRNA sequence
actatgaatgtcagtgtcta

SEQ ID NO: 614095 - DNA, 20 bp, Artificial
  CRISPR gRNA sequence
ctatgaatgtcagtgtctaa

SEQ ID NO: 614096 - DNA, 20 bp, Artificial
  CRISPR gRNA sequence
tgtcagtgtctaagggctaa

SEQ ID NO: 614097 - DNA, 20 bp, Artificial
  CRISPR gRNA sequence
gtgtctaagggctaacagat

SEQ ID NO: 614098 - DNA, 20 bp, Artificial
  CRISPR gRNA sequence
agggctaacagattagtcca

SEQ ID NO: 614099 - DNA, 20 bp, Artificial
  CRISPR gRNA sequence
cagattagtccatagcaact

SEQ ID NO: 614100 - DNA, 20 bp, Artificial
  CRISPR gRNA sequence
gtccatagcaacttagaaaa

SEQ ID NO: 614101 - DNA, 20 bp, Artificial
  CRISPR gRNA sequence
tccatagcaacttagaaaaa

SEQ ID NO: 614102 - DNA, 20 bp, Artificial
  CRISPR gRNA sequence
ccatagcaacttagaaaaaa

SEQ ID NO: 614103 - DNA, 20 bp, Artificial
  CRISPR gRNA sequence
acttagaaaaaagggatgaa

SEQ ID NO: 614104 - DNA, 20 bp, Artificial
  CRISPR gRNA sequence
cttagaaaaaagggatgaat

SEQ ID NO: 614105 - DNA, 20 bp, Artificial
  CRISPR gRNA sequence
ttagaaaaaagggatgaata

SEQ ID NO: 614106 - DNA, 20 bp, Artificial
  CRISPR gRNA sequence
aaaaagggatgaatagggaa

SEQ ID NO: 614107 - DNA, 20 bp, Artificial
  CRISPR gRNA sequence
ggatgaatagggaacagcat

SEQ ID NO: 614108 - DNA, 20 bp, Artificial
  CRISPR gRNA sequence
atgaatagggaacagcattg

SEQ ID NO: 614109 - DNA, 20 bp, Artificial
  CRISPR gRNA sequence
gaatagggaacagcattgga

SEQ ID NO: 614110 - DNA, 20 bp, Artificial
  CRISPR gRNA sequence
agagtatatgtcaaatgaat

SEQ ID NO: 614111 - DNA, 20 bp, Artificial
  CRISPR gRNA sequence
gagtatatgtcaaatgaatt

SEQ ID NO: 614112 - DNA, 20 bp, Artificial
  CRISPR gRNA sequence
agtatatgtcaaatgaatta

SEQ ID NO: 614113 - DNA, 20 bp, Artificial
  CRISPR gRNA sequence
atatgtcaaatgaattaggg

SEQ ID NO: 614114 - DNA, 20 bp, Artificial
  CRISPR gRNA sequence
tgtcaaatgaattagggcag

SEQ ID NO: 614115 - DNA, 20 bp, Artificial
  CRISPR gRNA sequence
aatgaattagggcagtagtt

SEQ ID NO: 614116 - DNA, 20 bp, Artificial
  CRISPR gRNA sequence
aattagggcagtagtttagt

SEQ ID NO: 614117 - DNA, 20 bp, Artificial
  CRISPR gRNA sequence
agtgagccaatgtgccaatt

SEQ ID NO: 614118 - DNA, 20 bp, Artificial
  CRISPR gRNA sequence
ccaatgtgccaatttagaaa

SEQ ID NO: 614119 - DNA, 20 bp, Artificial
  CRISPR gRNA sequence
atggattcttcttcctgctg

SEQ ID NO: 614120 - DNA, 20 bp, Artificial
  CRISPR gRNA sequence
ggattcttcttcctgctgaa

SEQ ID NO: 614121 - DNA, 20 bp, Artificial
  CRISPR gRNA sequence
taaaataaattacaatcata

SEQ ID NO: 614122 - DNA, 20 bp, Artificial
  CRISPR gRNA sequence
ttacaatcataaagctgcca

SEQ ID NO: 614123 - DNA, 20 bp, Artificial
  CRISPR gRNA sequence
ctgccacagtttactgtgca

SEQ ID NO: 614124 - DNA, 20 bp, Artificial
  CRISPR gRNA sequence
ttactgtgcatagacatgtt

SEQ ID NO: 614125 - DNA, 20 bp, Artificial
  CRISPR gRNA sequence
tgcatagacatgttcagaat

SEQ ID NO: 614126 - DNA, 20 bp, Artificial
  CRISPR gRNA sequence
cagaattggctcttcttcat

SEQ ID NO: 614127 - DNA, 20 bp, Artificial
  CRISPR gRNA sequence
agaattggctcttcttcatg

SEQ ID NO: 614128 - DNA, 20 bp, Artificial
  CRISPR gRNA sequence
gaattggctcttcttcatga

SEQ ID NO: 614129 - DNA, 20 bp, Artificial
  CRISPR gRNA sequence
tcttcttcatgagggctgct

SEQ ID NO: 614130 - DNA, 20 bp, Artificial
  CRISPR gRNA sequence
ttcatgagggctgcttggtg

SEQ ID NO: 614131 - DNA, 20 bp, Artificial
  CRISPR gRNA sequence
tcatgagggctgcttggtgc

SEQ ID NO: 614132 - DNA, 20 bp, Artificial
  CRISPR gRNA sequence
gctgcttggtgcaggtattt

SEQ ID NO: 614133 - DNA, 20 bp, Artificial
  CRISPR gRNA sequence
gtatttaagctactgccaat

SEQ ID NO: 614134 - DNA, 20 bp, Artificial
  CRISPR gRNA sequence
tatttaagctactgccaata

SEQ ID NO: 614135 - DNA, 20 bp, Artificial
  CRISPR gRNA sequence
gctactgccaataaggctaa

SEQ ID NO: 614136 - DNA, 20 bp, Artificial
  CRISPR gRNA sequence
aaggctaacagctcatcaaa

SEQ ID NO: 614137 - DNA, 20 bp, Artificial
  CRISPR gRNA sequence
atcaaatagaaaatacgctg

SEQ ID NO: 614138 - DNA, 20 bp, Artificial
  CRISPR gRNA sequence
tcaaatagaaaatacgctgc

SEQ ID NO: 614139 - DNA, 20 bp, Artificial
  CRISPR gRNA sequence
atacgctgcaggaaaataca

SEQ ID NO: 614140 - DNA, 20 bp, Artificial
  CRISPR gRNA sequence
tacgctgcaggaaaatacat

SEQ ID NO: 614141 - DNA, 20 bp, Artificial
  CRISPR gRNA sequence
tgcaggaaaatacatgggtt

SEQ ID NO: 614142 - DNA, 20 bp, Artificial
  CRISPR gRNA sequence
aatacatgggttaagaaaaa

SEQ ID NO: 614143 - DNA, 20 bp, Artificial
  CRISPR gRNA sequence
gttattttgtatgtctgttt

SEQ ID NO: 614144 - DNA, 20 bp, Artificial
  CRISPR gRNA sequence
tttaagcttttctctcaaac

SEQ ID NO: 614145 - DNA, 20 bp, Artificial
  CRISPR gRNA sequence
tttttaaaaataaactctaa

SEQ ID NO: 614146 - DNA, 20 bp, Artificial
  CRISPR gRNA sequence
aactctaaaagccttgaaaa

SEQ ID NO: 614147 - DNA, 20 bp, Artificial
  CRISPR gRNA sequence
taaaagccttgaaaatagtg

SEQ ID NO: 614148 - DNA, 20 bp, Artificial
  CRISPR gRNA sequence
tgaaaatagtgcagtcttaa

SEQ ID NO: 614149 - DNA, 20 bp, Artificial
  CRISPR gRNA sequence
aaatagtgcagtcttaaaag

SEQ ID NO: 614150 - DNA, 20 bp, Artificial
  CRISPR gRNA sequence
cttaaaagtagtattgattt

SEQ ID NO: 614151 - DNA, 20 bp, Artificial
  CRISPR gRNA sequence
gtcaatgctaaaaacacttt

SEQ ID NO: 614152 - DNA, 20 bp, Artificial
  CRISPR gRNA sequence
tcaatgctaaaaacactttc

SEQ ID NO: 614153 - DNA, 20 bp, Artificial
  CRISPR gRNA sequence
caatgctaaaaacactttca

SEQ ID NO: 614154 - DNA, 20 bp, Artificial
  CRISPR gRNA sequence
aatgctaaaaacactttcag

SEQ ID NO: 614155 - DNA, 20 bp, Artificial
  CRISPR gRNA sequence
aaaaacactttcaggggaat

SEQ ID NO: 614156 - DNA, 20 bp, Artificial
  CRISPR gRNA sequence
cactttcaggggaataagat

SEQ ID NO: 614157 - DNA, 20 bp, Artificial
  CRISPR gRNA sequence
agatgagaaaccacatgaac

SEQ ID NO: 614158 - DNA, 20 bp, Artificial
  CRISPR gRNA sequence
atgaacaagtttgccaccaa

SEQ ID NO: 614159 - DNA, 20 bp, Artificial
  CRISPR gRNA sequence
aacaagtttgccaccaatag

SEQ ID NO: 614160 - DNA, 20 bp, Artificial
  CRISPR gRNA sequence
tttgccaccaatagtggcaa

SEQ ID NO: 614161 - DNA, 20 bp, Artificial
  CRISPR gRNA sequence
gcaacagtgtatgtatgtca

SEQ ID NO: 614162 - DNA, 20 bp, Artificial
  CRISPR gRNA sequence
tgtatgtatgtcatggattt

SEQ ID NO: 614163 - DNA, 20 bp, Artificial
  CRISPR gRNA sequence
tatgtatgtcatggatttaa

SEQ ID NO: 614164 - DNA, 20 bp, Artificial
  CRISPR gRNA sequence
tgtatgtcatggatttaaga

SEQ ID NO: 614165 - DNA, 20 bp, Artificial
  CRISPR gRNA sequence
tcaaataaaaacaaatcctc

SEQ ID NO: 614166 - DNA, 20 bp, Artificial
  CRISPR gRNA sequence
tatgtgtgtgtgcaaattta

SEQ ID NO: 614167 - DNA, 20 bp, Artificial
  CRISPR gRNA sequence
tgtgtgtgtgcaaatttaaa

SEQ ID NO: 614168 - DNA, 20 bp, Artificial
  CRISPR gRNA sequence
taaagagtatactttcacac

SEQ ID NO: 614169 - DNA, 20 bp, Artificial
  CRISPR gRNA sequence
aagagtatactttcacacta

SEQ ID NO: 614170 - DNA, 20 bp, Artificial
  CRISPR gRNA sequence
agagtatactttcacactag

SEQ ID NO: 614171 - DNA, 20 bp, Artificial
  CRISPR gRNA sequence
gagtatactttcacactaga

SEQ ID NO: 614172 - DNA, 20 bp, Artificial
  CRISPR gRNA sequence
ctttctacttgcttctactg

SEQ ID NO: 614173 - DNA, 20 bp, Artificial
  CRISPR gRNA sequence
ttgcttctactgaagcatac

SEQ ID NO: 614174 - DNA, 20 bp, Artificial
  CRISPR gRNA sequence
tagcttttataacacatatc

SEQ ID NO: 614175 - DNA, 20 bp, Artificial
  CRISPR gRNA sequence
ttttataacacatatcgaga

SEQ ID NO: 614176 - DNA, 20 bp, Artificial
  CRISPR gRNA sequence
acatatcgagatggcatatc

SEQ ID NO: 614177 - DNA, 20 bp, Artificial
  CRISPR gRNA sequence
ttgtatcatccaaaatgttg

SEQ ID NO: 614178 - DNA, 20 bp, Artificial
  CRISPR gRNA sequence
caaaatgttgaagaaattat

SEQ ID NO: 614179 - DNA, 20 bp, Artificial
  CRISPR gRNA sequence
tatcagattgcatttttcta

SEQ ID NO: 614180 - DNA, 20 bp, Artificial
  CRISPR gRNA sequence
catttttctatggttttgta

SEQ ID NO: 614181 - DNA, 20 bp, Artificial
  CRISPR gRNA sequence
gttttgtatagtacctccta

SEQ ID NO: 614182 - DNA, 20 bp, Artificial
  CRISPR gRNA sequence
ttgtatagtacctcctatgg

SEQ ID NO: 614183 - DNA, 20 bp, Artificial
  CRISPR gRNA sequence
tacctcctatggaagattgt

SEQ ID NO: 614184 - DNA, 20 bp, Artificial
  CRISPR gRNA sequence
acctcctatggaagattgta

SEQ ID NO: 614185 - DNA, 20 bp, Artificial
  CRISPR gRNA sequence
tatggaagattgtaaggaac

SEQ ID NO: 614186 - DNA, 20 bp, Artificial
  CRISPR gRNA sequence
tggaagattgtaaggaacaa

SEQ ID NO: 614187 - DNA, 20 bp, Artificial
  CRISPR gRNA sequence
taaggaacaagagcctatta

SEQ ID NO: 614188 - DNA, 20 bp, Artificial
  CRISPR gRNA sequence
tatggacaacaatatttctc

SEQ ID NO: 614189 - DNA, 20 bp, Artificial
  CRISPR gRNA sequence
atatttctctggtgcctttt

SEQ ID NO: 614190 - DNA, 20 bp, Artificial
  CRISPR gRNA sequence
atttctctggtgccttttga

SEQ ID NO: 614191 - DNA, 20 bp, Artificial
  CRISPR gRNA sequence
ttttgagagacctgctgtca

SEQ ID NO: 614192 - DNA, 20 bp, Artificial
  CRISPR gRNA sequence
ttgagagacctgctgtcata

SEQ ID NO: 614193 - DNA, 20 bp, Artificial
  CRISPR gRNA sequence
agagacctgctgtcatagag

SEQ ID NO: 614194 - DNA, 20 bp, Artificial
  CRISPR gRNA sequence
tgctgtcatagagaagctca

SEQ ID NO: 614195 - DNA, 20 bp, Artificial
  CRISPR gRNA sequence
gctgtcatagagaagctcac

SEQ ID NO: 614196 - DNA, 20 bp, Artificial
  CRISPR gRNA sequence
ctgtcatagagaagctcacg

SEQ ID NO: 614197 - DNA, 20 bp, Artificial
  CRISPR gRNA sequence
agagaagctcacggggaata

SEQ ID NO: 614198 - DNA, 20 bp, Artificial
  CRISPR gRNA sequence
gagaagctcacggggaatat

SEQ ID NO: 614199 - DNA, 20 bp, Artificial
  CRISPR gRNA sequence
gggaatatgggaaaacgtaa

SEQ ID NO: 614200 - DNA, 20 bp, Artificial
  CRISPR gRNA sequence
gtaaaagctccactccacaa

SEQ ID NO: 614201 - DNA, 20 bp, Artificial
  CRISPR gRNA sequence
ctccactccacaaaagtttg

SEQ ID NO: 614202 - DNA, 20 bp, Artificial
  CRISPR gRNA sequence
tccactccacaaaagtttgt

SEQ ID NO: 614203 - DNA, 20 bp, Artificial
  CRISPR gRNA sequence
ctccacaaaagtttgtgggt

SEQ ID NO: 614204 - DNA, 20 bp, Artificial
  CRISPR gRNA sequence
aaatgcttttgtttctttgc

SEQ ID NO: 614205 - DNA, 20 bp, Artificial
  CRISPR gRNA sequence
aatgcttttgtttctttgca

SEQ ID NO: 614206 - DNA, 20 bp, Artificial
  CRISPR gRNA sequence
tctttgcaaggtgatgttaa

SEQ ID NO: 614207 - DNA, 20 bp, Artificial
  CRISPR gRNA sequence
ctttgcaaggtgatgttaat

SEQ ID NO: 614208 - DNA, 20 bp, Artificial
  CRISPR gRNA sequence
caaggtgatgttaataggaa

SEQ ID NO: 614209 - DNA, 20 bp, Artificial
  CRISPR gRNA sequence
aaggtgatgttaataggaaa

SEQ ID NO: 614210 - DNA, 20 bp, Artificial
  CRISPR gRNA sequence
tgatgttaataggaaaaggc

SEQ ID NO: 614211 - DNA, 20 bp, Artificial
  CRISPR gRNA sequence
aaaggcaagttcccatgtat

SEQ ID NO: 614212 - DNA, 20 bp, Artificial
  CRISPR gRNA sequence
ccatgtattagaaatatata

SEQ ID NO: 614213 - DNA, 20 bp, Artificial
  CRISPR gRNA sequence
gaaatatatatggtgtgttt

SEQ ID NO: 614214 - DNA, 20 bp, Artificial
  CRISPR gRNA sequence
caacacacacaaatacatat

SEQ ID NO: 614215 - DNA, 20 bp, Artificial
  CRISPR gRNA sequence
acacacacaaatacatatga

SEQ ID NO: 614216 - DNA, 20 bp, Artificial
  CRISPR gRNA sequence
acaaatacatatgagagata

SEQ ID NO: 614217 - DNA, 20 bp, Artificial
  CRISPR gRNA sequence
atatgagagataaagactga

SEQ ID NO: 614218 - DNA, 20 bp, Artificial
  CRISPR gRNA sequence
tgagagataaagactgatag

SEQ ID NO: 614219 - DNA, 20 bp, Artificial
  CRISPR gRNA sequence
tcaaaatatgatgatatata

SEQ ID NO: 614220 - DNA, 20 bp, Artificial
  CRISPR gRNA sequence
aagtgaaataacatgtaaaa

SEQ ID NO: 614221 - DNA, 20 bp, Artificial
  CRISPR gRNA sequence
atattaatttctttaaaaaa

SEQ ID NO: 614222 - DNA, 20 bp, Artificial
  CRISPR gRNA sequence
ttctttaaaaaatagtcata

SEQ ID NO: 614223 - DNA, 20 bp, Artificial
  CRISPR gRNA sequence
tttaaaaaatagtcatacag

SEQ ID NO: 614224 - DNA, 20 bp, Artificial
  CRISPR gRNA sequence
taaaaaatagtcatacagaa

SEQ ID NO: 614225 - DNA, 20 bp, Artificial
  CRISPR gRNA sequence
atagtcatacagaagagaaa

SEQ ID NO: 614226 - DNA, 20 bp, Artificial
  CRISPR gRNA sequence
catacagaagagaaacggtc

SEQ ID NO: 614227 - DNA, 20 bp, Artificial
  CRISPR gRNA sequence
agagaaacggtccagcctat

SEQ ID NO: 614228 - DNA, 20 bp, Artificial
  CRISPR gRNA sequence
aaacggtccagcctattggc

SEQ ID NO: 614229 - DNA, 20 bp, Artificial
  CRISPR gRNA sequence
atctgttttaaaattttcat

SEQ ID NO: 614230 - DNA, 20 bp, Artificial
  CRISPR gRNA sequence
tttaaaattttcattagtgt

SEQ ID NO: 614231 - DNA, 20 bp, Artificial
  CRISPR gRNA sequence
ttaaaattttcattagtgtc

SEQ ID NO: 614232 - DNA, 20 bp, Artificial
  CRISPR gRNA sequence
tttcattagtgtcaggtttt

SEQ ID NO: 614233 - DNA, 20 bp, Artificial
  CRISPR gRNA sequence
aacctattaacatttatgcc

SEQ ID NO: 614234 - DNA, 20 bp, Artificial
  CRISPR gRNA sequence
tatgcctagtgtcccattat

SEQ ID NO: 614235 - DNA, 20 bp, Artificial
  CRISPR gRNA sequence
tgtcccattattggaacgct

SEQ ID NO: 614236 - DNA, 20 bp, Artificial
  CRISPR gRNA sequence
ttattggaacgctaagcatg

SEQ ID NO: 614237 - DNA, 20 bp, Artificial
  CRISPR gRNA sequence
tattggaacgctaagcatgt

SEQ ID NO: 614238 - DNA, 20 bp, Artificial
  CRISPR gRNA sequence
ttggaacgctaagcatgtgg

SEQ ID NO: 614239 - DNA, 20 bp, Artificial
  CRISPR gRNA sequence
ttatttatatcctactgctc

SEQ ID NO: 614240 - DNA, 20 bp, Artificial
  CRISPR gRNA sequence
tatttatatcctactgctca

SEQ ID NO: 614241 - DNA, 20 bp, Artificial
  CRISPR gRNA sequence
tactgctcaaggtcatcgcc

SEQ ID NO: 614242 - DNA, 20 bp, Artificial
  CRISPR gRNA sequence
actgctcaaggtcatcgcca

SEQ ID NO: 614243 - DNA, 20 bp, Artificial
  CRISPR gRNA sequence
ttaaaacaaaatttcaacct

SEQ ID NO: 614244 - DNA, 20 bp, Artificial
  CRISPR gRNA sequence
taaaacaaaatttcaacctc

SEQ ID NO: 614245 - DNA, 20 bp, Artificial
  CRISPR gRNA sequence
atttcaacctcaggcataaa

SEQ ID NO: 614246 - DNA, 20 bp, Artificial
  CRISPR gRNA sequence
tttcaacctcaggcataaat

SEQ ID NO: 614247 - DNA, 20 bp, Artificial
  CRISPR gRNA sequence
aattattttcgtattttatc

SEQ ID NO: 614248 - DNA, 20 bp, Artificial
  CRISPR gRNA sequence
ttcgtattttatctggaatg

SEQ ID NO: 614249 - DNA, 20 bp, Artificial
  CRISPR gRNA sequence
tttttttcaaaattctgcat

SEQ ID NO: 614250 - DNA, 20 bp, Artificial
  CRISPR gRNA sequence
tctgcattggaaaaataatg

SEQ ID NO: 614251 - DNA, 20 bp, Artificial
  CRISPR gRNA sequence
taatgcagcaacctacattc

SEQ ID NO: 614252 - DNA, 20 bp, Artificial
  CRISPR gRNA sequence
cattcaagatgtttcatatt

SEQ ID NO: 614253 - DNA, 20 bp, Artificial
  CRISPR gRNA sequence
ttaatctttgttttttcatc

SEQ ID NO: 614254 - DNA, 20 bp, Artificial
  CRISPR gRNA sequence
gcctatgattttgaactgaa

SEQ ID NO: 614255 - DNA, 20 bp, Artificial
  CRISPR gRNA sequence
aagattaaatatcatatatt

SEQ ID NO: 614256 - DNA, 20 bp, Artificial
  CRISPR gRNA sequence
ccttttcatttccgaaccct

SEQ ID NO: 614257 - DNA, 20 bp, Artificial
  CRISPR gRNA sequence
ttctttgatacgcccaatgt

SEQ ID NO: 614258 - DNA, 20 bp, Artificial
  CRISPR gRNA sequence
gcccaatgttggcatcattc

SEQ ID NO: 614259 - DNA, 20 bp, Artificial
  CRISPR gRNA sequence
tcattctggatgcatgctgt

SEQ ID NO: 614260 - DNA, 20 bp, Artificial
  CRISPR gRNA sequence
tggatgcatgctgtaagtca

SEQ ID NO: 614261 - DNA, 20 bp, Artificial
  CRISPR gRNA sequence
gtaagtcatagattgtctct

SEQ ID NO: 614262 - DNA, 20 bp, Artificial
  CRISPR gRNA sequence
taagtcatagattgtctctg

SEQ ID NO: 614263 - DNA, 20 bp, Artificial
  CRISPR gRNA sequence
attgtctctgaggatacaaa

SEQ ID NO: 614264 - DNA, 20 bp, Artificial
  CRISPR gRNA sequence
ctctgaggatacaaaaagca

SEQ ID NO: 614265 - DNA, 20 bp, Artificial
  CRISPR gRNA sequence
aaaaagcatggactttttaa

SEQ ID NO: 614266 - DNA, 20 bp, Artificial
  CRISPR gRNA sequence
tttaaaagaaatatgaataa

SEQ ID NO: 614267 - DNA, 20 bp, Artificial
  CRISPR gRNA sequence
taaaagaaatatgaataata

SEQ ID NO: 614268 - DNA, 20 bp, Artificial
  CRISPR gRNA sequence
aataatagagattcaataaa

SEQ ID NO: 614269 - DNA, 20 bp, Artificial
  CRISPR gRNA sequence
ttcaataaaaagaattgtta

SEQ ID NO: 614270 - DNA, 20 bp, Artificial
  CRISPR gRNA sequence
ttcattgtatatatatctat

SEQ ID NO: 614271 - DNA, 20 bp, Artificial
  CRISPR gRNA sequence
tcattgtatatatatctatt

SEQ ID NO: 614272 - DNA, 20 bp, Artificial
  CRISPR gRNA sequence
ttaggataaaaatattcaaa

SEQ ID NO: 614273 - DNA, 20 bp, Artificial
  CRISPR gRNA sequence
tcaaacagattctgacattc

SEQ ID NO: 614274 - DNA, 20 bp, Artificial
  CRISPR gRNA sequence
agattctgacattctagtgt

SEQ ID NO: 614275 - DNA, 20 bp, Artificial
  CRISPR gRNA sequence
acattctagtgtcagcattg

SEQ ID NO: 614276 - DNA, 20 bp, Artificial
  CRISPR gRNA sequence
cattctagtgtcagcattgt

SEQ ID NO: 614277 - DNA, 20 bp, Artificial
  CRISPR gRNA sequence
tgtgggacatcctgattaaa

SEQ ID NO: 614278 - DNA, 20 bp, Artificial
  CRISPR gRNA sequence
atcctgattaaatggtgatt

SEQ ID NO: 614279 - DNA, 20 bp, Artificial
  CRISPR gRNA sequence
tgagacaaaaatctttgctt

SEQ ID NO: 614280 - DNA, 20 bp, Artificial
  CRISPR gRNA sequence
aatctttgctttggttattt

SEQ ID NO: 614281 - DNA, 20 bp, Artificial
  CRISPR gRNA sequence
atctttgctttggttatttc

SEQ ID NO: 614282 - DNA, 20 bp, Artificial
  CRISPR gRNA sequence
tctttgctttggttatttca

SEQ ID NO: 614283 - DNA, 20 bp, Artificial
  CRISPR gRNA sequence
tttgctttggttatttcagg

SEQ ID NO: 614284 - DNA, 20 bp, Artificial
  CRISPR gRNA sequence
ttgctttggttatttcaggg

SEQ ID NO: 614285 - DNA, 20 bp, Artificial
  CRISPR gRNA sequence
gctttggttatttcagggag

SEQ ID NO: 614286 - DNA, 20 bp, Artificial
  CRISPR gRNA sequence
tttggttatttcagggagga

SEQ ID NO: 614287 - DNA, 20 bp, Artificial
  CRISPR gRNA sequence
ttggttatttcagggaggag

SEQ ID NO: 614288 - DNA, 20 bp, Artificial
  CRISPR gRNA sequence
attacttcaataaacactta

SEQ ID NO: 614289 - DNA, 20 bp, Artificial
  CRISPR gRNA sequence
acttcaataaacacttaaag

SEQ ID NO: 614290 - DNA, 20 bp, Artificial
  CRISPR gRNA sequence
cttcaataaacacttaaaga

SEQ ID NO: 614291 - DNA, 20 bp, Artificial
  CRISPR gRNA sequence
ttcctttcaatctgaaattg

SEQ ID NO: 614292 - DNA, 20 bp, Artificial
  CRISPR gRNA sequence
gaactaacacatcaccaaaa

SEQ ID NO: 614293 - DNA, 20 bp, Artificial
  CRISPR gRNA sequence
catcaccaaaatagcactct

SEQ ID NO: 614294 - DNA, 20 bp, Artificial
  CRISPR gRNA sequence
ccaaaatagcactctaagac

SEQ ID NO: 614295 - DNA, 20 bp, Artificial
  CRISPR gRNA sequence
aatagcactctaagactagc

SEQ ID NO: 614296 - DNA, 20 bp, Artificial
  CRISPR gRNA sequence
tagcactctaagactagctg

SEQ ID NO: 614297 - DNA, 20 bp, Artificial
  CRISPR gRNA sequence
agcactctaagactagctgg

SEQ ID NO: 614298 - DNA, 20 bp, Artificial
  CRISPR gRNA sequence
gcactctaagactagctgga

SEQ ID NO: 614299 - DNA, 20 bp, Artificial
  CRISPR gRNA sequence
actagctggagggatttatt

SEQ ID NO: 614300 - DNA, 20 bp, Artificial
  CRISPR gRNA sequence
atttattgagaactcattga

SEQ ID NO: 614301 - DNA, 20 bp, Artificial
  CRISPR gRNA sequence
tattgagaactcattgaaag

SEQ ID NO: 614302 - DNA, 20 bp, Artificial
  CRISPR gRNA sequence
attgagaactcattgaaaga

SEQ ID NO: 614303 - DNA, 20 bp, Artificial
  CRISPR gRNA sequence
aactcattgaaagaaggcct

SEQ ID NO: 614304 - DNA, 20 bp, Artificial
  CRISPR gRNA sequence
actcattgaaagaaggccta

SEQ ID NO: 614305 - DNA, 20 bp, Artificial
  CRISPR gRNA sequence
ctcattgaaagaaggcctaa

SEQ ID NO: 614306 - DNA, 20 bp, Artificial
  CRISPR gRNA sequence
gaaggcctaagggtgactat

SEQ ID NO: 614307 - DNA, 20 bp, Artificial
  CRISPR gRNA sequence
aaggcctaagggtgactata

SEQ ID NO: 614308 - DNA, 20 bp, Artificial
  CRISPR gRNA sequence
aggcctaagggtgactataa

SEQ ID NO: 614309 - DNA, 20 bp, Artificial
  CRISPR gRNA sequence
aagggtgactataagggcca

SEQ ID NO: 614310 - DNA, 20 bp, Artificial
  CRISPR gRNA sequence
ggccatagtttatattatgt

SEQ ID NO: 614311 - DNA, 20 bp, Artificial
  CRISPR gRNA sequence
agtttatattatgtcagttg

SEQ ID NO: 614312 - DNA, 20 bp, Artificial
  CRISPR gRNA sequence
ttatgtcagttgaagcccct

SEQ ID NO: 614313 - DNA, 20 bp, Artificial
  CRISPR gRNA sequence
aagcccctgagttatacaca

SEQ ID NO: 614314 - DNA, 20 bp, Artificial
  CRISPR gRNA sequence
agcccctgagttatacacaa

SEQ ID NO: 614315 - DNA, 20 bp, Artificial
  CRISPR gRNA sequence
ttatacacaaaggactgcct

SEQ ID NO: 614316 - DNA, 20 bp, Artificial
  CRISPR gRNA sequence
tatacacaaaggactgcctc

SEQ ID NO: 614317 - DNA, 20 bp, Artificial
  CRISPR gRNA sequence
aaaggactgcctcaggcctt

SEQ ID NO: 614318 - DNA, 20 bp, Artificial
  CRISPR gRNA sequence
taactttttttctgttcttg

SEQ ID NO: 614319 - DNA, 20 bp, Artificial
  CRISPR gRNA sequence
aactttttttctgttcttgt

SEQ ID NO: 614320 - DNA, 20 bp, Artificial
  CRISPR gRNA sequence
tgtgggtaactatgaaaaaa

SEQ ID NO: 614321 - DNA, 20 bp, Artificial
  CRISPR gRNA sequence
actatgaaaaaaaagaaata

SEQ ID NO: 614322 - DNA, 20 bp, Artificial
  CRISPR gRNA sequence
tatgaaaaaaaagaaataaa

SEQ ID NO: 614323 - DNA, 20 bp, Artificial
  CRISPR gRNA sequence
aaaaaaaagaaataaagagc

SEQ ID NO: 614324 - DNA, 20 bp, Artificial
  CRISPR gRNA sequence
tttaatattgatttttttgt

SEQ ID NO: 614325 - DNA, 20 bp, Artificial
  CRISPR gRNA sequence
attaaatgcttaaatctaac

SEQ ID NO: 614326 - DNA, 20 bp, Artificial
  CRISPR gRNA sequence
aatctaactagactctaatg

SEQ ID NO: 614327 - DNA, 20 bp, Artificial
  CRISPR gRNA sequence
taactagactctaatgtagt

SEQ ID NO: 614328 - DNA, 20 bp, Artificial
  CRISPR gRNA sequence
ttctgtcttctgaatttata

SEQ ID NO: 614329 - DNA, 20 bp, Artificial
  CRISPR gRNA sequence
ttttgtcatgtttcctgact

SEQ ID NO: 614330 - DNA, 20 bp, Artificial
  CRISPR gRNA sequence
ttgtcatgtttcctgactta

SEQ ID NO: 614331 - DNA, 20 bp, Artificial
  CRISPR gRNA sequence
ttttatttcactgcattcct

SEQ ID NO: 614332 - DNA, 20 bp, Artificial
  CRISPR gRNA sequence
tttcactgcattccttagaa

SEQ ID NO: 614333 - DNA, 20 bp, Artificial
  CRISPR gRNA sequence
tcactgcattccttagaaaa

SEQ ID NO: 614334 - DNA, 20 bp, Artificial
  CRISPR gRNA sequence
cactgcattccttagaaaag

SEQ ID NO: 614335 - DNA, 20 bp, Artificial
  CRISPR gRNA sequence
actgcattccttagaaaaga

SEQ ID NO: 614336 - DNA, 20 bp, Artificial
  CRISPR gRNA sequence
cattccttagaaaagaggga

SEQ ID NO: 614337 - DNA, 20 bp, Artificial
  CRISPR gRNA sequence
agaaaagagggacagctttt

SEQ ID NO: 614338 - DNA, 20 bp, Artificial
  CRISPR gRNA sequence
tttatattatatttttaatt

SEQ ID NO: 614339 - DNA, 20 bp, Artificial
  CRISPR gRNA sequence
atatttttaattaagaattt

SEQ ID NO: 614340 - DNA, 20 bp, Artificial
  CRISPR gRNA sequence
atttttaattaagaatttga

SEQ ID NO: 614341 - DNA, 20 bp, Artificial
  CRISPR gRNA sequence
agagaatatttttctttatt

SEQ ID NO: 614342 - DNA, 20 bp, Artificial
  CRISPR gRNA sequence
tctttatttggattctatcc

SEQ ID NO: 614343 - DNA, 20 bp, Artificial
  CRISPR gRNA sequence
tcctagtaatatataacaaa

SEQ ID NO: 614344 - DNA, 20 bp, Artificial
  CRISPR gRNA sequence
tagtaatatataacaaacag

SEQ ID NO: 614345 - DNA, 20 bp, Artificial
  CRISPR gRNA sequence
tatataacaaacagtagcca

SEQ ID NO: 614346 - DNA, 20 bp, Artificial
  CRISPR gRNA sequence
attgccttctccatgtgcct

SEQ ID NO: 614347 - DNA, 20 bp, Artificial
  CRISPR gRNA sequence
tttgaccttatcaaattctc

SEQ ID NO: 614348 - DNA, 20 bp, Artificial
  CRISPR gRNA sequence
tctccctctcttttcttatt

SEQ ID NO: 614349 - DNA, 20 bp, Artificial
  CRISPR gRNA sequence
ctctcttttcttattcagct

SEQ ID NO: 614350 - DNA, 20 bp, Artificial
  CRISPR gRNA sequence
cttattcagcttagattcca

SEQ ID NO: 614351 - DNA, 20 bp, Artificial
  CRISPR gRNA sequence
tcttgcctttcttgccttgt

SEQ ID NO: 614352 - DNA, 20 bp, Artificial
  CRISPR gRNA sequence
tgaaaccctactgtcttgta

SEQ ID NO: 614353 - DNA, 20 bp, Artificial
  CRISPR gRNA sequence
actgtcttgtaaagctgact

SEQ ID NO: 614354 - DNA, 20 bp, Artificial
  CRISPR gRNA sequence
tttccatacttatatctcac

SEQ ID NO: 614355 - DNA, 20 bp, Artificial
  CRISPR gRNA sequence
atctcactagatgtgcaccc

SEQ ID NO: 614356 - DNA, 20 bp, Artificial
  CRISPR gRNA sequence
tgcaccccagcctgcacatc

SEQ ID NO: 614357 - DNA, 20 bp, Artificial
  CRISPR gRNA sequence
gcctgcacatctggtacttt

SEQ ID NO: 614358 - DNA, 20 bp, Artificial
  CRISPR gRNA sequence
ctgcacatctggtacttttg

SEQ ID NO: 614359 - DNA, 20 bp, Artificial
  CRISPR gRNA sequence
tacttttggagaaaattcca

SEQ ID NO: 614360 - DNA, 20 bp, Artificial
  CRISPR gRNA sequence
acttttggagaaaattccac

SEQ ID NO: 614361 - DNA, 20 bp, Artificial
  CRISPR gRNA sequence
agaaaattccacaggctgat

SEQ ID NO: 614362 - DNA, 20 bp, Artificial
  CRISPR gRNA sequence
aattccacaggctgatgagt

SEQ ID NO: 614363 - DNA, 20 bp, Artificial
  CRISPR gRNA sequence
gaataactgatcccaaatat

SEQ ID NO: 614364 - DNA, 20 bp, Artificial
  CRISPR gRNA sequence
aactgatcccaaatatcagc

SEQ ID NO: 614365 - DNA, 20 bp, Artificial
  CRISPR gRNA sequence
cagctggcctatccatccta

SEQ ID NO: 614366 - DNA, 20 bp, Artificial
  CRISPR gRNA sequence
gctggcctatccatcctatg

SEQ ID NO: 614367 - DNA, 20 bp, Artificial
  CRISPR gRNA sequence
ggcctatccatcctatggag

SEQ ID NO: 614368 - DNA, 20 bp, Artificial
  CRISPR gRNA sequence
cctatggagcagcatccctg

SEQ ID NO: 614369 - DNA, 20 bp, Artificial
  CRISPR gRNA sequence
tctcctgctctccaccatga

SEQ ID NO: 614370 - DNA, 20 bp, Artificial
  CRISPR gRNA sequence
aaacatgctgtctcactcct

SEQ ID NO: 614371 - DNA, 20 bp, Artificial
  CRISPR gRNA sequence
tgatcttatatctatattca

SEQ ID NO: 614372 - DNA, 20 bp, Artificial
  CRISPR gRNA sequence
gatcttatatctatattcac

SEQ ID NO: 614373 - DNA, 20 bp, Artificial
  CRISPR gRNA sequence
atcttatatctatattcaca

SEQ ID NO: 614374 - DNA, 20 bp, Artificial
  CRISPR gRNA sequence
tcttatatctatattcacag

SEQ ID NO: 614375 - DNA, 20 bp, Artificial
  CRISPR gRNA sequence
ttcacaggggataaaatcgc

SEQ ID NO: 614376 - DNA, 20 bp, Artificial
  CRISPR gRNA sequence
acataatattaccaattcta

SEQ ID NO: 614377 - DNA, 20 bp, Artificial
  CRISPR gRNA sequence
cataatattaccaattctat

SEQ ID NO: 614378 - DNA, 20 bp, Artificial
  CRISPR gRNA sequence
actatccctctttctaatta

SEQ ID NO: 614379 - DNA, 20 bp, Artificial
  CRISPR gRNA sequence
ttcattccccctcttgtgca

SEQ ID NO: 614380 - DNA, 20 bp, Artificial
  CRISPR gRNA sequence
tcattccccctcttgtgcac

SEQ ID NO: 614381 - DNA, 20 bp, Artificial
  CRISPR gRNA sequence
gcacaggaattctcctatcc

SEQ ID NO: 614382 - DNA, 20 bp, Artificial
  CRISPR gRNA sequence
attctcctatcctggccccc

SEQ ID NO: 614383 - DNA, 20 bp, Artificial
  CRISPR gRNA sequence
ttttaacctctcccctctat

SEQ ID NO: 614384 - DNA, 20 bp, Artificial
  CRISPR gRNA sequence
tttaacctctcccctctatt

SEQ ID NO: 614385 - DNA, 20 bp, Artificial
  CRISPR gRNA sequence
ctctattgggcatttcctat

SEQ ID NO: 614386 - DNA, 20 bp, Artificial
  CRISPR gRNA sequence
attaaaaaaaatcttccttt

SEQ ID NO: 614387 - DNA, 20 bp, Artificial
  CRISPR gRNA sequence
ctttaagccccatctccttc

SEQ ID NO: 614388 - DNA, 20 bp, Artificial
  CRISPR gRNA sequence
tttaagccccatctccttcc

SEQ ID NO: 614389 - DNA, 20 bp, Artificial
  CRISPR gRNA sequence
tctccttccaggtacacctg

SEQ ID NO: 614390 - DNA, 20 bp, Artificial
  CRISPR gRNA sequence
ctgtagtctccttttcttca

SEQ ID NO: 614391 - DNA, 20 bp, Artificial
  CRISPR gRNA sequence
ttcaaagatgaaattgttga

SEQ ID NO: 614392 - DNA, 20 bp, Artificial
  CRISPR gRNA sequence
ttttttttctattcatttcc

SEQ ID NO: 614393 - DNA, 20 bp, Artificial
  CRISPR gRNA sequence
ccattaaaattattctcact

SEQ ID NO: 614394 - DNA, 20 bp, Artificial
  CRISPR gRNA sequence
cattaaaattattctcactg

SEQ ID NO: 614395 - DNA, 20 bp, Artificial
  CRISPR gRNA sequence
attctcactgaggtcacaac

SEQ ID NO: 614396 - DNA, 20 bp, Artificial
  CRISPR gRNA sequence
gaggtcacaactagcttctg

SEQ ID NO: 614397 - DNA, 20 bp, Artificial
  CRISPR gRNA sequence
agcttctgtagtgccaaatc

SEQ ID NO: 614398 - DNA, 20 bp, Artificial
  CRISPR gRNA sequence
ttctgtagtgccaaatcgag

SEQ ID NO: 614399 - DNA, 20 bp, Artificial
  CRISPR gRNA sequence
caaatcgagtagactctttt

SEQ ID NO: 614400 - DNA, 20 bp, Artificial
  CRISPR gRNA sequence
tcgagtagactcttttaaga

SEQ ID NO: 614401 - DNA, 20 bp, Artificial
  CRISPR gRNA sequence
ttttaagacagtatcttaca

SEQ ID NO: 614402 - DNA, 20 bp, Artificial
  CRISPR gRNA sequence
acagtatcttacacagctcc

SEQ ID NO: 614403 - DNA, 20 bp, Artificial
  CRISPR gRNA sequence
agtatcttacacagctccta

SEQ ID NO: 614404 - DNA, 20 bp, Artificial
  CRISPR gRNA sequence
tatcttacacagctcctaga

SEQ ID NO: 614405 - DNA, 20 bp, Artificial
  CRISPR gRNA sequence
gagtatctgccactattgaa

SEQ ID NO: 614406 - DNA, 20 bp, Artificial
  CRISPR gRNA sequence
tattgaatagtcaattcctt

SEQ ID NO: 614407 - DNA, 20 bp, Artificial
  CRISPR gRNA sequence
ttggaaacacactcttttct

SEQ ID NO: 614408 - DNA, 20 bp, Artificial
  CRISPR gRNA sequence
tctctctctctgactgtgtt

SEQ ID NO: 614409 - DNA, 20 bp, Artificial
  CRISPR gRNA sequence
gactgtgttcagtattcttt

SEQ ID NO: 614410 - DNA, 20 bp, Artificial
  CRISPR gRNA sequence
tctttcagacttatccttaa

SEQ ID NO: 614411 - DNA, 20 bp, Artificial
  CRISPR gRNA sequence
cttatccttaacagctatgc

SEQ ID NO: 614412 - DNA, 20 bp, Artificial
  CRISPR gRNA sequence
tccttaacagctatgcaagt

SEQ ID NO: 614413 - DNA, 20 bp, Artificial
  CRISPR gRNA sequence
acagctatgcaagttggcca

SEQ ID NO: 614414 - DNA, 20 bp, Artificial
  CRISPR gRNA sequence
caagttggccaaagtacaaa

SEQ ID NO: 614415 - DNA, 20 bp, Artificial
  CRISPR gRNA sequence
agttggccaaagtacaaatg

SEQ ID NO: 614416 - DNA, 20 bp, Artificial
  CRISPR gRNA sequence
gttggccaaagtacaaatgg

SEQ ID NO: 614417 - DNA, 20 bp, Artificial
  CRISPR gRNA sequence
tctacccttccaacttgact

SEQ ID NO: 614418 - DNA, 20 bp, Artificial
  CRISPR gRNA sequence
tcaaataaatatgcaattct

SEQ ID NO: 614419 - DNA, 20 bp, Artificial
  CRISPR gRNA sequence
tgcaattctcagatttcctg

SEQ ID NO: 614420 - DNA, 20 bp, Artificial
  CRISPR gRNA sequence
tgtagctctacactacacct

SEQ ID NO: 614421 - DNA, 20 bp, Artificial
  CRISPR gRNA sequence
agctctacactacaccttgg

SEQ ID NO: 614422 - DNA, 20 bp, Artificial
  CRISPR gRNA sequence
acactacaccttggcagcac

SEQ ID NO: 614423 - DNA, 20 bp, Artificial
  CRISPR gRNA sequence
ctacaccttggcagcacgag

SEQ ID NO: 614424 - DNA, 20 bp, Artificial
  CRISPR gRNA sequence
gcacgagcagaaccacccac

SEQ ID NO: 614425 - DNA, 20 bp, Artificial
  CRISPR gRNA sequence
cagaaccacccactggctta

SEQ ID NO: 614426 - DNA, 20 bp, Artificial
  CRISPR gRNA sequence
accacccactggcttacagc

SEQ ID NO: 614427 - DNA, 20 bp, Artificial
  CRISPR gRNA sequence
ccacccactggcttacagct

SEQ ID NO: 614428 - DNA, 20 bp, Artificial
  CRISPR gRNA sequence
ttacagctaggctcctctct

SEQ ID NO: 614429 - DNA, 20 bp, Artificial
  CRISPR gRNA sequence
tcctctcttagacccactcc

SEQ ID NO: 614430 - DNA, 20 bp, Artificial
  CRISPR gRNA sequence
cctagttctctccattacca

SEQ ID NO: 614431 - DNA, 20 bp, Artificial
  CRISPR gRNA sequence
ctagttctctccattaccaa

SEQ ID NO: 614432 - DNA, 20 bp, Artificial
  CRISPR gRNA sequence
tagttctctccattaccaaa

SEQ ID NO: 614433 - DNA, 20 bp, Artificial
  CRISPR gRNA sequence
agttctctccattaccaaag

SEQ ID NO: 614434 - DNA, 20 bp, Artificial
  CRISPR gRNA sequence
gttctctccattaccaaagg

SEQ ID NO: 614435 - DNA, 20 bp, Artificial
  CRISPR gRNA sequence
gggtctcacacacacatgta

SEQ ID NO: 614436 - DNA, 20 bp, Artificial
  CRISPR gRNA sequence
acacacatgtatggacaccc

SEQ ID NO: 614437 - DNA, 20 bp, Artificial
  CRISPR gRNA sequence
gacaccccagcctgcatatc

SEQ ID NO: 614438 - DNA, 20 bp, Artificial
  CRISPR gRNA sequence
acaccccagcctgcatatcc

SEQ ID NO: 614439 - DNA, 20 bp, Artificial
  CRISPR gRNA sequence
ttctttttacattgcacata

SEQ ID NO: 614440 - DNA, 20 bp, Artificial
  CRISPR gRNA sequence
tttacattgcacataaagac

SEQ ID NO: 614441 - DNA, 20 bp, Artificial
  CRISPR gRNA sequence
gcacataaagaccagtgcct

SEQ ID NO: 614442 - DNA, 20 bp, Artificial
  CRISPR gRNA sequence
aagaccagtgccttggccat

SEQ ID NO: 614443 - DNA, 20 bp, Artificial
  CRISPR gRNA sequence
agaccagtgccttggccatc

SEQ ID NO: 614444 - DNA, 20 bp, Artificial
  CRISPR gRNA sequence
agtgccttggccatcaggcc

SEQ ID NO: 614445 - DNA, 20 bp, Artificial
  CRISPR gRNA sequence
gtgccttggccatcaggcct

SEQ ID NO: 614446 - DNA, 20 bp, Artificial
  CRISPR gRNA sequence
aggcctaggtgtgtgcttac

SEQ ID NO: 614447 - DNA, 20 bp, Artificial
  CRISPR gRNA sequence
cctaggtgtgtgcttaccag

SEQ ID NO: 614448 - DNA, 20 bp, Artificial
  CRISPR gRNA sequence
gtgtgtgcttaccagtagca

SEQ ID NO: 614449 - DNA, 20 bp, Artificial
  CRISPR gRNA sequence
gtgcttaccagtagcacagt

SEQ ID NO: 614450 - DNA, 20 bp, Artificial
  CRISPR gRNA sequence
ccagtagcacagttggtatg

SEQ ID NO: 614451 - DNA, 20 bp, Artificial
  CRISPR gRNA sequence
acagttggtatgaagtatta

SEQ ID NO: 614452 - DNA, 20 bp, Artificial
  CRISPR gRNA sequence
gaagtattatggaccctatg

SEQ ID NO: 614453 - DNA, 20 bp, Artificial
  CRISPR gRNA sequence
agtattatggaccctatgaa

SEQ ID NO: 614454 - DNA, 20 bp, Artificial
  CRISPR gRNA sequence
gtattatggaccctatgaag

SEQ ID NO: 614455 - DNA, 20 bp, Artificial
  CRISPR gRNA sequence
accctatgaagaggactgtg

SEQ ID NO: 614456 - DNA, 20 bp, Artificial
  CRISPR gRNA sequence
gaagaggactgtgtagtccc

SEQ ID NO: 614457 - DNA, 20 bp, Artificial
  CRISPR gRNA sequence
gaggactgtgtagtccctag

SEQ ID NO: 614458 - DNA, 20 bp, Artificial
  CRISPR gRNA sequence
gactgtgtagtccctagaag

SEQ ID NO: 614459 - DNA, 20 bp, Artificial
  CRISPR gRNA sequence
actgtgtagtccctagaagc

SEQ ID NO: 614460 - DNA, 20 bp, Artificial
  CRISPR gRNA sequence
gtagtccctagaagcaggct

SEQ ID NO: 614461 - DNA, 20 bp, Artificial
  CRISPR gRNA sequence
gaagcaggctcagaaccatt

SEQ ID NO: 614462 - DNA, 20 bp, Artificial
  CRISPR gRNA sequence
aagcaggctcagaaccattt

SEQ ID NO: 614463 - DNA, 20 bp, Artificial
  CRISPR gRNA sequence
aggctcagaaccatttgggc

SEQ ID NO: 614464 - DNA, 20 bp, Artificial
  CRISPR gRNA sequence
ggctcagaaccatttgggca

SEQ ID NO: 614465 - DNA, 20 bp, Artificial
  CRISPR gRNA sequence
accatttgggcaaggaattc

SEQ ID NO: 614466 - DNA, 20 bp, Artificial
  CRISPR gRNA sequence
ccatttgggcaaggaattct

SEQ ID NO: 614467 - DNA, 20 bp, Artificial
  CRISPR gRNA sequence
catttgggcaaggaattctg

SEQ ID NO: 614468 - DNA, 20 bp, Artificial
  CRISPR gRNA sequence
ggcaaggaattctggggtct

SEQ ID NO: 614469 - DNA, 20 bp, Artificial
  CRISPR gRNA sequence
aggaattctggggtctgagt

SEQ ID NO: 614470 - DNA, 20 bp, Artificial
  CRISPR gRNA sequence
tctggggtctgagtgagctt

SEQ ID NO: 614471 - DNA, 20 bp, Artificial
  CRISPR gRNA sequence
ggtctgagtgagcttcagat

SEQ ID NO: 614472 - DNA, 20 bp, Artificial
  CRISPR gRNA sequence
ttcagatcagcacattccct

SEQ ID NO: 614473 - DNA, 20 bp, Artificial
  CRISPR gRNA sequence
tcagcacattcccttggccc

SEQ ID NO: 614474 - DNA, 20 bp, Artificial
  CRISPR gRNA sequence
gcacattcccttggccctag

SEQ ID NO: 614475 - DNA, 20 bp, Artificial
  CRISPR gRNA sequence
ctagaagctcctcatttcct

SEQ ID NO: 614476 - DNA, 20 bp, Artificial
  CRISPR gRNA sequence
gaagctcctcatttcctgag

SEQ ID NO: 614477 - DNA, 20 bp, Artificial
  CRISPR gRNA sequence
ctcctcatttcctgagaaga

SEQ ID NO: 614478 - DNA, 20 bp, Artificial
  CRISPR gRNA sequence
tcctcatttcctgagaagaa

SEQ ID NO: 614479 - DNA, 20 bp, Artificial
  CRISPR gRNA sequence
atttcctgagaagaaaggcc

SEQ ID NO: 614480 - DNA, 20 bp, Artificial
  CRISPR gRNA sequence
tttcctgagaagaaaggccc

SEQ ID NO: 614481 - DNA, 20 bp, Artificial
  CRISPR gRNA sequence
ttcctgagaagaaaggccca

SEQ ID NO: 614482 - DNA, 20 bp, Artificial
  CRISPR gRNA sequence
ggcccagggctccctaaaca

SEQ ID NO: 614483 - DNA, 20 bp, Artificial
  CRISPR gRNA sequence
gcccagggctccctaaacat

SEQ ID NO: 614484 - DNA, 20 bp, Artificial
  CRISPR gRNA sequence
cccagggctccctaaacatg

SEQ ID NO: 614485 - DNA, 20 bp, Artificial
  CRISPR gRNA sequence
ggctccctaaacatggggcc

SEQ ID NO: 614486 - DNA, 20 bp, Artificial
  CRISPR gRNA sequence
ccccactttccctgatctat

SEQ ID NO: 614487 - DNA, 20 bp, Artificial
  CRISPR gRNA sequence
cactttccctgatctatgag

SEQ ID NO: 614488 - DNA, 20 bp, Artificial
  CRISPR gRNA sequence
actttccctgatctatgagt

SEQ ID NO: 614489 - DNA, 20 bp, Artificial
  CRISPR gRNA sequence
ttccctgatctatgagtagg

SEQ ID NO: 614490 - DNA, 20 bp, Artificial
  CRISPR gRNA sequence
atgagtaggcagacaaatct

SEQ ID NO: 614491 - DNA, 20 bp, Artificial
  CRISPR gRNA sequence
gacaaatcttagtgttattc

SEQ ID NO: 614492 - DNA, 20 bp, Artificial
  CRISPR gRNA sequence
acaaatcttagtgttattcc

SEQ ID NO: 614493 - DNA, 20 bp, Artificial
  CRISPR gRNA sequence
catccccttcacactctacc

SEQ ID NO: 614494 - DNA, 20 bp, Artificial
  CRISPR gRNA sequence
atccccttcacactctacct

SEQ ID NO: 614495 - DNA, 20 bp, Artificial
  CRISPR gRNA sequence
acactctacctgggtgatat

SEQ ID NO: 614496 - DNA, 20 bp, Artificial
  CRISPR gRNA sequence
ggtgatatcagttatttcct

SEQ ID NO: 614497 - DNA, 20 bp, Artificial
  CRISPR gRNA sequence
atcagttatttccttggctt

SEQ ID NO: 614498 - DNA, 20 bp, Artificial
  CRISPR gRNA sequence
agttatttccttggcttcag

SEQ ID NO: 614499 - DNA, 20 bp, Artificial
  CRISPR gRNA sequence
atgactcatttctacatctc

SEQ ID NO: 614500 - DNA, 20 bp, Artificial
  CRISPR gRNA sequence
tcatttctacatctcaagcc

SEQ ID NO: 614501 - DNA, 20 bp, Artificial
  CRISPR gRNA sequence
catttctacatctcaagccc

SEQ ID NO: 614502 - DNA, 20 bp, Artificial
  CRISPR gRNA sequence
caggtctctcttctgaattt

SEQ ID NO: 614503 - DNA, 20 bp, Artificial
  CRISPR gRNA sequence
gaatttgagactaaacttac

SEQ ID NO: 614504 - DNA, 20 bp, Artificial
  CRISPR gRNA sequence
ctggacattattattactca

SEQ ID NO: 614505 - DNA, 20 bp, Artificial
  CRISPR gRNA sequence
ttgtcatctactaaatttcc

SEQ ID NO: 614506 - DNA, 20 bp, Artificial
  CRISPR gRNA sequence
tgtcatctactaaatttcct

SEQ ID NO: 614507 - DNA, 20 bp, Artificial
  CRISPR gRNA sequence
atctactaaatttcctaggc

SEQ ID NO: 614508 - DNA, 20 bp, Artificial
  CRISPR gRNA sequence
aatttcctaggccagaaacc

SEQ ID NO: 614509 - DNA, 20 bp, Artificial
  CRISPR gRNA sequence
tttcctaggccagaaaccta

SEQ ID NO: 614510 - DNA, 20 bp, Artificial
  CRISPR gRNA sequence
cctaggccagaaacctagag

SEQ ID NO: 614511 - DNA, 20 bp, Artificial
  CRISPR gRNA sequence
ctttgctaaatgaatacctt

SEQ ID NO: 614512 - DNA, 20 bp, Artificial
  CRISPR gRNA sequence
tttgctaaatgaataccttc

SEQ ID NO: 614513 - DNA, 20 bp, Artificial
  CRISPR gRNA sequence
ttgctaaatgaataccttca

SEQ ID NO: 614514 - DNA, 20 bp, Artificial
  CRISPR gRNA sequence
cccttcaatctgtattcctt

SEQ ID NO: 614515 - DNA, 20 bp, Artificial
  CRISPR gRNA sequence
ccttcaatctgtattccttt

SEQ ID NO: 614516 - DNA, 20 bp, Artificial
  CRISPR gRNA sequence
cttcaatctgtattccttta

SEQ ID NO: 614517 - DNA, 20 bp, Artificial
  CRISPR gRNA sequence
tagggaaatattcaaatttt

SEQ ID NO: 614518 - DNA, 20 bp, Artificial
  CRISPR gRNA sequence
attcaaatttttagcatatt

SEQ ID NO: 614519 - DNA, 20 bp, Artificial
  CRISPR gRNA sequence
ttcgcacttgtttctactct

SEQ ID NO: 614520 - DNA, 20 bp, Artificial
  CRISPR gRNA sequence
ttctactctcagccttattg

SEQ ID NO: 614521 - DNA, 20 bp, Artificial
  CRISPR gRNA sequence
tctcagccttattgaagtat

SEQ ID NO: 614522 - DNA, 20 bp, Artificial
  CRISPR gRNA sequence
ataagtaattcctcctttat

SEQ ID NO: 614523 - DNA, 20 bp, Artificial
  CRISPR gRNA sequence
ttgcctctgatcctttctac

SEQ ID NO: 614524 - DNA, 20 bp, Artificial
  CRISPR gRNA sequence
ccacctcatgtttcttcact

SEQ ID NO: 614525 - DNA, 20 bp, Artificial
  CRISPR gRNA sequence
tccttgattccatttccttc

SEQ ID NO: 614526 - DNA, 20 bp, Artificial
  CRISPR gRNA sequence
ttgattccatttccttcaag

SEQ ID NO: 614527 - DNA, 20 bp, Artificial
  CRISPR gRNA sequence
tccttcaagaagtgttcctt

SEQ ID NO: 614528 - DNA, 20 bp, Artificial
  CRISPR gRNA sequence
gaagtgttcctttagtcccc

SEQ ID NO: 614529 - DNA, 20 bp, Artificial
  CRISPR gRNA sequence
ttcctttagtcccctggtat

SEQ ID NO: 614530 - DNA, 20 bp, Artificial
  CRISPR gRNA sequence
tattgttccttccaaactgt

SEQ ID NO: 614531 - DNA, 20 bp, Artificial
  CRISPR gRNA sequence
ttccaaactgtaagttcttt

SEQ ID NO: 614532 - DNA, 20 bp, Artificial
  CRISPR gRNA sequence
ctgtaagttctttaagaata

SEQ ID NO: 614533 - DNA, 20 bp, Artificial
  CRISPR gRNA sequence
agttctttaagaatatagat

SEQ ID NO: 614534 - DNA, 20 bp, Artificial
  CRISPR gRNA sequence
gttctttaagaatatagatc

SEQ ID NO: 614535 - DNA, 20 bp, Artificial
  CRISPR gRNA sequence
gaatatagatcaggtttgtc

SEQ ID NO: 614536 - DNA, 20 bp, Artificial
  CRISPR gRNA sequence
caggtttgtctagcttaatt

SEQ ID NO: 614537 - DNA, 20 bp, Artificial
  CRISPR gRNA sequence
tttgacattgcatatatctt

SEQ ID NO: 614538 - DNA, 20 bp, Artificial
  CRISPR gRNA sequence
cattgcatatatcttaagtt

SEQ ID NO: 614539 - DNA, 20 bp, Artificial
  CRISPR gRNA sequence
atcattacactgatctcacg

SEQ ID NO: 614540 - DNA, 20 bp, Artificial
  CRISPR gRNA sequence
tcattacactgatctcacgt

SEQ ID NO: 614541 - DNA, 20 bp, Artificial
  CRISPR gRNA sequence
cattacactgatctcacgta

SEQ ID NO: 614542 - DNA, 20 bp, Artificial
  CRISPR gRNA sequence
attacactgatctcacgtag

SEQ ID NO: 614543 - DNA, 20 bp, Artificial
  CRISPR gRNA sequence
ggggccatttcttccaatct

SEQ ID NO: 614544 - DNA, 20 bp, Artificial
  CRISPR gRNA sequence
ggccatttcttccaatctga

SEQ ID NO: 614545 - DNA, 20 bp, Artificial
  CRISPR gRNA sequence
agagtatctgccaaaattac

SEQ ID NO: 614546 - DNA, 20 bp, Artificial
  CRISPR gRNA sequence
atctgccaaaattacaagtt

SEQ ID NO: 614547 - DNA, 20 bp, Artificial
  CRISPR gRNA sequence
aacaacatattaaccattta

SEQ ID NO: 614548 - DNA, 20 bp, Artificial
  CRISPR gRNA sequence
acaacatattaaccatttat

SEQ ID NO: 614549 - DNA, 20 bp, Artificial
  CRISPR gRNA sequence
ggaaacccacatatgttttt

SEQ ID NO: 614550 - DNA, 20 bp, Artificial
  CRISPR gRNA sequence
aacccacatatgtttttaag

SEQ ID NO: 614551 - DNA, 20 bp, Artificial
  CRISPR gRNA sequence
tttaagaagcatttatctgt

SEQ ID NO: 614552 - DNA, 20 bp, Artificial
  CRISPR gRNA sequence
tctgtaagatttacctatga

SEQ ID NO: 614553 - DNA, 20 bp, Artificial
  CRISPR gRNA sequence
gatttacctatgaaagtaac

SEQ ID NO: 614554 - DNA, 20 bp, Artificial
  CRISPR gRNA sequence
ctatgaaagtaactggtaaa

SEQ ID NO: 614555 - DNA, 20 bp, Artificial
  CRISPR gRNA sequence
atgaaagtaactggtaaata

SEQ ID NO: 614556 - DNA, 20 bp, Artificial
  CRISPR gRNA sequence
aaatagagaccacattgtct

SEQ ID NO: 614557 - DNA, 20 bp, Artificial
  CRISPR gRNA sequence
aatagagaccacattgtctt

SEQ ID NO: 614558 - DNA, 20 bp, Artificial
  CRISPR gRNA sequence
atagagaccacattgtctta

SEQ ID NO: 614559 - DNA, 20 bp, Artificial
  CRISPR gRNA sequence
agaccacattgtcttaggga

SEQ ID NO: 614560 - DNA, 20 bp, Artificial
  CRISPR gRNA sequence
cttagggacagaatttgtaa

SEQ ID NO: 614561 - DNA, 20 bp, Artificial
  CRISPR gRNA sequence
ctaaatattctgttcaaaac

SEQ ID NO: 614562 - DNA, 20 bp, Artificial
  CRISPR gRNA sequence
tgttcaaaaccagcaatatc

SEQ ID NO: 614563 - DNA, 20 bp, Artificial
  CRISPR gRNA sequence
aaaactacttttcccgttgc

SEQ ID NO: 614564 - DNA, 20 bp, Artificial
  CRISPR gRNA sequence
caagcaccaaaactctttta

SEQ ID NO: 614565 - DNA, 20 bp, Artificial
  CRISPR gRNA sequence
caaaactcttttatagttaa

SEQ ID NO: 614566 - DNA, 20 bp, Artificial
  CRISPR gRNA sequence
actcttttatagttaacagt

SEQ ID NO: 614567 - DNA, 20 bp, Artificial
  CRISPR gRNA sequence
attatgttgatgtaaaatat

SEQ ID NO: 614568 - DNA, 20 bp, Artificial
  CRISPR gRNA sequence
tatgttgatgtaaaatattg

SEQ ID NO: 614569 - DNA, 20 bp, Artificial
  CRISPR gRNA sequence
ggagtaaaattatatttgtt

SEQ ID NO: 614570 - DNA, 20 bp, Artificial
  CRISPR gRNA sequence
gagtaaaattatatttgttg

SEQ ID NO: 614571 - DNA, 20 bp, Artificial
  CRISPR gRNA sequence
atttgttgaggtgtatattt

SEQ ID NO: 614572 - DNA, 20 bp, Artificial
  CRISPR gRNA sequence
tttgttgaggtgtatattta

SEQ ID NO: 614573 - DNA, 20 bp, Artificial
  CRISPR gRNA sequence
actgcaaacatgcttcaatc

SEQ ID NO: 614574 - DNA, 20 bp, Artificial
  CRISPR gRNA sequence
aacatgcttcaatcaagaaa

SEQ ID NO: 614575 - DNA, 20 bp, Artificial
  CRISPR gRNA sequence
gcttcaatcaagaaaaagta

SEQ ID NO: 614576 - DNA, 20 bp, Artificial
  CRISPR gRNA sequence
cttcaatcaagaaaaagtat

SEQ ID NO: 614577 - DNA, 20 bp, Artificial
  CRISPR gRNA sequence
caatcaagaaaaagtatggg

SEQ ID NO: 614578 - DNA, 20 bp, Artificial
  CRISPR gRNA sequence
caagaaaaagtatgggaagc

SEQ ID NO: 614579 - DNA, 20 bp, Artificial
  CRISPR gRNA sequence
aaagtatgggaagctagcaa

SEQ ID NO: 614580 - DNA, 20 bp, Artificial
  CRISPR gRNA sequence
aagtatgggaagctagcaat

SEQ ID NO: 614581 - DNA, 20 bp, Artificial
  CRISPR gRNA sequence
ctagcaatgggtgtacgtac

SEQ ID NO: 614582 - DNA, 20 bp, Artificial
  CRISPR gRNA sequence
tcacatacacatgtctaaat

SEQ ID NO: 614583 - DNA, 20 bp, Artificial
  CRISPR gRNA sequence
atacacatgtctaaataaga

SEQ ID NO: 614584 - DNA, 20 bp, Artificial
  CRISPR gRNA sequence
tacacatgtctaaataagaa

SEQ ID NO: 614585 - DNA, 20 bp, Artificial
  CRISPR gRNA sequence
taaaaatgaatattaatttc

SEQ ID NO: 614586 - DNA, 20 bp, Artificial
  CRISPR gRNA sequence
aaatgaatattaatttcaag

SEQ ID NO: 614587 - DNA, 20 bp, Artificial
  CRISPR gRNA sequence
atttcaagaagcaaaacaat

SEQ ID NO: 614588 - DNA, 20 bp, Artificial
  CRISPR gRNA sequence
aagaagcaaaacaatgagac

SEQ ID NO: 614589 - DNA, 20 bp, Artificial
  CRISPR gRNA sequence
acaatgagacaagattttcc

SEQ ID NO: 614590 - DNA, 20 bp, Artificial
  CRISPR gRNA sequence
acaagattttccgagtttat

SEQ ID NO: 614591 - DNA, 20 bp, Artificial
  CRISPR gRNA sequence
tacatttcattcatttttat

SEQ ID NO: 614592 - DNA, 20 bp, Artificial
  CRISPR gRNA sequence
acatttcattcatttttatt

SEQ ID NO: 614593 - DNA, 20 bp, Artificial
  CRISPR gRNA sequence
tttcattcatttttattagg

SEQ ID NO: 614594 - DNA, 20 bp, Artificial
  CRISPR gRNA sequence
ttaggtggtactacttttaa

SEQ ID NO: 614595 - DNA, 20 bp, Artificial
  CRISPR gRNA sequence
aatgacttttaaaaaatctc

SEQ ID NO: 614596 - DNA, 20 bp, Artificial
  CRISPR gRNA sequence
aatctccagaatgacatata

SEQ ID NO: 614597 - DNA, 20 bp, Artificial
  CRISPR gRNA sequence
atctccagaatgacatatat

SEQ ID NO: 614598 - DNA, 20 bp, Artificial
  CRISPR gRNA sequence
tatatatattttttctgaaa

SEQ ID NO: 614599 - DNA, 20 bp, Artificial
  CRISPR gRNA sequence
atatattttttctgaaatag

SEQ ID NO: 614600 - DNA, 20 bp, Artificial
  CRISPR gRNA sequence
accaacttaaccctacacaa

SEQ ID NO: 614601 - DNA, 20 bp, Artificial
  CRISPR gRNA sequence
acttaaccctacacaacagt

SEQ ID NO: 614602 - DNA, 20 bp, Artificial
  CRISPR gRNA sequence
cttaaccctacacaacagtg

SEQ ID NO: 614603 - DNA, 20 bp, Artificial
  CRISPR gRNA sequence
gaggtgccatatgttataac

SEQ ID NO: 614604 - DNA, 20 bp, Artificial
  CRISPR gRNA sequence
tctcacttttatgatctttg

SEQ ID NO: 614605 - DNA, 20 bp, Artificial
  CRISPR gRNA sequence
cttttatgatctttgtagct

SEQ ID NO: 614606 - DNA, 20 bp, Artificial
  CRISPR gRNA sequence
tgtttaaaatatgcaaaatc

SEQ ID NO: 614607 - DNA, 20 bp, Artificial
  CRISPR gRNA sequence
aaaatatgcaaaatcaagca

SEQ ID NO: 614608 - DNA, 20 bp, Artificial
  CRISPR gRNA sequence
agtctctgacttgtttttac

SEQ ID NO: 614609 - DNA, 20 bp, Artificial
  CRISPR gRNA sequence
gtctctgacttgtttttact

SEQ ID NO: 614610 - DNA, 20 bp, Artificial
  CRISPR gRNA sequence
ttcttcctcctattctcctt

SEQ ID NO: 614611 - DNA, 20 bp, Artificial
  CRISPR gRNA sequence
attctccttgagctctattc

SEQ ID NO: 614612 - DNA, 20 bp, Artificial
  CRISPR gRNA sequence
tccttgagctctattcaagt

SEQ ID NO: 614613 - DNA, 20 bp, Artificial
  CRISPR gRNA sequence
tattcaagtgagaattttaa

SEQ ID NO: 614614 - DNA, 20 bp, Artificial
  CRISPR gRNA sequence
ataaactcaatcatatcttt

SEQ ID NO: 614615 - DNA, 20 bp, Artificial
  CRISPR gRNA sequence
ctcaatcatatctttcagac

SEQ ID NO: 614616 - DNA, 20 bp, Artificial
  CRISPR gRNA sequence
gactagatgcattctcatga

SEQ ID NO: 614617 - DNA, 20 bp, Artificial
  CRISPR gRNA sequence
atgcattctcatgatggcat

SEQ ID NO: 614618 - DNA, 20 bp, Artificial
  CRISPR gRNA sequence
ggcatcagaacaaatgcaaa

SEQ ID NO: 614619 - DNA, 20 bp, Artificial
  CRISPR gRNA sequence
ttttatatttttttcatgtc

SEQ ID NO: 614620 - DNA, 20 bp, Artificial
  CRISPR gRNA sequence
tttcatgtcaagaatatttg

SEQ ID NO: 614621 - DNA, 20 bp, Artificial
  CRISPR gRNA sequence
atgtcaagaatatttgtggc

SEQ ID NO: 614622 - DNA, 20 bp, Artificial
  CRISPR gRNA sequence
agaatatttgtggccagacc

SEQ ID NO: 614623 - DNA, 20 bp, Artificial
  CRISPR gRNA sequence
tgcctgtaatcgtaacactt

SEQ ID NO: 614624 - DNA, 20 bp, Artificial
  CRISPR gRNA sequence
gcctgtaatcgtaacacttt

SEQ ID NO: 614625 - DNA, 20 bp, Artificial
  CRISPR gRNA sequence
ctgtaatcgtaacactttgg

SEQ ID NO: 614626 - DNA, 20 bp, Artificial
  CRISPR gRNA sequence
tgtaatcgtaacactttggg

SEQ ID NO: 614627 - DNA, 20 bp, Artificial
  CRISPR gRNA sequence
tcgtaacactttgggaggcc

SEQ ID NO: 614628 - DNA, 20 bp, Artificial
  CRISPR gRNA sequence
cgtaacactttgggaggcca

SEQ ID NO: 614629 - DNA, 20 bp, Artificial
  CRISPR gRNA sequence
aacactttgggaggccaagg

SEQ ID NO: 614630 - DNA, 20 bp, Artificial
  CRISPR gRNA sequence
acactttgggaggccaaggt

SEQ ID NO: 614631 - DNA, 20 bp, Artificial
  CRISPR gRNA sequence
ctttgggaggccaaggtggg

SEQ ID NO: 614632 - DNA, 20 bp, Artificial
  CRISPR gRNA sequence
ccaaggtgggtggatcactt

SEQ ID NO: 614633 - DNA, 20 bp, Artificial
  CRISPR gRNA sequence
caaggtgggtggatcacttg

SEQ ID NO: 614634 - DNA, 20 bp, Artificial
  CRISPR gRNA sequence
gtgggtggatcacttgaggc

SEQ ID NO: 614635 - DNA, 20 bp, Artificial
  CRISPR gRNA sequence
tgggtggatcacttgaggcc

SEQ ID NO: 614636 - DNA, 20 bp, Artificial
  CRISPR gRNA sequence
ggtggatcacttgaggccag

SEQ ID NO: 614637 - DNA, 20 bp, Artificial
  CRISPR gRNA sequence
tcacttgaggccaggagttc

SEQ ID NO: 614638 - DNA, 20 bp, Artificial
  CRISPR gRNA sequence
tgaggccaggagttctagac

SEQ ID NO: 614639 - DNA, 20 bp, Artificial
  CRISPR gRNA sequence
ccaggagttctagaccagcc

SEQ ID NO: 614640 - DNA, 20 bp, Artificial
  CRISPR gRNA sequence
ttctagaccagcctggctaa

SEQ ID NO: 614641 - DNA, 20 bp, Artificial
  CRISPR gRNA sequence
tctagaccagcctggctaac

SEQ ID NO: 614642 - DNA, 20 bp, Artificial
  CRISPR gRNA sequence
ctagaccagcctggctaaca

SEQ ID NO: 614643 - DNA, 20 bp, Artificial
  CRISPR gRNA sequence
tctactaaaaatacaaaaat

SEQ ID NO: 614644 - DNA, 20 bp, Artificial
  CRISPR gRNA sequence
ctaaaaatacaaaaattagc

SEQ ID NO: 614645 - DNA, 20 bp, Artificial
  CRISPR gRNA sequence
taaaaatacaaaaattagcc

SEQ ID NO: 614646 - DNA, 20 bp, Artificial
  CRISPR gRNA sequence
atacaaaaattagccaggta

SEQ ID NO: 614647 - DNA, 20 bp, Artificial
  CRISPR gRNA sequence
tacaaaaattagccaggtat

SEQ ID NO: 614648 - DNA, 20 bp, Artificial
  CRISPR gRNA sequence
acaaaaattagccaggtatg

SEQ ID NO: 614649 - DNA, 20 bp, Artificial
  CRISPR gRNA sequence
caaaaattagccaggtatgg

SEQ ID NO: 614650 - DNA, 20 bp, Artificial
  CRISPR gRNA sequence
ggggcgcatgcctgtaattc

SEQ ID NO: 614651 - DNA, 20 bp, Artificial
  CRISPR gRNA sequence
tgcctgtaattccagctact

SEQ ID NO: 614652 - DNA, 20 bp, Artificial
  CRISPR gRNA sequence
gcctgtaattccagctactc

SEQ ID NO: 614653 - DNA, 20 bp, Artificial
  CRISPR gRNA sequence
tgtaattccagctactcagg

SEQ ID NO: 614654 - DNA, 20 bp, Artificial
  CRISPR gRNA sequence
ttccagctactcaggtggct

SEQ ID NO: 614655 - DNA, 20 bp, Artificial
  CRISPR gRNA sequence
tccagctactcaggtggctg

SEQ ID NO: 614656 - DNA, 20 bp, Artificial
  CRISPR gRNA sequence
tactcaggtggctgaggcat

SEQ ID NO: 614657 - DNA, 20 bp, Artificial
  CRISPR gRNA sequence
ggcatgagaatcccttgaac

SEQ ID NO: 614658 - DNA, 20 bp, Artificial
  CRISPR gRNA sequence
catgagaatcccttgaactg

SEQ ID NO: 614659 - DNA, 20 bp, Artificial
  CRISPR gRNA sequence
tgagaatcccttgaactgga

SEQ ID NO: 614660 - DNA, 20 bp, Artificial
  CRISPR gRNA sequence
gagaatcccttgaactggag

SEQ ID NO: 614661 - DNA, 20 bp, Artificial
  CRISPR gRNA sequence
aatcccttgaactggagagg

SEQ ID NO: 614662 - DNA, 20 bp, Artificial
  CRISPR gRNA sequence
tcccttgaactggagaggtg

SEQ ID NO: 614663 - DNA, 20 bp, Artificial
  CRISPR gRNA sequence
cccttgaactggagaggtgg

SEQ ID NO: 614664 - DNA, 20 bp, Artificial
  CRISPR gRNA sequence
aactggagaggtggaggttg

SEQ ID NO: 614665 - DNA, 20 bp, Artificial
  CRISPR gRNA sequence
ggagaggtggaggttgcagt

SEQ ID NO: 614666 - DNA, 20 bp, Artificial
  CRISPR gRNA sequence
gaggtggaggttgcagtgag

SEQ ID NO: 614667 - DNA, 20 bp, Artificial
  CRISPR gRNA sequence
ggtggaggttgcagtgagca

SEQ ID NO: 614668 - DNA, 20 bp, Artificial
  CRISPR gRNA sequence
gtgagcagagatcacaccct

SEQ ID NO: 614669 - DNA, 20 bp, Artificial
  CRISPR gRNA sequence
aaaaaaaaaaaaatgtgtgt

SEQ ID NO: 614670 - DNA, 20 bp, Artificial
  CRISPR gRNA sequence
aaaaaaatgtgtgtgagcat

SEQ ID NO: 614671 - DNA, 20 bp, Artificial
  CRISPR gRNA sequence
aaaatgtgtgtgagcatcag

SEQ ID NO: 614672 - DNA, 20 bp, Artificial
  CRISPR gRNA sequence
ttgcccaaatacttgactta

SEQ ID NO: 614673 - DNA, 20 bp, Artificial
  CRISPR gRNA sequence
gcccaaatacttgacttata

SEQ ID NO: 614674 - DNA, 20 bp, Artificial
  CRISPR gRNA sequence
atataccaaattatgaaaaa

SEQ ID NO: 614675 - DNA, 20 bp, Artificial
  CRISPR gRNA sequence
ataccaaattatgaaaaatg

SEQ ID NO: 614676 - DNA, 20 bp, Artificial
  CRISPR gRNA sequence
taccaaattatgaaaaatgg

SEQ ID NO: 614677 - DNA, 20 bp, Artificial
  CRISPR gRNA sequence
ttatgaaaaatggaggcaat

SEQ ID NO: 614678 - DNA, 20 bp, Artificial
  CRISPR gRNA sequence
tttcacctcccactcccttc

SEQ ID NO: 614679 - DNA, 20 bp, Artificial
  CRISPR gRNA sequence
ttcacctcccactcccttcc

SEQ ID NO: 614680 - DNA, 20 bp, Artificial
  CRISPR gRNA sequence
tcacctcccactcccttcca

SEQ ID NO: 614681 - DNA, 20 bp, Artificial
  CRISPR gRNA sequence
cacctcccactcccttccag

SEQ ID NO: 614682 - DNA, 20 bp, Artificial
  CRISPR gRNA sequence
cccactcccttccaggggaa

SEQ ID NO: 614683 - DNA, 20 bp, Artificial
  CRISPR gRNA sequence
ggggaaaagctcatgcgatt

SEQ ID NO: 614684 - DNA, 20 bp, Artificial
  CRISPR gRNA sequence
gctcatgcgattcagctacc

SEQ ID NO: 614685 - DNA, 20 bp, Artificial
  CRISPR gRNA sequence
ttgatatgaacttaacatat

SEQ ID NO: 614686 - DNA, 20 bp, Artificial
  CRISPR gRNA sequence
atatgaacttaacatatgag

SEQ ID NO: 614687 - DNA, 20 bp, Artificial
  CRISPR gRNA sequence
tatgaacttaacatatgaga

SEQ ID NO: 614688 - DNA, 20 bp, Artificial
  CRISPR gRNA sequence
tgaacttaacatatgagaag

SEQ ID NO: 614689 - DNA, 20 bp, Artificial
  CRISPR gRNA sequence
gaacttaacatatgagaagg

SEQ ID NO: 614690 - DNA, 20 bp, Artificial
  CRISPR gRNA sequence
taacatatgagaaggaggct

SEQ ID NO: 614691 - DNA, 20 bp, Artificial
  CRISPR gRNA sequence
agaaggaggctgagctgatg

SEQ ID NO: 614692 - DNA, 20 bp, Artificial
  CRISPR gRNA sequence
gctgatgcagtctcatatga

SEQ ID NO: 614693 - DNA, 20 bp, Artificial
  CRISPR gRNA sequence
gcagtctcatatgatggacc

SEQ ID NO: 614694 - DNA, 20 bp, Artificial
  CRISPR gRNA sequence
aacaatgcaatcacctacct

SEQ ID NO: 614695 - DNA, 20 bp, Artificial
  CRISPR gRNA sequence
caatgcaatcacctaccttg

SEQ ID NO: 614696 - DNA, 20 bp, Artificial
  CRISPR gRNA sequence
caatcacctaccttggagct

SEQ ID NO: 614697 - DNA, 20 bp, Artificial
  CRISPR gRNA sequence
aatcacctaccttggagctg

SEQ ID NO: 614698 - DNA, 20 bp, Artificial
  CRISPR gRNA sequence
aggcccttcaccctctgatg

SEQ ID NO: 614699 - DNA, 20 bp, Artificial
  CRISPR gRNA sequence
cctctgatgcagcacccgcc

SEQ ID NO: 614700 - DNA, 20 bp, Artificial
  CRISPR gRNA sequence
cccgccaagcacaatcgctg

SEQ ID NO: 614701 - DNA, 20 bp, Artificial
  CRISPR gRNA sequence
gccaagcacaatcgctgaag

SEQ ID NO: 614702 - DNA, 20 bp, Artificial
  CRISPR gRNA sequence
cacaatcgctgaagtggccc

SEQ ID NO: 614703 - DNA, 20 bp, Artificial
  CRISPR gRNA sequence
gctgaagtggccccagttat

SEQ ID NO: 614704 - DNA, 20 bp, Artificial
  CRISPR gRNA sequence
agtggccccagttataagct

SEQ ID NO: 614705 - DNA, 20 bp, Artificial
  CRISPR gRNA sequence
ttataagctcagcttattct

SEQ ID NO: 614706 - DNA, 20 bp, Artificial
  CRISPR gRNA sequence
tataagctcagcttattctc

SEQ ID NO: 614707 - DNA, 20 bp, Artificial
  CRISPR gRNA sequence
tctcaggtctatcatccaaa

SEQ ID NO: 614708 - DNA, 20 bp, Artificial
  CRISPR gRNA sequence
ctcaggtctatcatccaaat

SEQ ID NO: 614709 - DNA, 20 bp, Artificial
  CRISPR gRNA sequence
ggtctatcatccaaatagga

SEQ ID NO: 614710 - DNA, 20 bp, Artificial
  CRISPR gRNA sequence
tatcatccaaataggataga

SEQ ID NO: 614711 - DNA, 20 bp, Artificial
  CRISPR gRNA sequence
aataggatagaaagacccat

SEQ ID NO: 614712 - DNA, 20 bp, Artificial
  CRISPR gRNA sequence
aggatagaaagacccattag

SEQ ID NO: 614713 - DNA, 20 bp, Artificial
  CRISPR gRNA sequence
ggatagaaagacccattagc

SEQ ID NO: 614714 - DNA, 20 bp, Artificial
  CRISPR gRNA sequence
gatagaaagacccattagca

SEQ ID NO: 614715 - DNA, 20 bp, Artificial
  CRISPR gRNA sequence
attagcagggaaactgctga

SEQ ID NO: 614716 - DNA, 20 bp, Artificial
  CRISPR gRNA sequence
tgatagtcatgaaaacaaca

SEQ ID NO: 614717 - DNA, 20 bp, Artificial
  CRISPR gRNA sequence
agtcatgaaaacaacatgga

SEQ ID NO: 614718 - DNA, 20 bp, Artificial
  CRISPR gRNA sequence
gatggccccatctctctcat

SEQ ID NO: 614719 - DNA, 20 bp, Artificial
  CRISPR gRNA sequence
ccatctctctcatcagacca

SEQ ID NO: 614720 - DNA, 20 bp, Artificial
  CRISPR gRNA sequence
atctctctcatcagaccaaa

SEQ ID NO: 614721 - DNA, 20 bp, Artificial
  CRISPR gRNA sequence
tcagaccaaagagtcgaccc

SEQ ID NO: 614722 - DNA, 20 bp, Artificial
  CRISPR gRNA sequence
cagaccaaagagtcgacccc

SEQ ID NO: 614723 - DNA, 20 bp, Artificial
  CRISPR gRNA sequence
ccaaagagtcgaccccagga

SEQ ID NO: 614724 - DNA, 20 bp, Artificial
  CRISPR gRNA sequence
aaagagtcgaccccaggaaa

SEQ ID NO: 614725 - DNA, 20 bp, Artificial
  CRISPR gRNA sequence
agagtcgaccccaggaaaga

SEQ ID NO: 614726 - DNA, 20 bp, Artificial
  CRISPR gRNA sequence
gagtcgaccccaggaaagag

SEQ ID NO: 614727 - DNA, 20 bp, Artificial
  CRISPR gRNA sequence
caggaaagagaggcctctcc

SEQ ID NO: 614728 - DNA, 20 bp, Artificial
  CRISPR gRNA sequence
agagaggcctctcccagcaa

SEQ ID NO: 614729 - DNA, 20 bp, Artificial
  CRISPR gRNA sequence
ctctcccagcaatagctgcc

SEQ ID NO: 614730 - DNA, 20 bp, Artificial
  CRISPR gRNA sequence
ctgcctggattccactgact

SEQ ID NO: 614731 - DNA, 20 bp, Artificial
  CRISPR gRNA sequence
ctggattccactgactcaga

SEQ ID NO: 614732 - DNA, 20 bp, Artificial
  CRISPR gRNA sequence
gattccactgactcagaaag

SEQ ID NO: 614733 - DNA, 20 bp, Artificial
  CRISPR gRNA sequence
aaagcagccatgatgaccac

SEQ ID NO: 614734 - DNA, 20 bp, Artificial
  CRISPR gRNA sequence
tgatgaccaccagtcctacc

SEQ ID NO: 614735 - DNA, 20 bp, Artificial
  CRISPR gRNA sequence
gatgaccaccagtcctacca

SEQ ID NO: 614736 - DNA, 20 bp, Artificial
  CRISPR gRNA sequence
gacaccctgccttaaatccc

SEQ ID NO: 614737 - DNA, 20 bp, Artificial
  CRISPR gRNA sequence
caccctgccttaaatcccaa

SEQ ID NO: 614738 - DNA, 20 bp, Artificial
  CRISPR gRNA sequence
accctgccttaaatcccaag

SEQ ID NO: 614739 - DNA, 20 bp, Artificial
  CRISPR gRNA sequence
ttaaatcccaagaggaaaca

SEQ ID NO: 614740 - DNA, 20 bp, Artificial
  CRISPR gRNA sequence
tcccaagaggaaacaaagcc

SEQ ID NO: 614741 - DNA, 20 bp, Artificial
  CRISPR gRNA sequence
aacaaagcccagcttacatg

SEQ ID NO: 614742 - DNA, 20 bp, Artificial
  CRISPR gRNA sequence
acaaagcccagcttacatga

SEQ ID NO: 614743 - DNA, 20 bp, Artificial
  CRISPR gRNA sequence
aaagcccagcttacatgaag

SEQ ID NO: 614744 - DNA, 20 bp, Artificial
  CRISPR gRNA sequence
aagcccagcttacatgaagg

SEQ ID NO: 614745 - DNA, 20 bp, Artificial
  CRISPR gRNA sequence
ttacatgaaggaggatgtca

SEQ ID NO: 614746 - DNA, 20 bp, Artificial
  CRISPR gRNA sequence
gaaggaggatgtcaaagctt

SEQ ID NO: 614747 - DNA, 20 bp, Artificial
  CRISPR gRNA sequence
tcaaagctttggatactacc

SEQ ID NO: 614748 - DNA, 20 bp, Artificial
  CRISPR gRNA sequence
caaagctttggatactacca

SEQ ID NO: 614749 - DNA, 20 bp, Artificial
  CRISPR gRNA sequence
tggatactaccaaggctcct

SEQ ID NO: 614750 - DNA, 20 bp, Artificial
  CRISPR gRNA sequence
ggatactaccaaggctccta

SEQ ID NO: 614751 - DNA, 20 bp, Artificial
  CRISPR gRNA sequence
gatactaccaaggctcctaa

SEQ ID NO: 614752 - DNA, 20 bp, Artificial
  CRISPR gRNA sequence
aggctcctaagggctctctg

SEQ ID NO: 614753 - DNA, 20 bp, Artificial
  CRISPR gRNA sequence
ggctcctaagggctctctga

SEQ ID NO: 614754 - DNA, 20 bp, Artificial
  CRISPR gRNA sequence
gctctctgaaggacatctac

SEQ ID NO: 614755 - DNA, 20 bp, Artificial
  CRISPR gRNA sequence
ctctctgaaggacatctaca

SEQ ID NO: 614756 - DNA, 20 bp, Artificial
  CRISPR gRNA sequence
gacatctacaaggtcttcaa

SEQ ID NO: 614757 - DNA, 20 bp, Artificial
  CRISPR gRNA sequence
catctacaaggtcttcaatg

SEQ ID NO: 614758 - DNA, 20 bp, Artificial
  CRISPR gRNA sequence
ctacaaggtcttcaatggag

SEQ ID NO: 614759 - DNA, 20 bp, Artificial
  CRISPR gRNA sequence
tacaaggtcttcaatggaga

SEQ ID NO: 614760 - DNA, 20 bp, Artificial
  CRISPR gRNA sequence
caaggtcttcaatggagaag

SEQ ID NO: 614761 - DNA, 20 bp, Artificial
  CRISPR gRNA sequence
tcttcaatggagaaggagaa

SEQ ID NO: 614762 - DNA, 20 bp, Artificial
  CRISPR gRNA sequence
aatggagaaggagaacagat

SEQ ID NO: 614763 - DNA, 20 bp, Artificial
  CRISPR gRNA sequence
atggagaaggagaacagatt

SEQ ID NO: 614764 - DNA, 20 bp, Artificial
  CRISPR gRNA sequence
tggagaaggagaacagatta

SEQ ID NO: 614765 - DNA, 20 bp, Artificial
  CRISPR gRNA sequence
gagaacagattagggccttc

SEQ ID NO: 614766 - DNA, 20 bp, Artificial
  CRISPR gRNA sequence
agattagggccttcaagtgt

SEQ ID NO: 614767 - DNA, 20 bp, Artificial
  CRISPR gRNA sequence
cttcaagtgtgagcactgcc

SEQ ID NO: 614768 - DNA, 20 bp, Artificial
  CRISPR gRNA sequence
gcactgccgagtccttttcc

SEQ ID NO: 614769 - DNA, 20 bp, Artificial
  CRISPR gRNA sequence
tgtcatgtacaccattcaca

SEQ ID NO: 614770 - DNA, 20 bp, Artificial
  CRISPR gRNA sequence
gtcatgtacaccattcacat

SEQ ID NO: 614771 - DNA, 20 bp, Artificial
  CRISPR gRNA sequence
accattcacatgggttgcca

SEQ ID NO: 614772 - DNA, 20 bp, Artificial
  CRISPR gRNA sequence
acatgggttgccatggctac

SEQ ID NO: 614773 - DNA, 20 bp, Artificial
  CRISPR gRNA sequence
catgggttgccatggctacc

SEQ ID NO: 614774 - DNA, 20 bp, Artificial
  CRISPR gRNA sequence
ccatggctaccgggacccac

SEQ ID NO: 614775 - DNA, 20 bp, Artificial
  CRISPR gRNA sequence
ccactggaatgcaacatctg

SEQ ID NO: 614776 - DNA, 20 bp, Artificial
  CRISPR gRNA sequence
gaatgcaacatctgtggcta

SEQ ID NO: 614777 - DNA, 20 bp, Artificial
  CRISPR gRNA sequence
tgcaacatctgtggctacag

SEQ ID NO: 614778 - DNA, 20 bp, Artificial
  CRISPR gRNA sequence
acatctgtggctacagaagc

SEQ ID NO: 614779 - DNA, 20 bp, Artificial
  CRISPR gRNA sequence
catctgtggctacagaagcc

SEQ ID NO: 614780 - DNA, 20 bp, Artificial
  CRISPR gRNA sequence
acagaagccaggaccgttat

SEQ ID NO: 614781 - DNA, 20 bp, Artificial
  CRISPR gRNA sequence
gttttcatcacacattgttc

SEQ ID NO: 614782 - DNA, 20 bp, Artificial
  CRISPR gRNA sequence
ttttcatcacacattgttcg

SEQ ID NO: 614783 - DNA, 20 bp, Artificial
  CRISPR gRNA sequence
tttcatcacacattgttcga

SEQ ID NO: 614784 - DNA, 20 bp, Artificial
  CRISPR gRNA sequence
ttcatcacacattgttcgag

SEQ ID NO: 614785 - DNA, 20 bp, Artificial
  CRISPR gRNA sequence
catcacacattgttcgaggg

SEQ ID NO: 614786 - DNA, 20 bp, Artificial
  CRISPR gRNA sequence
gaggggagcacacattccac

SEQ ID NO: 614787 - DNA, 20 bp, Artificial
  CRISPR gRNA sequence
aggggagcacacattccact

SEQ ID NO: 614788 - DNA, 20 bp, Artificial
  CRISPR gRNA sequence
cactaggccttttcattcca

SEQ ID NO: 614789 - DNA, 20 bp, Artificial
  CRISPR gRNA sequence
actaggccttttcattccaa

SEQ ID NO: 614790 - DNA, 20 bp, Artificial
  CRISPR gRNA sequence
ctaggccttttcattccaaa

SEQ ID NO: 614791 - DNA, 20 bp, Artificial
  CRISPR gRNA sequence
taggccttttcattccaaag

SEQ ID NO: 614792 - DNA, 20 bp, Artificial
  CRISPR gRNA sequence
ttccaaaggggacccctatg

SEQ ID NO: 614793 - DNA, 20 bp, Artificial
  CRISPR gRNA sequence
aaggggacccctatgaagta

SEQ ID NO: 614794 - DNA, 20 bp, Artificial
  CRISPR gRNA sequence
gaagtaaagaactgcacatg

SEQ ID NO: 614795 - DNA, 20 bp, Artificial
  CRISPR gRNA sequence
tgttgataattcttattttg

SEQ ID NO: 614796 - DNA, 20 bp, Artificial
  CRISPR gRNA sequence
ttgataattcttattttgtg

SEQ ID NO: 614797 - DNA, 20 bp, Artificial
  CRISPR gRNA sequence
tgataattcttattttgtgg

SEQ ID NO: 614798 - DNA, 20 bp, Artificial
  CRISPR gRNA sequence
taattcttattttgtggagg

SEQ ID NO: 614799 - DNA, 20 bp, Artificial
  CRISPR gRNA sequence
ttgctctgcctaattacgat

SEQ ID NO: 614800 - DNA, 20 bp, Artificial
  CRISPR gRNA sequence
tgctctgcctaattacgata

SEQ ID NO: 614801 - DNA, 20 bp, Artificial
  CRISPR gRNA sequence
tctgcctaattacgataagg

SEQ ID NO: 614802 - DNA, 20 bp, Artificial
  CRISPR gRNA sequence
taattacgataaggaagaaa

SEQ ID NO: 614803 - DNA, 20 bp, Artificial
  CRISPR gRNA sequence
ttacgataaggaagaaacag

SEQ ID NO: 614804 - DNA, 20 bp, Artificial
  CRISPR gRNA sequence
acgataaggaagaaacagaa

SEQ ID NO: 614805 - DNA, 20 bp, Artificial
  CRISPR gRNA sequence
gataaggaagaaacagaaga

SEQ ID NO: 614806 - DNA, 20 bp, Artificial
  CRISPR gRNA sequence
aaggaagaaacagaagagag

SEQ ID NO: 614807 - DNA, 20 bp, Artificial
  CRISPR gRNA sequence
aggaagaaacagaagagaga

SEQ ID NO: 614808 - DNA, 20 bp, Artificial
  CRISPR gRNA sequence
ggaagaaacagaagagagaa

SEQ ID NO: 614809 - DNA, 20 bp, Artificial
  CRISPR gRNA sequence
gaagaaacagaagagagaag

SEQ ID NO: 614810 - DNA, 20 bp, Artificial
  CRISPR gRNA sequence
gaaacagaagagagaagggg

SEQ ID NO: 614811 - DNA, 20 bp, Artificial
  CRISPR gRNA sequence
aaacagaagagagaaggggc

SEQ ID NO: 614812 - DNA, 20 bp, Artificial
  CRISPR gRNA sequence
aatattgtttctttatcacc

SEQ ID NO: 614813 - DNA, 20 bp, Artificial
  CRISPR gRNA sequence
cacctggcttgtttattttg

SEQ ID NO: 614814 - DNA, 20 bp, Artificial
  CRISPR gRNA sequence
acctggcttgtttattttgt

SEQ ID NO: 614815 - DNA, 20 bp, Artificial
  CRISPR gRNA sequence
tgtttattttgtgggaattt

SEQ ID NO: 614816 - DNA, 20 bp, Artificial
  CRISPR gRNA sequence
tttattttgtgggaatttaa

SEQ ID NO: 614817 - DNA, 20 bp, Artificial
  CRISPR gRNA sequence
attttgtgggaatttaagag

SEQ ID NO: 614818 - DNA, 20 bp, Artificial
  CRISPR gRNA sequence
aagagcagtccatttctacc

SEQ ID NO: 614819 - DNA, 20 bp, Artificial
  CRISPR gRNA sequence
agagcagtccatttctacca

SEQ ID NO: 614820 - DNA, 20 bp, Artificial
  CRISPR gRNA sequence
gaaaaatcacttgattcata

SEQ ID NO: 614821 - DNA, 20 bp, Artificial
  CRISPR gRNA sequence
tgattcataaagattcacct

SEQ ID NO: 614822 - DNA, 20 bp, Artificial
  CRISPR gRNA sequence
attcataaagattcacctaa

SEQ ID NO: 614823 - DNA, 20 bp, Artificial
  CRISPR gRNA sequence
tctgatttgccactgatatt

SEQ ID NO: 614824 - DNA, 20 bp, Artificial
  CRISPR gRNA sequence
actgatattcagaattatga

SEQ ID NO: 614825 - DNA, 20 bp, Artificial
  CRISPR gRNA sequence
gatattcagaattatgatgg

SEQ ID NO: 614826 - DNA, 20 bp, Artificial
  CRISPR gRNA sequence
ttcagaattatgatggaaga

SEQ ID NO: 614827 - DNA, 20 bp, Artificial
  CRISPR gRNA sequence
tcagaattatgatggaagac

SEQ ID NO: 614828 - DNA, 20 bp, Artificial
  CRISPR gRNA sequence
aattatgatggaagacagga

SEQ ID NO: 614829 - DNA, 20 bp, Artificial
  CRISPR gRNA sequence
tgatggaagacaggaaagtt

SEQ ID NO: 614830 - DNA, 20 bp, Artificial
  CRISPR gRNA sequence
atggaagacaggaaagttca

SEQ ID NO: 614831 - DNA, 20 bp, Artificial
  CRISPR gRNA sequence
caggaaagttcagagttttc

SEQ ID NO: 614832 - DNA, 20 bp, Artificial
  CRISPR gRNA sequence
aggaaagttcagagttttct

SEQ ID NO: 614833 - DNA, 20 bp, Artificial
  CRISPR gRNA sequence
aaagttcagagttttctggg

SEQ ID NO: 614834 - DNA, 20 bp, Artificial
  CRISPR gRNA sequence
aagttcagagttttctgggt

SEQ ID NO: 614835 - DNA, 20 bp, Artificial
  CRISPR gRNA sequence
gagttttctgggtaggactt

SEQ ID NO: 614836 - DNA, 20 bp, Artificial
  CRISPR gRNA sequence
ttttctgggtaggactttgg

SEQ ID NO: 614837 - DNA, 20 bp, Artificial
  CRISPR gRNA sequence
ggactttggtggtttaaaaa

SEQ ID NO: 614838 - DNA, 20 bp, Artificial
  CRISPR gRNA sequence
tggtggtttaaaaatggtat

SEQ ID NO: 614839 - DNA, 20 bp, Artificial
  CRISPR gRNA sequence
ataagtaactttattcttga

SEQ ID NO: 614840 - DNA, 20 bp, Artificial
  CRISPR gRNA sequence
agtaactttattcttgaaag

SEQ ID NO: 614841 - DNA, 20 bp, Artificial
  CRISPR gRNA sequence
taaaccaattttttgttctt

SEQ ID NO: 614842 - DNA, 20 bp, Artificial
  CRISPR gRNA sequence
aaccaattttttgttcttca

SEQ ID NO: 614843 - DNA, 20 bp, Artificial
  CRISPR gRNA sequence
tttttgttcttcagagatca

SEQ ID NO: 614844 - DNA, 20 bp, Artificial
  CRISPR gRNA sequence
cacaaacacattgttatttt

SEQ ID NO: 614845 - DNA, 20 bp, Artificial
  CRISPR gRNA sequence
tattttcagtgataactcct

SEQ ID NO: 614846 - DNA, 20 bp, Artificial
  CRISPR gRNA sequence
ttttcagtgataactcctaa

SEQ ID NO: 614847 - DNA, 20 bp, Artificial
  CRISPR gRNA sequence
tttcagtgataactcctaag

SEQ ID NO: 614848 - DNA, 20 bp, Artificial
  CRISPR gRNA sequence
tcagtgataactcctaagag

SEQ ID NO: 614849 - DNA, 20 bp, Artificial
  CRISPR gRNA sequence
gataactcctaagaggagct

SEQ ID NO: 614850 - DNA, 20 bp, Artificial
  CRISPR gRNA sequence
taagaggagctgagttgttg

SEQ ID NO: 614851 - DNA, 20 bp, Artificial
  CRISPR gRNA sequence
aagaggagctgagttgttgt

SEQ ID NO: 614852 - DNA, 20 bp, Artificial
  CRISPR gRNA sequence
ttctatgtttacttccccta

SEQ ID NO: 614853 - DNA, 20 bp, Artificial
  CRISPR gRNA sequence
cccctatggaatttataatt

SEQ ID NO: 614854 - DNA, 20 bp, Artificial
  CRISPR gRNA sequence
atgttttacactgtaccata

SEQ ID NO: 614855 - DNA, 20 bp, Artificial
  CRISPR gRNA sequence
atagcaaaacttttaaacta

SEQ ID NO: 614856 - DNA, 20 bp, Artificial
  CRISPR gRNA sequence
tagcaaaacttttaaactac

SEQ ID NO: 614857 - DNA, 20 bp, Artificial
  CRISPR gRNA sequence
caaaacttttaaactacagg

SEQ ID NO: 614858 - DNA, 20 bp, Artificial
  CRISPR gRNA sequence
cttttaaactacaggtagtt

SEQ ID NO: 614859 - DNA, 20 bp, Artificial
  CRISPR gRNA sequence
ttttaaactacaggtagtta

SEQ ID NO: 614860 - DNA, 20 bp, Artificial
  CRISPR gRNA sequence
tttaaactacaggtagttaa

SEQ ID NO: 614861 - DNA, 20 bp, Artificial
  CRISPR gRNA sequence
gggccacctacaatacatct

SEQ ID NO: 614862 - DNA, 20 bp, Artificial
  CRISPR gRNA sequence
ggccacctacaatacatctg

SEQ ID NO: 614863 - DNA, 20 bp, Artificial
  CRISPR gRNA sequence
gatcttatttttctaaacgt

SEQ ID NO: 614864 - DNA, 20 bp, Artificial
  CRISPR gRNA sequence
acgtaagcactgtttttcca

SEQ ID NO: 614865 - DNA, 20 bp, Artificial
  CRISPR gRNA sequence
ttttccatagttttgatgac

SEQ ID NO: 614866 - DNA, 20 bp, Artificial
  CRISPR gRNA sequence
ttttgatgactggcatttta

SEQ ID NO: 614867 - DNA, 20 bp, Artificial
  CRISPR gRNA sequence
ctggcattttatagacaccc

SEQ ID NO: 614868 - DNA, 20 bp, Artificial
  CRISPR gRNA sequence
gcattttatagacaccctgg

SEQ ID NO: 614869 - DNA, 20 bp, Artificial
  CRISPR gRNA sequence
gccttacttttaacaccttt

SEQ ID NO: 614870 - DNA, 20 bp, Artificial
  CRISPR gRNA sequence
ccttacttttaacaccttta

SEQ ID NO: 614871 - DNA, 20 bp, Artificial
  CRISPR gRNA sequence
cttttaacacctttaaggaa

SEQ ID NO: 614872 - DNA, 20 bp, Artificial
  CRISPR gRNA sequence
taaggaatagtatttttatg

SEQ ID NO: 614873 - DNA, 20 bp, Artificial
  CRISPR gRNA sequence
tagtatttttatgtagtttt

SEQ ID NO: 614874 - DNA, 20 bp, Artificial
  CRISPR gRNA sequence
gtagttttcagaataacata

SEQ ID NO: 614875 - DNA, 20 bp, Artificial
  CRISPR gRNA sequence
ttcagaataacatatggtct

SEQ ID NO: 614876 - DNA, 20 bp, Artificial
  CRISPR gRNA sequence
cagaataacatatggtctaa

SEQ ID NO: 614877 - DNA, 20 bp, Artificial
  CRISPR gRNA sequence
aataacatatggtctaagag

SEQ ID NO: 614878 - DNA, 20 bp, Artificial
  CRISPR gRNA sequence
tatggtctaagagtggataa

SEQ ID NO: 614879 - DNA, 20 bp, Artificial
  CRISPR gRNA sequence
atggtctaagagtggataaa

SEQ ID NO: 614880 - DNA, 20 bp, Artificial
  CRISPR gRNA sequence
gtctaagagtggataaaagg

SEQ ID NO: 614881 - DNA, 20 bp, Artificial
  CRISPR gRNA sequence
aaaaggcagtcaataatttc

SEQ ID NO: 614882 - DNA, 20 bp, Artificial
  CRISPR gRNA sequence
aaaggcagtcaataatttct

SEQ ID NO: 614883 - DNA, 20 bp, Artificial
  CRISPR gRNA sequence
aggcagtcaataatttctgg

SEQ ID NO: 614884 - DNA, 20 bp, Artificial
  CRISPR gRNA sequence
ggcagtcaataatttctggg

SEQ ID NO: 614885 - DNA, 20 bp, Artificial
  CRISPR gRNA sequence
gcagtcaataatttctggga

SEQ ID NO: 614886 - DNA, 20 bp, Artificial
  CRISPR gRNA sequence
ctactttcataaatttgttt

SEQ ID NO: 614887 - DNA, 20 bp, Artificial
  CRISPR gRNA sequence
actttcataaatttgtttga

SEQ ID NO: 614888 - DNA, 20 bp, Artificial
  CRISPR gRNA sequence
ctttcataaatttgtttgag

SEQ ID NO: 614889 - DNA, 20 bp, Artificial
  CRISPR gRNA sequence
gtttgagaggttttctttta

SEQ ID NO: 614890 - DNA, 20 bp, Artificial
  CRISPR gRNA sequence
cttttaaagttgtaatgtga

SEQ ID NO: 614891 - DNA, 20 bp, Artificial
  CRISPR gRNA sequence
ttaaagttgtaatgtgatgg

SEQ ID NO: 614892 - DNA, 20 bp, Artificial
  CRISPR gRNA sequence
gttgtaatgtgatggcagca

SEQ ID NO: 614893 - DNA, 20 bp, Artificial
  CRISPR gRNA sequence
gtatatgtatttgtttctaa

SEQ ID NO: 614894 - DNA, 20 bp, Artificial
  CRISPR gRNA sequence
gcttacgattgtcactttat

SEQ ID NO: 614895 - DNA, 20 bp, Artificial
  CRISPR gRNA sequence
tcactttatcagcatttaat

SEQ ID NO: 614896 - DNA, 20 bp, Artificial
  CRISPR gRNA sequence
agcatttaatcagtgttaac

SEQ ID NO: 614897 - DNA, 20 bp, Artificial
  CRISPR gRNA sequence
tttaatcagtgttaaccagt

SEQ ID NO: 614898 - DNA, 20 bp, Artificial
  CRISPR gRNA sequence
aatcagtgttaaccagtcag

SEQ ID NO: 614899 - DNA, 20 bp, Artificial
  CRISPR gRNA sequence
gaaaaatataattatgctaa

SEQ ID NO: 614900 - DNA, 20 bp, Artificial
  CRISPR gRNA sequence
aaatataattatgctaacag

SEQ ID NO: 614901 - DNA, 20 bp, Artificial
  CRISPR gRNA sequence
aatataattatgctaacagt

SEQ ID NO: 614902 - DNA, 20 bp, Artificial
  CRISPR gRNA sequence
atataattatgctaacagta

SEQ ID NO: 614903 - DNA, 20 bp, Artificial
  CRISPR gRNA sequence
tataattatgctaacagtag

SEQ ID NO: 614904 - DNA, 20 bp, Artificial
  CRISPR gRNA sequence
ataattatgctaacagtagg

SEQ ID NO: 614905 - DNA, 20 bp, Artificial
  CRISPR gRNA sequence
aattatgctaacagtagggg

SEQ ID NO: 614906 - DNA, 20 bp, Artificial
  CRISPR gRNA sequence
gtagggggagaaaacccact

SEQ ID NO: 614907 - DNA, 20 bp, Artificial
  CRISPR gRNA sequence
ccacttagaaatcccttttc

SEQ ID NO: 614908 - DNA, 20 bp, Artificial
  CRISPR gRNA sequence
tctggtatttctcttttcac

SEQ ID NO: 614909 - DNA, 20 bp, Artificial
  CRISPR gRNA sequence
tcttttcactagtttttttc

SEQ ID NO: 614910 - DNA, 20 bp, Artificial
  CRISPR gRNA sequence
tttttcaagatgtgacctcc

SEQ ID NO: 614911 - DNA, 20 bp, Artificial
  CRISPR gRNA sequence
acctcccggtgttctgtcca

SEQ ID NO: 614912 - DNA, 20 bp, Artificial
  CRISPR gRNA sequence
tcattcatcctttactcttc

SEQ ID NO: 614913 - DNA, 20 bp, Artificial
  CRISPR gRNA sequence
ttcatcctttactcttcgag

SEQ ID NO: 614914 - DNA, 20 bp, Artificial
  CRISPR gRNA sequence
atcctttactcttcgagtag

SEQ ID NO: 614915 - DNA, 20 bp, Artificial
  CRISPR gRNA sequence
tcctttactcttcgagtaga

SEQ ID NO: 614916 - DNA, 20 bp, Artificial
  CRISPR gRNA sequence
cttcgagtagaaggtcttaa

SEQ ID NO: 614917 - DNA, 20 bp, Artificial
  CRISPR gRNA sequence
ggtcttaaaagtcttcctgt

SEQ ID NO: 614918 - DNA, 20 bp, Artificial
  CRISPR gRNA sequence
tgtttctttcaaaatctcct

SEQ ID NO: 614919 - DNA, 20 bp, Artificial
  CRISPR gRNA sequence
tttctttcaaaatctcctca

SEQ ID NO: 614920 - DNA, 20 bp, Artificial
  CRISPR gRNA sequence
cctcagagcaattgctaatt

SEQ ID NO: 614921 - DNA, 20 bp, Artificial
  CRISPR gRNA sequence
ttgctaatttggcctgaatc

SEQ ID NO: 614922 - DNA, 20 bp, Artificial
  CRISPR gRNA sequence
tctggtaacttgaaccctgt

SEQ ID NO: 614923 - DNA, 20 bp, Artificial
  CRISPR gRNA sequence
ctggtaacttgaaccctgta

SEQ ID NO: 614924 - DNA, 20 bp, Artificial
  CRISPR gRNA sequence
acttgaaccctgtaaggtta

SEQ ID NO: 614925 - DNA, 20 bp, Artificial
  CRISPR gRNA sequence
accctgtaaggttacagaac

SEQ ID NO: 614926 - DNA, 20 bp, Artificial
  CRISPR gRNA sequence
ccctgtaaggttacagaact

SEQ ID NO: 614927 - DNA, 20 bp, Artificial
  CRISPR gRNA sequence
cctgtaaggttacagaacta

SEQ ID NO: 614928 - DNA, 20 bp, Artificial
  CRISPR gRNA sequence
agaactagggctatttattt

SEQ ID NO: 614929 - DNA, 20 bp, Artificial
  CRISPR gRNA sequence
tatttattttagcatttctt

SEQ ID NO: 614930 - DNA, 20 bp, Artificial
  CRISPR gRNA sequence
ttattttagcatttcttcag

SEQ ID NO: 614931 - DNA, 20 bp, Artificial
  CRISPR gRNA sequence
tatttactactcttgttgca

SEQ ID NO: 614932 - DNA, 20 bp, Artificial
  CRISPR gRNA sequence
actactcttgttgcaaagaa

SEQ ID NO: 614933 - DNA, 20 bp, Artificial
  CRISPR gRNA sequence
ctactcttgttgcaaagaaa

SEQ ID NO: 614934 - DNA, 20 bp, Artificial
  CRISPR gRNA sequence
tactcttgttgcaaagaaaa

SEQ ID NO: 614935 - DNA, 20 bp, Artificial
  CRISPR gRNA sequence
ttgttgcaaagaaaagggaa

SEQ ID NO: 614936 - DNA, 20 bp, Artificial
  CRISPR gRNA sequence
tgttgcaaagaaaagggaat

SEQ ID NO: 614937 - DNA, 20 bp, Artificial
  CRISPR gRNA sequence
cttctttgtaacctgtacct

SEQ ID NO: 614938 - DNA, 20 bp, Artificial
  CRISPR gRNA sequence
gtaacctgtaccttggacaa

SEQ ID NO: 614939 - DNA, 20 bp, Artificial
  CRISPR gRNA sequence
gtaccttggacaacagataa

SEQ ID NO: 614940 - DNA, 20 bp, Artificial
  CRISPR gRNA sequence
gataaaagaaacaaaaaaat

SEQ ID NO: 614941 - DNA, 20 bp, Artificial
  CRISPR gRNA sequence
aaagaaacaaaaaaataaga

SEQ ID NO: 614942 - DNA, 20 bp, Artificial
  CRISPR gRNA sequence
aagtttacttttacccttct

SEQ ID NO: 614943 - DNA, 20 bp, Artificial
  CRISPR gRNA sequence
gtttacttttacccttcttg

SEQ ID NO: 614944 - DNA, 20 bp, Artificial
  CRISPR gRNA sequence
cttttacccttcttggagtc

SEQ ID NO: 614945 - DNA, 20 bp, Artificial
  CRISPR gRNA sequence
tcttggagtctagaatgtga

SEQ ID NO: 614946 - DNA, 20 bp, Artificial
  CRISPR gRNA sequence
agaatgtgacagaaccccca

SEQ ID NO: 614947 - DNA, 20 bp, Artificial
  CRISPR gRNA sequence
gaatgtgacagaacccccaa

SEQ ID NO: 614948 - DNA, 20 bp, Artificial
  CRISPR gRNA sequence
gtgacagaacccccaaagga

SEQ ID NO: 614949 - DNA, 20 bp, Artificial
  CRISPR gRNA sequence
tccaaaacatttaattgtgt

SEQ ID NO: 614950 - DNA, 20 bp, Artificial
  CRISPR gRNA sequence
ttaattgtgtaagtccttgt

SEQ ID NO: 614951 - DNA, 20 bp, Artificial
  CRISPR gRNA sequence
agaaatgaatctcaatccct

SEQ ID NO: 614952 - DNA, 20 bp, Artificial
  CRISPR gRNA sequence
tgaatctcaatcccttagta

SEQ ID NO: 614953 - DNA, 20 bp, Artificial
  CRISPR gRNA sequence
agtatagaattccccttaca

SEQ ID NO: 614954 - DNA, 20 bp, Artificial
  CRISPR gRNA sequence
agaattccccttacatggta

SEQ ID NO: 614955 - DNA, 20 bp, Artificial
  CRISPR gRNA sequence
gaattccccttacatggtat

SEQ ID NO: 614956 - DNA, 20 bp, Artificial
  CRISPR gRNA sequence
aggttgccatatttcatgtg

SEQ ID NO: 614957 - DNA, 20 bp, Artificial
  CRISPR gRNA sequence
agattttaatttcatttatg

SEQ ID NO: 614958 - DNA, 20 bp, Artificial
  CRISPR gRNA sequence
gattttaatttcatttatgt

SEQ ID NO: 614959 - DNA, 20 bp, Artificial
  CRISPR gRNA sequence
ggcgctctgttttttctttg

SEQ ID NO: 614960 - DNA, 20 bp, Artificial
  CRISPR gRNA sequence
tctgttttttctttgcagtc

SEQ ID NO: 614961 - DNA, 20 bp, Artificial
  CRISPR gRNA sequence
tctttgcagtccagccacat

SEQ ID NO: 614962 - DNA, 20 bp, Artificial
  CRISPR gRNA sequence
tttgcagtccagccacatta

SEQ ID NO: 614963 - DNA, 20 bp, Artificial
  CRISPR gRNA sequence
ttgcagtccagccacattag

SEQ ID NO: 614964 - DNA, 20 bp, Artificial
  CRISPR gRNA sequence
tgcagtccagccacattaga

SEQ ID NO: 614965 - DNA, 20 bp, Artificial
  CRISPR gRNA sequence
gcagtccagccacattagag

SEQ ID NO: 614966 - DNA, 20 bp, Artificial
  CRISPR gRNA sequence
agtccagccacattagaggg

SEQ ID NO: 614967 - DNA, 20 bp, Artificial
  CRISPR gRNA sequence
gtccagccacattagagggg

SEQ ID NO: 614968 - DNA, 20 bp, Artificial
  CRISPR gRNA sequence
cacattagaggggaggaacc

SEQ ID NO: 614969 - DNA, 20 bp, Artificial
  CRISPR gRNA sequence
gaaccgagtgatattgattc

SEQ ID NO: 614970 - DNA, 20 bp, Artificial
  CRISPR gRNA sequence
gatattgattcaagtcattt

SEQ ID NO: 614971 - DNA, 20 bp, Artificial
  CRISPR gRNA sequence
atattgattcaagtcatttt

SEQ ID NO: 614972 - DNA, 20 bp, Artificial
  CRISPR gRNA sequence
tattgattcaagtcatttta

SEQ ID NO: 614973 - DNA, 20 bp, Artificial
  CRISPR gRNA sequence
attgattcaagtcattttag

SEQ ID NO: 614974 - DNA, 20 bp, Artificial
  CRISPR gRNA sequence
ttgattcaagtcattttagg

SEQ ID NO: 614975 - DNA, 20 bp, Artificial
  CRISPR gRNA sequence
tcattttagggggacatact

SEQ ID NO: 614976 - DNA, 20 bp, Artificial
  CRISPR gRNA sequence
ttttagggggacatacttgg

SEQ ID NO: 614977 - DNA, 20 bp, Artificial
  CRISPR gRNA sequence
tttagggggacatacttgga

SEQ ID NO: 614978 - DNA, 20 bp, Artificial
  CRISPR gRNA sequence
agggggacatacttggaagg

SEQ ID NO: 614979 - DNA, 20 bp, Artificial
  CRISPR gRNA sequence
cagaacttgctgcttctgtt

SEQ ID NO: 614980 - DNA, 20 bp, Artificial
  CRISPR gRNA sequence
agaacttgctgcttctgttt

SEQ ID NO: 614981 - DNA, 20 bp, Artificial
  CRISPR gRNA sequence
gaacttgctgcttctgtttg

SEQ ID NO: 614982 - DNA, 20 bp, Artificial
  CRISPR gRNA sequence
acttgctgcttctgtttggg

SEQ ID NO: 614983 - DNA, 20 bp, Artificial
  CRISPR gRNA sequence
cttgctgcttctgtttgggg

SEQ ID NO: 614984 - DNA, 20 bp, Artificial
  CRISPR gRNA sequence
ctgcttctgtttggggagga

SEQ ID NO: 614985 - DNA, 20 bp, Artificial
  CRISPR gRNA sequence
aggacagacctgactgtgac

SEQ ID NO: 614986 - DNA, 20 bp, Artificial
  CRISPR gRNA sequence
tgtgaatactgaaattctgt

SEQ ID NO: 614987 - DNA, 20 bp, Artificial
  CRISPR gRNA sequence
gtgaatactgaaattctgtt

SEQ ID NO: 614988 - DNA, 20 bp, Artificial
  CRISPR gRNA sequence
aatactgaaattctgttagg

SEQ ID NO: 614989 - DNA, 20 bp, Artificial
  CRISPR gRNA sequence
agtaactgataactgctcta

SEQ ID NO: 614990 - DNA, 20 bp, Artificial
  CRISPR gRNA sequence
gtaactgataactgctctaa

SEQ ID NO: 614991 - DNA, 20 bp, Artificial
  CRISPR gRNA sequence
tgctctaaaggatcattaaa

SEQ ID NO: 614992 - DNA, 20 bp, Artificial
  CRISPR gRNA sequence
gctctaaaggatcattaaat

SEQ ID NO: 614993 - DNA, 20 bp, Artificial
  CRISPR gRNA sequence
tgaaattatgtatcttaata

SEQ ID NO: 614994 - DNA, 20 bp, Artificial
  CRISPR gRNA sequence
ttatgtatcttaatacagtg

SEQ ID NO: 614995 - DNA, 20 bp, Artificial
  CRISPR gRNA sequence
atcttaatacagtgtggtat

SEQ ID NO: 614996 - DNA, 20 bp, Artificial
  CRISPR gRNA sequence
agtgtggtatgagaattacc

SEQ ID NO: 614997 - DNA, 20 bp, Artificial
  CRISPR gRNA sequence
ggtatgagaattaccaagtc

SEQ ID NO: 614998 - DNA, 20 bp, Artificial
  CRISPR gRNA sequence
tatgagaattaccaagtcaa

SEQ ID NO: 614999 - DNA, 20 bp, Artificial
  CRISPR gRNA sequence
ttaccaagtcaagagaattg

SEQ ID NO: 615000 - DNA, 20 bp, Artificial
  CRISPR gRNA sequence
gtcaagagaattgtggacat

SEQ ID NO: 615001 - DNA, 20 bp, Artificial
  CRISPR gRNA sequence
agagaattgtggacataagc

SEQ ID NO: 615002 - DNA, 20 bp, Artificial
  CRISPR gRNA sequence
attgtggacataagcaagtt

SEQ ID NO: 615003 - DNA, 20 bp, Artificial
  CRISPR gRNA sequence
actgctcttaactcattttc

SEQ ID NO: 615004 - DNA, 20 bp, Artificial
  CRISPR gRNA sequence
cttactatttgctatttaaa

SEQ ID NO: 615005 - DNA, 20 bp, Artificial
  CRISPR gRNA sequence
actatttgctatttaaatgg

SEQ ID NO: 615006 - DNA, 20 bp, Artificial
  CRISPR gRNA sequence
ctatttgctatttaaatggt

SEQ ID NO: 615007 - DNA, 20 bp, Artificial
  CRISPR gRNA sequence
gctatttaaatggtaggcac

SEQ ID NO: 615008 - DNA, 20 bp, Artificial
  CRISPR gRNA sequence
ttaaatggtaggcaccagct

SEQ ID NO: 615009 - DNA, 20 bp, Artificial
  CRISPR gRNA sequence
ggcaccagctaagcacttct

SEQ ID NO: 615010 - DNA, 20 bp, Artificial
  CRISPR gRNA sequence
agcacttctaagcactaaca

SEQ ID NO: 615011 - DNA, 20 bp, Artificial
  CRISPR gRNA sequence
cttctaagcactaacacagc

SEQ ID NO: 615012 - DNA, 20 bp, Artificial
  CRISPR gRNA sequence
agcactaacacagctagaac

SEQ ID NO: 615013 - DNA, 20 bp, Artificial
  CRISPR gRNA sequence
gcactaacacagctagaact

SEQ ID NO: 615014 - DNA, 20 bp, Artificial
  CRISPR gRNA sequence
cagctagaactaggcaaaaa

SEQ ID NO: 615015 - DNA, 20 bp, Artificial
  CRISPR gRNA sequence
tagaactaggcaaaaatggt

SEQ ID NO: 615016 - DNA, 20 bp, Artificial
  CRISPR gRNA sequence
aggcaaaaatggttagaact

SEQ ID NO: 615017 - DNA, 20 bp, Artificial
  CRISPR gRNA sequence
agaactcagctctcttctac

SEQ ID NO: 615018 - DNA, 20 bp, Artificial
  CRISPR gRNA sequence
gtccctgtcataattatttt

SEQ ID NO: 615019 - DNA, 20 bp, Artificial
  CRISPR gRNA sequence
tccctgtcataattattttt

SEQ ID NO: 615020 - DNA, 20 bp, Artificial
  CRISPR gRNA sequence
aaactgccccctttaaatct

SEQ ID NO: 615021 - DNA, 20 bp, Artificial
  CRISPR gRNA sequence
aactgccccctttaaatcta

SEQ ID NO: 615022 - DNA, 20 bp, Artificial
  CRISPR gRNA sequence
actgccccctttaaatctaa

SEQ ID NO: 615023 - DNA, 20 bp, Artificial
  CRISPR gRNA sequence
tctaagggaatgcaccaaaa

SEQ ID NO: 615024 - DNA, 20 bp, Artificial
  CRISPR gRNA sequence
taagggaatgcaccaaaaca

SEQ ID NO: 615025 - DNA, 20 bp, Artificial
  CRISPR gRNA sequence
tgcaccaaaacagagatata

SEQ ID NO: 615026 - DNA, 20 bp, Artificial
  CRISPR gRNA sequence
ttttttttttctgcatgcct

SEQ ID NO: 615027 - DNA, 20 bp, Artificial
  CRISPR gRNA sequence
tttctgcatgccttggtaca

SEQ ID NO: 615028 - DNA, 20 bp, Artificial
  CRISPR gRNA sequence
gtgaacatacaacctattta

SEQ ID NO: 615029 - DNA, 20 bp, Artificial
  CRISPR gRNA sequence
atacaacctatttaaagata

SEQ ID NO: 615030 - DNA, 20 bp, Artificial
  CRISPR gRNA sequence
taaagataaagcatgttttt

SEQ ID NO: 615031 - DNA, 20 bp, Artificial
  CRISPR gRNA sequence
aaccactcccaaataataat

SEQ ID NO: 615032 - DNA, 20 bp, Artificial
  CRISPR gRNA sequence
accactcccaaataataatt

SEQ ID NO: 615033 - DNA, 20 bp, Artificial
  CRISPR gRNA sequence
gatgccattttttttccttt

SEQ ID NO: 615034 - DNA, 20 bp, Artificial
  CRISPR gRNA sequence
cattttttttccttttggat

SEQ ID NO: 615035 - DNA, 20 bp, Artificial
  CRISPR gRNA sequence
attttttttccttttggatg

SEQ ID NO: 615036 - DNA, 20 bp, Artificial
  CRISPR gRNA sequence
tggatgaggtaaataatttt

SEQ ID NO: 615037 - DNA, 20 bp, Artificial
  CRISPR gRNA sequence
ggatgaggtaaataatttta

SEQ ID NO: 615038 - DNA, 20 bp, Artificial
  CRISPR gRNA sequence
tttgtcttttactgcaattt

SEQ ID NO: 615039 - DNA, 20 bp, Artificial
  CRISPR gRNA sequence
ttgtcttttactgcaattta

SEQ ID NO: 615040 - DNA, 20 bp, Artificial
  CRISPR gRNA sequence
ctgcaatttaaggaaacatt

SEQ ID NO: 615041 - DNA, 20 bp, Artificial
  CRISPR gRNA sequence
ttaaggaaacatttggatgt

SEQ ID NO: 615042 - DNA, 20 bp, Artificial
  CRISPR gRNA sequence
agtcaatatgttcataattt

SEQ ID NO: 615043 - DNA, 20 bp, Artificial
  CRISPR gRNA sequence
ggctgtgtgcgaatttctgc

SEQ ID NO: 615044 - DNA, 20 bp, Artificial
  CRISPR gRNA sequence
cttcctacttattttttttt

SEQ ID NO: 615045 - DNA, 20 bp, Artificial
  CRISPR gRNA sequence
aatcatgtatctacctgccc

SEQ ID NO: 615046 - DNA, 20 bp, Artificial
  CRISPR gRNA sequence
atcatgtatctacctgcccc

SEQ ID NO: 615047 - DNA, 20 bp, Artificial
  CRISPR gRNA sequence
ccccaggatgaaactaaatt

SEQ ID NO: 615048 - DNA, 20 bp, Artificial
  CRISPR gRNA sequence
cccaggatgaaactaaattt

SEQ ID NO: 615049 - DNA, 20 bp, Artificial
  CRISPR gRNA sequence
aggatgaaactaaatttagg

SEQ ID NO: 615050 - DNA, 20 bp, Artificial
  CRISPR gRNA sequence
ggtggaccctaaaccttatg

SEQ ID NO: 615051 - DNA, 20 bp, Artificial
  CRISPR gRNA sequence
gaccctaaaccttatgaaga

SEQ ID NO: 615052 - DNA, 20 bp, Artificial
  CRISPR gRNA sequence
aaccttatgaagacagtgct

SEQ ID NO: 615053 - DNA, 20 bp, Artificial
  CRISPR gRNA sequence
accttatgaagacagtgctg

SEQ ID NO: 615054 - DNA, 20 bp, Artificial
  CRISPR gRNA sequence
cttttctgatttcatctttt

SEQ ID NO: 615055 - DNA, 20 bp, Artificial
  CRISPR gRNA sequence
ttttctgatttcatcttttt

SEQ ID NO: 615056 - DNA, 20 bp, Artificial
  CRISPR gRNA sequence
tttgggaatctgttttattg

SEQ ID NO: 615057 - DNA, 20 bp, Artificial
  CRISPR gRNA sequence
ttgggaatctgttttattga

SEQ ID NO: 615058 - DNA, 20 bp, Artificial
  CRISPR gRNA sequence
ggaatctgttttattgaagg

SEQ ID NO: 615059 - DNA, 20 bp, Artificial
  CRISPR gRNA sequence
tctgttttattgaaggtagt

SEQ ID NO: 615060 - DNA, 20 bp, Artificial
  CRISPR gRNA sequence
gttttattgaaggtagttag

SEQ ID NO: 615061 - DNA, 20 bp, Artificial
  CRISPR gRNA sequence
attgaaggtagttagtagtt

SEQ ID NO: 615062 - DNA, 20 bp, Artificial
  CRISPR gRNA sequence
tgaaggtagttagtagttga

SEQ ID NO: 615063 - DNA, 20 bp, Artificial
  CRISPR gRNA sequence
gttgagagtgcatttgctac

SEQ ID NO: 615064 - DNA, 20 bp, Artificial
  CRISPR gRNA sequence
agcatatacttgtatcttcc

SEQ ID NO: 615065 - DNA, 20 bp, Artificial
  CRISPR gRNA sequence
ttgtatcttcctagcttcat

SEQ ID NO: 615066 - DNA, 20 bp, Artificial
  CRISPR gRNA sequence
tgtatcttcctagcttcatg

SEQ ID NO: 615067 - DNA, 20 bp, Artificial
  CRISPR gRNA sequence
cttcctagcttcatgaggaa

SEQ ID NO: 615068 - DNA, 20 bp, Artificial
  CRISPR gRNA sequence
ctagcttcatgaggaacaga

SEQ ID NO: 615069 - DNA, 20 bp, Artificial
  CRISPR gRNA sequence
agcttcatgaggaacagaaa

SEQ ID NO: 615070 - DNA, 20 bp, Artificial
  CRISPR gRNA sequence
gcttcatgaggaacagaaag

SEQ ID NO: 615071 - DNA, 20 bp, Artificial
  CRISPR gRNA sequence
tcatgaggaacagaaagagg

SEQ ID NO: 615072 - DNA, 20 bp, Artificial
  CRISPR gRNA sequence
ggaacagaaagaggtggata

SEQ ID NO: 615073 - DNA, 20 bp, Artificial
  CRISPR gRNA sequence
agaaagaggtggatatggct

SEQ ID NO: 615074 - DNA, 20 bp, Artificial
  CRISPR gRNA sequence
gaaagaggtggatatggctc

SEQ ID NO: 615075 - DNA, 20 bp, Artificial
  CRISPR gRNA sequence
aaagaggtggatatggctca

SEQ ID NO: 615076 - DNA, 20 bp, Artificial
  CRISPR gRNA sequence
ggtggatatggctcagggtg

SEQ ID NO: 615077 - DNA, 20 bp, Artificial
  CRISPR gRNA sequence
ggatatggctcagggtgtgg

SEQ ID NO: 615078 - DNA, 20 bp, Artificial
  CRISPR gRNA sequence
gatatggctcagggtgtggc

SEQ ID NO: 615079 - DNA, 20 bp, Artificial
  CRISPR gRNA sequence
atatggctcagggtgtggca

SEQ ID NO: 615080 - DNA, 20 bp, Artificial
  CRISPR gRNA sequence
agggtgtggcagggacaatt

SEQ ID NO: 615081 - DNA, 20 bp, Artificial
  CRISPR gRNA sequence
gggtgtggcagggacaattg

SEQ ID NO: 615082 - DNA, 20 bp, Artificial
  CRISPR gRNA sequence
ggcagggacaattgaggaca

SEQ ID NO: 615083 - DNA, 20 bp, Artificial
  CRISPR gRNA sequence
acaaagtcaattcaaatttg

SEQ ID NO: 615084 - DNA, 20 bp, Artificial
  CRISPR gRNA sequence
caaagtcaattcaaatttgt

SEQ ID NO: 615085 - DNA, 20 bp, Artificial
  CRISPR gRNA sequence
gtcaattcaaatttgtgggt

SEQ ID NO: 615086 - DNA, 20 bp, Artificial
  CRISPR gRNA sequence
attcaaatttgtgggtcaga

SEQ ID NO: 615087 - DNA, 20 bp, Artificial
  CRISPR gRNA sequence
tgggtcagaaagaatttttg

SEQ ID NO: 615088 - DNA, 20 bp, Artificial
  CRISPR gRNA sequence
agaaagaatttttgtggacg

SEQ ID NO: 615089 - DNA, 20 bp, Artificial
  CRISPR gRNA sequence
ttttgtggacgtagtgtttt

SEQ ID NO: 615090 - DNA, 20 bp, Artificial
  CRISPR gRNA sequence
ttgtggacgtagtgtttttg

SEQ ID NO: 615091 - DNA, 20 bp, Artificial
  CRISPR gRNA sequence
tagtgtttttggagaaactc

SEQ ID NO: 615092 - DNA, 20 bp, Artificial
  CRISPR gRNA sequence
gtttttggagaaactctgga

SEQ ID NO: 615093 - DNA, 20 bp, Artificial
  CRISPR gRNA sequence
tgtgcatgccttttcttcaa

SEQ ID NO: 615094 - DNA, 20 bp, Artificial
  CRISPR gRNA sequence
gtgcatgccttttcttcaaa

SEQ ID NO: 615095 - DNA, 20 bp, Artificial
  CRISPR gRNA sequence
ttcttcaaaaggaaatacgc

SEQ ID NO: 615096 - DNA, 20 bp, Artificial
  CRISPR gRNA sequence
tcttcaaaaggaaatacgca

SEQ ID NO: 615097 - DNA, 20 bp, Artificial
  CRISPR gRNA sequence
aaaggaaatacgcaaggttg

SEQ ID NO: 615098 - DNA, 20 bp, Artificial
  CRISPR gRNA sequence
tagcatctaaaaataaacat

SEQ ID NO: 615099 - DNA, 20 bp, Artificial
  CRISPR gRNA sequence
gcatctaaaaataaacataa

SEQ ID NO: 615100 - DNA, 20 bp, Artificial
  CRISPR gRNA sequence
ctaaaaataaacataagagt

SEQ ID NO: 615101 - DNA, 20 bp, Artificial
  CRISPR gRNA sequence
agtcagacaccaaataaatc

SEQ ID NO: 615102 - DNA, 20 bp, Artificial
  CRISPR gRNA sequence
ataaatcaagttttacataa

SEQ ID NO: 615103 - DNA, 20 bp, Artificial
  CRISPR gRNA sequence
ttacataacagttgtatgcc

SEQ ID NO: 615104 - DNA, 20 bp, Artificial
  CRISPR gRNA sequence
agttgtatgcccagtttgtt

SEQ ID NO: 615105 - DNA, 20 bp, Artificial
  CRISPR gRNA sequence
gttgtatgcccagtttgttt

SEQ ID NO: 615106 - DNA, 20 bp, Artificial
  CRISPR gRNA sequence
tatgcccagtttgtttaggt

SEQ ID NO: 615107 - DNA, 20 bp, Artificial
  CRISPR gRNA sequence
ttaggtgagatttcacatta

SEQ ID NO: 615108 - DNA, 20 bp, Artificial
  CRISPR gRNA sequence
gtgagatttcacattacaga

SEQ ID NO: 615109 - DNA, 20 bp, Artificial
  CRISPR gRNA sequence
tcacattacagaaagtattt

SEQ ID NO: 615110 - DNA, 20 bp, Artificial
  CRISPR gRNA sequence
cacattacagaaagtatttg

SEQ ID NO: 615111 - DNA, 20 bp, Artificial
  CRISPR gRNA sequence
cattacagaaagtatttgag

SEQ ID NO: 615112 - DNA, 20 bp, Artificial
  CRISPR gRNA sequence
gtatttgaggagcatgaaaa

SEQ ID NO: 615113 - DNA, 20 bp, Artificial
  CRISPR gRNA sequence
tatttgaggagcatgaaaat

SEQ ID NO: 615114 - DNA, 20 bp, Artificial
  CRISPR gRNA sequence
gggttatcttctgtattttc

SEQ ID NO: 615115 - DNA, 20 bp, Artificial
  CRISPR gRNA sequence
atcttctgtattttccagtt

SEQ ID NO: 615116 - DNA, 20 bp, Artificial
  CRISPR gRNA sequence
tgtattttccagtttggcaa

SEQ ID NO: 615117 - DNA, 20 bp, Artificial
  CRISPR gRNA sequence
tttccagtttggcaaaagtt

SEQ ID NO: 615118 - DNA, 20 bp, Artificial
  CRISPR gRNA sequence
tgctttgccctaattttgcc

SEQ ID NO: 615119 - DNA, 20 bp, Artificial
  CRISPR gRNA sequence
ttttgcccagaattttatct

SEQ ID NO: 615120 - DNA, 20 bp, Artificial
  CRISPR gRNA sequence
ttatcttagcctctctctga

SEQ ID NO: 615121 - DNA, 20 bp, Artificial
  CRISPR gRNA sequence
cagtgatgaatcatgctcaa

SEQ ID NO: 615122 - DNA, 20 bp, Artificial
  CRISPR gRNA sequence
tgctcaaaagccattctaat

SEQ ID NO: 615123 - DNA, 20 bp, Artificial
  CRISPR gRNA sequence
cattctaattggaccttttt

SEQ ID NO: 615124 - DNA, 20 bp, Artificial
  CRISPR gRNA sequence
ctaattggacctttttaaga

SEQ ID NO: 615125 - DNA, 20 bp, Artificial
  CRISPR gRNA sequence
taattggacctttttaagac

SEQ ID NO: 615126 - DNA, 20 bp, Artificial
  CRISPR gRNA sequence
aattggacctttttaagaca

SEQ ID NO: 615127 - DNA, 20 bp, Artificial
  CRISPR gRNA sequence
ggacctttttaagacaggga

SEQ ID NO: 615128 - DNA, 20 bp, Artificial
  CRISPR gRNA sequence
gacctttttaagacagggaa

SEQ ID NO: 615129 - DNA, 20 bp, Artificial
  CRISPR gRNA sequence
acctttttaagacagggaaa

SEQ ID NO: 615130 - DNA, 20 bp, Artificial
  CRISPR gRNA sequence
tttaagacagggaaagggat

SEQ ID NO: 615131 - DNA, 20 bp, Artificial
  CRISPR gRNA sequence
aagacagggaaagggatcag

SEQ ID NO: 615132 - DNA, 20 bp, Artificial
  CRISPR gRNA sequence
agacagggaaagggatcagt

SEQ ID NO: 615133 - DNA, 20 bp, Artificial
  CRISPR gRNA sequence
cagggaaagggatcagtagg

SEQ ID NO: 615134 - DNA, 20 bp, Artificial
  CRISPR gRNA sequence
aaagggatcagtaggcggat

SEQ ID NO: 615135 - DNA, 20 bp, Artificial
  CRISPR gRNA sequence
gggatcagtaggcggattgg

SEQ ID NO: 615136 - DNA, 20 bp, Artificial
  CRISPR gRNA sequence
ggcggattggaagaaatttc

SEQ ID NO: 615137 - DNA, 20 bp, Artificial
  CRISPR gRNA sequence
agtcattgaaatattccatt

SEQ ID NO: 615138 - DNA, 20 bp, Artificial
  CRISPR gRNA sequence
tattccattgagatttccta

SEQ ID NO: 615139 - DNA, 20 bp, Artificial
  CRISPR gRNA sequence
attccattgagatttcctaa

SEQ ID NO: 615140 - DNA, 20 bp, Artificial
  CRISPR gRNA sequence
ttccattgagatttcctaaa

SEQ ID NO: 615141 - DNA, 20 bp, Artificial
  CRISPR gRNA sequence
atttcctaaagggacaaaat

SEQ ID NO: 615142 - DNA, 20 bp, Artificial
  CRISPR gRNA sequence
tttcctaaagggacaaaatt

SEQ ID NO: 615143 - DNA, 20 bp, Artificial
  CRISPR gRNA sequence
agggacaaaattgggaaaat

SEQ ID NO: 615144 - DNA, 20 bp, Artificial
  CRISPR gRNA sequence
gaaaataagaaactacgact

SEQ ID NO: 615145 - DNA, 20 bp, Artificial
  CRISPR gRNA sequence
aagaaactacgacttagatt

SEQ ID NO: 615146 - DNA, 20 bp, Artificial
  CRISPR gRNA sequence
acgacttagatttggctacg

SEQ ID NO: 615147 - DNA, 20 bp, Artificial
  CRISPR gRNA sequence
acttagatttggctacgtag

SEQ ID NO: 615148 - DNA, 20 bp, Artificial
  CRISPR gRNA sequence
agatttggctacgtagtaga

SEQ ID NO: 615149 - DNA, 20 bp, Artificial
  CRISPR gRNA sequence
gtatctcccctacatacata

SEQ ID NO: 615150 - DNA, 20 bp, Artificial
  CRISPR gRNA sequence
tatctcccctacatacatac

SEQ ID NO: 615151 - DNA, 20 bp, Artificial
  CRISPR gRNA sequence
gcaattgtatgtatgaatca

SEQ ID NO: 615152 - DNA, 20 bp, Artificial
  CRISPR gRNA sequence
caattgtatgtatgaatcat

SEQ ID NO: 615153 - DNA, 20 bp, Artificial
  CRISPR gRNA sequence
aattgtatgtatgaatcata

SEQ ID NO: 615154 - DNA, 20 bp, Artificial
  CRISPR gRNA sequence
actacacacacattctttta

SEQ ID NO: 615155 - DNA, 20 bp, Artificial
  CRISPR gRNA sequence
tacacacacattcttttaaa

SEQ ID NO: 615156 - DNA, 20 bp, Artificial
  CRISPR gRNA sequence
attcttttaaagagaattca

SEQ ID NO: 615157 - DNA, 20 bp, Artificial
  CRISPR gRNA sequence
aagagaattcatggaaaaaa

SEQ ID NO: 615158 - DNA, 20 bp, Artificial
  CRISPR gRNA sequence
agaattcatggaaaaaaaag

SEQ ID NO: 615159 - DNA, 20 bp, Artificial
  CRISPR gRNA sequence
ttcatggaaaaaaaagcagt

SEQ ID NO: 615160 - DNA, 20 bp, Artificial
  CRISPR gRNA sequence
catggaaaaaaaagcagttg

SEQ ID NO: 615161 - DNA, 20 bp, Artificial
  CRISPR gRNA sequence
aaaaaagcagttggagtgat

SEQ ID NO: 615162 - DNA, 20 bp, Artificial
  CRISPR gRNA sequence
agatgtattgcaaaaacata

SEQ ID NO: 615163 - DNA, 20 bp, Artificial
  CRISPR gRNA sequence
atgtattgcaaaaacataca

SEQ ID NO: 615164 - DNA, 20 bp, Artificial
  CRISPR gRNA sequence
catacagagaatttaaatga

SEQ ID NO: 615165 - DNA, 20 bp, Artificial
  CRISPR gRNA sequence
tttaaatgacagttaatacc

SEQ ID NO: 615166 - DNA, 20 bp, Artificial
  CRISPR gRNA sequence
gacagttaataccaagaaat

SEQ ID NO: 615167 - DNA, 20 bp, Artificial
  CRISPR gRNA sequence
gttaataccaagaaattagt

SEQ ID NO: 615168 - DNA, 20 bp, Artificial
  CRISPR gRNA sequence
ttaataccaagaaattagtt

SEQ ID NO: 615169 - DNA, 20 bp, Artificial
  CRISPR gRNA sequence
attagttgggtttactttat

SEQ ID NO: 615170 - DNA, 20 bp, Artificial
  CRISPR gRNA sequence
ttagttgggtttactttatc

SEQ ID NO: 615171 - DNA, 20 bp, Artificial
  CRISPR gRNA sequence
tttactttatcaggtcgtaa

SEQ ID NO: 615172 - DNA, 20 bp, Artificial
  CRISPR gRNA sequence
ttactttatcaggtcgtaat

SEQ ID NO: 615173 - DNA, 20 bp, Artificial
  CRISPR gRNA sequence
ggtcgtaataggaatcacta

SEQ ID NO: 615174 - DNA, 20 bp, Artificial
  CRISPR gRNA sequence
cgtaataggaatcactaaag

SEQ ID NO: 615175 - DNA, 20 bp, Artificial
  CRISPR gRNA sequence
ggaatcactaaagaagttac

SEQ ID NO: 615176 - DNA, 20 bp, Artificial
  CRISPR gRNA sequence
agaagttactagtgtgtctt

SEQ ID NO: 615177 - DNA, 20 bp, Artificial
  CRISPR gRNA sequence
gaagttactagtgtgtcttt

SEQ ID NO: 615178 - DNA, 20 bp, Artificial
  CRISPR gRNA sequence
tactagtgtgtctttaggac

SEQ ID NO: 615179 - DNA, 20 bp, Artificial
  CRISPR gRNA sequence
tagtgtgtctttaggaccag

SEQ ID NO: 615180 - DNA, 20 bp, Artificial
  CRISPR gRNA sequence
caactcttaaactaaaactt

SEQ ID NO: 615181 - DNA, 20 bp, Artificial
  CRISPR gRNA sequence
aactcttaaactaaaacttt

SEQ ID NO: 615182 - DNA, 20 bp, Artificial
  CRISPR gRNA sequence
gggtccttattatctactta

SEQ ID NO: 615183 - DNA, 20 bp, Artificial
  CRISPR gRNA sequence
tattatctacttacagaaca

SEQ ID NO: 615184 - DNA, 20 bp, Artificial
  CRISPR gRNA sequence
aagtgaaacaaacaatgatt

SEQ ID NO: 615185 - DNA, 20 bp, Artificial
  CRISPR gRNA sequence
caaacaatgattaagctgat

SEQ ID NO: 615186 - DNA, 20 bp, Artificial
  CRISPR gRNA sequence
gctgattggatatacattca

SEQ ID NO: 615187 - DNA, 20 bp, Artificial
  CRISPR gRNA sequence
attcaaagatatttaatgta

SEQ ID NO: 615188 - DNA, 20 bp, Artificial
  CRISPR gRNA sequence
atatttaatgtaaagttttt

SEQ ID NO: 615189 - DNA, 20 bp, Artificial
  CRISPR gRNA sequence
gtaaagttttttggaatacg

SEQ ID NO: 615190 - DNA, 20 bp, Artificial
  CRISPR gRNA sequence
tttggaatacgaagaaaatt

SEQ ID NO: 615191 - DNA, 20 bp, Artificial
  CRISPR gRNA sequence
cagaaaataaatattatcaa

SEQ ID NO: 615192 - DNA, 20 bp, Artificial
  CRISPR gRNA sequence
tattatcaacagttacttat

SEQ ID NO: 615193 - DNA, 20 bp, Artificial
  CRISPR gRNA sequence
aacagttacttattggcaaa

SEQ ID NO: 615194 - DNA, 20 bp, Artificial
  CRISPR gRNA sequence
cagttacttattggcaaata

SEQ ID NO: 615195 - DNA, 20 bp, Artificial
  CRISPR gRNA sequence
tacttattggcaaatagaga

SEQ ID NO: 615196 - DNA, 20 bp, Artificial
  CRISPR gRNA sequence
attggcaaatagagaaagac

SEQ ID NO: 615197 - DNA, 20 bp, Artificial
  CRISPR gRNA sequence
caaatagagaaagacaagaa

SEQ ID NO: 615198 - DNA, 20 bp, Artificial
  CRISPR gRNA sequence
agagaaagacaagaatagtt

SEQ ID NO: 615199 - DNA, 20 bp, Artificial
  CRISPR gRNA sequence
aaagacaagaatagtttagt

SEQ ID NO: 615200 - DNA, 20 bp, Artificial
  CRISPR gRNA sequence
caagaatagtttagtgagcc

SEQ ID NO: 615201 - DNA, 20 bp, Artificial
  CRISPR gRNA sequence
agcccggtattttgttttta

SEQ ID NO: 615202 - DNA, 20 bp, Artificial
  CRISPR gRNA sequence
tgtttttatagtttttatct

SEQ ID NO: 615203 - DNA, 20 bp, Artificial
  CRISPR gRNA sequence
gtacaactcacaaaaccatg

SEQ ID NO: 615204 - DNA, 20 bp, Artificial
  CRISPR gRNA sequence
tcacaaaaccatgaagtctt

SEQ ID NO: 615205 - DNA, 20 bp, Artificial
  CRISPR gRNA sequence
atgtttaacaaaatttacat

SEQ ID NO: 615206 - DNA, 20 bp, Artificial
  CRISPR gRNA sequence
aacaaaatttacatcagatt

SEQ ID NO: 615207 - DNA, 20 bp, Artificial
  CRISPR gRNA sequence
acaaaatttacatcagatta

SEQ ID NO: 615208 - DNA, 20 bp, Artificial
  CRISPR gRNA sequence
ttacatcagattaaggcatt

SEQ ID NO: 615209 - DNA, 20 bp, Artificial
  CRISPR gRNA sequence
ctatctccaaaatgatttct

SEQ ID NO: 615210 - DNA, 20 bp, Artificial
  CRISPR gRNA sequence
tatctccaaaatgatttctt

SEQ ID NO: 615211 - DNA, 20 bp, Artificial
  CRISPR gRNA sequence
atctccaaaatgatttctta

SEQ ID NO: 615212 - DNA, 20 bp, Artificial
  CRISPR gRNA sequence
atgatttcttagggtacaaa

SEQ ID NO: 615213 - DNA, 20 bp, Artificial
  CRISPR gRNA sequence
gatttcttagggtacaaaaa

SEQ ID NO: 615214 - DNA, 20 bp, Artificial
  CRISPR gRNA sequence
ttcttagggtacaaaaagag

SEQ ID NO: 615215 - DNA, 20 bp, Artificial
  CRISPR gRNA sequence
tagggtacaaaaagagcaga

SEQ ID NO: 615216 - DNA, 20 bp, Artificial
  CRISPR gRNA sequence
agggtacaaaaagagcagac

SEQ ID NO: 615217 - DNA, 20 bp, Artificial
  CRISPR gRNA sequence
gggtacaaaaagagcagacg

SEQ ID NO: 615218 - DNA, 20 bp, Artificial
  CRISPR gRNA sequence
agacggggctgtaaaaatac

SEQ ID NO: 615219 - DNA, 20 bp, Artificial
  CRISPR gRNA sequence
agcaaaaaactgtgtgcccc

SEQ ID NO: 615220 - DNA, 20 bp, Artificial
  CRISPR gRNA sequence
aaactgtgtgcccctagttt

SEQ ID NO: 615221 - DNA, 20 bp, Artificial
  CRISPR gRNA sequence
aactgtgtgcccctagtttc

SEQ ID NO: 615222 - DNA, 20 bp, Artificial
  CRISPR gRNA sequence
tgtgtgcccctagtttcagg

SEQ ID NO: 615223 - DNA, 20 bp, Artificial
  CRISPR gRNA sequence
tcaggcagaacttaaactgt

SEQ ID NO: 615224 - DNA, 20 bp, Artificial
  CRISPR gRNA sequence
aggcagaacttaaactgtca

SEQ ID NO: 615225 - DNA, 20 bp, Artificial
  CRISPR gRNA sequence
ggcagaacttaaactgtcag

SEQ ID NO: 615226 - DNA, 20 bp, Artificial
  CRISPR gRNA sequence
acttaaactgtcagaggtac

SEQ ID NO: 615227 - DNA, 20 bp, Artificial
  CRISPR gRNA sequence
catgatttgttttttaactt

SEQ ID NO: 615228 - DNA, 20 bp, Artificial
  CRISPR gRNA sequence
ggattgttcacgtccaaaaa

SEQ ID NO: 615229 - DNA, 20 bp, Artificial
  CRISPR gRNA sequence
attacatttgtgtttatcat

SEQ ID NO: 615230 - DNA, 20 bp, Artificial
  CRISPR gRNA sequence
taataaatactatctgaatg

SEQ ID NO: 615231 - DNA, 20 bp, Artificial
  CRISPR gRNA sequence
gaatgaagactattctaaac

SEQ ID NO: 615232 - DNA, 20 bp, Artificial
  CRISPR gRNA sequence
agaaaattccccaaatccaa

SEQ ID NO: 615233 - DNA, 20 bp, Artificial
  CRISPR gRNA sequence
ccaaatccaaaagaaaaaaa

SEQ ID NO: 615234 - DNA, 20 bp, Artificial
  CRISPR gRNA sequence
aatccaaaagaaaaaaaaag

SEQ ID NO: 615235 - DNA, 20 bp, Artificial
  CRISPR gRNA sequence
atccaaaagaaaaaaaaagt

SEQ ID NO: 615236 - DNA, 20 bp, Artificial
  CRISPR gRNA sequence
caaaagaaaaaaaaagtggg

SEQ ID NO: 615237 - DNA, 20 bp, Artificial
  CRISPR gRNA sequence
aaagaaaaaaaaagtgggaa

SEQ ID NO: 615238 - DNA, 20 bp, Artificial
  CRISPR gRNA sequence
aagaaaaaaaaagtgggaag

SEQ ID NO: 615239 - DNA, 20 bp, Artificial
  CRISPR gRNA sequence
agtgggaagaggtgaaattg

SEQ ID NO: 615240 - DNA, 20 bp, Artificial
  CRISPR gRNA sequence
attgaagtttgtgtatatga

SEQ ID NO: 615241 - DNA, 20 bp, Artificial
  CRISPR gRNA sequence
tgtgtatatgaaagttatct

SEQ ID NO: 615242 - DNA, 20 bp, Artificial
  CRISPR gRNA sequence
tagacatatttttaattctc

SEQ ID NO: 615243 - DNA, 20 bp, Artificial
  CRISPR gRNA sequence
tgcaaaataattaaaatata

SEQ ID NO: 615244 - DNA, 20 bp, Artificial
  CRISPR gRNA sequence
taattaaaatatacagtaac

SEQ ID NO: 615245 - DNA, 20 bp, Artificial
  CRISPR gRNA sequence
aatacttatgttctttatat

SEQ ID NO: 615246 - DNA, 20 bp, Artificial
  CRISPR gRNA sequence
gtgcctttttaaaatgcatt

SEQ ID NO: 615247 - DNA, 20 bp, Artificial
  CRISPR gRNA sequence
gcctttttaaaatgcattga

SEQ ID NO: 615248 - DNA, 20 bp, Artificial
  CRISPR gRNA sequence
ttaaaatgcattgagagtgt

SEQ ID NO: 615249 - DNA, 20 bp, Artificial
  CRISPR gRNA sequence
aatgcattgagagtgttggt

SEQ ID NO: 615250 - DNA, 20 bp, Artificial
  CRISPR gRNA sequence
agagtgttggttagctgttg

SEQ ID NO: 615251 - DNA, 20 bp, Artificial
  CRISPR gRNA sequence
tttaaaaatcacttaaaatt

SEQ ID NO: 615252 - DNA, 20 bp, Artificial
  CRISPR gRNA sequence
ataattcatctctgcatttt

SEQ ID NO: 615253 - DNA, 20 bp, Artificial
  CRISPR gRNA sequence
gcatttttagtgcaaatctt

SEQ ID NO: 615254 - DNA, 20 bp, Artificial
  CRISPR gRNA sequence
atttttagtgcaaatcttta

SEQ ID NO: 615255 - DNA, 20 bp, Artificial
  CRISPR gRNA sequence
atctttagagcaatttctaa

SEQ ID NO: 615256 - DNA, 20 bp, Artificial
  CRISPR gRNA sequence
ctttagagcaatttctaata

SEQ ID NO: 615257 - DNA, 20 bp, Artificial
  CRISPR gRNA sequence
atttctaatagagaaatttt

SEQ ID NO: 615258 - DNA, 20 bp, Artificial
  CRISPR gRNA sequence
taatagagaaattttcagct

SEQ ID NO: 615259 - DNA, 20 bp, Artificial
  CRISPR gRNA sequence
attttcagctcagctgttaa

SEQ ID NO: 615260 - DNA, 20 bp, Artificial
  CRISPR gRNA sequence
ttttcagctcagctgttaaa

SEQ ID NO: 615261 - DNA, 20 bp, Artificial
  CRISPR gRNA sequence
agctcagctgttaaaaggaa

SEQ ID NO: 615262 - DNA, 20 bp, Artificial
  CRISPR gRNA sequence
gctcagctgttaaaaggaaa

SEQ ID NO: 615263 - DNA, 20 bp, Artificial
  CRISPR gRNA sequence
ggaaaaggaaactttgaaac

SEQ ID NO: 615264 - DNA, 20 bp, Artificial
  CRISPR gRNA sequence
actagactttactacctttt

SEQ ID NO: 615265 - DNA, 20 bp, Artificial
  CRISPR gRNA sequence
ttactacctttttagtttca

SEQ ID NO: 615266 - DNA, 20 bp, Artificial
  CRISPR gRNA sequence
gtatttctgaatatgattac

SEQ ID NO: 615267 - DNA, 20 bp, Artificial
  CRISPR gRNA sequence
aatatgattacaagattatg

SEQ ID NO: 615268 - DNA, 20 bp, Artificial
  CRISPR gRNA sequence
atatgattacaagattatgc

SEQ ID NO: 615269 - DNA, 20 bp, Artificial
  CRISPR gRNA sequence
aagattatgcaggtaaaata

SEQ ID NO: 615270 - DNA, 20 bp, Artificial
  CRISPR gRNA sequence
gattatgcaggtaaaatata

SEQ ID NO: 615271 - DNA, 20 bp, Artificial
  CRISPR gRNA sequence
tgtgtttttgttttgttttt

SEQ ID NO: 615272 - DNA, 20 bp, Artificial
  CRISPR gRNA sequence
gtgtttttgttttgttttta

SEQ ID NO: 615273 - DNA, 20 bp, Artificial
  CRISPR gRNA sequence
tttttgttttgtttttaagg

SEQ ID NO: 615274 - DNA, 20 bp, Artificial
  CRISPR gRNA sequence
ttttgtttttaaggaagaat

SEQ ID NO: 615275 - DNA, 20 bp, Artificial
  CRISPR gRNA sequence
gaataagttctgtatcaaac

SEQ ID NO: 615276 - DNA, 20 bp, Artificial
  CRISPR gRNA sequence
tgtatcaaacaagaatttat

SEQ ID NO: 615277 - DNA, 20 bp, Artificial
  CRISPR gRNA sequence
gaatttattagataattttt

SEQ ID NO: 615278 - DNA, 20 bp, Artificial
  CRISPR gRNA sequence
attttttggtcaataaaata

SEQ ID NO: 615279 - DNA, 20 bp, Artificial
  CRISPR gRNA sequence
aataaaatacagtattcatt

SEQ ID NO: 615280 - DNA, 20 bp, Artificial
  CRISPR gRNA sequence
ttcatttggattttcatctc

SEQ ID NO: 615281 - DNA, 20 bp, Artificial
  CRISPR gRNA sequence
ttggattttcatctccagac

SEQ ID NO: 615282 - DNA, 20 bp, Artificial
  CRISPR gRNA sequence
tctccagactagtattgttc

SEQ ID NO: 615283 - DNA, 20 bp, Artificial
  CRISPR gRNA sequence
gactagtattgttctagtct

SEQ ID NO: 615284 - DNA, 20 bp, Artificial
  CRISPR gRNA sequence
atctgtattttctaatctgt

SEQ ID NO: 615285 - DNA, 20 bp, Artificial
  CRISPR gRNA sequence
ttttctaatctgttagaaaa

SEQ ID NO: 615286 - DNA, 20 bp, Artificial
  CRISPR gRNA sequence
ttctaatctgttagaaaata

SEQ ID NO: 615287 - DNA, 20 bp, Artificial
  CRISPR gRNA sequence
aaatagagattgaaaattga

SEQ ID NO: 615288 - DNA, 20 bp, Artificial
  CRISPR gRNA sequence
attgatggaataatgtgaaa

SEQ ID NO: 615289 - DNA, 20 bp, Artificial
  CRISPR gRNA sequence
gatggaataatgtgaaaaag

SEQ ID NO: 615290 - DNA, 20 bp, Artificial
  CRISPR gRNA sequence
atggaataatgtgaaaaagc

SEQ ID NO: 615291 - DNA, 20 bp, Artificial
  CRISPR gRNA sequence
taattaattctccttgaaca

SEQ ID NO: 615292 - DNA, 20 bp, Artificial
  CRISPR gRNA sequence
ttgaacaaagcaaaactgaa

SEQ ID NO: 615293 - DNA, 20 bp, Artificial
  CRISPR gRNA sequence
tatcacattgctattctcca

SEQ ID NO: 615294 - DNA, 20 bp, Artificial
  CRISPR gRNA sequence
ctccaaagcataatctcaaa

SEQ ID NO: 615295 - DNA, 20 bp, Artificial
  CRISPR gRNA sequence
tctcaaatggtttcatatca

SEQ ID NO: 615296 - DNA, 20 bp, Artificial
  CRISPR gRNA sequence
tggttgtgtattacttgcaa

SEQ ID NO: 615297 - DNA, 20 bp, Artificial
  CRISPR gRNA sequence
ggttgtgtattacttgcaat

SEQ ID NO: 615298 - DNA, 20 bp, Artificial
  CRISPR gRNA sequence
attacttgcaatgggtgtgt

SEQ ID NO: 615299 - DNA, 20 bp, Artificial
  CRISPR gRNA sequence
ttacttgcaatgggtgtgtt

SEQ ID NO: 615300 - DNA, 20 bp, Artificial
  CRISPR gRNA sequence
atgggtgtgttaggatatga

SEQ ID NO: 615301 - DNA, 20 bp, Artificial
  CRISPR gRNA sequence
tgacagctttttaaaaaaat

SEQ ID NO: 615302 - DNA, 20 bp, Artificial
  CRISPR gRNA sequence
tttttaaaaaaatgagctgc

SEQ ID NO: 615303 - DNA, 20 bp, Artificial
  CRISPR gRNA sequence
aatgagctgctggttataca

SEQ ID NO: 615304 - DNA, 20 bp, Artificial
  CRISPR gRNA sequence
tgctggttatacaaagcaaa

SEQ ID NO: 615305 - DNA, 20 bp, Artificial
  CRISPR gRNA sequence
aaagcaaatggcatatgacc

SEQ ID NO: 615306 - DNA, 20 bp, Artificial
  CRISPR gRNA sequence
gcaaatggcatatgaccaag

SEQ ID NO: 615307 - DNA, 20 bp, Artificial
  CRISPR gRNA sequence
accaagaagctgtgatatgc

SEQ ID NO: 615308 - DNA, 20 bp, Artificial
  CRISPR gRNA sequence
gctagtgtttctttttatca

SEQ ID NO: 615309 - DNA, 20 bp, Artificial
  CRISPR gRNA sequence
tttttatcatagtgtattac

SEQ ID NO: 615310 - DNA, 20 bp, Artificial
  CRISPR gRNA sequence
ttttatcatagtgtattact

SEQ ID NO: 615311 - DNA, 20 bp, Artificial
  CRISPR gRNA sequence
gaatatttttacatttattg

SEQ ID NO: 615312 - DNA, 20 bp, Artificial
  CRISPR gRNA sequence
attgcagaaaccttaaactt

SEQ ID NO: 615313 - DNA, 20 bp, Artificial
  CRISPR gRNA sequence
ttaaactttggaatttccat

SEQ ID NO: 615314 - DNA, 20 bp, Artificial
  CRISPR gRNA sequence
taaactttggaatttccata

SEQ ID NO: 615315 - DNA, 20 bp, Artificial
  CRISPR gRNA sequence
tttatgtaatattctatttc

SEQ ID NO: 615316 - DNA, 20 bp, Artificial
  CRISPR gRNA sequence
atattctatttctagctttt

SEQ ID NO: 615317 - DNA, 20 bp, Artificial
  CRISPR gRNA sequence
gttttatcttgctgtactgt

SEQ ID NO: 615318 - DNA, 20 bp, Artificial
  CRISPR gRNA sequence
tcttgctgtactgtaagttt

SEQ ID NO: 615319 - DNA, 20 bp, Artificial
  CRISPR gRNA sequence
cttgctgtactgtaagtttg

SEQ ID NO: 615320 - DNA, 20 bp, Artificial
  CRISPR gRNA sequence
atatttttcacctgcactct

SEQ ID NO: 615321 - DNA, 20 bp, Artificial
  CRISPR gRNA sequence
tatttttcacctgcactctt

SEQ ID NO: 615322 - DNA, 20 bp, Artificial
  CRISPR gRNA sequence
tcacctgcactcttaggaat

SEQ ID NO: 615323 - DNA, 20 bp, Artificial
  CRISPR gRNA sequence
taagttcataattctgttta

SEQ ID NO: 615324 - DNA, 20 bp, Artificial
  CRISPR gRNA sequence
aagttcataattctgtttat

SEQ ID NO: 615325 - DNA, 20 bp, Artificial
  CRISPR gRNA sequence
agttcataattctgtttatg

SEQ ID NO: 615326 - DNA, 20 bp, Artificial
  CRISPR gRNA sequence
gtattaacctttatcccata

SEQ ID NO: 615327 - DNA, 20 bp, Artificial
  CRISPR gRNA sequence
attaacctttatcccataca

SEQ ID NO: 615328 - DNA, 20 bp, Artificial
  CRISPR gRNA sequence
taacctttatcccatacaga

SEQ ID NO: 615329 - DNA, 20 bp, Artificial
  CRISPR gRNA sequence
cctttatcccatacagagag

SEQ ID NO: 615330 - DNA, 20 bp, Artificial
  CRISPR gRNA sequence
gagagtggtacatgaatgac

SEQ ID NO: 615331 - DNA, 20 bp, Artificial
  CRISPR gRNA sequence
acatgaatgactagttttct

SEQ ID NO: 615332 - DNA, 20 bp, Artificial
  CRISPR gRNA sequence
ttattgtgaataaaatataa

SEQ ID NO: 615333 - DNA, 20 bp, Artificial
  CRISPR gRNA sequence
tgaataaaatataaaagtta

SEQ ID NO: 615334 - DNA, 20 bp, Artificial
  CRISPR gRNA sequence
gaataaaatataaaagttaa

SEQ ID NO: 615335 - DNA, 20 bp, Artificial
  CRISPR gRNA sequence
aaagttaaaggccctctgct

SEQ ID NO: 615336 - DNA, 20 bp, Artificial
  CRISPR gRNA sequence
gccctctgctaagtcacata

SEQ ID NO: 615337 - DNA, 20 bp, Artificial
  CRISPR gRNA sequence
ctgctaagtcacataaagta

SEQ ID NO: 615338 - DNA, 20 bp, Artificial
  CRISPR gRNA sequence
tcacataaagtacagcatat

SEQ ID NO: 615339 - DNA, 20 bp, Artificial
  CRISPR gRNA sequence
gtacagcatataagttcata

SEQ ID NO: 615340 - DNA, 20 bp, Artificial
  CRISPR gRNA sequence
tacagcatataagttcatat

SEQ ID NO: 615341 - DNA, 20 bp, Artificial
  CRISPR gRNA sequence
tcatataggtacaaataaat

SEQ ID NO: 615342 - DNA, 20 bp, Artificial
  CRISPR gRNA sequence
ggtacaaataaatgagtttg

SEQ ID NO: 615343 - DNA, 20 bp, Artificial
  CRISPR gRNA sequence
taaatgagtttgcagtgaat

SEQ ID NO: 615344 - DNA, 20 bp, Artificial
  CRISPR gRNA sequence
aaatgagtttgcagtgaatt

SEQ ID NO: 615345 - DNA, 20 bp, Artificial
  CRISPR gRNA sequence
ttgggccttcaaattacctc

SEQ ID NO: 615346 - DNA, 20 bp, Artificial
  CRISPR gRNA sequence
cttcaaattacctcaagtga

SEQ ID NO: 615347 - DNA, 20 bp, Artificial
  CRISPR gRNA sequence
aaattacctcaagtgacaga

SEQ ID NO: 615348 - DNA, 20 bp, Artificial
  CRISPR gRNA sequence
tacctcaagtgacagatagt

SEQ ID NO: 615349 - DNA, 20 bp, Artificial
  CRISPR gRNA sequence
caagtgacagatagtaagaa

SEQ ID NO: 615350 - DNA, 20 bp, Artificial
  CRISPR gRNA sequence
gatagtaagaaaagcttctt

SEQ ID NO: 615351 - DNA, 20 bp, Artificial
  CRISPR gRNA sequence
agtaagaaaagcttcttgag

SEQ ID NO: 615352 - DNA, 20 bp, Artificial
  CRISPR gRNA sequence
gtaagaaaagcttcttgagc

SEQ ID NO: 615353 - DNA, 20 bp, Artificial
  CRISPR gRNA sequence
agaaaagcttcttgagcagg

SEQ ID NO: 615354 - DNA, 20 bp, Artificial
  CRISPR gRNA sequence
aaaagcttcttgagcaggtg

SEQ ID NO: 615355 - DNA, 20 bp, Artificial
  CRISPR gRNA sequence
aaagcttcttgagcaggtgg

SEQ ID NO: 615356 - DNA, 20 bp, Artificial
  CRISPR gRNA sequence
tcccctactatgcacttacc

SEQ ID NO: 615357 - DNA, 20 bp, Artificial
  CRISPR gRNA sequence
ttttacttactttaatttac

SEQ ID NO: 615358 - DNA, 20 bp, Artificial
  CRISPR gRNA sequence
aaaaatgactacactgtaac

SEQ ID NO: 615359 - DNA, 20 bp, Artificial
  CRISPR gRNA sequence
aaaatgactacactgtaaca

SEQ ID NO: 615360 - DNA, 20 bp, Artificial
  CRISPR gRNA sequence
aaatgactacactgtaacaa

SEQ ID NO: 615361 - DNA, 20 bp, Artificial
  CRISPR gRNA sequence
tgactacactgtaacaaggg

SEQ ID NO: 615362 - DNA, 20 bp, Artificial
  CRISPR gRNA sequence
gactacactgtaacaaggga

SEQ ID NO: 615363 - DNA, 20 bp, Artificial
  CRISPR gRNA sequence
actacactgtaacaagggaa

SEQ ID NO: 615364 - DNA, 20 bp, Artificial
  CRISPR gRNA sequence
ctgtaacaagggaagggatc

SEQ ID NO: 615365 - DNA, 20 bp, Artificial
  CRISPR gRNA sequence
tgtaacaagggaagggatct

SEQ ID NO: 615366 - DNA, 20 bp, Artificial
  CRISPR gRNA sequence
gttttattcttgtttttttt

SEQ ID NO: 615367 - DNA, 20 bp, Artificial
  CRISPR gRNA sequence
ttattcttgttttttttaag

SEQ ID NO: 615368 - DNA, 20 bp, Artificial
  CRISPR gRNA sequence
tgtgatttaaaaatttttta

SEQ ID NO: 615369 - DNA, 20 bp, Artificial
  CRISPR gRNA sequence
tttaaaaattttttacagtc

SEQ ID NO: 615370 - DNA, 20 bp, Artificial
  CRISPR gRNA sequence
ccttccctttctgtgtaaca

SEQ ID NO: 615371 - DNA, 20 bp, Artificial
  CRISPR gRNA sequence
cttccctttctgtgtaacaa

SEQ ID NO: 615372 - DNA, 20 bp, Artificial
  CRISPR gRNA sequence
aaattttgttacatctccct

SEQ ID NO: 615373 - DNA, 20 bp, Artificial
  CRISPR gRNA sequence
ctcccttctgtcattgtcta

SEQ ID NO: 615374 - DNA, 20 bp, Artificial
  CRISPR gRNA sequence
ttacctctctgttctcctaa

SEQ ID NO: 615375 - DNA, 20 bp, Artificial
  CRISPR gRNA sequence
tctgttctcctaaaagtttg

SEQ ID NO: 615376 - DNA, 20 bp, Artificial
  CRISPR gRNA sequence
tctcctaaaagtttgaagat

SEQ ID NO: 615377 - DNA, 20 bp, Artificial
  CRISPR gRNA sequence
ctcctaaaagtttgaagatt

SEQ ID NO: 615378 - DNA, 20 bp, Artificial
  CRISPR gRNA sequence
attaggtcaactcttatttc

SEQ ID NO: 615379 - DNA, 20 bp, Artificial
  CRISPR gRNA sequence
aactcttatttctagttcat

SEQ ID NO: 615380 - DNA, 20 bp, Artificial
  CRISPR gRNA sequence
ttttttttcgtgatttttgt

SEQ ID NO: 615381 - DNA, 20 bp, Artificial
  CRISPR gRNA sequence
gctgacgtatttttatactc

SEQ ID NO: 615382 - DNA, 20 bp, Artificial
  CRISPR gRNA sequence
cgtatttttatactcaagtg

SEQ ID NO: 615383 - DNA, 20 bp, Artificial
  CRISPR gRNA sequence
aagtgtagttttctattaaa

SEQ ID NO: 615384 - DNA, 20 bp, Artificial
  CRISPR gRNA sequence
tagttttctattaaaaagaa

SEQ ID NO: 615385 - DNA, 20 bp, Artificial
  CRISPR gRNA sequence
ttttctattaaaaagaaaag

SEQ ID NO: 615386 - DNA, 20 bp, Artificial
  CRISPR gRNA sequence
ctattaaaaagaaaagtggt

SEQ ID NO: 615387 - DNA, 20 bp, Artificial
  CRISPR gRNA sequence
aaaagtggttggattaaaaa

SEQ ID NO: 615388 - DNA, 20 bp, Artificial
  CRISPR gRNA sequence
gtggttggattaaaaatagt

SEQ ID NO: 615389 - DNA, 20 bp, Artificial
  CRISPR gRNA sequence
ttactttcactttcaaatat

SEQ ID NO: 615390 - DNA, 20 bp, Artificial
  CRISPR gRNA sequence
tactttcactttcaaatatt

SEQ ID NO: 615391 - DNA, 20 bp, Artificial
  CRISPR gRNA sequence
gggtacctaaaacattactt

SEQ ID NO: 615392 - DNA, 20 bp, Artificial
  CRISPR gRNA sequence
gtacctaaaacattacttca

SEQ ID NO: 615393 - DNA, 20 bp, Artificial
  CRISPR gRNA sequence
gagattatgtaatcctatta

SEQ ID NO: 615394 - DNA, 20 bp, Artificial
  CRISPR gRNA sequence
tgtttgctttcctttattgt

SEQ ID NO: 615395 - DNA, 20 bp, Artificial
  CRISPR gRNA sequence
ttggattttacattctgatt

SEQ ID NO: 615396 - DNA, 20 bp, Artificial
  CRISPR gRNA sequence
ccaaaaaatgtatatcatga

SEQ ID NO: 615397 - DNA, 20 bp, Artificial
  CRISPR gRNA sequence
aaatgtatatcatgaaagac

SEQ ID NO: 615398 - DNA, 20 bp, Artificial
  CRISPR gRNA sequence
gtatatcatgaaagactaga

SEQ ID NO: 615399 - DNA, 20 bp, Artificial
  CRISPR gRNA sequence
aagactagacagttatttgc

SEQ ID NO: 615400 - DNA, 20 bp, Artificial
  CRISPR gRNA sequence
gacagttatttgcaagtgtt

SEQ ID NO: 615401 - DNA, 20 bp, Artificial
  CRISPR gRNA sequence
gttatttgcaagtgtttaga

SEQ ID NO: 615402 - DNA, 20 bp, Artificial
  CRISPR gRNA sequence
ttatttgcaagtgtttagaa

SEQ ID NO: 615403 - DNA, 20 bp, Artificial
  CRISPR gRNA sequence
agaaaggtgttaaaaatgta

SEQ ID NO: 615404 - DNA, 20 bp, Artificial
  CRISPR gRNA sequence
ggtgttaaaaatgtaaagca

SEQ ID NO: 615405 - DNA, 20 bp, Artificial
  CRISPR gRNA sequence
tgttaaaaatgtaaagcaaa

SEQ ID NO: 615406 - DNA, 20 bp, Artificial
  CRISPR gRNA sequence
agtcttaactttctcctaat

SEQ ID NO: 615407 - DNA, 20 bp, Artificial
  CRISPR gRNA sequence
gtcttaactttctcctaatt

SEQ ID NO: 615408 - DNA, 20 bp, Artificial
  CRISPR gRNA sequence
cttaactttctcctaattgg

SEQ ID NO: 615409 - DNA, 20 bp, Artificial
  CRISPR gRNA sequence
acattactataataatattc

SEQ ID NO: 615410 - DNA, 20 bp, Artificial
  CRISPR gRNA sequence
cattactataataatattcc

SEQ ID NO: 615411 - DNA, 20 bp, Artificial
  CRISPR gRNA sequence
ctataataatattccaggtt

SEQ ID NO: 615412 - DNA, 20 bp, Artificial
  CRISPR gRNA sequence
ataataatattccaggtttg

SEQ ID NO: 615413 - DNA, 20 bp, Artificial
  CRISPR gRNA sequence
taataatattccaggtttgg

SEQ ID NO: 615414 - DNA, 20 bp, Artificial
  CRISPR gRNA sequence
aataatattccaggtttgga

SEQ ID NO: 615415 - DNA, 20 bp, Artificial
  CRISPR gRNA sequence
ataatattccaggtttggag

SEQ ID NO: 615416 - DNA, 20 bp, Artificial
  CRISPR gRNA sequence
taatattccaggtttggagg

SEQ ID NO: 615417 - DNA, 20 bp, Artificial
  CRISPR gRNA sequence
ccaggtttggagggggtctc

SEQ ID NO: 615418 - DNA, 20 bp, Artificial
  CRISPR gRNA sequence
caggtttggagggggtctcc

SEQ ID NO: 615419 - DNA, 20 bp, Artificial
  CRISPR gRNA sequence
ggccccatatttgctgttaa

SEQ ID NO: 615420 - DNA, 20 bp, Artificial
  CRISPR gRNA sequence
ccatatttgctgttaatagt

SEQ ID NO: 615421 - DNA, 20 bp, Artificial
  CRISPR gRNA sequence
ctgttaatagttggaccttt

SEQ ID NO: 615422 - DNA, 20 bp, Artificial
  CRISPR gRNA sequence
ccatgtgttatttgcaatcc

SEQ ID NO: 615423 - DNA, 20 bp, Artificial
  CRISPR gRNA sequence
agaatgattgcttctgctat

SEQ ID NO: 615424 - DNA, 20 bp, Artificial
  CRISPR gRNA sequence
tgcttctgctattagttaaa

SEQ ID NO: 615425 - DNA, 20 bp, Artificial
  CRISPR gRNA sequence
ctattcttttctttctgtac

SEQ ID NO: 615426 - DNA, 20 bp, Artificial
  CRISPR gRNA sequence
caagtgcaatactccccttg

SEQ ID NO: 615427 - DNA, 20 bp, Artificial
  CRISPR gRNA sequence
ccttgaagtcttaaaaacta

SEQ ID NO: 615428 - DNA, 20 bp, Artificial
  CRISPR gRNA sequence
tttctgacctattcttcctt

SEQ ID NO: 615429 - DNA, 20 bp, Artificial
  CRISPR gRNA sequence
ttcctttagctaatgacaaa

SEQ ID NO: 615430 - DNA, 20 bp, Artificial
  CRISPR gRNA sequence
tgacaaaaagaaactcataa

SEQ ID NO: 615431 - DNA, 20 bp, Artificial
  CRISPR gRNA sequence
aaagaaactcataaaagtca

SEQ ID NO: 615432 - DNA, 20 bp, Artificial
  CRISPR gRNA sequence
ataaaagtcatagtatgtta

SEQ ID NO: 615433 - DNA, 20 bp, Artificial
  CRISPR gRNA sequence
taaaagtcatagtatgttaa

SEQ ID NO: 615434 - DNA, 20 bp, Artificial
  CRISPR gRNA sequence
agtatgttaaaggacacaac

SEQ ID NO: 615435 - DNA, 20 bp, Artificial
  CRISPR gRNA sequence
gttaaaggacacaacaagca

SEQ ID NO: 615436 - DNA, 20 bp, Artificial
  CRISPR gRNA sequence
taaaggacacaacaagcaaa

SEQ ID NO: 615437 - DNA, 20 bp, Artificial
  CRISPR gRNA sequence
gaaaaacactccacaatcaa

SEQ ID NO: 615438 - DNA, 20 bp, Artificial
  CRISPR gRNA sequence
actccacaatcaaaagatta

SEQ ID NO: 615439 - DNA, 20 bp, Artificial
  CRISPR gRNA sequence
aatcaaaagattacagaatg

SEQ ID NO: 615440 - DNA, 20 bp, Artificial
  CRISPR gRNA sequence
ttacagaatgtggaaaccac

SEQ ID NO: 615441 - DNA, 20 bp, Artificial
  CRISPR gRNA sequence
aaaccactagtctgatctca

SEQ ID NO: 615442 - DNA, 20 bp, Artificial
  CRISPR gRNA sequence
atctcatggtatctttattt

SEQ ID NO: 615443 - DNA, 20 bp, Artificial
  CRISPR gRNA sequence
ttatttaagctaaatttcca

SEQ ID NO: 615444 - DNA, 20 bp, Artificial
  CRISPR gRNA sequence
agctaaatttccatggaaat

SEQ ID NO: 615445 - DNA, 20 bp, Artificial
  CRISPR gRNA sequence
tgcttgaaaaatgtgtccta

SEQ ID NO: 615446 - DNA, 20 bp, Artificial
  CRISPR gRNA sequence
tcctaaagttgaacttttta

SEQ ID NO: 615447 - DNA, 20 bp, Artificial
  CRISPR gRNA sequence
ttttacagattgaatcttct

SEQ ID NO: 615448 - DNA, 20 bp, Artificial
  CRISPR gRNA sequence
ctcgcccaatgctctaaatt

SEQ ID NO: 615449 - DNA, 20 bp, Artificial
  CRISPR gRNA sequence
ttattttacttctccccttt

SEQ ID NO: 615450 - DNA, 20 bp, Artificial
  CRISPR gRNA sequence
agaaataaacttttaaataa

SEQ ID NO: 615451 - DNA, 20 bp, Artificial
  CRISPR gRNA sequence
taaacttttaaataaaagca

SEQ ID NO: 615452 - DNA, 20 bp, Artificial
  CRISPR gRNA sequence
ttaaataaaagcaaagcact

SEQ ID NO: 615453 - DNA, 20 bp, Artificial
  CRISPR gRNA sequence
taaaagcaaagcacttagct

SEQ ID NO: 615454 - DNA, 20 bp, Artificial
  CRISPR gRNA sequence
aacacttacatatcacctat

SEQ ID NO: 615455 - DNA, 20 bp, Artificial
  CRISPR gRNA sequence
cacttacatatcacctattg

SEQ ID NO: 615456 - DNA, 20 bp, Artificial
  CRISPR gRNA sequence
aaattttttttaaaaatatt

SEQ ID NO: 615457 - DNA, 20 bp, Artificial
  CRISPR gRNA sequence
attttttttaaaaatatttg

SEQ ID NO: 615458 - DNA, 20 bp, Artificial
  CRISPR gRNA sequence
ttttttaaaaatatttggag

SEQ ID NO: 615459 - DNA, 20 bp, Artificial
  CRISPR gRNA sequence
tcctgttttcatacaaattt

SEQ ID NO: 615460 - DNA, 20 bp, Artificial
  CRISPR gRNA sequence
gttttcatacaaatttaagt

SEQ ID NO: 615461 - DNA, 20 bp, Artificial
  CRISPR gRNA sequence
tttcatacaaatttaagtaa

SEQ ID NO: 615462 - DNA, 20 bp, Artificial
  CRISPR gRNA sequence
ttcatacaaatttaagtaag

SEQ ID NO: 615463 - DNA, 20 bp, Artificial
  CRISPR gRNA sequence
ttcttatacatatttatatg

SEQ ID NO: 615464 - DNA, 20 bp, Artificial
  CRISPR gRNA sequence
tttttatacctgtgtccctg

SEQ ID NO: 615465 - DNA, 20 bp, Artificial
  CRISPR gRNA sequence
ataaatacatgttttgttaa

SEQ ID NO: 615466 - DNA, 20 bp, Artificial
  CRISPR gRNA sequence
gttaaaagataacatttctt

SEQ ID NO: 615467 - DNA, 20 bp, Artificial
  CRISPR gRNA sequence
tttctttggcatttctttta

SEQ ID NO: 615468 - DNA, 20 bp, Artificial
  CRISPR gRNA sequence
ttctttggcatttcttttaa

SEQ ID NO: 615469 - DNA, 20 bp, Artificial
  CRISPR gRNA sequence
tttggcatttcttttaaagg

SEQ ID NO: 615470 - DNA, 20 bp, Artificial
  CRISPR gRNA sequence
actgcatttctgcatttgta

SEQ ID NO: 615471 - DNA, 20 bp, Artificial
  CRISPR gRNA sequence
catttgtacagtatgtgtct

SEQ ID NO: 615472 - DNA, 20 bp, Artificial
  CRISPR gRNA sequence
agtatgtgtcttggccattt

SEQ ID NO: 615473 - DNA, 20 bp, Artificial
  CRISPR gRNA sequence
ttctttctttaacaatacca

SEQ ID NO: 615474 - DNA, 20 bp, Artificial
  CRISPR gRNA sequence
tctttctttaacaataccaa

SEQ ID NO: 615475 - DNA, 20 bp, Artificial
  CRISPR gRNA sequence
ttaacaataccaaaggtaat

SEQ ID NO: 615476 - DNA, 20 bp, Artificial
  CRISPR gRNA sequence
aaggtaattagactatttta

SEQ ID NO: 615477 - DNA, 20 bp, Artificial
  CRISPR gRNA sequence
tttaaagactaattgcttga

SEQ ID NO: 615478 - DNA, 20 bp, Artificial
  CRISPR gRNA sequence
actaattgcttgacagtttc

SEQ ID NO: 615479 - DNA, 20 bp, Artificial
  CRISPR gRNA sequence
ctaattgcttgacagtttct

SEQ ID NO: 615480 - DNA, 20 bp, Artificial
  CRISPR gRNA sequence
taattgcttgacagtttcta

SEQ ID NO: 615481 - DNA, 20 bp, Artificial
  CRISPR gRNA sequence
ttctagggtattttgtgttt

SEQ ID NO: 615482 - DNA, 20 bp, Artificial
  CRISPR gRNA sequence
tagggtattttgtgttttag

SEQ ID NO: 615483 - DNA, 20 bp, Artificial
  CRISPR gRNA sequence
ttgtgttttagaagcaaaaa

SEQ ID NO: 615484 - DNA, 20 bp, Artificial
  CRISPR gRNA sequence
agcaaaaaaagaaaaaaaaa

SEQ ID NO: 615485 - DNA, 20 bp, Artificial
  CRISPR gRNA sequence
gcaaaaaaagaaaaaaaaat

SEQ ID NO: 615486 - DNA, 20 bp, Artificial
  CRISPR gRNA sequence
gaaaaaaaaataggtcaaac

SEQ ID NO: 615487 - DNA, 20 bp, Artificial
  CRISPR gRNA sequence
tttttttcaaactaataatt

SEQ ID NO: 615488 - DNA, 20 bp, Artificial
  CRISPR gRNA sequence
ttttttcaaactaataattt

SEQ ID NO: 615489 - DNA, 20 bp, Artificial
  CRISPR gRNA sequence
tttttcaaactaataatttg

SEQ ID NO: 615490 - DNA, 20 bp, Artificial
  CRISPR gRNA sequence
ataaaaactattgtttaaaa

SEQ ID NO: 615491 - DNA, 20 bp, Artificial
  CRISPR gRNA sequence
tatatataaatatatatgta

SEQ ID NO: 615492 - DNA, 20 bp, Artificial
  CRISPR gRNA sequence
aaattccataccttgtatgt

SEQ ID NO: 615493 - DNA, 20 bp, Artificial
  CRISPR gRNA sequence
aattccataccttgtatgtc

SEQ ID NO: 615494 - DNA, 20 bp, Artificial
  CRISPR gRNA sequence
ccttgtatgtcaggtttgct

SEQ ID NO: 615495 - DNA, 20 bp, Artificial
  CRISPR gRNA sequence
caggtttgctaagtgtaatg

SEQ ID NO: 615496 - DNA, 20 bp, Artificial
  CRISPR gRNA sequence
aagtgtaatgtagttttttt

SEQ ID NO: 615497 - DNA, 20 bp, Artificial
  CRISPR gRNA sequence
agtgtaatgtagttttttta

SEQ ID NO: 615498 - DNA, 20 bp, Artificial
  CRISPR gRNA sequence
aaggctcaaataccatacct

SEQ ID NO: 615499 - DNA, 20 bp, Artificial
  CRISPR gRNA sequence
aataccatacctcagaaaat

SEQ ID NO: 615500 - DNA, 20 bp, Artificial
  CRISPR gRNA sequence
ataccatacctcagaaaatg

SEQ ID NO: 615501 - DNA, 20 bp, Artificial
  CRISPR gRNA sequence
tcagaaaatgaggtttacta

SEQ ID NO: 615502 - DNA, 20 bp, Artificial
  CRISPR gRNA sequence
ttactatggaaatactgaaa

SEQ ID NO: 615503 - DNA, 20 bp, Artificial
  CRISPR gRNA sequence
aaatactgaaacagtctttg

SEQ ID NO: 615504 - DNA, 20 bp, Artificial
  CRISPR gRNA sequence
agtctttgcagctgtgtgac

SEQ ID NO: 615505 - DNA, 20 bp, Artificial
  CRISPR gRNA sequence
cactctactacatactgatt

SEQ ID NO: 615506 - DNA, 20 bp, Artificial
  CRISPR gRNA sequence
ctctactacatactgatttg

SEQ ID NO: 615507 - DNA, 20 bp, Artificial
  CRISPR gRNA sequence
atttggagacctccgctaaa

SEQ ID NO: 615508 - DNA, 20 bp, Artificial
  CRISPR gRNA sequence
gctaaatagttttatcactg

SEQ ID NO: 615509 - DNA, 20 bp, Artificial
  CRISPR gRNA sequence
tatcactgcagactaaaatg

SEQ ID NO: 615510 - DNA, 20 bp, Artificial
  CRISPR gRNA sequence
atcactgcagactaaaatgt

SEQ ID NO: 615511 - DNA, 20 bp, Artificial
  CRISPR gRNA sequence
acatgttctgtgcatgtatg

SEQ ID NO: 615512 - DNA, 20 bp, Artificial
  CRISPR gRNA sequence
gttactgtgtatatgtgtat

SEQ ID NO: 615513 - DNA, 20 bp, Artificial
  CRISPR gRNA sequence
agtgttgtatatgcatgtgt

SEQ ID NO: 615514 - DNA, 20 bp, Artificial
  CRISPR gRNA sequence
tctgtatgtgtgtacaacta

SEQ ID NO: 615515 - DNA, 20 bp, Artificial
  CRISPR gRNA sequence
gtatgtgtgtacaactaaag

SEQ ID NO: 615516 - DNA, 20 bp, Artificial
  CRISPR gRNA sequence
gtgtacaactaaagaagctg

SEQ ID NO: 615517 - DNA, 20 bp, Artificial
  CRISPR gRNA sequence
actttgtaatactttgtgaa

SEQ ID NO: 615518 - DNA, 20 bp, Artificial
  CRISPR gRNA sequence
ctttgtaatactttgtgaaa

SEQ ID NO: 615519 - DNA, 20 bp, Artificial
  CRISPR gRNA sequence
gtgaaaaggattatattata

SEQ ID NO: 615520 - DNA, 20 bp, Artificial
  CRISPR gRNA sequence
tgaaaaggattatattataa

SEQ ID NO: 615521 - DNA, 20 bp, Artificial
  CRISPR gRNA sequence
tataaaggtttgtactgtct

SEQ ID NO: 615522 - DNA, 20 bp, Artificial
  CRISPR gRNA sequence
gtttgtactgtctgagtgca

SEQ ID NO: 615523 - DNA, 20 bp, Artificial
  CRISPR gRNA sequence
ctgtctgagtgcacagctac

SEQ ID NO: 615524 - DNA, 20 bp, Artificial
  CRISPR gRNA sequence
cacagctactggaataaatt

SEQ ID NO: 615525 - DNA, 20 bp, Artificial
  CRISPR gRNA sequence
acagctactggaataaattt

SEQ ID NO: 615526 - DNA, 20 bp, Artificial
  CRISPR gRNA sequence
cagctactggaataaattta

SEQ ID NO: 615527 - DNA, 20 bp, Artificial
  CRISPR gRNA sequence
ggaataaatttagggaatct

SEQ ID NO: 615528 - DNA, 20 bp, Artificial
  CRISPR gRNA sequence
gaataaatttagggaatctc

SEQ ID NO: 615529 - DNA, 20 bp, Artificial
  CRISPR gRNA sequence
atttagggaatctcaggaac

SEQ ID NO: 615530 - DNA, 20 bp, Artificial
  CRISPR gRNA sequence
aacaagcatataatttgtcc

SEQ ID NO: 615531 - DNA, 20 bp, Artificial
  CRISPR gRNA sequence
gtccaagatttatttcttct

SEQ ID NO: 615532 - DNA, 20 bp, Artificial
  CRISPR gRNA sequence
caagatttatttcttctcag

SEQ ID NO: 615533 - DNA, 20 bp, Artificial
  CRISPR gRNA sequence
ttatttcttctcagaagtgt

SEQ ID NO: 615534 - DNA, 20 bp, Artificial
  CRISPR gRNA sequence
tcttctcagaagtgtaagtg

SEQ ID NO: 615535 - DNA, 20 bp, Artificial
  CRISPR gRNA sequence
aaataaacttctgacataaa

SEQ ID NO: 615536 - DNA, 20 bp, Artificial
  CRISPR gRNA sequence
agtttgctataaaaactttc

SEQ ID NO: 615537 - DNA, 20 bp, Artificial
  CRISPR gRNA sequence
acaaacatgtcttccaaata

SEQ ID NO: 615538 - DNA, 20 bp, Artificial
  CRISPR gRNA sequence
aacatgtcttccaaatacag

SEQ ID NO: 615539 - DNA, 20 bp, Artificial
  CRISPR gRNA sequence
gactaaattgttgactatac

SEQ ID NO: 615540 - DNA, 20 bp, Artificial
  CRISPR gRNA sequence
actaaattgttgactatacc

SEQ ID NO: 615541 - DNA, 20 bp, Artificial
  CRISPR gRNA sequence
ttggaagacatgtttgtgta

SEQ ID NO: 615542 - DNA, 20 bp, Artificial
  CRISPR gRNA sequence
gtaaaatattaaataatata

SEQ ID NO: 615543 - DNA, 20 bp, Artificial
  CRISPR gRNA sequence
gtctccaaatcagtatgtag

SEQ ID NO: 615544 - DNA, 20 bp, Artificial
  CRISPR gRNA sequence
caaacctgacatacaaggta

SEQ ID NO: 615545 - DNA, 20 bp, Artificial
  CRISPR gRNA sequence
acctttggtattgttaaaga

SEQ ID NO: 615546 - DNA, 20 bp, Artificial
  CRISPR gRNA sequence
cttaatttagagcattgggc

SEQ ID NO: 615547 - DNA, 20 bp, Artificial
  CRISPR gRNA sequence
attctgtaatcttttgattg

SEQ ID NO: 615548 - DNA, 20 bp, Artificial
  CRISPR gRNA sequence
tttaacatactatgactttt

SEQ ID NO: 615549 - DNA, 20 bp, Artificial
  CRISPR gRNA sequence
tttttgtcattagctaaagg

SEQ ID NO: 615550 - DNA, 20 bp, Artificial
  CRISPR gRNA sequence
atagtttttaagacttcaag

SEQ ID NO: 615551 - DNA, 20 bp, Artificial
  CRISPR gRNA sequence
ttgcacttgtacagaaagaa

SEQ ID NO: 615552 - DNA, 20 bp, Artificial
  CRISPR gRNA sequence
aatagcagaagcaatcattc

SEQ ID NO: 615553 - DNA, 20 bp, Artificial
  CRISPR gRNA sequence
ctggagaccccctccaaacc

SEQ ID NO: 615554 - DNA, 20 bp, Artificial
  CRISPR gRNA sequence
tttttggaggaaagccaaat

SEQ ID NO: 615555 - DNA, 20 bp, Artificial
  CRISPR gRNA sequence
ggaaagcaaacatactataa

SEQ ID NO: 615556 - DNA, 20 bp, Artificial
  CRISPR gRNA sequence
tttgaaagtgaaagtaacat

SEQ ID NO: 615557 - DNA, 20 bp, Artificial
  CRISPR gRNA sequence
tttttaatagaaaactacac

SEQ ID NO: 615558 - DNA, 20 bp, Artificial
  CRISPR gRNA sequence
attaccaatgaactagaaat

SEQ ID NO: 615559 - DNA, 20 bp, Artificial
  CRISPR gRNA sequence
tttgttacacagaaagggaa

SEQ ID NO: 615560 - DNA, 20 bp, Artificial
  CRISPR gRNA sequence
aagggagttatgttcaaaat

SEQ ID NO: 615561 - DNA, 20 bp, Artificial
  CRISPR gRNA sequence
aaatttttaaatcacagttt

SEQ ID NO: 615562 - DNA, 20 bp, Artificial
  CRISPR gRNA sequence
ttgaactacttaaaaaaaac

SEQ ID NO: 615563 - DNA, 20 bp, Artificial
  CRISPR gRNA sequence
atcttggtaagtgcatagta

SEQ ID NO: 615564 - DNA, 20 bp, Artificial
  CRISPR gRNA sequence
ttcatgtaccactctctgta

SEQ ID NO: 615565 - DNA, 20 bp, Artificial
  CRISPR gRNA sequence
tgggaggaaagccccataaa

SEQ ID NO: 615566 - DNA, 20 bp, Artificial
  CRISPR gRNA sequence
agaattatgaacttattcct

SEQ ID NO: 615567 - DNA, 20 bp, Artificial
  CRISPR gRNA sequence
taaaactaaaaagctagaaa

SEQ ID NO: 615568 - DNA, 20 bp, Artificial
  CRISPR gRNA sequence
ccatttgagattatgctttg

SEQ ID NO: 615569 - DNA, 20 bp, Artificial
  CRISPR gRNA sequence
tcagttttgctttgttcaag

SEQ ID NO: 615570 - DNA, 20 bp, Artificial
  CRISPR gRNA sequence
gtctggagatgaaaatccaa

SEQ ID NO: 615571 - DNA, 20 bp, Artificial
  CRISPR gRNA sequence
tttgcactaaaaatgcagag

SEQ ID NO: 615572 - DNA, 20 bp, Artificial
  CRISPR gRNA sequence
agtatttaatacattaaatt

SEQ ID NO: 615573 - DNA, 20 bp, Artificial
  CRISPR gRNA sequence
taattattttgcagaaactg

SEQ ID NO: 615574 - DNA, 20 bp, Artificial
  CRISPR gRNA sequence
cttcccactttttttttctt

SEQ ID NO: 615575 - DNA, 20 bp, Artificial
  CRISPR gRNA sequence
ttttttttcttttggatttg

SEQ ID NO: 615576 - DNA, 20 bp, Artificial
  CRISPR gRNA sequence
atttggggaattttctggtt

SEQ ID NO: 615577 - DNA, 20 bp, Artificial
  CRISPR gRNA sequence
ctaagaaatcattttggaga

SEQ ID NO: 615578 - DNA, 20 bp, Artificial
  CRISPR gRNA sequence
accaaagacttcatggtttt

SEQ ID NO: 615579 - DNA, 20 bp, Artificial
  CRISPR gRNA sequence
ctgttgataatatttatttt

SEQ ID NO: 615580 - DNA, 20 bp, Artificial
  CRISPR gRNA sequence
aaactttacattaaatatct

SEQ ID NO: 615581 - DNA, 20 bp, Artificial
  CRISPR gRNA sequence
aggacccaaagttttagttt

SEQ ID NO: 615582 - DNA, 20 bp, Artificial
  CRISPR gRNA sequence
ctccaactgcttttttttcc

SEQ ID NO: 615583 - DNA, 20 bp, Artificial
  CRISPR gRNA sequence
tttccatgaattctctttaa

SEQ ID NO: 615584 - DNA, 20 bp, Artificial
  CRISPR gRNA sequence
gtccctttaggaaatctcaa

SEQ ID NO: 615585 - DNA, 20 bp, Artificial
  CRISPR gRNA sequence
ctgtcttaaaaaggtccaat

SEQ ID NO: 615586 - DNA, 20 bp, Artificial
  CRISPR gRNA sequence
ggcatgcacatataaccatc

SEQ ID NO: 615587 - DNA, 20 bp, Artificial
  CRISPR gRNA sequence
attctttctgacccacaaat

SEQ ID NO: 615588 - DNA, 20 bp, Artificial
  CRISPR gRNA sequence
agcactgtcttcataaggtt

SEQ ID NO: 615589 - DNA, 20 bp, Artificial
  CRISPR gRNA sequence
tggcatcccaattattattt

SEQ ID NO: 615590 - DNA, 20 bp, Artificial
  CRISPR gRNA sequence
caattattatttgggagtgg

SEQ ID NO: 615591 - DNA, 20 bp, Artificial
  CRISPR gRNA sequence
ttgggagtggttgggtgggg

SEQ ID NO: 615592 - DNA, 20 bp, Artificial
  CRISPR gRNA sequence
ggttgggtgggggggggtga

SEQ ID NO: 615593 - DNA, 20 bp, Artificial
  CRISPR gRNA sequence
cagggactagtagaagagag

SEQ ID NO: 615594 - DNA, 20 bp, Artificial
  CRISPR gRNA sequence
agcaaatagtaagctggaaa

SEQ ID NO: 615595 - DNA, 20 bp, Artificial
  CRISPR gRNA sequence
agttatcagttactgcctaa

SEQ ID NO: 615596 - DNA, 20 bp, Artificial
  CRISPR gRNA sequence
gtatgtccccctaaaatgac

SEQ ID NO: 615597 - DNA, 20 bp, Artificial
  CRISPR gRNA sequence
ggcaacctataccatgtaag

SEQ ID NO: 615598 - DNA, 20 bp, Artificial
  CRISPR gRNA sequence
gtaaggggaattctatacta

SEQ ID NO: 615599 - DNA, 20 bp, Artificial
  CRISPR gRNA sequence
aatgtgcaggactttccttt

SEQ ID NO: 615600 - DNA, 20 bp, Artificial
  CRISPR gRNA sequence
gtcacattctagactccaag

SEQ ID NO: 615601 - DNA, 20 bp, Artificial
  CRISPR gRNA sequence
cattcccttttctttgcaac

SEQ ID NO: 615602 - DNA, 20 bp, Artificial
  CRISPR gRNA sequence
gccctagttctgtaacctta

SEQ ID NO: 615603 - DNA, 20 bp, Artificial
  CRISPR gRNA sequence
cttttaagaccttctactcg

SEQ ID NO: 615604 - DNA, 20 bp, Artificial
  CRISPR gRNA sequence
gaccttctactcgaagagta

SEQ ID NO: 615605 - DNA, 20 bp, Artificial
  CRISPR gRNA sequence
ttctactcgaagagtaaagg

SEQ ID NO: 615606 - DNA, 20 bp, Artificial
  CRISPR gRNA sequence
gaaaagagaaataccagaaa

SEQ ID NO: 615607 - DNA, 20 bp, Artificial
  CRISPR gRNA sequence
accagaaaagggatttctaa

SEQ ID NO: 615608 - DNA, 20 bp, Artificial
  CRISPR gRNA sequence
ggtgttaaaagtaaggctgc

SEQ ID NO: 615609 - DNA, 20 bp, Artificial
  CRISPR gRNA sequence
atggtacagtgtaaaacata

SEQ ID NO: 615610 - DNA, 20 bp, Artificial
  CRISPR gRNA sequence
acaacaactcagctcctctt

SEQ ID NO: 615611 - DNA, 20 bp, Artificial
  CRISPR gRNA sequence
ttgaaacacattcttctttc

SEQ ID NO: 615612 - DNA, 20 bp, Artificial
  CRISPR gRNA sequence
tcctgtcttccatcataatt

SEQ ID NO: 615613 - DNA, 20 bp, Artificial
  CRISPR gRNA sequence
tctgaatatcagtggcaaat

SEQ ID NO: 615614 - DNA, 20 bp, Artificial
  CRISPR gRNA sequence
ggcaaatcagaatctcttag

SEQ ID NO: 615615 - DNA, 20 bp, Artificial
  CRISPR gRNA sequence
aatctcttaggtgaatcttt

SEQ ID NO: 615616 - DNA, 20 bp, Artificial
  CRISPR gRNA sequence
tgacactgcctccacaaaat

SEQ ID NO: 615617 - DNA, 20 bp, Artificial
  CRISPR gRNA sequence
tgtcaacatttgaggaaagg

SEQ ID NO: 615618 - DNA, 20 bp, Artificial
  CRISPR gRNA sequence
tgtgcagttctttacttcat

SEQ ID NO: 615619 - DNA, 20 bp, Artificial
  CRISPR gRNA sequence
tacttcataggggtcccctt

SEQ ID NO: 615620 - DNA, 20 bp, Artificial
  CRISPR gRNA sequence
tttggaatgaaaaggcctag

SEQ ID NO: 615621 - DNA, 20 bp, Artificial
  CRISPR gRNA sequence
gccacagatgttgcattcca

SEQ ID NO: 615622 - DNA, 20 bp, Artificial
  CRISPR gRNA sequence
cggtagccatggcaacccat

SEQ ID NO: 615623 - DNA, 20 bp, Artificial
  CRISPR gRNA sequence
agctgggctttgtttcctct

SEQ ID NO: 615624 - DNA, 20 bp, Artificial
  CRISPR gRNA sequence
tttcctcttgggatttaagg

SEQ ID NO: 615625 - DNA, 20 bp, Artificial
  CRISPR gRNA sequence
gtggtcatcatggctgcttt

SEQ ID NO: 615626 - DNA, 20 bp, Artificial
  CRISPR gRNA sequence
atggctgctttctgagtcag

SEQ ID NO: 615627 - DNA, 20 bp, Artificial
  CRISPR gRNA sequence
tgggagaggcctctctttcc

SEQ ID NO: 615628 - DNA, 20 bp, Artificial
  CRISPR gRNA sequence
tatcagcagtttccctgcta

SEQ ID NO: 615629 - DNA, 20 bp, Artificial
  CRISPR gRNA sequence
aatgggtctttctatcctat

SEQ ID NO: 615630 - DNA, 20 bp, Artificial
  CRISPR gRNA sequence
cctatttggatgatagacct

SEQ ID NO: 615631 - DNA, 20 bp, Artificial
  CRISPR gRNA sequence
cacttcagcgattgtgcttg

SEQ ID NO: 615632 - DNA, 20 bp, Artificial
  CRISPR gRNA sequence
gcttggcgggtgctgcatca

SEQ ID NO: 615633 - DNA, 20 bp, Artificial
  CRISPR gRNA sequence
tatgttaagttcatatcaaa

SEQ ID NO: 615634 - DNA, 20 bp, Artificial
  CRISPR gRNA sequence
gttcatatcaaagtgaatat

SEQ ID NO: 615635 - DNA, 20 bp, Artificial
  CRISPR gRNA sequence
caaagtgaatatctgggtag

SEQ ID NO: 615636 - DNA, 20 bp, Artificial
  CRISPR gRNA sequence
catgagcttttcccctggaa

SEQ ID NO: 615637 - DNA, 20 bp, Artificial
  CRISPR gRNA sequence
gtatcagattaaaaatatga

SEQ ID NO: 615638 - DNA, 20 bp, Artificial
  CRISPR gRNA sequence
cattttttttttttttgaga

SEQ ID NO: 615639 - DNA, 20 bp, Artificial
  CRISPR gRNA sequence
ttttttttgagacagagtct

SEQ ID NO: 615640 - DNA, 20 bp, Artificial
  CRISPR gRNA sequence
acctccacctctccagttca

SEQ ID NO: 615641 - DNA, 20 bp, Artificial
  CRISPR gRNA sequence
gattctcatgcctcagccac

SEQ ID NO: 615642 - DNA, 20 bp, Artificial
  CRISPR gRNA sequence
gcctcagccacctgagtagc

SEQ ID NO: 615643 - DNA, 20 bp, Artificial
  CRISPR gRNA sequence
ttttgtatttttagtagaga

SEQ ID NO: 615644 - DNA, 20 bp, Artificial
  CRISPR gRNA sequence
acgattacaggcatgagaca

SEQ ID NO: 615645 - DNA, 20 bp, Artificial
  CRISPR gRNA sequence
atttgttctgatgccatcat

SEQ ID NO: 615646 - DNA, 20 bp, Artificial
  CRISPR gRNA sequence
atctagtctgaaagatatga

SEQ ID NO: 615647 - DNA, 20 bp, Artificial
  CRISPR gRNA sequence
ttttcttttaaaattctcac

SEQ ID NO: 615648 - DNA, 20 bp, Artificial
  CRISPR gRNA sequence
tcacttgaatagagctcaag

SEQ ID NO: 615649 - DNA, 20 bp, Artificial
  CRISPR gRNA sequence
agctcaaggagaataggagg

SEQ ID NO: 615650 - DNA, 20 bp, Artificial
  CRISPR gRNA sequence
gctacaaagatcataaaagt

SEQ ID NO: 615651 - DNA, 20 bp, Artificial
  CRISPR gRNA sequence
tatggcacctcactgttgtg

SEQ ID NO: 615652 - DNA, 20 bp, Artificial
  CRISPR gRNA sequence
agtagtaccacctaataaaa

SEQ ID NO: 615653 - DNA, 20 bp, Artificial
  CRISPR gRNA sequence
taataaaaatgaatgaaatg

SEQ ID NO: 615654 - DNA, 20 bp, Artificial
  CRISPR gRNA sequence
ggttatttaaaaataaaatt

SEQ ID NO: 615655 - DNA, 20 bp, Artificial
  CRISPR gRNA sequence
tgtctgactgttaactataa

SEQ ID NO: 615656 - DNA, 20 bp, Artificial
  CRISPR gRNA sequence
cagatattgctggttttgaa

SEQ ID NO: 615657 - DNA, 20 bp, Artificial
  CRISPR gRNA sequence
aatgcttcttaaaaacatat

SEQ ID NO: 615658 - DNA, 20 bp, Artificial
  CRISPR gRNA sequence
taaatggttaatatgttgtt

SEQ ID NO: 615659 - DNA, 20 bp, Artificial
  CRISPR gRNA sequence
tggttaatatgttgttgtgg

SEQ ID NO: 615660 - DNA, 20 bp, Artificial
  CRISPR gRNA sequence
cgtgagatcagtgtaatgat

SEQ ID NO: 615661 - DNA, 20 bp, Artificial
  CRISPR gRNA sequence
ggaaggaacaatagcaattt

SEQ ID NO: 615662 - DNA, 20 bp, Artificial
  CRISPR gRNA sequence
acatagtgtggtatgtgtga

SEQ ID NO: 615663 - DNA, 20 bp, Artificial
  CRISPR gRNA sequence
gtgtgatggggtcaaataag

SEQ ID NO: 615664 - DNA, 20 bp, Artificial
  CRISPR gRNA sequence
ggaacacttcttgaaggaaa

SEQ ID NO: 615665 - DNA, 20 bp, Artificial
  CRISPR gRNA sequence
ccaagtgaagaaacatgagg

SEQ ID NO: 615666 - DNA, 20 bp, Artificial
  CRISPR gRNA sequence
gaggtggagtagctggtaga

SEQ ID NO: 615667 - DNA, 20 bp, Artificial
  CRISPR gRNA sequence
gagggcatcacttataaagg

SEQ ID NO: 615668 - DNA, 20 bp, Artificial
  CRISPR gRNA sequence
acttatacttcaataaggct

SEQ ID NO: 615669 - DNA, 20 bp, Artificial
  CRISPR gRNA sequence
aggctaaatatgctaaaaat

SEQ ID NO: 615670 - DNA, 20 bp, Artificial
  CRISPR gRNA sequence
aaatttgaatatttccctaa

SEQ ID NO: 615671 - DNA, 20 bp, Artificial
  CRISPR gRNA sequence
ctaaaggaatacagattgaa

SEQ ID NO: 615672 - DNA, 20 bp, Artificial
  CRISPR gRNA sequence
tgaaggtattcatttagcaa

SEQ ID NO: 615673 - DNA, 20 bp, Artificial
  CRISPR gRNA sequence
acaatgagatagaaaagatg

SEQ ID NO: 615674 - DNA, 20 bp, Artificial
  CRISPR gRNA sequence
gaattcagtttgggaggact

SEQ ID NO: 615675 - DNA, 20 bp, Artificial
  CRISPR gRNA sequence
cctgggcttgagatgtagaa

SEQ ID NO: 615676 - DNA, 20 bp, Artificial
  CRISPR gRNA sequence
aataactgatatcacccagg

SEQ ID NO: 615677 - DNA, 20 bp, Artificial
  CRISPR gRNA sequence
tcacccaggtagagtgtgaa

SEQ ID NO: 615678 - DNA, 20 bp, Artificial
  CRISPR gRNA sequence
ccaggtagagtgtgaagggg

SEQ ID NO: 615679 - DNA, 20 bp, Artificial
  CRISPR gRNA sequence
gatgggtcaaaaatagaacc

SEQ ID NO: 615680 - DNA, 20 bp, Artificial
  CRISPR gRNA sequence
tactcatagatcagggaaag

SEQ ID NO: 615681 - DNA, 20 bp, Artificial
  CRISPR gRNA sequence
tgaggagcttctagggccaa

SEQ ID NO: 615682 - DNA, 20 bp, Artificial
  CRISPR gRNA sequence
tctgaagctcactcagaccc

SEQ ID NO: 615683 - DNA, 20 bp, Artificial
  CRISPR gRNA sequence
ggactacacagtcctcttca

SEQ ID NO: 615684 - DNA, 20 bp, Artificial
  CRISPR gRNA sequence
atgtgcaatgtaaaaagaac

SEQ ID NO: 615685 - DNA, 20 bp, Artificial
  CRISPR gRNA sequence
aagaacctggatatgcaggc

SEQ ID NO: 615686 - DNA, 20 bp, Artificial
  CRISPR gRNA sequence
ctttggtaatggagagaact

SEQ ID NO: 615687 - DNA, 20 bp, Artificial
  CRISPR gRNA sequence
ggtaatggagagaactagga

SEQ ID NO: 615688 - DNA, 20 bp, Artificial
  CRISPR gRNA sequence
aggagcctagctgtaagcca

SEQ ID NO: 615689 - DNA, 20 bp, Artificial
  CRISPR gRNA sequence
tgtagagctacaggaaatct

SEQ ID NO: 615690 - DNA, 20 bp, Artificial
  CRISPR gRNA sequence
tttgaacttagtcaagttgg

SEQ ID NO: 615691 - DNA, 20 bp, Artificial
  CRISPR gRNA sequence
atataaaaatatttaggcat

SEQ ID NO: 615692 - DNA, 20 bp, Artificial
  CRISPR gRNA sequence
ggccaacttgcatagctgtt

SEQ ID NO: 615693 - DNA, 20 bp, Artificial
  CRISPR gRNA sequence
gctgttaaggataagtctga

SEQ ID NO: 615694 - DNA, 20 bp, Artificial
  CRISPR gRNA sequence
aatgtcataaaaaccaagaa

SEQ ID NO: 615695 - DNA, 20 bp, Artificial
  CRISPR gRNA sequence
agaaaagagtgtgtttccaa

SEQ ID NO: 615696 - DNA, 20 bp, Artificial
  CRISPR gRNA sequence
tgtgtaagatactgtcttaa

SEQ ID NO: 615697 - DNA, 20 bp, Artificial
  CRISPR gRNA sequence
aagctagttgtgacctcagt

SEQ ID NO: 615698 - DNA, 20 bp, Artificial
  CRISPR gRNA sequence
ctcagtgagaataattttaa

SEQ ID NO: 615699 - DNA, 20 bp, Artificial
  CRISPR gRNA sequence
caggttgcatggacttggaa

SEQ ID NO: 615700 - DNA, 20 bp, Artificial
  CRISPR gRNA sequence
ggaagattttttttaattat

SEQ ID NO: 615701 - DNA, 20 bp, Artificial
  CRISPR gRNA sequence
gcgtgaggtatctggggggc

SEQ ID NO: 615702 - DNA, 20 bp, Artificial
  CRISPR gRNA sequence
tatctggggggccaggatag

SEQ ID NO: 615703 - DNA, 20 bp, Artificial
  CRISPR gRNA sequence
gaattcctgtgcacaagagg

SEQ ID NO: 615704 - DNA, 20 bp, Artificial
  CRISPR gRNA sequence
aatgaactttaattagaaag

SEQ ID NO: 615705 - DNA, 20 bp, Artificial
  CRISPR gRNA sequence
aaaaagataaaagcatttac

SEQ ID NO: 615706 - DNA, 20 bp, Artificial
  CRISPR gRNA sequence
catggatgcatacaatccta

SEQ ID NO: 615707 - DNA, 20 bp, Artificial
  CRISPR gRNA sequence
ttccagcgattttatcccct

SEQ ID NO: 615708 - DNA, 20 bp, Artificial
  CRISPR gRNA sequence
atatagatataagatcacca

SEQ ID NO: 615709 - DNA, 20 bp, Artificial
  CRISPR gRNA sequence
agtgagacagcatgtttgca

SEQ ID NO: 615710 - DNA, 20 bp, Artificial
  CRISPR gRNA sequence
agcaggagagatgattcttc

SEQ ID NO: 615711 - DNA, 20 bp, Artificial
  CRISPR gRNA sequence
tcttcagggatgctgctcca

SEQ ID NO: 615712 - DNA, 20 bp, Artificial
  CRISPR gRNA sequence
cagggatgctgctccatagg

SEQ ID NO: 615713 - DNA, 20 bp, Artificial
  CRISPR gRNA sequence
tggataggccagctgatatt

SEQ ID NO: 615714 - DNA, 20 bp, Artificial
  CRISPR gRNA sequence
gatgccaactcatcagcctg

SEQ ID NO: 615715 - DNA, 20 bp, Artificial
  CRISPR gRNA sequence
aaagtaccagatgtgcaggc

SEQ ID NO: 615716 - DNA, 20 bp, Artificial
  CRISPR gRNA sequence
tagtgagatataagtatgga

SEQ ID NO: 615717 - DNA, 20 bp, Artificial
  CRISPR gRNA sequence
cagtcagctttacaagacag

SEQ ID NO: 615718 - DNA, 20 bp, Artificial
  CRISPR gRNA sequence
gtagggtttcatcaggagaa

SEQ ID NO: 615719 - DNA, 20 bp, Artificial
  CRISPR gRNA sequence
gccaacaaggcaagaaaggc

SEQ ID NO: 615720 - DNA, 20 bp, Artificial
  CRISPR gRNA sequence
gatgtagaagtgatgagcca

SEQ ID NO: 615721 - DNA, 20 bp, Artificial
  CRISPR gRNA sequence
gatgagccatggaatctaag

SEQ ID NO: 615722 - DNA, 20 bp, Artificial
  CRISPR gRNA sequence
agtagatatgcaggaagttc

SEQ ID NO: 615723 - DNA, 20 bp, Artificial
  CRISPR gRNA sequence
gttcagggatcattggtctg

SEQ ID NO: 615724 - DNA, 20 bp, Artificial
  CRISPR gRNA sequence
tggagaatttgataaggtca

SEQ ID NO: 615725 - DNA, 20 bp, Artificial
  CRISPR gRNA sequence
aaggcaatttataataagtg

SEQ ID NO: 615726 - DNA, 20 bp, Artificial
  CRISPR gRNA sequence
tactgtttgttatatattac

SEQ ID NO: 615727 - DNA, 20 bp, Artificial
  CRISPR gRNA sequence
tttgttatatattactagga

SEQ ID NO: 615728 - DNA, 20 bp, Artificial
  CRISPR gRNA sequence
aaaatataatataaatattt

SEQ ID NO: 615729 - DNA, 20 bp, Artificial
  CRISPR gRNA sequence
aaagctgtccctcttttcta

SEQ ID NO: 615730 - DNA, 20 bp, Artificial
  CRISPR gRNA sequence
gaatgcagtgaaataaaatt

SEQ ID NO: 615731 - DNA, 20 bp, Artificial
  CRISPR gRNA sequence
acatgacaaaaaacgttaca

SEQ ID NO: 615732 - DNA, 20 bp, Artificial
  CRISPR gRNA sequence
atataaattcagaagacaga

SEQ ID NO: 615733 - DNA, 20 bp, Artificial
  CRISPR gRNA sequence
tttattttttccaactacat

SEQ ID NO: 615734 - DNA, 20 bp, Artificial
  CRISPR gRNA sequence
cacccttaggccttctttca

SEQ ID NO: 615735 - DNA, 20 bp, Artificial
  CRISPR gRNA sequence
taaatccctccagctagtct

SEQ ID NO: 615736 - DNA, 20 bp, Artificial
  CRISPR gRNA sequence
ttaagtgtttattgaagtaa

SEQ ID NO: 615737 - DNA, 20 bp, Artificial
  CRISPR gRNA sequence
tgtctcaatcaccatttaat

SEQ ID NO: 615738 - DNA, 20 bp, Artificial
  CRISPR gRNA sequence
atgtcccacaatgctgacac

SEQ ID NO: 615739 - DNA, 20 bp, Artificial
  CRISPR gRNA sequence
caatgctgacactagaatgt

SEQ ID NO: 615740 - DNA, 20 bp, Artificial
  CRISPR gRNA sequence
actagaatgtcagaatctgt

SEQ ID NO: 615741 - DNA, 20 bp, Artificial
  CRISPR gRNA sequence
tcctaatagatatatataca

SEQ ID NO: 615742 - DNA, 20 bp, Artificial
  CRISPR gRNA sequence
ttctttaacaattcttttta

SEQ ID NO: 615743 - DNA, 20 bp, Artificial
  CRISPR gRNA sequence
tatgacttacagcatgcatc

SEQ ID NO: 615744 - DNA, 20 bp, Artificial
  CRISPR gRNA sequence
tgccaacattgggcgtatca

SEQ ID NO: 615745 - DNA, 20 bp, Artificial
  CRISPR gRNA sequence
gggcgtatcaaagaatatct

SEQ ID NO: 615746 - DNA, 20 bp, Artificial
  CRISPR gRNA sequence
tttcagttcaaaatcatagg

SEQ ID NO: 615747 - DNA, 20 bp, Artificial
  CRISPR gRNA sequence
agatccaaatatgaaacatc

SEQ ID NO: 615748 - DNA, 20 bp, Artificial
  CRISPR gRNA sequence
gctgcattatttttccaatg

SEQ ID NO: 615749 - DNA, 20 bp, Artificial
  CRISPR gRNA sequence
ttggcgatgaccttgagcag

SEQ ID NO: 615750 - DNA, 20 bp, Artificial
  CRISPR gRNA sequence
tggtgtaagtgtggtgtaca

SEQ ID NO: 615751 - DNA, 20 bp, Artificial
  CRISPR gRNA sequence
gtggtgtacacagaatgtca

SEQ ID NO: 615752 - DNA, 20 bp, Artificial
  CRISPR gRNA sequence
cagaatgtcagagagtaaaa

SEQ ID NO: 615753 - DNA, 20 bp, Artificial
  CRISPR gRNA sequence
aagaataatgaagaaaagag

SEQ ID NO: 615754 - DNA, 20 bp, Artificial
  CRISPR gRNA sequence
tgcttacccacaaacttttg

SEQ ID NO: 615755 - DNA, 20 bp, Artificial
  CRISPR gRNA sequence
ctgataatttcttcaacatt

SEQ ID NO: 615756 - DNA, 20 bp, Artificial
  CRISPR gRNA sequence
acattttggatgatacaaag

SEQ ID NO: 615757 - DNA, 20 bp, Artificial
  CRISPR gRNA sequence
cttcagtagaagcaagtaga

SEQ ID NO: 615758 - DNA, 20 bp, Artificial
  CRISPR gRNA sequence
gcacacacacatatacacca

SEQ ID NO: 615759 - DNA, 20 bp, Artificial
  CRISPR gRNA sequence
accagaggatttgtttttat

SEQ ID NO: 615760 - DNA, 20 bp, Artificial
  CRISPR gRNA sequence
tgcactattttcaaggcttt

SEQ ID NO: 615761 - DNA, 20 bp, Artificial
  CRISPR gRNA sequence
aagagctcttcagcaggaag

SEQ ID NO: 615762 - DNA, 20 bp, Artificial
  CRISPR gRNA sequence
gaacttaaaacagttgtttt

SEQ ID NO: 615763 - DNA, 20 bp, Artificial
  CRISPR gRNA sequence
tttgagtagaaatactgccc

SEQ ID NO: 615764 - DNA, 20 bp, Artificial
  CRISPR gRNA sequence
ctgcccaaggatgtttaatt

SEQ ID NO: 615765 - DNA, 20 bp, Artificial
  CRISPR gRNA sequence
caaggatgtttaattaagga

SEQ ID NO: 615766 - DNA, 20 bp, Artificial
  CRISPR gRNA sequence
agggtaacaactcagacaag

SEQ ID NO: 615767 - DNA, 20 bp, Artificial
  CRISPR gRNA sequence
aacctaaagctttcatttct

SEQ ID NO: 615768 - DNA, 20 bp, Artificial
  CRISPR gRNA sequence
aaatgtagtctcatttataa

SEQ ID NO: 615769 - DNA, 20 bp, Artificial
  CRISPR gRNA sequence
aagttttgattaacctatag

SEQ ID NO: 615770 - DNA, 20 bp, Artificial
  CRISPR gRNA sequence
ctatagatgggtcaaaaaaa

SEQ ID NO: 615771 - DNA, 20 bp, Artificial
  CRISPR gRNA sequence
taataagaagtcctctggct

SEQ ID NO: 615772 - DNA, 20 bp, Artificial
  CRISPR gRNA sequence
tcctctggctatgaatagca

SEQ ID NO: 615773 - DNA, 20 bp, Artificial
  CRISPR gRNA sequence
aaaaagtgacacaaaagtaa

SEQ ID NO: 615774 - DNA, 20 bp, Artificial
  CRISPR gRNA sequence
aaagagtcaacaaaaaagca

SEQ ID NO: 615775 - DNA, 20 bp, Artificial
  CRISPR gRNA sequence
aaagaatttcaaaaacattc

SEQ ID NO: 615776 - DNA, 20 bp, Artificial
  CRISPR gRNA sequence
ggatgaccaattcacgtaag

SEQ ID NO: 615777 - DNA, 20 bp, Artificial
  CRISPR gRNA sequence
attcacgtaaggggagtcag

SEQ ID NO: 615778 - DNA, 20 bp, Artificial
  CRISPR gRNA sequence
tcaaaatcttaactttttgt

SEQ ID NO: 615779 - DNA, 20 bp, Artificial
  CRISPR gRNA sequence
cttaactttttgtttggatg

SEQ ID NO: 615780 - DNA, 20 bp, Artificial
  CRISPR gRNA sequence
cagaccaagatccaaaatga

SEQ ID NO: 615781 - DNA, 20 bp, Artificial
  CRISPR gRNA sequence
aaaactagcaaaactggtta

SEQ ID NO: 615782 - DNA, 20 bp, Artificial
  CRISPR gRNA sequence
atatgctaatttgttctgaa

SEQ ID NO: 615783 - DNA, 20 bp, Artificial
  CRISPR gRNA sequence
gttttgctctaagtttcacc

SEQ ID NO: 615784 - DNA, 20 bp, Artificial
  CRISPR gRNA sequence
tttaacactcaaaacgaaac

SEQ ID NO: 615785 - DNA, 20 bp, Artificial
  CRISPR gRNA sequence
ctcaattcagatgatttgtc

SEQ ID NO: 615786 - DNA, 20 bp, Artificial
  CRISPR gRNA sequence
actgaaaatgatgattttgg

SEQ ID NO: 615787 - DNA, 20 bp, Artificial
  CRISPR gRNA sequence
gagatgttaagtaatttcct

SEQ ID NO: 615788 - DNA, 20 bp, Artificial
  CRISPR gRNA sequence
gggtttacatctagttagta

SEQ ID NO: 615789 - DNA, 20 bp, Artificial
  CRISPR gRNA sequence
tagagaatgttattactact

SEQ ID NO: 615790 - DNA, 20 bp, Artificial
  CRISPR gRNA sequence
catatttgtaaggtctgcca

SEQ ID NO: 615791 - DNA, 20 bp, Artificial
  CRISPR gRNA sequence
atctgattttgttttgcttc

SEQ ID NO: 615792 - DNA, 20 bp, Artificial
  CRISPR gRNA sequence
ttttgttttgcttcatggat

SEQ ID NO: 615793 - DNA, 20 bp, Artificial
  CRISPR gRNA sequence
agctcctgagcaggagaggg

SEQ ID NO: 615794 - DNA, 20 bp, Artificial
  CRISPR gRNA sequence
gagggcagagtacctggact

SEQ ID NO: 615795 - DNA, 20 bp, Artificial
  CRISPR gRNA sequence
tgttatcaagagaaggagga

SEQ ID NO: 615796 - DNA, 20 bp, Artificial
  CRISPR gRNA sequence
gggccactacataaattatg

SEQ ID NO: 615797 - DNA, 20 bp, Artificial
  CRISPR gRNA sequence
cctatttcatggagacataa

SEQ ID NO: 615798 - DNA, 20 bp, Artificial
  CRISPR gRNA sequence
ttttcctaattaccatatca

SEQ ID NO: 615799 - DNA, 20 bp, Artificial
  CRISPR gRNA sequence
cactactaattaccatatca

SEQ ID NO: 615800 - DNA, 20 bp, Artificial
  CRISPR gRNA sequence
tcaatcccgggaaattcctc

SEQ ID NO: 615801 - DNA, 20 bp, Artificial
  CRISPR gRNA sequence
aatagctggtaaataacctc

SEQ ID NO: 615802 - DNA, 20 bp, Artificial
  CRISPR gRNA sequence
caagagagatataatattca

SEQ ID NO: 615803 - DNA, 20 bp, Artificial
  CRISPR gRNA sequence
taatattcaatggatgttca

SEQ ID NO: 615804 - DNA, 20 bp, Artificial
  CRISPR gRNA sequence
aaaagcttattccaaagttt

SEQ ID NO: 615805 - DNA, 20 bp, Artificial
  CRISPR gRNA sequence
caattattatttccaaaact

SEQ ID NO: 615806 - DNA, 20 bp, Artificial
  CRISPR gRNA sequence
ctccaagcctctttttctcc

SEQ ID NO: 615807 - DNA, 20 bp, Artificial
  CRISPR gRNA sequence
tttttactcatccctcatgt

SEQ ID NO: 615808 - DNA, 20 bp, Artificial
  CRISPR gRNA sequence
gaagcctctcttgacttttc

SEQ ID NO: 615809 - DNA, 20 bp, Artificial
  CRISPR gRNA sequence
aaagtaagtgtattaaaaga

SEQ ID NO: 615810 - DNA, 20 bp, Artificial
  CRISPR gRNA sequence
gtccatttatttttataccc

SEQ ID NO: 615811 - DNA, 20 bp, Artificial
  CRISPR gRNA sequence
aagctcttgataaatgtttt

SEQ ID NO: 615812 - DNA, 20 bp, Artificial
  CRISPR gRNA sequence
aataacatacagcaagagaa

SEQ ID NO: 615813 - DNA, 20 bp, Artificial
  CRISPR gRNA sequence
aacaacagatagaggagatt

SEQ ID NO: 615814 - DNA, 20 bp, Artificial
  CRISPR gRNA sequence
aaagtatggtatgaaatggc

SEQ ID NO: 615815 - DNA, 20 bp, Artificial
  CRISPR gRNA sequence
taaaatgatatccagtattt

SEQ ID NO: 615816 - DNA, 20 bp, Artificial
  CRISPR gRNA sequence
acggagggctaagcaatctg

SEQ ID NO: 615817 - DNA, 20 bp, Artificial
  CRISPR gRNA sequence
gctaagcaatctggggaata

SEQ ID NO: 615818 - DNA, 20 bp, Artificial
  CRISPR gRNA sequence
ctattaccatatagtctttt

SEQ ID NO: 615819 - DNA, 20 bp, Artificial
  CRISPR gRNA sequence
ttaggagtatgtatgcaata

SEQ ID NO: 615820 - DNA, 20 bp, Artificial
  CRISPR gRNA sequence
acagaattccataaataact

SEQ ID NO: 615821 - DNA, 20 bp, Artificial
  CRISPR gRNA sequence
aaatgtcagaactgcaatgg

SEQ ID NO: 615822 - DNA, 20 bp, Artificial
  CRISPR gRNA sequence
tggtaaataacaaatttata

SEQ ID NO: 615823 - DNA, 20 bp, Artificial
  CRISPR gRNA sequence
ttaatcctcaaacccagcct

SEQ ID NO: 615824 - DNA, 20 bp, Artificial
  CRISPR gRNA sequence
tggacttgatcacaaatcaa

SEQ ID NO: 615825 - DNA, 20 bp, Artificial
  CRISPR gRNA sequence
aaggaaatgcttcagttgtt

SEQ ID NO: 615826 - DNA, 20 bp, Artificial
  CRISPR gRNA sequence
cgggcagctcacctgaggtc

SEQ ID NO: 615827 - DNA, 20 bp, Artificial
  CRISPR gRNA sequence
tacttggcaggctgaagcag

SEQ ID NO: 615828 - DNA, 20 bp, Artificial
  CRISPR gRNA sequence
tcgtgccactgcactccagc

SEQ ID NO: 615829 - DNA, 20 bp, Artificial
  CRISPR gRNA sequence
tccagcctgggtggcaaagt

SEQ ID NO: 615830 - DNA, 20 bp, Artificial
  CRISPR gRNA sequence
aaattaacttttcaggaaca

SEQ ID NO: 615831 - DNA, 20 bp, Artificial
  CRISPR gRNA sequence
attattcattgataaacctt

SEQ ID NO: 615832 - DNA, 20 bp, Artificial
  CRISPR gRNA sequence
gccgtagtgtatttagagat

SEQ ID NO: 615833 - DNA, 20 bp, Artificial
  CRISPR gRNA sequence
agatcaggatgttttgcttg

SEQ ID NO: 615834 - DNA, 20 bp, Artificial
  CRISPR gRNA sequence
aggcagcctacagactaatg

SEQ ID NO: 615835 - DNA, 20 bp, Artificial
  CRISPR gRNA sequence
tggttagaaaaatgaaaaag

SEQ ID NO: 615836 - DNA, 20 bp, Artificial
  CRISPR gRNA sequence
aacattatcagaaataattt

SEQ ID NO: 615837 - DNA, 20 bp, Artificial
  CRISPR gRNA sequence
agtagggggaaataaaaatg

SEQ ID NO: 615838 - DNA, 20 bp, Artificial
  CRISPR gRNA sequence
agacaaagacaagaagacag

SEQ ID NO: 615839 - DNA, 20 bp, Artificial
  CRISPR gRNA sequence
ctctggcaacaggggaaata

SEQ ID NO: 615840 - DNA, 20 bp, Artificial
  CRISPR gRNA sequence
tgactcattcaagacaaatc

SEQ ID NO: 615841 - DNA, 20 bp, Artificial
  CRISPR gRNA sequence
aggagtatcctagatacatc

SEQ ID NO: 615842 - DNA, 20 bp, Artificial
  CRISPR gRNA sequence
tttttttgtttgttttcttt

SEQ ID NO: 615843 - DNA, 20 bp, Artificial
  CRISPR gRNA sequence
tttcttttcgggtaagggca

SEQ ID NO: 615844 - DNA, 20 bp, Artificial
  CRISPR gRNA sequence
gtttaataaagagattattc

SEQ ID NO: 615845 - DNA, 20 bp, Artificial
  CRISPR gRNA sequence
agaaaaagtacagatgaaag

SEQ ID NO: 615846 - DNA, 20 bp, Artificial
  CRISPR gRNA sequence
tcatcagcttttataatacc

SEQ ID NO: 615847 - DNA, 20 bp, Artificial
  CRISPR gRNA sequence
gaattaacctactaggtgct

SEQ ID NO: 615848 - DNA, 20 bp, Artificial
  CRISPR gRNA sequence
acctactaggtgctttgagt

SEQ ID NO: 615849 - DNA, 20 bp, Artificial
  CRISPR gRNA sequence
aaacatctcacattaaggaa

SEQ ID NO: 615850 - DNA, 20 bp, Artificial
  CRISPR gRNA sequence
gagcactttgactcttggtt

SEQ ID NO: 615851 - DNA, 20 bp, Artificial
  CRISPR gRNA sequence
actttgactcttggttttga

SEQ ID NO: 615852 - DNA, 20 bp, Artificial
  CRISPR gRNA sequence
tgtctctatttgactcccag

SEQ ID NO: 615853 - DNA, 20 bp, Artificial
  CRISPR gRNA sequence
gaattatttagttttgctca

SEQ ID NO: 615854 - DNA, 20 bp, Artificial
  CRISPR gRNA sequence
actatcataaaagttattta

SEQ ID NO: 615855 - DNA, 20 bp, Artificial
  CRISPR gRNA sequence
agcttctattttttggaacc

SEQ ID NO: 615856 - DNA, 20 bp, Artificial
  CRISPR gRNA sequence
tggatttctgggaagtagct

SEQ ID NO: 615857 - DNA, 20 bp, Artificial
  CRISPR gRNA sequence
actattagcattactcagtt

SEQ ID NO: 615858 - DNA, 20 bp, Artificial
  CRISPR gRNA sequence
atatttctctagaaatagta

SEQ ID NO: 615859 - DNA, 20 bp, Artificial
  CRISPR gRNA sequence
gtaaactacttcagtcattt

SEQ ID NO: 615860 - DNA, 20 bp, Artificial
  CRISPR gRNA sequence
ccttcctcttcatcccatca

SEQ ID NO: 615861 - DNA, 20 bp, Artificial
  CRISPR gRNA sequence
atcccatcattgagtccaac

SEQ ID NO: 615862 - DNA, 20 bp, Artificial
  CRISPR gRNA sequence
tcattgagtccaacagggat

SEQ ID NO: 615863 - DNA, 20 bp, Artificial
  CRISPR gRNA sequence
cccaattattaggtgacatg

SEQ ID NO: 615864 - DNA, 20 bp, Artificial
  CRISPR gRNA sequence
tgggcagttgcatggagcaa

SEQ ID NO: 615865 - DNA, 20 bp, Artificial
  CRISPR gRNA sequence
aagtagtcattatataattg

SEQ ID NO: 615866 - DNA, 20 bp, Artificial
  CRISPR gRNA sequence
tcattatataattggggagt

SEQ ID NO: 615867 - DNA, 20 bp, Artificial
  CRISPR gRNA sequence
ggggagtgagggtggaaagg

SEQ ID NO: 615868 - DNA, 20 bp, Artificial
  CRISPR gRNA sequence
agggtggaaaggcaggattt

SEQ ID NO: 615869 - DNA, 20 bp, Artificial
  CRISPR gRNA sequence
atacatgtgtttatctgtac

SEQ ID NO: 615870 - DNA, 20 bp, Artificial
  CRISPR gRNA sequence
ttttgaaaagtcagtggtct

SEQ ID NO: 615871 - DNA, 20 bp, Artificial
  CRISPR gRNA sequence
ctatcaagctttcttgtgtc

SEQ ID NO: 615872 - DNA, 20 bp, Artificial
  CRISPR gRNA sequence
tgaaacatccacatcaggtc

SEQ ID NO: 615873 - DNA, 20 bp, Artificial
  CRISPR gRNA sequence
ccatgtacatctttcaatgt

SEQ ID NO: 615874 - DNA, 20 bp, Artificial
  CRISPR gRNA sequence
gtacatctttcaatgtctga

SEQ ID NO: 615875 - DNA, 20 bp, Artificial
  CRISPR gRNA sequence
aactgtgttgtaattaacca

SEQ ID NO: 615876 - DNA, 20 bp, Artificial
  CRISPR gRNA sequence
ttttaaattgataatacata

SEQ ID NO: 615877 - DNA, 20 bp, Artificial
  CRISPR gRNA sequence
caggagacaatatatatttg

SEQ ID NO: 615878 - DNA, 20 bp, Artificial
  CRISPR gRNA sequence
tccatacttgcaactgcctt

SEQ ID NO: 615879 - DNA, 20 bp, Artificial
  CRISPR gRNA sequence
tgccttttgagtcttgcctc

SEQ ID NO: 615880 - DNA, 20 bp, Artificial
  CRISPR gRNA sequence
attactttacacctacactt

SEQ ID NO: 615881 - DNA, 20 bp, Artificial
  CRISPR gRNA sequence
atgtgtctttgtaacttccg

SEQ ID NO: 615882 - DNA, 20 bp, Artificial
  CRISPR gRNA sequence
gtaacttccgaagagtttag

SEQ ID NO: 615883 - DNA, 20 bp, Artificial
  CRISPR gRNA sequence
tcatagaaagaactaataag

SEQ ID NO: 615884 - DNA, 20 bp, Artificial
  CRISPR gRNA sequence
aactaataagtggagttttt

SEQ ID NO: 615885 - DNA, 20 bp, Artificial
  CRISPR gRNA sequence
agataaattttggtatgaaa

SEQ ID NO: 615886 - DNA, 20 bp, Artificial
  CRISPR gRNA sequence
attctagatttatggtaatg

SEQ ID NO: 615887 - DNA, 20 bp, Artificial
  CRISPR gRNA sequence
tattcagtttgctcagcatt

SEQ ID NO: 615888 - DNA, 20 bp, Artificial
  CRISPR gRNA sequence
ttcatatttctaaataatat

SEQ ID NO: 615889 - DNA, 20 bp, Artificial
  CRISPR gRNA sequence
gcttctctgtcctggtagtt

SEQ ID NO: 615890 - DNA, 20 bp, Artificial
  CRISPR gRNA sequence
gtgcagcttttaatttttcc

SEQ ID NO: 615891 - DNA, 20 bp, Artificial
  CRISPR gRNA sequence
ctcacaccttactgataact

SEQ ID NO: 615892 - DNA, 20 bp, Artificial
  CRISPR gRNA sequence
cagttggaactgatggtacc

SEQ ID NO: 615893 - DNA, 20 bp, Artificial
  CRISPR gRNA sequence
atggtaccctgggtttatta

SEQ ID NO: 615894 - DNA, 20 bp, Artificial
  CRISPR gRNA sequence
catgattagtcttctgctgc

SEQ ID NO: 615895 - DNA, 20 bp, Artificial
  CRISPR gRNA sequence
atcccatgttttcctcttcg

SEQ ID NO: 615896 - DNA, 20 bp, Artificial
  CRISPR gRNA sequence
gttttcctcttcgttgggtt

SEQ ID NO: 615897 - DNA, 20 bp, Artificial
  CRISPR gRNA sequence
tctggtctaaagtctctaat

SEQ ID NO: 615898 - DNA, 20 bp, Artificial
  CRISPR gRNA sequence
atatactagttcacatattg

SEQ ID NO: 615899 - DNA, 20 bp, Artificial
  CRISPR gRNA sequence
ttaatttttatatatggcat

SEQ ID NO: 615900 - DNA, 20 bp, Artificial
  CRISPR gRNA sequence
agaccatttttttcaaaaat

SEQ ID NO: 615901 - DNA, 20 bp, Artificial
  CRISPR gRNA sequence
ttgaaaatcaactgaccaat

SEQ ID NO: 615902 - DNA, 20 bp, Artificial
  CRISPR gRNA sequence
aaaccaacagagcaagtctt

SEQ ID NO: 615903 - DNA, 20 bp, Artificial
  CRISPR gRNA sequence
gcaagtcttaggaatagatt

SEQ ID NO: 615904 - DNA, 20 bp, Artificial
  CRISPR gRNA sequence
atttctgttaaaaagcttgt

SEQ ID NO: 615905 - DNA, 20 bp, Artificial
  CRISPR gRNA sequence
aaaccaacatcttaacaata

SEQ ID NO: 615906 - DNA, 20 bp, Artificial
  CRISPR gRNA sequence
tctaagtatttcatacattt

SEQ ID NO: 615907 - DNA, 20 bp, Artificial
  CRISPR gRNA sequence
ttcttttctactcagttgca

SEQ ID NO: 615908 - DNA, 20 bp, Artificial
  CRISPR gRNA sequence
atttttataatatgtgaaag

SEQ ID NO: 615909 - DNA, 20 bp, Artificial
  CRISPR gRNA sequence
acttttgcatctgcatcatg

SEQ ID NO: 615910 - DNA, 20 bp, Artificial
  CRISPR gRNA sequence
aatgtctttgattttggtgt

SEQ ID NO: 615911 - DNA, 20 bp, Artificial
  CRISPR gRNA sequence
attttggtgtcagagtaatg

SEQ ID NO: 615912 - DNA, 20 bp, Artificial
  CRISPR gRNA sequence
ctcccttttctattgtctgg

SEQ ID NO: 615913 - DNA, 20 bp, Artificial
  CRISPR gRNA sequence
cattttccttaaatatttga

SEQ ID NO: 615914 - DNA, 20 bp, Artificial
  CRISPR gRNA sequence
aatttaccagtgaagtcatc

SEQ ID NO: 615915 - DNA, 20 bp, Artificial
  CRISPR gRNA sequence
ttaacttcaatttcaattcc

SEQ ID NO: 615916 - DNA, 20 bp, Artificial
  CRISPR gRNA sequence
tggaataaatgtgggctatt

SEQ ID NO: 615917 - DNA, 20 bp, Artificial
  CRISPR gRNA sequence
ttcagagtgtatatttcttc

SEQ ID NO: 615918 - DNA, 20 bp, Artificial
  CRISPR gRNA sequence
gtgtatatttcttcctgaat

SEQ ID NO: 615919 - DNA, 20 bp, Artificial
  CRISPR gRNA sequence
ctattttttatttcatctag

SEQ ID NO: 615920 - DNA, 20 bp, Artificial
  CRISPR gRNA sequence
tattatgcctccaatggcta

SEQ ID NO: 615921 - DNA, 20 bp, Artificial
  CRISPR gRNA sequence
aaacaaaacaaaaccctgtt

SEQ ID NO: 615922 - DNA, 20 bp, Artificial
  CRISPR gRNA sequence
atatattataattttcccaa

SEQ ID NO: 615923 - DNA, 20 bp, Artificial
  CRISPR gRNA sequence
gtcttactgcttttgtcttt

SEQ ID NO: 615924 - DNA, 20 bp, Artificial
  CRISPR gRNA sequence
ttttaaaattctgcctgata

SEQ ID NO: 615925 - DNA, 20 bp, Artificial
  CRISPR gRNA sequence
atgaaatgattaagtgggaa

SEQ ID NO: 615926 - DNA, 20 bp, Artificial
  CRISPR gRNA sequence
aaagtgagatatctttcaaa

SEQ ID NO: 615927 - DNA, 20 bp, Artificial
  CRISPR gRNA sequence
ctctttatatgaaatcattt

SEQ ID NO: 615928 - DNA, 20 bp, Artificial
  CRISPR gRNA sequence
gacagtttactaaagtagtt

SEQ ID NO: 615929 - DNA, 20 bp, Artificial
  CRISPR gRNA sequence
actaaagtagttgagggtgg

SEQ ID NO: 615930 - DNA, 20 bp, Artificial
  CRISPR gRNA sequence
aagtagttgagggtgggggg

SEQ ID NO: 615931 - DNA, 20 bp, Artificial
  CRISPR gRNA sequence
gagcattatcagaggttctt

SEQ ID NO: 615932 - DNA, 20 bp, Artificial
  CRISPR gRNA sequence
tttttttttgtttggtgaga

SEQ ID NO: 615933 - DNA, 20 bp, Artificial
  CRISPR gRNA sequence
tgtcgcccagactggagggc

SEQ ID NO: 615934 - DNA, 20 bp, Artificial
  CRISPR gRNA sequence
aggagtgcactggtgccacc

SEQ ID NO: 615935 - DNA, 20 bp, Artificial
  CRISPR gRNA sequence
atcactgcaacctccacctc

SEQ ID NO: 615936 - DNA, 20 bp, Artificial
  CRISPR gRNA sequence
gattctccagcctcagcctc

SEQ ID NO: 615937 - DNA, 20 bp, Artificial
  CRISPR gRNA sequence
ttttgtatttttagtagaga

SEQ ID NO: 615938 - DNA, 20 bp, Artificial
  CRISPR gRNA sequence
gcctcagcctcccaaagtgc

SEQ ID NO: 615939 - DNA, 20 bp, Artificial
  CRISPR gRNA sequence
tactgtttactcttctttaa

SEQ ID NO: 615940 - DNA, 20 bp, Artificial
  CRISPR gRNA sequence
ttatgtaagattatttttat

SEQ ID NO: 615941 - DNA, 20 bp, Artificial
  CRISPR gRNA sequence
tcaaaaaccatttaacccct

SEQ ID NO: 615942 - DNA, 20 bp, Artificial
  CRISPR gRNA sequence
gtcatttaacagattggttg

SEQ ID NO: 615943 - DNA, 20 bp, Artificial
  CRISPR gRNA sequence
tgtgcaaaatattcattatg

SEQ ID NO: 615944 - DNA, 20 bp, Artificial
  CRISPR gRNA sequence
aagtaaacagaaaggctagt

SEQ ID NO: 615945 - DNA, 20 bp, Artificial
  CRISPR gRNA sequence
ttactaggcatacagattaa

SEQ ID NO: 615946 - DNA, 20 bp, Artificial
  CRISPR gRNA sequence
tatcttggagatattgcagg

SEQ ID NO: 615947 - DNA, 20 bp, Artificial
  CRISPR gRNA sequence
agttccaccccatcacaata

SEQ ID NO: 615948 - DNA, 20 bp, Artificial
  CRISPR gRNA sequence
aaagaatatatcctgataaa

SEQ ID NO: 615949 - DNA, 20 bp, Artificial
  CRISPR gRNA sequence
ataatctattaagtgtgcaa

SEQ ID NO: 615950 - DNA, 20 bp, Artificial
  CRISPR gRNA sequence
actttgggaagtggaggcag

SEQ ID NO: 615951 - DNA, 20 bp, Artificial
  CRISPR gRNA sequence
caggaggatcactaaagccc

SEQ ID NO: 615952 - DNA, 20 bp, Artificial
  CRISPR gRNA sequence
acaaaactagcaaaattagc

SEQ ID NO: 615953 - DNA, 20 bp, Artificial
  CRISPR gRNA sequence
aggctgagaggctgaggtgg

SEQ ID NO: 615954 - DNA, 20 bp, Artificial
  CRISPR gRNA sequence
tcatctttccactggtggag

SEQ ID NO: 615955 - DNA, 20 bp, Artificial
  CRISPR gRNA sequence
ggctggtggttgttgaaggc

SEQ ID NO: 615956 - DNA, 20 bp, Artificial
  CRISPR gRNA sequence
ggtggttgttgaaggctggg

SEQ ID NO: 615957 - DNA, 20 bp, Artificial
  CRISPR gRNA sequence
ctatttgatacgattttacc

SEQ ID NO: 615958 - DNA, 20 bp, Artificial
  CRISPR gRNA sequence
tgatacgattttacccagag

SEQ ID NO: 615959 - DNA, 20 bp, Artificial
  CRISPR gRNA sequence
gagtagaatttctttcaaaa

SEQ ID NO: 615960 - DNA, 20 bp, Artificial
  CRISPR gRNA sequence
tgtcatttcaacaatattca

SEQ ID NO: 615961 - DNA, 20 bp, Artificial
  CRISPR gRNA sequence
taatatcttgaccttctcag

SEQ ID NO: 615962 - DNA, 20 bp, Artificial
  CRISPR gRNA sequence
caaatgttctcaatgacatc

SEQ ID NO: 615963 - DNA, 20 bp, Artificial
  CRISPR gRNA sequence
tctcaatgacatctagaatt

SEQ ID NO: 615964 - DNA, 20 bp, Artificial
  CRISPR gRNA sequence
taacccttgagcgtgggctg

SEQ ID NO: 615965 - DNA, 20 bp, Artificial
  CRISPR gRNA sequence
gtacatctccatcagaagtt

SEQ ID NO: 615966 - DNA, 20 bp, Artificial
  CRISPR gRNA sequence
atgaactgtaatattttgaa

SEQ ID NO: 615967 - DNA, 20 bp, Artificial
  CRISPR gRNA sequence
ttccatttatagagcacagg

SEQ ID NO: 615968 - DNA, 20 bp, Artificial
  CRISPR gRNA sequence
agcataattcttaaggacct

SEQ ID NO: 615969 - DNA, 20 bp, Artificial
  CRISPR gRNA sequence
cttaaggaccttagaatttt

SEQ ID NO: 615970 - DNA, 20 bp, Artificial
  CRISPR gRNA sequence
cagctgcattgtcctaccaa

SEQ ID NO: 615971 - DNA, 20 bp, Artificial
  CRISPR gRNA sequence
aattagcttagctagttctt

SEQ ID NO: 615972 - DNA, 20 bp, Artificial
  CRISPR gRNA sequence
agcttagctagttcttctgg

SEQ ID NO: 615973 - DNA, 20 bp, Artificial
  CRISPR gRNA sequence
atctcgtggccttcagaaaa

SEQ ID NO: 615974 - DNA, 20 bp, Artificial
  CRISPR gRNA sequence
ttcagaaaattgaatattgt

SEQ ID NO: 615975 - DNA, 20 bp, Artificial
  CRISPR gRNA sequence
aatattgttagggtcttcct

SEQ ID NO: 615976 - DNA, 20 bp, Artificial
  CRISPR gRNA sequence
aggattaggctttgatttaa

SEQ ID NO: 615977 - DNA, 20 bp, Artificial
  CRISPR gRNA sequence
cttatcacttgtgtgttcac

SEQ ID NO: 615978 - DNA, 20 bp, Artificial
  CRISPR gRNA sequence
tttgatttaaagtgagaaat

SEQ ID NO: 615979 - DNA, 20 bp, Artificial
  CRISPR gRNA sequence
tttcagtatttttgcatttc

SEQ ID NO: 615980 - DNA, 20 bp, Artificial
  CRISPR gRNA sequence
gagcaaatgtgaaatattgc

SEQ ID NO: 615981 - DNA, 20 bp, Artificial
  CRISPR gRNA sequence
atggtatcaaccgacttgct

SEQ ID NO: 615982 - DNA, 20 bp, Artificial
  CRISPR gRNA sequence
tcaaccgacttgcttggaat

SEQ ID NO: 615983 - DNA, 20 bp, Artificial
  CRISPR gRNA sequence
tattacaagaactcaggctt

SEQ ID NO: 615984 - DNA, 20 bp, Artificial
  CRISPR gRNA sequence
cttatgagtaagcaaataat

SEQ ID NO: 615985 - DNA, 20 bp, Artificial
  CRISPR gRNA sequence
aaatagcttgctctaactta

SEQ ID NO: 615986 - DNA, 20 bp, Artificial
  CRISPR gRNA sequence
acttatggaatattcatata

SEQ ID NO: 615987 - DNA, 20 bp, Artificial
  CRISPR gRNA sequence
agaatatgtatttgtatatc

SEQ ID NO: 615988 - DNA, 20 bp, Artificial
  CRISPR gRNA sequence
tccagaatgtggtttcttac

SEQ ID NO: 615989 - DNA, 20 bp, Artificial
  CRISPR gRNA sequence
acctaactcacagcatttct

SEQ ID NO: 615990 - DNA, 20 bp, Artificial
  CRISPR gRNA sequence
caatctcacagagcttacat

SEQ ID NO: 615991 - DNA, 20 bp, Artificial
  CRISPR gRNA sequence
gagcttacattcgagtgagg

SEQ ID NO: 615992 - DNA, 20 bp, Artificial
  CRISPR gRNA sequence
agatagcaaaatagaactaa

SEQ ID NO: 615993 - DNA, 20 bp, Artificial
  CRISPR gRNA sequence
atgcttctggtaggttgctt

SEQ ID NO: 615994 - DNA, 20 bp, Artificial
  CRISPR gRNA sequence
acgctgaaggtgttgacttc

SEQ ID NO: 615995 - DNA, 20 bp, Artificial
  CRISPR gRNA sequence
ttagttcaaaaacagtagga

SEQ ID NO: 615996 - DNA, 20 bp, Artificial
  CRISPR gRNA sequence
taggaaagaataaagaaacc

SEQ ID NO: 615997 - DNA, 20 bp, Artificial
  CRISPR gRNA sequence
acctcgggttgcaaagaacc

SEQ ID NO: 615998 - DNA, 20 bp, Artificial
  CRISPR gRNA sequence
cattaaaatattttaagaag

SEQ ID NO: 615999 - DNA, 20 bp, Artificial
  CRISPR gRNA sequence
aacattctggttgctatctg

SEQ ID NO: 616000 - DNA, 20 bp, Artificial
  CRISPR gRNA sequence
tggagaatagattgggaagc

SEQ ID NO: 616001 - DNA, 20 bp, Artificial
  CRISPR gRNA sequence
gagcttatatctcagctttc

SEQ ID NO: 616002 - DNA, 20 bp, Artificial
  CRISPR gRNA sequence
tttcatgagtatattggaag

SEQ ID NO: 616003 - DNA, 20 bp, Artificial
  CRISPR gRNA sequence
aattcttgttttattgtgct

SEQ ID NO: 616004 - DNA, 20 bp, Artificial
  CRISPR gRNA sequence
ctcaaccaccattgacctcc

SEQ ID NO: 616005 - DNA, 20 bp, Artificial
  CRISPR gRNA sequence
aaaacctttctagttaatat

SEQ ID NO: 616006 - DNA, 20 bp, Artificial
  CRISPR gRNA sequence
ttcaatcaatatggtatata

SEQ ID NO: 616007 - DNA, 20 bp, Artificial
  CRISPR gRNA sequence
aaaatctcttctttgagatg

SEQ ID NO: 616008 - DNA, 20 bp, Artificial
  CRISPR gRNA sequence
atatattttacatgcttatg

SEQ ID NO: 616009 - DNA, 20 bp, Artificial
  CRISPR gRNA sequence
tgtctgattttctaccattt

SEQ ID NO: 616010 - DNA, 20 bp, Artificial
  CRISPR gRNA sequence
ttggcaagatagtataggct

SEQ ID NO: 616011 - DNA, 20 bp, Artificial
  CRISPR gRNA sequence
tcccagtgtgtcatgccctt

SEQ ID NO: 616012 - DNA, 20 bp, Artificial
  CRISPR gRNA sequence
catgcccttctggatactag

SEQ ID NO: 616013 - DNA, 20 bp, Artificial
  CRISPR gRNA sequence
cagcctctccacttctgttg

SEQ ID NO: 616014 - DNA, 20 bp, Artificial
  CRISPR gRNA sequence
ctgtccacactaaatccatg

SEQ ID NO: 616015 - DNA, 20 bp, Artificial
  CRISPR gRNA sequence
aaaactgtggtagcaagctt

SEQ ID NO: 616016 - DNA, 20 bp, Artificial
  CRISPR gRNA sequence
agaacaatgagaaagcagct

SEQ ID NO: 616017 - DNA, 20 bp, Artificial
  CRISPR gRNA sequence
ccaaagtgaaaagagctgca

SEQ ID NO: 616018 - DNA, 20 bp, Artificial
  CRISPR gRNA sequence
ttattaattccttctagaaa

SEQ ID NO: 616019 - DNA, 20 bp, Artificial
  CRISPR gRNA sequence
ttttattagaaacaataacg

SEQ ID NO: 616020 - DNA, 20 bp, Artificial
  CRISPR gRNA sequence
atacataatggttattggtc

SEQ ID NO: 616021 - DNA, 20 bp, Artificial
  CRISPR gRNA sequence
taccttctaggtaaatttca

SEQ ID NO: 616022 - DNA, 20 bp, Artificial
  CRISPR gRNA sequence
ggacctcaagtgtgtgtttt

SEQ ID NO: 616023 - DNA, 20 bp, Artificial
  CRISPR gRNA sequence
aagtgtgtgttttaagagtc

SEQ ID NO: 616024 - DNA, 20 bp, Artificial
  CRISPR gRNA sequence
ggcaccaaaggcatcagtat

SEQ ID NO: 616025 - DNA, 20 bp, Artificial
  CRISPR gRNA sequence
ggcatcagtatcagaatttg

SEQ ID NO: 616026 - DNA, 20 bp, Artificial
  CRISPR gRNA sequence
caggaaggaaaggaggggct

SEQ ID NO: 616027 - DNA, 20 bp, Artificial
  CRISPR gRNA sequence
tttaatgcaccatcactatt

SEQ ID NO: 616028 - DNA, 20 bp, Artificial
  CRISPR gRNA sequence
actattatgaatgagctgca

SEQ ID NO: 616029 - DNA, 20 bp, Artificial
  CRISPR gRNA sequence
ttttcttttcttttttgaga

SEQ ID NO: 616030 - DNA, 20 bp, Artificial
  CRISPR gRNA sequence
tctcactctgtcacccaggc

SEQ ID NO: 616031 - DNA, 20 bp, Artificial
  CRISPR gRNA sequence
cccaggctggagtgcagtgg

SEQ ID NO: 616032 - DNA, 20 bp, Artificial
  CRISPR gRNA sequence
ccagctaatttttttgtatt

SEQ ID NO: 616033 - DNA, 20 bp, Artificial
  CRISPR gRNA sequence
ttttgtattttgagtagaga

SEQ ID NO: 616034 - DNA, 20 bp, Artificial
  CRISPR gRNA sequence
cggggtttcaccgtgttagc

SEQ ID NO: 616035 - DNA, 20 bp, Artificial
  CRISPR gRNA sequence
gtgaagtaatatggaagcaa

SEQ ID NO: 616036 - DNA, 20 bp, Artificial
  CRISPR gRNA sequence
aatatggaagcaaatggatg

SEQ ID NO: 616037 - DNA, 20 bp, Artificial
  CRISPR gRNA sequence
ggatgaaggattgagggaaa

SEQ ID NO: 616038 - DNA, 20 bp, Artificial
  CRISPR gRNA sequence
gaaactggtgtattataaaa

SEQ ID NO: 616039 - DNA, 20 bp, Artificial
  CRISPR gRNA sequence
taagagacaacaatgcgttt

SEQ ID NO: 616040 - DNA, 20 bp, Artificial
  CRISPR gRNA sequence
tgtggaaatatatttaaaca

SEQ ID NO: 616041 - DNA, 20 bp, Artificial
  CRISPR gRNA sequence
gaaatatatttaaacatagg

SEQ ID NO: 616042 - DNA, 20 bp, Artificial
  CRISPR gRNA sequence
gatgagtcataatactttac

SEQ ID NO: 616043 - DNA, 20 bp, Artificial
  CRISPR gRNA sequence
tataaactaggctatttaat

SEQ ID NO: 616044 - DNA, 20 bp, Artificial
  CRISPR gRNA sequence
aatatttctgagctattttt

SEQ ID NO: 616045 - DNA, 20 bp, Artificial
  CRISPR gRNA sequence
aagttgttgttttaacagat

SEQ ID NO: 616046 - DNA, 20 bp, Artificial
  CRISPR gRNA sequence
tccagttcctttttatggaa

SEQ ID NO: 616047 - DNA, 20 bp, Artificial
  CRISPR gRNA sequence
aagctgaaaattgtcaaaca

SEQ ID NO: 616048 - DNA, 20 bp, Artificial
  CRISPR gRNA sequence
aagtaagatagatacatgtt

SEQ ID NO: 616049 - DNA, 20 bp, Artificial
  CRISPR gRNA sequence
ttgaaagctgaggttttact

SEQ ID NO: 616050 - DNA, 20 bp, Artificial
  CRISPR gRNA sequence
aataattattttcttaaaat

SEQ ID NO: 616051 - DNA, 20 bp, Artificial
  CRISPR gRNA sequence
ttttagatttataagagaca

SEQ ID NO: 616052 - DNA, 20 bp, Artificial
  CRISPR gRNA sequence
tttttaattttcaaatgtat

SEQ ID NO: 616053 - DNA, 20 bp, Artificial
  CRISPR gRNA sequence
agtataattcttagccaaaa

SEQ ID NO: 616054 - DNA, 20 bp, Artificial
  CRISPR gRNA sequence
tatataggtaaacttgtgtc

SEQ ID NO: 616055 - DNA, 20 bp, Artificial
  CRISPR gRNA sequence
ttctgttttaaacctttaat

SEQ ID NO: 616056 - DNA, 20 bp, Artificial
  CRISPR gRNA sequence
ctttaatttgggtacagcat

SEQ ID NO: 616057 - DNA, 20 bp, Artificial
  CRISPR gRNA sequence
catgtaattctatttcctcc

SEQ ID NO: 616058 - DNA, 20 bp, Artificial
  CRISPR gRNA sequence
taaatattattttgactaat

SEQ ID NO: 616059 - DNA, 20 bp, Artificial
  CRISPR gRNA sequence
taatttaaacactatcccct

SEQ ID NO: 616060 - DNA, 20 bp, Artificial
  CRISPR gRNA sequence
aatatagtaatcaaatttat

SEQ ID NO: 616061 - DNA, 20 bp, Artificial
  CRISPR gRNA sequence
tcatcattaaatagtcactt

SEQ ID NO: 616062 - DNA, 20 bp, Artificial
  CRISPR gRNA sequence
actttgggaggctgaggcag

SEQ ID NO: 616063 - DNA, 20 bp, Artificial
  CRISPR gRNA sequence
caggcgaatcacctgaggtc

SEQ ID NO: 616064 - DNA, 20 bp, Artificial
  CRISPR gRNA sequence
ctgcactccagcctgggcca

SEQ ID NO: 616065 - DNA, 20 bp, Artificial
  CRISPR gRNA sequence
tatagtaaatctcaagatta

SEQ ID NO: 616066 - DNA, 20 bp, Artificial
  CRISPR gRNA sequence
tctcaagattactgaatagc

SEQ ID NO: 616067 - DNA, 20 bp, Artificial
  CRISPR gRNA sequence
gactgtaatctttttttggg

SEQ ID NO: 616068 - DNA, 20 bp, Artificial
  CRISPR gRNA sequence
tctttttttggggggggtgg

SEQ ID NO: 616069 - DNA, 20 bp, Artificial
  CRISPR gRNA sequence
ttttggggggggtgggagga

SEQ ID NO: 616070 - DNA, 20 bp, Artificial
  CRISPR gRNA sequence
ccaggctggtgtccgcctcc

SEQ ID NO: 616071 - DNA, 20 bp, Artificial
  CRISPR gRNA sequence
aatcctcctgcctcagcctc

SEQ ID NO: 616072 - DNA, 20 bp, Artificial
  CRISPR gRNA sequence
cacggtttcaccatgttaac

SEQ ID NO: 616073 - DNA, 20 bp, Artificial
  CRISPR gRNA sequence
acctcggcctcccaaagtgt

SEQ ID NO: 616074 - DNA, 20 bp, Artificial
  CRISPR gRNA sequence
cacttcaaggctatcagatg

SEQ ID NO: 616075 - DNA, 20 bp, Artificial
  CRISPR gRNA sequence
acaaaaagaagtaatttgga

SEQ ID NO: 616076 - DNA, 20 bp, Artificial
  CRISPR gRNA sequence
tagcagcaccaggagattta

SEQ ID NO: 616077 - DNA, 20 bp, Artificial
  CRISPR gRNA sequence
cattttttttttcaatcatt

SEQ ID NO: 616078 - DNA, 20 bp, Artificial
  CRISPR gRNA sequence
atcattaggagttacttcag

SEQ ID NO: 616079 - DNA, 20 bp, Artificial
  CRISPR gRNA sequence
tcagtagagttaaagcttta

SEQ ID NO: 616080 - DNA, 20 bp, Artificial
  CRISPR gRNA sequence
ctgtgtcatttatcacttag

SEQ ID NO: 616081 - DNA, 20 bp, Artificial
  CRISPR gRNA sequence
ggtgtgatgagcacaaattg

SEQ ID NO: 616082 - DNA, 20 bp, Artificial
  CRISPR gRNA sequence
ttgctgccttagtttaaatc

SEQ ID NO: 616083 - DNA, 20 bp, Artificial
  CRISPR gRNA sequence
tttctgcctcagtgtacaat

SEQ ID NO: 616084 - DNA, 20 bp, Artificial
  CRISPR gRNA sequence
tctctttgtaaaacatacta

SEQ ID NO: 616085 - DNA, 20 bp, Artificial
  CRISPR gRNA sequence
ctaatggataaccaaaaaca

SEQ ID NO: 616086 - DNA, 20 bp, Artificial
  CRISPR gRNA sequence
tacgttcttctttggtacgt

SEQ ID NO: 616087 - DNA, 20 bp, Artificial
  CRISPR gRNA sequence
gagctgtatgtgtagtcact

SEQ ID NO: 616088 - DNA, 20 bp, Artificial
  CRISPR gRNA sequence
tccaacgaaataattacaaa

SEQ ID NO: 616089 - DNA, 20 bp, Artificial
  CRISPR gRNA sequence
ataaaaatatttctaaagaa

SEQ ID NO: 616090 - DNA, 20 bp, Artificial
  CRISPR gRNA sequence
tagtgaaaaaatctttaaaa

SEQ ID NO: 616091 - DNA, 20 bp, Artificial
  CRISPR gRNA sequence
atagaagtctgactgcttca

SEQ ID NO: 616092 - DNA, 20 bp, Artificial
  CRISPR gRNA sequence
gtaactaaagataatgtgtt

SEQ ID NO: 616093 - DNA, 20 bp, Artificial
  CRISPR gRNA sequence
ggtgtcctctagaggacaag

SEQ ID NO: 616094 - DNA, 20 bp, Artificial
  CRISPR gRNA sequence
agaaaaataccaccttgtac

SEQ ID NO: 616095 - DNA, 20 bp, Artificial
  CRISPR gRNA sequence
ccacaaatgacaggtggtgg

SEQ ID NO: 616096 - DNA, 20 bp, Artificial
  CRISPR gRNA sequence
aggtggtgggggaatgattt

SEQ ID NO: 616097 - DNA, 20 bp, Artificial
  CRISPR gRNA sequence
cttgcatgcgcagttcacaa

SEQ ID NO: 616098 - DNA, 20 bp, Artificial
  CRISPR gRNA sequence
acaatagggtgcgtgcctat

SEQ ID NO: 616099 - DNA, 20 bp, Artificial
  CRISPR gRNA sequence
gaggcaccagtaagagactg

SEQ ID NO: 616100 - DNA, 20 bp, Artificial
  CRISPR gRNA sequence
gtaagagactgaagggtgga

SEQ ID NO: 616101 - DNA, 20 bp, Artificial
  CRISPR gRNA sequence
aagggtggaaagagtgaggt

SEQ ID NO: 616102 - DNA, 20 bp, Artificial
  CRISPR gRNA sequence
ttattcctaaccattctttt

SEQ ID NO: 616103 - DNA, 20 bp, Artificial
  CRISPR gRNA sequence
tgtccccaaattttccccac

SEQ ID NO: 616104 - DNA, 20 bp, Artificial
  CRISPR gRNA sequence
gtgtcttactgttttcttgt

SEQ ID NO: 616105 - DNA, 20 bp, Artificial
  CRISPR gRNA sequence
tgtcaggatcctgactgata

SEQ ID NO: 616106 - DNA, 20 bp, Artificial
  CRISPR gRNA sequence
gcccaaagctccagtcaaaa

SEQ ID NO: 616107 - DNA, 20 bp, Artificial
  CRISPR gRNA sequence
ctccagtcaaaatggaattc

SEQ ID NO: 616108 - DNA, 20 bp, Artificial
  CRISPR gRNA sequence
aaaatggaattcaaggatag

SEQ ID NO: 616109 - DNA, 20 bp, Artificial
  CRISPR gRNA sequence
gcaggatagcctccttatca

SEQ ID NO: 616110 - DNA, 20 bp, Artificial
  CRISPR gRNA sequence
tgtcactggtggtagcatgg

SEQ ID NO: 616111 - DNA, 20 bp, Artificial
  CRISPR gRNA sequence
gcatggaaggatgtacgacg

SEQ ID NO: 616112 - DNA, 20 bp, Artificial
  CRISPR gRNA sequence
acacaaaggtggaagacaaa

SEQ ID NO: 616113 - DNA, 20 bp, Artificial
  CRISPR gRNA sequence
tggaagacaaactgagtgcc

SEQ ID NO: 616114 - DNA, 20 bp, Artificial
  CRISPR gRNA sequence
agtgcctggaatactcaagt

SEQ ID NO: 616115 - DNA, 20 bp, Artificial
  CRISPR gRNA sequence
aaagtttatgtcagctttaa

SEQ ID NO: 616116 - DNA, 20 bp, Artificial
  CRISPR gRNA sequence
ataaggctgaagaccaactc

SEQ ID NO: 616117 - DNA, 20 bp, Artificial
  CRISPR gRNA sequence
caactccagaatctgatttg

SEQ ID NO: 616118 - DNA, 20 bp, Artificial
  CRISPR gRNA sequence
gaatctgatttgaagggtta

SEQ ID NO: 616119 - DNA, 20 bp, Artificial
  CRISPR gRNA sequence
gatgagaaagcagagaaaca

SEQ ID NO: 616120 - DNA, 20 bp, Artificial
  CRISPR gRNA sequence
ctaaaagaaataataattct

SEQ ID NO: 616121 - DNA, 20 bp, Artificial
  CRISPR gRNA sequence
aagaaataataattctatgg

SEQ ID NO: 616122 - DNA, 20 bp, Artificial
  CRISPR gRNA sequence
tcagaaaactgaaagatgtt

SEQ ID NO: 616123 - DNA, 20 bp, Artificial
  CRISPR gRNA sequence
cattccaaaaaacatcaagc

SEQ ID NO: 616124 - DNA, 20 bp, Artificial
  CRISPR gRNA sequence
attatattcatgacattaca

SEQ ID NO: 616125 - DNA, 20 bp, Artificial
  CRISPR gRNA sequence
acactgagtgaacttgggag

SEQ ID NO: 616126 - DNA, 20 bp, Artificial
  CRISPR gRNA sequence
tcagtaagagatatatgcta

SEQ ID NO: 616127 - DNA, 20 bp, Artificial
  CRISPR gRNA sequence
agaagcaacatagaccatat

SEQ ID NO: 616128 - DNA, 20 bp, Artificial
  CRISPR gRNA sequence
agagcagcctggggcaagaa

SEQ ID NO: 616129 - DNA, 20 bp, Artificial
  CRISPR gRNA sequence
gtgtactgggccataggact

SEQ ID NO: 616130 - DNA, 20 bp, Artificial
  CRISPR gRNA sequence
aacccgtatgtatggcctca

SEQ ID NO: 616131 - DNA, 20 bp, Artificial
  CRISPR gRNA sequence
attctcagtgactagttgat

SEQ ID NO: 616132 - DNA, 20 bp, Artificial
  CRISPR gRNA sequence
gttgatgaggatgaaacagt

SEQ ID NO: 616133 - DNA, 20 bp, Artificial
  CRISPR gRNA sequence
gtgtggatctggtttgtaaa

SEQ ID NO: 616134 - DNA, 20 bp, Artificial
  CRISPR gRNA sequence
tggtttgtaaatagaatgtc

SEQ ID NO: 616135 - DNA, 20 bp, Artificial
  CRISPR gRNA sequence
gtggctatcccaccagcagc

SEQ ID NO: 616136 - DNA, 20 bp, Artificial
  CRISPR gRNA sequence
tggtgacagaaagtctaggg

SEQ ID NO: 616137 - DNA, 20 bp, Artificial
  CRISPR gRNA sequence
aaagtctagggaagagttat

SEQ ID NO: 616138 - DNA, 20 bp, Artificial
  CRISPR gRNA sequence
agttatgaggatatatcctt

SEQ ID NO: 616139 - DNA, 20 bp, Artificial
  CRISPR gRNA sequence
aaggctgttagtaatctgaa

SEQ ID NO: 616140 - DNA, 20 bp, Artificial
  CRISPR gRNA sequence
aatctgaagggggtaatctc

SEQ ID NO: 616141 - DNA, 20 bp, Artificial
  CRISPR gRNA sequence
ccaatgtacaaagtgacaat

SEQ ID NO: 616142 - DNA, 20 bp, Artificial
  CRISPR gRNA sequence
gaggcagaaatatatcctaa

SEQ ID NO: 616143 - DNA, 20 bp, Artificial
  CRISPR gRNA sequence
ttttgcaagctccctcaaat

SEQ ID NO: 616144 - DNA, 20 bp, Artificial
  CRISPR gRNA sequence
tccctcaaatatggatttaa

SEQ ID NO: 616145 - DNA, 20 bp, Artificial
  CRISPR gRNA sequence
atacaattagcgcaaatcta

SEQ ID NO: 616146 - DNA, 20 bp, Artificial
  CRISPR gRNA sequence
agcgcaaatctatagaatgc

SEQ ID NO: 616147 - DNA, 20 bp, Artificial
  CRISPR gRNA sequence
ataccccatgtatcaccaca

SEQ ID NO: 616148 - DNA, 20 bp, Artificial
  CRISPR gRNA sequence
cacagaatcagctggctaca

SEQ ID NO: 616149 - DNA, 20 bp, Artificial
  CRISPR gRNA sequence
gtggtgaaatggcctaccaa

SEQ ID NO: 616150 - DNA, 20 bp, Artificial
  CRISPR gRNA sequence
atgtatggttgccagctggg

SEQ ID NO: 616151 - DNA, 20 bp, Artificial
  CRISPR gRNA sequence
ggttgccagctgggaggagt

SEQ ID NO: 616152 - DNA, 20 bp, Artificial
  CRISPR gRNA sequence
aggagtttgggtgtgttcta

SEQ ID NO: 616153 - DNA, 20 bp, Artificial
  CRISPR gRNA sequence
ctcctccatagccagaaggc

SEQ ID NO: 616154 - DNA, 20 bp, Artificial
  CRISPR gRNA sequence
gagatctcagttcccaaaag

SEQ ID NO: 616155 - DNA, 20 bp, Artificial
  CRISPR gRNA sequence
gtcctgttgtattggaagct

SEQ ID NO: 616156 - DNA, 20 bp, Artificial
  CRISPR gRNA sequence
ttataatttttccagactac

SEQ ID NO: 616157 - DNA, 20 bp, Artificial
  CRISPR gRNA sequence
agaactatgcttggaactca

SEQ ID NO: 616158 - DNA, 20 bp, Artificial
  CRISPR gRNA sequence
tatttagccgatgtgctaaa

SEQ ID NO: 616159 - DNA, 20 bp, Artificial
  CRISPR gRNA sequence
gccgatgtgctaaacagagt

SEQ ID NO: 616160 - DNA, 20 bp, Artificial
  CRISPR gRNA sequence
tatctattatgaagaaaatt

SEQ ID NO: 616161 - DNA, 20 bp, Artificial
  CRISPR gRNA sequence
gattccaattggaagcatga

SEQ ID NO: 616162 - DNA, 20 bp, Artificial
  CRISPR gRNA sequence
agctcttggtgatgcagtag

SEQ ID NO: 616163 - DNA, 20 bp, Artificial
  CRISPR gRNA sequence
agggactccattaaactctc

SEQ ID NO: 616164 - DNA, 20 bp, Artificial
  CRISPR gRNA sequence
actctcttgaattacccaat

SEQ ID NO: 616165 - DNA, 20 bp, Artificial
  CRISPR gRNA sequence
atgatttcaacaaaaataag

SEQ ID NO: 616166 - DNA, 20 bp, Artificial
  CRISPR gRNA sequence
aataataatttaactctggc

SEQ ID NO: 616167 - DNA, 20 bp, Artificial
  CRISPR gRNA sequence
aatgttgtagttggaagtaa

SEQ ID NO: 616168 - DNA, 20 bp, Artificial
  CRISPR gRNA sequence
tttgtaactgccccaaattt

SEQ ID NO: 616169 - DNA, 20 bp, Artificial
  CRISPR gRNA sequence
taaaaacttagtacagcctt

SEQ ID NO: 616170 - DNA, 20 bp, Artificial
  CRISPR gRNA sequence
gaaacaaataaaactagctt

SEQ ID NO: 616171 - DNA, 20 bp, Artificial
  CRISPR gRNA sequence
aaaagtcaaatgagattcat

SEQ ID NO: 616172 - DNA, 20 bp, Artificial
  CRISPR gRNA sequence
tatttttttcttttattccc

SEQ ID NO: 616173 - DNA, 20 bp, Artificial
  CRISPR gRNA sequence
tatgaaacacagcaaagttt

SEQ ID NO: 616174 - DNA, 20 bp, Artificial
  CRISPR gRNA sequence
ttgagagctaaagatacaag

SEQ ID NO: 616175 - DNA, 20 bp, Artificial
  CRISPR gRNA sequence
gatacaaggagagttaaaat

SEQ ID NO: 616176 - DNA, 20 bp, Artificial
  CRISPR gRNA sequence
atactcgaaaagccaatttt

SEQ ID NO: 616177 - DNA, 20 bp, Artificial
  CRISPR gRNA sequence
gaaacataactgatattata

SEQ ID NO: 616178 - DNA, 20 bp, Artificial
  CRISPR gRNA sequence
atactggatcttcacttatc

SEQ ID NO: 616179 - DNA, 20 bp, Artificial
  CRISPR gRNA sequence
ctgttttacttttcttctca

SEQ ID NO: 616180 - DNA, 20 bp, Artificial
  CRISPR gRNA sequence
aaggagttggtgacacttac

SEQ ID NO: 616181 - DNA, 20 bp, Artificial
  CRISPR gRNA sequence
agttggtgacacttaccaga

SEQ ID NO: 616182 - DNA, 20 bp, Artificial
  CRISPR gRNA sequence
acatttgaacggcttctctc

SEQ ID NO: 616183 - DNA, 20 bp, Artificial
  CRISPR gRNA sequence
tgtctcagaaggttgccctt

SEQ ID NO: 616184 - DNA, 20 bp, Artificial
  CRISPR gRNA sequence
aagaaatgggaagtatcaac

SEQ ID NO: 616185 - DNA, 20 bp, Artificial
  CRISPR gRNA sequence
cttttaaacatttatctgcc

SEQ ID NO: 616186 - DNA, 20 bp, Artificial
  CRISPR gRNA sequence
aagtcctatcattgactcag

SEQ ID NO: 616187 - DNA, 20 bp, Artificial
  CRISPR gRNA sequence
ctttagggccttacacacaa

SEQ ID NO: 616188 - DNA, 20 bp, Artificial
  CRISPR gRNA sequence
acacaattggatgctttcca

SEQ ID NO: 616189 - DNA, 20 bp, Artificial
  CRISPR gRNA sequence
tgtgaaacttattatttgaa

SEQ ID NO: 616190 - DNA, 20 bp, Artificial
  CRISPR gRNA sequence
gaagcagtacaactggcaag

SEQ ID NO: 616191 - DNA, 20 bp, Artificial
  CRISPR gRNA sequence
tcatactaaagctctaagtt

SEQ ID NO: 616192 - DNA, 20 bp, Artificial
  CRISPR gRNA sequence
taactgaaacacacataata

SEQ ID NO: 616193 - DNA, 20 bp, Artificial
  CRISPR gRNA sequence
tctgtagtatttagtgtttt

SEQ ID NO: 616194 - DNA, 20 bp, Artificial
  CRISPR gRNA sequence
ataccaaaaaggtgtaatct

SEQ ID NO: 616195 - DNA, 20 bp, Artificial
  CRISPR gRNA sequence
gtgtaatctgtgggtgtggt

SEQ ID NO: 616196 - DNA, 20 bp, Artificial
  CRISPR gRNA sequence
gaggtcctatattgataata

SEQ ID NO: 616197 - DNA, 20 bp, Artificial
  CRISPR gRNA sequence
acataaggttttaaaataaa

SEQ ID NO: 616198 - DNA, 20 bp, Artificial
  CRISPR gRNA sequence
tatttgattctctttcctaa

SEQ ID NO: 616199 - DNA, 20 bp, Artificial
  CRISPR gRNA sequence
aggctgcaactttttaaatc

SEQ ID NO: 616200 - DNA, 20 bp, Artificial
  CRISPR gRNA sequence
ttcgttaacaataactttac

SEQ ID NO: 616201 - DNA, 20 bp, Artificial
  CRISPR gRNA sequence
ctttaaacctcctacaatgt

SEQ ID NO: 616202 - DNA, 20 bp, Artificial
  CRISPR gRNA sequence
atatttcaaaatccttaatt

SEQ ID NO: 616203 - DNA, 20 bp, Artificial
  CRISPR gRNA sequence
gaaacaatatcttttttaaa

SEQ ID NO: 616204 - DNA, 20 bp, Artificial
  CRISPR gRNA sequence
gaattttaaaattcacctaa

SEQ ID NO: 616205 - DNA, 20 bp, Artificial
  CRISPR gRNA sequence
gagttttatgcgattaatga

SEQ ID NO: 616206 - DNA, 20 bp, Artificial
  CRISPR gRNA sequence
tttttaataagaaattactt

SEQ ID NO: 616207 - DNA, 20 bp, Artificial
  CRISPR gRNA sequence
atgatcatccccaaatggcg

SEQ ID NO: 616208 - DNA, 20 bp, Artificial
  CRISPR gRNA sequence
ctggaaatattgtcctgttg

SEQ ID NO: 616209 - DNA, 20 bp, Artificial
  CRISPR gRNA sequence
aggctttgggagatattgat

SEQ ID NO: 616210 - DNA, 20 bp, Artificial
  CRISPR gRNA sequence
gggagatattgatttgaatt

SEQ ID NO: 616211 - DNA, 20 bp, Artificial
  CRISPR gRNA sequence
ttgatagatgctttttacat

SEQ ID NO: 616212 - DNA, 20 bp, Artificial
  CRISPR gRNA sequence
gaaaagataattatcatttc

SEQ ID NO: 616213 - DNA, 20 bp, Artificial
  CRISPR gRNA sequence
tgttccaaactaaagttagt

SEQ ID NO: 616214 - DNA, 20 bp, Artificial
  CRISPR gRNA sequence
aagacaatactgttagaaac

SEQ ID NO: 616215 - DNA, 20 bp, Artificial
  CRISPR gRNA sequence
tagaaacaaggattaaaaca

SEQ ID NO: 616216 - DNA, 20 bp, Artificial
  CRISPR gRNA sequence
agtatacatagttatattcc

SEQ ID NO: 616217 - DNA, 20 bp, Artificial
  CRISPR gRNA sequence
tgtctaataacaaataaaaa

SEQ ID NO: 616218 - DNA, 20 bp, Artificial
  CRISPR gRNA sequence
aaacattagcaaccctttta

SEQ ID NO: 616219 - DNA, 20 bp, Artificial
  CRISPR gRNA sequence
aacccttttattgaatgtcg

SEQ ID NO: 616220 - DNA, 20 bp, Artificial
  CRISPR gRNA sequence
atttcctggcctaggcatta

SEQ ID NO: 616221 - DNA, 20 bp, Artificial
  CRISPR gRNA sequence
actgcatcaatgtgcccttt

SEQ ID NO: 616222 - DNA, 20 bp, Artificial
  CRISPR gRNA sequence
aaaaatctagactaacaaaa

SEQ ID NO: 616223 - DNA, 20 bp, Artificial
  CRISPR gRNA sequence
ggtccatttttatttattga

SEQ ID NO: 616224 - DNA, 20 bp, Artificial
  CRISPR gRNA sequence
attatatattatttttatta

SEQ ID NO: 616225 - DNA, 20 bp, Artificial
  CRISPR gRNA sequence
atatgcatcaacttgctttg

SEQ ID NO: 616226 - DNA, 20 bp, Artificial
  CRISPR gRNA sequence
gctttggtgaatcaaagaca

SEQ ID NO: 616227 - DNA, 20 bp, Artificial
  CRISPR gRNA sequence
agacagagggtgctcctatg

SEQ ID NO: 616228 - DNA, 20 bp, Artificial
  CRISPR gRNA sequence
tggaacaacctacaaatatg

SEQ ID NO: 616229 - DNA, 20 bp, Artificial
  CRISPR gRNA sequence
tgcagaatctcaagcatctg

SEQ ID NO: 616230 - DNA, 20 bp, Artificial
  CRISPR gRNA sequence
tgctgagtgcctttgagcaa

SEQ ID NO: 616231 - DNA, 20 bp, Artificial
  CRISPR gRNA sequence
acaaaatacggtgctgaaaa

SEQ ID NO: 616232 - DNA, 20 bp, Artificial
  CRISPR gRNA sequence
tgaaaactgagttacaagat

SEQ ID NO: 616233 - DNA, 20 bp, Artificial
  CRISPR gRNA sequence
attaaggagaggcaaaatta

SEQ ID NO: 616234 - DNA, 20 bp, Artificial
  CRISPR gRNA sequence
caatcgatatgtgttcatgc

SEQ ID NO: 616235 - DNA, 20 bp, Artificial
  CRISPR gRNA sequence
ttctctctatattcccagtg

SEQ ID NO: 616236 - DNA, 20 bp, Artificial
  CRISPR gRNA sequence
tattcccagtgaagagtgcc

SEQ ID NO: 616237 - DNA, 20 bp, Artificial
  CRISPR gRNA sequence
cactgcaattggtactttag

SEQ ID NO: 616238 - DNA, 20 bp, Artificial
  CRISPR gRNA sequence
gagtatgacagagaaagaag

SEQ ID NO: 616239 - DNA, 20 bp, Artificial
  CRISPR gRNA sequence
atgacagagaaagaagaaga

SEQ ID NO: 616240 - DNA, 20 bp, Artificial
  CRISPR gRNA sequence
tgatgctccatgatattgta

SEQ ID NO: 616241 - DNA, 20 bp, Artificial
  CRISPR gRNA sequence
ctccatgatattgtaatgaa

SEQ ID NO: 616242 - DNA, 20 bp, Artificial
  CRISPR gRNA sequence
atcccagcactttgagaggc

SEQ ID NO: 616243 - DNA, 20 bp, Artificial
  CRISPR gRNA sequence
cagcactttgagaggctagg

SEQ ID NO: 616244 - DNA, 20 bp, Artificial
  CRISPR gRNA sequence
tgggtggaacaactgaggtc

SEQ ID NO: 616245 - DNA, 20 bp, Artificial
  CRISPR gRNA sequence
tactttggaggctgaggcag

SEQ ID NO: 616246 - DNA, 20 bp, Artificial
  CRISPR gRNA sequence
tcgcttgaacccaggaggtg

SEQ ID NO: 616247 - DNA, 20 bp, Artificial
  CRISPR gRNA sequence
atgagagataaacaattgat

SEQ ID NO: 616248 - DNA, 20 bp, Artificial
  CRISPR gRNA sequence
gacacactcagatgtataaa

SEQ ID NO: 616249 - DNA, 20 bp, Artificial
  CRISPR gRNA sequence
ttaacatactccttgctgtt

SEQ ID NO: 616250 - DNA, 20 bp, Artificial
  CRISPR gRNA sequence
atactccttgctgttatgag

SEQ ID NO: 616251 - DNA, 20 bp, Artificial
  CRISPR gRNA sequence
tccttgctgttatgagttga

SEQ ID NO: 616252 - DNA, 20 bp, Artificial
  CRISPR gRNA sequence
ttgagtgagtctcgtattcc

SEQ ID NO: 616253 - DNA, 20 bp, Artificial
  CRISPR gRNA sequence
agtaaataacaaaaggacag

SEQ ID NO: 616254 - DNA, 20 bp, Artificial
  CRISPR gRNA sequence
tttacaaattaacaatcctc

SEQ ID NO: 616255 - DNA, 20 bp, Artificial
  CRISPR gRNA sequence
tgaatattattgtagctaca

SEQ ID NO: 616256 - DNA, 20 bp, Artificial
  CRISPR gRNA sequence
aaaaactgtactctggttct

SEQ ID NO: 616257 - DNA, 20 bp, Artificial
  CRISPR gRNA sequence
agataggagaagttacacat

SEQ ID NO: 616258 - DNA, 20 bp, Artificial
  CRISPR gRNA sequence
aggagaagttacacatttga

SEQ ID NO: 616259 - DNA, 20 bp, Artificial
  CRISPR gRNA sequence
aatacaatcactcttacata

SEQ ID NO: 616260 - DNA, 20 bp, Artificial
  CRISPR gRNA sequence
cttgtttttagaactgtcgt

SEQ ID NO: 616261 - DNA, 20 bp, Artificial
  CRISPR gRNA sequence
aatgtaattgactgtatgat

SEQ ID NO: 616262 - DNA, 20 bp, Artificial
  CRISPR gRNA sequence
gcaatgcctttacctacata

SEQ ID NO: 616263 - DNA, 20 bp, Artificial
  CRISPR gRNA sequence
aaagtatattttaaaactct

SEQ ID NO: 616264 - DNA, 20 bp, Artificial
  CRISPR gRNA sequence
aaaccaattttcatatgaac

SEQ ID NO: 616265 - DNA, 20 bp, Artificial
  CRISPR gRNA sequence
gaacttgaatcttttttgtt

SEQ ID NO: 616266 - DNA, 20 bp, Artificial
  CRISPR gRNA sequence
ttaagaaaaaaaaattggca

SEQ ID NO: 616267 - DNA, 20 bp, Artificial
  CRISPR gRNA sequence
caaatgtttaaaaatatagt

SEQ ID NO: 616268 - DNA, 20 bp, Artificial
  CRISPR gRNA sequence
gctttttcctcactctatcc

SEQ ID NO: 616269 - DNA, 20 bp, Artificial
  CRISPR gRNA sequence
aatcctacatatatccttgc

SEQ ID NO: 616270 - DNA, 20 bp, Artificial
  CRISPR gRNA sequence
cctgctactgagacctgtgg

SEQ ID NO: 616271 - DNA, 20 bp, Artificial
  CRISPR gRNA sequence
caatcagaaattgtatttca

SEQ ID NO: 616272 - DNA, 20 bp, Artificial
  CRISPR gRNA sequence
attgtatttcaaggagttaa

SEQ ID NO: 616273 - DNA, 20 bp, Artificial
  CRISPR gRNA sequence
ttattcacttacataaatgc

SEQ ID NO: 616274 - DNA, 20 bp, Artificial
  CRISPR gRNA sequence
gcaaactatattacctgccc

SEQ ID NO: 616275 - DNA, 20 bp, Artificial
  CRISPR gRNA sequence
tatattaagaactgtggaaa

SEQ ID NO: 616276 - DNA, 20 bp, Artificial
  CRISPR gRNA sequence
tttctgcaatccaatactag

SEQ ID NO: 616277 - DNA, 20 bp, Artificial
  CRISPR gRNA sequence
agttttcaccactgccaccc

SEQ ID NO: 616278 - DNA, 20 bp, Artificial
  CRISPR gRNA sequence
acccctgaataaaaaggaaa

SEQ ID NO: 616279 - DNA, 20 bp, Artificial
  CRISPR gRNA sequence
ttcagtttaccattcggaag

SEQ ID NO: 616280 - DNA, 20 bp, Artificial
  CRISPR gRNA sequence
ccacctcgctgctctcaatt

SEQ ID NO: 616281 - DNA, 20 bp, Artificial
  CRISPR gRNA sequence
tgatctcatcttcacggctc

SEQ ID NO: 616282 - DNA, 20 bp, Artificial
  CRISPR gRNA sequence
actctgcatttctagcttta

SEQ ID NO: 616283 - DNA, 20 bp, Artificial
  CRISPR gRNA sequence
actcattgtcatcctactaa

SEQ ID NO: 616284 - DNA, 20 bp, Artificial
  CRISPR gRNA sequence
gatgaaaatgatatataaag

SEQ ID NO: 616285 - DNA, 20 bp, Artificial
  CRISPR gRNA sequence
aaatgatatataaagtagaa

SEQ ID NO: 616286 - DNA, 20 bp, Artificial
  CRISPR gRNA sequence
aagtagaatagagttcatca

SEQ ID NO: 616287 - DNA, 20 bp, Artificial
  CRISPR gRNA sequence
tcaggaaaactctaggtaaa

SEQ ID NO: 616288 - DNA, 20 bp, Artificial
  CRISPR gRNA sequence
aataatcctggtattggctt

SEQ ID NO: 616289 - DNA, 20 bp, Artificial
  CRISPR gRNA sequence
taagactcctaggactgaga

SEQ ID NO: 616290 - DNA, 20 bp, Artificial
  CRISPR gRNA sequence
tcatattctctgtttcacat

SEQ ID NO: 616291 - DNA, 20 bp, Artificial
  CRISPR gRNA sequence
acagggcaagagaaacaatt

SEQ ID NO: 616292 - DNA, 20 bp, Artificial
  CRISPR gRNA sequence
atgccttctgtttgctgttt

SEQ ID NO: 616293 - DNA, 20 bp, Artificial
  CRISPR gRNA sequence
ggatcatcccacagaaaagt

SEQ ID NO: 616294 - DNA, 20 bp, Artificial
  CRISPR gRNA sequence
ttgttagcacagccttcatt

SEQ ID NO: 616295 - DNA, 20 bp, Artificial
  CRISPR gRNA sequence
ccttcattctggattgctga

SEQ ID NO: 616296 - DNA, 20 bp, Artificial
  CRISPR gRNA sequence
aaagcagaaacaagctttaa

SEQ ID NO: 616297 - DNA, 20 bp, Artificial
  CRISPR gRNA sequence
gtcattagtacttatcacaa

SEQ ID NO: 616298 - DNA, 20 bp, Artificial
  CRISPR gRNA sequence
tcttgaactaattatttaaa

SEQ ID NO: 616299 - DNA, 20 bp, Artificial
  CRISPR gRNA sequence
gtacagatgaactcagatta

SEQ ID NO: 616300 - DNA, 20 bp, Artificial
  CRISPR gRNA sequence
acagtttaggtattaagaac

SEQ ID NO: 616301 - DNA, 20 bp, Artificial
  CRISPR gRNA sequence
caccatgtcctttataaaac

SEQ ID NO: 616302 - DNA, 20 bp, Artificial
  CRISPR gRNA sequence
atggttgctgtgagcattaa

SEQ ID NO: 616303 - DNA, 20 bp, Artificial
  CRISPR gRNA sequence
atgtgcttatcttttttttc

SEQ ID NO: 616304 - DNA, 20 bp, Artificial
  CRISPR gRNA sequence
atatatagtgctctatttca

SEQ ID NO: 616305 - DNA, 20 bp, Artificial
  CRISPR gRNA sequence
cttcctggacccatttctaa

SEQ ID NO: 616306 - DNA, 20 bp, Artificial
  CRISPR gRNA sequence
ctaacagagtaccaactata

SEQ ID NO: 616307 - DNA, 20 bp, Artificial
  CRISPR gRNA sequence
ctcccttactagtttttaaa

SEQ ID NO: 616308 - DNA, 20 bp, Artificial
  CRISPR gRNA sequence
tttatattgccagcatgctc

SEQ ID NO: 616309 - DNA, 20 bp, Artificial
  CRISPR gRNA sequence
ctgagatgttttactaactt

SEQ ID NO: 616310 - DNA, 20 bp, Artificial
  CRISPR gRNA sequence
aagaaaaaacaaaaaacata

SEQ ID NO: 616311 - DNA, 20 bp, Artificial
  CRISPR gRNA sequence
attttcaaattccaaatagt

SEQ ID NO: 616312 - DNA, 20 bp, Artificial
  CRISPR gRNA sequence
ttaaaaagcattttaaaatt

SEQ ID NO: 616313 - DNA, 20 bp, Artificial
  CRISPR gRNA sequence
aaacgttctttattttttct

SEQ ID NO: 616314 - DNA, 20 bp, Artificial
  CRISPR gRNA sequence
aggttgtcagtcttttctca

SEQ ID NO: 616315 - DNA, 20 bp, Artificial
  CRISPR gRNA sequence
atatatgctaatttcacatg

SEQ ID NO: 616316 - DNA, 20 bp, Artificial
  CRISPR gRNA sequence
aaagtcttcagttatggctc

SEQ ID NO: 616317 - DNA, 20 bp, Artificial
  CRISPR gRNA sequence
ttagtgtgcataaagtgtat

SEQ ID NO: 616318 - DNA, 20 bp, Artificial
  CRISPR gRNA sequence
gtgtatcagaattccatttc

SEQ ID NO: 616319 - DNA, 20 bp, Artificial
  CRISPR gRNA sequence
tagttttagaacctgaaact

SEQ ID NO: 616320 - DNA, 20 bp, Artificial
  CRISPR gRNA sequence
ttttaaatttcaaaatagct

SEQ ID NO: 616321 - DNA, 20 bp, Artificial
  CRISPR gRNA sequence
caaaatagctcagaattatg

SEQ ID NO: 616322 - DNA, 20 bp, Artificial
  CRISPR gRNA sequence
ttagaactttttatctatag

SEQ ID NO: 616323 - DNA, 20 bp, Artificial
  CRISPR gRNA sequence
atactataaagaagtatgtt

SEQ ID NO: 616324 - DNA, 20 bp, Artificial
  CRISPR gRNA sequence
aagaagtatgtttagaatat

SEQ ID NO: 616325 - DNA, 20 bp, Artificial
  CRISPR gRNA sequence
ctacaattaggttgaaattc

SEQ ID NO: 616326 - DNA, 20 bp, Artificial
  CRISPR gRNA sequence
agaataaaagcaattattct

SEQ ID NO: 616327 - DNA, 20 bp, Artificial
  CRISPR gRNA sequence
actatatgatgccacaacta

SEQ ID NO: 616328 - DNA, 20 bp, Artificial
  CRISPR gRNA sequence
aaccactgtacaataatatt

SEQ ID NO: 616329 - DNA, 20 bp, Artificial
  CRISPR gRNA sequence
aaagatgaaaacttgttcat

SEQ ID NO: 616330 - DNA, 20 bp, Artificial
  CRISPR gRNA sequence
ctgttacaattctcaatacc

SEQ ID NO: 616331 - DNA, 20 bp, Artificial
  CRISPR gRNA sequence
tgtttctctgatatgaaata

SEQ ID NO: 616332 - DNA, 20 bp, Artificial
  CRISPR gRNA sequence
caataatggtttaatttaaa

SEQ ID NO: 616333 - DNA, 20 bp, Artificial
  CRISPR gRNA sequence
caaactgttagcaatgaaaa

SEQ ID NO: 616334 - DNA, 20 bp, Artificial
  CRISPR gRNA sequence
caggtttgtgaacacaagga

SEQ ID NO: 616335 - DNA, 20 bp, Artificial
  CRISPR gRNA sequence
ttccaaacaaaaaaaagctt

SEQ ID NO: 616336 - DNA, 20 bp, Artificial
  CRISPR gRNA sequence
ttcaggatataaacattttc

SEQ ID NO: 616337 - DNA, 20 bp, Artificial
  CRISPR gRNA sequence
aaaatactatttataaacac

SEQ ID NO: 616338 - DNA, 20 bp, Artificial
  CRISPR gRNA sequence
cacagatactcttttttaaa

SEQ ID NO: 616339 - DNA, 20 bp, Artificial
  CRISPR gRNA sequence
ttgcttccagatacataata

SEQ ID NO: 616340 - DNA, 20 bp, Artificial
  CRISPR gRNA sequence
attcactaatatgataataa

SEQ ID NO: 616341 - DNA, 20 bp, Artificial
  CRISPR gRNA sequence
atatgataataaaaggataa

SEQ ID NO: 616342 - DNA, 20 bp, Artificial
  CRISPR gRNA sequence
agatcattgtgaaaaaaaag

SEQ ID NO: 616343 - DNA, 20 bp, Artificial
  CRISPR gRNA sequence
gagcaaaatcatgttatttt

SEQ ID NO: 616344 - DNA, 20 bp, Artificial
  CRISPR gRNA sequence
aactcaaattttactcacat

SEQ ID NO: 616345 - DNA, 20 bp, Artificial
  CRISPR gRNA sequence
tttactcacataagaatgaa

SEQ ID NO: 616346 - DNA, 20 bp, Artificial
  CRISPR gRNA sequence
aataaagaacaaagacagca

SEQ ID NO: 616347 - DNA, 20 bp, Artificial
  CRISPR gRNA sequence
taagtaacccatattaacac

SEQ ID NO: 616348 - DNA, 20 bp, Artificial
  CRISPR gRNA sequence
tactccaaaaatggccataa

SEQ ID NO: 616349 - DNA, 20 bp, Artificial
  CRISPR gRNA sequence
aaatggccataaaagagttc

SEQ ID NO: 616350 - DNA, 20 bp, Artificial
  CRISPR gRNA sequence
ccataaaagagttcatgagt

SEQ ID NO: 616351 - DNA, 20 bp, Artificial
  CRISPR gRNA sequence
aaatttatttcttcaataat

SEQ ID NO: 616352 - DNA, 20 bp, Artificial
  CRISPR gRNA sequence
ataaattctaccctcatcat

SEQ ID NO: 616353 - DNA, 20 bp, Artificial
  CRISPR gRNA sequence
taaccaggaaaataatgcag

SEQ ID NO: 616354 - DNA, 20 bp, Artificial
  CRISPR gRNA sequence
tgatgtatttattgatctta

SEQ ID NO: 616355 - DNA, 20 bp, Artificial
  CRISPR gRNA sequence
ttcaaggaagtaaatattat

SEQ ID NO: 616356 - DNA, 20 bp, Artificial
  CRISPR gRNA sequence
gcaattcaagtgggcactta

SEQ ID NO: 616357 - DNA, 20 bp, Artificial
  CRISPR gRNA sequence
gtaaagcccaattatttact

SEQ ID NO: 616358 - DNA, 20 bp, Artificial
  CRISPR gRNA sequence
tgtatttgttccttttgact

SEQ ID NO: 616359 - DNA, 20 bp, Artificial
  CRISPR gRNA sequence
ttttgactgtggataaataa

SEQ ID NO: 616360 - DNA, 20 bp, Artificial
  CRISPR gRNA sequence
gactgtggataaataaatgg

SEQ ID NO: 616361 - DNA, 20 bp, Artificial
  CRISPR gRNA sequence
gtttcttcacaacatcctta

SEQ ID NO: 616362 - DNA, 20 bp, Artificial
  CRISPR gRNA sequence
gagctgcagctgagccactt

SEQ ID NO: 616363 - DNA, 20 bp, Artificial
  CRISPR gRNA sequence
tatgtatttcttaaacccac

SEQ ID NO: 616364 - DNA, 20 bp, Artificial
  CRISPR gRNA sequence
tgcacctgaaggcagaaaac

SEQ ID NO: 616365 - DNA, 20 bp, Artificial
  CRISPR gRNA sequence
tctctggtagactacagatt

SEQ ID NO: 616366 - DNA, 20 bp, Artificial
  CRISPR gRNA sequence
acatattcttttttgatact

SEQ ID NO: 616367 - DNA, 20 bp, Artificial
  CRISPR gRNA sequence
cagaatgactgcattgtagg

SEQ ID NO: 616368 - DNA, 20 bp, Artificial
  CRISPR gRNA sequence
ggttgttaagtggctattga

SEQ ID NO: 616369 - DNA, 20 bp, Artificial
  CRISPR gRNA sequence
aactatgtccaccagttgaa

SEQ ID NO: 616370 - DNA, 20 bp, Artificial
  CRISPR gRNA sequence
ggataccagaaacttaagtc

SEQ ID NO: 616371 - DNA, 20 bp, Artificial
  CRISPR gRNA sequence
agtttccataaaccaaacta

SEQ ID NO: 616372 - DNA, 20 bp, Artificial
  CRISPR gRNA sequence
ttatgactttctatcaaaac

SEQ ID NO: 616373 - DNA, 20 bp, Artificial
  CRISPR gRNA sequence
aaatttgctttgctgttgtc

SEQ ID NO: 616374 - DNA, 20 bp, Artificial
  CRISPR gRNA sequence
tgcagtacacctagttgctg

SEQ ID NO: 616375 - DNA, 20 bp, Artificial
  CRISPR gRNA sequence
tctatactccttgtcctgct

SEQ ID NO: 616376 - DNA, 20 bp, Artificial
  CRISPR gRNA sequence
ctctaaaccaatagtttatg

SEQ ID NO: 616377 - DNA, 20 bp, Artificial
  CRISPR gRNA sequence
gtttatgaaggatagcattt

SEQ ID NO: 616378 - DNA, 20 bp, Artificial
  CRISPR gRNA sequence
tataaagataaatcacacct

SEQ ID NO: 616379 - DNA, 20 bp, Artificial
  CRISPR gRNA sequence
acacctgtgagttggtaatg

SEQ ID NO: 616380 - DNA, 20 bp, Artificial
  CRISPR gRNA sequence
ttcatggaaaaaaaatgtaa

SEQ ID NO: 616381 - DNA, 20 bp, Artificial
  CRISPR gRNA sequence
gcaccattgtggcccacaga

SEQ ID NO: 616382 - DNA, 20 bp, Artificial
  CRISPR gRNA sequence
ttggcggacaactagttcat

SEQ ID NO: 616383 - DNA, 20 bp, Artificial
  CRISPR gRNA sequence
tccctttatccaacctttcg

SEQ ID NO: 616384 - DNA, 20 bp, Artificial
  CRISPR gRNA sequence
ttagattaatcttcctattg

SEQ ID NO: 616385 - DNA, 20 bp, Artificial
  CRISPR gRNA sequence
taaatacaaaggtattggta

SEQ ID NO: 616386 - DNA, 20 bp, Artificial
  CRISPR gRNA sequence
aaggtattggtatggaattt

SEQ ID NO: 616387 - DNA, 20 bp, Artificial
  CRISPR gRNA sequence
atccttcagccatatgtcct

SEQ ID NO: 616388 - DNA, 20 bp, Artificial
  CRISPR gRNA sequence
aagcacctgcttttattttc

SEQ ID NO: 616389 - DNA, 20 bp, Artificial
  CRISPR gRNA sequence
taaaaattagcacatcatta

SEQ ID NO: 616390 - DNA, 20 bp, Artificial
  CRISPR gRNA sequence
cttatctgctaccttttttc

SEQ ID NO: 616391 - DNA, 20 bp, Artificial
  CRISPR gRNA sequence
acataaatcaaatacacatg

SEQ ID NO: 616392 - DNA, 20 bp, Artificial
  CRISPR gRNA sequence
aagaaccattaatgacagga

SEQ ID NO: 616393 - DNA, 20 bp, Artificial
  CRISPR gRNA sequence
aggtgcgttatatatatcaa

SEQ ID NO: 616394 - DNA, 20 bp, Artificial
  CRISPR gRNA sequence
attcaattcatacaaatatt

SEQ ID NO: 616395 - DNA, 20 bp, Artificial
  CRISPR gRNA sequence
aaacagatgtcaatatgtta

SEQ ID NO: 616396 - DNA, 20 bp, Artificial
  CRISPR gRNA sequence
tatgttaaagaatgatacct

SEQ ID NO: 616397 - DNA, 20 bp, Artificial
  CRISPR gRNA sequence
atatgttttttactccacag

SEQ ID NO: 616398 - DNA, 20 bp, Artificial
  CRISPR gRNA sequence
tgaggtaaagagaaagttgt

SEQ ID NO: 616399 - DNA, 20 bp, Artificial
  CRISPR gRNA sequence
cactgccaaatttcctgagc

SEQ ID NO: 616400 - DNA, 20 bp, Artificial
  CRISPR gRNA sequence
ctgtaagaagtaaaatccag

SEQ ID NO: 616401 - DNA, 20 bp, Artificial
  CRISPR gRNA sequence
aagaagtaaaatccagctga

SEQ ID NO: 616402 - DNA, 20 bp, Artificial
  CRISPR gRNA sequence
atgttcccaaagggacccac

SEQ ID NO: 616403 - DNA, 20 bp, Artificial
  CRISPR gRNA sequence
gaaagagataaggaagagag

SEQ ID NO: 616404 - DNA, 20 bp, Artificial
  CRISPR gRNA sequence
aacacacttcagcagcttta

SEQ ID NO: 616405 - DNA, 20 bp, Artificial
  CRISPR gRNA sequence
taccccaggttcaaacatcc

SEQ ID NO: 616406 - DNA, 20 bp, Artificial
  CRISPR gRNA sequence
ataaacactgtactactggt

SEQ ID NO: 616407 - DNA, 20 bp, Artificial
  CRISPR gRNA sequence
actggtctgagtcaaataaa

SEQ ID NO: 616408 - DNA, 20 bp, Artificial
  CRISPR gRNA sequence
ctgcatttggccctcagatg

SEQ ID NO: 616409 - DNA, 20 bp, Artificial
  CRISPR gRNA sequence
gaaaacttgtggtgattaag

SEQ ID NO: 616410 - DNA, 20 bp, Artificial
  CRISPR gRNA sequence
tacctagttttctactccta

SEQ ID NO: 616411 - DNA, 20 bp, Artificial
  CRISPR gRNA sequence
tagttttctactcctaatga

SEQ ID NO: 616412 - DNA, 20 bp, Artificial
  CRISPR gRNA sequence
gaatgaatgagcattttaag

SEQ ID NO: 616413 - DNA, 20 bp, Artificial
  CRISPR gRNA sequence
gagcattttaagtaggatta

SEQ ID NO: 616414 - DNA, 20 bp, Artificial
  CRISPR gRNA sequence
gggctctaggtccagcaccc

SEQ ID NO: 616415 - DNA, 20 bp, Artificial
  CRISPR gRNA sequence
taatgacaacagctgcctcc

SEQ ID NO: 616416 - DNA, 20 bp, Artificial
  CRISPR gRNA sequence
agctgcctcctagggttgtc

SEQ ID NO: 616417 - DNA, 20 bp, Artificial
  CRISPR gRNA sequence
acatcaaacaaacataaatc

SEQ ID NO: 616418 - DNA, 20 bp, Artificial
  CRISPR gRNA sequence
atgtaaaatagtactaaaag

SEQ ID NO: 616419 - DNA, 20 bp, Artificial
  CRISPR gRNA sequence
catgaagagaggaaaaaggc

SEQ ID NO: 616420 - DNA, 20 bp, Artificial
  CRISPR gRNA sequence
ggcatgagtacatgttggtt

SEQ ID NO: 616421 - DNA, 20 bp, Artificial
  CRISPR gRNA sequence
gtgaatgacaccattttttc

SEQ ID NO: 616422 - DNA, 20 bp, Artificial
  CRISPR gRNA sequence
atgacaccattttttccaga

SEQ ID NO: 616423 - DNA, 20 bp, Artificial
  CRISPR gRNA sequence
ttccagaatggatacactca

SEQ ID NO: 616424 - DNA, 20 bp, Artificial
  CRISPR gRNA sequence
taaaattgagcaaagtacaa

SEQ ID NO: 616425 - DNA, 20 bp, Artificial
  CRISPR gRNA sequence
aagtacaagagaattaatgc

SEQ ID NO: 616426 - DNA, 20 bp, Artificial
  CRISPR gRNA sequence
aaatatttaatgagcaatac

SEQ ID NO: 616427 - DNA, 20 bp, Artificial
  CRISPR gRNA sequence
taagccccacaccaccatgc

SEQ ID NO: 616428 - DNA, 20 bp, Artificial
  CRISPR gRNA sequence
actgaagtcttggttattca

SEQ ID NO: 616429 - DNA, 20 bp, Artificial
  CRISPR gRNA sequence
attacattaatcagatgtaa

SEQ ID NO: 616430 - DNA, 20 bp, Artificial
  CRISPR gRNA sequence
ccatttaaaaatacttcttt

SEQ ID NO: 616431 - DNA, 20 bp, Artificial
  CRISPR gRNA sequence
tagatcaaaatttatacaaa

SEQ ID NO: 616432 - DNA, 20 bp, Artificial
  CRISPR gRNA sequence
aagatcacatctatgtcacc

SEQ ID NO: 616433 - DNA, 20 bp, Artificial
  CRISPR gRNA sequence
aagcctacctgcctgaggtt

SEQ ID NO: 616434 - DNA, 20 bp, Artificial
  CRISPR gRNA sequence
atggtatctatctatgatta

SEQ ID NO: 616435 - DNA, 20 bp, Artificial
  CRISPR gRNA sequence
aaatttatttatacaaaatc

SEQ ID NO: 616436 - DNA, 20 bp, Artificial
  CRISPR gRNA sequence
ctatgtgttcaggtgtttct

SEQ ID NO: 616437 - DNA, 20 bp, Artificial
  CRISPR gRNA sequence
aggtaaaagcatgtttaaat

SEQ ID NO: 616438 - DNA, 20 bp, Artificial
  CRISPR gRNA sequence
aaacctagttggtatgtgtg

SEQ ID NO: 616439 - DNA, 20 bp, Artificial
  CRISPR gRNA sequence
tccccatgtgtttccttcag

SEQ ID NO: 616440 - DNA, 20 bp, Artificial
  CRISPR gRNA sequence
ataatgttatgaagactctt

SEQ ID NO: 616441 - DNA, 20 bp, Artificial
  CRISPR gRNA sequence
tttctctactttgtccccgt

SEQ ID NO: 616442 - DNA, 20 bp, Artificial
  CRISPR gRNA sequence
tgtatggcttgcggctgttt

SEQ ID NO: 616443 - DNA, 20 bp, Artificial
  CRISPR gRNA sequence
aattgcaggtttccagggag

SEQ ID NO: 616444 - DNA, 20 bp, Artificial
  CRISPR gRNA sequence
gaggggaatgctgttacagt

SEQ ID NO: 616445 - DNA, 20 bp, Artificial
  CRISPR gRNA sequence
ggatcacctcagcacttcac

SEQ ID NO: 616446 - DNA, 20 bp, Artificial
  CRISPR gRNA sequence
ttctcaaaggctataaacat

SEQ ID NO: 616447 - DNA, 20 bp, Artificial
  CRISPR gRNA sequence
aatcttcttccacctttaaa

SEQ ID NO: 616448 - DNA, 20 bp, Artificial
  CRISPR gRNA sequence
tgcaattatttcaggagcac

SEQ ID NO: 616449 - DNA, 20 bp, Artificial
  CRISPR gRNA sequence
tttcaggagcacaagaattc

SEQ ID NO: 616450 - DNA, 20 bp, Artificial
  CRISPR gRNA sequence
gttagcaatatgtttttggc

SEQ ID NO: 616451 - DNA, 20 bp, Artificial
  CRISPR gRNA sequence
ccatgatctgacactatcag

SEQ ID NO: 616452 - DNA, 20 bp, Artificial
  CRISPR gRNA sequence
tttaaacttccagctgacac

SEQ ID NO: 616453 - DNA, 20 bp, Artificial
  CRISPR gRNA sequence
tatcagtttacaaggttcat

SEQ ID NO: 616454 - DNA, 20 bp, Artificial
  CRISPR gRNA sequence
tacatagcaaaattaaatta

SEQ ID NO: 616455 - DNA, 20 bp, Artificial
  CRISPR gRNA sequence
agcaaaattaaattaaggaa

SEQ ID NO: 616456 - DNA, 20 bp, Artificial
  CRISPR gRNA sequence
aattaaggaatagaatcctg

SEQ ID NO: 616457 - DNA, 20 bp, Artificial
  CRISPR gRNA sequence
ctacttacatctaatatata

SEQ ID NO: 616458 - DNA, 20 bp, Artificial
  CRISPR gRNA sequence
agtgtggacttgggaagtca

SEQ ID NO: 616459 - DNA, 20 bp, Artificial
  CRISPR gRNA sequence
gaagtcactggattgtattc

SEQ ID NO: 616460 - DNA, 20 bp, Artificial
  CRISPR gRNA sequence
tggattgtattccaggatca

SEQ ID NO: 616461 - DNA, 20 bp, Artificial
  CRISPR gRNA sequence
tcagggaattcactgatttt

SEQ ID NO: 616462 - DNA, 20 bp, Artificial
  CRISPR gRNA sequence
atttatcaaataccaattta

SEQ ID NO: 616463 - DNA, 20 bp, Artificial
  CRISPR gRNA sequence
acactagacactgttaagta

SEQ ID NO: 616464 - DNA, 20 bp, Artificial
  CRISPR gRNA sequence
gacaggcttatagtctggtt

SEQ ID NO: 616465 - DNA, 20 bp, Artificial
  CRISPR gRNA sequence
gaactaaaaggaaaagacag

SEQ ID NO: 616466 - DNA, 20 bp, Artificial
  CRISPR gRNA sequence
tccagggccaatagggccac

SEQ ID NO: 616467 - DNA, 20 bp, Artificial
  CRISPR gRNA sequence
attttatacaaaaggaagct

SEQ ID NO: 616468 - DNA, 20 bp, Artificial
  CRISPR gRNA sequence
atcaggaccacatcacaatg

SEQ ID NO: 616469 - DNA, 20 bp, Artificial
  CRISPR gRNA sequence
gaaaatgtttctacaaatat

SEQ ID NO: 616470 - DNA, 20 bp, Artificial
  CRISPR gRNA sequence
tatttattagtaactgatat

SEQ ID NO: 616471 - DNA, 20 bp, Artificial
  CRISPR gRNA sequence
taactgatatctgaatatta

SEQ ID NO: 616472 - DNA, 20 bp, Artificial
  CRISPR gRNA sequence
aaaataaacagaaaaatgca

SEQ ID NO: 616473 - DNA, 20 bp, Artificial
  CRISPR gRNA sequence
gcaaagaatctgcagagaaa

SEQ ID NO: 616474 - DNA, 20 bp, Artificial
  CRISPR gRNA sequence
gaatctgcagagaaaaggaa

SEQ ID NO: 616475 - DNA, 20 bp, Artificial
  CRISPR gRNA sequence
gagaaaaggaattgaatgta

SEQ ID NO: 616476 - DNA, 20 bp, Artificial
  CRISPR gRNA sequence
aaaggaattgaatgtaacga

SEQ ID NO: 616477 - DNA, 20 bp, Artificial
  CRISPR gRNA sequence
cggtttcaaggtgataaaat

SEQ ID NO: 616478 - DNA, 20 bp, Artificial
  CRISPR gRNA sequence
cttcactcaacaaatattta

SEQ ID NO: 616479 - DNA, 20 bp, Artificial
  CRISPR gRNA sequence
gaaggagaagtataaaggca

SEQ ID NO: 616480 - DNA, 20 bp, Artificial
  CRISPR gRNA sequence
tatatccctttatcagaaag

SEQ ID NO: 616481 - DNA, 20 bp, Artificial
  CRISPR gRNA sequence
cacatacacacacacaattt

SEQ ID NO: 616482 - DNA, 20 bp, Artificial
  CRISPR gRNA sequence
gtcagttctgttttgaaaca

SEQ ID NO: 616483 - DNA, 20 bp, Artificial
  CRISPR gRNA sequence
gaattctcgcccagcatgac

SEQ ID NO: 616484 - DNA, 20 bp, Artificial
  CRISPR gRNA sequence
ctaacgatgaaatataagaa

SEQ ID NO: 616485 - DNA, 20 bp, Artificial
  CRISPR gRNA sequence
ttttgtcgccagcaaatata

SEQ ID NO: 616486 - DNA, 20 bp, Artificial
  CRISPR gRNA sequence
cacagtgttatacaatagta

SEQ ID NO: 616487 - DNA, 20 bp, Artificial
  CRISPR gRNA sequence
tttattatcattatcgctca

SEQ ID NO: 616488 - DNA, 20 bp, Artificial
  CRISPR gRNA sequence
tattgaacttatccctgtag

SEQ ID NO: 616489 - DNA, 20 bp, Artificial
  CRISPR gRNA sequence
acaaacttttataagcctta

SEQ ID NO: 616490 - DNA, 20 bp, Artificial
  CRISPR gRNA sequence
ggaacccattcagttagaga

SEQ ID NO: 616491 - DNA, 20 bp, Artificial
  CRISPR gRNA sequence
aaattcagtaaatattcaga

SEQ ID NO: 616492 - DNA, 20 bp, Artificial
  CRISPR gRNA sequence
agtataagtacagtattgtc

SEQ ID NO: 616493 - DNA, 20 bp, Artificial
  CRISPR gRNA sequence
caagaaagcagaaggtttac

SEQ ID NO: 616494 - DNA, 20 bp, Artificial
  CRISPR gRNA sequence
gttctactgctggttagtga

SEQ ID NO: 616495 - DNA, 20 bp, Artificial
  CRISPR gRNA sequence
ctggttagtgatggagttca

SEQ ID NO: 616496 - DNA, 20 bp, Artificial
  CRISPR gRNA sequence
agtgatggagttcagtgagt

SEQ ID NO: 616497 - DNA, 20 bp, Artificial
  CRISPR gRNA sequence
tcataaatataaaaaggttt

SEQ ID NO: 616498 - DNA, 20 bp, Artificial
  CRISPR gRNA sequence
gaaagccatgttaacttcca

SEQ ID NO: 616499 - DNA, 20 bp, Artificial
  CRISPR gRNA sequence
tcagaagtccataaaaactt

SEQ ID NO: 616500 - DNA, 20 bp, Artificial
  CRISPR gRNA sequence
aatttttgttttctttgaga

SEQ ID NO: 616501 - DNA, 20 bp, Artificial
  CRISPR gRNA sequence
tcttgctctgtcgccaggtc

SEQ ID NO: 616502 - DNA, 20 bp, Artificial
  CRISPR gRNA sequence
taacctaaattttaaaaatt

SEQ ID NO: 616503 - DNA, 20 bp, Artificial
  CRISPR gRNA sequence
taaaaattcagaatgatgtg

SEQ ID NO: 616504 - DNA, 20 bp, Artificial
  CRISPR gRNA sequence
aatttccatttcacaatccc

SEQ ID NO: 616505 - DNA, 20 bp, Artificial
  CRISPR gRNA sequence
aatcatatttccctggtccc

SEQ ID NO: 616506 - DNA, 20 bp, Artificial
  CRISPR gRNA sequence
tctctaactaaaaacatgaa

SEQ ID NO: 616507 - DNA, 20 bp, Artificial
  CRISPR gRNA sequence
atcaactatcacctaactac

SEQ ID NO: 616508 - DNA, 20 bp, Artificial
  CRISPR gRNA sequence
gtgtacatcacaaatctaga

SEQ ID NO: 616509 - DNA, 20 bp, Artificial
  CRISPR gRNA sequence
ctgcacagcatgttactgta

SEQ ID NO: 616510 - DNA, 20 bp, Artificial
  CRISPR gRNA sequence
aatccagatggaacattagt

SEQ ID NO: 616511 - DNA, 20 bp, Artificial
  CRISPR gRNA sequence
aaaactcttaaatccaatca

SEQ ID NO: 616512 - DNA, 20 bp, Artificial
  CRISPR gRNA sequence
gctgtgattcaaatttcact

SEQ ID NO: 616513 - DNA, 20 bp, Artificial
  CRISPR gRNA sequence
gccaagttttgctacagtaa

SEQ ID NO: 616514 - DNA, 20 bp, Artificial
  CRISPR gRNA sequence
caaaccttattaatatgatg

SEQ ID NO: 616515 - DNA, 20 bp, Artificial
  CRISPR gRNA sequence
ttcaggctagacagacaagc

SEQ ID NO: 616516 - DNA, 20 bp, Artificial
  CRISPR gRNA sequence
gccattgcaatacttcaaat

SEQ ID NO: 616517 - DNA, 20 bp, Artificial
  CRISPR gRNA sequence
atatatatcttatcctatat

SEQ ID NO: 616518 - DNA, 20 bp, Artificial
  CRISPR gRNA sequence
tatatttgagttcccccaat

SEQ ID NO: 616519 - DNA, 20 bp, Artificial
  CRISPR gRNA sequence
ttatttatcaactctcattt

SEQ ID NO: 616520 - DNA, 20 bp, Artificial
  CRISPR gRNA sequence
atcaactctcatttgagaat

SEQ ID NO: 616521 - DNA, 20 bp, Artificial
  CRISPR gRNA sequence
aagttttcttttaacaaaac

SEQ ID NO: 616522 - DNA, 20 bp, Artificial
  CRISPR gRNA sequence
tgtattttaaccatcctcgt

SEQ ID NO: 616523 - DNA, 20 bp, Artificial
  CRISPR gRNA sequence
aagcactgacattcaaacta

SEQ ID NO: 616524 - DNA, 20 bp, Artificial
  CRISPR gRNA sequence
tttttgatttttctctgcct

SEQ ID NO: 616525 - DNA, 20 bp, Artificial
  CRISPR gRNA sequence
aataatcataagcaaatact

SEQ ID NO: 616526 - DNA, 20 bp, Artificial
  CRISPR gRNA sequence
tacacatcatgtaaactaaa

SEQ ID NO: 616527 - DNA, 20 bp, Artificial
  CRISPR gRNA sequence
acaaaactaatgcttttcct

SEQ ID NO: 616528 - DNA, 20 bp, Artificial
  CRISPR gRNA sequence
acatgtaatataaacaagag

SEQ ID NO: 616529 - DNA, 20 bp, Artificial
  CRISPR gRNA sequence
caaataatgtgtagtaggca

SEQ ID NO: 616530 - DNA, 20 bp, Artificial
  CRISPR gRNA sequence
gctagttattataatatttt

SEQ ID NO: 616531 - DNA, 20 bp, Artificial
  CRISPR gRNA sequence
taaatgtttaatatagaaaa

SEQ ID NO: 616532 - DNA, 20 bp, Artificial
  CRISPR gRNA sequence
tttccctatacttaatacca

SEQ ID NO: 616533 - DNA, 20 bp, Artificial
  CRISPR gRNA sequence
aatatttatcttcaattgtt

SEQ ID NO: 616534 - DNA, 20 bp, Artificial
  CRISPR gRNA sequence
aataaaagtatatgaactta

SEQ ID NO: 616535 - DNA, 20 bp, Artificial
  CRISPR gRNA sequence
aaggaaaattttggtttcct

SEQ ID NO: 616536 - DNA, 20 bp, Artificial
  CRISPR gRNA sequence
caagtttaccaaaaggactg

SEQ ID NO: 616537 - DNA, 20 bp, Artificial
  CRISPR gRNA sequence
tcttatatacatgaaattca

SEQ ID NO: 616538 - DNA, 20 bp, Artificial
  CRISPR gRNA sequence
gtatagagaaggcttatttt

SEQ ID NO: 616539 - DNA, 20 bp, Artificial
  CRISPR gRNA sequence
gtgacttaattctacattta

SEQ ID NO: 616540 - DNA, 20 bp, Artificial
  CRISPR gRNA sequence
ttacagaattctaacaccaa

SEQ ID NO: 616541 - DNA, 20 bp, Artificial
  CRISPR gRNA sequence
cttttttccatcacagaaat

SEQ ID NO: 616542 - DNA, 20 bp, Artificial
  CRISPR gRNA sequence
tgaactacctcttatctata

SEQ ID NO: 616543 - DNA, 20 bp, Artificial
  CRISPR gRNA sequence
gaatgctgtcaatcaacaaa

SEQ ID NO: 616544 - DNA, 20 bp, Artificial
  CRISPR gRNA sequence
ttttttttttttttttgaga

SEQ ID NO: 616545 - DNA, 20 bp, Artificial
  CRISPR gRNA sequence
tcttgctctctcgcccaggc

SEQ ID NO: 616546 - DNA, 20 bp, Artificial
  CRISPR gRNA sequence
ttgtgtatttttagtagaga

SEQ ID NO: 616547 - DNA, 20 bp, Artificial
  CRISPR gRNA sequence
cggggtttcaccgtgttagc

SEQ ID NO: 616548 - DNA, 20 bp, Artificial
  CRISPR gRNA sequence
tcctcggcctcccaaagtac

SEQ ID NO: 616549 - DNA, 20 bp, Artificial
  CRISPR gRNA sequence
ttgtttaatctataacacaa

SEQ ID NO: 616550 - DNA, 20 bp, Artificial
  CRISPR gRNA sequence
aatctataacacaagtgggt

SEQ ID NO: 616551 - DNA, 20 bp, Artificial
  CRISPR gRNA sequence
aagagctttatgatcctact

SEQ ID NO: 616552 - DNA, 20 bp, Artificial
  CRISPR gRNA sequence
tcctttaaaaaaaacaattc

SEQ ID NO: 616553 - DNA, 20 bp, Artificial
  CRISPR gRNA sequence
gttttgctatattattttag

SEQ ID NO: 616554 - DNA, 20 bp, Artificial
  CRISPR gRNA sequence
tatgagaaactcttttcttt

SEQ ID NO: 616555 - DNA, 20 bp, Artificial
  CRISPR gRNA sequence
cttaaacagtttatttagtt

SEQ ID NO: 616556 - DNA, 20 bp, Artificial
  CRISPR gRNA sequence
atctcaatagatcttcacac

SEQ ID NO: 616557 - DNA, 20 bp, Artificial
  CRISPR gRNA sequence
ccagtaaacgtacaagaaaa

SEQ ID NO: 616558 - DNA, 20 bp, Artificial
  CRISPR gRNA sequence
gaaaactgaatcgcagaaaa

SEQ ID NO: 616559 - DNA, 20 bp, Artificial
  CRISPR gRNA sequence
tttcttcatccctttgaaaa

SEQ ID NO: 616560 - DNA, 20 bp, Artificial
  CRISPR gRNA sequence
cctttgaaaagtgagtccag

SEQ ID NO: 616561 - DNA, 20 bp, Artificial
  CRISPR gRNA sequence
aattttacattttagtgaaa

SEQ ID NO: 616562 - DNA, 20 bp, Artificial
  CRISPR gRNA sequence
ttacattttagtgaaataga

SEQ ID NO: 616563 - DNA, 20 bp, Artificial
  CRISPR gRNA sequence
gttcacaaccaaactgctct

SEQ ID NO: 616564 - DNA, 20 bp, Artificial
  CRISPR gRNA sequence
tgagaaacaatagtggcatg

SEQ ID NO: 616565 - DNA, 20 bp, Artificial
  CRISPR gRNA sequence
gggggagaaggtctataaag

SEQ ID NO: 616566 - DNA, 20 bp, Artificial
  CRISPR gRNA sequence
tctataaagaagagtcttgg

SEQ ID NO: 616567 - DNA, 20 bp, Artificial
  CRISPR gRNA sequence
agtcccaacagtttgggagc

SEQ ID NO: 616568 - DNA, 20 bp, Artificial
  CRISPR gRNA sequence
gacgagcctgggcaacatag

SEQ ID NO: 616569 - DNA, 20 bp, Artificial
  CRISPR gRNA sequence
actacttgggggactgggac

SEQ ID NO: 616570 - DNA, 20 bp, Artificial
  CRISPR gRNA sequence
caggagtattgcttcagccc

SEQ ID NO: 616571 - DNA, 20 bp, Artificial
  CRISPR gRNA sequence
tcagcccaggagttcaaggc

SEQ ID NO: 616572 - DNA, 20 bp, Artificial
  CRISPR gRNA sequence
aaggaaggaaaggagggagg

SEQ ID NO: 616573 - DNA, 20 bp, Artificial
  CRISPR gRNA sequence
gttgtcccaccacagttggg

SEQ ID NO: 616574 - DNA, 20 bp, Artificial
  CRISPR gRNA sequence
agatagatagatagatagat

SEQ ID NO: 616575 - DNA, 20 bp, Artificial
  CRISPR gRNA sequence
atttgggagggaaagtattt

SEQ ID NO: 616576 - DNA, 20 bp, Artificial
  CRISPR gRNA sequence
cgaggagaacaaatcaatca

SEQ ID NO: 616577 - DNA, 20 bp, Artificial
  CRISPR gRNA sequence
aatgtatgactgtaagagac

SEQ ID NO: 616578 - DNA, 20 bp, Artificial
  CRISPR gRNA sequence
agtaaattttcatgtatcta

SEQ ID NO: 616579 - DNA, 20 bp, Artificial
  CRISPR gRNA sequence
cttctctaatccatttaata

SEQ ID NO: 616580 - DNA, 20 bp, Artificial
  CRISPR gRNA sequence
aaaaaaaatttggtgttagg

SEQ ID NO: 616581 - DNA, 20 bp, Artificial
  CRISPR gRNA sequence
acaactaataaaaaagcaat

SEQ ID NO: 616582 - DNA, 20 bp, Artificial
  CRISPR gRNA sequence
aagttaggtctgtgaaggcc

SEQ ID NO: 616583 - DNA, 20 bp, Artificial
  CRISPR gRNA sequence
aaggcctagagtctaggaag

SEQ ID NO: 616584 - DNA, 20 bp, Artificial
  CRISPR gRNA sequence
ggaagatgagtaaggcccat

SEQ ID NO: 616585 - DNA, 20 bp, Artificial
  CRISPR gRNA sequence
ggaaacataccaggcctggg

SEQ ID NO: 616586 - DNA, 20 bp, Artificial
  CRISPR gRNA sequence
aaaggtaggtacactgaaat

SEQ ID NO: 616587 - DNA, 20 bp, Artificial
  CRISPR gRNA sequence
agaacagaagaaaaaaaaaa

SEQ ID NO: 616588 - DNA, 20 bp, Artificial
  CRISPR gRNA sequence
acagaaagtcaacaaataat

SEQ ID NO: 616589 - DNA, 20 bp, Artificial
  CRISPR gRNA sequence
aataatgagaatatggcatg

SEQ ID NO: 616590 - DNA, 20 bp, Artificial
  CRISPR gRNA sequence
taaggagaagatataaaaga

SEQ ID NO: 616591 - DNA, 20 bp, Artificial
  CRISPR gRNA sequence
gaggggatgatcaaagaagt

SEQ ID NO: 616592 - DNA, 20 bp, Artificial
  CRISPR gRNA sequence
aggtttctcaaagaagatga

SEQ ID NO: 616593 - DNA, 20 bp, Artificial
  CRISPR gRNA sequence
tgggaagatatcccagaagg

SEQ ID NO: 616594 - DNA, 20 bp, Artificial
  CRISPR gRNA sequence
cagaagggggaataacatgt

SEQ ID NO: 616595 - DNA, 20 bp, Artificial
  CRISPR gRNA sequence
aataacatgtgcgaatgcaa

SEQ ID NO: 616596 - DNA, 20 bp, Artificial
  CRISPR gRNA sequence
atgcaatggagtatgaaaaa

SEQ ID NO: 616597 - DNA, 20 bp, Artificial
  CRISPR gRNA sequence
aggtaccagtcatggggaaa

SEQ ID NO: 616598 - DNA, 20 bp, Artificial
  CRISPR gRNA sequence
cacccctcctaatatcctct

SEQ ID NO: 616599 - DNA, 20 bp, Artificial
  CRISPR gRNA sequence
ctcctaatatcctctggggg

SEQ ID NO: 616600 - DNA, 20 bp, Artificial
  CRISPR gRNA sequence
tatcctctgggggtagggtc

SEQ ID NO: 616601 - DNA, 20 bp, Artificial
  CRISPR gRNA sequence
ctgggggtagggtccagaat

SEQ ID NO: 616602 - DNA, 20 bp, Artificial
  CRISPR gRNA sequence
gtccagaatctgagtccatt

SEQ ID NO: 616603 - DNA, 20 bp, Artificial
  CRISPR gRNA sequence
cccaatagtgatgaaatatc

SEQ ID NO: 616604 - DNA, 20 bp, Artificial
  CRISPR gRNA sequence
aaactattgtgctaagtttg

SEQ ID NO: 616605 - DNA, 20 bp, Artificial
  CRISPR gRNA sequence
gaggaataaatacaacgata

SEQ ID NO: 616606 - DNA, 20 bp, Artificial
  CRISPR gRNA sequence
gaaaaggtacatttgcacaa

SEQ ID NO: 616607 - DNA, 20 bp, Artificial
  CRISPR gRNA sequence
actttaaaactctaagttta

SEQ ID NO: 616608 - DNA, 20 bp, Artificial
  CRISPR gRNA sequence
tactcaaggcactcagtata

SEQ ID NO: 616609 - DNA, 20 bp, Artificial
  CRISPR gRNA sequence
gaacttgcctattataaagc

SEQ ID NO: 616610 - DNA, 20 bp, Artificial
  CRISPR gRNA sequence
atactcttcttcaaagtttg

SEQ ID NO: 616611 - DNA, 20 bp, Artificial
  CRISPR gRNA sequence
cttcaaagtttggtgagtgt

SEQ ID NO: 616612 - DNA, 20 bp, Artificial
  CRISPR gRNA sequence
aaatttcactgacaattttt

SEQ ID NO: 616613 - DNA, 20 bp, Artificial
  CRISPR gRNA sequence
tcactgacaatttttttgga

SEQ ID NO: 616614 - DNA, 20 bp, Artificial
  CRISPR gRNA sequence
agaaatgttgctttggtttg

SEQ ID NO: 616615 - DNA, 20 bp, Artificial
  CRISPR gRNA sequence
ttttttttttttttttgaga

SEQ ID NO: 616616 - DNA, 20 bp, Artificial
  CRISPR gRNA sequence
ttcgctcttgttgcccaggc

SEQ ID NO: 616617 - DNA, 20 bp, Artificial
  CRISPR gRNA sequence
ttctcctgcctcagcctagc

SEQ ID NO: 616618 - DNA, 20 bp, Artificial
  CRISPR gRNA sequence
ttttgtatttttagtagaga

SEQ ID NO: 616619 - DNA, 20 bp, Artificial
  CRISPR gRNA sequence
acctcggcctcccaaagtac

SEQ ID NO: 616620 - DNA, 20 bp, Artificial
  CRISPR gRNA sequence
ctagcttgtgtgctccttat

SEQ ID NO: 616621 - DNA, 20 bp, Artificial
  CRISPR gRNA sequence
tccacagattctacattatg

SEQ ID NO: 616622 - DNA, 20 bp, Artificial
  CRISPR gRNA sequence
ttctacattatgatgagtta

SEQ ID NO: 616623 - DNA, 20 bp, Artificial
  CRISPR gRNA sequence
gcacaataaatgtaatgctc

SEQ ID NO: 616624 - DNA, 20 bp, Artificial
  CRISPR gRNA sequence
tacttggtgccaaaaaggtt

SEQ ID NO: 616625 - DNA, 20 bp, Artificial
  CRISPR gRNA sequence
ggtgccaaaaaggttgggga

SEQ ID NO: 616626 - DNA, 20 bp, Artificial
  CRISPR gRNA sequence
gggatagaatacagattatt

SEQ ID NO: 616627 - DNA, 20 bp, Artificial
  CRISPR gRNA sequence
agtaaagtgagcatatgatg

SEQ ID NO: 616628 - DNA, 20 bp, Artificial
  CRISPR gRNA sequence
ttagtcagcctcagtttccc

SEQ ID NO: 616629 - DNA, 20 bp, Artificial
  CRISPR gRNA sequence
aactttccagggaagtttta

SEQ ID NO: 616630 - DNA, 20 bp, Artificial
  CRISPR gRNA sequence
tcacacagtacctaacatat

SEQ ID NO: 616631 - DNA, 20 bp, Artificial
  CRISPR gRNA sequence
aatcatttttattatggctt

SEQ ID NO: 616632 - DNA, 20 bp, Artificial
  CRISPR gRNA sequence
tcatgccttctctaatctga

SEQ ID NO: 616633 - DNA, 20 bp, Artificial
  CRISPR gRNA sequence
tcatgtagtatccctttgca

SEQ ID NO: 616634 - DNA, 20 bp, Artificial
  CRISPR gRNA sequence
gtttcaatgtgatttcctaa

SEQ ID NO: 616635 - DNA, 20 bp, Artificial
  CRISPR gRNA sequence
gtgaaattaatggctcctaa

SEQ ID NO: 616636 - DNA, 20 bp, Artificial
  CRISPR gRNA sequence
taatggctcctaacagaata

SEQ ID NO: 616637 - DNA, 20 bp, Artificial
  CRISPR gRNA sequence
taatgttcaaaaaatattta

SEQ ID NO: 616638 - DNA, 20 bp, Artificial
  CRISPR gRNA sequence
aaaatatttacagaatcaag

SEQ ID NO: 616639 - DNA, 20 bp, Artificial
  CRISPR gRNA sequence
aagtgacactattgacatct

SEQ ID NO: 616640 - DNA, 20 bp, Artificial
  CRISPR gRNA sequence
atttataaatgcagtaaaat

SEQ ID NO: 616641 - DNA, 20 bp, Artificial
  CRISPR gRNA sequence
gagtttattcatcaactcat

SEQ ID NO: 616642 - DNA, 20 bp, Artificial
  CRISPR gRNA sequence
gtttcaccatggtgtaataa

SEQ ID NO: 616643 - DNA, 20 bp, Artificial
  CRISPR gRNA sequence
atggtgtaataaaagaatga

SEQ ID NO: 616644 - DNA, 20 bp, Artificial
  CRISPR gRNA sequence
tgtaataaaagaatgagaga

SEQ ID NO: 616645 - DNA, 20 bp, Artificial
  CRISPR gRNA sequence
gaaacccataacataatctg

SEQ ID NO: 616646 - DNA, 20 bp, Artificial
  CRISPR gRNA sequence
atgaaggaggcaacacgatg

SEQ ID NO: 616647 - DNA, 20 bp, Artificial
  CRISPR gRNA sequence
tggaaaatgttgagactttc

SEQ ID NO: 616648 - DNA, 20 bp, Artificial
  CRISPR gRNA sequence
ggttctgcagtggtgagacg

SEQ ID NO: 616649 - DNA, 20 bp, Artificial
  CRISPR gRNA sequence
cagtggtgagacgtggggta

SEQ ID NO: 616650 - DNA, 20 bp, Artificial
  CRISPR gRNA sequence
aaaacaaaactgcttagtat

SEQ ID NO: 616651 - DNA, 20 bp, Artificial
  CRISPR gRNA sequence
ttggacttggaaaaaaactt

SEQ ID NO: 616652 - DNA, 20 bp, Artificial
  CRISPR gRNA sequence
tataactccatgtgagcatg

SEQ ID NO: 616653 - DNA, 20 bp, Artificial
  CRISPR gRNA sequence
gagcatgtagaatccaggga

SEQ ID NO: 616654 - DNA, 20 bp, Artificial
  CRISPR gRNA sequence
gaatccagggaaagaatccc

SEQ ID NO: 616655 - DNA, 20 bp, Artificial
  CRISPR gRNA sequence
ccctggaatgctgtaactgt

SEQ ID NO: 616656 - DNA, 20 bp, Artificial
  CRISPR gRNA sequence
acctacatccaaaaagaaaa

SEQ ID NO: 616657 - DNA, 20 bp, Artificial
  CRISPR gRNA sequence
tctaaatttctgtggacaag

SEQ ID NO: 616658 - DNA, 20 bp, Artificial
  CRISPR gRNA sequence
atggtattaaggtagttcag

SEQ ID NO: 616659 - DNA, 20 bp, Artificial
  CRISPR gRNA sequence
cccttggctgtgctcaagca

SEQ ID NO: 616660 - DNA, 20 bp, Artificial
  CRISPR gRNA sequence
gtgctcaagcaaagaatttt

SEQ ID NO: 616661 - DNA, 20 bp, Artificial
  CRISPR gRNA sequence
tcaagcaaagaattttagga

SEQ ID NO: 616662 - DNA, 20 bp, Artificial
  CRISPR gRNA sequence
agaattttaggaatgggtaa

SEQ ID NO: 616663 - DNA, 20 bp, Artificial
  CRISPR gRNA sequence
aaggaatggcacattcccta

SEQ ID NO: 616664 - DNA, 20 bp, Artificial
  CRISPR gRNA sequence
attccctagagagtttagtg

SEQ ID NO: 616665 - DNA, 20 bp, Artificial
  CRISPR gRNA sequence
tagagagtttagtgtggaat

SEQ ID NO: 616666 - DNA, 20 bp, Artificial
  CRISPR gRNA sequence
attattaactattatgctga

SEQ ID NO: 616667 - DNA, 20 bp, Artificial
  CRISPR gRNA sequence
taactattatgctgatggaa

SEQ ID NO: 616668 - DNA, 20 bp, Artificial
  CRISPR gRNA sequence
ctccctgttaatgcaatagg

SEQ ID NO: 616669 - DNA, 20 bp, Artificial
  CRISPR gRNA sequence
taatatatatttactctatt

SEQ ID NO: 616670 - DNA, 20 bp, Artificial
  CRISPR gRNA sequence
tttaattatactttaagttc

SEQ ID NO: 616671 - DNA, 20 bp, Artificial
  CRISPR gRNA sequence
tcattgttcagttcccacct

SEQ ID NO: 616672 - DNA, 20 bp, Artificial
  CRISPR gRNA sequence
agtctatcactgatggacat

SEQ ID NO: 616673 - DNA, 20 bp, Artificial
  CRISPR gRNA sequence
ggttccaagtctttgctatt

SEQ ID NO: 616674 - DNA, 20 bp, Artificial
  CRISPR gRNA sequence
gcagcatgatttataatcct

SEQ ID NO: 616675 - DNA, 20 bp, Artificial
  CRISPR gRNA sequence
tttgggtatatacccagtaa

SEQ ID NO: 616676 - DNA, 20 bp, Artificial
  CRISPR gRNA sequence
tatacccagtaatgggatgg

SEQ ID NO: 616677 - DNA, 20 bp, Artificial
  CRISPR gRNA sequence
tttctagttctagatccctg

SEQ ID NO: 616678 - DNA, 20 bp, Artificial
  CRISPR gRNA sequence
atcctttgcccactttttga

SEQ ID NO: 616679 - DNA, 20 bp, Artificial
  CRISPR gRNA sequence
gtttaagttctttgtagatt

SEQ ID NO: 616680 - DNA, 20 bp, Artificial
  CRISPR gRNA sequence
aatttgagaggctgaggcag

SEQ ID NO: 616681 - DNA, 20 bp, Artificial
  CRISPR gRNA sequence
cagggggatcatttgaagtc

SEQ ID NO: 616682 - DNA, 20 bp, Artificial
  CRISPR gRNA sequence
cggctgtaatcacaccactt

SEQ ID NO: 616683 - DNA, 20 bp, Artificial
  CRISPR gRNA sequence
cacttgggaatctgaggcag

SEQ ID NO: 616684 - DNA, 20 bp, Artificial
  CRISPR gRNA sequence
ttaggtgctaattacttgtc

SEQ ID NO: 616685 - DNA, 20 bp, Artificial
  CRISPR gRNA sequence
attacttgtcaagaattaca

SEQ ID NO: 616686 - DNA, 20 bp, Artificial
  CRISPR gRNA sequence
cactaagtcttaaaaaactg

SEQ ID NO: 616687 - DNA, 20 bp, Artificial
  CRISPR gRNA sequence
ctgcaggagcatcctggctc

SEQ ID NO: 616688 - DNA, 20 bp, Artificial
  CRISPR gRNA sequence
tcatcttgatttgagattct

SEQ ID NO: 616689 - DNA, 20 bp, Artificial
  CRISPR gRNA sequence
ccccactgctcctgctctag

SEQ ID NO: 616690 - DNA, 20 bp, Artificial
  CRISPR gRNA sequence
tgcaaagtgtcacaattccc

SEQ ID NO: 616691 - DNA, 20 bp, Artificial
  CRISPR gRNA sequence
gagaaggaggaggaaattgg

SEQ ID NO: 616692 - DNA, 20 bp, Artificial
  CRISPR gRNA sequence
gagaattctgtaagggggag

SEQ ID NO: 616693 - DNA, 20 bp, Artificial
  CRISPR gRNA sequence
agattaaatgcttacagtaa

SEQ ID NO: 616694 - DNA, 20 bp, Artificial
  CRISPR gRNA sequence
cctgataggaagtaacaaca

SEQ ID NO: 616695 - DNA, 20 bp, Artificial
  CRISPR gRNA sequence
gccaatggacctcctgagct

SEQ ID NO: 616696 - DNA, 20 bp, Artificial
  CRISPR gRNA sequence
tgtgtgttagtgacagctga

SEQ ID NO: 616697 - DNA, 20 bp, Artificial
  CRISPR gRNA sequence
tggacatatgtgaggtgaca

SEQ ID NO: 616698 - DNA, 20 bp, Artificial
  CRISPR gRNA sequence
gaggtgacagtggattccta

SEQ ID NO: 616699 - DNA, 20 bp, Artificial
  CRISPR gRNA sequence
acaggtacatggtgaagaag

SEQ ID NO: 616700 - DNA, 20 bp, Artificial
  CRISPR gRNA sequence
ggtgaagaaggtgaatttat

SEQ ID NO: 616701 - DNA, 20 bp, Artificial
  CRISPR gRNA sequence
ggccagtgcggccagtagta

SEQ ID NO: 616702 - DNA, 20 bp, Artificial
  CRISPR gRNA sequence
ctttaaaaattgcagatgta

SEQ ID NO: 616703 - DNA, 20 bp, Artificial
  CRISPR gRNA sequence
aaggtaagatgaagtcgtac

SEQ ID NO: 616704 - DNA, 20 bp, Artificial
  CRISPR gRNA sequence
aagatgaagtcgtactagag

SEQ ID NO: 616705 - DNA, 20 bp, Artificial
  CRISPR gRNA sequence
tttagacagagacatgcata

SEQ ID NO: 616706 - DNA, 20 bp, Artificial
  CRISPR gRNA sequence
gacagagacatgcatatggg

SEQ ID NO: 616707 - DNA, 20 bp, Artificial
  CRISPR gRNA sequence
gtgaacatgaaggcaaagat

SEQ ID NO: 616708 - DNA, 20 bp, Artificial
  CRISPR gRNA sequence
gatataagccaggaacacca

SEQ ID NO: 616709 - DNA, 20 bp, Artificial
  CRISPR gRNA sequence
ttttacgatttttaaaggca

SEQ ID NO: 616710 - DNA, 20 bp, Artificial
  CRISPR gRNA sequence
gatttttaaaggcaaaggat

SEQ ID NO: 616711 - DNA, 20 bp, Artificial
  CRISPR gRNA sequence
tttaaaaagtatgatccaat

SEQ ID NO: 616712 - DNA, 20 bp, Artificial
  CRISPR gRNA sequence
aataatatttttattgttga

SEQ ID NO: 616713 - DNA, 20 bp, Artificial
  CRISPR gRNA sequence
gtgcatgacacacagctgac

SEQ ID NO: 616714 - DNA, 20 bp, Artificial
  CRISPR gRNA sequence
atacctgatcccctcaatgg

SEQ ID NO: 616715 - DNA, 20 bp, Artificial
  CRISPR gRNA sequence
atcatccgtctgaagaagaa

SEQ ID NO: 616716 - DNA, 20 bp, Artificial
  CRISPR gRNA sequence
aggtagatatgagatcaagg

SEQ ID NO: 616717 - DNA, 20 bp, Artificial
  CRISPR gRNA sequence
ggctggatttatgaaagatg

SEQ ID NO: 616718 - DNA, 20 bp, Artificial
  CRISPR gRNA sequence
tgtgaaaatttaataaaaga

SEQ ID NO: 616719 - DNA, 20 bp, Artificial
  CRISPR gRNA sequence
ttccaatccattctgtgaaa

SEQ ID NO: 616720 - DNA, 20 bp, Artificial
  CRISPR gRNA sequence
tgcacatactatttttgaga

SEQ ID NO: 616721 - DNA, 20 bp, Artificial
  CRISPR gRNA sequence
tctcactctgttgcccaggc

SEQ ID NO: 616722 - DNA, 20 bp, Artificial
  CRISPR gRNA sequence
gatcttccctcctcagtctc

SEQ ID NO: 616723 - DNA, 20 bp, Artificial
  CRISPR gRNA sequence
ttacttcaaatatagctggc

SEQ ID NO: 616724 - DNA, 20 bp, Artificial
  CRISPR gRNA sequence
tctacataccatgccacgca

SEQ ID NO: 616725 - DNA, 20 bp, Artificial
  CRISPR gRNA sequence
ctttggtgcccagctcagtc

SEQ ID NO: 616726 - DNA, 20 bp, Artificial
  CRISPR gRNA sequence
aattttctatcatcagcccc

SEQ ID NO: 616727 - DNA, 20 bp, Artificial
  CRISPR gRNA sequence
catcagccccatgagttcaa

SEQ ID NO: 616728 - DNA, 20 bp, Artificial
  CRISPR gRNA sequence
tgagttcaaaagggtttctc

SEQ ID NO: 616729 - DNA, 20 bp, Artificial
  CRISPR gRNA sequence
cttgaatgttggttgccagg

SEQ ID NO: 616730 - DNA, 20 bp, Artificial
  CRISPR gRNA sequence
cctcaatgtaacttcatttc

SEQ ID NO: 616731 - DNA, 20 bp, Artificial
  CRISPR gRNA sequence
tcattgccctttccagagac

SEQ ID NO: 616732 - DNA, 20 bp, Artificial
  CRISPR gRNA sequence
gccctttccagagactggga

SEQ ID NO: 616733 - DNA, 20 bp, Artificial
  CRISPR gRNA sequence
caggaaccagctttacagag

SEQ ID NO: 616734 - DNA, 20 bp, Artificial
  CRISPR gRNA sequence
agaatacaagtgcattctca

SEQ ID NO: 616735 - DNA, 20 bp, Artificial
  CRISPR gRNA sequence
caatagttgtttgttgcttt

SEQ ID NO: 616736 - DNA, 20 bp, Artificial
  CRISPR gRNA sequence
ctctcatactctactgctat

SEQ ID NO: 616737 - DNA, 20 bp, Artificial
  CRISPR gRNA sequence
ctttcaactgtaagctctat

SEQ ID NO: 616738 - DNA, 20 bp, Artificial
  CRISPR gRNA sequence
atattttattagataattga

SEQ ID NO: 616739 - DNA, 20 bp, Artificial
  CRISPR gRNA sequence
tataagacataagctgctat

SEQ ID NO: 616740 - DNA, 20 bp, Artificial
  CRISPR gRNA sequence
agttagtaaaagtttcaagg

SEQ ID NO: 616741 - DNA, 20 bp, Artificial
  CRISPR gRNA sequence
tcttgtgggaaaaggtaaac

SEQ ID NO: 616742 - DNA, 20 bp, Artificial
  CRISPR gRNA sequence
tgagttcatctgagaaaggt

SEQ ID NO: 616743 - DNA, 20 bp, Artificial
  CRISPR gRNA sequence
ggttaagcagacatggtaaa

SEQ ID NO: 616744 - DNA, 20 bp, Artificial
  CRISPR gRNA sequence
gagttgataaaaagtttgaa

SEQ ID NO: 616745 - DNA, 20 bp, Artificial
  CRISPR gRNA sequence
ttcaaatttccatctcttag

SEQ ID NO: 616746 - DNA, 20 bp, Artificial
  CRISPR gRNA sequence
gggagattcatctgactatg

SEQ ID NO: 616747 - DNA, 20 bp, Artificial
  CRISPR gRNA sequence
gactatgctgagtatgtcag

SEQ ID NO: 616748 - DNA, 20 bp, Artificial
  CRISPR gRNA sequence
aggataagtagctagaggta

SEQ ID NO: 616749 - DNA, 20 bp, Artificial
  CRISPR gRNA sequence
accataacagctatgaagct

SEQ ID NO: 616750 - DNA, 20 bp, Artificial
  CRISPR gRNA sequence
tatgaagcttggagtaaaga

SEQ ID NO: 616751 - DNA, 20 bp, Artificial
  CRISPR gRNA sequence
tggtgtaccagcactgacac

SEQ ID NO: 616752 - DNA, 20 bp, Artificial
  CRISPR gRNA sequence
cagggtaccatctttcctgg

SEQ ID NO: 616753 - DNA, 20 bp, Artificial
  CRISPR gRNA sequence
ccagttgacagcatattaag

SEQ ID NO: 616754 - DNA, 20 bp, Artificial
  CRISPR gRNA sequence
cagggtacccacaaagctct

SEQ ID NO: 616755 - DNA, 20 bp, Artificial
  CRISPR gRNA sequence
cacaaagctcttgggatgaa

SEQ ID NO: 616756 - DNA, 20 bp, Artificial
  CRISPR gRNA sequence
tataatcatatctgtaagtg

SEQ ID NO: 616757 - DNA, 20 bp, Artificial
  CRISPR gRNA sequence
actggcaagaggagagagga

SEQ ID NO: 616758 - DNA, 20 bp, Artificial
  CRISPR gRNA sequence
atgacagactaggagaagcc

SEQ ID NO: 616759 - DNA, 20 bp, Artificial
  CRISPR gRNA sequence
gtctgaagaaccatataggg

SEQ ID NO: 616760 - DNA, 20 bp, Artificial
  CRISPR gRNA sequence
gacataaggtattttggaaa

SEQ ID NO: 616761 - DNA, 20 bp, Artificial
  CRISPR gRNA sequence
attttggaaacagaataaat

SEQ ID NO: 616762 - DNA, 20 bp, Artificial
  CRISPR gRNA sequence
atttgagtgaagtggtatat

SEQ ID NO: 616763 - DNA, 20 bp, Artificial
  CRISPR gRNA sequence
tgaagtggtatatgagaatt

SEQ ID NO: 616764 - DNA, 20 bp, Artificial
  CRISPR gRNA sequence
ttaagtaagtgaacattaaa

SEQ ID NO: 616765 - DNA, 20 bp, Artificial
  CRISPR gRNA sequence
agtgaacattaaaatgaatc

SEQ ID NO: 616766 - DNA, 20 bp, Artificial
  CRISPR gRNA sequence
gcatatagatagctttcttt

SEQ ID NO: 616767 - DNA, 20 bp, Artificial
  CRISPR gRNA sequence
catatcattaaattaaaaat

SEQ ID NO: 616768 - DNA, 20 bp, Artificial
  CRISPR gRNA sequence
ttaaaacgtgatccccaaac

SEQ ID NO: 616769 - DNA, 20 bp, Artificial
  CRISPR gRNA sequence
tggggtgcatattagactct

SEQ ID NO: 616770 - DNA, 20 bp, Artificial
  CRISPR gRNA sequence
tggtggttgaccaattagat

SEQ ID NO: 616771 - DNA, 20 bp, Artificial
  CRISPR gRNA sequence
gaccaattagatgggaatca

SEQ ID NO: 616772 - DNA, 20 bp, Artificial
  CRISPR gRNA sequence
caaatgtcttagaaaaagat

SEQ ID NO: 616773 - DNA, 20 bp, Artificial
  CRISPR gRNA sequence
agatttatctagacactgaa

SEQ ID NO: 616774 - DNA, 20 bp, Artificial
  CRISPR gRNA sequence
tgaaaagagtttaaacatag

SEQ ID NO: 616775 - DNA, 20 bp, Artificial
  CRISPR gRNA sequence
ttggtatttgtagctcatct

SEQ ID NO: 616776 - DNA, 20 bp, Artificial
  CRISPR gRNA sequence
tagtcataagtaacccatct

SEQ ID NO: 616777 - DNA, 20 bp, Artificial
  CRISPR gRNA sequence
ctagaagaggtactggagaa

SEQ ID NO: 616778 - DNA, 20 bp, Artificial
  CRISPR gRNA sequence
aaaaatagcacccattcact

SEQ ID NO: 616779 - DNA, 20 bp, Artificial
  CRISPR gRNA sequence
catcatactctaaacttgat

SEQ ID NO: 616780 - DNA, 20 bp, Artificial
  CRISPR gRNA sequence
tgaaagaaacttaatagcca

SEQ ID NO: 616781 - DNA, 20 bp, Artificial
  CRISPR gRNA sequence
tattgactctaaagatgtct

SEQ ID NO: 616782 - DNA, 20 bp, Artificial
  CRISPR gRNA sequence
aaagatgtcttagaatgtct

SEQ ID NO: 616783 - DNA, 20 bp, Artificial
  CRISPR gRNA sequence
tatcgataaacagataatgt

SEQ ID NO: 616784 - DNA, 20 bp, Artificial
  CRISPR gRNA sequence
actatatatacttcagctta

SEQ ID NO: 616785 - DNA, 20 bp, Artificial
  CRISPR gRNA sequence
atactccagtgtctactttt

SEQ ID NO: 616786 - DNA, 20 bp, Artificial
  CRISPR gRNA sequence
aggtgtcaatttaaacttgc

SEQ ID NO: 616787 - DNA, 20 bp, Artificial
  CRISPR gRNA sequence
ctttcatcatttataatatg

SEQ ID NO: 616788 - DNA, 20 bp, Artificial
  CRISPR gRNA sequence
ttatgctaattagtacaact

SEQ ID NO: 616789 - DNA, 20 bp, Artificial
  CRISPR gRNA sequence
ttagttaataatcatatcta

SEQ ID NO: 616790 - DNA, 20 bp, Artificial
  CRISPR gRNA sequence
ttagcctttatgtccagtag

SEQ ID NO: 616791 - DNA, 20 bp, Artificial
  CRISPR gRNA sequence
gaaattgtgactcctatatt

SEQ ID NO: 616792 - DNA, 20 bp, Artificial
  CRISPR gRNA sequence
tccttaccttaaattaatgg

SEQ ID NO: 616793 - DNA, 20 bp, Artificial
  CRISPR gRNA sequence
ttagagaaagctttttttac

SEQ ID NO: 616794 - DNA, 20 bp, Artificial
  CRISPR gRNA sequence
gagtgattaaaacagttaac

SEQ ID NO: 616795 - DNA, 20 bp, Artificial
  CRISPR gRNA sequence
tctagaccttcactgtgcat

SEQ ID NO: 616796 - DNA, 20 bp, Artificial
  CRISPR gRNA sequence
ctatttttattaaattggta

SEQ ID NO: 616797 - DNA, 20 bp, Artificial
  CRISPR gRNA sequence
tttattaaattggtatggga

SEQ ID NO: 616798 - DNA, 20 bp, Artificial
  CRISPR gRNA sequence
tattgagaagaaataaatta

SEQ ID NO: 616799 - DNA, 20 bp, Artificial
  CRISPR gRNA sequence
agcaactcgcaaaatgagac

SEQ ID NO: 616800 - DNA, 20 bp, Artificial
  CRISPR gRNA sequence
cttacaagaaaatctcctcc

SEQ ID NO: 616801 - DNA, 20 bp, Artificial
  CRISPR gRNA sequence
ctcctggaatcaaaagaggt

SEQ ID NO: 616802 - DNA, 20 bp, Artificial
  CRISPR gRNA sequence
aagtaacattttctttgctt

SEQ ID NO: 616803 - DNA, 20 bp, Artificial
  CRISPR gRNA sequence
cagcaggaaaaaaaatatat

SEQ ID NO: 616804 - DNA, 20 bp, Artificial
  CRISPR gRNA sequence
ggaaaaaaaatatataggaa

SEQ ID NO: 616805 - DNA, 20 bp, Artificial
  CRISPR gRNA sequence
cggttaaaacctgtttgtct

SEQ ID NO: 616806 - DNA, 20 bp, Artificial
  CRISPR gRNA sequence
cagtgccttcaagggcagca

SEQ ID NO: 616807 - DNA, 20 bp, Artificial
  CRISPR gRNA sequence
tcaagggcagcagagaatca

SEQ ID NO: 616808 - DNA, 20 bp, Artificial
  CRISPR gRNA sequence
aatattagctagttgattta

SEQ ID NO: 616809 - DNA, 20 bp, Artificial
  CRISPR gRNA sequence
gaagggaagcatctagtaaa

SEQ ID NO: 616810 - DNA, 20 bp, Artificial
  CRISPR gRNA sequence
atatacatgattcctgaaag

SEQ ID NO: 616811 - DNA, 20 bp, Artificial
  CRISPR gRNA sequence
tgagtatctatgtacatatg

SEQ ID NO: 616812 - DNA, 20 bp, Artificial
  CRISPR gRNA sequence
ctcatctgctttttttgaaa

SEQ ID NO: 616813 - DNA, 20 bp, Artificial
  CRISPR gRNA sequence
tagctcggcatctctaaaat

SEQ ID NO: 616814 - DNA, 20 bp, Artificial
  CRISPR gRNA sequence
cctatcccgttgtgctttta

SEQ ID NO: 616815 - DNA, 20 bp, Artificial
  CRISPR gRNA sequence
tgatagttattactaggtat

SEQ ID NO: 616816 - DNA, 20 bp, Artificial
  CRISPR gRNA sequence
ctactgctttagattcatta

SEQ ID NO: 616817 - DNA, 20 bp, Artificial
  CRISPR gRNA sequence
cacataagttactaatataa

SEQ ID NO: 616818 - DNA, 20 bp, Artificial
  CRISPR gRNA sequence
agctaactgacactaagcac

SEQ ID NO: 616819 - DNA, 20 bp, Artificial
  CRISPR gRNA sequence
tattaagtaggactactata

SEQ ID NO: 616820 - DNA, 20 bp, Artificial
  CRISPR gRNA sequence
tataaagaatacttgatttt

SEQ ID NO: 616821 - DNA, 20 bp, Artificial
  CRISPR gRNA sequence
attaatggtgtttcacttac

SEQ ID NO: 616822 - DNA, 20 bp, Artificial
  CRISPR gRNA sequence
aatctcaattcaaactaggt

SEQ ID NO: 616823 - DNA, 20 bp, Artificial
  CRISPR gRNA sequence
aaggctatttaatacagcca

SEQ ID NO: 616824 - DNA, 20 bp, Artificial
  CRISPR gRNA sequence
aactatgaaaaacaaccaat

SEQ ID NO: 616825 - DNA, 20 bp, Artificial
  CRISPR gRNA sequence
aatctaactacaatatactt

SEQ ID NO: 616826 - DNA, 20 bp, Artificial
  CRISPR gRNA sequence
ttcattagttatttaaacac

SEQ ID NO: 616827 - DNA, 20 bp, Artificial
  CRISPR gRNA sequence
tacctatggttatccagaaa

SEQ ID NO: 616828 - DNA, 20 bp, Artificial
  CRISPR gRNA sequence
tggttatccagaaaaggaat

SEQ ID NO: 616829 - DNA, 20 bp, Artificial
  CRISPR gRNA sequence
tccagaaaaggaatgagaat

SEQ ID NO: 616830 - DNA, 20 bp, Artificial
  CRISPR gRNA sequence
gcctaaagaaaacactagga

SEQ ID NO: 616831 - DNA, 20 bp, Artificial
  CRISPR gRNA sequence
ttataacaatcagctatcaa

SEQ ID NO: 616832 - DNA, 20 bp, Artificial
  CRISPR gRNA sequence
aatgaataatccagcacctt

SEQ ID NO: 616833 - DNA, 20 bp, Artificial
  CRISPR gRNA sequence
aacgatagtacactcacacc

SEQ ID NO: 616834 - DNA, 20 bp, Artificial
  CRISPR gRNA sequence
tgtagacctaaatctgctac

SEQ ID NO: 616835 - DNA, 20 bp, Artificial
  CRISPR gRNA sequence
caataattctgtatttaaac

SEQ ID NO: 616836 - DNA, 20 bp, Artificial
  CRISPR gRNA sequence
gtggtgctgttggcagttgt

SEQ ID NO: 616837 - DNA, 20 bp, Artificial
  CRISPR gRNA sequence
caaattgataattttcaaaa

SEQ ID NO: 616838 - DNA, 20 bp, Artificial
  CRISPR gRNA sequence
ccattaaatgtaatacaaac

SEQ ID NO: 616839 - DNA, 20 bp, Artificial
  CRISPR gRNA sequence
aatccacagcatatagcaaa

SEQ ID NO: 616840 - DNA, 20 bp, Artificial
  CRISPR gRNA sequence
ataacatttaaaggaagggg

SEQ ID NO: 616841 - DNA, 20 bp, Artificial
  CRISPR gRNA sequence
gggggggggtctcaattcta

SEQ ID NO: 616842 - DNA, 20 bp, Artificial
  CRISPR gRNA sequence
tctcaattctattgaattta

SEQ ID NO: 616843 - DNA, 20 bp, Artificial
  CRISPR gRNA sequence
aaaaaggttcctttttactc

SEQ ID NO: 616844 - DNA, 20 bp, Artificial
  CRISPR gRNA sequence
tggacccaaggaaataactg

SEQ ID NO: 616845 - DNA, 20 bp, Artificial
  CRISPR gRNA sequence
gatcaagtccatatagtggt

SEQ ID NO: 616846 - DNA, 20 bp, Artificial
  CRISPR gRNA sequence
gtcagtagctagttattcct

SEQ ID NO: 616847 - DNA, 20 bp, Artificial
  CRISPR gRNA sequence
agcttaataaacaatcacaa

SEQ ID NO: 616848 - DNA, 20 bp, Artificial
  CRISPR gRNA sequence
aggataataaaaagtattat

SEQ ID NO: 616849 - DNA, 20 bp, Artificial
  CRISPR gRNA sequence
aaaagtttagtgggcactta

SEQ ID NO: 616850 - DNA, 20 bp, Artificial
  CRISPR gRNA sequence
gggcacttactgaatgtata

SEQ ID NO: 616851 - DNA, 20 bp, Artificial
  CRISPR gRNA sequence
actgaatgtatagtgaatga

SEQ ID NO: 616852 - DNA, 20 bp, Artificial
  CRISPR gRNA sequence
aatgtatagtgaatgagaga

SEQ ID NO: 616853 - DNA, 20 bp, Artificial
  CRISPR gRNA sequence
tatagtgaatgagagaatga

SEQ ID NO: 616854 - DNA, 20 bp, Artificial
  CRISPR gRNA sequence
gtgaatgagagaatgaatga

SEQ ID NO: 616855 - DNA, 20 bp, Artificial
  CRISPR gRNA sequence
agcctttttttctttaagga

SEQ ID NO: 616856 - DNA, 20 bp, Artificial
  CRISPR gRNA sequence
aaatgtttgttttgtaaact

SEQ ID NO: 616857 - DNA, 20 bp, Artificial
  CRISPR gRNA sequence
tttgaataattaggggaaac

SEQ ID NO: 616858 - DNA, 20 bp, Artificial
  CRISPR gRNA sequence
aagaaaatgttaaaaggact

SEQ ID NO: 616859 - DNA, 20 bp, Artificial
  CRISPR gRNA sequence
aggactttgaatttgctaaa

SEQ ID NO: 616860 - DNA, 20 bp, Artificial
  CRISPR gRNA sequence
gtagtatattttgaaatgta

SEQ ID NO: 616861 - DNA, 20 bp, Artificial
  CRISPR gRNA sequence
ttaaaaagatttttagtatt

SEQ ID NO: 616862 - DNA, 20 bp, Artificial
  CRISPR gRNA sequence
tattcagaattatatatttc

SEQ ID NO: 616863 - DNA, 20 bp, Artificial
  CRISPR gRNA sequence
taatgctcacaagacacacc

SEQ ID NO: 616864 - DNA, 20 bp, Artificial
  CRISPR gRNA sequence
cattaatagtacagttaaaa

SEQ ID NO: 616865 - DNA, 20 bp, Artificial
  CRISPR gRNA sequence
taaaccacagggcagaggca

SEQ ID NO: 616866 - DNA, 20 bp, Artificial
  CRISPR gRNA sequence
gagccaaaagtatcatttta

SEQ ID NO: 616867 - DNA, 20 bp, Artificial
  CRISPR gRNA sequence
attttactgagtgaagaaaa

SEQ ID NO: 616868 - DNA, 20 bp, Artificial
  CRISPR gRNA sequence
ttccccccaaaatattaata

SEQ ID NO: 616869 - DNA, 20 bp, Artificial
  CRISPR gRNA sequence
ataaagaatagggaaaggaa

SEQ ID NO: 616870 - DNA, 20 bp, Artificial
  CRISPR gRNA sequence
gttctcttctagatagtacg

SEQ ID NO: 616871 - DNA, 20 bp, Artificial
  CRISPR gRNA sequence
agggactctgcttgctgcca

SEQ ID NO: 616872 - DNA, 20 bp, Artificial
  CRISPR gRNA sequence
agccattcccatactcagat

SEQ ID NO: 616873 - DNA, 20 bp, Artificial
  CRISPR gRNA sequence
aggcccccatgctcctatcc

SEQ ID NO: 616874 - DNA, 20 bp, Artificial
  CRISPR gRNA sequence
ctttccctcactggcttcct

SEQ ID NO: 616875 - DNA, 20 bp, Artificial
  CRISPR gRNA sequence
cagaggttttgggggaaggg

SEQ ID NO: 616876 - DNA, 20 bp, Artificial
  CRISPR gRNA sequence
cacacatgcacatacagtgc

SEQ ID NO: 616877 - DNA, 20 bp, Artificial
  CRISPR gRNA sequence
agtgtgtggggggggaaggg

SEQ ID NO: 616878 - DNA, 20 bp, Artificial
  CRISPR gRNA sequence
gattatcaaatgctacaaat

SEQ ID NO: 616879 - DNA, 20 bp, Artificial
  CRISPR gRNA sequence
tcttcagccacgactattga

SEQ ID NO: 616880 - DNA, 20 bp, Artificial
  CRISPR gRNA sequence
taatgttttcaaaaagattt

SEQ ID NO: 616881 - DNA, 20 bp, Artificial
  CRISPR gRNA sequence
ttgcgcctgttttttaaagg

SEQ ID NO: 616882 - DNA, 20 bp, Artificial
  CRISPR gRNA sequence
actttgggaggccgcggctg

SEQ ID NO: 616883 - DNA, 20 bp, Artificial
  CRISPR gRNA sequence
ctgtgagacatagtgagacc

SEQ ID NO: 616884 - DNA, 20 bp, Artificial
  CRISPR gRNA sequence
tagtccagaggctgaggtga

SEQ ID NO: 616885 - DNA, 20 bp, Artificial
  CRISPR gRNA sequence
tgagaggatctcttgagccc

SEQ ID NO: 616886 - DNA, 20 bp, Artificial
  CRISPR gRNA sequence
ctgcactccaacctgggcga

SEQ ID NO: 616887 - DNA, 20 bp, Artificial
  CRISPR gRNA sequence
atatagaaggacacggtaag

SEQ ID NO: 616888 - DNA, 20 bp, Artificial
  CRISPR gRNA sequence
gatgagcaaattagcctgct

SEQ ID NO: 616889 - DNA, 20 bp, Artificial
  CRISPR gRNA sequence
tcagagtcagaaacaacact

SEQ ID NO: 616890 - DNA, 20 bp, Artificial
  CRISPR gRNA sequence
aaggcttagcaagacaaaca

SEQ ID NO: 616891 - DNA, 20 bp, Artificial
  CRISPR gRNA sequence
acagttgtagtttttaaagg

SEQ ID NO: 616892 - DNA, 20 bp, Artificial
  CRISPR gRNA sequence
gtatcacaaaattctaattg

SEQ ID NO: 616893 - DNA, 20 bp, Artificial
  CRISPR gRNA sequence
gtgtaactaccttcatgtat

SEQ ID NO: 616894 - DNA, 20 bp, Artificial
  CRISPR gRNA sequence
aaatttagataatttatctc

SEQ ID NO: 616895 - DNA, 20 bp, Artificial
  CRISPR gRNA sequence
aaatttagataatttatctc

SEQ ID NO: 616896 - DNA, 20 bp, Artificial
  CRISPR gRNA sequence
caacattttagagaactatc

SEQ ID NO: 616897 - DNA, 20 bp, Artificial
  CRISPR gRNA sequence
acgacagaacacaatgcatg

SEQ ID NO: 616898 - DNA, 20 bp, Artificial
  CRISPR gRNA sequence
acaacggccgtgaaacccta

SEQ ID NO: 616899 - DNA, 20 bp, Artificial
  CRISPR gRNA sequence
aaaccctactgagttgatag

SEQ ID NO: 616900 - DNA, 20 bp, Artificial
  CRISPR gRNA sequence
ctactgagttgataggagaa

SEQ ID NO: 616901 - DNA, 20 bp, Artificial
  CRISPR gRNA sequence
gatttcccgaaatattcaaa

SEQ ID NO: 616902 - DNA, 20 bp, Artificial
  CRISPR gRNA sequence
gtgcatgctttgatgtcaac

SEQ ID NO: 616903 - DNA, 20 bp, Artificial
  CRISPR gRNA sequence
aataaggactatataagatg

SEQ ID NO: 616904 - DNA, 20 bp, Artificial
  CRISPR gRNA sequence
cctcaataggaaaacggtcc

SEQ ID NO: 616905 - DNA, 20 bp, Artificial
  CRISPR gRNA sequence
ggtgccaacttctactcttc

SEQ ID NO: 616906 - DNA, 20 bp, Artificial
  CRISPR gRNA sequence
catcctacaattcaatctcg

SEQ ID NO: 616907 - DNA, 20 bp, Artificial
  CRISPR gRNA sequence
taaatcaaacaaaaatcaca

SEQ ID NO: 616908 - DNA, 20 bp, Artificial
  CRISPR gRNA sequence
atcataagtaacacaaccac

SEQ ID NO: 616909 - DNA, 20 bp, Artificial
  CRISPR gRNA sequence
gtaattcacacagctattaa

SEQ ID NO: 616910 - DNA, 20 bp, Artificial
  CRISPR gRNA sequence
caaaacttaagacacagctc

SEQ ID NO: 616911 - DNA, 20 bp, Artificial
  CRISPR gRNA sequence
gttcaatattaattgcttga

SEQ ID NO: 616912 - DNA, 20 bp, Artificial
  CRISPR gRNA sequence
taaaaccatcaacaaatgat

SEQ ID NO: 616913 - DNA, 20 bp, Artificial
  CRISPR gRNA sequence
caacaaatgatctgagtgta

SEQ ID NO: 616914 - DNA, 20 bp, Artificial
  CRISPR gRNA sequence
gtaaggaatctacatctaaa

SEQ ID NO: 616915 - DNA, 20 bp, Artificial
  CRISPR gRNA sequence
ggtgttggggaagcaaatta

SEQ ID NO: 616916 - DNA, 20 bp, Artificial
  CRISPR gRNA sequence
gttgtcaaataggtagatat

SEQ ID NO: 616917 - DNA, 20 bp, Artificial
  CRISPR gRNA sequence
gtataaaagtatatctagtg

SEQ ID NO: 616918 - DNA, 20 bp, Artificial
  CRISPR gRNA sequence
attaccttcttgtttatcct

SEQ ID NO: 616919 - DNA, 20 bp, Artificial
  CRISPR gRNA sequence
taattattagtaaacatttc

SEQ ID NO: 616920 - DNA, 20 bp, Artificial
  CRISPR gRNA sequence
acttgcataatattcaatta

SEQ ID NO: 616921 - DNA, 20 bp, Artificial
  CRISPR gRNA sequence
atatgaaaaacaatgctgca

SEQ ID NO: 616922 - DNA, 20 bp, Artificial
  CRISPR gRNA sequence
taagataaatttgtagaaac

SEQ ID NO: 616923 - DNA, 20 bp, Artificial
  CRISPR gRNA sequence
aatttgtagaaacaggagta

SEQ ID NO: 616924 - DNA, 20 bp, Artificial
  CRISPR gRNA sequence
ttcagttttttgctaatata

SEQ ID NO: 616925 - DNA, 20 bp, Artificial
  CRISPR gRNA sequence
agttttatatacctcctatt

SEQ ID NO: 616926 - DNA, 20 bp, Artificial
  CRISPR gRNA sequence
tttttctgtgaactgtgtgt

SEQ ID NO: 616927 - DNA, 20 bp, Artificial
  CRISPR gRNA sequence
ttagatacttactgtacttc

SEQ ID NO: 616928 - DNA, 20 bp, Artificial
  CRISPR gRNA sequence
ttaaccgtttaagtcatcat

SEQ ID NO: 616929 - DNA, 20 bp, Artificial
  CRISPR gRNA sequence
agaaatttttattattttaa

SEQ ID NO: 616930 - DNA, 20 bp, Artificial
  CRISPR gRNA sequence
ttgaaattgacttttagata

SEQ ID NO: 616931 - DNA, 20 bp, Artificial
  CRISPR gRNA sequence
tatatatctttgttccaatt

SEQ ID NO: 616932 - DNA, 20 bp, Artificial
  CRISPR gRNA sequence
aatattgcatctacctgtga

SEQ ID NO: 616933 - DNA, 20 bp, Artificial
  CRISPR gRNA sequence
actaaattattttattgttt

SEQ ID NO: 616934 - DNA, 20 bp, Artificial
  CRISPR gRNA sequence
cagctgattctctgcagttt

SEQ ID NO: 616935 - DNA, 20 bp, Artificial
  CRISPR gRNA sequence
cgtccagcacaatattaaaa

SEQ ID NO: 616936 - DNA, 20 bp, Artificial
  CRISPR gRNA sequence
gcatgcgtatgtgttttcct

SEQ ID NO: 616937 - DNA, 20 bp, Artificial
  CRISPR gRNA sequence
tttccctttatttctgttta

SEQ ID NO: 616938 - DNA, 20 bp, Artificial
  CRISPR gRNA sequence
atttctgtttactgggtgta

SEQ ID NO: 616939 - DNA, 20 bp, Artificial
  CRISPR gRNA sequence
ataacaaattattactttca

SEQ ID NO: 616940 - DNA, 20 bp, Artificial
  CRISPR gRNA sequence
attttatcctaacactgttt

SEQ ID NO: 616941 - DNA, 20 bp, Artificial
  CRISPR gRNA sequence
tctttcttttttttttaaga

SEQ ID NO: 616942 - DNA, 20 bp, Artificial
  CRISPR gRNA sequence
atatcatattagctaagacg

SEQ ID NO: 616943 - DNA, 20 bp, Artificial
  CRISPR gRNA sequence
tggaactaggcaaccaaggt

SEQ ID NO: 616944 - DNA, 20 bp, Artificial
  CRISPR gRNA sequence
caatactagcatctacctca

SEQ ID NO: 616945 - DNA, 20 bp, Artificial
  CRISPR gRNA sequence
tagggttttattgagattaa

SEQ ID NO: 616946 - DNA, 20 bp, Artificial
  CRISPR gRNA sequence
atatctgattgttttttaaa

SEQ ID NO: 616947 - DNA, 20 bp, Artificial
  CRISPR gRNA sequence
ttttttaaagtgaatctgaa

SEQ ID NO: 616948 - DNA, 20 bp, Artificial
  CRISPR gRNA sequence
ctcttttattcctactttat

SEQ ID NO: 616949 - DNA, 20 bp, Artificial
  CRISPR gRNA sequence
tcattctgaaatggtatgca

SEQ ID NO: 616950 - DNA, 20 bp, Artificial
  CRISPR gRNA sequence
gcctaatctttacagtattt

SEQ ID NO: 616951 - DNA, 20 bp, Artificial
  CRISPR gRNA sequence
cttaaaatcagcctggagga

SEQ ID NO: 616952 - DNA, 20 bp, Artificial
  CRISPR gRNA sequence
agttaactttagagcccatg

SEQ ID NO: 616953 - DNA, 20 bp, Artificial
  CRISPR gRNA sequence
ttactattacataagcttgc

SEQ ID NO: 616954 - DNA, 20 bp, Artificial
  CRISPR gRNA sequence
ttttctaattgttttaggga

SEQ ID NO: 616955 - DNA, 20 bp, Artificial
  CRISPR gRNA sequence
agcatgtttctaaatgtgcc

SEQ ID NO: 616956 - DNA, 20 bp, Artificial
  CRISPR gRNA sequence
tctattgagcaaggaggggc

SEQ ID NO: 616957 - DNA, 20 bp, Artificial
  CRISPR gRNA sequence
gctatttttatactcatcac

SEQ ID NO: 616958 - DNA, 20 bp, Artificial
  CRISPR gRNA sequence
tgacaagtgctagcaatggc

SEQ ID NO: 616959 - DNA, 20 bp, Artificial
  CRISPR gRNA sequence
ttgacacccaactccaaatt

SEQ ID NO: 616960 - DNA, 20 bp, Artificial
  CRISPR gRNA sequence
tttcagtgtttatatttgct

SEQ ID NO: 616961 - DNA, 20 bp, Artificial
  CRISPR gRNA sequence
tgaaaaaaaattttcttcct

SEQ ID NO: 616962 - DNA, 20 bp, Artificial
  CRISPR gRNA sequence
ttcctctataataaaaaggt

SEQ ID NO: 616963 - DNA, 20 bp, Artificial
  CRISPR gRNA sequence
gttataggggcaaaggtgca

SEQ ID NO: 616964 - DNA, 20 bp, Artificial
  CRISPR gRNA sequence
gaaacatctaaaacgttatt

SEQ ID NO: 616965 - DNA, 20 bp, Artificial
  CRISPR gRNA sequence
tttcttccatttatttactg

SEQ ID NO: 616966 - DNA, 20 bp, Artificial
  CRISPR gRNA sequence
tgttggatggacttgagaaa

SEQ ID NO: 616967 - DNA, 20 bp, Artificial
  CRISPR gRNA sequence
tggccatgtgatgtatgaca

SEQ ID NO: 616968 - DNA, 20 bp, Artificial
  CRISPR gRNA sequence
ccaaaataaagtgtatgaaa

SEQ ID NO: 616969 - DNA, 20 bp, Artificial
  CRISPR gRNA sequence
atgaaaatgaatgtgaaact

SEQ ID NO: 616970 - DNA, 20 bp, Artificial
  CRISPR gRNA sequence
actttgggagggcaacctgg

SEQ ID NO: 616971 - DNA, 20 bp, Artificial
  CRISPR gRNA sequence
actgcactccagcctggtga

SEQ ID NO: 616972 - DNA, 20 bp, Artificial
  CRISPR gRNA sequence
caaaagcataaacctatttc

SEQ ID NO: 616973 - DNA, 20 bp, Artificial
  CRISPR gRNA sequence
tacatctggctcaaagaagg

SEQ ID NO: 616974 - DNA, 20 bp, Artificial
  CRISPR gRNA sequence
cacagttatagtaggtaatg

SEQ ID NO: 616975 - DNA, 20 bp, Artificial
  CRISPR gRNA sequence
tgatggcagctgtgaaaaag

SEQ ID NO: 616976 - DNA, 20 bp, Artificial
  CRISPR gRNA sequence
aggaaggaaaacagtgacta

SEQ ID NO: 616977 - DNA, 20 bp, Artificial
  CRISPR gRNA sequence
taaacaacactagtctcctc

SEQ ID NO: 616978 - DNA, 20 bp, Artificial
  CRISPR gRNA sequence
ccataggcataaaacaatgg

SEQ ID NO: 616979 - DNA, 20 bp, Artificial
  CRISPR gRNA sequence
tggaagaatttaaccacata

SEQ ID NO: 616980 - DNA, 20 bp, Artificial
  CRISPR gRNA sequence
acttcagatccacatatctc

SEQ ID NO: 616981 - DNA, 20 bp, Artificial
  CRISPR gRNA sequence
ctgccttaacaataaattaa

SEQ ID NO: 616982 - DNA, 20 bp, Artificial
  CRISPR gRNA sequence
caatgcatgactcaaaccat

SEQ ID NO: 616983 - DNA, 20 bp, Artificial
  CRISPR gRNA sequence
tcacatggtgtaataaatac

SEQ ID NO: 616984 - DNA, 20 bp, Artificial
  CRISPR gRNA sequence
ccaccccattattacaatgt

SEQ ID NO: 616985 - DNA, 20 bp, Artificial
  CRISPR gRNA sequence
agagctttcttattttgtgt

SEQ ID NO: 616986 - DNA, 20 bp, Artificial
  CRISPR gRNA sequence
ttgaacctcttttaatgtaa

SEQ ID NO: 616987 - DNA, 20 bp, Artificial
  CRISPR gRNA sequence
agttagtccattaccacaga

SEQ ID NO: 616988 - DNA, 20 bp, Artificial
  CRISPR gRNA sequence
ataatctaaacagatatact

SEQ ID NO: 616989 - DNA, 20 bp, Artificial
  CRISPR gRNA sequence
gatatactttgagttgctaa

SEQ ID NO: 616990 - DNA, 20 bp, Artificial
  CRISPR gRNA sequence
atacacagtaaatgctcttt

SEQ ID NO: 616991 - DNA, 20 bp, Artificial
  CRISPR gRNA sequence
cagcattttgggaggccaag

SEQ ID NO: 616992 - DNA, 20 bp, Artificial
  CRISPR gRNA sequence
attttgggaggccaaggcgg

SEQ ID NO: 616993 - DNA, 20 bp, Artificial
  CRISPR gRNA sequence
ggccaaggcgggtggattgc

SEQ ID NO: 616994 - DNA, 20 bp, Artificial
  CRISPR gRNA sequence
cgggtggattgcttgagtcc

SEQ ID NO: 616995 - DNA, 20 bp, Artificial
  CRISPR gRNA sequence
gaccagcctgggaaacacag

SEQ ID NO: 616996 - DNA, 20 bp, Artificial
  CRISPR gRNA sequence
catttaaaaaattatacagg

SEQ ID NO: 616997 - DNA, 20 bp, Artificial
  CRISPR gRNA sequence
agctacttggaaggctgagg

SEQ ID NO: 616998 - DNA, 20 bp, Artificial
  CRISPR gRNA sequence
tcgcatcactgcactcaagc

SEQ ID NO: 616999 - DNA, 20 bp, Artificial
  CRISPR gRNA sequence
ctgcactcaagcctgggtga

SEQ ID NO: 617000 - DNA, 20 bp, Artificial
  CRISPR gRNA sequence
attttgtatggtaattggct

SEQ ID NO: 617001 - DNA, 20 bp, Artificial
  CRISPR gRNA sequence
aatttgtactcaacagcact

SEQ ID NO: 617002 - DNA, 20 bp, Artificial
  CRISPR gRNA sequence
aattccgtaggtaaaaagcc

SEQ ID NO: 617003 - DNA, 20 bp, Artificial
  CRISPR gRNA sequence
aatattaaaatattaggcat

SEQ ID NO: 617004 - DNA, 20 bp, Artificial
  CRISPR gRNA sequence
tgccattcaacccacagtta

SEQ ID NO: 617005 - DNA, 20 bp, Artificial
  CRISPR gRNA sequence
ttcaaccctttagggctgag

SEQ ID NO: 617006 - DNA, 20 bp, Artificial
  CRISPR gRNA sequence
caagatttgaacctaggccc

SEQ ID NO: 617007 - DNA, 20 bp, Artificial
  CRISPR gRNA sequence
accctcttcaaattctgatc

SEQ ID NO: 617008 - DNA, 20 bp, Artificial
  CRISPR gRNA sequence
tttattgttgtttctttcaa

SEQ ID NO: 617009 - DNA, 20 bp, Artificial
  CRISPR gRNA sequence
cttataaccactaccataat

SEQ ID NO: 617010 - DNA, 20 bp, Artificial
  CRISPR gRNA sequence
accaggctttccttctattc

SEQ ID NO: 617011 - DNA, 20 bp, Artificial
  CRISPR gRNA sequence
ttccttctattctagaataa

SEQ ID NO: 617012 - DNA, 20 bp, Artificial
  CRISPR gRNA sequence
acctgtggctttccattttt

SEQ ID NO: 617013 - DNA, 20 bp, Artificial
  CRISPR gRNA sequence
agggctctgttctaagacta

SEQ ID NO: 617014 - DNA, 20 bp, Artificial
  CRISPR gRNA sequence
caaactgaaaaggcagttga

SEQ ID NO: 617015 - DNA, 20 bp, Artificial
  CRISPR gRNA sequence
tcccagaaaaatttttggaa

SEQ ID NO: 617016 - DNA, 20 bp, Artificial
  CRISPR gRNA sequence
aaatttttggaacagggtca

SEQ ID NO: 617017 - DNA, 20 bp, Artificial
  CRISPR gRNA sequence
acagggtcaacgaatggcca

SEQ ID NO: 617018 - DNA, 20 bp, Artificial
  CRISPR gRNA sequence
atattttgtgcttgtgaaaa

SEQ ID NO: 617019 - DNA, 20 bp, Artificial
  CRISPR gRNA sequence
tcagtctcaaaaaccttagc

SEQ ID NO: 617020 - DNA, 20 bp, Artificial
  CRISPR gRNA sequence
cttagcttgaattcatttac

SEQ ID NO: 617021 - DNA, 20 bp, Artificial
  CRISPR gRNA sequence
ttacttgaattgttctatga

SEQ ID NO: 617022 - DNA, 20 bp, Artificial
  CRISPR gRNA sequence
acaggatggaaagctgggga

SEQ ID NO: 617023 - DNA, 20 bp, Artificial
  CRISPR gRNA sequence
gtccacagacaggttttggt

SEQ ID NO: 617024 - DNA, 20 bp, Artificial
  CRISPR gRNA sequence
aagattgtgaagacacgtat

SEQ ID NO: 617025 - DNA, 20 bp, Artificial
  CRISPR gRNA sequence
aagcaagtaccacaagggaa

SEQ ID NO: 617026 - DNA, 20 bp, Artificial
  CRISPR gRNA sequence
gaagtgctaagaaagaaaaa

SEQ ID NO: 617027 - DNA, 20 bp, Artificial
  CRISPR gRNA sequence
gagaaggaggaaaaaaaaga

SEQ ID NO: 617028 - DNA, 20 bp, Artificial
  CRISPR gRNA sequence
catatccatcttagtcagct

SEQ ID NO: 617029 - DNA, 20 bp, Artificial
  CRISPR gRNA sequence
cttagtcagctctgagttat

SEQ ID NO: 617030 - DNA, 20 bp, Artificial
  CRISPR gRNA sequence
agaatatgcctgaagccaag

SEQ ID NO: 617031 - DNA, 20 bp, Artificial
  CRISPR gRNA sequence
tgaagccaagatgaatggac

SEQ ID NO: 617032 - DNA, 20 bp, Artificial
  CRISPR gRNA sequence
aagatgaatggacttgggta

SEQ ID NO: 617033 - DNA, 20 bp, Artificial
  CRISPR gRNA sequence
gcaaggctttctctacagac

SEQ ID NO: 617034 - DNA, 20 bp, Artificial
  CRISPR gRNA sequence
ttcagaggtcaccatcatat

SEQ ID NO: 617035 - DNA, 20 bp, Artificial
  CRISPR gRNA sequence
gtatctgtttgtttggagaa

SEQ ID NO: 617036 - DNA, 20 bp, Artificial
  CRISPR gRNA sequence
aacaatagcaatacaatgtg

SEQ ID NO: 617037 - DNA, 20 bp, Artificial
  CRISPR gRNA sequence
ctcagtgctatagaaatatg

SEQ ID NO: 617038 - DNA, 20 bp, Artificial
  CRISPR gRNA sequence
agttacactggacctttgaa

SEQ ID NO: 617039 - DNA, 20 bp, Artificial
  CRISPR gRNA sequence
ctggacctttgaaaaggatt

SEQ ID NO: 617040 - DNA, 20 bp, Artificial
  CRISPR gRNA sequence
cagaaatccaaggaaaggag

SEQ ID NO: 617041 - DNA, 20 bp, Artificial
  CRISPR gRNA sequence
gcaaagaaaaggcaatttga

SEQ ID NO: 617042 - DNA, 20 bp, Artificial
  CRISPR gRNA sequence
gaagcacagtatatgtgaaa

SEQ ID NO: 617043 - DNA, 20 bp, Artificial
  CRISPR gRNA sequence
gactgcattcctcaggtaag

SEQ ID NO: 617044 - DNA, 20 bp, Artificial
  CRISPR gRNA sequence
aaggggagtcattcagaaaa

SEQ ID NO: 617045 - DNA, 20 bp, Artificial
  CRISPR gRNA sequence
agtctcgtagtaacccaggc

SEQ ID NO: 617046 - DNA, 20 bp, Artificial
  CRISPR gRNA sequence
ctcactgcagcctcaacctc

SEQ ID NO: 617047 - DNA, 20 bp, Artificial
  CRISPR gRNA sequence
gcctcaacctcctgggttca

SEQ ID NO: 617048 - DNA, 20 bp, Artificial
  CRISPR gRNA sequence
cccctcaagtagctgggact

SEQ ID NO: 617049 - DNA, 20 bp, Artificial
  CRISPR gRNA sequence
ttttgtattttttgtagaga

SEQ ID NO: 617050 - DNA, 20 bp, Artificial
  CRISPR gRNA sequence
gatgcataatagttatccta

SEQ ID NO: 617051 - DNA, 20 bp, Artificial
  CRISPR gRNA sequence
tatcttaggcaaatcagtac

SEQ ID NO: 617052 - DNA, 20 bp, Artificial
  CRISPR gRNA sequence
tagtaattcaatgtggaagc

SEQ ID NO: 617053 - DNA, 20 bp, Artificial
  CRISPR gRNA sequence
cagatcatgtatgatattcc

SEQ ID NO: 617054 - DNA, 20 bp, Artificial
  CRISPR gRNA sequence
aatattctttctaacattca

SEQ ID NO: 617055 - DNA, 20 bp, Artificial
  CRISPR gRNA sequence
ccctggcatattacaacttg

SEQ ID NO: 617056 - DNA, 20 bp, Artificial
  CRISPR gRNA sequence
tatttgtacaaaaaactaaa

SEQ ID NO: 617057 - DNA, 20 bp, Artificial
  CRISPR gRNA sequence
taatatctgtttccattctg

SEQ ID NO: 617058 - DNA, 20 bp, Artificial
  CRISPR gRNA sequence
attttgtgtcaacaggctga

SEQ ID NO: 617059 - DNA, 20 bp, Artificial
  CRISPR gRNA sequence
aagtgcagaaataaataata

SEQ ID NO: 617060 - DNA, 20 bp, Artificial
  CRISPR gRNA sequence
tcctaaacttgcctgattat

SEQ ID NO: 617061 - DNA, 20 bp, Artificial
  CRISPR gRNA sequence
acttgcctgattatcagaat

SEQ ID NO: 617062 - DNA, 20 bp, Artificial
  CRISPR gRNA sequence
ctttgtttgattcagtatac

SEQ ID NO: 617063 - DNA, 20 bp, Artificial
  CRISPR gRNA sequence
tttaaaaataaattggtttt

SEQ ID NO: 617064 - DNA, 20 bp, Artificial
  CRISPR gRNA sequence
tttaaggattattctttcct

SEQ ID NO: 617065 - DNA, 20 bp, Artificial
  CRISPR gRNA sequence
ctccaaactaaagtaaagag

SEQ ID NO: 617066 - DNA, 20 bp, Artificial
  CRISPR gRNA sequence
acacgtgatatttctgcagc

SEQ ID NO: 617067 - DNA, 20 bp, Artificial
  CRISPR gRNA sequence
agctaatttccctgttaaat

SEQ ID NO: 617068 - DNA, 20 bp, Artificial
  CRISPR gRNA sequence
aatttccctgttaaatgtga

SEQ ID NO: 617069 - DNA, 20 bp, Artificial
  CRISPR gRNA sequence
atatcctcagaggaagaaat

SEQ ID NO: 617070 - DNA, 20 bp, Artificial
  CRISPR gRNA sequence
ccatattatctttttcacct

SEQ ID NO: 617071 - DNA, 20 bp, Artificial
  CRISPR gRNA sequence
atgtcagctggaaaaccgtg

SEQ ID NO: 617072 - DNA, 20 bp, Artificial
  CRISPR gRNA sequence
gatgatcatacttccttcat

SEQ ID NO: 617073 - DNA, 20 bp, Artificial
  CRISPR gRNA sequence
tgtaaatggaaacataagca

SEQ ID NO: 617074 - DNA, 20 bp, Artificial
  CRISPR gRNA sequence
ttattttaaccataagttat

SEQ ID NO: 617075 - DNA, 20 bp, Artificial
  CRISPR gRNA sequence
accataagttatttgaattg

SEQ ID NO: 617076 - DNA, 20 bp, Artificial
  CRISPR gRNA sequence
ttgtcgaataaaagacttaa

SEQ ID NO: 617077 - DNA, 20 bp, Artificial
  CRISPR gRNA sequence
aaaataaataaataaattaa

SEQ ID NO: 617078 - DNA, 20 bp, Artificial
  CRISPR gRNA sequence
caagttattgaaaataaatt

SEQ ID NO: 617079 - DNA, 20 bp, Artificial
  CRISPR gRNA sequence
aaacttgtgagatatttagc

SEQ ID NO: 617080 - DNA, 20 bp, Artificial
  CRISPR gRNA sequence
aatataaggaagaactttct

SEQ ID NO: 617081 - DNA, 20 bp, Artificial
  CRISPR gRNA sequence
cacctgtcatgcatgctgtc

SEQ ID NO: 617082 - DNA, 20 bp, Artificial
  CRISPR gRNA sequence
aagttgttctaaatgacctt

SEQ ID NO: 617083 - DNA, 20 bp, Artificial
  CRISPR gRNA sequence
cacttttaagtaactgattc

SEQ ID NO: 617084 - DNA, 20 bp, Artificial
  CRISPR gRNA sequence
caaggattattttcagtgag

SEQ ID NO: 617085 - DNA, 20 bp, Artificial
  CRISPR gRNA sequence
ttttcagtgagatgaatggc

SEQ ID NO: 617086 - DNA, 20 bp, Artificial
  CRISPR gRNA sequence
ccattgtgcagaagggggaa

SEQ ID NO: 617087 - DNA, 20 bp, Artificial
  CRISPR gRNA sequence
caggtacaagccttctgcct

SEQ ID NO: 617088 - DNA, 20 bp, Artificial
  CRISPR gRNA sequence
tacaaaactacacgacacac

SEQ ID NO: 617089 - DNA, 20 bp, Artificial
  CRISPR gRNA sequence
gcataatttttcacgtacaa

SEQ ID NO: 617090 - DNA, 20 bp, Artificial
  CRISPR gRNA sequence
aatgaactttctctgctctc

SEQ ID NO: 617091 - DNA, 20 bp, Artificial
  CRISPR gRNA sequence
tttcccatgtgtagaaagta

SEQ ID NO: 617092 - DNA, 20 bp, Artificial
  CRISPR gRNA sequence
ccatgtgtagaaagtacagg

SEQ ID NO: 617093 - DNA, 20 bp, Artificial
  CRISPR gRNA sequence
agtacagggtgagtctaaac

SEQ ID NO: 617094 - DNA, 20 bp, Artificial
  CRISPR gRNA sequence
ataagtatacaacttatttc

SEQ ID NO: 617095 - DNA, 20 bp, Artificial
  CRISPR gRNA sequence
accaggtttcatcttttctc

SEQ ID NO: 617096 - DNA, 20 bp, Artificial
  CRISPR gRNA sequence
gctttgcctatgtgtttcca

SEQ ID NO: 617097 - DNA, 20 bp, Artificial
  CRISPR gRNA sequence
tgctaatcaattgacaaact

SEQ ID NO: 617098 - DNA, 20 bp, Artificial
  CRISPR gRNA sequence
tacacaatcttttcccctaa

SEQ ID NO: 617099 - DNA, 20 bp, Artificial
  CRISPR gRNA sequence
tcccctaatagaatggctat

SEQ ID NO: 617100 - DNA, 20 bp, Artificial
  CRISPR gRNA sequence
atgacaaggtttcttgatat

SEQ ID NO: 617101 - DNA, 20 bp, Artificial
  CRISPR gRNA sequence
tgctatgctaaatactttgg

SEQ ID NO: 617102 - DNA, 20 bp, Artificial
  CRISPR gRNA sequence
aaaagtcacatcttctgttc

SEQ ID NO: 617103 - DNA, 20 bp, Artificial
  CRISPR gRNA sequence
taataaatatgcctcaaatc

SEQ ID NO: 617104 - DNA, 20 bp, Artificial
  CRISPR gRNA sequence
tatgcctcaaatcatgaatc

SEQ ID NO: 617105 - DNA, 20 bp, Artificial
  CRISPR gRNA sequence
ctctttctcctagttcctaa

SEQ ID NO: 617106 - DNA, 20 bp, Artificial
  CRISPR gRNA sequence
tcaggaacaaaaattaaata

SEQ ID NO: 617107 - DNA, 20 bp, Artificial
  CRISPR gRNA sequence
ccccattcagatgaaccaaa

SEQ ID NO: 617108 - DNA, 20 bp, Artificial
  CRISPR gRNA sequence
atacacagctaagttatcct

SEQ ID NO: 617109 - DNA, 20 bp, Artificial
  CRISPR gRNA sequence
taaggatgtaaagaaggtaa

SEQ ID NO: 617110 - DNA, 20 bp, Artificial
  CRISPR gRNA sequence
aagaaggtaaatgaatgaac

SEQ ID NO: 617111 - DNA, 20 bp, Artificial
  CRISPR gRNA sequence
aacaacctaaatgtccaaca

SEQ ID NO: 617112 - DNA, 20 bp, Artificial
  CRISPR gRNA sequence
aaaaaatcctaaatgaaaaa

SEQ ID NO: 617113 - DNA, 20 bp, Artificial
  CRISPR gRNA sequence
aaattatggaaagataatta

SEQ ID NO: 617114 - DNA, 20 bp, Artificial
  CRISPR gRNA sequence
tagcacaggaaactgaggac

SEQ ID NO: 617115 - DNA, 20 bp, Artificial
  CRISPR gRNA sequence
gaaactgaggactagggtac

SEQ ID NO: 617116 - DNA, 20 bp, Artificial
  CRISPR gRNA sequence
gttcctatatcatttttacc

SEQ ID NO: 617117 - DNA, 20 bp, Artificial
  CRISPR gRNA sequence
tctttagccccacactatgt

SEQ ID NO: 617118 - DNA, 20 bp, Artificial
  CRISPR gRNA sequence
aatgctggccacatcccctg

SEQ ID NO: 617119 - DNA, 20 bp, Artificial
  CRISPR gRNA sequence
tccagttcagaacttacgta

SEQ ID NO: 617120 - DNA, 20 bp, Artificial
  CRISPR gRNA sequence
acttacgtaatggatggttt

SEQ ID NO: 617121 - DNA, 20 bp, Artificial
  CRISPR gRNA sequence
tctaaaatctaagctccttt

SEQ ID NO: 617122 - DNA, 20 bp, Artificial
  CRISPR gRNA sequence
aatctaagctcctttgagag

SEQ ID NO: 617123 - DNA, 20 bp, Artificial
  CRISPR gRNA sequence
taccggtaataaataaacat

SEQ ID NO: 617124 - DNA, 20 bp, Artificial
  CRISPR gRNA sequence
aaaattgtattttacaagag

SEQ ID NO: 617125 - DNA, 20 bp, Artificial
  CRISPR gRNA sequence
ttcctactttcctgaccata

SEQ ID NO: 617126 - DNA, 20 bp, Artificial
  CRISPR gRNA sequence
cacggtacacatttataaca

SEQ ID NO: 617127 - DNA, 20 bp, Artificial
  CRISPR gRNA sequence
agtgaataggaactacacat

SEQ ID NO: 617128 - DNA, 20 bp, Artificial
  CRISPR gRNA sequence
ataggaactacacatcagaa

SEQ ID NO: 617129 - DNA, 20 bp, Artificial
  CRISPR gRNA sequence
gaatgattattgatttctta

SEQ ID NO: 617130 - DNA, 20 bp, Artificial
  CRISPR gRNA sequence
caccaaaaaaccatcaatct

SEQ ID NO: 617131 - DNA, 20 bp, Artificial
  CRISPR gRNA sequence
cagcccatacagcattctga

SEQ ID NO: 617132 - DNA, 20 bp, Artificial
  CRISPR gRNA sequence
ctccagctccaaccacaata

SEQ ID NO: 617133 - DNA, 20 bp, Artificial
  CRISPR gRNA sequence
ggtaaacaatcaggtcctgg

SEQ ID NO: 617134 - DNA, 20 bp, Artificial
  CRISPR gRNA sequence
ctatgaaaactgtaaataaa

SEQ ID NO: 617135 - DNA, 20 bp, Artificial
  CRISPR gRNA sequence
ttagtggcaggttgtggaga

SEQ ID NO: 617136 - DNA, 20 bp, Artificial
  CRISPR gRNA sequence
acctcttcccaaatctgcac

SEQ ID NO: 617137 - DNA, 20 bp, Artificial
  CRISPR gRNA sequence
tagttctctttctaaatcct

SEQ ID NO: 617138 - DNA, 20 bp, Artificial
  CRISPR gRNA sequence
cacttttactaaatatccag

SEQ ID NO: 617139 - DNA, 20 bp, Artificial
  CRISPR gRNA sequence
cacctagcagtccttaatca

SEQ ID NO: 617140 - DNA, 20 bp, Artificial
  CRISPR gRNA sequence
ctttaagtcctatctatcat

SEQ ID NO: 617141 - DNA, 20 bp, Artificial
  CRISPR gRNA sequence
tatgtcaacattcttttcta

SEQ ID NO: 617142 - DNA, 20 bp, Artificial
  CRISPR gRNA sequence
tccacccaattaactaactt

SEQ ID NO: 617143 - DNA, 20 bp, Artificial
  CRISPR gRNA sequence
tttgtgaaatggtgaaatgt

SEQ ID NO: 617144 - DNA, 20 bp, Artificial
  CRISPR gRNA sequence
ggcaaaacaaatgtatttcc

SEQ ID NO: 617145 - DNA, 20 bp, Artificial
  CRISPR gRNA sequence
tagaatgcaagtggtaactt

SEQ ID NO: 617146 - DNA, 20 bp, Artificial
  CRISPR gRNA sequence
tgcaagtggtaactttagaa

SEQ ID NO: 617147 - DNA, 20 bp, Artificial
  CRISPR gRNA sequence
gctattaggttgaaaaacaa

SEQ ID NO: 617148 - DNA, 20 bp, Artificial
  CRISPR gRNA sequence
cttacggcttaacccaaaag

SEQ ID NO: 617149 - DNA, 20 bp, Artificial
  CRISPR gRNA sequence
agggcctcaccccaaaacat

SEQ ID NO: 617150 - DNA, 20 bp, Artificial
  CRISPR gRNA sequence
aaagcaaggaacaccaagcc

SEQ ID NO: 617151 - DNA, 20 bp, Artificial
  CRISPR gRNA sequence
tgttgttgttgtttttcaga

SEQ ID NO: 617152 - DNA, 20 bp, Artificial
  CRISPR gRNA sequence
gagtctcactttctgtcgcc

SEQ ID NO: 617153 - DNA, 20 bp, Artificial
  CRISPR gRNA sequence
tcactttctgtcgcccagga

SEQ ID NO: 617154 - DNA, 20 bp, Artificial
  CRISPR gRNA sequence
tattctcctgcctcagcctc

SEQ ID NO: 617155 - DNA, 20 bp, Artificial
  CRISPR gRNA sequence
gcctcagcctccagagtagc

SEQ ID NO: 617156 - DNA, 20 bp, Artificial
  CRISPR gRNA sequence
ttttgtatttttagtagaga

SEQ ID NO: 617157 - DNA, 20 bp, Artificial
  CRISPR gRNA sequence
gtctcggcctcccaaagtgc

SEQ ID NO: 617158 - DNA, 20 bp, Artificial
  CRISPR gRNA sequence
atgtacaggtttctaaaata

SEQ ID NO: 617159 - DNA, 20 bp, Artificial
  CRISPR gRNA sequence
ggtttctaaaatagagggtt

SEQ ID NO: 617160 - DNA, 20 bp, Artificial
  CRISPR gRNA sequence
ttgctttatagacacacaca

SEQ ID NO: 617161 - DNA, 20 bp, Artificial
  CRISPR gRNA sequence
tttatggaagggaaagaaca

SEQ ID NO: 617162 - DNA, 20 bp, Artificial
  CRISPR gRNA sequence
aacaaggagtcagttcatct

SEQ ID NO: 617163 - DNA, 20 bp, Artificial
  CRISPR gRNA sequence
tacattcctggccctactac

SEQ ID NO: 617164 - DNA, 20 bp, Artificial
  CRISPR gRNA sequence
gtataataaagaaaataaaa

SEQ ID NO: 617165 - DNA, 20 bp, Artificial
  CRISPR gRNA sequence
aataaaacaggataatgtca

SEQ ID NO: 617166 - DNA, 20 bp, Artificial
  CRISPR gRNA sequence
tggagaggggcttatttatc

SEQ ID NO: 617167 - DNA, 20 bp, Artificial
  CRISPR gRNA sequence
aaaagttcagtgaacaggga

SEQ ID NO: 617168 - DNA, 20 bp, Artificial
  CRISPR gRNA sequence
ggaccttacagactttggaa

SEQ ID NO: 617169 - DNA, 20 bp, Artificial
  CRISPR gRNA sequence
aagcttttgtgtttaaagca

SEQ ID NO: 617170 - DNA, 20 bp, Artificial
  CRISPR gRNA sequence
atgaattgttatgatctgat

SEQ ID NO: 617171 - DNA, 20 bp, Artificial
  CRISPR gRNA sequence
aaaacaaactacagagaagc

SEQ ID NO: 617172 - DNA, 20 bp, Artificial
  CRISPR gRNA sequence
gttacagtagcgggcctggt

SEQ ID NO: 617173 - DNA, 20 bp, Artificial
  CRISPR gRNA sequence
tggtgagaattgtttaaatt

SEQ ID NO: 617174 - DNA, 20 bp, Artificial
  CRISPR gRNA sequence
tgtattttagaagcagagcc

SEQ ID NO: 617175 - DNA, 20 bp, Artificial
  CRISPR gRNA sequence
agccaaggatttctgataga

SEQ ID NO: 617176 - DNA, 20 bp, Artificial
  CRISPR gRNA sequence
gatttctgatagactggatg

SEQ ID NO: 617177 - DNA, 20 bp, Artificial
  CRISPR gRNA sequence
gaaagaaacagtgctagatg

SEQ ID NO: 617178 - DNA, 20 bp, Artificial
  CRISPR gRNA sequence
caggctgcaaatagatgaag

SEQ ID NO: 617179 - DNA, 20 bp, Artificial
  CRISPR gRNA sequence
agttttctgatgtcctctaa

SEQ ID NO: 617180 - DNA, 20 bp, Artificial
  CRISPR gRNA sequence
acaaaaactaatcactaagc

SEQ ID NO: 617181 - DNA, 20 bp, Artificial
  CRISPR gRNA sequence
taaattgctactaaaaatat

SEQ ID NO: 617182 - DNA, 20 bp, Artificial
  CRISPR gRNA sequence
aaaaatatatggatacaagc

SEQ ID NO: 617183 - DNA, 20 bp, Artificial
  CRISPR gRNA sequence
gcttgaattttcagttcagt

SEQ ID NO: 617184 - DNA, 20 bp, Artificial
  CRISPR gRNA sequence
tctgttacaatgtaaacaaa

SEQ ID NO: 617185 - DNA, 20 bp, Artificial
  CRISPR gRNA sequence
gccttatttcttgcagctat

SEQ ID NO: 617186 - DNA, 20 bp, Artificial
  CRISPR gRNA sequence
tttaagcaaatatttctagt

SEQ ID NO: 617187 - DNA, 20 bp, Artificial
  CRISPR gRNA sequence
tagtaagaattcaactgagg

SEQ ID NO: 617188 - DNA, 20 bp, Artificial
  CRISPR gRNA sequence
ctgagggggaatgtaaatgt

SEQ ID NO: 617189 - DNA, 20 bp, Artificial
  CRISPR gRNA sequence
tggaggtctggctcacaatc

SEQ ID NO: 617190 - DNA, 20 bp, Artificial
  CRISPR gRNA sequence
agggagagccatttgattca

SEQ ID NO: 617191 - DNA, 20 bp, Artificial
  CRISPR gRNA sequence
tgatctttgagatttagcta

SEQ ID NO: 617192 - DNA, 20 bp, Artificial
  CRISPR gRNA sequence
aagtttattaaaaacaacat

SEQ ID NO: 617193 - DNA, 20 bp, Artificial
  CRISPR gRNA sequence
tgatttatgacttgaaagat

SEQ ID NO: 617194 - DNA, 20 bp, Artificial
  CRISPR gRNA sequence
taaaatccatctctaaattc

SEQ ID NO: 617195 - DNA, 20 bp, Artificial
  CRISPR gRNA sequence
ttagtccaatgtagtattgt

SEQ ID NO: 617196 - DNA, 20 bp, Artificial
  CRISPR gRNA sequence
tccaatgtagtattgtttga

SEQ ID NO: 617197 - DNA, 20 bp, Artificial
  CRISPR gRNA sequence
gtttgaatgagtgttgagaa

SEQ ID NO: 617198 - DNA, 20 bp, Artificial
  CRISPR gRNA sequence
atttattttaaaactgcctt

SEQ ID NO: 617199 - DNA, 20 bp, Artificial
  CRISPR gRNA sequence
tgccttctgggtaagactag

SEQ ID NO: 617200 - DNA, 20 bp, Artificial
  CRISPR gRNA sequence
agcataactgaagtaacctg

SEQ ID NO: 617201 - DNA, 20 bp, Artificial
  CRISPR gRNA sequence
aagtaacctgtggggttaat

SEQ ID NO: 617202 - DNA, 20 bp, Artificial
  CRISPR gRNA sequence
ttaatctgaataataatgtc

SEQ ID NO: 617203 - DNA, 20 bp, Artificial
  CRISPR gRNA sequence
caatcagataaccaacacat

SEQ ID NO: 617204 - DNA, 20 bp, Artificial
  CRISPR gRNA sequence
agcttctgtggaaaagataa

SEQ ID NO: 617205 - DNA, 20 bp, Artificial
  CRISPR gRNA sequence
agtcattttccctgccctca

SEQ ID NO: 617206 - DNA, 20 bp, Artificial
  CRISPR gRNA sequence
gaaattaagcaatgataaaa

SEQ ID NO: 617207 - DNA, 20 bp, Artificial
  CRISPR gRNA sequence
aaaaaaaaaaaaagatcatt

SEQ ID NO: 617208 - DNA, 20 bp, Artificial
  CRISPR gRNA sequence
aaaaaagatcatttggaatt

SEQ ID NO: 617209 - DNA, 20 bp, Artificial
  CRISPR gRNA sequence
taatgtgaaatccttttaaa

SEQ ID NO: 617210 - DNA, 20 bp, Artificial
  CRISPR gRNA sequence
agagaaaaaaagaacactgc

SEQ ID NO: 617211 - DNA, 20 bp, Artificial
  CRISPR gRNA sequence
gggtatgtatatgtggttct

SEQ ID NO: 617212 - DNA, 20 bp, Artificial
  CRISPR gRNA sequence
tccagatatgcaacagagac

SEQ ID NO: 617213 - DNA, 20 bp, Artificial
  CRISPR gRNA sequence
taaaatttcagagctatact

SEQ ID NO: 617214 - DNA, 20 bp, Artificial
  CRISPR gRNA sequence
cctgccagcaaacacatctt

SEQ ID NO: 617215 - DNA, 20 bp, Artificial
  CRISPR gRNA sequence
tcaattatacccgtcacaaa

SEQ ID NO: 617216 - DNA, 20 bp, Artificial
  CRISPR gRNA sequence
tcatttcttcagtaattgat

SEQ ID NO: 617217 - DNA, 20 bp, Artificial
  CRISPR gRNA sequence
agtaattgatttgaatacaa

SEQ ID NO: 617218 - DNA, 20 bp, Artificial
  CRISPR gRNA sequence
tttcttttcaaacaaaaatt

SEQ ID NO: 617219 - DNA, 20 bp, Artificial
  CRISPR gRNA sequence
taatgctaagtactatcaaa

SEQ ID NO: 617220 - DNA, 20 bp, Artificial
  CRISPR gRNA sequence
aattttttaaaaatgtctca

SEQ ID NO: 617221 - DNA, 20 bp, Artificial
  CRISPR gRNA sequence
aacctgagccttctaaataa

SEQ ID NO: 617222 - DNA, 20 bp, Artificial
  CRISPR gRNA sequence
cagcgatcagaggacaaaaa

SEQ ID NO: 617223 - DNA, 20 bp, Artificial
  CRISPR gRNA sequence
taccgcatccacgataattt

SEQ ID NO: 617224 - DNA, 20 bp, Artificial
  CRISPR gRNA sequence
aatttaggaatacgaccagt

SEQ ID NO: 617225 - DNA, 20 bp, Artificial
  CRISPR gRNA sequence
ctttaattggctaattgttc

SEQ ID NO: 617226 - DNA, 20 bp, Artificial
  CRISPR gRNA sequence
aagaagtatgcttctttctc

SEQ ID NO: 617227 - DNA, 20 bp, Artificial
  CRISPR gRNA sequence
ttgctctattgctctctcca

SEQ ID NO: 617228 - DNA, 20 bp, Artificial
  CRISPR gRNA sequence
agtggatctactaactcaag

SEQ ID NO: 617229 - DNA, 20 bp, Artificial
  CRISPR gRNA sequence
ctgtggcttgtcctccactt

SEQ ID NO: 617230 - DNA, 20 bp, Artificial
  CRISPR gRNA sequence
tacctccattagcaacatac

SEQ ID NO: 617231 - DNA, 20 bp, Artificial
  CRISPR gRNA sequence
aaaaaattagcaacattcga

SEQ ID NO: 617232 - DNA, 20 bp, Artificial
  CRISPR gRNA sequence
ttcgagggaattttaaattg

SEQ ID NO: 617233 - DNA, 20 bp, Artificial
  CRISPR gRNA sequence
cttgtttgttacatgcaaga

SEQ ID NO: 617234 - DNA, 20 bp, Artificial
  CRISPR gRNA sequence
agtgtatgacacttcatgct

SEQ ID NO: 617235 - DNA, 20 bp, Artificial
  CRISPR gRNA sequence
tatgacacttcatgctatga

SEQ ID NO: 617236 - DNA, 20 bp, Artificial
  CRISPR gRNA sequence
atattactcataaaacaatt

SEQ ID NO: 617237 - DNA, 20 bp, Artificial
  CRISPR gRNA sequence
tactcaggaggctgaggcgg

SEQ ID NO: 617238 - DNA, 20 bp, Artificial
  CRISPR gRNA sequence
cgggagaatcacttgaggcc

SEQ ID NO: 617239 - DNA, 20 bp, Artificial
  CRISPR gRNA sequence
tgagaagattgcttgagccc

SEQ ID NO: 617240 - DNA, 20 bp, Artificial
  CRISPR gRNA sequence
aagagatgaaaagaaaagaa

SEQ ID NO: 617241 - DNA, 20 bp, Artificial
  CRISPR gRNA sequence
gcacggtggctcacaagctc

SEQ ID NO: 617242 - DNA, 20 bp, Artificial
  CRISPR gRNA sequence
tactcaggaggctgaggcag

SEQ ID NO: 617243 - DNA, 20 bp, Artificial
  CRISPR gRNA sequence
actttgggaggctgaggcag

SEQ ID NO: 617244 - DNA, 20 bp, Artificial
  CRISPR gRNA sequence
caggtggatagcccgaggtc

SEQ ID NO: 617245 - DNA, 20 bp, Artificial
  CRISPR gRNA sequence
tactcgggagactgaggcag

SEQ ID NO: 617246 - DNA, 20 bp, Artificial
  CRISPR gRNA sequence
caggagaattgcttgaacct

SEQ ID NO: 617247 - DNA, 20 bp, Artificial
  CRISPR gRNA sequence
attgcttgaacctgggagtg

SEQ ID NO: 617248 - DNA, 20 bp, Artificial
  CRISPR gRNA sequence
tcgcgccactgcactccagc

SEQ ID NO: 617249 - DNA, 20 bp, Artificial
  CRISPR gRNA sequence
gaaaaagaaaagaaaaaaga

SEQ ID NO: 617250 - DNA, 20 bp, Artificial
  CRISPR gRNA sequence
gatgacagctgatcattttt

SEQ ID NO: 617251 - DNA, 20 bp, Artificial
  CRISPR gRNA sequence
tattgaaatttcaaagttaa

SEQ ID NO: 617252 - DNA, 20 bp, Artificial
  CRISPR gRNA sequence
tggctccatactttctttta

SEQ ID NO: 617253 - DNA, 20 bp, Artificial
  CRISPR gRNA sequence
ttcttttagaggatggttga

SEQ ID NO: 617254 - DNA, 20 bp, Artificial
  CRISPR gRNA sequence
ttaaattacacaaataatat

SEQ ID NO: 617255 - DNA, 20 bp, Artificial
  CRISPR gRNA sequence
tattttttgtaagagactta

SEQ ID NO: 617256 - DNA, 20 bp, Artificial
  CRISPR gRNA sequence
ttaaagaatgtagaactatt

SEQ ID NO: 617257 - DNA, 20 bp, Artificial
  CRISPR gRNA sequence
aaatggtattatcatataca

SEQ ID NO: 617258 - DNA, 20 bp, Artificial
  CRISPR gRNA sequence
attgtgttttgttgaggtac

SEQ ID NO: 617259 - DNA, 20 bp, Artificial
  CRISPR gRNA sequence
tacatttccaaatactacat

SEQ ID NO: 617260 - DNA, 20 bp, Artificial
  CRISPR gRNA sequence
tttttagtacctaaaaatta

SEQ ID NO: 617261 - DNA, 20 bp, Artificial
  CRISPR gRNA sequence
tttcaagctttagatgatat

SEQ ID NO: 617262 - DNA, 20 bp, Artificial
  CRISPR gRNA sequence
gaaatagaccttttacaatc

SEQ ID NO: 617263 - DNA, 20 bp, Artificial
  CRISPR gRNA sequence
agtcatctacttcagaccat

SEQ ID NO: 617264 - DNA, 20 bp, Artificial
  CRISPR gRNA sequence
gtatttttaaacaacaaaac

SEQ ID NO: 617265 - DNA, 20 bp, Artificial
  CRISPR gRNA sequence
ataagatcaagtcctgcatg

SEQ ID NO: 617266 - DNA, 20 bp, Artificial
  CRISPR gRNA sequence
taggtagagctgacatagac

SEQ ID NO: 617267 - DNA, 20 bp, Artificial
  CRISPR gRNA sequence
acgtcaaaagtgtagacacc

SEQ ID NO: 617268 - DNA, 20 bp, Artificial
  CRISPR gRNA sequence
tatacactcatcaaaatatc

SEQ ID NO: 617269 - DNA, 20 bp, Artificial
  CRISPR gRNA sequence
gctttaaaattacaagtata

SEQ ID NO: 617270 - DNA, 20 bp, Artificial
  CRISPR gRNA sequence
acatctacattaacattcat

SEQ ID NO: 617271 - DNA, 20 bp, Artificial
  CRISPR gRNA sequence
ttccactgaacatggttgta

SEQ ID NO: 617272 - DNA, 20 bp, Artificial
  CRISPR gRNA sequence
gaagattacaaaatcttttt

SEQ ID NO: 617273 - DNA, 20 bp, Artificial
  CRISPR gRNA sequence
agagaaaatcacaagtaaat

SEQ ID NO: 617274 - DNA, 20 bp, Artificial
  CRISPR gRNA sequence
tcacaagtaaattaggattt

SEQ ID NO: 617275 - DNA, 20 bp, Artificial
  CRISPR gRNA sequence
atgcatacaatgcatatgct

SEQ ID NO: 617276 - DNA, 20 bp, Artificial
  CRISPR gRNA sequence
tctatatcaccagctaactt

SEQ ID NO: 617277 - DNA, 20 bp, Artificial
  CRISPR gRNA sequence
catcagctgtcgagatttct

SEQ ID NO: 617278 - DNA, 20 bp, Artificial
  CRISPR gRNA sequence
agatttctgtgaatggaagt

SEQ ID NO: 617279 - DNA, 20 bp, Artificial
  CRISPR gRNA sequence
tataaatcacactaaagaaa

SEQ ID NO: 617280 - DNA, 20 bp, Artificial
  CRISPR gRNA sequence
aatcacactaaagaaaatga

SEQ ID NO: 617281 - DNA, 20 bp, Artificial
  CRISPR gRNA sequence
gtattaatataggttacaga

SEQ ID NO: 617282 - DNA, 20 bp, Artificial
  CRISPR gRNA sequence
taggttacagactgaatctg

SEQ ID NO: 617283 - DNA, 20 bp, Artificial
  CRISPR gRNA sequence
gaagccaaggggaaaaaaaa

SEQ ID NO: 617284 - DNA, 20 bp, Artificial
  CRISPR gRNA sequence
gaagtattttggttgaacta

SEQ ID NO: 617285 - DNA, 20 bp, Artificial
  CRISPR gRNA sequence
atgctatctctattgtgatg

SEQ ID NO: 617286 - DNA, 20 bp, Artificial
  CRISPR gRNA sequence
agtctaatgccattaaacat

SEQ ID NO: 617287 - DNA, 20 bp, Artificial
  CRISPR gRNA sequence
aatgatctagtcaagccaac

SEQ ID NO: 617288 - DNA, 20 bp, Artificial
  CRISPR gRNA sequence
aatctagtttcagaacttgc

SEQ ID NO: 617289 - DNA, 20 bp, Artificial
  CRISPR gRNA sequence
tagtttcagaacttgcaagg

SEQ ID NO: 617290 - DNA, 20 bp, Artificial
  CRISPR gRNA sequence
aagcagctcattaatctata

SEQ ID NO: 617291 - DNA, 20 bp, Artificial
  CRISPR gRNA sequence
aagtgcttaataaatgtttg

SEQ ID NO: 617292 - DNA, 20 bp, Artificial
  CRISPR gRNA sequence
agatgaaaaatatctctcta

SEQ ID NO: 617293 - DNA, 20 bp, Artificial
  CRISPR gRNA sequence
aaatatctctctaaggagtt

SEQ ID NO: 617294 - DNA, 20 bp, Artificial
  CRISPR gRNA sequence
ttctagcattaacattcatt

SEQ ID NO: 617295 - DNA, 20 bp, Artificial
  CRISPR gRNA sequence
atttggaattctatggtgtc

SEQ ID NO: 617296 - DNA, 20 bp, Artificial
  CRISPR gRNA sequence
cagcgcttacatttttaaga

SEQ ID NO: 617297 - DNA, 20 bp, Artificial
  CRISPR gRNA sequence
gaattctgtaataaatattt

SEQ ID NO: 617298 - DNA, 20 bp, Artificial
  CRISPR gRNA sequence
atctaggtaacctcatccca

SEQ ID NO: 617299 - DNA, 20 bp, Artificial
  CRISPR gRNA sequence
tcttcaaaaaggctctggtg

SEQ ID NO: 617300 - DNA, 20 bp, Artificial
  CRISPR gRNA sequence
atttataaggaaacaggtta

SEQ ID NO: 617301 - DNA, 20 bp, Artificial
  CRISPR gRNA sequence
acagaataaagacagatcat

SEQ ID NO: 617302 - DNA, 20 bp, Artificial
  CRISPR gRNA sequence
gatcattagaatagaggcac

SEQ ID NO: 617303 - DNA, 20 bp, Artificial
  CRISPR gRNA sequence
agctttttgtttaaaaatca

SEQ ID NO: 617304 - DNA, 20 bp, Artificial
  CRISPR gRNA sequence
caacttctgagaccagtata

SEQ ID NO: 617305 - DNA, 20 bp, Artificial
  CRISPR gRNA sequence
ataaaggattccattaagca

SEQ ID NO: 617306 - DNA, 20 bp, Artificial
  CRISPR gRNA sequence
tgtgcacataaaactcaata

SEQ ID NO: 617307 - DNA, 20 bp, Artificial
  CRISPR gRNA sequence
aaggccactgatcaaatact

SEQ ID NO: 617308 - DNA, 20 bp, Artificial
  CRISPR gRNA sequence
atactgagaattacttagac

SEQ ID NO: 617309 - DNA, 20 bp, Artificial
  CRISPR gRNA sequence
cctctcccaaattgtaccct

SEQ ID NO: 617310 - DNA, 20 bp, Artificial
  CRISPR gRNA sequence
accctgtgggtgcttcaaac

SEQ ID NO: 617311 - DNA, 20 bp, Artificial
  CRISPR gRNA sequence
ctccaaagtcattcctggcc

SEQ ID NO: 617312 - DNA, 20 bp, Artificial
  CRISPR gRNA sequence
accaatctgcttgtatttcc

SEQ ID NO: 617313 - DNA, 20 bp, Artificial
  CRISPR gRNA sequence
gctatttctcacctcttatt

SEQ ID NO: 617314 - DNA, 20 bp, Artificial
  CRISPR gRNA sequence
ttaatgtctgtctgtcccac

SEQ ID NO: 617315 - DNA, 20 bp, Artificial
  CRISPR gRNA sequence
tctgtctgtcccactagagt

SEQ ID NO: 617316 - DNA, 20 bp, Artificial
  CRISPR gRNA sequence
tctatactctttattcacct

SEQ ID NO: 617317 - DNA, 20 bp, Artificial
  CRISPR gRNA sequence
aggtatcccacaaatattta

SEQ ID NO: 617318 - DNA, 20 bp, Artificial
  CRISPR gRNA sequence
tatttattgaattgatcaac

SEQ ID NO: 617319 - DNA, 20 bp, Artificial
  CRISPR gRNA sequence
tttattaggtatcatcaagt

SEQ ID NO: 617320 - DNA, 20 bp, Artificial
  CRISPR gRNA sequence
attttagatgaggactctct

SEQ ID NO: 617321 - DNA, 20 bp, Artificial
  CRISPR gRNA sequence
tctaagaattgattctctgt

SEQ ID NO: 617322 - DNA, 20 bp, Artificial
  CRISPR gRNA sequence
ggaataggttactctattaa

SEQ ID NO: 617323 - DNA, 20 bp, Artificial
  CRISPR gRNA sequence
aaaaccacaaaactatactc

SEQ ID NO: 617324 - DNA, 20 bp, Artificial
  CRISPR gRNA sequence
catagatgctttaaataacg

SEQ ID NO: 617325 - DNA, 20 bp, Artificial
  CRISPR gRNA sequence
gacccagatttcaaatagac

SEQ ID NO: 617326 - DNA, 20 bp, Artificial
  CRISPR gRNA sequence
aaaaaagtaacttgactgct

SEQ ID NO: 617327 - DNA, 20 bp, Artificial
  CRISPR gRNA sequence
atagcagcagtgattattta

SEQ ID NO: 617328 - DNA, 20 bp, Artificial
  CRISPR gRNA sequence
gtattgcttatccctattct

SEQ ID NO: 617329 - DNA, 20 bp, Artificial
  CRISPR gRNA sequence
ccaaggtcacacagcaaagc

SEQ ID NO: 617330 - DNA, 20 bp, Artificial
  CRISPR gRNA sequence
cagttttaagtgttataaaa

SEQ ID NO: 617331 - DNA, 20 bp, Artificial
  CRISPR gRNA sequence
gtaattacatgcctacctca

SEQ ID NO: 617332 - DNA, 20 bp, Artificial
  CRISPR gRNA sequence
catactaagtgcactcaata

SEQ ID NO: 617333 - DNA, 20 bp, Artificial
  CRISPR gRNA sequence
tatatcaaaacagaggtata

SEQ ID NO: 617334 - DNA, 20 bp, Artificial
  CRISPR gRNA sequence
tgaacaaagatagagatgat

SEQ ID NO: 617335 - DNA, 20 bp, Artificial
  CRISPR gRNA sequence
ctaagcagactaaaaagata

SEQ ID NO: 617336 - DNA, 20 bp, Artificial
  CRISPR gRNA sequence
aaaagatagggagttgggag

SEQ ID NO: 617337 - DNA, 20 bp, Artificial
  CRISPR gRNA sequence
agaactaaatgtaaagtaca

SEQ ID NO: 617338 - DNA, 20 bp, Artificial
  CRISPR gRNA sequence
aagcccatctggtgttatat

SEQ ID NO: 617339 - DNA, 20 bp, Artificial
  CRISPR gRNA sequence
tgtcctacagaaatccaagc

SEQ ID NO: 617340 - DNA, 20 bp, Artificial
  CRISPR gRNA sequence
ttaatgtgaagtactctgaa

SEQ ID NO: 617341 - DNA, 20 bp, Artificial
  CRISPR gRNA sequence
ccaatactgaacaactatgc

SEQ ID NO: 617342 - DNA, 20 bp, Artificial
  CRISPR gRNA sequence
tgagctaaccaagaaacaga

SEQ ID NO: 617343 - DNA, 20 bp, Artificial
  CRISPR gRNA sequence
ctgatgggccgaaatacaat

SEQ ID NO: 617344 - DNA, 20 bp, Artificial
  CRISPR gRNA sequence
aagtagtcattataaaatgt

SEQ ID NO: 617345 - DNA, 20 bp, Artificial
  CRISPR gRNA sequence
acagaaacccttcatcttag

SEQ ID NO: 617346 - DNA, 20 bp, Artificial
  CRISPR gRNA sequence
cttattgatacttttctggc

SEQ ID NO: 617347 - DNA, 20 bp, Artificial
  CRISPR gRNA sequence
aaagtcaacaatgcatgtaa

SEQ ID NO: 617348 - DNA, 20 bp, Artificial
  CRISPR gRNA sequence
tccaagtcacagaaaaacat

SEQ ID NO: 617349 - DNA, 20 bp, Artificial
  CRISPR gRNA sequence
tcttgttctaattaatagac

SEQ ID NO: 617350 - DNA, 20 bp, Artificial
  CRISPR gRNA sequence
agatctaacagagaggaaaa

SEQ ID NO: 617351 - DNA, 20 bp, Artificial
  CRISPR gRNA sequence
cttctccatctaacacctaa

SEQ ID NO: 617352 - DNA, 20 bp, Artificial
  CRISPR gRNA sequence
ctgtaaatagaggctacata

SEQ ID NO: 617353 - DNA, 20 bp, Artificial
  CRISPR gRNA sequence
agccaaaacctgtactaaca

SEQ ID NO: 617354 - DNA, 20 bp, Artificial
  CRISPR gRNA sequence
caaacataagtttactgttg

SEQ ID NO: 617355 - DNA, 20 bp, Artificial
  CRISPR gRNA sequence
tgcactgtttatttaaaaag

SEQ ID NO: 617356 - DNA, 20 bp, Artificial
  CRISPR gRNA sequence
gaagcaagtacttgcaaaac

SEQ ID NO: 617357 - DNA, 20 bp, Artificial
  CRISPR gRNA sequence
ttttcctgtggttgtgtcta

SEQ ID NO: 617358 - DNA, 20 bp, Artificial
  CRISPR gRNA sequence
tttactctttaggaaattgt

SEQ ID NO: 617359 - DNA, 20 bp, Artificial
  CRISPR gRNA sequence
caaatcaactagcaaaaaac

SEQ ID NO: 617360 - DNA, 20 bp, Artificial
  CRISPR gRNA sequence
tttttctttctaaatgatac

SEQ ID NO: 617361 - DNA, 20 bp, Artificial
  CRISPR gRNA sequence
aggaagtgctcattacttaa

SEQ ID NO: 617362 - DNA, 20 bp, Artificial
  CRISPR gRNA sequence
aaaagaaaaagttgctctct

SEQ ID NO: 617363 - DNA, 20 bp, Artificial
  CRISPR gRNA sequence
agttgctctctctggatagt

SEQ ID NO: 617364 - DNA, 20 bp, Artificial
  CRISPR gRNA sequence
ttcggggggggggaaggaaa

SEQ ID NO: 617365 - DNA, 20 bp, Artificial
  CRISPR gRNA sequence
atgtcctttctataacatgt

SEQ ID NO: 617366 - DNA, 20 bp, Artificial
  CRISPR gRNA sequence
aacaagatttcaaattactt

SEQ ID NO: 617367 - DNA, 20 bp, Artificial
  CRISPR gRNA sequence
atttcaaattacttttgagt

SEQ ID NO: 617368 - DNA, 20 bp, Artificial
  CRISPR gRNA sequence
ctttcaactttgctacagaa

SEQ ID NO: 617369 - DNA, 20 bp, Artificial
  CRISPR gRNA sequence
tgctacagaaatggatataa

SEQ ID NO: 617370 - DNA, 20 bp, Artificial
  CRISPR gRNA sequence
tatttcattttttaactgtg

SEQ ID NO: 617371 - DNA, 20 bp, Artificial
  CRISPR gRNA sequence
ccagctcccaaatgccacct

SEQ ID NO: 617372 - DNA, 20 bp, Artificial
  CRISPR gRNA sequence
aggctcatgttttataatac

SEQ ID NO: 617373 - DNA, 20 bp, Artificial
  CRISPR gRNA sequence
tttataatactagaatgaac

SEQ ID NO: 617374 - DNA, 20 bp, Artificial
  CRISPR gRNA sequence
ttggtgaggcatgctgtcca

SEQ ID NO: 617375 - DNA, 20 bp, Artificial
  CRISPR gRNA sequence
ggtgaggtcaattgccatat

SEQ ID NO: 617376 - DNA, 20 bp, Artificial
  CRISPR gRNA sequence
ccatattggagtgctccctt

SEQ ID NO: 617377 - DNA, 20 bp, Artificial
  CRISPR gRNA sequence
tatcatttagaaatatacag

SEQ ID NO: 617378 - DNA, 20 bp, Artificial
  CRISPR gRNA sequence
taatttaattgttaagcaca

SEQ ID NO: 617379 - DNA, 20 bp, Artificial
  CRISPR gRNA sequence
aaaatgctggctatcagaga

SEQ ID NO: 617380 - DNA, 20 bp, Artificial
  CRISPR gRNA sequence
aattgtgaacagagagaaaa

SEQ ID NO: 617381 - DNA, 20 bp, Artificial
  CRISPR gRNA sequence
aacagagagaaaaaagagta

SEQ ID NO: 617382 - DNA, 20 bp, Artificial
  CRISPR gRNA sequence
tcaataaagtttcataatcc

SEQ ID NO: 617383 - DNA, 20 bp, Artificial
  CRISPR gRNA sequence
gatctgattcctgctggaga

SEQ ID NO: 617384 - DNA, 20 bp, Artificial
  CRISPR gRNA sequence
gagatgggctagagcaaaaa

SEQ ID NO: 617385 - DNA, 20 bp, Artificial
  CRISPR gRNA sequence
actctcttaatcaaaattta

SEQ ID NO: 617386 - DNA, 20 bp, Artificial
  CRISPR gRNA sequence
attgggtttaagaaaaaata

SEQ ID NO: 617387 - DNA, 20 bp, Artificial
  CRISPR gRNA sequence
tcaaatgtgtcagctttaac

SEQ ID NO: 617388 - DNA, 20 bp, Artificial
  CRISPR gRNA sequence
taaactttggttgtgctaga

SEQ ID NO: 617389 - DNA, 20 bp, Artificial
  CRISPR gRNA sequence
ttctgtggggaaaaaagttt

SEQ ID NO: 617390 - DNA, 20 bp, Artificial
  CRISPR gRNA sequence
gtatatttagccctggctcc

SEQ ID NO: 617391 - DNA, 20 bp, Artificial
  CRISPR gRNA sequence
aacttttatttctttcttta

SEQ ID NO: 617392 - DNA, 20 bp, Artificial
  CRISPR gRNA sequence
ttaaaagaggagcagtttct

SEQ ID NO: 617393 - DNA, 20 bp, Artificial
  CRISPR gRNA sequence
cctccaagccaagccccctg

SEQ ID NO: 617394 - DNA, 20 bp, Artificial
  CRISPR gRNA sequence
gaaggaaaagcactttacag

SEQ ID NO: 617395 - DNA, 20 bp, Artificial
  CRISPR gRNA sequence
acccctccccctcgtccctt

SEQ ID NO: 617396 - DNA, 20 bp, Artificial
  CRISPR gRNA sequence
tctagtaggaaaagtcactc

SEQ ID NO: 617397 - DNA, 20 bp, Artificial
  CRISPR gRNA sequence
acttgatccaccggttcctt

SEQ ID NO: 617398 - DNA, 20 bp, Artificial
  CRISPR gRNA sequence
tgaaagaaaagggggggggg

SEQ ID NO: 617399 - DNA, 20 bp, Artificial
  CRISPR gRNA sequence
cctgtttacatgtgtcatac

SEQ ID NO: 617400 - DNA, 20 bp, Artificial
  CRISPR gRNA sequence
ttttttttttttaattccaa

SEQ ID NO: 617401 - DNA, 20 bp, Artificial
  CRISPR gRNA sequence
ttttttaattccaacaggat

SEQ ID NO: 617402 - DNA, 20 bp, Artificial
  CRISPR gRNA sequence
gcctacccaatctttcttct

SEQ ID NO: 617403 - DNA, 20 bp, Artificial
  CRISPR gRNA sequence
cacatatttatatataatct

SEQ ID NO: 617404 - DNA, 20 bp, Artificial
  CRISPR gRNA sequence
tggtggtggaaactaaggca

SEQ ID NO: 617405 - DNA, 20 bp, Artificial
  CRISPR gRNA sequence
aaggcagtggatctgtagct

SEQ ID NO: 617406 - DNA, 20 bp, Artificial
  CRISPR gRNA sequence
cctccatcttcagcgaggag

SEQ ID NO: 617407 - DNA, 20 bp, Artificial
  CRISPR gRNA sequence
gggggccaggtaacccgctt

SEQ ID NO: 617408 - DNA, 20 bp, Artificial
  CRISPR gRNA sequence
cgtgaagttttctttcaaac

SEQ ID NO: 617409 - DNA, 20 bp, Artificial
  CRISPR gRNA sequence
ggcgatcttggcgccctgcg

SEQ ID NO: 617410 - DNA, 20 bp, Artificial
  CRISPR gRNA sequence
gtccgggagccgcgtcccgg

SEQ ID NO: 617411 - DNA, 20 bp, Artificial
  CRISPR gRNA sequence
gccgcgtcccggccgagtcg

SEQ ID NO: 617412 - DNA, 20 bp, Artificial
  CRISPR gRNA sequence
gcattgaccgggacctgaag

SEQ ID NO: 617413 - DNA, 20 bp, Artificial
  CRISPR gRNA sequence
gggacctgaagcgggataag

SEQ ID NO: 617414 - DNA, 20 bp, Artificial
  CRISPR gRNA sequence
gcgggataagaggggtcctg

SEQ ID NO: 617415 - DNA, 20 bp, Artificial
  CRISPR gRNA sequence
cgtcttccaaagtcaaagga

SEQ ID NO: 617416 - DNA, 20 bp, Artificial
  CRISPR gRNA sequence
ttccaaagtcaaaggaacgg

SEQ ID NO: 617417 - DNA, 20 bp, Artificial
  CRISPR gRNA sequence
tgaccacatttgcgaaaaga

SEQ ID NO: 617418 - DNA, 20 bp, Artificial
  CRISPR gRNA sequence
aaaatagtgaactgtgtagt

SEQ ID NO: 617419 - DNA, 20 bp, Artificial
  CRISPR gRNA sequence
gtgaagaaaatcaatgctag

SEQ ID NO: 617420 - DNA, 20 bp, Artificial
  CRISPR gRNA sequence
accgtactcttactcctttg

SEQ ID NO: 617421 - DNA, 20 bp, Artificial
  CRISPR gRNA sequence
gcaccactctgtaggtaatt

SEQ ID NO: 617422 - DNA, 20 bp, Artificial
  CRISPR gRNA sequence
tttacattttgatataggga

SEQ ID NO: 617423 - DNA, 20 bp, Artificial
  CRISPR gRNA sequence
acatcgacacaaacgaagta

SEQ ID NO: 617424 - DNA, 20 bp, Artificial
  CRISPR gRNA sequence
gtgatactgtagcttttata

SEQ ID NO: 617425 - DNA, 20 bp, Artificial
  CRISPR gRNA sequence
taagaaaaattgcagttcct

SEQ ID NO: 617426 - DNA, 20 bp, Artificial
  CRISPR gRNA sequence
aaagtcgtatttgggaaagt

SEQ ID NO: 617427 - DNA, 20 bp, Artificial
  CRISPR gRNA sequence
atgtaaatgcacaatatgta

SEQ ID NO: 617428 - DNA, 20 bp, Artificial
  CRISPR gRNA sequence
aatgtaattatttggtagaa

SEQ ID NO: 617429 - DNA, 20 bp, Artificial
  CRISPR gRNA sequence
ccttgaagctggtccttttc

SEQ ID NO: 617430 - DNA, 20 bp, Artificial
  CRISPR gRNA sequence
ttctgtcaccctgcctcccc

SEQ ID NO: 617431 - DNA, 20 bp, Artificial
  CRISPR gRNA sequence
gtcaccctgcctccccctga

SEQ ID NO: 617432 - DNA, 20 bp, Artificial
  CRISPR gRNA sequence
cctgaatggatcccagattt

SEQ ID NO: 617433 - DNA, 20 bp, Artificial
  CRISPR gRNA sequence
aagatctcatgaccacctgg

SEQ ID NO: 617434 - DNA, 20 bp, Artificial
  CRISPR gRNA sequence
tatgttttcataccaagatt

SEQ ID NO: 617435 - DNA, 20 bp, Artificial
  CRISPR gRNA sequence
ggggttttatttcatgcctg

SEQ ID NO: 617436 - DNA, 20 bp, Artificial
  CRISPR gRNA sequence
aaactgtaattcactttgtt

SEQ ID NO: 617437 - DNA, 20 bp, Artificial
  CRISPR gRNA sequence
tcactttgttcagaatttct

SEQ ID NO: 617438 - DNA, 20 bp, Artificial
  CRISPR gRNA sequence
tggttttgtttttgttgaga

SEQ ID NO: 617439 - DNA, 20 bp, Artificial
  CRISPR gRNA sequence
tctcactctgtcacccaggc

SEQ ID NO: 617440 - DNA, 20 bp, Artificial
  CRISPR gRNA sequence
ctcactacaatctctgcttc

SEQ ID NO: 617441 - DNA, 20 bp, Artificial
  CRISPR gRNA sequence
gattctcctgcctcagcctt

SEQ ID NO: 617442 - DNA, 20 bp, Artificial
  CRISPR gRNA sequence
gcctcagccttctgagtagc

SEQ ID NO: 617443 - DNA, 20 bp, Artificial
  CRISPR gRNA sequence
tactcagaaggctgaggcag

SEQ ID NO: 617444 - DNA, 20 bp, Artificial
  CRISPR gRNA sequence
cggcgccactgcactccagc

SEQ ID NO: 617445 - DNA, 20 bp, Artificial
  CRISPR gRNA sequence
ctgcactccagcctgggtga

SEQ ID NO: 617446 - DNA, 20 bp, Artificial
  CRISPR gRNA sequence
ccagagaaattctgaacaaa

SEQ ID NO: 617447 - DNA, 20 bp, Artificial
  CRISPR gRNA sequence
aagtgaattacagtttatgc

SEQ ID NO: 617448 - DNA, 20 bp, Artificial
  CRISPR gRNA sequence
ttatgcaagggttctttccc

SEQ ID NO: 617449 - DNA, 20 bp, Artificial
  CRISPR gRNA sequence
gcaagggttctttcccatga

SEQ ID NO: 617450 - DNA, 20 bp, Artificial
  CRISPR gRNA sequence
tcccatgagtggattgcatt

SEQ ID NO: 617451 - DNA, 20 bp, Artificial
  CRISPR gRNA sequence
aaaacataatcttgatttct

SEQ ID NO: 617452 - DNA, 20 bp, Artificial
  CRISPR gRNA sequence
cataatcttgatttctctgg

SEQ ID NO: 617453 - DNA, 20 bp, Artificial
  CRISPR gRNA sequence
ccataacctgcaaataagaa

SEQ ID NO: 617454 - DNA, 20 bp, Artificial
  CRISPR gRNA sequence
ctgcaaataagaaaggaatg

SEQ ID NO: 617455 - DNA, 20 bp, Artificial
  CRISPR gRNA sequence
atctttgttattctaaaatc

SEQ ID NO: 617456 - DNA, 20 bp, Artificial
  CRISPR gRNA sequence
gggatccattcagggggagg

SEQ ID NO: 617457 - DNA, 20 bp, Artificial
  CRISPR gRNA sequence
ttcagggggaggcagggtga

SEQ ID NO: 617458 - DNA, 20 bp, Artificial
  CRISPR gRNA sequence
tacatcaacttggtaactgt

SEQ ID NO: 617459 - DNA, 20 bp, Artificial
  CRISPR gRNA sequence
tgtatctttaagatttcaca

SEQ ID NO: 617460 - DNA, 20 bp, Artificial
  CRISPR gRNA sequence
tatctttatttcatattttc

SEQ ID NO: 617461 - DNA, 20 bp, Artificial
  CRISPR gRNA sequence
ctaaaatatttgctctctgt

SEQ ID NO: 617462 - DNA, 20 bp, Artificial
  CRISPR gRNA sequence
ttgctctctgttgggatgat

SEQ ID NO: 617463 - DNA, 20 bp, Artificial
  CRISPR gRNA sequence
attacttcgtttgtgtcgat

SEQ ID NO: 617464 - DNA, 20 bp, Artificial
  CRISPR gRNA sequence
acactatccaaaattaccta

SEQ ID NO: 617465 - DNA, 20 bp, Artificial
  CRISPR gRNA sequence
aaaacctcaacaactatttc

SEQ ID NO: 617466 - DNA, 20 bp, Artificial
  CRISPR gRNA sequence
ctatttctgggattcttcaa

SEQ ID NO: 617467 - DNA, 20 bp, Artificial
  CRISPR gRNA sequence
ctgggattcttcaaaggagt

SEQ ID NO: 617468 - DNA, 20 bp, Artificial
  CRISPR gRNA sequence
taaatgctactatttgtaga

SEQ ID NO: 617469 - DNA, 20 bp, Artificial
  CRISPR gRNA sequence
atagtgataggtaacacttc

SEQ ID NO: 617470 - DNA, 20 bp, Artificial
  CRISPR gRNA sequence
agttgagcttcatctcagac

SEQ ID NO: 617471 - DNA, 20 bp, Artificial
  CRISPR gRNA sequence
cgctttccgaaatggggccg

SEQ ID NO: 617472 - DNA, 20 bp, Artificial
  CRISPR gRNA sequence
atgacacggggaggggagat

SEQ ID NO: 617473 - DNA, 20 bp, Artificial
  CRISPR gRNA sequence
tcgccgtggcacactcggaa

SEQ ID NO: 617474 - DNA, 20 bp, Artificial
  CRISPR gRNA sequence
tacctggcccccgtcggggg

SEQ ID NO: 617475 - DNA, 20 bp, Artificial
  CRISPR gRNA sequence
ggggcgacgcggccgggcgc

SEQ ID NO: 617476 - DNA, 20 bp, Artificial
  CRISPR gRNA sequence
gggcgcgcgggtgggcgcga

SEQ ID NO: 617477 - DNA, 20 bp, Artificial
  CRISPR gRNA sequence
ggagatgtgctcgggctcca

SEQ ID NO: 617478 - DNA, 20 bp, Artificial
  CRISPR gRNA sequence
gctccaccggatcggtttct

SEQ ID NO: 617479 - DNA, 20 bp, Artificial
  CRISPR gRNA sequence
gaagatggaggaagtaaaaa

SEQ ID NO: 617480 - DNA, 20 bp, Artificial
  CRISPR gRNA sequence
ttaacagtaaacacaaacaa

SEQ ID NO: 617481 - DNA, 20 bp, Artificial
  CRISPR gRNA sequence
aaacacaaacaaaagggtga

SEQ ID NO: 617482 - DNA, 20 bp, Artificial
  CRISPR gRNA sequence
tgtgtatgatttgcaaaggg

SEQ ID NO: 617483 - DNA, 20 bp, Artificial
  CRISPR gRNA sequence
tataggtatttttctctggg

SEQ ID NO: 617484 - DNA, 20 bp, Artificial
  CRISPR gRNA sequence
ggtatttttctctgggaggg

SEQ ID NO: 617485 - DNA, 20 bp, Artificial
  CRISPR gRNA sequence
ggatggattgtggttctgat

SEQ ID NO: 617486 - DNA, 20 bp, Artificial
  CRISPR gRNA sequence
atttttgtaaaggacgctca

SEQ ID NO: 617487 - DNA, 20 bp, Artificial
  CRISPR gRNA sequence
tgtaaaggacgctcagggaa

SEQ ID NO: 617488 - DNA, 20 bp, Artificial
  CRISPR gRNA sequence
ccctccttgtaatctgtttc

SEQ ID NO: 617489 - DNA, 20 bp, Artificial
  CRISPR gRNA sequence
ttctcatctctatagctgtc

SEQ ID NO: 617490 - DNA, 20 bp, Artificial
  CRISPR gRNA sequence
ttgttttgctttgttttaac

SEQ ID NO: 617491 - DNA, 20 bp, Artificial
  CRISPR gRNA sequence
ttgaattccaagaagaaaga

SEQ ID NO: 617492 - DNA, 20 bp, Artificial
  CRISPR gRNA sequence
agaagaaagattgggtaggc

SEQ ID NO: 617493 - DNA, 20 bp, Artificial
  CRISPR gRNA sequence
aggtaatatccagatcctgt

SEQ ID NO: 617494 - DNA, 20 bp, Artificial
  CRISPR gRNA sequence
tctagtatgggcgaaagaga

SEQ ID NO: 617495 - DNA, 20 bp, Artificial
  CRISPR gRNA sequence
aacagtcctgtgaagttggc

SEQ ID NO: 617496 - DNA, 20 bp, Artificial
  CRISPR gRNA sequence
aagttggcctgggttcctag

SEQ ID NO: 617497 - DNA, 20 bp, Artificial
  CRISPR gRNA sequence
ggtcgattcttaaggaaccg

SEQ ID NO: 617498 - DNA, 20 bp, Artificial
  CRISPR gRNA sequence
gaaagtacgtggtgccattc

SEQ ID NO: 617499 - DNA, 20 bp, Artificial
  CRISPR gRNA sequence
atccctaagggacgaggggg

SEQ ID NO: 617500 - DNA, 20 bp, Artificial
  CRISPR gRNA sequence
aggaggaggaggaggaggag

SEQ ID NO: 617501 - DNA, 20 bp, Artificial
  CRISPR gRNA sequence
tttatcagccgatctgtttg

SEQ ID NO: 617502 - DNA, 20 bp, Artificial
  CRISPR gRNA sequence
ctgtttgctggatttgggct

SEQ ID NO: 617503 - DNA, 20 bp, Artificial
  CRISPR gRNA sequence
acattgtcacctcctctttg

SEQ ID NO: 617504 - DNA, 20 bp, Artificial
  CRISPR gRNA sequence
cgacagagctggaaatggtg

SEQ ID NO: 617505 - DNA, 20 bp, Artificial
  CRISPR gRNA sequence
ttttccttctttccttctct

SEQ ID NO: 617506 - DNA, 20 bp, Artificial
  CRISPR gRNA sequence
ctgctcctcttttaaacttt

SEQ ID NO: 617507 - DNA, 20 bp, Artificial
  CRISPR gRNA sequence
cttatgtaatcataatttaa

SEQ ID NO: 617508 - DNA, 20 bp, Artificial
  CRISPR gRNA sequence
atttaagtgctatgtagtga

SEQ ID NO: 617509 - DNA, 20 bp, Artificial
  CRISPR gRNA sequence
tgctatgtagtgactgagtt

SEQ ID NO: 617510 - DNA, 20 bp, Artificial
  CRISPR gRNA sequence
taaaagtttttttttggggg

SEQ ID NO: 617511 - DNA, 20 bp, Artificial
  CRISPR gRNA sequence
tttttttggggggggggtaa

SEQ ID NO: 617512 - DNA, 20 bp, Artificial
  CRISPR gRNA sequence
caatacagaaatggctcatt

SEQ ID NO: 617513 - DNA, 20 bp, Artificial
  CRISPR gRNA sequence
aatttagctgctggtgcagt

SEQ ID NO: 617514 - DNA, 20 bp, Artificial
  CRISPR gRNA sequence
ttcttaaacttttttcccca

SEQ ID NO: 617515 - DNA, 20 bp, Artificial
  CRISPR gRNA sequence
attatcgatcttttcattat

SEQ ID NO: 617516 - DNA, 20 bp, Artificial
  CRISPR gRNA sequence
cattatgtgaatcaaagcta

SEQ ID NO: 617517 - DNA, 20 bp, Artificial
  CRISPR gRNA sequence
tacagtttacttttgtttct

SEQ ID NO: 617518 - DNA, 20 bp, Artificial
  CRISPR gRNA sequence
gttgtgtggcgtttgtgcat

SEQ ID NO: 617519 - DNA, 20 bp, Artificial
  CRISPR gRNA sequence
acaggtgcttacacagaact

SEQ ID NO: 617520 - DNA, 20 bp, Artificial
  CRISPR gRNA sequence
taaaatgtcaatacaagtca

SEQ ID NO: 617521 - DNA, 20 bp, Artificial
  CRISPR gRNA sequence
tgaaccaacttgcaacaatt

SEQ ID NO: 617522 - DNA, 20 bp, Artificial
  CRISPR gRNA sequence
cagtgtgattgtgggaagta

SEQ ID NO: 617523 - DNA, 20 bp, Artificial
  CRISPR gRNA sequence
acccaataaattttgattaa

SEQ ID NO: 617524 - DNA, 20 bp, Artificial
  CRISPR gRNA sequence
tttcctatcctatctccagc

SEQ ID NO: 617525 - DNA, 20 bp, Artificial
  CRISPR gRNA sequence
ggaatcagatcatttgcaga

SEQ ID NO: 617526 - DNA, 20 bp, Artificial
  CRISPR gRNA sequence
cttggagcttcaaataagtt

SEQ ID NO: 617527 - DNA, 20 bp, Artificial
  CRISPR gRNA sequence
atttaatggcagatactgaa

SEQ ID NO: 617528 - DNA, 20 bp, Artificial
  CRISPR gRNA sequence
ctgaaaggaatcattgtatt

SEQ ID NO: 617529 - DNA, 20 bp, Artificial
  CRISPR gRNA sequence
tattacctgtgttttaattc

SEQ ID NO: 617530 - DNA, 20 bp, Artificial
  CRISPR gRNA sequence
ctggattatgaaactttatt

SEQ ID NO: 617531 - DNA, 20 bp, Artificial
  CRISPR gRNA sequence
ctctgttcacaatttcacct

SEQ ID NO: 617532 - DNA, 20 bp, Artificial
  CRISPR gRNA sequence
gttcacaatttcacctttga

SEQ ID NO: 617533 - DNA, 20 bp, Artificial
  CRISPR gRNA sequence
aatttactttgttgtaagtt

SEQ ID NO: 617534 - DNA, 20 bp, Artificial
  CRISPR gRNA sequence
ttcagacatattatgtgaaa

SEQ ID NO: 617535 - DNA, 20 bp, Artificial
  CRISPR gRNA sequence
ttttgttaattttttttatt

SEQ ID NO: 617536 - DNA, 20 bp, Artificial
  CRISPR gRNA sequence
taattacatcttatgtgaca

SEQ ID NO: 617537 - DNA, 20 bp, Artificial
  CRISPR gRNA sequence
actttaatttgttaggtctg

SEQ ID NO: 617538 - DNA, 20 bp, Artificial
  CRISPR gRNA sequence
ctgtatcaggtaagaaaggt

SEQ ID NO: 617539 - DNA, 20 bp, Artificial
  CRISPR gRNA sequence
ttgacttgccaggtttatga

SEQ ID NO: 617540 - DNA, 20 bp, Artificial
  CRISPR gRNA sequence
gactggattttttgttgttg

SEQ ID NO: 617541 - DNA, 20 bp, Artificial
  CRISPR gRNA sequence
ataaaatttggaaagatgtt

SEQ ID NO: 617542 - DNA, 20 bp, Artificial
  CRISPR gRNA sequence
tttggctactgtttttgata

SEQ ID NO: 617543 - DNA, 20 bp, Artificial
  CRISPR gRNA sequence
agaagacaaaatactttatt

SEQ ID NO: 617544 - DNA, 20 bp, Artificial
  CRISPR gRNA sequence
agatttaataactaagaaaa

SEQ ID NO: 617545 - DNA, 20 bp, Artificial
  CRISPR gRNA sequence
tgaaatttaagcaatttata

SEQ ID NO: 617546 - DNA, 20 bp, Artificial
  CRISPR gRNA sequence
gcaatttatatagaatacca

SEQ ID NO: 617547 - DNA, 20 bp, Artificial
  CRISPR gRNA sequence
ctattgacttgaaattatga

SEQ ID NO: 617548 - DNA, 20 bp, Artificial
  CRISPR gRNA sequence
acttgaaattatgattgagt

SEQ ID NO: 617549 - DNA, 20 bp, Artificial
  CRISPR gRNA sequence
aaaactagtaaagttagcag

SEQ ID NO: 617550 - DNA, 20 bp, Artificial
  CRISPR gRNA sequence
attatcatactaatctcata

SEQ ID NO: 617551 - DNA, 20 bp, Artificial
  CRISPR gRNA sequence
tatgactacaatttaggcaa

SEQ ID NO: 617552 - DNA, 20 bp, Artificial
  CRISPR gRNA sequence
ataactcacacaatttccta

SEQ ID NO: 617553 - DNA, 20 bp, Artificial
  CRISPR gRNA sequence
ctttagaaacattgcatgta

SEQ ID NO: 617554 - DNA, 20 bp, Artificial
  CRISPR gRNA sequence
aacattgcatgtatagggta

SEQ ID NO: 617555 - DNA, 20 bp, Artificial
  CRISPR gRNA sequence
gttaattggctgctttattt

SEQ ID NO: 617556 - DNA, 20 bp, Artificial
  CRISPR gRNA sequence
atctttttaaataaacagtg

SEQ ID NO: 617557 - DNA, 20 bp, Artificial
  CRISPR gRNA sequence
cagtaaacttatgtttggta

SEQ ID NO: 617558 - DNA, 20 bp, Artificial
  CRISPR gRNA sequence
tgttttcaggttcttttcca

SEQ ID NO: 617559 - DNA, 20 bp, Artificial
  CRISPR gRNA sequence
ttcctctctgttagatctag

SEQ ID NO: 617560 - DNA, 20 bp, Artificial
  CRISPR gRNA sequence
attaattagaacaagagacc

SEQ ID NO: 617561 - DNA, 20 bp, Artificial
  CRISPR gRNA sequence
tctgatgtttttctgtgact

SEQ ID NO: 617562 - DNA, 20 bp, Artificial
  CRISPR gRNA sequence
atcttcaaatatacttcctg

SEQ ID NO: 617563 - DNA, 20 bp, Artificial
  CRISPR gRNA sequence
agggtgcctgcttccaaaaa

SEQ ID NO: 617564 - DNA, 20 bp, Artificial
  CRISPR gRNA sequence
gtttctagtagcaggaagga

SEQ ID NO: 617565 - DNA, 20 bp, Artificial
  CRISPR gRNA sequence
agtagcaggaaggagaggat

SEQ ID NO: 617566 - DNA, 20 bp, Artificial
  CRISPR gRNA sequence
ttggtaactcttctaagatg

SEQ ID NO: 617567 - DNA, 20 bp, Artificial
  CRISPR gRNA sequence
ctatcattatttgacagtgc

SEQ ID NO: 617568 - DNA, 20 bp, Artificial
  CRISPR gRNA sequence
aatgactacttcctatggtt

SEQ ID NO: 617569 - DNA, 20 bp, Artificial
  CRISPR gRNA sequence
actacttcctatggttttga

SEQ ID NO: 617570 - DNA, 20 bp, Artificial
  CRISPR gRNA sequence
gaactttaaactttttcttc

SEQ ID NO: 617571 - DNA, 20 bp, Artificial
  CRISPR gRNA sequence
taaactttttcttctggaat

SEQ ID NO: 617572 - DNA, 20 bp, Artificial
  CRISPR gRNA sequence
tgagatcattagtgtacata

SEQ ID NO: 617573 - DNA, 20 bp, Artificial
  CRISPR gRNA sequence
tgctgacaatcttcggtgtc

SEQ ID NO: 617574 - DNA, 20 bp, Artificial
  CRISPR gRNA sequence
tgttaagtgatttttaaaaa

SEQ ID NO: 617575 - DNA, 20 bp, Artificial
  CRISPR gRNA sequence
aaaaatagaatctgggactt

SEQ ID NO: 617576 - DNA, 20 bp, Artificial
  CRISPR gRNA sequence
ctttgcaggtagttacttaa

SEQ ID NO: 617577 - DNA, 20 bp, Artificial
  CRISPR gRNA sequence
tattactttaaagctgttaa

SEQ ID NO: 617578 - DNA, 20 bp, Artificial
  CRISPR gRNA sequence
tgatggccaggtggcatgta

SEQ ID NO: 617579 - DNA, 20 bp, Artificial
  CRISPR gRNA sequence
tctgaccaataatcaggtca

SEQ ID NO: 617580 - DNA, 20 bp, Artificial
  CRISPR gRNA sequence
ggaatctagtttattctttt

SEQ ID NO: 617581 - DNA, 20 bp, Artificial
  CRISPR gRNA sequence
tagcagaaagatgaagttat

SEQ ID NO: 617582 - DNA, 20 bp, Artificial
  CRISPR gRNA sequence
taaaattgtgatattacctt

SEQ ID NO: 617583 - DNA, 20 bp, Artificial
  CRISPR gRNA sequence
tctctacaatgtcaccttct

SEQ ID NO: 617584 - DNA, 20 bp, Artificial
  CRISPR gRNA sequence
gacaaatatctcagaaatag

SEQ ID NO: 617585 - DNA, 20 bp, Artificial
  CRISPR gRNA sequence
agaaatagaagagttattat

SEQ ID NO: 617586 - DNA, 20 bp, Artificial
  CRISPR gRNA sequence
tagaagagttattatgaggg

SEQ ID NO: 617587 - DNA, 20 bp, Artificial
  CRISPR gRNA sequence
atatcagattatcttttcag

SEQ ID NO: 617588 - DNA, 20 bp, Artificial
  CRISPR gRNA sequence
ttatgggacttaccagcttt

SEQ ID NO: 617589 - DNA, 20 bp, Artificial
  CRISPR gRNA sequence
agtttggcagtcacccttgc

SEQ ID NO: 617590 - DNA, 20 bp, Artificial
  CRISPR gRNA sequence
catttagttcttgtttatta

SEQ ID NO: 617591 - DNA, 20 bp, Artificial
  CRISPR gRNA sequence
tttttagtctgcttagtact

SEQ ID NO: 617592 - DNA, 20 bp, Artificial
  CRISPR gRNA sequence
accattgattgtgttctatt

SEQ ID NO: 617593 - DNA, 20 bp, Artificial
  CRISPR gRNA sequence
gagtcttcctgtaagccata

SEQ ID NO: 617594 - DNA, 20 bp, Artificial
  CRISPR gRNA sequence
gccataatgaattttcatct

SEQ ID NO: 617595 - DNA, 20 bp, Artificial
  CRISPR gRNA sequence
ttttgacatgttgatatatt

SEQ ID NO: 617596 - DNA, 20 bp, Artificial
  CRISPR gRNA sequence
atatttggaaatatcaatag

SEQ ID NO: 617597 - DNA, 20 bp, Artificial
  CRISPR gRNA sequence
gttccagtcctaaaatgagg

SEQ ID NO: 617598 - DNA, 20 bp, Artificial
  CRISPR gRNA sequence
cctgttggtattttcctttt

SEQ ID NO: 617599 - DNA, 20 bp, Artificial
  CRISPR gRNA sequence
cctctgttttgatataggta

SEQ ID NO: 617600 - DNA, 20 bp, Artificial
  CRISPR gRNA sequence
gatataggtaaggaatattt

SEQ ID NO: 617601 - DNA, 20 bp, Artificial
  CRISPR gRNA sequence
aggtagaggggcatccttta

SEQ ID NO: 617602 - DNA, 20 bp, Artificial
  CRISPR gRNA sequence
aggctcagaagcagtagact

SEQ ID NO: 617603 - DNA, 20 bp, Artificial
  CRISPR gRNA sequence
ggctttgcaattatgctggc

SEQ ID NO: 617604 - DNA, 20 bp, Artificial
  CRISPR gRNA sequence
gcaattatgctggcctgggt

SEQ ID NO: 617605 - DNA, 20 bp, Artificial
  CRISPR gRNA sequence
agctccagtttccttatccg

SEQ ID NO: 617606 - DNA, 20 bp, Artificial
  CRISPR gRNA sequence
agtttccttatccgtagaat

SEQ ID NO: 617607 - DNA, 20 bp, Artificial
  CRISPR gRNA sequence
gacctatgacttgtaagaaa

SEQ ID NO: 617608 - DNA, 20 bp, Artificial
  CRISPR gRNA sequence
aatccaagtctatttgaaat

SEQ ID NO: 617609 - DNA, 20 bp, Artificial
  CRISPR gRNA sequence
caggtccagggaagaaagat

SEQ ID NO: 617610 - DNA, 20 bp, Artificial
  CRISPR gRNA sequence
gatagggatttctgataatt

SEQ ID NO: 617611 - DNA, 20 bp, Artificial
  CRISPR gRNA sequence
gattttggttaagaaagaaa

SEQ ID NO: 617612 - DNA, 20 bp, Artificial
  CRISPR gRNA sequence
aatagagtttgtctatatgt

SEQ ID NO: 617613 - DNA, 20 bp, Artificial
  CRISPR gRNA sequence
tatatgtcagaattggggag

SEQ ID NO: 617614 - DNA, 20 bp, Artificial
  CRISPR gRNA sequence
gggggtggcgctcaacattc

SEQ ID NO: 617615 - DNA, 20 bp, Artificial
  CRISPR gRNA sequence
aaagaaaaaaattcccttaa

SEQ ID NO: 617616 - DNA, 20 bp, Artificial
  CRISPR gRNA sequence
tagagtaacctattcctaca

SEQ ID NO: 617617 - DNA, 20 bp, Artificial
  CRISPR gRNA sequence
ctacagagaatcaattctta

SEQ ID NO: 617618 - DNA, 20 bp, Artificial
  CRISPR gRNA sequence
aattgttgattgtgcacttc

SEQ ID NO: 617619 - DNA, 20 bp, Artificial
  CRISPR gRNA sequence
atcaattcaataaatatttg

SEQ ID NO: 617620 - DNA, 20 bp, Artificial
  CRISPR gRNA sequence
tatgtgccaggtattgtaag

SEQ ID NO: 617621 - DNA, 20 bp, Artificial
  CRISPR gRNA sequence
attgtaaggtgaatccaaag

SEQ ID NO: 617622 - DNA, 20 bp, Artificial
  CRISPR gRNA sequence
ggtgaatccaaaggtgaata

SEQ ID NO: 617623 - DNA, 20 bp, Artificial
  CRISPR gRNA sequence
ccaaaggtgaataaagagta

SEQ ID NO: 617624 - DNA, 20 bp, Artificial
  CRISPR gRNA sequence
ttagtgtcttgattattacg

SEQ ID NO: 617625 - DNA, 20 bp, Artificial
  CRISPR gRNA sequence
cttgagccgagacttattaa

SEQ ID NO: 617626 - DNA, 20 bp, Artificial
  CRISPR gRNA sequence
gccgagacttattaaatgaa

SEQ ID NO: 617627 - DNA, 20 bp, Artificial
  CRISPR gRNA sequence
ttattaaatgaataggattt

SEQ ID NO: 617628 - DNA, 20 bp, Artificial
  CRISPR gRNA sequence
gtatttctagactataaagt

SEQ ID NO: 617629 - DNA, 20 bp, Artificial
  CRISPR gRNA sequence
agactataaagttggagtct

SEQ ID NO: 617630 - DNA, 20 bp, Artificial
  CRISPR gRNA sequence
gagtctaggaattcgaggcc

SEQ ID NO: 617631 - DNA, 20 bp, Artificial
  CRISPR gRNA sequence
cgaggccaggaatgactttg

SEQ ID NO: 617632 - DNA, 20 bp, Artificial
  CRISPR gRNA sequence
ctttggagagttaatcaagg

SEQ ID NO: 617633 - DNA, 20 bp, Artificial
  CRISPR gRNA sequence
acttcagtcttttgactgac

SEQ ID NO: 617634 - DNA, 20 bp, Artificial
  CRISPR gRNA sequence
acaatgtggggaaaaagatt

SEQ ID NO: 617635 - DNA, 20 bp, Artificial
  CRISPR gRNA sequence
ttaacaggctgtttcaatga

SEQ ID NO: 617636 - DNA, 20 bp, Artificial
  CRISPR gRNA sequence
gtcatgcaagctagcagtag

SEQ ID NO: 617637 - DNA, 20 bp, Artificial
  CRISPR gRNA sequence
gtgggataaaaaggaaggag

SEQ ID NO: 617638 - DNA, 20 bp, Artificial
  CRISPR gRNA sequence
catcttaaagtagacagtac

SEQ ID NO: 617639 - DNA, 20 bp, Artificial
  CRISPR gRNA sequence
agtagacagtacttgggtag

SEQ ID NO: 617640 - DNA, 20 bp, Artificial
  CRISPR gRNA sequence
tagtagaattaaggagacaa

SEQ ID NO: 617641 - DNA, 20 bp, Artificial
  CRISPR gRNA sequence
attaaggagacaatagagtc

SEQ ID NO: 617642 - DNA, 20 bp, Artificial
  CRISPR gRNA sequence
ggatggcaacctttaaatta

SEQ ID NO: 617643 - DNA, 20 bp, Artificial
  CRISPR gRNA sequence
attctggtttgaagcaccca

SEQ ID NO: 617644 - DNA, 20 bp, Artificial
  CRISPR gRNA sequence
cacagggtacaatttgggag

SEQ ID NO: 617645 - DNA, 20 bp, Artificial
  CRISPR gRNA sequence
gagggatagcaattaggcac

SEQ ID NO: 617646 - DNA, 20 bp, Artificial
  CRISPR gRNA sequence
acatggatatagactgaagt

SEQ ID NO: 617647 - DNA, 20 bp, Artificial
  CRISPR gRNA sequence
cattaaatcaaaattctata

SEQ ID NO: 617648 - DNA, 20 bp, Artificial
  CRISPR gRNA sequence
ttaataaactctttgcttaa

SEQ ID NO: 617649 - DNA, 20 bp, Artificial
  CRISPR gRNA sequence
ctttatactggtctcagaag

SEQ ID NO: 617650 - DNA, 20 bp, Artificial
  CRISPR gRNA sequence
ttctgccacattaatagcta

SEQ ID NO: 617651 - DNA, 20 bp, Artificial
  CRISPR gRNA sequence
tattttaaaatgattttgta

SEQ ID NO: 617652 - DNA, 20 bp, Artificial
  CRISPR gRNA sequence
aaatataatatcatacccct

SEQ ID NO: 617653 - DNA, 20 bp, Artificial
  CRISPR gRNA sequence
ttattctgaaatatttatta

SEQ ID NO: 617654 - DNA, 20 bp, Artificial
  CRISPR gRNA sequence
gctgactacccaagacacca

SEQ ID NO: 617655 - DNA, 20 bp, Artificial
  CRISPR gRNA sequence
aagacaccatagaattccaa

SEQ ID NO: 617656 - DNA, 20 bp, Artificial
  CRISPR gRNA sequence
tggggctcaaaaaataggtt

SEQ ID NO: 617657 - DNA, 20 bp, Artificial
  CRISPR gRNA sequence
gtttggggtgttttctagag

SEQ ID NO: 617658 - DNA, 20 bp, Artificial
  CRISPR gRNA sequence
tagagaaggatggtatcttc

SEQ ID NO: 617659 - DNA, 20 bp, Artificial
  CRISPR gRNA sequence
tggtatcttcaagggtccaa

SEQ ID NO: 617660 - DNA, 20 bp, Artificial
  CRISPR gRNA sequence
cttattgcatttagaagtaa

SEQ ID NO: 617661 - DNA, 20 bp, Artificial
  CRISPR gRNA sequence
gcttctcaccttttacctcc

SEQ ID NO: 617662 - DNA, 20 bp, Artificial
  CRISPR gRNA sequence
tttcaaatgtgtgtaaattt

SEQ ID NO: 617663 - DNA, 20 bp, Artificial
  CRISPR gRNA sequence
gccacttagataggttctca

SEQ ID NO: 617664 - DNA, 20 bp, Artificial
  CRISPR gRNA sequence
ccacaaaattatttataatg

SEQ ID NO: 617665 - DNA, 20 bp, Artificial
  CRISPR gRNA sequence
aactagatttgtggcacact

SEQ ID NO: 617666 - DNA, 20 bp, Artificial
  CRISPR gRNA sequence
agatttgtggcacacttaga

SEQ ID NO: 617667 - DNA, 20 bp, Artificial
  CRISPR gRNA sequence
acaaaactgatatttaaaat

SEQ ID NO: 617668 - DNA, 20 bp, Artificial
  CRISPR gRNA sequence
gcaaccaacaaacataggag

SEQ ID NO: 617669 - DNA, 20 bp, Artificial
  CRISPR gRNA sequence
gttcttgtgaactgacctat

SEQ ID NO: 617670 - DNA, 20 bp, Artificial
  CRISPR gRNA sequence
taaaggtcatttactgagca

SEQ ID NO: 617671 - DNA, 20 bp, Artificial
  CRISPR gRNA sequence
tcatttactgagcaaggaat

SEQ ID NO: 617672 - DNA, 20 bp, Artificial
  CRISPR gRNA sequence
gagcaaggaatctgaataaa

SEQ ID NO: 617673 - DNA, 20 bp, Artificial
  CRISPR gRNA sequence
aatagagatagcattgctat

SEQ ID NO: 617674 - DNA, 20 bp, Artificial
  CRISPR gRNA sequence
tccctctccttttaatggac

SEQ ID NO: 617675 - DNA, 20 bp, Artificial
  CRISPR gRNA sequence
atacatacaatcaggttacg

SEQ ID NO: 617676 - DNA, 20 bp, Artificial
  CRISPR gRNA sequence
acaatcttatagtgcccata

SEQ ID NO: 617677 - DNA, 20 bp, Artificial
  CRISPR gRNA sequence
gctgatgtggtcagcagttt

SEQ ID NO: 617678 - DNA, 20 bp, Artificial
  CRISPR gRNA sequence
taggaaagctgtcttaatta

SEQ ID NO: 617679 - DNA, 20 bp, Artificial
  CRISPR gRNA sequence
agctgtcttaattactgagt

SEQ ID NO: 617680 - DNA, 20 bp, Artificial
  CRISPR gRNA sequence
attaatcaggttttccagat

SEQ ID NO: 617681 - DNA, 20 bp, Artificial
  CRISPR gRNA sequence
aggagccctgtaaatatttg

SEQ ID NO: 617682 - DNA, 20 bp, Artificial
  CRISPR gRNA sequence
acttgtgattttctctgttt

SEQ ID NO: 617683 - DNA, 20 bp, Artificial
  CRISPR gRNA sequence
ttctatacaaccatgttcag

SEQ ID NO: 617684 - DNA, 20 bp, Artificial
  CRISPR gRNA sequence
ccatgttcagtggaatccac

SEQ ID NO: 617685 - DNA, 20 bp, Artificial
  CRISPR gRNA sequence
ttttagtagcatgtacaaga

SEQ ID NO: 617686 - DNA, 20 bp, Artificial
  CRISPR gRNA sequence
tatgcactccagatattttg

SEQ ID NO: 617687 - DNA, 20 bp, Artificial
  CRISPR gRNA sequence
cgttctaataaattaacatt

SEQ ID NO: 617688 - DNA, 20 bp, Artificial
  CRISPR gRNA sequence
ttgatcttattttgaagtgc

SEQ ID NO: 617689 - DNA, 20 bp, Artificial
  CRISPR gRNA sequence
ctacgttgctgtgttttcag

SEQ ID NO: 617690 - DNA, 20 bp, Artificial
  CRISPR gRNA sequence
ttttcagttgaattaacagt

SEQ ID NO: 617691 - DNA, 20 bp, Artificial
  CRISPR gRNA sequence
ttaacagtgagaatttctgg

SEQ ID NO: 617692 - DNA, 20 bp, Artificial
  CRISPR gRNA sequence
tttctatagtttttagggct

SEQ ID NO: 617693 - DNA, 20 bp, Artificial
  CRISPR gRNA sequence
tacgccttaaaaacactgac

SEQ ID NO: 617694 - DNA, 20 bp, Artificial
  CRISPR gRNA sequence
gattgtgtctggacataact

SEQ ID NO: 617695 - DNA, 20 bp, Artificial
  CRISPR gRNA sequence
aagaaatatgagatttttct

SEQ ID NO: 617696 - DNA, 20 bp, Artificial
  CRISPR gRNA sequence
tgtttttaagttctcgaagc

SEQ ID NO: 617697 - DNA, 20 bp, Artificial
  CRISPR gRNA sequence
atttacacactgccatctgt

SEQ ID NO: 617698 - DNA, 20 bp, Artificial
  CRISPR gRNA sequence
tgctgtttgcataaagtttt

SEQ ID NO: 617699 - DNA, 20 bp, Artificial
  CRISPR gRNA sequence
ataaagttttggggatgcat

SEQ ID NO: 617700 - DNA, 20 bp, Artificial
  CRISPR gRNA sequence
gttttagttggtgttacatt

SEQ ID NO: 617701 - DNA, 20 bp, Artificial
  CRISPR gRNA sequence
atatgtgcatgtgtatgcgt

SEQ ID NO: 617702 - DNA, 20 bp, Artificial
  CRISPR gRNA sequence
aaacttgatatagttgactt

SEQ ID NO: 617703 - DNA, 20 bp, Artificial
  CRISPR gRNA sequence
tagttgactttgggatatcg

SEQ ID NO: 617704 - DNA, 20 bp, Artificial
  CRISPR gRNA sequence
ttgggatatcggagggtaaa

SEQ ID NO: 617705 - DNA, 20 bp, Artificial
  CRISPR gRNA sequence
gtaatttaaagaaaagacca

SEQ ID NO: 617706 - DNA, 20 bp, Artificial
  CRISPR gRNA sequence
aaatgatatcttcagattta

SEQ ID NO: 617707 - DNA, 20 bp, Artificial
  CRISPR gRNA sequence
tcccgctctgtcacccaggc

SEQ ID NO: 617708 - DNA, 20 bp, Artificial
  CRISPR gRNA sequence
aattctcctgcctcagtctc

SEQ ID NO: 617709 - DNA, 20 bp, Artificial
  CRISPR gRNA sequence
gcctcagtctcccgagtagc

SEQ ID NO: 617710 - DNA, 20 bp, Artificial
  CRISPR gRNA sequence
tttttattttttagtgtaga

SEQ ID NO: 617711 - DNA, 20 bp, Artificial
  CRISPR gRNA sequence
tgcctcagcctcccaaagtg

SEQ ID NO: 617712 - DNA, 20 bp, Artificial
  CRISPR gRNA sequence
tcttttttttttttttgaaa

SEQ ID NO: 617713 - DNA, 20 bp, Artificial
  CRISPR gRNA sequence
tctcgctctgtagcccaggc

SEQ ID NO: 617714 - DNA, 20 bp, Artificial
  CRISPR gRNA sequence
ctcactgcaacctccgcctc

SEQ ID NO: 617715 - DNA, 20 bp, Artificial
  CRISPR gRNA sequence
aattctcctgcctcagcctc

SEQ ID NO: 617716 - DNA, 20 bp, Artificial
  CRISPR gRNA sequence
gcctcagcctcctgagtagc

SEQ ID NO: 617717 - DNA, 20 bp, Artificial
  CRISPR gRNA sequence
ttttgcatttttagtggaga

SEQ ID NO: 617718 - DNA, 20 bp, Artificial
  CRISPR gRNA sequence
ttccttttcctttcctgaga

SEQ ID NO: 617719 - DNA, 20 bp, Artificial
  CRISPR gRNA sequence
tcttgttctgttgttcaggc

SEQ ID NO: 617720 - DNA, 20 bp, Artificial
  CRISPR gRNA sequence
aatttttaacaatttttttt

SEQ ID NO: 617721 - DNA, 20 bp, Artificial
  CRISPR gRNA sequence
taacaatttttttttagagt

SEQ ID NO: 617722 - DNA, 20 bp, Artificial
  CRISPR gRNA sequence
gattctcccgcctcagcctc

SEQ ID NO: 617723 - DNA, 20 bp, Artificial
  CRISPR gRNA sequence
cgcctcagcctcctgagtag

SEQ ID NO: 617724 - DNA, 20 bp, Artificial
  CRISPR gRNA sequence
tccaaataatgttatatact

SEQ ID NO: 617725 - DNA, 20 bp, Artificial
  CRISPR gRNA sequence
tatatactctgaattgtttt

SEQ ID NO: 617726 - DNA, 20 bp, Artificial
  CRISPR gRNA sequence
catctgatggcaaaagaaat

SEQ ID NO: 617727 - DNA, 20 bp, Artificial
  CRISPR gRNA sequence
gatggcaaaagaaatctgag

SEQ ID NO: 617728 - DNA, 20 bp, Artificial
  CRISPR gRNA sequence
gcaaaagaaatctgagtaga

SEQ ID NO: 617729 - DNA, 20 bp, Artificial
  CRISPR gRNA sequence
ttcatcaatttaaaattccc

SEQ ID NO: 617730 - DNA, 20 bp, Artificial
  CRISPR gRNA sequence
aaagctggcaagaagaaaga

SEQ ID NO: 617731 - DNA, 20 bp, Artificial
  CRISPR gRNA sequence
ggacaagccacagactccac

SEQ ID NO: 617732 - DNA, 20 bp, Artificial
  CRISPR gRNA sequence
aaaaataaataaagagaaat

SEQ ID NO: 617733 - DNA, 20 bp, Artificial
  CRISPR gRNA sequence
agagaaatcagaatttataa

SEQ ID NO: 617734 - DNA, 20 bp, Artificial
  CRISPR gRNA sequence
agctgcctgcttaagtgatg

SEQ ID NO: 617735 - DNA, 20 bp, Artificial
  CRISPR gRNA sequence
gaggaatgtggcaataagat

SEQ ID NO: 617736 - DNA, 20 bp, Artificial
  CRISPR gRNA sequence
tggtttctggtagaagctaa

SEQ ID NO: 617737 - DNA, 20 bp, Artificial
  CRISPR gRNA sequence
cttcagatatttgaaagcca

SEQ ID NO: 617738 - DNA, 20 bp, Artificial
  CRISPR gRNA sequence
aaagccagggagtaggagat

SEQ ID NO: 617739 - DNA, 20 bp, Artificial
  CRISPR gRNA sequence
gggtagattggttaaaagaa

SEQ ID NO: 617740 - DNA, 20 bp, Artificial
  CRISPR gRNA sequence
gttaaaagaactgggtccta

SEQ ID NO: 617741 - DNA, 20 bp, Artificial
  CRISPR gRNA sequence
gaacaattagccaattaaag

SEQ ID NO: 617742 - DNA, 20 bp, Artificial
  CRISPR gRNA sequence
ggtcgtattcctaaattatc

SEQ ID NO: 617743 - DNA, 20 bp, Artificial
  CRISPR gRNA sequence
agtgggaaaggagattggaa

SEQ ID NO: 617744 - DNA, 20 bp, Artificial
  CRISPR gRNA sequence
gtgtctaagacacaggcact

SEQ ID NO: 617745 - DNA, 20 bp, Artificial
  CRISPR gRNA sequence
aataacaataataaaaagat

SEQ ID NO: 617746 - DNA, 20 bp, Artificial
  CRISPR gRNA sequence
aaacaaattttaagtctact

SEQ ID NO: 617747 - DNA, 20 bp, Artificial
  CRISPR gRNA sequence
aaatgcttttacatctagca

SEQ ID NO: 617748 - DNA, 20 bp, Artificial
  CRISPR gRNA sequence
aatatttatgcaaccagtgt

SEQ ID NO: 617749 - DNA, 20 bp, Artificial
  CRISPR gRNA sequence
cttagcattactggaaaata

SEQ ID NO: 617750 - DNA, 20 bp, Artificial
  CRISPR gRNA sequence
atttatttattttttcgaga

SEQ ID NO: 617751 - DNA, 20 bp, Artificial
  CRISPR gRNA sequence
tctatctttgtcgcccaggc

SEQ ID NO: 617752 - DNA, 20 bp, Artificial
  CRISPR gRNA sequence
ttttgtatttttagtagaga

SEQ ID NO: 617753 - DNA, 20 bp, Artificial
  CRISPR gRNA sequence
acctcagcctcccaaagtgc

SEQ ID NO: 617754 - DNA, 20 bp, Artificial
  CRISPR gRNA sequence
aaacatgtttttaaaaatta

SEQ ID NO: 617755 - DNA, 20 bp, Artificial
  CRISPR gRNA sequence
ctcagctttatttgtaaaaa

SEQ ID NO: 617756 - DNA, 20 bp, Artificial
  CRISPR gRNA sequence
gggatattgctctctgtcag

SEQ ID NO: 617757 - DNA, 20 bp, Artificial
  CRISPR gRNA sequence
ctggctcatggtaagttagc

SEQ ID NO: 617758 - DNA, 20 bp, Artificial
  CRISPR gRNA sequence
ctattttattgttagataaa

SEQ ID NO: 617759 - DNA, 20 bp, Artificial
  CRISPR gRNA sequence
aaaagaatatgagaaaaaag

SEQ ID NO: 617760 - DNA, 20 bp, Artificial
  CRISPR gRNA sequence
ttgcatggaacataacatat

SEQ ID NO: 617761 - DNA, 20 bp, Artificial
  CRISPR gRNA sequence
taacatatctggatcactta

SEQ ID NO: 617762 - DNA, 20 bp, Artificial
  CRISPR gRNA sequence
tatttctgcttttcatctgt

SEQ ID NO: 617763 - DNA, 20 bp, Artificial
  CRISPR gRNA sequence
tgctgtcaggtagacagact

SEQ ID NO: 617764 - DNA, 20 bp, Artificial
  CRISPR gRNA sequence
agtaaaattacctaattaaa

SEQ ID NO: 617765 - DNA, 20 bp, Artificial
  CRISPR gRNA sequence
ataaacctactctgtttgtg

SEQ ID NO: 617766 - DNA, 20 bp, Artificial
  CRISPR gRNA sequence
ggtagtaatgcatttcattt

SEQ ID NO: 617767 - DNA, 20 bp, Artificial
  CRISPR gRNA sequence
cctccctaggtgaccttgtc

SEQ ID NO: 617768 - DNA, 20 bp, Artificial
  CRISPR gRNA sequence
cctaggtgaccttgtccaga

SEQ ID NO: 617769 - DNA, 20 bp, Artificial
  CRISPR gRNA sequence
ccttgtccagagtgagtttt

SEQ ID NO: 617770 - DNA, 20 bp, Artificial
  CRISPR gRNA sequence
ttgtataactagatgtgttg

SEQ ID NO: 617771 - DNA, 20 bp, Artificial
  CRISPR gRNA sequence
ataactagatgtgttggtga

SEQ ID NO: 617772 - DNA, 20 bp, Artificial
  CRISPR gRNA sequence
tcatgtctctgttgcatatc

SEQ ID NO: 617773 - DNA, 20 bp, Artificial
  CRISPR gRNA sequence
ttctttttttctctcttgtg

SEQ ID NO: 617774 - DNA, 20 bp, Artificial
  CRISPR gRNA sequence
gtgtagaatcaaggagaaaa

SEQ ID NO: 617775 - DNA, 20 bp, Artificial
  CRISPR gRNA sequence
aaacagaatattcagtttaa

SEQ ID NO: 617776 - DNA, 20 bp, Artificial
  CRISPR gRNA sequence
agtttaaaaggatttcacat

SEQ ID NO: 617777 - DNA, 20 bp, Artificial
  CRISPR gRNA sequence
acacataaacagacattttc

SEQ ID NO: 617778 - DNA, 20 bp, Artificial
  CRISPR gRNA sequence
tgagtgaagtttcacctttt

SEQ ID NO: 617779 - DNA, 20 bp, Artificial
  CRISPR gRNA sequence
aagtttcaccttttttgggt

SEQ ID NO: 617780 - DNA, 20 bp, Artificial
  CRISPR gRNA sequence
aaatgatctttttttttttt

SEQ ID NO: 617781 - DNA, 20 bp, Artificial
  CRISPR gRNA sequence
ttttatcattgcttaatttc

SEQ ID NO: 617782 - DNA, 20 bp, Artificial
  CRISPR gRNA sequence
ctttgtaatctctgcagcct

SEQ ID NO: 617783 - DNA, 20 bp, Artificial
  CRISPR gRNA sequence
tgcagcctgagggtagcaga

SEQ ID NO: 617784 - DNA, 20 bp, Artificial
  CRISPR gRNA sequence
acttttagcacctaaccgac

SEQ ID NO: 617785 - DNA, 20 bp, Artificial
  CRISPR gRNA sequence
gaaagttagtgcttgtctct

SEQ ID NO: 617786 - DNA, 20 bp, Artificial
  CRISPR gRNA sequence
ttgtctcttggagttgttgt

SEQ ID NO: 617787 - DNA, 20 bp, Artificial
  CRISPR gRNA sequence
tgtttattttaaaatatatt

SEQ ID NO: 617788 - DNA, 20 bp, Artificial
  CRISPR gRNA sequence
tgtgttggttatctgattga

SEQ ID NO: 617789 - DNA, 20 bp, Artificial
  CRISPR gRNA sequence
tcagttatgctatctgtgtt

SEQ ID NO: 617790 - DNA, 20 bp, Artificial
  CRISPR gRNA sequence
cttttcagccagtgtcactc

SEQ ID NO: 617791 - DNA, 20 bp, Artificial
  CRISPR gRNA sequence
tgtcactctagaatttagag

SEQ ID NO: 617792 - DNA, 20 bp, Artificial
  CRISPR gRNA sequence
ggattttataaaacacttta

SEQ ID NO: 617793 - DNA, 20 bp, Artificial
  CRISPR gRNA sequence
aacactttaagggataccta

SEQ ID NO: 617794 - DNA, 20 bp, Artificial
  CRISPR gRNA sequence
ttagtgttactattattatt

SEQ ID NO: 617795 - DNA, 20 bp, Artificial
  CRISPR gRNA sequence
tactattattattttgagta

SEQ ID NO: 617796 - DNA, 20 bp, Artificial
  CRISPR gRNA sequence
gctaaatctcaaagatcatt

SEQ ID NO: 617797 - DNA, 20 bp, Artificial
  CRISPR gRNA sequence
caaagatcatttagaatcct

SEQ ID NO: 617798 - DNA, 20 bp, Artificial
  CRISPR gRNA sequence
ccagacctccattttcttag

SEQ ID NO: 617799 - DNA, 20 bp, Artificial
  CRISPR gRNA sequence
tacaattattgtaacagtac

SEQ ID NO: 617800 - DNA, 20 bp, Artificial
  CRISPR gRNA sequence
acatttacattccccctcag

SEQ ID NO: 617801 - DNA, 20 bp, Artificial
  CRISPR gRNA sequence
gcagtatatttaatagcttg

SEQ ID NO: 617802 - DNA, 20 bp, Artificial
  CRISPR gRNA sequence
tttgcttggcgtatggttct

SEQ ID NO: 617803 - DNA, 20 bp, Artificial
  CRISPR gRNA sequence
ctgtttgacatttttttcct

SEQ ID NO: 617804 - DNA, 20 bp, Artificial
  CRISPR gRNA sequence
taaaattgatttttccctgc

SEQ ID NO: 617805 - DNA, 20 bp, Artificial
  CRISPR gRNA sequence
attgatttttccctgcttgg

SEQ ID NO: 617806 - DNA, 20 bp, Artificial
  CRISPR gRNA sequence
ccttttcaagtgtgaagttt

SEQ ID NO: 617807 - DNA, 20 bp, Artificial
  CRISPR gRNA sequence
gtgtgaagtttacggatatt

SEQ ID NO: 617808 - DNA, 20 bp, Artificial
  CRISPR gRNA sequence
tttggatcttactgtgttct

SEQ ID NO: 617809 - DNA, 20 bp, Artificial
  CRISPR gRNA sequence
ttagtgattagtttttgttt

SEQ ID NO: 617810 - DNA, 20 bp, Artificial
  CRISPR gRNA sequence
ttttctagattactggctat

SEQ ID NO: 617811 - DNA, 20 bp, Artificial
  CRISPR gRNA sequence
ctctgcttctaaaatacatc

SEQ ID NO: 617812 - DNA, 20 bp, Artificial
  CRISPR gRNA sequence
caaaagctttccactgaaac

SEQ ID NO: 617813 - DNA, 20 bp, Artificial
  CRISPR gRNA sequence
tttattatacttaatagtat

SEQ ID NO: 617814 - DNA, 20 bp, Artificial
  CRISPR gRNA sequence
ttcattcatgtagtagggcc

SEQ ID NO: 617815 - DNA, 20 bp, Artificial
  CRISPR gRNA sequence
tgttctttcccttccataaa

SEQ ID NO: 617816 - DNA, 20 bp, Artificial
  CRISPR gRNA sequence
aggcgaaagtcacatgggga

SEQ ID NO: 617817 - DNA, 20 bp, Artificial
  CRISPR gRNA sequence
cagcactttgggaggccgag

SEQ ID NO: 617818 - DNA, 20 bp, Artificial
  CRISPR gRNA sequence
actttgggaggccgagacgg

SEQ ID NO: 617819 - DNA, 20 bp, Artificial
  CRISPR gRNA sequence
tactctggaggctgaggcag

SEQ ID NO: 617820 - DNA, 20 bp, Artificial
  CRISPR gRNA sequence
aggagaatagtttgaacttg

SEQ ID NO: 617821 - DNA, 20 bp, Artificial
  CRISPR gRNA sequence
catgatacactcttatgttt

SEQ ID NO: 617822 - DNA, 20 bp, Artificial
  CRISPR gRNA sequence
gaggccctgtagaagtagtt

SEQ ID NO: 617823 - DNA, 20 bp, Artificial
  CRISPR gRNA sequence
catattacatagacctggtt

SEQ ID NO: 617824 - DNA, 20 bp, Artificial
  CRISPR gRNA sequence
cctggctgtgcaccctactt

SEQ ID NO: 617825 - DNA, 20 bp, Artificial
  CRISPR gRNA sequence
tacttttgggttaagccgta

SEQ ID NO: 617826 - DNA, 20 bp, Artificial
  CRISPR gRNA sequence
cctaatagctgtgtgacctt

SEQ ID NO: 617827 - DNA, 20 bp, Artificial
  CRISPR gRNA sequence
tatttattagataaggcttc

SEQ ID NO: 617828 - DNA, 20 bp, Artificial
  CRISPR gRNA sequence
cttctagggtttgaaaatta

SEQ ID NO: 617829 - DNA, 20 bp, Artificial
  CRISPR gRNA sequence
ttttgccttgttttaagatt

SEQ ID NO: 617830 - DNA, 20 bp, Artificial
  CRISPR gRNA sequence
aatctaatttctttagttcc

SEQ ID NO: 617831 - DNA, 20 bp, Artificial
  CRISPR gRNA sequence
tgtattcttaagttagttaa

SEQ ID NO: 617832 - DNA, 20 bp, Artificial
  CRISPR gRNA sequence
gcagttataattctttagaa

SEQ ID NO: 617833 - DNA, 20 bp, Artificial
  CRISPR gRNA sequence
tgatttcaaattacttttat

SEQ ID NO: 617834 - DNA, 20 bp, Artificial
  CRISPR gRNA sequence
tcaaattacttttatttggg

SEQ ID NO: 617835 - DNA, 20 bp, Artificial
  CRISPR gRNA sequence
tatagatcaaataaggtgtt

SEQ ID NO: 617836 - DNA, 20 bp, Artificial
  CRISPR gRNA sequence
atcaaataaggtgttcagaa

SEQ ID NO: 617837 - DNA, 20 bp, Artificial
  CRISPR gRNA sequence
gctaggtgaaactgacataa

SEQ ID NO: 617838 - DNA, 20 bp, Artificial
  CRISPR gRNA sequence
ttagttgtattggtattcca

SEQ ID NO: 617839 - DNA, 20 bp, Artificial
  CRISPR gRNA sequence
ctatttactgagaacatcct

SEQ ID NO: 617840 - DNA, 20 bp, Artificial
  CRISPR gRNA sequence
atttacagttttcatagcta

SEQ ID NO: 617841 - DNA, 20 bp, Artificial
  CRISPR gRNA sequence
gcagtaactttcaattcagt

SEQ ID NO: 617842 - DNA, 20 bp, Artificial
  CRISPR gRNA sequence
tatttattaccggtacctcc

SEQ ID NO: 617843 - DNA, 20 bp, Artificial
  CRISPR gRNA sequence
aggatgccattgtgggaagc

SEQ ID NO: 617844 - DNA, 20 bp, Artificial
  CRISPR gRNA sequence
gaaatcaacacacataacat

SEQ ID NO: 617845 - DNA, 20 bp, Artificial
  CRISPR gRNA sequence
tgttatggcatgatagtgct

SEQ ID NO: 617846 - DNA, 20 bp, Artificial
  CRISPR gRNA sequence
catgatagtgctagggatga

SEQ ID NO: 617847 - DNA, 20 bp, Artificial
  CRISPR gRNA sequence
agtgctagggatgatggggt

SEQ ID NO: 617848 - DNA, 20 bp, Artificial
  CRISPR gRNA sequence
gtgataaacttcatcccaca

SEQ ID NO: 617849 - DNA, 20 bp, Artificial
  CRISPR gRNA sequence
tttcctattaatagtacaaa

SEQ ID NO: 617850 - DNA, 20 bp, Artificial
  CRISPR gRNA sequence
ctatgactcaatttttcatt

SEQ ID NO: 617851 - DNA, 20 bp, Artificial
  CRISPR gRNA sequence
ttttaataccaacgttgttc

SEQ ID NO: 617852 - DNA, 20 bp, Artificial
  CRISPR gRNA sequence
atttaccttctttacatcct

SEQ ID NO: 617853 - DNA, 20 bp, Artificial
  CRISPR gRNA sequence
tatgtcaagaagtctgtgca

SEQ ID NO: 617854 - DNA, 20 bp, Artificial
  CRISPR gRNA sequence
tacactacaactagtaatat

SEQ ID NO: 617855 - DNA, 20 bp, Artificial
  CRISPR gRNA sequence
ttttatccattttggttcat

SEQ ID NO: 617856 - DNA, 20 bp, Artificial
  CRISPR gRNA sequence
gtatttaatttttgttcctg

SEQ ID NO: 617857 - DNA, 20 bp, Artificial
  CRISPR gRNA sequence
gatttgaggcatatttatta

SEQ ID NO: 617858 - DNA, 20 bp, Artificial
  CRISPR gRNA sequence
tttattaaaggataatggca

SEQ ID NO: 617859 - DNA, 20 bp, Artificial
  CRISPR gRNA sequence
ttaaaggataatggcaggga

SEQ ID NO: 617860 - DNA, 20 bp, Artificial
  CRISPR gRNA sequence
atagcagttcaatgaagttc

SEQ ID NO: 617861 - DNA, 20 bp, Artificial
  CRISPR gRNA sequence
agttcaggggttaatgaaat

SEQ ID NO: 617862 - DNA, 20 bp, Artificial
  CRISPR gRNA sequence
ctaataagaagtagcaaaca

SEQ ID NO: 617863 - DNA, 20 bp, Artificial
  CRISPR gRNA sequence
agttgctaggtgaggtataa

SEQ ID NO: 617864 - DNA, 20 bp, Artificial
  CRISPR gRNA sequence
aagggaatagataccttgtg

SEQ ID NO: 617865 - DNA, 20 bp, Artificial
  CRISPR gRNA sequence
gataccttgtgcaggatgta

SEQ ID NO: 617866 - DNA, 20 bp, Artificial
  CRISPR gRNA sequence
ttcaagactggtagagaact

SEQ ID NO: 617867 - DNA, 20 bp, Artificial
  CRISPR gRNA sequence
tttgtcaattgattagcaag

SEQ ID NO: 617868 - DNA, 20 bp, Artificial
  CRISPR gRNA sequence
ctcctggtctgtcccgggaa

SEQ ID NO: 617869 - DNA, 20 bp, Artificial
  CRISPR gRNA sequence
ggatggtttgcagactgtta

SEQ ID NO: 617870 - DNA, 20 bp, Artificial
  CRISPR gRNA sequence
tgctgaaggttacctaggac

SEQ ID NO: 617871 - DNA, 20 bp, Artificial
  CRISPR gRNA sequence
catctcactgaaaataatcc

SEQ ID NO: 617872 - DNA, 20 bp, Artificial
  CRISPR gRNA sequence
aacaacttccttaacaaagc

SEQ ID NO: 617873 - DNA, 20 bp, Artificial
  CRISPR gRNA sequence
catgcatgacaggtggtctc

SEQ ID NO: 617874 - DNA, 20 bp, Artificial
  CRISPR gRNA sequence
caggctttcatgtaggtttt

SEQ ID NO: 617875 - DNA, 20 bp, Artificial
  CRISPR gRNA sequence
tttgcattggcccttgtatt

SEQ ID NO: 617876 - DNA, 20 bp, Artificial
  CRISPR gRNA sequence
tactatcatcatttcttctg

SEQ ID NO: 617877 - DNA, 20 bp, Artificial
  CRISPR gRNA sequence
aaaccaaaccaaaccaaacc

SEQ ID NO: 617878 - DNA, 20 bp, Artificial
  CRISPR gRNA sequence
tattattatactttaagttc

SEQ ID NO: 617879 - DNA, 20 bp, Artificial
  CRISPR gRNA sequence
tacaattttgactttgtgca

SEQ ID NO: 617880 - DNA, 20 bp, Artificial
  CRISPR gRNA sequence
aaggaagtatgatcatcttt

SEQ ID NO: 617881 - DNA, 20 bp, Artificial
  CRISPR gRNA sequence
cctaggtgaaaaagataata

SEQ ID NO: 617882 - DNA, 20 bp, Artificial
  CRISPR gRNA sequence
gcatccacatttcttcctct

SEQ ID NO: 617883 - DNA, 20 bp, Artificial
  CRISPR gRNA sequence
tctgaggatattagcaacac

SEQ ID NO: 617884 - DNA, 20 bp, Artificial
  CRISPR gRNA sequence
acttcttatttctcccttgc

SEQ ID NO: 617885 - DNA, 20 bp, Artificial
  CRISPR gRNA sequence
gcagttttactgtgccttta

SEQ ID NO: 617886 - DNA, 20 bp, Artificial
  CRISPR gRNA sequence
tattggatttactgttgtaa

SEQ ID NO: 617887 - DNA, 20 bp, Artificial
  CRISPR gRNA sequence
tttactgttgtaattggata

SEQ ID NO: 617888 - DNA, 20 bp, Artificial
  CRISPR gRNA sequence
accttagcaatctaaatcgt

SEQ ID NO: 617889 - DNA, 20 bp, Artificial
  CRISPR gRNA sequence
tggcaaaatctagccatgtg

SEQ ID NO: 617890 - DNA, 20 bp, Artificial
  CRISPR gRNA sequence
aatctagccatgtgaaggat

SEQ ID NO: 617891 - DNA, 20 bp, Artificial
  CRISPR gRNA sequence
cacctctttactttagtttg

SEQ ID NO: 617892 - DNA, 20 bp, Artificial
  CRISPR gRNA sequence
ttggagaattatttaagtag

SEQ ID NO: 617893 - DNA, 20 bp, Artificial
  CRISPR gRNA sequence
aatcactggctgagaaatga

SEQ ID NO: 617894 - DNA, 20 bp, Artificial
  CRISPR gRNA sequence
tatgtcactgcagatttggt

SEQ ID NO: 617895 - DNA, 20 bp, Artificial
  CRISPR gRNA sequence
acattatgaaattcttagga

SEQ ID NO: 617896 - DNA, 20 bp, Artificial
  CRISPR gRNA sequence
tttttaaaatagttatgtca

SEQ ID NO: 617897 - DNA, 20 bp, Artificial
  CRISPR gRNA sequence
tctcaaacttgcttgatcgt

SEQ ID NO: 617898 - DNA, 20 bp, Artificial
  CRISPR gRNA sequence
cagacctcaactcaagtata

SEQ ID NO: 617899 - DNA, 20 bp, Artificial
  CRISPR gRNA sequence
acgtgactgaactgcatctt

SEQ ID NO: 617900 - DNA, 20 bp, Artificial
  CRISPR gRNA sequence
actgaactgcatctttaggg

SEQ ID NO: 617901 - DNA, 20 bp, Artificial
  CRISPR gRNA sequence
agggttgggtggtaggcagg

SEQ ID NO: 617902 - DNA, 20 bp, Artificial
  CRISPR gRNA sequence
gagatgttttataaaatcat

SEQ ID NO: 617903 - DNA, 20 bp, Artificial
  CRISPR gRNA sequence
acatgttcctgtttcagcca

SEQ ID NO: 617904 - DNA, 20 bp, Artificial
  CRISPR gRNA sequence
caaactgagaaggaactctt

SEQ ID NO: 617905 - DNA, 20 bp, Artificial
  CRISPR gRNA sequence
tccacaagttgtaatatgcc

SEQ ID NO: 617906 - DNA, 20 bp, Artificial
  CRISPR gRNA sequence
cttgtatttatagcaactca

SEQ ID NO: 617907 - DNA, 20 bp, Artificial
  CRISPR gRNA sequence
gcaactcaatgaatgttaga

SEQ ID NO: 617908 - DNA, 20 bp, Artificial
  CRISPR gRNA sequence
aatgttagaaagaatattgg

SEQ ID NO: 617909 - DNA, 20 bp, Artificial
  CRISPR gRNA sequence
aagaatattggtagaattcc

SEQ ID NO: 617910 - DNA, 20 bp, Artificial
  CRISPR gRNA sequence
tcagaactccagcttccaca

SEQ ID NO: 617911 - DNA, 20 bp, Artificial
  CRISPR gRNA sequence
gcttccacattgaattacta

SEQ ID NO: 617912 - DNA, 20 bp, Artificial
  CRISPR gRNA sequence
ctgaagaaatagatcagaaa

SEQ ID NO: 617913 - DNA, 20 bp, Artificial
  CRISPR gRNA sequence
aataggatcagggagcataa

SEQ ID NO: 617914 - DNA, 20 bp, Artificial
  CRISPR gRNA sequence
gaaatattatataatagaaa

SEQ ID NO: 617915 - DNA, 20 bp, Artificial
  CRISPR gRNA sequence
agtttctagaaaagatccta

SEQ ID NO: 617916 - DNA, 20 bp, Artificial
  CRISPR gRNA sequence
ttgtgtataggacagagaag

SEQ ID NO: 617917 - DNA, 20 bp, Artificial
  CRISPR gRNA sequence
aatgcattttttcctttaaa

SEQ ID NO: 617918 - DNA, 20 bp, Artificial
  CRISPR gRNA sequence
agcagtttaatattttagat

SEQ ID NO: 617919 - DNA, 20 bp, Artificial
  CRISPR gRNA sequence
tacttgaggggctgaggtga

SEQ ID NO: 617920 - DNA, 20 bp, Artificial
  CRISPR gRNA sequence
tcttgcaactgcactccagc

SEQ ID NO: 617921 - DNA, 20 bp, Artificial
  CRISPR gRNA sequence
ataaataaatatataaagtg

SEQ ID NO: 617922 - DNA, 20 bp, Artificial
  CRISPR gRNA sequence
taggtcatctgccttccagt

SEQ ID NO: 617923 - DNA, 20 bp, Artificial
  CRISPR gRNA sequence
ctgccttccagttagagtta

SEQ ID NO: 617924 - DNA, 20 bp, Artificial
  CRISPR gRNA sequence
tttgtttgccattctttttt

SEQ ID NO: 617925 - DNA, 20 bp, Artificial
  CRISPR gRNA sequence
tgaatgactccccttacctg

SEQ ID NO: 617926 - DNA, 20 bp, Artificial
  CRISPR gRNA sequence
ccacagatacttgccatgtc

SEQ ID NO: 617927 - DNA, 20 bp, Artificial
  CRISPR gRNA sequence
tcaaattgccttttctttgc

SEQ ID NO: 617928 - DNA, 20 bp, Artificial
  CRISPR gRNA sequence
catgaatccttctcctttcc

SEQ ID NO: 617929 - DNA, 20 bp, Artificial
  CRISPR gRNA sequence
ggtccagtgtaactgcttat

SEQ ID NO: 617930 - DNA, 20 bp, Artificial
  CRISPR gRNA sequence
ttccccatatttctatagca

SEQ ID NO: 617931 - DNA, 20 bp, Artificial
  CRISPR gRNA sequence
ttttgccactgtacctggca

SEQ ID NO: 617932 - DNA, 20 bp, Artificial
  CRISPR gRNA sequence
tatgaacaaatgactaaaag

SEQ ID NO: 617933 - DNA, 20 bp, Artificial
  CRISPR gRNA sequence
aacaaatgactaaaaggaga

SEQ ID NO: 617934 - DNA, 20 bp, Artificial
  CRISPR gRNA sequence
agtgaatgaactttcatgaa

SEQ ID NO: 617935 - DNA, 20 bp, Artificial
  CRISPR gRNA sequence
tgaactttcatgaagtggat

SEQ ID NO: 617936 - DNA, 20 bp, Artificial
  CRISPR gRNA sequence
tggccttgaagaaagagaga

SEQ ID NO: 617937 - DNA, 20 bp, Artificial
  CRISPR gRNA sequence
ggagttggctgctttacctg

SEQ ID NO: 617938 - DNA, 20 bp, Artificial
  CRISPR gRNA sequence
cagatactatctcactaaag

SEQ ID NO: 617939 - DNA, 20 bp, Artificial
  CRISPR gRNA sequence
atcacatgcccttatgcaca

SEQ ID NO: 617940 - DNA, 20 bp, Artificial
  CRISPR gRNA sequence
ttatgcacacaggatgtggt

SEQ ID NO: 617941 - DNA, 20 bp, Artificial
  CRISPR gRNA sequence
tatgatggtgacctctgaac

SEQ ID NO: 617942 - DNA, 20 bp, Artificial
  CRISPR gRNA sequence
ataactcagagctgactaag

SEQ ID NO: 617943 - DNA, 20 bp, Artificial
  CRISPR gRNA sequence
tctgtagctgtgcctcatca

SEQ ID NO: 617944 - DNA, 20 bp, Artificial
  CRISPR gRNA sequence
agctgtgcctcatcataggg

SEQ ID NO: 617945 - DNA, 20 bp, Artificial
  CRISPR gRNA sequence
cttatgtgtgtcatctgtaa

SEQ ID NO: 617946 - DNA, 20 bp, Artificial
  CRISPR gRNA sequence
taaaaaaaatgaggttgtgg

SEQ ID NO: 617947 - DNA, 20 bp, Artificial
  CRISPR gRNA sequence
aaaaatgaggttgtggtagg

SEQ ID NO: 617948 - DNA, 20 bp, Artificial
  CRISPR gRNA sequence
gttgtggtaggatgagtact

SEQ ID NO: 617949 - DNA, 20 bp, Artificial
  CRISPR gRNA sequence
tacagatagggctggcttta

SEQ ID NO: 617950 - DNA, 20 bp, Artificial
  CRISPR gRNA sequence
ctggctttagagaattacct

SEQ ID NO: 617951 - DNA, 20 bp, Artificial
  CRISPR gRNA sequence
gctcagtcctgcctgccttt

SEQ ID NO: 617952 - DNA, 20 bp, Artificial
  CRISPR gRNA sequence
tcatagaacaattcaagtaa

SEQ ID NO: 617953 - DNA, 20 bp, Artificial
  CRISPR gRNA sequence
tcaggtaccagattatgctg

SEQ ID NO: 617954 - DNA, 20 bp, Artificial
  CRISPR gRNA sequence
ggtatggagaagaagtttgg

SEQ ID NO: 617955 - DNA, 20 bp, Artificial
  CRISPR gRNA sequence
gcccaaaggtagtaccagac

SEQ ID NO: 617956 - DNA, 20 bp, Artificial
  CRISPR gRNA sequence
ttgtagttacaaaagtgtta

SEQ ID NO: 617957 - DNA, 20 bp, Artificial
  CRISPR gRNA sequence
acaaaagtgttagagaatat

SEQ ID NO: 617958 - DNA, 20 bp, Artificial
  CRISPR gRNA sequence
caactgccttttcagtttgt

SEQ ID NO: 617959 - DNA, 20 bp, Artificial
  CRISPR gRNA sequence
ctccacctagctagtctctt

SEQ ID NO: 617960 - DNA, 20 bp, Artificial
  CRISPR gRNA sequence
gtcaaacctctgccatggaa

SEQ ID NO: 617961 - DNA, 20 bp, Artificial
  CRISPR gRNA sequence
ggtgtccaattcacttattc

SEQ ID NO: 617962 - DNA, 20 bp, Artificial
  CRISPR gRNA sequence
aagcctggtgtgttggaaga

SEQ ID NO: 617963 - DNA, 20 bp, Artificial
  CRISPR gRNA sequence
gccgtctctctttttttaat

SEQ ID NO: 617964 - DNA, 20 bp, Artificial
  CRISPR gRNA sequence
ctgattatggtagtggttat

SEQ ID NO: 617965 - DNA, 20 bp, Artificial
  CRISPR gRNA sequence
aatctatgcatgttgtagaa

SEQ ID NO: 617966 - DNA, 20 bp, Artificial
  CRISPR gRNA sequence
caactttaaaaataaaatga

SEQ ID NO: 617967 - DNA, 20 bp, Artificial
  CRISPR gRNA sequence
aaaataaaatgaaggggtta

SEQ ID NO: 617968 - DNA, 20 bp, Artificial
  CRISPR gRNA sequence
agttaatgtggcaattgtag

SEQ ID NO: 617969 - DNA, 20 bp, Artificial
  CRISPR gRNA sequence
actttcccctgttcattgtc

SEQ ID NO: 617970 - DNA, 20 bp, Artificial
  CRISPR gRNA sequence
cagttgcagtgactgcagtg

SEQ ID NO: 617971 - DNA, 20 bp, Artificial
  CRISPR gRNA sequence
cagtgatggatgtagggact

SEQ ID NO: 617972 - DNA, 20 bp, Artificial
  CRISPR gRNA sequence
tggatgtagggactcaggat

SEQ ID NO: 617973 - DNA, 20 bp, Artificial
  CRISPR gRNA sequence
actcaggatcagaatttgaa

SEQ ID NO: 617974 - DNA, 20 bp, Artificial
  CRISPR gRNA sequence
gaatttgaagagggtagacc

SEQ ID NO: 617975 - DNA, 20 bp, Artificial
  CRISPR gRNA sequence
cttgtgcctagcattttttc

SEQ ID NO: 617976 - DNA, 20 bp, Artificial
  CRISPR gRNA sequence
tacttaccagctatgtgatc

SEQ ID NO: 617977 - DNA, 20 bp, Artificial
  CRISPR gRNA sequence
cctcattcctctcagcccta

SEQ ID NO: 617978 - DNA, 20 bp, Artificial
  CRISPR gRNA sequence
ctctctcataaggctgttgg

SEQ ID NO: 617979 - DNA, 20 bp, Artificial
  CRISPR gRNA sequence
gatatgattattcagtaact

SEQ ID NO: 617980 - DNA, 20 bp, Artificial
  CRISPR gRNA sequence
gattattcagtaactgtggg

SEQ ID NO: 617981 - DNA, 20 bp, Artificial
  CRISPR gRNA sequence
cttgtgttggagaggcagtg

SEQ ID NO: 617982 - DNA, 20 bp, Artificial
  CRISPR gRNA sequence
ttcagtgctggtctgtttat

SEQ ID NO: 617983 - DNA, 20 bp, Artificial
  CRISPR gRNA sequence
ctggtctgtttattggggtc

SEQ ID NO: 617984 - DNA, 20 bp, Artificial
  CRISPR gRNA sequence
atttctttcgctgttcagca

SEQ ID NO: 617985 - DNA, 20 bp, Artificial
  CRISPR gRNA sequence
aattctgggctttttaccta

SEQ ID NO: 617986 - DNA, 20 bp, Artificial
  CRISPR gRNA sequence
gaattttaccctaagtgctg

SEQ ID NO: 617987 - DNA, 20 bp, Artificial
  CRISPR gRNA sequence
ttacgaggtacaacagttag

SEQ ID NO: 617988 - DNA, 20 bp, Artificial
  CRISPR gRNA sequence
ttagatgaattttttataat

SEQ ID NO: 617989 - DNA, 20 bp, Artificial
  CRISPR gRNA sequence
ctttttccaaattgtgatta

SEQ ID NO: 617990 - DNA, 20 bp, Artificial
  CRISPR gRNA sequence
tttttaataaacatttttga

SEQ ID NO: 617991 - DNA, 20 bp, Artificial
  CRISPR gRNA sequence
taataaacatttttgataga

SEQ ID NO: 617992 - DNA, 20 bp, Artificial
  CRISPR gRNA sequence
gcagatttttgtgtgtgaga

SEQ ID NO: 617993 - DNA, 20 bp, Artificial
  CRISPR gRNA sequence
tctcactctgtcacccaggc

SEQ ID NO: 617994 - DNA, 20 bp, Artificial
  CRISPR gRNA sequence
gccttggcctcccaaaatgc

SEQ ID NO: 617995 - DNA, 20 bp, Artificial
  CRISPR gRNA sequence
atgaccatgtaaacatggaa

SEQ ID NO: 617996 - DNA, 20 bp, Artificial
  CRISPR gRNA sequence
catgtaaacatggaaatgga

SEQ ID NO: 617997 - DNA, 20 bp, Artificial
  CRISPR gRNA sequence
attataattattaacagcta

SEQ ID NO: 617998 - DNA, 20 bp, Artificial
  CRISPR gRNA sequence
ttgtgttcctgtaacgaaga

SEQ ID NO: 617999 - DNA, 20 bp, Artificial
  CRISPR gRNA sequence
aacagtgctttgctatattt

SEQ ID NO: 618000 - DNA, 20 bp, Artificial
  CRISPR gRNA sequence
acacccatacattgtaataa

SEQ ID NO: 618001 - DNA, 20 bp, Artificial
  CRISPR gRNA sequence
ccaagtatttattacaccat

SEQ ID NO: 618002 - DNA, 20 bp, Artificial
  CRISPR gRNA sequence
cttgttgagattcacatggt

SEQ ID NO: 618003 - DNA, 20 bp, Artificial
  CRISPR gRNA sequence
ttttaatttattgttaaggc

SEQ ID NO: 618004 - DNA, 20 bp, Artificial
  CRISPR gRNA sequence
ttcaaattatggactggttt

SEQ ID NO: 618005 - DNA, 20 bp, Artificial
  CRISPR gRNA sequence
gattataattcaggagatat

SEQ ID NO: 618006 - DNA, 20 bp, Artificial
  CRISPR gRNA sequence
tatgaaaacagacattttcc

SEQ ID NO: 618007 - DNA, 20 bp, Artificial
  CRISPR gRNA sequence
cttccattgttttatgccta

SEQ ID NO: 618008 - DNA, 20 bp, Artificial
  CRISPR gRNA sequence
tccttcctcatacctcaaat

SEQ ID NO: 618009 - DNA, 20 bp, Artificial
  CRISPR gRNA sequence
ttaaaacttcagtaaacgta

SEQ ID NO: 618010 - DNA, 20 bp, Artificial
  CRISPR gRNA sequence
ttcagtaaacgtatcgaata

SEQ ID NO: 618011 - DNA, 20 bp, Artificial
  CRISPR gRNA sequence
gtaaacgtatcgaatactga

SEQ ID NO: 618012 - DNA, 20 bp, Artificial
  CRISPR gRNA sequence
cgtatcgaatactgaatgaa

SEQ ID NO: 618013 - DNA, 20 bp, Artificial
  CRISPR gRNA sequence
actacactgttgtaactttt

SEQ ID NO: 618014 - DNA, 20 bp, Artificial
  CRISPR gRNA sequence
gattttttttttttttgaga

SEQ ID NO: 618015 - DNA, 20 bp, Artificial
  CRISPR gRNA sequence
gtctcactctgtcaccaggc

SEQ ID NO: 618016 - DNA, 20 bp, Artificial
  CRISPR gRNA sequence
gggctcactacagttgcctc

SEQ ID NO: 618017 - DNA, 20 bp, Artificial
  CRISPR gRNA sequence
gattttcctgcctcagcctc

SEQ ID NO: 618018 - DNA, 20 bp, Artificial
  CRISPR gRNA sequence
tgaggtttcaccatgttggc

SEQ ID NO: 618019 - DNA, 20 bp, Artificial
  CRISPR gRNA sequence
aggttgccctcccaaagtgc

SEQ ID NO: 618020 - DNA, 20 bp, Artificial
  CRISPR gRNA sequence
tcccaaagtgctgggattat

SEQ ID NO: 618021 - DNA, 20 bp, Artificial
  CRISPR gRNA sequence
ttttggaaaaatctcttacc

SEQ ID NO: 618022 - DNA, 20 bp, Artificial
  CRISPR gRNA sequence
tttctgtaacaatttacatt

SEQ ID NO: 618023 - DNA, 20 bp, Artificial
  CRISPR gRNA sequence
atctctcaaagtcaaactat

SEQ ID NO: 618024 - DNA, 20 bp, Artificial
  CRISPR gRNA sequence
caaactatcagaatacttgt

SEQ ID NO: 618025 - DNA, 20 bp, Artificial
  CRISPR gRNA sequence
tattatttgaactcaaaatt

SEQ ID NO: 618026 - DNA, 20 bp, Artificial
  CRISPR gRNA sequence
tttgaactcaaaatttggag

SEQ ID NO: 618027 - DNA, 20 bp, Artificial
  CRISPR gRNA sequence
attattacaggtatattagg

SEQ ID NO: 618028 - DNA, 20 bp, Artificial
  CRISPR gRNA sequence
caggtatattaggaggagtt

SEQ ID NO: 618029 - DNA, 20 bp, Artificial
  CRISPR gRNA sequence
tagcacttgtcatccttgtg

SEQ ID NO: 618030 - DNA, 20 bp, Artificial
  CRISPR gRNA sequence
gctcaatagatgccaacttt

SEQ ID NO: 618031 - DNA, 20 bp, Artificial
  CRISPR gRNA sequence
tttagagaaacagacatttg

SEQ ID NO: 618032 - DNA, 20 bp, Artificial
  CRISPR gRNA sequence
aacagacatttgcagagtta

SEQ ID NO: 618033 - DNA, 20 bp, Artificial
  CRISPR gRNA sequence
aataccatttgttttgtaca

SEQ ID NO: 618034 - DNA, 20 bp, Artificial
  CRISPR gRNA sequence
ttgaagaggccccaaaaaaa

SEQ ID NO: 618035 - DNA, 20 bp, Artificial
  CRISPR gRNA sequence
ctactctctgcataccattt

SEQ ID NO: 618036 - DNA, 20 bp, Artificial
  CRISPR gRNA sequence
tctctgcataccatttcaga

SEQ ID NO: 618037 - DNA, 20 bp, Artificial
  CRISPR gRNA sequence
cataccatttcagaatgagt

SEQ ID NO: 618038 - DNA, 20 bp, Artificial
  CRISPR gRNA sequence
aagggacatccatataaagt

SEQ ID NO: 618039 - DNA, 20 bp, Artificial
  CRISPR gRNA sequence
ctccacagtttttgtatttt

SEQ ID NO: 618040 - DNA, 20 bp, Artificial
  CRISPR gRNA sequence
tttgctttttttagcaactg

SEQ ID NO: 618041 - DNA, 20 bp, Artificial
  CRISPR gRNA sequence
aaaccttggttgcctagttc

SEQ ID NO: 618042 - DNA, 20 bp, Artificial
  CRISPR gRNA sequence
actgtaaattttaatttatt

SEQ ID NO: 618043 - DNA, 20 bp, Artificial
  CRISPR gRNA sequence
ttttaatttattatgggttg

SEQ ID NO: 618044 - DNA, 20 bp, Artificial
  CRISPR gRNA sequence
acactttagtaaaaatgata

SEQ ID NO: 618045 - DNA, 20 bp, Artificial
  CRISPR gRNA sequence
tgatatggaatagaaaacgt

SEQ ID NO: 618046 - DNA, 20 bp, Artificial
  CRISPR gRNA sequence
gaatagaaaacgttagaata

SEQ ID NO: 618047 - DNA, 20 bp, Artificial
  CRISPR gRNA sequence
tatgcagaaggctgaggcaa

SEQ ID NO: 618048 - DNA, 20 bp, Artificial
  CRISPR gRNA sequence
caagaggatcacttgagccc

SEQ ID NO: 618049 - DNA, 20 bp, Artificial
  CRISPR gRNA sequence
cacaatctgtcactgggaga

SEQ ID NO: 618050 - DNA, 20 bp, Artificial
  CRISPR gRNA sequence
tacatagacatatgtatata

SEQ ID NO: 618051 - DNA, 20 bp, Artificial
  CRISPR gRNA sequence
atatattttttattgtctgt

SEQ ID NO: 618052 - DNA, 20 bp, Artificial
  CRISPR gRNA sequence
ttcagtaaatctgtactaag

SEQ ID NO: 618053 - DNA, 20 bp, Artificial
  CRISPR gRNA sequence
aaataacccataaacagtgt

SEQ ID NO: 618054 - DNA, 20 bp, Artificial
  CRISPR gRNA sequence
ctgagcatataatttcccta

SEQ ID NO: 618055 - DNA, 20 bp, Artificial
  CRISPR gRNA sequence
ctaaaaaaataaattacaat

SEQ ID NO: 618056 - DNA, 20 bp, Artificial
  CRISPR gRNA sequence
gaaatttatttcagcagtgc

SEQ ID NO: 618057 - DNA, 20 bp, Artificial
  CRISPR gRNA sequence
tttatttcagcagtgcaagg

SEQ ID NO: 618058 - DNA, 20 bp, Artificial
  CRISPR gRNA sequence
tagtgatcaaatgtatgtat

SEQ ID NO: 618059 - DNA, 20 bp, Artificial
  CRISPR gRNA sequence
tgtgctggacgaaactgcca

SEQ ID NO: 618060 - DNA, 20 bp, Artificial
  CRISPR gRNA sequence
ttttgtatccataaactgca

SEQ ID NO: 618061 - DNA, 20 bp, Artificial
  CRISPR gRNA sequence
ttatatcttatactgaactt

SEQ ID NO: 618062 - DNA, 20 bp, Artificial
  CRISPR gRNA sequence
actgaacttcaggataaact

SEQ ID NO: 618063 - DNA, 20 bp, Artificial
  CRISPR gRNA sequence
atatctaaaagtcaatttca

SEQ ID NO: 618064 - DNA, 20 bp, Artificial
  CRISPR gRNA sequence
gccttttatgtattgttgat

SEQ ID NO: 618065 - DNA, 20 bp, Artificial
  CRISPR gRNA sequence
gagtataaatttatataaat

SEQ ID NO: 618066 - DNA, 20 bp, Artificial
  CRISPR gRNA sequence
ttataataatttgtcaaatg

SEQ ID NO: 618067 - DNA, 20 bp, Artificial
  CRISPR gRNA sequence
gcaaacaatgcccatcagta

SEQ ID NO: 618068 - DNA, 20 bp, Artificial
  CRISPR gRNA sequence
aaattaggtatatccaataa

SEQ ID NO: 618069 - DNA, 20 bp, Artificial
  CRISPR gRNA sequence
tatgcaagtatataaaaaat

SEQ ID NO: 618070 - DNA, 20 bp, Artificial
  CRISPR gRNA sequence
gtatataaaaaataagaatc

SEQ ID NO: 618071 - DNA, 20 bp, Artificial
  CRISPR gRNA sequence
aaggggcagaagaaaataag

SEQ ID NO: 618072 - DNA, 20 bp, Artificial
  CRISPR gRNA sequence
taattatatttaaaaactca

SEQ ID NO: 618073 - DNA, 20 bp, Artificial
  CRISPR gRNA sequence
aatgaaataattaattgttt

SEQ ID NO: 618074 - DNA, 20 bp, Artificial
  CRISPR gRNA sequence
gtttgggagtgtatagatag

SEQ ID NO: 618075 - DNA, 20 bp, Artificial
  CRISPR gRNA sequence
cagctgagcagatgaggggc

SEQ ID NO: 618076 - DNA, 20 bp, Artificial
  CRISPR gRNA sequence
tttttgagaaaatatttcta

SEQ ID NO: 618077 - DNA, 20 bp, Artificial
  CRISPR gRNA sequence
atcaagaccagtgttcattt

SEQ ID NO: 618078 - DNA, 20 bp, Artificial
  CRISPR gRNA sequence
atgataataatggtagtgtt

SEQ ID NO: 618079 - DNA, 20 bp, Artificial
  CRISPR gRNA sequence
actaaatatctgtttggaaa

SEQ ID NO: 618080 - DNA, 20 bp, Artificial
  CRISPR gRNA sequence
agctgtgtcttaagttttgg

SEQ ID NO: 618081 - DNA, 20 bp, Artificial
  CRISPR gRNA sequence
aggattcatttaatagctgt

SEQ ID NO: 618082 - DNA, 20 bp, Artificial
  CRISPR gRNA sequence
tgatactaatacatgcctta

SEQ ID NO: 618083 - DNA, 20 bp, Artificial
  CRISPR gRNA sequence
tacagggttgtggtcaaggt

SEQ ID NO: 618084 - DNA, 20 bp, Artificial
  CRISPR gRNA sequence
gggttgtggtcaaggttgga

SEQ ID NO: 618085 - DNA, 20 bp, Artificial
  CRISPR gRNA sequence
tgtagccctaaaattgcaag

SEQ ID NO: 618086 - DNA, 20 bp, Artificial
  CRISPR gRNA sequence
acctgtaagatttgatttat

SEQ ID NO: 618087 - DNA, 20 bp, Artificial
  CRISPR gRNA sequence
ttgagtaaaataaaggggag

SEQ ID NO: 618088 - DNA, 20 bp, Artificial
  CRISPR gRNA sequence
gcttgcatgttttacttgct

SEQ ID NO: 618089 - DNA, 20 bp, Artificial
  CRISPR gRNA sequence
tttacttgctgagaatttgg

SEQ ID NO: 618090 - DNA, 20 bp, Artificial
  CRISPR gRNA sequence
caaagtgattatttaatacg

SEQ ID NO: 618091 - DNA, 20 bp, Artificial
  CRISPR gRNA sequence
tttaaaaaataatatattaa

SEQ ID NO: 618092 - DNA, 20 bp, Artificial
  CRISPR gRNA sequence
aaaataatatattaattgga

SEQ ID NO: 618093 - DNA, 20 bp, Artificial
  CRISPR gRNA sequence
tgttaaaaaccatgtgcttt

SEQ ID NO: 618094 - DNA, 20 bp, Artificial
  CRISPR gRNA sequence
gattatacaagtttatatag

SEQ ID NO: 618095 - DNA, 20 bp, Artificial
  CRISPR gRNA sequence
tttcatagaggaaagatgag

SEQ ID NO: 618096 - DNA, 20 bp, Artificial
  CRISPR gRNA sequence
gagatgaatatacaccaaat

SEQ ID NO: 618097 - DNA, 20 bp, Artificial
  CRISPR gRNA sequence
aatgtgaatagtggtcattt

SEQ ID NO: 618098 - DNA, 20 bp, Artificial
  CRISPR gRNA sequence
tagtggtcatttttgagtgt

SEQ ID NO: 618099 - DNA, 20 bp, Artificial
  CRISPR gRNA sequence
tgtttatgtattcttcgaga

SEQ ID NO: 618100 - DNA, 20 bp, Artificial
  CRISPR gRNA sequence
tattcttcgagattgaattg

SEQ ID NO: 618101 - DNA, 20 bp, Artificial
  CRISPR gRNA sequence
cttcgagattgaattgtagg

SEQ ID NO: 618102 - DNA, 20 bp, Artificial
  CRISPR gRNA sequence
agctatatcaactttgttag

SEQ ID NO: 618103 - DNA, 20 bp, Artificial
  CRISPR gRNA sequence
ttagtggaattttattccag

SEQ ID NO: 618104 - DNA, 20 bp, Artificial
  CRISPR gRNA sequence
ggaccgttttcctattgagg

SEQ ID NO: 618105 - DNA, 20 bp, Artificial
  CRISPR gRNA sequence
tagcccgatggctactgcag

SEQ ID NO: 618106 - DNA, 20 bp, Artificial
  CRISPR gRNA sequence
aaactgtggggcacagtgag

SEQ ID NO: 618107 - DNA, 20 bp, Artificial
  CRISPR gRNA sequence
tattatgaccacagttcatt

SEQ ID NO: 618108 - DNA, 20 bp, Artificial
  CRISPR gRNA sequence
taaaaatcacctactttcca

SEQ ID NO: 618109 - DNA, 20 bp, Artificial
  CRISPR gRNA sequence
catcaaagcatgcacccatt

SEQ ID NO: 618110 - DNA, 20 bp, Artificial
  CRISPR gRNA sequence
aaatctcattaaacactgaa

SEQ ID NO: 618111 - DNA, 20 bp, Artificial
  CRISPR gRNA sequence
actgaaaaggataatgcctt

SEQ ID NO: 618112 - DNA, 20 bp, Artificial
  CRISPR gRNA sequence
ccattctcctatcaactcag

SEQ ID NO: 618113 - DNA, 20 bp, Artificial
  CRISPR gRNA sequence
aaacttcaggtcttttgatt

SEQ ID NO: 618114 - DNA, 20 bp, Artificial
  CRISPR gRNA sequence
agatctttgtgatctcgcca

SEQ ID NO: 618115 - DNA, 20 bp, Artificial
  CRISPR gRNA sequence
ttgtttgtttttcctcctgc

SEQ ID NO: 618116 - DNA, 20 bp, Artificial
  CRISPR gRNA sequence
tctaaattttcactgaaaac

SEQ ID NO: 618117 - DNA, 20 bp, Artificial
  CRISPR gRNA sequence
tttagagacaattctacaat

SEQ ID NO: 618118 - DNA, 20 bp, Artificial
  CRISPR gRNA sequence
aatgagctatacaatttgtt

SEQ ID NO: 618119 - DNA, 20 bp, Artificial
  CRISPR gRNA sequence
ccttaaagttctcatgggca

SEQ ID NO: 618120 - DNA, 20 bp, Artificial
  CRISPR gRNA sequence
ctcatgggcaagggatgaga

SEQ ID NO: 618121 - DNA, 20 bp, Artificial
  CRISPR gRNA sequence
ttttgtcttgtgttaacagc

SEQ ID NO: 618122 - DNA, 20 bp, Artificial
  CRISPR gRNA sequence
atcatataatggctttcttg

SEQ ID NO: 618123 - DNA, 20 bp, Artificial
  CRISPR gRNA sequence
ctttcttgatgggtggcata

SEQ ID NO: 618124 - DNA, 20 bp, Artificial
  CRISPR gRNA sequence
aaatttttttgacttttgct

SEQ ID NO: 618125 - DNA, 20 bp, Artificial
  CRISPR gRNA sequence
tcatcatagtacaaaatatg

SEQ ID NO: 618126 - DNA, 20 bp, Artificial
  CRISPR gRNA sequence
atagtacaaaatatgaagaa

SEQ ID NO: 618127 - DNA, 20 bp, Artificial
  CRISPR gRNA sequence
aaaatatgaagaatagagtt

SEQ ID NO: 618128 - DNA, 20 bp, Artificial
  CRISPR gRNA sequence
ttcttttttttttttttaga

SEQ ID NO: 618129 - DNA, 20 bp, Artificial
  CRISPR gRNA sequence
cctcactctgtcgcccaggt

SEQ ID NO: 618130 - DNA, 20 bp, Artificial
  CRISPR gRNA sequence
gccgcggcctcccaaagtgt

SEQ ID NO: 618131 - DNA, 20 bp, Artificial
  CRISPR gRNA sequence
tagccatttttttttttcgt

SEQ ID NO: 618132 - DNA, 20 bp, Artificial
  CRISPR gRNA sequence
ttcctttaaaaaacaggcgc

SEQ ID NO: 618133 - DNA, 20 bp, Artificial
  CRISPR gRNA sequence
gatatgtaaatactaattat

SEQ ID NO: 618134 - DNA, 20 bp, Artificial
  CRISPR gRNA sequence
ttatatcttaaagtgaaaaa

SEQ ID NO: 618135 - DNA, 20 bp, Artificial
  CRISPR gRNA sequence
aaataacaaaagttttccag

SEQ ID NO: 618136 - DNA, 20 bp, Artificial
  CRISPR gRNA sequence
ctttgatttttgtttgtttg

SEQ ID NO: 618137 - DNA, 20 bp, Artificial
  CRISPR gRNA sequence
ttgataatcacaaatttaaa

SEQ ID NO: 618138 - DNA, 20 bp, Artificial
  CRISPR gRNA sequence
atcatttaatcaagcttttt

SEQ ID NO: 618139 - DNA, 20 bp, Artificial
  CRISPR gRNA sequence
atcaagctttttgggaatgt

SEQ ID NO: 618140 - DNA, 20 bp, Artificial
  CRISPR gRNA sequence
aggtaagagaaaaccagtcc

SEQ ID NO: 618141 - DNA, 20 bp, Artificial
  CRISPR gRNA sequence
aggaaaacagcaagggagaa

SEQ ID NO: 618142 - DNA, 20 bp, Artificial
  CRISPR gRNA sequence
aacagcaagggagaagagga

SEQ ID NO: 618143 - DNA, 20 bp, Artificial
  CRISPR gRNA sequence
agtctagggaactggtttct

SEQ ID NO: 618144 - DNA, 20 bp, Artificial
  CRISPR gRNA sequence
ggagagctttgcagtagaag

SEQ ID NO: 618145 - DNA, 20 bp, Artificial
  CRISPR gRNA sequence
agaggagtcaaaccttttgg

SEQ ID NO: 618146 - DNA, 20 bp, Artificial
  CRISPR gRNA sequence
aaaccttttgggagggtcag

SEQ ID NO: 618147 - DNA, 20 bp, Artificial
  CRISPR gRNA sequence
ggaataaattggacatttca

SEQ ID NO: 618148 - DNA, 20 bp, Artificial
  CRISPR gRNA sequence
tggacatttcagggagtccc

SEQ ID NO: 618149 - DNA, 20 bp, Artificial
  CRISPR gRNA sequence
gagctcctttgagaaaattc

SEQ ID NO: 618150 - DNA, 20 bp, Artificial
  CRISPR gRNA sequence
catgggggcctgggagggga

SEQ ID NO: 618151 - DNA, 20 bp, Artificial
  CRISPR gRNA sequence
ctgggaggggagggaatctc

SEQ ID NO: 618152 - DNA, 20 bp, Artificial
  CRISPR gRNA sequence
cataggtccctggtgtgtga

SEQ ID NO: 618153 - DNA, 20 bp, Artificial
  CRISPR gRNA sequence
ctagataggtgtagttataa

SEQ ID NO: 618154 - DNA, 20 bp, Artificial
  CRISPR gRNA sequence
ctgtaaatctgttcatatat

SEQ ID NO: 618155 - DNA, 20 bp, Artificial
  CRISPR gRNA sequence
tcttctttttacattcttat

SEQ ID NO: 618156 - DNA, 20 bp, Artificial
  CRISPR gRNA sequence
ttacattcttatctgagtat

SEQ ID NO: 618157 - DNA, 20 bp, Artificial
  CRISPR gRNA sequence
atctgtgtgttgcatgctat

SEQ ID NO: 618158 - DNA, 20 bp, Artificial
  CRISPR gRNA sequence
cagggcaagcttgttctagt

SEQ ID NO: 618159 - DNA, 20 bp, Artificial
  CRISPR gRNA sequence
gaccatagcaatttggaaca

SEQ ID NO: 618160 - DNA, 20 bp, Artificial
  CRISPR gRNA sequence
tggaacaatggatacattac

SEQ ID NO: 618161 - DNA, 20 bp, Artificial
  CRISPR gRNA sequence
ctgaattcactggcagcaag

SEQ ID NO: 618162 - DNA, 20 bp, Artificial
  CRISPR gRNA sequence
ttctttattaatattttggg

SEQ ID NO: 618163 - DNA, 20 bp, Artificial
  CRISPR gRNA sequence
tgaaagtagtacaagattgg

SEQ ID NO: 618164 - DNA, 20 bp, Artificial
  CRISPR gRNA sequence
tcagtgcctggggaacatag

SEQ ID NO: 618165 - DNA, 20 bp, Artificial
  CRISPR gRNA sequence
cctggggaacataggcgagt

SEQ ID NO: 618166 - DNA, 20 bp, Artificial
  CRISPR gRNA sequence
gactagcaacaagtttgtta

SEQ ID NO: 618167 - DNA, 20 bp, Artificial
  CRISPR gRNA sequence
ctctgccctgtggtttacta

SEQ ID NO: 618168 - DNA, 20 bp, Artificial
  CRISPR gRNA sequence
cctgtggtttactacagaat

SEQ ID NO: 618169 - DNA, 20 bp, Artificial
  CRISPR gRNA sequence
cattttatgtatactgcaaa

SEQ ID NO: 618170 - DNA, 20 bp, Artificial
  CRISPR gRNA sequence
tatccaggaaatatataatt

SEQ ID NO: 618171 - DNA, 20 bp, Artificial
  CRISPR gRNA sequence
tatcactatatttgtaacta

SEQ ID NO: 618172 - DNA, 20 bp, Artificial
  CRISPR gRNA sequence
taagaagacatttcctttca

SEQ ID NO: 618173 - DNA, 20 bp, Artificial
  CRISPR gRNA sequence
atttatcattgtttacccaa

SEQ ID NO: 618174 - DNA, 20 bp, Artificial
  CRISPR gRNA sequence
aaggaataactagctactga

SEQ ID NO: 618175 - DNA, 20 bp, Artificial
  CRISPR gRNA sequence
tactgactgagtgaccttgt

SEQ ID NO: 618176 - DNA, 20 bp, Artificial
  CRISPR gRNA sequence
ttgacttacctgtacaaagt

SEQ ID NO: 618177 - DNA, 20 bp, Artificial
  CRISPR gRNA sequence
ctctacggtatttagaacat

SEQ ID NO: 618178 - DNA, 20 bp, Artificial
  CRISPR gRNA sequence
ttgatcctccagttatttcc

SEQ ID NO: 618179 - DNA, 20 bp, Artificial
  CRISPR gRNA sequence
ctgcttatctcacaatattc

SEQ ID NO: 618180 - DNA, 20 bp, Artificial
  CRISPR gRNA sequence
tgcttactgttgtagagcag

SEQ ID NO: 618181 - DNA, 20 bp, Artificial
  CRISPR gRNA sequence
acagctggaaatatgacaag

SEQ ID NO: 618182 - DNA, 20 bp, Artificial
  CRISPR gRNA sequence
atattattctataaattcaa

SEQ ID NO: 618183 - DNA, 20 bp, Artificial
  CRISPR gRNA sequence
aattcattttgctatatgct

SEQ ID NO: 618184 - DNA, 20 bp, Artificial
  CRISPR gRNA sequence
tttttgtttaatttctaatg

SEQ ID NO: 618185 - DNA, 20 bp, Artificial
  CRISPR gRNA sequence
caacctcccaacttgtcttg

SEQ ID NO: 618186 - DNA, 20 bp, Artificial
  CRISPR gRNA sequence
ccaacttgtcttggtgaatt

SEQ ID NO: 618187 - DNA, 20 bp, Artificial
  CRISPR gRNA sequence
gcttattacctttgctccag

SEQ ID NO: 618188 - DNA, 20 bp, Artificial
  CRISPR gRNA sequence
agcaccacgccttggttttc

SEQ ID NO: 618189 - DNA, 20 bp, Artificial
  CRISPR gRNA sequence
cacaaattctagtttaaata

SEQ ID NO: 618190 - DNA, 20 bp, Artificial
  CRISPR gRNA sequence
caatgttctaagtgccagtt

SEQ ID NO: 618191 - DNA, 20 bp, Artificial
  CRISPR gRNA sequence
ttgaatactagtaacctgtc

SEQ ID NO: 618192 - DNA, 20 bp, Artificial
  CRISPR gRNA sequence
gcaggtttatttgttatggg

SEQ ID NO: 618193 - DNA, 20 bp, Artificial
  CRISPR gRNA sequence
cctttagacagagctaaagt

SEQ ID NO: 618194 - DNA, 20 bp, Artificial
  CRISPR gRNA sequence
gtgagaataaagtagtaaga

SEQ ID NO: 618195 - DNA, 20 bp, Artificial
  CRISPR gRNA sequence
tgtttctttgcactctaggt

SEQ ID NO: 618196 - DNA, 20 bp, Artificial
  CRISPR gRNA sequence
gtactatatttcatgtatga

SEQ ID NO: 618197 - DNA, 20 bp, Artificial
  CRISPR gRNA sequence
ttaaaaatactcttaaggtg

SEQ ID NO: 618198 - DNA, 20 bp, Artificial
  CRISPR gRNA sequence
agctgattgttataagacgt

SEQ ID NO: 618199 - DNA, 20 bp, Artificial
  CRISPR gRNA sequence
atttaatttggagcctaggt

SEQ ID NO: 618200 - DNA, 20 bp, Artificial
  CRISPR gRNA sequence
taattttttttttgtaatct

SEQ ID NO: 618201 - DNA, 20 bp, Artificial
  CRISPR gRNA sequence
ttctaattctcattcctttt

SEQ ID NO: 618202 - DNA, 20 bp, Artificial
  CRISPR gRNA sequence
ttttccaggttggagaaata

SEQ ID NO: 618203 - DNA, 20 bp, Artificial
  CRISPR gRNA sequence
aattttaacattatagacat

SEQ ID NO: 618204 - DNA, 20 bp, Artificial
  CRISPR gRNA sequence
gtgattttgtttagtcaaca

SEQ ID NO: 618205 - DNA, 20 bp, Artificial
  CRISPR gRNA sequence
ttctaccatggcagcccaag

SEQ ID NO: 618206 - DNA, 20 bp, Artificial
  CRISPR gRNA sequence
gtagggttcaaccgtgtagg

SEQ ID NO: 618207 - DNA, 20 bp, Artificial
  CRISPR gRNA sequence
ctaaacattttaatatatta

SEQ ID NO: 618208 - DNA, 20 bp, Artificial
  CRISPR gRNA sequence
ttaatatattattgagtttg

SEQ ID NO: 618209 - DNA, 20 bp, Artificial
  CRISPR gRNA sequence
ctttaaaaagaaatactacc

SEQ ID NO: 618210 - DNA, 20 bp, Artificial
  CRISPR gRNA sequence
gtattagatcaacattaagt

SEQ ID NO: 618211 - DNA, 20 bp, Artificial
  CRISPR gRNA sequence
ttttaaaattcatacctagt

SEQ ID NO: 618212 - DNA, 20 bp, Artificial
  CRISPR gRNA sequence
gtaagtgaaacaccattaat

SEQ ID NO: 618213 - DNA, 20 bp, Artificial
  CRISPR gRNA sequence
cttgaaattaaatatagaag

SEQ ID NO: 618214 - DNA, 20 bp, Artificial
  CRISPR gRNA sequence
aaactgtcaccaaagtttga

SEQ ID NO: 618215 - DNA, 20 bp, Artificial
  CRISPR gRNA sequence
gacttgattatacaaatgtg

SEQ ID NO: 618216 - DNA, 20 bp, Artificial
  CRISPR gRNA sequence
ccaattggtccttcccacag

SEQ ID NO: 618217 - DNA, 20 bp, Artificial
  CRISPR gRNA sequence
atcactttagatgacattag

SEQ ID NO: 618218 - DNA, 20 bp, Artificial
  CRISPR gRNA sequence
cacttatattagtaacttat

SEQ ID NO: 618219 - DNA, 20 bp, Artificial
  CRISPR gRNA sequence
aaatgaaagccaattcttta

SEQ ID NO: 618220 - DNA, 20 bp, Artificial
  CRISPR gRNA sequence
taagtgcttacaatgtgcaa

SEQ ID NO: 618221 - DNA, 20 bp, Artificial
  CRISPR gRNA sequence
ttaatcctctaaaagcacaa

SEQ ID NO: 618222 - DNA, 20 bp, Artificial
  CRISPR gRNA sequence
cattttagagatgccgagct

SEQ ID NO: 618223 - DNA, 20 bp, Artificial
  CRISPR gRNA sequence
tgaggaggtaataacatgta

SEQ ID NO: 618224 - DNA, 20 bp, Artificial
  CRISPR gRNA sequence
gtaataacatgtactgggta

SEQ ID NO: 618225 - DNA, 20 bp, Artificial
  CRISPR gRNA sequence
tgtgtaccatgctgtatatg

SEQ ID NO: 618226 - DNA, 20 bp, Artificial
  CRISPR gRNA sequence
aagcatgcaaatcttcagtg

SEQ ID NO: 618227 - DNA, 20 bp, Artificial
  CRISPR gRNA sequence
ttcagtgctgagttggtata

SEQ ID NO: 618228 - DNA, 20 bp, Artificial
  CRISPR gRNA sequence
acgtacgttgctcttgatct

SEQ ID NO: 618229 - DNA, 20 bp, Artificial
  CRISPR gRNA sequence
acttgatacagcttataaga

SEQ ID NO: 618230 - DNA, 20 bp, Artificial
  CRISPR gRNA sequence
tacatagatactcaactttc

SEQ ID NO: 618231 - DNA, 20 bp, Artificial
  CRISPR gRNA sequence
gttatctttataaaagaaag

SEQ ID NO: 618232 - DNA, 20 bp, Artificial
  CRISPR gRNA sequence
cttcagatcttcatcagtat

SEQ ID NO: 618233 - DNA, 20 bp, Artificial
  CRISPR gRNA sequence
atcaactagctaatatttaa

SEQ ID NO: 618234 - DNA, 20 bp, Artificial
  CRISPR gRNA sequence
ataacctttgcacagtgttt

SEQ ID NO: 618235 - DNA, 20 bp, Artificial
  CRISPR gRNA sequence
ttgcacagtgtttaaggatt

SEQ ID NO: 618236 - DNA, 20 bp, Artificial
  CRISPR gRNA sequence
ctctgctgcccttgaaggca

SEQ ID NO: 618237 - DNA, 20 bp, Artificial
  CRISPR gRNA sequence
gaaacaagtgcctgcatgtg

SEQ ID NO: 618238 - DNA, 20 bp, Artificial
  CRISPR gRNA sequence
catgtgttggattttgttag

SEQ ID NO: 618239 - DNA, 20 bp, Artificial
  CRISPR gRNA sequence
ttagttggatctagctccag

SEQ ID NO: 618240 - DNA, 20 bp, Artificial
  CRISPR gRNA sequence
caaacaggttttaaccggga

SEQ ID NO: 618241 - DNA, 20 bp, Artificial
  CRISPR gRNA sequence
ttttaaccgggacagagtga

SEQ ID NO: 618242 - DNA, 20 bp, Artificial
  CRISPR gRNA sequence
ggaccatttatggcattagt

SEQ ID NO: 618243 - DNA, 20 bp, Artificial
  CRISPR gRNA sequence
taccatcattttgtgtaagg

SEQ ID NO: 618244 - DNA, 20 bp, Artificial
  CRISPR gRNA sequence
ttgaatgccaattaaatgtc

SEQ ID NO: 618245 - DNA, 20 bp, Artificial
  CRISPR gRNA sequence
taagtcctaaaattggaaac

SEQ ID NO: 618246 - DNA, 20 bp, Artificial
  CRISPR gRNA sequence
ttggattctagtctcatttt

SEQ ID NO: 618247 - DNA, 20 bp, Artificial
  CRISPR gRNA sequence
atttatttcttctcaatatg

SEQ ID NO: 618248 - DNA, 20 bp, Artificial
  CRISPR gRNA sequence
tctcaactttggctgcacat

SEQ ID NO: 618249 - DNA, 20 bp, Artificial
  CRISPR gRNA sequence
tggctgcacattagaatcat

SEQ ID NO: 618250 - DNA, 20 bp, Artificial
  CRISPR gRNA sequence
cataccaatttaataaaaat

SEQ ID NO: 618251 - DNA, 20 bp, Artificial
  CRISPR gRNA sequence
cacagtgaaggtctagagcc

SEQ ID NO: 618252 - DNA, 20 bp, Artificial
  CRISPR gRNA sequence
aaggtctagagccatggata

SEQ ID NO: 618253 - DNA, 20 bp, Artificial
  CRISPR gRNA sequence
aaaaagctttctctaattta

SEQ ID NO: 618254 - DNA, 20 bp, Artificial
  CRISPR gRNA sequence
tagggtctttttcaaaaata

SEQ ID NO: 618255 - DNA, 20 bp, Artificial
  CRISPR gRNA sequence
ttcaaccattaatttaaggt

SEQ ID NO: 618256 - DNA, 20 bp, Artificial
  CRISPR gRNA sequence
gagctggaagttaggggaaa

SEQ ID NO: 618257 - DNA, 20 bp, Artificial
  CRISPR gRNA sequence
gatacaatcacccgtaatat

SEQ ID NO: 618258 - DNA, 20 bp, Artificial
  CRISPR gRNA sequence
tatgatgaaatcagttctta

SEQ ID NO: 618259 - DNA, 20 bp, Artificial
  CRISPR gRNA sequence
taattatattttgtaagtca

SEQ ID NO: 618260 - DNA, 20 bp, Artificial
  CRISPR gRNA sequence
tttgtaagtcatagaatctc

SEQ ID NO: 618261 - DNA, 20 bp, Artificial
  CRISPR gRNA sequence
tgactgatcttaaaagtcat

SEQ ID NO: 618262 - DNA, 20 bp, Artificial
  CRISPR gRNA sequence
aaggctaaatgtgaaggttt

SEQ ID NO: 618263 - DNA, 20 bp, Artificial
  CRISPR gRNA sequence
atactttaacatatgaaatc

SEQ ID NO: 618264 - DNA, 20 bp, Artificial
  CRISPR gRNA sequence
tttaacatatgaaatcaaga

SEQ ID NO: 618265 - DNA, 20 bp, Artificial
  CRISPR gRNA sequence
atgaaatcaagagtgaatgt

SEQ ID NO: 618266 - DNA, 20 bp, Artificial
  CRISPR gRNA sequence
taactgtttgcttcatggtg

SEQ ID NO: 618267 - DNA, 20 bp, Artificial
  CRISPR gRNA sequence
tccaactattgcatattttt

SEQ ID NO: 618268 - DNA, 20 bp, Artificial
  CRISPR gRNA sequence
ttagaatcaccatagttaac

SEQ ID NO: 618269 - DNA, 20 bp, Artificial
  CRISPR gRNA sequence
aaaaaaacttttgtaatctc

SEQ ID NO: 618270 - DNA, 20 bp, Artificial
  CRISPR gRNA sequence
ttatccacaaaagtagacac

SEQ ID NO: 618271 - DNA, 20 bp, Artificial
  CRISPR gRNA sequence
tcttaaaaattatgctgttg

SEQ ID NO: 618272 - DNA, 20 bp, Artificial
  CRISPR gRNA sequence
catgctaaaatgttaaaaat

SEQ ID NO: 618273 - DNA, 20 bp, Artificial
  CRISPR gRNA sequence
gttactttcataatcagaaa

SEQ ID NO: 618274 - DNA, 20 bp, Artificial
  CRISPR gRNA sequence
tagacattctaagacatctt

SEQ ID NO: 618275 - DNA, 20 bp, Artificial
  CRISPR gRNA sequence
tgtgaaattcgcatcaagtt

SEQ ID NO: 618276 - DNA, 20 bp, Artificial
  CRISPR gRNA sequence
gatcaagtaacatatcctta

SEQ ID NO: 618277 - DNA, 20 bp, Artificial
  CRISPR gRNA sequence
aagtaacatatccttagtga

SEQ ID NO: 618278 - DNA, 20 bp, Artificial
  CRISPR gRNA sequence
ggctcttttggacatatctt

SEQ ID NO: 618279 - DNA, 20 bp, Artificial
  CRISPR gRNA sequence
gtggttactgtaacccagag

SEQ ID NO: 618280 - DNA, 20 bp, Artificial
  CRISPR gRNA sequence
ttgttaaagatactacaaat

SEQ ID NO: 618281 - DNA, 20 bp, Artificial
  CRISPR gRNA sequence
tgagctacaaataccaaatt

SEQ ID NO: 618282 - DNA, 20 bp, Artificial
  CRISPR gRNA sequence
taccaaattaggaatttccc

SEQ ID NO: 618283 - DNA, 20 bp, Artificial
  CRISPR gRNA sequence
atgatggtaaaagttaccca

SEQ ID NO: 618284 - DNA, 20 bp, Artificial
  CRISPR gRNA sequence
tctaatatgcaccccagttt

SEQ ID NO: 618285 - DNA, 20 bp, Artificial
  CRISPR gRNA sequence
tttggggatcacgttttaaa

SEQ ID NO: 618286 - DNA, 20 bp, Artificial
  CRISPR gRNA sequence
atcacgttttaaaatgaatc

SEQ ID NO: 618287 - DNA, 20 bp, Artificial
  CRISPR gRNA sequence
tatctatatgcacatttatt

SEQ ID NO: 618288 - DNA, 20 bp, Artificial
  CRISPR gRNA sequence
ttttaatgttcacttactta

SEQ ID NO: 618289 - DNA, 20 bp, Artificial
  CRISPR gRNA sequence
tttccccaaagtctgtaact

SEQ ID NO: 618290 - DNA, 20 bp, Artificial
  CRISPR gRNA sequence
ttgtacttttagttgccttt

SEQ ID NO: 618291 - DNA, 20 bp, Artificial
  CRISPR gRNA sequence
atggatgtttatgaacaact

SEQ ID NO: 618292 - DNA, 20 bp, Artificial
  CRISPR gRNA sequence
gttcttcagacttgaaatct

SEQ ID NO: 618293 - DNA, 20 bp, Artificial
  CRISPR gRNA sequence
gagacttttcctcaagtcca

SEQ ID NO: 618294 - DNA, 20 bp, Artificial
  CRISPR gRNA sequence
cccttcatcccaagagcttt

SEQ ID NO: 618295 - DNA, 20 bp, Artificial
  CRISPR gRNA sequence
atctcagcctcagtgtgccc

SEQ ID NO: 618296 - DNA, 20 bp, Artificial
  CRISPR gRNA sequence
gatgttctctcccaggctag

SEQ ID NO: 618297 - DNA, 20 bp, Artificial
  CRISPR gRNA sequence
tctctgctgttgccagttta

SEQ ID NO: 618298 - DNA, 20 bp, Artificial
  CRISPR gRNA sequence
gacatactcagcatagtcag

SEQ ID NO: 618299 - DNA, 20 bp, Artificial
  CRISPR gRNA sequence
ttttcacatgttcacatctc

SEQ ID NO: 618300 - DNA, 20 bp, Artificial
  CRISPR gRNA sequence
cttttactaacttcccaaat

SEQ ID NO: 618301 - DNA, 20 bp, Artificial
  CRISPR gRNA sequence
taagaatgaccttctgttct

SEQ ID NO: 618302 - DNA, 20 bp, Artificial
  CRISPR gRNA sequence
taaagctagtggttctgtta

SEQ ID NO: 618303 - DNA, 20 bp, Artificial
  CRISPR gRNA sequence
aatatttcttgaggcttact

SEQ ID NO: 618304 - DNA, 20 bp, Artificial
  CRISPR gRNA sequence
cattataattaaaaagaaca

SEQ ID NO: 618305 - DNA, 20 bp, Artificial
  CRISPR gRNA sequence
cttagtttatattgacgatt

SEQ ID NO: 618306 - DNA, 20 bp, Artificial
  CRISPR gRNA sequence
tttaaactatagaggaggta

SEQ ID NO: 618307 - DNA, 20 bp, Artificial
  CRISPR gRNA sequence
gggggccactcagatagcag

SEQ ID NO: 618308 - DNA, 20 bp, Artificial
  CRISPR gRNA sequence
gagcctgctatggagggaga

SEQ ID NO: 618309 - DNA, 20 bp, Artificial
  CRISPR gRNA sequence
gtaatatactttattttttt

SEQ ID NO: 618310 - DNA, 20 bp, Artificial
  CRISPR gRNA sequence
atttttttgaggatttgggg

SEQ ID NO: 618311 - DNA, 20 bp, Artificial
  CRISPR gRNA sequence
tgaggatttggggaagaatt

SEQ ID NO: 618312 - DNA, 20 bp, Artificial
  CRISPR gRNA sequence
agtgttgaacactgacttgg

SEQ ID NO: 618313 - DNA, 20 bp, Artificial
  CRISPR gRNA sequence
atttatgatttttttaggtg

SEQ ID NO: 618314 - DNA, 20 bp, Artificial
  CRISPR gRNA sequence
gtgcttatcttctgtattac

SEQ ID NO: 618315 - DNA, 20 bp, Artificial
  CRISPR gRNA sequence
atagaagtctgccactccct

SEQ ID NO: 618316 - DNA, 20 bp, Artificial
  CRISPR gRNA sequence
aagttacattgaggacagaa

SEQ ID NO: 618317 - DNA, 20 bp, Artificial
  CRISPR gRNA sequence
gagctgggcaccaaaggaaa

SEQ ID NO: 618318 - DNA, 20 bp, Artificial
  CRISPR gRNA sequence
ctgtggctcgaacagggcgg

SEQ ID NO: 618319 - DNA, 20 bp, Artificial
  CRISPR gRNA sequence
cacaggggggactaacattg

SEQ ID NO: 618320 - DNA, 20 bp, Artificial
  CRISPR gRNA sequence
gataaaagaccagtagcctt

SEQ ID NO: 618321 - DNA, 20 bp, Artificial
  CRISPR gRNA sequence
ctgcactccagcctgggcaa

SEQ ID NO: 618322 - DNA, 20 bp, Artificial
  CRISPR gRNA sequence
ataaattaaataaaaatagt

SEQ ID NO: 618323 - DNA, 20 bp, Artificial
  CRISPR gRNA sequence
acagcttatactctctttca

SEQ ID NO: 618324 - DNA, 20 bp, Artificial
  CRISPR gRNA sequence
cttatactctctttcacaga

SEQ ID NO: 618325 - DNA, 20 bp, Artificial
  CRISPR gRNA sequence
taagtaaaatatattagcac

SEQ ID NO: 618326 - DNA, 20 bp, Artificial
  CRISPR gRNA sequence
gtgacagttacacagagaaa

SEQ ID NO: 618327 - DNA, 20 bp, Artificial
  CRISPR gRNA sequence
ctaattcctttcttcttcag

SEQ ID NO: 618328 - DNA, 20 bp, Artificial
  CRISPR gRNA sequence
ttcttcagacggatgatttc

SEQ ID NO: 618329 - DNA, 20 bp, Artificial
  CRISPR gRNA sequence
aatcaaaactcagccattga

SEQ ID NO: 618330 - DNA, 20 bp, Artificial
  CRISPR gRNA sequence
ttgtcattaatcaatactgt

SEQ ID NO: 618331 - DNA, 20 bp, Artificial
  CRISPR gRNA sequence
gtgtggttgttcaacctgtt

SEQ ID NO: 618332 - DNA, 20 bp, Artificial
  CRISPR gRNA sequence
atgagagctttcttcagata

SEQ ID NO: 618333 - DNA, 20 bp, Artificial
  CRISPR gRNA sequence
ttcagatatggaattaagtt

SEQ ID NO: 618334 - DNA, 20 bp, Artificial
  CRISPR gRNA sequence
ttatttttagtgaacccata

SEQ ID NO: 618335 - DNA, 20 bp, Artificial
  CRISPR gRNA sequence
ctgtaacgaactaccacaga

SEQ ID NO: 618336 - DNA, 20 bp, Artificial
  CRISPR gRNA sequence
ttcatgtgagggctgtgagg

SEQ ID NO: 618337 - DNA, 20 bp, Artificial
  CRISPR gRNA sequence
ttggcttgttttttggtgaa

SEQ ID NO: 618338 - DNA, 20 bp, Artificial
  CRISPR gRNA sequence
ccaaagcatcaaatagaaat

SEQ ID NO: 618339 - DNA, 20 bp, Artificial
  CRISPR gRNA sequence
aatgccaaagtaagtgagcc

SEQ ID NO: 618340 - DNA, 20 bp, Artificial
  CRISPR gRNA sequence
ccatgtacctgtgaccctct

SEQ ID NO: 618341 - DNA, 20 bp, Artificial
  CRISPR gRNA sequence
tatcaggagaaaatcagtgc

SEQ ID NO: 618342 - DNA, 20 bp, Artificial
  CRISPR gRNA sequence
agaaaatcagtgcttgagtc

SEQ ID NO: 618343 - DNA, 20 bp, Artificial
  CRISPR gRNA sequence
tgcttgagtcaaggatgctt

SEQ ID NO: 618344 - DNA, 20 bp, Artificial
  CRISPR gRNA sequence
caggaggtctctccccagct

SEQ ID NO: 618345 - DNA, 20 bp, Artificial
  CRISPR gRNA sequence
aaagaagctctgctagtgcc

SEQ ID NO: 618346 - DNA, 20 bp, Artificial
  CRISPR gRNA sequence
tctggtcataatcttttttc

SEQ ID NO: 618347 - DNA, 20 bp, Artificial
  CRISPR gRNA sequence
taagcatttaatctcaggca

SEQ ID NO: 618348 - DNA, 20 bp, Artificial
  CRISPR gRNA sequence
actaacccttctccccctta

SEQ ID NO: 618349 - DNA, 20 bp, Artificial
  CRISPR gRNA sequence
cctcctccttctccccgtaa

SEQ ID NO: 618350 - DNA, 20 bp, Artificial
  CRISPR gRNA sequence
ccttctccccgtaacagaat

SEQ ID NO: 618351 - DNA, 20 bp, Artificial
  CRISPR gRNA sequence
tacaaaccagattgggcctg

SEQ ID NO: 618352 - DNA, 20 bp, Artificial
  CRISPR gRNA sequence
aatgttctattacaaaagca

SEQ ID NO: 618353 - DNA, 20 bp, Artificial
  CRISPR gRNA sequence
aaagcagtggattttctagt

SEQ ID NO: 618354 - DNA, 20 bp, Artificial
  CRISPR gRNA sequence
ttctagttagaatcattctt

SEQ ID NO: 618355 - DNA, 20 bp, Artificial
  CRISPR gRNA sequence
tggtgtacttgaggaacagc

SEQ ID NO: 618356 - DNA, 20 bp, Artificial
  CRISPR gRNA sequence
aaagaggggagagatctgta

SEQ ID NO: 618357 - DNA, 20 bp, Artificial
  CRISPR gRNA sequence
tcatatatttcataaattat

SEQ ID NO: 618358 - DNA, 20 bp, Artificial
  CRISPR gRNA sequence
aattatctgggtcccatgtg

SEQ ID NO: 618359 - DNA, 20 bp, Artificial
  CRISPR gRNA sequence
ccaactagagcaggagcagt

SEQ ID NO: 618360 - DNA, 20 bp, Artificial
  CRISPR gRNA sequence
agagcctgttggacttgctg

SEQ ID NO: 618361 - DNA, 20 bp, Artificial
  CRISPR gRNA sequence
gtgagggaaaaagaggtcta

SEQ ID NO: 618362 - DNA, 20 bp, Artificial
  CRISPR gRNA sequence
tgtttggcttaagtagcctg

SEQ ID NO: 618363 - DNA, 20 bp, Artificial
  CRISPR gRNA sequence
gttttgaacaggtgaagctt

SEQ ID NO: 618364 - DNA, 20 bp, Artificial
  CRISPR gRNA sequence
tgaagcttgagagtcattcc

SEQ ID NO: 618365 - DNA, 20 bp, Artificial
  CRISPR gRNA sequence
tcctagaatctcaaatcaag

SEQ ID NO: 618366 - DNA, 20 bp, Artificial
  CRISPR gRNA sequence
taatcaaaatgtcttagcca

SEQ ID NO: 618367 - DNA, 20 bp, Artificial
  CRISPR gRNA sequence
tagccaaaggattcgagagc

SEQ ID NO: 618368 - DNA, 20 bp, Artificial
  CRISPR gRNA sequence
cgagagccaggatgctcctg

SEQ ID NO: 618369 - DNA, 20 bp, Artificial
  CRISPR gRNA sequence
tagtgtcctcacttataggt

SEQ ID NO: 618370 - DNA, 20 bp, Artificial
  CRISPR gRNA sequence
gggatatattacttatttca

SEQ ID NO: 618371 - DNA, 20 bp, Artificial
  CRISPR gRNA sequence
tttatttatttattttgaga

SEQ ID NO: 618372 - DNA, 20 bp, Artificial
  CRISPR gRNA sequence
tctcgctctgttgcccagac

SEQ ID NO: 618373 - DNA, 20 bp, Artificial
  CRISPR gRNA sequence
ctcactgcaacctccgcctt

SEQ ID NO: 618374 - DNA, 20 bp, Artificial
  CRISPR gRNA sequence
ctgtttttaaatatcagctt

SEQ ID NO: 618375 - DNA, 20 bp, Artificial
  CRISPR gRNA sequence
atatcagctttggaatgaaa

SEQ ID NO: 618376 - DNA, 20 bp, Artificial
  CRISPR gRNA sequence
aaattaatacttagtatatc

SEQ ID NO: 618377 - DNA, 20 bp, Artificial
  CRISPR gRNA sequence
accccatcaaaaagtgggca

SEQ ID NO: 618378 - DNA, 20 bp, Artificial
  CRISPR gRNA sequence
agataccatctcacaccagt

SEQ ID NO: 618379 - DNA, 20 bp, Artificial
  CRISPR gRNA sequence
aggaaacagcaggtgctgga

SEQ ID NO: 618380 - DNA, 20 bp, Artificial
  CRISPR gRNA sequence
agacagtgtggcaattcctc

SEQ ID NO: 618381 - DNA, 20 bp, Artificial
  CRISPR gRNA sequence
ttgacccagccatcccatta

SEQ ID NO: 618382 - DNA, 20 bp, Artificial
  CRISPR gRNA sequence
cattactgggtatataccca

SEQ ID NO: 618383 - DNA, 20 bp, Artificial
  CRISPR gRNA sequence
aaatgtccatcagtgataga

SEQ ID NO: 618384 - DNA, 20 bp, Artificial
  CRISPR gRNA sequence
aatgtggcacatatacacca

SEQ ID NO: 618385 - DNA, 20 bp, Artificial
  CRISPR gRNA sequence
aatactatgcagccacgaaa

SEQ ID NO: 618386 - DNA, 20 bp, Artificial
  CRISPR gRNA sequence
ctatgcagccacgaaaaagg

SEQ ID NO: 618387 - DNA, 20 bp, Artificial
  CRISPR gRNA sequence
ttcatgtcctttgtagggac

SEQ ID NO: 618388 - DNA, 20 bp, Artificial
  CRISPR gRNA sequence
acaatgagaacacttggaca

SEQ ID NO: 618389 - DNA, 20 bp, Artificial
  CRISPR gRNA sequence
tcacacactggggcctgtca

SEQ ID NO: 618390 - DNA, 20 bp, Artificial
  CRISPR gRNA sequence
ggggcctgtcatggggtgca

SEQ ID NO: 618391 - DNA, 20 bp, Artificial
  CRISPR gRNA sequence
catggggtgcagggagtggg

SEQ ID NO: 618392 - DNA, 20 bp, Artificial
  CRISPR gRNA sequence
gcagggagtggggagggtag

SEQ ID NO: 618393 - DNA, 20 bp, Artificial
  CRISPR gRNA sequence
agatatacctaatgtaaatg

SEQ ID NO: 618394 - DNA, 20 bp, Artificial
  CRISPR gRNA sequence
ctaatgtaaatgatgagtta

SEQ ID NO: 618395 - DNA, 20 bp, Artificial
  CRISPR gRNA sequence
aattaaaaaataaattagta

SEQ ID NO: 618396 - DNA, 20 bp, Artificial
  CRISPR gRNA sequence
aaacaactttttctttttaa

SEQ ID NO: 618397 - DNA, 20 bp, Artificial
  CRISPR gRNA sequence
gaactacaaagtattaaaat

SEQ ID NO: 618398 - DNA, 20 bp, Artificial
  CRISPR gRNA sequence
aaagtattaaaatcaggatt

SEQ ID NO: 618399 - DNA, 20 bp, Artificial
  CRISPR gRNA sequence
gcgtacgtgtgaggaacttt

SEQ ID NO: 618400 - DNA, 20 bp, Artificial
  CRISPR gRNA sequence
ttataaatgtgattagtgac

SEQ ID NO: 618401 - DNA, 20 bp, Artificial
  CRISPR gRNA sequence
tcaaagttcccacagaaata

SEQ ID NO: 618402 - DNA, 20 bp, Artificial
  CRISPR gRNA sequence
ttttttttcctctgctctgc

SEQ ID NO: 618403 - DNA, 20 bp, Artificial
  CRISPR gRNA sequence
tatcaagacctttgatttgc

SEQ ID NO: 618404 - DNA, 20 bp, Artificial
  CRISPR gRNA sequence
attgtggaaggtgttttatt

SEQ ID NO: 618405 - DNA, 20 bp, Artificial
  CRISPR gRNA sequence
ggaaggtgttttattcagaa

SEQ ID NO: 618406 - DNA, 20 bp, Artificial
  CRISPR gRNA sequence
aatagagtaaatatatatta

SEQ ID NO: 618407 - DNA, 20 bp, Artificial
  CRISPR gRNA sequence
gttaataatagttgattgac

SEQ ID NO: 618408 - DNA, 20 bp, Artificial
  CRISPR gRNA sequence
agttgattgacagggatgtg

SEQ ID NO: 618409 - DNA, 20 bp, Artificial
  CRISPR gRNA sequence
attccacactaaactctcta

SEQ ID NO: 618410 - DNA, 20 bp, Artificial
  CRISPR gRNA sequence
gcctgactgtttggaggctg

SEQ ID NO: 618411 - DNA, 20 bp, Artificial
  CRISPR gRNA sequence
tgtttggaggctggagagta

SEQ ID NO: 618412 - DNA, 20 bp, Artificial
  CRISPR gRNA sequence
agagtagggggtctctctga

SEQ ID NO: 618413 - DNA, 20 bp, Artificial
  CRISPR gRNA sequence
agcaatctctggacatcttt

SEQ ID NO: 618414 - DNA, 20 bp, Artificial
  CRISPR gRNA sequence
cctgaactaccttaatacca

SEQ ID NO: 618415 - DNA, 20 bp, Artificial
  CRISPR gRNA sequence
ctaccttaataccatgggat

SEQ ID NO: 618416 - DNA, 20 bp, Artificial
  CRISPR gRNA sequence
cttccaactcttttttcttt

SEQ ID NO: 618417 - DNA, 20 bp, Artificial
  CRISPR gRNA sequence
tttttggatgtaggtatttg

SEQ ID NO: 618418 - DNA, 20 bp, Artificial
  CRISPR gRNA sequence
tcaaacagttacagcattcc

SEQ ID NO: 618419 - DNA, 20 bp, Artificial
  CRISPR gRNA sequence
gcattccagggattctttcc

SEQ ID NO: 618420 - DNA, 20 bp, Artificial
  CRISPR gRNA sequence
ctggattctacatgctcaca

SEQ ID NO: 618421 - DNA, 20 bp, Artificial
  CRISPR gRNA sequence
atgctcacatggagttatat

SEQ ID NO: 618422 - DNA, 20 bp, Artificial
  CRISPR gRNA sequence
ttgaataccaagaagtattg

SEQ ID NO: 618423 - DNA, 20 bp, Artificial
  CRISPR gRNA sequence
caagtaatttatgtttttag

SEQ ID NO: 618424 - DNA, 20 bp, Artificial
  CRISPR gRNA sequence
catttggtgttgccctcagt

SEQ ID NO: 618425 - DNA, 20 bp, Artificial
  CRISPR gRNA sequence
ctcaagtttaagaacttggc

SEQ ID NO: 618426 - DNA, 20 bp, Artificial
  CRISPR gRNA sequence
gaaagtctcaacattttcca

SEQ ID NO: 618427 - DNA, 20 bp, Artificial
  CRISPR gRNA sequence
aacaaggctgcaacctcctt

SEQ ID NO: 618428 - DNA, 20 bp, Artificial
  CRISPR gRNA sequence
aacataaagaggttatacag

SEQ ID NO: 618429 - DNA, 20 bp, Artificial
  CRISPR gRNA sequence
aggatgcgatagttcttaaa

SEQ ID NO: 618430 - DNA, 20 bp, Artificial
  CRISPR gRNA sequence
ttcattctacagattatgtt

SEQ ID NO: 618431 - DNA, 20 bp, Artificial
  CRISPR gRNA sequence
ttaatgctgcaacaccttca

SEQ ID NO: 618432 - DNA, 20 bp, Artificial
  CRISPR gRNA sequence
aaccagcactgccaactctc

SEQ ID NO: 618433 - DNA, 20 bp, Artificial
  CRISPR gRNA sequence
ctgccaactctcatgagttg

SEQ ID NO: 618434 - DNA, 20 bp, Artificial
  CRISPR gRNA sequence
gaaactttaaaaatagtttc

SEQ ID NO: 618435 - DNA, 20 bp, Artificial
  CRISPR gRNA sequence
gtttctggaataagatcatg

SEQ ID NO: 618436 - DNA, 20 bp, Artificial
  CRISPR gRNA sequence
ttaaacaaagccatgtttaa

SEQ ID NO: 618437 - DNA, 20 bp, Artificial
  CRISPR gRNA sequence
aagagaaagatgacttgggg

SEQ ID NO: 618438 - DNA, 20 bp, Artificial
  CRISPR gRNA sequence
cagccactgtgttaagtgcc

SEQ ID NO: 618439 - DNA, 20 bp, Artificial
  CRISPR gRNA sequence
taagtgcctggaatgcagag

SEQ ID NO: 618440 - DNA, 20 bp, Artificial
  CRISPR gRNA sequence
agagatgaataagattgttc

SEQ ID NO: 618441 - DNA, 20 bp, Artificial
  CRISPR gRNA sequence
ttcaccaaaattggacagaa

SEQ ID NO: 618442 - DNA, 20 bp, Artificial
  CRISPR gRNA sequence
aatcacattgaaactggacc

SEQ ID NO: 618443 - DNA, 20 bp, Artificial
  CRISPR gRNA sequence
aatgaggacatccaatgcaa

SEQ ID NO: 618444 - DNA, 20 bp, Artificial
  CRISPR gRNA sequence
agggatactacatgagcaaa

SEQ ID NO: 618445 - DNA, 20 bp, Artificial
  CRISPR gRNA sequence
cagaaaatacttaagaaagg

SEQ ID NO: 618446 - DNA, 20 bp, Artificial
  CRISPR gRNA sequence
ttttttttcaatttcttttt

SEQ ID NO: 618447 - DNA, 20 bp, Artificial
  CRISPR gRNA sequence
acttttctaacactgaccat

SEQ ID NO: 618448 - DNA, 20 bp, Artificial
  CRISPR gRNA sequence
agaatgaaattaacattgct

SEQ ID NO: 618449 - DNA, 20 bp, Artificial
  CRISPR gRNA sequence
gtgagtaaactgtagtttag

SEQ ID NO: 618450 - DNA, 20 bp, Artificial
  CRISPR gRNA sequence
aggaacagaactattattta

SEQ ID NO: 618451 - DNA, 20 bp, Artificial
  CRISPR gRNA sequence
cagctggtaagtgacaggtt

SEQ ID NO: 618452 - DNA, 20 bp, Artificial
  CRISPR gRNA sequence
gggatgcaaaatcaaggtgg

SEQ ID NO: 618453 - DNA, 20 bp, Artificial
  CRISPR gRNA sequence
tgtagtttagacaggtgtac

SEQ ID NO: 618454 - DNA, 20 bp, Artificial
  CRISPR gRNA sequence
ggcaggtgacaagtgtcagt

SEQ ID NO: 618455 - DNA, 20 bp, Artificial
  CRISPR gRNA sequence
agacaatttttccacagcct

SEQ ID NO: 618456 - DNA, 20 bp, Artificial
  CRISPR gRNA sequence
ccacagcctgagggttagtg

SEQ ID NO: 618457 - DNA, 20 bp, Artificial
  CRISPR gRNA sequence
gggttagtgggggatggttt

SEQ ID NO: 618458 - DNA, 20 bp, Artificial
  CRISPR gRNA sequence
ttctataactcatcataatg

SEQ ID NO: 618459 - DNA, 20 bp, Artificial
  CRISPR gRNA sequence
tcatcataatgtagaatctg

SEQ ID NO: 618460 - DNA, 20 bp, Artificial
  CRISPR gRNA sequence
tagatagtcccagatagtct

SEQ ID NO: 618461 - DNA, 20 bp, Artificial
  CRISPR gRNA sequence
actttgggaggccgaggtgg

SEQ ID NO: 618462 - DNA, 20 bp, Artificial
  CRISPR gRNA sequence
tgggcggatcacctgaggtt

SEQ ID NO: 618463 - DNA, 20 bp, Artificial
  CRISPR gRNA sequence
tcccagctaggctgaggcag

SEQ ID NO: 618464 - DNA, 20 bp, Artificial
  CRISPR gRNA sequence
aaaaaggttcgccgtcctat

SEQ ID NO: 618465 - DNA, 20 bp, Artificial
  CRISPR gRNA sequence
gttcctactggtccctggcc

SEQ ID NO: 618466 - DNA, 20 bp, Artificial
  CRISPR gRNA sequence
tggtccctggcctggggttt

SEQ ID NO: 618467 - DNA, 20 bp, Artificial
  CRISPR gRNA sequence
aacttcaaacattgcaaaag

SEQ ID NO: 618468 - DNA, 20 bp, Artificial
  CRISPR gRNA sequence
atgcttttctggacctctaa

SEQ ID NO: 618469 - DNA, 20 bp, Artificial
  CRISPR gRNA sequence
gtgaaatgtctccagtgttt

SEQ ID NO: 618470 - DNA, 20 bp, Artificial
  CRISPR gRNA sequence
agtgtttatggatgtaataa

SEQ ID NO: 618471 - DNA, 20 bp, Artificial
  CRISPR gRNA sequence
aaaaattgtcagtgaaattt

SEQ ID NO: 618472 - DNA, 20 bp, Artificial
  CRISPR gRNA sequence
gagtctttttgctatctgta

SEQ ID NO: 618473 - DNA, 20 bp, Artificial
  CRISPR gRNA sequence
acactcaccaaactttgaag

SEQ ID NO: 618474 - DNA, 20 bp, Artificial
  CRISPR gRNA sequence
atttcttcatattctgtata

SEQ ID NO: 618475 - DNA, 20 bp, Artificial
  CRISPR gRNA sequence
tattctgtatactgagtgcc

SEQ ID NO: 618476 - DNA, 20 bp, Artificial
  CRISPR gRNA sequence
tactgagtgccttgagtaat

SEQ ID NO: 618477 - DNA, 20 bp, Artificial
  CRISPR gRNA sequence
cttgagtaatttgaatgata

SEQ ID NO: 618478 - DNA, 20 bp, Artificial
  CRISPR gRNA sequence
agttctaaatccaataaact

SEQ ID NO: 618479 - DNA, 20 bp, Artificial
  CRISPR gRNA sequence
ttttaaagttgacttagtca

SEQ ID NO: 618480 - DNA, 20 bp, Artificial
  CRISPR gRNA sequence
cttgcattaatataacatca

SEQ ID NO: 618481 - DNA, 20 bp, Artificial
  CRISPR gRNA sequence
aatttggctgtaaacttctt

SEQ ID NO: 618482 - DNA, 20 bp, Artificial
  CRISPR gRNA sequence
gctgtaaacttcttgagagt

SEQ ID NO: 618483 - DNA, 20 bp, Artificial
  CRISPR gRNA sequence
tcctagatatttcatcacta

SEQ ID NO: 618484 - DNA, 20 bp, Artificial
  CRISPR gRNA sequence
cacttgcctttaacttgatc

SEQ ID NO: 618485 - DNA, 20 bp, Artificial
  CRISPR gRNA sequence
cagacctctgacctttacaa

SEQ ID NO: 618486 - DNA, 20 bp, Artificial
  CRISPR gRNA sequence
gattctggaccctaccccca

SEQ ID NO: 618487 - DNA, 20 bp, Artificial
  CRISPR gRNA sequence
tacccccagaggatattagg

SEQ ID NO: 618488 - DNA, 20 bp, Artificial
  CRISPR gRNA sequence
atgattttatggtttgctct

SEQ ID NO: 618489 - DNA, 20 bp, Artificial
  CRISPR gRNA sequence
tatggtttgctctcagggtc

SEQ ID NO: 618490 - DNA, 20 bp, Artificial
  CRISPR gRNA sequence
gcacatgttattcccccttc

SEQ ID NO: 618491 - DNA, 20 bp, Artificial
  CRISPR gRNA sequence
tgaaacttcatgtttcaagg

SEQ ID NO: 618492 - DNA, 20 bp, Artificial
  CRISPR gRNA sequence
tttatatcttctccttatac

SEQ ID NO: 618493 - DNA, 20 bp, Artificial
  CRISPR gRNA sequence
gtagttcaataaatgtttaa

SEQ ID NO: 618494 - DNA, 20 bp, Artificial
  CRISPR gRNA sequence
ttcaataaatgtttaaaaga

SEQ ID NO: 618495 - DNA, 20 bp, Artificial
  CRISPR gRNA sequence
attacttctgtgactttgtt

SEQ ID NO: 618496 - DNA, 20 bp, Artificial
  CRISPR gRNA sequence
acctgtcctgcatctacttg

SEQ ID NO: 618497 - DNA, 20 bp, Artificial
  CRISPR gRNA sequence
cttggaggatattatagata

SEQ ID NO: 618498 - DNA, 20 bp, Artificial
  CRISPR gRNA sequence
attatagatactggatttaa

SEQ ID NO: 618499 - DNA, 20 bp, Artificial
  CRISPR gRNA sequence
tgctccagtttgttgattgc

SEQ ID NO: 618500 - DNA, 20 bp, Artificial
  CRISPR gRNA sequence
aatttttttttctttatgaa

SEQ ID NO: 618501 - DNA, 20 bp, Artificial
  CRISPR gRNA sequence
aacatttcatcccttattaa

SEQ ID NO: 618502 - DNA, 20 bp, Artificial
  CRISPR gRNA sequence
gttgcaattgtcaaacctat

SEQ ID NO: 618503 - DNA, 20 bp, Artificial
  CRISPR gRNA sequence
tcaaacctattagaattagt

SEQ ID NO: 618504 - DNA, 20 bp, Artificial
  CRISPR gRNA sequence
tattagaattagttaggatt

SEQ ID NO: 618505 - DNA, 20 bp, Artificial
  CRISPR gRNA sequence
cttacagtcatacattatta

SEQ ID NO: 618506 - DNA, 20 bp, Artificial
  CRISPR gRNA sequence
tcaaccattttcaaagtttt

SEQ ID NO: 618507 - DNA, 20 bp, Artificial
  CRISPR gRNA sequence
tttcctttaatgttgaaaat

SEQ ID NO: 618508 - DNA, 20 bp, Artificial
  CRISPR gRNA sequence
tgacacagtatttgtaaatt

SEQ ID NO: 618509 - DNA, 20 bp, Artificial
  CRISPR gRNA sequence
tgtaaattatgggtgggcaa

SEQ ID NO: 618510 - DNA, 20 bp, Artificial
  CRISPR gRNA sequence
tccatattatcacatcataa

SEQ ID NO: 618511 - DNA, 20 bp, Artificial
  CRISPR gRNA sequence
gattttttaaatatatactt

SEQ ID NO: 618512 - DNA, 20 bp, Artificial
  CRISPR gRNA sequence
cttatctctttttctcttag

SEQ ID NO: 618513 - DNA, 20 bp, Artificial
  CRISPR gRNA sequence
tagttgtaagttgtgggaac

SEQ ID NO: 618514 - DNA, 20 bp, Artificial
  CRISPR gRNA sequence
gtaagttgtgggaactggaa

SEQ ID NO: 618515 - DNA, 20 bp, Artificial
  CRISPR gRNA sequence
gtttcctaaaaagcttttgg

SEQ ID NO: 618516 - DNA, 20 bp, Artificial
  CRISPR gRNA sequence
ggtgataggagaaatgaaaa

SEQ ID NO: 618517 - DNA, 20 bp, Artificial
  CRISPR gRNA sequence
aatacaaagtgtggttcatt

SEQ ID NO: 618518 - DNA, 20 bp, Artificial
  CRISPR gRNA sequence
gaaagctgggcatcaaactg

SEQ ID NO: 618519 - DNA, 20 bp, Artificial
  CRISPR gRNA sequence
cactaattagatgccttaag

SEQ ID NO: 618520 - DNA, 20 bp, Artificial
  CRISPR gRNA sequence
ttttaaattttttgtataga

SEQ ID NO: 618521 - DNA, 20 bp, Artificial
  CRISPR gRNA sequence
agttggttaacatgggagag

SEQ ID NO: 618522 - DNA, 20 bp, Artificial
  CRISPR gRNA sequence
ggtttggcaggaaatgacag

SEQ ID NO: 618523 - DNA, 20 bp, Artificial
  CRISPR gRNA sequence
gcagaatttctttctatatg

SEQ ID NO: 618524 - DNA, 20 bp, Artificial
  CRISPR gRNA sequence
cttctggactcacttttcaa

SEQ ID NO: 618525 - DNA, 20 bp, Artificial
  CRISPR gRNA sequence
agttttcttgtacgtttact

SEQ ID NO: 618526 - DNA, 20 bp, Artificial
  CRISPR gRNA sequence
actaaataaactgtttaagt

SEQ ID NO: 618527 - DNA, 20 bp, Artificial
  CRISPR gRNA sequence
ataatataactcataaagaa

SEQ ID NO: 618528 - DNA, 20 bp, Artificial
  CRISPR gRNA sequence
agagtttctcataacctctg

SEQ ID NO: 618529 - DNA, 20 bp, Artificial
  CRISPR gRNA sequence
atactgattttgtttctgga

SEQ ID NO: 618530 - DNA, 20 bp, Artificial
  CRISPR gRNA sequence
agaatatagtaattgttgct

SEQ ID NO: 618531 - DNA, 20 bp, Artificial
  CRISPR gRNA sequence
aaacataaatctttgtattc

SEQ ID NO: 618532 - DNA, 20 bp, Artificial
  CRISPR gRNA sequence
acataatctgtttacacttg

SEQ ID NO: 618533 - DNA, 20 bp, Artificial
  CRISPR gRNA sequence
ctgtttacacttgaagagtt

SEQ ID NO: 618534 - DNA, 20 bp, Artificial
  CRISPR gRNA sequence
acttgaagagttgaggatac

SEQ ID NO: 618535 - DNA, 20 bp, Artificial
  CRISPR gRNA sequence
ggaatatgtgcgtttatcag

SEQ ID NO: 618536 - DNA, 20 bp, Artificial
  CRISPR gRNA sequence
tttatcagtgggatccttag

SEQ ID NO: 618537 - DNA, 20 bp, Artificial
  CRISPR gRNA sequence
ataaagctcttaagacggaa

SEQ ID NO: 618538 - DNA, 20 bp, Artificial
  CRISPR gRNA sequence
attttagagagaaatataga

SEQ ID NO: 618539 - DNA, 20 bp, Artificial
  CRISPR gRNA sequence
gattaaaaaaaataagtaca

SEQ ID NO: 618540 - DNA, 20 bp, Artificial
  CRISPR gRNA sequence
aaataagtacatagaatagg

SEQ ID NO: 618541 - DNA, 20 bp, Artificial
  CRISPR gRNA sequence
cagtactttgggaggccgag

SEQ ID NO: 618542 - DNA, 20 bp, Artificial
  CRISPR gRNA sequence
actttgggaggccgaggagg

SEQ ID NO: 618543 - DNA, 20 bp, Artificial
  CRISPR gRNA sequence
tacttgggaggctggggcag

SEQ ID NO: 618544 - DNA, 20 bp, Artificial
  CRISPR gRNA sequence
aaaaaaaaaaaaaaagtaca

SEQ ID NO: 618545 - DNA, 20 bp, Artificial
  CRISPR gRNA sequence
gtattattttacttgagcta

SEQ ID NO: 618546 - DNA, 20 bp, Artificial
  CRISPR gRNA sequence
ctataacacttgtgcttttc

SEQ ID NO: 618547 - DNA, 20 bp, Artificial
  CRISPR gRNA sequence
ttatcatattcatttggtgt

SEQ ID NO: 618548 - DNA, 20 bp, Artificial
  CRISPR gRNA sequence
gtgttagaattctgtaaatg

SEQ ID NO: 618549 - DNA, 20 bp, Artificial
  CRISPR gRNA sequence
ccttctctataccagattca

SEQ ID NO: 618550 - DNA, 20 bp, Artificial
  CRISPR gRNA sequence
gtgaatttcatgtatataag

SEQ ID NO: 618551 - DNA, 20 bp, Artificial
  CRISPR gRNA sequence
ttatttattttttttggaga

SEQ ID NO: 618552 - DNA, 20 bp, Artificial
  CRISPR gRNA sequence
tctggctttgtcgcccaggc

SEQ ID NO: 618553 - DNA, 20 bp, Artificial
  CRISPR gRNA sequence
gctcacgcaagctccgcctc

SEQ ID NO: 618554 - DNA, 20 bp, Artificial
  CRISPR gRNA sequence
ccttctcctgcctcagcctc

SEQ ID NO: 618555 - DNA, 20 bp, Artificial
  CRISPR gRNA sequence
tggactttcatttcttaata

SEQ ID NO: 618556 - DNA, 20 bp, Artificial
  CRISPR gRNA sequence
catttcttaatagtgaattg

SEQ ID NO: 618557 - DNA, 20 bp, Artificial
  CRISPR gRNA sequence
ttaatagtgaattgtagaat

SEQ ID NO: 618558 - DNA, 20 bp, Artificial
  CRISPR gRNA sequence
tgaattgtagaatttggatg

SEQ ID NO: 618559 - DNA, 20 bp, Artificial
  CRISPR gRNA sequence
aaatattataataactagca

SEQ ID NO: 618560 - DNA, 20 bp, Artificial
  CRISPR gRNA sequence
taataactagcagtgaatat

SEQ ID NO: 618561 - DNA, 20 bp, Artificial
  CRISPR gRNA sequence
tgaatatatgaatttacgtt

SEQ ID NO: 618562 - DNA, 20 bp, Artificial
  CRISPR gRNA sequence
accatgtttaatttttgtgt

SEQ ID NO: 618563 - DNA, 20 bp, Artificial
  CRISPR gRNA sequence
cttgtttatattacatgttt

SEQ ID NO: 618564 - DNA, 20 bp, Artificial
  CRISPR gRNA sequence
gtagttttgtttcggtgttt

SEQ ID NO: 618565 - DNA, 20 bp, Artificial
  CRISPR gRNA sequence
tttcggtgttttagaataaa

SEQ ID NO: 618566 - DNA, 20 bp, Artificial
  CRISPR gRNA sequence
ataaatggaatttctataaa

SEQ ID NO: 618567 - DNA, 20 bp, Artificial
  CRISPR gRNA sequence
gaaaagcattagttttgtaa

SEQ ID NO: 618568 - DNA, 20 bp, Artificial
  CRISPR gRNA sequence
tgtgtgttttaaatttgtat

SEQ ID NO: 618569 - DNA, 20 bp, Artificial
  CRISPR gRNA sequence
tgccattaacctaaatttgg

SEQ ID NO: 618570 - DNA, 20 bp, Artificial
  CRISPR gRNA sequence
tatttgcttatgattatttt

SEQ ID NO: 618571 - DNA, 20 bp, Artificial
  CRISPR gRNA sequence
ttctttccatattctttagt

SEQ ID NO: 618572 - DNA, 20 bp, Artificial
  CRISPR gRNA sequence
tcttcatttctcacccaaac

SEQ ID NO: 618573 - DNA, 20 bp, Artificial
  CRISPR gRNA sequence
acgaggatggttaaaataca

SEQ ID NO: 618574 - DNA, 20 bp, Artificial
  CRISPR gRNA sequence
attaatcaaatgtttccttt

SEQ ID NO: 618575 - DNA, 20 bp, Artificial
  CRISPR gRNA sequence
ttgtattcagattctcaaat

SEQ ID NO: 618576 - DNA, 20 bp, Artificial
  CRISPR gRNA sequence
acattgggggaactcaaata

SEQ ID NO: 618577 - DNA, 20 bp, Artificial
  CRISPR gRNA sequence
taagatatatattttttcta

SEQ ID NO: 618578 - DNA, 20 bp, Artificial
  CRISPR gRNA sequence
gagtataacttgaaagtact

SEQ ID NO: 618579 - DNA, 20 bp, Artificial
  CRISPR gRNA sequence
catatttaatgttaataaat

SEQ ID NO: 618580 - DNA, 20 bp, Artificial
  CRISPR gRNA sequence
agaacagaacaaaactttaa

SEQ ID NO: 618581 - DNA, 20 bp, Artificial
  CRISPR gRNA sequence
gaacagtttgaaagccactt

SEQ ID NO: 618582 - DNA, 20 bp, Artificial
  CRISPR gRNA sequence
aagaaaacaaaccgcctttt

SEQ ID NO: 618583 - DNA, 20 bp, Artificial
  CRISPR gRNA sequence
tccatgcttgtctgtctagc

SEQ ID NO: 618584 - DNA, 20 bp, Artificial
  CRISPR gRNA sequence
catcatattaataaggtttg

SEQ ID NO: 618585 - DNA, 20 bp, Artificial
  CRISPR gRNA sequence
tttgatgaatcaaattttta

SEQ ID NO: 618586 - DNA, 20 bp, Artificial
  CRISPR gRNA sequence
gcaaagaccaaagtacagaa

SEQ ID NO: 618587 - DNA, 20 bp, Artificial
  CRISPR gRNA sequence
atctagattcttagtgaaat

SEQ ID NO: 618588 - DNA, 20 bp, Artificial
  CRISPR gRNA sequence
atgtaagcaaaatccattga

SEQ ID NO: 618589 - DNA, 20 bp, Artificial
  CRISPR gRNA sequence
aaaatccattgattggattt

SEQ ID NO: 618590 - DNA, 20 bp, Artificial
  CRISPR gRNA sequence
tattctaactaatgttccat

SEQ ID NO: 618591 - DNA, 20 bp, Artificial
  CRISPR gRNA sequence
tgatgccataatattataaa

SEQ ID NO: 618592 - DNA, 20 bp, Artificial
  CRISPR gRNA sequence
ctgtgtatatgtagatacca

SEQ ID NO: 618593 - DNA, 20 bp, Artificial
  CRISPR gRNA sequence
tgtaatagttataaacatgt

SEQ ID NO: 618594 - DNA, 20 bp, Artificial
  CRISPR gRNA sequence
ttccttgacttagttttata

SEQ ID NO: 618595 - DNA, 20 bp, Artificial
  CRISPR gRNA sequence
gttcatgtttttagttagag

SEQ ID NO: 618596 - DNA, 20 bp, Artificial
  CRISPR gRNA sequence
atgatatttaaatcagtgct

SEQ ID NO: 618597 - DNA, 20 bp, Artificial
  CRISPR gRNA sequence
tggatatttgcaacaaaata

SEQ ID NO: 618598 - DNA, 20 bp, Artificial
  CRISPR gRNA sequence
ttgtcactttctcagtttga

SEQ ID NO: 618599 - DNA, 20 bp, Artificial
  CRISPR gRNA sequence
gggaaatatgattataggag

SEQ ID NO: 618600 - DNA, 20 bp, Artificial
  CRISPR gRNA sequence
ggtcaaataggtacaagttt

SEQ ID NO: 618601 - DNA, 20 bp, Artificial
  CRISPR gRNA sequence
ggtacaagtttctggatccc

SEQ ID NO: 618602 - DNA, 20 bp, Artificial
  CRISPR gRNA sequence
aaatttatctttttctactt

SEQ ID NO: 618603 - DNA, 20 bp, Artificial
  CRISPR gRNA sequence
agataattcttcacatcatt

SEQ ID NO: 618604 - DNA, 20 bp, Artificial
  CRISPR gRNA sequence
tgtaacatgctattaaacat

SEQ ID NO: 618605 - DNA, 20 bp, Artificial
  CRISPR gRNA sequence
aaacatagatcatgtcaata

SEQ ID NO: 618606 - DNA, 20 bp, Artificial
  CRISPR gRNA sequence
tacttcttctgtggtaaata

SEQ ID NO: 618607 - DNA, 20 bp, Artificial
  CRISPR gRNA sequence
actaaccagcagtagaacct

SEQ ID NO: 618608 - DNA, 20 bp, Artificial
  CRISPR gRNA sequence
tttatttgtgatgtttttca

SEQ ID NO: 618609 - DNA, 20 bp, Artificial
  CRISPR gRNA sequence
tccacttcccccaaatcaca

SEQ ID NO: 618610 - DNA, 20 bp, Artificial
  CRISPR gRNA sequence
gagacaatactgtacttata

SEQ ID NO: 618611 - DNA, 20 bp, Artificial
  CRISPR gRNA sequence
atactggataagtattctgt

SEQ ID NO: 618612 - DNA, 20 bp, Artificial
  CRISPR gRNA sequence
gtattctgtctgaatattta

SEQ ID NO: 618613 - DNA, 20 bp, Artificial
  CRISPR gRNA sequence
ctgaatttatgcattattaa

SEQ ID NO: 618614 - DNA, 20 bp, Artificial
  CRISPR gRNA sequence
acattgattgaccatcattt

SEQ ID NO: 618615 - DNA, 20 bp, Artificial
  CRISPR gRNA sequence
gagtattgaagaagcttaag

SEQ ID NO: 618616 - DNA, 20 bp, Artificial
  CRISPR gRNA sequence
agcataaattcagtctctaa

SEQ ID NO: 618617 - DNA, 20 bp, Artificial
  CRISPR gRNA sequence
taaattcagtctctaactga

SEQ ID NO: 618618 - DNA, 20 bp, Artificial
  CRISPR gRNA sequence
gtgttcatgtgtcattttcg

SEQ ID NO: 618619 - DNA, 20 bp, Artificial
  CRISPR gRNA sequence
taggccatacttaattttta

SEQ ID NO: 618620 - DNA, 20 bp, Artificial
  CRISPR gRNA sequence
tcttaacagacttaactttc

SEQ ID NO: 618621 - DNA, 20 bp, Artificial
  CRISPR gRNA sequence
tatctttgccttgtctatct

SEQ ID NO: 618622 - DNA, 20 bp, Artificial
  CRISPR gRNA sequence
tggtgacattattccactac

SEQ ID NO: 618623 - DNA, 20 bp, Artificial
  CRISPR gRNA sequence
atatatttgctggcgacaaa

SEQ ID NO: 618624 - DNA, 20 bp, Artificial
  CRISPR gRNA sequence
caaaatgagtttttaaagaa

SEQ ID NO: 618625 - DNA, 20 bp, Artificial
  CRISPR gRNA sequence
aaaaaaaaaaaacaaaggaa

SEQ ID NO: 618626 - DNA, 20 bp, Artificial
  CRISPR gRNA sequence
ccaattagtgacagaaattt

SEQ ID NO: 618627 - DNA, 20 bp, Artificial
  CRISPR gRNA sequence
ttacccctgtcatgctgggc

SEQ ID NO: 618628 - DNA, 20 bp, Artificial
  CRISPR gRNA sequence
tttcaaaacagaactgacaa

SEQ ID NO: 618629 - DNA, 20 bp, Artificial
  CRISPR gRNA sequence
cgatcttgtatctaatgatg

SEQ ID NO: 618630 - DNA, 20 bp, Artificial
  CRISPR gRNA sequence
atctaatgatggtgaatata

SEQ ID NO: 618631 - DNA, 20 bp, Artificial
  CRISPR gRNA sequence
aatattctgctttctgataa

SEQ ID NO: 618632 - DNA, 20 bp, Artificial
  CRISPR gRNA sequence
gggctacaagtccttagttc

SEQ ID NO: 618633 - DNA, 20 bp, Artificial
  CRISPR gRNA sequence
tccttagttcaggaatttaa

SEQ ID NO: 618634 - DNA, 20 bp, Artificial
  CRISPR gRNA sequence
acacagacagacacttgtag

SEQ ID NO: 618635 - DNA, 20 bp, Artificial
  CRISPR gRNA sequence
ttgtctccacctaatataaa

SEQ ID NO: 618636 - DNA, 20 bp, Artificial
  CRISPR gRNA sequence
tcttaccccataaatatttg

SEQ ID NO: 618637 - DNA, 20 bp, Artificial
  CRISPR gRNA sequence
cataaatatttgttgagtga

SEQ ID NO: 618638 - DNA, 20 bp, Artificial
  CRISPR gRNA sequence
cccattaatggaaaaagact

SEQ ID NO: 618639 - DNA, 20 bp, Artificial
  CRISPR gRNA sequence
tagccagtgatatacataat

SEQ ID NO: 618640 - DNA, 20 bp, Artificial
  CRISPR gRNA sequence
aatttcacaaaactagccca

SEQ ID NO: 618641 - DNA, 20 bp, Artificial
  CRISPR gRNA sequence
ttcctgtggccctattggcc

SEQ ID NO: 618642 - DNA, 20 bp, Artificial
  CRISPR gRNA sequence
ggaaagtgatgatggcaaga

SEQ ID NO: 618643 - DNA, 20 bp, Artificial
  CRISPR gRNA sequence
agagggaatcctgaaaatca

SEQ ID NO: 618644 - DNA, 20 bp, Artificial
  CRISPR gRNA sequence
atcagtgaattccctgatcc

SEQ ID NO: 618645 - DNA, 20 bp, Artificial
  CRISPR gRNA sequence
tattagatgtaagtagtaac

SEQ ID NO: 618646 - DNA, 20 bp, Artificial
  CRISPR gRNA sequence
tatctgtaaaagctattctt

SEQ ID NO: 618647 - DNA, 20 bp, Artificial
  CRISPR gRNA sequence
catattatttgaaaaactat

SEQ ID NO: 618648 - DNA, 20 bp, Artificial
  CRISPR gRNA sequence
agctggaagtttaaagcttc

SEQ ID NO: 618649 - DNA, 20 bp, Artificial
  CRISPR gRNA sequence
agttagttcaaatttctgaa

SEQ ID NO: 618650 - DNA, 20 bp, Artificial
  CRISPR gRNA sequence
gaaaggaatttttttttcct

SEQ ID NO: 618651 - DNA, 20 bp, Artificial
  CRISPR gRNA sequence
gtgaaagtcaaaccagacat

SEQ ID NO: 618652 - DNA, 20 bp, Artificial
  CRISPR gRNA sequence
ctcaaaatgcatgaaaataa

SEQ ID NO: 618653 - DNA, 20 bp, Artificial
  CRISPR gRNA sequence
ccttcctggagaaacatagc

SEQ ID NO: 618654 - DNA, 20 bp, Artificial
  CRISPR gRNA sequence
gagaaacatagcttgaattt

SEQ ID NO: 618655 - DNA, 20 bp, Artificial
  CRISPR gRNA sequence
agaagttgtgtcattatttc

SEQ ID NO: 618656 - DNA, 20 bp, Artificial
  CRISPR gRNA sequence
ttgaacaaaggcaacctgct

SEQ ID NO: 618657 - DNA, 20 bp, Artificial
  CRISPR gRNA sequence
gacagtgggctttggaagat

SEQ ID NO: 618658 - DNA, 20 bp, Artificial
  CRISPR gRNA sequence
agtgacaaaaacgtagattc

SEQ ID NO: 618659 - DNA, 20 bp, Artificial
  CRISPR gRNA sequence
cttacataatttcagtaaca

SEQ ID NO: 618660 - DNA, 20 bp, Artificial
  CRISPR gRNA sequence
cctggtggctagcttgtcac

SEQ ID NO: 618661 - DNA, 20 bp, Artificial
  CRISPR gRNA sequence
ccgcaagccatacataatgg

SEQ ID NO: 618662 - DNA, 20 bp, Artificial
  CRISPR gRNA sequence
agagaaaaagagaaattcag

SEQ ID NO: 618663 - DNA, 20 bp, Artificial
  CRISPR gRNA sequence
aagagtcttcataacattat

SEQ ID NO: 618664 - DNA, 20 bp, Artificial
  CRISPR gRNA sequence
tcttttttctttttaaagtt

SEQ ID NO: 618665 - DNA, 20 bp, Artificial
  CRISPR gRNA sequence
gtgtgtgtgttttctccctc

SEQ ID NO: 618666 - DNA, 20 bp, Artificial
  CRISPR gRNA sequence
ttcaactgaaggaaacacat

SEQ ID NO: 618667 - DNA, 20 bp, Artificial
  CRISPR gRNA sequence
ctcagaaacacctgaacaca

SEQ ID NO: 618668 - DNA, 20 bp, Artificial
  CRISPR gRNA sequence
tgttatttatggaaaactta

SEQ ID NO: 618669 - DNA, 20 bp, Artificial
  CRISPR gRNA sequence
tctaaaagaagtatttttaa

SEQ ID NO: 618670 - DNA, 20 bp, Artificial
  CRISPR gRNA sequence
ttagaaatggagataactca

SEQ ID NO: 618671 - DNA, 20 bp, Artificial
  CRISPR gRNA sequence
agacttcagttcacaaatac

SEQ ID NO: 618672 - DNA, 20 bp, Artificial
  CRISPR gRNA sequence
tacaatgagaagttatcttt

SEQ ID NO: 618673 - DNA, 20 bp, Artificial
  CRISPR gRNA sequence
ttttgaattagtgatcttat

SEQ ID NO: 618674 - DNA, 20 bp, Artificial
  CRISPR gRNA sequence
gcactgaggttttatagtag

SEQ ID NO: 618675 - DNA, 20 bp, Artificial
  CRISPR gRNA sequence
ggcatggtggtgtggggctt

SEQ ID NO: 618676 - DNA, 20 bp, Artificial
  CRISPR gRNA sequence
tcactagtgccataaaagca

SEQ ID NO: 618677 - DNA, 20 bp, Artificial
  CRISPR gRNA sequence
tggtacagagcaggtgctca

SEQ ID NO: 618678 - DNA, 20 bp, Artificial
  CRISPR gRNA sequence
caggtgctcagtgagtaatt

SEQ ID NO: 618679 - DNA, 20 bp, Artificial
  CRISPR gRNA sequence
gtaattttgaatgatttctt

SEQ ID NO: 618680 - DNA, 20 bp, Artificial
  CRISPR gRNA sequence
ttttaaatgctctgtggttt

SEQ ID NO: 618681 - DNA, 20 bp, Artificial
  CRISPR gRNA sequence
gttctattgtatattatcca

SEQ ID NO: 618682 - DNA, 20 bp, Artificial
  CRISPR gRNA sequence
tcttcatgcttgcccctatc

SEQ ID NO: 618683 - DNA, 20 bp, Artificial
  CRISPR gRNA sequence
acgaacctggccttaaactc

SEQ ID NO: 618684 - DNA, 20 bp, Artificial
  CRISPR gRNA sequence
gtcttcacagttttaatgta

SEQ ID NO: 618685 - DNA, 20 bp, Artificial
  CRISPR gRNA sequence
tccatgatttaaatacttca

SEQ ID NO: 618686 - DNA, 20 bp, Artificial
  CRISPR gRNA sequence
aaaatgctcattcattcatt

SEQ ID NO: 618687 - DNA, 20 bp, Artificial
  CRISPR gRNA sequence
gatgtcaatgtgtatgaccc

SEQ ID NO: 618688 - DNA, 20 bp, Artificial
  CRISPR gRNA sequence
gacccagggatgtttgaacc

SEQ ID NO: 618689 - DNA, 20 bp, Artificial
  CRISPR gRNA sequence
acctggggtatggaaacctg

SEQ ID NO: 618690 - DNA, 20 bp, Artificial
  CRISPR gRNA sequence
aagcgtccttagtgacctct

SEQ ID NO: 618691 - DNA, 20 bp, Artificial
  CRISPR gRNA sequence
agtgacctctgggaatcctt

SEQ ID NO: 618692 - DNA, 20 bp, Artificial
  CRISPR gRNA sequence
ttgggaacatacccactcag

SEQ ID NO: 618693 - DNA, 20 bp, Artificial
  CRISPR gRNA sequence
cttcttacagaagttaggtt

SEQ ID NO: 618694 - DNA, 20 bp, Artificial
  CRISPR gRNA sequence
gctacacctgtattccactg

SEQ ID NO: 618695 - DNA, 20 bp, Artificial
  CRISPR gRNA sequence
tggcatcatagggaaatagc

SEQ ID NO: 618696 - DNA, 20 bp, Artificial
  CRISPR gRNA sequence
caagaatttggtcatcagtt

SEQ ID NO: 618697 - DNA, 20 bp, Artificial
  CRISPR gRNA sequence
ctctgactctcaatatttgt

SEQ ID NO: 618698 - DNA, 20 bp, Artificial
  CRISPR gRNA sequence
actctcaatatttgtatgaa

SEQ ID NO: 618699 - DNA, 20 bp, Artificial
  CRISPR gRNA sequence
agtttcctcatttgtaaaat

SEQ ID NO: 618700 - DNA, 20 bp, Artificial
  CRISPR gRNA sequence
ggataaaattacgtacttca

SEQ ID NO: 618701 - DNA, 20 bp, Artificial
  CRISPR gRNA sequence
actggttcaacaaatacata

SEQ ID NO: 618702 - DNA, 20 bp, Artificial
  CRISPR gRNA sequence
attgggtgctttgtatgtgt

SEQ ID NO: 618703 - DNA, 20 bp, Artificial
  CRISPR gRNA sequence
gtgctttgtatgtgtaagga

SEQ ID NO: 618704 - DNA, 20 bp, Artificial
  CRISPR gRNA sequence
gatagaatgattttacaact

SEQ ID NO: 618705 - DNA, 20 bp, Artificial
  CRISPR gRNA sequence
gtggtttcactggaaaaggc

SEQ ID NO: 618706 - DNA, 20 bp, Artificial
  CRISPR gRNA sequence
actcataggacatatggctg

SEQ ID NO: 618707 - DNA, 20 bp, Artificial
  CRISPR gRNA sequence
ggatatgatgggactacact

SEQ ID NO: 618708 - DNA, 20 bp, Artificial
  CRISPR gRNA sequence
cagttcttgaagacatttag

SEQ ID NO: 618709 - DNA, 20 bp, Artificial
  CRISPR gRNA sequence
taggaagattaatctaacaa

SEQ ID NO: 618710 - DNA, 20 bp, Artificial
  CRISPR gRNA sequence
aatctaacaactgaatatag

SEQ ID NO: 618711 - DNA, 20 bp, Artificial
  CRISPR gRNA sequence
atatagatgaattgggggag

SEQ ID NO: 618712 - DNA, 20 bp, Artificial
  CRISPR gRNA sequence
tgttccaggtgagaggtcat

SEQ ID NO: 618713 - DNA, 20 bp, Artificial
  CRISPR gRNA sequence
tgaaatcattcatcgaaagg

SEQ ID NO: 618714 - DNA, 20 bp, Artificial
  CRISPR gRNA sequence
ttcatcgaaaggttggataa

SEQ ID NO: 618715 - DNA, 20 bp, Artificial
  CRISPR gRNA sequence
gcacgctatacaaggtttca

SEQ ID NO: 618716 - DNA, 20 bp, Artificial
  CRISPR gRNA sequence
acaaggtttcatggagtgtg

SEQ ID NO: 618717 - DNA, 20 bp, Artificial
  CRISPR gRNA sequence
cgataattcatagcaggaca

SEQ ID NO: 618718 - DNA, 20 bp, Artificial
  CRISPR gRNA sequence
tagagaggaggaggaaaaga

SEQ ID NO: 618719 - DNA, 20 bp, Artificial
  CRISPR gRNA sequence
aaaattatgaggtagttgtt

SEQ ID NO: 618720 - DNA, 20 bp, Artificial
  CRISPR gRNA sequence
gagccagtatcatgtcatag

SEQ ID NO: 618721 - DNA, 20 bp, Artificial
  CRISPR gRNA sequence
cagtatcatgtcatagaagg

SEQ ID NO: 618722 - DNA, 20 bp, Artificial
  CRISPR gRNA sequence
catagaaggatggataggct

SEQ ID NO: 618723 - DNA, 20 bp, Artificial
  CRISPR gRNA sequence
aggctacgagtcaaaagatc

SEQ ID NO: 618724 - DNA, 20 bp, Artificial
  CRISPR gRNA sequence
cttcctacaatgcagtcatt

SEQ ID NO: 618725 - DNA, 20 bp, Artificial
  CRISPR gRNA sequence
agtcattctgagtatcaaaa

SEQ ID NO: 618726 - DNA, 20 bp, Artificial
  CRISPR gRNA sequence
atcattactattatcattaa

SEQ ID NO: 618727 - DNA, 20 bp, Artificial
  CRISPR gRNA sequence
attttagatggtactagtgg

SEQ ID NO: 618728 - DNA, 20 bp, Artificial
  CRISPR gRNA sequence
gatggtactagtggctgagt

SEQ ID NO: 618729 - DNA, 20 bp, Artificial
  CRISPR gRNA sequence
tggttttctgccttcaggtg

SEQ ID NO: 618730 - DNA, 20 bp, Artificial
  CRISPR gRNA sequence
taactttactacactattgt

SEQ ID NO: 618731 - DNA, 20 bp, Artificial
  CRISPR gRNA sequence
aaatcagtactgtcttgatc

SEQ ID NO: 618732 - DNA, 20 bp, Artificial
  CRISPR gRNA sequence
cttgatctggagtaactcca

SEQ ID NO: 618733 - DNA, 20 bp, Artificial
  CRISPR gRNA sequence
tatattgaacagagaagaaa

SEQ ID NO: 618734 - DNA, 20 bp, Artificial
  CRISPR gRNA sequence
ggtgatgtgatatacagatt

SEQ ID NO: 618735 - DNA, 20 bp, Artificial
  CRISPR gRNA sequence
gtttataaaacaaattcttt

SEQ ID NO: 618736 - DNA, 20 bp, Artificial
  CRISPR gRNA sequence
acattgcatgaaattttgct

SEQ ID NO: 618737 - DNA, 20 bp, Artificial
  CRISPR gRNA sequence
cacattatttaaacagctgt

SEQ ID NO: 618738 - DNA, 20 bp, Artificial
  CRISPR gRNA sequence
acagctgttgggatattaac

SEQ ID NO: 618739 - DNA, 20 bp, Artificial
  CRISPR gRNA sequence
tttagaaagtttacgtgaga

SEQ ID NO: 618740 - DNA, 20 bp, Artificial
  CRISPR gRNA sequence
aaaatcccttaagtgcccac

SEQ ID NO: 618741 - DNA, 20 bp, Artificial
  CRISPR gRNA sequence
ctttttttcatttggtaagt

SEQ ID NO: 618742 - DNA, 20 bp, Artificial
  CRISPR gRNA sequence
ctaacttgtttgtagattag

SEQ ID NO: 618743 - DNA, 20 bp, Artificial
  CRISPR gRNA sequence
gaaaataaaattctaatgat

SEQ ID NO: 618744 - DNA, 20 bp, Artificial
  CRISPR gRNA sequence
taaaattctaatgatgaggg

SEQ ID NO: 618745 - DNA, 20 bp, Artificial
  CRISPR gRNA sequence
tcttaaaaattttaaaaatt

SEQ ID NO: 618746 - DNA, 20 bp, Artificial
  CRISPR gRNA sequence
tcatatgctgtcttgcacaa

SEQ ID NO: 618747 - DNA, 20 bp, Artificial
  CRISPR gRNA sequence
aactcttttatggccatttt

SEQ ID NO: 618748 - DNA, 20 bp, Artificial
  CRISPR gRNA sequence
gtacatactcttgtgttaat

SEQ ID NO: 618749 - DNA, 20 bp, Artificial
  CRISPR gRNA sequence
ctggtttaatgattttttaa

SEQ ID NO: 618750 - DNA, 20 bp, Artificial
  CRISPR gRNA sequence
ttctttattggctaaggtag

SEQ ID NO: 618751 - DNA, 20 bp, Artificial
  CRISPR gRNA sequence
aaggtagatgagttctataa

SEQ ID NO: 618752 - DNA, 20 bp, Artificial
  CRISPR gRNA sequence
attatccttttcattcttat

SEQ ID NO: 618753 - DNA, 20 bp, Artificial
  CRISPR gRNA sequence
cattcttatgtgagtaaaat

SEQ ID NO: 618754 - DNA, 20 bp, Artificial
  CRISPR gRNA sequence
aatgtccattatgacattga

SEQ ID NO: 618755 - DNA, 20 bp, Artificial
  CRISPR gRNA sequence
atccttttattatcatatta

SEQ ID NO: 618756 - DNA, 20 bp, Artificial
  CRISPR gRNA sequence
gcctttgattgtagagagcc

SEQ ID NO: 618757 - DNA, 20 bp, Artificial
  CRISPR gRNA sequence
gcttgaaattcactttaaaa

SEQ ID NO: 618758 - DNA, 20 bp, Artificial
  CRISPR gRNA sequence
tacttcttgtaatttgtaag

SEQ ID NO: 618759 - DNA, 20 bp, Artificial
  CRISPR gRNA sequence
aagaagaagaggggaaaagc

SEQ ID NO: 618760 - DNA, 20 bp, Artificial
  CRISPR gRNA sequence
ctttccttgtgttcacaaac

SEQ ID NO: 618761 - DNA, 20 bp, Artificial
  CRISPR gRNA sequence
aaacctgagtctactaaaat

SEQ ID NO: 618762 - DNA, 20 bp, Artificial
  CRISPR gRNA sequence
gaaaaataactcttggtatt

SEQ ID NO: 618763 - DNA, 20 bp, Artificial
  CRISPR gRNA sequence
catctttatagcccatttat

SEQ ID NO: 618764 - DNA, 20 bp, Artificial
  CRISPR gRNA sequence
tatttgaaaagtaaagcact

SEQ ID NO: 618765 - DNA, 20 bp, Artificial
  CRISPR gRNA sequence
tggcatcatatagtgtagct

SEQ ID NO: 618766 - DNA, 20 bp, Artificial
  CRISPR gRNA sequence
tatatatataagttataatt

SEQ ID NO: 618767 - DNA, 20 bp, Artificial
  CRISPR gRNA sequence
atagtgaaaataaaccatgg

SEQ ID NO: 618768 - DNA, 20 bp, Artificial
  CRISPR gRNA sequence
taaaccatgggagagtttct

SEQ ID NO: 618769 - DNA, 20 bp, Artificial
  CRISPR gRNA sequence
tatgtaatagttaagattca

SEQ ID NO: 618770 - DNA, 20 bp, Artificial
  CRISPR gRNA sequence
aagaataattgcttttattc

SEQ ID NO: 618771 - DNA, 20 bp, Artificial
  CRISPR gRNA sequence
ttcaacctaattgtagtgag

SEQ ID NO: 618772 - DNA, 20 bp, Artificial
  CRISPR gRNA sequence
gggtgaaagattagttacac

SEQ ID NO: 618773 - DNA, 20 bp, Artificial
  CRISPR gRNA sequence
acttctttatagtattgtta

SEQ ID NO: 618774 - DNA, 20 bp, Artificial
  CRISPR gRNA sequence
gtatttcttcattcctgaaa

SEQ ID NO: 618775 - DNA, 20 bp, Artificial
  CRISPR gRNA sequence
tttaattttaaatggcaatt

SEQ ID NO: 618776 - DNA, 20 bp, Artificial
  CRISPR gRNA sequence
ttttaaatggcaattatgaa

SEQ ID NO: 618777 - DNA, 20 bp, Artificial
  CRISPR gRNA sequence
gaatggaatataacactata

SEQ ID NO: 618778 - DNA, 20 bp, Artificial
  CRISPR gRNA sequence
taccagaaaaaataccatgg

SEQ ID NO: 618779 - DNA, 20 bp, Artificial
  CRISPR gRNA sequence
aaacctgttgatgcaagata

SEQ ID NO: 618780 - DNA, 20 bp, Artificial
  CRISPR gRNA sequence
atatatgccaaaaaatgccc

SEQ ID NO: 618781 - DNA, 20 bp, Artificial
  CRISPR gRNA sequence
ttcaaatttccaatgattaa

SEQ ID NO: 618782 - DNA, 20 bp, Artificial
  CRISPR gRNA sequence
aatgatgctagatttataaa

SEQ ID NO: 618783 - DNA, 20 bp, Artificial
  CRISPR gRNA sequence
taaaatggattcagactatt

SEQ ID NO: 618784 - DNA, 20 bp, Artificial
  CRISPR gRNA sequence
gttttttctttgccatgttt

SEQ ID NO: 618785 - DNA, 20 bp, Artificial
  CRISPR gRNA sequence
taagttagtaaaacatctca

SEQ ID NO: 618786 - DNA, 20 bp, Artificial
  CRISPR gRNA sequence
agcatgctggcaatataaag

SEQ ID NO: 618787 - DNA, 20 bp, Artificial
  CRISPR gRNA sequence
ctctttttaaaaactagtaa

SEQ ID NO: 618788 - DNA, 20 bp, Artificial
  CRISPR gRNA sequence
agggagtaacaatttgtaaa

SEQ ID NO: 618789 - DNA, 20 bp, Artificial
  CRISPR gRNA sequence
tagttggtactctgttagaa

SEQ ID NO: 618790 - DNA, 20 bp, Artificial
  CRISPR gRNA sequence
ctgttagaaatgggtccagg

SEQ ID NO: 618791 - DNA, 20 bp, Artificial
  CRISPR gRNA sequence
gcatatcactttgtagatct

SEQ ID NO: 618792 - DNA, 20 bp, Artificial
  CRISPR gRNA sequence
ctcgaactttattcagtaat

SEQ ID NO: 618793 - DNA, 20 bp, Artificial
  CRISPR gRNA sequence
ttaagaaattttctatatta

SEQ ID NO: 618794 - DNA, 20 bp, Artificial
  CRISPR gRNA sequence
aaaagactctgtcagcaatc

SEQ ID NO: 618795 - DNA, 20 bp, Artificial
  CRISPR gRNA sequence
acaaaattccaacttttctg

SEQ ID NO: 618796 - DNA, 20 bp, Artificial
  CRISPR gRNA sequence
gctttttggtgtgcatagat

SEQ ID NO: 618797 - DNA, 20 bp, Artificial
  CRISPR gRNA sequence
tggtgtgcatagattagagt

SEQ ID NO: 618798 - DNA, 20 bp, Artificial
  CRISPR gRNA sequence
ttttagatagaaaaaatagg

SEQ ID NO: 618799 - DNA, 20 bp, Artificial
  CRISPR gRNA sequence
tacatttatatagctcgaaa

SEQ ID NO: 618800 - DNA, 20 bp, Artificial
  CRISPR gRNA sequence
tcatatgtcaaagacatttg

SEQ ID NO: 618801 - DNA, 20 bp, Artificial
  CRISPR gRNA sequence
acatttgctggattaagatc

SEQ ID NO: 618802 - DNA, 20 bp, Artificial
  CRISPR gRNA sequence
aagtactctgatgtgaaaca

SEQ ID NO: 618803 - DNA, 20 bp, Artificial
  CRISPR gRNA sequence
cataatcctatctcagtcct

SEQ ID NO: 618804 - DNA, 20 bp, Artificial
  CRISPR gRNA sequence
acagactcaaaagccaatac

SEQ ID NO: 618805 - DNA, 20 bp, Artificial
  CRISPR gRNA sequence
aaatagtcattctgtttacc

SEQ ID NO: 618806 - DNA, 20 bp, Artificial
  CRISPR gRNA sequence
tatcattttcatccatttag

SEQ ID NO: 618807 - DNA, 20 bp, Artificial
  CRISPR gRNA sequence
atccatttagtaggatgaca

SEQ ID NO: 618808 - DNA, 20 bp, Artificial
  CRISPR gRNA sequence
agtagaaaagagatgtaggt

SEQ ID NO: 618809 - DNA, 20 bp, Artificial
  CRISPR gRNA sequence
attcagtaaagctagaaatg

SEQ ID NO: 618810 - DNA, 20 bp, Artificial
  CRISPR gRNA sequence
gctagaaatgcagagtgatg

SEQ ID NO: 618811 - DNA, 20 bp, Artificial
  CRISPR gRNA sequence
atgagatcaggggccatgat

SEQ ID NO: 618812 - DNA, 20 bp, Artificial
  CRISPR gRNA sequence
caggagcttcaaggcgaggg

SEQ ID NO: 618813 - DNA, 20 bp, Artificial
  CRISPR gRNA sequence
gcgagggaggaatccggctt

SEQ ID NO: 618814 - DNA, 20 bp, Artificial
  CRISPR gRNA sequence
atgtgcttatggtacataaa

SEQ ID NO: 618815 - DNA, 20 bp, Artificial
  CRISPR gRNA sequence
tcacactggtaagcagctga

SEQ ID NO: 618816 - DNA, 20 bp, Artificial
  CRISPR gRNA sequence
attctctttcctttttattc

SEQ ID NO: 618817 - DNA, 20 bp, Artificial
  CRISPR gRNA sequence
agtggtgaaaactacctttt

SEQ ID NO: 618818 - DNA, 20 bp, Artificial
  CRISPR gRNA sequence
ttttcagaattctgctagta

SEQ ID NO: 618819 - DNA, 20 bp, Artificial
  CRISPR gRNA sequence
tattggattgcagaaaaaca

SEQ ID NO: 618820 - DNA, 20 bp, Artificial
  CRISPR gRNA sequence
gcagaaaaacagagagtagc

SEQ ID NO: 618821 - DNA, 20 bp, Artificial
  CRISPR gRNA sequence
ttgacttccagccttcaaat

SEQ ID NO: 618822 - DNA, 20 bp, Artificial
  CRISPR gRNA sequence
agcatatcagaaaagaagtt

SEQ ID NO: 618823 - DNA, 20 bp, Artificial
  CRISPR gRNA sequence
taatatagcaataatatgat

SEQ ID NO: 618824 - DNA, 20 bp, Artificial
  CRISPR gRNA sequence
taagggttcaaaaggtatag

SEQ ID NO: 618825 - DNA, 20 bp, Artificial
  CRISPR gRNA sequence
ggtaatatagtttgctagat

SEQ ID NO: 618826 - DNA, 20 bp, Artificial
  CRISPR gRNA sequence
gcactcatgcatttatgtaa

SEQ ID NO: 618827 - DNA, 20 bp, Artificial
  CRISPR gRNA sequence
ggcaggtgcttttgtagttc

SEQ ID NO: 618828 - DNA, 20 bp, Artificial
  CRISPR gRNA sequence
ttgttggttataactcctgc

SEQ ID NO: 618829 - DNA, 20 bp, Artificial
  CRISPR gRNA sequence
aactcctgcaaggatatatg

SEQ ID NO: 618830 - DNA, 20 bp, Artificial
  CRISPR gRNA sequence
ctgcaaggatatatgtagga

SEQ ID NO: 618831 - DNA, 20 bp, Artificial
  CRISPR gRNA sequence
atagtggctggtgtgtaggt

SEQ ID NO: 618832 - DNA, 20 bp, Artificial
  CRISPR gRNA sequence
taggttggaatatgtaattc

SEQ ID NO: 618833 - DNA, 20 bp, Artificial
  CRISPR gRNA sequence
tggaatatgtaattctggga

SEQ ID NO: 618834 - DNA, 20 bp, Artificial
  CRISPR gRNA sequence
gatagtaagtggtaagctag

SEQ ID NO: 618835 - DNA, 20 bp, Artificial
  CRISPR gRNA sequence
atattaataactaatattct

SEQ ID NO: 618836 - DNA, 20 bp, Artificial
  CRISPR gRNA sequence
ggcattgctgaagctagaac

SEQ ID NO: 618837 - DNA, 20 bp, Artificial
  CRISPR gRNA sequence
gcttggtatgtcagtatacc

SEQ ID NO: 618838 - DNA, 20 bp, Artificial
  CRISPR gRNA sequence
ttataatatattcattatgt

SEQ ID NO: 618839 - DNA, 20 bp, Artificial
  CRISPR gRNA sequence
tcagtctaatggcttttcag

SEQ ID NO: 618840 - DNA, 20 bp, Artificial
  CRISPR gRNA sequence
tttaattgatcttttatgtt

SEQ ID NO: 618841 - DNA, 20 bp, Artificial
  CRISPR gRNA sequence
attaagaaaattcaaagaac

SEQ ID NO: 618842 - DNA, 20 bp, Artificial
  CRISPR gRNA sequence
gtagctacaataatattcat

SEQ ID NO: 618843 - DNA, 20 bp, Artificial
  CRISPR gRNA sequence
tttgttatttactagtgtgg

SEQ ID NO: 618844 - DNA, 20 bp, Artificial
  CRISPR gRNA sequence
tatttactagtgtggtagag

SEQ ID NO: 618845 - DNA, 20 bp, Artificial
  CRISPR gRNA sequence
tacagatttccacaaatcct

SEQ ID NO: 618846 - DNA, 20 bp, Artificial
  CRISPR gRNA sequence
tcactcaactcataacagca

SEQ ID NO: 618847 - DNA, 20 bp, Artificial
  CRISPR gRNA sequence
tgatgatccagtttatacat

SEQ ID NO: 618848 - DNA, 20 bp, Artificial
  CRISPR gRNA sequence
tagattgagaaaaatgtagt

SEQ ID NO: 618849 - DNA, 20 bp, Artificial
  CRISPR gRNA sequence
attttagtgtttttagttca

SEQ ID NO: 618850 - DNA, 20 bp, Artificial
  CRISPR gRNA sequence
tatctaatataatttttttt

SEQ ID NO: 618851 - DNA, 20 bp, Artificial
  CRISPR gRNA sequence
atataattttttttttgagt

SEQ ID NO: 618852 - DNA, 20 bp, Artificial
  CRISPR gRNA sequence
tcttgctctgtcgcccaggc

SEQ ID NO: 618853 - DNA, 20 bp, Artificial
  CRISPR gRNA sequence
tggagtgtagtggtgcaatc

SEQ ID NO: 618854 - DNA, 20 bp, Artificial
  CRISPR gRNA sequence
atcactgcaccctccacctc

SEQ ID NO: 618855 - DNA, 20 bp, Artificial
  CRISPR gRNA sequence
gcctcagcctccaaagtagc

SEQ ID NO: 618856 - DNA, 20 bp, Artificial
  CRISPR gRNA sequence
ttctgtatttttagtagaga

SEQ ID NO: 618857 - DNA, 20 bp, Artificial
  CRISPR gRNA sequence
accctagcctctcaaagtgc

SEQ ID NO: 618858 - DNA, 20 bp, Artificial
  CRISPR gRNA sequence
caatatcatggagcatcaga

SEQ ID NO: 618859 - DNA, 20 bp, Artificial
  CRISPR gRNA sequence
gtaatcaggtaatattgtca

SEQ ID NO: 618860 - DNA, 20 bp, Artificial
  CRISPR gRNA sequence
tactccaggcactcttcact

SEQ ID NO: 618861 - DNA, 20 bp, Artificial
  CRISPR gRNA sequence
ttcactgggaatatagagag

SEQ ID NO: 618862 - DNA, 20 bp, Artificial
  CRISPR gRNA sequence
tcgattggacattatacata

SEQ ID NO: 618863 - DNA, 20 bp, Artificial
  CRISPR gRNA sequence
catatatatttgcattttaa

SEQ ID NO: 618864 - DNA, 20 bp, Artificial
  CRISPR gRNA sequence
aactacttaatgttttcagc

SEQ ID NO: 618865 - DNA, 20 bp, Artificial
  CRISPR gRNA sequence
ttaaagtttcatagacagta

SEQ ID NO: 618866 - DNA, 20 bp, Artificial
  CRISPR gRNA sequence
catagagaaaagatagttaa

SEQ ID NO: 618867 - DNA, 20 bp, Artificial
  CRISPR gRNA sequence
taccccacgacattcaataa

SEQ ID NO: 618868 - DNA, 20 bp, Artificial
  CRISPR gRNA sequence
agaaataactttatcaaaaa

SEQ ID NO: 618869 - DNA, 20 bp, Artificial
  CRISPR gRNA sequence
ttatttgttattagacagat

SEQ ID NO: 618870 - DNA, 20 bp, Artificial
  CRISPR gRNA sequence
tatggatattacttctatat

SEQ ID NO: 618871 - DNA, 20 bp, Artificial
  CRISPR gRNA sequence
ttctatatttggattattcc

SEQ ID NO: 618872 - DNA, 20 bp, Artificial
  CRISPR gRNA sequence
tttctaacagtattgtcttt

SEQ ID NO: 618873 - DNA, 20 bp, Artificial
  CRISPR gRNA sequence
catataatcaagacatcaac

SEQ ID NO: 618874 - DNA, 20 bp, Artificial
  CRISPR gRNA sequence
ttgtttattctacgccattt

SEQ ID NO: 618875 - DNA, 20 bp, Artificial
  CRISPR gRNA sequence
taaaaagatttgaagatatc

SEQ ID NO: 618876 - DNA, 20 bp, Artificial
  CRISPR gRNA sequence
atcgcataaaactcaattag

SEQ ID NO: 618877 - DNA, 20 bp, Artificial
  CRISPR gRNA sequence
ttagactagcattatttttg

SEQ ID NO: 618878 - DNA, 20 bp, Artificial
  CRISPR gRNA sequence
agaatgaactactctaaatt

SEQ ID NO: 618879 - DNA, 20 bp, Artificial
  CRISPR gRNA sequence
gtaggaggtttaaaggaaat

SEQ ID NO: 618880 - DNA, 20 bp, Artificial
  CRISPR gRNA sequence
aattggagtcagcatgctat

SEQ ID NO: 618881 - DNA, 20 bp, Artificial
  CRISPR gRNA sequence
ctcttgtaaagttattgtta

SEQ ID NO: 618882 - DNA, 20 bp, Artificial
  CRISPR gRNA sequence
taaaagtaaaatcaaatttt

SEQ ID NO: 618883 - DNA, 20 bp, Artificial
  CRISPR gRNA sequence
tttccttttattactatggc

SEQ ID NO: 618884 - DNA, 20 bp, Artificial
  CRISPR gRNA sequence
ttattactatggcaggggtt

SEQ ID NO: 618885 - DNA, 20 bp, Artificial
  CRISPR gRNA sequence
cctgtgattccattaggaaa

SEQ ID NO: 618886 - DNA, 20 bp, Artificial
  CRISPR gRNA sequence
tcccaaaacactaaatacta

SEQ ID NO: 618887 - DNA, 20 bp, Artificial
  CRISPR gRNA sequence
tttataacaaatctatatga

SEQ ID NO: 618888 - DNA, 20 bp, Artificial
  CRISPR gRNA sequence
ctcttagctttctttaataa

SEQ ID NO: 618889 - DNA, 20 bp, Artificial
  CRISPR gRNA sequence
tttctttaataaaagaatca

SEQ ID NO: 618890 - DNA, 20 bp, Artificial
  CRISPR gRNA sequence
tgtcaaagggccaaaaaacc

SEQ ID NO: 618891 - DNA, 20 bp, Artificial
  CRISPR gRNA sequence
ttttgaaaaactattaaaat

SEQ ID NO: 618892 - DNA, 20 bp, Artificial
  CRISPR gRNA sequence
atggtccagttcaaccaaaa

SEQ ID NO: 618893 - DNA, 20 bp, Artificial
  CRISPR gRNA sequence
tttttactgtttacttatat

SEQ ID NO: 618894 - DNA, 20 bp, Artificial
  CRISPR gRNA sequence
atgtatatctttagtgatag

SEQ ID NO: 618895 - DNA, 20 bp, Artificial
  CRISPR gRNA sequence
ttttatatttgatgacattg

SEQ ID NO: 618896 - DNA, 20 bp, Artificial
  CRISPR gRNA sequence
aaaacatgtacaggacatgt

SEQ ID NO: 618897 - DNA, 20 bp, Artificial
  CRISPR gRNA sequence
catgtacaggacatgtctgg

SEQ ID NO: 618898 - DNA, 20 bp, Artificial
  CRISPR gRNA sequence
gttttactattagtgaccag

SEQ ID NO: 618899 - DNA, 20 bp, Artificial
  CRISPR gRNA sequence
tttccatatcagctaaatga

SEQ ID NO: 618900 - DNA, 20 bp, Artificial
  CRISPR gRNA sequence
taattattgtcattgtaaga

SEQ ID NO: 618901 - DNA, 20 bp, Artificial
  CRISPR gRNA sequence
atgctattattgttattctt

SEQ ID NO: 618902 - DNA, 20 bp, Artificial
  CRISPR gRNA sequence
agaactggctttggttaaca

SEQ ID NO: 618903 - DNA, 20 bp, Artificial
  CRISPR gRNA sequence
agtaaaacaggaaaacttag

SEQ ID NO: 618904 - DNA, 20 bp, Artificial
  CRISPR gRNA sequence
gaaaacttagaagagtacta

SEQ ID NO: 618905 - DNA, 20 bp, Artificial
  CRISPR gRNA sequence
taaataattgataaatcttg

SEQ ID NO: 618906 - DNA, 20 bp, Artificial
  CRISPR gRNA sequence
gaaaggagcactgtcaactg

SEQ ID NO: 618907 - DNA, 20 bp, Artificial
  CRISPR gRNA sequence
agtatcttacttcaatatat

SEQ ID NO: 618908 - DNA, 20 bp, Artificial
  CRISPR gRNA sequence
aattttaaaattttacaatt

SEQ ID NO: 618909 - DNA, 20 bp, Artificial
  CRISPR gRNA sequence
agtataatatcagttatgtt

SEQ ID NO: 618910 - DNA, 20 bp, Artificial
  CRISPR gRNA sequence
gactgatacagtgctcaggc

SEQ ID NO: 618911 - DNA, 20 bp, Artificial
  CRISPR gRNA sequence
atactcagaaaattggcttt

SEQ ID NO: 618912 - DNA, 20 bp, Artificial
  CRISPR gRNA sequence
tagctctcaaacaatagtca

SEQ ID NO: 618913 - DNA, 20 bp, Artificial
  CRISPR gRNA sequence
cataaatcatttaaaaaatg

SEQ ID NO: 618914 - DNA, 20 bp, Artificial
  CRISPR gRNA sequence
gtagaatatgacaaattctt

SEQ ID NO: 618915 - DNA, 20 bp, Artificial
  CRISPR gRNA sequence
ttaatgtttttaagaaatgc

SEQ ID NO: 618916 - DNA, 20 bp, Artificial
  CRISPR gRNA sequence
atataacacataaaagagaa

SEQ ID NO: 618917 - DNA, 20 bp, Artificial
  CRISPR gRNA sequence
aagaatgatcagaaatccaa

SEQ ID NO: 618918 - DNA, 20 bp, Artificial
  CRISPR gRNA sequence
ttaaaggtggaaaattaata

SEQ ID NO: 618919 - DNA, 20 bp, Artificial
  CRISPR gRNA sequence
tacattgacaaatcgtatta

SEQ ID NO: 618920 - DNA, 20 bp, Artificial
  CRISPR gRNA sequence
gctgtactaagtttttaaac

SEQ ID NO: 618921 - DNA, 20 bp, Artificial
  CRISPR gRNA sequence
ctaagtttttaaacatgaat

SEQ ID NO: 618922 - DNA, 20 bp, Artificial
  CRISPR gRNA sequence
tatatatttttctttcctcc

SEQ ID NO: 618923 - DNA, 20 bp, Artificial
  CRISPR gRNA sequence
ttctttcctccctgagttaa

SEQ ID NO: 618924 - DNA, 20 bp, Artificial
  CRISPR gRNA sequence
agcttgtcatgtactctagc

SEQ ID NO: 618925 - DNA, 20 bp, Artificial
  CRISPR gRNA sequence
tagccagagttaaattatta

SEQ ID NO: 618926 - DNA, 20 bp, Artificial
  CRISPR gRNA sequence
tataaatagatatattcaaa

SEQ ID NO: 618927 - DNA, 20 bp, Artificial
  CRISPR gRNA sequence
attcaaattgggtaattcaa

SEQ ID NO: 618928 - DNA, 20 bp, Artificial
  CRISPR gRNA sequence
ggtaattcaagagagtttaa

SEQ ID NO: 618929 - DNA, 20 bp, Artificial
  CRISPR gRNA sequence
aattcaatcatgcttccaat

SEQ ID NO: 618930 - DNA, 20 bp, Artificial
  CRISPR gRNA sequence
ataatagatagaacataaaa

SEQ ID NO: 618931 - DNA, 20 bp, Artificial
  CRISPR gRNA sequence
tgactaaaattttataggtt

SEQ ID NO: 618932 - DNA, 20 bp, Artificial
  CRISPR gRNA sequence
gagatgccccagtaaatccc

SEQ ID NO: 618933 - DNA, 20 bp, Artificial
  CRISPR gRNA sequence
tgacatgcccaaaatagcta

SEQ ID NO: 618934 - DNA, 20 bp, Artificial
  CRISPR gRNA sequence
aatctgaaggtttcaggaca

SEQ ID NO: 618935 - DNA, 20 bp, Artificial
  CRISPR gRNA sequence
acagagtaaaaagcctttaa

SEQ ID NO: 618936 - DNA, 20 bp, Artificial
  CRISPR gRNA sequence
aatgggttatttgatgttat

SEQ ID NO: 618937 - DNA, 20 bp, Artificial
  CRISPR gRNA sequence
tgattctgtgtggtgataca

SEQ ID NO: 618938 - DNA, 20 bp, Artificial
  CRISPR gRNA sequence
gtatttgtcttgccataaaa

SEQ ID NO: 618939 - DNA, 20 bp, Artificial
  CRISPR gRNA sequence
tggttgaaggcagtatagca

SEQ ID NO: 618940 - DNA, 20 bp, Artificial
  CRISPR gRNA sequence
ggcagtatagcaaggaatac

SEQ ID NO: 618941 - DNA, 20 bp, Artificial
  CRISPR gRNA sequence
aaagggaaggcatatcctat

SEQ ID NO: 618942 - DNA, 20 bp, Artificial
  CRISPR gRNA sequence
tctgcctcttccatgttgga

SEQ ID NO: 618943 - DNA, 20 bp, Artificial
  CRISPR gRNA sequence
ttgcttggttgatctctctc

SEQ ID NO: 618944 - DNA, 20 bp, Artificial
  CRISPR gRNA sequence
tctcaggaatggtgccatat

SEQ ID NO: 618945 - DNA, 20 bp, Artificial
  CRISPR gRNA sequence
agaagaggaagtccatgtaa

SEQ ID NO: 618946 - DNA, 20 bp, Artificial
  CRISPR gRNA sequence
agtaccaggtaagcctggta

SEQ ID NO: 618947 - DNA, 20 bp, Artificial
  CRISPR gRNA sequence
tactaacagccttcactaca

SEQ ID NO: 618948 - DNA, 20 bp, Artificial
  CRISPR gRNA sequence
tacagtgaatgccctctgga

SEQ ID NO: 618949 - DNA, 20 bp, Artificial
  CRISPR gRNA sequence
ccctctggagagaatttaca

SEQ ID NO: 618950 - DNA, 20 bp, Artificial
  CRISPR gRNA sequence
tacattttgtaccaattctg

SEQ ID NO: 618951 - DNA, 20 bp, Artificial
  CRISPR gRNA sequence
tgtgcagttaaatgtactag

SEQ ID NO: 618952 - DNA, 20 bp, Artificial
  CRISPR gRNA sequence
aatgaaattctggctgctgg

SEQ ID NO: 618953 - DNA, 20 bp, Artificial
  CRISPR gRNA sequence
caccatagtcatagctggta

SEQ ID NO: 618954 - DNA, 20 bp, Artificial
  CRISPR gRNA sequence
atcctcatcaactagtcact

SEQ ID NO: 618955 - DNA, 20 bp, Artificial
  CRISPR gRNA sequence
taccccatgaggccatacat

SEQ ID NO: 618956 - DNA, 20 bp, Artificial
  CRISPR gRNA sequence
ttgtgtacatttttgatatg

SEQ ID NO: 618957 - DNA, 20 bp, Artificial
  CRISPR gRNA sequence
gtttgggctacattgtcatt

SEQ ID NO: 618958 - DNA, 20 bp, Artificial
  CRISPR gRNA sequence
ccaaagttcattagcaagta

SEQ ID NO: 618959 - DNA, 20 bp, Artificial
  CRISPR gRNA sequence
gtctttactataaaaccacg

SEQ ID NO: 618960 - DNA, 20 bp, Artificial
  CRISPR gRNA sequence
tccaaaaatcattgcatctg

SEQ ID NO: 618961 - DNA, 20 bp, Artificial
  CRISPR gRNA sequence
tcattgcatctgctgaatct

SEQ ID NO: 618962 - DNA, 20 bp, Artificial
  CRISPR gRNA sequence
agagggagctttcatcatgg

SEQ ID NO: 618963 - DNA, 20 bp, Artificial
  CRISPR gRNA sequence
gctctcaaaatggacagcct

SEQ ID NO: 618964 - DNA, 20 bp, Artificial
  CRISPR gRNA sequence
cattttcacgaaggaaggtg

SEQ ID NO: 618965 - DNA, 20 bp, Artificial
  CRISPR gRNA sequence
gcaatttctcacttacaatg

SEQ ID NO: 618966 - DNA, 20 bp, Artificial
  CRISPR gRNA sequence
tgaaagtccctgaactttct

SEQ ID NO: 618967 - DNA, 20 bp, Artificial
  CRISPR gRNA sequence
agttcactcagtgtaatgtc

SEQ ID NO: 618968 - DNA, 20 bp, Artificial
  CRISPR gRNA sequence
tattccagcttgatgttttt

SEQ ID NO: 618969 - DNA, 20 bp, Artificial
  CRISPR gRNA sequence
ctatgttatgacaaagagag

SEQ ID NO: 618970 - DNA, 20 bp, Artificial
  CRISPR gRNA sequence
ttgacctagccttaaggtaa

SEQ ID NO: 618971 - DNA, 20 bp, Artificial
  CRISPR gRNA sequence
tagcctaataaacagtttaa

SEQ ID NO: 618972 - DNA, 20 bp, Artificial
  CRISPR gRNA sequence
agtttaaatgggtgtatagt

SEQ ID NO: 618973 - DNA, 20 bp, Artificial
  CRISPR gRNA sequence
tactgtctgttattcatcca

SEQ ID NO: 618974 - DNA, 20 bp, Artificial
  CRISPR gRNA sequence
taacccttcaaatcagattc

SEQ ID NO: 618975 - DNA, 20 bp, Artificial
  CRISPR gRNA sequence
ttatttgccttgaggcttaa

SEQ ID NO: 618976 - DNA, 20 bp, Artificial
  CRISPR gRNA sequence
tattttgcctgtattctgac

SEQ ID NO: 618977 - DNA, 20 bp, Artificial
  CRISPR gRNA sequence
atgctaccaccagtgacaat

SEQ ID NO: 618978 - DNA, 20 bp, Artificial
  CRISPR gRNA sequence
tcatcttgccagcacatgcc

SEQ ID NO: 618979 - DNA, 20 bp, Artificial
  CRISPR gRNA sequence
aggaggctatcctgctatcc

SEQ ID NO: 618980 - DNA, 20 bp, Artificial
  CRISPR gRNA sequence
atcagtaactctttatcagt

SEQ ID NO: 618981 - DNA, 20 bp, Artificial
  CRISPR gRNA sequence
tgaaagacaaatattcacaa

SEQ ID NO: 618982 - DNA, 20 bp, Artificial
  CRISPR gRNA sequence
atattcacaaaagaatggtt

SEQ ID NO: 618983 - DNA, 20 bp, Artificial
  CRISPR gRNA sequence
acaaaagaatggttaggaat

SEQ ID NO: 618984 - DNA, 20 bp, Artificial
  CRISPR gRNA sequence
ggtagtctacaaaaagatgg

SEQ ID NO: 618985 - DNA, 20 bp, Artificial
  CRISPR gRNA sequence
gctctagcctgaaagagaaa

SEQ ID NO: 618986 - DNA, 20 bp, Artificial
  CRISPR gRNA sequence
aaaggggatctagaggtcac

SEQ ID NO: 618987 - DNA, 20 bp, Artificial
  CRISPR gRNA sequence
tggaattaagagaaatagga

SEQ ID NO: 618988 - DNA, 20 bp, Artificial
  CRISPR gRNA sequence
tgagcactgaccttcggtag

SEQ ID NO: 618989 - DNA, 20 bp, Artificial
  CRISPR gRNA sequence
ctttgctaacctgtgacttg

SEQ ID NO: 618990 - DNA, 20 bp, Artificial
  CRISPR gRNA sequence
atggctatggcagccaaaca

SEQ ID NO: 618991 - DNA, 20 bp, Artificial
  CRISPR gRNA sequence
taaaattactagtatagagc

SEQ ID NO: 618992 - DNA, 20 bp, Artificial
  CRISPR gRNA sequence
ctgcagaccagtaccagtca

SEQ ID NO: 618993 - DNA, 20 bp, Artificial
  CRISPR gRNA sequence
ctacttggtgtgctccttat

SEQ ID NO: 618994 - DNA, 20 bp, Artificial
  CRISPR gRNA sequence
taatgcctgatgatctgagg

SEQ ID NO: 618995 - DNA, 20 bp, Artificial
  CRISPR gRNA sequence
aaggttgggaactgctgata

SEQ ID NO: 618996 - DNA, 20 bp, Artificial
  CRISPR gRNA sequence
tgctgatatagagtattaag

SEQ ID NO: 618997 - DNA, 20 bp, Artificial
  CRISPR gRNA sequence
taaatttaatctctgttttt

SEQ ID NO: 618998 - DNA, 20 bp, Artificial
  CRISPR gRNA sequence
ttgtattgttatttatcatg

SEQ ID NO: 618999 - DNA, 20 bp, Artificial
  CRISPR gRNA sequence
caagcccagcacagatgtgc

SEQ ID NO: 619000 - DNA, 20 bp, Artificial
  CRISPR gRNA sequence
aaaatactttgaaaaatatc

SEQ ID NO: 619001 - DNA, 20 bp, Artificial
  CRISPR gRNA sequence
atatgtattaagtaaatact

SEQ ID NO: 619002 - DNA, 20 bp, Artificial
  CRISPR gRNA sequence
tggtagttaggttatttatc

SEQ ID NO: 619003 - DNA, 20 bp, Artificial
  CRISPR gRNA sequence
ttcagtgagaaatttggttg

SEQ ID NO: 619004 - DNA, 20 bp, Artificial
  CRISPR gRNA sequence
tttttatcagcttatcttta

SEQ ID NO: 619005 - DNA, 20 bp, Artificial
  CRISPR gRNA sequence
aagaagaacgtatgagctcc

SEQ ID NO: 619006 - DNA, 20 bp, Artificial
  CRISPR gRNA sequence
ccattagtatgttttacaaa

SEQ ID NO: 619007 - DNA, 20 bp, Artificial
  CRISPR gRNA sequence
agaagtcacacaggcagacc

SEQ ID NO: 619008 - DNA, 20 bp, Artificial
  CRISPR gRNA sequence
aagtcaggagatcaaggcat

SEQ ID NO: 619009 - DNA, 20 bp, Artificial
  CRISPR gRNA sequence
agatcaaggcatgtgggttt

SEQ ID NO: 619010 - DNA, 20 bp, Artificial
  CRISPR gRNA sequence
caatgtgttatcttttctcc

SEQ ID NO: 619011 - DNA, 20 bp, Artificial
  CRISPR gRNA sequence
gtcactactaccacacctta

SEQ ID NO: 619012 - DNA, 20 bp, Artificial
  CRISPR gRNA sequence
taaaataagttttcatgaaa

SEQ ID NO: 619013 - DNA, 20 bp, Artificial
  CRISPR gRNA sequence
ttaacatcttaaggtttata

SEQ ID NO: 619014 - DNA, 20 bp, Artificial
  CRISPR gRNA sequence
actttgggaggccgaggtgg

SEQ ID NO: 619015 - DNA, 20 bp, Artificial
  CRISPR gRNA sequence
tactcgggaggctgaggcag

SEQ ID NO: 619016 - DNA, 20 bp, Artificial
  CRISPR gRNA sequence
cccgggaggcggacaccagc

SEQ ID NO: 619017 - DNA, 20 bp, Artificial
  CRISPR gRNA sequence
acttttttttttttctgaga

SEQ ID NO: 619018 - DNA, 20 bp, Artificial
  CRISPR gRNA sequence
tctcactctgtggcccaggc

SEQ ID NO: 619019 - DNA, 20 bp, Artificial
  CRISPR gRNA sequence
ctcactgcaacctccgcctc

SEQ ID NO: 619020 - DNA, 20 bp, Artificial
  CRISPR gRNA sequence
gcctcagcctcccaagtagc

SEQ ID NO: 619021 - DNA, 20 bp, Artificial
  CRISPR gRNA sequence
ttttgtatttttagtagaga

SEQ ID NO: 619022 - DNA, 20 bp, Artificial
  CRISPR gRNA sequence
gcctcagcctcccaaagtgc

SEQ ID NO: 619023 - DNA, 20 bp, Artificial
  CRISPR gRNA sequence
ccttaagtgactatttaatg

SEQ ID NO: 619024 - DNA, 20 bp, Artificial
  CRISPR gRNA sequence
tattatacctaatactctga

SEQ ID NO: 619025 - DNA, 20 bp, Artificial
  CRISPR gRNA sequence
ttaaaaattctaggaggaaa

SEQ ID NO: 619026 - DNA, 20 bp, Artificial
  CRISPR gRNA sequence
aaattaaaggtttaaaacag

SEQ ID NO: 619027 - DNA, 20 bp, Artificial
  CRISPR gRNA sequence
aaattataaagagaaaaatg

SEQ ID NO: 619028 - DNA, 20 bp, Artificial
  CRISPR gRNA sequence
taaagagaaaaatgatgagt

SEQ ID NO: 619029 - DNA, 20 bp, Artificial
  CRISPR gRNA sequence
acacatactggggcctattg

SEQ ID NO: 619030 - DNA, 20 bp, Artificial
  CRISPR gRNA sequence
ctggggcctattggagagta

SEQ ID NO: 619031 - DNA, 20 bp, Artificial
  CRISPR gRNA sequence
gtagagggtgggacgaagga

SEQ ID NO: 619032 - DNA, 20 bp, Artificial
  CRISPR gRNA sequence
aatggtgctagccttaatac

SEQ ID NO: 619033 - DNA, 20 bp, Artificial
  CRISPR gRNA sequence
taaaataaaagttaaaaaaa

SEQ ID NO: 619034 - DNA, 20 bp, Artificial
  CRISPR gRNA sequence
aaaaaacagaatgcatctca

SEQ ID NO: 619035 - DNA, 20 bp, Artificial
  CRISPR gRNA sequence
tgaaaaattcaattttggct

SEQ ID NO: 619036 - DNA, 20 bp, Artificial
  CRISPR gRNA sequence
aattatgtattgctcaaaaa

SEQ ID NO: 619037 - DNA, 20 bp, Artificial
  CRISPR gRNA sequence
ttaagtaagaaaataagtaa

SEQ ID NO: 619038 - DNA, 20 bp, Artificial
  CRISPR gRNA sequence
ttatctgtatcacataactt

SEQ ID NO: 619039 - DNA, 20 bp, Artificial
  CRISPR gRNA sequence
atgtcaaagttcttttgact

SEQ ID NO: 619040 - DNA, 20 bp, Artificial
  CRISPR gRNA sequence
atcttacttccaaacacttt

SEQ ID NO: 619041 - DNA, 20 bp, Artificial
  CRISPR gRNA sequence
acaaaaatagctcagaaata

SEQ ID NO: 619042 - DNA, 20 bp, Artificial
  CRISPR gRNA sequence
atttccacatttatctttaa

SEQ ID NO: 619043 - DNA, 20 bp, Artificial
  CRISPR gRNA sequence
aaaaaaaattaccatgtggc

SEQ ID NO: 619044 - DNA, 20 bp, Artificial
  CRISPR gRNA sequence
atagtctcttaatttgtcat

SEQ ID NO: 619045 - DNA, 20 bp, Artificial
  CRISPR gRNA sequence
cgcattgttgtctcttacta

SEQ ID NO: 619046 - DNA, 20 bp, Artificial
  CRISPR gRNA sequence
aattatcttcccttcttctt

SEQ ID NO: 619047 - DNA, 20 bp, Artificial
  CRISPR gRNA sequence
gcaaaatgttttgtataaga

SEQ ID NO: 619048 - DNA, 20 bp, Artificial
  CRISPR gRNA sequence
tagctgcaagttatacacct

SEQ ID NO: 619049 - DNA, 20 bp, Artificial
  CRISPR gRNA sequence
taatagtagtgatagttttg

SEQ ID NO: 619050 - DNA, 20 bp, Artificial
  CRISPR gRNA sequence
tcctgccactgcactccagc

SEQ ID NO: 619051 - DNA, 20 bp, Artificial
  CRISPR gRNA sequence
ctgcactccagcctgggtga

SEQ ID NO: 619052 - DNA, 20 bp, Artificial
  CRISPR gRNA sequence
atgacttttttttttttttt

SEQ ID NO: 619053 - DNA, 20 bp, Artificial
  CRISPR gRNA sequence
tttttttaaggatagaaaca

SEQ ID NO: 619054 - DNA, 20 bp, Artificial
  CRISPR gRNA sequence
aaattatgctggtttagaaa

SEQ ID NO: 619055 - DNA, 20 bp, Artificial
  CRISPR gRNA sequence
cctggcacctggcccacttt

SEQ ID NO: 619056 - DNA, 20 bp, Artificial
  CRISPR gRNA sequence
cctggaggtggctgatagag

SEQ ID NO: 619057 - DNA, 20 bp, Artificial
  CRISPR gRNA sequence
taaacactgaagaaaggaga

SEQ ID NO: 619058 - DNA, 20 bp, Artificial
  CRISPR gRNA sequence
catatacaatcacatctttt

SEQ ID NO: 619059 - DNA, 20 bp, Artificial
  CRISPR gRNA sequence
tttcagaccctatttctaga

SEQ ID NO: 619060 - DNA, 20 bp, Artificial
  CRISPR gRNA sequence
ttccttcctcctttattatc

SEQ ID NO: 619061 - DNA, 20 bp, Artificial
  CRISPR gRNA sequence
ttagctgctttctcattgtt

SEQ ID NO: 619062 - DNA, 20 bp, Artificial
  CRISPR gRNA sequence
accacagttttgtaccctgc

SEQ ID NO: 619063 - DNA, 20 bp, Artificial
  CRISPR gRNA sequence
cacattttcccttccacacc

SEQ ID NO: 619064 - DNA, 20 bp, Artificial
  CRISPR gRNA sequence
gtgtgtgtggtgtgttttgt

SEQ ID NO: 619065 - DNA, 20 bp, Artificial
  CRISPR gRNA sequence
ttcctacttgatctgtgtat

SEQ ID NO: 619066 - DNA, 20 bp, Artificial
  CRISPR gRNA sequence
ataagcatgtaaaatatatt

SEQ ID NO: 619067 - DNA, 20 bp, Artificial
  CRISPR gRNA sequence
gtaaggtatcagaaatctat

SEQ ID NO: 619068 - DNA, 20 bp, Artificial
  CRISPR gRNA sequence
gtatcagaaatctatcagag

SEQ ID NO: 619069 - DNA, 20 bp, Artificial
  CRISPR gRNA sequence
atgataatgattataagcaa

SEQ ID NO: 619070 - DNA, 20 bp, Artificial
  CRISPR gRNA sequence
atgattataagcaactggat

SEQ ID NO: 619071 - DNA, 20 bp, Artificial
  CRISPR gRNA sequence
tcccttatataccatattga

SEQ ID NO: 619072 - DNA, 20 bp, Artificial
  CRISPR gRNA sequence
ttatataccatattgattga

SEQ ID NO: 619073 - DNA, 20 bp, Artificial
  CRISPR gRNA sequence
taatggacagattattttat

SEQ ID NO: 619074 - DNA, 20 bp, Artificial
  CRISPR gRNA sequence
ttcatggaggtcaatggtgg

SEQ ID NO: 619075 - DNA, 20 bp, Artificial
  CRISPR gRNA sequence
tattacaaaaattaaaaatt

SEQ ID NO: 619076 - DNA, 20 bp, Artificial
  CRISPR gRNA sequence
ggccttattttgcagataag

SEQ ID NO: 619077 - DNA, 20 bp, Artificial
  CRISPR gRNA sequence
ggtttggcaacaatgtatta

SEQ ID NO: 619078 - DNA, 20 bp, Artificial
  CRISPR gRNA sequence
cacccacagcacaataaaac

SEQ ID NO: 619079 - DNA, 20 bp, Artificial
  CRISPR gRNA sequence
atagtataaattatatttgt

SEQ ID NO: 619080 - DNA, 20 bp, Artificial
  CRISPR gRNA sequence
agatataagctctggtctgt

SEQ ID NO: 619081 - DNA, 20 bp, Artificial
  CRISPR gRNA sequence
agctctggtctgtctgaatc

SEQ ID NO: 619082 - DNA, 20 bp, Artificial
  CRISPR gRNA sequence
tctattctccagatagcaac

SEQ ID NO: 619083 - DNA, 20 bp, Artificial
  CRISPR gRNA sequence
ctactactttacgcctcact

SEQ ID NO: 619084 - DNA, 20 bp, Artificial
  CRISPR gRNA sequence
ttcctactgtttttgaacta

SEQ ID NO: 619085 - DNA, 20 bp, Artificial
  CRISPR gRNA sequence
tctctatcttaataaaaagc

SEQ ID NO: 619086 - DNA, 20 bp, Artificial
  CRISPR gRNA sequence
tcttaataaaaagcttgaat

SEQ ID NO: 619087 - DNA, 20 bp, Artificial
  CRISPR gRNA sequence
tctgtgccatcccacctcac

SEQ ID NO: 619088 - DNA, 20 bp, Artificial
  CRISPR gRNA sequence
tttaataaggggagacgggc

SEQ ID NO: 619089 - DNA, 20 bp, Artificial
  CRISPR gRNA sequence
tttattgtgtgttaagtacc

SEQ ID NO: 619090 - DNA, 20 bp, Artificial
  CRISPR gRNA sequence
aagtaccttgagttttccat

SEQ ID NO: 619091 - DNA, 20 bp, Artificial
  CRISPR gRNA sequence
tatatactcacagaaatgct

SEQ ID NO: 619092 - DNA, 20 bp, Artificial
  CRISPR gRNA sequence
gcttcacacacaactggcat

SEQ ID NO: 619093 - DNA, 20 bp, Artificial
  CRISPR gRNA sequence
cacacaactggcattagggt

SEQ ID NO: 619094 - DNA, 20 bp, Artificial
  CRISPR gRNA sequence
tccaagtaagaaaccacatt

SEQ ID NO: 619095 - DNA, 20 bp, Artificial
  CRISPR gRNA sequence
tacaaatacatattctttat

SEQ ID NO: 619096 - DNA, 20 bp, Artificial
  CRISPR gRNA sequence
ttagagcaagctatttgctt

SEQ ID NO: 619097 - DNA, 20 bp, Artificial
  CRISPR gRNA sequence
ttatttgcttactcataagc

SEQ ID NO: 619098 - DNA, 20 bp, Artificial
  CRISPR gRNA sequence
tgttattattataactgttt

SEQ ID NO: 619099 - DNA, 20 bp, Artificial
  CRISPR gRNA sequence
acctatacaggctggcaaac

SEQ ID NO: 619100 - DNA, 20 bp, Artificial
  CRISPR gRNA sequence
ctgtgccaaacagccacatt

SEQ ID NO: 619101 - DNA, 20 bp, Artificial
  CRISPR gRNA sequence
atggagaaagtttcagtggt

SEQ ID NO: 619102 - DNA, 20 bp, Artificial
  CRISPR gRNA sequence
aaggtggttgtgataaatgg

SEQ ID NO: 619103 - DNA, 20 bp, Artificial
  CRISPR gRNA sequence
tagagaggagaagtcagtgc

SEQ ID NO: 619104 - DNA, 20 bp, Artificial
  CRISPR gRNA sequence
ccaaaaattctaaggtcctt

SEQ ID NO: 619105 - DNA, 20 bp, Artificial
  CRISPR gRNA sequence
tataaatggaacagcaaagt

SEQ ID NO: 619106 - DNA, 20 bp, Artificial
  CRISPR gRNA sequence
tttgtttacaatatggttta

SEQ ID NO: 619107 - DNA, 20 bp, Artificial
  CRISPR gRNA sequence
atattcttcagcccacgctc

SEQ ID NO: 619108 - DNA, 20 bp, Artificial
  CRISPR gRNA sequence
catagacagtgatttctatg

SEQ ID NO: 619109 - DNA, 20 bp, Artificial
  CRISPR gRNA sequence
taaactgaaaaccttctgga

SEQ ID NO: 619110 - DNA, 20 bp, Artificial
  CRISPR gRNA sequence
aaaaccttctggaaaggatt

SEQ ID NO: 619111 - DNA, 20 bp, Artificial
  CRISPR gRNA sequence
gagaaggtcaagatattaac

SEQ ID NO: 619112 - DNA, 20 bp, Artificial
  CRISPR gRNA sequence
aaaaagttgatttcaacctc

SEQ ID NO: 619113 - DNA, 20 bp, Artificial
  CRISPR gRNA sequence
tcaggaggttcaggacttca

SEQ ID NO: 619114 - DNA, 20 bp, Artificial
  CRISPR gRNA sequence
gatagaaacagcaacataac

SEQ ID NO: 619115 - DNA, 20 bp, Artificial
  CRISPR gRNA sequence
agtggagcctgaagatgtga

SEQ ID NO: 619116 - DNA, 20 bp, Artificial
  CRISPR gRNA sequence
ctgcagtctcgttataaaat

SEQ ID NO: 619117 - DNA, 20 bp, Artificial
  CRISPR gRNA sequence
agtctcgttataaaatgtga

SEQ ID NO: 619118 - DNA, 20 bp, Artificial
  CRISPR gRNA sequence
ttataaaatgtgaatggatg

SEQ ID NO: 619119 - DNA, 20 bp, Artificial
  CRISPR gRNA sequence
aagaaagtggtttcttgaga

SEQ ID NO: 619120 - DNA, 20 bp, Artificial
  CRISPR gRNA sequence
aatcttctagtgtagatcct

SEQ ID NO: 619121 - DNA, 20 bp, Artificial
  CRISPR gRNA sequence
atattgttgaaatgacaaca

SEQ ID NO: 619122 - DNA, 20 bp, Artificial
  CRISPR gRNA sequence
tgaaatgacaacagaggatt

SEQ ID NO: 619123 - DNA, 20 bp, Artificial
  CRISPR gRNA sequence
cttagttgacaaagcagtag

SEQ ID NO: 619124 - DNA, 20 bp, Artificial
  CRISPR gRNA sequence
aaagcagtagcagagtttga

SEQ ID NO: 619125 - DNA, 20 bp, Artificial
  CRISPR gRNA sequence
agtagcagagtttgagagag

SEQ ID NO: 619126 - DNA, 20 bp, Artificial
  CRISPR gRNA sequence
attttgaaagaaattctact

SEQ ID NO: 619127 - DNA, 20 bp, Artificial
  CRISPR gRNA sequence
ttcattgttgccttatgtta

SEQ ID NO: 619128 - DNA, 20 bp, Artificial
  CRISPR gRNA sequence
cctccaccagtggaaagatg

SEQ ID NO: 619129 - DNA, 20 bp, Artificial
  CRISPR gRNA sequence
cacctcagcctctcagcctc

SEQ ID NO: 619130 - DNA, 20 bp, Artificial
  CRISPR gRNA sequence
gatataaacataacttctat

SEQ ID NO: 619131 - DNA, 20 bp, Artificial
  CRISPR gRNA sequence
atctgagtgacccactttat

SEQ ID NO: 619132 - DNA, 20 bp, Artificial
  CRISPR gRNA sequence
ggatatattctttattgtga

SEQ ID NO: 619133 - DNA, 20 bp, Artificial
  CRISPR gRNA sequence
attgaaatctcattaaaagg

SEQ ID NO: 619134 - DNA, 20 bp, Artificial
  CRISPR gRNA sequence
aaaggaagagtctatataat

SEQ ID NO: 619135 - DNA, 20 bp, Artificial
  CRISPR gRNA sequence
tttactttttattccccata

SEQ ID NO: 619136 - DNA, 20 bp, Artificial
  CRISPR gRNA sequence
tgaaagaagtgagcatccct

SEQ ID NO: 619137 - DNA, 20 bp, Artificial
  CRISPR gRNA sequence
ccctaggggttaaatggttt

SEQ ID NO: 619138 - DNA, 20 bp, Artificial
  CRISPR gRNA sequence
agctggtaaatacatgttgt

SEQ ID NO: 619139 - DNA, 20 bp, Artificial
  CRISPR gRNA sequence
tacataagacattttcttgt

SEQ ID NO: 619140 - DNA, 20 bp, Artificial
  CRISPR gRNA sequence
aattgtgactatttttcttc

SEQ ID NO: 619141 - DNA, 20 bp, Artificial
  CRISPR gRNA sequence
tataaaacaaatggcaatat

SEQ ID NO: 619142 - DNA, 20 bp, Artificial
  CRISPR gRNA sequence
tggttaataatgttagctct

SEQ ID NO: 619143 - DNA, 20 bp, Artificial
  CRISPR gRNA sequence
aatgttagctctgtggatgc

SEQ ID NO: 619144 - DNA, 20 bp, Artificial
  CRISPR gRNA sequence
cagcacctagaacgtggaca

SEQ ID NO: 619145 - DNA, 20 bp, Artificial
  CRISPR gRNA sequence
cctggcacatcctgttaaag

SEQ ID NO: 619146 - DNA, 20 bp, Artificial
  CRISPR gRNA sequence
actttgggaggctgaggcgg

SEQ ID NO: 619147 - DNA, 20 bp, Artificial
  CRISPR gRNA sequence
cgggcggatcacttgaggtc

SEQ ID NO: 619148 - DNA, 20 bp, Artificial
  CRISPR gRNA sequence
tactcaggaggctgaggctg

SEQ ID NO: 619149 - DNA, 20 bp, Artificial
  CRISPR gRNA sequence
tttagtttttttggaaaacg

SEQ ID NO: 619150 - DNA, 20 bp, Artificial
  CRISPR gRNA sequence
tttcattaaaaaaataaacc

SEQ ID NO: 619151 - DNA, 20 bp, Artificial
  CRISPR gRNA sequence
tttagaaaaaaaaagtaggt

SEQ ID NO: 619152 - DNA, 20 bp, Artificial
  CRISPR gRNA sequence
ctaaaaaattccatatcagg

SEQ ID NO: 619153 - DNA, 20 bp, Artificial
  CRISPR gRNA sequence
atataaattgaaacccaaaa

SEQ ID NO: 619154 - DNA, 20 bp, Artificial
  CRISPR gRNA sequence
tggccacagttacttactaa

SEQ ID NO: 619155 - DNA, 20 bp, Artificial
  CRISPR gRNA sequence
acacataatttggcatcatc

SEQ ID NO: 619156 - DNA, 20 bp, Artificial
  CRISPR gRNA sequence
agccattggaggcataatat

SEQ ID NO: 619157 - DNA, 20 bp, Artificial
  CRISPR gRNA sequence
ttcaggaagaaatatacact

SEQ ID NO: 619158 - DNA, 20 bp, Artificial
  CRISPR gRNA sequence
gaatagcccacatttattcc

SEQ ID NO: 619159 - DNA, 20 bp, Artificial
  CRISPR gRNA sequence
gtccttaaaattttaacaca

SEQ ID NO: 619160 - DNA, 20 bp, Artificial
  CRISPR gRNA sequence
aaattttaacacattgaatc

SEQ ID NO: 619161 - DNA, 20 bp, Artificial
  CRISPR gRNA sequence
ttgaatctggaatatataaa

SEQ ID NO: 619162 - DNA, 20 bp, Artificial
  CRISPR gRNA sequence
gataatatatcatgaccaag

SEQ ID NO: 619163 - DNA, 20 bp, Artificial
  CRISPR gRNA sequence
gaccaagtgggatttatctt

SEQ ID NO: 619164 - DNA, 20 bp, Artificial
  CRISPR gRNA sequence
aatttaaagttggtttaaca

SEQ ID NO: 619165 - DNA, 20 bp, Artificial
  CRISPR gRNA sequence
attataaaaattctctgcaa

SEQ ID NO: 619166 - DNA, 20 bp, Artificial
  CRISPR gRNA sequence
atcatgatggttatcatttg

SEQ ID NO: 619167 - DNA, 20 bp, Artificial
  CRISPR gRNA sequence
caaatgtatttctatatgct

SEQ ID NO: 619168 - DNA, 20 bp, Artificial
  CRISPR gRNA sequence
aggaatgaacagttggacat

SEQ ID NO: 619169 - DNA, 20 bp, Artificial
  CRISPR gRNA sequence
cccaaaatgtatgaaatact

SEQ ID NO: 619170 - DNA, 20 bp, Artificial
  CRISPR gRNA sequence
gatgttggtttctcctgaaa

SEQ ID NO: 619171 - DNA, 20 bp, Artificial
  CRISPR gRNA sequence
ataattttgaaaagccaaat

SEQ ID NO: 619172 - DNA, 20 bp, Artificial
  CRISPR gRNA sequence
agtatagacatagaggttaa

SEQ ID NO: 619173 - DNA, 20 bp, Artificial
  CRISPR gRNA sequence
agacatagaggttaatggaa

SEQ ID NO: 619174 - DNA, 20 bp, Artificial
  CRISPR gRNA sequence
tagaggttaatggaatggaa

SEQ ID NO: 619175 - DNA, 20 bp, Artificial
  CRISPR gRNA sequence
tgagataatttaagggggga

SEQ ID NO: 619176 - DNA, 20 bp, Artificial
  CRISPR gRNA sequence
aaggataatattttctataa

SEQ ID NO: 619177 - DNA, 20 bp, Artificial
  CRISPR gRNA sequence
tataaatgggtctagaacaa

SEQ ID NO: 619178 - DNA, 20 bp, Artificial
  CRISPR gRNA sequence
ttgacaactatagtaattat

SEQ ID NO: 619179 - DNA, 20 bp, Artificial
  CRISPR gRNA sequence
agagacatacgctcatattt

SEQ ID NO: 619180 - DNA, 20 bp, Artificial
  CRISPR gRNA sequence
cttcaaaatgttaagagaaa

SEQ ID NO: 619181 - DNA, 20 bp, Artificial
  CRISPR gRNA sequence
acccaacgaagaggaaaaca

SEQ ID NO: 619182 - DNA, 20 bp, Artificial
  CRISPR gRNA sequence
gagggggacaaaggaaagtt

SEQ ID NO: 619183 - DNA, 20 bp, Artificial
  CRISPR gRNA sequence
taacaactctgtaataaacc

SEQ ID NO: 619184 - DNA, 20 bp, Artificial
  CRISPR gRNA sequence
catcagttccaactggagaa

SEQ ID NO: 619185 - DNA, 20 bp, Artificial
  CRISPR gRNA sequence
ctatgacattgttctggact

SEQ ID NO: 619186 - DNA, 20 bp, Artificial
  CRISPR gRNA sequence
ggtgtgagaacctcagagga

SEQ ID NO: 619187 - DNA, 20 bp, Artificial
  CRISPR gRNA sequence
agaggaaggggtaagtggca

SEQ ID NO: 619188 - DNA, 20 bp, Artificial
  CRISPR gRNA sequence
tattgaaagaccacagaagt

SEQ ID NO: 619189 - DNA, 20 bp, Artificial
  CRISPR gRNA sequence
accacagaagtgagaattga

SEQ ID NO: 619190 - DNA, 20 bp, Artificial
  CRISPR gRNA sequence
agagggtgtttgtaagagag

SEQ ID NO: 619191 - DNA, 20 bp, Artificial
  CRISPR gRNA sequence
atagattatctctaaacctg

SEQ ID NO: 619192 - DNA, 20 bp, Artificial
  CRISPR gRNA sequence
cccacatattatttagaaat

SEQ ID NO: 619193 - DNA, 20 bp, Artificial
  CRISPR gRNA sequence
agctgaaaatggttgctttt

SEQ ID NO: 619194 - DNA, 20 bp, Artificial
  CRISPR gRNA sequence
cgtaataaaagaaaaggact

SEQ ID NO: 619195 - DNA, 20 bp, Artificial
  CRISPR gRNA sequence
gactcagaatgctgagcaaa

SEQ ID NO: 619196 - DNA, 20 bp, Artificial
  CRISPR gRNA sequence
attcagcattaccataaatc

SEQ ID NO: 619197 - DNA, 20 bp, Artificial
  CRISPR gRNA sequence
catgcattaaaaaaatgcaa

SEQ ID NO: 619198 - DNA, 20 bp, Artificial
  CRISPR gRNA sequence
tatttctaaatgatataatt

SEQ ID NO: 619199 - DNA, 20 bp, Artificial
  CRISPR gRNA sequence
ggtgattaaaaaaattttat

SEQ ID NO: 619200 - DNA, 20 bp, Artificial
  CRISPR gRNA sequence
taatgagaaaaagctattta

SEQ ID NO: 619201 - DNA, 20 bp, Artificial
  CRISPR gRNA sequence
aagtcacagataatataaga

SEQ ID NO: 619202 - DNA, 20 bp, Artificial
  CRISPR gRNA sequence
gataatataagatagaatga

SEQ ID NO: 619203 - DNA, 20 bp, Artificial
  CRISPR gRNA sequence
gttggaagtgttctaagcat

SEQ ID NO: 619204 - DNA, 20 bp, Artificial
  CRISPR gRNA sequence
ctaagcatgagggtcaatac

SEQ ID NO: 619205 - DNA, 20 bp, Artificial
  CRISPR gRNA sequence
aagatcacgttaaaatggaa

SEQ ID NO: 619206 - DNA, 20 bp, Artificial
  CRISPR gRNA sequence
gttaaggaggttggaagtgg

SEQ ID NO: 619207 - DNA, 20 bp, Artificial
  CRISPR gRNA sequence
gttggaagtggagggatgtg

SEQ ID NO: 619208 - DNA, 20 bp, Artificial
  CRISPR gRNA sequence
aagtaattttgactggggcc

SEQ ID NO: 619209 - DNA, 20 bp, Artificial
  CRISPR gRNA sequence
ttttgactggggcctggggt

SEQ ID NO: 619210 - DNA, 20 bp, Artificial
  CRISPR gRNA sequence
actggggcctggggtaggag

SEQ ID NO: 619211 - DNA, 20 bp, Artificial
  CRISPR gRNA sequence
tgctttgggaccagatggta

SEQ ID NO: 619212 - DNA, 20 bp, Artificial
  CRISPR gRNA sequence
ggaccagatggtatagggtg

SEQ ID NO: 619213 - DNA, 20 bp, Artificial
  CRISPR gRNA sequence
gggtgctgaatgccaggtaa

SEQ ID NO: 619214 - DNA, 20 bp, Artificial
  CRISPR gRNA sequence
tattgaaagttgttggagag

SEQ ID NO: 619215 - DNA, 20 bp, Artificial
  CRISPR gRNA sequence
tgaactaggacgttgattgt

SEQ ID NO: 619216 - DNA, 20 bp, Artificial
  CRISPR gRNA sequence
tgattgtgagaatgaaaaga

SEQ ID NO: 619217 - DNA, 20 bp, Artificial
  CRISPR gRNA sequence
tgaaaagaagggatcaactt

SEQ ID NO: 619218 - DNA, 20 bp, Artificial
  CRISPR gRNA sequence
atcaacttgagaatcatttt

SEQ ID NO: 619219 - DNA, 20 bp, Artificial
  CRISPR gRNA sequence
cattttacgagtccagtata

SEQ ID NO: 619220 - DNA, 20 bp, Artificial
  CRISPR gRNA sequence
agaggtagaaggtaacagaa

SEQ ID NO: 619221 - DNA, 20 bp, Artificial
  CRISPR gRNA sequence
acagaagtgggtgcattgtt

SEQ ID NO: 619222 - DNA, 20 bp, Artificial
  CRISPR gRNA sequence
tgggtgcattgttgtgaatc

SEQ ID NO: 619223 - DNA, 20 bp, Artificial
  CRISPR gRNA sequence
aagggcagtcagaacaaaga

SEQ ID NO: 619224 - DNA, 20 bp, Artificial
  CRISPR gRNA sequence
ttttgtggaggaagatagtt

SEQ ID NO: 619225 - DNA, 20 bp, Artificial
  CRISPR gRNA sequence
ggaagatagttttgggtatc

SEQ ID NO: 619226 - DNA, 20 bp, Artificial
  CRISPR gRNA sequence
aatgtttgatttggttttgg

SEQ ID NO: 619227 - DNA, 20 bp, Artificial
  CRISPR gRNA sequence
ctcaaaaggcagttgcaagt

SEQ ID NO: 619228 - DNA, 20 bp, Artificial
  CRISPR gRNA sequence
tatgtattatcaatttaaaa

SEQ ID NO: 619229 - DNA, 20 bp, Artificial
  CRISPR gRNA sequence
tgttataagtaatgcatcaa

SEQ ID NO: 619230 - DNA, 20 bp, Artificial
  CRISPR gRNA sequence
atgcatcaacagagtacgaa

SEQ ID NO: 619231 - DNA, 20 bp, Artificial
  CRISPR gRNA sequence
cttcgttttggttgtaggga

SEQ ID NO: 619232 - DNA, 20 bp, Artificial
  CRISPR gRNA sequence
gaaattattcttgacctgat

SEQ ID NO: 619233 - DNA, 20 bp, Artificial
  CRISPR gRNA sequence
gtactgagaacaatatctga

SEQ ID NO: 619234 - DNA, 20 bp, Artificial
  CRISPR gRNA sequence
aaaactgagaagcagtgagg

SEQ ID NO: 619235 - DNA, 20 bp, Artificial
  CRISPR gRNA sequence
agaagcagtgagggcgaatg

SEQ ID NO: 619236 - DNA, 20 bp, Artificial
  CRISPR gRNA sequence
gccaagagattaggaagaca

SEQ ID NO: 619237 - DNA, 20 bp, Artificial
  CRISPR gRNA sequence
cagaggattaataaaagcct

SEQ ID NO: 619238 - DNA, 20 bp, Artificial
  CRISPR gRNA sequence
tgaaatattggtccttttat

SEQ ID NO: 619239 - DNA, 20 bp, Artificial
  CRISPR gRNA sequence
tacagataaacacatgtata

SEQ ID NO: 619240 - DNA, 20 bp, Artificial
  CRISPR gRNA sequence
tttttaagaaatagtatgaa

SEQ ID NO: 619241 - DNA, 20 bp, Artificial
  CRISPR gRNA sequence
ttgtggagatagcagagcca

SEQ ID NO: 619242 - DNA, 20 bp, Artificial
  CRISPR gRNA sequence
agcagagccattgaatttgc

SEQ ID NO: 619243 - DNA, 20 bp, Artificial
  CRISPR gRNA sequence
tgtctgaaaacaattttcaa

SEQ ID NO: 619244 - DNA, 20 bp, Artificial
  CRISPR gRNA sequence
tttcaaaggagtagtaaggg

SEQ ID NO: 619245 - DNA, 20 bp, Artificial
  CRISPR gRNA sequence
caccagactgtcagttgcat

SEQ ID NO: 619246 - DNA, 20 bp, Artificial
  CRISPR gRNA sequence
tgcatacggataggcaccat

SEQ ID NO: 619247 - DNA, 20 bp, Artificial
  CRISPR gRNA sequence
tggtacatagtagtctgtta

SEQ ID NO: 619248 - DNA, 20 bp, Artificial
  CRISPR gRNA sequence
acatagtagtctgttattga

SEQ ID NO: 619249 - DNA, 20 bp, Artificial
  CRISPR gRNA sequence
tgaatgaatgagagaggtaa

SEQ ID NO: 619250 - DNA, 20 bp, Artificial
  CRISPR gRNA sequence
cagagcaaatttattggaaa

SEQ ID NO: 619251 - DNA, 20 bp, Artificial
  CRISPR gRNA sequence
tccaacatgtcacctaataa

SEQ ID NO: 619252 - DNA, 20 bp, Artificial
  CRISPR gRNA sequence
tcacctaataattgggttgc

SEQ ID NO: 619253 - DNA, 20 bp, Artificial
  CRISPR gRNA sequence
taataattgggttgctggaa

SEQ ID NO: 619254 - DNA, 20 bp, Artificial
  CRISPR gRNA sequence
gctggaatagaatggagatg

SEQ ID NO: 619255 - DNA, 20 bp, Artificial
  CRISPR gRNA sequence
agatgaagagttgggaaaat

SEQ ID NO: 619256 - DNA, 20 bp, Artificial
  CRISPR gRNA sequence
atccctgttggactcaatga

SEQ ID NO: 619257 - DNA, 20 bp, Artificial
  CRISPR gRNA sequence
caatgatgggatgaagagga

SEQ ID NO: 619258 - DNA, 20 bp, Artificial
  CRISPR gRNA sequence
agaagctgaaataaagcaga

SEQ ID NO: 619259 - DNA, 20 bp, Artificial
  CRISPR gRNA sequence
aaagcagatgggatagtaat

SEQ ID NO: 619260 - DNA, 20 bp, Artificial
  CRISPR gRNA sequence
agtaatgagagtagtaaaaa

SEQ ID NO: 619261 - DNA, 20 bp, Artificial
  CRISPR gRNA sequence
tgtctcttccttcttatcag

SEQ ID NO: 619262 - DNA, 20 bp, Artificial
  CRISPR gRNA sequence
caggtgagttgggactttta

SEQ ID NO: 619263 - DNA, 20 bp, Artificial
  CRISPR gRNA sequence
ttagagggttgtgagccaag

SEQ ID NO: 619264 - DNA, 20 bp, Artificial
  CRISPR gRNA sequence
gggttgtgagccaaggggaa

SEQ ID NO: 619265 - DNA, 20 bp, Artificial
  CRISPR gRNA sequence
ataaggggaagaaagtatag

SEQ ID NO: 619266 - DNA, 20 bp, Artificial
  CRISPR gRNA sequence
tattacagaagaacccaaaa

SEQ ID NO: 619267 - DNA, 20 bp, Artificial
  CRISPR gRNA sequence
tgccaagcatttttaaaaaa

SEQ ID NO: 619268 - DNA, 20 bp, Artificial
  CRISPR gRNA sequence
agtgaaactttcaggcagcc

SEQ ID NO: 619269 - DNA, 20 bp, Artificial
  CRISPR gRNA sequence
cttgtgaccagtgtcatagc

SEQ ID NO: 619270 - DNA, 20 bp, Artificial
  CRISPR gRNA sequence
gcatgggtttataagttaac

SEQ ID NO: 619271 - DNA, 20 bp, Artificial
  CRISPR gRNA sequence
tttataagttaactggagtt

SEQ ID NO: 619272 - DNA, 20 bp, Artificial
  CRISPR gRNA sequence
tgctatctttggtcatgaaa

SEQ ID NO: 619273 - DNA, 20 bp, Artificial
  CRISPR gRNA sequence
caaaactaaataattcctct

SEQ ID NO: 619274 - DNA, 20 bp, Artificial
  CRISPR gRNA sequence
agtcaaatagagacacgggc

SEQ ID NO: 619275 - DNA, 20 bp, Artificial
  CRISPR gRNA sequence
gggctttggcacagaccacc

SEQ ID NO: 619276 - DNA, 20 bp, Artificial
  CRISPR gRNA sequence
ttctgtattcattcaaaacc

SEQ ID NO: 619277 - DNA, 20 bp, Artificial
  CRISPR gRNA sequence
tgctctgtgatgtccttatg

SEQ ID NO: 619278 - DNA, 20 bp, Artificial
  CRISPR gRNA sequence
taatggctccctagctatta

SEQ ID NO: 619279 - DNA, 20 bp, Artificial
  CRISPR gRNA sequence
tattataaaagctgatgagg

SEQ ID NO: 619280 - DNA, 20 bp, Artificial
  CRISPR gRNA sequence
tgccacaaaattttgcatgt

SEQ ID NO: 619281 - DNA, 20 bp, Artificial
  CRISPR gRNA sequence
tctgtactttttctcaccac

SEQ ID NO: 619282 - DNA, 20 bp, Artificial
  CRISPR gRNA sequence
ttttaatcttcttggtaccc

SEQ ID NO: 619283 - DNA, 20 bp, Artificial
  CRISPR gRNA sequence
accacaactcttgatgtatc

SEQ ID NO: 619284 - DNA, 20 bp, Artificial
  CRISPR gRNA sequence
taggatactcctgatttgtc

SEQ ID NO: 619285 - DNA, 20 bp, Artificial
  CRISPR gRNA sequence
atactcctgatttgtcttga

SEQ ID NO: 619286 - DNA, 20 bp, Artificial
  CRISPR gRNA sequence
gtcttgaatgagtcaaagct

SEQ ID NO: 619287 - DNA, 20 bp, Artificial
  CRISPR gRNA sequence
aagctgagagtcagtgtatt

SEQ ID NO: 619288 - DNA, 20 bp, Artificial
  CRISPR gRNA sequence
atcaccaggccctcaaggtc

SEQ ID NO: 619289 - DNA, 20 bp, Artificial
  CRISPR gRNA sequence
gtctagaatacagtcagagc

SEQ ID NO: 619290 - DNA, 20 bp, Artificial
  CRISPR gRNA sequence
ttatcttttcttaccaaaat

SEQ ID NO: 619291 - DNA, 20 bp, Artificial
  CRISPR gRNA sequence
gatttaagtctgaaaattat

SEQ ID NO: 619292 - DNA, 20 bp, Artificial
  CRISPR gRNA sequence
agttagctattgattttgct

SEQ ID NO: 619293 - DNA, 20 bp, Artificial
  CRISPR gRNA sequence
agactaacagcacactgacc

SEQ ID NO: 619294 - DNA, 20 bp, Artificial
  CRISPR gRNA sequence
gaccttgagttctcttcaca

SEQ ID NO: 619295 - DNA, 20 bp, Artificial
  CRISPR gRNA sequence
aacgctgccacaactatctc

SEQ ID NO: 619296 - DNA, 20 bp, Artificial
  CRISPR gRNA sequence
tggaggctgctgggcaggtc

SEQ ID NO: 619297 - DNA, 20 bp, Artificial
  CRISPR gRNA sequence
gcaggtcatgagtcaccatg

SEQ ID NO: 619298 - DNA, 20 bp, Artificial
  CRISPR gRNA sequence
gtcaccatggtgggtagaaa

SEQ ID NO: 619299 - DNA, 20 bp, Artificial
  CRISPR gRNA sequence
tttagatcactttaacttaa

SEQ ID NO: 619300 - DNA, 20 bp, Artificial
  CRISPR gRNA sequence
aacttaaatgagttgagctt

SEQ ID NO: 619301 - DNA, 20 bp, Artificial
  CRISPR gRNA sequence
caaattatttctgataatgt

SEQ ID NO: 619302 - DNA, 20 bp, Artificial
  CRISPR gRNA sequence
ttagtctgtaggctgcctaa

SEQ ID NO: 619303 - DNA, 20 bp, Artificial
  CRISPR gRNA sequence
tctgtaggctgcctaaaaga

SEQ ID NO: 619304 - DNA, 20 bp, Artificial
  CRISPR gRNA sequence
taaaagaatgaattggttat

SEQ ID NO: 619305 - DNA, 20 bp, Artificial
  CRISPR gRNA sequence
gcaatccctaaggtttatca

SEQ ID NO: 619306 - DNA, 20 bp, Artificial
  CRISPR gRNA sequence
cagccttatataggaaaata

SEQ ID NO: 619307 - DNA, 20 bp, Artificial
  CRISPR gRNA sequence
tctcactttgccacccaggc

SEQ ID NO: 619308 - DNA, 20 bp, Artificial
  CRISPR gRNA sequence
gcttcagcctgccaagtaac

SEQ ID NO: 619309 - DNA, 20 bp, Artificial
  CRISPR gRNA sequence
ttttgtatttttagtagaga

SEQ ID NO: 619310 - DNA, 20 bp, Artificial
  CRISPR gRNA sequence
gccttgccttcccaaagttc

SEQ ID NO: 619311 - DNA, 20 bp, Artificial
  CRISPR gRNA sequence
cagtattaaatggtatagtt

SEQ ID NO: 619312 - DNA, 20 bp, Artificial
  CRISPR gRNA sequence
ggcttatacatagccaggtc

SEQ ID NO: 619313 - DNA, 20 bp, Artificial
  CRISPR gRNA sequence
gccaggtcaaggattatttc

SEQ ID NO: 619314 - DNA, 20 bp, Artificial
  CRISPR gRNA sequence
ggggttttctgtttgtttta

SEQ ID NO: 619315 - DNA, 20 bp, Artificial
  CRISPR gRNA sequence
cagctagtgattatgtgttg

SEQ ID NO: 619316 - DNA, 20 bp, Artificial
  CRISPR gRNA sequence
tgattatgtgttgttgagtt

SEQ ID NO: 619317 - DNA, 20 bp, Artificial
  CRISPR gRNA sequence
cttctagtttctataatcta

SEQ ID NO: 619318 - DNA, 20 bp, Artificial
  CRISPR gRNA sequence
ctgggctgatgatgatagca

SEQ ID NO: 619319 - DNA, 20 bp, Artificial
  CRISPR gRNA sequence
gattacaaaatggtgcgtct

SEQ ID NO: 619320 - DNA, 20 bp, Artificial
  CRISPR gRNA sequence
ctgctctggctacttcgtgt

SEQ ID NO: 619321 - DNA, 20 bp, Artificial
  CRISPR gRNA sequence
ctgggtgtgtcactcatagg

SEQ ID NO: 619322 - DNA, 20 bp, Artificial
  CRISPR gRNA sequence
gtcactcataggctgggttt

SEQ ID NO: 619323 - DNA, 20 bp, Artificial
  CRISPR gRNA sequence
ggtttgaggattaaatgtga

SEQ ID NO: 619324 - DNA, 20 bp, Artificial
  CRISPR gRNA sequence
catttgagaacattaaataa

SEQ ID NO: 619325 - DNA, 20 bp, Artificial
  CRISPR gRNA sequence
cactgttactatttaaattg

SEQ ID NO: 619326 - DNA, 20 bp, Artificial
  CRISPR gRNA sequence
ctatttaaattgatggattt

SEQ ID NO: 619327 - DNA, 20 bp, Artificial
  CRISPR gRNA sequence
ggaagctgatggaagcttgg

SEQ ID NO: 619328 - DNA, 20 bp, Artificial
  CRISPR gRNA sequence
tttgcattcctagttattta

SEQ ID NO: 619329 - DNA, 20 bp, Artificial
  CRISPR gRNA sequence
ataaattattataatcaaca

SEQ ID NO: 619330 - DNA, 20 bp, Artificial
  CRISPR gRNA sequence
gttggcagattgaactttta

SEQ ID NO: 619331 - DNA, 20 bp, Artificial
  CRISPR gRNA sequence
caagtgggggaaagtgggaa

SEQ ID NO: 619332 - DNA, 20 bp, Artificial
  CRISPR gRNA sequence
gtgggaaaggggtaggggca

SEQ ID NO: 619333 - DNA, 20 bp, Artificial
  CRISPR gRNA sequence
ggcactgggtaggtagagca

SEQ ID NO: 619334 - DNA, 20 bp, Artificial
  CRISPR gRNA sequence
gggtaaaaccaaagaggaga

SEQ ID NO: 619335 - DNA, 20 bp, Artificial
  CRISPR gRNA sequence
accaaagaggagaagggatt

SEQ ID NO: 619336 - DNA, 20 bp, Artificial
  CRISPR gRNA sequence
gaaacaaatattcttaaata

SEQ ID NO: 619337 - DNA, 20 bp, Artificial
  CRISPR gRNA sequence
catttcataccatacttttt

SEQ ID NO: 619338 - DNA, 20 bp, Artificial
  CRISPR gRNA sequence
ggaaattggccatacgaggt

SEQ ID NO: 619339 - DNA, 20 bp, Artificial
  CRISPR gRNA sequence
atggttctgtaaaatgctgc

SEQ ID NO: 619340 - DNA, 20 bp, Artificial
  CRISPR gRNA sequence
tccttttttgtggtagatat

SEQ ID NO: 619341 - DNA, 20 bp, Artificial
  CRISPR gRNA sequence
cctgtgttgttcttctagta

SEQ ID NO: 619342 - DNA, 20 bp, Artificial
  CRISPR gRNA sequence
ccaagttatatagaacattc

SEQ ID NO: 619343 - DNA, 20 bp, Artificial
  CRISPR gRNA sequence
aatgaaacaaaagctctaat

SEQ ID NO: 619344 - DNA, 20 bp, Artificial
  CRISPR gRNA sequence
gttctctgggaacatagatg

SEQ ID NO: 619345 - DNA, 20 bp, Artificial
  CRISPR gRNA sequence
aagagaggcttcttacatgc

SEQ ID NO: 619346 - DNA, 20 bp, Artificial
  CRISPR gRNA sequence
gagtgttcaatccaaacatg

SEQ ID NO: 619347 - DNA, 20 bp, Artificial
  CRISPR gRNA sequence
gttcaatccaaacatgaggg

SEQ ID NO: 619348 - DNA, 20 bp, Artificial
  CRISPR gRNA sequence
taaaaattgcatatatcagg

SEQ ID NO: 619349 - DNA, 20 bp, Artificial
  CRISPR gRNA sequence
catatatcaggcaggataca

SEQ ID NO: 619350 - DNA, 20 bp, Artificial
  CRISPR gRNA sequence
aattaacagcttccctgatg

SEQ ID NO: 619351 - DNA, 20 bp, Artificial
  CRISPR gRNA sequence
ttgagtgtaactgcagttta

SEQ ID NO: 619352 - DNA, 20 bp, Artificial
  CRISPR gRNA sequence
agtggtaggaaatgaagctt

SEQ ID NO: 619353 - DNA, 20 bp, Artificial
  CRISPR gRNA sequence
agtaggttgtgatgcaaaga

SEQ ID NO: 619354 - DNA, 20 bp, Artificial
  CRISPR gRNA sequence
cttctctgctaagctagtgt

SEQ ID NO: 619355 - DNA, 20 bp, Artificial
  CRISPR gRNA sequence
tgtaactgatggggggccac

SEQ ID NO: 619356 - DNA, 20 bp, Artificial
  CRISPR gRNA sequence
tcaagaaaaatgtctccaat

SEQ ID NO: 619357 - DNA, 20 bp, Artificial
  CRISPR gRNA sequence
ataaatgcctacctggggca

SEQ ID NO: 619358 - DNA, 20 bp, Artificial
  CRISPR gRNA sequence
ttgaagacatatttaggagg

SEQ ID NO: 619359 - DNA, 20 bp, Artificial
  CRISPR gRNA sequence
aatggtcttagaaaagttga

SEQ ID NO: 619360 - DNA, 20 bp, Artificial
  CRISPR gRNA sequence
attgagtttgaggaaaaagg

SEQ ID NO: 619361 - DNA, 20 bp, Artificial
  CRISPR gRNA sequence
catagttttggaaataataa

SEQ ID NO: 619362 - DNA, 20 bp, Artificial
  CRISPR gRNA sequence
tatataattaaattatttaa

SEQ ID NO: 619363 - DNA, 20 bp, Artificial
  CRISPR gRNA sequence
tgatgagcttatttatttta

SEQ ID NO: 619364 - DNA, 20 bp, Artificial
  CRISPR gRNA sequence
aaaatgaaagtgcaaagcag

SEQ ID NO: 619365 - DNA, 20 bp, Artificial
  CRISPR gRNA sequence
tatattgttaggtttatgct

SEQ ID NO: 619366 - DNA, 20 bp, Artificial
  CRISPR gRNA sequence
tattgggcacccccaaactt

SEQ ID NO: 619367 - DNA, 20 bp, Artificial
  CRISPR gRNA sequence
gcttttttgacttatttcta

SEQ ID NO: 619368 - DNA, 20 bp, Artificial
  CRISPR gRNA sequence
catcattcagtgaacatcca

SEQ ID NO: 619369 - DNA, 20 bp, Artificial
  CRISPR gRNA sequence
tattagagacacaaatacaa

SEQ ID NO: 619370 - DNA, 20 bp, Artificial
  CRISPR gRNA sequence
aaatcagcagaacatccaag

SEQ ID NO: 619371 - DNA, 20 bp, Artificial
  CRISPR gRNA sequence
aacatccaagaggaatttcc

SEQ ID NO: 619372 - DNA, 20 bp, Artificial
  CRISPR gRNA sequence
atgtgaactaataaatggag

SEQ ID NO: 619373 - DNA, 20 bp, Artificial
  CRISPR gRNA sequence
aatgtagcatctaaaacact

SEQ ID NO: 619374 - DNA, 20 bp, Artificial
  CRISPR gRNA sequence
ggaggaggagaggcagaaga

SEQ ID NO: 619375 - DNA, 20 bp, Artificial
  CRISPR gRNA sequence
ctggatgaaaggaagaaatc

SEQ ID NO: 619376 - DNA, 20 bp, Artificial
  CRISPR gRNA sequence
caggtgaccagcatggctga

SEQ ID NO: 619377 - DNA, 20 bp, Artificial
  CRISPR gRNA sequence
atagatctcaagctcttgag

SEQ ID NO: 619378 - DNA, 20 bp, Artificial
  CRISPR gRNA sequence
ctcaagctcttgagaggggt

SEQ ID NO: 619379 - DNA, 20 bp, Artificial
  CRISPR gRNA sequence
ctgagtaggaaacaaagatg

SEQ ID NO: 619380 - DNA, 20 bp, Artificial
  CRISPR gRNA sequence
gtagtttttaataaggcaat

SEQ ID NO: 619381 - DNA, 20 bp, Artificial
  CRISPR gRNA sequence
taaggcaatacggataagta

SEQ ID NO: 619382 - DNA, 20 bp, Artificial
  CRISPR gRNA sequence
aggaaaaaaatttcatgaag

SEQ ID NO: 619383 - DNA, 20 bp, Artificial
  CRISPR gRNA sequence
ttcatgaagatgagtaagag

SEQ ID NO: 619384 - DNA, 20 bp, Artificial
  CRISPR gRNA sequence
gagcagagtaggaacatgga

SEQ ID NO: 619385 - DNA, 20 bp, Artificial
  CRISPR gRNA sequence
tgtaaagttttttttttaga

SEQ ID NO: 619386 - DNA, 20 bp, Artificial
  CRISPR gRNA sequence
ttcctccttctcttgataac

SEQ ID NO: 619387 - DNA, 20 bp, Artificial
  CRISPR gRNA sequence
taacctaggtccctcagact

SEQ ID NO: 619388 - DNA, 20 bp, Artificial
  CRISPR gRNA sequence
aggtccctcagacttggaat

SEQ ID NO: 619389 - DNA, 20 bp, Artificial
  CRISPR gRNA sequence
ctcagacttggaatttgaat

SEQ ID NO: 619390 - DNA, 20 bp, Artificial
  CRISPR gRNA sequence
tgaactgtttggtttttcaa

SEQ ID NO: 619391 - DNA, 20 bp, Artificial
  CRISPR gRNA sequence
gtttttcaaaagaatacatt

SEQ ID NO: 619392 - DNA, 20 bp, Artificial
  CRISPR gRNA sequence
gtgatgaaacagtgatctaa

SEQ ID NO: 619393 - DNA, 20 bp, Artificial
  CRISPR gRNA sequence
acctcaaatataaggtcaaa

SEQ ID NO: 619394 - DNA, 20 bp, Artificial
  CRISPR gRNA sequence
atgcattattgagatatcta

SEQ ID NO: 619395 - DNA, 20 bp, Artificial
  CRISPR gRNA sequence
gtatacacagaaatattttg

SEQ ID NO: 619396 - DNA, 20 bp, Artificial
  CRISPR gRNA sequence
atgctcaaaatacctctaca

SEQ ID NO: 619397 - DNA, 20 bp, Artificial
  CRISPR gRNA sequence
gaggaaattacttaacatct

SEQ ID NO: 619398 - DNA, 20 bp, Artificial
  CRISPR gRNA sequence
atggtattacacctatttca

SEQ ID NO: 619399 - DNA, 20 bp, Artificial
  CRISPR gRNA sequence
acacctatttcatggagttt

SEQ ID NO: 619400 - DNA, 20 bp, Artificial
  CRISPR gRNA sequence
ctatttcatggagtttctgg

SEQ ID NO: 619401 - DNA, 20 bp, Artificial
  CRISPR gRNA sequence
ttgaactcgggacaaatcat

SEQ ID NO: 619402 - DNA, 20 bp, Artificial
  CRISPR gRNA sequence
gacaaatcatctgaattgag

SEQ ID NO: 619403 - DNA, 20 bp, Artificial
  CRISPR gRNA sequence
tcccacacccaggtttcgtt

SEQ ID NO: 619404 - DNA, 20 bp, Artificial
  CRISPR gRNA sequence
tgcgttcaaatatgaaaatt

SEQ ID NO: 619405 - DNA, 20 bp, Artificial
  CRISPR gRNA sequence
tcttgccaaattctttcatt

SEQ ID NO: 619406 - DNA, 20 bp, Artificial
  CRISPR gRNA sequence
attcttctgactccccttac

SEQ ID NO: 619407 - DNA, 20 bp, Artificial
  CRISPR gRNA sequence
cttacgtgaattggtcatcc

SEQ ID NO: 619408 - DNA, 20 bp, Artificial
  CRISPR gRNA sequence
ttttttagttgttactaaaa

SEQ ID NO: 619409 - DNA, 20 bp, Artificial
  CRISPR gRNA sequence
atctataggttaatcaaaac

SEQ ID NO: 619410 - DNA, 20 bp, Artificial
  CRISPR gRNA sequence
taggttaatcaaaacttgga

SEQ ID NO: 619411 - DNA, 20 bp, Artificial
  CRISPR gRNA sequence
ttggttattaaatacatcaa

SEQ ID NO: 619412 - DNA, 20 bp, Artificial
  CRISPR gRNA sequence
tacatcaactgaattgtgca

SEQ ID NO: 619413 - DNA, 20 bp, Artificial
  CRISPR gRNA sequence
cttatttttgtgtctgccaa

SEQ ID NO: 619414 - DNA, 20 bp, Artificial
  CRISPR gRNA sequence
ggactatcttatacaaatga

SEQ ID NO: 619415 - DNA, 20 bp, Artificial
  CRISPR gRNA sequence
tcttatacaaatgaaaggat

SEQ ID NO: 619416 - DNA, 20 bp, Artificial
  CRISPR gRNA sequence
aatcaactgattcgccttgt

SEQ ID NO: 619417 - DNA, 20 bp, Artificial
  CRISPR gRNA sequence
ttaagttctttgtctgcact

SEQ ID NO: 619418 - DNA, 20 bp, Artificial
  CRISPR gRNA sequence
tccatagcaacttagaaaaa

SEQ ID NO: 619419 - DNA, 20 bp, Artificial
  CRISPR gRNA sequence
tagcaacttagaaaaaaggg

SEQ ID NO: 619420 - DNA, 20 bp, Artificial
  CRISPR gRNA sequence
atgaatagggaacagcattg

SEQ ID NO: 619421 - DNA, 20 bp, Artificial
  CRISPR gRNA sequence
cattggagagtatatgtcaa

SEQ ID NO: 619422 - DNA, 20 bp, Artificial
  CRISPR gRNA sequence
gccaatgtgccaatttagaa

SEQ ID NO: 619423 - DNA, 20 bp, Artificial
  CRISPR gRNA sequence
ttactgtgcatagacatgtt

SEQ ID NO: 619424 - DNA, 20 bp, Artificial
  CRISPR gRNA sequence
aatacgctgcaggaaaatac

SEQ ID NO: 619425 - DNA, 20 bp, Artificial
  CRISPR gRNA sequence
aatgctaaaaacactttcag

SEQ ID NO: 619426 - DNA, 20 bp, Artificial
  CRISPR gRNA sequence
ggcaacagtgtatgtatgtc

SEQ ID NO: 619427 - DNA, 20 bp, Artificial
  CRISPR gRNA sequence
tatgtgtgtgtgcaaattta

SEQ ID NO: 619428 - DNA, 20 bp, Artificial
  CRISPR gRNA sequence
aagagtatactttcacacta

SEQ ID NO: 619429 - DNA, 20 bp, Artificial
  CRISPR gRNA sequence
ctgtcatagagaagctcacg

SEQ ID NO: 619430 - DNA, 20 bp, Artificial
  CRISPR gRNA sequence
gctccactccacaaaagttt

SEQ ID NO: 619431 - DNA, 20 bp, Artificial
  CRISPR gRNA sequence
tattggaacgctaagcatgt

SEQ ID NO: 619432 - DNA, 20 bp, Artificial
  CRISPR gRNA sequence
aatttcaacctcaggcataa

SEQ ID NO: 619433 - DNA, 20 bp, Artificial
  CRISPR gRNA sequence
aattattttcgtattttatc

SEQ ID NO: 619434 - DNA, 20 bp, Artificial
  CRISPR gRNA sequence
acattcaagatgtttcatat

SEQ ID NO: 619435 - DNA, 20 bp, Artificial
  CRISPR gRNA sequence
cgcccaatgttggcatcatt

SEQ ID NO: 619436 - DNA, 20 bp, Artificial
  CRISPR gRNA sequence
gtaagtcatagattgtctct

SEQ ID NO: 619437 - DNA, 20 bp, Artificial
  CRISPR gRNA sequence
atggactttttaaaagaaat

SEQ ID NO: 619438 - DNA, 20 bp, Artificial
  CRISPR gRNA sequence
aataatagagattcaataaa

SEQ ID NO: 619439 - DNA, 20 bp, Artificial
  CRISPR gRNA sequence
ttcaataaaaagaattgtta

SEQ ID NO: 619440 - DNA, 20 bp, Artificial
  CRISPR gRNA sequence
ttcattgtatatatatctat

SEQ ID NO: 619441 - DNA, 20 bp, Artificial
  CRISPR gRNA sequence
tttggttatttcagggagga

SEQ ID NO: 619442 - DNA, 20 bp, Artificial
  CRISPR gRNA sequence
agcactctaagactagctgg

SEQ ID NO: 619443 - DNA, 20 bp, Artificial
  CRISPR gRNA sequence
aactcattgaaagaaggcct

SEQ ID NO: 619444 - DNA, 20 bp, Artificial
  CRISPR gRNA sequence
tattatgtcagttgaagccc

SEQ ID NO: 619445 - DNA, 20 bp, Artificial
  CRISPR gRNA sequence
gtaactttttttctgttctt

SEQ ID NO: 619446 - DNA, 20 bp, Artificial
  CRISPR gRNA sequence
ttttaatattgatttttttg

SEQ ID NO: 619447 - DNA, 20 bp, Artificial
  CRISPR gRNA sequence
attattattctttctgtctt

SEQ ID NO: 619448 - DNA, 20 bp, Artificial
  CRISPR gRNA sequence
tttatattatatttttaatt

SEQ ID NO: 619449 - DNA, 20 bp, Artificial
  CRISPR gRNA sequence
atttttaattaagaatttga

SEQ ID NO: 619450 - DNA, 20 bp, Artificial
  CRISPR gRNA sequence
gagagaatatttttctttat

SEQ ID NO: 619451 - DNA, 20 bp, Artificial
  CRISPR gRNA sequence
ggagaaaattccacaggctg

SEQ ID NO: 619452 - DNA, 20 bp, Artificial
  CRISPR gRNA sequence
atgagttggcatcaatatat

SEQ ID NO: 619453 - DNA, 20 bp, Artificial
  CRISPR gRNA sequence
gttggcatcaatatatatga

SEQ ID NO: 619454 - DNA, 20 bp, Artificial
  CRISPR gRNA sequence
cctatggagcagcatccctg

SEQ ID NO: 619455 - DNA, 20 bp, Artificial
  CRISPR gRNA sequence
atcttatatctatattcaca

SEQ ID NO: 619456 - DNA, 20 bp, Artificial
  CRISPR gRNA sequence
acataatattaccaattcta

SEQ ID NO: 619457 - DNA, 20 bp, Artificial
  CRISPR gRNA sequence
tcattccccctcttgtgcac

SEQ ID NO: 619458 - DNA, 20 bp, Artificial
  CRISPR gRNA sequence
ttcaaagatgaaattgttga

SEQ ID NO: 619459 - DNA, 20 bp, Artificial
  CRISPR gRNA sequence
ctagcttctgtagtgccaaa

SEQ ID NO: 619460 - DNA, 20 bp, Artificial
  CRISPR gRNA sequence
agtatcttacacagctccta

SEQ ID NO: 619461 - DNA, 20 bp, Artificial
  CRISPR gRNA sequence
ctagagagtatctgccacta

SEQ ID NO: 619462 - DNA, 20 bp, Artificial
  CRISPR gRNA sequence
tagttctctccattaccaaa

SEQ ID NO: 619463 - DNA, 20 bp, Artificial
  CRISPR gRNA sequence
ggctcagaaccatttgggca

SEQ ID NO: 619464 - DNA, 20 bp, Artificial
  CRISPR gRNA sequence
accatttgggcaaggaattc

SEQ ID NO: 619465 - DNA, 20 bp, Artificial
  CRISPR gRNA sequence
tgggcaaggaattctggggt

SEQ ID NO: 619466 - DNA, 20 bp, Artificial
  CRISPR gRNA sequence
aaccccactttccctgatct

SEQ ID NO: 619467 - DNA, 20 bp, Artificial
  CRISPR gRNA sequence
ccatccccttcacactctac

SEQ ID NO: 619468 - DNA, 20 bp, Artificial
  CRISPR gRNA sequence
ctcaagcccaggtctctctt

SEQ ID NO: 619469 - DNA, 20 bp, Artificial
  CRISPR gRNA sequence
ttactcatagtcctcccaaa

SEQ ID NO: 619470 - DNA, 20 bp, Artificial
  CRISPR gRNA sequence
ttcctaaacccctttgctaa

SEQ ID NO: 619471 - DNA, 20 bp, Artificial
  CRISPR gRNA sequence
ttccaaactgtaagttcttt

SEQ ID NO: 619472 - DNA, 20 bp, Artificial
  CRISPR gRNA sequence
gacattgcatatatcttaag

SEQ ID NO: 619473 - DNA, 20 bp, Artificial
  CRISPR gRNA sequence
ggggccatttcttccaatct

SEQ ID NO: 619474 - DNA, 20 bp, Artificial
  CRISPR gRNA sequence
agaccacattgtcttaggga

SEQ ID NO: 619475 - DNA, 20 bp, Artificial
  CRISPR gRNA sequence
attatgttgatgtaaaatat

SEQ ID NO: 619476 - DNA, 20 bp, Artificial
  CRISPR gRNA sequence
aaaagtatgggaagctagca

SEQ ID NO: 619477 - DNA, 20 bp, Artificial
  CRISPR gRNA sequence
atacacatgtctaaataaga

SEQ ID NO: 619478 - DNA, 20 bp, Artificial
  CRISPR gRNA sequence
taagaaaggatgatataaaa

SEQ ID NO: 619479 - DNA, 20 bp, Artificial
  CRISPR gRNA sequence
aaacaatgagacaagatttt

SEQ ID NO: 619480 - DNA, 20 bp, Artificial
  CRISPR gRNA sequence
aatgacttttaaaaaatctc

SEQ ID NO: 619481 - DNA, 20 bp, Artificial
  CRISPR gRNA sequence
aaatctccagaatgacatat

SEQ ID NO: 619482 - DNA, 20 bp, Artificial
  CRISPR gRNA sequence
tattttttctgaaatagtgg

SEQ ID NO: 619483 - DNA, 20 bp, Artificial
  CRISPR gRNA sequence
tagtctctgacttgttttta

SEQ ID NO: 619484 - DNA, 20 bp, Artificial
  CRISPR gRNA sequence
tccttgagctctattcaagt

SEQ ID NO: 619485 - DNA, 20 bp, Artificial
  CRISPR gRNA sequence
ttttatatttttttcatgtc

SEQ ID NO: 619486 - DNA, 20 bp, Artificial
  CRISPR gRNA sequence
taacactttgggaggccaag

SEQ ID NO: 619487 - DNA, 20 bp, Artificial
  CRISPR gRNA sequence
actttgggaggccaaggtgg

SEQ ID NO: 619488 - DNA, 20 bp, Artificial
  CRISPR gRNA sequence
tgggtggatcacttgaggcc

SEQ ID NO: 619489 - DNA, 20 bp, Artificial
  CRISPR gRNA sequence
tactcaggtggctgaggcat

SEQ ID NO: 619490 - DNA, 20 bp, Artificial
  CRISPR gRNA sequence
aaaatgtgtgtgagcatcag

SEQ ID NO: 619491 - DNA, 20 bp, Artificial
  CRISPR gRNA sequence
ttgcccaaatacttgactta

SEQ ID NO: 619492 - DNA, 20 bp, Artificial
  CRISPR gRNA sequence
tctcaggtctatcatccaaa

SEQ ID NO: 619493 - DNA, 20 bp, Artificial
  CRISPR gRNA sequence
ctgatagtcatgaaaacaac

SEQ ID NO: 619494 - DNA, 20 bp, Artificial
  CRISPR gRNA sequence
ccatctctctcatcagacca

SEQ ID NO: 619495 - DNA, 20 bp, Artificial
  CRISPR gRNA sequence
cctctcccagcaatagctgc

SEQ ID NO: 619496 - DNA, 20 bp, Artificial
  CRISPR gRNA sequence
aaagcccagcttacatgaag

SEQ ID NO: 619497 - DNA, 20 bp, Artificial
  CRISPR gRNA sequence
tgaaggaggatgtcaaagct

SEQ ID NO: 619498 - DNA, 20 bp, Artificial
  CRISPR gRNA sequence
gccttcaagtgtgagcactg

SEQ ID NO: 619499 - DNA, 20 bp, Artificial
  CRISPR gRNA sequence
atgtcatgtacaccattcac

SEQ ID NO: 619500 - DNA, 20 bp, Artificial
  CRISPR gRNA sequence
ccatggctaccgggacccac

SEQ ID NO: 619501 - DNA, 20 bp, Artificial
  CRISPR gRNA sequence
ctacagaagccaggaccgtt

SEQ ID NO: 619502 - DNA, 20 bp, Artificial
  CRISPR gRNA sequence
aaacagaagagagaaggggc

SEQ ID NO: 619503 - DNA, 20 bp, Artificial
  CRISPR gRNA sequence
acctggcttgtttattttgt

SEQ ID NO: 619504 - DNA, 20 bp, Artificial
  CRISPR gRNA sequence
tctgatttgccactgatatt

SEQ ID NO: 619505 - DNA, 20 bp, Artificial
  CRISPR gRNA sequence
tgatggaagacaggaaagtt

SEQ ID NO: 619506 - DNA, 20 bp, Artificial
  CRISPR gRNA sequence
acaggaaagttcagagtttt

SEQ ID NO: 619507 - DNA, 20 bp, Artificial
  CRISPR gRNA sequence
agtaactttattcttgaaag

SEQ ID NO: 619508 - DNA, 20 bp, Artificial
  CRISPR gRNA sequence
gtgataactcctaagaggag

SEQ ID NO: 619509 - DNA, 20 bp, Artificial
  CRISPR gRNA sequence
ctaagaggagctgagttgtt

SEQ ID NO: 619510 - DNA, 20 bp, Artificial
  CRISPR gRNA sequence
ttctatgtttacttccccta

SEQ ID NO: 619511 - DNA, 20 bp, Artificial
  CRISPR gRNA sequence
ccttacttttaacaccttta

SEQ ID NO: 619512 - DNA, 20 bp, Artificial
  CRISPR gRNA sequence
tagtatttttatgtagtttt

SEQ ID NO: 619513 - DNA, 20 bp, Artificial
  CRISPR gRNA sequence
ttcagaataacatatggtct

SEQ ID NO: 619514 - DNA, 20 bp, Artificial
  CRISPR gRNA sequence
gaataacatatggtctaaga

SEQ ID NO: 619515 - DNA, 20 bp, Artificial
  CRISPR gRNA sequence
gttcattcatcctttactct

SEQ ID NO: 619516 - DNA, 20 bp, Artificial
  CRISPR gRNA sequence
agagcaattgctaatttggc

SEQ ID NO: 619517 - DNA, 20 bp, Artificial
  CRISPR gRNA sequence
tactcttgttgcaaagaaaa

SEQ ID NO: 619518 - DNA, 20 bp, Artificial
  CRISPR gRNA sequence
aagtttacttttacccttct

SEQ ID NO: 619519 - DNA, 20 bp, Artificial
  CRISPR gRNA sequence
cttttacccttcttggagtc

SEQ ID NO: 619520 - DNA, 20 bp, Artificial
  CRISPR gRNA sequence
tgtgtaagtccttgtcagaa

SEQ ID NO: 619521 - DNA, 20 bp, Artificial
  CRISPR gRNA sequence
tgaatctcaatcccttagta

SEQ ID NO: 619522 - DNA, 20 bp, Artificial
  CRISPR gRNA sequence
gccacattagaggggaggaa

SEQ ID NO: 619523 - DNA, 20 bp, Artificial
  CRISPR gRNA sequence
gaggacagacctgactgtga

SEQ ID NO: 619524 - DNA, 20 bp, Artificial
  CRISPR gRNA sequence
ggattatctgataaccattt

SEQ ID NO: 619525 - DNA, 20 bp, Artificial
  CRISPR gRNA sequence
agtaactgataactgctcta

SEQ ID NO: 619526 - DNA, 20 bp, Artificial
  CRISPR gRNA sequence
tgctctaaaggatcattaaa

SEQ ID NO: 619527 - DNA, 20 bp, Artificial
  CRISPR gRNA sequence
atcttaatacagtgtggtat

SEQ ID NO: 619528 - DNA, 20 bp, Artificial
  CRISPR gRNA sequence
tatgagaattaccaagtcaa

SEQ ID NO: 619529 - DNA, 20 bp, Artificial
  CRISPR gRNA sequence
actgccccctttaaatctaa

SEQ ID NO: 619530 - DNA, 20 bp, Artificial
  CRISPR gRNA sequence
tgcaccaaaacagagatata

SEQ ID NO: 619531 - DNA, 20 bp, Artificial
  CRISPR gRNA sequence
aaccactcccaaataataat

SEQ ID NO: 619532 - DNA, 20 bp, Artificial
  CRISPR gRNA sequence
ggatgccattttttttcctt

SEQ ID NO: 619533 - DNA, 20 bp, Artificial
  CRISPR gRNA sequence
actgcaatttaaggaaacat

SEQ ID NO: 619534 - DNA, 20 bp, Artificial
  CRISPR gRNA sequence
gttcataattttggctgtgt

SEQ ID NO: 619535 - DNA, 20 bp, Artificial
  CRISPR gRNA sequence
aatttctgctggcattatct

SEQ ID NO: 619536 - DNA, 20 bp, Artificial
  CRISPR gRNA sequence
aatcatgtatctacctgccc

SEQ ID NO: 619537 - DNA, 20 bp, Artificial
  CRISPR gRNA sequence
ttttctgatttcatcttttt

SEQ ID NO: 619538 - DNA, 20 bp, Artificial
  CRISPR gRNA sequence
attgaaggtagttagtagtt

SEQ ID NO: 619539 - DNA, 20 bp, Artificial
  CRISPR gRNA sequence
ttcatgaggaacagaaagag

SEQ ID NO: 619540 - DNA, 20 bp, Artificial
  CRISPR gRNA sequence
agaaagaggtggatatggct

SEQ ID NO: 619541 - DNA, 20 bp, Artificial
  CRISPR gRNA sequence
gacaaagtcaattcaaattt

SEQ ID NO: 619542 - DNA, 20 bp, Artificial
  CRISPR gRNA sequence
attcaaatttgtgggtcaga

SEQ ID NO: 619543 - DNA, 20 bp, Artificial
  CRISPR gRNA sequence
gtagtgtttttggagaaact

SEQ ID NO: 619544 - DNA, 20 bp, Artificial
  CRISPR gRNA sequence
tagcatctaaaaataaacat

SEQ ID NO: 619545 - DNA, 20 bp, Artificial
  CRISPR gRNA sequence
agtatttgaggagcatgaaa

SEQ ID NO: 619546 - DNA, 20 bp, Artificial
  CRISPR gRNA sequence
tttccagtttggcaaaagtt

SEQ ID NO: 619547 - DNA, 20 bp, Artificial
  CRISPR gRNA sequence
tgctttgccctaattttgcc

SEQ ID NO: 619548 - DNA, 20 bp, Artificial
  CRISPR gRNA sequence
ttagcctctctctgacagtg

SEQ ID NO: 619549 - DNA, 20 bp, Artificial
  CRISPR gRNA sequence
gacctttttaagacagggaa

SEQ ID NO: 619550 - DNA, 20 bp, Artificial
  CRISPR gRNA sequence
acagggaaagggatcagtag

SEQ ID NO: 619551 - DNA, 20 bp, Artificial
  CRISPR gRNA sequence
acatacaggcaattgtatgt

SEQ ID NO: 619552 - DNA, 20 bp, Artificial
  CRISPR gRNA sequence
gcaattgtatgtatgaatca

SEQ ID NO: 619553 - DNA, 20 bp, Artificial
  CRISPR gRNA sequence
tacacacacattcttttaaa

SEQ ID NO: 619554 - DNA, 20 bp, Artificial
  CRISPR gRNA sequence
ttcatggaaaaaaaagcagt

SEQ ID NO: 619555 - DNA, 20 bp, Artificial
  CRISPR gRNA sequence
atgtattgcaaaaacataca

SEQ ID NO: 619556 - DNA, 20 bp, Artificial
  CRISPR gRNA sequence
agttaataccaagaaattag

SEQ ID NO: 619557 - DNA, 20 bp, Artificial
  CRISPR gRNA sequence
ttactttatcaggtcgtaat

SEQ ID NO: 619558 - DNA, 20 bp, Artificial
  CRISPR gRNA sequence
gcaactcttaaactaaaact

SEQ ID NO: 619559 - DNA, 20 bp, Artificial
  CRISPR gRNA sequence
acaaacaatgattaagctga

SEQ ID NO: 619560 - DNA, 20 bp, Artificial
  CRISPR gRNA sequence
atatttaatgtaaagttttt

SEQ ID NO: 619561 - DNA, 20 bp, Artificial
  CRISPR gRNA sequence
attggcaaatagagaaagac

SEQ ID NO: 619562 - DNA, 20 bp, Artificial
  CRISPR gRNA sequence
ctatctccaaaatgatttct

SEQ ID NO: 619563 - DNA, 20 bp, Artificial
  CRISPR gRNA sequence
acatgatttgttttttaact

SEQ ID NO: 619564 - DNA, 20 bp, Artificial
  CRISPR gRNA sequence
tggattgttcacgtccaaaa

SEQ ID NO: 619565 - DNA, 20 bp, Artificial
  CRISPR gRNA sequence
attattttaataaatactat

SEQ ID NO: 619566 - DNA, 20 bp, Artificial
  CRISPR gRNA sequence
agtaactggtctcctaaatc

SEQ ID NO: 619567 - DNA, 20 bp, Artificial
  CRISPR gRNA sequence
gtgcctttttaaaatgcatt

SEQ ID NO: 619568 - DNA, 20 bp, Artificial
  CRISPR gRNA sequence
tttttaaaaatcacttaaaa

SEQ ID NO: 619569 - DNA, 20 bp, Artificial
  CRISPR gRNA sequence
tttttagtttcatagtattt

SEQ ID NO: 619570 - DNA, 20 bp, Artificial
  CRISPR gRNA sequence
aagattatgcaggtaaaata

SEQ ID NO: 619571 - DNA, 20 bp, Artificial
  CRISPR gRNA sequence
tatagagtgaaactttacct

SEQ ID NO: 619572 - DNA, 20 bp, Artificial
  CRISPR gRNA sequence
agtgaaactttacctgtgaa

SEQ ID NO: 619573 - DNA, 20 bp, Artificial
  CRISPR gRNA sequence
tttttgttttgtttttaagg

SEQ ID NO: 619574 - DNA, 20 bp, Artificial
  CRISPR gRNA sequence
gaataagttctgtatcaaac

SEQ ID NO: 619575 - DNA, 20 bp, Artificial
  CRISPR gRNA sequence
caataaaatacagtattcat

SEQ ID NO: 619576 - DNA, 20 bp, Artificial
  CRISPR gRNA sequence
gactagtattgttctagtct

SEQ ID NO: 619577 - DNA, 20 bp, Artificial
  CRISPR gRNA sequence
aaatagagattgaaaattga

SEQ ID NO: 619578 - DNA, 20 bp, Artificial
  CRISPR gRNA sequence
atggttgtgtattacttgca

SEQ ID NO: 619579 - DNA, 20 bp, Artificial
  CRISPR gRNA sequence
attacttgcaatgggtgtgt

SEQ ID NO: 619580 - DNA, 20 bp, Artificial
  CRISPR gRNA sequence
ctaggccaaataatgacacc

SEQ ID NO: 619581 - DNA, 20 bp, Artificial
  CRISPR gRNA sequence
attgcagaaaccttaaactt

SEQ ID NO: 619582 - DNA, 20 bp, Artificial
  CRISPR gRNA sequence
tcttgctgtactgtaagttt

SEQ ID NO: 619583 - DNA, 20 bp, Artificial
  CRISPR gRNA sequence
tatttttcacctgcactctt

SEQ ID NO: 619584 - DNA, 20 bp, Artificial
  CRISPR gRNA sequence
attaacctttatcccataca

SEQ ID NO: 619585 - DNA, 20 bp, Artificial
  CRISPR gRNA sequence
tcccatacagagagtggtac

SEQ ID NO: 619586 - DNA, 20 bp, Artificial
  CRISPR gRNA sequence
tctaagatgtcctttttatt

SEQ ID NO: 619587 - DNA, 20 bp, Artificial
  CRISPR gRNA sequence
gttcatataggtacaaataa

SEQ ID NO: 619588 - DNA, 20 bp, Artificial
  CRISPR gRNA sequence
tacaaataaatgagtttgca

SEQ ID NO: 619589 - DNA, 20 bp, Artificial
  CRISPR gRNA sequence
tcttgagcaggtggaggtca

SEQ ID NO: 619590 - DNA, 20 bp, Artificial
  CRISPR gRNA sequence
gactacactgtaacaaggga

SEQ ID NO: 619591 - DNA, 20 bp, Artificial
  CRISPR gRNA sequence
actgtaacaagggaagggat

SEQ ID NO: 619592 - DNA, 20 bp, Artificial
  CRISPR gRNA sequence
tctcccttctgtcattgtct

SEQ ID NO: 619593 - DNA, 20 bp, Artificial
  CRISPR gRNA sequence
tctattaaaaagaaaagtgg

SEQ ID NO: 619594 - DNA, 20 bp, Artificial
  CRISPR gRNA sequence
gttactttcactttcaaata

SEQ ID NO: 619595 - DNA, 20 bp, Artificial
  CRISPR gRNA sequence
atgtttgctttcctttattg

SEQ ID NO: 619596 - DNA, 20 bp, Artificial
  CRISPR gRNA sequence
ggtgttaaaaatgtaaagca

SEQ ID NO: 619597 - DNA, 20 bp, Artificial
  CRISPR gRNA sequence
aataatattccaggtttgga

SEQ ID NO: 619598 - DNA, 20 bp, Artificial
  CRISPR gRNA sequence
ccatgtgttatttgcaatcc

SEQ ID NO: 619599 - DNA, 20 bp, Artificial
  CRISPR gRNA sequence
actccacaatcaaaagatta

SEQ ID NO: 619600 - DNA, 20 bp, Artificial
  CRISPR gRNA sequence
aaagttgaactttttacaga

SEQ ID NO: 619601 - DNA, 20 bp, Artificial
  CRISPR gRNA sequence
aataaaagcaaagcacttag

SEQ ID NO: 619602 - DNA, 20 bp, Artificial
  CRISPR gRNA sequence
actaattgcttgacagtttc

SEQ ID NO: 619603 - DNA, 20 bp, Artificial
  CRISPR gRNA sequence
tggttactgtgtatatgtgt

SEQ ID NO: 619604 - DNA, 20 bp, Artificial
  CRISPR gRNA sequence
tgagtgttgtatatgcatgt

SEQ ID NO: 619605 - DNA, 20 bp, Artificial
  CRISPR gRNA sequence
actttgtaatactttgtgaa

SEQ ID NO: 619606 - DNA, 20 bp, Artificial
  CRISPR gRNA sequence
attataaaggtttgtactgt

SEQ ID NO: 619607 - DNA, 20 bp, Artificial
  CRISPR gRNA sequence
ctgtctgagtgcacagctac

SEQ ID NO: 619608 - DNA, 20 bp, Artificial
  CRISPR gRNA sequence
cagctactggaataaattta

SEQ ID NO: 619609 - DNA, 20 bp, Artificial
  CRISPR gRNA sequence
tagtcttctgtatttggaag

SEQ ID NO: 619610 - DNA, 20 bp, Artificial
  CRISPR gRNA sequence
tgtgtacagaattttcacca

SEQ ID NO: 619611 - DNA, 20 bp, Artificial
  CRISPR gRNA sequence
tatagcaaactttttatgtc

SEQ ID NO: 619612 - DNA, 20 bp, Artificial
  CRISPR gRNA sequence
aaataaatcttggacaaatt

SEQ ID NO: 619613 - DNA, 20 bp, Artificial
  CRISPR gRNA sequence
gacaaattatatgcttgttc

SEQ ID NO: 619614 - DNA, 20 bp, Artificial
  CRISPR gRNA sequence
atccttttcacaaagtatta

SEQ ID NO: 619615 - DNA, 20 bp, Artificial
  CRISPR gRNA sequence
acaaagtattacaaagtttc

SEQ ID NO: 619616 - DNA, 20 bp, Artificial
  CRISPR gRNA sequence
acttgtcacacagctgcaaa

SEQ ID NO: 619617 - DNA, 20 bp, Artificial
  CRISPR gRNA sequence
tatatatttcttttttaaac

SEQ ID NO: 619618 - DNA, 20 bp, Artificial
  CRISPR gRNA sequence
agtttttatttccccaaatt

SEQ ID NO: 619619 - DNA, 20 bp, Artificial
  CRISPR gRNA sequence
attattagtttgaaaaaaaa

SEQ ID NO: 619620 - DNA, 20 bp, Artificial
  CRISPR gRNA sequence
tttgaaaaaaaatgaggttt

SEQ ID NO: 619621 - DNA, 20 bp, Artificial
  CRISPR gRNA sequence
tgacctatttttttttcttt

SEQ ID NO: 619622 - DNA, 20 bp, Artificial
  CRISPR gRNA sequence
aaaacatgtatttatattac

SEQ ID NO: 619623 - DNA, 20 bp, Artificial
  CRISPR gRNA sequence
ttctccaataggtgatatgt

SEQ ID NO: 619624 - DNA, 20 bp, Artificial
  CRISPR gRNA sequence
taagtgtttaaaactcagct

SEQ ID NO: 619625 - DNA, 20 bp, Artificial
  CRISPR gRNA sequence
gtttaaaactcagctaagtg

SEQ ID NO: 619626 - DNA, 20 bp, Artificial
  CRISPR gRNA sequence
taagtgctttgcttttattt

SEQ ID NO: 619627 - DNA, 20 bp, Artificial
  CRISPR gRNA sequence
gagcattgggcgagggtcta

SEQ ID NO: 619628 - DNA, 20 bp, Artificial
  CRISPR gRNA sequence
ttaggacacatttttcaagc

SEQ ID NO: 619629 - DNA, 20 bp, Artificial
  CRISPR gRNA sequence
attactaatttccatggaaa

SEQ ID NO: 619630 - DNA, 20 bp, Artificial
  CRISPR gRNA sequence
agataccatgagatcagact

SEQ ID NO: 619631 - DNA, 20 bp, Artificial
  CRISPR gRNA sequence
ggtttccacattctgtaatc

SEQ ID NO: 619632 - DNA, 20 bp, Artificial
  CRISPR gRNA sequence
tctgtaatcttttgattgtg

SEQ ID NO: 619633 - DNA, 20 bp, Artificial
  CRISPR gRNA sequence
tgattgtggagtgtttttct

SEQ ID NO: 619634 - DNA, 20 bp, Artificial
  CRISPR gRNA sequence
tttaacatactatgactttt

SEQ ID NO: 619635 - DNA, 20 bp, Artificial
  CRISPR gRNA sequence
agaaaagaaaaaaaaatcac

SEQ ID NO: 619636 - DNA, 20 bp, Artificial
  CRISPR gRNA sequence
taatagcagaagcaatcatt

SEQ ID NO: 619637 - DNA, 20 bp, Artificial
  CRISPR gRNA sequence
attaggagaaagttaagact

SEQ ID NO: 619638 - DNA, 20 bp, Artificial
  CRISPR gRNA sequence
aggaaagcaaacatactata

SEQ ID NO: 619639 - DNA, 20 bp, Artificial
  CRISPR gRNA sequence
ggattacataatctctgaag

SEQ ID NO: 619640 - DNA, 20 bp, Artificial
  CRISPR gRNA sequence
tgaaagtaacatgagggtta

SEQ ID NO: 619641 - DNA, 20 bp, Artificial
  CRISPR gRNA sequence
cttgagtataaaaatacgtc

SEQ ID NO: 619642 - DNA, 20 bp, Artificial
  CRISPR gRNA sequence
caaaaatcacgaaaaaaaaa

SEQ ID NO: 619643 - DNA, 20 bp, Artificial
  CRISPR gRNA sequence
gggagttatgttcaaaatca

SEQ ID NO: 619644 - DNA, 20 bp, Artificial
  CRISPR gRNA sequence
actgtaaaaaatttttaaat

SEQ ID NO: 619645 - DNA, 20 bp, Artificial
  CRISPR gRNA sequence
aatcttggtaagtgcatagt

SEQ ID NO: 619646 - DNA, 20 bp, Artificial
  CRISPR gRNA sequence
cagtgacctccacctgctca

SEQ ID NO: 619647 - DNA, 20 bp, Artificial
  CRISPR gRNA sequence
taaaaaccttatggaaattc

SEQ ID NO: 619648 - DNA, 20 bp, Artificial
  CRISPR gRNA sequence
cttatggaaattccaaagtt

SEQ ID NO: 619649 - DNA, 20 bp, Artificial
  CRISPR gRNA sequence
aaaaagaaacactagcatat

SEQ ID NO: 619650 - DNA, 20 bp, Artificial
  CRISPR gRNA sequence
cagcttcttggtcatatgcc

SEQ ID NO: 619651 - DNA, 20 bp, Artificial
  CRISPR gRNA sequence
caaccatgatatgaaaccat

SEQ ID NO: 619652 - DNA, 20 bp, Artificial
  CRISPR gRNA sequence
tgatatgaaaccatttgaga

SEQ ID NO: 619653 - DNA, 20 bp, Artificial
  CRISPR gRNA sequence
atagcaatgtgatatgactg

SEQ ID NO: 619654 - DNA, 20 bp, Artificial
  CRISPR gRNA sequence
aatgtgatatgactgttcag

SEQ ID NO: 619655 - DNA, 20 bp, Artificial
  CRISPR gRNA sequence
ttgttcaaggagaattaatt

SEQ ID NO: 619656 - DNA, 20 bp, Artificial
  CRISPR gRNA sequence
attttcaatctctattttct

SEQ ID NO: 619657 - DNA, 20 bp, Artificial
  CRISPR gRNA sequence
ttttctaacagattagaaaa

SEQ ID NO: 619658 - DNA, 20 bp, Artificial
  CRISPR gRNA sequence
caaaaaattatctaataaat

SEQ ID NO: 619659 - DNA, 20 bp, Artificial
  CRISPR gRNA sequence
attataattcaattcacagg

SEQ ID NO: 619660 - DNA, 20 bp, Artificial
  CRISPR gRNA sequence
aaactaaaaaggtagtaaag

SEQ ID NO: 619661 - DNA, 20 bp, Artificial
  CRISPR gRNA sequence
aaggtagtaaagtctagttt

SEQ ID NO: 619662 - DNA, 20 bp, Artificial
  CRISPR gRNA sequence
ttctctattagaaattgctc

SEQ ID NO: 619663 - DNA, 20 bp, Artificial
  CRISPR gRNA sequence
attatatagtactcaatttt

SEQ ID NO: 619664 - DNA, 20 bp, Artificial
  CRISPR gRNA sequence
aagtatttaatacattaaat

SEQ ID NO: 619665 - DNA, 20 bp, Artificial
  CRISPR gRNA sequence
tcttcccactttttttttct

SEQ ID NO: 619666 - DNA, 20 bp, Artificial
  CRISPR gRNA sequence
cttttggatttggggaattt

SEQ ID NO: 619667 - DNA, 20 bp, Artificial
  CRISPR gRNA sequence
atcatgtagctagtacctct

SEQ ID NO: 619668 - DNA, 20 bp, Artificial
  CRISPR gRNA sequence
tctgcctgaaactaggggca

SEQ ID NO: 619669 - DNA, 20 bp, Artificial
  CRISPR gRNA sequence
gaaactaggggcacacagtt

SEQ ID NO: 619670 - DNA, 20 bp, Artificial
  CRISPR gRNA sequence
ttataaaataccaaagactt

SEQ ID NO: 619671 - DNA, 20 bp, Artificial
  CRISPR gRNA sequence
tatctttgaatgtatatcca

SEQ ID NO: 619672 - DNA, 20 bp, Artificial
  CRISPR gRNA sequence
gtatatccaatcagcttaat

SEQ ID NO: 619673 - DNA, 20 bp, Artificial
  CRISPR gRNA sequence
atccaatcagcttaatcatt

SEQ ID NO: 619674 - DNA, 20 bp, Artificial
  CRISPR gRNA sequence
gtaagtagataataaggacc

SEQ ID NO: 619675 - DNA, 20 bp, Artificial
  CRISPR gRNA sequence
agataataaggacccaaagt

SEQ ID NO: 619676 - DNA, 20 bp, Artificial
  CRISPR gRNA sequence
agacacactagtaacttctt

SEQ ID NO: 619677 - DNA, 20 bp, Artificial
  CRISPR gRNA sequence
aactgtcatttaaattctct

SEQ ID NO: 619678 - DNA, 20 bp, Artificial
  CRISPR gRNA sequence
gcaatacatctgatcactcc

SEQ ID NO: 619679 - DNA, 20 bp, Artificial
  CRISPR gRNA sequence
agtatacacacacatatacc

SEQ ID NO: 619680 - DNA, 20 bp, Artificial
  CRISPR gRNA sequence
ctacgtagccaaatctaagt

SEQ ID NO: 619681 - DNA, 20 bp, Artificial
  CRISPR gRNA sequence
tcttaaaaaggtccaattag

SEQ ID NO: 619682 - DNA, 20 bp, Artificial
  CRISPR gRNA sequence
ccaattagaatggcttttga

SEQ ID NO: 619683 - DNA, 20 bp, Artificial
  CRISPR gRNA sequence
gcatacaactgttatgtaaa

SEQ ID NO: 619684 - DNA, 20 bp, Artificial
  CRISPR gRNA sequence
atttatttggtgtctgactc

SEQ ID NO: 619685 - DNA, 20 bp, Artificial
  CRISPR gRNA sequence
ggcatgcacatataaccatc

SEQ ID NO: 619686 - DNA, 20 bp, Artificial
  CRISPR gRNA sequence
gaagctaggaagatacaagt

SEQ ID NO: 619687 - DNA, 20 bp, Artificial
  CRISPR gRNA sequence
ctactaactaccttcaataa

SEQ ID NO: 619688 - DNA, 20 bp, Artificial
  CRISPR gRNA sequence
gtgcctcagcactgtcttca

SEQ ID NO: 619689 - DNA, 20 bp, Artificial
  CRISPR gRNA sequence
aggtttagggtccacctaaa

SEQ ID NO: 619690 - DNA, 20 bp, Artificial
  CRISPR gRNA sequence
tcatcctggggcaggtagat

SEQ ID NO: 619691 - DNA, 20 bp, Artificial
  CRISPR gRNA sequence
gaacatattgactgacatcc

SEQ ID NO: 619692 - DNA, 20 bp, Artificial
  CRISPR gRNA sequence
ggggtgagcgagtctcaaaa

SEQ ID NO: 619693 - DNA, 20 bp, Artificial
  CRISPR gRNA sequence
atggttgacattctatatat

SEQ ID NO: 619694 - DNA, 20 bp, Artificial
  CRISPR gRNA sequence
tctctgttttggtgcattcc

SEQ ID NO: 619695 - DNA, 20 bp, Artificial
  CRISPR gRNA sequence
attcccttagatttaaaggg

SEQ ID NO: 619696 - DNA, 20 bp, Artificial
  CRISPR gRNA sequence
ttgcctagttctagctgtgt

SEQ ID NO: 619697 - DNA, 20 bp, Artificial
  CRISPR gRNA sequence
ctagctgtgttagtgcttag

SEQ ID NO: 619698 - DNA, 20 bp, Artificial
  CRISPR gRNA sequence
aagagcagtattggggccaa

SEQ ID NO: 619699 - DNA, 20 bp, Artificial
  CRISPR gRNA sequence
tgtaaggggaattctatact

SEQ ID NO: 619700 - DNA, 20 bp, Artificial
  CRISPR gRNA sequence
gggaattctatactaaggga

SEQ ID NO: 619701 - DNA, 20 bp, Artificial
  CRISPR gRNA sequence
tgacaaggacttacacaatt

SEQ ID NO: 619702 - DNA, 20 bp, Artificial
  CRISPR gRNA sequence
aaaagtaaactttcttattt

SEQ ID NO: 619703 - DNA, 20 bp, Artificial
  CRISPR gRNA sequence
aaccttacagggttcaagtt

SEQ ID NO: 619704 - DNA, 20 bp, Artificial
  CRISPR gRNA sequence
ccaaattagcaattgctctg

SEQ ID NO: 619705 - DNA, 20 bp, Artificial
  CRISPR gRNA sequence
tgaaaagagaaataccagaa

SEQ ID NO: 619706 - DNA, 20 bp, Artificial
  CRISPR gRNA sequence
accagaaaagggatttctaa

SEQ ID NO: 619707 - DNA, 20 bp, Artificial
  CRISPR gRNA sequence
tttttctgctgactggttaa

SEQ ID NO: 619708 - DNA, 20 bp, Artificial
  CRISPR gRNA sequence
tcatcaaaactatggaaaaa

SEQ ID NO: 619709 - DNA, 20 bp, Artificial
  CRISPR gRNA sequence
aaactatggaaaaacagtgc

SEQ ID NO: 619710 - DNA, 20 bp, Artificial
  CRISPR gRNA sequence
gtaggtggcccttaactacc

SEQ ID NO: 619711 - DNA, 20 bp, Artificial
  CRISPR gRNA sequence
cccttaactacctgtagttt

SEQ ID NO: 619712 - DNA, 20 bp, Artificial
  CRISPR gRNA sequence
agttatcactgaaaataaca

SEQ ID NO: 619713 - DNA, 20 bp, Artificial
  CRISPR gRNA sequence
tgatctctgaagaacaaaaa

SEQ ID NO: 619714 - DNA, 20 bp, Artificial
  CRISPR gRNA sequence
tgaagaacaaaaaattggtt

SEQ ID NO: 619715 - DNA, 20 bp, Artificial
  CRISPR gRNA sequence
taggtgaatctttatgaatc

SEQ ID NO: 619716 - DNA, 20 bp, Artificial
  CRISPR gRNA sequence
atattcccgccccttctctc

SEQ ID NO: 619717 - DNA, 20 bp, Artificial
  CRISPR gRNA sequence
atgtcaacatttgaggaaag

SEQ ID NO: 619718 - DNA, 20 bp, Artificial
  CRISPR gRNA sequence
tgatgaaaactcataacggt

SEQ ID NO: 619719 - DNA, 20 bp, Artificial
  CRISPR gRNA sequence
ttaggagccttggtagtatc

SEQ ID NO: 619720 - DNA, 20 bp, Artificial
  CRISPR gRNA sequence
gacatcctccttcatgtaag

SEQ ID NO: 619721 - DNA, 20 bp, Artificial
  CRISPR gRNA sequence
cctccttcatgtaagctggg

SEQ ID NO: 619722 - DNA, 20 bp, Artificial
  CRISPR gRNA sequence
aagctgggctttgtttcctc

SEQ ID NO: 619723 - DNA, 20 bp, Artificial
  CRISPR gRNA sequence
gtaggactggtggtcatcat

SEQ ID NO: 619724 - DNA, 20 bp, Artificial
  CRISPR gRNA sequence
gagagagatggggccatcca

SEQ ID NO: 619725 - DNA, 20 bp, Artificial
  CRISPR gRNA sequence
atgttgttttcatgactatc

SEQ ID NO: 619726 - DNA, 20 bp, Artificial
  CRISPR gRNA sequence
atgatagacctgagaataag

SEQ ID NO: 619727 - DNA, 20 bp, Artificial
  CRISPR gRNA sequence
gcttataactggggccactt

SEQ ID NO: 619728 - DNA, 20 bp, Artificial
  CRISPR gRNA sequence
aactggggccacttcagcga

SEQ ID NO: 619729 - DNA, 20 bp, Artificial
  CRISPR gRNA sequence
aagggcctcagctccaaggt

SEQ ID NO: 619730 - DNA, 20 bp, Artificial
  CRISPR gRNA sequence
aggtaggtgattgcattgtt

SEQ ID NO: 619731 - DNA, 20 bp, Artificial
  CRISPR gRNA sequence
tatctgggtagctgaatcgc

SEQ ID NO: 619732 - DNA, 20 bp, Artificial
  CRISPR gRNA sequence
aaaaatacaacaacattagt

SEQ ID NO: 619733 - DNA, 20 bp, Artificial
  CRISPR gRNA sequence
atatgaaagggtacgaagtt

SEQ ID NO: 619734 - DNA, 20 bp, Artificial
  CRISPR gRNA sequence
aacctccacctctccagttc

SEQ ID NO: 619735 - DNA, 20 bp, Artificial
  CRISPR gRNA sequence
ttttgtatttttagtagaga

SEQ ID NO: 619736 - DNA, 20 bp, Artificial
  CRISPR gRNA sequence
caccttggcctcccaaagtg

SEQ ID NO: 619737 - DNA, 20 bp, Artificial
  CRISPR gRNA sequence
gaatgcatctagtctgaaag

SEQ ID NO: 619738 - DNA, 20 bp, Artificial
  CRISPR gRNA sequence
atctagtctgaaagatatga

SEQ ID NO: 619739 - DNA, 20 bp, Artificial
  CRISPR gRNA sequence
cagtaaaaacaagtcagaga

SEQ ID NO: 619740 - DNA, 20 bp, Artificial
  CRISPR gRNA sequence
aaaaacaagtcagagactat

SEQ ID NO: 619741 - DNA, 20 bp, Artificial
  CRISPR gRNA sequence
ctgttgtgtagggttaagtt

SEQ ID NO: 619742 - DNA, 20 bp, Artificial
  CRISPR gRNA sequence
ataacccatatatgtcattc

SEQ ID NO: 619743 - DNA, 20 bp, Artificial
  CRISPR gRNA sequence
aaactcggaaaatcttgtct

SEQ ID NO: 619744 - DNA, 20 bp, Artificial
  CRISPR gRNA sequence
cggaaaatcttgtctcattg

SEQ ID NO: 619745 - DNA, 20 bp, Artificial
  CRISPR gRNA sequence
tgctggtacgtacacccatt

SEQ ID NO: 619746 - DNA, 20 bp, Artificial
  CRISPR gRNA sequence
tgctagcttcccatactttt

SEQ ID NO: 619747 - DNA, 20 bp, Artificial
  CRISPR gRNA sequence
catactttttcttgattgaa

SEQ ID NO: 619748 - DNA, 20 bp, Artificial
  CRISPR gRNA sequence
tttcttgattgaagcatgtt

SEQ ID NO: 619749 - DNA, 20 bp, Artificial
  CRISPR gRNA sequence
tgtctgactgttaactataa

SEQ ID NO: 619750 - DNA, 20 bp, Artificial
  CRISPR gRNA sequence
tgttaactataaaagagttt

SEQ ID NO: 619751 - DNA, 20 bp, Artificial
  CRISPR gRNA sequence
ttggtgcttgcaacgggaaa

SEQ ID NO: 619752 - DNA, 20 bp, Artificial
  CRISPR gRNA sequence
gcttgcaacgggaaaagtag

SEQ ID NO: 619753 - DNA, 20 bp, Artificial
  CRISPR gRNA sequence
ttgatttttagccagatatt

SEQ ID NO: 619754 - DNA, 20 bp, Artificial
  CRISPR gRNA sequence
cataggtaaatcttacagat

SEQ ID NO: 619755 - DNA, 20 bp, Artificial
  CRISPR gRNA sequence
aatgcttcttaaaaacatat

SEQ ID NO: 619756 - DNA, 20 bp, Artificial
  CRISPR gRNA sequence
gttaatatgttgttgtggat

SEQ ID NO: 619757 - DNA, 20 bp, Artificial
  CRISPR gRNA sequence
ttgtaattttggcagatact

SEQ ID NO: 619758 - DNA, 20 bp, Artificial
  CRISPR gRNA sequence
gcccctacgtgagatcagtg

SEQ ID NO: 619759 - DNA, 20 bp, Artificial
  CRISPR gRNA sequence
atctatattcttaaagaact

SEQ ID NO: 619760 - DNA, 20 bp, Artificial
  CRISPR gRNA sequence
aaatggaatcaaggacaata

SEQ ID NO: 619761 - DNA, 20 bp, Artificial
  CRISPR gRNA sequence
tgaatatttccctaaaggaa

SEQ ID NO: 619762 - DNA, 20 bp, Artificial
  CRISPR gRNA sequence
tgaaggtattcatttagcaa

SEQ ID NO: 619763 - DNA, 20 bp, Artificial
  CRISPR gRNA sequence
gggtttaggaaattgctgct

SEQ ID NO: 619764 - DNA, 20 bp, Artificial
  CRISPR gRNA sequence
gagatagaaaagatgatgaa

SEQ ID NO: 619765 - DNA, 20 bp, Artificial
  CRISPR gRNA sequence
atgagtaataataatgtcca

SEQ ID NO: 619766 - DNA, 20 bp, Artificial
  CRISPR gRNA sequence
ctcaaattcagaagagagac

SEQ ID NO: 619767 - DNA, 20 bp, Artificial
  CRISPR gRNA sequence
aaatagaacctggaataaca

SEQ ID NO: 619768 - DNA, 20 bp, Artificial
  CRISPR gRNA sequence
tactcatagatcagggaaag

SEQ ID NO: 619769 - DNA, 20 bp, Artificial
  CRISPR gRNA sequence
agtggggtttgcactgggcc

SEQ ID NO: 619770 - DNA, 20 bp, Artificial
  CRISPR gRNA sequence
gcctttcttctcaggaaatg

SEQ ID NO: 619771 - DNA, 20 bp, Artificial
  CRISPR gRNA sequence
ccttgcccaaatggttctga

SEQ ID NO: 619772 - DNA, 20 bp, Artificial
  CRISPR gRNA sequence
tcaagttggaagggtagaaa

SEQ ID NO: 619773 - DNA, 20 bp, Artificial
  CRISPR gRNA sequence
ggtagaaaataagttttaca

SEQ ID NO: 619774 - DNA, 20 bp, Artificial
  CRISPR gRNA sequence
tcataaaaaccaagaaaaga

SEQ ID NO: 619775 - DNA, 20 bp, Artificial
  CRISPR gRNA sequence
atactgtcttaaaagagtct

SEQ ID NO: 619776 - DNA, 20 bp, Artificial
  CRISPR gRNA sequence
aaaatcattgaaaacaagca

SEQ ID NO: 619777 - DNA, 20 bp, Artificial
  CRISPR gRNA sequence
caggtgtacctggaaggaga

SEQ ID NO: 619778 - DNA, 20 bp, Artificial
  CRISPR gRNA sequence
ggaaggagatggggcttaaa

SEQ ID NO: 619779 - DNA, 20 bp, Artificial
  CRISPR gRNA sequence
ctttaattagaaagagggat

SEQ ID NO: 619780 - DNA, 20 bp, Artificial
  CRISPR gRNA sequence
tattatgttgaaatcagttc

SEQ ID NO: 619781 - DNA, 20 bp, Artificial
  CRISPR gRNA sequence
gatcaccaaggagtgagaca

SEQ ID NO: 619782 - DNA, 20 bp, Artificial
  CRISPR gRNA sequence
gtcatggtggagagcaggag

SEQ ID NO: 619783 - DNA, 20 bp, Artificial
  CRISPR gRNA sequence
aagtatggaaaggatgctca

SEQ ID NO: 619784 - DNA, 20 bp, Artificial
  CRISPR gRNA sequence
cagtcagctttacaagacag

SEQ ID NO: 619785 - DNA, 20 bp, Artificial
  CRISPR gRNA sequence
aagtgtggaatgatgaaatt

SEQ ID NO: 619786 - DNA, 20 bp, Artificial
  CRISPR gRNA sequence
acagaagtagttactatggc

SEQ ID NO: 619787 - DNA, 20 bp, Artificial
  CRISPR gRNA sequence
tccaactacattagagtcta

SEQ ID NO: 619788 - DNA, 20 bp, Artificial
  CRISPR gRNA sequence
cagtcctttgtgtataactc

SEQ ID NO: 619789 - DNA, 20 bp, Artificial
  CRISPR gRNA sequence
tgatgtgttagttcttcaat

SEQ ID NO: 619790 - DNA, 20 bp, Artificial
  CRISPR gRNA sequence
attgaaaggaaaccttcttt

SEQ ID NO: 619791 - DNA, 20 bp, Artificial
  CRISPR gRNA sequence
cctccctgaaataaccaaag

SEQ ID NO: 619792 - DNA, 20 bp, Artificial
  CRISPR gRNA sequence
gctgacactagaatgtcaga

SEQ ID NO: 619793 - DNA, 20 bp, Artificial
  CRISPR gRNA sequence
tcatatttcttttaaaaagt

SEQ ID NO: 619794 - DNA, 20 bp, Artificial
  CRISPR gRNA sequence
tcataggctggatgaaaaaa

SEQ ID NO: 619795 - DNA, 20 bp, Artificial
  CRISPR gRNA sequence
atttatgcctgaggttgaaa

SEQ ID NO: 619796 - DNA, 20 bp, Artificial
  CRISPR gRNA sequence
gtaggatataaataactccc

SEQ ID NO: 619797 - DNA, 20 bp, Artificial
  CRISPR gRNA sequence
gacactaatgaaaattttaa

SEQ ID NO: 619798 - DNA, 20 bp, Artificial
  CRISPR gRNA sequence
caaaactggccaataggctg

SEQ ID NO: 619799 - DNA, 20 bp, Artificial
  CRISPR gRNA sequence
caaagaaacaaaagcatttg

SEQ ID NO: 619800 - DNA, 20 bp, Artificial
  CRISPR gRNA sequence
acccacaaacttttgtggag

SEQ ID NO: 619801 - DNA, 20 bp, Artificial
  CRISPR gRNA sequence
acttttgtggagtggagctt

SEQ ID NO: 619802 - DNA, 20 bp, Artificial
  CRISPR gRNA sequence
tacgttttcccatattcccc

SEQ ID NO: 619803 - DNA, 20 bp, Artificial
  CRISPR gRNA sequence
gatatgtgttataaaagcta

SEQ ID NO: 619804 - DNA, 20 bp, Artificial
  CRISPR gRNA sequence
tgcacacacacatatacacc

SEQ ID NO: 619805 - DNA, 20 bp, Artificial
  CRISPR gRNA sequence
acacacatatacaccagagg

SEQ ID NO: 619806 - DNA, 20 bp, Artificial
  CRISPR gRNA sequence
attggtggcaaacttgttca

SEQ ID NO: 619807 - DNA, 20 bp, Artificial
  CRISPR gRNA sequence
ttctcatcttattcccctga

SEQ ID NO: 619808 - DNA, 20 bp, Artificial
  CRISPR gRNA sequence
ttttaagactgcactatttt

SEQ ID NO: 619809 - DNA, 20 bp, Artificial
  CRISPR gRNA sequence
tgcactattttcaaggcttt

SEQ ID NO: 619810 - DNA, 20 bp, Artificial
  CRISPR gRNA sequence
aaaacaatttaagtaagtca

SEQ ID NO: 619811 - DNA, 20 bp, Artificial
  CRISPR gRNA sequence
taagtcaacttgtttgagag

SEQ ID NO: 619812 - DNA, 20 bp, Artificial
  CRISPR gRNA sequence
aaaataacagcacggtattt

SEQ ID NO: 619813 - DNA, 20 bp, Artificial
  CRISPR gRNA sequence
gagctgttagccttattggc

SEQ ID NO: 619814 - DNA, 20 bp, Artificial
  CRISPR gRNA sequence
gtctatgcacagtaaactgt

SEQ ID NO: 619815 - DNA, 20 bp, Artificial
  CRISPR gRNA sequence
cacagtaaactgtggcagct

SEQ ID NO: 619816 - DNA, 20 bp, Artificial
  CRISPR gRNA sequence
gcagacaaagaacttaaaac

SEQ ID NO: 619817 - DNA, 20 bp, Artificial
  CRISPR gRNA sequence
tgagtagaaatactgcccaa

SEQ ID NO: 619818 - DNA, 20 bp, Artificial
  CRISPR gRNA sequence
caactcagacaaggcgaatc

SEQ ID NO: 619819 - DNA, 20 bp, Artificial
  CRISPR gRNA sequence
aaagaacataacttattact

SEQ ID NO: 619820 - DNA, 20 bp, Artificial
  CRISPR gRNA sequence
acttattacttgttgtttat

SEQ ID NO: 619821 - DNA, 20 bp, Artificial
  CRISPR gRNA sequence
tccagttgcacttgtgccag

SEQ ID NO: 619822 - DNA, 20 bp, Artificial
  CRISPR gRNA sequence
gccagtactgtttggaaacc

SEQ ID NO: 619823 - DNA, 20 bp, Artificial
  CRISPR gRNA sequence
ttgttcagtatgccctgtaa

SEQ ID NO: 619824 - DNA, 20 bp, Artificial
  CRISPR gRNA sequence
aaatgaaacatagtgtgaaa

SEQ ID NO: 619825 - DNA, 20 bp, Artificial
  CRISPR gRNA sequence
catagtgtgaaaaaatgttt

SEQ ID NO: 619826 - DNA, 20 bp, Artificial
  CRISPR gRNA sequence
aaaatgttttcatgatttgg

SEQ ID NO: 619827 - DNA, 20 bp, Artificial
  CRISPR gRNA sequence
taaagaaatcaacattccat

SEQ ID NO: 619828 - DNA, 20 bp, Artificial
  CRISPR gRNA sequence
aaatcaacattccatccaag

SEQ ID NO: 619829 - DNA, 20 bp, Artificial
  CRISPR gRNA sequence
gtcctctggctatgaatagc

SEQ ID NO: 619830 - DNA, 20 bp, Artificial
  CRISPR gRNA sequence
tattagatgttaatttggaa

SEQ ID NO: 619831 - DNA, 20 bp, Artificial
  CRISPR gRNA sequence
ttgtggtcaaaatcttaact

SEQ ID NO: 619832 - DNA, 20 bp, Artificial
  CRISPR gRNA sequence
tcttaactttttgtttggat

SEQ ID NO: 619833 - DNA, 20 bp, Artificial
  CRISPR gRNA sequence
aaaactagcaaaactggtta

SEQ ID NO: 619834 - DNA, 20 bp, Artificial
  CRISPR gRNA sequence
aaatgagtagtccaaaacct

SEQ ID NO: 619835 - DNA, 20 bp, Artificial
  CRISPR gRNA sequence
caaaacctggcagttttgct

SEQ ID NO: 619836 - DNA, 20 bp, Artificial
  CRISPR gRNA sequence
caccacatccacctcaattc

SEQ ID NO: 619837 - DNA, 20 bp, Artificial
  CRISPR gRNA sequence
aagctcatgtgaactgaaaa

SEQ ID NO: 619838 - DNA, 20 bp, Artificial
  CRISPR gRNA sequence
cttttcatgtcaaaaattga

SEQ ID NO: 619839 - DNA, 20 bp, Artificial
  CRISPR gRNA sequence
gacgtatactatgtgctgtg

SEQ ID NO: 619840 - DNA, 20 bp, Artificial
  CRISPR gRNA sequence
ctatgtgctgtgtgctgttt

SEQ ID NO: 619841 - DNA, 20 bp, Artificial
  CRISPR gRNA sequence
gagatgttaagtaatttcct

SEQ ID NO: 619842 - DNA, 20 bp, Artificial
  CRISPR gRNA sequence
tttccttaattatgtaacca

SEQ ID NO: 619843 - DNA, 20 bp, Artificial
  CRISPR gRNA sequence
taattatgtaaccaatctga

SEQ ID NO: 619844 - DNA, 20 bp, Artificial
  CRISPR gRNA sequence
atgtaaccaatctgattttg

SEQ ID NO: 619845 - DNA, 20 bp, Artificial
  CRISPR gRNA sequence
tataccaataaggtaacttc

SEQ ID NO: 619846 - DNA, 20 bp, Artificial
  CRISPR gRNA sequence
aaaacataattccattagat

SEQ ID NO: 619847 - DNA, 20 bp, Artificial
  CRISPR gRNA sequence
cagcatttggcagtgctgac

SEQ ID NO: 619848 - DNA, 20 bp, Artificial
  CRISPR gRNA sequence
ttggcagtgctgacacttgc

SEQ ID NO: 619849 - DNA, 20 bp, Artificial
  CRISPR gRNA sequence
aattatgatggatcctgcat

SEQ ID NO: 619850 - DNA, 20 bp, Artificial
  CRISPR gRNA sequence
ttcctactcagacccctctc

SEQ ID NO: 619851 - DNA, 20 bp, Artificial
  CRISPR gRNA sequence
atatatttaacatcttccta

SEQ ID NO: 619852 - DNA, 20 bp, Artificial
  CRISPR gRNA sequence
gctggtcacctgtggaaaat

SEQ ID NO: 619853 - DNA, 20 bp, Artificial
  CRISPR gRNA sequence
aacacacatggaggtacccc

SEQ ID NO: 619854 - DNA, 20 bp, Artificial
  CRISPR gRNA sequence
ctccatttattagttcacat

SEQ ID NO: 619855 - DNA, 20 bp, Artificial
  CRISPR gRNA sequence
gaaattcctcttggatgttc

SEQ ID NO: 619856 - DNA, 20 bp, Artificial
  CRISPR gRNA sequence
gtatgtcctctctgtctcca

SEQ ID NO: 619857 - DNA, 20 bp, Artificial
  CRISPR gRNA sequence
ttatcacatagtactataat

SEQ ID NO: 619858 - DNA, 20 bp, Artificial
  CRISPR gRNA sequence
acccaatagaaataagtcaa

SEQ ID NO: 619859 - DNA, 20 bp, Artificial
  CRISPR gRNA sequence
taagtcaaaaaagcttattc

SEQ ID NO: 619860 - DNA, 20 bp, Artificial
  CRISPR gRNA sequence
agcataaacctaacaatata

SEQ ID NO: 619861 - DNA, 20 bp, Artificial
  CRISPR gRNA sequence
agattttaagctggctatcc

SEQ ID NO: 619862 - DNA, 20 bp, Artificial
  CRISPR gRNA sequence
ttgcactttcatttttgtct

SEQ ID NO: 619863 - DNA, 20 bp, Artificial
  CRISPR gRNA sequence
ttaggtaaaacaggtaataa

SEQ ID NO: 619864 - DNA, 20 bp, Artificial
  CRISPR gRNA sequence
gtaaaacaggtaataacata

SEQ ID NO: 619865 - DNA, 20 bp, Artificial
  CRISPR gRNA sequence
gtaataacatagtttgattt

SEQ ID NO: 619866 - DNA, 20 bp, Artificial
  CRISPR gRNA sequence
atcctcattggagacatttt

SEQ ID NO: 619867 - DNA, 20 bp, Artificial
  CRISPR gRNA sequence
cattggagacatttttcttg

SEQ ID NO: 619868 - DNA, 20 bp, Artificial
  CRISPR gRNA sequence
ttacacaatgaaattcaaac

SEQ ID NO: 619869 - DNA, 20 bp, Artificial
  CRISPR gRNA sequence
gcatcacaacctactaattc

SEQ ID NO: 619870 - DNA, 20 bp, Artificial
  CRISPR gRNA sequence
atgcaatttttactcatccc

SEQ ID NO: 619871 - DNA, 20 bp, Artificial
  CRISPR gRNA sequence
atttttactcatccctcatg

SEQ ID NO: 619872 - DNA, 20 bp, Artificial
  CRISPR gRNA sequence
aactgtgtatgcatccttat

SEQ ID NO: 619873 - DNA, 20 bp, Artificial
  CRISPR gRNA sequence
gtatgcatccttattagagc

SEQ ID NO: 619874 - DNA, 20 bp, Artificial
  CRISPR gRNA sequence
gcacatagtaagctcttgat

SEQ ID NO: 619875 - DNA, 20 bp, Artificial
  CRISPR gRNA sequence
gaagaacaacacagggaaaa

SEQ ID NO: 619876 - DNA, 20 bp, Artificial
  CRISPR gRNA sequence
agcaagagaagggaatagat

SEQ ID NO: 619877 - DNA, 20 bp, Artificial
  CRISPR gRNA sequence
agatataagtttcatcatgg

SEQ ID NO: 619878 - DNA, 20 bp, Artificial
  CRISPR gRNA sequence
tctagcagcattttacagaa

SEQ ID NO: 619879 - DNA, 20 bp, Artificial
  CRISPR gRNA sequence
ggcatgttaacaacagatag

SEQ ID NO: 619880 - DNA, 20 bp, Artificial
  CRISPR gRNA sequence
gatatccagtatttaagaat

SEQ ID NO: 619881 - DNA, 20 bp, Artificial
  CRISPR gRNA sequence
accctcaatcccttctcctc

SEQ ID NO: 619882 - DNA, 20 bp, Artificial
  CRISPR gRNA sequence
cccactttcccccacttggt

SEQ ID NO: 619883 - DNA, 20 bp, Artificial
  CRISPR gRNA sequence
gggggtaagactgaggcccc

SEQ ID NO: 619884 - DNA, 20 bp, Artificial
  CRISPR gRNA sequence
cagttgtttaggggacatat

SEQ ID NO: 619885 - DNA, 20 bp, Artificial
  CRISPR gRNA sequence
ctttgcttctctcaaaatat

SEQ ID NO: 619886 - DNA, 20 bp, Artificial
  CRISPR gRNA sequence
tgtttaaatttttcgttagc

SEQ ID NO: 619887 - DNA, 20 bp, Artificial
  CRISPR gRNA sequence
tctgccaacagataattcaa

SEQ ID NO: 619888 - DNA, 20 bp, Artificial
  CRISPR gRNA sequence
aaactagtagcaatgccata

SEQ ID NO: 619889 - DNA, 20 bp, Artificial
  CRISPR gRNA sequence
aatgccataaggtgttttgg

SEQ ID NO: 619890 - DNA, 20 bp, Artificial
  CRISPR gRNA sequence
ggggaagatttggtattccc

SEQ ID NO: 619891 - DNA, 20 bp, Artificial
  CRISPR gRNA sequence
tggtattcccccaagcttcc

SEQ ID NO: 619892 - DNA, 20 bp, Artificial
  CRISPR gRNA sequence
tggtcagcaaatgaaacttc

SEQ ID NO: 619893 - DNA, 20 bp, Artificial
  CRISPR gRNA sequence
ccagacacgaagtagccaga

SEQ ID NO: 619894 - DNA, 20 bp, Artificial
  CRISPR gRNA sequence
tcatcatcagcccaggtaat

SEQ ID NO: 619895 - DNA, 20 bp, Artificial
  CRISPR gRNA sequence
taccaagacttgatacacag

SEQ ID NO: 619896 - DNA, 20 bp, Artificial
  CRISPR gRNA sequence
cttgatcacaaatcaataga

SEQ ID NO: 619897 - DNA, 20 bp, Artificial
  CRISPR gRNA sequence
aaatcaatagaattagattc

SEQ ID NO: 619898 - DNA, 20 bp, Artificial
  CRISPR gRNA sequence
agattatagaaactagaagg

SEQ ID NO: 619899 - DNA, 20 bp, Artificial
  CRISPR gRNA sequence
cgggcagctcacctgaggtc

SEQ ID NO: 619900 - DNA, 20 bp, Artificial
  CRISPR gRNA sequence
ttggcaggctgaagcaggag

SEQ ID NO: 619901 - DNA, 20 bp, Artificial
  CRISPR gRNA sequence
gatatacatgtactaataag

SEQ ID NO: 619902 - DNA, 20 bp, Artificial
  CRISPR gRNA sequence
ttcattattttcctatataa

SEQ ID NO: 619903 - DNA, 20 bp, Artificial
  CRISPR gRNA sequence
aattattcattgataaacct

SEQ ID NO: 619904 - DNA, 20 bp, Artificial
  CRISPR gRNA sequence
cgtagtgtatttagagatca

SEQ ID NO: 619905 - DNA, 20 bp, Artificial
  CRISPR gRNA sequence
tgtatttagagatcaggatg

SEQ ID NO: 619906 - DNA, 20 bp, Artificial
  CRISPR gRNA sequence
atcaggatgttttgcttgga

SEQ ID NO: 619907 - DNA, 20 bp, Artificial
  CRISPR gRNA sequence
gagatggtgtctaatgttgg

SEQ ID NO: 619908 - DNA, 20 bp, Artificial
  CRISPR gRNA sequence
tggtgtctaatgttggtcta

SEQ ID NO: 619909 - DNA, 20 bp, Artificial
  CRISPR gRNA sequence
atttctcataaaaattaaag

SEQ ID NO: 619910 - DNA, 20 bp, Artificial
  CRISPR gRNA sequence
ggagtattgcaaaatttcaa

SEQ ID NO: 619911 - DNA, 20 bp, Artificial
  CRISPR gRNA sequence
tttaagttaaagtgatctaa

SEQ ID NO: 619912 - DNA, 20 bp, Artificial
  CRISPR gRNA sequence
ctaaaatagttttaaacagc

SEQ ID NO: 619913 - DNA, 20 bp, Artificial
  CRISPR gRNA sequence
ggggaaataaaaatgatgaa

SEQ ID NO: 619914 - DNA, 20 bp, Artificial
  CRISPR gRNA sequence
tgtgctcctccagtgaactg

SEQ ID NO: 619915 - DNA, 20 bp, Artificial
  CRISPR gRNA sequence
ctccagtgaactgcgctgct

SEQ ID NO: 619916 - DNA, 20 bp, Artificial
  CRISPR gRNA sequence
gtccacagtagttgcacttg

SEQ ID NO: 619917 - DNA, 20 bp, Artificial
  CRISPR gRNA sequence
tcactcttaatacactgact

SEQ ID NO: 619918 - DNA, 20 bp, Artificial
  CRISPR gRNA sequence
atcctagatacatcaagagt

SEQ ID NO: 619919 - DNA, 20 bp, Artificial
  CRISPR gRNA sequence
catcaagagttgtggttttt

SEQ ID NO: 619920 - DNA, 20 bp, Artificial
  CRISPR gRNA sequence
aagagttgtggttttttttt

SEQ ID NO: 619921 - DNA, 20 bp, Artificial
  CRISPR gRNA sequence
aatgcaacaacttgaaatgt

SEQ ID NO: 619922 - DNA, 20 bp, Artificial
  CRISPR gRNA sequence
tgaaatgtcacagtttaata

SEQ ID NO: 619923 - DNA, 20 bp, Artificial
  CRISPR gRNA sequence
gagattattcttgggtacca

SEQ ID NO: 619924 - DNA, 20 bp, Artificial
  CRISPR gRNA sequence
agaaaaagtacagatgaaag

SEQ ID NO: 619925 - DNA, 20 bp, Artificial
  CRISPR gRNA sequence
aggtaagtatattctccctc

SEQ ID NO: 619926 - DNA, 20 bp, Artificial
  CRISPR gRNA sequence
ataccaagaattaacctact

SEQ ID NO: 619927 - DNA, 20 bp, Artificial
  CRISPR gRNA sequence
aacctactaggtgctttgag

SEQ ID NO: 619928 - DNA, 20 bp, Artificial
  CRISPR gRNA sequence
tataatctctatggaaagaa

SEQ ID NO: 619929 - DNA, 20 bp, Artificial
  CRISPR gRNA sequence
catcacagagcactttgact

SEQ ID NO: 619930 - DNA, 20 bp, Artificial
  CRISPR gRNA sequence
tttgactcccagaggaatta

SEQ ID NO: 619931 - DNA, 20 bp, Artificial
  CRISPR gRNA sequence
caaggtattcatggctgcct

SEQ ID NO: 619932 - DNA, 20 bp, Artificial
  CRISPR gRNA sequence
aaagaaagctacaccaaacc

SEQ ID NO: 619933 - DNA, 20 bp, Artificial
  CRISPR gRNA sequence
atcagttatttcataatcat

SEQ ID NO: 619934 - DNA, 20 bp, Artificial
  CRISPR gRNA sequence
tatcataaaagttatttatg

SEQ ID NO: 619935 - DNA, 20 bp, Artificial
  CRISPR gRNA sequence
gtgattattcatttttttaa

SEQ ID NO: 619936 - DNA, 20 bp, Artificial
  CRISPR gRNA sequence
tttttaaaaatgcttggcaa

SEQ ID NO: 619937 - DNA, 20 bp, Artificial
  CRISPR gRNA sequence
cagcttctattttttggaac

SEQ ID NO: 619938 - DNA, 20 bp, Artificial
  CRISPR gRNA sequence
cagcattaaaaatacaaaaa

SEQ ID NO: 619939 - DNA, 20 bp, Artificial
  CRISPR gRNA sequence
gggactacataacaaaaagt

SEQ ID NO: 619940 - DNA, 20 bp, Artificial
  CRISPR gRNA sequence
tctgtttactattagcatta

SEQ ID NO: 619941 - DNA, 20 bp, Artificial
  CRISPR gRNA sequence
tagtaatgaatttatactga

SEQ ID NO: 619942 - DNA, 20 bp, Artificial
  CRISPR gRNA sequence
ccttctcaatttaattgaaa

SEQ ID NO: 619943 - DNA, 20 bp, Artificial
  CRISPR gRNA sequence
ctgataagaaggaagagaca

SEQ ID NO: 619944 - DNA, 20 bp, Artificial
  CRISPR gRNA sequence
aaggaagagacatgtagttt

SEQ ID NO: 619945 - DNA, 20 bp, Artificial
  CRISPR gRNA sequence
actactctcattactatccc

SEQ ID NO: 619946 - DNA, 20 bp, Artificial
  CRISPR gRNA sequence
tactatcccatctgctttat

SEQ ID NO: 619947 - DNA, 20 bp, Artificial
  CRISPR gRNA sequence
gagtccaacagggatctgag

SEQ ID NO: 619948 - DNA, 20 bp, Artificial
  CRISPR gRNA sequence
acccaattattaggtgacat

SEQ ID NO: 619949 - DNA, 20 bp, Artificial
  CRISPR gRNA sequence
gtgtagtataacatggggaa

SEQ ID NO: 619950 - DNA, 20 bp, Artificial
  CRISPR gRNA sequence
tgaaaaggttgaacaagaag

SEQ ID NO: 619951 - DNA, 20 bp, Artificial
  CRISPR gRNA sequence
tggggagtgagggtggaaag

SEQ ID NO: 619952 - DNA, 20 bp, Artificial
  CRISPR gRNA sequence
gagggtggaaaggcaggatt

SEQ ID NO: 619953 - DNA, 20 bp, Artificial
  CRISPR gRNA sequence
gcccttactactcctttgaa

SEQ ID NO: 619954 - DNA, 20 bp, Artificial
  CRISPR gRNA sequence
aaaaataaagttcataaaaa

SEQ ID NO: 619955 - DNA, 20 bp, Artificial
  CRISPR gRNA sequence
tttatacttactccctatac

SEQ ID NO: 619956 - DNA, 20 bp, Artificial
  CRISPR gRNA sequence
atacatgtgtttatctgtac

SEQ ID NO: 619957 - DNA, 20 bp, Artificial
  CRISPR gRNA sequence
gtctctgaatcactaaatcc

SEQ ID NO: 619958 - DNA, 20 bp, Artificial
  CRISPR gRNA sequence
tcctaatctcttggccacta

SEQ ID NO: 619959 - DNA, 20 bp, Artificial
  CRISPR gRNA sequence
gctttcttgtgtcttgggtc

SEQ ID NO: 619960 - DNA, 20 bp, Artificial
  CRISPR gRNA sequence
tcagatcctacattcgccct

SEQ ID NO: 619961 - DNA, 20 bp, Artificial
  CRISPR gRNA sequence
tacattcgccctcactgctt

SEQ ID NO: 619962 - DNA, 20 bp, Artificial
  CRISPR gRNA sequence
atcaggtcaagaataatttc

SEQ ID NO: 619963 - DNA, 20 bp, Artificial
  CRISPR gRNA sequence
ttatttccctagtccaaacg

SEQ ID NO: 619964 - DNA, 20 bp, Artificial
  CRISPR gRNA sequence
gagcttcatgaggagagaga

SEQ ID NO: 619965 - DNA, 20 bp, Artificial
  CRISPR gRNA sequence
tgttaccactgttctaatac

SEQ ID NO: 619966 - DNA, 20 bp, Artificial
  CRISPR gRNA sequence
ttctatatactggactcgta

SEQ ID NO: 619967 - DNA, 20 bp, Artificial
  CRISPR gRNA sequence
cctggcataatagacttcaa

SEQ ID NO: 619968 - DNA, 20 bp, Artificial
  CRISPR gRNA sequence
ccaacaactttcaataactg

SEQ ID NO: 619969 - DNA, 20 bp, Artificial
  CRISPR gRNA sequence
attactttacacctacactt

SEQ ID NO: 619970 - DNA, 20 bp, Artificial
  CRISPR gRNA sequence
tttacacctacacttctgag

SEQ ID NO: 619971 - DNA, 20 bp, Artificial
  CRISPR gRNA sequence
tttgttgctgtaattgcctc

SEQ ID NO: 619972 - DNA, 20 bp, Artificial
  CRISPR gRNA sequence
aactattcctgtattgaccc

SEQ ID NO: 619973 - DNA, 20 bp, Artificial
  CRISPR gRNA sequence
atgtgtctttgtaacttccg

SEQ ID NO: 619974 - DNA, 20 bp, Artificial
  CRISPR gRNA sequence
aacttccgaagagtttagca

SEQ ID NO: 619975 - DNA, 20 bp, Artificial
  CRISPR gRNA sequence
tcatagaaagaactaataag

SEQ ID NO: 619976 - DNA, 20 bp, Artificial
  CRISPR gRNA sequence
tataatttccaaactcttta

SEQ ID NO: 619977 - DNA, 20 bp, Artificial
  CRISPR gRNA sequence
tctttaaatagctttttctc

SEQ ID NO: 619978 - DNA, 20 bp, Artificial
  CRISPR gRNA sequence
ttatacactgttattttata

SEQ ID NO: 619979 - DNA, 20 bp, Artificial
  CRISPR gRNA sequence
gctgttaggtaacactttct

SEQ ID NO: 619980 - DNA, 20 bp, Artificial
  CRISPR gRNA sequence
ggtaacactttctcccagat

SEQ ID NO: 619981 - DNA, 20 bp, Artificial
  CRISPR gRNA sequence
tttatggtaatgctgaatta

SEQ ID NO: 619982 - DNA, 20 bp, Artificial
  CRISPR gRNA sequence
gtccttttcttttattacgt

SEQ ID NO: 619983 - DNA, 20 bp, Artificial
  CRISPR gRNA sequence
ccattttcagctccttcttt

SEQ ID NO: 619984 - DNA, 20 bp, Artificial
  CRISPR gRNA sequence
atgtgggttatttttattca

SEQ ID NO: 619985 - DNA, 20 bp, Artificial
  CRISPR gRNA sequence
catcaggtttagagataatc

SEQ ID NO: 619986 - DNA, 20 bp, Artificial
  CRISPR gRNA sequence
tgcttctctgtcctggtagt

SEQ ID NO: 619987 - DNA, 20 bp, Artificial
  CRISPR gRNA sequence
ttcaatagttacataatcat

SEQ ID NO: 619988 - DNA, 20 bp, Artificial
  CRISPR gRNA sequence
taacatactatttggctcaa

SEQ ID NO: 619989 - DNA, 20 bp, Artificial
  CRISPR gRNA sequence
tgattacatttccttttttg

SEQ ID NO: 619990 - DNA, 20 bp, Artificial
  CRISPR gRNA sequence
aataatcgtctcacttttta

SEQ ID NO: 619991 - DNA, 20 bp, Artificial
  CRISPR gRNA sequence
cgtctcactttttattttgc

SEQ ID NO: 619992 - DNA, 20 bp, Artificial
  CRISPR gRNA sequence
cagttggaactgatggtacc

SEQ ID NO: 619993 - DNA, 20 bp, Artificial
  CRISPR gRNA sequence
agaactttcctttgtccccc

SEQ ID NO: 619994 - DNA, 20 bp, Artificial
  CRISPR gRNA sequence
agtcttctgctgcctgaatc

SEQ ID NO: 619995 - DNA, 20 bp, Artificial
  CRISPR gRNA sequence
atcccatgttttcctcttcg

SEQ ID NO: 619996 - DNA, 20 bp, Artificial
  CRISPR gRNA sequence
ttcactgggctactaacctc

SEQ ID NO: 619997 - DNA, 20 bp, Artificial
  CRISPR gRNA sequence
ttttaaaagtattatataaa

SEQ ID NO: 619998 - DNA, 20 bp, Artificial
  CRISPR gRNA sequence
taaatatagctttatatgtg

SEQ ID NO: 619999 - DNA, 20 bp, Artificial
  CRISPR gRNA sequence
gtctgaaagctcttagtaac

SEQ ID NO: 620000 - DNA, 20 bp, Artificial
  CRISPR gRNA sequence
tggtctaaagtctctaattt

SEQ ID NO: 620001 - DNA, 20 bp, Artificial
  CRISPR gRNA sequence
tacagataaaacaaataaat

SEQ ID NO: 620002 - DNA, 20 bp, Artificial
  CRISPR gRNA sequence
acaaataaatatgtgtttaa

SEQ ID NO: 620003 - DNA, 20 bp, Artificial
  CRISPR gRNA sequence
ccaacagagcaagtcttagg

SEQ ID NO: 620004 - DNA, 20 bp, Artificial
  CRISPR gRNA sequence
ggcagtgcaagtcatccaaa

SEQ ID NO: 620005 - DNA, 20 bp, Artificial
  CRISPR gRNA sequence
tttaggtctacatttccaaa

SEQ ID NO: 620006 - DNA, 20 bp, Artificial
  CRISPR gRNA sequence
atttccaaacaaagtttgta

SEQ ID NO: 620007 - DNA, 20 bp, Artificial
  CRISPR gRNA sequence
cagtttgccaatttctgtta

SEQ ID NO: 620008 - DNA, 20 bp, Artificial
  CRISPR gRNA sequence
aatttctgttaaaaagcttg

SEQ ID NO: 620009 - DNA, 20 bp, Artificial
  CRISPR gRNA sequence
aaattgccctgaactgacag

SEQ ID NO: 620010 - DNA, 20 bp, Artificial
  CRISPR gRNA sequence
taatttatctcagcaatgtg

SEQ ID NO: 620011 - DNA, 20 bp, Artificial
  CRISPR gRNA sequence
tgggatgttataatcaatgg

SEQ ID NO: 620012 - DNA, 20 bp, Artificial
  CRISPR gRNA sequence
ttcctagcatatagaaatac

SEQ ID NO: 620013 - DNA, 20 bp, Artificial
  CRISPR gRNA sequence
tcaaagaaatatttgcatta

SEQ ID NO: 620014 - DNA, 20 bp, Artificial
  CRISPR gRNA sequence
taatatggaaaattacattg

SEQ ID NO: 620015 - DNA, 20 bp, Artificial
  CRISPR gRNA sequence
atattatcctttttatatat

SEQ ID NO: 620016 - DNA, 20 bp, Artificial
  CRISPR gRNA sequence
gtatttttttcttgtaatgt

SEQ ID NO: 620017 - DNA, 20 bp, Artificial
  CRISPR gRNA sequence
gagtaatgctgaatataata

SEQ ID NO: 620018 - DNA, 20 bp, Artificial
  CRISPR gRNA sequence
tctggaggaatttgttcctt

SEQ ID NO: 620019 - DNA, 20 bp, Artificial
  CRISPR gRNA sequence
aatttaccagtgaagtcatc

SEQ ID NO: 620020 - DNA, 20 bp, Artificial
  CRISPR gRNA sequence
atctggagttttctttgtgg

SEQ ID NO: 620021 - DNA, 20 bp, Artificial
  CRISPR gRNA sequence
atattatgcctccaatggct

SEQ ID NO: 620022 - DNA, 20 bp, Artificial
  CRISPR gRNA sequence
tccaatggctacaggatttt

SEQ ID NO: 620023 - DNA, 20 bp, Artificial
  CRISPR gRNA sequence
ctacaggatttttagtgatt

SEQ ID NO: 620024 - DNA, 20 bp, Artificial
  CRISPR gRNA sequence
caaattatgtgttcttttaa

SEQ ID NO: 620025 - DNA, 20 bp, Artificial
  CRISPR gRNA sequence
taatattgattgatcttgct

SEQ ID NO: 620026 - DNA, 20 bp, Artificial
  CRISPR gRNA sequence
gatcttctcatataatcagt

SEQ ID NO: 620027 - DNA, 20 bp, Artificial
  CRISPR gRNA sequence
gatgaaaaaacaaaacaaaa

SEQ ID NO: 620028 - DNA, 20 bp, Artificial
  CRISPR gRNA sequence
aaacaaaacaaaaccctgtt

SEQ ID NO: 620029 - DNA, 20 bp, Artificial
  CRISPR gRNA sequence
tagggcacaaatcattatta

SEQ ID NO: 620030 - DNA, 20 bp, Artificial
  CRISPR gRNA sequence
ctacagtcacaatgaaccaa

SEQ ID NO: 620031 - DNA, 20 bp, Artificial
  CRISPR gRNA sequence
aaacaaaaaaatcattagac

SEQ ID NO: 620032 - DNA, 20 bp, Artificial
  CRISPR gRNA sequence
ctatttttaaattatggtct

SEQ ID NO: 620033 - DNA, 20 bp, Artificial
  CRISPR gRNA sequence
tcttgacttacctatttgac

SEQ ID NO: 620034 - DNA, 20 bp, Artificial
  CRISPR gRNA sequence
tatttgacttatgctttttt

SEQ ID NO: 620035 - DNA, 20 bp, Artificial
  CRISPR gRNA sequence
ttatgctttttttgaggttt

SEQ ID NO: 620036 - DNA, 20 bp, Artificial
  CRISPR gRNA sequence
ttcttgtggtcaaaattgtt

SEQ ID NO: 620037 - DNA, 20 bp, Artificial
  CRISPR gRNA sequence
attgttggtagtttcccacg

SEQ ID NO: 620038 - DNA, 20 bp, Artificial
  CRISPR gRNA sequence
ttcccacgttgtgatttctt

SEQ ID NO: 620039 - DNA, 20 bp, Artificial
  CRISPR gRNA sequence
gttgtgatttctttactgtt

SEQ ID NO: 620040 - DNA, 20 bp, Artificial
  CRISPR gRNA sequence
ctttagaagtcttaatgact

SEQ ID NO: 620041 - DNA, 20 bp, Artificial
  CRISPR gRNA sequence
ctaggtttatttttttaatg

SEQ ID NO: 620042 - DNA, 20 bp, Artificial
  CRISPR gRNA sequence
ataacttttatctctctaag

SEQ ID NO: 620043 - DNA, 20 bp, Artificial
  CRISPR gRNA sequence
agggtggggggatgaatgtt

SEQ ID NO: 620044 - DNA, 20 bp, Artificial
  CRISPR gRNA sequence
ctgtgagacagtatatttaa

SEQ ID NO: 620045 - DNA, 20 bp, Artificial
  CRISPR gRNA sequence
tatatttaatgcagatttct

SEQ ID NO: 620046 - DNA, 20 bp, Artificial
  CRISPR gRNA sequence
gcattatcagaggttctttt

SEQ ID NO: 620047 - DNA, 20 bp, Artificial
  CRISPR gRNA sequence
atcagaggttcttttggatg

SEQ ID NO: 620048 - DNA, 20 bp, Artificial
  CRISPR gRNA sequence
cagacaaaacttatttaacc

SEQ ID NO: 620049 - DNA, 20 bp, Artificial
  CRISPR gRNA sequence
tatttttctttttttttttt

SEQ ID NO: 620050 - DNA, 20 bp, Artificial
  CRISPR gRNA sequence
aacctccacctcctgggttc

SEQ ID NO: 620051 - DNA, 20 bp, Artificial
  CRISPR gRNA sequence
ttttgtatttttagtagaga

SEQ ID NO: 620052 - DNA, 20 bp, Artificial
  CRISPR gRNA sequence
cgcctcagcctcccaaagtg

SEQ ID NO: 620053 - DNA, 20 bp, Artificial
  CRISPR gRNA sequence
actgcgccaggctgtgttaa

SEQ ID NO: 620054 - DNA, 20 bp, Artificial
  CRISPR gRNA sequence
ttaaccatccaaatattgcc

SEQ ID NO: 620055 - DNA, 20 bp, Artificial
  CRISPR gRNA sequence
gacatttgaaagcaaaagaa

SEQ ID NO: 620056 - DNA, 20 bp, Artificial
  CRISPR gRNA sequence
agcaaaagaaaactgctttt

SEQ ID NO: 620057 - DNA, 20 bp, Artificial
  CRISPR gRNA sequence
caaacaagaaaatgtcttat

SEQ ID NO: 620058 - DNA, 20 bp, Artificial
  CRISPR gRNA sequence
actttaagttaacacatttc

SEQ ID NO: 620059 - DNA, 20 bp, Artificial
  CRISPR gRNA sequence
atattttggcagtgtaacag

SEQ ID NO: 620060 - DNA, 20 bp, Artificial
  CRISPR gRNA sequence
ccttaccacataaaatattt

SEQ ID NO: 620061 - DNA, 20 bp, Artificial
  CRISPR gRNA sequence
attaaacaataaatggaagt

SEQ ID NO: 620062 - DNA, 20 bp, Artificial
  CRISPR gRNA sequence
gttaaaaatatatacatatc

SEQ ID NO: 620063 - DNA, 20 bp, Artificial
  CRISPR gRNA sequence
aagtgtaacataagtcattt

SEQ ID NO: 620064 - DNA, 20 bp, Artificial
  CRISPR gRNA sequence
agagaaagtataaaggtgca

SEQ ID NO: 620065 - DNA, 20 bp, Artificial
  CRISPR gRNA sequence
gaaacagcagatatatttga

SEQ ID NO: 620066 - DNA, 20 bp, Artificial
  CRISPR gRNA sequence
tagtaagaatttactaggca

SEQ ID NO: 620067 - DNA, 20 bp, Artificial
  CRISPR gRNA sequence
tatatagactcttcctttta

SEQ ID NO: 620068 - DNA, 20 bp, Artificial
  CRISPR gRNA sequence
gtgggtcactcagatagaag

SEQ ID NO: 620069 - DNA, 20 bp, Artificial
  CRISPR gRNA sequence
acagtcaaggctacagtcag

SEQ ID NO: 620070 - DNA, 20 bp, Artificial
  CRISPR gRNA sequence
gttgccttgatgtcgatggc

SEQ ID NO: 620071 - DNA, 20 bp, Artificial
  CRISPR gRNA sequence
tccttaacataaggcaacaa

SEQ ID NO: 620072 - DNA, 20 bp, Artificial
  CRISPR gRNA sequence
gtagcatgtgatgctatttg

SEQ ID NO: 620073 - DNA, 20 bp, Artificial
  CRISPR gRNA sequence
agagtagaatttctttcaaa

SEQ ID NO: 620074 - DNA, 20 bp, Artificial
  CRISPR gRNA sequence
tcaactctctcaaactctgc

SEQ ID NO: 620075 - DNA, 20 bp, Artificial
  CRISPR gRNA sequence
ctctgctactgctttgtcaa

SEQ ID NO: 620076 - DNA, 20 bp, Artificial
  CRISPR gRNA sequence
atattcacaggatctacact

SEQ ID NO: 620077 - DNA, 20 bp, Artificial
  CRISPR gRNA sequence
acttctaactctagttatgt

SEQ ID NO: 620078 - DNA, 20 bp, Artificial
  CRISPR gRNA sequence
agaattctgaatcctttcca

SEQ ID NO: 620079 - DNA, 20 bp, Artificial
  CRISPR gRNA sequence
tgaatcctttccagaaggtt

SEQ ID NO: 620080 - DNA, 20 bp, Artificial
  CRISPR gRNA sequence
tgtcttaagtaataagactt

SEQ ID NO: 620081 - DNA, 20 bp, Artificial
  CRISPR gRNA sequence
cagccatgaaaacaacatta

SEQ ID NO: 620082 - DNA, 20 bp, Artificial
  CRISPR gRNA sequence
tctgcttgtacatctccatc

SEQ ID NO: 620083 - DNA, 20 bp, Artificial
  CRISPR gRNA sequence
tgtaatattttgaaaggaat

SEQ ID NO: 620084 - DNA, 20 bp, Artificial
  CRISPR gRNA sequence
ttctgagcagtgtctaaaca

SEQ ID NO: 620085 - DNA, 20 bp, Artificial
  CRISPR gRNA sequence
aagagagtcagcctgtcctt

SEQ ID NO: 620086 - DNA, 20 bp, Artificial
  CRISPR gRNA sequence
ggcctcttcttctaatagaa

SEQ ID NO: 620087 - DNA, 20 bp, Artificial
  CRISPR gRNA sequence
tatcacaaccaccttcatta

SEQ ID NO: 620088 - DNA, 20 bp, Artificial
  CRISPR gRNA sequence
ttgcacttttatgttataga

SEQ ID NO: 620089 - DNA, 20 bp, Artificial
  CRISPR gRNA sequence
aacctcatgaaccaacctct

SEQ ID NO: 620090 - DNA, 20 bp, Artificial
  CRISPR gRNA sequence
ctagcttccaacttttcttc

SEQ ID NO: 620091 - DNA, 20 bp, Artificial
  CRISPR gRNA sequence
gaatattgttagggtcttcc

SEQ ID NO: 620092 - DNA, 20 bp, Artificial
  CRISPR gRNA sequence
tgttagggtcttcctcagga

SEQ ID NO: 620093 - DNA, 20 bp, Artificial
  CRISPR gRNA sequence
gggtcttcctcaggattagg

SEQ ID NO: 620094 - DNA, 20 bp, Artificial
  CRISPR gRNA sequence
tgatttaagagaatgttgtg

SEQ ID NO: 620095 - DNA, 20 bp, Artificial
  CRISPR gRNA sequence
ttctccataatcagaagtaa

SEQ ID NO: 620096 - DNA, 20 bp, Artificial
  CRISPR gRNA sequence
cataatcagaagtaaggcag

SEQ ID NO: 620097 - DNA, 20 bp, Artificial
  CRISPR gRNA sequence
ttcctttgcattcacaatgt

SEQ ID NO: 620098 - DNA, 20 bp, Artificial
  CRISPR gRNA sequence
cacaggaggcctatcttttg

SEQ ID NO: 620099 - DNA, 20 bp, Artificial
  CRISPR gRNA sequence
cctcactaagcctcatcatt

SEQ ID NO: 620100 - DNA, 20 bp, Artificial
  CRISPR gRNA sequence
taagcctcatcatttctagc

SEQ ID NO: 620101 - DNA, 20 bp, Artificial
  CRISPR gRNA sequence
tggccagttggtgaagcagt

SEQ ID NO: 620102 - DNA, 20 bp, Artificial
  CRISPR gRNA sequence
acatttatcaacacaaaaat

SEQ ID NO: 620103 - DNA, 20 bp, Artificial
  CRISPR gRNA sequence
tggaaaaatggtatcaaccg

SEQ ID NO: 620104 - DNA, 20 bp, Artificial
  CRISPR gRNA sequence
gtaaggcacaataaaggaag

SEQ ID NO: 620105 - DNA, 20 bp, Artificial
  CRISPR gRNA sequence
actttctatattacaagaac

SEQ ID NO: 620106 - DNA, 20 bp, Artificial
  CRISPR gRNA sequence
aaataatcaattcagaagca

SEQ ID NO: 620107 - DNA, 20 bp, Artificial
  CRISPR gRNA sequence
atgtatttgtatatccagaa

SEQ ID NO: 620108 - DNA, 20 bp, Artificial
  CRISPR gRNA sequence
tcaacatcttctaacatatt

SEQ ID NO: 620109 - DNA, 20 bp, Artificial
  CRISPR gRNA sequence
aacatattatatgatttttt

SEQ ID NO: 620110 - DNA, 20 bp, Artificial
  CRISPR gRNA sequence
tcttgcagtccacaatctca

SEQ ID NO: 620111 - DNA, 20 bp, Artificial
  CRISPR gRNA sequence
aaactaaacaccaacataac

SEQ ID NO: 620112 - DNA, 20 bp, Artificial
  CRISPR gRNA sequence
aacaccaacataaccacaga

SEQ ID NO: 620113 - DNA, 20 bp, Artificial
  CRISPR gRNA sequence
acataaccacagattctgat

SEQ ID NO: 620114 - DNA, 20 bp, Artificial
  CRISPR gRNA sequence
atagcaaaatagaactaagg

SEQ ID NO: 620115 - DNA, 20 bp, Artificial
  CRISPR gRNA sequence
ctaaggggatgcttctggta

SEQ ID NO: 620116 - DNA, 20 bp, Artificial
  CRISPR gRNA sequence
gtgggcagaaccaccaatgg

SEQ ID NO: 620117 - DNA, 20 bp, Artificial
  CRISPR gRNA sequence
aaccaccaatggccatgatt

SEQ ID NO: 620118 - DNA, 20 bp, Artificial
  CRISPR gRNA sequence
accaatggccatgattagta

SEQ ID NO: 620119 - DNA, 20 bp, Artificial
  CRISPR gRNA sequence
tattttaagaagaggagtga

SEQ ID NO: 620120 - DNA, 20 bp, Artificial
  CRISPR gRNA sequence
agaggagtgacatggtttaa

SEQ ID NO: 620121 - DNA, 20 bp, Artificial
  CRISPR gRNA sequence
attctggttgctatctggag

SEQ ID NO: 620122 - DNA, 20 bp, Artificial
  CRISPR gRNA sequence
tagtggctgagagcagagac

SEQ ID NO: 620123 - DNA, 20 bp, Artificial
  CRISPR gRNA sequence
gaccctagattcagacagac

SEQ ID NO: 620124 - DNA, 20 bp, Artificial
  CRISPR gRNA sequence
agacagaccagagcttatat

SEQ ID NO: 620125 - DNA, 20 bp, Artificial
  CRISPR gRNA sequence
gtaaacatatagttatcaag

SEQ ID NO: 620126 - DNA, 20 bp, Artificial
  CRISPR gRNA sequence
caaatataatttatactatt

SEQ ID NO: 620127 - DNA, 20 bp, Artificial
  CRISPR gRNA sequence
tatatgtcttcaagcctcat

SEQ ID NO: 620128 - DNA, 20 bp, Artificial
  CRISPR gRNA sequence
cttcaagcctcatgatagat

SEQ ID NO: 620129 - DNA, 20 bp, Artificial
  CRISPR gRNA sequence
ttataagagcatgatacaat

SEQ ID NO: 620130 - DNA, 20 bp, Artificial
  CRISPR gRNA sequence
tgtgctgtgggtgtgtatgt

SEQ ID NO: 620131 - DNA, 20 bp, Artificial
  CRISPR gRNA sequence
gcaaaataaggcccttaaca

SEQ ID NO: 620132 - DNA, 20 bp, Artificial
  CRISPR gRNA sequence
aggaccttttattcttatcc

SEQ ID NO: 620133 - DNA, 20 bp, Artificial
  CRISPR gRNA sequence
atttaaaaggactccactct

SEQ ID NO: 620134 - DNA, 20 bp, Artificial
  CRISPR gRNA sequence
ttatattctaaatatatttt

SEQ ID NO: 620135 - DNA, 20 bp, Artificial
  CRISPR gRNA sequence
catgcttatgatgaatgata

SEQ ID NO: 620136 - DNA, 20 bp, Artificial
  CRISPR gRNA sequence
ggtttttatctttcttattt

SEQ ID NO: 620137 - DNA, 20 bp, Artificial
  CRISPR gRNA sequence
tgtctgattttctaccattt

SEQ ID NO: 620138 - DNA, 20 bp, Artificial
  CRISPR gRNA sequence
atagtataggctgtggatga

SEQ ID NO: 620139 - DNA, 20 bp, Artificial
  CRISPR gRNA sequence
tctggatactaggtgagtaa

SEQ ID NO: 620140 - DNA, 20 bp, Artificial
  CRISPR gRNA sequence
cagggtacaaaactgtggta

SEQ ID NO: 620141 - DNA, 20 bp, Artificial
  CRISPR gRNA sequence
aagctttggaatgaggacag

SEQ ID NO: 620142 - DNA, 20 bp, Artificial
  CRISPR gRNA sequence
cctgataataaaggaggaag

SEQ ID NO: 620143 - DNA, 20 bp, Artificial
  CRISPR gRNA sequence
gctgcatagaattataaaag

SEQ ID NO: 620144 - DNA, 20 bp, Artificial
  CRISPR gRNA sequence
actactacaattcataaaag

SEQ ID NO: 620145 - DNA, 20 bp, Artificial
  CRISPR gRNA sequence
atgtgattgtatatgctatt

SEQ ID NO: 620146 - DNA, 20 bp, Artificial
  CRISPR gRNA sequence
ttacagccggcctgactgaa

SEQ ID NO: 620147 - DNA, 20 bp, Artificial
  CRISPR gRNA sequence
caatgagtaggacctcaagt

SEQ ID NO: 620148 - DNA, 20 bp, Artificial
  CRISPR gRNA sequence
ttaatcccatctcctttctt

SEQ ID NO: 620149 - DNA, 20 bp, Artificial
  CRISPR gRNA sequence
caaatcatgtgtgcaactga

SEQ ID NO: 620150 - DNA, 20 bp, Artificial
  CRISPR gRNA sequence
ggccaggtgccaggtctaca

SEQ ID NO: 620151 - DNA, 20 bp, Artificial
  CRISPR gRNA sequence
cactattatgaatgagctgc

SEQ ID NO: 620152 - DNA, 20 bp, Artificial
  CRISPR gRNA sequence
taaaccagcataatttaatt

SEQ ID NO: 620153 - DNA, 20 bp, Artificial
  CRISPR gRNA sequence
aaaaaaaaaaagtcatggtg

SEQ ID NO: 620154 - DNA, 20 bp, Artificial
  CRISPR gRNA sequence
aaaaaagtcatggtggtctg

SEQ ID NO: 620155 - DNA, 20 bp, Artificial
  CRISPR gRNA sequence
agtcatggtggtctgttttg

SEQ ID NO: 620156 - DNA, 20 bp, Artificial
  CRISPR gRNA sequence
ttttgtattttgagtagaga

SEQ ID NO: 620157 - DNA, 20 bp, Artificial
  CRISPR gRNA sequence
gagccaccgtgtccagctgg

SEQ ID NO: 620158 - DNA, 20 bp, Artificial
  CRISPR gRNA sequence
aataatgtaaataggaaaac

SEQ ID NO: 620159 - DNA, 20 bp, Artificial
  CRISPR gRNA sequence
taatatggaagcaaatggat

SEQ ID NO: 620160 - DNA, 20 bp, Artificial
  CRISPR gRNA sequence
tacagtacattagaaaatac

SEQ ID NO: 620161 - DNA, 20 bp, Artificial
  CRISPR gRNA sequence
gttgtcaatttaaagaaacg

SEQ ID NO: 620162 - DNA, 20 bp, Artificial
  CRISPR gRNA sequence
ttccttagtaagagacaaca

SEQ ID NO: 620163 - DNA, 20 bp, Artificial
  CRISPR gRNA sequence
caaattaagagactatttct

SEQ ID NO: 620164 - DNA, 20 bp, Artificial
  CRISPR gRNA sequence
aactagagcaactaacatta

SEQ ID NO: 620165 - DNA, 20 bp, Artificial
  CRISPR gRNA sequence
gaagaagaccatcttgtctt

SEQ ID NO: 620166 - DNA, 20 bp, Artificial
  CRISPR gRNA sequence
catataccttaaaaatgcat

SEQ ID NO: 620167 - DNA, 20 bp, Artificial
  CRISPR gRNA sequence
atataaactaggctatttaa

SEQ ID NO: 620168 - DNA, 20 bp, Artificial
  CRISPR gRNA sequence
catatatatatatatactaa

SEQ ID NO: 620169 - DNA, 20 bp, Artificial
  CRISPR gRNA sequence
ttttttagttgggaggaagt

SEQ ID NO: 620170 - DNA, 20 bp, Artificial
  CRISPR gRNA sequence
gaagttgttgttttaacaga

SEQ ID NO: 620171 - DNA, 20 bp, Artificial
  CRISPR gRNA sequence
agttcctttttatggaacag

SEQ ID NO: 620172 - DNA, 20 bp, Artificial
  CRISPR gRNA sequence
tgtaaaaatcaacattccta

SEQ ID NO: 620173 - DNA, 20 bp, Artificial
  CRISPR gRNA sequence
taagatagatacatgttcag

SEQ ID NO: 620174 - DNA, 20 bp, Artificial
  CRISPR gRNA sequence
atgctggttcaattgaaagc

SEQ ID NO: 620175 - DNA, 20 bp, Artificial
  CRISPR gRNA sequence
tataaatctttgaaaaataa

SEQ ID NO: 620176 - DNA, 20 bp, Artificial
  CRISPR gRNA sequence
tatggttctcttaataagta

SEQ ID NO: 620177 - DNA, 20 bp, Artificial
  CRISPR gRNA sequence
cttaataagtatttggcttt

SEQ ID NO: 620178 - DNA, 20 bp, Artificial
  CRISPR gRNA sequence
gaataaatgtctttgggaaa

SEQ ID NO: 620179 - DNA, 20 bp, Artificial
  CRISPR gRNA sequence
tttaattttcaaatgtattt

SEQ ID NO: 620180 - DNA, 20 bp, Artificial
  CRISPR gRNA sequence
tttcaaatgtatttggatga

SEQ ID NO: 620181 - DNA, 20 bp, Artificial
  CRISPR gRNA sequence
ttgagactctatgagatgca

SEQ ID NO: 620182 - DNA, 20 bp, Artificial
  CRISPR gRNA sequence
ttaagttcagaggtacatgt

SEQ ID NO: 620183 - DNA, 20 bp, Artificial
  CRISPR gRNA sequence
tatataggtaaacttgtgtc

SEQ ID NO: 620184 - DNA, 20 bp, Artificial
  CRISPR gRNA sequence
tagcaccattagttattttc

SEQ ID NO: 620185 - DNA, 20 bp, Artificial
  CRISPR gRNA sequence
tctttataatttataaaaag

SEQ ID NO: 620186 - DNA, 20 bp, Artificial
  CRISPR gRNA sequence
aagaaatgtttaacacacat

SEQ ID NO: 620187 - DNA, 20 bp, Artificial
  CRISPR gRNA sequence
tatattaaaattatacactc

SEQ ID NO: 620188 - DNA, 20 bp, Artificial
  CRISPR gRNA sequence
tattttgactaataggggtc

SEQ ID NO: 620189 - DNA, 20 bp, Artificial
  CRISPR gRNA sequence
aatcatttttgtagcagaag

SEQ ID NO: 620190 - DNA, 20 bp, Artificial
  CRISPR gRNA sequence
aagttcacatgaagcaaagt

SEQ ID NO: 620191 - DNA, 20 bp, Artificial
  CRISPR gRNA sequence
gatgatttgtatagtaaatc

SEQ ID NO: 620192 - DNA, 20 bp, Artificial
  CRISPR gRNA sequence
tctcaagattactgaatagc

SEQ ID NO: 620193 - DNA, 20 bp, Artificial
  CRISPR gRNA sequence
ttatgtaatgtatctctggg

SEQ ID NO: 620194 - DNA, 20 bp, Artificial
  CRISPR gRNA sequence
ttttggggggggtgggagga

SEQ ID NO: 620195 - DNA, 20 bp, Artificial
  CRISPR gRNA sequence
ttttgtatttttagtagaaa

SEQ ID NO: 620196 - DNA, 20 bp, Artificial
  CRISPR gRNA sequence
cacctcggcctcccaaagtg

SEQ ID NO: 620197 - DNA, 20 bp, Artificial
  CRISPR gRNA sequence
tataaaccttaagatgttaa

SEQ ID NO: 620198 - DNA, 20 bp, Artificial
  CRISPR gRNA sequence
ctttaaggtgtggtagtagt

SEQ ID NO: 620199 - DNA, 20 bp, Artificial
  CRISPR gRNA sequence
catcatataatagcagcacc

SEQ ID NO: 620200 - DNA, 20 bp, Artificial
  CRISPR gRNA sequence
aggagttacttcagtagagt

SEQ ID NO: 620201 - DNA, 20 bp, Artificial
  CRISPR gRNA sequence
ggtgtgatgagcacaaattg

SEQ ID NO: 620202 - DNA, 20 bp, Artificial
  CRISPR gRNA sequence
caaattgtggagtttgctgc

SEQ ID NO: 620203 - DNA, 20 bp, Artificial
  CRISPR gRNA sequence
ctgtagcaaaacctatttat

SEQ ID NO: 620204 - DNA, 20 bp, Artificial
  CRISPR gRNA sequence
cgaaataattacaaaaagaa

SEQ ID NO: 620205 - DNA, 20 bp, Artificial
  CRISPR gRNA sequence
aaccaaattttaccactttg

SEQ ID NO: 620206 - DNA, 20 bp, Artificial
  CRISPR gRNA sequence
ttaaaaatgaatagaagtct

SEQ ID NO: 620207 - DNA, 20 bp, Artificial
  CRISPR gRNA sequence
taaagataatgtgttatggg

SEQ ID NO: 620208 - DNA, 20 bp, Artificial
  CRISPR gRNA sequence
caaatttctcactgaaagaa

SEQ ID NO: 620209 - DNA, 20 bp, Artificial
  CRISPR gRNA sequence
gctattaatctacaatctct

SEQ ID NO: 620210 - DNA, 20 bp, Artificial
  CRISPR gRNA sequence
tttttgcttatgttagataa

SEQ ID NO: 620211 - DNA, 20 bp, Artificial
  CRISPR gRNA sequence
tttattaaagaaaccatgga

SEQ ID NO: 620212 - DNA, 20 bp, Artificial
  CRISPR gRNA sequence
tgtattcatgcacatctgtg

SEQ ID NO: 620213 - DNA, 20 bp, Artificial
  CRISPR gRNA sequence
aataataatattcataaaaa

SEQ ID NO: 620214 - DNA, 20 bp, Artificial
  CRISPR gRNA sequence
caaccttttcaccaccaggg

SEQ ID NO: 620215 - DNA, 20 bp, Artificial
  CRISPR gRNA sequence
cagggaccagtttcatggaa

SEQ ID NO: 620216 - DNA, 20 bp, Artificial
  CRISPR gRNA sequence
acaaatgacaggtggtgggg

SEQ ID NO: 620217 - DNA, 20 bp, Artificial
  CRISPR gRNA sequence
tccacctcagatcatcaggc

SEQ ID NO: 620218 - DNA, 20 bp, Artificial
  CRISPR gRNA sequence
aggaagaggagctcaggcag

SEQ ID NO: 620219 - DNA, 20 bp, Artificial
  CRISPR gRNA sequence
tagttaatctgtggcacatt

SEQ ID NO: 620220 - DNA, 20 bp, Artificial
  CRISPR gRNA sequence
tcccgcaaaagctaattttt

SEQ ID NO: 620221 - DNA, 20 bp, Artificial
  CRISPR gRNA sequence
atcaattggctccgttgtcc

SEQ ID NO: 620222 - DNA, 20 bp, Artificial
  CRISPR gRNA sequence
cgttgtcctctggcttctgg

SEQ ID NO: 620223 - DNA, 20 bp, Artificial
  CRISPR gRNA sequence
gggtggaaagagtgaggtca

SEQ ID NO: 620224 - DNA, 20 bp, Artificial
  CRISPR gRNA sequence
ctttcaggctagagctagta

SEQ ID NO: 620225 - DNA, 20 bp, Artificial
  CRISPR gRNA sequence
ttttccccacttgagtgtct

SEQ ID NO: 620226 - DNA, 20 bp, Artificial
  CRISPR gRNA sequence
atccaaggcatgtgctggca

SEQ ID NO: 620227 - DNA, 20 bp, Artificial
  CRISPR gRNA sequence
gaaggatgtacgacgcaggg

SEQ ID NO: 620228 - DNA, 20 bp, Artificial
  CRISPR gRNA sequence
aaagcagcaatggtagtgta

SEQ ID NO: 620229 - DNA, 20 bp, Artificial
  CRISPR gRNA sequence
agaatacaggcaaaatacaa

SEQ ID NO: 620230 - DNA, 20 bp, Artificial
  CRISPR gRNA sequence
caaaatacaagaaagtttat

SEQ ID NO: 620231 - DNA, 20 bp, Artificial
  CRISPR gRNA sequence
ggctgaagaccaactccaga

SEQ ID NO: 620232 - DNA, 20 bp, Artificial
  CRISPR gRNA sequence
caatggacaatactaagacc

SEQ ID NO: 620233 - DNA, 20 bp, Artificial
  CRISPR gRNA sequence
atgtagcactagccatattt

SEQ ID NO: 620234 - DNA, 20 bp, Artificial
  CRISPR gRNA sequence
tcacactatacacccattta

SEQ ID NO: 620235 - DNA, 20 bp, Artificial
  CRISPR gRNA sequence
ttcataatgctaactgtaga

SEQ ID NO: 620236 - DNA, 20 bp, Artificial
  CRISPR gRNA sequence
cactaggtatgaagcaatga

SEQ ID NO: 620237 - DNA, 20 bp, Artificial
  CRISPR gRNA sequence
tatgaagcaatgaacttgat

SEQ ID NO: 620238 - DNA, 20 bp, Artificial
  CRISPR gRNA sequence
gtataacaaagataatcaga

SEQ ID NO: 620239 - DNA, 20 bp, Artificial
  CRISPR gRNA sequence
gcacaaaatgtggtggcctc

SEQ ID NO: 620240 - DNA, 20 bp, Artificial
  CRISPR gRNA sequence
agctccctctacttttgact

SEQ ID NO: 620241 - DNA, 20 bp, Artificial
  CRISPR gRNA sequence
actctaagattcagcagatg

SEQ ID NO: 620242 - DNA, 20 bp, Artificial
  CRISPR gRNA sequence
gcctcagtgtgtagatccct

SEQ ID NO: 620243 - DNA, 20 bp, Artificial
  CRISPR gRNA sequence
gtggttttatagtaaagaca

SEQ ID NO: 620244 - DNA, 20 bp, Artificial
  CRISPR gRNA sequence
aggtccctaatacctgctac

SEQ ID NO: 620245 - DNA, 20 bp, Artificial
  CRISPR gRNA sequence
ctactactgcttctcaatct

SEQ ID NO: 620246 - DNA, 20 bp, Artificial
  CRISPR gRNA sequence
tgaggatgaaacagtgtgga

SEQ ID NO: 620247 - DNA, 20 bp, Artificial
  CRISPR gRNA sequence
ttcaataccagctatgacta

SEQ ID NO: 620248 - DNA, 20 bp, Artificial
  CRISPR gRNA sequence
catgaatctcagactcttta

SEQ ID NO: 620249 - DNA, 20 bp, Artificial
  CRISPR gRNA sequence
gtagggacacagaaactatg

SEQ ID NO: 620250 - DNA, 20 bp, Artificial
  CRISPR gRNA sequence
atggacttcctcttctctat

SEQ ID NO: 620251 - DNA, 20 bp, Artificial
  CRISPR gRNA sequence
tttttgcaagctccctcaaa

SEQ ID NO: 620252 - DNA, 20 bp, Artificial
  CRISPR gRNA sequence
atgtatggttgccagctggg

SEQ ID NO: 620253 - DNA, 20 bp, Artificial
  CRISPR gRNA sequence
taacatcaaataacccattt

SEQ ID NO: 620254 - DNA, 20 bp, Artificial
  CRISPR gRNA sequence
ttactctgtgtcctgaaacc

SEQ ID NO: 620255 - DNA, 20 bp, Artificial
  CRISPR gRNA sequence
tgtcctgaaaccttcagatt

SEQ ID NO: 620256 - DNA, 20 bp, Artificial
  CRISPR gRNA sequence
gatctcagttcccaaaagaa

SEQ ID NO: 620257 - DNA, 20 bp, Artificial
  CRISPR gRNA sequence
ccaaaagaagaatgttttct

SEQ ID NO: 620258 - DNA, 20 bp, Artificial
  CRISPR gRNA sequence
aagctgctaaataaacaggg

SEQ ID NO: 620259 - DNA, 20 bp, Artificial
  CRISPR gRNA sequence
ataatttttccagactacca

SEQ ID NO: 620260 - DNA, 20 bp, Artificial
  CRISPR gRNA sequence
tacaatgaggacaagaagaa

SEQ ID NO: 620261 - DNA, 20 bp, Artificial
  CRISPR gRNA sequence
aagaactatgcttggaactc

SEQ ID NO: 620262 - DNA, 20 bp, Artificial
  CRISPR gRNA sequence
taagagtaaggggaagatgt

SEQ ID NO: 620263 - DNA, 20 bp, Artificial
  CRISPR gRNA sequence
gaacactataatgatcaatt

SEQ ID NO: 620264 - DNA, 20 bp, Artificial
  CRISPR gRNA sequence
aggagcaaaaactgtagcaa

SEQ ID NO: 620265 - DNA, 20 bp, Artificial
  CRISPR gRNA sequence
aaattagggatggctagtat

SEQ ID NO: 620266 - DNA, 20 bp, Artificial
  CRISPR gRNA sequence
attttagattccaattggaa

SEQ ID NO: 620267 - DNA, 20 bp, Artificial
  CRISPR gRNA sequence
ggcagttataaggaccatgt

SEQ ID NO: 620268 - DNA, 20 bp, Artificial
  CRISPR gRNA sequence
aaaccatgatattaaaaaca

SEQ ID NO: 620269 - DNA, 20 bp, Artificial
  CRISPR gRNA sequence
gatttcaacaaaaataagat

SEQ ID NO: 620270 - DNA, 20 bp, Artificial
  CRISPR gRNA sequence
acgaagatctatttgttata

SEQ ID NO: 620271 - DNA, 20 bp, Artificial
  CRISPR gRNA sequence
aagaacttttcataagaaaa

SEQ ID NO: 620272 - DNA, 20 bp, Artificial
  CRISPR gRNA sequence
aaaaatatatacttaaaata

SEQ ID NO: 620273 - DNA, 20 bp, Artificial
  CRISPR gRNA sequence
atacttaaaatattttgttt

SEQ ID NO: 620274 - DNA, 20 bp, Artificial
  CRISPR gRNA sequence
actgccccaaatttaagagt

SEQ ID NO: 620275 - DNA, 20 bp, Artificial
  CRISPR gRNA sequence
atttaagagttaatgtttaa

SEQ ID NO: 620276 - DNA, 20 bp, Artificial
  CRISPR gRNA sequence
ttaatgtttaaaatagtttt

SEQ ID NO: 620277 - DNA, 20 bp, Artificial
  CRISPR gRNA sequence
tagttttacacgattcacat

SEQ ID NO: 620278 - DNA, 20 bp, Artificial
  CRISPR gRNA sequence
cacaacctcagcactctcta

SEQ ID NO: 620279 - DNA, 20 bp, Artificial
  CRISPR gRNA sequence
tctctaatacgatttgtcaa

SEQ ID NO: 620280 - DNA, 20 bp, Artificial
  CRISPR gRNA sequence
gaacagaagaaacaaataaa

SEQ ID NO: 620281 - DNA, 20 bp, Artificial
  CRISPR gRNA sequence
aaatttatgctaaaagtcaa

SEQ ID NO: 620282 - DNA, 20 bp, Artificial
  CRISPR gRNA sequence
taaaagtcaaatgagattca

SEQ ID NO: 620283 - DNA, 20 bp, Artificial
  CRISPR gRNA sequence
tgtcatattctacatttttt

SEQ ID NO: 620284 - DNA, 20 bp, Artificial
  CRISPR gRNA sequence
aaatgatttatgaaacacag

SEQ ID NO: 620285 - DNA, 20 bp, Artificial
  CRISPR gRNA sequence
gtttcagagtacccaatgac

SEQ ID NO: 620286 - DNA, 20 bp, Artificial
  CRISPR gRNA sequence
ccaattttctgagtatattt

SEQ ID NO: 620287 - DNA, 20 bp, Artificial
  CRISPR gRNA sequence
cactgtatcagtcaaaaaaa

SEQ ID NO: 620288 - DNA, 20 bp, Artificial
  CRISPR gRNA sequence
tatactggatcttcacttat

SEQ ID NO: 620289 - DNA, 20 bp, Artificial
  CRISPR gRNA sequence
aattatagaaaatatataac

SEQ ID NO: 620290 - DNA, 20 bp, Artificial
  CRISPR gRNA sequence
atgaaagatacatgcatcct

SEQ ID NO: 620291 - DNA, 20 bp, Artificial
  CRISPR gRNA sequence
ttatttaatgtacaccaata

SEQ ID NO: 620292 - DNA, 20 bp, Artificial
  CRISPR gRNA sequence
tatcattcaatagtactctt

SEQ ID NO: 620293 - DNA, 20 bp, Artificial
  CRISPR gRNA sequence
aatagtactcttctaagttt

SEQ ID NO: 620294 - DNA, 20 bp, Artificial
  CRISPR gRNA sequence
agctacagaaaggacatttg

SEQ ID NO: 620295 - DNA, 20 bp, Artificial
  CRISPR gRNA sequence
taaacatttatctgcccaga

SEQ ID NO: 620296 - DNA, 20 bp, Artificial
  CRISPR gRNA sequence
tcaatacagttaccaaagtc

SEQ ID NO: 620297 - DNA, 20 bp, Artificial
  CRISPR gRNA sequence
ttagggccttacacacaatt

SEQ ID NO: 620298 - DNA, 20 bp, Artificial
  CRISPR gRNA sequence
tcttacaatgacaataatta

SEQ ID NO: 620299 - DNA, 20 bp, Artificial
  CRISPR gRNA sequence
caaggtgagaaatgaacctg

SEQ ID NO: 620300 - DNA, 20 bp, Artificial
  CRISPR gRNA sequence
ctaaaaggtacagcaaatga

SEQ ID NO: 620301 - DNA, 20 bp, Artificial
  CRISPR gRNA sequence
agcttacaaagctcattagt

SEQ ID NO: 620302 - DNA, 20 bp, Artificial
  CRISPR gRNA sequence
acaagattttcaaatacggg

SEQ ID NO: 620303 - DNA, 20 bp, Artificial
  CRISPR gRNA sequence
tttcaaatacgggccaggtt

SEQ ID NO: 620304 - DNA, 20 bp, Artificial
  CRISPR gRNA sequence
ttcatccagacatgtcctgt

SEQ ID NO: 620305 - DNA, 20 bp, Artificial
  CRISPR gRNA sequence
atttgaaaggaatcttttct

SEQ ID NO: 620306 - DNA, 20 bp, Artificial
  CRISPR gRNA sequence
ttctattactgatattgcta

SEQ ID NO: 620307 - DNA, 20 bp, Artificial
  CRISPR gRNA sequence
gaagtttttaagcctcaatt

SEQ ID NO: 620308 - DNA, 20 bp, Artificial
  CRISPR gRNA sequence
aaatgtatcatactaaagct

SEQ ID NO: 620309 - DNA, 20 bp, Artificial
  CRISPR gRNA sequence
tttctttacctgcagttaga

SEQ ID NO: 620310 - DNA, 20 bp, Artificial
  CRISPR gRNA sequence
tagatgatgattctaatttt

SEQ ID NO: 620311 - DNA, 20 bp, Artificial
  CRISPR gRNA sequence
ctaattttaatagtttttca

SEQ ID NO: 620312 - DNA, 20 bp, Artificial
  CRISPR gRNA sequence
aaaaagcttacattgaaatg

SEQ ID NO: 620313 - DNA, 20 bp, Artificial
  CRISPR gRNA sequence
aataatgaataataaaaact

SEQ ID NO: 620314 - DNA, 20 bp, Artificial
  CRISPR gRNA sequence
cctttgacataatgcaaact

SEQ ID NO: 620315 - DNA, 20 bp, Artificial
  CRISPR gRNA sequence
agctattgaaaattctatca

SEQ ID NO: 620316 - DNA, 20 bp, Artificial
  CRISPR gRNA sequence
atctcaaattctgtagtatt

SEQ ID NO: 620317 - DNA, 20 bp, Artificial
  CRISPR gRNA sequence
tctgtgggtgtggtgggggt

SEQ ID NO: 620318 - DNA, 20 bp, Artificial
  CRISPR gRNA sequence
agaggtcctatattgataat

SEQ ID NO: 620319 - DNA, 20 bp, Artificial
  CRISPR gRNA sequence
gttcccttaagtggtatctt

SEQ ID NO: 620320 - DNA, 20 bp, Artificial
  CRISPR gRNA sequence
ccttaagtggtatcttctta

SEQ ID NO: 620321 - DNA, 20 bp, Artificial
  CRISPR gRNA sequence
tcatataaagtcttccaaca

SEQ ID NO: 620322 - DNA, 20 bp, Artificial
  CRISPR gRNA sequence
acttttacacacaatataca

SEQ ID NO: 620323 - DNA, 20 bp, Artificial
  CRISPR gRNA sequence
acacaatatacaacttgatt

SEQ ID NO: 620324 - DNA, 20 bp, Artificial
  CRISPR gRNA sequence
ttatacttttcactccaaaa

SEQ ID NO: 620325 - DNA, 20 bp, Artificial
  CRISPR gRNA sequence
acttttaaaatatgtctacg

SEQ ID NO: 620326 - DNA, 20 bp, Artificial
  CRISPR gRNA sequence
aatttcctttaaacctccta

SEQ ID NO: 620327 - DNA, 20 bp, Artificial
  CRISPR gRNA sequence
gaattttaaaattcacctaa

SEQ ID NO: 620328 - DNA, 20 bp, Artificial
  CRISPR gRNA sequence
aattcacctaattgagtttt

SEQ ID NO: 620329 - DNA, 20 bp, Artificial
  CRISPR gRNA sequence
tgcgattaatgaaagggtaa

SEQ ID NO: 620330 - DNA, 20 bp, Artificial
  CRISPR gRNA sequence
aacaaggcatgatgaaggta

SEQ ID NO: 620331 - DNA, 20 bp, Artificial
  CRISPR gRNA sequence
acattttaatttcaataaga

SEQ ID NO: 620332 - DNA, 20 bp, Artificial
  CRISPR gRNA sequence
taagataaggctttgggaga

SEQ ID NO: 620333 - DNA, 20 bp, Artificial
  CRISPR gRNA sequence
aattatgaataagtcttgat

SEQ ID NO: 620334 - DNA, 20 bp, Artificial
  CRISPR gRNA sequence
ttacatttggatactaattt

SEQ ID NO: 620335 - DNA, 20 bp, Artificial
  CRISPR gRNA sequence
ttgcctaactcctgttgatg

SEQ ID NO: 620336 - DNA, 20 bp, Artificial
  CRISPR gRNA sequence
aattatcatttcaagagtcc

SEQ ID NO: 620337 - DNA, 20 bp, Artificial
  CRISPR gRNA sequence
aaagacaatactgttagaaa

SEQ ID NO: 620338 - DNA, 20 bp, Artificial
  CRISPR gRNA sequence
attaaaacagagggtaattt

SEQ ID NO: 620339 - DNA, 20 bp, Artificial
  CRISPR gRNA sequence
aaattatctgataattaagt

SEQ ID NO: 620340 - DNA, 20 bp, Artificial
  CRISPR gRNA sequence
catcaatgtgccctttttga

SEQ ID NO: 620341 - DNA, 20 bp, Artificial
  CRISPR gRNA sequence
aatccaagctgaaaacatta

SEQ ID NO: 620342 - DNA, 20 bp, Artificial
  CRISPR gRNA sequence
ttcatgtccatatctcaatc

SEQ ID NO: 620343 - DNA, 20 bp, Artificial
  CRISPR gRNA sequence
gtccatatctcaatctgttg

SEQ ID NO: 620344 - DNA, 20 bp, Artificial
  CRISPR gRNA sequence
catttttatttattgactgg

SEQ ID NO: 620345 - DNA, 20 bp, Artificial
  CRISPR gRNA sequence
atgcaaatatatatgcatca

SEQ ID NO: 620346 - DNA, 20 bp, Artificial
  CRISPR gRNA sequence
aaactgagttacaagatggg

SEQ ID NO: 620347 - DNA, 20 bp, Artificial
  CRISPR gRNA sequence
tcgatatgtgttcatgcatg

SEQ ID NO: 620348 - DNA, 20 bp, Artificial
  CRISPR gRNA sequence
tgaattgatttactttccct

SEQ ID NO: 620349 - DNA, 20 bp, Artificial
  CRISPR gRNA sequence
gagtatccgatgacaatatt

SEQ ID NO: 620350 - DNA, 20 bp, Artificial
  CRISPR gRNA sequence
tatgacagagaaagaagaag

SEQ ID NO: 620351 - DNA, 20 bp, Artificial
  CRISPR gRNA sequence
tgggtggaacaactgaggtc

SEQ ID NO: 620352 - DNA, 20 bp, Artificial
  CRISPR gRNA sequence
tttggaggctgaggcaggag

SEQ ID NO: 620353 - DNA, 20 bp, Artificial
  CRISPR gRNA sequence
gaggtggagggtgcagtgat

SEQ ID NO: 620354 - DNA, 20 bp, Artificial
  CRISPR gRNA sequence
tgaactaaaaacactaaaat

SEQ ID NO: 620355 - DNA, 20 bp, Artificial
  CRISPR gRNA sequence
tatgtttctcaaaggcatta

SEQ ID NO: 620356 - DNA, 20 bp, Artificial
  CRISPR gRNA sequence
gagaaaacatttggctaatg

SEQ ID NO: 620357 - DNA, 20 bp, Artificial
  CRISPR gRNA sequence
tctgactacatttttctcaa

SEQ ID NO: 620358 - DNA, 20 bp, Artificial
  CRISPR gRNA sequence
atcagaaatatgttgaagtg

SEQ ID NO: 620359 - DNA, 20 bp, Artificial
  CRISPR gRNA sequence
tgacaaagcatgacaggtat

SEQ ID NO: 620360 - DNA, 20 bp, Artificial
  CRISPR gRNA sequence
ttgcacaatgctccaataaa

SEQ ID NO: 620361 - DNA, 20 bp, Artificial
  CRISPR gRNA sequence
gttgagtgagtctcgtattc

SEQ ID NO: 620362 - DNA, 20 bp, Artificial
  CRISPR gRNA sequence
ggatttgtggaaatctgtat

SEQ ID NO: 620363 - DNA, 20 bp, Artificial
  CRISPR gRNA sequence
ttataaactttattatgcca

SEQ ID NO: 620364 - DNA, 20 bp, Artificial
  CRISPR gRNA sequence
ttattgtagctacagtgaat

SEQ ID NO: 620365 - DNA, 20 bp, Artificial
  CRISPR gRNA sequence
tcaattaaaaatcttctaaa

SEQ ID NO: 620366 - DNA, 20 bp, Artificial
  CRISPR gRNA sequence
aaaatcttctaaatactgtt

SEQ ID NO: 620367 - DNA, 20 bp, Artificial
  CRISPR gRNA sequence
atactgtttttagtttattt

SEQ ID NO: 620368 - DNA, 20 bp, Artificial
  CRISPR gRNA sequence
ctgaaaagccattagactga

SEQ ID NO: 620369 - DNA, 20 bp, Artificial
  CRISPR gRNA sequence
aagccattagactgactgtg

SEQ ID NO: 620370 - DNA, 20 bp, Artificial
  CRISPR gRNA sequence
atatattataactttgtgga

SEQ ID NO: 620371 - DNA, 20 bp, Artificial
  CRISPR gRNA sequence
gttcatgagcgtagatgaaa

SEQ ID NO: 620372 - DNA, 20 bp, Artificial
  CRISPR gRNA sequence
tactttttatcaaatagata

SEQ ID NO: 620373 - DNA, 20 bp, Artificial
  CRISPR gRNA sequence
taaatatttttaaaacatcg

SEQ ID NO: 620374 - DNA, 20 bp, Artificial
  CRISPR gRNA sequence
aaagcaaaatgtaattgact

SEQ ID NO: 620375 - DNA, 20 bp, Artificial
  CRISPR gRNA sequence
aagtatatatgttctaaagc

SEQ ID NO: 620376 - DNA, 20 bp, Artificial
  CRISPR gRNA sequence
atatgttctaaagctgatga

SEQ ID NO: 620377 - DNA, 20 bp, Artificial
  CRISPR gRNA sequence
gatgattttgattatgataa

SEQ ID NO: 620378 - DNA, 20 bp, Artificial
  CRISPR gRNA sequence
gtaatttttaagatatcagc

SEQ ID NO: 620379 - DNA, 20 bp, Artificial
  CRISPR gRNA sequence
gggcatcagaaaaccctggt

SEQ ID NO: 620380 - DNA, 20 bp, Artificial
  CRISPR gRNA sequence
tttgacctaccttgtatctt

SEQ ID NO: 620381 - DNA, 20 bp, Artificial
  CRISPR gRNA sequence
aaaacttttaaataaattta

SEQ ID NO: 620382 - DNA, 20 bp, Artificial
  CRISPR gRNA sequence
tgttaagagtcaacgatcct

SEQ ID NO: 620383 - DNA, 20 bp, Artificial
  CRISPR gRNA sequence
accacttactatctcatttc

SEQ ID NO: 620384 - DNA, 20 bp, Artificial
  CRISPR gRNA sequence
ttaagaaaaaaaaattggca

SEQ ID NO: 620385 - DNA, 20 bp, Artificial
  CRISPR gRNA sequence
aaaaattggcaaagggttta

SEQ ID NO: 620386 - DNA, 20 bp, Artificial
  CRISPR gRNA sequence
aaataagaccttctcatttg

SEQ ID NO: 620387 - DNA, 20 bp, Artificial
  CRISPR gRNA sequence
caaaaaacttttcacctctc

SEQ ID NO: 620388 - DNA, 20 bp, Artificial
  CRISPR gRNA sequence
aatatagtatgaattaatct

SEQ ID NO: 620389 - DNA, 20 bp, Artificial
  CRISPR gRNA sequence
aaaatatgtatagaaataca

SEQ ID NO: 620390 - DNA, 20 bp, Artificial
  CRISPR gRNA sequence
acttcttttctgatatgcta

SEQ ID NO: 620391 - DNA, 20 bp, Artificial
  CRISPR gRNA sequence
aagtcaagacccaggctact

SEQ ID NO: 620392 - DNA, 20 bp, Artificial
  CRISPR gRNA sequence
tactagcagaattctgaaaa

SEQ ID NO: 620393 - DNA, 20 bp, Artificial
  CRISPR gRNA sequence
agtcatcaggttattctttc

SEQ ID NO: 620394 - DNA, 20 bp, Artificial
  CRISPR gRNA sequence
ccatgccacagacgtcacat

SEQ ID NO: 620395 - DNA, 20 bp, Artificial
  CRISPR gRNA sequence
tttcagtttaccattcggaa

SEQ ID NO: 620396 - DNA, 20 bp, Artificial
  CRISPR gRNA sequence
tgatctcatcttcacggctc

SEQ ID NO: 620397 - DNA, 20 bp, Artificial
  CRISPR gRNA sequence
actcttcatcactctgcatt

SEQ ID NO: 620398 - DNA, 20 bp, Artificial
  CRISPR gRNA sequence
gaatgactatttcctcacat

SEQ ID NO: 620399 - DNA, 20 bp, Artificial
  CRISPR gRNA sequence
tttgtttctttcacttagac

SEQ ID NO: 620400 - DNA, 20 bp, Artificial
  CRISPR gRNA sequence
cttagacatttgctttttaa

SEQ ID NO: 620401 - DNA, 20 bp, Artificial
  CRISPR gRNA sequence
gtttttttaataatcctggt

SEQ ID NO: 620402 - DNA, 20 bp, Artificial
  CRISPR gRNA sequence
ctaagactcctaggactgag

SEQ ID NO: 620403 - DNA, 20 bp, Artificial
  CRISPR gRNA sequence
gagataggattatggaagaa

SEQ ID NO: 620404 - DNA, 20 bp, Artificial
  CRISPR gRNA sequence
atggaagaaacaagattaaa

SEQ ID NO: 620405 - DNA, 20 bp, Artificial
  CRISPR gRNA sequence
cattatgtatacttcatatt

SEQ ID NO: 620406 - DNA, 20 bp, Artificial
  CRISPR gRNA sequence
acatcagagtacttgtataa

SEQ ID NO: 620407 - DNA, 20 bp, Artificial
  CRISPR gRNA sequence
aatcaaactaaacacatata

SEQ ID NO: 620408 - DNA, 20 bp, Artificial
  CRISPR gRNA sequence
aaaaaattacctatggaaca

SEQ ID NO: 620409 - DNA, 20 bp, Artificial
  CRISPR gRNA sequence
ctgttaagaaatttaatgcc

SEQ ID NO: 620410 - DNA, 20 bp, Artificial
  CRISPR gRNA sequence
gaaatttaatgccttctgtt

SEQ ID NO: 620411 - DNA, 20 bp, Artificial
  CRISPR gRNA sequence
tttgttagcacagccttcat

SEQ ID NO: 620412 - DNA, 20 bp, Artificial
  CRISPR gRNA sequence
agtcttttcataaagcagaa

SEQ ID NO: 620413 - DNA, 20 bp, Artificial
  CRISPR gRNA sequence
gaaacaagctttaagtgagt

SEQ ID NO: 620414 - DNA, 20 bp, Artificial
  CRISPR gRNA sequence
aaaacaacttatttggtact

SEQ ID NO: 620415 - DNA, 20 bp, Artificial
  CRISPR gRNA sequence
aagtaagttcttttcattgc

SEQ ID NO: 620416 - DNA, 20 bp, Artificial
  CRISPR gRNA sequence
tcttagagaaaccacacagt

SEQ ID NO: 620417 - DNA, 20 bp, Artificial
  CRISPR gRNA sequence
ctaattatttaaactgagtc

SEQ ID NO: 620418 - DNA, 20 bp, Artificial
  CRISPR gRNA sequence
gtttgcaaagtacagatgaa

SEQ ID NO: 620419 - DNA, 20 bp, Artificial
  CRISPR gRNA sequence
actgaataaagttcgagcag

SEQ ID NO: 620420 - DNA, 20 bp, Artificial
  CRISPR gRNA sequence
gaacgaggatagtgaggaac

SEQ ID NO: 620421 - DNA, 20 bp, Artificial
  CRISPR gRNA sequence
taaatgagtaaatacaggaa

SEQ ID NO: 620422 - DNA, 20 bp, Artificial
  CRISPR gRNA sequence
atatatagtgctctatttca

SEQ ID NO: 620423 - DNA, 20 bp, Artificial
  CRISPR gRNA sequence
ctaacagagtaccaactata

SEQ ID NO: 620424 - DNA, 20 bp, Artificial
  CRISPR gRNA sequence
ttacaaattgttactccctt

SEQ ID NO: 620425 - DNA, 20 bp, Artificial
  CRISPR gRNA sequence
tgttcaagtagtattcactg

SEQ ID NO: 620426 - DNA, 20 bp, Artificial
  CRISPR gRNA sequence
ctgagatgttttactaactt

SEQ ID NO: 620427 - DNA, 20 bp, Artificial
  CRISPR gRNA sequence
ttttactaacttaagagttt

SEQ ID NO: 620428 - DNA, 20 bp, Artificial
  CRISPR gRNA sequence
taagagttttattgctttaa

SEQ ID NO: 620429 - DNA, 20 bp, Artificial
  CRISPR gRNA sequence
tattgctttaaacttgcttt

SEQ ID NO: 620430 - DNA, 20 bp, Artificial
  CRISPR gRNA sequence
attggaaatttgaaattatt

SEQ ID NO: 620431 - DNA, 20 bp, Artificial
  CRISPR gRNA sequence
ccacatagttctgtcaatct

SEQ ID NO: 620432 - DNA, 20 bp, Artificial
  CRISPR gRNA sequence
gattaaaactggtattttat

SEQ ID NO: 620433 - DNA, 20 bp, Artificial
  CRISPR gRNA sequence
atatattaaggaacttagcc

SEQ ID NO: 620434 - DNA, 20 bp, Artificial
  CRISPR gRNA sequence
atgatatcttttgcaaacat

SEQ ID NO: 620435 - DNA, 20 bp, Artificial
  CRISPR gRNA sequence
taaagtcttcagttatggct

SEQ ID NO: 620436 - DNA, 20 bp, Artificial
  CRISPR gRNA sequence
ggattctatatcttgcatca

SEQ ID NO: 620437 - DNA, 20 bp, Artificial
  CRISPR gRNA sequence
aagaaatacataactgaaag

SEQ ID NO: 620438 - DNA, 20 bp, Artificial
  CRISPR gRNA sequence
atatgactgacattacacta

SEQ ID NO: 620439 - DNA, 20 bp, Artificial
  CRISPR gRNA sequence
ataacatgaaacagataaaa

SEQ ID NO: 620440 - DNA, 20 bp, Artificial
  CRISPR gRNA sequence
tctaacaatactataaagaa

SEQ ID NO: 620441 - DNA, 20 bp, Artificial
  CRISPR gRNA sequence
gaatcttaactattacatag

SEQ ID NO: 620442 - DNA, 20 bp, Artificial
  CRISPR gRNA sequence
tccactcatagaaactctcc

SEQ ID NO: 620443 - DNA, 20 bp, Artificial
  CRISPR gRNA sequence
tggtttattttcactattta

SEQ ID NO: 620444 - DNA, 20 bp, Artificial
  CRISPR gRNA sequence
cacctaatattttaacttat

SEQ ID NO: 620445 - DNA, 20 bp, Artificial
  CRISPR gRNA sequence
ccactgtacaataatattca

SEQ ID NO: 620446 - DNA, 20 bp, Artificial
  CRISPR gRNA sequence
ttacttttcaaatatttgaa

SEQ ID NO: 620447 - DNA, 20 bp, Artificial
  CRISPR gRNA sequence
tcaataccaagagttatttt

SEQ ID NO: 620448 - DNA, 20 bp, Artificial
  CRISPR gRNA sequence
taccaagagttatttttcaa

SEQ ID NO: 620449 - DNA, 20 bp, Artificial
  CRISPR gRNA sequence
atcatatgctaataagcaat

SEQ ID NO: 620450 - DNA, 20 bp, Artificial
  CRISPR gRNA sequence
caatgaaaaggggatatgag

SEQ ID NO: 620451 - DNA, 20 bp, Artificial
  CRISPR gRNA sequence
aaggggatatgagacaagat

SEQ ID NO: 620452 - DNA, 20 bp, Artificial
  CRISPR gRNA sequence
gattttagttttgatgataa

SEQ ID NO: 620453 - DNA, 20 bp, Artificial
  CRISPR gRNA sequence
acatccatattttagtagac

SEQ ID NO: 620454 - DNA, 20 bp, Artificial
  CRISPR gRNA sequence
atagaaaaaaactgttatgg

SEQ ID NO: 620455 - DNA, 20 bp, Artificial
  CRISPR gRNA sequence
tatggtcaagtttatgtaga

SEQ ID NO: 620456 - DNA, 20 bp, Artificial
  CRISPR gRNA sequence
acatatttttccaaacaaaa

SEQ ID NO: 620457 - DNA, 20 bp, Artificial
  CRISPR gRNA sequence
atataaacattttcatgaat

SEQ ID NO: 620458 - DNA, 20 bp, Artificial
  CRISPR gRNA sequence
agcttttcccctcttcttct

SEQ ID NO: 620459 - DNA, 20 bp, Artificial
  CRISPR gRNA sequence
atcttgatgccataaaaaca

SEQ ID NO: 620460 - DNA, 20 bp, Artificial
  CRISPR gRNA sequence
attctaggctctctacaatc

SEQ ID NO: 620461 - DNA, 20 bp, Artificial
  CRISPR gRNA sequence
atcaaaggcttcacaatagt

SEQ ID NO: 620462 - DNA, 20 bp, Artificial
  CRISPR gRNA sequence
actttgtcaataataatagt

SEQ ID NO: 620463 - DNA, 20 bp, Artificial
  CRISPR gRNA sequence
acccatttgtgcaagacagc

SEQ ID NO: 620464 - DNA, 20 bp, Artificial
  CRISPR gRNA sequence
aaaactttattattaatatg

SEQ ID NO: 620465 - DNA, 20 bp, Artificial
  CRISPR gRNA sequence
ctaatctacaaacaagttag

SEQ ID NO: 620466 - DNA, 20 bp, Artificial
  CRISPR gRNA sequence
ctaaccaggaaaataatgca

SEQ ID NO: 620467 - DNA, 20 bp, Artificial
  CRISPR gRNA sequence
aggaaaataatgcagaggga

SEQ ID NO: 620468 - DNA, 20 bp, Artificial
  CRISPR gRNA sequence
ttgatcttatagagtataaa

SEQ ID NO: 620469 - DNA, 20 bp, Artificial
  CRISPR gRNA sequence
atagagtataaaataagctt

SEQ ID NO: 620470 - DNA, 20 bp, Artificial
  CRISPR gRNA sequence
ctatgaaattggtgacttat

SEQ ID NO: 620471 - DNA, 20 bp, Artificial
  CRISPR gRNA sequence
gtaagtggactttttatatg

SEQ ID NO: 620472 - DNA, 20 bp, Artificial
  CRISPR gRNA sequence
ggcaattcaagtgggcactt

SEQ ID NO: 620473 - DNA, 20 bp, Artificial
  CRISPR gRNA sequence
gctatctaataatttattga

SEQ ID NO: 620474 - DNA, 20 bp, Artificial
  CRISPR gRNA sequence
tttctaaacagaaacaccaa

SEQ ID NO: 620475 - DNA, 20 bp, Artificial
  CRISPR gRNA sequence
atccatgttaatatcccaac

SEQ ID NO: 620476 - DNA, 20 bp, Artificial
  CRISPR gRNA sequence
taaatggatgagtcttgaaa

SEQ ID NO: 620477 - DNA, 20 bp, Artificial
  CRISPR gRNA sequence
cttcacaacatccttaaaga

SEQ ID NO: 620478 - DNA, 20 bp, Artificial
  CRISPR gRNA sequence
gttactccagatcaagacag

SEQ ID NO: 620479 - DNA, 20 bp, Artificial
  CRISPR gRNA sequence
ttgttatgggaccttgggaa

SEQ ID NO: 620480 - DNA, 20 bp, Artificial
  CRISPR gRNA sequence
atatggggggaaataacact

SEQ ID NO: 620481 - DNA, 20 bp, Artificial
  CRISPR gRNA sequence
taaaataatctctggtagac

SEQ ID NO: 620482 - DNA, 20 bp, Artificial
  CRISPR gRNA sequence
taataataatagaaaaataa

SEQ ID NO: 620483 - DNA, 20 bp, Artificial
  CRISPR gRNA sequence
atagaaaaataaaacagttt

SEQ ID NO: 620484 - DNA, 20 bp, Artificial
  CRISPR gRNA sequence
aatggtcagataaagaaatg

SEQ ID NO: 620485 - DNA, 20 bp, Artificial
  CRISPR gRNA sequence
aactacctcataattttaaa

SEQ ID NO: 620486 - DNA, 20 bp, Artificial
  CRISPR gRNA sequence
tcaattttaatctctaaacc

SEQ ID NO: 620487 - DNA, 20 bp, Artificial
  CRISPR gRNA sequence
agtttatgaaggatagcatt

SEQ ID NO: 620488 - DNA, 20 bp, Artificial
  CRISPR gRNA sequence
tttcaggatttcctttgtgg

SEQ ID NO: 620489 - DNA, 20 bp, Artificial
  CRISPR gRNA sequence
tggcaacaaaataaagacca

SEQ ID NO: 620490 - DNA, 20 bp, Artificial
  CRISPR gRNA sequence
gcaccattgtggcccacaga

SEQ ID NO: 620491 - DNA, 20 bp, Artificial
  CRISPR gRNA sequence
cctttatccaacctttcgat

SEQ ID NO: 620492 - DNA, 20 bp, Artificial
  CRISPR gRNA sequence
atatcttctatgtcttgcac

SEQ ID NO: 620493 - DNA, 20 bp, Artificial
  CRISPR gRNA sequence
caattcatctatattcagtt

SEQ ID NO: 620494 - DNA, 20 bp, Artificial
  CRISPR gRNA sequence
tttccagtgaaaccactgtc

SEQ ID NO: 620495 - DNA, 20 bp, Artificial
  CRISPR gRNA sequence
catttatacatctctactta

SEQ ID NO: 620496 - DNA, 20 bp, Artificial
  CRISPR gRNA sequence
catctctacttactaggttt

SEQ ID NO: 620497 - DNA, 20 bp, Artificial
  CRISPR gRNA sequence
ttttttgttttttctcaagc

SEQ ID NO: 620498 - DNA, 20 bp, Artificial
  CRISPR gRNA sequence
tatctgctaccttttttcat

SEQ ID NO: 620499 - DNA, 20 bp, Artificial
  CRISPR gRNA sequence
atttacttcactttacatta

SEQ ID NO: 620500 - DNA, 20 bp, Artificial
  CRISPR gRNA sequence
tgtatttgttgaaccagtgc

SEQ ID NO: 620501 - DNA, 20 bp, Artificial
  CRISPR gRNA sequence
tgctgatttacgtatgatat

SEQ ID NO: 620502 - DNA, 20 bp, Artificial
  CRISPR gRNA sequence
atgatgaataaatataacaa

SEQ ID NO: 620503 - DNA, 20 bp, Artificial
  CRISPR gRNA sequence
ataaatataacaatacagat

SEQ ID NO: 620504 - DNA, 20 bp, Artificial
  CRISPR gRNA sequence
cattttacaaatgaggaaac

SEQ ID NO: 620505 - DNA, 20 bp, Artificial
  CRISPR gRNA sequence
gaatcagtgtatacaatctg

SEQ ID NO: 620506 - DNA, 20 bp, Artificial
  CRISPR gRNA sequence
ccacagtggaatacaggtgt

SEQ ID NO: 620507 - DNA, 20 bp, Artificial
  CRISPR gRNA sequence
agagaaagttgtctgagtaa

SEQ ID NO: 620508 - DNA, 20 bp, Artificial
  CRISPR gRNA sequence
taagcctgttttggaagaag

SEQ ID NO: 620509 - DNA, 20 bp, Artificial
  CRISPR gRNA sequence
acactgccaaatttcctgag

SEQ ID NO: 620510 - DNA, 20 bp, Artificial
  CRISPR gRNA sequence
aagagcaatctactttgaac

SEQ ID NO: 620511 - DNA, 20 bp, Artificial
  CRISPR gRNA sequence
tgaactggtgtttggcaacc

SEQ ID NO: 620512 - DNA, 20 bp, Artificial
  CRISPR gRNA sequence
atctgcttaacgtaactgta

SEQ ID NO: 620513 - DNA, 20 bp, Artificial
  CRISPR gRNA sequence
tatgttcccaaagggaccca

SEQ ID NO: 620514 - DNA, 20 bp, Artificial
  CRISPR gRNA sequence
ggattcccagaggtcactaa

SEQ ID NO: 620515 - DNA, 20 bp, Artificial
  CRISPR gRNA sequence
agaaagagataaggaagaga

SEQ ID NO: 620516 - DNA, 20 bp, Artificial
  CRISPR gRNA sequence
aaagcagtgcaacacacttc

SEQ ID NO: 620517 - DNA, 20 bp, Artificial
  CRISPR gRNA sequence
tgaagcaacaggggaaccca

SEQ ID NO: 620518 - DNA, 20 bp, Artificial
  CRISPR gRNA sequence
tctgcatttggccctcagat

SEQ ID NO: 620519 - DNA, 20 bp, Artificial
  CRISPR gRNA sequence
agtgagaaagagaaaacttg

SEQ ID NO: 620520 - DNA, 20 bp, Artificial
  CRISPR gRNA sequence
attttccacaatgtagcagc

SEQ ID NO: 620521 - DNA, 20 bp, Artificial
  CRISPR gRNA sequence
tcttctttacaatgctcata

SEQ ID NO: 620522 - DNA, 20 bp, Artificial
  CRISPR gRNA sequence
tgaatgaatgagcattttaa

SEQ ID NO: 620523 - DNA, 20 bp, Artificial
  CRISPR gRNA sequence
agtatttaaatcatggaaat

SEQ ID NO: 620524 - DNA, 20 bp, Artificial
  CRISPR gRNA sequence
gaaataccagattataacat

SEQ ID NO: 620525 - DNA, 20 bp, Artificial
  CRISPR gRNA sequence
agattataacatctatgttt

SEQ ID NO: 620526 - DNA, 20 bp, Artificial
  CRISPR gRNA sequence
ttggaagccacttgctagct

SEQ ID NO: 620527 - DNA, 20 bp, Artificial
  CRISPR gRNA sequence
gggctctaggtccagcaccc

SEQ ID NO: 620528 - DNA, 20 bp, Artificial
  CRISPR gRNA sequence
gtcacatgaccttaggaaac

SEQ ID NO: 620529 - DNA, 20 bp, Artificial
  CRISPR gRNA sequence
taaacaatacacttggaact

SEQ ID NO: 620530 - DNA, 20 bp, Artificial
  CRISPR gRNA sequence
aaacaaacataaatctgggg

SEQ ID NO: 620531 - DNA, 20 bp, Artificial
  CRISPR gRNA sequence
ggaagtacagggaagatgca

SEQ ID NO: 620532 - DNA, 20 bp, Artificial
  CRISPR gRNA sequence
tgagcaaagtacaagagaat

SEQ ID NO: 620533 - DNA, 20 bp, Artificial
  CRISPR gRNA sequence
gtgaacaagacagatacatt

SEQ ID NO: 620534 - DNA, 20 bp, Artificial
  CRISPR gRNA sequence
aaaatatttaatgagcaata

SEQ ID NO: 620535 - DNA, 20 bp, Artificial
  CRISPR gRNA sequence
catttctaaatcaccattta

SEQ ID NO: 620536 - DNA, 20 bp, Artificial
  CRISPR gRNA sequence
gtatagttaaagggcatata

SEQ ID NO: 620537 - DNA, 20 bp, Artificial
  CRISPR gRNA sequence
aatacttcttttagaatact

SEQ ID NO: 620538 - DNA, 20 bp, Artificial
  CRISPR gRNA sequence
tagatcaaaatttatacaaa

SEQ ID NO: 620539 - DNA, 20 bp, Artificial
  CRISPR gRNA sequence
gttttatttcttctattaac

SEQ ID NO: 620540 - DNA, 20 bp, Artificial
  CRISPR gRNA sequence
attgtacaagttaccttcta

SEQ ID NO: 620541 - DNA, 20 bp, Artificial
  CRISPR gRNA sequence
acaagttaccttctaagggg

SEQ ID NO: 620542 - DNA, 20 bp, Artificial
  CRISPR gRNA sequence
ctgtgaaataaaggtaatgc

SEQ ID NO: 620543 - DNA, 20 bp, Artificial
  CRISPR gRNA sequence
gctaccgatttgtgcaggta

SEQ ID NO: 620544 - DNA, 20 bp, Artificial
  CRISPR gRNA sequence
cttcaatctatggtatctat

SEQ ID NO: 620545 - DNA, 20 bp, Artificial
  CRISPR gRNA sequence
gaatacaaccagactattct

SEQ ID NO: 620546 - DNA, 20 bp, Artificial
  CRISPR gRNA sequence
atgcctaattctatgtgttc

SEQ ID NO: 620547 - DNA, 20 bp, Artificial
  CRISPR gRNA sequence
tctgagggtcataggtaaaa

SEQ ID NO: 620548 - DNA, 20 bp, Artificial
  CRISPR gRNA sequence
gtgataaatgtgccatcccc

SEQ ID NO: 620549 - DNA, 20 bp, Artificial
  CRISPR gRNA sequence
atgtgaaccctgccattatg

SEQ ID NO: 620550 - DNA, 20 bp, Artificial
  CRISPR gRNA sequence
tgccattatgtatggcttgc

SEQ ID NO: 620551 - DNA, 20 bp, Artificial
  CRISPR gRNA sequence
tgtatggcttgcggctgttt

SEQ ID NO: 620552 - DNA, 20 bp, Artificial
  CRISPR gRNA sequence
ctgggactaagaggcaaatt

SEQ ID NO: 620553 - DNA, 20 bp, Artificial
  CRISPR gRNA sequence
gggatcacctcagcacttca

SEQ ID NO: 620554 - DNA, 20 bp, Artificial
  CRISPR gRNA sequence
tccctgtgacaagctagcca

SEQ ID NO: 620555 - DNA, 20 bp, Artificial
  CRISPR gRNA sequence
ttactgaaattatgtaaggt

SEQ ID NO: 620556 - DNA, 20 bp, Artificial
  CRISPR gRNA sequence
tagttttagaagcctaaagt

SEQ ID NO: 620557 - DNA, 20 bp, Artificial
  CRISPR gRNA sequence
gagcacaagaattcccgaat

SEQ ID NO: 620558 - DNA, 20 bp, Artificial
  CRISPR gRNA sequence
ttgcctttgttcaaggcagc

SEQ ID NO: 620559 - DNA, 20 bp, Artificial
  CRISPR gRNA sequence
gaaataatgacacaacttct

SEQ ID NO: 620560 - DNA, 20 bp, Artificial
  CRISPR gRNA sequence
tgaccactcagaaattcaag

SEQ ID NO: 620561 - DNA, 20 bp, Artificial
  CRISPR gRNA sequence
caacctgaacaaagttagca

SEQ ID NO: 620562 - DNA, 20 bp, Artificial
  CRISPR gRNA sequence
atatgtttttggcaagagta

SEQ ID NO: 620563 - DNA, 20 bp, Artificial
  CRISPR gRNA sequence
tcctcacagtgctatttcta

SEQ ID NO: 620564 - DNA, 20 bp, Artificial
  CRISPR gRNA sequence
ctccattattttcatgcatt

SEQ ID NO: 620565 - DNA, 20 bp, Artificial
  CRISPR gRNA sequence
tattttcatgcattttgaga

SEQ ID NO: 620566 - DNA, 20 bp, Artificial
  CRISPR gRNA sequence
attaagtttatattcaaatg

SEQ ID NO: 620567 - DNA, 20 bp, Artificial
  CRISPR gRNA sequence
aactaacttccttaaactca

SEQ ID NO: 620568 - DNA, 20 bp, Artificial
  CRISPR gRNA sequence
ttccagctgacacaagaatt

SEQ ID NO: 620569 - DNA, 20 bp, Artificial
  CRISPR gRNA sequence
tatgaatacagtaaaatcct

SEQ ID NO: 620570 - DNA, 20 bp, Artificial
  CRISPR gRNA sequence
aaacacaggacatattttaa

SEQ ID NO: 620571 - DNA, 20 bp, Artificial
  CRISPR gRNA sequence
cccattattaagagatcaag

SEQ ID NO: 620572 - DNA, 20 bp, Artificial
  CRISPR gRNA sequence
taaggaatagaatcctgaag

SEQ ID NO: 620573 - DNA, 20 bp, Artificial
  CRISPR gRNA sequence
tagcttttacagatagaaaa

SEQ ID NO: 620574 - DNA, 20 bp, Artificial
  CRISPR gRNA sequence
gagtgtggacttgggaagtc

SEQ ID NO: 620575 - DNA, 20 bp, Artificial
  CRISPR gRNA sequence
tattccaggatcagggaatt

SEQ ID NO: 620576 - DNA, 20 bp, Artificial
  CRISPR gRNA sequence
atcagggaattcactgattt

SEQ ID NO: 620577 - DNA, 20 bp, Artificial
  CRISPR gRNA sequence
gatctataggactagacaag

SEQ ID NO: 620578 - DNA, 20 bp, Artificial
  CRISPR gRNA sequence
cacggtctcagtgcaaaata

SEQ ID NO: 620579 - DNA, 20 bp, Artificial
  CRISPR gRNA sequence
aaataatactgctggaaaag

SEQ ID NO: 620580 - DNA, 20 bp, Artificial
  CRISPR gRNA sequence
aggaatttattattctgtgg

SEQ ID NO: 620581 - DNA, 20 bp, Artificial
  CRISPR gRNA sequence
aacaaatctttccaataagt

SEQ ID NO: 620582 - DNA, 20 bp, Artificial
  CRISPR gRNA sequence
aaagaaaccaagttggggga

SEQ ID NO: 620583 - DNA, 20 bp, Artificial
  CRISPR gRNA sequence
aaaggaattgaatgtaacga

SEQ ID NO: 620584 - DNA, 20 bp, Artificial
  CRISPR gRNA sequence
gtaacgagtgagtttaagaa

SEQ ID NO: 620585 - DNA, 20 bp, Artificial
  CRISPR gRNA sequence
ttaagaactgggcttttacg

SEQ ID NO: 620586 - DNA, 20 bp, Artificial
  CRISPR gRNA sequence
gccatagtcctaacttcata

SEQ ID NO: 620587 - DNA, 20 bp, Artificial
  CRISPR gRNA sequence
gttctcactaatacttccta

SEQ ID NO: 620588 - DNA, 20 bp, Artificial
  CRISPR gRNA sequence
atagaacattggtcaaaaat

SEQ ID NO: 620589 - DNA, 20 bp, Artificial
  CRISPR gRNA sequence
tcttcatgctgataatagtt

SEQ ID NO: 620590 - DNA, 20 bp, Artificial
  CRISPR gRNA sequence
taatgaaattcacttgtcag

SEQ ID NO: 620591 - DNA, 20 bp, Artificial
  CRISPR gRNA sequence
ctgtcactaattggtcaaaa

SEQ ID NO: 620592 - DNA, 20 bp, Artificial
  CRISPR gRNA sequence
actaattggtcaaaaaaaag

SEQ ID NO: 620593 - DNA, 20 bp, Artificial
  CRISPR gRNA sequence
ggtcaaaaaaaagattagtt

SEQ ID NO: 620594 - DNA, 20 bp, Artificial
  CRISPR gRNA sequence
ttagttttcagattcctttc

SEQ ID NO: 620595 - DNA, 20 bp, Artificial
  CRISPR gRNA sequence
tttcctttgttttttttttt

SEQ ID NO: 620596 - DNA, 20 bp, Artificial
  CRISPR gRNA sequence
gcagtagacagtctacaatc

SEQ ID NO: 620597 - DNA, 20 bp, Artificial
  CRISPR gRNA sequence
taagagaaaggaccatattt

SEQ ID NO: 620598 - DNA, 20 bp, Artificial
  CRISPR gRNA sequence
cattaaactttatatttttc

SEQ ID NO: 620599 - DNA, 20 bp, Artificial
  CRISPR gRNA sequence
atttttctagtgtttttatt

SEQ ID NO: 620600 - DNA, 20 bp, Artificial
  CRISPR gRNA sequence
tcagttagagactgaattta

SEQ ID NO: 620601 - DNA, 20 bp, Artificial
  CRISPR gRNA sequence
atgctgttttataaatttta

SEQ ID NO: 620602 - DNA, 20 bp, Artificial
  CRISPR gRNA sequence
ttttataaattttattctgc

SEQ ID NO: 620603 - DNA, 20 bp, Artificial
  CRISPR gRNA sequence
actctcaaatgatggtcaat

SEQ ID NO: 620604 - DNA, 20 bp, Artificial
  CRISPR gRNA sequence
gtctcggatgcaagaaagca

SEQ ID NO: 620605 - DNA, 20 bp, Artificial
  CRISPR gRNA sequence
acgtcataagtccatattct

SEQ ID NO: 620606 - DNA, 20 bp, Artificial
  CRISPR gRNA sequence
tgggggaagtggaaaatgaa

SEQ ID NO: 620607 - DNA, 20 bp, Artificial
  CRISPR gRNA sequence
aaccaatcactgaactagaa

SEQ ID NO: 620608 - DNA, 20 bp, Artificial
  CRISPR gRNA sequence
gtggaggtaaatgttagtgt

SEQ ID NO: 620609 - DNA, 20 bp, Artificial
  CRISPR gRNA sequence
taatccattattgacatgat

SEQ ID NO: 620610 - DNA, 20 bp, Artificial
  CRISPR gRNA sequence
tctatgtttcataaatataa

SEQ ID NO: 620611 - DNA, 20 bp, Artificial
  CRISPR gRNA sequence
ttagagtatgacagttattc

SEQ ID NO: 620612 - DNA, 20 bp, Artificial
  CRISPR gRNA sequence
aaacttatgaataacataat

SEQ ID NO: 620613 - DNA, 20 bp, Artificial
  CRISPR gRNA sequence
tttgttgcaaatatccagag

SEQ ID NO: 620614 - DNA, 20 bp, Artificial
  CRISPR gRNA sequence
tttaaatatcatacaaatga

SEQ ID NO: 620615 - DNA, 20 bp, Artificial
  CRISPR gRNA sequence
aaggaaaatatattattctg

SEQ ID NO: 620616 - DNA, 20 bp, Artificial
  CRISPR gRNA sequence
caaaactcttaaatccaatc

SEQ ID NO: 620617 - DNA, 20 bp, Artificial
  CRISPR gRNA sequence
tcttaaatccaatcaatgga

SEQ ID NO: 620618 - DNA, 20 bp, Artificial
  CRISPR gRNA sequence
attgcattaccacatagaag

SEQ ID NO: 620619 - DNA, 20 bp, Artificial
  CRISPR gRNA sequence
gattcaaatttcactaagaa

SEQ ID NO: 620620 - DNA, 20 bp, Artificial
  CRISPR gRNA sequence
gttctgtactttggtctttg

SEQ ID NO: 620621 - DNA, 20 bp, Artificial
  CRISPR gRNA sequence
ctcttaaacattctataaaa

SEQ ID NO: 620622 - DNA, 20 bp, Artificial
  CRISPR gRNA sequence
acaagcatggatcctgaaaa

SEQ ID NO: 620623 - DNA, 20 bp, Artificial
  CRISPR gRNA sequence
gcatggatcctgaaaaggcg

SEQ ID NO: 620624 - DNA, 20 bp, Artificial
  CRISPR gRNA sequence
taaaactaacttccagttat

SEQ ID NO: 620625 - DNA, 20 bp, Artificial
  CRISPR gRNA sequence
tttctagaagacaattctaa

SEQ ID NO: 620626 - DNA, 20 bp, Artificial
  CRISPR gRNA sequence
actaccttatttcattcagt

SEQ ID NO: 620627 - DNA, 20 bp, Artificial
  CRISPR gRNA sequence
ttaaagttttgttctgttct

SEQ ID NO: 620628 - DNA, 20 bp, Artificial
  CRISPR gRNA sequence
aaatagtaaatctcactggg

SEQ ID NO: 620629 - DNA, 20 bp, Artificial
  CRISPR gRNA sequence
aaagttttctaaaagctaat

SEQ ID NO: 620630 - DNA, 20 bp, Artificial
  CRISPR gRNA sequence
aatctattggcacatgctgt

SEQ ID NO: 620631 - DNA, 20 bp, Artificial
  CRISPR gRNA sequence
taggttgatgccaaagtaac

SEQ ID NO: 620632 - DNA, 20 bp, Artificial
  CRISPR gRNA sequence
gttgtcataatgtcattagt

SEQ ID NO: 620633 - DNA, 20 bp, Artificial
  CRISPR gRNA sequence
agaagtttattttttaaagt

SEQ ID NO: 620634 - DNA, 20 bp, Artificial
  CRISPR gRNA sequence
ttaattttctgaggtcacac

SEQ ID NO: 620635 - DNA, 20 bp, Artificial
  CRISPR gRNA sequence
ctagaatcctcaaaggaaac

SEQ ID NO: 620636 - DNA, 20 bp, Artificial
  CRISPR gRNA sequence
tactgacacaataaccatta

SEQ ID NO: 620637 - DNA, 20 bp, Artificial
  CRISPR gRNA sequence
acccagtgtattttaaccat

SEQ ID NO: 620638 - DNA, 20 bp, Artificial
  CRISPR gRNA sequence
tcaaactaaagaatatggaa

SEQ ID NO: 620639 - DNA, 20 bp, Artificial
  CRISPR gRNA sequence
aaagaatatggaaagaagat

SEQ ID NO: 620640 - DNA, 20 bp, Artificial
  CRISPR gRNA sequence
acacacagacacactaatga

SEQ ID NO: 620641 - DNA, 20 bp, Artificial
  CRISPR gRNA sequence
taatgactatgtttttaaat

SEQ ID NO: 620642 - DNA, 20 bp, Artificial
  CRISPR gRNA sequence
actgattgtaaaaaaacaaa

SEQ ID NO: 620643 - DNA, 20 bp, Artificial
  CRISPR gRNA sequence
aaaaacaaataatgttttcc

SEQ ID NO: 620644 - DNA, 20 bp, Artificial
  CRISPR gRNA sequence
ctacacatcatgtaaactaa

SEQ ID NO: 620645 - DNA, 20 bp, Artificial
  CRISPR gRNA sequence
atgaaaccccattacaaaac

SEQ ID NO: 620646 - DNA, 20 bp, Artificial
  CRISPR gRNA sequence
taaagtcatatgcaccatca

SEQ ID NO: 620647 - DNA, 20 bp, Artificial
  CRISPR gRNA sequence
ccaacacaaaaattaaacat

SEQ ID NO: 620648 - DNA, 20 bp, Artificial
  CRISPR gRNA sequence
ttaaatgaaatatgtatgtg

SEQ ID NO: 620649 - DNA, 20 bp, Artificial
  CRISPR gRNA sequence
attataatatttttggaatt

SEQ ID NO: 620650 - DNA, 20 bp, Artificial
  CRISPR gRNA sequence
accatggaatatttatcttc

SEQ ID NO: 620651 - DNA, 20 bp, Artificial
  CRISPR gRNA sequence
ttatgatattttaatttaaa

SEQ ID NO: 620652 - DNA, 20 bp, Artificial
  CRISPR gRNA sequence
aagggcgtgaacccaggagg

SEQ ID NO: 620653 - DNA, 20 bp, Artificial
  CRISPR gRNA sequence
taaatcatttcaaggaaaat

SEQ ID NO: 620654 - DNA, 20 bp, Artificial
  CRISPR gRNA sequence
aattttggtttcctcagaat

SEQ ID NO: 620655 - DNA, 20 bp, Artificial
  CRISPR gRNA sequence
aaagattgttacacacaggt

SEQ ID NO: 620656 - DNA, 20 bp, Artificial
  CRISPR gRNA sequence
ctgtggaatatctttatgca

SEQ ID NO: 620657 - DNA, 20 bp, Artificial
  CRISPR gRNA sequence
ttcactgaatctggtataga

SEQ ID NO: 620658 - DNA, 20 bp, Artificial
  CRISPR gRNA sequence
ggtatagagaaggcttattt

SEQ ID NO: 620659 - DNA, 20 bp, Artificial
  CRISPR gRNA sequence
aataagtgtattaatgtgtc

SEQ ID NO: 620660 - DNA, 20 bp, Artificial
  CRISPR gRNA sequence
acaatcttaacatctttgca

SEQ ID NO: 620661 - DNA, 20 bp, Artificial
  CRISPR gRNA sequence
taaatttttttaattgacct

SEQ ID NO: 620662 - DNA, 20 bp, Artificial
  CRISPR gRNA sequence
ttgtgtatttttagtagaga

SEQ ID NO: 620663 - DNA, 20 bp, Artificial
  CRISPR gRNA sequence
ctcctcggcctcccaaagta

SEQ ID NO: 620664 - DNA, 20 bp, Artificial
  CRISPR gRNA sequence
tatgtacttattttttttaa

SEQ ID NO: 620665 - DNA, 20 bp, Artificial
  CRISPR gRNA sequence
ttttttttaatcatgtttac

SEQ ID NO: 620666 - DNA, 20 bp, Artificial
  CRISPR gRNA sequence
atctatatttctctctaaaa

SEQ ID NO: 620667 - DNA, 20 bp, Artificial
  CRISPR gRNA sequence
tatttctctctaaaatctag

SEQ ID NO: 620668 - DNA, 20 bp, Artificial
  CRISPR gRNA sequence
taacacaagtgggttagagt

SEQ ID NO: 620669 - DNA, 20 bp, Artificial
  CRISPR gRNA sequence
tgcatattcctttccgtctt

SEQ ID NO: 620670 - DNA, 20 bp, Artificial
  CRISPR gRNA sequence
tcctcaactcttcaagtgta

SEQ ID NO: 620671 - DNA, 20 bp, Artificial
  CRISPR gRNA sequence
aaaaaaacaattcatgaata

SEQ ID NO: 620672 - DNA, 20 bp, Artificial
  CRISPR gRNA sequence
caattcatgaatacaaagat

SEQ ID NO: 620673 - DNA, 20 bp, Artificial
  CRISPR gRNA sequence
atgtactttctatttttaac

SEQ ID NO: 620674 - DNA, 20 bp, Artificial
  CRISPR gRNA sequence
tataatgtaactcatactta

SEQ ID NO: 620675 - DNA, 20 bp, Artificial
  CRISPR gRNA sequence
taaacagtttatttagttca

SEQ ID NO: 620676 - DNA, 20 bp, Artificial
  CRISPR gRNA sequence
ctaataagtaagttgaagag

SEQ ID NO: 620677 - DNA, 20 bp, Artificial
  CRISPR gRNA sequence
agtaagttgaagagcagggc

SEQ ID NO: 620678 - DNA, 20 bp, Artificial
  CRISPR gRNA sequence
gttgaagagcagggcttagg

SEQ ID NO: 620679 - DNA, 20 bp, Artificial
  CRISPR gRNA sequence
agcagggcttaggttttgtt

SEQ ID NO: 620680 - DNA, 20 bp, Artificial
  CRISPR gRNA sequence
tttgctttgccctctaaata

SEQ ID NO: 620681 - DNA, 20 bp, Artificial
  CRISPR gRNA sequence
tgtcatttcctgccaaacca

SEQ ID NO: 620682 - DNA, 20 bp, Artificial
  CRISPR gRNA sequence
gttcacaaccaaactgctct

SEQ ID NO: 620683 - DNA, 20 bp, Artificial
  CRISPR gRNA sequence
accaaactgctctctgagtt

SEQ ID NO: 620684 - DNA, 20 bp, Artificial
  CRISPR gRNA sequence
tggctcatgcctgtagtccc

SEQ ID NO: 620685 - DNA, 20 bp, Artificial
  CRISPR gRNA sequence
atgtagccaggtgtggtagt

SEQ ID NO: 620686 - DNA, 20 bp, Artificial
  CRISPR gRNA sequence
ttgggggactgggacaggag

SEQ ID NO: 620687 - DNA, 20 bp, Artificial
  CRISPR gRNA sequence
gagttcaaggctggagtaag

SEQ ID NO: 620688 - DNA, 20 bp, Artificial
  CRISPR gRNA sequence
tcttgtatactaccaagaga

SEQ ID NO: 620689 - DNA, 20 bp, Artificial
  CRISPR gRNA sequence
atttgccagcccaagtaaaa

SEQ ID NO: 620690 - DNA, 20 bp, Artificial
  CRISPR gRNA sequence
aaaaatatgattaaaatagg

SEQ ID NO: 620691 - DNA, 20 bp, Artificial
  CRISPR gRNA sequence
aataggcaaagcttgtcatc

SEQ ID NO: 620692 - DNA, 20 bp, Artificial
  CRISPR gRNA sequence
tctcctgatttttactttct

SEQ ID NO: 620693 - DNA, 20 bp, Artificial
  CRISPR gRNA sequence
taaggcatctaattagtgcc

SEQ ID NO: 620694 - DNA, 20 bp, Artificial
  CRISPR gRNA sequence
tgcccactgtttttccaccc

SEQ ID NO: 620695 - DNA, 20 bp, Artificial
  CRISPR gRNA sequence
ttccaccctccagtttgatg

SEQ ID NO: 620696 - DNA, 20 bp, Artificial
  CRISPR gRNA sequence
ctaaatgaaccacactttgt

SEQ ID NO: 620697 - DNA, 20 bp, Artificial
  CRISPR gRNA sequence
ctatcacctggaaccctgcc

SEQ ID NO: 620698 - DNA, 20 bp, Artificial
  CRISPR gRNA sequence
taagagaaaaagagataagc

SEQ ID NO: 620699 - DNA, 20 bp, Artificial
  CRISPR gRNA sequence
atgatgtgataatatggaaa

SEQ ID NO: 620700 - DNA, 20 bp, Artificial
  CRISPR gRNA sequence
aagagacatgggtaaaatgc

SEQ ID NO: 620701 - DNA, 20 bp, Artificial
  CRISPR gRNA sequence
atgggctagccatggcaaga

SEQ ID NO: 620702 - DNA, 20 bp, Artificial
  CRISPR gRNA sequence
caaaatcctaactaattcta

SEQ ID NO: 620703 - DNA, 20 bp, Artificial
  CRISPR gRNA sequence
aatccatttaataagggatg

SEQ ID NO: 620704 - DNA, 20 bp, Artificial
  CRISPR gRNA sequence
aaaaaaaatttggtgttagg

SEQ ID NO: 620705 - DNA, 20 bp, Artificial
  CRISPR gRNA sequence
acaactaataaaaaagcaat

SEQ ID NO: 620706 - DNA, 20 bp, Artificial
  CRISPR gRNA sequence
aggtatgtaagtatgtcatt

SEQ ID NO: 620707 - DNA, 20 bp, Artificial
  CRISPR gRNA sequence
cctccaagtagatgcaggac

SEQ ID NO: 620708 - DNA, 20 bp, Artificial
  CRISPR gRNA sequence
ataaaagaggggatgatcaa

SEQ ID NO: 620709 - DNA, 20 bp, Artificial
  CRISPR gRNA sequence
agaagtttgggtaggctggg

SEQ ID NO: 620710 - DNA, 20 bp, Artificial
  CRISPR gRNA sequence
ctgaattccaccttgaaaca

SEQ ID NO: 620711 - DNA, 20 bp, Artificial
  CRISPR gRNA sequence
aggtaccagtcatggggaaa

SEQ ID NO: 620712 - DNA, 20 bp, Artificial
  CRISPR gRNA sequence
aaagtcagggaggtccttaa

SEQ ID NO: 620713 - DNA, 20 bp, Artificial
  CRISPR gRNA sequence
acccaatagtgatgaaatat

SEQ ID NO: 620714 - DNA, 20 bp, Artificial
  CRISPR gRNA sequence
acatgtcaaacagaaatttt

SEQ ID NO: 620715 - DNA, 20 bp, Artificial
  CRISPR gRNA sequence
tgttatgtgctatatgttaa

SEQ ID NO: 620716 - DNA, 20 bp, Artificial
  CRISPR gRNA sequence
agcagcaataaatgtatact

SEQ ID NO: 620717 - DNA, 20 bp, Artificial
  CRISPR gRNA sequence
gcaatagaaaaactattgtg

SEQ ID NO: 620718 - DNA, 20 bp, Artificial
  CRISPR gRNA sequence
aagaatgatccttactctca

SEQ ID NO: 620719 - DNA, 20 bp, Artificial
  CRISPR gRNA sequence
tataaaccaatgtacttttt

SEQ ID NO: 620720 - DNA, 20 bp, Artificial
  CRISPR gRNA sequence
atgttatattaatgcaagaa

SEQ ID NO: 620721 - DNA, 20 bp, Artificial
  CRISPR gRNA sequence
actaagtcaactttaaaact

SEQ ID NO: 620722 - DNA, 20 bp, Artificial
  CRISPR gRNA sequence
aactttaaaactctaagttt

SEQ ID NO: 620723 - DNA, 20 bp, Artificial
  CRISPR gRNA sequence
gggttaaaaatactcttctt

SEQ ID NO: 620724 - DNA, 20 bp, Artificial
  CRISPR gRNA sequence
tcactgacaatttttttgga

SEQ ID NO: 620725 - DNA, 20 bp, Artificial
  CRISPR gRNA sequence
atttcactacttttgacagt

SEQ ID NO: 620726 - DNA, 20 bp, Artificial
  CRISPR gRNA sequence
gttcaagttttccttctaaa

SEQ ID NO: 620727 - DNA, 20 bp, Artificial
  CRISPR gRNA sequence
atataatttcagaggagaaa

SEQ ID NO: 620728 - DNA, 20 bp, Artificial
  CRISPR gRNA sequence
tttcagaggagaaatgttgc

SEQ ID NO: 620729 - DNA, 20 bp, Artificial
  CRISPR gRNA sequence
agaaatgttgctttggtttg

SEQ ID NO: 620730 - DNA, 20 bp, Artificial
  CRISPR gRNA sequence
atatttcttttccttcatat

SEQ ID NO: 620731 - DNA, 20 bp, Artificial
  CRISPR gRNA sequence
tactttaagtaatgaaaaca

SEQ ID NO: 620732 - DNA, 20 bp, Artificial
  CRISPR gRNA sequence
atgaaaacactctgcttttg

SEQ ID NO: 620733 - DNA, 20 bp, Artificial
  CRISPR gRNA sequence
gcacttcccatctctcatac

SEQ ID NO: 620734 - DNA, 20 bp, Artificial
  CRISPR gRNA sequence
cctgtcagatcagctatggc

SEQ ID NO: 620735 - DNA, 20 bp, Artificial
  CRISPR gRNA sequence
ttttttttttttttttgaga

SEQ ID NO: 620736 - DNA, 20 bp, Artificial
  CRISPR gRNA sequence
gctcaccacaacctctgcct

SEQ ID NO: 620737 - DNA, 20 bp, Artificial
  CRISPR gRNA sequence
aacctctgcctcccagtttc

SEQ ID NO: 620738 - DNA, 20 bp, Artificial
  CRISPR gRNA sequence
attctcctgcctcagcctag

SEQ ID NO: 620739 - DNA, 20 bp, Artificial
  CRISPR gRNA sequence
ttttgtatttttagtagaga

SEQ ID NO: 620740 - DNA, 20 bp, Artificial
  CRISPR gRNA sequence
cacctcggcctcccaaagta

SEQ ID NO: 620741 - DNA, 20 bp, Artificial
  CRISPR gRNA sequence
tgaactgcacatgccagaga

SEQ ID NO: 620742 - DNA, 20 bp, Artificial
  CRISPR gRNA sequence
gactatctagttgcaggaaa

SEQ ID NO: 620743 - DNA, 20 bp, Artificial
  CRISPR gRNA sequence
ggaaaacaagcttaggactc

SEQ ID NO: 620744 - DNA, 20 bp, Artificial
  CRISPR gRNA sequence
caaaaaggttggggatagaa

SEQ ID NO: 620745 - DNA, 20 bp, Artificial
  CRISPR gRNA sequence
ttatttggagtaagtcaggc

SEQ ID NO: 620746 - DNA, 20 bp, Artificial
  CRISPR gRNA sequence
tatgatgtggaattcaacca

SEQ ID NO: 620747 - DNA, 20 bp, Artificial
  CRISPR gRNA sequence
cacagagcatattagtcagc

SEQ ID NO: 620748 - DNA, 20 bp, Artificial
  CRISPR gRNA sequence
agtcagcctcagtttccctg

SEQ ID NO: 620749 - DNA, 20 bp, Artificial
  CRISPR gRNA sequence
cagtttccctggaatgcttc

SEQ ID NO: 620750 - DNA, 20 bp, Artificial
  CRISPR gRNA sequence
ttgagataataactttccag

SEQ ID NO: 620751 - DNA, 20 bp, Artificial
  CRISPR gRNA sequence
atagttctgttcctcactac

SEQ ID NO: 620752 - DNA, 20 bp, Artificial
  CRISPR gRNA sequence
tacaaaagattctcctaaac

SEQ ID NO: 620753 - DNA, 20 bp, Artificial
  CRISPR gRNA sequence
tcttatggtcagtgttagaa

SEQ ID NO: 620754 - DNA, 20 bp, Artificial
  CRISPR gRNA sequence
tgcttagtaatcatttttat

SEQ ID NO: 620755 - DNA, 20 bp, Artificial
  CRISPR gRNA sequence
agaagtaacaaggtctacaa

SEQ ID NO: 620756 - DNA, 20 bp, Artificial
  CRISPR gRNA sequence
gtcctcatttgtcctcattt

SEQ ID NO: 620757 - DNA, 20 bp, Artificial
  CRISPR gRNA sequence
ttgtcctcattttctagctt

SEQ ID NO: 620758 - DNA, 20 bp, Artificial
  CRISPR gRNA sequence
ctagctttcatgattcaagg

SEQ ID NO: 620759 - DNA, 20 bp, Artificial
  CRISPR gRNA sequence
tgattcaaggtccagtttca

SEQ ID NO: 620760 - DNA, 20 bp, Artificial
  CRISPR gRNA sequence
ttaaatatttttcaaattat

SEQ ID NO: 620761 - DNA, 20 bp, Artificial
  CRISPR gRNA sequence
tattgacatcttagggtata

SEQ ID NO: 620762 - DNA, 20 bp, Artificial
  CRISPR gRNA sequence
aaatatattaatgtatttca

SEQ ID NO: 620763 - DNA, 20 bp, Artificial
  CRISPR gRNA sequence
ttcaatatgattcatttaaa

SEQ ID NO: 620764 - DNA, 20 bp, Artificial
  CRISPR gRNA sequence
tatgattcatttaaacatgg

SEQ ID NO: 620765 - DNA, 20 bp, Artificial
  CRISPR gRNA sequence
cttattccagaaactatttt

SEQ ID NO: 620766 - DNA, 20 bp, Artificial
  CRISPR gRNA sequence
atttataaatgcagtaaaat

SEQ ID NO: 620767 - DNA, 20 bp, Artificial
  CRISPR gRNA sequence
aactcatgagagttggcagt

SEQ ID NO: 620768 - DNA, 20 bp, Artificial
  CRISPR gRNA sequence
catcctgctgtataacctct

SEQ ID NO: 620769 - DNA, 20 bp, Artificial
  CRISPR gRNA sequence
acagaagagcaggtctcctt

SEQ ID NO: 620770 - DNA, 20 bp, Artificial
  CRISPR gRNA sequence
agttcttaaacttgagaagg

SEQ ID NO: 620771 - DNA, 20 bp, Artificial
  CRISPR gRNA sequence
caccaaattaaagaaaacaa

SEQ ID NO: 620772 - DNA, 20 bp, Artificial
  CRISPR gRNA sequence
aagaatccctggaatgctgt

SEQ ID NO: 620773 - DNA, 20 bp, Artificial
  CRISPR gRNA sequence
agtactaaataccaacaaaa

SEQ ID NO: 620774 - DNA, 20 bp, Artificial
  CRISPR gRNA sequence
aaaataatatatgatatgat

SEQ ID NO: 620775 - DNA, 20 bp, Artificial
  CRISPR gRNA sequence
tattaaggtagttcaggtga

SEQ ID NO: 620776 - DNA, 20 bp, Artificial
  CRISPR gRNA sequence
tgcatatccctaaagatgtc

SEQ ID NO: 620777 - DNA, 20 bp, Artificial
  CRISPR gRNA sequence
ctaaagatgtccagagattg

SEQ ID NO: 620778 - DNA, 20 bp, Artificial
  CRISPR gRNA sequence
aaggaatggcacattcccta

SEQ ID NO: 620779 - DNA, 20 bp, Artificial
  CRISPR gRNA sequence
ctaacgttatactggctaag

SEQ ID NO: 620780 - DNA, 20 bp, Artificial
  CRISPR gRNA sequence
actattgccaaaaaacagac

SEQ ID NO: 620781 - DNA, 20 bp, Artificial
  CRISPR gRNA sequence
gtacacttaaagtggtaatc

SEQ ID NO: 620782 - DNA, 20 bp, Artificial
  CRISPR gRNA sequence
actcattatttctgtgggaa

SEQ ID NO: 620783 - DNA, 20 bp, Artificial
  CRISPR gRNA sequence
cgtacgcataaaattcaaaa

SEQ ID NO: 620784 - DNA, 20 bp, Artificial
  CRISPR gRNA sequence
caactcatttaaaaagaaaa

SEQ ID NO: 620785 - DNA, 20 bp, Artificial
  CRISPR gRNA sequence
agggtacatgtgcacaacat

SEQ ID NO: 620786 - DNA, 20 bp, Artificial
  CRISPR gRNA sequence
cacctatgagtgagaacatg

SEQ ID NO: 620787 - DNA, 20 bp, Artificial
  CRISPR gRNA sequence
atgagtgagaacatgcggtg

SEQ ID NO: 620788 - DNA, 20 bp, Artificial
  CRISPR gRNA sequence
gtttggttttctgtccttgc

SEQ ID NO: 620789 - DNA, 20 bp, Artificial
  CRISPR gRNA sequence
tgcgatagtttgctcataat

SEQ ID NO: 620790 - DNA, 20 bp, Artificial
  CRISPR gRNA sequence
gtttgctcataatgatggtt

SEQ ID NO: 620791 - DNA, 20 bp, Artificial
  CRISPR gRNA sequence
gtgcatgtgtctttatagca

SEQ ID NO: 620792 - DNA, 20 bp, Artificial
  CRISPR gRNA sequence
ctgtcttccacaatggttga

SEQ ID NO: 620793 - DNA, 20 bp, Artificial
  CRISPR gRNA sequence
tccacatcctctccagcacc

SEQ ID NO: 620794 - DNA, 20 bp, Artificial
  CRISPR gRNA sequence
ggtgtgagatggtatctcat

SEQ ID NO: 620795 - DNA, 20 bp, Artificial
  CRISPR gRNA sequence
gagatggtatctcattgtgg

SEQ ID NO: 620796 - DNA, 20 bp, Artificial
  CRISPR gRNA sequence
ctttgcccactttttgatgg

SEQ ID NO: 620797 - DNA, 20 bp, Artificial
  CRISPR gRNA sequence
gcccactttttgatggggtt

SEQ ID NO: 620798 - DNA, 20 bp, Artificial
  CRISPR gRNA sequence
gtttgatttttttcttgtaa

SEQ ID NO: 620799 - DNA, 20 bp, Artificial
  CRISPR gRNA sequence
gtaaatttgtttaagttctt

SEQ ID NO: 620800 - DNA, 20 bp, Artificial
  CRISPR gRNA sequence
ttccaaagctgatatttaaa

SEQ ID NO: 620801 - DNA, 20 bp, Artificial
  CRISPR gRNA sequence
cagggggatcatttgaagtc

SEQ ID NO: 620802 - DNA, 20 bp, Artificial
  CRISPR gRNA sequence
ttgggaatctgaggcaggag

SEQ ID NO: 620803 - DNA, 20 bp, Artificial
  CRISPR gRNA sequence
aaggcggaggttgcagtgag

SEQ ID NO: 620804 - DNA, 20 bp, Artificial
  CRISPR gRNA sequence
attacttgtcaagaattaca

SEQ ID NO: 620805 - DNA, 20 bp, Artificial
  CRISPR gRNA sequence
taagtcttaaaaaactgttg

SEQ ID NO: 620806 - DNA, 20 bp, Artificial
  CRISPR gRNA sequence
cgaatcctttggctaagaca

SEQ ID NO: 620807 - DNA, 20 bp, Artificial
  CRISPR gRNA sequence
gacattttgattaagactca

SEQ ID NO: 620808 - DNA, 20 bp, Artificial
  CRISPR gRNA sequence
tgattaagactcatcttgat

SEQ ID NO: 620809 - DNA, 20 bp, Artificial
  CRISPR gRNA sequence
tgagattctaggaatgactc

SEQ ID NO: 620810 - DNA, 20 bp, Artificial
  CRISPR gRNA sequence
agacctctttttccctcaca

SEQ ID NO: 620811 - DNA, 20 bp, Artificial
  CRISPR gRNA sequence
gcaggcctcctcacagggca

SEQ ID NO: 620812 - DNA, 20 bp, Artificial
  CRISPR gRNA sequence
caaagtgtcacaattcccaa

SEQ ID NO: 620813 - DNA, 20 bp, Artificial
  CRISPR gRNA sequence
atgattctaactagaaaatc

SEQ ID NO: 620814 - DNA, 20 bp, Artificial
  CRISPR gRNA sequence
cctccactctccaggcccaa

SEQ ID NO: 620815 - DNA, 20 bp, Artificial
  CRISPR gRNA sequence
ttcttcattggactccttgc

SEQ ID NO: 620816 - DNA, 20 bp, Artificial
  CRISPR gRNA sequence
tggactccttgcctgagatt

SEQ ID NO: 620817 - DNA, 20 bp, Artificial
  CRISPR gRNA sequence
actgaaatgaaattctggaa

SEQ ID NO: 620818 - DNA, 20 bp, Artificial
  CRISPR gRNA sequence
cctgatactctgggcactag

SEQ ID NO: 620819 - DNA, 20 bp, Artificial
  CRISPR gRNA sequence
agaagcatccttgactcaag

SEQ ID NO: 620820 - DNA, 20 bp, Artificial
  CRISPR gRNA sequence
gtgttagtgacagctgagag

SEQ ID NO: 620821 - DNA, 20 bp, Artificial
  CRISPR gRNA sequence
ctggacatatgtgaggtgac

SEQ ID NO: 620822 - DNA, 20 bp, Artificial
  CRISPR gRNA sequence
ttggcattcacatttctatt

SEQ ID NO: 620823 - DNA, 20 bp, Artificial
  CRISPR gRNA sequence
agaagacaattatacaataa

SEQ ID NO: 620824 - DNA, 20 bp, Artificial
  CRISPR gRNA sequence
aaaacaagccaatttaaaaa

SEQ ID NO: 620825 - DNA, 20 bp, Artificial
  CRISPR gRNA sequence
ctggtgtccttacaaaaagg

SEQ ID NO: 620826 - DNA, 20 bp, Artificial
  CRISPR gRNA sequence
cagccaggggagagggacat

SEQ ID NO: 620827 - DNA, 20 bp, Artificial
  CRISPR gRNA sequence
cagccctcacatgaaaccaa

SEQ ID NO: 620828 - DNA, 20 bp, Artificial
  CRISPR gRNA sequence
actgtgaggcaataaacttc

SEQ ID NO: 620829 - DNA, 20 bp, Artificial
  CRISPR gRNA sequence
gaaccagaaaggagatgcag

SEQ ID NO: 620830 - DNA, 20 bp, Artificial
  CRISPR gRNA sequence
ggaccagagacgggctaatt

SEQ ID NO: 620831 - DNA, 20 bp, Artificial
  CRISPR gRNA sequence
attttgtcaatctaagataa

SEQ ID NO: 620832 - DNA, 20 bp, Artificial
  CRISPR gRNA sequence
accaattaaaattggaaggt

SEQ ID NO: 620833 - DNA, 20 bp, Artificial
  CRISPR gRNA sequence
gttgatggaattattaaact

SEQ ID NO: 620834 - DNA, 20 bp, Artificial
  CRISPR gRNA sequence
gaacaaccacacccaaacag

SEQ ID NO: 620835 - DNA, 20 bp, Artificial
  CRISPR gRNA sequence
tgtgccatagggctattttc

SEQ ID NO: 620836 - DNA, 20 bp, Artificial
  CRISPR gRNA sequence
attgaaaagaaacttgcaag

SEQ ID NO: 620837 - DNA, 20 bp, Artificial
  CRISPR gRNA sequence
atacctgatcccctcaatgg

SEQ ID NO: 620838 - DNA, 20 bp, Artificial
  CRISPR gRNA sequence
tgatcccctcaatggctgag

SEQ ID NO: 620839 - DNA, 20 bp, Artificial
  CRISPR gRNA sequence
aaggtagatatgagatcaag

SEQ ID NO: 620840 - DNA, 20 bp, Artificial
  CRISPR gRNA sequence
tatgaaagatgtgggatcaa

SEQ ID NO: 620841 - DNA, 20 bp, Artificial
  CRISPR gRNA sequence
tgctggtcctctccatggcc

SEQ ID NO: 620842 - DNA, 20 bp, Artificial
  CRISPR gRNA sequence
taatttatttacttattatt

SEQ ID NO: 620843 - DNA, 20 bp, Artificial
  CRISPR gRNA sequence
ctcactgcagcatcgacttc

SEQ ID NO: 620844 - DNA, 20 bp, Artificial
  CRISPR gRNA sequence
gatctccctatgttgcccag

SEQ ID NO: 620845 - DNA, 20 bp, Artificial
  CRISPR gRNA sequence
tgccttggcctcccaaaatg

SEQ ID NO: 620846 - DNA, 20 bp, Artificial
  CRISPR gRNA sequence
tgttcgagccacagtgatga

SEQ ID NO: 620847 - DNA, 20 bp, Artificial
  CRISPR gRNA sequence
cagtcaagggtgctctactt

SEQ ID NO: 620848 - DNA, 20 bp, Artificial
  CRISPR gRNA sequence
catcagccccatgagttcaa

SEQ ID NO: 620849 - DNA, 20 bp, Artificial
  CRISPR gRNA sequence
ctcattgccctttccagaga

SEQ ID NO: 620850 - DNA, 20 bp, Artificial
  CRISPR gRNA sequence
aactgatctcctccccagga

SEQ ID NO: 620851 - DNA, 20 bp, Artificial
  CRISPR gRNA sequence
gacttctattaatgaagtca

SEQ ID NO: 620852 - DNA, 20 bp, Artificial
  CRISPR gRNA sequence
gaaagttttctgctctatga

SEQ ID NO: 620853 - DNA, 20 bp, Artificial
  CRISPR gRNA sequence
taatacagaagataagcact

SEQ ID NO: 620854 - DNA, 20 bp, Artificial
  CRISPR gRNA sequence
gtgttcaacactatttcaat

SEQ ID NO: 620855 - DNA, 20 bp, Artificial
  CRISPR gRNA sequence
acactatttcaatagttgtt

SEQ ID NO: 620856 - DNA, 20 bp, Artificial
  CRISPR gRNA sequence
cccccactccttacctcctc

SEQ ID NO: 620857 - DNA, 20 bp, Artificial
  CRISPR gRNA sequence
aaattattacatacttatat

SEQ ID NO: 620858 - DNA, 20 bp, Artificial
  CRISPR gRNA sequence
ctctataaggatagagcctt

SEQ ID NO: 620859 - DNA, 20 bp, Artificial
  CRISPR gRNA sequence
gttttgttcactgctgtaga

SEQ ID NO: 620860 - DNA, 20 bp, Artificial
  CRISPR gRNA sequence
aaatacccaataacagaacc

SEQ ID NO: 620861 - DNA, 20 bp, Artificial
  CRISPR gRNA sequence
agaaatcttcattgtacatc

SEQ ID NO: 620862 - DNA, 20 bp, Artificial
  CRISPR gRNA sequence
gtacatcgcatgctttgcac

SEQ ID NO: 620863 - DNA, 20 bp, Artificial
  CRISPR gRNA sequence
ttataagacataagctgcta

SEQ ID NO: 620864 - DNA, 20 bp, Artificial
  CRISPR gRNA sequence
ttcttatttgggaagttagt

SEQ ID NO: 620865 - DNA, 20 bp, Artificial
  CRISPR gRNA sequence
atcgagatataacttagagg

SEQ ID NO: 620866 - DNA, 20 bp, Artificial
  CRISPR gRNA sequence
agatataacttagaggaaat

SEQ ID NO: 620867 - DNA, 20 bp, Artificial
  CRISPR gRNA sequence
ctgagttcatctgagaaagg

SEQ ID NO: 620868 - DNA, 20 bp, Artificial
  CRISPR gRNA sequence
catggtaaagtgagttgata

SEQ ID NO: 620869 - DNA, 20 bp, Artificial
  CRISPR gRNA sequence
ttaggggagtgataaaatta

SEQ ID NO: 620870 - DNA, 20 bp, Artificial
  CRISPR gRNA sequence
ctaatctaccataacagcta

SEQ ID NO: 620871 - DNA, 20 bp, Artificial
  CRISPR gRNA sequence
gagagctggcaagagactac

SEQ ID NO: 620872 - DNA, 20 bp, Artificial
  CRISPR gRNA sequence
gaagccaagaatattaagta

SEQ ID NO: 620873 - DNA, 20 bp, Artificial
  CRISPR gRNA sequence
gaatattaagtaatctgatt

SEQ ID NO: 620874 - DNA, 20 bp, Artificial
  CRISPR gRNA sequence
tgaagtggtatatgagaatt

SEQ ID NO: 620875 - DNA, 20 bp, Artificial
  CRISPR gRNA sequence
cctgaataaatgtgcatata

SEQ ID NO: 620876 - DNA, 20 bp, Artificial
  CRISPR gRNA sequence
aataaatcatttttaaatat

SEQ ID NO: 620877 - DNA, 20 bp, Artificial
  CRISPR gRNA sequence
gtaaagtcaaatgtcttaga

SEQ ID NO: 620878 - DNA, 20 bp, Artificial
  CRISPR gRNA sequence
gatttgaataatcttcaatg

SEQ ID NO: 620879 - DNA, 20 bp, Artificial
  CRISPR gRNA sequence
caatgaagagctttaaaaaa

SEQ ID NO: 620880 - DNA, 20 bp, Artificial
  CRISPR gRNA sequence
agatttatctagacactgaa

SEQ ID NO: 620881 - DNA, 20 bp, Artificial
  CRISPR gRNA sequence
caggtataccataaacattt

SEQ ID NO: 620882 - DNA, 20 bp, Artificial
  CRISPR gRNA sequence
taaacattttaaagattaaa

SEQ ID NO: 620883 - DNA, 20 bp, Artificial
  CRISPR gRNA sequence
tgtctttcaaattttttaaa

SEQ ID NO: 620884 - DNA, 20 bp, Artificial
  CRISPR gRNA sequence
ttttttaaatctagttttac

SEQ ID NO: 620885 - DNA, 20 bp, Artificial
  CRISPR gRNA sequence
atttgtagctcatctaagga

SEQ ID NO: 620886 - DNA, 20 bp, Artificial
  CRISPR gRNA sequence
acagtaaccactaaatatta

SEQ ID NO: 620887 - DNA, 20 bp, Artificial
  CRISPR gRNA sequence
ctgctaactataggtaaaaa

SEQ ID NO: 620888 - DNA, 20 bp, Artificial
  CRISPR gRNA sequence
aactttgttttctattcttt

SEQ ID NO: 620889 - DNA, 20 bp, Artificial
  CRISPR gRNA sequence
cccctatttttaacatttta

SEQ ID NO: 620890 - DNA, 20 bp, Artificial
  CRISPR gRNA sequence
atgtttcttttcaaaaaaat

SEQ ID NO: 620891 - DNA, 20 bp, Artificial
  CRISPR gRNA sequence
atttttaagactatatatac

SEQ ID NO: 620892 - DNA, 20 bp, Artificial
  CRISPR gRNA sequence
tacttcagcttatggaataa

SEQ ID NO: 620893 - DNA, 20 bp, Artificial
  CRISPR gRNA sequence
taaatctgtctgcatttcta

SEQ ID NO: 620894 - DNA, 20 bp, Artificial
  CRISPR gRNA sequence
tattgatgttaaacaatctc

SEQ ID NO: 620895 - DNA, 20 bp, Artificial
  CRISPR gRNA sequence
attttaaagtgtatttattt

SEQ ID NO: 620896 - DNA, 20 bp, Artificial
  CRISPR gRNA sequence
gtcgcgttaattattaattc

SEQ ID NO: 620897 - DNA, 20 bp, Artificial
  CRISPR gRNA sequence
ttattaattcctgagattac

SEQ ID NO: 620898 - DNA, 20 bp, Artificial
  CRISPR gRNA sequence
taaaatcaaggctaatggca

SEQ ID NO: 620899 - DNA, 20 bp, Artificial
  CRISPR gRNA sequence
gcagtttaatgagataatta

SEQ ID NO: 620900 - DNA, 20 bp, Artificial
  CRISPR gRNA sequence
ggaatcattctagttaacta

SEQ ID NO: 620901 - DNA, 20 bp, Artificial
  CRISPR gRNA sequence
atatgcaatagttggaaata

SEQ ID NO: 620902 - DNA, 20 bp, Artificial
  CRISPR gRNA sequence
aattgatataaaatatttca

SEQ ID NO: 620903 - DNA, 20 bp, Artificial
  CRISPR gRNA sequence
tttaaaatcctaacattcac

SEQ ID NO: 620904 - DNA, 20 bp, Artificial
  CRISPR gRNA sequence
ttttaagatcagtcataccc

SEQ ID NO: 620905 - DNA, 20 bp, Artificial
  CRISPR gRNA sequence
ttaattaataactctttaag

SEQ ID NO: 620906 - DNA, 20 bp, Artificial
  CRISPR gRNA sequence
aattgtgactcctatattac

SEQ ID NO: 620907 - DNA, 20 bp, Artificial
  CRISPR gRNA sequence
aaaagaccctataaattaga

SEQ ID NO: 620908 - DNA, 20 bp, Artificial
  CRISPR gRNA sequence
agagaaagctttttttacaa

SEQ ID NO: 620909 - DNA, 20 bp, Artificial
  CRISPR gRNA sequence
agtattttttaaacatatcc

SEQ ID NO: 620910 - DNA, 20 bp, Artificial
  CRISPR gRNA sequence
tcgcaaaatgagactagaat

SEQ ID NO: 620911 - DNA, 20 bp, Artificial
  CRISPR gRNA sequence
aatctcctcctggaatcaaa

SEQ ID NO: 620912 - DNA, 20 bp, Artificial
  CRISPR gRNA sequence
aatttcaaaagtaacatttt

SEQ ID NO: 620913 - DNA, 20 bp, Artificial
  CRISPR gRNA sequence
accgccttaggtgatgggca

SEQ ID NO: 620914 - DNA, 20 bp, Artificial
  CRISPR gRNA sequence
ctcactctgtcccggttaaa

SEQ ID NO: 620915 - DNA, 20 bp, Artificial
  CRISPR gRNA sequence
ccggttaaaacctgtttgtc

SEQ ID NO: 620916 - DNA, 20 bp, Artificial
  CRISPR gRNA sequence
attggctcagctgctccagt

SEQ ID NO: 620917 - DNA, 20 bp, Artificial
  CRISPR gRNA sequence
aaaatccaacacatgcaggc

SEQ ID NO: 620918 - DNA, 20 bp, Artificial
  CRISPR gRNA sequence
cctcttctaatcttgccctt

SEQ ID NO: 620919 - DNA, 20 bp, Artificial
  CRISPR gRNA sequence
aattcaattaaatattagct

SEQ ID NO: 620920 - DNA, 20 bp, Artificial
  CRISPR gRNA sequence
gaagggaagcatctagtaaa

SEQ ID NO: 620921 - DNA, 20 bp, Artificial
  CRISPR gRNA sequence
tcatatactgatgaagatct

SEQ ID NO: 620922 - DNA, 20 bp, Artificial
  CRISPR gRNA sequence
ttcttttataaagataactg

SEQ ID NO: 620923 - DNA, 20 bp, Artificial
  CRISPR gRNA sequence
gtaagatgccaatattatat

SEQ ID NO: 620924 - DNA, 20 bp, Artificial
  CRISPR gRNA sequence
ccatttaaaaatcacatctc

SEQ ID NO: 620925 - DNA, 20 bp, Artificial
  CRISPR gRNA sequence
tctcatctgctttttttgaa

SEQ ID NO: 620926 - DNA, 20 bp, Artificial
  CRISPR gRNA sequence
tccctataccaactcagcac

SEQ ID NO: 620927 - DNA, 20 bp, Artificial
  CRISPR gRNA sequence
caactcagcactgaagattt

SEQ ID NO: 620928 - DNA, 20 bp, Artificial
  CRISPR gRNA sequence
agcactgaagatttgcatgc

SEQ ID NO: 620929 - DNA, 20 bp, Artificial
  CRISPR gRNA sequence
tcctcatatacagcatggta

SEQ ID NO: 620930 - DNA, 20 bp, Artificial
  CRISPR gRNA sequence
taatcatattatgaacaaaa

SEQ ID NO: 620931 - DNA, 20 bp, Artificial
  CRISPR gRNA sequence
gaacaaaagcatgttttaat

SEQ ID NO: 620932 - DNA, 20 bp, Artificial
  CRISPR gRNA sequence
gtaataaggaacctatcccg

SEQ ID NO: 620933 - DNA, 20 bp, Artificial
  CRISPR gRNA sequence
acctatcccgttgtgctttt

SEQ ID NO: 620934 - DNA, 20 bp, Artificial
  CRISPR gRNA sequence
aggtatatgagtaaaggctc

SEQ ID NO: 620935 - DNA, 20 bp, Artificial
  CRISPR gRNA sequence
atgagtaaaggctctactgc

SEQ ID NO: 620936 - DNA, 20 bp, Artificial
  CRISPR gRNA sequence
tgctttagattcattaaaga

SEQ ID NO: 620937 - DNA, 20 bp, Artificial
  CRISPR gRNA sequence
gaattggctttcattttcat

SEQ ID NO: 620938 - DNA, 20 bp, Artificial
  CRISPR gRNA sequence
cacataagttactaatataa

SEQ ID NO: 620939 - DNA, 20 bp, Artificial
  CRISPR gRNA sequence
ctaatataagtgggtttttg

SEQ ID NO: 620940 - DNA, 20 bp, Artificial
  CRISPR gRNA sequence
tccttctgtgggaaggacca

SEQ ID NO: 620941 - DNA, 20 bp, Artificial
  CRISPR gRNA sequence
ttactctatcaaactttggt

SEQ ID NO: 620942 - DNA, 20 bp, Artificial
  CRISPR gRNA sequence
tttcaaggcagactggtaac

SEQ ID NO: 620943 - DNA, 20 bp, Artificial
  CRISPR gRNA sequence
gtaggactactataaagaat

SEQ ID NO: 620944 - DNA, 20 bp, Artificial
  CRISPR gRNA sequence
aaactaaaaatccttattaa

SEQ ID NO: 620945 - DNA, 20 bp, Artificial
  CRISPR gRNA sequence
caaccaataagagtaacctt

SEQ ID NO: 620946 - DNA, 20 bp, Artificial
  CRISPR gRNA sequence
acaaactcaataatatatta

SEQ ID NO: 620947 - DNA, 20 bp, Artificial
  CRISPR gRNA sequence
ctcaataatatattaaaatg

SEQ ID NO: 620948 - DNA, 20 bp, Artificial
  CRISPR gRNA sequence
atatattaaaatgtttagct

SEQ ID NO: 620949 - DNA, 20 bp, Artificial
  CRISPR gRNA sequence
acagataatactttctaggt

SEQ ID NO: 620950 - DNA, 20 bp, Artificial
  CRISPR gRNA sequence
tttctaggtatttgcttttc

SEQ ID NO: 620951 - DNA, 20 bp, Artificial
  CRISPR gRNA sequence
gtatttgcttttctagtgct

SEQ ID NO: 620952 - DNA, 20 bp, Artificial
  CRISPR gRNA sequence
agtgctttatgatttcaacg

SEQ ID NO: 620953 - DNA, 20 bp, Artificial
  CRISPR gRNA sequence
tgatttcaacgtaatgtttt

SEQ ID NO: 620954 - DNA, 20 bp, Artificial
  CRISPR gRNA sequence
ttatgtctataatgttaaaa

SEQ ID NO: 620955 - DNA, 20 bp, Artificial
  CRISPR gRNA sequence
aattacttcatatctttcaa

SEQ ID NO: 620956 - DNA, 20 bp, Artificial
  CRISPR gRNA sequence
aaaaatctcagaaaccataa

SEQ ID NO: 620957 - DNA, 20 bp, Artificial
  CRISPR gRNA sequence
aacactagaataggtagtga

SEQ ID NO: 620958 - DNA, 20 bp, Artificial
  CRISPR gRNA sequence
tatacaaatttccttcacat

SEQ ID NO: 620959 - DNA, 20 bp, Artificial
  CRISPR gRNA sequence
tacctactattaagataatt

SEQ ID NO: 620960 - DNA, 20 bp, Artificial
  CRISPR gRNA sequence
ttttaaaaagcaattattaa

SEQ ID NO: 620961 - DNA, 20 bp, Artificial
  CRISPR gRNA sequence
ccatcatacatgaaatatag

SEQ ID NO: 620962 - DNA, 20 bp, Artificial
  CRISPR gRNA sequence
gaaatatagtacagcttgtt

SEQ ID NO: 620963 - DNA, 20 bp, Artificial
  CRISPR gRNA sequence
ctgctacatggatctttttt

SEQ ID NO: 620964 - DNA, 20 bp, Artificial
  CRISPR gRNA sequence
aatacatatttttaaagaag

SEQ ID NO: 620965 - DNA, 20 bp, Artificial
  CRISPR gRNA sequence
ttttaaagaagtggtgattt

SEQ ID NO: 620966 - DNA, 20 bp, Artificial
  CRISPR gRNA sequence
ctgttggcagttgtcagggt

SEQ ID NO: 620967 - DNA, 20 bp, Artificial
  CRISPR gRNA sequence
ttcaccaagacaagttggga

SEQ ID NO: 620968 - DNA, 20 bp, Artificial
  CRISPR gRNA sequence
aggttgtttttacacctgtt

SEQ ID NO: 620969 - DNA, 20 bp, Artificial
  CRISPR gRNA sequence
attgaatttatagaataata

SEQ ID NO: 620970 - DNA, 20 bp, Artificial
  CRISPR gRNA sequence
cagaaaatttttttaaaaag

SEQ ID NO: 620971 - DNA, 20 bp, Artificial
  CRISPR gRNA sequence
catgttctaaataccgtaga

SEQ ID NO: 620972 - DNA, 20 bp, Artificial
  CRISPR gRNA sequence
acacatatcacaactaatgg

SEQ ID NO: 620973 - DNA, 20 bp, Artificial
  CRISPR gRNA sequence
tatcacaactaatggcaatg

SEQ ID NO: 620974 - DNA, 20 bp, Artificial
  CRISPR gRNA sequence
gaaccattgcagactgtctt

SEQ ID NO: 620975 - DNA, 20 bp, Artificial
  CRISPR gRNA sequence
ctgtcttcaaagcttggaca

SEQ ID NO: 620976 - DNA, 20 bp, Artificial
  CRISPR gRNA sequence
aatacttatcaaagataatc

SEQ ID NO: 620977 - DNA, 20 bp, Artificial
  CRISPR gRNA sequence
tcaacagactgaacgaaaag

SEQ ID NO: 620978 - DNA, 20 bp, Artificial
  CRISPR gRNA sequence
aacgaaaagaaaggcttaat

SEQ ID NO: 620979 - DNA, 20 bp, Artificial
  CRISPR gRNA sequence
tgacatcactgatcgtcaat

SEQ ID NO: 620980 - DNA, 20 bp, Artificial
  CRISPR gRNA sequence
atcactgatcgtcaataaat

SEQ ID NO: 620981 - DNA, 20 bp, Artificial
  CRISPR gRNA sequence
aatatagcaaaatatttgaa

SEQ ID NO: 620982 - DNA, 20 bp, Artificial
  CRISPR gRNA sequence
ttagttacaaatatagtgat

SEQ ID NO: 620983 - DNA, 20 bp, Artificial
  CRISPR gRNA sequence
attacataaatgatcaatta

SEQ ID NO: 620984 - DNA, 20 bp, Artificial
  CRISPR gRNA sequence
tatatatttcctggataaaa

SEQ ID NO: 620985 - DNA, 20 bp, Artificial
  CRISPR gRNA sequence
atttcctggataaaactgtg

SEQ ID NO: 620986 - DNA, 20 bp, Artificial
  CRISPR gRNA sequence
ttaatgctcacaagacacac

SEQ ID NO: 620987 - DNA, 20 bp, Artificial
  CRISPR gRNA sequence
gctcacaagacacacctcgg

SEQ ID NO: 620988 - DNA, 20 bp, Artificial
  CRISPR gRNA sequence
gtcttctgaggttaccgcac

SEQ ID NO: 620989 - DNA, 20 bp, Artificial
  CRISPR gRNA sequence
ggttaccgcacaagtgtttt

SEQ ID NO: 620990 - DNA, 20 bp, Artificial
  CRISPR gRNA sequence
ccgcacaagtgttttaaaag

SEQ ID NO: 620991 - DNA, 20 bp, Artificial
  CRISPR gRNA sequence
ttttaaaagttttgttttgc

SEQ ID NO: 620992 - DNA, 20 bp, Artificial
  CRISPR gRNA sequence
gttttgttttgctgtggttt

SEQ ID NO: 620993 - DNA, 20 bp, Artificial
  CRISPR gRNA sequence
ttagtgtgtaatctctctac

SEQ ID NO: 620994 - DNA, 20 bp, Artificial
  CRISPR gRNA sequence
attttactgagtgaagaaaa

SEQ ID NO: 620995 - DNA, 20 bp, Artificial
  CRISPR gRNA sequence
ctttcacctcaaccttgcaa

SEQ ID NO: 620996 - DNA, 20 bp, Artificial
  CRISPR gRNA sequence
ggcacgcatagaagcaggga

SEQ ID NO: 620997 - DNA, 20 bp, Artificial
  CRISPR gRNA sequence
tgacaggaaccccaactaga

SEQ ID NO: 620998 - DNA, 20 bp, Artificial
  CRISPR gRNA sequence
gaaagacattcacatatatg

SEQ ID NO: 620999 - DNA, 20 bp, Artificial
  CRISPR gRNA sequence
agccaacaacaaaggtactc

SEQ ID NO: 621000 - DNA, 20 bp, Artificial
  CRISPR gRNA sequence
agaattttctcaaaggagct

SEQ ID NO: 621001 - DNA, 20 bp, Artificial
  CRISPR gRNA sequence
ggagctcattgctttccctc

SEQ ID NO: 621002 - DNA, 20 bp, Artificial
  CRISPR gRNA sequence
agtgtcaaaaagacttccct

SEQ ID NO: 621003 - DNA, 20 bp, Artificial
  CRISPR gRNA sequence
aagacttcccttaatgcttt

SEQ ID NO: 621004 - DNA, 20 bp, Artificial
  CRISPR gRNA sequence
ttattcccctgaccctccca

SEQ ID NO: 621005 - DNA, 20 bp, Artificial
  CRISPR gRNA sequence
gatccaatcctcttctccct

SEQ ID NO: 621006 - DNA, 20 bp, Artificial
  CRISPR gRNA sequence
attattagtgaaaatacacc

SEQ ID NO: 621007 - DNA, 20 bp, Artificial
  CRISPR gRNA sequence
aatgatgttctcattcctgg

SEQ ID NO: 621008 - DNA, 20 bp, Artificial
  CRISPR gRNA sequence
gacacactcaaacattccca

SEQ ID NO: 621009 - DNA, 20 bp, Artificial
  CRISPR gRNA sequence
cactcaaacattcccaaaaa

SEQ ID NO: 621010 - DNA, 20 bp, Artificial
  CRISPR gRNA sequence
cattcccaaaaagcttgatt

SEQ ID NO: 621011 - DNA, 20 bp, Artificial
  CRISPR gRNA sequence
tgcaaagatcctttttaaat

SEQ ID NO: 621012 - DNA, 20 bp, Artificial
  CRISPR gRNA sequence
cgactattgatagggtaaca

SEQ ID NO: 621013 - DNA, 20 bp, Artificial
  CRISPR gRNA sequence
gaaaatgctgtgctctagct

SEQ ID NO: 621014 - DNA, 20 bp, Artificial
  CRISPR gRNA sequence
aaacttttgttatttcgctg

SEQ ID NO: 621015 - DNA, 20 bp, Artificial
  CRISPR gRNA sequence
atttcgctgtaatgttttca

SEQ ID NO: 621016 - DNA, 20 bp, Artificial
  CRISPR gRNA sequence
taatgttttcaaaaagattt

SEQ ID NO: 621017 - DNA, 20 bp, Artificial
  CRISPR gRNA sequence
gatttaagagtttccaaaca

SEQ ID NO: 621018 - DNA, 20 bp, Artificial
  CRISPR gRNA sequence
acaacttgttttacactgac

SEQ ID NO: 621019 - DNA, 20 bp, Artificial
  CRISPR gRNA sequence
ttttacctagctcagataaa

SEQ ID NO: 621020 - DNA, 20 bp, Artificial
  CRISPR gRNA sequence
gggcaaaagataaatgtaca

SEQ ID NO: 621021 - DNA, 20 bp, Artificial
  CRISPR gRNA sequence
taaatgtacaatttgtttga

SEQ ID NO: 621022 - DNA, 20 bp, Artificial
  CRISPR gRNA sequence
taaaatatagtaacaaaatt

SEQ ID NO: 621023 - DNA, 20 bp, Artificial
  CRISPR gRNA sequence
tttatttaaattgtcagact

SEQ ID NO: 621024 - DNA, 20 bp, Artificial
  CRISPR gRNA sequence
aagacggcaccaatctattt

SEQ ID NO: 621025 - DNA, 20 bp, Artificial
  CRISPR gRNA sequence
tctgtttaagagatccttgc

SEQ ID NO: 621026 - DNA, 20 bp, Artificial
  CRISPR gRNA sequence
ttgggaggccgcggctggag

SEQ ID NO: 621027 - DNA, 20 bp, Artificial
  CRISPR gRNA sequence
ctggagaatcgcttgagccc

SEQ ID NO: 621028 - DNA, 20 bp, Artificial
  CRISPR gRNA sequence
agaaaagaaaagaagaaaaa

SEQ ID NO: 621029 - DNA, 20 bp, Artificial
  CRISPR gRNA sequence
agaaaaaaaatgttttttaa

SEQ ID NO: 621030 - DNA, 20 bp, Artificial
  CRISPR gRNA sequence
atttctgagactaaatatct

SEQ ID NO: 621031 - DNA, 20 bp, Artificial
  CRISPR gRNA sequence
aagtaatacatatatttaac

SEQ ID NO: 621032 - DNA, 20 bp, Artificial
  CRISPR gRNA sequence
aaacagcagatatatcatgc

SEQ ID NO: 621033 - DNA, 20 bp, Artificial
  CRISPR gRNA sequence
ggacacggtaaggagaatgt

SEQ ID NO: 621034 - DNA, 20 bp, Artificial
  CRISPR gRNA sequence
tcccttgcccatgagaactt

SEQ ID NO: 621035 - DNA, 20 bp, Artificial
  CRISPR gRNA sequence
agaattatatatttcttggg

SEQ ID NO: 621036 - DNA, 20 bp, Artificial
  CRISPR gRNA sequence
agatgatcactgtgaggtct

SEQ ID NO: 621037 - DNA, 20 bp, Artificial
  CRISPR gRNA sequence
aggtcttatagcttcacagt

SEQ ID NO: 621038 - DNA, 20 bp, Artificial
  CRISPR gRNA sequence
ctaattgtagaattgtctct

SEQ ID NO: 621039 - DNA, 20 bp, Artificial
  CRISPR gRNA sequence
gtttttctcactgtggaaaa

SEQ ID NO: 621040 - DNA, 20 bp, Artificial
  CRISPR gRNA sequence
gtgtaactaccttcatgtat

SEQ ID NO: 621041 - DNA, 20 bp, Artificial
  CRISPR gRNA sequence
agataatttatctcaggaat

SEQ ID NO: 621042 - DNA, 20 bp, Artificial
  CRISPR gRNA sequence
gaattcgaaatcaaaagacc

SEQ ID NO: 621043 - DNA, 20 bp, Artificial
  CRISPR gRNA sequence
cctgtgttctaactgtgtag

SEQ ID NO: 621044 - DNA, 20 bp, Artificial
  CRISPR gRNA sequence
ggtatgctacatctcgaaag

SEQ ID NO: 621045 - DNA, 20 bp, Artificial
  CRISPR gRNA sequence
tcaatgtaaacttgggaaaa

SEQ ID NO: 621046 - DNA, 20 bp, Artificial
  CRISPR gRNA sequence
ccacaaggcattatcctttt

SEQ ID NO: 621047 - DNA, 20 bp, Artificial
  CRISPR gRNA sequence
attatccttttcagtgttta

SEQ ID NO: 621048 - DNA, 20 bp, Artificial
  CRISPR gRNA sequence
ccgaaatattcaaaatgggt

SEQ ID NO: 621049 - DNA, 20 bp, Artificial
  CRISPR gRNA sequence
agaattatccattggaaagt

SEQ ID NO: 621050 - DNA, 20 bp, Artificial
  CRISPR gRNA sequence
ggtgatttttattgaggaaa

SEQ ID NO: 621051 - DNA, 20 bp, Artificial
  CRISPR gRNA sequence
attttacataatataaaata

SEQ ID NO: 621052 - DNA, 20 bp, Artificial
  CRISPR gRNA sequence
atataaaatattatgcttac

SEQ ID NO: 621053 - DNA, 20 bp, Artificial
  CRISPR gRNA sequence
aatgaactgtggtcataata

SEQ ID NO: 621054 - DNA, 20 bp, Artificial
  CRISPR gRNA sequence
gtgcatgaaaagacagaggg

SEQ ID NO: 621055 - DNA, 20 bp, Artificial
  CRISPR gRNA sequence
aaacccttctcactgtgccc

SEQ ID NO: 621056 - DNA, 20 bp, Artificial
  CRISPR gRNA sequence
tcaataggaaaacggtccaa

SEQ ID NO: 621057 - DNA, 20 bp, Artificial
  CRISPR gRNA sequence
aattccactaacaaagttga

SEQ ID NO: 621058 - DNA, 20 bp, Artificial
  CRISPR gRNA sequence
acaaagttgatatagcttta

SEQ ID NO: 621059 - DNA, 20 bp, Artificial
  CRISPR gRNA sequence
cataaaaaagcaatacaaca

SEQ ID NO: 621060 - DNA, 20 bp, Artificial
  CRISPR gRNA sequence
tttgctaatataaaagtaat

SEQ ID NO: 621061 - DNA, 20 bp, Artificial
  CRISPR gRNA sequence
tatacatctatttatatatg

SEQ ID NO: 621062 - DNA, 20 bp, Artificial
  CRISPR gRNA sequence
ccataatcattcttaaagca

SEQ ID NO: 621063 - DNA, 20 bp, Artificial
  CRISPR gRNA sequence
tttgaggagacttattttag

SEQ ID NO: 621064 - DNA, 20 bp, Artificial
  CRISPR gRNA sequence
aacacaaccacaggaataat

SEQ ID NO: 621065 - DNA, 20 bp, Artificial
  CRISPR gRNA sequence
tattagtatcactttttttt

SEQ ID NO: 621066 - DNA, 20 bp, Artificial
  CRISPR gRNA sequence
aattctaaaatgaacactgg

SEQ ID NO: 621067 - DNA, 20 bp, Artificial
  CRISPR gRNA sequence
ggtcttgatttttgtacaac

SEQ ID NO: 621068 - DNA, 20 bp, Artificial
  CRISPR gRNA sequence
taattacactgttcaatatt

SEQ ID NO: 621069 - DNA, 20 bp, Artificial
  CRISPR gRNA sequence
gggtgttggggaagcaaatt

SEQ ID NO: 621070 - DNA, 20 bp, Artificial
  CRISPR gRNA sequence
gaagcaaattaatggattac

SEQ ID NO: 621071 - DNA, 20 bp, Artificial
  CRISPR gRNA sequence
tcaaaaaaactaatatttac

SEQ ID NO: 621072 - DNA, 20 bp, Artificial
  CRISPR gRNA sequence
tgtggtttagttgttattat

SEQ ID NO: 621073 - DNA, 20 bp, Artificial
  CRISPR gRNA sequence
tattattagtgtttttttcc

SEQ ID NO: 621074 - DNA, 20 bp, Artificial
  CRISPR gRNA sequence
aattaattatttcattacct

SEQ ID NO: 621075 - DNA, 20 bp, Artificial
  CRISPR gRNA sequence
attaccttcttgtttatcct

SEQ ID NO: 621076 - DNA, 20 bp, Artificial
  CRISPR gRNA sequence
taattattagtaaacatttc

SEQ ID NO: 621077 - DNA, 20 bp, Artificial
  CRISPR gRNA sequence
ttttcgaaatctttccatat

SEQ ID NO: 621078 - DNA, 20 bp, Artificial
  CRISPR gRNA sequence
atcaatccactactgatggg

SEQ ID NO: 621079 - DNA, 20 bp, Artificial
  CRISPR gRNA sequence
actgatgggcattgtttgca

SEQ ID NO: 621080 - DNA, 20 bp, Artificial
  CRISPR gRNA sequence
tagaaacaggagtactgagt

SEQ ID NO: 621081 - DNA, 20 bp, Artificial
  CRISPR gRNA sequence
catcaacaatacataaaagg

SEQ ID NO: 621082 - DNA, 20 bp, Artificial
  CRISPR gRNA sequence
acacagcatgacacaaaatt

SEQ ID NO: 621083 - DNA, 20 bp, Artificial
  CRISPR gRNA sequence
aattagacatgctatgtcag

SEQ ID NO: 621084 - DNA, 20 bp, Artificial
  CRISPR gRNA sequence
tactaggagctgttatgtat

SEQ ID NO: 621085 - DNA, 20 bp, Artificial
  CRISPR gRNA sequence
gctgttatgtattagagatt

SEQ ID NO: 621086 - DNA, 20 bp, Artificial
  CRISPR gRNA sequence
tatgagttgcaaattttacc

SEQ ID NO: 621087 - DNA, 20 bp, Artificial
  CRISPR gRNA sequence
tgcaaattttacctccagct

SEQ ID NO: 621088 - DNA, 20 bp, Artificial
  CRISPR gRNA sequence
ctccagcttgttgtttacct

SEQ ID NO: 621089 - DNA, 20 bp, Artificial
  CRISPR gRNA sequence
agatattgaattttattaaa

SEQ ID NO: 621090 - DNA, 20 bp, Artificial
  CRISPR gRNA sequence
tatatatctttgttccaatt

SEQ ID NO: 621091 - DNA, 20 bp, Artificial
  CRISPR gRNA sequence
gtatatcttccccattttaa

SEQ ID NO: 621092 - DNA, 20 bp, Artificial
  CRISPR gRNA sequence
gccctattactaaattattt

SEQ ID NO: 621093 - DNA, 20 bp, Artificial
  CRISPR gRNA sequence
ttatgaattatttgtctttc

SEQ ID NO: 621094 - DNA, 20 bp, Artificial
  CRISPR gRNA sequence
ttgtctttcagctgattctc

SEQ ID NO: 621095 - DNA, 20 bp, Artificial
  CRISPR gRNA sequence
caaaacataccatctgcaaa

SEQ ID NO: 621096 - DNA, 20 bp, Artificial
  CRISPR gRNA sequence
ttttattatctaaatccatt

SEQ ID NO: 621097 - DNA, 20 bp, Artificial
  CRISPR gRNA sequence
aagagaacaaacaaaatcta

SEQ ID NO: 621098 - DNA, 20 bp, Artificial
  CRISPR gRNA sequence
tgaaattactgagcatgcgt

SEQ ID NO: 621099 - DNA, 20 bp, Artificial
  CRISPR gRNA sequence
tgtgttttcctatgaatcat

SEQ ID NO: 621100 - DNA, 20 bp, Artificial
  CRISPR gRNA sequence
catacatttgatcactatga

SEQ ID NO: 621101 - DNA, 20 bp, Artificial
  CRISPR gRNA sequence
atgaagaagtttccctttat

SEQ ID NO: 621102 - DNA, 20 bp, Artificial
  CRISPR gRNA sequence
aatggttgttaatttttgtc

SEQ ID NO: 621103 - DNA, 20 bp, Artificial
  CRISPR gRNA sequence
cactgtctatagagaaaatc

SEQ ID NO: 621104 - DNA, 20 bp, Artificial
  CRISPR gRNA sequence
aaaatcatatgattgttctc

SEQ ID NO: 621105 - DNA, 20 bp, Artificial
  CRISPR gRNA sequence
tttagtttaatatgataaat

SEQ ID NO: 621106 - DNA, 20 bp, Artificial
  CRISPR gRNA sequence
caataaaaaattaccaacca

SEQ ID NO: 621107 - DNA, 20 bp, Artificial
  CRISPR gRNA sequence
ttgaggagcaggtataaact

SEQ ID NO: 621108 - DNA, 20 bp, Artificial
  CRISPR gRNA sequence
agcaggtataaactaataga

SEQ ID NO: 621109 - DNA, 20 bp, Artificial
  CRISPR gRNA sequence
aatagattatgtttgataat

SEQ ID NO: 621110 - DNA, 20 bp, Artificial
  CRISPR gRNA sequence
gcagaagtattttatcctaa

SEQ ID NO: 621111 - DNA, 20 bp, Artificial
  CRISPR gRNA sequence
aatacattaattcaacttag

SEQ ID NO: 621112 - DNA, 20 bp, Artificial
  CRISPR gRNA sequence
catcaactattttcaaggta

SEQ ID NO: 621113 - DNA, 20 bp, Artificial
  CRISPR gRNA sequence
gtattgagattgtgtagttc

SEQ ID NO: 621114 - DNA, 20 bp, Artificial
  CRISPR gRNA sequence
atgtatgtctaaatacatat

SEQ ID NO: 621115 - DNA, 20 bp, Artificial
  CRISPR gRNA sequence
tacatattaatgtttatgaa

SEQ ID NO: 621116 - DNA, 20 bp, Artificial
  CRISPR gRNA sequence
gtctcaccctgtctcccagt

SEQ ID NO: 621117 - DNA, 20 bp, Artificial
  CRISPR gRNA sequence
cagctcaatattccatattc

SEQ ID NO: 621118 - DNA, 20 bp, Artificial
  CRISPR gRNA sequence
catatcatttttactaaagt

SEQ ID NO: 621119 - DNA, 20 bp, Artificial
  CRISPR gRNA sequence
gtgttggtttctatacatta

SEQ ID NO: 621120 - DNA, 20 bp, Artificial
  CRISPR gRNA sequence
aatatcatattagctaagac

SEQ ID NO: 621121 - DNA, 20 bp, Artificial
  CRISPR gRNA sequence
ggattctggaactaggcaac

SEQ ID NO: 621122 - DNA, 20 bp, Artificial
  CRISPR gRNA sequence
taggcaaccaaggtttgaat

SEQ ID NO: 621123 - DNA, 20 bp, Artificial
  CRISPR gRNA sequence
gaatcacagctttacctctt

SEQ ID NO: 621124 - DNA, 20 bp, Artificial
  CRISPR gRNA sequence
ttaatggcttttaattgcac

SEQ ID NO: 621125 - DNA, 20 bp, Artificial
  CRISPR gRNA sequence
caatactagcatctacctca

SEQ ID NO: 621126 - DNA, 20 bp, Artificial
  CRISPR gRNA sequence
atctacctcatagggtttta

SEQ ID NO: 621127 - DNA, 20 bp, Artificial
  CRISPR gRNA sequence
atgaattaatacatataaat

SEQ ID NO: 621128 - DNA, 20 bp, Artificial
  CRISPR gRNA sequence
atatatgtttgaaatattat

SEQ ID NO: 621129 - DNA, 20 bp, Artificial
  CRISPR gRNA sequence
tgtttgaaatattatatttg

SEQ ID NO: 621130 - DNA, 20 bp, Artificial
  CRISPR gRNA sequence
catgccaatataatctaaat

SEQ ID NO: 621131 - DNA, 20 bp, Artificial
  CRISPR gRNA sequence
ccaatataatctaaatatct

SEQ ID NO: 621132 - DNA, 20 bp, Artificial
  CRISPR gRNA sequence
gcctaatctttacagtattt

SEQ ID NO: 621133 - DNA, 20 bp, Artificial
  CRISPR gRNA sequence
tgatcttatctcttccttaa

SEQ ID NO: 621134 - DNA, 20 bp, Artificial
  CRISPR gRNA sequence
taactttagagcccatggag

SEQ ID NO: 621135 - DNA, 20 bp, Artificial
  CRISPR gRNA sequence
acacataattttactattac

SEQ ID NO: 621136 - DNA, 20 bp, Artificial
  CRISPR gRNA sequence
tttactattacataagcttg

SEQ ID NO: 621137 - DNA, 20 bp, Artificial
  CRISPR gRNA sequence
aatcccctaactctgcaaat

SEQ ID NO: 621138 - DNA, 20 bp, Artificial
  CRISPR gRNA sequence
tttctctaaaaaacaaagaa

SEQ ID NO: 621139 - DNA, 20 bp, Artificial
  CRISPR gRNA sequence
gttaatttactttggaggta

SEQ ID NO: 621140 - DNA, 20 bp, Artificial
  CRISPR gRNA sequence
ttggaggtaagaagtttggt

SEQ ID NO: 621141 - DNA, 20 bp, Artificial
  CRISPR gRNA sequence
ggtaagaagtttggttgttg

SEQ ID NO: 621142 - DNA, 20 bp, Artificial
  CRISPR gRNA sequence
tacctattgatacttggcac

SEQ ID NO: 621143 - DNA, 20 bp, Artificial
  CRISPR gRNA sequence
ttggcacatacgttttttct

SEQ ID NO: 621144 - DNA, 20 bp, Artificial
  CRISPR gRNA sequence
tttagggaaggagtggagag

SEQ ID NO: 621145 - DNA, 20 bp, Artificial
  CRISPR gRNA sequence
gggaaggagtggagagaggt

SEQ ID NO: 621146 - DNA, 20 bp, Artificial
  CRISPR gRNA sequence
aggagtggagagaggtgttt

SEQ ID NO: 621147 - DNA, 20 bp, Artificial
  CRISPR gRNA sequence
tggagagaggtgtttgtttg

SEQ ID NO: 621148 - DNA, 20 bp, Artificial
  CRISPR gRNA sequence
tgtttgtttgttttgtttta

SEQ ID NO: 621149 - DNA, 20 bp, Artificial
  CRISPR gRNA sequence
tagcatgtttctaaatgtgc

SEQ ID NO: 621150 - DNA, 20 bp, Artificial
  CRISPR gRNA sequence
gcaaggaggggcaaggatac

SEQ ID NO: 621151 - DNA, 20 bp, Artificial
  CRISPR gRNA sequence
agttcaaataatagctgact

SEQ ID NO: 621152 - DNA, 20 bp, Artificial
  CRISPR gRNA sequence
gaaagttttcaatatatttt

SEQ ID NO: 621153 - DNA, 20 bp, Artificial
  CRISPR gRNA sequence
gtttatatttgctaaggata

SEQ ID NO: 621154 - DNA, 20 bp, Artificial
  CRISPR gRNA sequence
gttataggggcaaaggtgca

SEQ ID NO: 621155 - DNA, 20 bp, Artificial
  CRISPR gRNA sequence
tttactctgacaagtattct

SEQ ID NO: 621156 - DNA, 20 bp, Artificial
  CRISPR gRNA sequence
aaatcaaatatttaaaaaga

SEQ ID NO: 621157 - DNA, 20 bp, Artificial
  CRISPR gRNA sequence
gacttgagaaatggaattaa

SEQ ID NO: 621158 - DNA, 20 bp, Artificial
  CRISPR gRNA sequence
atgaatgtgaaactcagggt

SEQ ID NO: 621159 - DNA, 20 bp, Artificial
  CRISPR gRNA sequence
aaaatgtgaacctgaacagt

SEQ ID NO: 621160 - DNA, 20 bp, Artificial
  CRISPR gRNA sequence
cctgaacagtaactgattta

SEQ ID NO: 621161 - DNA, 20 bp, Artificial
  CRISPR gRNA sequence
acccttaaaagttacaacag

SEQ ID NO: 621162 - DNA, 20 bp, Artificial
  CRISPR gRNA sequence
ttccattcattcagtattcg

SEQ ID NO: 621163 - DNA, 20 bp, Artificial
  CRISPR gRNA sequence
tcagtattcgatacgtttac

SEQ ID NO: 621164 - DNA, 20 bp, Artificial
  CRISPR gRNA sequence
ctctgccaccctgggaaaat

SEQ ID NO: 621165 - DNA, 20 bp, Artificial
  CRISPR gRNA sequence
gcagaggttcttgagataat

SEQ ID NO: 621166 - DNA, 20 bp, Artificial
  CRISPR gRNA sequence
cagtcataattggtattaga

SEQ ID NO: 621167 - DNA, 20 bp, Artificial
  CRISPR gRNA sequence
ttcacatggtgtaataaata

SEQ ID NO: 621168 - DNA, 20 bp, Artificial
  CRISPR gRNA sequence
aaaaaaaagctgtgtaacat

SEQ ID NO: 621169 - DNA, 20 bp, Artificial
  CRISPR gRNA sequence
aactcttaaatatagcaaag

SEQ ID NO: 621170 - DNA, 20 bp, Artificial
  CRISPR gRNA sequence
ctcttttaatgtaaagggat

SEQ ID NO: 621171 - DNA, 20 bp, Artificial
  CRISPR gRNA sequence
ttaataattataatgtatgt

SEQ ID NO: 621172 - DNA, 20 bp, Artificial
  CRISPR gRNA sequence
ttatacaatcccatccattt

SEQ ID NO: 621173 - DNA, 20 bp, Artificial
  CRISPR gRNA sequence
cattttgggaggccaaggcg

SEQ ID NO: 621174 - DNA, 20 bp, Artificial
  CRISPR gRNA sequence
ttgggaggccaaggcgggtg

SEQ ID NO: 621175 - DNA, 20 bp, Artificial
  CRISPR gRNA sequence
ggctctgaatgtacaattat

SEQ ID NO: 621176 - DNA, 20 bp, Artificial
  CRISPR gRNA sequence
acctgcattcattctatcaa

SEQ ID NO: 621177 - DNA, 20 bp, Artificial
  CRISPR gRNA sequence
tatatgctccatactttgct

SEQ ID NO: 621178 - DNA, 20 bp, Artificial
  CRISPR gRNA sequence
catactttgctaagagattt

SEQ ID NO: 621179 - DNA, 20 bp, Artificial
  CRISPR gRNA sequence
cacatagctggtaagtagag

SEQ ID NO: 621180 - DNA, 20 bp, Artificial
  CRISPR gRNA sequence
cagaaggctaattacaatac

SEQ ID NO: 621181 - DNA, 20 bp, Artificial
  CRISPR gRNA sequence
gggaaagtgtatttcccaag

SEQ ID NO: 621182 - DNA, 20 bp, Artificial
  CRISPR gRNA sequence
tgtatttcccaagttctgat

SEQ ID NO: 621183 - DNA, 20 bp, Artificial
  CRISPR gRNA sequence
aaaatgtatttcctcatagt

SEQ ID NO: 621184 - DNA, 20 bp, Artificial
  CRISPR gRNA sequence
cattaactaagcctttttat

SEQ ID NO: 621185 - DNA, 20 bp, Artificial
  CRISPR gRNA sequence
aatttaaccaccatttttag

SEQ ID NO: 621186 - DNA, 20 bp, Artificial
  CRISPR gRNA sequence
gcattcagttctacaacatg

SEQ ID NO: 621187 - DNA, 20 bp, Artificial
  CRISPR gRNA sequence
attctcattaaaaaaagaga

SEQ ID NO: 621188 - DNA, 20 bp, Artificial
  CRISPR gRNA sequence
ttactctgtcttccaacaca

SEQ ID NO: 621189 - DNA, 20 bp, Artificial
  CRISPR gRNA sequence
caaaatatattttgtatacc

SEQ ID NO: 621190 - DNA, 20 bp, Artificial
  CRISPR gRNA sequence
ttttaaggatatttagaagc

SEQ ID NO: 621191 - DNA, 20 bp, Artificial
  CRISPR gRNA sequence
tttagaagctgtggttttat

SEQ ID NO: 621192 - DNA, 20 bp, Artificial
  CRISPR gRNA sequence
ttgaaattcttttccatggc

SEQ ID NO: 621193 - DNA, 20 bp, Artificial
  CRISPR gRNA sequence
caacactacacatgactgag

SEQ ID NO: 621194 - DNA, 20 bp, Artificial
  CRISPR gRNA sequence
gaaagaatattaatcaaagt

SEQ ID NO: 621195 - DNA, 20 bp, Artificial
  CRISPR gRNA sequence
aatattaatcaaagttcttg

SEQ ID NO: 621196 - DNA, 20 bp, Artificial
  CRISPR gRNA sequence
cgaatggccaaagagtcact

SEQ ID NO: 621197 - DNA, 20 bp, Artificial
  CRISPR gRNA sequence
cagtcatcagtgctaatatt

SEQ ID NO: 621198 - DNA, 20 bp, Artificial
  CRISPR gRNA sequence
cattatcagaaatttactac

SEQ ID NO: 621199 - DNA, 20 bp, Artificial
  CRISPR gRNA sequence
actatgtcagtctcaaaaac

SEQ ID NO: 621200 - DNA, 20 bp, Artificial
  CRISPR gRNA sequence
agggttcctagtgtccacag

SEQ ID NO: 621201 - DNA, 20 bp, Artificial
  CRISPR gRNA sequence
cctagtgtccacagacaggt

SEQ ID NO: 621202 - DNA, 20 bp, Artificial
  CRISPR gRNA sequence
caggttttggtttgaataaa

SEQ ID NO: 621203 - DNA, 20 bp, Artificial
  CRISPR gRNA sequence
aagcaagtaccacaagggaa

SEQ ID NO: 621204 - DNA, 20 bp, Artificial
  CRISPR gRNA sequence
tttccctaactttagtcaga

SEQ ID NO: 621205 - DNA, 20 bp, Artificial
  CRISPR gRNA sequence
atggacttgggtactgaatg

SEQ ID NO: 621206 - DNA, 20 bp, Artificial
  CRISPR gRNA sequence
tgtgcataagggcatgtgat

SEQ ID NO: 621207 - DNA, 20 bp, Artificial
  CRISPR gRNA sequence
ttcgactttagtgagatagt

SEQ ID NO: 621208 - DNA, 20 bp, Artificial
  CRISPR gRNA sequence
actttagtgagatagtatct

SEQ ID NO: 621209 - DNA, 20 bp, Artificial
  CRISPR gRNA sequence
cagttacactggacctttga

SEQ ID NO: 621210 - DNA, 20 bp, Artificial
  CRISPR gRNA sequence
ctggacctttgaaaaggatt

SEQ ID NO: 621211 - DNA, 20 bp, Artificial
  CRISPR gRNA sequence
acagaaatccaaggaaagga

SEQ ID NO: 621212 - DNA, 20 bp, Artificial
  CRISPR gRNA sequence
tcaggagatgaagacaaaaa

SEQ ID NO: 621213 - DNA, 20 bp, Artificial
  CRISPR gRNA sequence
gaagacaaaaagatagattg

SEQ ID NO: 621214 - DNA, 20 bp, Artificial
  CRISPR gRNA sequence
ggctgtagtataaaatgcta

SEQ ID NO: 621215 - DNA, 20 bp, Artificial
  CRISPR gRNA sequence
gtgacaaaactacagaaagg

SEQ ID NO: 621216 - DNA, 20 bp, Artificial
  CRISPR gRNA sequence
ttttgtattttttgtagaga

SEQ ID NO: 621217 - DNA, 20 bp, Artificial
  CRISPR gRNA sequence
attatatgaaaataatttta

SEQ ID NO: 621218 - DNA, 20 bp, Artificial
  CRISPR gRNA sequence
atgtatgatgtaactgtgaa

SEQ ID NO: 621219 - DNA, 20 bp, Artificial
  CRISPR gRNA sequence
ctataggatcttttctagaa

SEQ ID NO: 621220 - DNA, 20 bp, Artificial
  CRISPR gRNA sequence
atcttttctagaaactagtt

SEQ ID NO: 621221 - DNA, 20 bp, Artificial
  CRISPR gRNA sequence
ctagaaactagttttatgct

SEQ ID NO: 621222 - DNA, 20 bp, Artificial
  CRISPR gRNA sequence
actagttttatgctttctga

SEQ ID NO: 621223 - DNA, 20 bp, Artificial
  CRISPR gRNA sequence
tttctattatataatatttc

SEQ ID NO: 621224 - DNA, 20 bp, Artificial
  CRISPR gRNA sequence
ttggctccagctcatggaga

SEQ ID NO: 621225 - DNA, 20 bp, Artificial
  CRISPR gRNA sequence
taaatacaaggaccattatg

SEQ ID NO: 621226 - DNA, 20 bp, Artificial
  CRISPR gRNA sequence
caaggaccattatgaaatgt

SEQ ID NO: 621227 - DNA, 20 bp, Artificial
  CRISPR gRNA sequence
aggccttttataaccacagc

SEQ ID NO: 621228 - DNA, 20 bp, Artificial
  CRISPR gRNA sequence
aaaaaactaaatagaataat

SEQ ID NO: 621229 - DNA, 20 bp, Artificial
  CRISPR gRNA sequence
tccattctgaagagttcctt

SEQ ID NO: 621230 - DNA, 20 bp, Artificial
  CRISPR gRNA sequence
taatcagctgttgaaatcta

SEQ ID NO: 621231 - DNA, 20 bp, Artificial
  CRISPR gRNA sequence
aatacagtgtgaaaatattc

SEQ ID NO: 621232 - DNA, 20 bp, Artificial
  CRISPR gRNA sequence
acaataataaaattatgcat

SEQ ID NO: 621233 - DNA, 20 bp, Artificial
  CRISPR gRNA sequence
tatgcatatatgcttacatt

SEQ ID NO: 621234 - DNA, 20 bp, Artificial
  CRISPR gRNA sequence
ctgaaaagcagagactattt

SEQ ID NO: 621235 - DNA, 20 bp, Artificial
  CRISPR gRNA sequence
tgacagtatttcctaaactt

SEQ ID NO: 621236 - DNA, 20 bp, Artificial
  CRISPR gRNA sequence
ggctcctcctcccttgaaca

SEQ ID NO: 621237 - DNA, 20 bp, Artificial
  CRISPR gRNA sequence
cctcctcccttgaacacttt

SEQ ID NO: 621238 - DNA, 20 bp, Artificial
  CRISPR gRNA sequence
atacttgagttgaggtctgg

SEQ ID NO: 621239 - DNA, 20 bp, Artificial
  CRISPR gRNA sequence
ttatttttttcaagtatctt

SEQ ID NO: 621240 - DNA, 20 bp, Artificial
  CRISPR gRNA sequence
tagatgattcttacgatcaa

SEQ ID NO: 621241 - DNA, 20 bp, Artificial
  CRISPR gRNA sequence
cataactattttaaaaataa

SEQ ID NO: 621242 - DNA, 20 bp, Artificial
  CRISPR gRNA sequence
ttttaaaaataaattggttt

SEQ ID NO: 621243 - DNA, 20 bp, Artificial
  CRISPR gRNA sequence
atatccaatcatttctcagc

SEQ ID NO: 621244 - DNA, 20 bp, Artificial
  CRISPR gRNA sequence
aaactccaatccttcacatg

SEQ ID NO: 621245 - DNA, 20 bp, Artificial
  CRISPR gRNA sequence
atgtgagtgagtcaccatcc

SEQ ID NO: 621246 - DNA, 20 bp, Artificial
  CRISPR gRNA sequence
gtgagtcaccatcctaacga

SEQ ID NO: 621247 - DNA, 20 bp, Artificial
  CRISPR gRNA sequence
taaggtgcacatattgaaat

SEQ ID NO: 621248 - DNA, 20 bp, Artificial
  CRISPR gRNA sequence
gatgatcatacttccttcat

SEQ ID NO: 621249 - DNA, 20 bp, Artificial
  CRISPR gRNA sequence
tacttttaagcctcaaagca

SEQ ID NO: 621250 - DNA, 20 bp, Artificial
  CRISPR gRNA sequence
atgtaaatggaaacataagc

SEQ ID NO: 621251 - DNA, 20 bp, Artificial
  CRISPR gRNA sequence
tggaaacataagcaatggat

SEQ ID NO: 621252 - DNA, 20 bp, Artificial
  CRISPR gRNA sequence
atttctgtttccaaaatagg

SEQ ID NO: 621253 - DNA, 20 bp, Artificial
  CRISPR gRNA sequence
catgtaaacatatgtaacaa

SEQ ID NO: 621254 - DNA, 20 bp, Artificial
  CRISPR gRNA sequence
ataaataaattaaaagagta

SEQ ID NO: 621255 - DNA, 20 bp, Artificial
  CRISPR gRNA sequence
caagttattgaaaataaatt

SEQ ID NO: 621256 - DNA, 20 bp, Artificial
  CRISPR gRNA sequence
tattgaaaataaattcaggg

SEQ ID NO: 621257 - DNA, 20 bp, Artificial
  CRISPR gRNA sequence
aaaataaattcagggtttgg

SEQ ID NO: 621258 - DNA, 20 bp, Artificial
  CRISPR gRNA sequence
aaattcagggtttggtttgg

SEQ ID NO: 621259 - DNA, 20 bp, Artificial
  CRISPR gRNA sequence
tttgttatttaccatactta

SEQ ID NO: 621260 - DNA, 20 bp, Artificial
  CRISPR gRNA sequence
catctaaaacttgtgagata

SEQ ID NO: 621261 - DNA, 20 bp, Artificial
  CRISPR gRNA sequence
atgcatgctgtcaaggatat

SEQ ID NO: 621262 - DNA, 20 bp, Artificial
  CRISPR gRNA sequence
ctttggggtcacttttaagt

SEQ ID NO: 621263 - DNA, 20 bp, Artificial
  CRISPR gRNA sequence
tcacttttaagtaactgatt

SEQ ID NO: 621264 - DNA, 20 bp, Artificial
  CRISPR gRNA sequence
tggaagcctgatatttttaa

SEQ ID NO: 621265 - DNA, 20 bp, Artificial
  CRISPR gRNA sequence
acaggtacaagccttctgcc

SEQ ID NO: 621266 - DNA, 20 bp, Artificial
  CRISPR gRNA sequence
ttctctgctctcaagagtat

SEQ ID NO: 621267 - DNA, 20 bp, Artificial
  CRISPR gRNA sequence
tatacaacaacaacaaagta

SEQ ID NO: 621268 - DNA, 20 bp, Artificial
  CRISPR gRNA sequence
ggtttcatcttttctcaagg

SEQ ID NO: 621269 - DNA, 20 bp, Artificial
  CRISPR gRNA sequence
ctcaagggtaggctttgcct

SEQ ID NO: 621270 - DNA, 20 bp, Artificial
  CRISPR gRNA sequence
taattgtataatttttaagt

SEQ ID NO: 621271 - DNA, 20 bp, Artificial
  CRISPR gRNA sequence
tttatttttctttctgtatt

SEQ ID NO: 621272 - DNA, 20 bp, Artificial
  CRISPR gRNA sequence
tagaatggctatatggatga

SEQ ID NO: 621273 - DNA, 20 bp, Artificial
  CRISPR gRNA sequence
aaggtttcttgatataagaa

SEQ ID NO: 621274 - DNA, 20 bp, Artificial
  CRISPR gRNA sequence
tgctatgctaaatactttgg

SEQ ID NO: 621275 - DNA, 20 bp, Artificial
  CRISPR gRNA sequence
atactttggaagggtttctt

SEQ ID NO: 621276 - DNA, 20 bp, Artificial
  CRISPR gRNA sequence
ctctttctcctagttcctaa

SEQ ID NO: 621277 - DNA, 20 bp, Artificial
  CRISPR gRNA sequence
caaccaacaaacatttgaaa

SEQ ID NO: 621278 - DNA, 20 bp, Artificial
  CRISPR gRNA sequence
aggaaacaaaatatgtagac

SEQ ID NO: 621279 - DNA, 20 bp, Artificial
  CRISPR gRNA sequence
ggactagggtacttgagtgg

SEQ ID NO: 621280 - DNA, 20 bp, Artificial
  CRISPR gRNA sequence
tttcatgttatatctttctc

SEQ ID NO: 621281 - DNA, 20 bp, Artificial
  CRISPR gRNA sequence
tggccacatcccctgtggga

SEQ ID NO: 621282 - DNA, 20 bp, Artificial
  CRISPR gRNA sequence
agttcagaacttacgtaatg

SEQ ID NO: 621283 - DNA, 20 bp, Artificial
  CRISPR gRNA sequence
tcacacccttatgttatgtg

SEQ ID NO: 621284 - DNA, 20 bp, Artificial
  CRISPR gRNA sequence
agggtcaatgctgccttaat

SEQ ID NO: 621285 - DNA, 20 bp, Artificial
  CRISPR gRNA sequence
cggtaataaataaacattag

SEQ ID NO: 621286 - DNA, 20 bp, Artificial
  CRISPR gRNA sequence
aaacattagagttgtttttt

SEQ ID NO: 621287 - DNA, 20 bp, Artificial
  CRISPR gRNA sequence
agagttgttttttatgagat

SEQ ID NO: 621288 - DNA, 20 bp, Artificial
  CRISPR gRNA sequence
agagttggtaataaatcacc

SEQ ID NO: 621289 - DNA, 20 bp, Artificial
  CRISPR gRNA sequence
gattacagaaagaaacactg

SEQ ID NO: 621290 - DNA, 20 bp, Artificial
  CRISPR gRNA sequence
gaaagaaacactgagatgct

SEQ ID NO: 621291 - DNA, 20 bp, Artificial
  CRISPR gRNA sequence
aaggagacagaaacatttga

SEQ ID NO: 621292 - DNA, 20 bp, Artificial
  CRISPR gRNA sequence
gggaacacaaagaaaaagaa

SEQ ID NO: 621293 - DNA, 20 bp, Artificial
  CRISPR gRNA sequence
caaaaaacaaagcaaaacac

SEQ ID NO: 621294 - DNA, 20 bp, Artificial
  CRISPR gRNA sequence
aggaactacacatcagaatg

SEQ ID NO: 621295 - DNA, 20 bp, Artificial
  CRISPR gRNA sequence
acacatcagaatggaatgat

SEQ ID NO: 621296 - DNA, 20 bp, Artificial
  CRISPR gRNA sequence
ggaatgattattgatttctt

SEQ ID NO: 621297 - DNA, 20 bp, Artificial
  CRISPR gRNA sequence
catcaaatgctattacagga

SEQ ID NO: 621298 - DNA, 20 bp, Artificial
  CRISPR gRNA sequence
caaaaagaaaaccccattat

SEQ ID NO: 621299 - DNA, 20 bp, Artificial
  CRISPR gRNA sequence
tgtgatacggtattgatcaa

SEQ ID NO: 621300 - DNA, 20 bp, Artificial
  CRISPR gRNA sequence
taatttgaaatcaataacac

SEQ ID NO: 621301 - DNA, 20 bp, Artificial
  CRISPR gRNA sequence
atatcctaggaactaaagaa

SEQ ID NO: 621302 - DNA, 20 bp, Artificial
  CRISPR gRNA sequence
ctaggaactaaagaaattag

SEQ ID NO: 621303 - DNA, 20 bp, Artificial
  CRISPR gRNA sequence
gaactaaagaaattagattt

SEQ ID NO: 621304 - DNA, 20 bp, Artificial
  CRISPR gRNA sequence
aagttaccattataaaataa

SEQ ID NO: 621305 - DNA, 20 bp, Artificial
  CRISPR gRNA sequence
atagatttgtgaaataccac

SEQ ID NO: 621306 - DNA, 20 bp, Artificial
  CRISPR gRNA sequence
ggtgaaatgtgaggatgcaa

SEQ ID NO: 621307 - DNA, 20 bp, Artificial
  CRISPR gRNA sequence
aatgtgaggatgcaaacttg

SEQ ID NO: 621308 - DNA, 20 bp, Artificial
  CRISPR gRNA sequence
gatgcaaacttgttttgttt

SEQ ID NO: 621309 - DNA, 20 bp, Artificial
  CRISPR gRNA sequence
atggagtgtcagtaatccct

SEQ ID NO: 621310 - DNA, 20 bp, Artificial
  CRISPR gRNA sequence
ccaagccaagagtcagaaga

SEQ ID NO: 621311 - DNA, 20 bp, Artificial
  CRISPR gRNA sequence
taaggttttgttgttgttgt

SEQ ID NO: 621312 - DNA, 20 bp, Artificial
  CRISPR gRNA sequence
tgcctcagcctccagagtag

SEQ ID NO: 621313 - DNA, 20 bp, Artificial
  CRISPR gRNA sequence
ttttgtatttttagtagaga

SEQ ID NO: 621314 - DNA, 20 bp, Artificial
  CRISPR gRNA sequence
cgtctcggcctcccaaagtg

SEQ ID NO: 621315 - DNA, 20 bp, Artificial
  CRISPR gRNA sequence
gccaccacatctggccaaga

SEQ ID NO: 621316 - DNA, 20 bp, Artificial
  CRISPR gRNA sequence
tgtgactttcgcctcaatgt

SEQ ID NO: 621317 - DNA, 20 bp, Artificial
  CRISPR gRNA sequence
atgtacaggtttctaaaata

SEQ ID NO: 621318 - DNA, 20 bp, Artificial
  CRISPR gRNA sequence
gaacactacagtgtaaaaca

SEQ ID NO: 621319 - DNA, 20 bp, Artificial
  CRISPR gRNA sequence
actacagtgtaaaacacttt

SEQ ID NO: 621320 - DNA, 20 bp, Artificial
  CRISPR gRNA sequence
atgtcatagaatgcctggag

SEQ ID NO: 621321 - DNA, 20 bp, Artificial
  CRISPR gRNA sequence
aaatggaaataagaaaagaa

SEQ ID NO: 621322 - DNA, 20 bp, Artificial
  CRISPR gRNA sequence
gaaaggaattttagttgtat

SEQ ID NO: 621323 - DNA, 20 bp, Artificial
  CRISPR gRNA sequence
gttgtattctagtttcagtg

SEQ ID NO: 621324 - DNA, 20 bp, Artificial
  CRISPR gRNA sequence
ctagtttcagtggaaagctt

SEQ ID NO: 621325 - DNA, 20 bp, Artificial
  CRISPR gRNA sequence
taaagcaatgaattgttatg

SEQ ID NO: 621326 - DNA, 20 bp, Artificial
  CRISPR gRNA sequence
atgaattgttatgatctgat

SEQ ID NO: 621327 - DNA, 20 bp, Artificial
  CRISPR gRNA sequence
ggttaaactgttgcaatatt

SEQ ID NO: 621328 - DNA, 20 bp, Artificial
  CRISPR gRNA sequence
acagtagcgggcctggtgag

SEQ ID NO: 621329 - DNA, 20 bp, Artificial
  CRISPR gRNA sequence
atgtattttagaagcagagc

SEQ ID NO: 621330 - DNA, 20 bp, Artificial
  CRISPR gRNA sequence
ggatttctgatagactggat

SEQ ID NO: 621331 - DNA, 20 bp, Artificial
  CRISPR gRNA sequence
aatagatgaaggtgagtacc

SEQ ID NO: 621332 - DNA, 20 bp, Artificial
  CRISPR gRNA sequence
ctcactaagtaattggcagc

SEQ ID NO: 621333 - DNA, 20 bp, Artificial
  CRISPR gRNA sequence
ctagatcttgttgttctatc

SEQ ID NO: 621334 - DNA, 20 bp, Artificial
  CRISPR gRNA sequence
ttgttgttctatcaaaagct

SEQ ID NO: 621335 - DNA, 20 bp, Artificial
  CRISPR gRNA sequence
tgagagcattttagagcaat

SEQ ID NO: 621336 - DNA, 20 bp, Artificial
  CRISPR gRNA sequence
cagggaaaaatcaattttaa

SEQ ID NO: 621337 - DNA, 20 bp, Artificial
  CRISPR gRNA sequence
aaaaatgtcaaacagaaaat

SEQ ID NO: 621338 - DNA, 20 bp, Artificial
  CRISPR gRNA sequence
atgtcaaacagaaaattaca

SEQ ID NO: 621339 - DNA, 20 bp, Artificial
  CRISPR gRNA sequence
ttggcacataaatgcatatg

SEQ ID NO: 621340 - DNA, 20 bp, Artificial
  CRISPR gRNA sequence
gctactaaaaatatatggat

SEQ ID NO: 621341 - DNA, 20 bp, Artificial
  CRISPR gRNA sequence
agcttgaattttcagttcag

SEQ ID NO: 621342 - DNA, 20 bp, Artificial
  CRISPR gRNA sequence
agttcagttaggattaagta

SEQ ID NO: 621343 - DNA, 20 bp, Artificial
  CRISPR gRNA sequence
atatatgccagttagatatt

SEQ ID NO: 621344 - DNA, 20 bp, Artificial
  CRISPR gRNA sequence
cgccaagcaaattatatttc

SEQ ID NO: 621345 - DNA, 20 bp, Artificial
  CRISPR gRNA sequence
aacagtgaaagagatacaat

SEQ ID NO: 621346 - DNA, 20 bp, Artificial
  CRISPR gRNA sequence
cttatttcttgcagctatag

SEQ ID NO: 621347 - DNA, 20 bp, Artificial
  CRISPR gRNA sequence
ctataggaatgattacaaac

SEQ ID NO: 621348 - DNA, 20 bp, Artificial
  CRISPR gRNA sequence
caaatgcttgtaaaactaga

SEQ ID NO: 621349 - DNA, 20 bp, Artificial
  CRISPR gRNA sequence
taatgattgctcatgtaaca

SEQ ID NO: 621350 - DNA, 20 bp, Artificial
  CRISPR gRNA sequence
actgggggaaatatcttttg

SEQ ID NO: 621351 - DNA, 20 bp, Artificial
  CRISPR gRNA sequence
ggaatcaacagaactgtctt

SEQ ID NO: 621352 - DNA, 20 bp, Artificial
  CRISPR gRNA sequence
aacagttttaagggagagcc

SEQ ID NO: 621353 - DNA, 20 bp, Artificial
  CRISPR gRNA sequence
aagggagagccatttgattc

SEQ ID NO: 621354 - DNA, 20 bp, Artificial
  CRISPR gRNA sequence
cataggattctaaatgatct

SEQ ID NO: 621355 - DNA, 20 bp, Artificial
  CRISPR gRNA sequence
atgatctttgagatttagct

SEQ ID NO: 621356 - DNA, 20 bp, Artificial
  CRISPR gRNA sequence
ttgagatttagctactggat

SEQ ID NO: 621357 - DNA, 20 bp, Artificial
  CRISPR gRNA sequence
ttcatgtatatctactaaat

SEQ ID NO: 621358 - DNA, 20 bp, Artificial
  CRISPR gRNA sequence
aaatgactgatttatgactt

SEQ ID NO: 621359 - DNA, 20 bp, Artificial
  CRISPR gRNA sequence
ctaacttttaaattgtatct

SEQ ID NO: 621360 - DNA, 20 bp, Artificial
  CRISPR gRNA sequence
attttccaataatacctctg

SEQ ID NO: 621361 - DNA, 20 bp, Artificial
  CRISPR gRNA sequence
gacctgtttgtatatacatt

SEQ ID NO: 621362 - DNA, 20 bp, Artificial
  CRISPR gRNA sequence
gattctctaggtatccctta

SEQ ID NO: 621363 - DNA, 20 bp, Artificial
  CRISPR gRNA sequence
atgtatattttgaagccatg

SEQ ID NO: 621364 - DNA, 20 bp, Artificial
  CRISPR gRNA sequence
cttttgaagtcatgtacttg

SEQ ID NO: 621365 - DNA, 20 bp, Artificial
  CRISPR gRNA sequence
aagcttttagtccaatgtag

SEQ ID NO: 621366 - DNA, 20 bp, Artificial
  CRISPR gRNA sequence
ccttctgggtaagactagct

SEQ ID NO: 621367 - DNA, 20 bp, Artificial
  CRISPR gRNA sequence
tactatgtataaggcactgt

SEQ ID NO: 621368 - DNA, 20 bp, Artificial
  CRISPR gRNA sequence
aatgtattaggccctgtgat

SEQ ID NO: 621369 - DNA, 20 bp, Artificial
  CRISPR gRNA sequence
gccctgtgataaaagcttta

SEQ ID NO: 621370 - DNA, 20 bp, Artificial
  CRISPR gRNA sequence
tgtctgctaccctcaggctg

SEQ ID NO: 621371 - DNA, 20 bp, Artificial
  CRISPR gRNA sequence
agtcattttccctgccctca

SEQ ID NO: 621372 - DNA, 20 bp, Artificial
  CRISPR gRNA sequence
gaaacttcactcaggaaaat

SEQ ID NO: 621373 - DNA, 20 bp, Artificial
  CRISPR gRNA sequence
aaatccttttaaactgaata

SEQ ID NO: 621374 - DNA, 20 bp, Artificial
  CRISPR gRNA sequence
aactgaatattctgttttct

SEQ ID NO: 621375 - DNA, 20 bp, Artificial
  CRISPR gRNA sequence
ttatacccgtcacaaacaga

SEQ ID NO: 621376 - DNA, 20 bp, Artificial
  CRISPR gRNA sequence
cacaaacagagtaggtttat

SEQ ID NO: 621377 - DNA, 20 bp, Artificial
  CRISPR gRNA sequence
tttactttcatttcttcagt

SEQ ID NO: 621378 - DNA, 20 bp, Artificial
  CRISPR gRNA sequence
cagatatgttatgttccatg

SEQ ID NO: 621379 - DNA, 20 bp, Artificial
  CRISPR gRNA sequence
ggactaatttttaaaattat

SEQ ID NO: 621380 - DNA, 20 bp, Artificial
  CRISPR gRNA sequence
ttcctagaagactatttgat

SEQ ID NO: 621381 - DNA, 20 bp, Artificial
  CRISPR gRNA sequence
atttgatatatgtttgtggg

SEQ ID NO: 621382 - DNA, 20 bp, Artificial
  CRISPR gRNA sequence
catgagccagtcactgttct

SEQ ID NO: 621383 - DNA, 20 bp, Artificial
  CRISPR gRNA sequence
agctttacatatattgtgtc

SEQ ID NO: 621384 - DNA, 20 bp, Artificial
  CRISPR gRNA sequence
tcccctttttacaaataaag

SEQ ID NO: 621385 - DNA, 20 bp, Artificial
  CRISPR gRNA sequence
caattctgtaatttttaaaa

SEQ ID NO: 621386 - DNA, 20 bp, Artificial
  CRISPR gRNA sequence
cactttgggaggctgaggta

SEQ ID NO: 621387 - DNA, 20 bp, Artificial
  CRISPR gRNA sequence
tggtggcaggtacctgtaat

SEQ ID NO: 621388 - DNA, 20 bp, Artificial
  CRISPR gRNA sequence
tgctaagtactatcaaaaag

SEQ ID NO: 621389 - DNA, 20 bp, Artificial
  CRISPR gRNA sequence
tggttgcataaatattaagc

SEQ ID NO: 621390 - DNA, 20 bp, Artificial
  CRISPR gRNA sequence
gtattcttagtagacttaaa

SEQ ID NO: 621391 - DNA, 20 bp, Artificial
  CRISPR gRNA sequence
tctttttattattgttattt

SEQ ID NO: 621392 - DNA, 20 bp, Artificial
  CRISPR gRNA sequence
cttcaacaatgatacacatg

SEQ ID NO: 621393 - DNA, 20 bp, Artificial
  CRISPR gRNA sequence
aatttttactacagtattaa

SEQ ID NO: 621394 - DNA, 20 bp, Artificial
  CRISPR gRNA sequence
agacaactgaggggcaagat

SEQ ID NO: 621395 - DNA, 20 bp, Artificial
  CRISPR gRNA sequence
tttttgcaaaagataaaagc

SEQ ID NO: 621396 - DNA, 20 bp, Artificial
  CRISPR gRNA sequence
agatggccactgataatagc

SEQ ID NO: 621397 - DNA, 20 bp, Artificial
  CRISPR gRNA sequence
ctaggcaccactaactttta

SEQ ID NO: 621398 - DNA, 20 bp, Artificial
  CRISPR gRNA sequence
tctacccccatctcctactc

SEQ ID NO: 621399 - DNA, 20 bp, Artificial
  CRISPR gRNA sequence
gctttcaaatatctgaagaa

SEQ ID NO: 621400 - DNA, 20 bp, Artificial
  CRISPR gRNA sequence
tgcttctttctcccgaatct

SEQ ID NO: 621401 - DNA, 20 bp, Artificial
  CRISPR gRNA sequence
cgaatctaaatgcttattca

SEQ ID NO: 621402 - DNA, 20 bp, Artificial
  CRISPR gRNA sequence
cattcctcatcacttaagca

SEQ ID NO: 621403 - DNA, 20 bp, Artificial
  CRISPR gRNA sequence
atcacttaagcaggcagctt

SEQ ID NO: 621404 - DNA, 20 bp, Artificial
  CRISPR gRNA sequence
ttccttgattcacttataaa

SEQ ID NO: 621405 - DNA, 20 bp, Artificial
  CRISPR gRNA sequence
ctactaactcaagtggagtc

SEQ ID NO: 621406 - DNA, 20 bp, Artificial
  CRISPR gRNA sequence
tttattctttctttcttctt

SEQ ID NO: 621407 - DNA, 20 bp, Artificial
  CRISPR gRNA sequence
accagaattgtcttgctaaa

SEQ ID NO: 621408 - DNA, 20 bp, Artificial
  CRISPR gRNA sequence
gctaaaaatagtttctcttt

SEQ ID NO: 621409 - DNA, 20 bp, Artificial
  CRISPR gRNA sequence
aggctcttttttaaaagtaa

SEQ ID NO: 621410 - DNA, 20 bp, Artificial
  CRISPR gRNA sequence
tgcaagatagaattgaaaat

SEQ ID NO: 621411 - DNA, 20 bp, Artificial
  CRISPR gRNA sequence
ctatgttttaactcattcta

SEQ ID NO: 621412 - DNA, 20 bp, Artificial
  CRISPR gRNA sequence
cctgtagccccagatacttg

SEQ ID NO: 621413 - DNA, 20 bp, Artificial
  CRISPR gRNA sequence
tagccccagatacttgagaa

SEQ ID NO: 621414 - DNA, 20 bp, Artificial
  CRISPR gRNA sequence
tcaggaggctgaggcaggag

SEQ ID NO: 621415 - DNA, 20 bp, Artificial
  CRISPR gRNA sequence
gcctgggctacagagcgaga

SEQ ID NO: 621416 - DNA, 20 bp, Artificial
  CRISPR gRNA sequence
gaaaagaaagagccgggggc

SEQ ID NO: 621417 - DNA, 20 bp, Artificial
  CRISPR gRNA sequence
caggtggatagcccgaggtc

SEQ ID NO: 621418 - DNA, 20 bp, Artificial
  CRISPR gRNA sequence
tcgggagactgaggcaggag

SEQ ID NO: 621419 - DNA, 20 bp, Artificial
  CRISPR gRNA sequence
tatcatttgtacatgaaaat

SEQ ID NO: 621420 - DNA, 20 bp, Artificial
  CRISPR gRNA sequence
tggatgtaatcagagctact

SEQ ID NO: 621421 - DNA, 20 bp, Artificial
  CRISPR gRNA sequence
ttagaataaaatataaaaca

SEQ ID NO: 621422 - DNA, 20 bp, Artificial
  CRISPR gRNA sequence
atatcccaaagtcaactata

SEQ ID NO: 621423 - DNA, 20 bp, Artificial
  CRISPR gRNA sequence
aagtcaactatatcaagttt

SEQ ID NO: 621424 - DNA, 20 bp, Artificial
  CRISPR gRNA sequence
gtttccttcttgttcttatt

SEQ ID NO: 621425 - DNA, 20 bp, Artificial
  CRISPR gRNA sequence
acacgcatacacatgcacat

SEQ ID NO: 621426 - DNA, 20 bp, Artificial
  CRISPR gRNA sequence
aaatcaattgtctagttaac

SEQ ID NO: 621427 - DNA, 20 bp, Artificial
  CRISPR gRNA sequence
actttatgcaaacagcatta

SEQ ID NO: 621428 - DNA, 20 bp, Artificial
  CRISPR gRNA sequence
aaaaaataatttattttaaa

SEQ ID NO: 621429 - DNA, 20 bp, Artificial
  CRISPR gRNA sequence
tgtgttttgttgaggtacgg

SEQ ID NO: 621430 - DNA, 20 bp, Artificial
  CRISPR gRNA sequence
tgaggtacgggggtgtttct

SEQ ID NO: 621431 - DNA, 20 bp, Artificial
  CRISPR gRNA sequence
acagatggcagtgtgtaaat

SEQ ID NO: 621432 - DNA, 20 bp, Artificial
  CRISPR gRNA sequence
tatgtccagacacaatctat

SEQ ID NO: 621433 - DNA, 20 bp, Artificial
  CRISPR gRNA sequence
acaatctattgctgctttca

SEQ ID NO: 621434 - DNA, 20 bp, Artificial
  CRISPR gRNA sequence
tccaaatactacattcgagt

SEQ ID NO: 621435 - DNA, 20 bp, Artificial
  CRISPR gRNA sequence
cattttaaagcagtacacaa

SEQ ID NO: 621436 - DNA, 20 bp, Artificial
  CRISPR gRNA sequence
attattgaatagctcaattt

SEQ ID NO: 621437 - DNA, 20 bp, Artificial
  CRISPR gRNA sequence
taataagcatattggcataa

SEQ ID NO: 621438 - DNA, 20 bp, Artificial
  CRISPR gRNA sequence
atgaaaatggccatgaaaga

SEQ ID NO: 621439 - DNA, 20 bp, Artificial
  CRISPR gRNA sequence
tagacaagggtaaggagaac

SEQ ID NO: 621440 - DNA, 20 bp, Artificial
  CRISPR gRNA sequence
tttattagaacgtgacttca

SEQ ID NO: 621441 - DNA, 20 bp, Artificial
  CRISPR gRNA sequence
atcttgtacatgctactaaa

SEQ ID NO: 621442 - DNA, 20 bp, Artificial
  CRISPR gRNA sequence
aacagtttaagtgatggaga

SEQ ID NO: 621443 - DNA, 20 bp, Artificial
  CRISPR gRNA sequence
aacatctacattaacattca

SEQ ID NO: 621444 - DNA, 20 bp, Artificial
  CRISPR gRNA sequence
atagaatcagaaaacataag

SEQ ID NO: 621445 - DNA, 20 bp, Artificial
  CRISPR gRNA sequence
aactgtttagaaacttagag

SEQ ID NO: 621446 - DNA, 20 bp, Artificial
  CRISPR gRNA sequence
atcagcttttgggaccaatt

SEQ ID NO: 621447 - DNA, 20 bp, Artificial
  CRISPR gRNA sequence
cagagaaaatcacaagtaaa

SEQ ID NO: 621448 - DNA, 20 bp, Artificial
  CRISPR gRNA sequence
atcacaagtaaattaggatt

SEQ ID NO: 621449 - DNA, 20 bp, Artificial
  CRISPR gRNA sequence
ttatttcaacaactaagaaa

SEQ ID NO: 621450 - DNA, 20 bp, Artificial
  CRISPR gRNA sequence
agagatatgaccattttccc

SEQ ID NO: 621451 - DNA, 20 bp, Artificial
  CRISPR gRNA sequence
caaagattcacatctggaaa

SEQ ID NO: 621452 - DNA, 20 bp, Artificial
  CRISPR gRNA sequence
tgtggcccacaaataaatct

SEQ ID NO: 621453 - DNA, 20 bp, Artificial
  CRISPR gRNA sequence
aattcacactcagtaattaa

SEQ ID NO: 621454 - DNA, 20 bp, Artificial
  CRISPR gRNA sequence
tactaactaacatgaaatac

SEQ ID NO: 621455 - DNA, 20 bp, Artificial
  CRISPR gRNA sequence
cacttcaataatttcatgag

SEQ ID NO: 621456 - DNA, 20 bp, Artificial
  CRISPR gRNA sequence
ataatttcatgagactggtt

SEQ ID NO: 621457 - DNA, 20 bp, Artificial
  CRISPR gRNA sequence
actgctgaccacatcagctg

SEQ ID NO: 621458 - DNA, 20 bp, Artificial
  CRISPR gRNA sequence
aagtatcctttatgggcact

SEQ ID NO: 621459 - DNA, 20 bp, Artificial
  CRISPR gRNA sequence
gccagaaagaactcgtcgta

SEQ ID NO: 621460 - DNA, 20 bp, Artificial
  CRISPR gRNA sequence
ataggttacagactgaatct

SEQ ID NO: 621461 - DNA, 20 bp, Artificial
  CRISPR gRNA sequence
tatataactaactcccttta

SEQ ID NO: 621462 - DNA, 20 bp, Artificial
  CRISPR gRNA sequence
cttgctcagtaaatgacctt

SEQ ID NO: 621463 - DNA, 20 bp, Artificial
  CRISPR gRNA sequence
caactggagtgatccagctc

SEQ ID NO: 621464 - DNA, 20 bp, Artificial
  CRISPR gRNA sequence
ttggttgcatgtgtgtgtgt

SEQ ID NO: 621465 - DNA, 20 bp, Artificial
  CRISPR gRNA sequence
tatctaaacataaattggca

SEQ ID NO: 621466 - DNA, 20 bp, Artificial
  CRISPR gRNA sequence
ttggcattctgattttaaat

SEQ ID NO: 621467 - DNA, 20 bp, Artificial
  CRISPR gRNA sequence
tttaaatatcagttttgtaa

SEQ ID NO: 621468 - DNA, 20 bp, Artificial
  CRISPR gRNA sequence
cactctaagtgtgccacaaa

SEQ ID NO: 621469 - DNA, 20 bp, Artificial
  CRISPR gRNA sequence
atcctctgagaacctatcta

SEQ ID NO: 621470 - DNA, 20 bp, Artificial
  CRISPR gRNA sequence
aagtggcttgttgccctttt

SEQ ID NO: 621471 - DNA, 20 bp, Artificial
  CRISPR gRNA sequence
agcaatgcatcatacacagt

SEQ ID NO: 621472 - DNA, 20 bp, Artificial
  CRISPR gRNA sequence
atacacagtaagtgcttaat

SEQ ID NO: 621473 - DNA, 20 bp, Artificial
  CRISPR gRNA sequence
catacaggaaatctcagaag

SEQ ID NO: 621474 - DNA, 20 bp, Artificial
  CRISPR gRNA sequence
tctatggtgtcttgggtagt

SEQ ID NO: 621475 - DNA, 20 bp, Artificial
  CRISPR gRNA sequence
taaatatttcagaataatta

SEQ ID NO: 621476 - DNA, 20 bp, Artificial
  CRISPR gRNA sequence
attaatgtggcagaactggc

SEQ ID NO: 621477 - DNA, 20 bp, Artificial
  CRISPR gRNA sequence
gtatatggcatacattaatc

SEQ ID NO: 621478 - DNA, 20 bp, Artificial
  CRISPR gRNA sequence
agatataccacaaaatgttg

SEQ ID NO: 621479 - DNA, 20 bp, Artificial
  CRISPR gRNA sequence
ccacaaaatgttgaagagct

SEQ ID NO: 621480 - DNA, 20 bp, Artificial
  CRISPR gRNA sequence
tcaacttctgagaccagtat

SEQ ID NO: 621481 - DNA, 20 bp, Artificial
  CRISPR gRNA sequence
ataaaggattccattaagca

SEQ ID NO: 621482 - DNA, 20 bp, Artificial
  CRISPR gRNA sequence
acataaaactcaatatagaa

SEQ ID NO: 621483 - DNA, 20 bp, Artificial
  CRISPR gRNA sequence
actgagaattacttagacat

SEQ ID NO: 621484 - DNA, 20 bp, Artificial
  CRISPR gRNA sequence
taaccaaaccatgggctaat

SEQ ID NO: 621485 - DNA, 20 bp, Artificial
  CRISPR gRNA sequence
tctcccaaattgtaccctgt

SEQ ID NO: 621486 - DNA, 20 bp, Artificial
  CRISPR gRNA sequence
ttcctttttatcccactact

SEQ ID NO: 621487 - DNA, 20 bp, Artificial
  CRISPR gRNA sequence
gacttccatgaaaataaaag

SEQ ID NO: 621488 - DNA, 20 bp, Artificial
  CRISPR gRNA sequence
caagatgttccattatcctg

SEQ ID NO: 621489 - DNA, 20 bp, Artificial
  CRISPR gRNA sequence
tttatagtctagaaatacca

SEQ ID NO: 621490 - DNA, 20 bp, Artificial
  CRISPR gRNA sequence
cccccgtaataatcaagaca

SEQ ID NO: 621491 - DNA, 20 bp, Artificial
  CRISPR gRNA sequence
ctctatactctttattcacc

SEQ ID NO: 621492 - DNA, 20 bp, Artificial
  CRISPR gRNA sequence
gaattgaacagcaaaatgtc

SEQ ID NO: 621493 - DNA, 20 bp, Artificial
  CRISPR gRNA sequence
taccagaagcatcaaatgag

SEQ ID NO: 621494 - DNA, 20 bp, Artificial
  CRISPR gRNA sequence
ttagatgaggactctctaag

SEQ ID NO: 621495 - DNA, 20 bp, Artificial
  CRISPR gRNA sequence
tctggaacaccaataatatg

SEQ ID NO: 621496 - DNA, 20 bp, Artificial
  CRISPR gRNA sequence
aacaccaataatatgcagtg

SEQ ID NO: 621497 - DNA, 20 bp, Artificial
  CRISPR gRNA sequence
ttcttaaccaaaatcttcat

SEQ ID NO: 621498 - DNA, 20 bp, Artificial
  CRISPR gRNA sequence
tgctttaaataacggagggt

SEQ ID NO: 621499 - DNA, 20 bp, Artificial
  CRISPR gRNA sequence
atacagaaaagagcaaaaga

SEQ ID NO: 621500 - DNA, 20 bp, Artificial
  CRISPR gRNA sequence
agacccagatttcaaataga

SEQ ID NO: 621501 - DNA, 20 bp, Artificial
  CRISPR gRNA sequence
actgctctgagtaatagcag

SEQ ID NO: 621502 - DNA, 20 bp, Artificial
  CRISPR gRNA sequence
caacagcccattgaggtagg

SEQ ID NO: 621503 - DNA, 20 bp, Artificial
  CRISPR gRNA sequence
atttttaaccactcacagtc

SEQ ID NO: 621504 - DNA, 20 bp, Artificial
  CRISPR gRNA sequence
acagtctactgcttctgagc

SEQ ID NO: 621505 - DNA, 20 bp, Artificial
  CRISPR gRNA sequence
tctaccttctctcgctctag

SEQ ID NO: 621506 - DNA, 20 bp, Artificial
  CRISPR gRNA sequence
acccagagatgaaaattcat

SEQ ID NO: 621507 - DNA, 20 bp, Artificial
  CRISPR gRNA sequence
aaagtacttctagtgggaaa

SEQ ID NO: 621508 - DNA, 20 bp, Artificial
  CRISPR gRNA sequence
aggataatctttctgccata

SEQ ID NO: 621509 - DNA, 20 bp, Artificial
  CRISPR gRNA sequence
aatctttctgccatacgttg

SEQ ID NO: 621510 - DNA, 20 bp, Artificial
  CRISPR gRNA sequence
aaaagttacagcacttttgc

SEQ ID NO: 621511 - DNA, 20 bp, Artificial
  CRISPR gRNA sequence
taagtatggcgacttaaaac

SEQ ID NO: 621512 - DNA, 20 bp, Artificial
  CRISPR gRNA sequence
gctaagttctctaagaggta

SEQ ID NO: 621513 - DNA, 20 bp, Artificial
  CRISPR gRNA sequence
aaatagaaatcataatatac

SEQ ID NO: 621514 - DNA, 20 bp, Artificial
  CRISPR gRNA sequence
aagtactctgaaaagaataa

SEQ ID NO: 621515 - DNA, 20 bp, Artificial
  CRISPR gRNA sequence
agaataaactagattccctg

SEQ ID NO: 621516 - DNA, 20 bp, Artificial
  CRISPR gRNA sequence
aaaactagacttactacttc

SEQ ID NO: 621517 - DNA, 20 bp, Artificial
  CRISPR gRNA sequence
actgtacagttgatccactt

SEQ ID NO: 621518 - DNA, 20 bp, Artificial
  CRISPR gRNA sequence
gaaacagaaggaatcacaaa

SEQ ID NO: 621519 - DNA, 20 bp, Artificial
  CRISPR gRNA sequence
tctgatgggccgaaatacaa

SEQ ID NO: 621520 - DNA, 20 bp, Artificial
  CRISPR gRNA sequence
gttctgtctgagatgtctgt

SEQ ID NO: 621521 - DNA, 20 bp, Artificial
  CRISPR gRNA sequence
tctgtctcagattcttaagt

SEQ ID NO: 621522 - DNA, 20 bp, Artificial
  CRISPR gRNA sequence
tatactgtcatccctgacac

SEQ ID NO: 621523 - DNA, 20 bp, Artificial
  CRISPR gRNA sequence
gacatcctcattccagaaga

SEQ ID NO: 621524 - DNA, 20 bp, Artificial
  CRISPR gRNA sequence
ctaatacctcttacttcttc

SEQ ID NO: 621525 - DNA, 20 bp, Artificial
  CRISPR gRNA sequence
tcatcttagaagagttacca

SEQ ID NO: 621526 - DNA, 20 bp, Artificial
  CRISPR gRNA sequence
acttttctggccagaatgtt

SEQ ID NO: 621527 - DNA, 20 bp, Artificial
  CRISPR gRNA sequence
tttacttattttattttttt

SEQ ID NO: 621528 - DNA, 20 bp, Artificial
  CRISPR gRNA sequence
ctgctactagaaactgtctt

SEQ ID NO: 621529 - DNA, 20 bp, Artificial
  CRISPR gRNA sequence
taaaggttttcacatttact

SEQ ID NO: 621530 - DNA, 20 bp, Artificial
  CRISPR gRNA sequence
actttcaatcaaaattgcaa

SEQ ID NO: 621531 - DNA, 20 bp, Artificial
  CRISPR gRNA sequence
caaagtcaacaatgcatgta

SEQ ID NO: 621532 - DNA, 20 bp, Artificial
  CRISPR gRNA sequence
aaaccggtgatctcagacac

SEQ ID NO: 621533 - DNA, 20 bp, Artificial
  CRISPR gRNA sequence
gagagttcctctctatcact

SEQ ID NO: 621534 - DNA, 20 bp, Artificial
  CRISPR gRNA sequence
taaaaaactctctaccaaac

SEQ ID NO: 621535 - DNA, 20 bp, Artificial
  CRISPR gRNA sequence
ttgatcatgcctacactctg

SEQ ID NO: 621536 - DNA, 20 bp, Artificial
  CRISPR gRNA sequence
ctaggggatgacagtcaagt

SEQ ID NO: 621537 - DNA, 20 bp, Artificial
  CRISPR gRNA sequence
tactccctaccctatacatg

SEQ ID NO: 621538 - DNA, 20 bp, Artificial
  CRISPR gRNA sequence
ctagcaaaaaacatgaatgc

SEQ ID NO: 621539 - DNA, 20 bp, Artificial
  CRISPR gRNA sequence
atgaatgcaaaagattcatt

SEQ ID NO: 621540 - DNA, 20 bp, Artificial
  CRISPR gRNA sequence
tacattcacctgctaacttt

SEQ ID NO: 621541 - DNA, 20 bp, Artificial
  CRISPR gRNA sequence
aatgatacgggaattgtaag

SEQ ID NO: 621542 - DNA, 20 bp, Artificial
  CRISPR gRNA sequence
attcaatggtattctatata

SEQ ID NO: 621543 - DNA, 20 bp, Artificial
  CRISPR gRNA sequence
tcagtagtatttactaatta

SEQ ID NO: 621544 - DNA, 20 bp, Artificial
  CRISPR gRNA sequence
tatttactaattactaagct

SEQ ID NO: 621545 - DNA, 20 bp, Artificial
  CRISPR gRNA sequence
cttgcagttttataataact

SEQ ID NO: 621546 - DNA, 20 bp, Artificial
  CRISPR gRNA sequence
aaatatgctcataattaagt

SEQ ID NO: 621547 - DNA, 20 bp, Artificial
  CRISPR gRNA sequence
aaatctaaagtataaagaaa

SEQ ID NO: 621548 - DNA, 20 bp, Artificial
  CRISPR gRNA sequence
tttcaattacacttcacttc

SEQ ID NO: 621549 - DNA, 20 bp, Artificial
  CRISPR gRNA sequence
aacactgtaattttatcact

SEQ ID NO: 621550 - DNA, 20 bp, Artificial
  CRISPR gRNA sequence
tgtaattttatcactgacgg

SEQ ID NO: 621551 - DNA, 20 bp, Artificial
  CRISPR gRNA sequence
tgtgaagagtcctttggaag

SEQ ID NO: 621552 - DNA, 20 bp, Artificial
  CRISPR gRNA sequence
gttcagactagtaagcaggc

SEQ ID NO: 621553 - DNA, 20 bp, Artificial
  CRISPR gRNA sequence
aaaatcataaaatgaagact

SEQ ID NO: 621554 - DNA, 20 bp, Artificial
  CRISPR gRNA sequence
tgaggcatgctgtccattgg

SEQ ID NO: 621555 - DNA, 20 bp, Artificial
  CRISPR gRNA sequence
tcgggtgaaagctcattgtc

SEQ ID NO: 621556 - DNA, 20 bp, Artificial
  CRISPR gRNA sequence
gctttcacaaaatataatct

SEQ ID NO: 621557 - DNA, 20 bp, Artificial
  CRISPR gRNA sequence
acataagatgtaattactaa

SEQ ID NO: 621558 - DNA, 20 bp, Artificial
  CRISPR gRNA sequence
tattatctcaatacataagt

SEQ ID NO: 621559 - DNA, 20 bp, Artificial
  CRISPR gRNA sequence
agtgttgaactgctagctac

SEQ ID NO: 621560 - DNA, 20 bp, Artificial
  CRISPR gRNA sequence
taagtacactacttaactta

SEQ ID NO: 621561 - DNA, 20 bp, Artificial
  CRISPR gRNA sequence
aaagagtacagaattctcaa

SEQ ID NO: 621562 - DNA, 20 bp, Artificial
  CRISPR gRNA sequence
gttatatagccatcaatagc

SEQ ID NO: 621563 - DNA, 20 bp, Artificial
  CRISPR gRNA sequence
aaagtgcaatgctgcaaaac

SEQ ID NO: 621564 - DNA, 20 bp, Artificial
  CRISPR gRNA sequence
aaaagattatacccttaata

SEQ ID NO: 621565 - DNA, 20 bp, Artificial
  CRISPR gRNA sequence
ctgaactctttctgcaaatg

SEQ ID NO: 621566 - DNA, 20 bp, Artificial
  CRISPR gRNA sequence
actctcttaatcaaaattta

SEQ ID NO: 621567 - DNA, 20 bp, Artificial
  CRISPR gRNA sequence
agggggtatagctcaaatgt

SEQ ID NO: 621568 - DNA, 20 bp, Artificial
  CRISPR gRNA sequence
ctcaaatgtgtcagctttaa

SEQ ID NO: 621569 - DNA, 20 bp, Artificial
  CRISPR gRNA sequence
gtcagctttaactgggattt

SEQ ID NO: 621570 - DNA, 20 bp, Artificial
  CRISPR gRNA sequence
actacttcccacaatcacac

SEQ ID NO: 621571 - DNA, 20 bp, Artificial
  CRISPR gRNA sequence
cttagtgcccaacggtgtct

SEQ ID NO: 621572 - DNA, 20 bp, Artificial
  CRISPR gRNA sequence
aaccttaatttcctgccaga

SEQ ID NO: 621573 - DNA, 20 bp, Artificial
  CRISPR gRNA sequence
tgccaagcctacttaataca

SEQ ID NO: 621574 - DNA, 20 bp, Artificial
  CRISPR gRNA sequence
aactgtatgagatgacaccc

SEQ ID NO: 621575 - DNA, 20 bp, Artificial
  CRISPR gRNA sequence
tatgagatgacaccccctag

SEQ ID NO: 621576 - DNA, 20 bp, Artificial
  CRISPR gRNA sequence
taactgtattctgtggggaa

SEQ ID NO: 621577 - DNA, 20 bp, Artificial
  CRISPR gRNA sequence
ttaagaattgacaagtcctg

SEQ ID NO: 621578 - DNA, 20 bp, Artificial
  CRISPR gRNA sequence
tggccttggtcctttttgcc

SEQ ID NO: 621579 - DNA, 20 bp, Artificial
  CRISPR gRNA sequence
ccattacttactggaaaaca

SEQ ID NO: 621580 - DNA, 20 bp, Artificial
  CRISPR gRNA sequence
tgttatcacattcttttaaa

SEQ ID NO: 621581 - DNA, 20 bp, Artificial
  CRISPR gRNA sequence
tcttttaaattatgattaca

SEQ ID NO: 621582 - DNA, 20 bp, Artificial
  CRISPR gRNA sequence
gctttaaagaaagagatccg

SEQ ID NO: 621583 - DNA, 20 bp, Artificial
  CRISPR gRNA sequence
tccgtaaagtttaaaagagg

SEQ ID NO: 621584 - DNA, 20 bp, Artificial
  CRISPR gRNA sequence
tttcttcggatattttacaa

SEQ ID NO: 621585 - DNA, 20 bp, Artificial
  CRISPR gRNA sequence
tacatacaaaagaaattgtc

SEQ ID NO: 621586 - DNA, 20 bp, Artificial
  CRISPR gRNA sequence
agaaattgtcctttgattaa

SEQ ID NO: 621587 - DNA, 20 bp, Artificial
  CRISPR gRNA sequence
ttccagctctgtcgggagat

SEQ ID NO: 621588 - DNA, 20 bp, Artificial
  CRISPR gRNA sequence
ataaacggagggagaaagaa

SEQ ID NO: 621589 - DNA, 20 bp, Artificial
  CRISPR gRNA sequence
gggagaaagaaagaagtttt

SEQ ID NO: 621590 - DNA, 20 bp, Artificial
  CRISPR gRNA sequence
ggtcagtcagtgctatagca

SEQ ID NO: 621591 - DNA, 20 bp, Artificial
  CRISPR gRNA sequence
aacccaggccaacttcacag

SEQ ID NO: 621592 - DNA, 20 bp, Artificial
  CRISPR gRNA sequence
gcccatactagaacctgtca

SEQ ID NO: 621593 - DNA, 20 bp, Artificial
  CRISPR gRNA sequence
gtcaaagtgatttaactgct

SEQ ID NO: 621594 - DNA, 20 bp, Artificial
  CRISPR gRNA sequence
cctgtttacatgtgtcatac

SEQ ID NO: 621595 - DNA, 20 bp, Artificial
  CRISPR gRNA sequence
acatgtgtcataccagggtt

SEQ ID NO: 621596 - DNA, 20 bp, Artificial
  CRISPR gRNA sequence
tggatattaccttctatctg

SEQ ID NO: 621597 - DNA, 20 bp, Artificial
  CRISPR gRNA sequence
atgacagctatagagatgag

SEQ ID NO: 621598 - DNA, 20 bp, Artificial
  CRISPR gRNA sequence
tatagagatgagaactgatt

SEQ ID NO: 621599 - DNA, 20 bp, Artificial
  CRISPR gRNA sequence
taatcgattaacatcccaga

SEQ ID NO: 621600 - DNA, 20 bp, Artificial
  CRISPR gRNA sequence
ggcagaggacatcatcttca

SEQ ID NO: 621601 - DNA, 20 bp, Artificial
  CRISPR gRNA sequence
ttcaccacgcaaaagccaag

SEQ ID NO: 621602 - DNA, 20 bp, Artificial
  CRISPR gRNA sequence
gtaaaataatcccatcaccc

SEQ ID NO: 621603 - DNA, 20 bp, Artificial
  CRISPR gRNA sequence
taatcccatcacccttttgt

SEQ ID NO: 621604 - DNA, 20 bp, Artificial
  CRISPR gRNA sequence
ctttctttcctgtgcctaac

SEQ ID NO: 621605 - DNA, 20 bp, Artificial
  CRISPR gRNA sequence
ggatctgtagctaagggtaa

SEQ ID NO: 621606 - DNA, 20 bp, Artificial
  CRISPR gRNA sequence
agccgctcggcgcgctcggc

SEQ ID NO: 621607 - DNA, 20 bp, Artificial
  CRISPR gRNA sequence
cccccgacgggggccaggta

SEQ ID NO: 621608 - DNA, 20 bp, Artificial
  CRISPR gRNA sequence
tccccgtgtcataataaatc

SEQ ID NO: 621609 - DNA, 20 bp, Artificial
  CRISPR gRNA sequence
tctcacgttttctgccggct

SEQ ID NO: 621610 - DNA, 20 bp, Artificial
  CRISPR gRNA sequence
tgacgttcatttcggccgcg

SEQ ID NO: 621611 - DNA, 20 bp, Artificial
  CRISPR gRNA sequence
gcgtgaagttttctttcaaa

SEQ ID NO: 621612 - DNA, 20 bp, Artificial
  CRISPR gRNA sequence
ctcaactattactattttga

SEQ ID NO: 621613 - DNA, 20 bp, Artificial
  CRISPR gRNA sequence
tttgaaagtgctttaacagt

SEQ ID NO: 621614 - DNA, 20 bp, Artificial
  CRISPR gRNA sequence
gtttaaaaactaaagtgttg

SEQ ID NO: 621615 - DNA, 20 bp, Artificial
  CRISPR gRNA sequence
tgttacctatcactatcaac

SEQ ID NO: 621616 - DNA, 20 bp, Artificial
  CRISPR gRNA sequence
acctatcactatcaaccaca

SEQ ID NO: 621617 - DNA, 20 bp, Artificial
  CRISPR gRNA sequence
gtgttcctgagaaaccatat

SEQ ID NO: 621618 - DNA, 20 bp, Artificial
  CRISPR gRNA sequence
agaatcccagaaatagttgt

SEQ ID NO: 621619 - DNA, 20 bp, Artificial
  CRISPR gRNA sequence
ccatataacttgtgtgatac

SEQ ID NO: 621620 - DNA, 20 bp, Artificial
  CRISPR gRNA sequence
tttataatgaattacttctt

SEQ ID NO: 621621 - DNA, 20 bp, Artificial
  CRISPR gRNA sequence
caattgtaacgatagtctct

SEQ ID NO: 621622 - DNA, 20 bp, Artificial
  CRISPR gRNA sequence
tagatagtgtggtacagcaa

SEQ ID NO: 621623 - DNA, 20 bp, Artificial
  CRISPR gRNA sequence
tggagagaaattatttgggc

SEQ ID NO: 621624 - DNA, 20 bp, Artificial
  CRISPR gRNA sequence
tcaggcttgcaataacatta

SEQ ID NO: 621625 - DNA, 20 bp, Artificial
  CRISPR gRNA sequence
tgtgagttatatattgataa

SEQ ID NO: 621626 - DNA, 20 bp, Artificial
  CRISPR gRNA sequence
ttaaacacttagttgctaaa

SEQ ID NO: 621627 - DNA, 20 bp, Artificial
  CRISPR gRNA sequence
attacctcaaaaaatctgta

SEQ ID NO: 621628 - DNA, 20 bp, Artificial
  CRISPR gRNA sequence
ccttcctaaaaactgaacct

SEQ ID NO: 621629 - DNA, 20 bp, Artificial
  CRISPR gRNA sequence
gaaattaagatgaaatgtct

SEQ ID NO: 621630 - DNA, 20 bp, Artificial
  CRISPR gRNA sequence
aagttgatgtagtccttgcc

SEQ ID NO: 621631 - DNA, 20 bp, Artificial
  CRISPR gRNA sequence
agtccttgcccctggtttat

SEQ ID NO: 621632 - DNA, 20 bp, Artificial
  CRISPR gRNA sequence
cctggtttattgaagcttaa

SEQ ID NO: 621633 - DNA, 20 bp, Artificial
  CRISPR gRNA sequence
cactttctccctctagtggc

SEQ ID NO: 621634 - DNA, 20 bp, Artificial
  CRISPR gRNA sequence
ctgcctccccctgaatggat

SEQ ID NO: 621635 - DNA, 20 bp, Artificial
  CRISPR gRNA sequence
gagaattggaccatcttggc

SEQ ID NO: 621636 - DNA, 20 bp, Artificial
  CRISPR gRNA sequence
atctaactcatccagagaaa

SEQ ID NO: 621637 - DNA, 20 bp, Artificial
  CRISPR gRNA sequence
ctcatccagagaaatcaaga

SEQ ID NO: 621638 - DNA, 20 bp, Artificial
  CRISPR gRNA sequence
atcaagattatgttttcata

SEQ ID NO: 621639 - DNA, 20 bp, Artificial
  CRISPR gRNA sequence
tatgttttcataccaagatt

SEQ ID NO: 621640 - DNA, 20 bp, Artificial
  CRISPR gRNA sequence
tgcctgtggagtctatagtc

SEQ ID NO: 621641 - DNA, 20 bp, Artificial
  CRISPR gRNA sequence
ctttgttcagaatttctctg

SEQ ID NO: 621642 - DNA, 20 bp, Artificial
  CRISPR gRNA sequence
ttcagaatttctctgggtag

SEQ ID NO: 621643 - DNA, 20 bp, Artificial
  CRISPR gRNA sequence
gaatttctctgggtagtttt

SEQ ID NO: 621644 - DNA, 20 bp, Artificial
  CRISPR gRNA sequence
ctgggtagttttgtttgttt

SEQ ID NO: 621645 - DNA, 20 bp, Artificial
  CRISPR gRNA sequence
agttttgtttgtttgttcgt

SEQ ID NO: 621646 - DNA, 20 bp, Artificial
  CRISPR gRNA sequence
tgtttgtttgttcgttttgg

SEQ ID NO: 621647 - DNA, 20 bp, Artificial
  CRISPR gRNA sequence
ccgtctcggctcactacaat

SEQ ID NO: 621648 - DNA, 20 bp, Artificial
  CRISPR gRNA sequence
aatctctgcttcctgggttc

SEQ ID NO: 621649 - DNA, 20 bp, Artificial
  CRISPR gRNA sequence
aatcgcatgaacccaggaag

SEQ ID NO: 621650 - DNA, 20 bp, Artificial
  CRISPR gRNA sequence
aaattctgaacaaagtgaat

SEQ ID NO: 621651 - DNA, 20 bp, Artificial
  CRISPR gRNA sequence
tgcaagggttctttcccatg

SEQ ID NO: 621652 - DNA, 20 bp, Artificial
  CRISPR gRNA sequence
atcttggtatgaaaacataa

SEQ ID NO: 621653 - DNA, 20 bp, Artificial
  CRISPR gRNA sequence
aaagttaactcttgaaaagg

SEQ ID NO: 621654 - DNA, 20 bp, Artificial
  CRISPR gRNA sequence
ccagcttcaaggaagctaaa

SEQ ID NO: 621655 - DNA, 20 bp, Artificial
  CRISPR gRNA sequence
gtaactgtgaggatgtatct

SEQ ID NO: 621656 - DNA, 20 bp, Artificial
  CRISPR gRNA sequence
tatcagacatttcatcttaa

SEQ ID NO: 621657 - DNA, 20 bp, Artificial
  CRISPR gRNA sequence
cagatacctaaacacttagg

SEQ ID NO: 621658 - DNA, 20 bp, Artificial
  CRISPR gRNA sequence
tttacatattataaacgaca

SEQ ID NO: 621659 - DNA, 20 bp, Artificial
  CRISPR gRNA sequence
aaaatatttgctctctgttg

SEQ ID NO: 621660 - DNA, 20 bp, Artificial
  CRISPR gRNA sequence
gaaaactaattttagcaact

SEQ ID NO: 621661 - DNA, 20 bp, Artificial
  CRISPR gRNA sequence
ctccaacgaaaatttgttaa

SEQ ID NO: 621662 - DNA, 20 bp, Artificial
  CRISPR gRNA sequence
caaaaagagactatcgttac

SEQ ID NO: 621663 - DNA, 20 bp, Artificial
  CRISPR gRNA sequence
aagttatatggtatccatta

SEQ ID NO: 621664 - DNA, 20 bp, Artificial
  CRISPR gRNA sequence
atccaaaattacctacagag

SEQ ID NO: 621665 - DNA, 20 bp, Artificial
  CRISPR gRNA sequence
aaaaacctcaacaactattt

SEQ ID NO: 621666 - DNA, 20 bp, Artificial
  CRISPR gRNA sequence
gcctgttccgactcttctag

SEQ ID NO: 621667 - DNA, 20 bp, Artificial
  CRISPR gRNA sequence
attttcttcacaatctgtga

SEQ ID NO: 621668 - DNA, 20 bp, Artificial
  CRISPR gRNA sequence
gtgatatggtttctcaggaa

SEQ ID NO: 621669 - DNA, 20 bp, Artificial
  CRISPR gRNA sequence
ttggcagtcctgataatttc

SEQ ID NO: 621670 - DNA, 20 bp, Artificial
  CRISPR gRNA sequence
tatttgtagaaagaatatgc

SEQ ID NO: 621671 - DNA, 20 bp, Artificial
  CRISPR gRNA sequence
gagaaaaagcaagtcaacac

SEQ ID NO: 621672 - DNA, 20 bp, Artificial
  CRISPR gRNA sequence
cactttcaaaatagtaatag

SEQ ID NO: 621673 - DNA, 20 bp, Artificial
  CRISPR gRNA sequence
attccccaggacccctctta

SEQ ID NO: 621674 - DNA, 20 bp, Artificial
  CRISPR gRNA sequence
ttcaggtcccggtcaatgcg

SEQ ID NO: 621675 - DNA, 20 bp, Artificial
  CRISPR gRNA sequence
cccccggcctccccaccaat

SEQ ID NO: 621676 - DNA, 20 bp, Artificial
  CRISPR gRNA sequence
gcctccagccggcagaaaac

SEQ ID NO: 621677 - DNA, 20 bp, Artificial
  CRISPR gRNA sequence
cggggcagcacttgtcctgt

SEQ ID NO: 621678 - DNA, 20 bp, Artificial
  CRISPR gRNA sequence
atcgattgccgagcgcgccg

SEQ ID NO: 621679 - DNA, 20 bp, Artificial
  CRISPR gRNA sequence
atgtgctcgggctccaccgg

SEQ ID NO: 621680 - DNA, 20 bp, Artificial
  CRISPR gRNA sequence
gctccaccggatcggtttct

SEQ ID NO: 621681 - DNA, 20 bp, Artificial
  CRISPR gRNA sequence
tgaagatggaggaagtaaaa

SEQ ID NO: 621682 - DNA, 20 bp, Artificial
  CRISPR gRNA sequence
cttagctacagatccactgc

SEQ ID NO: 621683 - DNA, 20 bp, Artificial
  CRISPR gRNA sequence
taaacacaaacaaaagggtg

SEQ ID NO: 621684 - DNA, 20 bp, Artificial
  CRISPR gRNA sequence
catgcactgctgaggtaaat

SEQ ID NO: 621685 - DNA, 20 bp, Artificial
  CRISPR gRNA sequence
actgctgaggtaaatctccg

SEQ ID NO: 621686 - DNA, 20 bp, Artificial
  CRISPR gRNA sequence
tttgcgtggtgaagaacagc

SEQ ID NO: 621687 - DNA, 20 bp, Artificial
  CRISPR gRNA sequence
agaacagctcttgttttgtc

SEQ ID NO: 621688 - DNA, 20 bp, Artificial
  CRISPR gRNA sequence
tcttgttttgtcttctgatt

SEQ ID NO: 621689 - DNA, 20 bp, Artificial
  CRISPR gRNA sequence
tagattatatataaatatgt

SEQ ID NO: 621690 - DNA, 20 bp, Artificial
  CRISPR gRNA sequence
tgtatgatttgcaaaggggg

SEQ ID NO: 621691 - DNA, 20 bp, Artificial
  CRISPR gRNA sequence
ttaagtgtaattatatagca

SEQ ID NO: 621692 - DNA, 20 bp, Artificial
  CRISPR gRNA sequence
aggtatttttctctgggagg

SEQ ID NO: 621693 - DNA, 20 bp, Artificial
  CRISPR gRNA sequence
ctgggagggatggattgtgg

SEQ ID NO: 621694 - DNA, 20 bp, Artificial
  CRISPR gRNA sequence
gattgtggttctgattaggg

SEQ ID NO: 621695 - DNA, 20 bp, Artificial
  CRISPR gRNA sequence
tttatcgtcccctccttgta

SEQ ID NO: 621696 - DNA, 20 bp, Artificial
  CRISPR gRNA sequence
taatctgtttctgggatgtt

SEQ ID NO: 621697 - DNA, 20 bp, Artificial
  CRISPR gRNA sequence
tatagctgtcatgaatttgg

SEQ ID NO: 621698 - DNA, 20 bp, Artificial
  CRISPR gRNA sequence
ctgtcatgaatttggacttg

SEQ ID NO: 621699 - DNA, 20 bp, Artificial
  CRISPR gRNA sequence
atgaatttggacttgttttg

SEQ ID NO: 621700 - DNA, 20 bp, Artificial
  CRISPR gRNA sequence
tttaacttgaattccaagaa

SEQ ID NO: 621701 - DNA, 20 bp, Artificial
  CRISPR gRNA sequence
tatgggcgaaagagatggaa

SEQ ID NO: 621702 - DNA, 20 bp, Artificial
  CRISPR gRNA sequence
ccgcccccccccccttttct

SEQ ID NO: 621703 - DNA, 20 bp, Artificial
  CRISPR gRNA sequence
ttttctttcagttttcttgt

SEQ ID NO: 621704 - DNA, 20 bp, Artificial
  CRISPR gRNA sequence
gttttcttgtcttagctttt

SEQ ID NO: 621705 - DNA, 20 bp, Artificial
  CRISPR gRNA sequence
attcttaaggaaccggtgga

SEQ ID NO: 621706 - DNA, 20 bp, Artificial
  CRISPR gRNA sequence
ggtgttcttctctctcattt

SEQ ID NO: 621707 - DNA, 20 bp, Artificial
  CRISPR gRNA sequence
tcttctctctcatttcttgg

SEQ ID NO: 621708 - DNA, 20 bp, Artificial
  CRISPR gRNA sequence
ttggttttgtttatcagccg

SEQ ID NO: 621709 - DNA, 20 bp, Artificial
  CRISPR gRNA sequence
gtttatcagccgatctgttt

SEQ ID NO: 621710 - DNA, 20 bp, Artificial
  CRISPR gRNA sequence
agccgatctgtttgctggat

SEQ ID NO: 621711 - DNA, 20 bp, Artificial
  CRISPR gRNA sequence
cttggaatgacccacctgta

SEQ ID NO: 621712 - DNA, 20 bp, Artificial
  CRISPR gRNA sequence
tcctccccttgaactctgca

SEQ ID NO: 621713 - DNA, 20 bp, Artificial
  CRISPR gRNA sequence
cccttgaactctgcaggggg

SEQ ID NO: 621714 - DNA, 20 bp, Artificial
  CRISPR gRNA sequence
aaaaacttctttctttctcc

SEQ ID NO: 621715 - DNA, 20 bp, Artificial
  CRISPR gRNA sequence
caatttcttttgtatgtaca

SEQ ID NO: 621716 - DNA, 20 bp, Artificial
  CRISPR gRNA sequence
tcattgatggggcagccttc

SEQ ID NO: 621717 - DNA, 20 bp, Artificial
  CRISPR gRNA sequence
agccttctttcgcttctccc

SEQ ID NO: 621718 - DNA, 20 bp, Artificial
  CRISPR gRNA sequence
gtgactgagttgggaatttg

SEQ ID NO: 621719 - DNA, 20 bp, Artificial
  CRISPR gRNA sequence
tattccataaagaaagaaat

SEQ ID NO: 621720 - DNA, 20 bp, Artificial
  CRISPR gRNA sequence
gggaggggagggagaaggga

SEQ ID NO: 621721 - DNA, 20 bp, Artificial
  CRISPR gRNA sequence
tggagacaagaagtgaagct

SEQ ID NO: 621722 - DNA, 20 bp, Artificial
  CRISPR gRNA sequence
aatttagctgctggtgcagt

SEQ ID NO: 621723 - DNA, 20 bp, Artificial
  CRISPR gRNA sequence
ttttttccccacagaataca

SEQ ID NO: 621724 - DNA, 20 bp, Artificial
  CRISPR gRNA sequence
agctagggggtgtcatctca

SEQ ID NO: 621725 - DNA, 20 bp, Artificial
  CRISPR gRNA sequence
tgtcatctcatacagtttac

SEQ ID NO: 621726 - DNA, 20 bp, Artificial
  CRISPR gRNA sequence
gagaattatgttctgttgtg

SEQ ID NO: 621727 - DNA, 20 bp, Artificial
  CRISPR gRNA sequence
tgtgcatgagaataattgcc

SEQ ID NO: 621728 - DNA, 20 bp, Artificial
  CRISPR gRNA sequence
ccaaagtttttttttttttt

SEQ ID NO: 621729 - DNA, 20 bp, Artificial
  CRISPR gRNA sequence
atgattctctctagcacaac

SEQ ID NO: 621730 - DNA, 20 bp, Artificial
  CRISPR gRNA sequence
tcaaaatcagactgtattaa

SEQ ID NO: 621731 - DNA, 20 bp, Artificial
  CRISPR gRNA sequence
aaattaaggttacattgaac

SEQ ID NO: 621732 - DNA, 20 bp, Artificial
  CRISPR gRNA sequence
cttcaagacaccgttgggca

SEQ ID NO: 621733 - DNA, 20 bp, Artificial
  CRISPR gRNA sequence
acaccgttgggcactaagtt

SEQ ID NO: 621734 - DNA, 20 bp, Artificial
  CRISPR gRNA sequence
gttgggcactaagttttttg

SEQ ID NO: 621735 - DNA, 20 bp, Artificial
  CRISPR gRNA sequence
gcactaagttttttgttttg

SEQ ID NO: 621736 - DNA, 20 bp, Artificial
  CRISPR gRNA sequence
ttttgttttgttttgttttc

SEQ ID NO: 621737 - DNA, 20 bp, Artificial
  CRISPR gRNA sequence
gttttgttttgttttcttat

SEQ ID NO: 621738 - DNA, 20 bp, Artificial
  CRISPR gRNA sequence
ggggaagtcctcaaactgca

SEQ ID NO: 621739 - DNA, 20 bp, Artificial
  CRISPR gRNA sequence
tttttcttaaacccaataaa

SEQ ID NO: 621740 - DNA, 20 bp, Artificial
  CRISPR gRNA sequence
gagcacatacagtacactgt

SEQ ID NO: 621741 - DNA, 20 bp, Artificial
  CRISPR gRNA sequence
tggcagcagcaacatggact

SEQ ID NO: 621742 - DNA, 20 bp, Artificial
  CRISPR gRNA sequence
agcaacatggactaactgct

SEQ ID NO: 621743 - DNA, 20 bp, Artificial
  CRISPR gRNA sequence
attgtattaagggtataatc

SEQ ID NO: 621744 - DNA, 20 bp, Artificial
  CRISPR gRNA sequence
tggctatataacgtgtaagt

SEQ ID NO: 621745 - DNA, 20 bp, Artificial
  CRISPR gRNA sequence
aacgtgtaagtattagtttt

SEQ ID NO: 621746 - DNA, 20 bp, Artificial
  CRISPR gRNA sequence
taaagttgcctttgtattac

SEQ ID NO: 621747 - DNA, 20 bp, Artificial
  CRISPR gRNA sequence
gtattacctgtgttttaatt

SEQ ID NO: 621748 - DNA, 20 bp, Artificial
  CRISPR gRNA sequence
gttcacaatttcacctttga

SEQ ID NO: 621749 - DNA, 20 bp, Artificial
  CRISPR gRNA sequence
tgttgtaagttgagaatagg

SEQ ID NO: 621750 - DNA, 20 bp, Artificial
  CRISPR gRNA sequence
gacatattatgtgaaagaga

SEQ ID NO: 621751 - DNA, 20 bp, Artificial
  CRISPR gRNA sequence
aaatgctcattataaattct

SEQ ID NO: 621752 - DNA, 20 bp, Artificial
  CRISPR gRNA sequence
caacttatgtattgagataa

SEQ ID NO: 621753 - DNA, 20 bp, Artificial
  CRISPR gRNA sequence
tgttaattttttttattgtg

SEQ ID NO: 621754 - DNA, 20 bp, Artificial
  CRISPR gRNA sequence
tttttttattgtgggttgat

SEQ ID NO: 621755 - DNA, 20 bp, Artificial
  CRISPR gRNA sequence
atttctaaatgatatttcct

SEQ ID NO: 621756 - DNA, 20 bp, Artificial
  CRISPR gRNA sequence
aagggaaaaatgtattacct

SEQ ID NO: 621757 - DNA, 20 bp, Artificial
  CRISPR gRNA sequence
tgtgacaatgaatagaaacc

SEQ ID NO: 621758 - DNA, 20 bp, Artificial
  CRISPR gRNA sequence
ttttgtgaaagcaggtgaca

SEQ ID NO: 621759 - DNA, 20 bp, Artificial
  CRISPR gRNA sequence
acaagcagtaagtcttcatt

SEQ ID NO: 621760 - DNA, 20 bp, Artificial
  CRISPR gRNA sequence
cattgtggtatagctactgt

SEQ ID NO: 621761 - DNA, 20 bp, Artificial
  CRISPR gRNA sequence
ttttgctaaagaaagaacaa

SEQ ID NO: 621762 - DNA, 20 bp, Artificial
  CRISPR gRNA sequence
tctagtattataaaacatga

SEQ ID NO: 621763 - DNA, 20 bp, Artificial
  CRISPR gRNA sequence
ccaaggtggcatttgggagc

SEQ ID NO: 621764 - DNA, 20 bp, Artificial
  CRISPR gRNA sequence
aaaggttagaatttgctggt

SEQ ID NO: 621765 - DNA, 20 bp, Artificial
  CRISPR gRNA sequence
ctggttgttgttttgacttg

SEQ ID NO: 621766 - DNA, 20 bp, Artificial
  CRISPR gRNA sequence
tttgacttgccaggtttatg

SEQ ID NO: 621767 - DNA, 20 bp, Artificial
  CRISPR gRNA sequence
agtgataaaattacagtgtt

SEQ ID NO: 621768 - DNA, 20 bp, Artificial
  CRISPR gRNA sequence
tacttgcttttaaaaaatgt

SEQ ID NO: 621769 - DNA, 20 bp, Artificial
  CRISPR gRNA sequence
ccatttctgtagcaaagttg

SEQ ID NO: 621770 - DNA, 20 bp, Artificial
  CRISPR gRNA sequence
agaactgataaaatttggaa

SEQ ID NO: 621771 - DNA, 20 bp, Artificial
  CRISPR gRNA sequence
gttttgaatttgtaggaaaa

SEQ ID NO: 621772 - DNA, 20 bp, Artificial
  CRISPR gRNA sequence
taggaaaagacagttttggc

SEQ ID NO: 621773 - DNA, 20 bp, Artificial
  CRISPR gRNA sequence
tcatttactgatgtaatata

SEQ ID NO: 621774 - DNA, 20 bp, Artificial
  CRISPR gRNA sequence
aaatactttattaagaatat

SEQ ID NO: 621775 - DNA, 20 bp, Artificial
  CRISPR gRNA sequence
tttcttaattataatatttt

SEQ ID NO: 621776 - DNA, 20 bp, Artificial
  CRISPR gRNA sequence
tcagtttagttatcaagtgc

SEQ ID NO: 621777 - DNA, 20 bp, Artificial
  CRISPR gRNA sequence
tactcaaaagtaatttgaaa

SEQ ID NO: 621778 - DNA, 20 bp, Artificial
  CRISPR gRNA sequence
aaatcttgttttctttatac

SEQ ID NO: 621779 - DNA, 20 bp, Artificial
  CRISPR gRNA sequence
atgtaaatataattaaattt

SEQ ID NO: 621780 - DNA, 20 bp, Artificial
  CRISPR gRNA sequence
tataattaaatttacaagtt

SEQ ID NO: 621781 - DNA, 20 bp, Artificial
  CRISPR gRNA sequence
tctctttccttccccccccc

SEQ ID NO: 621782 - DNA, 20 bp, Artificial
  CRISPR gRNA sequence
ctgtaagttattataaaact

SEQ ID NO: 621783 - DNA, 20 bp, Artificial
  CRISPR gRNA sequence
ttttagctattgacttgaaa

SEQ ID NO: 621784 - DNA, 20 bp, Artificial
  CRISPR gRNA sequence
ctattgacttgaaattatga

SEQ ID NO: 621785 - DNA, 20 bp, Artificial
  CRISPR gRNA sequence
gaaattatgattgagtttga

SEQ ID NO: 621786 - DNA, 20 bp, Artificial
  CRISPR gRNA sequence
tcataatgaatcttttgcat

SEQ ID NO: 621787 - DNA, 20 bp, Artificial
  CRISPR gRNA sequence
ttgcattcatgttttttgct

SEQ ID NO: 621788 - DNA, 20 bp, Artificial
  CRISPR gRNA sequence
aatatactagttatttggtg

SEQ ID NO: 621789 - DNA, 20 bp, Artificial
  CRISPR gRNA sequence
aagagtaaaaagagataata

SEQ ID NO: 621790 - DNA, 20 bp, Artificial
  CRISPR gRNA sequence
gtagtttctattagttagct

SEQ ID NO: 621791 - DNA, 20 bp, Artificial
  CRISPR gRNA sequence
ccctagacacaaccacagga

SEQ ID NO: 621792 - DNA, 20 bp, Artificial
  CRISPR gRNA sequence
tgcttgtcaagtggttaatt

SEQ ID NO: 621793 - DNA, 20 bp, Artificial
  CRISPR gRNA sequence
attggctgctttatttctga

SEQ ID NO: 621794 - DNA, 20 bp, Artificial
  CRISPR gRNA sequence
gctttatttctgaatttgat

SEQ ID NO: 621795 - DNA, 20 bp, Artificial
  CRISPR gRNA sequence
ttgattctggttttgcaagt

SEQ ID NO: 621796 - DNA, 20 bp, Artificial
  CRISPR gRNA sequence
tcaatttgaacaaataagaa

SEQ ID NO: 621797 - DNA, 20 bp, Artificial
  CRISPR gRNA sequence
aagaactgtgcttttgacat

SEQ ID NO: 621798 - DNA, 20 bp, Artificial
  CRISPR gRNA sequence
ctcacccaacaacagtaaac

SEQ ID NO: 621799 - DNA, 20 bp, Artificial
  CRISPR gRNA sequence
cagtaaacttatgtttggta

SEQ ID NO: 621800 - DNA, 20 bp, Artificial
  CRISPR gRNA sequence
tgtggcaattccatgttagt

SEQ ID NO: 621801 - DNA, 20 bp, Artificial
  CRISPR gRNA sequence
acaggttttggctaagatgc

SEQ ID NO: 621802 - DNA, 20 bp, Artificial
  CRISPR gRNA sequence
atctaggagaatatcagcat

SEQ ID NO: 621803 - DNA, 20 bp, Artificial
  CRISPR gRNA sequence
agacctagaattggtcactc

SEQ ID NO: 621804 - DNA, 20 bp, Artificial
  CRISPR gRNA sequence
aatcacttgtgtctgagatc

SEQ ID NO: 621805 - DNA, 20 bp, Artificial
  CRISPR gRNA sequence
ccctttacatgcattgttga

SEQ ID NO: 621806 - DNA, 20 bp, Artificial
  CRISPR gRNA sequence
aaatatacttcctggagggt

SEQ ID NO: 621807 - DNA, 20 bp, Artificial
  CRISPR gRNA sequence
ttccaaaaacagaattgcaa

SEQ ID NO: 621808 - DNA, 20 bp, Artificial
  CRISPR gRNA sequence
gtaaatgtgaaaacctttaa

SEQ ID NO: 621809 - DNA, 20 bp, Artificial
  CRISPR gRNA sequence
aggcatgagagctcacttat

SEQ ID NO: 621810 - DNA, 20 bp, Artificial
  CRISPR gRNA sequence
tactactgtaaggtcccagc

SEQ ID NO: 621811 - DNA, 20 bp, Artificial
  CRISPR gRNA sequence
ttggtaactcttctaagatg

SEQ ID NO: 621812 - DNA, 20 bp, Artificial
  CRISPR gRNA sequence
ctaaaaatgttataatgcct

SEQ ID NO: 621813 - DNA, 20 bp, Artificial
  CRISPR gRNA sequence
tgttataatgcctgacagtt

SEQ ID NO: 621814 - DNA, 20 bp, Artificial
  CRISPR gRNA sequence
attttataatgactacttcc

SEQ ID NO: 621815 - DNA, 20 bp, Artificial
  CRISPR gRNA sequence
tattggaaatacacagtgtt

SEQ ID NO: 621816 - DNA, 20 bp, Artificial
  CRISPR gRNA sequence
cccatcagatgaaacttact

SEQ ID NO: 621817 - DNA, 20 bp, Artificial
  CRISPR gRNA sequence
gaaacttactttgtgattcc

SEQ ID NO: 621818 - DNA, 20 bp, Artificial
  CRISPR gRNA sequence
ttcttgcatagttgttcagt

SEQ ID NO: 621819 - DNA, 20 bp, Artificial
  CRISPR gRNA sequence
tggcaggtgactattttgaa

SEQ ID NO: 621820 - DNA, 20 bp, Artificial
  CRISPR gRNA sequence
ttttcttatctattttttta

SEQ ID NO: 621821 - DNA, 20 bp, Artificial
  CRISPR gRNA sequence
aaaatacatcatgatgcaaa

SEQ ID NO: 621822 - DNA, 20 bp, Artificial
  CRISPR gRNA sequence
gaatcggaagaagtagtaag

SEQ ID NO: 621823 - DNA, 20 bp, Artificial
  CRISPR gRNA sequence
ccaataatcaggtcagggaa

SEQ ID NO: 621824 - DNA, 20 bp, Artificial
  CRISPR gRNA sequence
tcacattaatttttttctta

SEQ ID NO: 621825 - DNA, 20 bp, Artificial
  CRISPR gRNA sequence
cctagcgaagcagaagtata

SEQ ID NO: 621826 - DNA, 20 bp, Artificial
  CRISPR gRNA sequence
tatttttcatatgtggaaat

SEQ ID NO: 621827 - DNA, 20 bp, Artificial
  CRISPR gRNA sequence
ttagcagaaagatgaagtta

SEQ ID NO: 621828 - DNA, 20 bp, Artificial
  CRISPR gRNA sequence
tattatgagggtggagtgat

SEQ ID NO: 621829 - DNA, 20 bp, Artificial
  CRISPR gRNA sequence
gagcctatattatgggactt

SEQ ID NO: 621830 - DNA, 20 bp, Artificial
  CRISPR gRNA sequence
ttatgggacttaccagcttt

SEQ ID NO: 621831 - DNA, 20 bp, Artificial
  CRISPR gRNA sequence
cagctttctgagttttcttc

SEQ ID NO: 621832 - DNA, 20 bp, Artificial
  CRISPR gRNA sequence
ttctgagttttcttctgtag

SEQ ID NO: 621833 - DNA, 20 bp, Artificial
  CRISPR gRNA sequence
tagcttagtttggcagtcac

SEQ ID NO: 621834 - DNA, 20 bp, Artificial
  CRISPR gRNA sequence
tagtttggcagtcacccttg

SEQ ID NO: 621835 - DNA, 20 bp, Artificial
  CRISPR gRNA sequence
acaccctaatataacaccag

SEQ ID NO: 621836 - DNA, 20 bp, Artificial
  CRISPR gRNA sequence
gatgggcttgatagaaaatc

SEQ ID NO: 621837 - DNA, 20 bp, Artificial
  CRISPR gRNA sequence
tctgttttaagtcgccatac

SEQ ID NO: 621838 - DNA, 20 bp, Artificial
  CRISPR gRNA sequence
caatgtactttacatttagt

SEQ ID NO: 621839 - DNA, 20 bp, Artificial
  CRISPR gRNA sequence
agggaattaaataaaaatag

SEQ ID NO: 621840 - DNA, 20 bp, Artificial
  CRISPR gRNA sequence
aaaaaggaaagtaaaagagg

SEQ ID NO: 621841 - DNA, 20 bp, Artificial
  CRISPR gRNA sequence
cccaactccctatcttttta

SEQ ID NO: 621842 - DNA, 20 bp, Artificial
  CRISPR gRNA sequence
gcttagtactgagaattaaa

SEQ ID NO: 621843 - DNA, 20 bp, Artificial
  CRISPR gRNA sequence
aaacaaaacaacgtatggca

SEQ ID NO: 621844 - DNA, 20 bp, Artificial
  CRISPR gRNA sequence
tttttaaaaaaaggtaacac

SEQ ID NO: 621845 - DNA, 20 bp, Artificial
  CRISPR gRNA sequence
tcctaaaatgaggtagaata

SEQ ID NO: 621846 - DNA, 20 bp, Artificial
  CRISPR gRNA sequence
ctttacttttttcccttctt

SEQ ID NO: 621847 - DNA, 20 bp, Artificial
  CRISPR gRNA sequence
ttaattgagacccaatatac

SEQ ID NO: 621848 - DNA, 20 bp, Artificial
  CRISPR gRNA sequence
ataggtaaggaatatttagg

SEQ ID NO: 621849 - DNA, 20 bp, Artificial
  CRISPR gRNA sequence
ttgagtgcacttagtatgct

SEQ ID NO: 621850 - DNA, 20 bp, Artificial
  CRISPR gRNA sequence
gactgtgagtggttaaaaat

SEQ ID NO: 621851 - DNA, 20 bp, Artificial
  CRISPR gRNA sequence
atgctggcctgggttagaat

SEQ ID NO: 621852 - DNA, 20 bp, Artificial
  CRISPR gRNA sequence
gtcacttcacatctctgagc

SEQ ID NO: 621853 - DNA, 20 bp, Artificial
  CRISPR gRNA sequence
acctacctcaatgggctgtt

SEQ ID NO: 621854 - DNA, 20 bp, Artificial
  CRISPR gRNA sequence
gacctatgacttgtaagaaa

SEQ ID NO: 621855 - DNA, 20 bp, Artificial
  CRISPR gRNA sequence
tatgacttgtaagaaaaagg

SEQ ID NO: 621856 - DNA, 20 bp, Artificial
  CRISPR gRNA sequence
acaggtccagggaagaaaga

SEQ ID NO: 621857 - DNA, 20 bp, Artificial
  CRISPR gRNA sequence
tccgttatttaaagcatcta

SEQ ID NO: 621858 - DNA, 20 bp, Artificial
  CRISPR gRNA sequence
gattttggttaagaaagaaa

SEQ ID NO: 621859 - DNA, 20 bp, Artificial
  CRISPR gRNA sequence
tggcgctcaacattcctgag

SEQ ID NO: 621860 - DNA, 20 bp, Artificial
  CRISPR gRNA sequence
aacattcctgagtatagttt

SEQ ID NO: 621861 - DNA, 20 bp, Artificial
  CRISPR gRNA sequence
atctaaaatctaacctcatt

SEQ ID NO: 621862 - DNA, 20 bp, Artificial
  CRISPR gRNA sequence
tgatgatacctaataaaatt

SEQ ID NO: 621863 - DNA, 20 bp, Artificial
  CRISPR gRNA sequence
aataaaattgttggtttaat

SEQ ID NO: 621864 - DNA, 20 bp, Artificial
  CRISPR gRNA sequence
tgattgtgcacttcgggggt

SEQ ID NO: 621865 - DNA, 20 bp, Artificial
  CRISPR gRNA sequence
ttagatgttctaaatttgaa

SEQ ID NO: 621866 - DNA, 20 bp, Artificial
  CRISPR gRNA sequence
aaatagggcattttactgta

SEQ ID NO: 621867 - DNA, 20 bp, Artificial
  CRISPR gRNA sequence
ttactgtagtaagcttagtg

SEQ ID NO: 621868 - DNA, 20 bp, Artificial
  CRISPR gRNA sequence
aaatattttttagaggggga

SEQ ID NO: 621869 - DNA, 20 bp, Artificial
  CRISPR gRNA sequence
agccgagacttattaaatga

SEQ ID NO: 621870 - DNA, 20 bp, Artificial
  CRISPR gRNA sequence
gcaatattctgggaaataca

SEQ ID NO: 621871 - DNA, 20 bp, Artificial
  CRISPR gRNA sequence
acatcttgtatgagaggaaa

SEQ ID NO: 621872 - DNA, 20 bp, Artificial
  CRISPR gRNA sequence
cttttattttcatggaagtc

SEQ ID NO: 621873 - DNA, 20 bp, Artificial
  CRISPR gRNA sequence
tcagtcttttgactgacatg

SEQ ID NO: 621874 - DNA, 20 bp, Artificial
  CRISPR gRNA sequence
cttttgactgacatggatcg

SEQ ID NO: 621875 - DNA, 20 bp, Artificial
  CRISPR gRNA sequence
atttgattacaatgtgggga

SEQ ID NO: 621876 - DNA, 20 bp, Artificial
  CRISPR gRNA sequence
aggcaggtgcatatttaaca

SEQ ID NO: 621877 - DNA, 20 bp, Artificial
  CRISPR gRNA sequence
gcatatttaacaggctgttt

SEQ ID NO: 621878 - DNA, 20 bp, Artificial
  CRISPR gRNA sequence
tgaagatagcaaatactgga

SEQ ID NO: 621879 - DNA, 20 bp, Artificial
  CRISPR gRNA sequence
tactggagcaggtttccggg

SEQ ID NO: 621880 - DNA, 20 bp, Artificial
  CRISPR gRNA sequence
agcaggtttccgggaaaaga

SEQ ID NO: 621881 - DNA, 20 bp, Artificial
  CRISPR gRNA sequence
aagatttagcttagttcaat

SEQ ID NO: 621882 - DNA, 20 bp, Artificial
  CRISPR gRNA sequence
agtgaaaactaatattagcc

SEQ ID NO: 621883 - DNA, 20 bp, Artificial
  CRISPR gRNA sequence
tctgcccatattactttaac

SEQ ID NO: 621884 - DNA, 20 bp, Artificial
  CRISPR gRNA sequence
cattaaatcaaaattctata

SEQ ID NO: 621885 - DNA, 20 bp, Artificial
  CRISPR gRNA sequence
ctatattgagttttatgtgc

SEQ ID NO: 621886 - DNA, 20 bp, Artificial
  CRISPR gRNA sequence
tgcacaggctttaataaact

SEQ ID NO: 621887 - DNA, 20 bp, Artificial
  CRISPR gRNA sequence
ctcagaagttgaattaattg

SEQ ID NO: 621888 - DNA, 20 bp, Artificial
  CRISPR gRNA sequence
attaattgatgtgattgacc

SEQ ID NO: 621889 - DNA, 20 bp, Artificial
  CRISPR gRNA sequence
ggtatatctaatatcataac

SEQ ID NO: 621890 - DNA, 20 bp, Artificial
  CRISPR gRNA sequence
tctgttttttaaaaaaaatc

SEQ ID NO: 621891 - DNA, 20 bp, Artificial
  CRISPR gRNA sequence
tgatctgtctttattctgta

SEQ ID NO: 621892 - DNA, 20 bp, Artificial
  CRISPR gRNA sequence
atacaatatatattatttta

SEQ ID NO: 621893 - DNA, 20 bp, Artificial
  CRISPR gRNA sequence
taatgctagaaacacttctt

SEQ ID NO: 621894 - DNA, 20 bp, Artificial
  CRISPR gRNA sequence
cttctgagatttcctgtatg

SEQ ID NO: 621895 - DNA, 20 bp, Artificial
  CRISPR gRNA sequence
ctggtgctggggctcaaaaa

SEQ ID NO: 621896 - DNA, 20 bp, Artificial
  CRISPR gRNA sequence
gggctcaaaaaataggtttg

SEQ ID NO: 621897 - DNA, 20 bp, Artificial
  CRISPR gRNA sequence
tattttgtgtgagatcgtaa

SEQ ID NO: 621898 - DNA, 20 bp, Artificial
  CRISPR gRNA sequence
taactgtgacttacatccat

SEQ ID NO: 621899 - DNA, 20 bp, Artificial
  CRISPR gRNA sequence
acatccattatagattaatg

SEQ ID NO: 621900 - DNA, 20 bp, Artificial
  CRISPR gRNA sequence
gcttctcaccttttacctcc

SEQ ID NO: 621901 - DNA, 20 bp, Artificial
  CRISPR gRNA sequence
cccacaaaattatttataat

SEQ ID NO: 621902 - DNA, 20 bp, Artificial
  CRISPR gRNA sequence
tcatccttgcaagttctgaa

SEQ ID NO: 621903 - DNA, 20 bp, Artificial
  CRISPR gRNA sequence
tcaaggttgactgacattaa

SEQ ID NO: 621904 - DNA, 20 bp, Artificial
  CRISPR gRNA sequence
tttaaaatcagaatgccaat

SEQ ID NO: 621905 - DNA, 20 bp, Artificial
  CRISPR gRNA sequence
aatgccaatttatgtttaga

SEQ ID NO: 621906 - DNA, 20 bp, Artificial
  CRISPR gRNA sequence
ataggagctggatcactcca

SEQ ID NO: 621907 - DNA, 20 bp, Artificial
  CRISPR gRNA sequence
gggagttagttatataattc

SEQ ID NO: 621908 - DNA, 20 bp, Artificial
  CRISPR gRNA sequence
ttccctctccttttaatgga

SEQ ID NO: 621909 - DNA, 20 bp, Artificial
  CRISPR gRNA sequence
ctccttttaatggacatgga

SEQ ID NO: 621910 - DNA, 20 bp, Artificial
  CRISPR gRNA sequence
ctagttcaaccaaaatactt

SEQ ID NO: 621911 - DNA, 20 bp, Artificial
  CRISPR gRNA sequence
gagattcatttttttttccc

SEQ ID NO: 621912 - DNA, 20 bp, Artificial
  CRISPR gRNA sequence
tggcttcctaggctaaatcc

SEQ ID NO: 621913 - DNA, 20 bp, Artificial
  CRISPR gRNA sequence
agatccattcattttcttta

SEQ ID NO: 621914 - DNA, 20 bp, Artificial
  CRISPR gRNA sequence
ttctttagtgtgatttatat

SEQ ID NO: 621915 - DNA, 20 bp, Artificial
  CRISPR gRNA sequence
ttctgctttaatttgtaaaa

SEQ ID NO: 621916 - DNA, 20 bp, Artificial
  CRISPR gRNA sequence
tctcgacagctgatgtggtc

SEQ ID NO: 621917 - DNA, 20 bp, Artificial
  CRISPR gRNA sequence
gctggtgatatagaggcact

SEQ ID NO: 621918 - DNA, 20 bp, Artificial
  CRISPR gRNA sequence
aagtgatctgaccgcatcaa

SEQ ID NO: 621919 - DNA, 20 bp, Artificial
  CRISPR gRNA sequence
ttaagtaacttttcaaagca

SEQ ID NO: 621920 - DNA, 20 bp, Artificial
  CRISPR gRNA sequence
agatttatttgtgggccaca

SEQ ID NO: 621921 - DNA, 20 bp, Artificial
  CRISPR gRNA sequence
cttgattataaagaaattaa

SEQ ID NO: 621922 - DNA, 20 bp, Artificial
  CRISPR gRNA sequence
ttgttgaatgaagaaaatac

SEQ ID NO: 621923 - DNA, 20 bp, Artificial
  CRISPR gRNA sequence
aagattagcatattacatat

SEQ ID NO: 621924 - DNA, 20 bp, Artificial
  CRISPR gRNA sequence
tacatatgtctgtttaaata

SEQ ID NO: 621925 - DNA, 20 bp, Artificial
  CRISPR gRNA sequence
ctacttgaaaaaatttggaa

SEQ ID NO: 621926 - DNA, 20 bp, Artificial
  CRISPR gRNA sequence
atccaaaaatcctaatttac

SEQ ID NO: 621927 - DNA, 20 bp, Artificial
  CRISPR gRNA sequence
cctaatttacttgtgatttt

SEQ ID NO: 621928 - DNA, 20 bp, Artificial
  CRISPR gRNA sequence
tttataatgtctcactctga

SEQ ID NO: 621929 - DNA, 20 bp, Artificial
  CRISPR gRNA sequence
ttggtcccaaaagctgatct

SEQ ID NO: 621930 - DNA, 20 bp, Artificial
  CRISPR gRNA sequence
tctaagtttctaaacagttc

SEQ ID NO: 621931 - DNA, 20 bp, Artificial
  CRISPR gRNA sequence
ttctaaacagttcttatgtt

SEQ ID NO: 621932 - DNA, 20 bp, Artificial
  CRISPR gRNA sequence
atccacatgaatgttaatgt

SEQ ID NO: 621933 - DNA, 20 bp, Artificial
  CRISPR gRNA sequence
tgatatagcacatttaaggt

SEQ ID NO: 621934 - DNA, 20 bp, Artificial
  CRISPR gRNA sequence
agccagttctccatcactta

SEQ ID NO: 621935 - DNA, 20 bp, Artificial
  CRISPR gRNA sequence
ttagtagcatgtacaagatg

SEQ ID NO: 621936 - DNA, 20 bp, Artificial
  CRISPR gRNA sequence
gtacaagatggaatgcttca

SEQ ID NO: 621937 - DNA, 20 bp, Artificial
  CRISPR gRNA sequence
attctgggtgtctacacttt

SEQ ID NO: 621938 - DNA, 20 bp, Artificial
  CRISPR gRNA sequence
agtgctagggtactacgttg

SEQ ID NO: 621939 - DNA, 20 bp, Artificial
  CRISPR gRNA sequence
atggccattttcataaatat

SEQ ID NO: 621940 - DNA, 20 bp, Artificial
  CRISPR gRNA sequence
tttcataaatatccttgttt

SEQ ID NO: 621941 - DNA, 20 bp, Artificial
  CRISPR gRNA sequence
ttctaatcagacttatgcca

SEQ ID NO: 621942 - DNA, 20 bp, Artificial
  CRISPR gRNA sequence
agactgaaaagtggcatttc

SEQ ID NO: 621943 - DNA, 20 bp, Artificial
  CRISPR gRNA sequence
gctgaggatgtatatttaat

SEQ ID NO: 621944 - DNA, 20 bp, Artificial
  CRISPR gRNA sequence
aaaaggtctatttctattag

SEQ ID NO: 621945 - DNA, 20 bp, Artificial
  CRISPR gRNA sequence
cagatcacccaaatatcatc

SEQ ID NO: 621946 - DNA, 20 bp, Artificial
  CRISPR gRNA sequence
ggtacctaatcatttttgtg

SEQ ID NO: 621947 - DNA, 20 bp, Artificial
  CRISPR gRNA sequence
gaaaactacttgaaagcagc

SEQ ID NO: 621948 - DNA, 20 bp, Artificial
  CRISPR gRNA sequence
tgagaattataaaaagaaat

SEQ ID NO: 621949 - DNA, 20 bp, Artificial
  CRISPR gRNA sequence
atgagatttttctgtgagtc

SEQ ID NO: 621950 - DNA, 20 bp, Artificial
  CRISPR gRNA sequence
tgacacattaatgacctaat

SEQ ID NO: 621951 - DNA, 20 bp, Artificial
  CRISPR gRNA sequence
attaatgacctaatgatagt

SEQ ID NO: 621952 - DNA, 20 bp, Artificial
  CRISPR gRNA sequence
acataaataaatcatagtaa

SEQ ID NO: 621953 - DNA, 20 bp, Artificial
  CRISPR gRNA sequence
tcatagtaatgctgtttgca

SEQ ID NO: 621954 - DNA, 20 bp, Artificial
  CRISPR gRNA sequence
aagttttggggatgcatttg

SEQ ID NO: 621955 - DNA, 20 bp, Artificial
  CRISPR gRNA sequence
gaagctatagttaactagac

SEQ ID NO: 621956 - DNA, 20 bp, Artificial
  CRISPR gRNA sequence
tatgtatatgataataccat

SEQ ID NO: 621957 - DNA, 20 bp, Artificial
  CRISPR gRNA sequence
gggatatcggagggtaaaca

SEQ ID NO: 621958 - DNA, 20 bp, Artificial
  CRISPR gRNA sequence
agccagaaaactgatagtag

SEQ ID NO: 621959 - DNA, 20 bp, Artificial
  CRISPR gRNA sequence
tttcatgtacaaatgatatc

SEQ ID NO: 621960 - DNA, 20 bp, Artificial
  CRISPR gRNA sequence
tttattgaatactattttac

SEQ ID NO: 621961 - DNA, 20 bp, Artificial
  CRISPR gRNA sequence
tgcctcagtctcccgagtag

SEQ ID NO: 621962 - DNA, 20 bp, Artificial
  CRISPR gRNA sequence
tttttattttttagtgtaga

SEQ ID NO: 621963 - DNA, 20 bp, Artificial
  CRISPR gRNA sequence
ctgcctcagcctcccaaagt

SEQ ID NO: 621964 - DNA, 20 bp, Artificial
  CRISPR gRNA sequence
tgcctcagcctcctgagtag

SEQ ID NO: 621965 - DNA, 20 bp, Artificial
  CRISPR gRNA sequence
ttttgcatttttagtggaga

SEQ ID NO: 621966 - DNA, 20 bp, Artificial
  CRISPR gRNA sequence
ggtcaggcgctctcgtactc

SEQ ID NO: 621967 - DNA, 20 bp, Artificial
  CRISPR gRNA sequence
gttcaggctggagtacggtg

SEQ ID NO: 621968 - DNA, 20 bp, Artificial
  CRISPR gRNA sequence
ggtcttgaactcctggcctc

SEQ ID NO: 621969 - DNA, 20 bp, Artificial
  CRISPR gRNA sequence
cgcctcagcctcctgagtag

SEQ ID NO: 621970 - DNA, 20 bp, Artificial
  CRISPR gRNA sequence
tgagccaccacacttggcta

SEQ ID NO: 621971 - DNA, 20 bp, Artificial
  CRISPR gRNA sequence
aaataatgttatatactctg

SEQ ID NO: 621972 - DNA, 20 bp, Artificial
  CRISPR gRNA sequence
ctgagtagaatgagttaaaa

SEQ ID NO: 621973 - DNA, 20 bp, Artificial
  CRISPR gRNA sequence
ttctatcttgcatgtaacaa

SEQ ID NO: 621974 - DNA, 20 bp, Artificial
  CRISPR gRNA sequence
aagaaagaaagaataaaaat

SEQ ID NO: 621975 - DNA, 20 bp, Artificial
  CRISPR gRNA sequence
ataagtgaatcaaggaagct

SEQ ID NO: 621976 - DNA, 20 bp, Artificial
  CRISPR gRNA sequence
aagtgatgaggaatgtggca

SEQ ID NO: 621977 - DNA, 20 bp, Artificial
  CRISPR gRNA sequence
gaatgtggcaataagattag

SEQ ID NO: 621978 - DNA, 20 bp, Artificial
  CRISPR gRNA sequence
agaagctaaatgaataagca

SEQ ID NO: 621979 - DNA, 20 bp, Artificial
  CRISPR gRNA sequence
gccagggagtaggagatggg

SEQ ID NO: 621980 - DNA, 20 bp, Artificial
  CRISPR gRNA sequence
ggttaaaagaactgggtcct

SEQ ID NO: 621981 - DNA, 20 bp, Artificial
  CRISPR gRNA sequence
aaaagaactgggtcctaagg

SEQ ID NO: 621982 - DNA, 20 bp, Artificial
  CRISPR gRNA sequence
gtggccatcttggactaatc

SEQ ID NO: 621983 - DNA, 20 bp, Artificial
  CRISPR gRNA sequence
attgcttttatcttttgcaa

SEQ ID NO: 621984 - DNA, 20 bp, Artificial
  CRISPR gRNA sequence
cccctcagttgtctttttac

SEQ ID NO: 621985 - DNA, 20 bp, Artificial
  CRISPR gRNA sequence
ttactttagtttagtgggaa

SEQ ID NO: 621986 - DNA, 20 bp, Artificial
  CRISPR gRNA sequence
aggctgccagaaagaacttt

SEQ ID NO: 621987 - DNA, 20 bp, Artificial
  CRISPR gRNA sequence
ttgatattgagcagatgaga

SEQ ID NO: 621988 - DNA, 20 bp, Artificial
  CRISPR gRNA sequence
agatgagatgaggttttgca

SEQ ID NO: 621989 - DNA, 20 bp, Artificial
  CRISPR gRNA sequence
ccagtttttgtcctctgatc

SEQ ID NO: 621990 - DNA, 20 bp, Artificial
  CRISPR gRNA sequence
ctgttatttagaaggctcag

SEQ ID NO: 621991 - DNA, 20 bp, Artificial
  CRISPR gRNA sequence
gagacatttttaaaaaatta

SEQ ID NO: 621992 - DNA, 20 bp, Artificial
  CRISPR gRNA sequence
atgtgtatcattgttgaaga

SEQ ID NO: 621993 - DNA, 20 bp, Artificial
  CRISPR gRNA sequence
aataataaaaagatcagggt

SEQ ID NO: 621994 - DNA, 20 bp, Artificial
  CRISPR gRNA sequence
aagatcagggtatatgttta

SEQ ID NO: 621995 - DNA, 20 bp, Artificial
  CRISPR gRNA sequence
tttgtaaggtacttttttca

SEQ ID NO: 621996 - DNA, 20 bp, Artificial
  CRISPR gRNA sequence
tagaatgtgctgatcaaaac

SEQ ID NO: 621997 - DNA, 20 bp, Artificial
  CRISPR gRNA sequence
aaccttcgcctcccgagaag

SEQ ID NO: 621998 - DNA, 20 bp, Artificial
  CRISPR gRNA sequence
ttttgtatttttagtagaga

SEQ ID NO: 621999 - DNA, 20 bp, Artificial
  CRISPR gRNA sequence
ccaccgtgcctggccagtaa

SEQ ID NO: 622000 - DNA, 20 bp, Artificial
  CRISPR gRNA sequence
tttaaaaattacagaattga

SEQ ID NO: 622001 - DNA, 20 bp, Artificial
  CRISPR gRNA sequence
ttacagaattgagcaagttt

SEQ ID NO: 622002 - DNA, 20 bp, Artificial
  CRISPR gRNA sequence
gatattttatctcttggaag

SEQ ID NO: 622003 - DNA, 20 bp, Artificial
  CRISPR gRNA sequence
agcattagacacaatatatg

SEQ ID NO: 622004 - DNA, 20 bp, Artificial
  CRISPR gRNA sequence
caaatagtcttctaggaagg

SEQ ID NO: 622005 - DNA, 20 bp, Artificial
  CRISPR gRNA sequence
ctaggaaggacatgctttta

SEQ ID NO: 622006 - DNA, 20 bp, Artificial
  CRISPR gRNA sequence
ctggatcacttactgaatat

SEQ ID NO: 622007 - DNA, 20 bp, Artificial
  CRISPR gRNA sequence
actgaatatttctgcttttc

SEQ ID NO: 622008 - DNA, 20 bp, Artificial
  CRISPR gRNA sequence
caggtagacagactcagaat

SEQ ID NO: 622009 - DNA, 20 bp, Artificial
  CRISPR gRNA sequence
ttgaatcacacataaaccta

SEQ ID NO: 622010 - DNA, 20 bp, Artificial
  CRISPR gRNA sequence
tgaggatggcaattcagaag

SEQ ID NO: 622011 - DNA, 20 bp, Artificial
  CRISPR gRNA sequence
tgtgtttgctggcaggtctt

SEQ ID NO: 622012 - DNA, 20 bp, Artificial
  CRISPR gRNA sequence
cctaggtgaccttgtccaga

SEQ ID NO: 622013 - DNA, 20 bp, Artificial
  CRISPR gRNA sequence
atcaaggagaaaacagaata

SEQ ID NO: 622014 - DNA, 20 bp, Artificial
  CRISPR gRNA sequence
aaaacagaatattcagttta

SEQ ID NO: 622015 - DNA, 20 bp, Artificial
  CRISPR gRNA sequence
taaacagacattttcctgag

SEQ ID NO: 622016 - DNA, 20 bp, Artificial
  CRISPR gRNA sequence
gatgcctttatcacctccta

SEQ ID NO: 622017 - DNA, 20 bp, Artificial
  CRISPR gRNA sequence
cacctcctatcctgttttat

SEQ ID NO: 622018 - DNA, 20 bp, Artificial
  CRISPR gRNA sequence
gggatagtatctttcctatg

SEQ ID NO: 622019 - DNA, 20 bp, Artificial
  CRISPR gRNA sequence
atttgtaaaatagggaaagt

SEQ ID NO: 622020 - DNA, 20 bp, Artificial
  CRISPR gRNA sequence
gtgagggttaataaacttag

SEQ ID NO: 622021 - DNA, 20 bp, Artificial
  CRISPR gRNA sequence
acatagtagtctctcaatta

SEQ ID NO: 622022 - DNA, 20 bp, Artificial
  CRISPR gRNA sequence
gtctctcaattaagaagatt

SEQ ID NO: 622023 - DNA, 20 bp, Artificial
  CRISPR gRNA sequence
aatatccctatgtgttggtt

SEQ ID NO: 622024 - DNA, 20 bp, Artificial
  CRISPR gRNA sequence
agttattccagacattatta

SEQ ID NO: 622025 - DNA, 20 bp, Artificial
  CRISPR gRNA sequence
ccagctagtcttacccagaa

SEQ ID NO: 622026 - DNA, 20 bp, Artificial
  CRISPR gRNA sequence
ataaatgctctaacgatggc

SEQ ID NO: 622027 - DNA, 20 bp, Artificial
  CRISPR gRNA sequence
aaacaatactacattggact

SEQ ID NO: 622028 - DNA, 20 bp, Artificial
  CRISPR gRNA sequence
cttctcaagtacatgacttc

SEQ ID NO: 622029 - DNA, 20 bp, Artificial
  CRISPR gRNA sequence
acatgacttcaaaagcttca

SEQ ID NO: 622030 - DNA, 20 bp, Artificial
  CRISPR gRNA sequence
gtgtcactctagaatttaga

SEQ ID NO: 622031 - DNA, 20 bp, Artificial
  CRISPR gRNA sequence
aaaatgacatgtaattctaa

SEQ ID NO: 622032 - DNA, 20 bp, Artificial
  CRISPR gRNA sequence
taaaactgttaagacagttc

SEQ ID NO: 622033 - DNA, 20 bp, Artificial
  CRISPR gRNA sequence
gttaagacagttctgttgat

SEQ ID NO: 622034 - DNA, 20 bp, Artificial
  CRISPR gRNA sequence
tctttacaaaagatatttcc

SEQ ID NO: 622035 - DNA, 20 bp, Artificial
  CRISPR gRNA sequence
gttgaattcttactagaaat

SEQ ID NO: 622036 - DNA, 20 bp, Artificial
  CRISPR gRNA sequence
tgttacatgagcaatcatta

SEQ ID NO: 622037 - DNA, 20 bp, Artificial
  CRISPR gRNA sequence
cattatctagttttacaagc

SEQ ID NO: 622038 - DNA, 20 bp, Artificial
  CRISPR gRNA sequence
agaaataaggcagtatattt

SEQ ID NO: 622039 - DNA, 20 bp, Artificial
  CRISPR gRNA sequence
tgaagaataccatgtattct

SEQ ID NO: 622040 - DNA, 20 bp, Artificial
  CRISPR gRNA sequence
atcttttattgtatctcttt

SEQ ID NO: 622041 - DNA, 20 bp, Artificial
  CRISPR gRNA sequence
ttggaagctcatgaaatata

SEQ ID NO: 622042 - DNA, 20 bp, Artificial
  CRISPR gRNA sequence
atcctaactgaactgaaaat

SEQ ID NO: 622043 - DNA, 20 bp, Artificial
  CRISPR gRNA sequence
tgcatttatgtgccaaaaag

SEQ ID NO: 622044 - DNA, 20 bp, Artificial
  CRISPR gRNA sequence
gtggtaatcaatctgtaatt

SEQ ID NO: 622045 - DNA, 20 bp, Artificial
  CRISPR gRNA sequence
taaaatactttcagctacta

SEQ ID NO: 622046 - DNA, 20 bp, Artificial
  CRISPR gRNA sequence
ttattttaaatcacaattaa

SEQ ID NO: 622047 - DNA, 20 bp, Artificial
  CRISPR gRNA sequence
cacaattaaaattgattttt

SEQ ID NO: 622048 - DNA, 20 bp, Artificial
  CRISPR gRNA sequence
gggaacttcagtgctccccc

SEQ ID NO: 622049 - DNA, 20 bp, Artificial
  CRISPR gRNA sequence
aaatgcttccttttcaagtg

SEQ ID NO: 622050 - DNA, 20 bp, Artificial
  CRISPR gRNA sequence
ggatcatgtctctaggtagg

SEQ ID NO: 622051 - DNA, 20 bp, Artificial
  CRISPR gRNA sequence
tgatgactgatgtctattaa

SEQ ID NO: 622052 - DNA, 20 bp, Artificial
  CRISPR gRNA sequence
gatgtctattaattgtgttt

SEQ ID NO: 622053 - DNA, 20 bp, Artificial
  CRISPR gRNA sequence
tttattgctctaaaatgctc

SEQ ID NO: 622054 - DNA, 20 bp, Artificial
  CRISPR gRNA sequence
ctttcctgcctgtgagagac

SEQ ID NO: 622055 - DNA, 20 bp, Artificial
  CRISPR gRNA sequence
gcctgtgagagaccctagct

SEQ ID NO: 622056 - DNA, 20 bp, Artificial
  CRISPR gRNA sequence
tgagagaccctagcttagtg

SEQ ID NO: 622057 - DNA, 20 bp, Artificial
  CRISPR gRNA sequence
accctagcttagtgattagt

SEQ ID NO: 622058 - DNA, 20 bp, Artificial
  CRISPR gRNA sequence
ttagtgattagtttttgttt

SEQ ID NO: 622059 - DNA, 20 bp, Artificial
  CRISPR gRNA sequence
attagtttttgtttctgagt

SEQ ID NO: 622060 - DNA, 20 bp, Artificial
  CRISPR gRNA sequence
tctgagtttctgtttttacc

SEQ ID NO: 622061 - DNA, 20 bp, Artificial
  CRISPR gRNA sequence
tttaccaagtgtttttattt

SEQ ID NO: 622062 - DNA, 20 bp, Artificial
  CRISPR gRNA sequence
ttagaggacatcagaaaact

SEQ ID NO: 622063 - DNA, 20 bp, Artificial
  CRISPR gRNA sequence
acaggtcctcttctctcttt

SEQ ID NO: 622064 - DNA, 20 bp, Artificial
  CRISPR gRNA sequence
tttatttctttagatactgt

SEQ ID NO: 622065 - DNA, 20 bp, Artificial
  CRISPR gRNA sequence
actttcaactctgcatctag

SEQ ID NO: 622066 - DNA, 20 bp, Artificial
  CRISPR gRNA sequence
agtctatcagaaatccttgg

SEQ ID NO: 622067 - DNA, 20 bp, Artificial
  CRISPR gRNA sequence
ccttaagcctaaaatattgc

SEQ ID NO: 622068 - DNA, 20 bp, Artificial
  CRISPR gRNA sequence
tgcaacagtttaaccggtct

SEQ ID NO: 622069 - DNA, 20 bp, Artificial
  CRISPR gRNA sequence
accggtcttcctgcttccat

SEQ ID NO: 622070 - DNA, 20 bp, Artificial
  CRISPR gRNA sequence
tgcttccattcttgcttctc

SEQ ID NO: 622071 - DNA, 20 bp, Artificial
  CRISPR gRNA sequence
tccattcttgcttctctgta

SEQ ID NO: 622072 - DNA, 20 bp, Artificial
  CRISPR gRNA sequence
caaatcagatcataacaatt

SEQ ID NO: 622073 - DNA, 20 bp, Artificial
  CRISPR gRNA sequence
caattcattgctttaaacac

SEQ ID NO: 622074 - DNA, 20 bp, Artificial
  CRISPR gRNA sequence
tgtctaaggacctctgtact

SEQ ID NO: 622075 - DNA, 20 bp, Artificial
  CRISPR gRNA sequence
acctctgtacttgctgtttc

SEQ ID NO: 622076 - DNA, 20 bp, Artificial
  CRISPR gRNA sequence
tgctgtttctttggtttggg

SEQ ID NO: 622077 - DNA, 20 bp, Artificial
  CRISPR gRNA sequence
ggtttgggacacgttttctt

SEQ ID NO: 622078 - DNA, 20 bp, Artificial
  CRISPR gRNA sequence
tttaactgtcgcctccttgg

SEQ ID NO: 622079 - DNA, 20 bp, Artificial
  CRISPR gRNA sequence
ccaggcattctatgacatta

SEQ ID NO: 622080 - DNA, 20 bp, Artificial
  CRISPR gRNA sequence
caacacacagttgaggaaca

SEQ ID NO: 622081 - DNA, 20 bp, Artificial
  CRISPR gRNA sequence
gtgtgtctataaagcaaaca

SEQ ID NO: 622082 - DNA, 20 bp, Artificial
  CRISPR gRNA sequence
atggggagagagtagtacaa

SEQ ID NO: 622083 - DNA, 20 bp, Artificial
  CRISPR gRNA sequence
tctggaggctgaggcaggag

SEQ ID NO: 622084 - DNA, 20 bp, Artificial
  CRISPR gRNA sequence
caaaaccttatcttctgact

SEQ ID NO: 622085 - DNA, 20 bp, Artificial
  CRISPR gRNA sequence
ctgactcttggcttggtgtt

SEQ ID NO: 622086 - DNA, 20 bp, Artificial
  CRISPR gRNA sequence
ttgctttacatgatacactc

SEQ ID NO: 622087 - DNA, 20 bp, Artificial
  CRISPR gRNA sequence
cctgtagaagtagttaagag

SEQ ID NO: 622088 - DNA, 20 bp, Artificial
  CRISPR gRNA sequence
tgattttcatattacataga

SEQ ID NO: 622089 - DNA, 20 bp, Artificial
  CRISPR gRNA sequence
ctacttttgggttaagccgt

SEQ ID NO: 622090 - DNA, 20 bp, Artificial
  CRISPR gRNA sequence
gtaagggattactgacactc

SEQ ID NO: 622091 - DNA, 20 bp, Artificial
  CRISPR gRNA sequence
gtgtgaccttaggaatgttc

SEQ ID NO: 622092 - DNA, 20 bp, Artificial
  CRISPR gRNA sequence
taataataataatacttgcc

SEQ ID NO: 622093 - DNA, 20 bp, Artificial
  CRISPR gRNA sequence
agcacttagctcattttttg

SEQ ID NO: 622094 - DNA, 20 bp, Artificial
  CRISPR gRNA sequence
attttttggcacgtttgctg

SEQ ID NO: 622095 - DNA, 20 bp, Artificial
  CRISPR gRNA sequence
atagactgcaaatatttgca

SEQ ID NO: 622096 - DNA, 20 bp, Artificial
  CRISPR gRNA sequence
gctttttaatatttattaga

SEQ ID NO: 622097 - DNA, 20 bp, Artificial
  CRISPR gRNA sequence
tatttattagataaggcttc

SEQ ID NO: 622098 - DNA, 20 bp, Artificial
  CRISPR gRNA sequence
acttgcattctaggaaatac

SEQ ID NO: 622099 - DNA, 20 bp, Artificial
  CRISPR gRNA sequence
taggaaatacatttgttttg

SEQ ID NO: 622100 - DNA, 20 bp, Artificial
  CRISPR gRNA sequence
tacatttgttttgccttgtt

SEQ ID NO: 622101 - DNA, 20 bp, Artificial
  CRISPR gRNA sequence
ttattaaacagacaaacaaa

SEQ ID NO: 622102 - DNA, 20 bp, Artificial
  CRISPR gRNA sequence
attttataatggtaacttta

SEQ ID NO: 622103 - DNA, 20 bp, Artificial
  CRISPR gRNA sequence
aactttatttagctttttct

SEQ ID NO: 622104 - DNA, 20 bp, Artificial
  CRISPR gRNA sequence
taatagcctcttaggaaggg

SEQ ID NO: 622105 - DNA, 20 bp, Artificial
  CRISPR gRNA sequence
gaaaatgtaaacaagtgtgt

SEQ ID NO: 622106 - DNA, 20 bp, Artificial
  CRISPR gRNA sequence
ttcaaattacttttatttgg

SEQ ID NO: 622107 - DNA, 20 bp, Artificial
  CRISPR gRNA sequence
taccgtatcacatcattatt

SEQ ID NO: 622108 - DNA, 20 bp, Artificial
  CRISPR gRNA sequence
gctaggtgaaactgacataa

SEQ ID NO: 622109 - DNA, 20 bp, Artificial
  CRISPR gRNA sequence
gctatttactgagaacatcc

SEQ ID NO: 622110 - DNA, 20 bp, Artificial
  CRISPR gRNA sequence
aggatttagaaagagaacta

SEQ ID NO: 622111 - DNA, 20 bp, Artificial
  CRISPR gRNA sequence
actatgtagttttatagtta

SEQ ID NO: 622112 - DNA, 20 bp, Artificial
  CRISPR gRNA sequence
tatagttacagagattctgg

SEQ ID NO: 622113 - DNA, 20 bp, Artificial
  CRISPR gRNA sequence
attctggtgcagatttggga

SEQ ID NO: 622114 - DNA, 20 bp, Artificial
  CRISPR gRNA sequence
cagcatgacctcaactaatg

SEQ ID NO: 622115 - DNA, 20 bp, Artificial
  CRISPR gRNA sequence
tgccttatacccattttatt

SEQ ID NO: 622116 - DNA, 20 bp, Artificial
  CRISPR gRNA sequence
aataagaaaattccaccagg

SEQ ID NO: 622117 - DNA, 20 bp, Artificial
  CRISPR gRNA sequence
agaaaattccaccaggacct

SEQ ID NO: 622118 - DNA, 20 bp, Artificial
  CRISPR gRNA sequence
agaatgctgtatgggctgtg

SEQ ID NO: 622119 - DNA, 20 bp, Artificial
  CRISPR gRNA sequence
ataggtttataattattacc

SEQ ID NO: 622120 - DNA, 20 bp, Artificial
  CRISPR gRNA sequence
ataattattacccaaagatt

SEQ ID NO: 622121 - DNA, 20 bp, Artificial
  CRISPR gRNA sequence
tgtaccgtgagctgaaacca

SEQ ID NO: 622122 - DNA, 20 bp, Artificial
  CRISPR gRNA sequence
cgtgagctgaaaccaatgtg

SEQ ID NO: 622123 - DNA, 20 bp, Artificial
  CRISPR gRNA sequence
gctgaaaccaatgtgttttg

SEQ ID NO: 622124 - DNA, 20 bp, Artificial
  CRISPR gRNA sequence
attttatttaaaactatttc

SEQ ID NO: 622125 - DNA, 20 bp, Artificial
  CRISPR gRNA sequence
ctttttaccatcatttactt

SEQ ID NO: 622126 - DNA, 20 bp, Artificial
  CRISPR gRNA sequence
ttaataattacaaattattt

SEQ ID NO: 622127 - DNA, 20 bp, Artificial
  CRISPR gRNA sequence
tttataagcttaaagcatct

SEQ ID NO: 622128 - DNA, 20 bp, Artificial
  CRISPR gRNA sequence
tgtttctttctgtaatctgg

SEQ ID NO: 622129 - DNA, 20 bp, Artificial
  CRISPR gRNA sequence
aatctcataaaaaacaactc

SEQ ID NO: 622130 - DNA, 20 bp, Artificial
  CRISPR gRNA sequence
taggatgccattgtgggaag

SEQ ID NO: 622131 - DNA, 20 bp, Artificial
  CRISPR gRNA sequence
agcattgaccctactctcaa

SEQ ID NO: 622132 - DNA, 20 bp, Artificial
  CRISPR gRNA sequence
tgaccctactctcaaaggag

SEQ ID NO: 622133 - DNA, 20 bp, Artificial
  CRISPR gRNA sequence
gggctaaagagcagtctaaa

SEQ ID NO: 622134 - DNA, 20 bp, Artificial
  CRISPR gRNA sequence
accactcaagtaccctagtc

SEQ ID NO: 622135 - DNA, 20 bp, Artificial
  CRISPR gRNA sequence
acaaatcatgtgtctacata

SEQ ID NO: 622136 - DNA, 20 bp, Artificial
  CRISPR gRNA sequence
cctatgactcaatttttcat

SEQ ID NO: 622137 - DNA, 20 bp, Artificial
  CRISPR gRNA sequence
ctttatacactgatgataca

SEQ ID NO: 622138 - DNA, 20 bp, Artificial
  CRISPR gRNA sequence
cattcactgttggacattta

SEQ ID NO: 622139 - DNA, 20 bp, Artificial
  CRISPR gRNA sequence
gttggacatttaggttgttt

SEQ ID NO: 622140 - DNA, 20 bp, Artificial
  CRISPR gRNA sequence
tgtttttgttattatgtaga

SEQ ID NO: 622141 - DNA, 20 bp, Artificial
  CRISPR gRNA sequence
acaactagtaatatgtgagt

SEQ ID NO: 622142 - DNA, 20 bp, Artificial
  CRISPR gRNA sequence
tgggggaagatggtatctac

SEQ ID NO: 622143 - DNA, 20 bp, Artificial
  CRISPR gRNA sequence
tatgtttgacatttcttaat

SEQ ID NO: 622144 - DNA, 20 bp, Artificial
  CRISPR gRNA sequence
ggttttttaaacataatttc

SEQ ID NO: 622145 - DNA, 20 bp, Artificial
  CRISPR gRNA sequence
tttttgttcctgaagaatat

SEQ ID NO: 622146 - DNA, 20 bp, Artificial
  CRISPR gRNA sequence
gaactaggagaaagagagaa

SEQ ID NO: 622147 - DNA, 20 bp, Artificial
  CRISPR gRNA sequence
agagagaaaaaagattttat

SEQ ID NO: 622148 - DNA, 20 bp, Artificial
  CRISPR gRNA sequence
aaaaagattttattcgtgat

SEQ ID NO: 622149 - DNA, 20 bp, Artificial
  CRISPR gRNA sequence
aaaggataatggcagggaat

SEQ ID NO: 622150 - DNA, 20 bp, Artificial
  CRISPR gRNA sequence
tatagccattctattagggg

SEQ ID NO: 622151 - DNA, 20 bp, Artificial
  CRISPR gRNA sequence
gcaggatgtaaggaataagg

SEQ ID NO: 622152 - DNA, 20 bp, Artificial
  CRISPR gRNA sequence
ttcaagactggtagagaact

SEQ ID NO: 622153 - DNA, 20 bp, Artificial
  CRISPR gRNA sequence
tagagaactctgagtttgtc

SEQ ID NO: 622154 - DNA, 20 bp, Artificial
  CRISPR gRNA sequence
gaaataagttgtatacttat

SEQ ID NO: 622155 - DNA, 20 bp, Artificial
  CRISPR gRNA sequence
ttatgcatccaagtgtgtcg

SEQ ID NO: 622156 - DNA, 20 bp, Artificial
  CRISPR gRNA sequence
ctggtctgtcccgggaacgg

SEQ ID NO: 622157 - DNA, 20 bp, Artificial
  CRISPR gRNA sequence
tgctgaaggttacctaggac

SEQ ID NO: 622158 - DNA, 20 bp, Artificial
  CRISPR gRNA sequence
ctaaagataatccctaggca

SEQ ID NO: 622159 - DNA, 20 bp, Artificial
  CRISPR gRNA sequence
ctttcccccttctgcacaat

SEQ ID NO: 622160 - DNA, 20 bp, Artificial
  CRISPR gRNA sequence
caatggcagtttcatgacag

SEQ ID NO: 622161 - DNA, 20 bp, Artificial
  CRISPR gRNA sequence
tgacagagctgattgatctt

SEQ ID NO: 622162 - DNA, 20 bp, Artificial
  CRISPR gRNA sequence
taaaatcacatttaaaaata

SEQ ID NO: 622163 - DNA, 20 bp, Artificial
  CRISPR gRNA sequence
gcatgcatgacaggtggtct

SEQ ID NO: 622164 - DNA, 20 bp, Artificial
  CRISPR gRNA sequence
atgacaggtggtctctggga

SEQ ID NO: 622165 - DNA, 20 bp, Artificial
  CRISPR gRNA sequence
tggtctctgggattttgctt

SEQ ID NO: 622166 - DNA, 20 bp, Artificial
  CRISPR gRNA sequence
gcttcaagtgctagaggaaa

SEQ ID NO: 622167 - DNA, 20 bp, Artificial
  CRISPR gRNA sequence
catctgcctgtctgaaatgt

SEQ ID NO: 622168 - DNA, 20 bp, Artificial
  CRISPR gRNA sequence
agactcaagctaaatatctc

SEQ ID NO: 622169 - DNA, 20 bp, Artificial
  CRISPR gRNA sequence
ctaaatatctcacaagtttt

SEQ ID NO: 622170 - DNA, 20 bp, Artificial
  CRISPR gRNA sequence
ttagatgctttgttatgtat

SEQ ID NO: 622171 - DNA, 20 bp, Artificial
  CRISPR gRNA sequence
tatgtattagtgcttgtaga

SEQ ID NO: 622172 - DNA, 20 bp, Artificial
  CRISPR gRNA sequence
cttgtagagcaggctttcat

SEQ ID NO: 622173 - DNA, 20 bp, Artificial
  CRISPR gRNA sequence
ggctttcatgtaggttttta

SEQ ID NO: 622174 - DNA, 20 bp, Artificial
  CRISPR gRNA sequence
gaggaatgatgctctaggtg

SEQ ID NO: 622175 - DNA, 20 bp, Artificial
  CRISPR gRNA sequence
agggtacatgtgcacaacaa

SEQ ID NO: 622176 - DNA, 20 bp, Artificial
  CRISPR gRNA sequence
acaacaagcaggtttgttac

SEQ ID NO: 622177 - DNA, 20 bp, Artificial
  CRISPR gRNA sequence
ctattttggaaacagaaatc

SEQ ID NO: 622178 - DNA, 20 bp, Artificial
  CRISPR gRNA sequence
tggaaacagaaatccattgc

SEQ ID NO: 622179 - DNA, 20 bp, Artificial
  CRISPR gRNA sequence
tgagcagatactataaaacc

SEQ ID NO: 622180 - DNA, 20 bp, Artificial
  CRISPR gRNA sequence
tactataaaacctgatgctt

SEQ ID NO: 622181 - DNA, 20 bp, Artificial
  CRISPR gRNA sequence
gaaggaagtatgatcatctt

SEQ ID NO: 622182 - DNA, 20 bp, Artificial
  CRISPR gRNA sequence
gatcatctttcaggatttta

SEQ ID NO: 622183 - DNA, 20 bp, Artificial
  CRISPR gRNA sequence
cttaggttgtggaaattcat

SEQ ID NO: 622184 - DNA, 20 bp, Artificial
  CRISPR gRNA sequence
ttccagctgacatttcttaa

SEQ ID NO: 622185 - DNA, 20 bp, Artificial
  CRISPR gRNA sequence
aggatattagcaacacttga

SEQ ID NO: 622186 - DNA, 20 bp, Artificial
  CRISPR gRNA sequence
tatttctcccttgcctgagt

SEQ ID NO: 622187 - DNA, 20 bp, Artificial
  CRISPR gRNA sequence
ggcagttttactgtgccttt

SEQ ID NO: 622188 - DNA, 20 bp, Artificial
  CRISPR gRNA sequence
cacatttaacagggaaatta

SEQ ID NO: 622189 - DNA, 20 bp, Artificial
  CRISPR gRNA sequence
gtggcaaaatctagccatgt

SEQ ID NO: 622190 - DNA, 20 bp, Artificial
  CRISPR gRNA sequence
aatctagccatgtgaaggat

SEQ ID NO: 622191 - DNA, 20 bp, Artificial
  CRISPR gRNA sequence
atgtgaaggattggagtttc

SEQ ID NO: 622192 - DNA, 20 bp, Artificial
  CRISPR gRNA sequence
agtttcttttgattatctag

SEQ ID NO: 622193 - DNA, 20 bp, Artificial
  CRISPR gRNA sequence
tttgtcatccacctctttac

SEQ ID NO: 622194 - DNA, 20 bp, Artificial
  CRISPR gRNA sequence
taggagaatcactggctgag

SEQ ID NO: 622195 - DNA, 20 bp, Artificial
  CRISPR gRNA sequence
agcccatttaattatgtcac

SEQ ID NO: 622196 - DNA, 20 bp, Artificial
  CRISPR gRNA sequence
tgtcactgcagatttggtaa

SEQ ID NO: 622197 - DNA, 20 bp, Artificial
  CRISPR gRNA sequence
tcatagggtctttttctcaa

SEQ ID NO: 622198 - DNA, 20 bp, Artificial
  CRISPR gRNA sequence
actctaattctgataatcag

SEQ ID NO: 622199 - DNA, 20 bp, Artificial
  CRISPR gRNA sequence
ccatcaatcactaaaatagt

SEQ ID NO: 622200 - DNA, 20 bp, Artificial
  CRISPR gRNA sequence
tatatgcataattttattat

SEQ ID NO: 622201 - DNA, 20 bp, Artificial
  CRISPR gRNA sequence
cctgcctttgataatttttc

SEQ ID NO: 622202 - DNA, 20 bp, Artificial
  CRISPR gRNA sequence
ctttgataatttttcctttg

SEQ ID NO: 622203 - DNA, 20 bp, Artificial
  CRISPR gRNA sequence
ttgcttggctttctaggtct

SEQ ID NO: 622204 - DNA, 20 bp, Artificial
  CRISPR gRNA sequence
tttctaggtctttttgattg

SEQ ID NO: 622205 - DNA, 20 bp, Artificial
  CRISPR gRNA sequence
gacacaaaatagacacatgt

SEQ ID NO: 622206 - DNA, 20 bp, Artificial
  CRISPR gRNA sequence
acatgttcctgtttcagcca

SEQ ID NO: 622207 - DNA, 20 bp, Artificial
  CRISPR gRNA sequence
ctgttgacacttcagaaata

SEQ ID NO: 622208 - DNA, 20 bp, Artificial
  CRISPR gRNA sequence
gacacttcagaaataatcag

SEQ ID NO: 622209 - DNA, 20 bp, Artificial
  CRISPR gRNA sequence
taatcagtttagatttcaac

SEQ ID NO: 622210 - DNA, 20 bp, Artificial
  CRISPR gRNA sequence
tggaaacagatattattcta

SEQ ID NO: 622211 - DNA, 20 bp, Artificial
  CRISPR gRNA sequence
tggttataaaaggcctttgc

SEQ ID NO: 622212 - DNA, 20 bp, Artificial
  CRISPR gRNA sequence
ataaaaggcctttgctgaag

SEQ ID NO: 622213 - DNA, 20 bp, Artificial
  CRISPR gRNA sequence
gtacctcaaagaggctatca

SEQ ID NO: 622214 - DNA, 20 bp, Artificial
  CRISPR gRNA sequence
aatatcatacatgatctgct

SEQ ID NO: 622215 - DNA, 20 bp, Artificial
  CRISPR gRNA sequence
tctgctaacagtttcagaac

SEQ ID NO: 622216 - DNA, 20 bp, Artificial
  CRISPR gRNA sequence
gtatcagtgtagcacccaag

SEQ ID NO: 622217 - DNA, 20 bp, Artificial
  CRISPR gRNA sequence
agaagagctcaacattttaa

SEQ ID NO: 622218 - DNA, 20 bp, Artificial
  CRISPR gRNA sequence
acggaatcagaaagcataaa

SEQ ID NO: 622219 - DNA, 20 bp, Artificial
  CRISPR gRNA sequence
cattttttcctttaaagaga

SEQ ID NO: 622220 - DNA, 20 bp, Artificial
  CRISPR gRNA sequence
cataaataaaaaaattaaat

SEQ ID NO: 622221 - DNA, 20 bp, Artificial
  CRISPR gRNA sequence
agcagtttaatattttagat

SEQ ID NO: 622222 - DNA, 20 bp, Artificial
  CRISPR gRNA sequence
ttttcatataattaaagtac

SEQ ID NO: 622223 - DNA, 20 bp, Artificial
  CRISPR gRNA sequence
aatatataaagtgcaggata

SEQ ID NO: 622224 - DNA, 20 bp, Artificial
  CRISPR gRNA sequence
agaattaatcattgcctttc

SEQ ID NO: 622225 - DNA, 20 bp, Artificial
  CRISPR gRNA sequence
cacctacttctattacaaaa

SEQ ID NO: 622226 - DNA, 20 bp, Artificial
  CRISPR gRNA sequence
gaaattccttttcacatata

SEQ ID NO: 622227 - DNA, 20 bp, Artificial
  CRISPR gRNA sequence
gcatgaatccttctcctttc

SEQ ID NO: 622228 - DNA, 20 bp, Artificial
  CRISPR gRNA sequence
ccttttcaaaggtccagtgt

SEQ ID NO: 622229 - DNA, 20 bp, Artificial
  CRISPR gRNA sequence
tattcaccacattgtattgc

SEQ ID NO: 622230 - DNA, 20 bp, Artificial
  CRISPR gRNA sequence
tttatgtctttgtctcccat

SEQ ID NO: 622231 - DNA, 20 bp, Artificial
  CRISPR gRNA sequence
agaataggtgtaccacttcc

SEQ ID NO: 622232 - DNA, 20 bp, Artificial
  CRISPR gRNA sequence
gaagaaagagagatggagtt

SEQ ID NO: 622233 - DNA, 20 bp, Artificial
  CRISPR gRNA sequence
cactaaagtcgaataagtga

SEQ ID NO: 622234 - DNA, 20 bp, Artificial
  CRISPR gRNA sequence
ctaattatttttcttctcct

SEQ ID NO: 622235 - DNA, 20 bp, Artificial
  CRISPR gRNA sequence
cagtacccaagtccattcat

SEQ ID NO: 622236 - DNA, 20 bp, Artificial
  CRISPR gRNA sequence
tttcttttttttcctccttc

SEQ ID NO: 622237 - DNA, 20 bp, Artificial
  CRISPR gRNA sequence
ttgtctcccacactttcatc

SEQ ID NO: 622238 - DNA, 20 bp, Artificial
  CRISPR gRNA sequence
tgtttatgctggctcgcagc

SEQ ID NO: 622239 - DNA, 20 bp, Artificial
  CRISPR gRNA sequence
ctctgactaaagttagggaa

SEQ ID NO: 622240 - DNA, 20 bp, Artificial
  CRISPR gRNA sequence
gcaaaggttatacagatagg

SEQ ID NO: 622241 - DNA, 20 bp, Artificial
  CRISPR gRNA sequence
gctttagagaattacctatg

SEQ ID NO: 622242 - DNA, 20 bp, Artificial
  CRISPR gRNA sequence
aaacccacttcccttgtggt

SEQ ID NO: 622243 - DNA, 20 bp, Artificial
  CRISPR gRNA sequence
cttcccttgtggtacttgct

SEQ ID NO: 622244 - DNA, 20 bp, Artificial
  CRISPR gRNA sequence
cctgcctgcctttcagggtt

SEQ ID NO: 622245 - DNA, 20 bp, Artificial
  CRISPR gRNA sequence
tggacactaggaaccctttc

SEQ ID NO: 622246 - DNA, 20 bp, Artificial
  CRISPR gRNA sequence
tcaagtaaatgaattcaagc

SEQ ID NO: 622247 - DNA, 20 bp, Artificial
  CRISPR gRNA sequence
gctaaggtttttgagactga

SEQ ID NO: 622248 - DNA, 20 bp, Artificial
  CRISPR gRNA sequence
ttttgagactgacatagttt

SEQ ID NO: 622249 - DNA, 20 bp, Artificial
  CRISPR gRNA sequence
gacatagtttaatagattac

SEQ ID NO: 622250 - DNA, 20 bp, Artificial
  CRISPR gRNA sequence
ctgttgttttatagtggcat

SEQ ID NO: 622251 - DNA, 20 bp, Artificial
  CRISPR gRNA sequence
tagtagtaaatttctgataa

SEQ ID NO: 622252 - DNA, 20 bp, Artificial
  CRISPR gRNA sequence
tgataatggagatttcaggt

SEQ ID NO: 622253 - DNA, 20 bp, Artificial
  CRISPR gRNA sequence
tatgctggagggtatggaga

SEQ ID NO: 622254 - DNA, 20 bp, Artificial
  CRISPR gRNA sequence
tatggagaagaagtttggga

SEQ ID NO: 622255 - DNA, 20 bp, Artificial
  CRISPR gRNA sequence
tgggagagtgattatttttc

SEQ ID NO: 622256 - DNA, 20 bp, Artificial
  CRISPR gRNA sequence
ccaaaaatttttctgggaaa

SEQ ID NO: 622257 - DNA, 20 bp, Artificial
  CRISPR gRNA sequence
tctgtaaagctaaacaagaa

SEQ ID NO: 622258 - DNA, 20 bp, Artificial
  CRISPR gRNA sequence
aatattctttcaactgcctt

SEQ ID NO: 622259 - DNA, 20 bp, Artificial
  CRISPR gRNA sequence
ccttttcagtttgttagagt

SEQ ID NO: 622260 - DNA, 20 bp, Artificial
  CRISPR gRNA sequence
ttagagttagtgttttttac

SEQ ID NO: 622261 - DNA, 20 bp, Artificial
  CRISPR gRNA sequence
gttagtgttttttacttttg

SEQ ID NO: 622262 - DNA, 20 bp, Artificial
  CRISPR gRNA sequence
taatataaggaacttctagt

SEQ ID NO: 622263 - DNA, 20 bp, Artificial
  CRISPR gRNA sequence
tgataaagcccctataaaac

SEQ ID NO: 622264 - DNA, 20 bp, Artificial
  CRISPR gRNA sequence
atattttgcaaaaatatacc

SEQ ID NO: 622265 - DNA, 20 bp, Artificial
  CRISPR gRNA sequence
gtaaaaagtcattaatgtaa

SEQ ID NO: 622266 - DNA, 20 bp, Artificial
  CRISPR gRNA sequence
gaatgcctttttgttctgta

SEQ ID NO: 622267 - DNA, 20 bp, Artificial
  CRISPR gRNA sequence
tgctaaaaggaaaaaaatgc

SEQ ID NO: 622268 - DNA, 20 bp, Artificial
  CRISPR gRNA sequence
attgaaagaaacaacaataa

SEQ ID NO: 622269 - DNA, 20 bp, Artificial
  CRISPR gRNA sequence
tggagtaggtgttcaataac

SEQ ID NO: 622270 - DNA, 20 bp, Artificial
  CRISPR gRNA sequence
gttgggagaattaaatgata

SEQ ID NO: 622271 - DNA, 20 bp, Artificial
  CRISPR gRNA sequence
agtgttccaataaatgtgag

SEQ ID NO: 622272 - DNA, 20 bp, Artificial
  CRISPR gRNA sequence
ggttgaatggcagtatctcg

SEQ ID NO: 622273 - DNA, 20 bp, Artificial
  CRISPR gRNA sequence
agttgctcctttcagtgctg

SEQ ID NO: 622274 - DNA, 20 bp, Artificial
  CRISPR gRNA sequence
ctggtctgtttattggggtc

SEQ ID NO: 622275 - DNA, 20 bp, Artificial
  CRISPR gRNA sequence
cagatgcctaatattttaat

SEQ ID NO: 622276 - DNA, 20 bp, Artificial
  CRISPR gRNA sequence
ttccttatgtacctcaaatt

SEQ ID NO: 622277 - DNA, 20 bp, Artificial
  CRISPR gRNA sequence
tatgggttactttttccaaa

SEQ ID NO: 622278 - DNA, 20 bp, Artificial
  CRISPR gRNA sequence
gtgattattggatgtgaaaa

SEQ ID NO: 622279 - DNA, 20 bp, Artificial
  CRISPR gRNA sequence
ataaattatattttaatgat

SEQ ID NO: 622280 - DNA, 20 bp, Artificial
  CRISPR gRNA sequence
ttaccatacaaaatgataat

SEQ ID NO: 622281 - DNA, 20 bp, Artificial
  CRISPR gRNA sequence
acagggtctcactctgtcac

SEQ ID NO: 622282 - DNA, 20 bp, Artificial
  CRISPR gRNA sequence
ccctgcctgtataatttttt

SEQ ID NO: 622283 - DNA, 20 bp, Artificial
  CRISPR gRNA sequence
tttgtacagacaagatccca

SEQ ID NO: 622284 - DNA, 20 bp, Artificial
  CRISPR gRNA sequence
cgccttggcctcccaaaatg

SEQ ID NO: 622285 - DNA, 20 bp, Artificial
  CRISPR gRNA sequence
tgtgtattaggcattgttct

SEQ ID NO: 622286 - DNA, 20 bp, Artificial
  CRISPR gRNA sequence
cacttagcaactcaaagtat

SEQ ID NO: 622287 - DNA, 20 bp, Artificial
  CRISPR gRNA sequence
agcaactcaaagtatatctg

SEQ ID NO: 622288 - DNA, 20 bp, Artificial
  CRISPR gRNA sequence
ccatgtaaacatggaaatgg

SEQ ID NO: 622289 - DNA, 20 bp, Artificial
  CRISPR gRNA sequence
ttaacattgtacgtcctcaa

SEQ ID NO: 622290 - DNA, 20 bp, Artificial
  CRISPR gRNA sequence
tgtacgtcctcaacactgtt

SEQ ID NO: 622291 - DNA, 20 bp, Artificial
  CRISPR gRNA sequence
ttgtgttcctgtaacgaaga

SEQ ID NO: 622292 - DNA, 20 bp, Artificial
  CRISPR gRNA sequence
taacatttaagatggtaata

SEQ ID NO: 622293 - DNA, 20 bp, Artificial
  CRISPR gRNA sequence
taagatggtaataatatgat

SEQ ID NO: 622294 - DNA, 20 bp, Artificial
  CRISPR gRNA sequence
tacattaaaagaggttcaaa

SEQ ID NO: 622295 - DNA, 20 bp, Artificial
  CRISPR gRNA sequence
aacagtgctttgctatattt

SEQ ID NO: 622296 - DNA, 20 bp, Artificial
  CRISPR gRNA sequence
tgctatatttaagagtttaa

SEQ ID NO: 622297 - DNA, 20 bp, Artificial
  CRISPR gRNA sequence
agagtttaaccttgtttttg

SEQ ID NO: 622298 - DNA, 20 bp, Artificial
  CRISPR gRNA sequence
ccttgtttttgccttgtttt

SEQ ID NO: 622299 - DNA, 20 bp, Artificial
  CRISPR gRNA sequence
ataagaaagctctgatgtta

SEQ ID NO: 622300 - DNA, 20 bp, Artificial
  CRISPR gRNA sequence
ggggtggctaattatttgct

SEQ ID NO: 622301 - DNA, 20 bp, Artificial
  CRISPR gRNA sequence
catgtgaatattttgacttt

SEQ ID NO: 622302 - DNA, 20 bp, Artificial
  CRISPR gRNA sequence
ttttttggtttactgacatt

SEQ ID NO: 622303 - DNA, 20 bp, Artificial
  CRISPR gRNA sequence
gtttagcatttccattgtct

SEQ ID NO: 622304 - DNA, 20 bp, Artificial
  CRISPR gRNA sequence
tagtaaatggaacatacttg

SEQ ID NO: 622305 - DNA, 20 bp, Artificial
  CRISPR gRNA sequence
aacatacttgttgagattca

SEQ ID NO: 622306 - DNA, 20 bp, Artificial
  CRISPR gRNA sequence
ggcaggagttcaaattatgg

SEQ ID NO: 622307 - DNA, 20 bp, Artificial
  CRISPR gRNA sequence
ttcagggtgtgaacatcagt

SEQ ID NO: 622308 - DNA, 20 bp, Artificial
  CRISPR gRNA sequence
cccattatctcaagaacctc

SEQ ID NO: 622309 - DNA, 20 bp, Artificial
  CRISPR gRNA sequence
tatctcaagaacctctgctg

SEQ ID NO: 622310 - DNA, 20 bp, Artificial
  CRISPR gRNA sequence
gctatgtggttaaattcttc

SEQ ID NO: 622311 - DNA, 20 bp, Artificial
  CRISPR gRNA sequence
tttattcaggaggagactag

SEQ ID NO: 622312 - DNA, 20 bp, Artificial
  CRISPR gRNA sequence
agtgttgtttactctctagt

SEQ ID NO: 622313 - DNA, 20 bp, Artificial
  CRISPR gRNA sequence
ttcctcatacctcaaattag

SEQ ID NO: 622314 - DNA, 20 bp, Artificial
  CRISPR gRNA sequence
tttcttagaccagtgcctga

SEQ ID NO: 622315 - DNA, 20 bp, Artificial
  CRISPR gRNA sequence
cgaatactgaatgaatggaa

SEQ ID NO: 622316 - DNA, 20 bp, Artificial
  CRISPR gRNA sequence
gacctgtgtaggaacatgca

SEQ ID NO: 622317 - DNA, 20 bp, Artificial
  CRISPR gRNA sequence
agtatgctttattataatgt

SEQ ID NO: 622318 - DNA, 20 bp, Artificial
  CRISPR gRNA sequence
gcgattgtatatatttatta

SEQ ID NO: 622319 - DNA, 20 bp, Artificial
  CRISPR gRNA sequence
tccagcattacctactataa

SEQ ID NO: 622320 - DNA, 20 bp, Artificial
  CRISPR gRNA sequence
catttgccttcattctagaa

SEQ ID NO: 622321 - DNA, 20 bp, Artificial
  CRISPR gRNA sequence
ccttcattctagaaataggt

SEQ ID NO: 622322 - DNA, 20 bp, Artificial
  CRISPR gRNA sequence
ttctagaaataggtttatgc

SEQ ID NO: 622323 - DNA, 20 bp, Artificial
  CRISPR gRNA sequence
ataggtttatgcttttgttt

SEQ ID NO: 622324 - DNA, 20 bp, Artificial
  CRISPR gRNA sequence
tacagttgcctcccgggttc

SEQ ID NO: 622325 - DNA, 20 bp, Artificial
  CRISPR gRNA sequence
ttttgtatttttagtagaga

SEQ ID NO: 622326 - DNA, 20 bp, Artificial
  CRISPR gRNA sequence
caggttgccctcccaaagtg

SEQ ID NO: 622327 - DNA, 20 bp, Artificial
  CRISPR gRNA sequence
agtgagccaccgcacctagc

SEQ ID NO: 622328 - DNA, 20 bp, Artificial
  CRISPR gRNA sequence
ccaccgcacctagcctgtgc

SEQ ID NO: 622329 - DNA, 20 bp, Artificial
  CRISPR gRNA sequence
gcctgtgcttttgtttctta

SEQ ID NO: 622330 - DNA, 20 bp, Artificial
  CRISPR gRNA sequence
ttttggaaaaatctcttacc

SEQ ID NO: 622331 - DNA, 20 bp, Artificial
  CRISPR gRNA sequence
aaaacttggtctttttaaat

SEQ ID NO: 622332 - DNA, 20 bp, Artificial
  CRISPR gRNA sequence
atatttgatttaattcaaaa

SEQ ID NO: 622333 - DNA, 20 bp, Artificial
  CRISPR gRNA sequence
ttaattcaaaataacgtttt

SEQ ID NO: 622334 - DNA, 20 bp, Artificial
  CRISPR gRNA sequence
ccacacctttttattataga

SEQ ID NO: 622335 - DNA, 20 bp, Artificial
  CRISPR gRNA sequence
cctttttattatagaggaag

SEQ ID NO: 622336 - DNA, 20 bp, Artificial
  CRISPR gRNA sequence
attatagaggaagatttgat

SEQ ID NO: 622337 - DNA, 20 bp, Artificial
  CRISPR gRNA sequence
ttggagttgggtgtcaatgt

SEQ ID NO: 622338 - DNA, 20 bp, Artificial
  CRISPR gRNA sequence
tcaagagatgtattagacgt

SEQ ID NO: 622339 - DNA, 20 bp, Artificial
  CRISPR gRNA sequence
attattacaggtatattagg

SEQ ID NO: 622340 - DNA, 20 bp, Artificial
  CRISPR gRNA sequence
acaggtatattaggaggagt

SEQ ID NO: 622341 - DNA, 20 bp, Artificial
  CRISPR gRNA sequence
attaactttgaaacatggtt

SEQ ID NO: 622342 - DNA, 20 bp, Artificial
  CRISPR gRNA sequence
aaacagacatttgcagagtt

SEQ ID NO: 622343 - DNA, 20 bp, Artificial
  CRISPR gRNA sequence
ttgcagagttaggggatttc

SEQ ID NO: 622344 - DNA, 20 bp, Artificial
  CRISPR gRNA sequence
aagtaggtagtatatttact

SEQ ID NO: 622345 - DNA, 20 bp, Artificial
  CRISPR gRNA sequence
ttactagaggttttaatacc

SEQ ID NO: 622346 - DNA, 20 bp, Artificial
  CRISPR gRNA sequence
tgtacaatggataaatccca

SEQ ID NO: 622347 - DNA, 20 bp, Artificial
  CRISPR gRNA sequence
taagatcattctttcctcca

SEQ ID NO: 622348 - DNA, 20 bp, Artificial
  CRISPR gRNA sequence
tttcctccaggctgatttta

SEQ ID NO: 622349 - DNA, 20 bp, Artificial
  CRISPR gRNA sequence
gtttaaactcctaaatactg

SEQ ID NO: 622350 - DNA, 20 bp, Artificial
  CRISPR gRNA sequence
taggaataaaagagacaact

SEQ ID NO: 622351 - DNA, 20 bp, Artificial
  CRISPR gRNA sequence
ccttgaaagagaagatccag

SEQ ID NO: 622352 - DNA, 20 bp, Artificial
  CRISPR gRNA sequence
ctttaaaaaacaatcagata

SEQ ID NO: 622353 - DNA, 20 bp, Artificial
  CRISPR gRNA sequence
tgataggaagtctgtatatc

SEQ ID NO: 622354 - DNA, 20 bp, Artificial
  CRISPR gRNA sequence
tgtatatctaatgatttctc

SEQ ID NO: 622355 - DNA, 20 bp, Artificial
  CRISPR gRNA sequence
agtttttgtattttggggat

SEQ ID NO: 622356 - DNA, 20 bp, Artificial
  CRISPR gRNA sequence
tgtattttggggatgcaagt

SEQ ID NO: 622357 - DNA, 20 bp, Artificial
  CRISPR gRNA sequence
agcaactgtaggatcaaggg

SEQ ID NO: 622358 - DNA, 20 bp, Artificial
  CRISPR gRNA sequence
aaagccattaagaggtaaag

SEQ ID NO: 622359 - DNA, 20 bp, Artificial
  CRISPR gRNA sequence
tggaatattgagctgggccc

SEQ ID NO: 622360 - DNA, 20 bp, Artificial
  CRISPR gRNA sequence
aaaaagaaagaaggaaagaa

SEQ ID NO: 622361 - DNA, 20 bp, Artificial
  CRISPR gRNA sequence
agaactatgattatgtgtag

SEQ ID NO: 622362 - DNA, 20 bp, Artificial
  CRISPR gRNA sequence
attgtctgtctgggtcaaaa

SEQ ID NO: 622363 - DNA, 20 bp, Artificial
  CRISPR gRNA sequence
gtaattatcaaacataatct

SEQ ID NO: 622364 - DNA, 20 bp, Artificial
  CRISPR gRNA sequence
ctttctggttggtaattttt

SEQ ID NO: 622365 - DNA, 20 bp, Artificial
  CRISPR gRNA sequence
ttggtaattttttattgctt

SEQ ID NO: 622366 - DNA, 20 bp, Artificial
  CRISPR gRNA sequence
ataatagtccaaaaagaaga

SEQ ID NO: 622367 - DNA, 20 bp, Artificial
  CRISPR gRNA sequence
ttaaactaaagagaacaatc

SEQ ID NO: 622368 - DNA, 20 bp, Artificial
  CRISPR gRNA sequence
gtatgtgagtccaaaagcca

SEQ ID NO: 622369 - DNA, 20 bp, Artificial
  CRISPR gRNA sequence
ctcagtaatttcagaaacta

SEQ ID NO: 622370 - DNA, 20 bp, Artificial
  CRISPR gRNA sequence
aatttcagaaactaggtaga

SEQ ID NO: 622371 - DNA, 20 bp, Artificial
  CRISPR gRNA sequence
ttgtgctggacgaaactgcc

SEQ ID NO: 622372 - DNA, 20 bp, Artificial
  CRISPR gRNA sequence
atggatttagataataaaaa

SEQ ID NO: 622373 - DNA, 20 bp, Artificial
  CRISPR gRNA sequence
ataatcactttttgcagatg

SEQ ID NO: 622374 - DNA, 20 bp, Artificial
  CRISPR gRNA sequence
ataaaataatttagtaatag

SEQ ID NO: 622375 - DNA, 20 bp, Artificial
  CRISPR gRNA sequence
tctttcacaggtagatgcaa

SEQ ID NO: 622376 - DNA, 20 bp, Artificial
  CRISPR gRNA sequence
aatatctaaaagtcaatttc

SEQ ID NO: 622377 - DNA, 20 bp, Artificial
  CRISPR gRNA sequence
accattggctcctacacata

SEQ ID NO: 622378 - DNA, 20 bp, Artificial
  CRISPR gRNA sequence
atataaatgtgaattggaac

SEQ ID NO: 622379 - DNA, 20 bp, Artificial
  CRISPR gRNA sequence
tataaactttgactcagtac

SEQ ID NO: 622380 - DNA, 20 bp, Artificial
  CRISPR gRNA sequence
aatttgtcaaatgttgagtg

SEQ ID NO: 622381 - DNA, 20 bp, Artificial
  CRISPR gRNA sequence
cacagatttattcattgcag

SEQ ID NO: 622382 - DNA, 20 bp, Artificial
  CRISPR gRNA sequence
tgcaaacaatgcccatcagt

SEQ ID NO: 622383 - DNA, 20 bp, Artificial
  CRISPR gRNA sequence
aacaatgcccatcagtagtg

SEQ ID NO: 622384 - DNA, 20 bp, Artificial
  CRISPR gRNA sequence
aaataagaatcatgaatatg

SEQ ID NO: 622385 - DNA, 20 bp, Artificial
  CRISPR gRNA sequence
aagatttcgaaaatatattg

SEQ ID NO: 622386 - DNA, 20 bp, Artificial
  CRISPR gRNA sequence
ttgggtaaaaaaaaccccag

SEQ ID NO: 622387 - DNA, 20 bp, Artificial
  CRISPR gRNA sequence
aagaaggtaatgaaataatt

SEQ ID NO: 622388 - DNA, 20 bp, Artificial
  CRISPR gRNA sequence
actagatatacttttatact

SEQ ID NO: 622389 - DNA, 20 bp, Artificial
  CRISPR gRNA sequence
acaactaaaccacagtaaat

SEQ ID NO: 622390 - DNA, 20 bp, Artificial
  CRISPR gRNA sequence
actgaaagtgtcagcccttc

SEQ ID NO: 622391 - DNA, 20 bp, Artificial
  CRISPR gRNA sequence
gaaactggtgtaatccatta

SEQ ID NO: 622392 - DNA, 20 bp, Artificial
  CRISPR gRNA sequence
tccccaacacccaatttaga

SEQ ID NO: 622393 - DNA, 20 bp, Artificial
  CRISPR gRNA sequence
ttacactcagatcatttgtt

SEQ ID NO: 622394 - DNA, 20 bp, Artificial
  CRISPR gRNA sequence
attttaattgcattttatat

SEQ ID NO: 622395 - DNA, 20 bp, Artificial
  CRISPR gRNA sequence
attgaacagtgtaattaagt

SEQ ID NO: 622396 - DNA, 20 bp, Artificial
  CRISPR gRNA sequence
aaatttctatagatatttta

SEQ ID NO: 622397 - DNA, 20 bp, Artificial
  CRISPR gRNA sequence
ctatagatattttaccttgc

SEQ ID NO: 622398 - DNA, 20 bp, Artificial
  CRISPR gRNA sequence
tataaatgagaacactaaat

SEQ ID NO: 622399 - DNA, 20 bp, Artificial
  CRISPR gRNA sequence
cactaaatatctgtttggaa

SEQ ID NO: 622400 - DNA, 20 bp, Artificial
  CRISPR gRNA sequence
tgggattcaagagctgtgtc

SEQ ID NO: 622401 - DNA, 20 bp, Artificial
  CRISPR gRNA sequence
gagctgtgtcttaagttttg

SEQ ID NO: 622402 - DNA, 20 bp, Artificial
  CRISPR gRNA sequence
aatattaacaagacaatatg

SEQ ID NO: 622403 - DNA, 20 bp, Artificial
  CRISPR gRNA sequence
tgcacagtttgccactacct

SEQ ID NO: 622404 - DNA, 20 bp, Artificial
  CRISPR gRNA sequence
agtttgccactacctgtaag

SEQ ID NO: 622405 - DNA, 20 bp, Artificial
  CRISPR gRNA sequence
tttgagtaaaataaagggga

SEQ ID NO: 622406 - DNA, 20 bp, Artificial
  CRISPR gRNA sequence
tttcactgctataattttgt

SEQ ID NO: 622407 - DNA, 20 bp, Artificial
  CRISPR gRNA sequence
ctataattttgtgtctgctt

SEQ ID NO: 622408 - DNA, 20 bp, Artificial
  CRISPR gRNA sequence
ttctaaaataagtctcctca

SEQ ID NO: 622409 - DNA, 20 bp, Artificial
  CRISPR gRNA sequence
aaatggagctgttaaaaacc

SEQ ID NO: 622410 - DNA, 20 bp, Artificial
  CRISPR gRNA sequence
ttaaaaaccatgtgctttaa

SEQ ID NO: 622411 - DNA, 20 bp, Artificial
  CRISPR gRNA sequence
tttttgaaatacatacatta

SEQ ID NO: 622412 - DNA, 20 bp, Artificial
  CRISPR gRNA sequence
acatacattaaaaagattat

SEQ ID NO: 622413 - DNA, 20 bp, Artificial
  CRISPR gRNA sequence
atagtggtcatttttgagtg

SEQ ID NO: 622414 - DNA, 20 bp, Artificial
  CRISPR gRNA sequence
tttttgagtgttgggattct

SEQ ID NO: 622415 - DNA, 20 bp, Artificial
  CRISPR gRNA sequence
gtgttgggattctttgtgat

SEQ ID NO: 622416 - DNA, 20 bp, Artificial
  CRISPR gRNA sequence
tgggattctttgtgattttt

SEQ ID NO: 622417 - DNA, 20 bp, Artificial
  CRISPR gRNA sequence
ttttgtttgatttatacttt

SEQ ID NO: 622418 - DNA, 20 bp, Artificial
  CRISPR gRNA sequence
gcaaaaaaagcaatatgttg

SEQ ID NO: 622419 - DNA, 20 bp, Artificial
  CRISPR gRNA sequence
caatatgttgtattgctttt

SEQ ID NO: 622420 - DNA, 20 bp, Artificial
  CRISPR gRNA sequence
tttttatgtttatgtattct

SEQ ID NO: 622421 - DNA, 20 bp, Artificial
  CRISPR gRNA sequence
ggcacctggaagcactcttg

SEQ ID NO: 622422 - DNA, 20 bp, Artificial
  CRISPR gRNA sequence
ggaccgttttcctattgagg

SEQ ID NO: 622423 - DNA, 20 bp, Artificial
  CRISPR gRNA sequence
aggtcatatcagttcagtag

SEQ ID NO: 622424 - DNA, 20 bp, Artificial
  CRISPR gRNA sequence
aaactgtggggcacagtgag

SEQ ID NO: 622425 - DNA, 20 bp, Artificial
  CRISPR gRNA sequence
ctgtcttttcatgcacacaa

SEQ ID NO: 622426 - DNA, 20 bp, Artificial
  CRISPR gRNA sequence
ggttgctccatagtaatttc

SEQ ID NO: 622427 - DNA, 20 bp, Artificial
  CRISPR gRNA sequence
taatttcaatcgtttttttc

SEQ ID NO: 622428 - DNA, 20 bp, Artificial
  CRISPR gRNA sequence
ccattctcctatcaactcag

SEQ ID NO: 622429 - DNA, 20 bp, Artificial
  CRISPR gRNA sequence
cagtagggtttcacggccgt

SEQ ID NO: 622430 - DNA, 20 bp, Artificial
  CRISPR gRNA sequence
cctaatttagcatcatgcct

SEQ ID NO: 622431 - DNA, 20 bp, Artificial
  CRISPR gRNA sequence
tggtttacatttcacttaat

SEQ ID NO: 622432 - DNA, 20 bp, Artificial
  CRISPR gRNA sequence
acacaggtaaacttcaggtc

SEQ ID NO: 622433 - DNA, 20 bp, Artificial
  CRISPR gRNA sequence
agatctttgtgatctcgcca

SEQ ID NO: 622434 - DNA, 20 bp, Artificial
  CRISPR gRNA sequence
agtttagaagtatgtatgtg

SEQ ID NO: 622435 - DNA, 20 bp, Artificial
  CRISPR gRNA sequence
tagaagtatgtatgtgtgtt

SEQ ID NO: 622436 - DNA, 20 bp, Artificial
  CRISPR gRNA sequence
cagcaatgactgaacttgaa

SEQ ID NO: 622437 - DNA, 20 bp, Artificial
  CRISPR gRNA sequence
ttctcgctacagatgagcaa

SEQ ID NO: 622438 - DNA, 20 bp, Artificial
  CRISPR gRNA sequence
tgcccaagaaatatataatt

SEQ ID NO: 622439 - DNA, 20 bp, Artificial
  CRISPR gRNA sequence
ttgtcttgtgttaacagcct

SEQ ID NO: 622440 - DNA, 20 bp, Artificial
  CRISPR gRNA sequence
gtgtctgagggaaccctaag

SEQ ID NO: 622441 - DNA, 20 bp, Artificial
  CRISPR gRNA sequence
tgtccttctatatgtgatat

SEQ ID NO: 622442 - DNA, 20 bp, Artificial
  CRISPR gRNA sequence
atatgtgatatagttgattt

SEQ ID NO: 622443 - DNA, 20 bp, Artificial
  CRISPR gRNA sequence
gatatagttgatttctaggt

SEQ ID NO: 622444 - DNA, 20 bp, Artificial
  CRISPR gRNA sequence
aatcagcagcatgatatatc

SEQ ID NO: 622445 - DNA, 20 bp, Artificial
  CRISPR gRNA sequence
atatctgctgtttatcatat

SEQ ID NO: 622446 - DNA, 20 bp, Artificial
  CRISPR gRNA sequence
atactttttggtacctttgc

SEQ ID NO: 622447 - DNA, 20 bp, Artificial
  CRISPR gRNA sequence
agagttatgagtgagacttg

SEQ ID NO: 622448 - DNA, 20 bp, Artificial
  CRISPR gRNA sequence
gagacttgagatgtttcact

SEQ ID NO: 622449 - DNA, 20 bp, Artificial
  CRISPR gRNA sequence
ttcttttttttttttttaga

SEQ ID NO: 622450 - DNA, 20 bp, Artificial
  CRISPR gRNA sequence
gagtgcagtggcaccatgat

SEQ ID NO: 622451 - DNA, 20 bp, Artificial
  CRISPR gRNA sequence
ggtctcaaacacttgggctc

SEQ ID NO: 622452 - DNA, 20 bp, Artificial
  CRISPR gRNA sequence
agccgcggcctcccaaagtg

SEQ ID NO: 622453 - DNA, 20 bp, Artificial
  CRISPR gRNA sequence
aaggatctcttaaacagaaa

SEQ ID NO: 622454 - DNA, 20 bp, Artificial
  CRISPR gRNA sequence
aattttcttttcaaccacaa

SEQ ID NO: 622455 - DNA, 20 bp, Artificial
  CRISPR gRNA sequence
acaaaagagatttttttaaa

SEQ ID NO: 622456 - DNA, 20 bp, Artificial
  CRISPR gRNA sequence
aagagatttttttaaaaaaa

SEQ ID NO: 622457 - DNA, 20 bp, Artificial
  CRISPR gRNA sequence
agatatgtaaatactaatta

SEQ ID NO: 622458 - DNA, 20 bp, Artificial
  CRISPR gRNA sequence
agtctgacaatttaaataaa

SEQ ID NO: 622459 - DNA, 20 bp, Artificial
  CRISPR gRNA sequence
tattttaggtcataaaaata

SEQ ID NO: 622460 - DNA, 20 bp, Artificial
  CRISPR gRNA sequence
aaaaatatactgattgaaga

SEQ ID NO: 622461 - DNA, 20 bp, Artificial
  CRISPR gRNA sequence
acttaagtcagtgtaaaaca

SEQ ID NO: 622462 - DNA, 20 bp, Artificial
  CRISPR gRNA sequence
aaacattacagcgaaataac

SEQ ID NO: 622463 - DNA, 20 bp, Artificial
  CRISPR gRNA sequence
gagcacagcattttcacaag

SEQ ID NO: 622464 - DNA, 20 bp, Artificial
  CRISPR gRNA sequence
tagtcgtggctgaagaagtt

SEQ ID NO: 622465 - DNA, 20 bp, Artificial
  CRISPR gRNA sequence
ggctgaagaagttctttgat

SEQ ID NO: 622466 - DNA, 20 bp, Artificial
  CRISPR gRNA sequence
gaagaagttctttgattttt

SEQ ID NO: 622467 - DNA, 20 bp, Artificial
  CRISPR gRNA sequence
atttttgtttgtttgcagaa

SEQ ID NO: 622468 - DNA, 20 bp, Artificial
  CRISPR gRNA sequence
tttaaaaaggatctttgcac

SEQ ID NO: 622469 - DNA, 20 bp, Artificial
  CRISPR gRNA sequence
aaaggatctttgcacttgtg

SEQ ID NO: 622470 - DNA, 20 bp, Artificial
  CRISPR gRNA sequence
ggtcacaattttataaattg

SEQ ID NO: 622471 - DNA, 20 bp, Artificial
  CRISPR gRNA sequence
ttttataaattggtatgttt

SEQ ID NO: 622472 - DNA, 20 bp, Artificial
  CRISPR gRNA sequence
cgccagataaaatcatttaa

SEQ ID NO: 622473 - DNA, 20 bp, Artificial
  CRISPR gRNA sequence
catttaatcaagctttttgg

SEQ ID NO: 622474 - DNA, 20 bp, Artificial
  CRISPR gRNA sequence
ttcctgcactgtatgtgcat

SEQ ID NO: 622475 - DNA, 20 bp, Artificial
  CRISPR gRNA sequence
aaggaaaacagcaagggaga

SEQ ID NO: 622476 - DNA, 20 bp, Artificial
  CRISPR gRNA sequence
aagaggattggatcttcggg

SEQ ID NO: 622477 - DNA, 20 bp, Artificial
  CRISPR gRNA sequence
gagggaaggcagtctaggga

SEQ ID NO: 622478 - DNA, 20 bp, Artificial
  CRISPR gRNA sequence
tctgtgggtagctcatgagg

SEQ ID NO: 622479 - DNA, 20 bp, Artificial
  CRISPR gRNA sequence
gttcatatatgtgaatgtct

SEQ ID NO: 622480 - DNA, 20 bp, Artificial
  CRISPR gRNA sequence
atctgagtatgggaatggct

SEQ ID NO: 622481 - DNA, 20 bp, Artificial
  CRISPR gRNA sequence
aatgcaaaagaaaatgcagg

SEQ ID NO: 622482 - DNA, 20 bp, Artificial
  CRISPR gRNA sequence
tcactggcagcaagcagagt

SEQ ID NO: 622483 - DNA, 20 bp, Artificial
  CRISPR gRNA sequence
gcttctatgcgtgcccttat

SEQ ID NO: 622484 - DNA, 20 bp, Artificial
  CRISPR gRNA sequence
ctttattaatattttggggg

SEQ ID NO: 622485 - DNA, 20 bp, Artificial
  CRISPR gRNA sequence
tagttagaaaatgtggaaaa

SEQ ID NO: 622486 - DNA, 20 bp, Artificial
  CRISPR gRNA sequence
aaggttgaggtgaaagtagt

SEQ ID NO: 622487 - DNA, 20 bp, Artificial
  CRISPR gRNA sequence
tggtgcagacaggactagca

SEQ ID NO: 622488 - DNA, 20 bp, Artificial
  CRISPR gRNA sequence
agaaccccttgcctctgccc

SEQ ID NO: 622489 - DNA, 20 bp, Artificial
  CRISPR gRNA sequence
gtccgttagaagcagtggta

SEQ ID NO: 622490 - DNA, 20 bp, Artificial
  CRISPR gRNA sequence
agtggtagagagattacaca

SEQ ID NO: 622491 - DNA, 20 bp, Artificial
  CRISPR gRNA sequence
tcagaagacaggttaacaca

SEQ ID NO: 622492 - DNA, 20 bp, Artificial
  CRISPR gRNA sequence
ctgttttaactgtactatta

SEQ ID NO: 622493 - DNA, 20 bp, Artificial
  CRISPR gRNA sequence
ctgtactattaatgtgtttt

SEQ ID NO: 622494 - DNA, 20 bp, Artificial
  CRISPR gRNA sequence
ttaaaataatgaaaacaaaa

SEQ ID NO: 622495 - DNA, 20 bp, Artificial
  CRISPR gRNA sequence
tgtaactaaggaattttatg

SEQ ID NO: 622496 - DNA, 20 bp, Artificial
  CRISPR gRNA sequence
gaattttatggtgagattat

SEQ ID NO: 622497 - DNA, 20 bp, Artificial
  CRISPR gRNA sequence
cacatctatatagactttaa

SEQ ID NO: 622498 - DNA, 20 bp, Artificial
  CRISPR gRNA sequence
cttcaaatattttgctatat

SEQ ID NO: 622499 - DNA, 20 bp, Artificial
  CRISPR gRNA sequence
tcctgtttcccctaattatt

SEQ ID NO: 622500 - DNA, 20 bp, Artificial
  CRISPR gRNA sequence
ttattgacgatcagtgatgt

SEQ ID NO: 622501 - DNA, 20 bp, Artificial
  CRISPR gRNA sequence
cgtagaaataaggaaggtta

SEQ ID NO: 622502 - DNA, 20 bp, Artificial
  CRISPR gRNA sequence
gcctttcttttcgttcagtc

SEQ ID NO: 622503 - DNA, 20 bp, Artificial
  CRISPR gRNA sequence
gtctgttgatttgataaatc

SEQ ID NO: 622504 - DNA, 20 bp, Artificial
  CRISPR gRNA sequence
taatactttttattatcctt

SEQ ID NO: 622505 - DNA, 20 bp, Artificial
  CRISPR gRNA sequence
actttttattatccttttgt

SEQ ID NO: 622506 - DNA, 20 bp, Artificial
  CRISPR gRNA sequence
ttgtttattaagctatctgt

SEQ ID NO: 622507 - DNA, 20 bp, Artificial
  CRISPR gRNA sequence
catcatttatcacaatttat

SEQ ID NO: 622508 - DNA, 20 bp, Artificial
  CRISPR gRNA sequence
agtgagaatacttatatttt

SEQ ID NO: 622509 - DNA, 20 bp, Artificial
  CRISPR gRNA sequence
tacttatattttttaagatt

SEQ ID NO: 622510 - DNA, 20 bp, Artificial
  CRISPR gRNA sequence
tgagtaacgtggttacttat

SEQ ID NO: 622511 - DNA, 20 bp, Artificial
  CRISPR gRNA sequence
tacctctcttatttttccat

SEQ ID NO: 622512 - DNA, 20 bp, Artificial
  CRISPR gRNA sequence
aaaggctgcccatttctcac

SEQ ID NO: 622513 - DNA, 20 bp, Artificial
  CRISPR gRNA sequence
gtgctttcctcttgatgcct

SEQ ID NO: 622514 - DNA, 20 bp, Artificial
  CRISPR gRNA sequence
cctcttgatgccttcatgct

SEQ ID NO: 622515 - DNA, 20 bp, Artificial
  CRISPR gRNA sequence
tgatgccttcatgcttgctg

SEQ ID NO: 622516 - DNA, 20 bp, Artificial
  CRISPR gRNA sequence
tatgacaagaagaatagaac

SEQ ID NO: 622517 - DNA, 20 bp, Artificial
  CRISPR gRNA sequence
aaattcattttgctatatgc

SEQ ID NO: 622518 - DNA, 20 bp, Artificial
  CRISPR gRNA sequence
tgtggatttttatgcattat

SEQ ID NO: 622519 - DNA, 20 bp, Artificial
  CRISPR gRNA sequence
taatttctaatgaagagtta

SEQ ID NO: 622520 - DNA, 20 bp, Artificial
  CRISPR gRNA sequence
tgaagagttattgagatttt

SEQ ID NO: 622521 - DNA, 20 bp, Artificial
  CRISPR gRNA sequence
tatttacttaaaaaatttcc

SEQ ID NO: 622522 - DNA, 20 bp, Artificial
  CRISPR gRNA sequence
cttggtgaattgtgaattgc

SEQ ID NO: 622523 - DNA, 20 bp, Artificial
  CRISPR gRNA sequence
tgtgaattgctctggtttat

SEQ ID NO: 622524 - DNA, 20 bp, Artificial
  CRISPR gRNA sequence
tatggtactatacattttaa

SEQ ID NO: 622525 - DNA, 20 bp, Artificial
  CRISPR gRNA sequence
ccactttctttttctatttc

SEQ ID NO: 622526 - DNA, 20 bp, Artificial
  CRISPR gRNA sequence
aactgccaacagcaccacgc

SEQ ID NO: 622527 - DNA, 20 bp, Artificial
  CRISPR gRNA sequence
caaagatgccgctcacaaat

SEQ ID NO: 622528 - DNA, 20 bp, Artificial
  CRISPR gRNA sequence
tctttaaaaatatgtattgt

SEQ ID NO: 622529 - DNA, 20 bp, Artificial
  CRISPR gRNA sequence
tgtattgtatgtgcttcttt

SEQ ID NO: 622530 - DNA, 20 bp, Artificial
  CRISPR gRNA sequence
caagtaaaaaagatccatgt

SEQ ID NO: 622531 - DNA, 20 bp, Artificial
  CRISPR gRNA sequence
atttaggtctacagcctgca

SEQ ID NO: 622532 - DNA, 20 bp, Artificial
  CRISPR gRNA sequence
tctacagcctgcaaattgct

SEQ ID NO: 622533 - DNA, 20 bp, Artificial
  CRISPR gRNA sequence
cagcctgcaaattgcttcct

SEQ ID NO: 622534 - DNA, 20 bp, Artificial
  CRISPR gRNA sequence
atggtgacaatgttctaagt

SEQ ID NO: 622535 - DNA, 20 bp, Artificial
  CRISPR gRNA sequence
tggatcagttatctgaaatg

SEQ ID NO: 622536 - DNA, 20 bp, Artificial
  CRISPR gRNA sequence
gagaataaagtagtaagaaa

SEQ ID NO: 622537 - DNA, 20 bp, Artificial
  CRISPR gRNA sequence
gagtgtactatcgttcgtgc

SEQ ID NO: 622538 - DNA, 20 bp, Artificial
  CRISPR gRNA sequence
tactatcgttcgtgctactg

SEQ ID NO: 622539 - DNA, 20 bp, Artificial
  CRISPR gRNA sequence
catgtatgatggaatacaga

SEQ ID NO: 622540 - DNA, 20 bp, Artificial
  CRISPR gRNA sequence
attaaaaatactcttaaggt

SEQ ID NO: 622541 - DNA, 20 bp, Artificial
  CRISPR gRNA sequence
tgctggattattcatttgat

SEQ ID NO: 622542 - DNA, 20 bp, Artificial
  CRISPR gRNA sequence
tggacataaacatttttaat

SEQ ID NO: 622543 - DNA, 20 bp, Artificial
  CRISPR gRNA sequence
aatttaatttggagcctagg

SEQ ID NO: 622544 - DNA, 20 bp, Artificial
  CRISPR gRNA sequence
tgtatatcataattctttcc

SEQ ID NO: 622545 - DNA, 20 bp, Artificial
  CRISPR gRNA sequence
atttgacctctgaaagaaga

SEQ ID NO: 622546 - DNA, 20 bp, Artificial
  CRISPR gRNA sequence
atcttagtcactacctattc

SEQ ID NO: 622547 - DNA, 20 bp, Artificial
  CRISPR gRNA sequence
ataactaatgaaaacatttt

SEQ ID NO: 622548 - DNA, 20 bp, Artificial
  CRISPR gRNA sequence
tgaaaacatttttatggttt

SEQ ID NO: 622549 - DNA, 20 bp, Artificial
  CRISPR gRNA sequence
tttctgagattttttttaaa

SEQ ID NO: 622550 - DNA, 20 bp, Artificial
  CRISPR gRNA sequence
aatgttgtctgtccatctca

SEQ ID NO: 622551 - DNA, 20 bp, Artificial
  CRISPR gRNA sequence
ctcataggtatagggaaaat

SEQ ID NO: 622552 - DNA, 20 bp, Artificial
  CRISPR gRNA sequence
ggtatagggaaaataggtga

SEQ ID NO: 622553 - DNA, 20 bp, Artificial
  CRISPR gRNA sequence
ctaaacattttaatatatta

SEQ ID NO: 622554 - DNA, 20 bp, Artificial
  CRISPR gRNA sequence
tttaatatattattgagttt

SEQ ID NO: 622555 - DNA, 20 bp, Artificial
  CRISPR gRNA sequence
gtattcctaagtatattgta

SEQ ID NO: 622556 - DNA, 20 bp, Artificial
  CRISPR gRNA sequence
cctgtaaggttactcttatt

SEQ ID NO: 622557 - DNA, 20 bp, Artificial
  CRISPR gRNA sequence
tactcttattggttgttttt

SEQ ID NO: 622558 - DNA, 20 bp, Artificial
  CRISPR gRNA sequence
atttagtgactattgcacgg

SEQ ID NO: 622559 - DNA, 20 bp, Artificial
  CRISPR gRNA sequence
ttaagacagtatgttaaata

SEQ ID NO: 622560 - DNA, 20 bp, Artificial
  CRISPR gRNA sequence
actattttttaaaattcata

SEQ ID NO: 622561 - DNA, 20 bp, Artificial
  CRISPR gRNA sequence
aaattcatacctagtttgaa

SEQ ID NO: 622562 - DNA, 20 bp, Artificial
  CRISPR gRNA sequence
tgtaagtgaaacaccattaa

SEQ ID NO: 622563 - DNA, 20 bp, Artificial
  CRISPR gRNA sequence
aaacaccattaataaggatt

SEQ ID NO: 622564 - DNA, 20 bp, Artificial
  CRISPR gRNA sequence
aaggatttttagttttaaat

SEQ ID NO: 622565 - DNA, 20 bp, Artificial
  CRISPR gRNA sequence
atttttagttttaaatttta

SEQ ID NO: 622566 - DNA, 20 bp, Artificial
  CRISPR gRNA sequence
attaaatatagaagttgagt

SEQ ID NO: 622567 - DNA, 20 bp, Artificial
  CRISPR gRNA sequence
taaatgcttaaaactgtcac

SEQ ID NO: 622568 - DNA, 20 bp, Artificial
  CRISPR gRNA sequence
ttgatagagtaataaaaata

SEQ ID NO: 622569 - DNA, 20 bp, Artificial
  CRISPR gRNA sequence
ataaaaatagggggcttgta

SEQ ID NO: 622570 - DNA, 20 bp, Artificial
  CRISPR gRNA sequence
ttttgtttttgtcaaatttg

SEQ ID NO: 622571 - DNA, 20 bp, Artificial
  CRISPR gRNA sequence
tgacattagaagagttatcc

SEQ ID NO: 622572 - DNA, 20 bp, Artificial
  CRISPR gRNA sequence
tatccatgtgcttagtgtca

SEQ ID NO: 622573 - DNA, 20 bp, Artificial
  CRISPR gRNA sequence
agtaacttatgtggataacc

SEQ ID NO: 622574 - DNA, 20 bp, Artificial
  CRISPR gRNA sequence
acctagtaataactatcatt

SEQ ID NO: 622575 - DNA, 20 bp, Artificial
  CRISPR gRNA sequence
ctaaaaaagctaacattaaa

SEQ ID NO: 622576 - DNA, 20 bp, Artificial
  CRISPR gRNA sequence
aaaacatgcttttgttcata

SEQ ID NO: 622577 - DNA, 20 bp, Artificial
  CRISPR gRNA sequence
tcataatatgattacacatc

SEQ ID NO: 622578 - DNA, 20 bp, Artificial
  CRISPR gRNA sequence
atgattacacatcttgtgct

SEQ ID NO: 622579 - DNA, 20 bp, Artificial
  CRISPR gRNA sequence
aacatgtactgggtaaagaa

SEQ ID NO: 622580 - DNA, 20 bp, Artificial
  CRISPR gRNA sequence
actgggtaaagaatgttgtt

SEQ ID NO: 622581 - DNA, 20 bp, Artificial
  CRISPR gRNA sequence
agttggtatagggagtaaga

SEQ ID NO: 622582 - DNA, 20 bp, Artificial
  CRISPR gRNA sequence
catgttcaagttacacttga

SEQ ID NO: 622583 - DNA, 20 bp, Artificial
  CRISPR gRNA sequence
tttcaaaaaaagcagatgag

SEQ ID NO: 622584 - DNA, 20 bp, Artificial
  CRISPR gRNA sequence
cttacagtaatatttacaat

SEQ ID NO: 622585 - DNA, 20 bp, Artificial
  CRISPR gRNA sequence
gaggaggctgacttttgtca

SEQ ID NO: 622586 - DNA, 20 bp, Artificial
  CRISPR gRNA sequence
ttcatcagtatatgaataaa

SEQ ID NO: 622587 - DNA, 20 bp, Artificial
  CRISPR gRNA sequence
atgaataaactcagtttact

SEQ ID NO: 622588 - DNA, 20 bp, Artificial
  CRISPR gRNA sequence
aatatttaattgaattttta

SEQ ID NO: 622589 - DNA, 20 bp, Artificial
  CRISPR gRNA sequence
ttgttttcttcatttggtcc

SEQ ID NO: 622590 - DNA, 20 bp, Artificial
  CRISPR gRNA sequence
tctgcctaataacctttgca

SEQ ID NO: 622591 - DNA, 20 bp, Artificial
  CRISPR gRNA sequence
aataacctttgcacagtgtt

SEQ ID NO: 622592 - DNA, 20 bp, Artificial
  CRISPR gRNA sequence
gaggataaaaactatcaagg

SEQ ID NO: 622593 - DNA, 20 bp, Artificial
  CRISPR gRNA sequence
attagaagaggtgactgact

SEQ ID NO: 622594 - DNA, 20 bp, Artificial
  CRISPR gRNA sequence
agaaacaagtgcctgcatgt

SEQ ID NO: 622595 - DNA, 20 bp, Artificial
  CRISPR gRNA sequence
ctgagccaatccccagacaa

SEQ ID NO: 622596 - DNA, 20 bp, Artificial
  CRISPR gRNA sequence
ttaaccgggacagagtgaga

SEQ ID NO: 622597 - DNA, 20 bp, Artificial
  CRISPR gRNA sequence
cgggacagagtgagagaatg

SEQ ID NO: 622598 - DNA, 20 bp, Artificial
  CRISPR gRNA sequence
tgtctgcccatcacctaagg

SEQ ID NO: 622599 - DNA, 20 bp, Artificial
  CRISPR gRNA sequence
gtctgttcatttttgtatag

SEQ ID NO: 622600 - DNA, 20 bp, Artificial
  CRISPR gRNA sequence
caaagtagttatgttagact

SEQ ID NO: 622601 - DNA, 20 bp, Artificial
  CRISPR gRNA sequence
tatgttagactttgagattt

SEQ ID NO: 622602 - DNA, 20 bp, Artificial
  CRISPR gRNA sequence
tttgagatttttttgttttc

SEQ ID NO: 622603 - DNA, 20 bp, Artificial
  CRISPR gRNA sequence
cattagtaagggtgatcatt

SEQ ID NO: 622604 - DNA, 20 bp, Artificial
  CRISPR gRNA sequence
taaatgtcatgggtgcctca

SEQ ID NO: 622605 - DNA, 20 bp, Artificial
  CRISPR gRNA sequence
ataatgtacattcaaacctc

SEQ ID NO: 622606 - DNA, 20 bp, Artificial
  CRISPR gRNA sequence
aaacctcttttgattccagg

SEQ ID NO: 622607 - DNA, 20 bp, Artificial
  CRISPR gRNA sequence
gtaagtcctaaaattggaaa

SEQ ID NO: 622608 - DNA, 20 bp, Artificial
  CRISPR gRNA sequence
tgcacattagaatcatctgg

SEQ ID NO: 622609 - DNA, 20 bp, Artificial
  CRISPR gRNA sequence
gggtagggctcaggcattga

SEQ ID NO: 622610 - DNA, 20 bp, Artificial
  CRISPR gRNA sequence
acctaacttctgtgactttt

SEQ ID NO: 622611 - DNA, 20 bp, Artificial
  CRISPR gRNA sequence
aacttctgtgacttttttga

SEQ ID NO: 622612 - DNA, 20 bp, Artificial
  CRISPR gRNA sequence
gagattgattaattcatgtt

SEQ ID NO: 622613 - DNA, 20 bp, Artificial
  CRISPR gRNA sequence
gttttaatcactcttgtaaa

SEQ ID NO: 622614 - DNA, 20 bp, Artificial
  CRISPR gRNA sequence
ttgatatacttctgttcctt

SEQ ID NO: 622615 - DNA, 20 bp, Artificial
  CRISPR gRNA sequence
caaccattaatttaaggtaa

SEQ ID NO: 622616 - DNA, 20 bp, Artificial
  CRISPR gRNA sequence
accttttaattacaaataaa

SEQ ID NO: 622617 - DNA, 20 bp, Artificial
  CRISPR gRNA sequence
cgtaatataggagtcacaat

SEQ ID NO: 622618 - DNA, 20 bp, Artificial
  CRISPR gRNA sequence
agttcttaaagagttattaa

SEQ ID NO: 622619 - DNA, 20 bp, Artificial
  CRISPR gRNA sequence
tggacataaaggctaaatgt

SEQ ID NO: 622620 - DNA, 20 bp, Artificial
  CRISPR gRNA sequence
tatgaaatcaagagtgaatg

SEQ ID NO: 622621 - DNA, 20 bp, Artificial
  CRISPR gRNA sequence
ttatacaggttatacagtgt

SEQ ID NO: 622622 - DNA, 20 bp, Artificial
  CRISPR gRNA sequence
acaggttatacagtgtaact

SEQ ID NO: 622623 - DNA, 20 bp, Artificial
  CRISPR gRNA sequence
taactgtttgcttcatggtg

SEQ ID NO: 622624 - DNA, 20 bp, Artificial
  CRISPR gRNA sequence
ttttcaattatggcagagat

SEQ ID NO: 622625 - DNA, 20 bp, Artificial
  CRISPR gRNA sequence
atagaagtttaattctttag

SEQ ID NO: 622626 - DNA, 20 bp, Artificial
  CRISPR gRNA sequence
atcaatttatattattataa

SEQ ID NO: 622627 - DNA, 20 bp, Artificial
  CRISPR gRNA sequence
agaatcaccatagttaacta

SEQ ID NO: 622628 - DNA, 20 bp, Artificial
  CRISPR gRNA sequence
attaaactgcatgccattag

SEQ ID NO: 622629 - DNA, 20 bp, Artificial
  CRISPR gRNA sequence
tctttaaaaatatagaaaat

SEQ ID NO: 622630 - DNA, 20 bp, Artificial
  CRISPR gRNA sequence
taatagtttagtctttcaat

SEQ ID NO: 622631 - DNA, 20 bp, Artificial
  CRISPR gRNA sequence
ttcaataattgattttaaat

SEQ ID NO: 622632 - DNA, 20 bp, Artificial
  CRISPR gRNA sequence
cactttaaaataataaaata

SEQ ID NO: 622633 - DNA, 20 bp, Artificial
  CRISPR gRNA sequence
attataaatgatgaaagcta

SEQ ID NO: 622634 - DNA, 20 bp, Artificial
  CRISPR gRNA sequence
taaatgatgaaagctactga

SEQ ID NO: 622635 - DNA, 20 bp, Artificial
  CRISPR gRNA sequence
tttaacatcaataacattgt

SEQ ID NO: 622636 - DNA, 20 bp, Artificial
  CRISPR gRNA sequence
tgatagcattacattggtaa

SEQ ID NO: 622637 - DNA, 20 bp, Artificial
  CRISPR gRNA sequence
tgttttgacacagtactcat

SEQ ID NO: 622638 - DNA, 20 bp, Artificial
  CRISPR gRNA sequence
attgacacctcattttggac

SEQ ID NO: 622639 - DNA, 20 bp, Artificial
  CRISPR gRNA sequence
ttatatatgggaactttata

SEQ ID NO: 622640 - DNA, 20 bp, Artificial
  CRISPR gRNA sequence
agaaacctgttagaaatgca

SEQ ID NO: 622641 - DNA, 20 bp, Artificial
  CRISPR gRNA sequence
attggaaattactttcggta

SEQ ID NO: 622642 - DNA, 20 bp, Artificial
  CRISPR gRNA sequence
agaatttcttaatgacatgg

SEQ ID NO: 622643 - DNA, 20 bp, Artificial
  CRISPR gRNA sequence
tatatatacatccatacatt

SEQ ID NO: 622644 - DNA, 20 bp, Artificial
  CRISPR gRNA sequence
ctaaaatgttaaaaataggg

SEQ ID NO: 622645 - DNA, 20 bp, Artificial
  CRISPR gRNA sequence
aaataggggtaggtttaggt

SEQ ID NO: 622646 - DNA, 20 bp, Artificial
  CRISPR gRNA sequence
gtttaaatatctctgtaaat

SEQ ID NO: 622647 - DNA, 20 bp, Artificial
  CRISPR gRNA sequence
atcagaaaaagaatagaaaa

SEQ ID NO: 622648 - DNA, 20 bp, Artificial
  CRISPR gRNA sequence
caaagtttttacctatagtt

SEQ ID NO: 622649 - DNA, 20 bp, Artificial
  CRISPR gRNA sequence
gcagctttattttggtgggg

SEQ ID NO: 622650 - DNA, 20 bp, Artificial
  CRISPR gRNA sequence
ctttattttggtggggccat

SEQ ID NO: 622651 - DNA, 20 bp, Artificial
  CRISPR gRNA sequence
tatttcctattctctggcta

SEQ ID NO: 622652 - DNA, 20 bp, Artificial
  CRISPR gRNA sequence
tctttcatgtgaaattcgca

SEQ ID NO: 622653 - DNA, 20 bp, Artificial
  CRISPR gRNA sequence
ctccaagtcatactacttaa

SEQ ID NO: 622654 - DNA, 20 bp, Artificial
  CRISPR gRNA sequence
aattaggaatttcccctgaa

SEQ ID NO: 622655 - DNA, 20 bp, Artificial
  CRISPR gRNA sequence
agttctagtgaaatagtgaa

SEQ ID NO: 622656 - DNA, 20 bp, Artificial
  CRISPR gRNA sequence
ccataagaaacttcagtaaa

SEQ ID NO: 622657 - DNA, 20 bp, Artificial
  CRISPR gRNA sequence
aaaacatattttaatcttta

SEQ ID NO: 622658 - DNA, 20 bp, Artificial
  CRISPR gRNA sequence
ctgtggttaaataacatatg

SEQ ID NO: 622659 - DNA, 20 bp, Artificial
  CRISPR gRNA sequence
acatatgcatggttttaaat

SEQ ID NO: 622660 - DNA, 20 bp, Artificial
  CRISPR gRNA sequence
gttttaaatttttgattctt

SEQ ID NO: 622661 - DNA, 20 bp, Artificial
  CRISPR gRNA sequence
tattttttaaagctcttcat

SEQ ID NO: 622662 - DNA, 20 bp, Artificial
  CRISPR gRNA sequence
ttttacagactattttaatt

SEQ ID NO: 622663 - DNA, 20 bp, Artificial
  CRISPR gRNA sequence
ccaaagagtctaatatgcac

SEQ ID NO: 622664 - DNA, 20 bp, Artificial
  CRISPR gRNA sequence
tatgcaccccagtttgggga

SEQ ID NO: 622665 - DNA, 20 bp, Artificial
  CRISPR gRNA sequence
aatgaatcttggatatttaa

SEQ ID NO: 622666 - DNA, 20 bp, Artificial
  CRISPR gRNA sequence
ttctaatttttaatttaatg

SEQ ID NO: 622667 - DNA, 20 bp, Artificial
  CRISPR gRNA sequence
ctatctatatgcacatttat

SEQ ID NO: 622668 - DNA, 20 bp, Artificial
  CRISPR gRNA sequence
ttttaatgttcacttactta

SEQ ID NO: 622669 - DNA, 20 bp, Artificial
  CRISPR gRNA sequence
cacatttatactgatatttg

SEQ ID NO: 622670 - DNA, 20 bp, Artificial
  CRISPR gRNA sequence
tttgagttcagatctgaact

SEQ ID NO: 622671 - DNA, 20 bp, Artificial
  CRISPR gRNA sequence
gtacttttagttgcctttat

SEQ ID NO: 622672 - DNA, 20 bp, Artificial
  CRISPR gRNA sequence
taccacttcactcaaattta

SEQ ID NO: 622673 - DNA, 20 bp, Artificial
  CRISPR gRNA sequence
ttcagacttgaaatcttgga

SEQ ID NO: 622674 - DNA, 20 bp, Artificial
  CRISPR gRNA sequence
gaatcagattacttaatatt

SEQ ID NO: 622675 - DNA, 20 bp, Artificial
  CRISPR gRNA sequence
ggtatcttgttctttttccg

SEQ ID NO: 622676 - DNA, 20 bp, Artificial
  CRISPR gRNA sequence
tctttttccgttaagatttc

SEQ ID NO: 622677 - DNA, 20 bp, Artificial
  CRISPR gRNA sequence
tatgcacccagcacttacag

SEQ ID NO: 622678 - DNA, 20 bp, Artificial
  CRISPR gRNA sequence
tactggttgctaaaatatta

SEQ ID NO: 622679 - DNA, 20 bp, Artificial
  CRISPR gRNA sequence
aaatattaaaatgcttttgt

SEQ ID NO: 622680 - DNA, 20 bp, Artificial
  CRISPR gRNA sequence
acctgtactcccttcatccc

SEQ ID NO: 622681 - DNA, 20 bp, Artificial
  CRISPR gRNA sequence
tcccaagagctttgtgggta

SEQ ID NO: 622682 - DNA, 20 bp, Artificial
  CRISPR gRNA sequence
ctctcccaggctaggggggt

SEQ ID NO: 622683 - DNA, 20 bp, Artificial
  CRISPR gRNA sequence
tcttgccagctctctcttgc

SEQ ID NO: 622684 - DNA, 20 bp, Artificial
  CRISPR gRNA sequence
actgcagcctctctgctgtt

SEQ ID NO: 622685 - DNA, 20 bp, Artificial
  CRISPR gRNA sequence
gctatcaccctatctttact

SEQ ID NO: 622686 - DNA, 20 bp, Artificial
  CRISPR gRNA sequence
ccaagcttcatagctgttat

SEQ ID NO: 622687 - DNA, 20 bp, Artificial
  CRISPR gRNA sequence
ttatcaactcactttaccat

SEQ ID NO: 622688 - DNA, 20 bp, Artificial
  CRISPR gRNA sequence
catacctttctcagatgaac

SEQ ID NO: 622689 - DNA, 20 bp, Artificial
  CRISPR gRNA sequence
agatgttcttatttaccttt

SEQ ID NO: 622690 - DNA, 20 bp, Artificial
  CRISPR gRNA sequence
atctctggagttctctcttg

SEQ ID NO: 622691 - DNA, 20 bp, Artificial
  CRISPR gRNA sequence
aacatttcctctaagttata

SEQ ID NO: 622692 - DNA, 20 bp, Artificial
  CRISPR gRNA sequence
tctgttcttagaatccacat

SEQ ID NO: 622693 - DNA, 20 bp, Artificial
  CRISPR gRNA sequence
gcaaagcatgcgatgtacaa

SEQ ID NO: 622694 - DNA, 20 bp, Artificial
  CRISPR gRNA sequence
ttatctaataaaatatttct

SEQ ID NO: 622695 - DNA, 20 bp, Artificial
  CRISPR gRNA sequence
ggcttactttgggtcaggca

SEQ ID NO: 622696 - DNA, 20 bp, Artificial
  CRISPR gRNA sequence
cagacaaggctctatcctta

SEQ ID NO: 622697 - DNA, 20 bp, Artificial
  CRISPR gRNA sequence
attaaaaagaacatcgggtc

SEQ ID NO: 622698 - DNA, 20 bp, Artificial
  CRISPR gRNA sequence
atcgggtccttagtttatat

SEQ ID NO: 622699 - DNA, 20 bp, Artificial
  CRISPR gRNA sequence
aggccccgcagcaggaaaaa

SEQ ID NO: 622700 - DNA, 20 bp, Artificial
  CRISPR gRNA sequence
tgtaatatactttatttttt

SEQ ID NO: 622701 - DNA, 20 bp, Artificial
  CRISPR gRNA sequence
ttgaggatttggggaagaat

SEQ ID NO: 622702 - DNA, 20 bp, Artificial
  CRISPR gRNA sequence
ttgaacactgacttggtaga

SEQ ID NO: 622703 - DNA, 20 bp, Artificial
  CRISPR gRNA sequence
ctgacttggtagaatttgat

SEQ ID NO: 622704 - DNA, 20 bp, Artificial
  CRISPR gRNA sequence
gagcagatatttaaatctag

SEQ ID NO: 622705 - DNA, 20 bp, Artificial
  CRISPR gRNA sequence
tgtattacttgaataacttt

SEQ ID NO: 622706 - DNA, 20 bp, Artificial
  CRISPR gRNA sequence
agctggttcctggggaggag

SEQ ID NO: 622707 - DNA, 20 bp, Artificial
  CRISPR gRNA sequence
cccagtctctggaaagggca

SEQ ID NO: 622708 - DNA, 20 bp, Artificial
  CRISPR gRNA sequence
agaccagtagccttgtgaat

SEQ ID NO: 622709 - DNA, 20 bp, Artificial
  CRISPR gRNA sequence
cttgtgaatagcagattaat

SEQ ID NO: 622710 - DNA, 20 bp, Artificial
  CRISPR gRNA sequence
gtagaggaggttattatggt

SEQ ID NO: 622711 - DNA, 20 bp, Artificial
  CRISPR gRNA sequence
tatggttacagtttataaaa

SEQ ID NO: 622712 - DNA, 20 bp, Artificial
  CRISPR gRNA sequence
ttgggaggccaaggcaggag

SEQ ID NO: 622713 - DNA, 20 bp, Artificial
  CRISPR gRNA sequence
gaagtcgatgctgcagtgag

SEQ ID NO: 622714 - DNA, 20 bp, Artificial
  CRISPR gRNA sequence
cacacacgcacacacacaca

SEQ ID NO: 622715 - DNA, 20 bp, Artificial
  CRISPR gRNA sequence
gcttatactctctttcacag

SEQ ID NO: 622716 - DNA, 20 bp, Artificial
  CRISPR gRNA sequence
atctcatatctacctttccc

SEQ ID NO: 622717 - DNA, 20 bp, Artificial
  CRISPR gRNA sequence
aattcctttcttcttcagac

SEQ ID NO: 622718 - DNA, 20 bp, Artificial
  CRISPR gRNA sequence
ttgtcagctgtgtgtcatgc

SEQ ID NO: 622719 - DNA, 20 bp, Artificial
  CRISPR gRNA sequence
aggtttgataaacatgcctt

SEQ ID NO: 622720 - DNA, 20 bp, Artificial
  CRISPR gRNA sequence
cctatggcacacaacctgag

SEQ ID NO: 622721 - DNA, 20 bp, Artificial
  CRISPR gRNA sequence
aacatcttgtcattaatcaa

SEQ ID NO: 622722 - DNA, 20 bp, Artificial
  CRISPR gRNA sequence
ttcgacctcaagaacattat

SEQ ID NO: 622723 - DNA, 20 bp, Artificial
  CRISPR gRNA sequence
aaagtccacatttttaaact

SEQ ID NO: 622724 - DNA, 20 bp, Artificial
  CRISPR gRNA sequence
ttcattgtaagcatatttat

SEQ ID NO: 622725 - DNA, 20 bp, Artificial
  CRISPR gRNA sequence
tctgagcctgtattaatttc

SEQ ID NO: 622726 - DNA, 20 bp, Artificial
  CRISPR gRNA sequence
taacgaactaccacagactg

SEQ ID NO: 622727 - DNA, 20 bp, Artificial
  CRISPR gRNA sequence
gactgggtggcttaaacaac

SEQ ID NO: 622728 - DNA, 20 bp, Artificial
  CRISPR gRNA sequence
cagttctggaggctggaagt

SEQ ID NO: 622729 - DNA, 20 bp, Artificial
  CRISPR gRNA sequence
gagattaaggtgtaagcagt

SEQ ID NO: 622730 - DNA, 20 bp, Artificial
  CRISPR gRNA sequence
tgctgatattccttggtgtt

SEQ ID NO: 622731 - DNA, 20 bp, Artificial
  CRISPR gRNA sequence
tttgtaaggacaccagtcac

SEQ ID NO: 622732 - DNA, 20 bp, Artificial
  CRISPR gRNA sequence
atctgcaatttttaaagaaa

SEQ ID NO: 622733 - DNA, 20 bp, Artificial
  CRISPR gRNA sequence
taaagaaacttagtttttaa

SEQ ID NO: 622734 - DNA, 20 bp, Artificial
  CRISPR gRNA sequence
gaaacttagtttttaaattg

SEQ ID NO: 622735 - DNA, 20 bp, Artificial
  CRISPR gRNA sequence
ggagttagtgacagaaaaga

SEQ ID NO: 622736 - DNA, 20 bp, Artificial
  CRISPR gRNA sequence
ttagtgacagaaaagaccat

SEQ ID NO: 622737 - DNA, 20 bp, Artificial
  CRISPR gRNA sequence
ttaacctaaaggcagaacca

SEQ ID NO: 622738 - DNA, 20 bp, Artificial
  CRISPR gRNA sequence
aagacacatatactttagtg

SEQ ID NO: 622739 - DNA, 20 bp, Artificial
  CRISPR gRNA sequence
ctctactactggccgcactg

SEQ ID NO: 622740 - DNA, 20 bp, Artificial
  CRISPR gRNA sequence
acatttctcccctagttccc

SEQ ID NO: 622741 - DNA, 20 bp, Artificial
  CRISPR gRNA sequence
acttcctatcaggagaaaat

SEQ ID NO: 622742 - DNA, 20 bp, Artificial
  CRISPR gRNA sequence
aaaatcagtgcttgagtcaa

SEQ ID NO: 622743 - DNA, 20 bp, Artificial
  CRISPR gRNA sequence
cttgagtcaaggatgcttct

SEQ ID NO: 622744 - DNA, 20 bp, Artificial
  CRISPR gRNA sequence
atgcatgtacatggttacaa

SEQ ID NO: 622745 - DNA, 20 bp, Artificial
  CRISPR gRNA sequence
aaatgttctattacaaaagc

SEQ ID NO: 622746 - DNA, 20 bp, Artificial
  CRISPR gRNA sequence
acttgaggaacagcaagggt

SEQ ID NO: 622747 - DNA, 20 bp, Artificial
  CRISPR gRNA sequence
aggaacagcaagggtaccag

SEQ ID NO: 622748 - DNA, 20 bp, Artificial
  CRISPR gRNA sequence
aagtgagaaggtctgcgtga

SEQ ID NO: 622749 - DNA, 20 bp, Artificial
  CRISPR gRNA sequence
tagagcctgttggacttgct

SEQ ID NO: 622750 - DNA, 20 bp, Artificial
  CRISPR gRNA sequence
gaggtctaaggagtgactgc

SEQ ID NO: 622751 - DNA, 20 bp, Artificial
  CRISPR gRNA sequence
ctaaggagtgactgctagtg

SEQ ID NO: 622752 - DNA, 20 bp, Artificial
  CRISPR gRNA sequence
tgacttggggaaatgaagag

SEQ ID NO: 622753 - DNA, 20 bp, Artificial
  CRISPR gRNA sequence
agagctctgttttgaacagg

SEQ ID NO: 622754 - DNA, 20 bp, Artificial
  CRISPR gRNA sequence
ttaatcaaaatgtcttagcc

SEQ ID NO: 622755 - DNA, 20 bp, Artificial
  CRISPR gRNA sequence
ctcctgcagagtagtgcaat

SEQ ID NO: 622756 - DNA, 20 bp, Artificial
  CRISPR gRNA sequence
gcagagaaccaaagctaccc

SEQ ID NO: 622757 - DNA, 20 bp, Artificial
  CRISPR gRNA sequence
tctttgaaggtaacattaga

SEQ ID NO: 622758 - DNA, 20 bp, Artificial
  CRISPR gRNA sequence
aacctccgccttctgggttc

SEQ ID NO: 622759 - DNA, 20 bp, Artificial
  CRISPR gRNA sequence
ggttcaagcgattctcctgc

SEQ ID NO: 622760 - DNA, 20 bp, Artificial
  CRISPR gRNA sequence
ctgcctcagattcccaagtg

SEQ ID NO: 622761 - DNA, 20 bp, Artificial
  CRISPR gRNA sequence
ccactatgactggctaattt

SEQ ID NO: 622762 - DNA, 20 bp, Artificial
  CRISPR gRNA sequence
ttttatgtttttactagaga

SEQ ID NO: 622763 - DNA, 20 bp, Artificial
  CRISPR gRNA sequence
ggtttcaccatgttggccag

SEQ ID NO: 622764 - DNA, 20 bp, Artificial
  CRISPR gRNA sequence
tgcctcagcctctcaaattg

SEQ ID NO: 622765 - DNA, 20 bp, Artificial
  CRISPR gRNA sequence
gccaggaaaattatttttaa

SEQ ID NO: 622766 - DNA, 20 bp, Artificial
  CRISPR gRNA sequence
ttttaaagctgtttttaaat

SEQ ID NO: 622767 - DNA, 20 bp, Artificial
  CRISPR gRNA sequence
ccattactgggtatataccc

SEQ ID NO: 622768 - DNA, 20 bp, Artificial
  CRISPR gRNA sequence
ctataaagacacatgcacac

SEQ ID NO: 622769 - DNA, 20 bp, Artificial
  CRISPR gRNA sequence
caaatgtccatcagtgatag

SEQ ID NO: 622770 - DNA, 20 bp, Artificial
  CRISPR gRNA sequence
agaactacaaagtattaaaa

SEQ ID NO: 622771 - DNA, 20 bp, Artificial
  CRISPR gRNA sequence
aggaactttctgaattataa

SEQ ID NO: 622772 - DNA, 20 bp, Artificial
  CRISPR gRNA sequence
atgtgattagtgacatgagt

SEQ ID NO: 622773 - DNA, 20 bp, Artificial
  CRISPR gRNA sequence
gagtcaaatacagcaacagg

SEQ ID NO: 622774 - DNA, 20 bp, Artificial
  CRISPR gRNA sequence
ttagcattttttttcctctg

SEQ ID NO: 622775 - DNA, 20 bp, Artificial
  CRISPR gRNA sequence
tatacattgcatatcaagac

SEQ ID NO: 622776 - DNA, 20 bp, Artificial
  CRISPR gRNA sequence
tatcaagacctttgatttgc

SEQ ID NO: 622777 - DNA, 20 bp, Artificial
  CRISPR gRNA sequence
tttgatttgctcgggttttc

SEQ ID NO: 622778 - DNA, 20 bp, Artificial
  CRISPR gRNA sequence
ctgatttgacttcccctacc

SEQ ID NO: 622779 - DNA, 20 bp, Artificial
  CRISPR gRNA sequence
cctaccttttgtttcaaaac

SEQ ID NO: 622780 - DNA, 20 bp, Artificial
  CRISPR gRNA sequence
aagtgtactggtattgtgga

SEQ ID NO: 622781 - DNA, 20 bp, Artificial
  CRISPR gRNA sequence
gatcacttaataaaaccaca

SEQ ID NO: 622782 - DNA, 20 bp, Artificial
  CRISPR gRNA sequence
ccagtcttagccagtataac

SEQ ID NO: 622783 - DNA, 20 bp, Artificial
  CRISPR gRNA sequence
tcagcataatagttaataat

SEQ ID NO: 622784 - DNA, 20 bp, Artificial
  CRISPR gRNA sequence
ctttacccattcctaaaatt

SEQ ID NO: 622785 - DNA, 20 bp, Artificial
  CRISPR gRNA sequence
gggctgctggactagtgcct

SEQ ID NO: 622786 - DNA, 20 bp, Artificial
  CRISPR gRNA sequence
tttagggatatgcagtaaag

SEQ ID NO: 622787 - DNA, 20 bp, Artificial
  CRISPR gRNA sequence
gtaaaggtgagcttccgggc

SEQ ID NO: 622788 - DNA, 20 bp, Artificial
  CRISPR gRNA sequence
taccatgggatcaggatcac

SEQ ID NO: 622789 - DNA, 20 bp, Artificial
  CRISPR gRNA sequence
tcatcttgtccacagaaatt

SEQ ID NO: 622790 - DNA, 20 bp, Artificial
  CRISPR gRNA sequence
gaaatttagagcttatttta

SEQ ID NO: 622791 - DNA, 20 bp, Artificial
  CRISPR gRNA sequence
actggtaaattagtaacatt

SEQ ID NO: 622792 - DNA, 20 bp, Artificial
  CRISPR gRNA sequence
ttcaaacagttacagcattc

SEQ ID NO: 622793 - DNA, 20 bp, Artificial
  CRISPR gRNA sequence
agcattccagggattctttc

SEQ ID NO: 622794 - DNA, 20 bp, Artificial
  CRISPR gRNA sequence
gaacataaggttcactagta

SEQ ID NO: 622795 - DNA, 20 bp, Artificial
  CRISPR gRNA sequence
agtgttttaggtgaaaattc

SEQ ID NO: 622796 - DNA, 20 bp, Artificial
  CRISPR gRNA sequence
tttttccaagtccaagtaat

SEQ ID NO: 622797 - DNA, 20 bp, Artificial
  CRISPR gRNA sequence
aatttatgtttttagtggag

SEQ ID NO: 622798 - DNA, 20 bp, Artificial
  CRISPR gRNA sequence
gagtaatgattcctatacta

SEQ ID NO: 622799 - DNA, 20 bp, Artificial
  CRISPR gRNA sequence
atgattcctatactaagcag

SEQ ID NO: 622800 - DNA, 20 bp, Artificial
  CRISPR gRNA sequence
agttagcatttggtgttgcc

SEQ ID NO: 622801 - DNA, 20 bp, Artificial
  CRISPR gRNA sequence
aacttttaatcaccaccttc

SEQ ID NO: 622802 - DNA, 20 bp, Artificial
  CRISPR gRNA sequence
tcgtgttgcctccttcattc

SEQ ID NO: 622803 - DNA, 20 bp, Artificial
  CRISPR gRNA sequence
ttcattctacagattatgtt

SEQ ID NO: 622804 - DNA, 20 bp, Artificial
  CRISPR gRNA sequence
cagattatgttatgggtttc

SEQ ID NO: 622805 - DNA, 20 bp, Artificial
  CRISPR gRNA sequence
gtttcaggtgtttttctcag

SEQ ID NO: 622806 - DNA, 20 bp, Artificial
  CRISPR gRNA sequence
tttataaatgaaactttaaa

SEQ ID NO: 622807 - DNA, 20 bp, Artificial
  CRISPR gRNA sequence
tcatggtgaataaagtccta

SEQ ID NO: 622808 - DNA, 20 bp, Artificial
  CRISPR gRNA sequence
actagattttttaaacaaag

SEQ ID NO: 622809 - DNA, 20 bp, Artificial
  CRISPR gRNA sequence
ataataagaacatgtgtcca

SEQ ID NO: 622810 - DNA, 20 bp, Artificial
  CRISPR gRNA sequence
gaacatgtgtccaaaaggct

SEQ ID NO: 622811 - DNA, 20 bp, Artificial
  CRISPR gRNA sequence
aataaaagaaggagctcacc

SEQ ID NO: 622812 - DNA, 20 bp, Artificial
  CRISPR gRNA sequence
agctcacctttcgattttaa

SEQ ID NO: 622813 - DNA, 20 bp, Artificial
  CRISPR gRNA sequence
ttttaaaaatgcttactaaa

SEQ ID NO: 622814 - DNA, 20 bp, Artificial
  CRISPR gRNA sequence
taaaaattgcttttaacatc

SEQ ID NO: 622815 - DNA, 20 bp, Artificial
  CRISPR gRNA sequence
ttttaacatcatctgtttct

SEQ ID NO: 622816 - DNA, 20 bp, Artificial
  CRISPR gRNA sequence
atctgtttctaagtgtttct

SEQ ID NO: 622817 - DNA, 20 bp, Artificial
  CRISPR gRNA sequence
atgacttggggaagaattca

SEQ ID NO: 622818 - DNA, 20 bp, Artificial
  CRISPR gRNA sequence
tgcctggaatgcagagatga

SEQ ID NO: 622819 - DNA, 20 bp, Artificial
  CRISPR gRNA sequence
cagttaaattatatttgcgg

SEQ ID NO: 622820 - DNA, 20 bp, Artificial
  CRISPR gRNA sequence
gttacaaagtacaacttcaa

SEQ ID NO: 622821 - DNA, 20 bp, Artificial
  CRISPR gRNA sequence
gcttaatgttattttattct

SEQ ID NO: 622822 - DNA, 20 bp, Artificial
  CRISPR gRNA sequence
agaaagggagagttgaagga

SEQ ID NO: 622823 - DNA, 20 bp, Artificial
  CRISPR gRNA sequence
catagatacattttatcatc

SEQ ID NO: 622824 - DNA, 20 bp, Artificial
  CRISPR gRNA sequence
ttgtagaccttgttacttct

SEQ ID NO: 622825 - DNA, 20 bp, Artificial
  CRISPR gRNA sequence
ttaccccaaagccataataa

SEQ ID NO: 622826 - DNA, 20 bp, Artificial
  CRISPR gRNA sequence
taacattgctgtgagtaaac

SEQ ID NO: 622827 - DNA, 20 bp, Artificial
  CRISPR gRNA sequence
tgatatacagctggtaagtg

SEQ ID NO: 622828 - DNA, 20 bp, Artificial
  CRISPR gRNA sequence
acatcatatgctcactttac

SEQ ID NO: 622829 - DNA, 20 bp, Artificial
  CRISPR gRNA sequence
ataattggcaggtgacaagt

SEQ ID NO: 622830 - DNA, 20 bp, Artificial
  CRISPR gRNA sequence
caacctttttggcaccaagt

SEQ ID NO: 622831 - DNA, 20 bp, Artificial
  CRISPR gRNA sequence
cagcctgagggttagtgggg

SEQ ID NO: 622832 - DNA, 20 bp, Artificial
  CRISPR gRNA sequence
gttagtgggggatggtttcg

SEQ ID NO: 622833 - DNA, 20 bp, Artificial
  CRISPR gRNA sequence
agcattacatttattgtgca

SEQ ID NO: 622834 - DNA, 20 bp, Artificial
  CRISPR gRNA sequence
aatgtagaatctgtggagtc

SEQ ID NO: 622835 - DNA, 20 bp, Artificial
  CRISPR gRNA sequence
tagaatctgtggagtcctaa

SEQ ID NO: 622836 - DNA, 20 bp, Artificial
  CRISPR gRNA sequence
acagtgacagatcatcaggc

SEQ ID NO: 622837 - DNA, 20 bp, Artificial
  CRISPR gRNA sequence
tcgccatctgaggctgggcg

SEQ ID NO: 622838 - DNA, 20 bp, Artificial
  CRISPR gRNA sequence
tgggcggatcacctgaggtt

SEQ ID NO: 622839 - DNA, 20 bp, Artificial
  CRISPR gRNA sequence
cagctaggctgaggcaggag

SEQ ID NO: 622840 - DNA, 20 bp, Artificial
  CRISPR gRNA sequence
gaggcagaggttgtggtgag

SEQ ID NO: 622841 - DNA, 20 bp, Artificial
  CRISPR gRNA sequence
agctcacctcctgctatgtg

SEQ ID NO: 622842 - DNA, 20 bp, Artificial
  CRISPR gRNA sequence
gttcctactggtccctggcc

SEQ ID NO: 622843 - DNA, 20 bp, Artificial
  CRISPR gRNA sequence
cttcaaacattgcaaaagca

SEQ ID NO: 622844 - DNA, 20 bp, Artificial
  CRISPR gRNA sequence
agtgttttcattacttaaag

SEQ ID NO: 622845 - DNA, 20 bp, Artificial
  CRISPR gRNA sequence
agcatgtcttactttctggc

SEQ ID NO: 622846 - DNA, 20 bp, Artificial
  CRISPR gRNA sequence
ctatatggctcattttaact

SEQ ID NO: 622847 - DNA, 20 bp, Artificial
  CRISPR gRNA sequence
tatgaaggaaaagaaatata

SEQ ID NO: 622848 - DNA, 20 bp, Artificial
  CRISPR gRNA sequence
caaaagtagtgaaatgtctc

SEQ ID NO: 622849 - DNA, 20 bp, Artificial
  CRISPR gRNA sequence
atctgtatggagttggcagc

SEQ ID NO: 622850 - DNA, 20 bp, Artificial
  CRISPR gRNA sequence
tgaagaagagtatttttaac

SEQ ID NO: 622851 - DNA, 20 bp, Artificial
  CRISPR gRNA sequence
agttctaaatccaataaact

SEQ ID NO: 622852 - DNA, 20 bp, Artificial
  CRISPR gRNA sequence
ttttaaagttgacttagtca

SEQ ID NO: 622853 - DNA, 20 bp, Artificial
  CRISPR gRNA sequence
aaagttgacttagtcagagg

SEQ ID NO: 622854 - DNA, 20 bp, Artificial
  CRISPR gRNA sequence
tgcttcattgctaacattag

SEQ ID NO: 622855 - DNA, 20 bp, Artificial
  CRISPR gRNA sequence
gtaccttttcttccttttat

SEQ ID NO: 622856 - DNA, 20 bp, Artificial
  CRISPR gRNA sequence
gataagctagtaaaaagtac

SEQ ID NO: 622857 - DNA, 20 bp, Artificial
  CRISPR gRNA sequence
atttgctcatatttctagat

SEQ ID NO: 622858 - DNA, 20 bp, Artificial
  CRISPR gRNA sequence
ttattcctcaaacttagcac

SEQ ID NO: 622859 - DNA, 20 bp, Artificial
  CRISPR gRNA sequence
agccttaagtatacatttat

SEQ ID NO: 622860 - DNA, 20 bp, Artificial
  CRISPR gRNA sequence
ttaagtatacatttattgct

SEQ ID NO: 622861 - DNA, 20 bp, Artificial
  CRISPR gRNA sequence
tgctgcttgatttcatgaaa

SEQ ID NO: 622862 - DNA, 20 bp, Artificial
  CRISPR gRNA sequence
tagaacaaaactagaaaaat

SEQ ID NO: 622863 - DNA, 20 bp, Artificial
  CRISPR gRNA sequence
aaagttcttattaaaatata

SEQ ID NO: 622864 - DNA, 20 bp, Artificial
  CRISPR gRNA sequence
aattgaatatccttaatgga

SEQ ID NO: 622865 - DNA, 20 bp, Artificial
  CRISPR gRNA sequence
taggaggggtgtagtagctc

SEQ ID NO: 622866 - DNA, 20 bp, Artificial
  CRISPR gRNA sequence
tggtacctcggttcctcagg

SEQ ID NO: 622867 - DNA, 20 bp, Artificial
  CRISPR gRNA sequence
ggttcctcagggcatgattt

SEQ ID NO: 622868 - DNA, 20 bp, Artificial
  CRISPR gRNA sequence
tatggtttgctctcagggtc

SEQ ID NO: 622869 - DNA, 20 bp, Artificial
  CRISPR gRNA sequence
caagtgtgactggtgaaact

SEQ ID NO: 622870 - DNA, 20 bp, Artificial
  CRISPR gRNA sequence
tgagctcattgtagttcaat

SEQ ID NO: 622871 - DNA, 20 bp, Artificial
  CRISPR gRNA sequence
agagtgaattacttctgtga

SEQ ID NO: 622872 - DNA, 20 bp, Artificial
  CRISPR gRNA sequence
acttggaggatattatagat

SEQ ID NO: 622873 - DNA, 20 bp, Artificial
  CRISPR gRNA sequence
ttcttctgttctggctaata

SEQ ID NO: 622874 - DNA, 20 bp, Artificial
  CRISPR gRNA sequence
tacctacctttgggccatgc

SEQ ID NO: 622875 - DNA, 20 bp, Artificial
  CRISPR gRNA sequence
ctttgggccatgctccagtt

SEQ ID NO: 622876 - DNA, 20 bp, Artificial
  CRISPR gRNA sequence
ctatactcttcccaggcctg

SEQ ID NO: 622877 - DNA, 20 bp, Artificial
  CRISPR gRNA sequence
gacatataaatagaaactct

SEQ ID NO: 622878 - DNA, 20 bp, Artificial
  CRISPR gRNA sequence
attgcttttttattagttgt

SEQ ID NO: 622879 - DNA, 20 bp, Artificial
  CRISPR gRNA sequence
ttctttatgaaagggatatt

SEQ ID NO: 622880 - DNA, 20 bp, Artificial
  CRISPR gRNA sequence
aaacatttcatcccttatta

SEQ ID NO: 622881 - DNA, 20 bp, Artificial
  CRISPR gRNA sequence
cttattaaatggattagaga

SEQ ID NO: 622882 - DNA, 20 bp, Artificial
  CRISPR gRNA sequence
attagagaaggagcttagta

SEQ ID NO: 622883 - DNA, 20 bp, Artificial
  CRISPR gRNA sequence
gtcaaacctattagaattag

SEQ ID NO: 622884 - DNA, 20 bp, Artificial
  CRISPR gRNA sequence
gtcctttatcttaaatttgt

SEQ ID NO: 622885 - DNA, 20 bp, Artificial
  CRISPR gRNA sequence
tcttaaatttgtcagtgatt

SEQ ID NO: 622886 - DNA, 20 bp, Artificial
  CRISPR gRNA sequence
cttacagtcatacattatta

SEQ ID NO: 622887 - DNA, 20 bp, Artificial
  CRISPR gRNA sequence
ttttctatttcaaccatttt

SEQ ID NO: 622888 - DNA, 20 bp, Artificial
  CRISPR gRNA sequence
gttttctgaattataatagt

SEQ ID NO: 622889 - DNA, 20 bp, Artificial
  CRISPR gRNA sequence
ataactgttgctcccccatt

SEQ ID NO: 622890 - DNA, 20 bp, Artificial
  CRISPR gRNA sequence
ctgttgctcccccattcatt

SEQ ID NO: 622891 - DNA, 20 bp, Artificial
  CRISPR gRNA sequence
ttcattgattgatttgttct

SEQ ID NO: 622892 - DNA, 20 bp, Artificial
  CRISPR gRNA sequence
tatctatctatctatctcta

SEQ ID NO: 622893 - DNA, 20 bp, Artificial
  CRISPR gRNA sequence
acttcagggtaaatagaagc

SEQ ID NO: 622894 - DNA, 20 bp, Artificial
  CRISPR gRNA sequence
tatctctttttctcttagga

SEQ ID NO: 622895 - DNA, 20 bp, Artificial
  CRISPR gRNA sequence
tgggaactggaattgggtac

SEQ ID NO: 622896 - DNA, 20 bp, Artificial
  CRISPR gRNA sequence
tttcttgctaaatattgctc

SEQ ID NO: 622897 - DNA, 20 bp, Artificial
  CRISPR gRNA sequence
taaatattgctcagcagttt

SEQ ID NO: 622898 - DNA, 20 bp, Artificial
  CRISPR gRNA sequence
gcagtttatcagattaggta

SEQ ID NO: 622899 - DNA, 20 bp, Artificial
  CRISPR gRNA sequence
attaggtaattggtttccta

SEQ ID NO: 622900 - DNA, 20 bp, Artificial
  CRISPR gRNA sequence
taggagaaatgaaaagtgaa

SEQ ID NO: 622901 - DNA, 20 bp, Artificial
  CRISPR gRNA sequence
aaagtaaaaatcaggagatg

SEQ ID NO: 622902 - DNA, 20 bp, Artificial
  CRISPR gRNA sequence
cccaactgtggtgggacaac

SEQ ID NO: 622903 - DNA, 20 bp, Artificial
  CRISPR gRNA sequence
gtatacaagaaatttatgga

SEQ ID NO: 622904 - DNA, 20 bp, Artificial
  CRISPR gRNA sequence
ctttccttccttccttcctt

SEQ ID NO: 622905 - DNA, 20 bp, Artificial
  CRISPR gRNA sequence
tttcttttctattgtgtcac

SEQ ID NO: 622906 - DNA, 20 bp, Artificial
  CRISPR gRNA sequence
cttcagtacagtggcacaat

SEQ ID NO: 622907 - DNA, 20 bp, Artificial
  CRISPR gRNA sequence
gcaacaacaaatgctgtatt

SEQ ID NO: 622908 - DNA, 20 bp, Artificial
  CRISPR gRNA sequence
gtatttaaggtttatttttc

SEQ ID NO: 622909 - DNA, 20 bp, Artificial
  CRISPR gRNA sequence
gttagtactcaccatgccac

SEQ ID NO: 622910 - DNA, 20 bp, Artificial
  CRISPR gRNA sequence
ccatgccactattgtttctc

SEQ ID NO: 622911 - DNA, 20 bp, Artificial
  CRISPR gRNA sequence
tggaaacagaaaactcagag

SEQ ID NO: 622912 - DNA, 20 bp, Artificial
  CRISPR gRNA sequence
acatgggagagaagaatcac

SEQ ID NO: 622913 - DNA, 20 bp, Artificial
  CRISPR gRNA sequence
cttcaacttacttattagct

SEQ ID NO: 622914 - DNA, 20 bp, Artificial
  CRISPR gRNA sequence
gtgtgattttgctcaaataa

SEQ ID NO: 622915 - DNA, 20 bp, Artificial
  CRISPR gRNA sequence
tgctcaaataattctgtttt

SEQ ID NO: 622916 - DNA, 20 bp, Artificial
  CRISPR gRNA sequence
aataattctgttttctgcga

SEQ ID NO: 622917 - DNA, 20 bp, Artificial
  CRISPR gRNA sequence
ttctgcgattcagttttctt

SEQ ID NO: 622918 - DNA, 20 bp, Artificial
  CRISPR gRNA sequence
gtgtgaagatctattgagat

SEQ ID NO: 622919 - DNA, 20 bp, Artificial
  CRISPR gRNA sequence
aaaacactctgaactaaata

SEQ ID NO: 622920 - DNA, 20 bp, Artificial
  CRISPR gRNA sequence
ataatataactcataaagaa

SEQ ID NO: 622921 - DNA, 20 bp, Artificial
  CRISPR gRNA sequence
ttctcataacctctgtagga

SEQ ID NO: 622922 - DNA, 20 bp, Artificial
  CRISPR gRNA sequence
taacctctgtaggatactga

SEQ ID NO: 622923 - DNA, 20 bp, Artificial
  CRISPR gRNA sequence
aaatattactgtctacattt

SEQ ID NO: 622924 - DNA, 20 bp, Artificial
  CRISPR gRNA sequence
cataaatctttgtattcatg

SEQ ID NO: 622925 - DNA, 20 bp, Artificial
  CRISPR gRNA sequence
ttttttttaaaggacacata

SEQ ID NO: 622926 - DNA, 20 bp, Artificial
  CRISPR gRNA sequence
agttgaggatacaggaatat

SEQ ID NO: 622927 - DNA, 20 bp, Artificial
  CRISPR gRNA sequence
ctactctaacccacttgtgt

SEQ ID NO: 622928 - DNA, 20 bp, Artificial
  CRISPR gRNA sequence
tgtgttatagattaaacaaa

SEQ ID NO: 622929 - DNA, 20 bp, Artificial
  CRISPR gRNA sequence
tatcttccaaactaatgtaa

SEQ ID NO: 622930 - DNA, 20 bp, Artificial
  CRISPR gRNA sequence
aatggcgtgaacctgggagg

SEQ ID NO: 622931 - DNA, 20 bp, Artificial
  CRISPR gRNA sequence
aaaaacaaattgcaaagatg

SEQ ID NO: 622932 - DNA, 20 bp, Artificial
  CRISPR gRNA sequence
acaaattgcaaagatgttaa

SEQ ID NO: 622933 - DNA, 20 bp, Artificial
  CRISPR gRNA sequence
cttactattttcattcattt

SEQ ID NO: 622934 - DNA, 20 bp, Artificial
  CRISPR gRNA sequence
gataagaggtagttcatggc

SEQ ID NO: 622935 - DNA, 20 bp, Artificial
  CRISPR gRNA sequence
caatttaatatctataacac

SEQ ID NO: 622936 - DNA, 20 bp, Artificial
  CRISPR gRNA sequence
catggatacattttaagaac

SEQ ID NO: 622937 - DNA, 20 bp, Artificial
  CRISPR gRNA sequence
ttaaaataagccttctctat

SEQ ID NO: 622938 - DNA, 20 bp, Artificial
  CRISPR gRNA sequence
tataagatggataattatta

SEQ ID NO: 622939 - DNA, 20 bp, Artificial
  CRISPR gRNA sequence
ggaaaccaaaattttccttg

SEQ ID NO: 622940 - DNA, 20 bp, Artificial
  CRISPR gRNA sequence
tattttttttggagacggag

SEQ ID NO: 622941 - DNA, 20 bp, Artificial
  CRISPR gRNA sequence
atttggaagttggacatctc

SEQ ID NO: 622942 - DNA, 20 bp, Artificial
  CRISPR gRNA sequence
ctagcagtgaatatatgaat

SEQ ID NO: 622943 - DNA, 20 bp, Artificial
  CRISPR gRNA sequence
tataactgtatcgcaaacca

SEQ ID NO: 622944 - DNA, 20 bp, Artificial
  CRISPR gRNA sequence
caccatgtttaatttttgtg

SEQ ID NO: 622945 - DNA, 20 bp, Artificial
  CRISPR gRNA sequence
ctatgcctactacacattat

SEQ ID NO: 622946 - DNA, 20 bp, Artificial
  CRISPR gRNA sequence
agttctctgtcttattcttc

SEQ ID NO: 622947 - DNA, 20 bp, Artificial
  CRISPR gRNA sequence
attcttctcttgtttatatt

SEQ ID NO: 622948 - DNA, 20 bp, Artificial
  CRISPR gRNA sequence
atattacatgtttaggaatt

SEQ ID NO: 622949 - DNA, 20 bp, Artificial
  CRISPR gRNA sequence
tgtgtttattattttagaaa

SEQ ID NO: 622950 - DNA, 20 bp, Artificial
  CRISPR gRNA sequence
tttagaaaatgagattatat

SEQ ID NO: 622951 - DNA, 20 bp, Artificial
  CRISPR gRNA sequence
aaaatgagattatatagtag

SEQ ID NO: 622952 - DNA, 20 bp, Artificial
  CRISPR gRNA sequence
attatatagtagttttgttt

SEQ ID NO: 622953 - DNA, 20 bp, Artificial
  CRISPR gRNA sequence
ataaatggaatttctataaa

SEQ ID NO: 622954 - DNA, 20 bp, Artificial
  CRISPR gRNA sequence
actttatccctaggaaaagc

SEQ ID NO: 622955 - DNA, 20 bp, Artificial
  CRISPR gRNA sequence
gaaaagcattagttttgtaa

SEQ ID NO: 622956 - DNA, 20 bp, Artificial
  CRISPR gRNA sequence
agttttgtaatggggtttca

SEQ ID NO: 622957 - DNA, 20 bp, Artificial
  CRISPR gRNA sequence
ttccgttcacttttttccct

SEQ ID NO: 622958 - DNA, 20 bp, Artificial
  CRISPR gRNA sequence
ccctgcctgtttaaaaaaaa

SEQ ID NO: 622959 - DNA, 20 bp, Artificial
  CRISPR gRNA sequence
cctgtttaaaaaaaatcctg

SEQ ID NO: 622960 - DNA, 20 bp, Artificial
  CRISPR gRNA sequence
gaaagcgttgggaaaacatt

SEQ ID NO: 622961 - DNA, 20 bp, Artificial
  CRISPR gRNA sequence
attatttgtttttttacaat

SEQ ID NO: 622962 - DNA, 20 bp, Artificial
  CRISPR gRNA sequence
acatagtcattagtgtgtct

SEQ ID NO: 622963 - DNA, 20 bp, Artificial
  CRISPR gRNA sequence
ggtggtggtgtattcttagt

SEQ ID NO: 622964 - DNA, 20 bp, Artificial
  CRISPR gRNA sequence
ggtgtattcttagtatttgc

SEQ ID NO: 622965 - DNA, 20 bp, Artificial
  CRISPR gRNA sequence
aaaatcttctttccatattc

SEQ ID NO: 622966 - DNA, 20 bp, Artificial
  CRISPR gRNA sequence
atattctttagtttgaatgt

SEQ ID NO: 622967 - DNA, 20 bp, Artificial
  CRISPR gRNA sequence
ggatggttaaaatacactgg

SEQ ID NO: 622968 - DNA, 20 bp, Artificial
  CRISPR gRNA sequence
caattaatgaaaaattaatc

SEQ ID NO: 622969 - DNA, 20 bp, Artificial
  CRISPR gRNA sequence
aattaatcaaatgtttcctt

SEQ ID NO: 622970 - DNA, 20 bp, Artificial
  CRISPR gRNA sequence
caaatgtttcctttgaggat

SEQ ID NO: 622971 - DNA, 20 bp, Artificial
  CRISPR gRNA sequence
tcagaaaattaatacttgta

SEQ ID NO: 622972 - DNA, 20 bp, Artificial
  CRISPR gRNA sequence
taatttgaagtattgcaatg

SEQ ID NO: 622973 - DNA, 20 bp, Artificial
  CRISPR gRNA sequence
aaacacatacagcatgtgcc

SEQ ID NO: 622974 - DNA, 20 bp, Artificial
  CRISPR gRNA sequence
acatacagcatgtgccaata

SEQ ID NO: 622975 - DNA, 20 bp, Artificial
  CRISPR gRNA sequence
aatagattgtttctctaaag

SEQ ID NO: 622976 - DNA, 20 bp, Artificial
  CRISPR gRNA sequence
attgtttctctaaagcagcg

SEQ ID NO: 622977 - DNA, 20 bp, Artificial
  CRISPR gRNA sequence
cttttagaaaacttttccca

SEQ ID NO: 622978 - DNA, 20 bp, Artificial
  CRISPR gRNA sequence
tgtatagtgtatagccaagg

SEQ ID NO: 622979 - DNA, 20 bp, Artificial
  CRISPR gRNA sequence
gaaatctgaaataactggaa

SEQ ID NO: 622980 - DNA, 20 bp, Artificial
  CRISPR gRNA sequence
acaaaccgccttttcaggat

SEQ ID NO: 622981 - DNA, 20 bp, Artificial
  CRISPR gRNA sequence
gtctgtctagcctgaataat

SEQ ID NO: 622982 - DNA, 20 bp, Artificial
  CRISPR gRNA sequence
ctagcctgaataatttaggc

SEQ ID NO: 622983 - DNA, 20 bp, Artificial
  CRISPR gRNA sequence
taaattcatcatcatattaa

SEQ ID NO: 622984 - DNA, 20 bp, Artificial
  CRISPR gRNA sequence
tgatgaatcaaatttttata

SEQ ID NO: 622985 - DNA, 20 bp, Artificial
  CRISPR gRNA sequence
tttttatagaatgtttaaga

SEQ ID NO: 622986 - DNA, 20 bp, Artificial
  CRISPR gRNA sequence
gaccaaagtacagaacagaa

SEQ ID NO: 622987 - DNA, 20 bp, Artificial
  CRISPR gRNA sequence
attcttagtgaaatttgaat

SEQ ID NO: 622988 - DNA, 20 bp, Artificial
  CRISPR gRNA sequence
atatgtatgtaagcaaaatc

SEQ ID NO: 622989 - DNA, 20 bp, Artificial
  CRISPR gRNA sequence
tatgtaagcaaaatccattg

SEQ ID NO: 622990 - DNA, 20 bp, Artificial
  CRISPR gRNA sequence
aaaatccattgattggattt

SEQ ID NO: 622991 - DNA, 20 bp, Artificial
  CRISPR gRNA sequence
gattggatttaagagttttg

SEQ ID NO: 622992 - DNA, 20 bp, Artificial
  CRISPR gRNA sequence
ttattctaactaatgttcca

SEQ ID NO: 622993 - DNA, 20 bp, Artificial
  CRISPR gRNA sequence
tcagtacagtaacatgctgt

SEQ ID NO: 622994 - DNA, 20 bp, Artificial
  CRISPR gRNA sequence
agtaacatgctgtgcaggtt

SEQ ID NO: 622995 - DNA, 20 bp, Artificial
  CRISPR gRNA sequence
gtatgaagtaggctatccta

SEQ ID NO: 622996 - DNA, 20 bp, Artificial
  CRISPR gRNA sequence
cattcctgtagttaggtgat

SEQ ID NO: 622997 - DNA, 20 bp, Artificial
  CRISPR gRNA sequence
gaataatatattttccttga

SEQ ID NO: 622998 - DNA, 20 bp, Artificial
  CRISPR gRNA sequence
gcaaaatactgctactctgt

SEQ ID NO: 622999 - DNA, 20 bp, Artificial
  CRISPR gRNA sequence
tagagatggatgtgtctctt

SEQ ID NO: 623000 - DNA, 20 bp, Artificial
  CRISPR gRNA sequence
ataatgaatattgtcacttt

SEQ ID NO: 623001 - DNA, 20 bp, Artificial
  CRISPR gRNA sequence
acattcaagggaccagggaa

SEQ ID NO: 623002 - DNA, 20 bp, Artificial
  CRISPR gRNA sequence
aggagctgggtcaaataggt

SEQ ID NO: 623003 - DNA, 20 bp, Artificial
  CRISPR gRNA sequence
aggtacaagtttctggatcc

SEQ ID NO: 623004 - DNA, 20 bp, Artificial
  CRISPR gRNA sequence
aaacaaaaattatgttattc

SEQ ID NO: 623005 - DNA, 20 bp, Artificial
  CRISPR gRNA sequence
attcataagtttttatggac

SEQ ID NO: 623006 - DNA, 20 bp, Artificial
  CRISPR gRNA sequence
tctgattcgttggaagttaa

SEQ ID NO: 623007 - DNA, 20 bp, Artificial
  CRISPR gRNA sequence
agttaacatggctttcactt

SEQ ID NO: 623008 - DNA, 20 bp, Artificial
  CRISPR gRNA sequence
acttccctgattttcattta

SEQ ID NO: 623009 - DNA, 20 bp, Artificial
  CRISPR gRNA sequence
tttcatttaatttgtttaat

SEQ ID NO: 623010 - DNA, 20 bp, Artificial
  CRISPR gRNA sequence
ttttggaaaggtgaagtgta

SEQ ID NO: 623011 - DNA, 20 bp, Artificial
  CRISPR gRNA sequence
gaagtgtacattgatttttc

SEQ ID NO: 623012 - DNA, 20 bp, Artificial
  CRISPR gRNA sequence
gaaacatagatcatgtcaat

SEQ ID NO: 623013 - DNA, 20 bp, Artificial
  CRISPR gRNA sequence
gtcaataatggattactatc

SEQ ID NO: 623014 - DNA, 20 bp, Artificial
  CRISPR gRNA sequence
tttgtttaatattttcctgg

SEQ ID NO: 623015 - DNA, 20 bp, Artificial
  CRISPR gRNA sequence
aatattttcctggcagtgtt

SEQ ID NO: 623016 - DNA, 20 bp, Artificial
  CRISPR gRNA sequence
tcttctgtggtaaatatgga

SEQ ID NO: 623017 - DNA, 20 bp, Artificial
  CRISPR gRNA sequence
taggaatcttacttctagtt

SEQ ID NO: 623018 - DNA, 20 bp, Artificial
  CRISPR gRNA sequence
atcttacttctagttcagtg

SEQ ID NO: 623019 - DNA, 20 bp, Artificial
  CRISPR gRNA sequence
cagtgattggtttattgtat

SEQ ID NO: 623020 - DNA, 20 bp, Artificial
  CRISPR gRNA sequence
attgtatctcagtttctagt

SEQ ID NO: 623021 - DNA, 20 bp, Artificial
  CRISPR gRNA sequence
ctcgtattaacttttatttg

SEQ ID NO: 623022 - DNA, 20 bp, Artificial
  CRISPR gRNA sequence
atgacgtattaagtagacct

SEQ ID NO: 623023 - DNA, 20 bp, Artificial
  CRISPR gRNA sequence
tacatctattcctgtaaacc

SEQ ID NO: 623024 - DNA, 20 bp, Artificial
  CRISPR gRNA sequence
aaatgaatgaaaaagggaaa

SEQ ID NO: 623025 - DNA, 20 bp, Artificial
  CRISPR gRNA sequence
ccatcatttgagagtattga

SEQ ID NO: 623026 - DNA, 20 bp, Artificial
  CRISPR gRNA sequence
aactgaatgggttccagtgc

SEQ ID NO: 623027 - DNA, 20 bp, Artificial
  CRISPR gRNA sequence
acttaatttttattgagttg

SEQ ID NO: 623028 - DNA, 20 bp, Artificial
  CRISPR gRNA sequence
tttattgagttgctgtgttt

SEQ ID NO: 623029 - DNA, 20 bp, Artificial
  CRISPR gRNA sequence
tgtgtttaacagttttcagc

SEQ ID NO: 623030 - DNA, 20 bp, Artificial
  CRISPR gRNA sequence
ataaaaacactagaaaaata

SEQ ID NO: 623031 - DNA, 20 bp, Artificial
  CRISPR gRNA sequence
agtttaatgtacctaatatg

SEQ ID NO: 623032 - DNA, 20 bp, Artificial
  CRISPR gRNA sequence
tcaagagtgctgaaattcac

SEQ ID NO: 623033 - DNA, 20 bp, Artificial
  CRISPR gRNA sequence
tgaaattcactaaggcttat

SEQ ID NO: 623034 - DNA, 20 bp, Artificial
  CRISPR gRNA sequence
gccttgtctatctttgaatg

SEQ ID NO: 623035 - DNA, 20 bp, Artificial
  CRISPR gRNA sequence
gcgataatgataataaaatc

SEQ ID NO: 623036 - DNA, 20 bp, Artificial
  CRISPR gRNA sequence
tataacactgtgtattttca

SEQ ID NO: 623037 - DNA, 20 bp, Artificial
  CRISPR gRNA sequence
atatatttgctggcgacaaa

SEQ ID NO: 623038 - DNA, 20 bp, Artificial
  CRISPR gRNA sequence
ctttcttatatttcatcgtt

SEQ ID NO: 623039 - DNA, 20 bp, Artificial
  CRISPR gRNA sequence
ttatatttcatcgttagctg

SEQ ID NO: 623040 - DNA, 20 bp, Artificial
  CRISPR gRNA sequence
tgatttgattgggaagagaa

SEQ ID NO: 623041 - DNA, 20 bp, Artificial
  CRISPR gRNA sequence
tgtcatgctgggcgagaatt

SEQ ID NO: 623042 - DNA, 20 bp, Artificial
  CRISPR gRNA sequence
tgataatatggcaacatagt

SEQ ID NO: 623043 - DNA, 20 bp, Artificial
  CRISPR gRNA sequence
tggtgaatataatgggttga

SEQ ID NO: 623044 - DNA, 20 bp, Artificial
  CRISPR gRNA sequence
tgggttgaagaggtttcatt

SEQ ID NO: 623045 - DNA, 20 bp, Artificial
  CRISPR gRNA sequence
aaaattgtgtgtgtgtatgt

SEQ ID NO: 623046 - DNA, 20 bp, Artificial
  CRISPR gRNA sequence
tgtgtttcattttaatattt

SEQ ID NO: 623047 - DNA, 20 bp, Artificial
  CRISPR gRNA sequence
ttcattttaatatttttagg

SEQ ID NO: 623048 - DNA, 20 bp, Artificial
  CRISPR gRNA sequence
gaaaaaagacaattatataa

SEQ ID NO: 623049 - DNA, 20 bp, Artificial
  CRISPR gRNA sequence
tgtatcttcaacagtaaata

SEQ ID NO: 623050 - DNA, 20 bp, Artificial
  CRISPR gRNA sequence
cacacagacagacacttgta

SEQ ID NO: 623051 - DNA, 20 bp, Artificial
  CRISPR gRNA sequence
acagaatatgaagttaggac

SEQ ID NO: 623052 - DNA, 20 bp, Artificial
  CRISPR gRNA sequence
aatatgaagttaggactatg

SEQ ID NO: 623053 - DNA, 20 bp, Artificial
  CRISPR gRNA sequence
cttgattgttactgtatctt

SEQ ID NO: 623054 - DNA, 20 bp, Artificial
  CRISPR gRNA sequence
tacattcaattccttttctc

SEQ ID NO: 623055 - DNA, 20 bp, Artificial
  CRISPR gRNA sequence
tctgcagattctttgcattt

SEQ ID NO: 623056 - DNA, 20 bp, Artificial
  CRISPR gRNA sequence
tgtttattttgttgcatttc

SEQ ID NO: 623057 - DNA, 20 bp, Artificial
  CRISPR gRNA sequence
gtttgcctattacttagtaa

SEQ ID NO: 623058 - DNA, 20 bp, Artificial
  CRISPR gRNA sequence
ctattacttagtaaatgagc

SEQ ID NO: 623059 - DNA, 20 bp, Artificial
  CRISPR gRNA sequence
gatatcagttactaataaat

SEQ ID NO: 623060 - DNA, 20 bp, Artificial
  CRISPR gRNA sequence
gtagaaacattttcccccaa

SEQ ID NO: 623061 - DNA, 20 bp, Artificial
  CRISPR gRNA sequence
attgtgatgtggtcctgatc

SEQ ID NO: 623062 - DNA, 20 bp, Artificial
  CRISPR gRNA sequence
aatgaaactaatacttattg

SEQ ID NO: 623063 - DNA, 20 bp, Artificial
  CRISPR gRNA sequence
aactaatacttattggaaag

SEQ ID NO: 623064 - DNA, 20 bp, Artificial
  CRISPR gRNA sequence
attcctgtggccctattggc

SEQ ID NO: 623065 - DNA, 20 bp, Artificial
  CRISPR gRNA sequence
ctgtactgtccttgtctgag

SEQ ID NO: 623066 - DNA, 20 bp, Artificial
  CRISPR gRNA sequence
tctgagaactgcttaccttg

SEQ ID NO: 623067 - DNA, 20 bp, Artificial
  CRISPR gRNA sequence
ctataaattggtatttgata

SEQ ID NO: 623068 - DNA, 20 bp, Artificial
  CRISPR gRNA sequence
aattggtatttgataaattg

SEQ ID NO: 623069 - DNA, 20 bp, Artificial
  CRISPR gRNA sequence
tttgataaattgatttgctt

SEQ ID NO: 623070 - DNA, 20 bp, Artificial
  CRISPR gRNA sequence
tattagatgtaagtagtaac

SEQ ID NO: 623071 - DNA, 20 bp, Artificial
  CRISPR gRNA sequence
ttaatatgtaaaggaagaag

SEQ ID NO: 623072 - DNA, 20 bp, Artificial
  CRISPR gRNA sequence
ctatctgtaaaagctattct

SEQ ID NO: 623073 - DNA, 20 bp, Artificial
  CRISPR gRNA sequence
tagttaaagataatggcatt

SEQ ID NO: 623074 - DNA, 20 bp, Artificial
  CRISPR gRNA sequence
aagcatagttaaaatatgtc

SEQ ID NO: 623075 - DNA, 20 bp, Artificial
  CRISPR gRNA sequence
ccatattatttgaaaaacta

SEQ ID NO: 623076 - DNA, 20 bp, Artificial
  CRISPR gRNA sequence
tgataattcttgtgtcagct

SEQ ID NO: 623077 - DNA, 20 bp, Artificial
  CRISPR gRNA sequence
tcttgtgtcagctggaagtt

SEQ ID NO: 623078 - DNA, 20 bp, Artificial
  CRISPR gRNA sequence
agctggaagtttaaagcttc

SEQ ID NO: 623079 - DNA, 20 bp, Artificial
  CRISPR gRNA sequence
tgaaaataatggagtgtgtt

SEQ ID NO: 623080 - DNA, 20 bp, Artificial
  CRISPR gRNA sequence
ctaggtaaattagtcatgca

SEQ ID NO: 623081 - DNA, 20 bp, Artificial
  CRISPR gRNA sequence
tcatggaaagaaaagaaaaa

SEQ ID NO: 623082 - DNA, 20 bp, Artificial
  CRISPR gRNA sequence
attgctaactttgttcaggt

SEQ ID NO: 623083 - DNA, 20 bp, Artificial
  CRISPR gRNA sequence
ctttgttcaggttgcagctt

SEQ ID NO: 623084 - DNA, 20 bp, Artificial
  CRISPR gRNA sequence
ttgcagcttttgtgtttcat

SEQ ID NO: 623085 - DNA, 20 bp, Artificial
  CRISPR gRNA sequence
cttttgtgtttcatttaggt

SEQ ID NO: 623086 - DNA, 20 bp, Artificial
  CRISPR gRNA sequence
tttggaccttcctggagaaa

SEQ ID NO: 623087 - DNA, 20 bp, Artificial
  CRISPR gRNA sequence
atagcttgaatttctgagtg

SEQ ID NO: 623088 - DNA, 20 bp, Artificial
  CRISPR gRNA sequence
atactacagtagttagagga

SEQ ID NO: 623089 - DNA, 20 bp, Artificial
  CRISPR gRNA sequence
tcattgcggtaattgctgtc

SEQ ID NO: 623090 - DNA, 20 bp, Artificial
  CRISPR gRNA sequence
taggagtgtgaaagaagaca

SEQ ID NO: 623091 - DNA, 20 bp, Artificial
  CRISPR gRNA sequence
gaagatgagagtgacaaaaa

SEQ ID NO: 623092 - DNA, 20 bp, Artificial
  CRISPR gRNA sequence
gcattcattttaaaggtgga

SEQ ID NO: 623093 - DNA, 20 bp, Artificial
  CRISPR gRNA sequence
ataacttttaatggttattc

SEQ ID NO: 623094 - DNA, 20 bp, Artificial
  CRISPR gRNA sequence
cctttgagaaaacaaagact

SEQ ID NO: 623095 - DNA, 20 bp, Artificial
  CRISPR gRNA sequence
aaagagtacaaaacctggtg

SEQ ID NO: 623096 - DNA, 20 bp, Artificial
  CRISPR gRNA sequence
cattatttgagtcaaggact

SEQ ID NO: 623097 - DNA, 20 bp, Artificial
  CRISPR gRNA sequence
tagcacttcttttttctttt

SEQ ID NO: 623098 - DNA, 20 bp, Artificial
  CRISPR gRNA sequence
gtgtgtgtgtgtgtgtgtgt

SEQ ID NO: 623099 - DNA, 20 bp, Artificial
  CRISPR gRNA sequence
atttatcacattgcactatc

SEQ ID NO: 623100 - DNA, 20 bp, Artificial
  CRISPR gRNA sequence
ttgcttaagtagctaacatt

SEQ ID NO: 623101 - DNA, 20 bp, Artificial
  CRISPR gRNA sequence
acatcctgcacacataccaa

SEQ ID NO: 623102 - DNA, 20 bp, Artificial
  CRISPR gRNA sequence
aaatgtacattcacatttaa

SEQ ID NO: 623103 - DNA, 20 bp, Artificial
  CRISPR gRNA sequence
acatagaattaggcatgccc

SEQ ID NO: 623104 - DNA, 20 bp, Artificial
  CRISPR gRNA sequence
tctaaaaggtagatctttac

SEQ ID NO: 623105 - DNA, 20 bp, Artificial
  CRISPR gRNA sequence
ctgtaatcatagatagatac

SEQ ID NO: 623106 - DNA, 20 bp, Artificial
  CRISPR gRNA sequence
agatccttaacctcaggcag

SEQ ID NO: 623107 - DNA, 20 bp, Artificial
  CRISPR gRNA sequence
agttaatagaagaaataaaa

SEQ ID NO: 623108 - DNA, 20 bp, Artificial
  CRISPR gRNA sequence
tggataaggaactctcttac

SEQ ID NO: 623109 - DNA, 20 bp, Artificial
  CRISPR gRNA sequence
ataccttatatgtctgtcta

SEQ ID NO: 623110 - DNA, 20 bp, Artificial
  CRISPR gRNA sequence
ggtgcatagtcatcacttta

SEQ ID NO: 623111 - DNA, 20 bp, Artificial
  CRISPR gRNA sequence
atgtttcacatactttagtt

SEQ ID NO: 623112 - DNA, 20 bp, Artificial
  CRISPR gRNA sequence
tttagttatgagctttagaa

SEQ ID NO: 623113 - DNA, 20 bp, Artificial
  CRISPR gRNA sequence
gctttagaaagctgtttaaa

SEQ ID NO: 623114 - DNA, 20 bp, Artificial
  CRISPR gRNA sequence
agttcacaaatacaaggatg

SEQ ID NO: 623115 - DNA, 20 bp, Artificial
  CRISPR gRNA sequence
agtgatcttatgagaatatt

SEQ ID NO: 623116 - DNA, 20 bp, Artificial
  CRISPR gRNA sequence
ttatgctctatattttgcac

SEQ ID NO: 623117 - DNA, 20 bp, Artificial
  CRISPR gRNA sequence
aatattctggcatggtggtg

SEQ ID NO: 623118 - DNA, 20 bp, Artificial
  CRISPR gRNA sequence
ttaaatattttacagtgcat

SEQ ID NO: 623119 - DNA, 20 bp, Artificial
  CRISPR gRNA sequence
aatgtatctgtcttgttcac

SEQ ID NO: 623120 - DNA, 20 bp, Artificial
  CRISPR gRNA sequence
ggtgctcagtgagtaatttt

SEQ ID NO: 623121 - DNA, 20 bp, Artificial
  CRISPR gRNA sequence
ttgctcaattttaaatgctc

SEQ ID NO: 623122 - DNA, 20 bp, Artificial
  CRISPR gRNA sequence
ctcatgcctttttcctctct

SEQ ID NO: 623123 - DNA, 20 bp, Artificial
  CRISPR gRNA sequence
ttccatgtagtaaacataac

SEQ ID NO: 623124 - DNA, 20 bp, Artificial
  CRISPR gRNA sequence
tagtaaacataaccccagat

SEQ ID NO: 623125 - DNA, 20 bp, Artificial
  CRISPR gRNA sequence
aaacataaccccagatttat

SEQ ID NO: 623126 - DNA, 20 bp, Artificial
  CRISPR gRNA sequence
gtttgatgttgatacttatg

SEQ ID NO: 623127 - DNA, 20 bp, Artificial
  CRISPR gRNA sequence
gaagcaagtagttccaagtg

SEQ ID NO: 623128 - DNA, 20 bp, Artificial
  CRISPR gRNA sequence
ggaggcagctgttgtcatta

SEQ ID NO: 623129 - DNA, 20 bp, Artificial
  CRISPR gRNA sequence
atagatgagaaaattgaaac

SEQ ID NO: 623130 - DNA, 20 bp, Artificial
  CRISPR gRNA sequence
gctctttaaccacagggcta

SEQ ID NO: 623131 - DNA, 20 bp, Artificial
  CRISPR gRNA sequence
tttaaccacagggctatgtt

SEQ ID NO: 623132 - DNA, 20 bp, Artificial
  CRISPR gRNA sequence
agggctatgttgcttgcttt

SEQ ID NO: 623133 - DNA, 20 bp, Artificial
  CRISPR gRNA sequence
gttgcttgctttaagtgatt

SEQ ID NO: 623134 - DNA, 20 bp, Artificial
  CRISPR gRNA sequence
ttgcatgcttttccagtctt

SEQ ID NO: 623135 - DNA, 20 bp, Artificial
  CRISPR gRNA sequence
taggaagcagggagctagca

SEQ ID NO: 623136 - DNA, 20 bp, Artificial
  CRISPR gRNA sequence
gatgttataatctggtattt

SEQ ID NO: 623137 - DNA, 20 bp, Artificial
  CRISPR gRNA sequence
catgatttaaatacttcata

SEQ ID NO: 623138 - DNA, 20 bp, Artificial
  CRISPR gRNA sequence
tacttcataggatgctttgt

SEQ ID NO: 623139 - DNA, 20 bp, Artificial
  CRISPR gRNA sequence
tctggcactgatctgtcaaa

SEQ ID NO: 623140 - DNA, 20 bp, Artificial
  CRISPR gRNA sequence
tttaattccccttaatcacc

SEQ ID NO: 623141 - DNA, 20 bp, Artificial
  CRISPR gRNA sequence
atctgagggccaaatgcaga

SEQ ID NO: 623142 - DNA, 20 bp, Artificial
  CRISPR gRNA sequence
tttgactcagaccagtagta

SEQ ID NO: 623143 - DNA, 20 bp, Artificial
  CRISPR gRNA sequence
tgtcaatgtgtatgacccag

SEQ ID NO: 623144 - DNA, 20 bp, Artificial
  CRISPR gRNA sequence
ggaaacctgttgggttcccc

SEQ ID NO: 623145 - DNA, 20 bp, Artificial
  CRISPR gRNA sequence
aaagctgctgaagtgtgttg

SEQ ID NO: 623146 - DNA, 20 bp, Artificial
  CRISPR gRNA sequence
ccagcagccttgccttctga

SEQ ID NO: 623147 - DNA, 20 bp, Artificial
  CRISPR gRNA sequence
tttgggaacatacccactca

SEQ ID NO: 623148 - DNA, 20 bp, Artificial
  CRISPR gRNA sequence
aaagataatttcacaatgta

SEQ ID NO: 623149 - DNA, 20 bp, Artificial
  CRISPR gRNA sequence
gttgccaaacaccagttcaa

SEQ ID NO: 623150 - DNA, 20 bp, Artificial
  CRISPR gRNA sequence
taagctggtcttcttccaaa

SEQ ID NO: 623151 - DNA, 20 bp, Artificial
  CRISPR gRNA sequence
cactgtggagtaaaaaacat

SEQ ID NO: 623152 - DNA, 20 bp, Artificial
  CRISPR gRNA sequence
aaaacatatcagattgtata

SEQ ID NO: 623153 - DNA, 20 bp, Artificial
  CRISPR gRNA sequence
tcattctttaacatattgac

SEQ ID NO: 623154 - DNA, 20 bp, Artificial
  CRISPR gRNA sequence
ttctttactattactagcta

SEQ ID NO: 623155 - DNA, 20 bp, Artificial
  CRISPR gRNA sequence
atgaattgaatgtgttactt

SEQ ID NO: 623156 - DNA, 20 bp, Artificial
  CRISPR gRNA sequence
aatgtgttacttcactgatt

SEQ ID NO: 623157 - DNA, 20 bp, Artificial
  CRISPR gRNA sequence
ttacttcactgattttaagc

SEQ ID NO: 623158 - DNA, 20 bp, Artificial
  CRISPR gRNA sequence
cgtacttcatggagtggcta

SEQ ID NO: 623159 - DNA, 20 bp, Artificial
  CRISPR gRNA sequence
aattaatgttattttgatat

SEQ ID NO: 623160 - DNA, 20 bp, Artificial
  CRISPR gRNA sequence
gttattttgatattgatgat

SEQ ID NO: 623161 - DNA, 20 bp, Artificial
  CRISPR gRNA sequence
tatatttattcatcatgtgt

SEQ ID NO: 623162 - DNA, 20 bp, Artificial
  CRISPR gRNA sequence
tggttcaacaaatacatatt

SEQ ID NO: 623163 - DNA, 20 bp, Artificial
  CRISPR gRNA sequence
gctttgtatgtgtaaggata

SEQ ID NO: 623164 - DNA, 20 bp, Artificial
  CRISPR gRNA sequence
gtatcccagaaaataaaagc

SEQ ID NO: 623165 - DNA, 20 bp, Artificial
  CRISPR gRNA sequence
tagtaagtagagatgtataa

SEQ ID NO: 623166 - DNA, 20 bp, Artificial
  CRISPR gRNA sequence
gtttctggaaaactgaggac

SEQ ID NO: 623167 - DNA, 20 bp, Artificial
  CRISPR gRNA sequence
gtaatatgaactctgcaata

SEQ ID NO: 623168 - DNA, 20 bp, Artificial
  CRISPR gRNA sequence
ttgggggagaagagtgtggc

SEQ ID NO: 623169 - DNA, 20 bp, Artificial
  CRISPR gRNA sequence
tgaaggaaagagaccagtta

SEQ ID NO: 623170 - DNA, 20 bp, Artificial
  CRISPR gRNA sequence
ggttggataaagggatagac

SEQ ID NO: 623171 - DNA, 20 bp, Artificial
  CRISPR gRNA sequence
ctgaggcatttctatttaaa

SEQ ID NO: 623172 - DNA, 20 bp, Artificial
  CRISPR gRNA sequence
ttgatgatgtgcacgctata

SEQ ID NO: 623173 - DNA, 20 bp, Artificial
  CRISPR gRNA sequence
agttagatattttgccctcc

SEQ ID NO: 623174 - DNA, 20 bp, Artificial
  CRISPR gRNA sequence
gtctttattttgttgccaag

SEQ ID NO: 623175 - DNA, 20 bp, Artificial
  CRISPR gRNA sequence
tctacattaccaactcacag

SEQ ID NO: 623176 - DNA, 20 bp, Artificial
  CRISPR gRNA sequence
aatgctatccttcataaact

SEQ ID NO: 623177 - DNA, 20 bp, Artificial
  CRISPR gRNA sequence
tccttcataaactattggtt

SEQ ID NO: 623178 - DNA, 20 bp, Artificial
  CRISPR gRNA sequence
aaaaaatagagaggaggagg

SEQ ID NO: 623179 - DNA, 20 bp, Artificial
  CRISPR gRNA sequence
ggaggaaaagattgaatatt

SEQ ID NO: 623180 - DNA, 20 bp, Artificial
  CRISPR gRNA sequence
aaattttaaaattatgaggt

SEQ ID NO: 623181 - DNA, 20 bp, Artificial
  CRISPR gRNA sequence
gttttgagtgagacatgcat

SEQ ID NO: 623182 - DNA, 20 bp, Artificial
  CRISPR gRNA sequence
ttgatagaaagtcataattc

SEQ ID NO: 623183 - DNA, 20 bp, Artificial
  CRISPR gRNA sequence
agaaagtcataattcaatag

SEQ ID NO: 623184 - DNA, 20 bp, Artificial
  CRISPR gRNA sequence
tttatctgaccattcgggac

SEQ ID NO: 623185 - DNA, 20 bp, Artificial
  CRISPR gRNA sequence
tatcctcttcaactggtgga

SEQ ID NO: 623186 - DNA, 20 bp, Artificial
  CRISPR gRNA sequence
agttttacagctaccgtaag

SEQ ID NO: 623187 - DNA, 20 bp, Artificial
  CRISPR gRNA sequence
cgtaagaactgtttgcctat

SEQ ID NO: 623188 - DNA, 20 bp, Artificial
  CRISPR gRNA sequence
atataatactaatgtaagtt

SEQ ID NO: 623189 - DNA, 20 bp, Artificial
  CRISPR gRNA sequence
tttcaatagccacttaacaa

SEQ ID NO: 623190 - DNA, 20 bp, Artificial
  CRISPR gRNA sequence
gccacttaacaaccatgctt

SEQ ID NO: 623191 - DNA, 20 bp, Artificial
  CRISPR gRNA sequence
agtattttataaatcataaa

SEQ ID NO: 623192 - DNA, 20 bp, Artificial
  CRISPR gRNA sequence
tatcattactattatcatta

SEQ ID NO: 623193 - DNA, 20 bp, Artificial
  CRISPR gRNA sequence
attctaaatctgtagtctac

SEQ ID NO: 623194 - DNA, 20 bp, Artificial
  CRISPR gRNA sequence
agagattattttatctagcc

SEQ ID NO: 623195 - DNA, 20 bp, Artificial
  CRISPR gRNA sequence
gcagaagaggtggtagagac

SEQ ID NO: 623196 - DNA, 20 bp, Artificial
  CRISPR gRNA sequence
cttgatctggagtaactcca

SEQ ID NO: 623197 - DNA, 20 bp, Artificial
  CRISPR gRNA sequence
aaaagtgaggtgatgtgata

SEQ ID NO: 623198 - DNA, 20 bp, Artificial
  CRISPR gRNA sequence
accagtgtctggacatgtcc

SEQ ID NO: 623199 - DNA, 20 bp, Artificial
  CRISPR gRNA sequence
ctttaaggatgttgtgaaga

SEQ ID NO: 623200 - DNA, 20 bp, Artificial
  CRISPR gRNA sequence
attttgctgaggatattaaa

SEQ ID NO: 623201 - DNA, 20 bp, Artificial
  CRISPR gRNA sequence
atgattgcatatacctttgt

SEQ ID NO: 623202 - DNA, 20 bp, Artificial
  CRISPR gRNA sequence
ctttgttgtggttttacttt

SEQ ID NO: 623203 - DNA, 20 bp, Artificial
  CRISPR gRNA sequence
ggtaaattcttagtaaataa

SEQ ID NO: 623204 - DNA, 20 bp, Artificial
  CRISPR gRNA sequence
taaataattgggctttacat

SEQ ID NO: 623205 - DNA, 20 bp, Artificial
  CRISPR gRNA sequence
acatcacagttttgaaggca

SEQ ID NO: 623206 - DNA, 20 bp, Artificial
  CRISPR gRNA sequence
aacagctgttgggatattaa

SEQ ID NO: 623207 - DNA, 20 bp, Artificial
  CRISPR gRNA sequence
ggatattaacatggatttaa

SEQ ID NO: 623208 - DNA, 20 bp, Artificial
  CRISPR gRNA sequence
aacatggatttaatcatgtt

SEQ ID NO: 623209 - DNA, 20 bp, Artificial
  CRISPR gRNA sequence
gatttaatcatgtttggtgt

SEQ ID NO: 623210 - DNA, 20 bp, Artificial
  CRISPR gRNA sequence
atgtttggtgtttctgttta

SEQ ID NO: 623211 - DNA, 20 bp, Artificial
  CRISPR gRNA sequence
tggcatagactgggaaatgt

SEQ ID NO: 623212 - DNA, 20 bp, Artificial
  CRISPR gRNA sequence
atttcatagaaattaaacta

SEQ ID NO: 623213 - DNA, 20 bp, Artificial
  CRISPR gRNA sequence
ctggttaggaaacttgacta

SEQ ID NO: 623214 - DNA, 20 bp, Artificial
  CRISPR gRNA sequence
ggaaacttgactaacttgtt

SEQ ID NO: 623215 - DNA, 20 bp, Artificial
  CRISPR gRNA sequence
gaatcaggtcatattaataa

SEQ ID NO: 623216 - DNA, 20 bp, Artificial
  CRISPR gRNA sequence
taataaagttttaacttgta

SEQ ID NO: 623217 - DNA, 20 bp, Artificial
  CRISPR gRNA sequence
tcagttctcattactatgta

SEQ ID NO: 623218 - DNA, 20 bp, Artificial
  CRISPR gRNA sequence
acttgacatttaaaaattat

SEQ ID NO: 623219 - DNA, 20 bp, Artificial
  CRISPR gRNA sequence
aaagtagtaaagtaaaatgt

SEQ ID NO: 623220 - DNA, 20 bp, Artificial
  CRISPR gRNA sequence
ttattatgtaaccaaattac

SEQ ID NO: 623221 - DNA, 20 bp, Artificial
  CRISPR gRNA sequence
atttaagttaatagtatttt

SEQ ID NO: 623222 - DNA, 20 bp, Artificial
  CRISPR gRNA sequence
gttaatagtattttttttgc

SEQ ID NO: 623223 - DNA, 20 bp, Artificial
  CRISPR gRNA sequence
tagatacttaataaatattt

SEQ ID NO: 623224 - DNA, 20 bp, Artificial
  CRISPR gRNA sequence
ttaataaatatttactggtt

SEQ ID NO: 623225 - DNA, 20 bp, Artificial
  CRISPR gRNA sequence
cattcttatgtgagtaaaat

SEQ ID NO: 623226 - DNA, 20 bp, Artificial
  CRISPR gRNA sequence
ttatgtgagtaaaatttgag

SEQ ID NO: 623227 - DNA, 20 bp, Artificial
  CRISPR gRNA sequence
aaagaaaatgtccattatga

SEQ ID NO: 623228 - DNA, 20 bp, Artificial
  CRISPR gRNA sequence
aaatgtccattatgacattg

SEQ ID NO: 623229 - DNA, 20 bp, Artificial
  CRISPR gRNA sequence
acattgattggattaaatta

SEQ ID NO: 623230 - DNA, 20 bp, Artificial
  CRISPR gRNA sequence
gattaaattaatttgttttt

SEQ ID NO: 623231 - DNA, 20 bp, Artificial
  CRISPR gRNA sequence
tttaatagattcacaaaata

SEQ ID NO: 623232 - DNA, 20 bp, Artificial
  CRISPR gRNA sequence
aataacatgattttgctcca

SEQ ID NO: 623233 - DNA, 20 bp, Artificial
  CRISPR gRNA sequence
atgattttgctccatttggt

SEQ ID NO: 623234 - DNA, 20 bp, Artificial
  CRISPR gRNA sequence
tttttttcacaatgatctat

SEQ ID NO: 623235 - DNA, 20 bp, Artificial
  CRISPR gRNA sequence
agcaatgactattgtgaagc

SEQ ID NO: 623236 - DNA, 20 bp, Artificial
  CRISPR gRNA sequence
aaggaacttttataattgaa

SEQ ID NO: 623237 - DNA, 20 bp, Artificial
  CRISPR gRNA sequence
acttttataattgaaaattg

SEQ ID NO: 623238 - DNA, 20 bp, Artificial
  CRISPR gRNA sequence
ttcttgtaatttgtaagtgg

SEQ ID NO: 623239 - DNA, 20 bp, Artificial
  CRISPR gRNA sequence
taagtggaattgcttaaact

SEQ ID NO: 623240 - DNA, 20 bp, Artificial
  CRISPR gRNA sequence
aactaggtgtttttatggca

SEQ ID NO: 623241 - DNA, 20 bp, Artificial
  CRISPR gRNA sequence
atggcatcaagattacattc

SEQ ID NO: 623242 - DNA, 20 bp, Artificial
  CRISPR gRNA sequence
agcataaagaagaagagggg

SEQ ID NO: 623243 - DNA, 20 bp, Artificial
  CRISPR gRNA sequence
ggaaaagcttgaattcatga

SEQ ID NO: 623244 - DNA, 20 bp, Artificial
  CRISPR gRNA sequence
tcatgaaaatgtttatatcc

SEQ ID NO: 623245 - DNA, 20 bp, Artificial
  CRISPR gRNA sequence
gtttatatcctgaagctttt

SEQ ID NO: 623246 - DNA, 20 bp, Artificial
  CRISPR gRNA sequence
tttttatcatgaaatatctt

SEQ ID NO: 623247 - DNA, 20 bp, Artificial
  CRISPR gRNA sequence
ttctacataaacttgaccat

SEQ ID NO: 623248 - DNA, 20 bp, Artificial
  CRISPR gRNA sequence
catatccccttttcattgct

SEQ ID NO: 623249 - DNA, 20 bp, Artificial
  CRISPR gRNA sequence
ttctttttaaattaaaccat

SEQ ID NO: 623250 - DNA, 20 bp, Artificial
  CRISPR gRNA sequence
gtacatttccacagatatgc

SEQ ID NO: 623251 - DNA, 20 bp, Artificial
  CRISPR gRNA sequence
ctttatttcatatcagagaa

SEQ ID NO: 623252 - DNA, 20 bp, Artificial
  CRISPR gRNA sequence
cttggtattgagaattgtaa

SEQ ID NO: 623253 - DNA, 20 bp, Artificial
  CRISPR gRNA sequence
ttttcattttactcaaatga

SEQ ID NO: 623254 - DNA, 20 bp, Artificial
  CRISPR gRNA sequence
agttataatttagaatacac

SEQ ID NO: 623255 - DNA, 20 bp, Artificial
  CRISPR gRNA sequence
atagtgaaaataaaccatgg

SEQ ID NO: 623256 - DNA, 20 bp, Artificial
  CRISPR gRNA sequence
aaaacttttctatgtaatag

SEQ ID NO: 623257 - DNA, 20 bp, Artificial
  CRISPR gRNA sequence
atagttaagattcaaagaat

SEQ ID NO: 623258 - DNA, 20 bp, Artificial
  CRISPR gRNA sequence
ctaattgtagtgagatgggt

SEQ ID NO: 623259 - DNA, 20 bp, Artificial
  CRISPR gRNA sequence
tgggtgaaagattagttaca

SEQ ID NO: 623260 - DNA, 20 bp, Artificial
  CRISPR gRNA sequence
aaagattagttacactggga

SEQ ID NO: 623261 - DNA, 20 bp, Artificial
  CRISPR gRNA sequence
tattaaaatgtgttgcactt

SEQ ID NO: 623262 - DNA, 20 bp, Artificial
  CRISPR gRNA sequence
tctttatagtattgttagag

SEQ ID NO: 623263 - DNA, 20 bp, Artificial
  CRISPR gRNA sequence
attgttagagaatagattac

SEQ ID NO: 623264 - DNA, 20 bp, Artificial
  CRISPR gRNA sequence
ctttactatttcttgtctat

SEQ ID NO: 623265 - DNA, 20 bp, Artificial
  CRISPR gRNA sequence
cttttaaaaatcacattttt

SEQ ID NO: 623266 - DNA, 20 bp, Artificial
  CRISPR gRNA sequence
acatttttatctgtttcatg

SEQ ID NO: 623267 - DNA, 20 bp, Artificial
  CRISPR gRNA sequence
attttgaaatttaaaagact

SEQ ID NO: 623268 - DNA, 20 bp, Artificial
  CRISPR gRNA sequence
ctgtataaagttacactttt

SEQ ID NO: 623269 - DNA, 20 bp, Artificial
  CRISPR gRNA sequence
ggataaccaatagcatttcg

SEQ ID NO: 623270 - DNA, 20 bp, Artificial
  CRISPR gRNA sequence
aaaataccatggaagaatta

SEQ ID NO: 623271 - DNA, 20 bp, Artificial
  CRISPR gRNA sequence
ttgagtaaagagataaacca

SEQ ID NO: 623272 - DNA, 20 bp, Artificial
  CRISPR gRNA sequence
taattctgagaaaaaataaa

SEQ ID NO: 623273 - DNA, 20 bp, Artificial
  CRISPR gRNA sequence
taacttcactcataatttta

SEQ ID NO: 623274 - DNA, 20 bp, Artificial
  CRISPR gRNA sequence
tttaaaaaccataataaaat

SEQ ID NO: 623275 - DNA, 20 bp, Artificial
  CRISPR gRNA sequence
taaaataccagttttaatct

SEQ ID NO: 623276 - DNA, 20 bp, Artificial
  CRISPR gRNA sequence
aagaaataatttcaaatttc

SEQ ID NO: 623277 - DNA, 20 bp, Artificial
  CRISPR gRNA sequence
taactggatgaacaaatgat

SEQ ID NO: 623278 - DNA, 20 bp, Artificial
  CRISPR gRNA sequence
aaatgatgctagatttataa

SEQ ID NO: 623279 - DNA, 20 bp, Artificial
  CRISPR gRNA sequence
aatttgaaaattatgatact

SEQ ID NO: 623280 - DNA, 20 bp, Artificial
  CRISPR gRNA sequence
gagatagggcctgaaagata

SEQ ID NO: 623281 - DNA, 20 bp, Artificial
  CRISPR gRNA sequence
tcatatgtaatttttattct

SEQ ID NO: 623282 - DNA, 20 bp, Artificial
  CRISPR gRNA sequence
taatttttattctttatgtt

SEQ ID NO: 623283 - DNA, 20 bp, Artificial
  CRISPR gRNA sequence
tgttttttgttttttctttg

SEQ ID NO: 623284 - DNA, 20 bp, Artificial
  CRISPR gRNA sequence
gggttctttaaacatacaaa

SEQ ID NO: 623285 - DNA, 20 bp, Artificial
  CRISPR gRNA sequence
tatcactttgtagatctcag

SEQ ID NO: 623286 - DNA, 20 bp, Artificial
  CRISPR gRNA sequence
agagtagtttatgtaccata

SEQ ID NO: 623287 - DNA, 20 bp, Artificial
  CRISPR gRNA sequence
gaagtcggtaccattatcat

SEQ ID NO: 623288 - DNA, 20 bp, Artificial
  CRISPR gRNA sequence
tgtactttgcaaacatgaga

SEQ ID NO: 623289 - DNA, 20 bp, Artificial
  CRISPR gRNA sequence
actcagtttaaataattagt

SEQ ID NO: 623290 - DNA, 20 bp, Artificial
  CRISPR gRNA sequence
taatgacaaatcacagactg

SEQ ID NO: 623291 - DNA, 20 bp, Artificial
  CRISPR gRNA sequence
taatcaagtagtaccaaata

SEQ ID NO: 623292 - DNA, 20 bp, Artificial
  CRISPR gRNA sequence
aagtagtaccaaataagttg

SEQ ID NO: 623293 - DNA, 20 bp, Artificial
  CRISPR gRNA sequence
ataaaaaactgatactcact

SEQ ID NO: 623294 - DNA, 20 bp, Artificial
  CRISPR gRNA sequence
aaaactgatactcacttaaa

SEQ ID NO: 623295 - DNA, 20 bp, Artificial
  CRISPR gRNA sequence
gatactcacttaaagcttgt

SEQ ID NO: 623296 - DNA, 20 bp, Artificial
  CRISPR gRNA sequence
acatgcatgctatgccatta

SEQ ID NO: 623297 - DNA, 20 bp, Artificial
  CRISPR gRNA sequence
gctatgccattactgtgatt

SEQ ID NO: 623298 - DNA, 20 bp, Artificial
  CRISPR gRNA sequence
attagctgctttttggtgtg

SEQ ID NO: 623299 - DNA, 20 bp, Artificial
  CRISPR gRNA sequence
catagattagagttggaata

SEQ ID NO: 623300 - DNA, 20 bp, Artificial
  CRISPR gRNA sequence
tatagctcgaaactgaatat

SEQ ID NO: 623301 - DNA, 20 bp, Artificial
  CRISPR gRNA sequence
ctcgaaactgaatatatgtg

SEQ ID NO: 623302 - DNA, 20 bp, Artificial
  CRISPR gRNA sequence
aaactgaatatatgtgttta

SEQ ID NO: 623303 - DNA, 20 bp, Artificial
  CRISPR gRNA sequence
ttcatatgtcaaagacattt

SEQ ID NO: 623304 - DNA, 20 bp, Artificial
  CRISPR gRNA sequence
tttgctggattaagatcctg

SEQ ID NO: 623305 - DNA, 20 bp, Artificial
  CRISPR gRNA sequence
ttctcttgccctgttcagaa

SEQ ID NO: 623306 - DNA, 20 bp, Artificial
  CRISPR gRNA sequence
gtgtgttaagcaatatttaa

SEQ ID NO: 623307 - DNA, 20 bp, Artificial
  CRISPR gRNA sequence
gacagactcaaaagccaata

SEQ ID NO: 623308 - DNA, 20 bp, Artificial
  CRISPR gRNA sequence
ataccaggattattaaaaaa

SEQ ID NO: 623309 - DNA, 20 bp, Artificial
  CRISPR gRNA sequence
aatatgtgaggaaatagtca

SEQ ID NO: 623310 - DNA, 20 bp, Artificial
  CRISPR gRNA sequence
aaatagtcattctgtttacc

SEQ ID NO: 623311 - DNA, 20 bp, Artificial
  CRISPR gRNA sequence
ggctgacaacaggaaagtcc

SEQ ID NO: 623312 - DNA, 20 bp, Artificial
  CRISPR gRNA sequence
gcttcaaggcgagggaggaa

SEQ ID NO: 623313 - DNA, 20 bp, Artificial
  CRISPR gRNA sequence
ctgaaatgtgacgtctgtgg

SEQ ID NO: 623314 - DNA, 20 bp, Artificial
  CRISPR gRNA sequence
catggtttgcattgggccca

SEQ ID NO: 623315 - DNA, 20 bp, Artificial
  CRISPR gRNA sequence
cttttcagaattctgctagt

SEQ ID NO: 623316 - DNA, 20 bp, Artificial
  CRISPR gRNA sequence
tctgaatagcatatcagaaa

SEQ ID NO: 623317 - DNA, 20 bp, Artificial
  CRISPR gRNA sequence
tagcatatcagaaaagaagt

SEQ ID NO: 623318 - DNA, 20 bp, Artificial
  CRISPR gRNA sequence
atcagaaaagaagtttggga

SEQ ID NO: 623319 - DNA, 20 bp, Artificial
  CRISPR gRNA sequence
ccatacccatgggcaggtaa

SEQ ID NO: 623320 - DNA, 20 bp, Artificial
  CRISPR gRNA sequence
ggtaatatagtttgctagat

SEQ ID NO: 623321 - DNA, 20 bp, Artificial
  CRISPR gRNA sequence
ttaactccttgaaatacaat

SEQ ID NO: 623322 - DNA, 20 bp, Artificial
  CRISPR gRNA sequence
cacaggtctcagtagcaggc

SEQ ID NO: 623323 - DNA, 20 bp, Artificial
  CRISPR gRNA sequence
taactcctgcaaggatatat

SEQ ID NO: 623324 - DNA, 20 bp, Artificial
  CRISPR gRNA sequence
gatagagtgaggaaaaagcc

SEQ ID NO: 623325 - DNA, 20 bp, Artificial
  CRISPR gRNA sequence
ttttaaacatttgagaggtg

SEQ ID NO: 623326 - DNA, 20 bp, Artificial
  CRISPR gRNA sequence
ggatcgttgactcttaacaa

SEQ ID NO: 623327 - DNA, 20 bp, Artificial
  CRISPR gRNA sequence
agattcaagttcatatgaaa

SEQ ID NO: 623328 - DNA, 20 bp, Artificial
  CRISPR gRNA sequence
aaaattggtttaatggtaat

SEQ ID NO: 623329 - DNA, 20 bp, Artificial
  CRISPR gRNA sequence
atattaataactaatattct

SEQ ID NO: 623330 - DNA, 20 bp, Artificial
  CRISPR gRNA sequence
aaatcacaataaatttattt

SEQ ID NO: 623331 - DNA, 20 bp, Artificial
  CRISPR gRNA sequence
atttaaaagttttatttcta

SEQ ID NO: 623332 - DNA, 20 bp, Artificial
  CRISPR gRNA sequence
ttctaaatagtttaacaatt

SEQ ID NO: 623333 - DNA, 20 bp, Artificial
  CRISPR gRNA sequence
atacacatgaagaaatagtc

SEQ ID NO: 623334 - DNA, 20 bp, Artificial
  CRISPR gRNA sequence
ggcattgctgaagctagaac

SEQ ID NO: 623335 - DNA, 20 bp, Artificial
  CRISPR gRNA sequence
cagggttttctgatgcccat

SEQ ID NO: 623336 - DNA, 20 bp, Artificial
  CRISPR gRNA sequence
ctggttttgttcagacacac

SEQ ID NO: 623337 - DNA, 20 bp, Artificial
  CRISPR gRNA sequence
gtgttatcataatcaaaatc

SEQ ID NO: 623338 - DNA, 20 bp, Artificial
  CRISPR gRNA sequence
caatcatacagtcaattaca

SEQ ID NO: 623339 - DNA, 20 bp, Artificial
  CRISPR gRNA sequence
cagtcaattacattttgctt

SEQ ID NO: 623340 - DNA, 20 bp, Artificial
  CRISPR gRNA sequence
tatctcctttttaaacagca

SEQ ID NO: 623341 - DNA, 20 bp, Artificial
  CRISPR gRNA sequence
tcttagaaaaggttgaaaga

SEQ ID NO: 623342 - DNA, 20 bp, Artificial
  CRISPR gRNA sequence
ataatatattcattatgtaa

SEQ ID NO: 623343 - DNA, 20 bp, Artificial
  CRISPR gRNA sequence
aaacaaaacacagtcagtct

SEQ ID NO: 623344 - DNA, 20 bp, Artificial
  CRISPR gRNA sequence
ataaactaaaaacagtattt

SEQ ID NO: 623345 - DNA, 20 bp, Artificial
  CRISPR gRNA sequence
gaaaattcaaagaaccagag

SEQ ID NO: 623346 - DNA, 20 bp, Artificial
  CRISPR gRNA sequence
tttagaaaatttaggttaat

SEQ ID NO: 623347 - DNA, 20 bp, Artificial
  CRISPR gRNA sequence
tgtagctacaataatattca

SEQ ID NO: 623348 - DNA, 20 bp, Artificial
  CRISPR gRNA sequence
aaataatctaattggcataa

SEQ ID NO: 623349 - DNA, 20 bp, Artificial
  CRISPR gRNA sequence
ataaagtttataaacagtta

SEQ ID NO: 623350 - DNA, 20 bp, Artificial
  CRISPR gRNA sequence
cactatctttttttgtcaat

SEQ ID NO: 623351 - DNA, 20 bp, Artificial
  CRISPR gRNA sequence
attattatactttcttcaga

SEQ ID NO: 623352 - DNA, 20 bp, Artificial
  CRISPR gRNA sequence
cggagaagctgtgatacctg

SEQ ID NO: 623353 - DNA, 20 bp, Artificial
  CRISPR gRNA sequence
cttcaacatatttctgatga

SEQ ID NO: 623354 - DNA, 20 bp, Artificial
  CRISPR gRNA sequence
tttgcatttctttaatttaa

SEQ ID NO: 623355 - DNA, 20 bp, Artificial
  CRISPR gRNA sequence
tcagaatctagtcattagcc

SEQ ID NO: 623356 - DNA, 20 bp, Artificial
  CRISPR gRNA sequence
tagaacttcccactcttatc

SEQ ID NO: 623357 - DNA, 20 bp, Artificial
  CRISPR gRNA sequence
cctttgagaaacatatattt

SEQ ID NO: 623358 - DNA, 20 bp, Artificial
  CRISPR gRNA sequence
ttctgtatttttagtagaga

SEQ ID NO: 623359 - DNA, 20 bp, Artificial
  CRISPR gRNA sequence
caccctagcctctcaaagtg

SEQ ID NO: 623360 - DNA, 20 bp, Artificial
  CRISPR gRNA sequence
accaattgcagtgtcttatt

SEQ ID NO: 623361 - DNA, 20 bp, Artificial
  CRISPR gRNA sequence
tcttattaatggtttcattt

SEQ ID NO: 623362 - DNA, 20 bp, Artificial
  CRISPR gRNA sequence
tcaattcatgcatgaacaca

SEQ ID NO: 623363 - DNA, 20 bp, Artificial
  CRISPR gRNA sequence
aatctactcccatcttgtaa

SEQ ID NO: 623364 - DNA, 20 bp, Artificial
  CRISPR gRNA sequence
cagcaccgtattttgtacat

SEQ ID NO: 623365 - DNA, 20 bp, Artificial
  CRISPR gRNA sequence
cttgctcaaaggcactcagc

SEQ ID NO: 623366 - DNA, 20 bp, Artificial
  CRISPR gRNA sequence
caaaggcactcagcagatgc

SEQ ID NO: 623367 - DNA, 20 bp, Artificial
  CRISPR gRNA sequence
aacataggagcaccctctgt

SEQ ID NO: 623368 - DNA, 20 bp, Artificial
  CRISPR gRNA sequence
ttaaatgcaggtctagaaat

SEQ ID NO: 623369 - DNA, 20 bp, Artificial
  CRISPR gRNA sequence
tcaataaataaaaatggacc

SEQ ID NO: 623370 - DNA, 20 bp, Artificial
  CRISPR gRNA sequence
tttaaaaataaaaacaaaac

SEQ ID NO: 623371 - DNA, 20 bp, Artificial
  CRISPR gRNA sequence
atcttaattattttcctcga

SEQ ID NO: 623372 - DNA, 20 bp, Artificial
  CRISPR gRNA sequence
cctcgatccagttttgttag

SEQ ID NO: 623373 - DNA, 20 bp, Artificial
  CRISPR gRNA sequence
gatttttgtgcctaccaggg

SEQ ID NO: 623374 - DNA, 20 bp, Artificial
  CRISPR gRNA sequence
tatggttataacaaactact

SEQ ID NO: 623375 - DNA, 20 bp, Artificial
  CRISPR gRNA sequence
ataacaaactacttaatgtt

SEQ ID NO: 623376 - DNA, 20 bp, Artificial
  CRISPR gRNA sequence
aaactacttaatgttttcag

SEQ ID NO: 623377 - DNA, 20 bp, Artificial
  CRISPR gRNA sequence
ttaatgtagttagtaaattt

SEQ ID NO: 623378 - DNA, 20 bp, Artificial
  CRISPR gRNA sequence
atttgtgagattttcttaaa

SEQ ID NO: 623379 - DNA, 20 bp, Artificial
  CRISPR gRNA sequence
ctttgatatacatatgaaga

SEQ ID NO: 623380 - DNA, 20 bp, Artificial
  CRISPR gRNA sequence
tacaagaaataattgagata

SEQ ID NO: 623381 - DNA, 20 bp, Artificial
  CRISPR gRNA sequence
ataattgagatatgttgttt

SEQ ID NO: 623382 - DNA, 20 bp, Artificial
  CRISPR gRNA sequence
ttaaagtttcatagacagta

SEQ ID NO: 623383 - DNA, 20 bp, Artificial
  CRISPR gRNA sequence
acattcaataaaagggttgc

SEQ ID NO: 623384 - DNA, 20 bp, Artificial
  CRISPR gRNA sequence
atatggatattacttctata

SEQ ID NO: 623385 - DNA, 20 bp, Artificial
  CRISPR gRNA sequence
tagaaatctcataaattacc

SEQ ID NO: 623386 - DNA, 20 bp, Artificial
  CRISPR gRNA sequence
aaattaccctctgttttaat

SEQ ID NO: 623387 - DNA, 20 bp, Artificial
  CRISPR gRNA sequence
tttctaacagtattgtcttt

SEQ ID NO: 623388 - DNA, 20 bp, Artificial
  CRISPR gRNA sequence
tattgtctttgagggtttca

SEQ ID NO: 623389 - DNA, 20 bp, Artificial
  CRISPR gRNA sequence
tcattatgattccaactaac

SEQ ID NO: 623390 - DNA, 20 bp, Artificial
  CRISPR gRNA sequence
ccagatatacctagactacc

SEQ ID NO: 623391 - DNA, 20 bp, Artificial
  CRISPR gRNA sequence
tcagaagtaatttcttatta

SEQ ID NO: 623392 - DNA, 20 bp, Artificial
  CRISPR gRNA sequence
aaaattctttttaaaaaaga

SEQ ID NO: 623393 - DNA, 20 bp, Artificial
  CRISPR gRNA sequence
aagaatgaactactctaaat

SEQ ID NO: 623394 - DNA, 20 bp, Artificial
  CRISPR gRNA sequence
atttcaactcaaacattgta

SEQ ID NO: 623395 - DNA, 20 bp, Artificial
  CRISPR gRNA sequence
ttattgttaacgaatttgtt

SEQ ID NO: 623396 - DNA, 20 bp, Artificial
  CRISPR gRNA sequence
aggggttgggagtggaaaat

SEQ ID NO: 623397 - DNA, 20 bp, Artificial
  CRISPR gRNA sequence
ttgatttaaaaagttgcagc

SEQ ID NO: 623398 - DNA, 20 bp, Artificial
  CRISPR gRNA sequence
acttaagggaactttaacat

SEQ ID NO: 623399 - DNA, 20 bp, Artificial
  CRISPR gRNA sequence
tacatgtagctcataagagc

SEQ ID NO: 623400 - DNA, 20 bp, Artificial
  CRISPR gRNA sequence
accttaacccccaccacacc

SEQ ID NO: 623401 - DNA, 20 bp, Artificial
  CRISPR gRNA sequence
ctaccaatttttaaatttat

SEQ ID NO: 623402 - DNA, 20 bp, Artificial
  CRISPR gRNA sequence
agctgctgccagaaagtgac

SEQ ID NO: 623403 - DNA, 20 bp, Artificial
  CRISPR gRNA sequence
agtttatcttatttatacct

SEQ ID NO: 623404 - DNA, 20 bp, Artificial
  CRISPR gRNA sequence
tttctttaataaaagaatca

SEQ ID NO: 623405 - DNA, 20 bp, Artificial
  CRISPR gRNA sequence
tgtcaaagggccaaaaaacc

SEQ ID NO: 623406 - DNA, 20 bp, Artificial
  CRISPR gRNA sequence
tttttattattcattattat

SEQ ID NO: 623407 - DNA, 20 bp, Artificial
  CRISPR gRNA sequence
atgaaacatgacatttcaat

SEQ ID NO: 623408 - DNA, 20 bp, Artificial
  CRISPR gRNA sequence
gtccagttcaaccaaaaggg

SEQ ID NO: 623409 - DNA, 20 bp, Artificial
  CRISPR gRNA sequence
tgttctttttattctaaact

SEQ ID NO: 623410 - DNA, 20 bp, Artificial
  CRISPR gRNA sequence
gctttagtatgatacatttt

SEQ ID NO: 623411 - DNA, 20 bp, Artificial
  CRISPR gRNA sequence
taaaataatagcattttctt

SEQ ID NO: 623412 - DNA, 20 bp, Artificial
  CRISPR gRNA sequence
ttgatcctacttgccagttg

SEQ ID NO: 623413 - DNA, 20 bp, Artificial
  CRISPR gRNA sequence
gttgtactgcttcattgcgt

SEQ ID NO: 623414 - DNA, 20 bp, Artificial
  CRISPR gRNA sequence
caacagaccaaacttataat

SEQ ID NO: 623415 - DNA, 20 bp, Artificial
  CRISPR gRNA sequence
agtaatagaaaaacggggag

SEQ ID NO: 623416 - DNA, 20 bp, Artificial
  CRISPR gRNA sequence
gaaaagattcctttcaaata

SEQ ID NO: 623417 - DNA, 20 bp, Artificial
  CRISPR gRNA sequence
ttttatttggaaattttgct

SEQ ID NO: 623418 - DNA, 20 bp, Artificial
  CRISPR gRNA sequence
tatttgaaaatcttgtacta

SEQ ID NO: 623419 - DNA, 20 bp, Artificial
  CRISPR gRNA sequence
agcatggtaaaagaaagaga

SEQ ID NO: 623420 - DNA, 20 bp, Artificial
  CRISPR gRNA sequence
tttctagctctgtgtaacaa

SEQ ID NO: 623421 - DNA, 20 bp, Artificial
  CRISPR gRNA sequence
ctaattattgtcattgtaag

SEQ ID NO: 623422 - DNA, 20 bp, Artificial
  CRISPR gRNA sequence
aaagcaaattctgggcagat

SEQ ID NO: 623423 - DNA, 20 bp, Artificial
  CRISPR gRNA sequence
gaacatttttagcatagaga

SEQ ID NO: 623424 - DNA, 20 bp, Artificial
  CRISPR gRNA sequence
cccttccactgtaaccagtg

SEQ ID NO: 623425 - DNA, 20 bp, Artificial
  CRISPR gRNA sequence
gtactattgaatgatagtaa

SEQ ID NO: 623426 - DNA, 20 bp, Artificial
  CRISPR gRNA sequence
tatctttcatttttagactt

SEQ ID NO: 623427 - DNA, 20 bp, Artificial
  CRISPR gRNA sequence
aagatccagtataatatcag

SEQ ID NO: 623428 - DNA, 20 bp, Artificial
  CRISPR gRNA sequence
gttactgtagaggaaatgaa

SEQ ID NO: 623429 - DNA, 20 bp, Artificial
  CRISPR gRNA sequence
gggatctctgtggaaaataa

SEQ ID NO: 623430 - DNA, 20 bp, Artificial
  CRISPR gRNA sequence
cttgaaaatatactcagaaa

SEQ ID NO: 623431 - DNA, 20 bp, Artificial
  CRISPR gRNA sequence
ttgggtactctgaaactttg

SEQ ID NO: 623432 - DNA, 20 bp, Artificial
  CRISPR gRNA sequence
ataaaagaaaaaaataaatt

SEQ ID NO: 623433 - DNA, 20 bp, Artificial
  CRISPR gRNA sequence
ttaatatagaatactctcaa

SEQ ID NO: 623434 - DNA, 20 bp, Artificial
  CRISPR gRNA sequence
aatactctcaagctagtttt

SEQ ID NO: 623435 - DNA, 20 bp, Artificial
  CRISPR gRNA sequence
agagtgctgaggttgtgaga

SEQ ID NO: 623436 - DNA, 20 bp, Artificial
  CRISPR gRNA sequence
tttttatccttaaggctgta

SEQ ID NO: 623437 - DNA, 20 bp, Artificial
  CRISPR gRNA sequence
ttacttccaactacaacatt

SEQ ID NO: 623438 - DNA, 20 bp, Artificial
  CRISPR gRNA sequence
atcaaaattatatcttaaag

SEQ ID NO: 623439 - DNA, 20 bp, Artificial
  CRISPR gRNA sequence
aggacatgataggcatttcc

SEQ ID NO: 623440 - DNA, 20 bp, Artificial
  CRISPR gRNA sequence
caaatagatcttcgtgaaca

SEQ ID NO: 623441 - DNA, 20 bp, Artificial
  CRISPR gRNA sequence
tcttatttttgttgaaatca

SEQ ID NO: 623442 - DNA, 20 bp, Artificial
  CRISPR gRNA sequence
aatcatgttgtttttaatat

SEQ ID NO: 623443 - DNA, 20 bp, Artificial
  CRISPR gRNA sequence
ttgcaatttagtatatcaag

SEQ ID NO: 623444 - DNA, 20 bp, Artificial
  CRISPR gRNA sequence
attcaaattgggtaattcaa

SEQ ID NO: 623445 - DNA, 20 bp, Artificial
  CRISPR gRNA sequence
aagagctgataccaattcaa

SEQ ID NO: 623446 - DNA, 20 bp, Artificial
  CRISPR gRNA sequence
agaacataaaacagagttgc

SEQ ID NO: 623447 - DNA, 20 bp, Artificial
  CRISPR gRNA sequence
acatcttccccttactctta

SEQ ID NO: 623448 - DNA, 20 bp, Artificial
  CRISPR gRNA sequence
tggaaaaattataagccagt

SEQ ID NO: 623449 - DNA, 20 bp, Artificial
  CRISPR gRNA sequence
aagccagtccctgtttattt

SEQ ID NO: 623450 - DNA, 20 bp, Artificial
  CRISPR gRNA sequence
caaaatagctagtgagtatt

SEQ ID NO: 623451 - DNA, 20 bp, Artificial
  CRISPR gRNA sequence
atctccaaaaccaccaatct

SEQ ID NO: 623452 - DNA, 20 bp, Artificial
  CRISPR gRNA sequence
tttcaccactccatgtagcc

SEQ ID NO: 623453 - DNA, 20 bp, Artificial
  CRISPR gRNA sequence
tatgtatgacccatgcattc

SEQ ID NO: 623454 - DNA, 20 bp, Artificial
  CRISPR gRNA sequence
gtatttgtcttgccataaaa

SEQ ID NO: 623455 - DNA, 20 bp, Artificial
  CRISPR gRNA sequence
tctgttaaatccatatttga

SEQ ID NO: 623456 - DNA, 20 bp, Artificial
  CRISPR gRNA sequence
aatgtaacctgcctgccact

SEQ ID NO: 623457 - DNA, 20 bp, Artificial
  CRISPR gRNA sequence
tccatgtaattgaatctgtt

SEQ ID NO: 623458 - DNA, 20 bp, Artificial
  CRISPR gRNA sequence
aggtaagcctggtaaagagt

SEQ ID NO: 623459 - DNA, 20 bp, Artificial
  CRISPR gRNA sequence
tggtaaagagtctgagattc

SEQ ID NO: 623460 - DNA, 20 bp, Artificial
  CRISPR gRNA sequence
agattcatgagattaccccc

SEQ ID NO: 623461 - DNA, 20 bp, Artificial
  CRISPR gRNA sequence
ctatttacaaaccagatcca

SEQ ID NO: 623462 - DNA, 20 bp, Artificial
  CRISPR gRNA sequence
catacatacgggttgaagca

SEQ ID NO: 623463 - DNA, 20 bp, Artificial
  CRISPR gRNA sequence
tacttgctcatacagtatac

SEQ ID NO: 623464 - DNA, 20 bp, Artificial
  CRISPR gRNA sequence
ataacacctagttcatgatg

SEQ ID NO: 623465 - DNA, 20 bp, Artificial
  CRISPR gRNA sequence
aagttcattagcaagtaagg

SEQ ID NO: 623466 - DNA, 20 bp, Artificial
  CRISPR gRNA sequence
gtaaggagtggcttttcaaa

SEQ ID NO: 623467 - DNA, 20 bp, Artificial
  CRISPR gRNA sequence
accacgagggatctacacac

SEQ ID NO: 623468 - DNA, 20 bp, Artificial
  CRISPR gRNA sequence
atcttagagtcaaaagtaga

SEQ ID NO: 623469 - DNA, 20 bp, Artificial
  CRISPR gRNA sequence
tgctctcaaaatggacagcc

SEQ ID NO: 623470 - DNA, 20 bp, Artificial
  CRISPR gRNA sequence
gtatacccaaatatggtcta

SEQ ID NO: 623471 - DNA, 20 bp, Artificial
  CRISPR gRNA sequence
tctagagaggccaccacatt

SEQ ID NO: 623472 - DNA, 20 bp, Artificial
  CRISPR gRNA sequence
tgaaagtccctgaactttct

SEQ ID NO: 623473 - DNA, 20 bp, Artificial
  CRISPR gRNA sequence
taatgtcatgaatataatat

SEQ ID NO: 623474 - DNA, 20 bp, Artificial
  CRISPR gRNA sequence
atgaatataatattccagct

SEQ ID NO: 623475 - DNA, 20 bp, Artificial
  CRISPR gRNA sequence
tttttggaatgtcaagatga

SEQ ID NO: 623476 - DNA, 20 bp, Artificial
  CRISPR gRNA sequence
cctctagtgtgaagggaaaa

SEQ ID NO: 623477 - DNA, 20 bp, Artificial
  CRISPR gRNA sequence
gtgtgaagggaaaaaactgc

SEQ ID NO: 623478 - DNA, 20 bp, Artificial
  CRISPR gRNA sequence
ccttaaacagaaatcaagtt

SEQ ID NO: 623479 - DNA, 20 bp, Artificial
  CRISPR gRNA sequence
gctatgttaatatgctccag

SEQ ID NO: 623480 - DNA, 20 bp, Artificial
  CRISPR gRNA sequence
catctacagttagcattatg

SEQ ID NO: 623481 - DNA, 20 bp, Artificial
  CRISPR gRNA sequence
tgccatgccttagcctaata

SEQ ID NO: 623482 - DNA, 20 bp, Artificial
  CRISPR gRNA sequence
aattatcacccctaacatct

SEQ ID NO: 623483 - DNA, 20 bp, Artificial
  CRISPR gRNA sequence
ctaacatctttcagttttct

SEQ ID NO: 623484 - DNA, 20 bp, Artificial
  CRISPR gRNA sequence
tccatagaattattatttct

SEQ ID NO: 623485 - DNA, 20 bp, Artificial
  CRISPR gRNA sequence
gaaataatattttttatttt

SEQ ID NO: 623486 - DNA, 20 bp, Artificial
  CRISPR gRNA sequence
tatttttcttgtttttttac

SEQ ID NO: 623487 - DNA, 20 bp, Artificial
  CRISPR gRNA sequence
agggagaagatactaccatc

SEQ ID NO: 623488 - DNA, 20 bp, Artificial
  CRISPR gRNA sequence
gatactaccatcccatgttt

SEQ ID NO: 623489 - DNA, 20 bp, Artificial
  CRISPR gRNA sequence
gcaattctataacccttcaa

SEQ ID NO: 623490 - DNA, 20 bp, Artificial
  CRISPR gRNA sequence
gtcttcagccttatttgcct

SEQ ID NO: 623491 - DNA, 20 bp, Artificial
  CRISPR gRNA sequence
tgacttgagtattccaggca

SEQ ID NO: 623492 - DNA, 20 bp, Artificial
  CRISPR gRNA sequence
taatctttatacactaccat

SEQ ID NO: 623493 - DNA, 20 bp, Artificial
  CRISPR gRNA sequence
tccttgaattccattttgac

SEQ ID NO: 623494 - DNA, 20 bp, Artificial
  CRISPR gRNA sequence
ggtagtctacaaaaagatgg

SEQ ID NO: 623495 - DNA, 20 bp, Artificial
  CRISPR gRNA sequence
agccagaggacaacggagcc

SEQ ID NO: 623496 - DNA, 20 bp, Artificial
  CRISPR gRNA sequence
attgattaaagccaataaaa

SEQ ID NO: 623497 - DNA, 20 bp, Artificial
  CRISPR gRNA sequence
cagccaaacagagaatgtgc

SEQ ID NO: 623498 - DNA, 20 bp, Artificial
  CRISPR gRNA sequence
attaactaaaatttaagaac

SEQ ID NO: 623499 - DNA, 20 bp, Artificial
  CRISPR gRNA sequence
cctgtcagatcagtgacagc

SEQ ID NO: 623500 - DNA, 20 bp, Artificial
  CRISPR gRNA sequence
tgcctgatgatctgaggtgg

SEQ ID NO: 623501 - DNA, 20 bp, Artificial
  CRISPR gRNA sequence
atagagtattaaggggaata

SEQ ID NO: 623502 - DNA, 20 bp, Artificial
  CRISPR gRNA sequence
ataatgattttaaatttaat

SEQ ID NO: 623503 - DNA, 20 bp, Artificial
  CRISPR gRNA sequence
tcctccaggtaataactgtc

SEQ ID NO: 623504 - DNA, 20 bp, Artificial
  CRISPR gRNA sequence
gttggatattaataccacat

SEQ ID NO: 623505 - DNA, 20 bp, Artificial
  CRISPR gRNA sequence
gtagacttaaaaatttctca

SEQ ID NO: 623506 - DNA, 20 bp, Artificial
  CRISPR gRNA sequence
tacattactgtgatagatgt

SEQ ID NO: 623507 - DNA, 20 bp, Artificial
  CRISPR gRNA sequence
ccctgtacaaggtggtattt

SEQ ID NO: 623508 - DNA, 20 bp, Artificial
  CRISPR gRNA sequence
tagaggacaccaagtagtgt

SEQ ID NO: 623509 - DNA, 20 bp, Artificial
  CRISPR gRNA sequence
ggttatttatctggaatttc

SEQ ID NO: 623510 - DNA, 20 bp, Artificial
  CRISPR gRNA sequence
acactgtactaagcattttc

SEQ ID NO: 623511 - DNA, 20 bp, Artificial
  CRISPR gRNA sequence
ttttatctaacataagcaaa

SEQ ID NO: 623512 - DNA, 20 bp, Artificial
  CRISPR gRNA sequence
taacataagcaaaaagagat

SEQ ID NO: 623513 - DNA, 20 bp, Artificial
  CRISPR gRNA sequence
aagtctagtaacatggaaaa

SEQ ID NO: 623514 - DNA, 20 bp, Artificial
  CRISPR gRNA sequence
acatggaaaatgcagttttg

SEQ ID NO: 623515 - DNA, 20 bp, Artificial
  CRISPR gRNA sequence
gtcagacttctattcatttt

SEQ ID NO: 623516 - DNA, 20 bp, Artificial
  CRISPR gRNA sequence
aaagattttttcactaattt

SEQ ID NO: 623517 - DNA, 20 bp, Artificial
  CRISPR gRNA sequence
acttctttagaaatattttt

SEQ ID NO: 623518 - DNA, 20 bp, Artificial
  CRISPR gRNA sequence
atcttttcaaagtggtaaaa

SEQ ID NO: 623519 - DNA, 20 bp, Artificial
  CRISPR gRNA sequence
tagcaggtaaactggcataa

SEQ ID NO: 623520 - DNA, 20 bp, Artificial
  CRISPR gRNA sequence
acgtatgagctccaagaatt

SEQ ID NO: 623521 - DNA, 20 bp, Artificial
  CRISPR gRNA sequence
gtgtttttggttatccatta

SEQ ID NO: 623522 - DNA, 20 bp, Artificial
  CRISPR gRNA sequence
aagaagtcacacaggcagac

SEQ ID NO: 623523 - DNA, 20 bp, Artificial
  CRISPR gRNA sequence
agtgataaatgacacagctc

SEQ ID NO: 623524 - DNA, 20 bp, Artificial
  CRISPR gRNA sequence
cagctcgtatgtttattcta

SEQ ID NO: 623525 - DNA, 20 bp, Artificial
  CRISPR gRNA sequence
aactctactgaagtaactcc

SEQ ID NO: 623526 - DNA, 20 bp, Artificial
  CRISPR gRNA sequence
aagtcaggagatcaaggcat

SEQ ID NO: 623527 - DNA, 20 bp, Artificial
  CRISPR gRNA sequence
acaatgtgttatcttttctc

SEQ ID NO: 623528 - DNA, 20 bp, Artificial
  CRISPR gRNA sequence
actccctccaaattacttct

SEQ ID NO: 623529 - DNA, 20 bp, Artificial
  CRISPR gRNA sequence
cctccaaattacttcttttt

SEQ ID NO: 623530 - DNA, 20 bp, Artificial
  CRISPR gRNA sequence
caaattacttctttttgttt

SEQ ID NO: 623531 - DNA, 20 bp, Artificial
  CRISPR gRNA sequence
ttacttctttttgtttgttt

SEQ ID NO: 623532 - DNA, 20 bp, Artificial
  CRISPR gRNA sequence
ttctttttgtttgtttgttt

SEQ ID NO: 623533 - DNA, 20 bp, Artificial
  CRISPR gRNA sequence
tgtttgttttagtattttgc

SEQ ID NO: 623534 - DNA, 20 bp, Artificial
  CRISPR gRNA sequence
ttgccctagtttattttaaa

SEQ ID NO: 623535 - DNA, 20 bp, Artificial
  CRISPR gRNA sequence
atgaaaccgaattaacatct

SEQ ID NO: 623536 - DNA, 20 bp, Artificial
  CRISPR gRNA sequence
gggagacaaataaataattg

SEQ ID NO: 623537 - DNA, 20 bp, Artificial
  CRISPR gRNA sequence
ttttatgaacaaagatcagc

SEQ ID NO: 623538 - DNA, 20 bp, Artificial
  CRISPR gRNA sequence
ttctggttaacatggtgaaa

SEQ ID NO: 623539 - DNA, 20 bp, Artificial
  CRISPR gRNA sequence
ctactcgggaggctgaggca

SEQ ID NO: 623540 - DNA, 20 bp, Artificial
  CRISPR gRNA sequence
tcgggaggctgaggcaggag

SEQ ID NO: 623541 - DNA, 20 bp, Artificial
  CRISPR gRNA sequence
atcctcccaccccccccaaa

SEQ ID NO: 623542 - DNA, 20 bp, Artificial
  CRISPR gRNA sequence
actcttgctattcagtaatc

SEQ ID NO: 623543 - DNA, 20 bp, Artificial
  CRISPR gRNA sequence
tttactatacaaatcatcta

SEQ ID NO: 623544 - DNA, 20 bp, Artificial
  CRISPR gRNA sequence
ctcactgcaacctccgcctc

SEQ ID NO: 623545 - DNA, 20 bp, Artificial
  CRISPR gRNA sequence
ttttgtatttttagtagaga

SEQ ID NO: 623546 - DNA, 20 bp, Artificial
  CRISPR gRNA sequence
ggtcttgaactcctgacctc

SEQ ID NO: 623547 - DNA, 20 bp, Artificial
  CRISPR gRNA sequence
tgcctcagcctcccaaagtg

SEQ ID NO: 623548 - DNA, 20 bp, Artificial
  CRISPR gRNA sequence
gtgactatttaatgatgaat

SEQ ID NO: 623549 - DNA, 20 bp, Artificial
  CRISPR gRNA sequence
aatcaatgcttctgctacaa

SEQ ID NO: 623550 - DNA, 20 bp, Artificial
  CRISPR gRNA sequence
ctgctacaaaaatgattttt

SEQ ID NO: 623551 - DNA, 20 bp, Artificial
  CRISPR gRNA sequence
atgatttttattagttttgt

SEQ ID NO: 623552 - DNA, 20 bp, Artificial
  CRISPR gRNA sequence
attagttttgtctcagattt

SEQ ID NO: 623553 - DNA, 20 bp, Artificial
  CRISPR gRNA sequence
ctcagatttttcagttttat

SEQ ID NO: 623554 - DNA, 20 bp, Artificial
  CRISPR gRNA sequence
tagttctttcattcttataa

SEQ ID NO: 623555 - DNA, 20 bp, Artificial
  CRISPR gRNA sequence
tacctaatactctgagggga

SEQ ID NO: 623556 - DNA, 20 bp, Artificial
  CRISPR gRNA sequence
ttctaggaggaaatagaatt

SEQ ID NO: 623557 - DNA, 20 bp, Artificial
  CRISPR gRNA sequence
tcttatgctgtacccaaatt

SEQ ID NO: 623558 - DNA, 20 bp, Artificial
  CRISPR gRNA sequence
aaaaaaaaaaaacccatgac

SEQ ID NO: 623559 - DNA, 20 bp, Artificial
  CRISPR gRNA sequence
ttggctaagaattatactgg

SEQ ID NO: 623560 - DNA, 20 bp, Artificial
  CRISPR gRNA sequence
tctaaaactaagttattttt

SEQ ID NO: 623561 - DNA, 20 bp, Artificial
  CRISPR gRNA sequence
agtaagaaaataagtaaagg

SEQ ID NO: 623562 - DNA, 20 bp, Artificial
  CRISPR gRNA sequence
tattaaattctaagtaaaac

SEQ ID NO: 623563 - DNA, 20 bp, Artificial
  CRISPR gRNA sequence
atcacataactttggagtaa

SEQ ID NO: 623564 - DNA, 20 bp, Artificial
  CRISPR gRNA sequence
acttccaaacactttaggaa

SEQ ID NO: 623565 - DNA, 20 bp, Artificial
  CRISPR gRNA sequence
acactactttgtgacctact

SEQ ID NO: 623566 - DNA, 20 bp, Artificial
  CRISPR gRNA sequence
ctactcagtgtttgacaatt

SEQ ID NO: 623567 - DNA, 20 bp, Artificial
  CRISPR gRNA sequence
gtttgacaattttcagctta

SEQ ID NO: 623568 - DNA, 20 bp, Artificial
  CRISPR gRNA sequence
aattttcagcttatgaagtt

SEQ ID NO: 623569 - DNA, 20 bp, Artificial
  CRISPR gRNA sequence
tttgttgtttatgtctaatt

SEQ ID NO: 623570 - DNA, 20 bp, Artificial
  CRISPR gRNA sequence
aaaaatagctcagaaatatt

SEQ ID NO: 623571 - DNA, 20 bp, Artificial
  CRISPR gRNA sequence
taaaaatcccaattaaatag

SEQ ID NO: 623572 - DNA, 20 bp, Artificial
  CRISPR gRNA sequence
gtaaagtattatgactcatc

SEQ ID NO: 623573 - DNA, 20 bp, Artificial
  CRISPR gRNA sequence
ataaaaaaaaaaaattacca

SEQ ID NO: 623574 - DNA, 20 bp, Artificial
  CRISPR gRNA sequence
atggagctcatctttgacca

SEQ ID NO: 623575 - DNA, 20 bp, Artificial
  CRISPR gRNA sequence
aacaacataatgttagttgc

SEQ ID NO: 623576 - DNA, 20 bp, Artificial
  CRISPR gRNA sequence
ggaatttattatcacaatca

SEQ ID NO: 623577 - DNA, 20 bp, Artificial
  CRISPR gRNA sequence
tctttaaattgacaactgat

SEQ ID NO: 623578 - DNA, 20 bp, Artificial
  CRISPR gRNA sequence
cttactctcttttataatac

SEQ ID NO: 623579 - DNA, 20 bp, Artificial
  CRISPR gRNA sequence
ttataatacaccagtttcta

SEQ ID NO: 623580 - DNA, 20 bp, Artificial
  CRISPR gRNA sequence
tttccctcaatccttcatcc

SEQ ID NO: 623581 - DNA, 20 bp, Artificial
  CRISPR gRNA sequence
ttcagtgtatgtatcatgca

SEQ ID NO: 623582 - DNA, 20 bp, Artificial
  CRISPR gRNA sequence
ctttggatattaatagtagt

SEQ ID NO: 623583 - DNA, 20 bp, Artificial
  CRISPR gRNA sequence
atagtagtgatagttttgtg

SEQ ID NO: 623584 - DNA, 20 bp, Artificial
  CRISPR gRNA sequence
tgaaaattaggtacttggcc

SEQ ID NO: 623585 - DNA, 20 bp, Artificial
  CRISPR gRNA sequence
gccagaagattatgataatc

SEQ ID NO: 623586 - DNA, 20 bp, Artificial
  CRISPR gRNA sequence
aacggcgtgcatctgggagg

SEQ ID NO: 623587 - DNA, 20 bp, Artificial
  CRISPR gRNA sequence
gaaacattgaattaaattat

SEQ ID NO: 623588 - DNA, 20 bp, Artificial
  CRISPR gRNA sequence
aatgtagtataatttgtctt

SEQ ID NO: 623589 - DNA, 20 bp, Artificial
  CRISPR gRNA sequence
catgagaaggaactatttta

SEQ ID NO: 623590 - DNA, 20 bp, Artificial
  CRISPR gRNA sequence
tcctggaggtggctgataga

SEQ ID NO: 623591 - DNA, 20 bp, Artificial
  CRISPR gRNA sequence
acaagcagtgtcagttgcac

SEQ ID NO: 623592 - DNA, 20 bp, Artificial
  CRISPR gRNA sequence
tgatttgcataactgtgctg

SEQ ID NO: 623593 - DNA, 20 bp, Artificial
  CRISPR gRNA sequence
gatgcctttggtgcctcact

SEQ ID NO: 623594 - DNA, 20 bp, Artificial
  CRISPR gRNA sequence
ataaacactgaagaaaggag

SEQ ID NO: 623595 - DNA, 20 bp, Artificial
  CRISPR gRNA sequence
ggccggctgtaagacagccc

SEQ ID NO: 623596 - DNA, 20 bp, Artificial
  CRISPR gRNA sequence
attatgtatctactcttcgt

SEQ ID NO: 623597 - DNA, 20 bp, Artificial
  CRISPR gRNA sequence
tcttttatgaattgtagtag

SEQ ID NO: 623598 - DNA, 20 bp, Artificial
  CRISPR gRNA sequence
tagaagatcaatttattgta

SEQ ID NO: 623599 - DNA, 20 bp, Artificial
  CRISPR gRNA sequence
caggagttctaaagaaatgg

SEQ ID NO: 623600 - DNA, 20 bp, Artificial
  CRISPR gRNA sequence
aagaaatggacaagattctt

SEQ ID NO: 623601 - DNA, 20 bp, Artificial
  CRISPR gRNA sequence
aatctacactgtcctcattc

SEQ ID NO: 623602 - DNA, 20 bp, Artificial
  CRISPR gRNA sequence
ctcattccaaagcttgctac

SEQ ID NO: 623603 - DNA, 20 bp, Artificial
  CRISPR gRNA sequence
taccacagttttgtaccctg

SEQ ID NO: 623604 - DNA, 20 bp, Artificial
  CRISPR gRNA sequence
accatgagtctgcaggcctg

SEQ ID NO: 623605 - DNA, 20 bp, Artificial
  CRISPR gRNA sequence
cttgtgtgtgtgtgtgtgtg

SEQ ID NO: 623606 - DNA, 20 bp, Artificial
  CRISPR gRNA sequence
gtgtgtgtgtgtgtggtgtg

SEQ ID NO: 623607 - DNA, 20 bp, Artificial
  CRISPR gRNA sequence
gtgtgtggtgtgttttgttt

SEQ ID NO: 623608 - DNA, 20 bp, Artificial
  CRISPR gRNA sequence
aaatatatttagaatataat

SEQ ID NO: 623609 - DNA, 20 bp, Artificial
  CRISPR gRNA sequence
attgtatagaaatatgatga

SEQ ID NO: 623610 - DNA, 20 bp, Artificial
  CRISPR gRNA sequence
ctagatccagcatctcaaag

SEQ ID NO: 623611 - DNA, 20 bp, Artificial
  CRISPR gRNA sequence
tcttcatcccttatatacca

SEQ ID NO: 623612 - DNA, 20 bp, Artificial
  CRISPR gRNA sequence
attgattgaatgaattaatg

SEQ ID NO: 623613 - DNA, 20 bp, Artificial
  CRISPR gRNA sequence
aatattcttatattaactag

SEQ ID NO: 623614 - DNA, 20 bp, Artificial
  CRISPR gRNA sequence
tatattaactagaaaggttt

SEQ ID NO: 623615 - DNA, 20 bp, Artificial
  CRISPR gRNA sequence
tggaggtcaatggtggttga

SEQ ID NO: 623616 - DNA, 20 bp, Artificial
  CRISPR gRNA sequence
tattttgcagataagtagag

SEQ ID NO: 623617 - DNA, 20 bp, Artificial
  CRISPR gRNA sequence
acatattacatgtatgcctc

SEQ ID NO: 623618 - DNA, 20 bp, Artificial
  CRISPR gRNA sequence
atgtatgcctcctcagctta

SEQ ID NO: 623619 - DNA, 20 bp, Artificial
  CRISPR gRNA sequence
cttatttttcttttattttc

SEQ ID NO: 623620 - DNA, 20 bp, Artificial
  CRISPR gRNA sequence
tggtttggcaacaatgtatt

SEQ ID NO: 623621 - DNA, 20 bp, Artificial
  CRISPR gRNA sequence
tggcaacaatgtattattgg

SEQ ID NO: 623622 - DNA, 20 bp, Artificial
  CRISPR gRNA sequence
ttataaacaaaaatctatca

SEQ ID NO: 623623 - DNA, 20 bp, Artificial
  CRISPR gRNA sequence
catgaggcttgaagacatat

SEQ ID NO: 623624 - DNA, 20 bp, Artificial
  CRISPR gRNA sequence
aaaatcataccttgataact

SEQ ID NO: 623625 - DNA, 20 bp, Artificial
  CRISPR gRNA sequence
tctgctctcagccactatac

SEQ ID NO: 623626 - DNA, 20 bp, Artificial
  CRISPR gRNA sequence
aaccagaatgttactttaaa

SEQ ID NO: 623627 - DNA, 20 bp, Artificial
  CRISPR gRNA sequence
tcctcttcttaaaatatttt

SEQ ID NO: 623628 - DNA, 20 bp, Artificial
  CRISPR gRNA sequence
aaaatattttaatggttttc

SEQ ID NO: 623629 - DNA, 20 bp, Artificial
  CRISPR gRNA sequence
actctgggttctttgcaacc

SEQ ID NO: 623630 - DNA, 20 bp, Artificial
  CRISPR gRNA sequence
gaggtttctttattctttcc

SEQ ID NO: 623631 - DNA, 20 bp, Artificial
  CRISPR gRNA sequence
atcctagaagtcaacacctt

SEQ ID NO: 623632 - DNA, 20 bp, Artificial
  CRISPR gRNA sequence
tgccttattatctttcagat

SEQ ID NO: 623633 - DNA, 20 bp, Artificial
  CRISPR gRNA sequence
ttgctatctctatcttaata

SEQ ID NO: 623634 - DNA, 20 bp, Artificial
  CRISPR gRNA sequence
atcagaatctgtggttatgt

SEQ ID NO: 623635 - DNA, 20 bp, Artificial
  CRISPR gRNA sequence
aatctgtggttatgttggtg

SEQ ID NO: 623636 - DNA, 20 bp, Artificial
  CRISPR gRNA sequence
ctcactcgaatgtaagctct

SEQ ID NO: 623637 - DNA, 20 bp, Artificial
  CRISPR gRNA sequence
ggactgcaagactgtctttg

SEQ ID NO: 623638 - DNA, 20 bp, Artificial
  CRISPR gRNA sequence
ttgactgctacagggaaaaa

SEQ ID NO: 623639 - DNA, 20 bp, Artificial
  CRISPR gRNA sequence
tttattgtgtgttaagtacc

SEQ ID NO: 623640 - DNA, 20 bp, Artificial
  CRISPR gRNA sequence
taagtaccttgagttttcca

SEQ ID NO: 623641 - DNA, 20 bp, Artificial
  CRISPR gRNA sequence
atttcctaatttaacgtaac

SEQ ID NO: 623642 - DNA, 20 bp, Artificial
  CRISPR gRNA sequence
tccataagttagagcaagct

SEQ ID NO: 623643 - DNA, 20 bp, Artificial
  CRISPR gRNA sequence
gagcaagctatttgcttctg

SEQ ID NO: 623644 - DNA, 20 bp, Artificial
  CRISPR gRNA sequence
tctgaattgattattttggg

SEQ ID NO: 623645 - DNA, 20 bp, Artificial
  CRISPR gRNA sequence
agctgtttgctatccaaatt

SEQ ID NO: 623646 - DNA, 20 bp, Artificial
  CRISPR gRNA sequence
ttattgcacttcacagataa

SEQ ID NO: 623647 - DNA, 20 bp, Artificial
  CRISPR gRNA sequence
aactgcgttttttacaaatt

SEQ ID NO: 623648 - DNA, 20 bp, Artificial
  CRISPR gRNA sequence
tcacatttgctcattattat

SEQ ID NO: 623649 - DNA, 20 bp, Artificial
  CRISPR gRNA sequence
atctttcttgttattattat

SEQ ID NO: 623650 - DNA, 20 bp, Artificial
  CRISPR gRNA sequence
ataaatgttgtgtaagctct

SEQ ID NO: 623651 - DNA, 20 bp, Artificial
  CRISPR gRNA sequence
tctgactgcttcaccaactg

SEQ ID NO: 623652 - DNA, 20 bp, Artificial
  CRISPR gRNA sequence
aaatcaaaagctagaaatga

SEQ ID NO: 623653 - DNA, 20 bp, Artificial
  CRISPR gRNA sequence
agaaagcaaaactgccttac

SEQ ID NO: 623654 - DNA, 20 bp, Artificial
  CRISPR gRNA sequence
gccttacttctgattatgga

SEQ ID NO: 623655 - DNA, 20 bp, Artificial
  CRISPR gRNA sequence
agctagcagaggttggttca

SEQ ID NO: 623656 - DNA, 20 bp, Artificial
  CRISPR gRNA sequence
aaggtggttgtgataaatgg

SEQ ID NO: 623657 - DNA, 20 bp, Artificial
  CRISPR gRNA sequence
gagaagtcagtgcctgggtt

SEQ ID NO: 623658 - DNA, 20 bp, Artificial
  CRISPR gRNA sequence
caaagtctgggtgacagcac

SEQ ID NO: 623659 - DNA, 20 bp, Artificial
  CRISPR gRNA sequence
gacagcacatttgtttacaa

SEQ ID NO: 623660 - DNA, 20 bp, Artificial
  CRISPR gRNA sequence
tatggtttagtgaataagcc

SEQ ID NO: 623661 - DNA, 20 bp, Artificial
  CRISPR gRNA sequence
acttctgatggagatgtaca

SEQ ID NO: 623662 - DNA, 20 bp, Artificial
  CRISPR gRNA sequence
gagatgtacaagcagattaa

SEQ ID NO: 623663 - DNA, 20 bp, Artificial
  CRISPR gRNA sequence
aaggctagaggtgccataga

SEQ ID NO: 623664 - DNA, 20 bp, Artificial
  CRISPR gRNA sequence
gtaaactgaaaaccttctgg

SEQ ID NO: 623665 - DNA, 20 bp, Artificial
  CRISPR gRNA sequence
ctagatgtcattgagaacat

SEQ ID NO: 623666 - DNA, 20 bp, Artificial
  CRISPR gRNA sequence
attaacaggagttgggaaaa

SEQ ID NO: 623667 - DNA, 20 bp, Artificial
  CRISPR gRNA sequence
taaaatgtgaatggatgaag

SEQ ID NO: 623668 - DNA, 20 bp, Artificial
  CRISPR gRNA sequence
ttcttacaatgggcaaagaa

SEQ ID NO: 623669 - DNA, 20 bp, Artificial
  CRISPR gRNA sequence
aatattgttgaaatgacaac

SEQ ID NO: 623670 - DNA, 20 bp, Artificial
  CRISPR gRNA sequence
cttagttgacaaagcagtag

SEQ ID NO: 623671 - DNA, 20 bp, Artificial
  CRISPR gRNA sequence
aaagatgatgagtctgaagg

SEQ ID NO: 623672 - DNA, 20 bp, Artificial
  CRISPR gRNA sequence
accacaccctggctaatttt

SEQ ID NO: 623673 - DNA, 20 bp, Artificial
  CRISPR gRNA sequence
ggctaattttgctagttttg

SEQ ID NO: 623674 - DNA, 20 bp, Artificial
  CRISPR gRNA sequence
gttttgtattgtttatagag

SEQ ID NO: 623675 - DNA, 20 bp, Artificial
  CRISPR gRNA sequence
cccaggctggtctagaactc

SEQ ID NO: 623676 - DNA, 20 bp, Artificial
  CRISPR gRNA sequence
cctcctgcctccacttccca

SEQ ID NO: 623677 - DNA, 20 bp, Artificial
  CRISPR gRNA sequence
ttttaaaattaaggtatata

SEQ ID NO: 623678 - DNA, 20 bp, Artificial
  CRISPR gRNA sequence
cacaattctgttgcacactt

SEQ ID NO: 623679 - DNA, 20 bp, Artificial
  CRISPR gRNA sequence
caatatctccaagatatgcc

SEQ ID NO: 623680 - DNA, 20 bp, Artificial
  CRISPR gRNA sequence
atctccaagatatgccagtg

SEQ ID NO: 623681 - DNA, 20 bp, Artificial
  CRISPR gRNA sequence
aaaaggaagagtctatataa

SEQ ID NO: 623682 - DNA, 20 bp, Artificial
  CRISPR gRNA sequence
tagtaaattcttactagcct

SEQ ID NO: 623683 - DNA, 20 bp, Artificial
  CRISPR gRNA sequence
gaaacagtatcaaatatatc

SEQ ID NO: 623684 - DNA, 20 bp, Artificial
  CRISPR gRNA sequence
atctgctgtttcccttgtgt

SEQ ID NO: 623685 - DNA, 20 bp, Artificial
  CRISPR gRNA sequence
gtgagcatccctaggggtta

SEQ ID NO: 623686 - DNA, 20 bp, Artificial
  CRISPR gRNA sequence
ggttaaatggtttttgaata

SEQ ID NO: 623687 - DNA, 20 bp, Artificial
  CRISPR gRNA sequence
tttgaatataatgtttatta

SEQ ID NO: 623688 - DNA, 20 bp, Artificial
  CRISPR gRNA sequence
aacagaagtgtaaaaattta

SEQ ID NO: 623689 - DNA, 20 bp, Artificial
  CRISPR gRNA sequence
attaagcatctacttccatt

SEQ ID NO: 623690 - DNA, 20 bp, Artificial
  CRISPR gRNA sequence
aaaatatgttacaatgtata

SEQ ID NO: 623691 - DNA, 20 bp, Artificial
  CRISPR gRNA sequence
gtatattttgcttcgtccca

SEQ ID NO: 623692 - DNA, 20 bp, Artificial
  CRISPR gRNA sequence
taatcttacataagacattt

SEQ ID NO: 623693 - DNA, 20 bp, Artificial
  CRISPR gRNA sequence
gagtgcccaaaacaataaaa

SEQ ID NO: 623694 - DNA, 20 bp, Artificial
  CRISPR gRNA sequence
aacaataaaaagcagttttc

SEQ ID NO: 623695 - DNA, 20 bp, Artificial
  CRISPR gRNA sequence
tttcttttgctttcaaatgt

SEQ ID NO: 623696 - DNA, 20 bp, Artificial
  CRISPR gRNA sequence
tttttatatacaatttttcc

SEQ ID NO: 623697 - DNA, 20 bp, Artificial
  CRISPR gRNA sequence
tcctggtgtttgtgtcctgt

SEQ ID NO: 623698 - DNA, 20 bp, Artificial
  CRISPR gRNA sequence
tttgtgtcctgtataagatt

SEQ ID NO: 623699 - DNA, 20 bp, Artificial
  CRISPR gRNA sequence
aaaagaaaaatagtactaat

SEQ ID NO: 623700 - DNA, 20 bp, Artificial
  CRISPR gRNA sequence
aaataaaaaattgtactata

SEQ ID NO: 623701 - DNA, 20 bp, Artificial
  CRISPR gRNA sequence
tttggaaaacgttgggttaa

SEQ ID NO: 623702 - DNA, 20 bp, Artificial
  CRISPR gRNA sequence
cgttgggttaaataagtttt

SEQ ID NO: 623703 - DNA, 20 bp, Artificial
  CRISPR gRNA sequence
gggttaaataagttttgtct

SEQ ID NO: 623704 - DNA, 20 bp, Artificial
  CRISPR gRNA sequence
ttaaatatactgtctcacag

SEQ ID NO: 623705 - DNA, 20 bp, Artificial
  CRISPR gRNA sequence
agataaaagttattttactg

SEQ ID NO: 623706 - DNA, 20 bp, Artificial
  CRISPR gRNA sequence
acagacacctaattatcctg

SEQ ID NO: 623707 - DNA, 20 bp, Artificial
  CRISPR gRNA sequence
tcctgaaatgatttcatata

SEQ ID NO: 623708 - DNA, 20 bp, Artificial
  CRISPR gRNA sequence
atctcacttttcaggtagag

SEQ ID NO: 623709 - DNA, 20 bp, Artificial
  CRISPR gRNA sequence
cctagagtcattaagacttc

SEQ ID NO: 623710 - DNA, 20 bp, Artificial
  CRISPR gRNA sequence
aaggacagcaaacaaatgtc

SEQ ID NO: 623711 - DNA, 20 bp, Artificial
  CRISPR gRNA sequence
aaacaaatgtctaatgattt

SEQ ID NO: 623712 - DNA, 20 bp, Artificial
  CRISPR gRNA sequence
aatgatttttttgtttaata

SEQ ID NO: 623713 - DNA, 20 bp, Artificial
  CRISPR gRNA sequence
ttacattttattacctagct

SEQ ID NO: 623714 - DNA, 20 bp, Artificial
  CRISPR gRNA sequence
tagggctaaaagtaatactg

SEQ ID NO: 623715 - DNA, 20 bp, Artificial
  CRISPR gRNA sequence
gtaaggtccaaacaacttaa

SEQ ID NO: 623716 - DNA, 20 bp, Artificial
  CRISPR gRNA sequence
atataaattgaaacccaaaa

SEQ ID NO: 623717 - DNA, 20 bp, Artificial
  CRISPR gRNA sequence
aattgaaacccaaaacaggg

SEQ ID NO: 623718 - DNA, 20 bp, Artificial
  CRISPR gRNA sequence
aaacccaaaacagggttttg

SEQ ID NO: 623719 - DNA, 20 bp, Artificial
  CRISPR gRNA sequence
cattagtaagtgaaatcgaa

SEQ ID NO: 623720 - DNA, 20 bp, Artificial
  CRISPR gRNA sequence
ggataatatatcatgaccaa

SEQ ID NO: 623721 - DNA, 20 bp, Artificial
  CRISPR gRNA sequence
atttatcttaggaatttaaa

SEQ ID NO: 623722 - DNA, 20 bp, Artificial
  CRISPR gRNA sequence
atattaacagactaaaaaag

SEQ ID NO: 623723 - DNA, 20 bp, Artificial
  CRISPR gRNA sequence
aaaagattttagtctgtctt

SEQ ID NO: 623724 - DNA, 20 bp, Artificial
  CRISPR gRNA sequence
agaaaaagtatttgacataa

SEQ ID NO: 623725 - DNA, 20 bp, Artificial
  CRISPR gRNA sequence
gcaaatatttctttgacata

SEQ ID NO: 623726 - DNA, 20 bp, Artificial
  CRISPR gRNA sequence
tggaatttagaaagcaatgc

SEQ ID NO: 623727 - DNA, 20 bp, Artificial
  CRISPR gRNA sequence
aatgcagagatgagacatta

SEQ ID NO: 623728 - DNA, 20 bp, Artificial
  CRISPR gRNA sequence
atgagacattatcatgattt

SEQ ID NO: 623729 - DNA, 20 bp, Artificial
  CRISPR gRNA sequence
agattcagtattgttaagat

SEQ ID NO: 623730 - DNA, 20 bp, Artificial
  CRISPR gRNA sequence
caatttcagtcaaaatccca

SEQ ID NO: 623731 - DNA, 20 bp, Artificial
  CRISPR gRNA sequence
ctttttaacagaaattggca

SEQ ID NO: 623732 - DNA, 20 bp, Artificial
  CRISPR gRNA sequence
attggcaaactgattacaaa

SEQ ID NO: 623733 - DNA, 20 bp, Artificial
  CRISPR gRNA sequence
aaatttggatgacttgcact

SEQ ID NO: 623734 - DNA, 20 bp, Artificial
  CRISPR gRNA sequence
ctattcctaagacttgctct

SEQ ID NO: 623735 - DNA, 20 bp, Artificial
  CRISPR gRNA sequence
aaatagaacccaaattggtc

SEQ ID NO: 623736 - DNA, 20 bp, Artificial
  CRISPR gRNA sequence
tcgatgttaaacacatattt

SEQ ID NO: 623737 - DNA, 20 bp, Artificial
  CRISPR gRNA sequence
aaggacaaactgaagttact

SEQ ID NO: 623738 - DNA, 20 bp, Artificial
  CRISPR gRNA sequence
ggttagtagcccagtgaaaa

SEQ ID NO: 623739 - DNA, 20 bp, Artificial
  CRISPR gRNA sequence
cttcaaaatgttaagagaaa

SEQ ID NO: 623740 - DNA, 20 bp, Artificial
  CRISPR gRNA sequence
aacccaacgaagaggaaaac

SEQ ID NO: 623741 - DNA, 20 bp, Artificial
  CRISPR gRNA sequence
cacaagcaaaataaaaagtg

SEQ ID NO: 623742 - DNA, 20 bp, Artificial
  CRISPR gRNA sequence
ctgttgagccaaatagtatg

SEQ ID NO: 623743 - DNA, 20 bp, Artificial
  CRISPR gRNA sequence
atttctatactattaatcag

SEQ ID NO: 623744 - DNA, 20 bp, Artificial
  CRISPR gRNA sequence
cacagaagtgagaattgaga

SEQ ID NO: 623745 - DNA, 20 bp, Artificial
  CRISPR gRNA sequence
aactaccaggacagagaagc

SEQ ID NO: 623746 - DNA, 20 bp, Artificial
  CRISPR gRNA sequence
caaaagaaggagctgaaaat

SEQ ID NO: 623747 - DNA, 20 bp, Artificial
  CRISPR gRNA sequence
gagctgaaaatggttgcttt

SEQ ID NO: 623748 - DNA, 20 bp, Artificial
  CRISPR gRNA sequence
aaaatggttgctttttggga

SEQ ID NO: 623749 - DNA, 20 bp, Artificial
  CRISPR gRNA sequence
ggttgctttttgggattttg

SEQ ID NO: 623750 - DNA, 20 bp, Artificial
  CRISPR gRNA sequence
gctttttgggattttgatta

SEQ ID NO: 623751 - DNA, 20 bp, Artificial
  CRISPR gRNA sequence
attaaatgccacttgggact

SEQ ID NO: 623752 - DNA, 20 bp, Artificial
  CRISPR gRNA sequence
ttatttctaaatgatataat

SEQ ID NO: 623753 - DNA, 20 bp, Artificial
  CRISPR gRNA sequence
gatataattatggattttac

SEQ ID NO: 623754 - DNA, 20 bp, Artificial
  CRISPR gRNA sequence
attttacatttgaaattaga

SEQ ID NO: 623755 - DNA, 20 bp, Artificial
  CRISPR gRNA sequence
taatgagaaaaagctattta

SEQ ID NO: 623756 - DNA, 20 bp, Artificial
  CRISPR gRNA sequence
ggttggaagtggagggatgt

SEQ ID NO: 623757 - DNA, 20 bp, Artificial
  CRISPR gRNA sequence
gcctggggtaggagtgggat

SEQ ID NO: 623758 - DNA, 20 bp, Artificial
  CRISPR gRNA sequence
agggtgctgaatgccaggta

SEQ ID NO: 623759 - DNA, 20 bp, Artificial
  CRISPR gRNA sequence
aatgaaggcctgaactagga

SEQ ID NO: 623760 - DNA, 20 bp, Artificial
  CRISPR gRNA sequence
aagggcagtcagaacaaaga

SEQ ID NO: 623761 - DNA, 20 bp, Artificial
  CRISPR gRNA sequence
gagggagttttgtggaggaa

SEQ ID NO: 623762 - DNA, 20 bp, Artificial
  CRISPR gRNA sequence
aagatagttttgggtatctt

SEQ ID NO: 623763 - DNA, 20 bp, Artificial
  CRISPR gRNA sequence
tagttttgggtatcttgaat

SEQ ID NO: 623764 - DNA, 20 bp, Artificial
  CRISPR gRNA sequence
tgggtatcttgaatgtttga

SEQ ID NO: 623765 - DNA, 20 bp, Artificial
  CRISPR gRNA sequence
actcaaaaggcagttgcaag

SEQ ID NO: 623766 - DNA, 20 bp, Artificial
  CRISPR gRNA sequence
cagcaaatatatattgtctc

SEQ ID NO: 623767 - DNA, 20 bp, Artificial
  CRISPR gRNA sequence
atctctctcctcatgaagct

SEQ ID NO: 623768 - DNA, 20 bp, Artificial
  CRISPR gRNA sequence
gacagctatgtcctgatgct

SEQ ID NO: 623769 - DNA, 20 bp, Artificial
  CRISPR gRNA sequence
tcttcgttttggttgtaggg

SEQ ID NO: 623770 - DNA, 20 bp, Artificial
  CRISPR gRNA sequence
gaaagatgtacatggccagt

SEQ ID NO: 623771 - DNA, 20 bp, Artificial
  CRISPR gRNA sequence
aattattcttgacctgatgt

SEQ ID NO: 623772 - DNA, 20 bp, Artificial
  CRISPR gRNA sequence
acaggagacccaagacacaa

SEQ ID NO: 623773 - DNA, 20 bp, Artificial
  CRISPR gRNA sequence
aagaaagcttgatagtggcc

SEQ ID NO: 623774 - DNA, 20 bp, Artificial
  CRISPR gRNA sequence
ggccaagagattaggaagac

SEQ ID NO: 623775 - DNA, 20 bp, Artificial
  CRISPR gRNA sequence
acagaggattaataaaagcc

SEQ ID NO: 623776 - DNA, 20 bp, Artificial
  CRISPR gRNA sequence
ttaataaaagcctatggatt

SEQ ID NO: 623777 - DNA, 20 bp, Artificial
  CRISPR gRNA sequence
agagaccactgacttttcaa

SEQ ID NO: 623778 - DNA, 20 bp, Artificial
  CRISPR gRNA sequence
tttcaataatagcagaaaaa

SEQ ID NO: 623779 - DNA, 20 bp, Artificial
  CRISPR gRNA sequence
tagcagagccattgaatttg

SEQ ID NO: 623780 - DNA, 20 bp, Artificial
  CRISPR gRNA sequence
ttcttgttcaaccttttcaa

SEQ ID NO: 623781 - DNA, 20 bp, Artificial
  CRISPR gRNA sequence
actgcccacaatttgtaata

SEQ ID NO: 623782 - DNA, 20 bp, Artificial
  CRISPR gRNA sequence
tacggataggcaccatggga

SEQ ID NO: 623783 - DNA, 20 bp, Artificial
  CRISPR gRNA sequence
atgaatgagagaggtaaaag

SEQ ID NO: 623784 - DNA, 20 bp, Artificial
  CRISPR gRNA sequence
agcaaatttattggaaatag

SEQ ID NO: 623785 - DNA, 20 bp, Artificial
  CRISPR gRNA sequence
atgggatgaagaggaaggag

SEQ ID NO: 623786 - DNA, 20 bp, Artificial
  CRISPR gRNA sequence
aaggggaatagaatgaaaaa

SEQ ID NO: 623787 - DNA, 20 bp, Artificial
  CRISPR gRNA sequence
tcaattaaattgagaaggta

SEQ ID NO: 623788 - DNA, 20 bp, Artificial
  CRISPR gRNA sequence
ttaaattgagaaggtataat

SEQ ID NO: 623789 - DNA, 20 bp, Artificial
  CRISPR gRNA sequence
gaagacccggaaatgactga

SEQ ID NO: 623790 - DNA, 20 bp, Artificial
  CRISPR gRNA sequence
gaagtagtttacagcgggct

SEQ ID NO: 623791 - DNA, 20 bp, Artificial
  CRISPR gRNA sequence
cgggctattagcttcaatgt

SEQ ID NO: 623792 - DNA, 20 bp, Artificial
  CRISPR gRNA sequence
ttatttatagtatttacact

SEQ ID NO: 623793 - DNA, 20 bp, Artificial
  CRISPR gRNA sequence
catggttccaaaaaatagaa

SEQ ID NO: 623794 - DNA, 20 bp, Artificial
  CRISPR gRNA sequence
actccataaataacttttat

SEQ ID NO: 623795 - DNA, 20 bp, Artificial
  CRISPR gRNA sequence
ttatgatagtttacaaacaa

SEQ ID NO: 623796 - DNA, 20 bp, Artificial
  CRISPR gRNA sequence
gtgtacctcaattacaatct

SEQ ID NO: 623797 - DNA, 20 bp, Artificial
  CRISPR gRNA sequence
attacaatctaaaggtttgg

SEQ ID NO: 623798 - DNA, 20 bp, Artificial
  CRISPR gRNA sequence
cttgtgaccagtgtcatagc

SEQ ID NO: 623799 - DNA, 20 bp, Artificial
  CRISPR gRNA sequence
agacacgggcctggatcaca

SEQ ID NO: 623800 - DNA, 20 bp, Artificial
  CRISPR gRNA sequence
tcacacggtgctttactatt

SEQ ID NO: 623801 - DNA, 20 bp, Artificial
  CRISPR gRNA sequence
gggctttggcacagaccacc

SEQ ID NO: 623802 - DNA, 20 bp, Artificial
  CRISPR gRNA sequence
atgaagagtcatgcattaaa

SEQ ID NO: 623803 - DNA, 20 bp, Artificial
  CRISPR gRNA sequence
ttaaaacatgcttctttcca

SEQ ID NO: 623804 - DNA, 20 bp, Artificial
  CRISPR gRNA sequence
atagagattatatttttctt

SEQ ID NO: 623805 - DNA, 20 bp, Artificial
  CRISPR gRNA sequence
tatttttcttctttgttttt

SEQ ID NO: 623806 - DNA, 20 bp, Artificial
  CRISPR gRNA sequence
taattcatttccttaatgtg

SEQ ID NO: 623807 - DNA, 20 bp, Artificial
  CRISPR gRNA sequence
acatttcaagttgttgcatt

SEQ ID NO: 623808 - DNA, 20 bp, Artificial
  CRISPR gRNA sequence
tcttgatgtatctaggatac

SEQ ID NO: 623809 - DNA, 20 bp, Artificial
  CRISPR gRNA sequence
agaatacagtcagagcaaga

SEQ ID NO: 623810 - DNA, 20 bp, Artificial
  CRISPR gRNA sequence
aaattggaatgtaaaggagg

SEQ ID NO: 623811 - DNA, 20 bp, Artificial
  CRISPR gRNA sequence
tttaagtctgaaaattatat

SEQ ID NO: 623812 - DNA, 20 bp, Artificial
  CRISPR gRNA sequence
ccagactatcaaaagttagc

SEQ ID NO: 623813 - DNA, 20 bp, Artificial
  CRISPR gRNA sequence
tatcaaaagttagctattga

SEQ ID NO: 623814 - DNA, 20 bp, Artificial
  CRISPR gRNA sequence
agtcaccatggtgggtagaa

SEQ ID NO: 623815 - DNA, 20 bp, Artificial
  CRISPR gRNA sequence
tcatcatttttatttccccc

SEQ ID NO: 623816 - DNA, 20 bp, Artificial
  CRISPR gRNA sequence
aacatgaagataaaatctta

SEQ ID NO: 623817 - DNA, 20 bp, Artificial
  CRISPR gRNA sequence
atcactttaacttaaatgag

SEQ ID NO: 623818 - DNA, 20 bp, Artificial
  CRISPR gRNA sequence
tactcccaaattatttctga

SEQ ID NO: 623819 - DNA, 20 bp, Artificial
  CRISPR gRNA sequence
ttttctaaccagatagttag

SEQ ID NO: 623820 - DNA, 20 bp, Artificial
  CRISPR gRNA sequence
ctttaatttttatgagaaat

SEQ ID NO: 623821 - DNA, 20 bp, Artificial
  CRISPR gRNA sequence
tttttatgagaaattactga

SEQ ID NO: 623822 - DNA, 20 bp, Artificial
  CRISPR gRNA sequence
gcaggtaggaaggcaatccc

SEQ ID NO: 623823 - DNA, 20 bp, Artificial
  CRISPR gRNA sequence
aaaataatgaatttcagttc

SEQ ID NO: 623824 - DNA, 20 bp, Artificial
  CRISPR gRNA sequence
atgtctatcttgtcttacta

SEQ ID NO: 623825 - DNA, 20 bp, Artificial
  CRISPR gRNA sequence
ctaattagatttgtctactg

SEQ ID NO: 623826 - DNA, 20 bp, Artificial
  CRISPR gRNA sequence
aacctctgcctccccggttc

SEQ ID NO: 623827 - DNA, 20 bp, Artificial
  CRISPR gRNA sequence
ctccccggttcaagcgattc

SEQ ID NO: 623828 - DNA, 20 bp, Artificial
  CRISPR gRNA sequence
tgcttcagcctgccaagtaa

SEQ ID NO: 623829 - DNA, 20 bp, Artificial
  CRISPR gRNA sequence
ggcatgtaccaccaggcctg

SEQ ID NO: 623830 - DNA, 20 bp, Artificial
  CRISPR gRNA sequence
ttttgtatttttagtagaga

SEQ ID NO: 623831 - DNA, 20 bp, Artificial
  CRISPR gRNA sequence
cgccttgccttcccaaagtt

SEQ ID NO: 623832 - DNA, 20 bp, Artificial
  CRISPR gRNA sequence
ttgtatatcttttatttaaa

SEQ ID NO: 623833 - DNA, 20 bp, Artificial
  CRISPR gRNA sequence
ccagtattaaatggtatagt

SEQ ID NO: 623834 - DNA, 20 bp, Artificial
  CRISPR gRNA sequence
taaaatataaatatctatgt

SEQ ID NO: 623835 - DNA, 20 bp, Artificial
  CRISPR gRNA sequence
tggcttatacatagccaggt

SEQ ID NO: 623836 - DNA, 20 bp, Artificial
  CRISPR gRNA sequence
gccaggtcaaggattatttc

SEQ ID NO: 623837 - DNA, 20 bp, Artificial
  CRISPR gRNA sequence
caaggattatttctggggtt

SEQ ID NO: 623838 - DNA, 20 bp, Artificial
  CRISPR gRNA sequence
gattatttctggggttttct

SEQ ID NO: 623839 - DNA, 20 bp, Artificial
  CRISPR gRNA sequence
atagagtatatactatggaa

SEQ ID NO: 623840 - DNA, 20 bp, Artificial
  CRISPR gRNA sequence
aactgtgtttgttggacagc

SEQ ID NO: 623841 - DNA, 20 bp, Artificial
  CRISPR gRNA sequence
gaacaactgaagcatttcct

SEQ ID NO: 623842 - DNA, 20 bp, Artificial
  CRISPR gRNA sequence
taatctaaagaatctaattc

SEQ ID NO: 623843 - DNA, 20 bp, Artificial
  CRISPR gRNA sequence
gtcttggtaaatttgatatt

SEQ ID NO: 623844 - DNA, 20 bp, Artificial
  CRISPR gRNA sequence
atagcataggatctggaaca

SEQ ID NO: 623845 - DNA, 20 bp, Artificial
  CRISPR gRNA sequence
ctgggtgtgtcactcatagg

SEQ ID NO: 623846 - DNA, 20 bp, Artificial
  CRISPR gRNA sequence
tgtcactcataggctgggtt

SEQ ID NO: 623847 - DNA, 20 bp, Artificial
  CRISPR gRNA sequence
tatgtaataaatgcccaata

SEQ ID NO: 623848 - DNA, 20 bp, Artificial
  CRISPR gRNA sequence
taataaatgcccaataaatg

SEQ ID NO: 623849 - DNA, 20 bp, Artificial
  CRISPR gRNA sequence
ccagcagtaacttaagcatt

SEQ ID NO: 623850 - DNA, 20 bp, Artificial
  CRISPR gRNA sequence
acactgttactatttaaatt

SEQ ID NO: 623851 - DNA, 20 bp, Artificial
  CRISPR gRNA sequence
aattgaggctggaagctgat

SEQ ID NO: 623852 - DNA, 20 bp, Artificial
  CRISPR gRNA sequence
aaacaccttatggcattgct

SEQ ID NO: 623853 - DNA, 20 bp, Artificial
  CRISPR gRNA sequence
tcaacattgaattatctgtt

SEQ ID NO: 623854 - DNA, 20 bp, Artificial
  CRISPR gRNA sequence
ctcagtcttaccccctattc

SEQ ID NO: 623855 - DNA, 20 bp, Artificial
  CRISPR gRNA sequence
gtcttaccccctattcccca

SEQ ID NO: 623856 - DNA, 20 bp, Artificial
  CRISPR gRNA sequence
agggtaaaaccaaagaggag

SEQ ID NO: 623857 - DNA, 20 bp, Artificial
  CRISPR gRNA sequence
aaagaggagaagggattgag

SEQ ID NO: 623858 - DNA, 20 bp, Artificial
  CRISPR gRNA sequence
ctggatatcattttaaccac

SEQ ID NO: 623859 - DNA, 20 bp, Artificial
  CRISPR gRNA sequence
catttcataccatacttttt

SEQ ID NO: 623860 - DNA, 20 bp, Artificial
  CRISPR gRNA sequence
gggtttgttataacaataat

SEQ ID NO: 623861 - DNA, 20 bp, Artificial
  CRISPR gRNA sequence
attaacatacgtctcatata

SEQ ID NO: 623862 - DNA, 20 bp, Artificial
  CRISPR gRNA sequence
tctcttgctgtatgttattt

SEQ ID NO: 623863 - DNA, 20 bp, Artificial
  CRISPR gRNA sequence
tggttgccattagctccatg

SEQ ID NO: 623864 - DNA, 20 bp, Artificial
  CRISPR gRNA sequence
catgaaatgatttaactatt

SEQ ID NO: 623865 - DNA, 20 bp, Artificial
  CRISPR gRNA sequence
cctagtctttcttttctaaa

SEQ ID NO: 623866 - DNA, 20 bp, Artificial
  CRISPR gRNA sequence
ttactcagaaaacatttatc

SEQ ID NO: 623867 - DNA, 20 bp, Artificial
  CRISPR gRNA sequence
ctaactctggaaaagtcaag

SEQ ID NO: 623868 - DNA, 20 bp, Artificial
  CRISPR gRNA sequence
atgtatattcaaggagaaaa

SEQ ID NO: 623869 - DNA, 20 bp, Artificial
  CRISPR gRNA sequence
tggagatataaaagataatt

SEQ ID NO: 623870 - DNA, 20 bp, Artificial
  CRISPR gRNA sequence
tccctgatgttgagtgtaac

SEQ ID NO: 623871 - DNA, 20 bp, Artificial
  CRISPR gRNA sequence
gtttaaggagtggtaggaaa

SEQ ID NO: 623872 - DNA, 20 bp, Artificial
  CRISPR gRNA sequence
cagagtcttctctgctaagc

SEQ ID NO: 623873 - DNA, 20 bp, Artificial
  CRISPR gRNA sequence
gaataaaatggtcttagaaa

SEQ ID NO: 623874 - DNA, 20 bp, Artificial
  CRISPR gRNA sequence
aatggtcttagaaaagttga

SEQ ID NO: 623875 - DNA, 20 bp, Artificial
  CRISPR gRNA sequence
aaaggaggaatatcatgact

SEQ ID NO: 623876 - DNA, 20 bp, Artificial
  CRISPR gRNA sequence
catagttttggaaataataa

SEQ ID NO: 623877 - DNA, 20 bp, Artificial
  CRISPR gRNA sequence
aaataataattgagttttat

SEQ ID NO: 623878 - DNA, 20 bp, Artificial
  CRISPR gRNA sequence
tatataattaaattatttaa

SEQ ID NO: 623879 - DNA, 20 bp, Artificial
  CRISPR gRNA sequence
aaattatttaattgggtttg

SEQ ID NO: 623880 - DNA, 20 bp, Artificial
  CRISPR gRNA sequence
tgatgagcttatttatttta

SEQ ID NO: 623881 - DNA, 20 bp, Artificial
  CRISPR gRNA sequence
tttattttattgggttttag

SEQ ID NO: 623882 - DNA, 20 bp, Artificial
  CRISPR gRNA sequence
agattatttatcttatttaa

SEQ ID NO: 623883 - DNA, 20 bp, Artificial
  CRISPR gRNA sequence
cttatttaattaggttttat

SEQ ID NO: 623884 - DNA, 20 bp, Artificial
  CRISPR gRNA sequence
cttgttcaatattatcttta

SEQ ID NO: 623885 - DNA, 20 bp, Artificial
  CRISPR gRNA sequence
tctttatgttgctttttcaa

SEQ ID NO: 623886 - DNA, 20 bp, Artificial
  CRISPR gRNA sequence
atgttgctttttcaagtctg

SEQ ID NO: 623887 - DNA, 20 bp, Artificial
  CRISPR gRNA sequence
aagtctgcttagcttgaagg

SEQ ID NO: 623888 - DNA, 20 bp, Artificial
  CRISPR gRNA sequence
taaaatcaaactatgttatt

SEQ ID NO: 623889 - DNA, 20 bp, Artificial
  CRISPR gRNA sequence
aagtgcaaagcagaaggata

SEQ ID NO: 623890 - DNA, 20 bp, Artificial
  CRISPR gRNA sequence
cttaaaatctatatatattg

SEQ ID NO: 623891 - DNA, 20 bp, Artificial
  CRISPR gRNA sequence
atctatatatattgttaggt

SEQ ID NO: 623892 - DNA, 20 bp, Artificial
  CRISPR gRNA sequence
attgttaggtttatgctttg

SEQ ID NO: 623893 - DNA, 20 bp, Artificial
  CRISPR gRNA sequence
gggcacccccaaactttgga

SEQ ID NO: 623894 - DNA, 20 bp, Artificial
  CRISPR gRNA sequence
gaacatccaagaggaatttc

SEQ ID NO: 623895 - DNA, 20 bp, Artificial
  CRISPR gRNA sequence
ccaagaggaatttcccggga

SEQ ID NO: 623896 - DNA, 20 bp, Artificial
  CRISPR gRNA sequence
aggaatttcccgggattgag

SEQ ID NO: 623897 - DNA, 20 bp, Artificial
  CRISPR gRNA sequence
gtgaactaataaatggagaa

SEQ ID NO: 623898 - DNA, 20 bp, Artificial
  CRISPR gRNA sequence
aacacttggggtacctccat

SEQ ID NO: 623899 - DNA, 20 bp, Artificial
  CRISPR gRNA sequence
actggatgaaaggaagaaat

SEQ ID NO: 623900 - DNA, 20 bp, Artificial
  CRISPR gRNA sequence
atagaagaaagaaaggtaaa

SEQ ID NO: 623901 - DNA, 20 bp, Artificial
  CRISPR gRNA sequence
tttatgtagtggcccaacgt

SEQ ID NO: 623902 - DNA, 20 bp, Artificial
  CRISPR gRNA sequence
gcagagtaggaacatggaaa

SEQ ID NO: 623903 - DNA, 20 bp, Artificial
  CRISPR gRNA sequence
gaaaataactaagataactg

SEQ ID NO: 623904 - DNA, 20 bp, Artificial
  CRISPR gRNA sequence
gcaacaatatagaagacatc

SEQ ID NO: 623905 - DNA, 20 bp, Artificial
  CRISPR gRNA sequence
ttggaatttgaatttgggtg

SEQ ID NO: 623906 - DNA, 20 bp, Artificial
  CRISPR gRNA sequence
atttgaatttgggtgaactg

SEQ ID NO: 623907 - DNA, 20 bp, Artificial
  CRISPR gRNA sequence
gaatacattgggaatacact

SEQ ID NO: 623908 - DNA, 20 bp, Artificial
  CRISPR gRNA sequence
gaaacagtgatctaatggaa

SEQ ID NO: 623909 - DNA, 20 bp, Artificial
  CRISPR gRNA sequence
ctcaaatataaggtcaaaga

SEQ ID NO: 623910 - DNA, 20 bp, Artificial
  CRISPR gRNA sequence
tcaaagaggatgtttggtta

SEQ ID NO: 623911 - DNA, 20 bp, Artificial
  CRISPR gRNA sequence
ccttattggtatatctttag

SEQ ID NO: 623912 - DNA, 20 bp, Artificial
  CRISPR gRNA sequence
tttagcccagattaatgtct

SEQ ID NO: 623913 - DNA, 20 bp, Artificial
  CRISPR gRNA sequence
attattgagatatctagaga

SEQ ID NO: 623914 - DNA, 20 bp, Artificial
  CRISPR gRNA sequence
agatatctagagaatttgtt

SEQ ID NO: 623915 - DNA, 20 bp, Artificial
  CRISPR gRNA sequence
gatccatgaagcaaaacaaa

SEQ ID NO: 623916 - DNA, 20 bp, Artificial
  CRISPR gRNA sequence
agaccttacaaatatgtctg

SEQ ID NO: 623917 - DNA, 20 bp, Artificial
  CRISPR gRNA sequence
atggtattacacctatttca

SEQ ID NO: 623918 - DNA, 20 bp, Artificial
  CRISPR gRNA sequence
aatcatcattttcagttcac

SEQ ID NO: 623919 - DNA, 20 bp, Artificial
  CRISPR gRNA sequence
gtgtgggacagttcccacac

SEQ ID NO: 623920 - DNA, 20 bp, Artificial
  CRISPR gRNA sequence
ggacagttcccacacccagg

SEQ ID NO: 623921 - DNA, 20 bp, Artificial
  CRISPR gRNA sequence
tgaaacttagagcaaaactg

SEQ ID NO: 623922 - DNA, 20 bp, Artificial
  CRISPR gRNA sequence
ttttgggggcaaacccgtta

SEQ ID NO: 623923 - DNA, 20 bp, Artificial
  CRISPR gRNA sequence
caaacccgttaaccagtttt

SEQ ID NO: 623924 - DNA, 20 bp, Artificial
  CRISPR gRNA sequence
tcatctttggtccatacttg

SEQ ID NO: 623925 - DNA, 20 bp, Artificial
  CRISPR gRNA sequence
ggtccatacttggactgctt

SEQ ID NO: 623926 - DNA, 20 bp, Artificial
  CRISPR gRNA sequence
gttatttctaataatgtagt

SEQ ID NO: 623927 - DNA, 20 bp, Artificial
  CRISPR gRNA sequence
tccatcatccaaacaaaaag

SEQ ID NO: 623928 - DNA, 20 bp, Artificial
  CRISPR gRNA sequence
tacgtgaattggtcatcctt

SEQ ID NO: 623929 - DNA, 20 bp, Artificial
  CRISPR gRNA sequence
ccttgaatgtttttgaaatt

SEQ ID NO: 623930 - DNA, 20 bp, Artificial
  CRISPR gRNA sequence
gttgttactaaaagagaata

SEQ ID NO: 623931 - DNA, 20 bp, Artificial
  CRISPR gRNA sequence
atgatatagtgcagacaatg

SEQ ID NO: 623932 - DNA, 20 bp, Artificial
  CRISPR gRNA sequence
ccagaggacttcttattaaa

SEQ ID NO: 623933 - DNA, 20 bp, Artificial
  CRISPR gRNA sequence
taatcaaaacttggatggaa

SEQ ID NO: 623934 - DNA, 20 bp, Artificial
  CRISPR gRNA sequence
catgaaaacattttttcaca

SEQ ID NO: 623935 - DNA, 20 bp, Artificial
  CRISPR gRNA sequence
gaattttcctacctttcatc

SEQ ID NO: 623936 - DNA, 20 bp, Artificial
  CRISPR gRNA sequence
gtaaagttattctaagaaat

SEQ ID NO: 623937 - DNA, 20 bp, Artificial
  CRISPR gRNA sequence
tattctaagaaatgaaagct

SEQ ID NO: 623938 - DNA, 20 bp, Artificial
  CRISPR gRNA sequence
gttatgttctttcctgagaa

SEQ ID NO: 623939 - DNA, 20 bp, Artificial
  CRISPR gRNA sequence
tgagaacactgtttttaatc

SEQ ID NO: 623940 - DNA, 20 bp, Artificial
  CRISPR gRNA sequence
agtatttctactcaaaaaac

SEQ ID NO: 623941 - DNA, 20 bp, Artificial
  CRISPR gRNA sequence
aatgtcagtgtctaagggct

SEQ ID NO: 623942 - DNA, 20 bp, Artificial
  CRISPR gRNA sequence
tatgtcaaatgaattagggc

SEQ ID NO: 623943 - DNA, 20 bp, Artificial
  CRISPR gRNA sequence
agccaatgtgccaatttaga

SEQ ID NO: 623944 - DNA, 20 bp, Artificial
  CRISPR gRNA sequence
aattacaatcataaagctgc

SEQ ID NO: 623945 - DNA, 20 bp, Artificial
  CRISPR gRNA sequence
aattggctcttcttcatgag

SEQ ID NO: 623946 - DNA, 20 bp, Artificial
  CRISPR gRNA sequence
accgtgctgttattttgtat

SEQ ID NO: 623947 - DNA, 20 bp, Artificial
  CRISPR gRNA sequence
ctgttattttgtatgtctgt

SEQ ID NO: 623948 - DNA, 20 bp, Artificial
  CRISPR gRNA sequence
caaacaagttgacttactta

SEQ ID NO: 623949 - DNA, 20 bp, Artificial
  CRISPR gRNA sequence
tagtgcagtcttaaaagtag

SEQ ID NO: 623950 - DNA, 20 bp, Artificial
  CRISPR gRNA sequence
taagatgagaaaccacatga

SEQ ID NO: 623951 - DNA, 20 bp, Artificial
  CRISPR gRNA sequence
tggcaacagtgtatgtatgt

SEQ ID NO: 623952 - DNA, 20 bp, Artificial
  CRISPR gRNA sequence
cactagagggtattctttct

SEQ ID NO: 623953 - DNA, 20 bp, Artificial
  CRISPR gRNA sequence
acttgcttctactgaagcat

SEQ ID NO: 623954 - DNA, 20 bp, Artificial
  CRISPR gRNA sequence
acacatatcgagatggcata

SEQ ID NO: 623955 - DNA, 20 bp, Artificial
  CRISPR gRNA sequence
tccaaaatgttgaagaaatt

SEQ ID NO: 623956 - DNA, 20 bp, Artificial
  CRISPR gRNA sequence
attatcagattgcatttttc

SEQ ID NO: 623957 - DNA, 20 bp, Artificial
  CRISPR gRNA sequence
ttttgtatagtacctcctat

SEQ ID NO: 623958 - DNA, 20 bp, Artificial
  CRISPR gRNA sequence
acgtaaaagctccactccac

SEQ ID NO: 623959 - DNA, 20 bp, Artificial
  CRISPR gRNA sequence
agtttgtgggtaagcattac

SEQ ID NO: 623960 - DNA, 20 bp, Artificial
  CRISPR gRNA sequence
tgggtaagcattacaaatgc

SEQ ID NO: 623961 - DNA, 20 bp, Artificial
  CRISPR gRNA sequence
atgtattagaaatatatatg

SEQ ID NO: 623962 - DNA, 20 bp, Artificial
  CRISPR gRNA sequence
agaaacggtccagcctattg

SEQ ID NO: 623963 - DNA, 20 bp, Artificial
  CRISPR gRNA sequence
gcctattggccagttttgta

SEQ ID NO: 623964 - DNA, 20 bp, Artificial
  CRISPR gRNA sequence
ttttaaaattttcattagtg

SEQ ID NO: 623965 - DNA, 20 bp, Artificial
  CRISPR gRNA sequence
ttcattagtgtcaggttttt

SEQ ID NO: 623966 - DNA, 20 bp, Artificial
  CRISPR gRNA sequence
tgctcaaggtcatcgccaag

SEQ ID NO: 623967 - DNA, 20 bp, Artificial
  CRISPR gRNA sequence
aatgcagcaacctacattca

SEQ ID NO: 623968 - DNA, 20 bp, Artificial
  CRISPR gRNA sequence
tctttatttcatattttaat

SEQ ID NO: 623969 - DNA, 20 bp, Artificial
  CRISPR gRNA sequence
tctttgttttttcatccagc

SEQ ID NO: 623970 - DNA, 20 bp, Artificial
  CRISPR gRNA sequence
cagcctatgattttgaactg

SEQ ID NO: 623971 - DNA, 20 bp, Artificial
  CRISPR gRNA sequence
tctggatgcatgctgtaagt

SEQ ID NO: 623972 - DNA, 20 bp, Artificial
  CRISPR gRNA sequence
tttaaaagaaatatgaataa

SEQ ID NO: 623973 - DNA, 20 bp, Artificial
  CRISPR gRNA sequence
tattaggataaaaatattca

SEQ ID NO: 623974 - DNA, 20 bp, Artificial
  CRISPR gRNA sequence
agtgtcagcattgtgggaca

SEQ ID NO: 623975 - DNA, 20 bp, Artificial
  CRISPR gRNA sequence
tgtgggacatcctgattaaa

SEQ ID NO: 623976 - DNA, 20 bp, Artificial
  CRISPR gRNA sequence
atggtgattgagacaaaaat

SEQ ID NO: 623977 - DNA, 20 bp, Artificial
  CRISPR gRNA sequence
tacttcaataaacacttaaa

SEQ ID NO: 623978 - DNA, 20 bp, Artificial
  CRISPR gRNA sequence
tagcactctaagactagctg

SEQ ID NO: 623979 - DNA, 20 bp, Artificial
  CRISPR gRNA sequence
ctaagggtgactataagggc

SEQ ID NO: 623980 - DNA, 20 bp, Artificial
  CRISPR gRNA sequence
tgaaaaaaaagaaataaaga

SEQ ID NO: 623981 - DNA, 20 bp, Artificial
  CRISPR gRNA sequence
gccagtttacttatttttaa

SEQ ID NO: 623982 - DNA, 20 bp, Artificial
  CRISPR gRNA sequence
tttttttgttggatgtcatt

SEQ ID NO: 623983 - DNA, 20 bp, Artificial
  CRISPR gRNA sequence
tttatatagtctactctttg

SEQ ID NO: 623984 - DNA, 20 bp, Artificial
  CRISPR gRNA sequence
actctttgtaacgttttttg

SEQ ID NO: 623985 - DNA, 20 bp, Artificial
  CRISPR gRNA sequence
tgcattccttagaaaagagg

SEQ ID NO: 623986 - DNA, 20 bp, Artificial
  CRISPR gRNA sequence
cagctttttagaaaattaca

SEQ ID NO: 623987 - DNA, 20 bp, Artificial
  CRISPR gRNA sequence
tgagagaatatttttcttta

SEQ ID NO: 623988 - DNA, 20 bp, Artificial
  CRISPR gRNA sequence
tctctccctctcttttctta

SEQ ID NO: 623989 - DNA, 20 bp, Artificial
  CRISPR gRNA sequence
ccctctcttttcttattcag

SEQ ID NO: 623990 - DNA, 20 bp, Artificial
  CRISPR gRNA sequence
acaggggataaaatcgctgg

SEQ ID NO: 623991 - DNA, 20 bp, Artificial
  CRISPR gRNA sequence
aacataatattaccaattct

SEQ ID NO: 623992 - DNA, 20 bp, Artificial
  CRISPR gRNA sequence
aggattgtatgcatccatgt

SEQ ID NO: 623993 - DNA, 20 bp, Artificial
  CRISPR gRNA sequence
tgaaattgttgaaagaatct

SEQ ID NO: 623994 - DNA, 20 bp, Artificial
  CRISPR gRNA sequence
attgttgaaagaatctctgt

SEQ ID NO: 623995 - DNA, 20 bp, Artificial
  CRISPR gRNA sequence
agaatctctgtgcttgtttt

SEQ ID NO: 623996 - DNA, 20 bp, Artificial
  CRISPR gRNA sequence
ttcatttccaagtccatgca

SEQ ID NO: 623997 - DNA, 20 bp, Artificial
  CRISPR gRNA sequence
ttattctcactgaggtcaca

SEQ ID NO: 623998 - DNA, 20 bp, Artificial
  CRISPR gRNA sequence
ctttggaaacacactctttt

SEQ ID NO: 623999 - DNA, 20 bp, Artificial
  CRISPR gRNA sequence
gttcaaataaatatgcaatt

SEQ ID NO: 624000 - DNA, 20 bp, Artificial
  CRISPR gRNA sequence
cagcacgagcagaaccaccc

SEQ ID NO: 624001 - DNA, 20 bp, Artificial
  CRISPR gRNA sequence
cttggccatcaggcctaggt

SEQ ID NO: 624002 - DNA, 20 bp, Artificial
  CRISPR gRNA sequence
caaggaattctggggtctga

SEQ ID NO: 624003 - DNA, 20 bp, Artificial
  CRISPR gRNA sequence
tgggtgatatcagttatttc

SEQ ID NO: 624004 - DNA, 20 bp, Artificial
  CRISPR gRNA sequence
gttatttccttggcttcaga

SEQ ID NO: 624005 - DNA, 20 bp, Artificial
  CRISPR gRNA sequence
tgaataccttcagggcactt

SEQ ID NO: 624006 - DNA, 20 bp, Artificial
  CRISPR gRNA sequence
ttatctaacttgtctttcgc

SEQ ID NO: 624007 - DNA, 20 bp, Artificial
  CRISPR gRNA sequence
tttctaccagctactccacc

SEQ ID NO: 624008 - DNA, 20 bp, Artificial
  CRISPR gRNA sequence
cctcatgtttcttcacttgg

SEQ ID NO: 624009 - DNA, 20 bp, Artificial
  CRISPR gRNA sequence
gtttacaatcacattattgt

SEQ ID NO: 624010 - DNA, 20 bp, Artificial
  CRISPR gRNA sequence
aagttctttaagaatataga

SEQ ID NO: 624011 - DNA, 20 bp, Artificial
  CRISPR gRNA sequence
aagaatatagatcaggtttg

SEQ ID NO: 624012 - DNA, 20 bp, Artificial
  CRISPR gRNA sequence
gtttgtctagcttaatttgg

SEQ ID NO: 624013 - DNA, 20 bp, Artificial
  CRISPR gRNA sequence
agtgccatgaaataatttct

SEQ ID NO: 624014 - DNA, 20 bp, Artificial
  CRISPR gRNA sequence
tgaaataatttctcctcgtt

SEQ ID NO: 624015 - DNA, 20 bp, Artificial
  CRISPR gRNA sequence
accatttatgggaaacccac

SEQ ID NO: 624016 - DNA, 20 bp, Artificial
  CRISPR gRNA sequence
tttttaagaagcatttatct

SEQ ID NO: 624017 - DNA, 20 bp, Artificial
  CRISPR gRNA sequence
tatttaaggaaaaactgcaa

SEQ ID NO: 624018 - DNA, 20 bp, Artificial
  CRISPR gRNA sequence
tcaagaagcaaaacaatgag

SEQ ID NO: 624019 - DNA, 20 bp, Artificial
  CRISPR gRNA sequence
aaacaatgagacaagatttt

SEQ ID NO: 624020 - DNA, 20 bp, Artificial
  CRISPR gRNA sequence
actctcacttttatgatctt

SEQ ID NO: 624021 - DNA, 20 bp, Artificial
  CRISPR gRNA sequence
gatctttgtagcttggtcac

SEQ ID NO: 624022 - DNA, 20 bp, Artificial
  CRISPR gRNA sequence
aaaatcaagcatagtctctg

SEQ ID NO: 624023 - DNA, 20 bp, Artificial
  CRISPR gRNA sequence
atggcatcagaacaaatgca

SEQ ID NO: 624024 - DNA, 20 bp, Artificial
  CRISPR gRNA sequence
caaatggcttacaaaatttt

SEQ ID NO: 624025 - DNA, 20 bp, Artificial
  CRISPR gRNA sequence
cccttccaggggaaaagctc

SEQ ID NO: 624026 - DNA, 20 bp, Artificial
  CRISPR gRNA sequence
gaagtggccccagttataag

SEQ ID NO: 624027 - DNA, 20 bp, Artificial
  CRISPR gRNA sequence
gcctctcccagcaatagctg

SEQ ID NO: 624028 - DNA, 20 bp, Artificial
  CRISPR gRNA sequence
aatcccaagaggaaacaaag

SEQ ID NO: 624029 - DNA, 20 bp, Artificial
  CRISPR gRNA sequence
gcttacatgaaggaggatgt

SEQ ID NO: 624030 - DNA, 20 bp, Artificial
  CRISPR gRNA sequence
ggtcttcaatggagaaggag

SEQ ID NO: 624031 - DNA, 20 bp, Artificial
  CRISPR gRNA sequence
ctacagaagccaggaccgtt

SEQ ID NO: 624032 - DNA, 20 bp, Artificial
  CRISPR gRNA sequence
gaagagagaaggggcgggaa

SEQ ID NO: 624033 - DNA, 20 bp, Artificial
  CRISPR gRNA sequence
ggaatattgtttctttatca

SEQ ID NO: 624034 - DNA, 20 bp, Artificial
  CRISPR gRNA sequence
tattgtttctttatcacctg

SEQ ID NO: 624035 - DNA, 20 bp, Artificial
  CRISPR gRNA sequence
tccatttctaccaaggcata

SEQ ID NO: 624036 - DNA, 20 bp, Artificial
  CRISPR gRNA sequence
atatcatgctttgaaaaatc

SEQ ID NO: 624037 - DNA, 20 bp, Artificial
  CRISPR gRNA sequence
ttgaaaaatcacttgattca

SEQ ID NO: 624038 - DNA, 20 bp, Artificial
  CRISPR gRNA sequence
tgattcataaagattcacct

SEQ ID NO: 624039 - DNA, 20 bp, Artificial
  CRISPR gRNA sequence
ataaagattcacctaagaga

SEQ ID NO: 624040 - DNA, 20 bp, Artificial
  CRISPR gRNA sequence
tgatggaagacaggaaagtt

SEQ ID NO: 624041 - DNA, 20 bp, Artificial
  CRISPR gRNA sequence
agttttctgggtaggacttt

SEQ ID NO: 624042 - DNA, 20 bp, Artificial
  CRISPR gRNA sequence
actttattcttgaaagaaga

SEQ ID NO: 624043 - DNA, 20 bp, Artificial
  CRISPR gRNA sequence
gagctgagttgttgtgggtt

SEQ ID NO: 624044 - DNA, 20 bp, Artificial
  CRISPR gRNA sequence
cctatggaatttataattca

SEQ ID NO: 624045 - DNA, 20 bp, Artificial
  CRISPR gRNA sequence
cttatttttctaaacgtaag

SEQ ID NO: 624046 - DNA, 20 bp, Artificial
  CRISPR gRNA sequence
aaacgtaagcactgtttttc

SEQ ID NO: 624047 - DNA, 20 bp, Artificial
  CRISPR gRNA sequence
tttaaggaatagtattttta

SEQ ID NO: 624048 - DNA, 20 bp, Artificial
  CRISPR gRNA sequence
agggacttctactttcataa

SEQ ID NO: 624049 - DNA, 20 bp, Artificial
  CRISPR gRNA sequence
tactttcataaatttgtttg

SEQ ID NO: 624050 - DNA, 20 bp, Artificial
  CRISPR gRNA sequence
gatggcagcatagtatatgt

SEQ ID NO: 624051 - DNA, 20 bp, Artificial
  CRISPR gRNA sequence
atatgtatttgtttctaaaa

SEQ ID NO: 624052 - DNA, 20 bp, Artificial
  CRISPR gRNA sequence
atttgtttctaaaagtatgc

SEQ ID NO: 624053 - DNA, 20 bp, Artificial
  CRISPR gRNA sequence
tttctggtatttctcttttc

SEQ ID NO: 624054 - DNA, 20 bp, Artificial
  CRISPR gRNA sequence
gtcttaaaagtcttcctgtc

SEQ ID NO: 624055 - DNA, 20 bp, Artificial
  CRISPR gRNA sequence
taaaagaaacaaaaaaataa

SEQ ID NO: 624056 - DNA, 20 bp, Artificial
  CRISPR gRNA sequence
aaggaaagtcctgcacattt

SEQ ID NO: 624057 - DNA, 20 bp, Artificial
  CRISPR gRNA sequence
ataggttgccatatttcatg

SEQ ID NO: 624058 - DNA, 20 bp, Artificial
  CRISPR gRNA sequence
taatttcatttatgtgggcg

SEQ ID NO: 624059 - DNA, 20 bp, Artificial
  CRISPR gRNA sequence
agaggggaggaaccgagtga

SEQ ID NO: 624060 - DNA, 20 bp, Artificial
  CRISPR gRNA sequence
catacttggaaggcagaact

SEQ ID NO: 624061 - DNA, 20 bp, Artificial
  CRISPR gRNA sequence
tggaaggcagaacttgctgc

SEQ ID NO: 624062 - DNA, 20 bp, Artificial
  CRISPR gRNA sequence
ggaggacagacctgactgtg

SEQ ID NO: 624063 - DNA, 20 bp, Artificial
  CRISPR gRNA sequence
caagagaattgtggacataa

SEQ ID NO: 624064 - DNA, 20 bp, Artificial
  CRISPR gRNA sequence
atactgctcttaactcattt

SEQ ID NO: 624065 - DNA, 20 bp, Artificial
  CRISPR gRNA sequence
acaacctatttaaagataaa

SEQ ID NO: 624066 - DNA, 20 bp, Artificial
  CRISPR gRNA sequence
agtgctgaggcactttcctt

SEQ ID NO: 624067 - DNA, 20 bp, Artificial
  CRISPR gRNA sequence
ctgatttcatctttttggga

SEQ ID NO: 624068 - DNA, 20 bp, Artificial
  CRISPR gRNA sequence
caagcatatacttgtatctt

SEQ ID NO: 624069 - DNA, 20 bp, Artificial
  CRISPR gRNA sequence
agaaagaatttttgtggacg

SEQ ID NO: 624070 - DNA, 20 bp, Artificial
  CRISPR gRNA sequence
agagtcagacaccaaataaa

SEQ ID NO: 624071 - DNA, 20 bp, Artificial
  CRISPR gRNA sequence
ttttacataacagttgtatg

SEQ ID NO: 624072 - DNA, 20 bp, Artificial
  CRISPR gRNA sequence
acataacagttgtatgccca

SEQ ID NO: 624073 - DNA, 20 bp, Artificial
  CRISPR gRNA sequence
tgtatgcccagtttgtttag

SEQ ID NO: 624074 - DNA, 20 bp, Artificial
  CRISPR gRNA sequence
atgggttatcttctgtattt

SEQ ID NO: 624075 - DNA, 20 bp, Artificial
  CRISPR gRNA sequence
aaaagttcagaatttcatca

SEQ ID NO: 624076 - DNA, 20 bp, Artificial
  CRISPR gRNA sequence
gacagggaaagggatcagta

SEQ ID NO: 624077 - DNA, 20 bp, Artificial
  CRISPR gRNA sequence
caagtcattgaaatattcca

SEQ ID NO: 624078 - DNA, 20 bp, Artificial
  CRISPR gRNA sequence
gggaaaataagaaactacga

SEQ ID NO: 624079 - DNA, 20 bp, Artificial
  CRISPR gRNA sequence
agttaataccaagaaattag

SEQ ID NO: 624080 - DNA, 20 bp, Artificial
  CRISPR gRNA sequence
acagaacaaagtgaaacaaa

SEQ ID NO: 624081 - DNA, 20 bp, Artificial
  CRISPR gRNA sequence
agtgaaacaaacaatgatta

SEQ ID NO: 624082 - DNA, 20 bp, Artificial
  CRISPR gRNA sequence
acattcaaagatatttaatg

SEQ ID NO: 624083 - DNA, 20 bp, Artificial
  CRISPR gRNA sequence
ggcaaatagagaaagacaag

SEQ ID NO: 624084 - DNA, 20 bp, Artificial
  CRISPR gRNA sequence
atagtttagtgagcccggta

SEQ ID NO: 624085 - DNA, 20 bp, Artificial
  CRISPR gRNA sequence
tgagcccggtattttgtttt

SEQ ID NO: 624086 - DNA, 20 bp, Artificial
  CRISPR gRNA sequence
tgaagtctttggtattttat

SEQ ID NO: 624087 - DNA, 20 bp, Artificial
  CRISPR gRNA sequence
aaatgtttaacaaaatttac

SEQ ID NO: 624088 - DNA, 20 bp, Artificial
  CRISPR gRNA sequence
tttatttcatcctatctcca

SEQ ID NO: 624089 - DNA, 20 bp, Artificial
  CRISPR gRNA sequence
caagcaaaaaactgtgtgcc

SEQ ID NO: 624090 - DNA, 20 bp, Artificial
  CRISPR gRNA sequence
aactgtcagaggtactagct

SEQ ID NO: 624091 - DNA, 20 bp, Artificial
  CRISPR gRNA sequence
tcagaggtactagctacatg

SEQ ID NO: 624092 - DNA, 20 bp, Artificial
  CRISPR gRNA sequence
tacatgatttgttttttaac

SEQ ID NO: 624093 - DNA, 20 bp, Artificial
  CRISPR gRNA sequence
caaaaatggataaattacat

SEQ ID NO: 624094 - DNA, 20 bp, Artificial
  CRISPR gRNA sequence
aaagtgggaagaggtgaaat

SEQ ID NO: 624095 - DNA, 20 bp, Artificial
  CRISPR gRNA sequence
cttagacatatttttaattc

SEQ ID NO: 624096 - DNA, 20 bp, Artificial
  CRISPR gRNA sequence
aaactagactttactacctt

SEQ ID NO: 624097 - DNA, 20 bp, Artificial
  CRISPR gRNA sequence
tagtttcatagtatttctga

SEQ ID NO: 624098 - DNA, 20 bp, Artificial
  CRISPR gRNA sequence
tagtatttctgaatatgatt

SEQ ID NO: 624099 - DNA, 20 bp, Artificial
  CRISPR gRNA sequence
cctgtgaattgaattataat

SEQ ID NO: 624100 - DNA, 20 bp, Artificial
  CRISPR gRNA sequence
aattgaattataatttgtgt

SEQ ID NO: 624101 - DNA, 20 bp, Artificial
  CRISPR gRNA sequence
aattataatttgtgtttttg

SEQ ID NO: 624102 - DNA, 20 bp, Artificial
  CRISPR gRNA sequence
tcaataaaatacagtattca

SEQ ID NO: 624103 - DNA, 20 bp, Artificial
  CRISPR gRNA sequence
ttttctaatctgttagaaaa

SEQ ID NO: 624104 - DNA, 20 bp, Artificial
  CRISPR gRNA sequence
ttctccaaagcataatctca

SEQ ID NO: 624105 - DNA, 20 bp, Artificial
  CRISPR gRNA sequence
caatgggtgtgttaggatat

SEQ ID NO: 624106 - DNA, 20 bp, Artificial
  CRISPR gRNA sequence
accaagaagctgtgatatgc

SEQ ID NO: 624107 - DNA, 20 bp, Artificial
  CRISPR gRNA sequence
cttaaactttggaatttcca

SEQ ID NO: 624108 - DNA, 20 bp, Artificial
  CRISPR gRNA sequence
tttttatgtaatattctatt

SEQ ID NO: 624109 - DNA, 20 bp, Artificial
  CRISPR gRNA sequence
taatattctatttctagctt

SEQ ID NO: 624110 - DNA, 20 bp, Artificial
  CRISPR gRNA sequence
tagttttatcttgctgtact

SEQ ID NO: 624111 - DNA, 20 bp, Artificial
  CRISPR gRNA sequence
tcttaggaataagttcataa

SEQ ID NO: 624112 - DNA, 20 bp, Artificial
  CRISPR gRNA sequence
taagttcataattctgttta

SEQ ID NO: 624113 - DNA, 20 bp, Artificial
  CRISPR gRNA sequence
cagagagtggtacatgaatg

SEQ ID NO: 624114 - DNA, 20 bp, Artificial
  CRISPR gRNA sequence
gttcatataggtacaaataa

SEQ ID NO: 624115 - DNA, 20 bp, Artificial
  CRISPR gRNA sequence
ctcaagtgacagatagtaag

SEQ ID NO: 624116 - DNA, 20 bp, Artificial
  CRISPR gRNA sequence
aatcccctactatgcactta

SEQ ID NO: 624117 - DNA, 20 bp, Artificial
  CRISPR gRNA sequence
acttactttaatttactgga

SEQ ID NO: 624118 - DNA, 20 bp, Artificial
  CRISPR gRNA sequence
actgtaacaagggaagggat

SEQ ID NO: 624119 - DNA, 20 bp, Artificial
  CRISPR gRNA sequence
ggaagggatctgggtttttt

SEQ ID NO: 624120 - DNA, 20 bp, Artificial
  CRISPR gRNA sequence
gggtttttttgttgttttat

SEQ ID NO: 624121 - DNA, 20 bp, Artificial
  CRISPR gRNA sequence
aagtagttcaaattctgaaa

SEQ ID NO: 624122 - DNA, 20 bp, Artificial
  CRISPR gRNA sequence
aaattttttacagtcaagca

SEQ ID NO: 624123 - DNA, 20 bp, Artificial
  CRISPR gRNA sequence
tcccttctgtcattgtctat

SEQ ID NO: 624124 - DNA, 20 bp, Artificial
  CRISPR gRNA sequence
gtttacctctctgttctcct

SEQ ID NO: 624125 - DNA, 20 bp, Artificial
  CRISPR gRNA sequence
tctctgttctcctaaaagtt

SEQ ID NO: 624126 - DNA, 20 bp, Artificial
  CRISPR gRNA sequence
atttaatcttaatttttttt

SEQ ID NO: 624127 - DNA, 20 bp, Artificial
  CRISPR gRNA sequence
gacgtatttttatactcaag

SEQ ID NO: 624128 - DNA, 20 bp, Artificial
  CRISPR gRNA sequence
ttctattaaaaagaaaagtg

SEQ ID NO: 624129 - DNA, 20 bp, Artificial
  CRISPR gRNA sequence
gggtacctaaaacattactt

SEQ ID NO: 624130 - DNA, 20 bp, Artificial
  CRISPR gRNA sequence
gattatgtaatcctattata

SEQ ID NO: 624131 - DNA, 20 bp, Artificial
  CRISPR gRNA sequence
atgtaatcctattatagtat

SEQ ID NO: 624132 - DNA, 20 bp, Artificial
  CRISPR gRNA sequence
tatgtttgctttcctttatt

SEQ ID NO: 624133 - DNA, 20 bp, Artificial
  CRISPR gRNA sequence
ctttattgttggattttaca

SEQ ID NO: 624134 - DNA, 20 bp, Artificial
  CRISPR gRNA sequence
tgttggattttacattctga

SEQ ID NO: 624135 - DNA, 20 bp, Artificial
  CRISPR gRNA sequence
aagactagacagttatttgc

SEQ ID NO: 624136 - DNA, 20 bp, Artificial
  CRISPR gRNA sequence
ctttctcctaattgggagaa

SEQ ID NO: 624137 - DNA, 20 bp, Artificial
  CRISPR gRNA sequence
aacattactataataatatt

SEQ ID NO: 624138 - DNA, 20 bp, Artificial
  CRISPR gRNA sequence
atgtgttatttgcaatccca

SEQ ID NO: 624139 - DNA, 20 bp, Artificial
  CRISPR gRNA sequence
gttatttgcaatcccagaat

SEQ ID NO: 624140 - DNA, 20 bp, Artificial
  CRISPR gRNA sequence
ccttgaagtcttaaaaacta

SEQ ID NO: 624141 - DNA, 20 bp, Artificial
  CRISPR gRNA sequence
gagaaaaacactccacaatc

SEQ ID NO: 624142 - DNA, 20 bp, Artificial
  CRISPR gRNA sequence
ttccatggaaattagtaatc

SEQ ID NO: 624143 - DNA, 20 bp, Artificial
  CRISPR gRNA sequence
tgtcctaaagttgaactttt

SEQ ID NO: 624144 - DNA, 20 bp, Artificial
  CRISPR gRNA sequence
aataaaagcaaagcacttag

SEQ ID NO: 624145 - DNA, 20 bp, Artificial
  CRISPR gRNA sequence
tttaaaaatatttggagcag

SEQ ID NO: 624146 - DNA, 20 bp, Artificial
  CRISPR gRNA sequence
aaaactgctgtaatataaat

SEQ ID NO: 624147 - DNA, 20 bp, Artificial
  CRISPR gRNA sequence
attagactattttaaagact

SEQ ID NO: 624148 - DNA, 20 bp, Artificial
  CRISPR gRNA sequence
attttaaagactaattgctt

SEQ ID NO: 624149 - DNA, 20 bp, Artificial
  CRISPR gRNA sequence
ttgacagtttctagggtatt

SEQ ID NO: 624150 - DNA, 20 bp, Artificial
  CRISPR gRNA sequence
taatttggggaaataaaaac

SEQ ID NO: 624151 - DNA, 20 bp, Artificial
  CRISPR gRNA sequence
aaaattccataccttgtatg

SEQ ID NO: 624152 - DNA, 20 bp, Artificial
  CRISPR gRNA sequence
gtcaggtttgctaagtgtaa

SEQ ID NO: 624153 - DNA, 20 bp, Artificial
  CRISPR gRNA sequence
aaataccatacctcagaaaa

SEQ ID NO: 624154 - DNA, 20 bp, Artificial
  CRISPR gRNA sequence
tgacaagtcactctactaca

SEQ ID NO: 624155 - DNA, 20 bp, Artificial
  CRISPR gRNA sequence
tgatttggagacctccgcta

SEQ ID NO: 624156 - DNA, 20 bp, Artificial
  CRISPR gRNA sequence
aaatgtgggacttgtatctt

SEQ ID NO: 624157 - DNA, 20 bp, Artificial
  CRISPR gRNA sequence
aactttgtaatactttgtga

SEQ ID NO: 624158 - DNA, 20 bp, Artificial
  CRISPR gRNA sequence
tgtgaaaaggattatattat

SEQ ID NO: 624159 - DNA, 20 bp, Artificial
  CRISPR gRNA sequence
ggaacaagcatataatttgt

SEQ ID NO: 624160 - DNA, 20 bp, Artificial
  CRISPR gRNA sequence
tttcttctcagaagtgtaag

SEQ ID NO: 624161 - DNA, 20 bp, Artificial
  CRISPR gRNA sequence
taaaataaacttctgacata

SEQ ID NO: 624162 - DNA, 20 bp, Artificial
  CRISPR gRNA sequence
agactaaattgttgactata

SEQ ID NO: 624163 - DNA, 20 bp, Artificial
  CRISPR gRNA sequence
tttggaagacatgtttgtgt

SEQ ID NO: 624164 - DNA, 20 bp, Artificial
  CRISPR gRNA sequence
gtttgtgtacagaattttca

SEQ ID NO: 624165 - DNA, 20 bp, Artificial
  CRISPR gRNA sequence
ggtaaaatattaaataatat

SEQ ID NO: 624166 - DNA, 20 bp, Artificial
  CRISPR gRNA sequence
aactgcacttacacttctga

SEQ ID NO: 624167 - DNA, 20 bp, Artificial
  CRISPR gRNA sequence
cttctaaaacacaaaatacc

SEQ ID NO: 624168 - DNA, 20 bp, Artificial
  CRISPR gRNA sequence
taattacctttggtattgtt

SEQ ID NO: 624169 - DNA, 20 bp, Artificial
  CRISPR gRNA sequence
tacctttggtattgttaaag

SEQ ID NO: 624170 - DNA, 20 bp, Artificial
  CRISPR gRNA sequence
aagacacatactgtacaaat

SEQ ID NO: 624171 - DNA, 20 bp, Artificial
  CRISPR gRNA sequence
aaatgcagtaactgccttta

SEQ ID NO: 624172 - DNA, 20 bp, Artificial
  CRISPR gRNA sequence
ctgcctttaaaagaaatgcc

SEQ ID NO: 624173 - DNA, 20 bp, Artificial
  CRISPR gRNA sequence
acagggacacaggtataaaa

SEQ ID NO: 624174 - DNA, 20 bp, Artificial
  CRISPR gRNA sequence
acactacatataaatatgta

SEQ ID NO: 624175 - DNA, 20 bp, Artificial
  CRISPR gRNA sequence
ctttttgtcattagctaaag

SEQ ID NO: 624176 - DNA, 20 bp, Artificial
  CRISPR gRNA sequence
ttagctaaaggaagaatagg

SEQ ID NO: 624177 - DNA, 20 bp, Artificial
  CRISPR gRNA sequence
taaaggaagaataggtcaga

SEQ ID NO: 624178 - DNA, 20 bp, Artificial
  CRISPR gRNA sequence
aaggggagtattgcacttgt

SEQ ID NO: 624179 - DNA, 20 bp, Artificial
  CRISPR gRNA sequence
ggagtattgcacttgtacag

SEQ ID NO: 624180 - DNA, 20 bp, Artificial
  CRISPR gRNA sequence
attgcacttgtacagaaaga

SEQ ID NO: 624181 - DNA, 20 bp, Artificial
  CRISPR gRNA sequence
aagcatttttctcccaatta

SEQ ID NO: 624182 - DNA, 20 bp, Artificial
  CRISPR gRNA sequence
ttttttggaggaaagccaaa

SEQ ID NO: 624183 - DNA, 20 bp, Artificial
  CRISPR gRNA sequence
tccaaccacttttcttttta

SEQ ID NO: 624184 - DNA, 20 bp, Artificial
  CRISPR gRNA sequence
aagattaaattaccaatgaa

SEQ ID NO: 624185 - DNA, 20 bp, Artificial
  CRISPR gRNA sequence
atgacagaagggagacggac

SEQ ID NO: 624186 - DNA, 20 bp, Artificial
  CRISPR gRNA sequence
aacagagagacctttgttac

SEQ ID NO: 624187 - DNA, 20 bp, Artificial
  CRISPR gRNA sequence
gaagggagttatgttcaaaa

SEQ ID NO: 624188 - DNA, 20 bp, Artificial
  CRISPR gRNA sequence
aaaatttttaaatcacagtt

SEQ ID NO: 624189 - DNA, 20 bp, Artificial
  CRISPR gRNA sequence
tttgaactacttaaaaaaaa

SEQ ID NO: 624190 - DNA, 20 bp, Artificial
  CRISPR gRNA sequence
ttcacaataaaaaggacatc

SEQ ID NO: 624191 - DNA, 20 bp, Artificial
  CRISPR gRNA sequence
atacacaacacatattttat

SEQ ID NO: 624192 - DNA, 20 bp, Artificial
  CRISPR gRNA sequence
atgggaggaaagccccataa

SEQ ID NO: 624193 - DNA, 20 bp, Artificial
  CRISPR gRNA sequence
agcaagataaaactaaaaag

SEQ ID NO: 624194 - DNA, 20 bp, Artificial
  CRISPR gRNA sequence
ataaaactaaaaagctagaa

SEQ ID NO: 624195 - DNA, 20 bp, Artificial
  CRISPR gRNA sequence
ctagtaatacactatgataa

SEQ ID NO: 624196 - DNA, 20 bp, Artificial
  CRISPR gRNA sequence
accatttgagattatgcttt

SEQ ID NO: 624197 - DNA, 20 bp, Artificial
  CRISPR gRNA sequence
ttcagttttgctttgttcaa

SEQ ID NO: 624198 - DNA, 20 bp, Artificial
  CRISPR gRNA sequence
aatctctattttctaacaga

SEQ ID NO: 624199 - DNA, 20 bp, Artificial
  CRISPR gRNA sequence
gcataatcttgtaatcatat

SEQ ID NO: 624200 - DNA, 20 bp, Artificial
  CRISPR gRNA sequence
ctgagctgaaaatttctcta

SEQ ID NO: 624201 - DNA, 20 bp, Artificial
  CRISPR gRNA sequence
ctgtatattttaattatttt

SEQ ID NO: 624202 - DNA, 20 bp, Artificial
  CRISPR gRNA sequence
ttaattattttgcagaaact

SEQ ID NO: 624203 - DNA, 20 bp, Artificial
  CRISPR gRNA sequence
gatttggggaattttctggt

SEQ ID NO: 624204 - DNA, 20 bp, Artificial
  CRISPR gRNA sequence
cgtctgctctttttgtaccc

SEQ ID NO: 624205 - DNA, 20 bp, Artificial
  CRISPR gRNA sequence
ttttccatgaattctcttta

SEQ ID NO: 624206 - DNA, 20 bp, Artificial
  CRISPR gRNA sequence
cctgtcttaaaaaggtccaa

SEQ ID NO: 624207 - DNA, 20 bp, Artificial
  CRISPR gRNA sequence
aaccttgcgtatttcctttt

SEQ ID NO: 624208 - DNA, 20 bp, Artificial
  CRISPR gRNA sequence
agattcccaaaaagatgaaa

SEQ ID NO: 624209 - DNA, 20 bp, Artificial
  CRISPR gRNA sequence
actgaaaaaaaaataagtag

SEQ ID NO: 624210 - DNA, 20 bp, Artificial
  CRISPR gRNA sequence
aaaattcatagataatgcca

SEQ ID NO: 624211 - DNA, 20 bp, Artificial
  CRISPR gRNA sequence
ttcactatgtaccaaggcat

SEQ ID NO: 624212 - DNA, 20 bp, Artificial
  CRISPR gRNA sequence
cagttatcagttactgccta

SEQ ID NO: 624213 - DNA, 20 bp, Artificial
  CRISPR gRNA sequence
ctctaatgtggctggactgc

SEQ ID NO: 624214 - DNA, 20 bp, Artificial
  CRISPR gRNA sequence
cacaattaaatgttttggaa

SEQ ID NO: 624215 - DNA, 20 bp, Artificial
  CRISPR gRNA sequence
caagagtagtaaatactact

SEQ ID NO: 624216 - DNA, 20 bp, Artificial
  CRISPR gRNA sequence
attgctctgaggagattttg

SEQ ID NO: 624217 - DNA, 20 bp, Artificial
  CRISPR gRNA sequence
cttgaaaaaaactagtgaaa

SEQ ID NO: 624218 - DNA, 20 bp, Artificial
  CRISPR gRNA sequence
aactagtgaaaagagaaata

SEQ ID NO: 624219 - DNA, 20 bp, Artificial
  CRISPR gRNA sequence
tgacaatcgtaagcatactt

SEQ ID NO: 624220 - DNA, 20 bp, Artificial
  CRISPR gRNA sequence
gccatcacattacaacttta

SEQ ID NO: 624221 - DNA, 20 bp, Artificial
  CRISPR gRNA sequence
tatgaaagtagaagtccctc

SEQ ID NO: 624222 - DNA, 20 bp, Artificial
  CRISPR gRNA sequence
tggaaaaacagtgcttacgt

SEQ ID NO: 624223 - DNA, 20 bp, Artificial
  CRISPR gRNA sequence
tttgaaacacattcttcttt

SEQ ID NO: 624224 - DNA, 20 bp, Artificial
  CRISPR gRNA sequence
ttaaaccaccaaagtcctac

SEQ ID NO: 624225 - DNA, 20 bp, Artificial
  CRISPR gRNA sequence
ttctgaatatcagtggcaaa

SEQ ID NO: 624226 - DNA, 20 bp, Artificial
  CRISPR gRNA sequence
tcaaagcatgatatgccttg

SEQ ID NO: 624227 - DNA, 20 bp, Artificial
  CRISPR gRNA sequence
aaataaacaagccaggtgat

SEQ ID NO: 624228 - DNA, 20 bp, Artificial
  CRISPR gRNA sequence
atgacactgcctccacaaaa

SEQ ID NO: 624229 - DNA, 20 bp, Artificial
  CRISPR gRNA sequence
tcctatttggatgatagacc

SEQ ID NO: 624230 - DNA, 20 bp, Artificial
  CRISPR gRNA sequence
catttgttctgatgccatca

SEQ ID NO: 624231 - DNA, 20 bp, Artificial
  CRISPR gRNA sequence
ctcacttgaatagagctcaa

SEQ ID NO: 624232 - DNA, 20 bp, Artificial
  CRISPR gRNA sequence
gagctcaaggagaataggag

SEQ ID NO: 624233 - DNA, 20 bp, Artificial
  CRISPR gRNA sequence
tggttgattcggccactatt

SEQ ID NO: 624234 - DNA, 20 bp, Artificial
  CRISPR gRNA sequence
ccagatattgctggttttga

SEQ ID NO: 624235 - DNA, 20 bp, Artificial
  CRISPR gRNA sequence
tggcagatactctcagattg

SEQ ID NO: 624236 - DNA, 20 bp, Artificial
  CRISPR gRNA sequence
aaaatggaaacacaaaacga

SEQ ID NO: 624237 - DNA, 20 bp, Artificial
  CRISPR gRNA sequence
gattgtaaacatagccaagt

SEQ ID NO: 624238 - DNA, 20 bp, Artificial
  CRISPR gRNA sequence
aacatgaggtggagtagctg

SEQ ID NO: 624239 - DNA, 20 bp, Artificial
  CRISPR gRNA sequence
atacttcaataaggctgaga

SEQ ID NO: 624240 - DNA, 20 bp, Artificial
  CRISPR gRNA sequence
atttagtagatgacaatgag

SEQ ID NO: 624241 - DNA, 20 bp, Artificial
  CRISPR gRNA sequence
gagagacctgggcttgagat

SEQ ID NO: 624242 - DNA, 20 bp, Artificial
  CRISPR gRNA sequence
tagaaatgagtcatcagttg

SEQ ID NO: 624243 - DNA, 20 bp, Artificial
  CRISPR gRNA sequence
atctgaagctcactcagacc

SEQ ID NO: 624244 - DNA, 20 bp, Artificial
  CRISPR gRNA sequence
gtgtagagctacaggaaatc

SEQ ID NO: 624245 - DNA, 20 bp, Artificial
  CRISPR gRNA sequence
aacttagtcaagttggaagg

SEQ ID NO: 624246 - DNA, 20 bp, Artificial
  CRISPR gRNA sequence
agctgttaaggataagtctg

SEQ ID NO: 624247 - DNA, 20 bp, Artificial
  CRISPR gRNA sequence
gagaacaatgtcataaaaac

SEQ ID NO: 624248 - DNA, 20 bp, Artificial
  CRISPR gRNA sequence
gaagctagttgtgacctcag

SEQ ID NO: 624249 - DNA, 20 bp, Artificial
  CRISPR gRNA sequence
taattttaatggagtgtggg

SEQ ID NO: 624250 - DNA, 20 bp, Artificial
  CRISPR gRNA sequence
ttgcatggacttggaaatga

SEQ ID NO: 624251 - DNA, 20 bp, Artificial
  CRISPR gRNA sequence
ctttcaacaatttcatcttt

SEQ ID NO: 624252 - DNA, 20 bp, Artificial
  CRISPR gRNA sequence
aggaagattttttttaatta

SEQ ID NO: 624253 - DNA, 20 bp, Artificial
  CRISPR gRNA sequence
ggagaggttaaaaatgtaag

SEQ ID NO: 624254 - DNA, 20 bp, Artificial
  CRISPR gRNA sequence
gtatctggggggccaggata

SEQ ID NO: 624255 - DNA, 20 bp, Artificial
  CRISPR gRNA sequence
agagggggaatgaactttaa

SEQ ID NO: 624256 - DNA, 20 bp, Artificial
  CRISPR gRNA sequence
acatggatgcatacaatcct

SEQ ID NO: 624257 - DNA, 20 bp, Artificial
  CRISPR gRNA sequence
tgatagatcagccaacaagg

SEQ ID NO: 624258 - DNA, 20 bp, Artificial
  CRISPR gRNA sequence
agccaacaaggcaagaaagg

SEQ ID NO: 624259 - DNA, 20 bp, Artificial
  CRISPR gRNA sequence
gccatggaatctaagctgaa

SEQ ID NO: 624260 - DNA, 20 bp, Artificial
  CRISPR gRNA sequence
agttcagggatcattggtct

SEQ ID NO: 624261 - DNA, 20 bp, Artificial
  CRISPR gRNA sequence
ctggagaatttgataaggtc

SEQ ID NO: 624262 - DNA, 20 bp, Artificial
  CRISPR gRNA sequence
gtttgttatatattactagg

SEQ ID NO: 624263 - DNA, 20 bp, Artificial
  CRISPR gRNA sequence
tactaggatagaatccaaat

SEQ ID NO: 624264 - DNA, 20 bp, Artificial
  CRISPR gRNA sequence
aaaaatataatataaatatt

SEQ ID NO: 624265 - DNA, 20 bp, Artificial
  CRISPR gRNA sequence
agactatataaattcagaag

SEQ ID NO: 624266 - DNA, 20 bp, Artificial
  CRISPR gRNA sequence
tatataaattcagaagacag

SEQ ID NO: 624267 - DNA, 20 bp, Artificial
  CRISPR gRNA sequence
tttcatagttacccacaaga

SEQ ID NO: 624268 - DNA, 20 bp, Artificial
  CRISPR gRNA sequence
gatgtcccacaatgctgaca

SEQ ID NO: 624269 - DNA, 20 bp, Artificial
  CRISPR gRNA sequence
acaatgctgacactagaatg

SEQ ID NO: 624270 - DNA, 20 bp, Artificial
  CRISPR gRNA sequence
ctatgacttacagcatgcat

SEQ ID NO: 624271 - DNA, 20 bp, Artificial
  CRISPR gRNA sequence
atgccaacattgggcgtatc

SEQ ID NO: 624272 - DNA, 20 bp, Artificial
  CRISPR gRNA sequence
tgctgcattatttttccaat

SEQ ID NO: 624273 - DNA, 20 bp, Artificial
  CRISPR gRNA sequence
ccaatgcagaattttgaaaa

SEQ ID NO: 624274 - DNA, 20 bp, Artificial
  CRISPR gRNA sequence
cttctgtatgactatttttt

SEQ ID NO: 624275 - DNA, 20 bp, Artificial
  CRISPR gRNA sequence
ttggtgtaagtgtggtgtac

SEQ ID NO: 624276 - DNA, 20 bp, Artificial
  CRISPR gRNA sequence
acagaatgtcagagagtaaa

SEQ ID NO: 624277 - DNA, 20 bp, Artificial
  CRISPR gRNA sequence
agagagtaaaaaagaataat

SEQ ID NO: 624278 - DNA, 20 bp, Artificial
  CRISPR gRNA sequence
tcctattaacatcaccttgc

SEQ ID NO: 624279 - DNA, 20 bp, Artificial
  CRISPR gRNA sequence
caggtctctcaaaaggcacc

SEQ ID NO: 624280 - DNA, 20 bp, Artificial
  CRISPR gRNA sequence
aggaggtactatacaaaacc

SEQ ID NO: 624281 - DNA, 20 bp, Artificial
  CRISPR gRNA sequence
gtatgcttcagtagaagcaa

SEQ ID NO: 624282 - DNA, 20 bp, Artificial
  CRISPR gRNA sequence
gcttcagtagaagcaagtag

SEQ ID NO: 624283 - DNA, 20 bp, Artificial
  CRISPR gRNA sequence
taagtaagtcaacttgtttg

SEQ ID NO: 624284 - DNA, 20 bp, Artificial
  CRISPR gRNA sequence
aaagagctcttcagcaggaa

SEQ ID NO: 624285 - DNA, 20 bp, Artificial
  CRISPR gRNA sequence
ttaaaacagttgttttttga

SEQ ID NO: 624286 - DNA, 20 bp, Artificial
  CRISPR gRNA sequence
aaacctaaagctttcatttc

SEQ ID NO: 624287 - DNA, 20 bp, Artificial
  CRISPR gRNA sequence
ttggcagacacaaaaataag

SEQ ID NO: 624288 - DNA, 20 bp, Artificial
  CRISPR gRNA sequence
accaataggttaccaatttt

SEQ ID NO: 624289 - DNA, 20 bp, Artificial
  CRISPR gRNA sequence
ttcatgatttggacatgttt

SEQ ID NO: 624290 - DNA, 20 bp, Artificial
  CRISPR gRNA sequence
aaaagagtcaacaaaaaagc

SEQ ID NO: 624291 - DNA, 20 bp, Artificial
  CRISPR gRNA sequence
aattcacgtaaggggagtca

SEQ ID NO: 624292 - DNA, 20 bp, Artificial
  CRISPR gRNA sequence
tacaagcacttactacatta

SEQ ID NO: 624293 - DNA, 20 bp, Artificial
  CRISPR gRNA sequence
tcagaccaagatccaaaatg

SEQ ID NO: 624294 - DNA, 20 bp, Artificial
  CRISPR gRNA sequence
tccaaaatgaaagaatttgg

SEQ ID NO: 624295 - DNA, 20 bp, Artificial
  CRISPR gRNA sequence
taataattaatttaattcat

SEQ ID NO: 624296 - DNA, 20 bp, Artificial
  CRISPR gRNA sequence
tcttcactgtacagatgaga

SEQ ID NO: 624297 - DNA, 20 bp, Artificial
  CRISPR gRNA sequence
agggtttacatctagttagt

SEQ ID NO: 624298 - DNA, 20 bp, Artificial
  CRISPR gRNA sequence
atatttctgtgtatacattg

SEQ ID NO: 624299 - DNA, 20 bp, Artificial
  CRISPR gRNA sequence
gcctatttcatggagacata

SEQ ID NO: 624300 - DNA, 20 bp, Artificial
  CRISPR gRNA sequence
tcactgaatgatgtcaccca

SEQ ID NO: 624301 - DNA, 20 bp, Artificial
  CRISPR gRNA sequence
ggtccatttatttttatacc

SEQ ID NO: 624302 - DNA, 20 bp, Artificial
  CRISPR gRNA sequence
aacacagggaaaaacatgtt

SEQ ID NO: 624303 - DNA, 20 bp, Artificial
  CRISPR gRNA sequence
agggaaaaacatgttttaga

SEQ ID NO: 624304 - DNA, 20 bp, Artificial
  CRISPR gRNA sequence
aaattattgttataacaaac

SEQ ID NO: 624305 - DNA, 20 bp, Artificial
  CRISPR gRNA sequence
ttaaaatgatatccagtatt

SEQ ID NO: 624306 - DNA, 20 bp, Artificial
  CRISPR gRNA sequence
tttaggagtatgtatgcaat

SEQ ID NO: 624307 - DNA, 20 bp, Artificial
  CRISPR gRNA sequence
caaatgtcagaactgcaatg

SEQ ID NO: 624308 - DNA, 20 bp, Artificial
  CRISPR gRNA sequence
ctgcaatgggagaatataat

SEQ ID NO: 624309 - DNA, 20 bp, Artificial
  CRISPR gRNA sequence
atggacttgatcacaaatca

SEQ ID NO: 624310 - DNA, 20 bp, Artificial
  CRISPR gRNA sequence
agaattagattctttagatt

SEQ ID NO: 624311 - DNA, 20 bp, Artificial
  CRISPR gRNA sequence
gcttcagttgttcaggataa

SEQ ID NO: 624312 - DNA, 20 bp, Artificial
  CRISPR gRNA sequence
gtatatactctataaaacaa

SEQ ID NO: 624313 - DNA, 20 bp, Artificial
  CRISPR gRNA sequence
tataaaacaaacagaaaacc

SEQ ID NO: 624314 - DNA, 20 bp, Artificial
  CRISPR gRNA sequence
ttacttggcaggctgaagca

SEQ ID NO: 624315 - DNA, 20 bp, Artificial
  CRISPR gRNA sequence
aaaattaacttttcaggaac

SEQ ID NO: 624316 - DNA, 20 bp, Artificial
  CRISPR gRNA sequence
gagatcaggatgttttgctt

SEQ ID NO: 624317 - DNA, 20 bp, Artificial
  CRISPR gRNA sequence
tctagattgttttgcacatt

SEQ ID NO: 624318 - DNA, 20 bp, Artificial
  CRISPR gRNA sequence
taaaaattaaagggccgatt

SEQ ID NO: 624319 - DNA, 20 bp, Artificial
  CRISPR gRNA sequence
aatcagctctaactatctgg

SEQ ID NO: 624320 - DNA, 20 bp, Artificial
  CRISPR gRNA sequence
ttatgctaattcaaacatta

SEQ ID NO: 624321 - DNA, 20 bp, Artificial
  CRISPR gRNA sequence
cctttacattccaattttgg

SEQ ID NO: 624322 - DNA, 20 bp, Artificial
  CRISPR gRNA sequence
ttttcttttcgggtaagggc

SEQ ID NO: 624323 - DNA, 20 bp, Artificial
  CRISPR gRNA sequence
taagggcagagaattttaca

SEQ ID NO: 624324 - DNA, 20 bp, Artificial
  CRISPR gRNA sequence
attaaaaagaactcaagtgg

SEQ ID NO: 624325 - DNA, 20 bp, Artificial
  CRISPR gRNA sequence
ctcatcagcttttataatac

SEQ ID NO: 624326 - DNA, 20 bp, Artificial
  CRISPR gRNA sequence
aaaaaaccttaaaaaacaaa

SEQ ID NO: 624327 - DNA, 20 bp, Artificial
  CRISPR gRNA sequence
ggaattatttagttttgctc

SEQ ID NO: 624328 - DNA, 20 bp, Artificial
  CRISPR gRNA sequence
agtttcactgtactgatgaa

SEQ ID NO: 624329 - DNA, 20 bp, Artificial
  CRISPR gRNA sequence
atggatttctgggaagtagc

SEQ ID NO: 624330 - DNA, 20 bp, Artificial
  CRISPR gRNA sequence
ggttcttctgtaatatttct

SEQ ID NO: 624331 - DNA, 20 bp, Artificial
  CRISPR gRNA sequence
gtgggcagttgcatggagca

SEQ ID NO: 624332 - DNA, 20 bp, Artificial
  CRISPR gRNA sequence
gaacatttcaggtgacaact

SEQ ID NO: 624333 - DNA, 20 bp, Artificial
  CRISPR gRNA sequence
atgaaacatccacatcaggt

SEQ ID NO: 624334 - DNA, 20 bp, Artificial
  CRISPR gRNA sequence
atgttagatcttgacctttt

SEQ ID NO: 624335 - DNA, 20 bp, Artificial
  CRISPR gRNA sequence
tttagcagggtgctttgctc

SEQ ID NO: 624336 - DNA, 20 bp, Artificial
  CRISPR gRNA sequence
aaaatccataattatatcat

SEQ ID NO: 624337 - DNA, 20 bp, Artificial
  CRISPR gRNA sequence
aatcatttctgattaatagt

SEQ ID NO: 624338 - DNA, 20 bp, Artificial
  CRISPR gRNA sequence
aatggaaatttccagtagtc

SEQ ID NO: 624339 - DNA, 20 bp, Artificial
  CRISPR gRNA sequence
tgttttcctcttcgttgggt

SEQ ID NO: 624340 - DNA, 20 bp, Artificial
  CRISPR gRNA sequence
gatgtttgtcccttacctct

SEQ ID NO: 624341 - DNA, 20 bp, Artificial
  CRISPR gRNA sequence
tatatactagttcacatatt

SEQ ID NO: 624342 - DNA, 20 bp, Artificial
  CRISPR gRNA sequence
cagttgttctagacccattt

SEQ ID NO: 624343 - DNA, 20 bp, Artificial
  CRISPR gRNA sequence
aactgacagactcgatttca

SEQ ID NO: 624344 - DNA, 20 bp, Artificial
  CRISPR gRNA sequence
caactgttcattcctagcat

SEQ ID NO: 624345 - DNA, 20 bp, Artificial
  CRISPR gRNA sequence
tgatttaatctcagtatgtc

SEQ ID NO: 624346 - DNA, 20 bp, Artificial
  CRISPR gRNA sequence
gttcttttctactcagttgc

SEQ ID NO: 624347 - DNA, 20 bp, Artificial
  CRISPR gRNA sequence
gacttttgcatctgcatcat

SEQ ID NO: 624348 - DNA, 20 bp, Artificial
  CRISPR gRNA sequence
acattttccttaaatatttg

SEQ ID NO: 624349 - DNA, 20 bp, Artificial
  CRISPR gRNA sequence
acactacagtcacaatgaac

SEQ ID NO: 624350 - DNA, 20 bp, Artificial
  CRISPR gRNA sequence
tgtctttctgaataaattga

SEQ ID NO: 624351 - DNA, 20 bp, Artificial
  CRISPR gRNA sequence
tctgcctgatatggaatttt

SEQ ID NO: 624352 - DNA, 20 bp, Artificial
  CRISPR gRNA sequence
aatgaaatgattaagtggga

SEQ ID NO: 624353 - DNA, 20 bp, Artificial
  CRISPR gRNA sequence
ttaagtgggaaaagaatatt

SEQ ID NO: 624354 - DNA, 20 bp, Artificial
  CRISPR gRNA sequence
aaaagtgagatatctttcaa

SEQ ID NO: 624355 - DNA, 20 bp, Artificial
  CRISPR gRNA sequence
atcacagacatttgaaagca

SEQ ID NO: 624356 - DNA, 20 bp, Artificial
  CRISPR gRNA sequence
ttattgttttgggcactctg

SEQ ID NO: 624357 - DNA, 20 bp, Artificial
  CRISPR gRNA sequence
aaaaatagtcacaattcaaa

SEQ ID NO: 624358 - DNA, 20 bp, Artificial
  CRISPR gRNA sequence
tgaatttaggaaaaagagct

SEQ ID NO: 624359 - DNA, 20 bp, Artificial
  CRISPR gRNA sequence
ttatggggaataaaaagtaa

SEQ ID NO: 624360 - DNA, 20 bp, Artificial
  CRISPR gRNA sequence
aaagtaaacagaaaggctag

SEQ ID NO: 624361 - DNA, 20 bp, Artificial
  CRISPR gRNA sequence
gagttccaccccatcacaat

SEQ ID NO: 624362 - DNA, 20 bp, Artificial
  CRISPR gRNA sequence
cataatctattaagtgtgca

SEQ ID NO: 624363 - DNA, 20 bp, Artificial
  CRISPR gRNA sequence
ttgatacgattttacccaga

SEQ ID NO: 624364 - DNA, 20 bp, Artificial
  CRISPR gRNA sequence
tacactagaagattcgatct

SEQ ID NO: 624365 - DNA, 20 bp, Artificial
  CRISPR gRNA sequence
acaaatgttctcaatgacat

SEQ ID NO: 624366 - DNA, 20 bp, Artificial
  CRISPR gRNA sequence
ttactttgcccacatccatc

SEQ ID NO: 624367 - DNA, 20 bp, Artificial
  CRISPR gRNA sequence
ttaacccttgagcgtgggct

SEQ ID NO: 624368 - DNA, 20 bp, Artificial
  CRISPR gRNA sequence
tagcataattcttaaggacc

SEQ ID NO: 624369 - DNA, 20 bp, Artificial
  CRISPR gRNA sequence
ttcctcacatctcgtggcct

SEQ ID NO: 624370 - DNA, 20 bp, Artificial
  CRISPR gRNA sequence
caggattaggctttgattta

SEQ ID NO: 624371 - DNA, 20 bp, Artificial
  CRISPR gRNA sequence
ttctagcttttgatttaaag

SEQ ID NO: 624372 - DNA, 20 bp, Artificial
  CRISPR gRNA sequence
caggtgagggacagagggac

SEQ ID NO: 624373 - DNA, 20 bp, Artificial
  CRISPR gRNA sequence
taaaacagttataataataa

SEQ ID NO: 624374 - DNA, 20 bp, Artificial
  CRISPR gRNA sequence
tgagcaaatgtgaaatattg

SEQ ID NO: 624375 - DNA, 20 bp, Artificial
  CRISPR gRNA sequence
aacttatggaatattcatat

SEQ ID NO: 624376 - DNA, 20 bp, Artificial
  CRISPR gRNA sequence
aagaatatgtatttgtatat

SEQ ID NO: 624377 - DNA, 20 bp, Artificial
  CRISPR gRNA sequence
attagttcaaaaacagtagg

SEQ ID NO: 624378 - DNA, 20 bp, Artificial
  CRISPR gRNA sequence
caaaaacagtaggaaagaat

SEQ ID NO: 624379 - DNA, 20 bp, Artificial
  CRISPR gRNA sequence
taacattctggttgctatct

SEQ ID NO: 624380 - DNA, 20 bp, Artificial
  CRISPR gRNA sequence
ttgccaaaccatggaaaata

SEQ ID NO: 624381 - DNA, 20 bp, Artificial
  CRISPR gRNA sequence
taaaacctttctagttaata

SEQ ID NO: 624382 - DNA, 20 bp, Artificial
  CRISPR gRNA sequence
agatcaagtaggaaaaattg

SEQ ID NO: 624383 - DNA, 20 bp, Artificial
  CRISPR gRNA sequence
aagaaatggtaaaggttagg

SEQ ID NO: 624384 - DNA, 20 bp, Artificial
  CRISPR gRNA sequence
gtgtagattattcagaacaa

SEQ ID NO: 624385 - DNA, 20 bp, Artificial
  CRISPR gRNA sequence
cagaacaatgagaaagcagc

SEQ ID NO: 624386 - DNA, 20 bp, Artificial
  CRISPR gRNA sequence
accaaagtgaaaagagctgc

SEQ ID NO: 624387 - DNA, 20 bp, Artificial
  CRISPR gRNA sequence
aagagctgcatagaattata

SEQ ID NO: 624388 - DNA, 20 bp, Artificial
  CRISPR gRNA sequence
gaaaggcttattaattcctt

SEQ ID NO: 624389 - DNA, 20 bp, Artificial
  CRISPR gRNA sequence
aaaagttttactttctttta

SEQ ID NO: 624390 - DNA, 20 bp, Artificial
  CRISPR gRNA sequence
caagtgtgtgttttaagagt

SEQ ID NO: 624391 - DNA, 20 bp, Artificial
  CRISPR gRNA sequence
aggcaccaaaggcatcagta

SEQ ID NO: 624392 - DNA, 20 bp, Artificial
  CRISPR gRNA sequence
gttcacacttgggagatcac

SEQ ID NO: 624393 - DNA, 20 bp, Artificial
  CRISPR gRNA sequence
tctggccaagtacctaattt

SEQ ID NO: 624394 - DNA, 20 bp, Artificial
  CRISPR gRNA sequence
tggatgaaggattgagggaa

SEQ ID NO: 624395 - DNA, 20 bp, Artificial
  CRISPR gRNA sequence
gattgagggaaaaagaatta

SEQ ID NO: 624396 - DNA, 20 bp, Artificial
  CRISPR gRNA sequence
aaaaagaattataagaaaga

SEQ ID NO: 624397 - DNA, 20 bp, Artificial
  CRISPR gRNA sequence
gataatttaaataaaacaaa

SEQ ID NO: 624398 - DNA, 20 bp, Artificial
  CRISPR gRNA sequence
atgacaaatgctacagtaca

SEQ ID NO: 624399 - DNA, 20 bp, Artificial
  CRISPR gRNA sequence
cactgatcagttgtcaattt

SEQ ID NO: 624400 - DNA, 20 bp, Artificial
  CRISPR gRNA sequence
taattttttttttttatttt

SEQ ID NO: 624401 - DNA, 20 bp, Artificial
  CRISPR gRNA sequence
gtccagttcctttttatgga

SEQ ID NO: 624402 - DNA, 20 bp, Artificial
  CRISPR gRNA sequence
gaagtaagatagatacatgt

SEQ ID NO: 624403 - DNA, 20 bp, Artificial
  CRISPR gRNA sequence
attgaaagctgaggttttac

SEQ ID NO: 624404 - DNA, 20 bp, Artificial
  CRISPR gRNA sequence
aatgaggatgaacaaaaata

SEQ ID NO: 624405 - DNA, 20 bp, Artificial
  CRISPR gRNA sequence
aaaattgaatttttcatctg

SEQ ID NO: 624406 - DNA, 20 bp, Artificial
  CRISPR gRNA sequence
tttctctttataatttataa

SEQ ID NO: 624407 - DNA, 20 bp, Artificial
  CRISPR gRNA sequence
aaatatacctgaaatgctaa

SEQ ID NO: 624408 - DNA, 20 bp, Artificial
  CRISPR gRNA sequence
acatgtaattctatttcctc

SEQ ID NO: 624409 - DNA, 20 bp, Artificial
  CRISPR gRNA sequence
ctcagagtattaggtataat

SEQ ID NO: 624410 - DNA, 20 bp, Artificial
  CRISPR gRNA sequence
aaatatagtaatcaaattta

SEQ ID NO: 624411 - DNA, 20 bp, Artificial
  CRISPR gRNA sequence
ccacagagtgagaccctgtc

SEQ ID NO: 624412 - DNA, 20 bp, Artificial
  CRISPR gRNA sequence
gataattttttgtattttta

SEQ ID NO: 624413 - DNA, 20 bp, Artificial
  CRISPR gRNA sequence
acacggtttcaccatgttaa

SEQ ID NO: 624414 - DNA, 20 bp, Artificial
  CRISPR gRNA sequence
ggatatcagacattagtaga

SEQ ID NO: 624415 - DNA, 20 bp, Artificial
  CRISPR gRNA sequence
gactgattagcaaaatccag

SEQ ID NO: 624416 - DNA, 20 bp, Artificial
  CRISPR gRNA sequence
ttcagtagagttaaagcttt

SEQ ID NO: 624417 - DNA, 20 bp, Artificial
  CRISPR gRNA sequence
ttccaacgaaataattacaa

SEQ ID NO: 624418 - DNA, 20 bp, Artificial
  CRISPR gRNA sequence
tgttatgggtatggtttaga

SEQ ID NO: 624419 - DNA, 20 bp, Artificial
  CRISPR gRNA sequence
aacaaccaaatttctcactg

SEQ ID NO: 624420 - DNA, 20 bp, Artificial
  CRISPR gRNA sequence
agataaaaaggttttttatt

SEQ ID NO: 624421 - DNA, 20 bp, Artificial
  CRISPR gRNA sequence
tctactgtctagggaaagct

SEQ ID NO: 624422 - DNA, 20 bp, Artificial
  CRISPR gRNA sequence
aggacaagaagagttcctaa

SEQ ID NO: 624423 - DNA, 20 bp, Artificial
  CRISPR gRNA sequence
ctactaaatgaaaatcaaga

SEQ ID NO: 624424 - DNA, 20 bp, Artificial
  CRISPR gRNA sequence
ttaagtctacaatataggaa

SEQ ID NO: 624425 - DNA, 20 bp, Artificial
  CRISPR gRNA sequence
caggtggtgggggaatgatt

SEQ ID NO: 624426 - DNA, 20 bp, Artificial
  CRISPR gRNA sequence
cacaatagggtgcgtgccta

SEQ ID NO: 624427 - DNA, 20 bp, Artificial
  CRISPR gRNA sequence
ctgataaagagttactgata

SEQ ID NO: 624428 - DNA, 20 bp, Artificial
  CRISPR gRNA sequence
gagtgcctggaatactcaag

SEQ ID NO: 624429 - DNA, 20 bp, Artificial
  CRISPR gRNA sequence
gtcagaatacaggcaaaata

SEQ ID NO: 624430 - DNA, 20 bp, Artificial
  CRISPR gRNA sequence
aataaggctgaagaccaact

SEQ ID NO: 624431 - DNA, 20 bp, Artificial
  CRISPR gRNA sequence
agaatctgatttgaagggtt

SEQ ID NO: 624432 - DNA, 20 bp, Artificial
  CRISPR gRNA sequence
ttttggtagtggggcaatga

SEQ ID NO: 624433 - DNA, 20 bp, Artificial
  CRISPR gRNA sequence
tggggcaatgatgagaaagc

SEQ ID NO: 624434 - DNA, 20 bp, Artificial
  CRISPR gRNA sequence
ataaaactgtagtaaaaaaa

SEQ ID NO: 624435 - DNA, 20 bp, Artificial
  CRISPR gRNA sequence
tctcccaagacagcaaacta

SEQ ID NO: 624436 - DNA, 20 bp, Artificial
  CRISPR gRNA sequence
aacagacagtagtgaaacca

SEQ ID NO: 624437 - DNA, 20 bp, Artificial
  CRISPR gRNA sequence
tctttgtcataacatagtct

SEQ ID NO: 624438 - DNA, 20 bp, Artificial
  CRISPR gRNA sequence
ctcagtaagagatatatgct

SEQ ID NO: 624439 - DNA, 20 bp, Artificial
  CRISPR gRNA sequence
atagaataggagataaactc

SEQ ID NO: 624440 - DNA, 20 bp, Artificial
  CRISPR gRNA sequence
aatagatcctccattgtaag

SEQ ID NO: 624441 - DNA, 20 bp, Artificial
  CRISPR gRNA sequence
attttgagagcagcctgggg

SEQ ID NO: 624442 - DNA, 20 bp, Artificial
  CRISPR gRNA sequence
agtgtggatctggtttgtaa

SEQ ID NO: 624443 - DNA, 20 bp, Artificial
  CRISPR gRNA sequence
agtggctatcccaccagcag

SEQ ID NO: 624444 - DNA, 20 bp, Artificial
  CRISPR gRNA sequence
acaaaattggacgactggtg

SEQ ID NO: 624445 - DNA, 20 bp, Artificial
  CRISPR gRNA sequence
gagttatgaggatatatcct

SEQ ID NO: 624446 - DNA, 20 bp, Artificial
  CRISPR gRNA sequence
gtgacaatgggagtagggac

SEQ ID NO: 624447 - DNA, 20 bp, Artificial
  CRISPR gRNA sequence
ctctttccaacatggaagag

SEQ ID NO: 624448 - DNA, 20 bp, Artificial
  CRISPR gRNA sequence
ctccctcaaatatggattta

SEQ ID NO: 624449 - DNA, 20 bp, Artificial
  CRISPR gRNA sequence
aatacaattagcgcaaatct

SEQ ID NO: 624450 - DNA, 20 bp, Artificial
  CRISPR gRNA sequence
cataccccatgtatcaccac

SEQ ID NO: 624451 - DNA, 20 bp, Artificial
  CRISPR gRNA sequence
ggagatctcagttcccaaaa

SEQ ID NO: 624452 - DNA, 20 bp, Artificial
  CRISPR gRNA sequence
ggtcctgttgtattggaagc

SEQ ID NO: 624453 - DNA, 20 bp, Artificial
  CRISPR gRNA sequence
cttataatttttccagacta

SEQ ID NO: 624454 - DNA, 20 bp, Artificial
  CRISPR gRNA sequence
ggatttactggggcatctct

SEQ ID NO: 624455 - DNA, 20 bp, Artificial
  CRISPR gRNA sequence
attgaaaaattatagtaata

SEQ ID NO: 624456 - DNA, 20 bp, Artificial
  CRISPR gRNA sequence
ttttatgttctatctattat

SEQ ID NO: 624457 - DNA, 20 bp, Artificial
  CRISPR gRNA sequence
tttcaataaagaacttttca

SEQ ID NO: 624458 - DNA, 20 bp, Artificial
  CRISPR gRNA sequence
attcctttaactcagggagg

SEQ ID NO: 624459 - DNA, 20 bp, Artificial
  CRISPR gRNA sequence
ttagtatgtcattatgaaca

SEQ ID NO: 624460 - DNA, 20 bp, Artificial
  CRISPR gRNA sequence
ttatttttttcttttattcc

SEQ ID NO: 624461 - DNA, 20 bp, Artificial
  CRISPR gRNA sequence
agatacaaggagagttaaaa

SEQ ID NO: 624462 - DNA, 20 bp, Artificial
  CRISPR gRNA sequence
tgagtatattttcaagttta

SEQ ID NO: 624463 - DNA, 20 bp, Artificial
  CRISPR gRNA sequence
aattgtaaaattttaaaatt

SEQ ID NO: 624464 - DNA, 20 bp, Artificial
  CRISPR gRNA sequence
caaggagttggtgacactta

SEQ ID NO: 624465 - DNA, 20 bp, Artificial
  CRISPR gRNA sequence
cttcttctacaggcgtagct

SEQ ID NO: 624466 - DNA, 20 bp, Artificial
  CRISPR gRNA sequence
gcgttcacctgcagtaagga

SEQ ID NO: 624467 - DNA, 20 bp, Artificial
  CRISPR gRNA sequence
tcttttaaacatttatctgc

SEQ ID NO: 624468 - DNA, 20 bp, Artificial
  CRISPR gRNA sequence
aaagtcctatcattgactca

SEQ ID NO: 624469 - DNA, 20 bp, Artificial
  CRISPR gRNA sequence
cacacaattggatgctttcc

SEQ ID NO: 624470 - DNA, 20 bp, Artificial
  CRISPR gRNA sequence
tttaattttaattaacaaat

SEQ ID NO: 624471 - DNA, 20 bp, Artificial
  CRISPR gRNA sequence
aactattttgttacacagag

SEQ ID NO: 624472 - DNA, 20 bp, Artificial
  CRISPR gRNA sequence
gagctagaaagtagtcaagg

SEQ ID NO: 624473 - DNA, 20 bp, Artificial
  CRISPR gRNA sequence
atgctatctctttaaaattg

SEQ ID NO: 624474 - DNA, 20 bp, Artificial
  CRISPR gRNA sequence
tgatagccttatcaaaccat

SEQ ID NO: 624475 - DNA, 20 bp, Artificial
  CRISPR gRNA sequence
atcatactaaagctctaagt

SEQ ID NO: 624476 - DNA, 20 bp, Artificial
  CRISPR gRNA sequence
aactcaatgattcttttatt

SEQ ID NO: 624477 - DNA, 20 bp, Artificial
  CRISPR gRNA sequence
tgggggttaaggttttttct

SEQ ID NO: 624478 - DNA, 20 bp, Artificial
  CRISPR gRNA sequence
caggctgcaactttttaaat

SEQ ID NO: 624479 - DNA, 20 bp, Artificial
  CRISPR gRNA sequence
ctttcacaaattaaattttt

SEQ ID NO: 624480 - DNA, 20 bp, Artificial
  CRISPR gRNA sequence
tgaaacaatatcttttttaa

SEQ ID NO: 624481 - DNA, 20 bp, Artificial
  CRISPR gRNA sequence
atatcttcaaatctttttaa

SEQ ID NO: 624482 - DNA, 20 bp, Artificial
  CRISPR gRNA sequence
tatgatcatccccaaatggc

SEQ ID NO: 624483 - DNA, 20 bp, Artificial
  CRISPR gRNA sequence
ttttcttcctttttttggta

SEQ ID NO: 624484 - DNA, 20 bp, Artificial
  CRISPR gRNA sequence
aaccctcaaagacaatactg

SEQ ID NO: 624485 - DNA, 20 bp, Artificial
  CRISPR gRNA sequence
tatttcctggcctaggcatt

SEQ ID NO: 624486 - DNA, 20 bp, Artificial
  CRISPR gRNA sequence
atgtatatcaaagcaaattt

SEQ ID NO: 624487 - DNA, 20 bp, Artificial
  CRISPR gRNA sequence
gtggaacaacctacaaatat

SEQ ID NO: 624488 - DNA, 20 bp, Artificial
  CRISPR gRNA sequence
gtactttagtagagtatgac

SEQ ID NO: 624489 - DNA, 20 bp, Artificial
  CRISPR gRNA sequence
accctgtctctactaaaaat

SEQ ID NO: 624490 - DNA, 20 bp, Artificial
  CRISPR gRNA sequence
agactagttcatggtattaa

SEQ ID NO: 624491 - DNA, 20 bp, Artificial
  CRISPR gRNA sequence
ttctcaatctagtttaaatt

SEQ ID NO: 624492 - DNA, 20 bp, Artificial
  CRISPR gRNA sequence
cagatgtataaactggatca

SEQ ID NO: 624493 - DNA, 20 bp, Artificial
  CRISPR gRNA sequence
ccgtaaatggctattaactt

SEQ ID NO: 624494 - DNA, 20 bp, Artificial
  CRISPR gRNA sequence
tttaagaaaaatctagatct

SEQ ID NO: 624495 - DNA, 20 bp, Artificial
  CRISPR gRNA sequence
acttgtttttagaactgtcg

SEQ ID NO: 624496 - DNA, 20 bp, Artificial
  CRISPR gRNA sequence
ttctaagacacttaaaaatt

SEQ ID NO: 624497 - DNA, 20 bp, Artificial
  CRISPR gRNA sequence
gaacaaaaccagtatgggca

SEQ ID NO: 624498 - DNA, 20 bp, Artificial
  CRISPR gRNA sequence
gcacgtaattgttaaactat

SEQ ID NO: 624499 - DNA, 20 bp, Artificial
  CRISPR gRNA sequence
aaaagtatattttaaaactc

SEQ ID NO: 624500 - DNA, 20 bp, Artificial
  CRISPR gRNA sequence
atctcatttctgttgctttt

SEQ ID NO: 624501 - DNA, 20 bp, Artificial
  CRISPR gRNA sequence
ggctttttcctcactctatc

SEQ ID NO: 624502 - DNA, 20 bp, Artificial
  CRISPR gRNA sequence
aggagttataaccaacaatt

SEQ ID NO: 624503 - DNA, 20 bp, Artificial
  CRISPR gRNA sequence
gtaggataggcagagatcaa

SEQ ID NO: 624504 - DNA, 20 bp, Artificial
  CRISPR gRNA sequence
atgggtatggtaaaatatgt

SEQ ID NO: 624505 - DNA, 20 bp, Artificial
  CRISPR gRNA sequence
ttttctgcaatccaatacta

SEQ ID NO: 624506 - DNA, 20 bp, Artificial
  CRISPR gRNA sequence
cacccctgaataaaaaggaa

SEQ ID NO: 624507 - DNA, 20 bp, Artificial
  CRISPR gRNA sequence
aatttgctgtaatttgaaaa

SEQ ID NO: 624508 - DNA, 20 bp, Artificial
  CRISPR gRNA sequence
ggatgaaaatgatatataaa

SEQ ID NO: 624509 - DNA, 20 bp, Artificial
  CRISPR gRNA sequence
ctcaggaaaactctaggtaa

SEQ ID NO: 624510 - DNA, 20 bp, Artificial
  CRISPR gRNA sequence
aggactgagataggattatg

SEQ ID NO: 624511 - DNA, 20 bp, Artificial
  CRISPR gRNA sequence
acctgcttctgaacagggca

SEQ ID NO: 624512 - DNA, 20 bp, Artificial
  CRISPR gRNA sequence
atgtacacacttgccactgt

SEQ ID NO: 624513 - DNA, 20 bp, Artificial
  CRISPR gRNA sequence
tgctgtttttggatcatccc

SEQ ID NO: 624514 - DNA, 20 bp, Artificial
  CRISPR gRNA sequence
tgacagagtcttttcataaa

SEQ ID NO: 624515 - DNA, 20 bp, Artificial
  CRISPR gRNA sequence
tcagttttttatccagtaat

SEQ ID NO: 624516 - DNA, 20 bp, Artificial
  CRISPR gRNA sequence
ttcattgccgttgttttctt

SEQ ID NO: 624517 - DNA, 20 bp, Artificial
  CRISPR gRNA sequence
actatcaaaatggctctgtg

SEQ ID NO: 624518 - DNA, 20 bp, Artificial
  CRISPR gRNA sequence
ctttatattgccagcatgct

SEQ ID NO: 624519 - DNA, 20 bp, Artificial
  CRISPR gRNA sequence
aaagaacccataaacatggc

SEQ ID NO: 624520 - DNA, 20 bp, Artificial
  CRISPR gRNA sequence
aaagaaaaaacaaaaaacat

SEQ ID NO: 624521 - DNA, 20 bp, Artificial
  CRISPR gRNA sequence
gaaacgttctttattttttc

SEQ ID NO: 624522 - DNA, 20 bp, Artificial
  CRISPR gRNA sequence
ttgccatttaaaattaaaat

SEQ ID NO: 624523 - DNA, 20 bp, Artificial
  CRISPR gRNA sequence
catttaaaattaaaattaag

SEQ ID NO: 624524 - DNA, 20 bp, Artificial
  CRISPR gRNA sequence
cttagtgtgcataaagtgta

SEQ ID NO: 624525 - DNA, 20 bp, Artificial
  CRISPR gRNA sequence
cagaattccatttcaggaat

SEQ ID NO: 624526 - DNA, 20 bp, Artificial
  CRISPR gRNA sequence
cttttaaatttcaaaatagc

SEQ ID NO: 624527 - DNA, 20 bp, Artificial
  CRISPR gRNA sequence
tcaaaatagctcagaattat

SEQ ID NO: 624528 - DNA, 20 bp, Artificial
  CRISPR gRNA sequence
gttagaactttttatctata

SEQ ID NO: 624529 - DNA, 20 bp, Artificial
  CRISPR gRNA sequence
agaatatactacaaataaat

SEQ ID NO: 624530 - DNA, 20 bp, Artificial
  CRISPR gRNA sequence
tttgctaaaaccgaaataga

SEQ ID NO: 624531 - DNA, 20 bp, Artificial
  CRISPR gRNA sequence
aatactataaagaagtatgt

SEQ ID NO: 624532 - DNA, 20 bp, Artificial
  CRISPR gRNA sequence
actacaattaggttgaaatt

SEQ ID NO: 624533 - DNA, 20 bp, Artificial
  CRISPR gRNA sequence
ctttgaatcttaactattac

SEQ ID NO: 624534 - DNA, 20 bp, Artificial
  CRISPR gRNA sequence
tagaaaagttttctccactc

SEQ ID NO: 624535 - DNA, 20 bp, Artificial
  CRISPR gRNA sequence
ttgtttctctgatatgaaat

SEQ ID NO: 624536 - DNA, 20 bp, Artificial
  CRISPR gRNA sequence
gcaataatggtttaatttaa

SEQ ID NO: 624537 - DNA, 20 bp, Artificial
  CRISPR gRNA sequence
tcaggtttgtgaacacaagg

SEQ ID NO: 624538 - DNA, 20 bp, Artificial
  CRISPR gRNA sequence
cacaaggaaagaataagtta

SEQ ID NO: 624539 - DNA, 20 bp, Artificial
  CRISPR gRNA sequence
actgttatggtcaagtttat

SEQ ID NO: 624540 - DNA, 20 bp, Artificial
  CRISPR gRNA sequence
caaaatactatttataaaca

SEQ ID NO: 624541 - DNA, 20 bp, Artificial
  CRISPR gRNA sequence
tagatcattgtgaaaaaaaa

SEQ ID NO: 624542 - DNA, 20 bp, Artificial
  CRISPR gRNA sequence
aaactcaaattttactcaca

SEQ ID NO: 624543 - DNA, 20 bp, Artificial
  CRISPR gRNA sequence
gccataaaagagttcatgag

SEQ ID NO: 624544 - DNA, 20 bp, Artificial
  CRISPR gRNA sequence
ttctcaatttttaaaatttt

SEQ ID NO: 624545 - DNA, 20 bp, Artificial
  CRISPR gRNA sequence
aataaattctaccctcatca

SEQ ID NO: 624546 - DNA, 20 bp, Artificial
  CRISPR gRNA sequence
ctctcacgtaaactttctaa

SEQ ID NO: 624547 - DNA, 20 bp, Artificial
  CRISPR gRNA sequence
tgtaaagcccaattatttac

SEQ ID NO: 624548 - DNA, 20 bp, Artificial
  CRISPR gRNA sequence
agtttcttcacaacatcctt

SEQ ID NO: 624549 - DNA, 20 bp, Artificial
  CRISPR gRNA sequence
aagttaccctgcacctgaag

SEQ ID NO: 624550 - DNA, 20 bp, Artificial
  CRISPR gRNA sequence
atctctggtagactacagat

SEQ ID NO: 624551 - DNA, 20 bp, Artificial
  CRISPR gRNA sequence
taatagtaatgataataata

SEQ ID NO: 624552 - DNA, 20 bp, Artificial
  CRISPR gRNA sequence
gacatattcttttttgatac

SEQ ID NO: 624553 - DNA, 20 bp, Artificial
  CRISPR gRNA sequence
tccaccagttgaagaggata

SEQ ID NO: 624554 - DNA, 20 bp, Artificial
  CRISPR gRNA sequence
taagtcccgaatggtcagat

SEQ ID NO: 624555 - DNA, 20 bp, Artificial
  CRISPR gRNA sequence
atgcagtacacctagttgct

SEQ ID NO: 624556 - DNA, 20 bp, Artificial
  CRISPR gRNA sequence
cacacctgtgagttggtaat

SEQ ID NO: 624557 - DNA, 20 bp, Artificial
  CRISPR gRNA sequence
tttggcggacaactagttca

SEQ ID NO: 624558 - DNA, 20 bp, Artificial
  CRISPR gRNA sequence
tcatgagaattatacaatgc

SEQ ID NO: 624559 - DNA, 20 bp, Artificial
  CRISPR gRNA sequence
agaaaataaacctactttaa

SEQ ID NO: 624560 - DNA, 20 bp, Artificial
  CRISPR gRNA sequence
acctctcacctggaacaata

SEQ ID NO: 624561 - DNA, 20 bp, Artificial
  CRISPR gRNA sequence
aaaggtattggtatggaatt

SEQ ID NO: 624562 - DNA, 20 bp, Artificial
  CRISPR gRNA sequence
aaaccactgtcctcagtttt

SEQ ID NO: 624563 - DNA, 20 bp, Artificial
  CRISPR gRNA sequence
aaagaaccattaatgacagg

SEQ ID NO: 624564 - DNA, 20 bp, Artificial
  CRISPR gRNA sequence
gcaaagtagctagtaatagt

SEQ ID NO: 624565 - DNA, 20 bp, Artificial
  CRISPR gRNA sequence
aaaacagatgtcaatatgtt

SEQ ID NO: 624566 - DNA, 20 bp, Artificial
  CRISPR gRNA sequence
agattgccagtctgaggtaa

SEQ ID NO: 624567 - DNA, 20 bp, Artificial
  CRISPR gRNA sequence
gcaaggctgctggcggctca

SEQ ID NO: 624568 - DNA, 20 bp, Artificial
  CRISPR gRNA sequence
tcagatgcaggattggtcag

SEQ ID NO: 624569 - DNA, 20 bp, Artificial
  CRISPR gRNA sequence
cagtaagatctatcaagtag

SEQ ID NO: 624570 - DNA, 20 bp, Artificial
  CRISPR gRNA sequence
gatctatcaagtagtgagaa

SEQ ID NO: 624571 - DNA, 20 bp, Artificial
  CRISPR gRNA sequence
tgagcattttaagtaggatt

SEQ ID NO: 624572 - DNA, 20 bp, Artificial
  CRISPR gRNA sequence
tgtgaatgacaccatttttt

SEQ ID NO: 624573 - DNA, 20 bp, Artificial
  CRISPR gRNA sequence
ttaaaattgagcaaagtaca

SEQ ID NO: 624574 - DNA, 20 bp, Artificial
  CRISPR gRNA sequence
aaccaagtatgaagaactct

SEQ ID NO: 624575 - DNA, 20 bp, Artificial
  CRISPR gRNA sequence
ataagccccacaccaccatg

SEQ ID NO: 624576 - DNA, 20 bp, Artificial
  CRISPR gRNA sequence
taaagtgatgactatgcacc

SEQ ID NO: 624577 - DNA, 20 bp, Artificial
  CRISPR gRNA sequence
tccatttaaaaatacttctt

SEQ ID NO: 624578 - DNA, 20 bp, Artificial
  CRISPR gRNA sequence
tatggtatctatctatgatt

SEQ ID NO: 624579 - DNA, 20 bp, Artificial
  CRISPR gRNA sequence
tgttggctagtatccaggag

SEQ ID NO: 624580 - DNA, 20 bp, Artificial
  CRISPR gRNA sequence
caacatactcaaaactttaa

SEQ ID NO: 624581 - DNA, 20 bp, Artificial
  CRISPR gRNA sequence
atgcaattatttcaggagca

SEQ ID NO: 624582 - DNA, 20 bp, Artificial
  CRISPR gRNA sequence
cctctaactactgtagtatt

SEQ ID NO: 624583 - DNA, 20 bp, Artificial
  CRISPR gRNA sequence
taaaatgtcaagctgaccac

SEQ ID NO: 624584 - DNA, 20 bp, Artificial
  CRISPR gRNA sequence
agaggaaaaaaaaattcctt

SEQ ID NO: 624585 - DNA, 20 bp, Artificial
  CRISPR gRNA sequence
ctttaaacttccagctgaca

SEQ ID NO: 624586 - DNA, 20 bp, Artificial
  CRISPR gRNA sequence
tagcaaaattaaattaagga

SEQ ID NO: 624587 - DNA, 20 bp, Artificial
  CRISPR gRNA sequence
aaattaaggaatagaatcct

SEQ ID NO: 624588 - DNA, 20 bp, Artificial
  CRISPR gRNA sequence
ctgaagaatagcttttacag

SEQ ID NO: 624589 - DNA, 20 bp, Artificial
  CRISPR gRNA sequence
atcatcactttcccataata

SEQ ID NO: 624590 - DNA, 20 bp, Artificial
  CRISPR gRNA sequence
ctcaaaataatactgctgga

SEQ ID NO: 624591 - DNA, 20 bp, Artificial
  CRISPR gRNA sequence
tatgtatatcactggctata

SEQ ID NO: 624592 - DNA, 20 bp, Artificial
  CRISPR gRNA sequence
agtgaaatgcaacaaaataa

SEQ ID NO: 624593 - DNA, 20 bp, Artificial
  CRISPR gRNA sequence
caaaataaacagaaaaatgc

SEQ ID NO: 624594 - DNA, 20 bp, Artificial
  CRISPR gRNA sequence
gaaaaatgcaaagaatctgc

SEQ ID NO: 624595 - DNA, 20 bp, Artificial
  CRISPR gRNA sequence
ggaaggagaagtataaaggc

SEQ ID NO: 624596 - DNA, 20 bp, Artificial
  CRISPR gRNA sequence
taaaggcacagaattgggaa

SEQ ID NO: 624597 - DNA, 20 bp, Artificial
  CRISPR gRNA sequence
ccctaccatatatcccttta

SEQ ID NO: 624598 - DNA, 20 bp, Artificial
  CRISPR gRNA sequence
atatatccctttatcagaaa

SEQ ID NO: 624599 - DNA, 20 bp, Artificial
  CRISPR gRNA sequence
aatcagctaacgatgaaata

SEQ ID NO: 624600 - DNA, 20 bp, Artificial
  CRISPR gRNA sequence
cttgaaagttaagtctgtta

SEQ ID NO: 624601 - DNA, 20 bp, Artificial
  CRISPR gRNA sequence
aaattaagtatggcctagaa

SEQ ID NO: 624602 - DNA, 20 bp, Artificial
  CRISPR gRNA sequence
taaattcagtaaatattcag

SEQ ID NO: 624603 - DNA, 20 bp, Artificial
  CRISPR gRNA sequence
gtacagtattgtctcggatg

SEQ ID NO: 624604 - DNA, 20 bp, Artificial
  CRISPR gRNA sequence
ctaatatagttaatctggta

SEQ ID NO: 624605 - DNA, 20 bp, Artificial
  CRISPR gRNA sequence
ctcagtttcccaataagtaa

SEQ ID NO: 624606 - DNA, 20 bp, Artificial
  CRISPR gRNA sequence
aagaagtatacaaaaattaa

SEQ ID NO: 624607 - DNA, 20 bp, Artificial
  CRISPR gRNA sequence
ctttgaaagaggtaacacta

SEQ ID NO: 624608 - DNA, 20 bp, Artificial
  CRISPR gRNA sequence
gtaacactacaagaaaaaca

SEQ ID NO: 624609 - DNA, 20 bp, Artificial
  CRISPR gRNA sequence
ataacctaaattttaaaaat

SEQ ID NO: 624610 - DNA, 20 bp, Artificial
  CRISPR gRNA sequence
ttaaaaattcagaatgatgt

SEQ ID NO: 624611 - DNA, 20 bp, Artificial
  CRISPR gRNA sequence
ctctaaagtaacatccagaa

SEQ ID NO: 624612 - DNA, 20 bp, Artificial
  CRISPR gRNA sequence
catttcacaatccctgggat

SEQ ID NO: 624613 - DNA, 20 bp, Artificial
  CRISPR gRNA sequence
attttactatcctctcaaac

SEQ ID NO: 624614 - DNA, 20 bp, Artificial
  CRISPR gRNA sequence
atacaaatgaaaaagattga

SEQ ID NO: 624615 - DNA, 20 bp, Artificial
  CRISPR gRNA sequence
ctaactacaggaatgtgctc

SEQ ID NO: 624616 - DNA, 20 bp, Artificial
  CRISPR gRNA sequence
ccaatggtatctacatatac

SEQ ID NO: 624617 - DNA, 20 bp, Artificial
  CRISPR gRNA sequence
aaatccagatggaacattag

SEQ ID NO: 624618 - DNA, 20 bp, Artificial
  CRISPR gRNA sequence
agctgtgattcaaatttcac

SEQ ID NO: 624619 - DNA, 20 bp, Artificial
  CRISPR gRNA sequence
tgccaagttttgctacagta

SEQ ID NO: 624620 - DNA, 20 bp, Artificial
  CRISPR gRNA sequence
actgagacagtctcaataaa

SEQ ID NO: 624621 - DNA, 20 bp, Artificial
  CRISPR gRNA sequence
taaaagctaatcgctgcttt

SEQ ID NO: 624622 - DNA, 20 bp, Artificial
  CRISPR gRNA sequence
ccataatatttaaaatgaac

SEQ ID NO: 624623 - DNA, 20 bp, Artificial
  CRISPR gRNA sequence
gtactttcaagttatactca

SEQ ID NO: 624624 - DNA, 20 bp, Artificial
  CRISPR gRNA sequence
attatttatcaactctcatt

SEQ ID NO: 624625 - DNA, 20 bp, Artificial
  CRISPR gRNA sequence
gaagttttcttttaacaaaa

SEQ ID NO: 624626 - DNA, 20 bp, Artificial
  CRISPR gRNA sequence
tttaaccatcctcgtttggg

SEQ ID NO: 624627 - DNA, 20 bp, Artificial
  CRISPR gRNA sequence
caagcactgacattcaaact

SEQ ID NO: 624628 - DNA, 20 bp, Artificial
  CRISPR gRNA sequence
aaataatcataagcaaatac

SEQ ID NO: 624629 - DNA, 20 bp, Artificial
  CRISPR gRNA sequence
agcagagcagataaggcatc

SEQ ID NO: 624630 - DNA, 20 bp, Artificial
  CRISPR gRNA sequence
caccatcacctagttttcca

SEQ ID NO: 624631 - DNA, 20 bp, Artificial
  CRISPR gRNA sequence
gttttccactagaaaaaaaa

SEQ ID NO: 624632 - DNA, 20 bp, Artificial
  CRISPR gRNA sequence
aaaaatagaaaactcttttt

SEQ ID NO: 624633 - DNA, 20 bp, Artificial
  CRISPR gRNA sequence
aacatgtaatataaacaaga

SEQ ID NO: 624634 - DNA, 20 bp, Artificial
  CRISPR gRNA sequence
acaaataatgtgtagtaggc

SEQ ID NO: 624635 - DNA, 20 bp, Artificial
  CRISPR gRNA sequence
tttggaattaaatgtttaat

SEQ ID NO: 624636 - DNA, 20 bp, Artificial
  CRISPR gRNA sequence
ttaaatgtttaatatagaaa

SEQ ID NO: 624637 - DNA, 20 bp, Artificial
  CRISPR gRNA sequence
caaattctacaattcactat

SEQ ID NO: 624638 - DNA, 20 bp, Artificial
  CRISPR gRNA sequence
ccaaaaaaaataaataaata

SEQ ID NO: 624639 - DNA, 20 bp, Artificial
  CRISPR gRNA sequence
caaggaaaattttggtttcc

SEQ ID NO: 624640 - DNA, 20 bp, Artificial
  CRISPR gRNA sequence
agtgacttaattctacattt

SEQ ID NO: 624641 - DNA, 20 bp, Artificial
  CRISPR gRNA sequence
atactagtcttttttccatc

SEQ ID NO: 624642 - DNA, 20 bp, Artificial
  CRISPR gRNA sequence
ctatattattttagaagggt

SEQ ID NO: 624643 - DNA, 20 bp, Artificial
  CRISPR gRNA sequence
gagaaattggctgaaattgc

SEQ ID NO: 624644 - DNA, 20 bp, Artificial
  CRISPR gRNA sequence
caacaattactatattcttt

SEQ ID NO: 624645 - DNA, 20 bp, Artificial
  CRISPR gRNA sequence
tcagtatcctacagaggtta

SEQ ID NO: 624646 - DNA, 20 bp, Artificial
  CRISPR gRNA sequence
catctcaatagatcttcaca

SEQ ID NO: 624647 - DNA, 20 bp, Artificial
  CRISPR gRNA sequence
tattatccccagtaaacgta

SEQ ID NO: 624648 - DNA, 20 bp, Artificial
  CRISPR gRNA sequence
acgtacaagaaaactgaatc

SEQ ID NO: 624649 - DNA, 20 bp, Artificial
  CRISPR gRNA sequence
agaaaactgaatcgcagaaa

SEQ ID NO: 624650 - DNA, 20 bp, Artificial
  CRISPR gRNA sequence
ccagatggacaacccaccat

SEQ ID NO: 624651 - DNA, 20 bp, Artificial
  CRISPR gRNA sequence
atggacaacccaccatatag

SEQ ID NO: 624652 - DNA, 20 bp, Artificial
  CRISPR gRNA sequence
gttttctgtttccaaaccta

SEQ ID NO: 624653 - DNA, 20 bp, Artificial
  CRISPR gRNA sequence
actgaagcctaggtgacaca

SEQ ID NO: 624654 - DNA, 20 bp, Artificial
  CRISPR gRNA sequence
agcctaggtgacacaataga

SEQ ID NO: 624655 - DNA, 20 bp, Artificial
  CRISPR gRNA sequence
aaaaaagaaggaaaggaaag

SEQ ID NO: 624656 - DNA, 20 bp, Artificial
  CRISPR gRNA sequence
aggaaaggagggagggggag

SEQ ID NO: 624657 - DNA, 20 bp, Artificial
  CRISPR gRNA sequence
agggagggggagagagaaaa

SEQ ID NO: 624658 - DNA, 20 bp, Artificial
  CRISPR gRNA sequence
aaaaaagaaagagagagaga

SEQ ID NO: 624659 - DNA, 20 bp, Artificial
  CRISPR gRNA sequence
gaagggagggagggaaggaa

SEQ ID NO: 624660 - DNA, 20 bp, Artificial
  CRISPR gRNA sequence
gaaaggggagagagagagac

SEQ ID NO: 624661 - DNA, 20 bp, Artificial
  CRISPR gRNA sequence
ggagagagagagacagagaa

SEQ ID NO: 624662 - DNA, 20 bp, Artificial
  CRISPR gRNA sequence
gagagagacagagaaagaga

SEQ ID NO: 624663 - DNA, 20 bp, Artificial
  CRISPR gRNA sequence
atttcttgtatactaccaag

SEQ ID NO: 624664 - DNA, 20 bp, Artificial
  CRISPR gRNA sequence
aactgctgagcaatatttag

SEQ ID NO: 624665 - DNA, 20 bp, Artificial
  CRISPR gRNA sequence
ctacaaagttcaaaggaaca

SEQ ID NO: 624666 - DNA, 20 bp, Artificial
  CRISPR gRNA sequence
gaaataaaaacactctccta

SEQ ID NO: 624667 - DNA, 20 bp, Artificial
  CRISPR gRNA sequence
aattttcaacattaaaggaa

SEQ ID NO: 624668 - DNA, 20 bp, Artificial
  CRISPR gRNA sequence
gaaactgcaactattataat

SEQ ID NO: 624669 - DNA, 20 bp, Artificial
  CRISPR gRNA sequence
aaactttgaaaatggttgaa

SEQ ID NO: 624670 - DNA, 20 bp, Artificial
  CRISPR gRNA sequence
aataaatgagaactaaatgt

SEQ ID NO: 624671 - DNA, 20 bp, Artificial
  CRISPR gRNA sequence
aggacatgggctagccatgg

SEQ ID NO: 624672 - DNA, 20 bp, Artificial
  CRISPR gRNA sequence
tcattaaatatccctttcat

SEQ ID NO: 624673 - DNA, 20 bp, Artificial
  CRISPR gRNA sequence
ggaagagtataggaggtagt

SEQ ID NO: 624674 - DNA, 20 bp, Artificial
  CRISPR gRNA sequence
tcaggatattagccagaaca

SEQ ID NO: 624675 - DNA, 20 bp, Artificial
  CRISPR gRNA sequence
cagaacagaagaaaaaaaaa

SEQ ID NO: 624676 - DNA, 20 bp, Artificial
  CRISPR gRNA sequence
gagctcaaagtccaatatag

SEQ ID NO: 624677 - DNA, 20 bp, Artificial
  CRISPR gRNA sequence
gacagaaagtcaacaaataa

SEQ ID NO: 624678 - DNA, 20 bp, Artificial
  CRISPR gRNA sequence
gggaaagtgggttttcaggg

SEQ ID NO: 624679 - DNA, 20 bp, Artificial
  CRISPR gRNA sequence
atatcctctgggggtagggt

SEQ ID NO: 624680 - DNA, 20 bp, Artificial
  CRISPR gRNA sequence
aataagaactttatagacct

SEQ ID NO: 624681 - DNA, 20 bp, Artificial
  CRISPR gRNA sequence
ggattttgataacatgtcaa

SEQ ID NO: 624682 - DNA, 20 bp, Artificial
  CRISPR gRNA sequence
atgtatacttaaggcttgca

SEQ ID NO: 624683 - DNA, 20 bp, Artificial
  CRISPR gRNA sequence
tgaggaataaatacaacgat

SEQ ID NO: 624684 - DNA, 20 bp, Artificial
  CRISPR gRNA sequence
taaggaaataaaacagctat

SEQ ID NO: 624685 - DNA, 20 bp, Artificial
  CRISPR gRNA sequence
cctgtgatgttatattaatg

SEQ ID NO: 624686 - DNA, 20 bp, Artificial
  CRISPR gRNA sequence
gataaaaacatagataaaag

SEQ ID NO: 624687 - DNA, 20 bp, Artificial
  CRISPR gRNA sequence
agaaaaggtacatttgcaca

SEQ ID NO: 624688 - DNA, 20 bp, Artificial
  CRISPR gRNA sequence
ttactcaaggcactcagtat

SEQ ID NO: 624689 - DNA, 20 bp, Artificial
  CRISPR gRNA sequence
gcactcagtatacagaatat

SEQ ID NO: 624690 - DNA, 20 bp, Artificial
  CRISPR gRNA sequence
aagtttggtgagtgtgtgag

SEQ ID NO: 624691 - DNA, 20 bp, Artificial
  CRISPR gRNA sequence
ttgcaaaatataatttcaga

SEQ ID NO: 624692 - DNA, 20 bp, Artificial
  CRISPR gRNA sequence
ttaacaattcatttagaggt

SEQ ID NO: 624693 - DNA, 20 bp, Artificial
  CRISPR gRNA sequence
aagtctattaaaaactatag

SEQ ID NO: 624694 - DNA, 20 bp, Artificial
  CRISPR gRNA sequence
tctagcttgtgtgctcctta

SEQ ID NO: 624695 - DNA, 20 bp, Artificial
  CRISPR gRNA sequence
attctacattatgatgagtt

SEQ ID NO: 624696 - DNA, 20 bp, Artificial
  CRISPR gRNA sequence
ttatatataacaatgtaata

SEQ ID NO: 624697 - DNA, 20 bp, Artificial
  CRISPR gRNA sequence
tggtgccaaaaaggttgggg

SEQ ID NO: 624698 - DNA, 20 bp, Artificial
  CRISPR gRNA sequence
ccctggaatgcttccctggc

SEQ ID NO: 624699 - DNA, 20 bp, Artificial
  CRISPR gRNA sequence
tttcattcttatggtcagtg

SEQ ID NO: 624700 - DNA, 20 bp, Artificial
  CRISPR gRNA sequence
tgtatctatgtcactctaaa

SEQ ID NO: 624701 - DNA, 20 bp, Artificial
  CRISPR gRNA sequence
atcatgccttctctaatctg

SEQ ID NO: 624702 - DNA, 20 bp, Artificial
  CRISPR gRNA sequence
agtttcaatgtgatttccta

SEQ ID NO: 624703 - DNA, 20 bp, Artificial
  CRISPR gRNA sequence
ggtgaaattaatggctccta

SEQ ID NO: 624704 - DNA, 20 bp, Artificial
  CRISPR gRNA sequence
ataatgttcaaaaaatattt

SEQ ID NO: 624705 - DNA, 20 bp, Artificial
  CRISPR gRNA sequence
atctttctcttttaaaacac

SEQ ID NO: 624706 - DNA, 20 bp, Artificial
  CRISPR gRNA sequence
tttaaaacacttagaaacac

SEQ ID NO: 624707 - DNA, 20 bp, Artificial
  CRISPR gRNA sequence
ttattcaccatgatcttatt

SEQ ID NO: 624708 - DNA, 20 bp, Artificial
  CRISPR gRNA sequence
ggtttcaccatggtgtaata

SEQ ID NO: 624709 - DNA, 20 bp, Artificial
  CRISPR gRNA sequence
taatgatagggaaactgacc

SEQ ID NO: 624710 - DNA, 20 bp, Artificial
  CRISPR gRNA sequence
tgaaacccataacataatct

SEQ ID NO: 624711 - DNA, 20 bp, Artificial
  CRISPR gRNA sequence
gcagtggtgagacgtggggt

SEQ ID NO: 624712 - DNA, 20 bp, Artificial
  CRISPR gRNA sequence
aatgctaacttcaccaaatt

SEQ ID NO: 624713 - DNA, 20 bp, Artificial
  CRISPR gRNA sequence
atataactccatgtgagcat

SEQ ID NO: 624714 - DNA, 20 bp, Artificial
  CRISPR gRNA sequence
tgagcatgtagaatccaggg

SEQ ID NO: 624715 - DNA, 20 bp, Artificial
  CRISPR gRNA sequence
ctgcaaatacctacatccaa

SEQ ID NO: 624716 - DNA, 20 bp, Artificial
  CRISPR gRNA sequence
ccaaaaagaaaaaagagttg

SEQ ID NO: 624717 - DNA, 20 bp, Artificial
  CRISPR gRNA sequence
gcccttggctgtgctcaagc

SEQ ID NO: 624718 - DNA, 20 bp, Artificial
  CRISPR gRNA sequence
tctccctgttaatgcaatag

SEQ ID NO: 624719 - DNA, 20 bp, Artificial
  CRISPR gRNA sequence
tcactaatcacatttataat

SEQ ID NO: 624720 - DNA, 20 bp, Artificial
  CRISPR gRNA sequence
aaaaaatgcaactcatttaa

SEQ ID NO: 624721 - DNA, 20 bp, Artificial
  CRISPR gRNA sequence
ccacttgggaatctgaggca

SEQ ID NO: 624722 - DNA, 20 bp, Artificial
  CRISPR gRNA sequence
attaggtgctaattacttgt

SEQ ID NO: 624723 - DNA, 20 bp, Artificial
  CRISPR gRNA sequence
atgcaaagtgtcacaattcc

SEQ ID NO: 624724 - DNA, 20 bp, Artificial
  CRISPR gRNA sequence
attcccaagaatgattctaa

SEQ ID NO: 624725 - DNA, 20 bp, Artificial
  CRISPR gRNA sequence
ggagaaggaggaggaaattg

SEQ ID NO: 624726 - DNA, 20 bp, Artificial
  CRISPR gRNA sequence
ggttagtaaaaggtaagtat

SEQ ID NO: 624727 - DNA, 20 bp, Artificial
  CRISPR gRNA sequence
ttctggaaaaaagattatga

SEQ ID NO: 624728 - DNA, 20 bp, Artificial
  CRISPR gRNA sequence
gcaaacatttgggaactagg

SEQ ID NO: 624729 - DNA, 20 bp, Artificial
  CRISPR gRNA sequence
gtgtgtgttagtgacagctg

SEQ ID NO: 624730 - DNA, 20 bp, Artificial
  CRISPR gRNA sequence
gatgagatatattttaggaa

SEQ ID NO: 624731 - DNA, 20 bp, Artificial
  CRISPR gRNA sequence
ctgaacttaattccatatct

SEQ ID NO: 624732 - DNA, 20 bp, Artificial
  CRISPR gRNA sequence
aatgttcttgaggtcgaaat

SEQ ID NO: 624733 - DNA, 20 bp, Artificial
  CRISPR gRNA sequence
ggctattttcacaagattga

SEQ ID NO: 624734 - DNA, 20 bp, Artificial
  CRISPR gRNA sequence
tcaatggctgagttttgatt

SEQ ID NO: 624735 - DNA, 20 bp, Artificial
  CRISPR gRNA sequence
ccagaaatcatccgtctgaa

SEQ ID NO: 624736 - DNA, 20 bp, Artificial
  CRISPR gRNA sequence
ggaattagagatgttaacca

SEQ ID NO: 624737 - DNA, 20 bp, Artificial
  CRISPR gRNA sequence
gtgggatcaaagtagcttat

SEQ ID NO: 624738 - DNA, 20 bp, Artificial
  CRISPR gRNA sequence
aaagatgtgaaaatttaata

SEQ ID NO: 624739 - DNA, 20 bp, Artificial
  CRISPR gRNA sequence
atgtgaaaatttaataaaag

SEQ ID NO: 624740 - DNA, 20 bp, Artificial
  CRISPR gRNA sequence
ccaggaaccagctttacaga

SEQ ID NO: 624741 - DNA, 20 bp, Artificial
  CRISPR gRNA sequence
gcagacttctattaatgaag

SEQ ID NO: 624742 - DNA, 20 bp, Artificial
  CRISPR gRNA sequence
ctgctctatatttgctaaac

SEQ ID NO: 624743 - DNA, 20 bp, Artificial
  CRISPR gRNA sequence
gcctgacccaaagtaagcct

SEQ ID NO: 624744 - DNA, 20 bp, Artificial
  CRISPR gRNA sequence
ttagataattgaaggaataa

SEQ ID NO: 624745 - DNA, 20 bp, Artificial
  CRISPR gRNA sequence
ccactagctttattgtcttg

SEQ ID NO: 624746 - DNA, 20 bp, Artificial
  CRISPR gRNA sequence
acaaaggtttcctaagttgg

SEQ ID NO: 624747 - DNA, 20 bp, Artificial
  CRISPR gRNA sequence
aaggtaaacctgagttcatc

SEQ ID NO: 624748 - DNA, 20 bp, Artificial
  CRISPR gRNA sequence
ccagggtaccatctttcctg

SEQ ID NO: 624749 - DNA, 20 bp, Artificial
  CRISPR gRNA sequence
ggtgcatatcagccacaggt

SEQ ID NO: 624750 - DNA, 20 bp, Artificial
  CRISPR gRNA sequence
gactggcaagaggagagagg

SEQ ID NO: 624751 - DNA, 20 bp, Artificial
  CRISPR gRNA sequence
gaggagagaggacagaatca

SEQ ID NO: 624752 - DNA, 20 bp, Artificial
  CRISPR gRNA sequence
gatgacagactaggagaagc

SEQ ID NO: 624753 - DNA, 20 bp, Artificial
  CRISPR gRNA sequence
agacataaggtattttggaa

SEQ ID NO: 624754 - DNA, 20 bp, Artificial
  CRISPR gRNA sequence
aatttgagtgaagtggtata

SEQ ID NO: 624755 - DNA, 20 bp, Artificial
  CRISPR gRNA sequence
acatatcattaaattaaaaa

SEQ ID NO: 624756 - DNA, 20 bp, Artificial
  CRISPR gRNA sequence
catatgtaaagtcaaatgtc

SEQ ID NO: 624757 - DNA, 20 bp, Artificial
  CRISPR gRNA sequence
ctgaaaagagtttaaacata

SEQ ID NO: 624758 - DNA, 20 bp, Artificial
  CRISPR gRNA sequence
ttttactgaagtttcttatg

SEQ ID NO: 624759 - DNA, 20 bp, Artificial
  CRISPR gRNA sequence
ttcactatttcactagaact

SEQ ID NO: 624760 - DNA, 20 bp, Artificial
  CRISPR gRNA sequence
aaatttaagtagtatgactt

SEQ ID NO: 624761 - DNA, 20 bp, Artificial
  CRISPR gRNA sequence
cttgatgcgaatttcacatg

SEQ ID NO: 624762 - DNA, 20 bp, Artificial
  CRISPR gRNA sequence
atgaaagaaacttaatagcc

SEQ ID NO: 624763 - DNA, 20 bp, Artificial
  CRISPR gRNA sequence
atattgactctaaagatgtc

SEQ ID NO: 624764 - DNA, 20 bp, Artificial
  CRISPR gRNA sequence
taaagatgtcttagaatgtc

SEQ ID NO: 624765 - DNA, 20 bp, Artificial
  CRISPR gRNA sequence
cctaagcatttccatgtcat

SEQ ID NO: 624766 - DNA, 20 bp, Artificial
  CRISPR gRNA sequence
attagttaataatcatatct

SEQ ID NO: 624767 - DNA, 20 bp, Artificial
  CRISPR gRNA sequence
gatttcatatgttaaagtat

SEQ ID NO: 624768 - DNA, 20 bp, Artificial
  CRISPR gRNA sequence
actgatttcatcatatataa

SEQ ID NO: 624769 - DNA, 20 bp, Artificial
  CRISPR gRNA sequence
tgaaaaagaccctataaatt

SEQ ID NO: 624770 - DNA, 20 bp, Artificial
  CRISPR gRNA sequence
ctctagaccttcactgtgca

SEQ ID NO: 624771 - DNA, 20 bp, Artificial
  CRISPR gRNA sequence
accaccattctacatattga

SEQ ID NO: 624772 - DNA, 20 bp, Artificial
  CRISPR gRNA sequence
gagcaactcgcaaaatgaga

SEQ ID NO: 624773 - DNA, 20 bp, Artificial
  CRISPR gRNA sequence
gtttccaattttaggactta

SEQ ID NO: 624774 - DNA, 20 bp, Artificial
  CRISPR gRNA sequence
ttttctttgcttctgaatct

SEQ ID NO: 624775 - DNA, 20 bp, Artificial
  CRISPR gRNA sequence
ttactttttgccatatataa

SEQ ID NO: 624776 - DNA, 20 bp, Artificial
  CRISPR gRNA sequence
aggaaaaaaaatatatagga

SEQ ID NO: 624777 - DNA, 20 bp, Artificial
  CRISPR gRNA sequence
ccagtgccttcaagggcagc

SEQ ID NO: 624778 - DNA, 20 bp, Artificial
  CRISPR gRNA sequence
agcaatcaaatggaccaaat

SEQ ID NO: 624779 - DNA, 20 bp, Artificial
  CRISPR gRNA sequence
aaatattagctagttgattt

SEQ ID NO: 624780 - DNA, 20 bp, Artificial
  CRISPR gRNA sequence
tgttattacctcctcattta

SEQ ID NO: 624781 - DNA, 20 bp, Artificial
  CRISPR gRNA sequence
tctactgctttagattcatt

SEQ ID NO: 624782 - DNA, 20 bp, Artificial
  CRISPR gRNA sequence
atattaagtaggactactat

SEQ ID NO: 624783 - DNA, 20 bp, Artificial
  CRISPR gRNA sequence
ctataaagaatacttgattt

SEQ ID NO: 624784 - DNA, 20 bp, Artificial
  CRISPR gRNA sequence
accctacttgggctgccatg

SEQ ID NO: 624785 - DNA, 20 bp, Artificial
  CRISPR gRNA sequence
ctgccatggtagaaagagag

SEQ ID NO: 624786 - DNA, 20 bp, Artificial
  CRISPR gRNA sequence
catggtagaaagagagagag

SEQ ID NO: 624787 - DNA, 20 bp, Artificial
  CRISPR gRNA sequence
agcctgctttaaaaaaaatc

SEQ ID NO: 624788 - DNA, 20 bp, Artificial
  CRISPR gRNA sequence
tttcattagttatttaaaca

SEQ ID NO: 624789 - DNA, 20 bp, Artificial
  CRISPR gRNA sequence
gtacctttacctatggttat

SEQ ID NO: 624790 - DNA, 20 bp, Artificial
  CRISPR gRNA sequence
atggttatccagaaaaggaa

SEQ ID NO: 624791 - DNA, 20 bp, Artificial
  CRISPR gRNA sequence
atccagaaaaggaatgagaa

SEQ ID NO: 624792 - DNA, 20 bp, Artificial
  CRISPR gRNA sequence
acgttcactgtagtctgcct

SEQ ID NO: 624793 - DNA, 20 bp, Artificial
  CRISPR gRNA sequence
tgcctaaagaaaacactagg

SEQ ID NO: 624794 - DNA, 20 bp, Artificial
  CRISPR gRNA sequence
tacactcacacctagagtgc

SEQ ID NO: 624795 - DNA, 20 bp, Artificial
  CRISPR gRNA sequence
tcaataattctgtatttaaa

SEQ ID NO: 624796 - DNA, 20 bp, Artificial
  CRISPR gRNA sequence
gatgggacagatgcatagtc

SEQ ID NO: 624797 - DNA, 20 bp, Artificial
  CRISPR gRNA sequence
aaaggtaataagctcttgaa

SEQ ID NO: 624798 - DNA, 20 bp, Artificial
  CRISPR gRNA sequence
aataagctcttgaaatagaa

SEQ ID NO: 624799 - DNA, 20 bp, Artificial
  CRISPR gRNA sequence
tccattaaatgtaatacaaa

SEQ ID NO: 624800 - DNA, 20 bp, Artificial
  CRISPR gRNA sequence
aaaatctcaataactcttca

SEQ ID NO: 624801 - DNA, 20 bp, Artificial
  CRISPR gRNA sequence
gtctcaattctattgaattt

SEQ ID NO: 624802 - DNA, 20 bp, Artificial
  CRISPR gRNA sequence
ttgtcatatttccagctgta

SEQ ID NO: 624803 - DNA, 20 bp, Artificial
  CRISPR gRNA sequence
catcaagaggaaagcacatg

SEQ ID NO: 624804 - DNA, 20 bp, Artificial
  CRISPR gRNA sequence
caaatcaacagactgaacga

SEQ ID NO: 624805 - DNA, 20 bp, Artificial
  CRISPR gRNA sequence
tactgaatgtatagtgaatg

SEQ ID NO: 624806 - DNA, 20 bp, Artificial
  CRISPR gRNA sequence
tataacttagaacaactgtt

SEQ ID NO: 624807 - DNA, 20 bp, Artificial
  CRISPR gRNA sequence
atatagtgatatcagattta

SEQ ID NO: 624808 - DNA, 20 bp, Artificial
  CRISPR gRNA sequence
attaaaaagatttttagtat

SEQ ID NO: 624809 - DNA, 20 bp, Artificial
  CRISPR gRNA sequence
acattaatagtacagttaaa

SEQ ID NO: 624810 - DNA, 20 bp, Artificial
  CRISPR gRNA sequence
taacggacaaaaaaaaaaaa

SEQ ID NO: 624811 - DNA, 20 bp, Artificial
  CRISPR gRNA sequence
acaaaaaaaaaaaaaaagaa

SEQ ID NO: 624812 - DNA, 20 bp, Artificial
  CRISPR gRNA sequence
aaagtatcattttactgagt

SEQ ID NO: 624813 - DNA, 20 bp, Artificial
  CRISPR gRNA sequence
attccccccaaaatattaat

SEQ ID NO: 624814 - DNA, 20 bp, Artificial
  CRISPR gRNA sequence
aataaagaatagggaaagga

SEQ ID NO: 624815 - DNA, 20 bp, Artificial
  CRISPR gRNA sequence
cagccattcccatactcaga

SEQ ID NO: 624816 - DNA, 20 bp, Artificial
  CRISPR gRNA sequence
aatgtaaaaagaagaggaaa

SEQ ID NO: 624817 - DNA, 20 bp, Artificial
  CRISPR gRNA sequence
caggcccccatgctcctatc

SEQ ID NO: 624818 - DNA, 20 bp, Artificial
  CRISPR gRNA sequence
ctctccctcatgagctaccc

SEQ ID NO: 624819 - DNA, 20 bp, Artificial
  CRISPR gRNA sequence
tgattatcaaatgctacaaa

SEQ ID NO: 624820 - DNA, 20 bp, Artificial
  CRISPR gRNA sequence
aaaatctcttttgtggttga

SEQ ID NO: 624821 - DNA, 20 bp, Artificial
  CRISPR gRNA sequence
cactttgggaggccgcggct

SEQ ID NO: 624822 - DNA, 20 bp, Artificial
  CRISPR gRNA sequence
accctgtctaaaaaaaaaaa

SEQ ID NO: 624823 - DNA, 20 bp, Artificial
  CRISPR gRNA sequence
ctaaaaaaaaaaaaaagaaa

SEQ ID NO: 624824 - DNA, 20 bp, Artificial
  CRISPR gRNA sequence
aaaaaaaaaaagaaaaaaga

SEQ ID NO: 624825 - DNA, 20 bp, Artificial
  CRISPR gRNA sequence
aaagaaaaaagaaaagaaaa

SEQ ID NO: 624826 - DNA, 20 bp, Artificial
  CRISPR gRNA sequence
atattccttatgccacccat

SEQ ID NO: 624827 - DNA, 20 bp, Artificial
  CRISPR gRNA sequence
taatggggaaaatcataaac

SEQ ID NO: 624828 - DNA, 20 bp, Artificial
  CRISPR gRNA sequence
catatagaaggacacggtaa

SEQ ID NO: 624829 - DNA, 20 bp, Artificial
  CRISPR gRNA sequence
gcaaattagcctgctcagag

SEQ ID NO: 624830 - DNA, 20 bp, Artificial
  CRISPR gRNA sequence
taaggcttagcaagacaaac

SEQ ID NO: 624831 - DNA, 20 bp, Artificial
  CRISPR gRNA sequence
agtatcacaaaattctaatt

SEQ ID NO: 624832 - DNA, 20 bp, Artificial
  CRISPR gRNA sequence
acaacattttagagaactat

SEQ ID NO: 624833 - DNA, 20 bp, Artificial
  CRISPR gRNA sequence
gaaaccctactgagttgata

SEQ ID NO: 624834 - DNA, 20 bp, Artificial
  CRISPR gRNA sequence
aaataaggactatataagat

SEQ ID NO: 624835 - DNA, 20 bp, Artificial
  CRISPR gRNA sequence
tcatcctacaattcaatctc

SEQ ID NO: 624836 - DNA, 20 bp, Artificial
  CRISPR gRNA sequence
ataaatcaaacaaaaatcac

SEQ ID NO: 624837 - DNA, 20 bp, Artificial
  CRISPR gRNA sequence
atcacttttttttaacagat

SEQ ID NO: 624838 - DNA, 20 bp, Artificial
  CRISPR gRNA sequence
ttggcaatactatatttcaa

SEQ ID NO: 624839 - DNA, 20 bp, Artificial
  CRISPR gRNA sequence
ataagcaaggtaaaatatct

SEQ ID NO: 624840 - DNA, 20 bp, Artificial
  CRISPR gRNA sequence
gacactttcagtctcaccct

SEQ ID NO: 624841 - DNA, 20 bp, Artificial
  CRISPR gRNA sequence
aattattataagataaattt

SEQ ID NO: 624842 - DNA, 20 bp, Artificial
  CRISPR gRNA sequence
cctcctattttgggtgaagt

SEQ ID NO: 624843 - DNA, 20 bp, Artificial
  CRISPR gRNA sequence
atttttctgtgaactgtgtg

SEQ ID NO: 624844 - DNA, 20 bp, Artificial
  CRISPR gRNA sequence
tttatgctattttttgccat

SEQ ID NO: 624845 - DNA, 20 bp, Artificial
  CRISPR gRNA sequence
caatattgcatctacctgtg

SEQ ID NO: 624846 - DNA, 20 bp, Artificial
  CRISPR gRNA sequence
tatttctgtttactgggtgt

SEQ ID NO: 624847 - DNA, 20 bp, Artificial
  CRISPR gRNA sequence
tatgttttttcactgtctat

SEQ ID NO: 624848 - DNA, 20 bp, Artificial
  CRISPR gRNA sequence
tcaaattgtaatttattttt

SEQ ID NO: 624849 - DNA, 20 bp, Artificial
  CRISPR gRNA sequence
aagcaataaaaaattaccaa

SEQ ID NO: 624850 - DNA, 20 bp, Artificial
  CRISPR gRNA sequence
ataaattaaaatttacagtg

SEQ ID NO: 624851 - DNA, 20 bp, Artificial
  CRISPR gRNA sequence
ccccaaaatacaaaaactgt

SEQ ID NO: 624852 - DNA, 20 bp, Artificial
  CRISPR gRNA sequence
tcttaaaatcagcctggagg

SEQ ID NO: 624853 - DNA, 20 bp, Artificial
  CRISPR gRNA sequence
aagttaactttagagcccat

SEQ ID NO: 624854 - DNA, 20 bp, Artificial
  CRISPR gRNA sequence
cctactttcaggtacaatct

SEQ ID NO: 624855 - DNA, 20 bp, Artificial
  CRISPR gRNA sequence
ggcaaggatacacaagtttg

SEQ ID NO: 624856 - DNA, 20 bp, Artificial
  CRISPR gRNA sequence
atgacaagtgctagcaatgg

SEQ ID NO: 624857 - DNA, 20 bp, Artificial
  CRISPR gRNA sequence
gatcctaaatgtaaattgtt

SEQ ID NO: 624858 - DNA, 20 bp, Artificial
  CRISPR gRNA sequence
tatttactgttggatggact

SEQ ID NO: 624859 - DNA, 20 bp, Artificial
  CRISPR gRNA sequence
tgatcaatgcaaaaacctct

SEQ ID NO: 624860 - DNA, 20 bp, Artificial
  CRISPR gRNA sequence
tctcaaaaaaaaaaaaaatc

SEQ ID NO: 624861 - DNA, 20 bp, Artificial
  CRISPR gRNA sequence
acaaaagcataaacctattt

SEQ ID NO: 624862 - DNA, 20 bp, Artificial
  CRISPR gRNA sequence
atcaatgtcaggcactggtc

SEQ ID NO: 624863 - DNA, 20 bp, Artificial
  CRISPR gRNA sequence
tccataggcataaaacaatg

SEQ ID NO: 624864 - DNA, 20 bp, Artificial
  CRISPR gRNA sequence
ttacaatgtatgggtgtatg

SEQ ID NO: 624865 - DNA, 20 bp, Artificial
  CRISPR gRNA sequence
tctagttaataacactattt

SEQ ID NO: 624866 - DNA, 20 bp, Artificial
  CRISPR gRNA sequence
ataccagttagtccattacc

SEQ ID NO: 624867 - DNA, 20 bp, Artificial
  CRISPR gRNA sequence
cagttagtccattaccacag

SEQ ID NO: 624868 - DNA, 20 bp, Artificial
  CRISPR gRNA sequence
attataatgtatgtatgtgc

SEQ ID NO: 624869 - DNA, 20 bp, Artificial
  CRISPR gRNA sequence
atttccatgtttacatggtc

SEQ ID NO: 624870 - DNA, 20 bp, Artificial
  CRISPR gRNA sequence
aatacacagtaaatgctctt

SEQ ID NO: 624871 - DNA, 20 bp, Artificial
  CRISPR gRNA sequence
aaattccgtaggtaaaaagc

SEQ ID NO: 624872 - DNA, 20 bp, Artificial
  CRISPR gRNA sequence
tttgaggtacataaggaaga

SEQ ID NO: 624873 - DNA, 20 bp, Artificial
  CRISPR gRNA sequence
gtattctgtgctgaacagcg

SEQ ID NO: 624874 - DNA, 20 bp, Artificial
  CRISPR gRNA sequence
ccaagatttgaacctaggcc

SEQ ID NO: 624875 - DNA, 20 bp, Artificial
  CRISPR gRNA sequence
gtagttattgaacacctact

SEQ ID NO: 624876 - DNA, 20 bp, Artificial
  CRISPR gRNA sequence
caccaggctttccttctatt

SEQ ID NO: 624877 - DNA, 20 bp, Artificial
  CRISPR gRNA sequence
taagtgaattggacaccaca

SEQ ID NO: 624878 - DNA, 20 bp, Artificial
  CRISPR gRNA sequence
acaaactgaaaaggcagttg

SEQ ID NO: 624879 - DNA, 20 bp, Artificial
  CRISPR gRNA sequence
gccacctaaaactttttttc

SEQ ID NO: 624880 - DNA, 20 bp, Artificial
  CRISPR gRNA sequence
actttaatggtattaatttg

SEQ ID NO: 624881 - DNA, 20 bp, Artificial
  CRISPR gRNA sequence
tattaatttgacagaaaaca

SEQ ID NO: 624882 - DNA, 20 bp, Artificial
  CRISPR gRNA sequence
ggtacctgaaatctccatta

SEQ ID NO: 624883 - DNA, 20 bp, Artificial
  CRISPR gRNA sequence
agacaggttttggtttgaat

SEQ ID NO: 624884 - DNA, 20 bp, Artificial
  CRISPR gRNA sequence
aaagattgtgaagacacgta

SEQ ID NO: 624885 - DNA, 20 bp, Artificial
  CRISPR gRNA sequence
gggtttgcaaatggaagtgc

SEQ ID NO: 624886 - DNA, 20 bp, Artificial
  CRISPR gRNA sequence
ttgcaaatggaagtgctaag

SEQ ID NO: 624887 - DNA, 20 bp, Artificial
  CRISPR gRNA sequence
ggaagtgctaagaaagaaaa

SEQ ID NO: 624888 - DNA, 20 bp, Artificial
  CRISPR gRNA sequence
agagatgaaagtgtgggaga

SEQ ID NO: 624889 - DNA, 20 bp, Artificial
  CRISPR gRNA sequence
aacatgagaaggaggaaaaa

SEQ ID NO: 624890 - DNA, 20 bp, Artificial
  CRISPR gRNA sequence
tcttagtcagctctgagtta

SEQ ID NO: 624891 - DNA, 20 bp, Artificial
  CRISPR gRNA sequence
ttactagcaatcttgaagga

SEQ ID NO: 624892 - DNA, 20 bp, Artificial
  CRISPR gRNA sequence
gtagtcagtaagtacctggc

SEQ ID NO: 624893 - DNA, 20 bp, Artificial
  CRISPR gRNA sequence
gagatagtatctgtttgttt

SEQ ID NO: 624894 - DNA, 20 bp, Artificial
  CRISPR gRNA sequence
agtatctgtttgtttggaga

SEQ ID NO: 624895 - DNA, 20 bp, Artificial
  CRISPR gRNA sequence
acatgtacatactcagtgct

SEQ ID NO: 624896 - DNA, 20 bp, Artificial
  CRISPR gRNA sequence
ggattgagagttttcctggt

SEQ ID NO: 624897 - DNA, 20 bp, Artificial
  CRISPR gRNA sequence
tttcctggttgagaaaaagt

SEQ ID NO: 624898 - DNA, 20 bp, Artificial
  CRISPR gRNA sequence
gaaaggagaaggattcatgc

SEQ ID NO: 624899 - DNA, 20 bp, Artificial
  CRISPR gRNA sequence
tgcaaagaaaaggcaatttg

SEQ ID NO: 624900 - DNA, 20 bp, Artificial
  CRISPR gRNA sequence
cctcaggtaaggggagtcat

SEQ ID NO: 624901 - DNA, 20 bp, Artificial
  CRISPR gRNA sequence
taaggggagtcattcagaaa

SEQ ID NO: 624902 - DNA, 20 bp, Artificial
  CRISPR gRNA sequence
tagaagtaggtgacaaaact

SEQ ID NO: 624903 - DNA, 20 bp, Artificial
  CRISPR gRNA sequence
agatgacctacaattagtcc

SEQ ID NO: 624904 - DNA, 20 bp, Artificial
  CRISPR gRNA sequence
gttatcctataggatctttt

SEQ ID NO: 624905 - DNA, 20 bp, Artificial
  CRISPR gRNA sequence
atctatttcttcagactgtt

SEQ ID NO: 624906 - DNA, 20 bp, Artificial
  CRISPR gRNA sequence
tagcctctttgaggtacaat

SEQ ID NO: 624907 - DNA, 20 bp, Artificial
  CRISPR gRNA sequence
atatttgtacaaaaaactaa

SEQ ID NO: 624908 - DNA, 20 bp, Artificial
  CRISPR gRNA sequence
aatacaactgagagagaagt

SEQ ID NO: 624909 - DNA, 20 bp, Artificial
  CRISPR gRNA sequence
aacatctcaatcaaaaagac

SEQ ID NO: 624910 - DNA, 20 bp, Artificial
  CRISPR gRNA sequence
tatcaaaggcaggtagagga

SEQ ID NO: 624911 - DNA, 20 bp, Artificial
  CRISPR gRNA sequence
ttcctaaacttgcctgatta

SEQ ID NO: 624912 - DNA, 20 bp, Artificial
  CRISPR gRNA sequence
ttcttacgatcaagcaagtt

SEQ ID NO: 624913 - DNA, 20 bp, Artificial
  CRISPR gRNA sequence
ttttaaggattattctttcc

SEQ ID NO: 624914 - DNA, 20 bp, Artificial
  CRISPR gRNA sequence
tctcttgccatgatggcaga

SEQ ID NO: 624915 - DNA, 20 bp, Artificial
  CRISPR gRNA sequence
aaatctagcctagataatca

SEQ ID NO: 624916 - DNA, 20 bp, Artificial
  CRISPR gRNA sequence
aaaactgccactcaggcaag

SEQ ID NO: 624917 - DNA, 20 bp, Artificial
  CRISPR gRNA sequence
tgttgctaatatcctcagag

SEQ ID NO: 624918 - DNA, 20 bp, Artificial
  CRISPR gRNA sequence
tttcacctaggaatctttct

SEQ ID NO: 624919 - DNA, 20 bp, Artificial
  CRISPR gRNA sequence
acctagagcatcattcctca

SEQ ID NO: 624920 - DNA, 20 bp, Artificial
  CRISPR gRNA sequence
caatataaggaagaactttc

SEQ ID NO: 624921 - DNA, 20 bp, Artificial
  CRISPR gRNA sequence
agtatttcagtttcccatgt

SEQ ID NO: 624922 - DNA, 20 bp, Artificial
  CRISPR gRNA sequence
tctaccagtcttgaaatagg

SEQ ID NO: 624923 - DNA, 20 bp, Artificial
  CRISPR gRNA sequence
agtcttgaaataggaaagaa

SEQ ID NO: 624924 - DNA, 20 bp, Artificial
  CRISPR gRNA sequence
atacacaatcttttccccta

SEQ ID NO: 624925 - DNA, 20 bp, Artificial
  CRISPR gRNA sequence
gatgacaaggtttcttgata

SEQ ID NO: 624926 - DNA, 20 bp, Artificial
  CRISPR gRNA sequence
ctagtgaaattagagcagat

SEQ ID NO: 624927 - DNA, 20 bp, Artificial
  CRISPR gRNA sequence
aatttctcccagacactgaa

SEQ ID NO: 624928 - DNA, 20 bp, Artificial
  CRISPR gRNA sequence
ttcaggaacaaaaattaaat

SEQ ID NO: 624929 - DNA, 20 bp, Artificial
  CRISPR gRNA sequence
tatgtttaaaaaaccgtaat

SEQ ID NO: 624930 - DNA, 20 bp, Artificial
  CRISPR gRNA sequence
aaaatgcatttttgtcaagg

SEQ ID NO: 624931 - DNA, 20 bp, Artificial
  CRISPR gRNA sequence
aaagaaggtaaatgaatgaa

SEQ ID NO: 624932 - DNA, 20 bp, Artificial
  CRISPR gRNA sequence
gtctacataataacaaaaac

SEQ ID NO: 624933 - DNA, 20 bp, Artificial
  CRISPR gRNA sequence
tgttcctatatcatttttac

SEQ ID NO: 624934 - DNA, 20 bp, Artificial
  CRISPR gRNA sequence
ctctttagccccacactatg

SEQ ID NO: 624935 - DNA, 20 bp, Artificial
  CRISPR gRNA sequence
taaaattgtattttacaaga

SEQ ID NO: 624936 - DNA, 20 bp, Artificial
  CRISPR gRNA sequence
taataaatcacctccagatt

SEQ ID NO: 624937 - DNA, 20 bp, Artificial
  CRISPR gRNA sequence
aaatcacctccagattacag

SEQ ID NO: 624938 - DNA, 20 bp, Artificial
  CRISPR gRNA sequence
taaatgatggtaaaaaggag

SEQ ID NO: 624939 - DNA, 20 bp, Artificial
  CRISPR gRNA sequence
agttttaaataaaatttttc

SEQ ID NO: 624940 - DNA, 20 bp, Artificial
  CRISPR gRNA sequence
catatggtacaagggaacac

SEQ ID NO: 624941 - DNA, 20 bp, Artificial
  CRISPR gRNA sequence
gtacaagggaacacaaagaa

SEQ ID NO: 624942 - DNA, 20 bp, Artificial
  CRISPR gRNA sequence
aaagaaaaagaaatttgatt

SEQ ID NO: 624943 - DNA, 20 bp, Artificial
  CRISPR gRNA sequence
cagtgaataggaactacaca

SEQ ID NO: 624944 - DNA, 20 bp, Artificial
  CRISPR gRNA sequence
aacctcttcccaaatctgca

SEQ ID NO: 624945 - DNA, 20 bp, Artificial
  CRISPR gRNA sequence
actaagatactattttccaa

SEQ ID NO: 624946 - DNA, 20 bp, Artificial
  CRISPR gRNA sequence
tctttaagtcctatctatca

SEQ ID NO: 624947 - DNA, 20 bp, Artificial
  CRISPR gRNA sequence
atatgtcaacattcttttct

SEQ ID NO: 624948 - DNA, 20 bp, Artificial
  CRISPR gRNA sequence
ttccacccaattaactaact

SEQ ID NO: 624949 - DNA, 20 bp, Artificial
  CRISPR gRNA sequence
tccaaaatatcctaggaact

SEQ ID NO: 624950 - DNA, 20 bp, Artificial
  CRISPR gRNA sequence
taagtataatataaaagcaa

SEQ ID NO: 624951 - DNA, 20 bp, Artificial
  CRISPR gRNA sequence
aggcaaaacaaatgtatttc

SEQ ID NO: 624952 - DNA, 20 bp, Artificial
  CRISPR gRNA sequence
ctagaatgcaagtggtaact

SEQ ID NO: 624953 - DNA, 20 bp, Artificial
  CRISPR gRNA sequence
aggtttctaaaatagagggt

SEQ ID NO: 624954 - DNA, 20 bp, Artificial
  CRISPR gRNA sequence
tttgctttatagacacacac

SEQ ID NO: 624955 - DNA, 20 bp, Artificial
  CRISPR gRNA sequence
cagatactattaagtataat

SEQ ID NO: 624956 - DNA, 20 bp, Artificial
  CRISPR gRNA sequence
aaataaaacaggataatgtc

SEQ ID NO: 624957 - DNA, 20 bp, Artificial
  CRISPR gRNA sequence
aggcgacagttaaatggaaa

SEQ ID NO: 624958 - DNA, 20 bp, Artificial
  CRISPR gRNA sequence
aggctttcatgcaaaacaag

SEQ ID NO: 624959 - DNA, 20 bp, Artificial
  CRISPR gRNA sequence
aagaaaacgtgtcccaaacc

SEQ ID NO: 624960 - DNA, 20 bp, Artificial
  CRISPR gRNA sequence
cgaacttgccatgtcccgga

SEQ ID NO: 624961 - DNA, 20 bp, Artificial
  CRISPR gRNA sequence
taaaagttcagtgaacaggg

SEQ ID NO: 624962 - DNA, 20 bp, Artificial
  CRISPR gRNA sequence
gttatgatctgatttgggtt

SEQ ID NO: 624963 - DNA, 20 bp, Artificial
  CRISPR gRNA sequence
gaaaacaaactacagagaag

SEQ ID NO: 624964 - DNA, 20 bp, Artificial
  CRISPR gRNA sequence
agttacagtagcgggcctgg

SEQ ID NO: 624965 - DNA, 20 bp, Artificial
  CRISPR gRNA sequence
atgtgggatttcctttgagg

SEQ ID NO: 624966 - DNA, 20 bp, Artificial
  CRISPR gRNA sequence
tgaaagcatctacagtatct

SEQ ID NO: 624967 - DNA, 20 bp, Artificial
  CRISPR gRNA sequence
cagtatctaaagaaataaac

SEQ ID NO: 624968 - DNA, 20 bp, Artificial
  CRISPR gRNA sequence
ttatcccaatagccagtaat

SEQ ID NO: 624969 - DNA, 20 bp, Artificial
  CRISPR gRNA sequence
aataaaaacacttggtaaaa

SEQ ID NO: 624970 - DNA, 20 bp, Artificial
  CRISPR gRNA sequence
cacttggtaaaaacagaaac

SEQ ID NO: 624971 - DNA, 20 bp, Artificial
  CRISPR gRNA sequence
tcaaaggaaaaaaatgtcaa

SEQ ID NO: 624972 - DNA, 20 bp, Artificial
  CRISPR gRNA sequence
caaaatttttttgtaacgtt

SEQ ID NO: 624973 - DNA, 20 bp, Artificial
  CRISPR gRNA sequence
atctgttacaatgtaaacaa

SEQ ID NO: 624974 - DNA, 20 bp, Artificial
  CRISPR gRNA sequence
atttaagcaaatatttctag

SEQ ID NO: 624975 - DNA, 20 bp, Artificial
  CRISPR gRNA sequence
gataattatcacaactcctc

SEQ ID NO: 624976 - DNA, 20 bp, Artificial
  CRISPR gRNA sequence
aaagtttattaaaaacaaca

SEQ ID NO: 624977 - DNA, 20 bp, Artificial
  CRISPR gRNA sequence
aaagatttggatcataaaga

SEQ ID NO: 624978 - DNA, 20 bp, Artificial
  CRISPR gRNA sequence
agtattgtttgaatgagtgt

SEQ ID NO: 624979 - DNA, 20 bp, Artificial
  CRISPR gRNA sequence
caaaggagataagatgtact

SEQ ID NO: 624980 - DNA, 20 bp, Artificial
  CRISPR gRNA sequence
tctccttgattctacacaag

SEQ ID NO: 624981 - DNA, 20 bp, Artificial
  CRISPR gRNA sequence
ggggtatgtatatgtggttc

SEQ ID NO: 624982 - DNA, 20 bp, Artificial
  CRISPR gRNA sequence
cagtaattgatttgaataca

SEQ ID NO: 624983 - DNA, 20 bp, Artificial
  CRISPR gRNA sequence
agcactcaaacagatgaaaa

SEQ ID NO: 624984 - DNA, 20 bp, Artificial
  CRISPR gRNA sequence
tctttatataccacagaggg

SEQ ID NO: 624985 - DNA, 20 bp, Artificial
  CRISPR gRNA sequence
taaataacagagtatgatct

SEQ ID NO: 624986 - DNA, 20 bp, Artificial
  CRISPR gRNA sequence
ccaagagggggaaaaaaagc

SEQ ID NO: 624987 - DNA, 20 bp, Artificial
  CRISPR gRNA sequence
gctttaattggctaattgtt

SEQ ID NO: 624988 - DNA, 20 bp, Artificial
  CRISPR gRNA sequence
gcttattcatttagcttcta

SEQ ID NO: 624989 - DNA, 20 bp, Artificial
  CRISPR gRNA sequence
ctctttatttatttttttgt

SEQ ID NO: 624990 - DNA, 20 bp, Artificial
  CRISPR gRNA sequence
ttatttatttttttgtgaag

SEQ ID NO: 624991 - DNA, 20 bp, Artificial
  CRISPR gRNA sequence
ctacctccattagcaacata

SEQ ID NO: 624992 - DNA, 20 bp, Artificial
  CRISPR gRNA sequence
acttgtttgttacatgcaag

SEQ ID NO: 624993 - DNA, 20 bp, Artificial
  CRISPR gRNA sequence
ctactcaggaggctgaggcg

SEQ ID NO: 624994 - DNA, 20 bp, Artificial
  CRISPR gRNA sequence
catctcaggaaaggaaaagg

SEQ ID NO: 624995 - DNA, 20 bp, Artificial
  CRISPR gRNA sequence
gaaaaaggaaaaaaggaaag

SEQ ID NO: 624996 - DNA, 20 bp, Artificial
  CRISPR gRNA sequence
aggaaaaaaggaaaggaaga

SEQ ID NO: 624997 - DNA, 20 bp, Artificial
  CRISPR gRNA sequence
aggaaaggaagaaaagaaag

SEQ ID NO: 624998 - DNA, 20 bp, Artificial
  CRISPR gRNA sequence
gaagaaaagaaagagagaaa

SEQ ID NO: 624999 - DNA, 20 bp, Artificial
  CRISPR gRNA sequence
agaaagaagaaaggaaaagg

SEQ ID NO: 625000 - DNA, 20 bp, Artificial
  CRISPR gRNA sequence
gaagacaagacaagagatga

SEQ ID NO: 625001 - DNA, 20 bp, Artificial
  CRISPR gRNA sequence
caagacaagagatgaaaaga

SEQ ID NO: 625002 - DNA, 20 bp, Artificial
  CRISPR gRNA sequence
caagagatgaaaagaaaaga

SEQ ID NO: 625003 - DNA, 20 bp, Artificial
  CRISPR gRNA sequence
ctactcaggaggctgaggca

SEQ ID NO: 625004 - DNA, 20 bp, Artificial
  CRISPR gRNA sequence
ctccgtttcaaaaaaaaaaa

SEQ ID NO: 625005 - DNA, 20 bp, Artificial
  CRISPR gRNA sequence
gtttcaaaaaaaaaaaaaag

SEQ ID NO: 625006 - DNA, 20 bp, Artificial
  CRISPR gRNA sequence
caaaaaaaaaaaaaagaaag

SEQ ID NO: 625007 - DNA, 20 bp, Artificial
  CRISPR gRNA sequence
aaaaaaaagaaagaaagaaa

SEQ ID NO: 625008 - DNA, 20 bp, Artificial
  CRISPR gRNA sequence
aaagaaagaaagaaaaaaga

SEQ ID NO: 625009 - DNA, 20 bp, Artificial
  CRISPR gRNA sequence
ctactcgggagactgaggca

SEQ ID NO: 625010 - DNA, 20 bp, Artificial
  CRISPR gRNA sequence
tcaaaaaaaaaaaaaaaaaa

SEQ ID NO: 625011 - DNA, 20 bp, Artificial
  CRISPR gRNA sequence
aaaaaaaaaaaaaaaaagaa

SEQ ID NO: 625012 - DNA, 20 bp, Artificial
  CRISPR gRNA sequence
aaaaaaaaaaagaaaaagaa

SEQ ID NO: 625013 - DNA, 20 bp, Artificial
  CRISPR gRNA sequence
aaaaaagaaaaagaaaaaga

SEQ ID NO: 625014 - DNA, 20 bp, Artificial
  CRISPR gRNA sequence
aaaaagaaaaagaaaagaaa

SEQ ID NO: 625015 - DNA, 20 bp, Artificial
  CRISPR gRNA sequence
agaaaaagaaaagaaaaaag

SEQ ID NO: 625016 - DNA, 20 bp, Artificial
  CRISPR gRNA sequence
aaaagaaaaaagaaagaata

SEQ ID NO: 625017 - DNA, 20 bp, Artificial
  CRISPR gRNA sequence
aaaaagaaagaataaaagaa

SEQ ID NO: 625018 - DNA, 20 bp, Artificial
  CRISPR gRNA sequence
ttattttttgtaagagactt

SEQ ID NO: 625019 - DNA, 20 bp, Artificial
  CRISPR gRNA sequence
cttaaagaatgtagaactat

SEQ ID NO: 625020 - DNA, 20 bp, Artificial
  CRISPR gRNA sequence
aacttaaaaacagcagactc

SEQ ID NO: 625021 - DNA, 20 bp, Artificial
  CRISPR gRNA sequence
gatctgagcaagcatttcta

SEQ ID NO: 625022 - DNA, 20 bp, Artificial
  CRISPR gRNA sequence
catcctcagccctaaaaact

SEQ ID NO: 625023 - DNA, 20 bp, Artificial
  CRISPR gRNA sequence
tatttatgaaaatggccatg

SEQ ID NO: 625024 - DNA, 20 bp, Artificial
  CRISPR gRNA sequence
aaatgttttatatacttgta

SEQ ID NO: 625025 - DNA, 20 bp, Artificial
  CRISPR gRNA sequence
tatgcctatttagaactcaa

SEQ ID NO: 625026 - DNA, 20 bp, Artificial
  CRISPR gRNA sequence
aacgtcaaaagtgtagacac

SEQ ID NO: 625027 - DNA, 20 bp, Artificial
  CRISPR gRNA sequence
atcaaaatatctggagtgca

SEQ ID NO: 625028 - DNA, 20 bp, Artificial
  CRISPR gRNA sequence
attccactgaacatggttgt

SEQ ID NO: 625029 - DNA, 20 bp, Artificial
  CRISPR gRNA sequence
ctgaacatggttgtatagaa

SEQ ID NO: 625030 - DNA, 20 bp, Artificial
  CRISPR gRNA sequence
tcagaaaacataagaactgt

SEQ ID NO: 625031 - DNA, 20 bp, Artificial
  CRISPR gRNA sequence
aaaataacacatccccaaac

SEQ ID NO: 625032 - DNA, 20 bp, Artificial
  CRISPR gRNA sequence
ttttggattatttcaacaac

SEQ ID NO: 625033 - DNA, 20 bp, Artificial
  CRISPR gRNA sequence
tcaacattttacaaattaaa

SEQ ID NO: 625034 - DNA, 20 bp, Artificial
  CRISPR gRNA sequence
gcagaaatataaatcacact

SEQ ID NO: 625035 - DNA, 20 bp, Artificial
  CRISPR gRNA sequence
gaaaatgaatggatctcagg

SEQ ID NO: 625036 - DNA, 20 bp, Artificial
  CRISPR gRNA sequence
cttgaagataccatccttct

SEQ ID NO: 625037 - DNA, 20 bp, Artificial
  CRISPR gRNA sequence
ggaattctgtaataaatatt

SEQ ID NO: 625038 - DNA, 20 bp, Artificial
  CRISPR gRNA sequence
tatttataaggaaacaggtt

SEQ ID NO: 625039 - DNA, 20 bp, Artificial
  CRISPR gRNA sequence
tacagaataaagacagatca

SEQ ID NO: 625040 - DNA, 20 bp, Artificial
  CRISPR gRNA sequence
ctgtgcacataaaactcaat

SEQ ID NO: 625041 - DNA, 20 bp, Artificial
  CRISPR gRNA sequence
taaggccactgatcaaatac

SEQ ID NO: 625042 - DNA, 20 bp, Artificial
  CRISPR gRNA sequence
ctactgttaaagtaatatgg

SEQ ID NO: 625043 - DNA, 20 bp, Artificial
  CRISPR gRNA sequence
taccctgtgggtgcttcaaa

SEQ ID NO: 625044 - DNA, 20 bp, Artificial
  CRISPR gRNA sequence
ctagactccaactttatagt

SEQ ID NO: 625045 - DNA, 20 bp, Artificial
  CRISPR gRNA sequence
taccaatctgcttgtatttc

SEQ ID NO: 625046 - DNA, 20 bp, Artificial
  CRISPR gRNA sequence
atatttattgaattgatcaa

SEQ ID NO: 625047 - DNA, 20 bp, Artificial
  CRISPR gRNA sequence
ttttattaggtatcatcaag

SEQ ID NO: 625048 - DNA, 20 bp, Artificial
  CRISPR gRNA sequence
gattttagatgaggactctc

SEQ ID NO: 625049 - DNA, 20 bp, Artificial
  CRISPR gRNA sequence
tcaatttttaccctaaatta

SEQ ID NO: 625050 - DNA, 20 bp, Artificial
  CRISPR gRNA sequence
tccctggacctgtgcaatat

SEQ ID NO: 625051 - DNA, 20 bp, Artificial
  CRISPR gRNA sequence
agtaattacatgcctacctc

SEQ ID NO: 625052 - DNA, 20 bp, Artificial
  CRISPR gRNA sequence
agataagaagggaaaaaagt

SEQ ID NO: 625053 - DNA, 20 bp, Artificial
  CRISPR gRNA sequence
ttgggagcggaatgaggtgc

SEQ ID NO: 625054 - DNA, 20 bp, Artificial
  CRISPR gRNA sequence
catttatctctgatacctgt

SEQ ID NO: 625055 - DNA, 20 bp, Artificial
  CRISPR gRNA sequence
gttatattagggtgtgtcct

SEQ ID NO: 625056 - DNA, 20 bp, Artificial
  CRISPR gRNA sequence
gactgccaaactaagctaca

SEQ ID NO: 625057 - DNA, 20 bp, Artificial
  CRISPR gRNA sequence
actaagctacagaagaaaac

SEQ ID NO: 625058 - DNA, 20 bp, Artificial
  CRISPR gRNA sequence
tcaatttccacatatgaaaa

SEQ ID NO: 625059 - DNA, 20 bp, Artificial
  CRISPR gRNA sequence
ttctaaaaatggaaactagc

SEQ ID NO: 625060 - DNA, 20 bp, Artificial
  CRISPR gRNA sequence
attaatgtgaagtactctga

SEQ ID NO: 625061 - DNA, 20 bp, Artificial
  CRISPR gRNA sequence
cacttaacagctttaaagta

SEQ ID NO: 625062 - DNA, 20 bp, Artificial
  CRISPR gRNA sequence
aaacattataaaaaaataga

SEQ ID NO: 625063 - DNA, 20 bp, Artificial
  CRISPR gRNA sequence
accaatactgaacaactatg

SEQ ID NO: 625064 - DNA, 20 bp, Artificial
  CRISPR gRNA sequence
agaattggaaatgagctaac

SEQ ID NO: 625065 - DNA, 20 bp, Artificial
  CRISPR gRNA sequence
acaaagacatcctcattcca

SEQ ID NO: 625066 - DNA, 20 bp, Artificial
  CRISPR gRNA sequence
agaaaaagtttaaagttctc

SEQ ID NO: 625067 - DNA, 20 bp, Artificial
  CRISPR gRNA sequence
aatagctggcagcaagttgc

SEQ ID NO: 625068 - DNA, 20 bp, Artificial
  CRISPR gRNA sequence
ccttattgatacttttctgg

SEQ ID NO: 625069 - DNA, 20 bp, Artificial
  CRISPR gRNA sequence
ccatcctctccttcctgcta

SEQ ID NO: 625070 - DNA, 20 bp, Artificial
  CRISPR gRNA sequence
atttgaagatattaaaaaat

SEQ ID NO: 625071 - DNA, 20 bp, Artificial
  CRISPR gRNA sequence
acaaaaaattattccaagtc

SEQ ID NO: 625072 - DNA, 20 bp, Artificial
  CRISPR gRNA sequence
ataagtttactgttgttggg

SEQ ID NO: 625073 - DNA, 20 bp, Artificial
  CRISPR gRNA sequence
tgaagcaagtacttgcaaaa

SEQ ID NO: 625074 - DNA, 20 bp, Artificial
  CRISPR gRNA sequence
ttgcaaaaccagaatcaaat

SEQ ID NO: 625075 - DNA, 20 bp, Artificial
  CRISPR gRNA sequence
ctaaagccaatagctaacta

SEQ ID NO: 625076 - DNA, 20 bp, Artificial
  CRISPR gRNA sequence
aggaaattgtgtgagttatc

SEQ ID NO: 625077 - DNA, 20 bp, Artificial
  CRISPR gRNA sequence
taggaagtgctcattactta

SEQ ID NO: 625078 - DNA, 20 bp, Artificial
  CRISPR gRNA sequence
tcgagagctgttagaagtaa

SEQ ID NO: 625079 - DNA, 20 bp, Artificial
  CRISPR gRNA sequence
aagttgctctctctggatag

SEQ ID NO: 625080 - DNA, 20 bp, Artificial
  CRISPR gRNA sequence
cttcggggggggggaaggaa

SEQ ID NO: 625081 - DNA, 20 bp, Artificial
  CRISPR gRNA sequence
ttccttcacatattgccaaa

SEQ ID NO: 625082 - DNA, 20 bp, Artificial
  CRISPR gRNA sequence
aatgtcctttctataacatg

SEQ ID NO: 625083 - DNA, 20 bp, Artificial
  CRISPR gRNA sequence
aaaatataaatctaaagtat

SEQ ID NO: 625084 - DNA, 20 bp, Artificial
  CRISPR gRNA sequence
aactgataaaatattataat

SEQ ID NO: 625085 - DNA, 20 bp, Artificial
  CRISPR gRNA sequence
aaaagcctttcaactttgct

SEQ ID NO: 625086 - DNA, 20 bp, Artificial
  CRISPR gRNA sequence
ttcacttccaatgctttgga

SEQ ID NO: 625087 - DNA, 20 bp, Artificial
  CRISPR gRNA sequence
caggctcatgttttataata

SEQ ID NO: 625088 - DNA, 20 bp, Artificial
  CRISPR gRNA sequence
taaggtaatacatttttccc

SEQ ID NO: 625089 - DNA, 20 bp, Artificial
  CRISPR gRNA sequence
aaactataaggaaatatcat

SEQ ID NO: 625090 - DNA, 20 bp, Artificial
  CRISPR gRNA sequence
tctaaagtatctttcagttg

SEQ ID NO: 625091 - DNA, 20 bp, Artificial
  CRISPR gRNA sequence
ctaatttaattgttaagcac

SEQ ID NO: 625092 - DNA, 20 bp, Artificial
  CRISPR gRNA sequence
gatggaaaagacaggtagct

SEQ ID NO: 625093 - DNA, 20 bp, Artificial
  CRISPR gRNA sequence
aaaggtgaaattgtgaacag

SEQ ID NO: 625094 - DNA, 20 bp, Artificial
  CRISPR gRNA sequence
gaacagagagaaaaaagagt

SEQ ID NO: 625095 - DNA, 20 bp, Artificial
  CRISPR gRNA sequence
gttgctgctgccacctgtgc

SEQ ID NO: 625096 - DNA, 20 bp, Artificial
  CRISPR gRNA sequence
taatcaaaatttattgggtt

SEQ ID NO: 625097 - DNA, 20 bp, Artificial
  CRISPR gRNA sequence
agggggaggacaaacaaaca

SEQ ID NO: 625098 - DNA, 20 bp, Artificial
  CRISPR gRNA sequence
ataaactttggttgtgctag

SEQ ID NO: 625099 - DNA, 20 bp, Artificial
  CRISPR gRNA sequence
cacacaacagaacataattc

SEQ ID NO: 625100 - DNA, 20 bp, Artificial
  CRISPR gRNA sequence
attctgtggggaaaaaagtt

SEQ ID NO: 625101 - DNA, 20 bp, Artificial
  CRISPR gRNA sequence
ttatgattacataaggcttt

SEQ ID NO: 625102 - DNA, 20 bp, Artificial
  CRISPR gRNA sequence
atttaacacacacatattaa

SEQ ID NO: 625103 - DNA, 20 bp, Artificial
  CRISPR gRNA sequence
aacacacacatattaaaaag

SEQ ID NO: 625104 - DNA, 20 bp, Artificial
  CRISPR gRNA sequence
tcagagaaggaaagaaggaa

SEQ ID NO: 625105 - DNA, 20 bp, Artificial
  CRISPR gRNA sequence
gaaagaaggaaaaagaaaaa

SEQ ID NO: 625106 - DNA, 20 bp, Artificial
  CRISPR gRNA sequence
aggaaaaagaaaaaggagaa

SEQ ID NO: 625107 - DNA, 20 bp, Artificial
  CRISPR gRNA sequence
agaaacgaaatgtacataca

SEQ ID NO: 625108 - DNA, 20 bp, Artificial
  CRISPR gRNA sequence
cgggctgaagataaacggag

SEQ ID NO: 625109 - DNA, 20 bp, Artificial
  CRISPR gRNA sequence
ctgaagataaacggagggag

SEQ ID NO: 625110 - DNA, 20 bp, Artificial
  CRISPR gRNA sequence
gatcggctgataaacaaaac

SEQ ID NO: 625111 - DNA, 20 bp, Artificial
  CRISPR gRNA sequence
ctatagcaatgcgattaaca

SEQ ID NO: 625112 - DNA, 20 bp, Artificial
  CRISPR gRNA sequence
aacttgatccaccggttcct

SEQ ID NO: 625113 - DNA, 20 bp, Artificial
  CRISPR gRNA sequence
gaatcgaccaaaagctaaga

SEQ ID NO: 625114 - DNA, 20 bp, Artificial
  CRISPR gRNA sequence
aagctaagacaagaaaactg

SEQ ID NO: 625115 - DNA, 20 bp, Artificial
  CRISPR gRNA sequence
tgtttttggcccttggcaaa

SEQ ID NO: 625116 - DNA, 20 bp, Artificial
  CRISPR gRNA sequence
ctgattaatcgattaacatc

SEQ ID NO: 625117 - DNA, 20 bp, Artificial
  CRISPR gRNA sequence
aaccacaatccatccctccc

SEQ ID NO: 625118 - DNA, 20 bp, Artificial
  CRISPR gRNA sequence
cgggacagctggtcaaaccc

SEQ ID NO: 625119 - DNA, 20 bp, Artificial
  CRISPR gRNA sequence
aggggtcctggggaatagac

SEQ ID NO: 625120 - DNA, 20 bp, Artificial
  CRISPR gRNA sequence
agaacttaagtgaaccgtca

SEQ ID NO: 625121 - DNA, 20 bp, Artificial
  CRISPR gRNA sequence
ggactgccaaacggtgttcc

SEQ ID NO: 625122 - DNA, 20 bp, Artificial
  CRISPR gRNA sequence
gaaaccatatcacagattgt

SEQ ID NO: 625123 - DNA, 20 bp, Artificial
  CRISPR gRNA sequence
caccgtactcttactccttt

SEQ ID NO: 625124 - DNA, 20 bp, Artificial
  CRISPR gRNA sequence
tcttactcctttgaagaatc

SEQ ID NO: 625125 - DNA, 20 bp, Artificial
  CRISPR gRNA sequence
ttgaggttttttttttctgc

SEQ ID NO: 625126 - DNA, 20 bp, Artificial
  CRISPR gRNA sequence
tagtctctttttgtttaact

SEQ ID NO: 625127 - DNA, 20 bp, Artificial
  CRISPR gRNA sequence
gattaacaaattttcgttgg

SEQ ID NO: 625128 - DNA, 20 bp, Artificial
  CRISPR gRNA sequence
caataacattatgatgattt

SEQ ID NO: 625129 - DNA, 20 bp, Artificial
  CRISPR gRNA sequence
ccctgaatggatcccagatt

SEQ ID NO: 625130 - DNA, 20 bp, Artificial
  CRISPR gRNA sequence
aaagatctcatgaccacctg

SEQ ID NO: 625131 - DNA, 20 bp, Artificial
  CRISPR gRNA sequence
atggtgtatctaactcatcc

SEQ ID NO: 625132 - DNA, 20 bp, Artificial
  CRISPR gRNA sequence
taaactgtaattcactttgt

SEQ ID NO: 625133 - DNA, 20 bp, Artificial
  CRISPR gRNA sequence
ctactcagaaggctgaggca

SEQ ID NO: 625134 - DNA, 20 bp, Artificial
  CRISPR gRNA sequence
acaaacaaacaaaactaccc

SEQ ID NO: 625135 - DNA, 20 bp, Artificial
  CRISPR gRNA sequence
gatacaccataacctgcaaa

SEQ ID NO: 625136 - DNA, 20 bp, Artificial
  CRISPR gRNA sequence
attcagggggaggcagggtg

SEQ ID NO: 625137 - DNA, 20 bp, Artificial
  CRISPR gRNA sequence
tgaagccttagccactagag

SEQ ID NO: 625138 - DNA, 20 bp, Artificial
  CRISPR gRNA sequence
ccttccctatatcaaaatgt

SEQ ID NO: 625139 - DNA, 20 bp, Artificial
  CRISPR gRNA sequence
caatatatctttttttctca

SEQ ID NO: 625140 - DNA, 20 bp, Artificial
  CRISPR gRNA sequence
gatactaaatgctactattt

SEQ ID NO: 625141 - DNA, 20 bp, Artificial
  CRISPR gRNA sequence
ctaaatgctactatttgtag

SEQ ID NO: 625142 - DNA, 20 bp, Artificial
  CRISPR gRNA sequence
gacgtggcacatgccccggg

SEQ ID NO: 625143 - DNA, 20 bp, Artificial
  CRISPR gRNA sequence
tccccaccaatcccagtttg

SEQ ID NO: 625144 - DNA, 20 bp, Artificial
  CRISPR gRNA sequence
ccgctccaagcctccagccg

SEQ ID NO: 625145 - DNA, 20 bp, Artificial
  CRISPR gRNA sequence
aaacacacgttaggcacagg

SEQ ID NO: 625146 - DNA, 20 bp, Artificial
  CRISPR gRNA sequence
acacgttaggcacaggaaag

SEQ ID NO: 625147 - DNA, 20 bp, Artificial
  CRISPR gRNA sequence
tgttttaacttgaattccaa

SEQ ID NO: 625148 - DNA, 20 bp, Artificial
  CRISPR gRNA sequence
agctcatttgtaaaatatcc

SEQ ID NO: 625149 - DNA, 20 bp, Artificial
  CRISPR gRNA sequence
ccttatgtaatcataattta

SEQ ID NO: 625150 - DNA, 20 bp, Artificial
  CRISPR gRNA sequence
atttgatctgattattccat

SEQ ID NO: 625151 - DNA, 20 bp, Artificial
  CRISPR gRNA sequence
gatctgattattccataaag

SEQ ID NO: 625152 - DNA, 20 bp, Artificial
  CRISPR gRNA sequence
cctgttttccagtaagtaat

SEQ ID NO: 625153 - DNA, 20 bp, Artificial
  CRISPR gRNA sequence
aaatatacttggcgatcaat

SEQ ID NO: 625154 - DNA, 20 bp, Artificial
  CRISPR gRNA sequence
attcttaaacttttttcccc

SEQ ID NO: 625155 - DNA, 20 bp, Artificial
  CRISPR gRNA sequence
atacagtttacttttgtttc

SEQ ID NO: 625156 - DNA, 20 bp, Artificial
  CRISPR gRNA sequence
tgttgtgtggcgtttgtgca

SEQ ID NO: 625157 - DNA, 20 bp, Artificial
  CRISPR gRNA sequence
cagggagttggccaactgct

SEQ ID NO: 625158 - DNA, 20 bp, Artificial
  CRISPR gRNA sequence
cagcaggaatcagatcattt

SEQ ID NO: 625159 - DNA, 20 bp, Artificial
  CRISPR gRNA sequence
gcttggagcttcaaataagt

SEQ ID NO: 625160 - DNA, 20 bp, Artificial
  CRISPR gRNA sequence
cctggattatgaaactttat

SEQ ID NO: 625161 - DNA, 20 bp, Artificial
  CRISPR gRNA sequence
atttcacctttgaatgagtt

SEQ ID NO: 625162 - DNA, 20 bp, Artificial
  CRISPR gRNA sequence
aagtgaaataagaaggaaat

SEQ ID NO: 625163 - DNA, 20 bp, Artificial
  CRISPR gRNA sequence
taatttactttgttgtaagt

SEQ ID NO: 625164 - DNA, 20 bp, Artificial
  CRISPR gRNA sequence
tttcagacatattatgtgaa

SEQ ID NO: 625165 - DNA, 20 bp, Artificial
  CRISPR gRNA sequence
aacaattaaattagatgtta

SEQ ID NO: 625166 - DNA, 20 bp, Artificial
  CRISPR gRNA sequence
tctttcaactgaaagatact

SEQ ID NO: 625167 - DNA, 20 bp, Artificial
  CRISPR gRNA sequence
tacatcttatgtgacaatga

SEQ ID NO: 625168 - DNA, 20 bp, Artificial
  CRISPR gRNA sequence
ctactgttatagattttgct

SEQ ID NO: 625169 - DNA, 20 bp, Artificial
  CRISPR gRNA sequence
tggtgcttacctgtatcagg

SEQ ID NO: 625170 - DNA, 20 bp, Artificial
  CRISPR gRNA sequence
cctgtatcaggtaagaaagg

SEQ ID NO: 625171 - DNA, 20 bp, Artificial
  CRISPR gRNA sequence
aataattttatgttgccttg

SEQ ID NO: 625172 - DNA, 20 bp, Artificial
  CRISPR gRNA sequence
cagaagacaaaatactttat

SEQ ID NO: 625173 - DNA, 20 bp, Artificial
  CRISPR gRNA sequence
atattttattcttacatgtt

SEQ ID NO: 625174 - DNA, 20 bp, Artificial
  CRISPR gRNA sequence
ccccccgaagatttaataac

SEQ ID NO: 625175 - DNA, 20 bp, Artificial
  CRISPR gRNA sequence
ctgaaatttaagcaatttat

SEQ ID NO: 625176 - DNA, 20 bp, Artificial
  CRISPR gRNA sequence
tttaagtaatgagcacttcc

SEQ ID NO: 625177 - DNA, 20 bp, Artificial
  CRISPR gRNA sequence
ccttacaattcccgtatcat

SEQ ID NO: 625178 - DNA, 20 bp, Artificial
  CRISPR gRNA sequence
acaattcccgtatcatttag

SEQ ID NO: 625179 - DNA, 20 bp, Artificial
  CRISPR gRNA sequence
ctatgactacaatttaggca

SEQ ID NO: 625180 - DNA, 20 bp, Artificial
  CRISPR gRNA sequence
ctattagttagctattggct

SEQ ID NO: 625181 - DNA, 20 bp, Artificial
  CRISPR gRNA sequence
tggttttgcaagtacttgct

SEQ ID NO: 625182 - DNA, 20 bp, Artificial
  CRISPR gRNA sequence
tttcctctctgttagatcta

SEQ ID NO: 625183 - DNA, 20 bp, Artificial
  CRISPR gRNA sequence
tattaattagaacaagagac

SEQ ID NO: 625184 - DNA, 20 bp, Artificial
  CRISPR gRNA sequence
gagggtgcctgcttccaaaa

SEQ ID NO: 625185 - DNA, 20 bp, Artificial
  CRISPR gRNA sequence
taaaacagctaacattctgg

SEQ ID NO: 625186 - DNA, 20 bp, Artificial
  CRISPR gRNA sequence
gctatcattatttgacagtg

SEQ ID NO: 625187 - DNA, 20 bp, Artificial
  CRISPR gRNA sequence
gtgttaagtgatttttaaaa

SEQ ID NO: 625188 - DNA, 20 bp, Artificial
  CRISPR gRNA sequence
taaaaatagaatctgggact

SEQ ID NO: 625189 - DNA, 20 bp, Artificial
  CRISPR gRNA sequence
atatgtggaaattgaggctt

SEQ ID NO: 625190 - DNA, 20 bp, Artificial
  CRISPR gRNA sequence
tttacctcttagagaactta

SEQ ID NO: 625191 - DNA, 20 bp, Artificial
  CRISPR gRNA sequence
atatttttgtgacaaatatc

SEQ ID NO: 625192 - DNA, 20 bp, Artificial
  CRISPR gRNA sequence
tataacaccagatgggcttg

SEQ ID NO: 625193 - DNA, 20 bp, Artificial
  CRISPR gRNA sequence
tgtcataactatgtaccaaa

SEQ ID NO: 625194 - DNA, 20 bp, Artificial
  CRISPR gRNA sequence
ctttttagtctgcttagtac

SEQ ID NO: 625195 - DNA, 20 bp, Artificial
  CRISPR gRNA sequence
aaaaaacaaaacaacgtatg

SEQ ID NO: 625196 - DNA, 20 bp, Artificial
  CRISPR gRNA sequence
agttccagtcctaaaatgag

SEQ ID NO: 625197 - DNA, 20 bp, Artificial
  CRISPR gRNA sequence
tgcaattatgctggcctggg

SEQ ID NO: 625198 - DNA, 20 bp, Artificial
  CRISPR gRNA sequence
gagctccagtttccttatcc

SEQ ID NO: 625199 - DNA, 20 bp, Artificial
  CRISPR gRNA sequence
ttttatggacctatgacttg

SEQ ID NO: 625200 - DNA, 20 bp, Artificial
  CRISPR gRNA sequence
gtatattgcacaggtccagg

SEQ ID NO: 625201 - DNA, 20 bp, Artificial
  CRISPR gRNA sequence
gcatctatgaagattttggt

SEQ ID NO: 625202 - DNA, 20 bp, Artificial
  CRISPR gRNA sequence
ctatgaagattttggttaag

SEQ ID NO: 625203 - DNA, 20 bp, Artificial
  CRISPR gRNA sequence
aaatagagtttgtctatatg

SEQ ID NO: 625204 - DNA, 20 bp, Artificial
  CRISPR gRNA sequence
accagtcattacaaataaca

SEQ ID NO: 625205 - DNA, 20 bp, Artificial
  CRISPR gRNA sequence
atagagtaacctattcctac

SEQ ID NO: 625206 - DNA, 20 bp, Artificial
  CRISPR gRNA sequence
aatatatccacaataagagg

SEQ ID NO: 625207 - DNA, 20 bp, Artificial
  CRISPR gRNA sequence
aagtagacagtacttgggta

SEQ ID NO: 625208 - DNA, 20 bp, Artificial
  CRISPR gRNA sequence
ttattttaaaatgattttgt

SEQ ID NO: 625209 - DNA, 20 bp, Artificial
  CRISPR gRNA sequence
attattctgaaatatttatt

SEQ ID NO: 625210 - DNA, 20 bp, Artificial
  CRISPR gRNA sequence
cgctgactacccaagacacc

SEQ ID NO: 625211 - DNA, 20 bp, Artificial
  CRISPR gRNA sequence
attccaaatgaatgttaatg

SEQ ID NO: 625212 - DNA, 20 bp, Artificial
  CRISPR gRNA sequence
tacaaaactgatatttaaaa

SEQ ID NO: 625213 - DNA, 20 bp, Artificial
  CRISPR gRNA sequence
ataaattcgaacttccattc

SEQ ID NO: 625214 - DNA, 20 bp, Artificial
  CRISPR gRNA sequence
gtgggccacaccttgattat

SEQ ID NO: 625215 - DNA, 20 bp, Artificial
  CRISPR gRNA sequence
cctgtaaatatttgttgaat

SEQ ID NO: 625216 - DNA, 20 bp, Artificial
  CRISPR gRNA sequence
gttttcagttgaattaacag

SEQ ID NO: 625217 - DNA, 20 bp, Artificial
  CRISPR gRNA sequence
ttgtaaaaggtctatttcta

SEQ ID NO: 625218 - DNA, 20 bp, Artificial
  CRISPR gRNA sequence
agattgtgtctggacataac

SEQ ID NO: 625219 - DNA, 20 bp, Artificial
  CRISPR gRNA sequence
gacataactgagaattataa

SEQ ID NO: 625220 - DNA, 20 bp, Artificial
  CRISPR gRNA sequence
ttttttggaaataaaaacaa

SEQ ID NO: 625221 - DNA, 20 bp, Artificial
  CRISPR gRNA sequence
atatattatttgtgtaattt

SEQ ID NO: 625222 - DNA, 20 bp, Artificial
  CRISPR gRNA sequence
attcagtcaaccatcctcta

SEQ ID NO: 625223 - DNA, 20 bp, Artificial
  CRISPR gRNA sequence
ctctaaaagaaagtatggag

SEQ ID NO: 625224 - DNA, 20 bp, Artificial
  CRISPR gRNA sequence
cattgtggcatctgatggca

SEQ ID NO: 625225 - DNA, 20 bp, Artificial
  CRISPR gRNA sequence
tgatggcaaaagaaatctga

SEQ ID NO: 625226 - DNA, 20 bp, Artificial
  CRISPR gRNA sequence
ttttacattaaaactattaa

SEQ ID NO: 625227 - DNA, 20 bp, Artificial
  CRISPR gRNA sequence
aaaataacttaaggcctata

SEQ ID NO: 625228 - DNA, 20 bp, Artificial
  CRISPR gRNA sequence
tgtgaagtatagagagcata

SEQ ID NO: 625229 - DNA, 20 bp, Artificial
  CRISPR gRNA sequence
gcatagaagaaagctggcaa

SEQ ID NO: 625230 - DNA, 20 bp, Artificial
  CRISPR gRNA sequence
agaagaaagctggcaagaag

SEQ ID NO: 625231 - DNA, 20 bp, Artificial
  CRISPR gRNA sequence
gaaagctggcaagaagaaag

SEQ ID NO: 625232 - DNA, 20 bp, Artificial
  CRISPR gRNA sequence
cttcacaaaaaaataaataa

SEQ ID NO: 625233 - DNA, 20 bp, Artificial
  CRISPR gRNA sequence
aaaaaataaataaagagaaa

SEQ ID NO: 625234 - DNA, 20 bp, Artificial
  CRISPR gRNA sequence
tgaggaatgtggcaataaga

SEQ ID NO: 625235 - DNA, 20 bp, Artificial
  CRISPR gRNA sequence
tgaataagcatttagattcg

SEQ ID NO: 625236 - DNA, 20 bp, Artificial
  CRISPR gRNA sequence
ttagggagactgtaaggctg

SEQ ID NO: 625237 - DNA, 20 bp, Artificial
  CRISPR gRNA sequence
tttacatgtgtatcattgtt

SEQ ID NO: 625238 - DNA, 20 bp, Artificial
  CRISPR gRNA sequence
aaaacaaattttaagtctac

SEQ ID NO: 625239 - DNA, 20 bp, Artificial
  CRISPR gRNA sequence
aaaatgcttttacatctagc

SEQ ID NO: 625240 - DNA, 20 bp, Artificial
  CRISPR gRNA sequence
taaacatgtttttaaaaatt

SEQ ID NO: 625241 - DNA, 20 bp, Artificial
  CRISPR gRNA sequence
actggctcatggtaagttag

SEQ ID NO: 625242 - DNA, 20 bp, Artificial
  CRISPR gRNA sequence
cctattttattgttagataa

SEQ ID NO: 625243 - DNA, 20 bp, Artificial
  CRISPR gRNA sequence
attgttagataaaaagaata

SEQ ID NO: 625244 - DNA, 20 bp, Artificial
  CRISPR gRNA sequence
aagttgaattacataataac

SEQ ID NO: 625245 - DNA, 20 bp, Artificial
  CRISPR gRNA sequence
gtgctgtcaggtagacagac

SEQ ID NO: 625246 - DNA, 20 bp, Artificial
  CRISPR gRNA sequence
gactcagaatttttgtttga

SEQ ID NO: 625247 - DNA, 20 bp, Artificial
  CRISPR gRNA sequence
ttgtattcaaatcaattact

SEQ ID NO: 625248 - DNA, 20 bp, Artificial
  CRISPR gRNA sequence
gttctttttttctctcttgt

SEQ ID NO: 625249 - DNA, 20 bp, Artificial
  CRISPR gRNA sequence
tctctcttgtgtagaatcaa

SEQ ID NO: 625250 - DNA, 20 bp, Artificial
  CRISPR gRNA sequence
tgtgtagaatcaaggagaaa

SEQ ID NO: 625251 - DNA, 20 bp, Artificial
  CRISPR gRNA sequence
ctgcagcctgagggtagcag

SEQ ID NO: 625252 - DNA, 20 bp, Artificial
  CRISPR gRNA sequence
tcacagggcctaatacattt

SEQ ID NO: 625253 - DNA, 20 bp, Artificial
  CRISPR gRNA sequence
atacattttaagaaataatt

SEQ ID NO: 625254 - DNA, 20 bp, Artificial
  CRISPR gRNA sequence
tcttttcagccagtgtcact

SEQ ID NO: 625255 - DNA, 20 bp, Artificial
  CRISPR gRNA sequence
aaacactttaagggatacct

SEQ ID NO: 625256 - DNA, 20 bp, Artificial
  CRISPR gRNA sequence
agctaaatctcaaagatcat

SEQ ID NO: 625257 - DNA, 20 bp, Artificial
  CRISPR gRNA sequence
ccccctcagttgaattctta

SEQ ID NO: 625258 - DNA, 20 bp, Artificial
  CRISPR gRNA sequence
tgtaatcattcctatagctg

SEQ ID NO: 625259 - DNA, 20 bp, Artificial
  CRISPR gRNA sequence
ggcagtatatttaatagctt

SEQ ID NO: 625260 - DNA, 20 bp, Artificial
  CRISPR gRNA sequence
aatgatccagttagaggaca

SEQ ID NO: 625261 - DNA, 20 bp, Artificial
  CRISPR gRNA sequence
ctagtgtccctatctaaaga

SEQ ID NO: 625262 - DNA, 20 bp, Artificial
  CRISPR gRNA sequence
agctgccaattacttagtga

SEQ ID NO: 625263 - DNA, 20 bp, Artificial
  CRISPR gRNA sequence
gaaatcccacatccagtcta

SEQ ID NO: 625264 - DNA, 20 bp, Artificial
  CRISPR gRNA sequence
acaaaagctttccactgaaa

SEQ ID NO: 625265 - DNA, 20 bp, Artificial
  CRISPR gRNA sequence
ttgttctttcccttccataa

SEQ ID NO: 625266 - DNA, 20 bp, Artificial
  CRISPR gRNA sequence
ttcattctaaaccctctatt

SEQ ID NO: 625267 - DNA, 20 bp, Artificial
  CRISPR gRNA sequence
atacaaaaaaaaaaaaaaaa

SEQ ID NO: 625268 - DNA, 20 bp, Artificial
  CRISPR gRNA sequence
ctactctggaggctgaggca

SEQ ID NO: 625269 - DNA, 20 bp, Artificial
  CRISPR gRNA sequence
actgtactccatcctgggcg

SEQ ID NO: 625270 - DNA, 20 bp, Artificial
  CRISPR gRNA sequence
taatacttgccttaagtttt

SEQ ID NO: 625271 - DNA, 20 bp, Artificial
  CRISPR gRNA sequence
gttttgccttgttttaagat

SEQ ID NO: 625272 - DNA, 20 bp, Artificial
  CRISPR gRNA sequence
aaaattgcagttataattct

SEQ ID NO: 625273 - DNA, 20 bp, Artificial
  CRISPR gRNA sequence
tgcagttataattctttaga

SEQ ID NO: 625274 - DNA, 20 bp, Artificial
  CRISPR gRNA sequence
tgatgatagataggacttaa

SEQ ID NO: 625275 - DNA, 20 bp, Artificial
  CRISPR gRNA sequence
atatagatcaaataaggtgt

SEQ ID NO: 625276 - DNA, 20 bp, Artificial
  CRISPR gRNA sequence
actgagaacatccttaggat

SEQ ID NO: 625277 - DNA, 20 bp, Artificial
  CRISPR gRNA sequence
ttttcatagctaatgaataa

SEQ ID NO: 625278 - DNA, 20 bp, Artificial
  CRISPR gRNA sequence
tccatattgtggttggagct

SEQ ID NO: 625279 - DNA, 20 bp, Artificial
  CRISPR gRNA sequence
ttgtggttggagctggagaa

SEQ ID NO: 625280 - DNA, 20 bp, Artificial
  CRISPR gRNA sequence
agcagtaactttcaattcag

SEQ ID NO: 625281 - DNA, 20 bp, Artificial
  CRISPR gRNA sequence
tttgtgcagcagtaatccat

SEQ ID NO: 625282 - DNA, 20 bp, Artificial
  CRISPR gRNA sequence
ctcaaaggagcttagatttt

SEQ ID NO: 625283 - DNA, 20 bp, Artificial
  CRISPR gRNA sequence
aaggagcttagattttagag

SEQ ID NO: 625284 - DNA, 20 bp, Artificial
  CRISPR gRNA sequence
tagattttagagaaagaaag

SEQ ID NO: 625285 - DNA, 20 bp, Artificial
  CRISPR gRNA sequence
cacacataacataagggtgt

SEQ ID NO: 625286 - DNA, 20 bp, Artificial
  CRISPR gRNA sequence
tagtataaagttaaaacggt

SEQ ID NO: 625287 - DNA, 20 bp, Artificial
  CRISPR gRNA sequence
tgtatttaatttttgttcct

SEQ ID NO: 625288 - DNA, 20 bp, Artificial
  CRISPR gRNA sequence
tatttctgcttcagtgtctg

SEQ ID NO: 625289 - DNA, 20 bp, Artificial
  CRISPR gRNA sequence
aaaaactctattaggaacta

SEQ ID NO: 625290 - DNA, 20 bp, Artificial
  CRISPR gRNA sequence
tattaggaactaggagaaag

SEQ ID NO: 625291 - DNA, 20 bp, Artificial
  CRISPR gRNA sequence
aatggatgatttgatgttaa

SEQ ID NO: 625292 - DNA, 20 bp, Artificial
  CRISPR gRNA sequence
agttatcttggtaaatcaca

SEQ ID NO: 625293 - DNA, 20 bp, Artificial
  CRISPR gRNA sequence
tgaaatctgaattcttatat

SEQ ID NO: 625294 - DNA, 20 bp, Artificial
  CRISPR gRNA sequence
tctaataagaagtagcaaac

SEQ ID NO: 625295 - DNA, 20 bp, Artificial
  CRISPR gRNA sequence
agaagtagcaaacaaagaat

SEQ ID NO: 625296 - DNA, 20 bp, Artificial
  CRISPR gRNA sequence
gtagcaaacaaagaatacag

SEQ ID NO: 625297 - DNA, 20 bp, Artificial
  CRISPR gRNA sequence
acataggcaaagcctaccct

SEQ ID NO: 625298 - DNA, 20 bp, Artificial
  CRISPR gRNA sequence
actgaaatactcttgagagc

SEQ ID NO: 625299 - DNA, 20 bp, Artificial
  CRISPR gRNA sequence
gaacaacttccttaacaaag

SEQ ID NO: 625300 - DNA, 20 bp, Artificial
  CRISPR gRNA sequence
ttgctgatcagctctaattc

SEQ ID NO: 625301 - DNA, 20 bp, Artificial
  CRISPR gRNA sequence
ttttgcattggcccttgtat

SEQ ID NO: 625302 - DNA, 20 bp, Artificial
  CRISPR gRNA sequence
aaactatgcctattttggaa

SEQ ID NO: 625303 - DNA, 20 bp, Artificial
  CRISPR gRNA sequence
atacaattttgactttgtgc

SEQ ID NO: 625304 - DNA, 20 bp, Artificial
  CRISPR gRNA sequence
gttttccagctgacatttct

SEQ ID NO: 625305 - DNA, 20 bp, Artificial
  CRISPR gRNA sequence
aggaggagctgaccctagct

SEQ ID NO: 625306 - DNA, 20 bp, Artificial
  CRISPR gRNA sequence
ccacctctttactttagttt

SEQ ID NO: 625307 - DNA, 20 bp, Artificial
  CRISPR gRNA sequence
tttggagaattatttaagta

SEQ ID NO: 625308 - DNA, 20 bp, Artificial
  CRISPR gRNA sequence
taagtaggagaatcactggc

SEQ ID NO: 625309 - DNA, 20 bp, Artificial
  CRISPR gRNA sequence
gacattatgaaattcttagg

SEQ ID NO: 625310 - DNA, 20 bp, Artificial
  CRISPR gRNA sequence
ttctcaaacttgcttgatcg

SEQ ID NO: 625311 - DNA, 20 bp, Artificial
  CRISPR gRNA sequence
tatatgtgcagggacttggg

SEQ ID NO: 625312 - DNA, 20 bp, Artificial
  CRISPR gRNA sequence
gggagagttgtagctcttct

SEQ ID NO: 625313 - DNA, 20 bp, Artificial
  CRISPR gRNA sequence
tttgtgcatctgttgacact

SEQ ID NO: 625314 - DNA, 20 bp, Artificial
  CRISPR gRNA sequence
ccaaactgagaaggaactct

SEQ ID NO: 625315 - DNA, 20 bp, Artificial
  CRISPR gRNA sequence
ttatagcaactcaatgaatg

SEQ ID NO: 625316 - DNA, 20 bp, Artificial
  CRISPR gRNA sequence
agcaactcaatgaatgttag

SEQ ID NO: 625317 - DNA, 20 bp, Artificial
  CRISPR gRNA sequence
gaatgttagaaagaatattg

SEQ ID NO: 625318 - DNA, 20 bp, Artificial
  CRISPR gRNA sequence
cattgaattactactgaatg

SEQ ID NO: 625319 - DNA, 20 bp, Artificial
  CRISPR gRNA sequence
ttatatttctccaacagtct

SEQ ID NO: 625320 - DNA, 20 bp, Artificial
  CRISPR gRNA sequence
caacagtctgaagaaataga

SEQ ID NO: 625321 - DNA, 20 bp, Artificial
  CRISPR gRNA sequence
aaataggatcagggagcata

SEQ ID NO: 625322 - DNA, 20 bp, Artificial
  CRISPR gRNA sequence
cagggagcataatagaatca

SEQ ID NO: 625323 - DNA, 20 bp, Artificial
  CRISPR gRNA sequence
atcagtagaaatattatata

SEQ ID NO: 625324 - DNA, 20 bp, Artificial
  CRISPR gRNA sequence
attatataatagaaacggaa

SEQ ID NO: 625325 - DNA, 20 bp, Artificial
  CRISPR gRNA sequence
agaaagcataaaactagttt

SEQ ID NO: 625326 - DNA, 20 bp, Artificial
  CRISPR gRNA sequence
attgtgtataggacagagaa

SEQ ID NO: 625327 - DNA, 20 bp, Artificial
  CRISPR gRNA sequence
gaatgcattttttcctttaa

SEQ ID NO: 625328 - DNA, 20 bp, Artificial
  CRISPR gRNA sequence
tctgccttccagttagagtt

SEQ ID NO: 625329 - DNA, 20 bp, Artificial
  CRISPR gRNA sequence
attttgccactgtacctggc

SEQ ID NO: 625330 - DNA, 20 bp, Artificial
  CRISPR gRNA sequence
tgggagtaggaactggcctt

SEQ ID NO: 625331 - DNA, 20 bp, Artificial
  CRISPR gRNA sequence
acctctgaacccgagtctgt

SEQ ID NO: 625332 - DNA, 20 bp, Artificial
  CRISPR gRNA sequence
ccttatgtgtgtcatctgta

SEQ ID NO: 625333 - DNA, 20 bp, Artificial
  CRISPR gRNA sequence
ggttgtggtaggatgagtac

SEQ ID NO: 625334 - DNA, 20 bp, Artificial
  CRISPR gRNA sequence
atacagatagggctggcttt

SEQ ID NO: 625335 - DNA, 20 bp, Artificial
  CRISPR gRNA sequence
atgctttaatagagatgtct

SEQ ID NO: 625336 - DNA, 20 bp, Artificial
  CRISPR gRNA sequence
tttgtagttacaaaagtgtt

SEQ ID NO: 625337 - DNA, 20 bp, Artificial
  CRISPR gRNA sequence
tacaaaagtgttagagaata

SEQ ID NO: 625338 - DNA, 20 bp, Artificial
  CRISPR gRNA sequence
tgtcaaacctctgccatgga

SEQ ID NO: 625339 - DNA, 20 bp, Artificial
  CRISPR gRNA sequence
tggtgtccaattcacttatt

SEQ ID NO: 625340 - DNA, 20 bp, Artificial
  CRISPR gRNA sequence
agccgtctctctttttttaa

SEQ ID NO: 625341 - DNA, 20 bp, Artificial
  CRISPR gRNA sequence
cctgattatggtagtggtta

SEQ ID NO: 625342 - DNA, 20 bp, Artificial
  CRISPR gRNA sequence
aaaaataaaatgaaggggtt

SEQ ID NO: 625343 - DNA, 20 bp, Artificial
  CRISPR gRNA sequence
atggtggttaaattccattg

SEQ ID NO: 625344 - DNA, 20 bp, Artificial
  CRISPR gRNA sequence
atggatgtagggactcagga

SEQ ID NO: 625345 - DNA, 20 bp, Artificial
  CRISPR gRNA sequence
tctctctcataaggctgttg

SEQ ID NO: 625346 - DNA, 20 bp, Artificial
  CRISPR gRNA sequence
aatttctttcgctgttcagc

SEQ ID NO: 625347 - DNA, 20 bp, Artificial
  CRISPR gRNA sequence
ttttttaataaacatttttg

SEQ ID NO: 625348 - DNA, 20 bp, Artificial
  CRISPR gRNA sequence
agccactgtgcccccagcct

SEQ ID NO: 625349 - DNA, 20 bp, Artificial
  CRISPR gRNA sequence
gaaatggatgggattgtata

SEQ ID NO: 625350 - DNA, 20 bp, Artificial
  CRISPR gRNA sequence
cttttttgtgttcctgtaac

SEQ ID NO: 625351 - DNA, 20 bp, Artificial
  CRISPR gRNA sequence
tgttttacccatacacaaaa

SEQ ID NO: 625352 - DNA, 20 bp, Artificial
  CRISPR gRNA sequence
aacgtgcatttgccttcatt

SEQ ID NO: 625353 - DNA, 20 bp, Artificial
  CRISPR gRNA sequence
catccaacagtaaataaatg

SEQ ID NO: 625354 - DNA, 20 bp, Artificial
  CRISPR gRNA sequence
aaatggaagaaataggaaag

SEQ ID NO: 625355 - DNA, 20 bp, Artificial
  CRISPR gRNA sequence
gatctctcaaagtcaaacta

SEQ ID NO: 625356 - DNA, 20 bp, Artificial
  CRISPR gRNA sequence
tgattttagattactctgag

SEQ ID NO: 625357 - DNA, 20 bp, Artificial
  CRISPR gRNA sequence
tgctcaatagatgccaactt

SEQ ID NO: 625358 - DNA, 20 bp, Artificial
  CRISPR gRNA sequence
gaatataatcccaggcacat

SEQ ID NO: 625359 - DNA, 20 bp, Artificial
  CRISPR gRNA sequence
ccactccttccctaaaacaa

SEQ ID NO: 625360 - DNA, 20 bp, Artificial
  CRISPR gRNA sequence
aagtatcaataggtacagct

SEQ ID NO: 625361 - DNA, 20 bp, Artificial
  CRISPR gRNA sequence
aacatggttctttgtttttt

SEQ ID NO: 625362 - DNA, 20 bp, Artificial
  CRISPR gRNA sequence
tgtaatagtaaaattatgtg

SEQ ID NO: 625363 - DNA, 20 bp, Artificial
  CRISPR gRNA sequence
gctactctctgcataccatt

SEQ ID NO: 625364 - DNA, 20 bp, Artificial
  CRISPR gRNA sequence
caaaccttggttgcctagtt

SEQ ID NO: 625365 - DNA, 20 bp, Artificial
  CRISPR gRNA sequence
ttggggaatcggtgtaatgt

SEQ ID NO: 625366 - DNA, 20 bp, Artificial
  CRISPR gRNA sequence
tttagtaaaaatgatatgga

SEQ ID NO: 625367 - DNA, 20 bp, Artificial
  CRISPR gRNA sequence
atgatatggaatagaaaacg

SEQ ID NO: 625368 - DNA, 20 bp, Artificial
  CRISPR gRNA sequence
gagaccctgtcttaaaaaaa

SEQ ID NO: 625369 - DNA, 20 bp, Artificial
  CRISPR gRNA sequence
gtaataatttgttattaaca

SEQ ID NO: 625370 - DNA, 20 bp, Artificial
  CRISPR gRNA sequence
ccattctctacacccagtaa

SEQ ID NO: 625371 - DNA, 20 bp, Artificial
  CRISPR gRNA sequence
catacgcatgctcagtaatt

SEQ ID NO: 625372 - DNA, 20 bp, Artificial
  CRISPR gRNA sequence
gttttgtatccataaactgc

SEQ ID NO: 625373 - DNA, 20 bp, Artificial
  CRISPR gRNA sequence
agttaaccatataagtaata

SEQ ID NO: 625374 - DNA, 20 bp, Artificial
  CRISPR gRNA sequence
tgaagtacagtaagtatcta

SEQ ID NO: 625375 - DNA, 20 bp, Artificial
  CRISPR gRNA sequence
attattctaacacacagttc

SEQ ID NO: 625376 - DNA, 20 bp, Artificial
  CRISPR gRNA sequence
ttatgcaagtatataaaaaa

SEQ ID NO: 625377 - DNA, 20 bp, Artificial
  CRISPR gRNA sequence
ttaaaaaaaaggaaggggca

SEQ ID NO: 625378 - DNA, 20 bp, Artificial
  CRISPR gRNA sequence
taagttgggtaaaaaaaacc

SEQ ID NO: 625379 - DNA, 20 bp, Artificial
  CRISPR gRNA sequence
acagtaaatattagtttttt

SEQ ID NO: 625380 - DNA, 20 bp, Artificial
  CRISPR gRNA sequence
actgtttgccagtggaactg

SEQ ID NO: 625381 - DNA, 20 bp, Artificial
  CRISPR gRNA sequence
aatcaagaccagtgttcatt

SEQ ID NO: 625382 - DNA, 20 bp, Artificial
  CRISPR gRNA sequence
tttttatacaatatgcaact

SEQ ID NO: 625383 - DNA, 20 bp, Artificial
  CRISPR gRNA sequence
tgtgtgaattacttaacctt

SEQ ID NO: 625384 - DNA, 20 bp, Artificial
  CRISPR gRNA sequence
tgcttgcatgttttacttgc

SEQ ID NO: 625385 - DNA, 20 bp, Artificial
  CRISPR gRNA sequence
tcaaagtgattatttaatac

SEQ ID NO: 625386 - DNA, 20 bp, Artificial
  CRISPR gRNA sequence
aaaaataatatattaattgg

SEQ ID NO: 625387 - DNA, 20 bp, Artificial
  CRISPR gRNA sequence
ctgttaaaaaccatgtgctt

SEQ ID NO: 625388 - DNA, 20 bp, Artificial
  CRISPR gRNA sequence
tagtaggatctcaaatatgt

SEQ ID NO: 625389 - DNA, 20 bp, Artificial
  CRISPR gRNA sequence
aaatatatgtaccttctttt

SEQ ID NO: 625390 - DNA, 20 bp, Artificial
  CRISPR gRNA sequence
taaaatatttacgtcatgta

SEQ ID NO: 625391 - DNA, 20 bp, Artificial
  CRISPR gRNA sequence
ttaaaatttgtaaaattttg

SEQ ID NO: 625392 - DNA, 20 bp, Artificial
  CRISPR gRNA sequence
gttgtttgtttttcctcctg

SEQ ID NO: 625393 - DNA, 20 bp, Artificial
  CRISPR gRNA sequence
atctaaattttcactgaaaa

SEQ ID NO: 625394 - DNA, 20 bp, Artificial
  CRISPR gRNA sequence
caaatctgctttttccacag

SEQ ID NO: 625395 - DNA, 20 bp, Artificial
  CRISPR gRNA sequence
atttagagacaattctacaa

SEQ ID NO: 625396 - DNA, 20 bp, Artificial
  CRISPR gRNA sequence
taaatgtgataaaccttgcc

SEQ ID NO: 625397 - DNA, 20 bp, Artificial
  CRISPR gRNA sequence
aagttctcatgggcaaggga

SEQ ID NO: 625398 - DNA, 20 bp, Artificial
  CRISPR gRNA sequence
ttcatcatagtacaaaatat

SEQ ID NO: 625399 - DNA, 20 bp, Artificial
  CRISPR gRNA sequence
cttttagatttttcaagtgg

SEQ ID NO: 625400 - DNA, 20 bp, Artificial
  CRISPR gRNA sequence
aaacttttagatatttagtc

SEQ ID NO: 625401 - DNA, 20 bp, Artificial
  CRISPR gRNA sequence
caggcgcaaggatctcttaa

SEQ ID NO: 625402 - DNA, 20 bp, Artificial
  CRISPR gRNA sequence
tggtaatgccttttttaaaa

SEQ ID NO: 625403 - DNA, 20 bp, Artificial
  CRISPR gRNA sequence
gtcataaaaatatactgatt

SEQ ID NO: 625404 - DNA, 20 bp, Artificial
  CRISPR gRNA sequence
ttgtacatttatcttttgcc

SEQ ID NO: 625405 - DNA, 20 bp, Artificial
  CRISPR gRNA sequence
tctttgatttttgtttgttt

SEQ ID NO: 625406 - DNA, 20 bp, Artificial
  CRISPR gRNA sequence
attgtgtatagacaaaggta

SEQ ID NO: 625407 - DNA, 20 bp, Artificial
  CRISPR gRNA sequence
gggaaagcaatgagctcctt

SEQ ID NO: 625408 - DNA, 20 bp, Artificial
  CRISPR gRNA sequence
aaagttggcatctaaatgca

SEQ ID NO: 625409 - DNA, 20 bp, Artificial
  CRISPR gRNA sequence
gaatgctttcatttcaatag

SEQ ID NO: 625410 - DNA, 20 bp, Artificial
  CRISPR gRNA sequence
gtgaaagtagtacaagattg

SEQ ID NO: 625411 - DNA, 20 bp, Artificial
  CRISPR gRNA sequence
cctctgccctgtggtttact

SEQ ID NO: 625412 - DNA, 20 bp, Artificial
  CRISPR gRNA sequence
gtaagaagacatttcctttc

SEQ ID NO: 625413 - DNA, 20 bp, Artificial
  CRISPR gRNA sequence
tttcctttcagagaattaac

SEQ ID NO: 625414 - DNA, 20 bp, Artificial
  CRISPR gRNA sequence
agatttcctatcctttcctt

SEQ ID NO: 625415 - DNA, 20 bp, Artificial
  CRISPR gRNA sequence
gttgacttacctgtacaaag

SEQ ID NO: 625416 - DNA, 20 bp, Artificial
  CRISPR gRNA sequence
ttgcttactgttgtagagca

SEQ ID NO: 625417 - DNA, 20 bp, Artificial
  CRISPR gRNA sequence
tacagctggaaatatgacaa

SEQ ID NO: 625418 - DNA, 20 bp, Artificial
  CRISPR gRNA sequence
catattattctataaattca

SEQ ID NO: 625419 - DNA, 20 bp, Artificial
  CRISPR gRNA sequence
acgccttggttttcccgggt

SEQ ID NO: 625420 - DNA, 20 bp, Artificial
  CRISPR gRNA sequence
tcacaaattctagtttaaat

SEQ ID NO: 625421 - DNA, 20 bp, Artificial
  CRISPR gRNA sequence
tcctttagacagagctaaag

SEQ ID NO: 625422 - DNA, 20 bp, Artificial
  CRISPR gRNA sequence
ctaaagtgagaataaagtag

SEQ ID NO: 625423 - DNA, 20 bp, Artificial
  CRISPR gRNA sequence
agtgagaataaagtagtaag

SEQ ID NO: 625424 - DNA, 20 bp, Artificial
  CRISPR gRNA sequence
ctaattttttttttgtaatc

SEQ ID NO: 625425 - DNA, 20 bp, Artificial
  CRISPR gRNA sequence
atagtaggtagtgtcagttg

SEQ ID NO: 625426 - DNA, 20 bp, Artificial
  CRISPR gRNA sequence
ttttaatttgacctctgaaa

SEQ ID NO: 625427 - DNA, 20 bp, Artificial
  CRISPR gRNA sequence
agaaaaagtttttccaggtt

SEQ ID NO: 625428 - DNA, 20 bp, Artificial
  CRISPR gRNA sequence
aaattttaacattatagaca

SEQ ID NO: 625429 - DNA, 20 bp, Artificial
  CRISPR gRNA sequence
tacgttgaaatcataaagca

SEQ ID NO: 625430 - DNA, 20 bp, Artificial
  CRISPR gRNA sequence
agcactagaaaagcaaatac

SEQ ID NO: 625431 - DNA, 20 bp, Artificial
  CRISPR gRNA sequence
agaaagtattatctgttctg

SEQ ID NO: 625432 - DNA, 20 bp, Artificial
  CRISPR gRNA sequence
tacaagtacctggcctttaa

SEQ ID NO: 625433 - DNA, 20 bp, Artificial
  CRISPR gRNA sequence
tgtattagatcaacattaag

SEQ ID NO: 625434 - DNA, 20 bp, Artificial
  CRISPR gRNA sequence
gattatacaaatgtgatgaa

SEQ ID NO: 625435 - DNA, 20 bp, Artificial
  CRISPR gRNA sequence
ccacagaaggatatttcatt

SEQ ID NO: 625436 - DNA, 20 bp, Artificial
  CRISPR gRNA sequence
ggtaataacatgtactgggt

SEQ ID NO: 625437 - DNA, 20 bp, Artificial
  CRISPR gRNA sequence
gttacacttgatacagctta

SEQ ID NO: 625438 - DNA, 20 bp, Artificial
  CRISPR gRNA sequence
cacttgatacagcttataag

SEQ ID NO: 625439 - DNA, 20 bp, Artificial
  CRISPR gRNA sequence
tctcttcagttatctttata

SEQ ID NO: 625440 - DNA, 20 bp, Artificial
  CRISPR gRNA sequence
ccttgaaggcactggataat

SEQ ID NO: 625441 - DNA, 20 bp, Artificial
  CRISPR gRNA sequence
gttagttggatctagctcca

SEQ ID NO: 625442 - DNA, 20 bp, Artificial
  CRISPR gRNA sequence
gttttaaccgggacagagtg

SEQ ID NO: 625443 - DNA, 20 bp, Artificial
  CRISPR gRNA sequence
tgctgtctgttcatttttgt

SEQ ID NO: 625444 - DNA, 20 bp, Artificial
  CRISPR gRNA sequence
ttttcttcagattcagaagc

SEQ ID NO: 625445 - DNA, 20 bp, Artificial
  CRISPR gRNA sequence
aatttatttcttctcaatat

SEQ ID NO: 625446 - DNA, 20 bp, Artificial
  CRISPR gRNA sequence
ttctcaactttggctgcaca

SEQ ID NO: 625447 - DNA, 20 bp, Artificial
  CRISPR gRNA sequence
gaaggtctagagccatggat

SEQ ID NO: 625448 - DNA, 20 bp, Artificial
  CRISPR gRNA sequence
atagggtctttttcaaaaat

SEQ ID NO: 625449 - DNA, 20 bp, Artificial
  CRISPR gRNA sequence
ttaattatattttgtaagtc

SEQ ID NO: 625450 - DNA, 20 bp, Artificial
  CRISPR gRNA sequence
ggattttaaaagtatgtcat

SEQ ID NO: 625451 - DNA, 20 bp, Artificial
  CRISPR gRNA sequence
ttccaactattgcatatttt

SEQ ID NO: 625452 - DNA, 20 bp, Artificial
  CRISPR gRNA sequence
tttagaatcaccatagttaa

SEQ ID NO: 625453 - DNA, 20 bp, Artificial
  CRISPR gRNA sequence
atctcttggtctttaaaaat

SEQ ID NO: 625454 - DNA, 20 bp, Artificial
  CRISPR gRNA sequence
cttctttgagacttcaattt

SEQ ID NO: 625455 - DNA, 20 bp, Artificial
  CRISPR gRNA sequence
cttcaattttaagaaacctg

SEQ ID NO: 625456 - DNA, 20 bp, Artificial
  CRISPR gRNA sequence
gtcttaaaaattatgctgtt

SEQ ID NO: 625457 - DNA, 20 bp, Artificial
  CRISPR gRNA sequence
aaaatctcaaatttttttga

SEQ ID NO: 625458 - DNA, 20 bp, Artificial
  CRISPR gRNA sequence
aggcattgttactttcataa

SEQ ID NO: 625459 - DNA, 20 bp, Artificial
  CRISPR gRNA sequence
tgttactttcataatcagaa

SEQ ID NO: 625460 - DNA, 20 bp, Artificial
  CRISPR gRNA sequence
ctttcataatcagaaaaaga

SEQ ID NO: 625461 - DNA, 20 bp, Artificial
  CRISPR gRNA sequence
tataattacctcgttagtag

SEQ ID NO: 625462 - DNA, 20 bp, Artificial
  CRISPR gRNA sequence
ttcccctgaattttgcttct

SEQ ID NO: 625463 - DNA, 20 bp, Artificial
  CRISPR gRNA sequence
attaacacacatttctacca

SEQ ID NO: 625464 - DNA, 20 bp, Artificial
  CRISPR gRNA sequence
ttttaatttactttatccta

SEQ ID NO: 625465 - DNA, 20 bp, Artificial
  CRISPR gRNA sequence
aaaatgcttttgtacaggtt

SEQ ID NO: 625466 - DNA, 20 bp, Artificial
  CRISPR gRNA sequence
ctctctgctgttgccagttt

SEQ ID NO: 625467 - DNA, 20 bp, Artificial
  CRISPR gRNA sequence
acttttactaacttcccaaa

SEQ ID NO: 625468 - DNA, 20 bp, Artificial
  CRISPR gRNA sequence
ataagaatgaccttctgttc

SEQ ID NO: 625469 - DNA, 20 bp, Artificial
  CRISPR gRNA sequence
ataatgtattagttcccgaa

SEQ ID NO: 625470 - DNA, 20 bp, Artificial
  CRISPR gRNA sequence
tatttttttgaggatttggg

SEQ ID NO: 625471 - DNA, 20 bp, Artificial
  CRISPR gRNA sequence
tagtgttgaacactgacttg

SEQ ID NO: 625472 - DNA, 20 bp, Artificial
  CRISPR gRNA sequence
tacacaatcattgtcataga

SEQ ID NO: 625473 - DNA, 20 bp, Artificial
  CRISPR gRNA sequence
aatagaagtctgccactccc

SEQ ID NO: 625474 - DNA, 20 bp, Artificial
  CRISPR gRNA sequence
gatgtccagcgccttctggg

SEQ ID NO: 625475 - DNA, 20 bp, Artificial
  CRISPR gRNA sequence
gaaatgaagttacattgagg

SEQ ID NO: 625476 - DNA, 20 bp, Artificial
  CRISPR gRNA sequence
cacctggcaaccaacattca

SEQ ID NO: 625477 - DNA, 20 bp, Artificial
  CRISPR gRNA sequence
ttgaactcatggggctgatg

SEQ ID NO: 625478 - DNA, 20 bp, Artificial
  CRISPR gRNA sequence
cacagcttatactctctttc

SEQ ID NO: 625479 - DNA, 20 bp, Artificial
  CRISPR gRNA sequence
atggattggaaaatgtaagg

SEQ ID NO: 625480 - DNA, 20 bp, Artificial
  CRISPR gRNA sequence
cactagagtgacagttacac

SEQ ID NO: 625481 - DNA, 20 bp, Artificial
  CRISPR gRNA sequence
agtgacagttacacagagaa

SEQ ID NO: 625482 - DNA, 20 bp, Artificial
  CRISPR gRNA sequence
cttcagatatggaattaagt

SEQ ID NO: 625483 - DNA, 20 bp, Artificial
  CRISPR gRNA sequence
tttcatgtgagggctgtgag

SEQ ID NO: 625484 - DNA, 20 bp, Artificial
  CRISPR gRNA sequence
tcattacatctgcaattttt

SEQ ID NO: 625485 - DNA, 20 bp, Artificial
  CRISPR gRNA sequence
gtgtatagccaaagcatcaa

SEQ ID NO: 625486 - DNA, 20 bp, Artificial
  CRISPR gRNA sequence
aagtgagcctggagttagtg

SEQ ID NO: 625487 - DNA, 20 bp, Artificial
  CRISPR gRNA sequence
ccatgtttgtttagtctcct

SEQ ID NO: 625488 - DNA, 20 bp, Artificial
  CRISPR gRNA sequence
cctttagaaatgttagagga

SEQ ID NO: 625489 - DNA, 20 bp, Artificial
  CRISPR gRNA sequence
cactgtcacctcacatatgt

SEQ ID NO: 625490 - DNA, 20 bp, Artificial
  CRISPR gRNA sequence
tttgttgttacttcctatca

SEQ ID NO: 625491 - DNA, 20 bp, Artificial
  CRISPR gRNA sequence
ttctggtcataatctttttt

SEQ ID NO: 625492 - DNA, 20 bp, Artificial
  CRISPR gRNA sequence
tactaacccttctccccctt

SEQ ID NO: 625493 - DNA, 20 bp, Artificial
  CRISPR gRNA sequence
tcctcctccttctccccgta

SEQ ID NO: 625494 - DNA, 20 bp, Artificial
  CRISPR gRNA sequence
aaaagcagtggattttctag

SEQ ID NO: 625495 - DNA, 20 bp, Artificial
  CRISPR gRNA sequence
gtgaagcttgagagtcattc

SEQ ID NO: 625496 - DNA, 20 bp, Artificial
  CRISPR gRNA sequence
taaattaatacttagtatat

SEQ ID NO: 625497 - DNA, 20 bp, Artificial
  CRISPR gRNA sequence
aaagaacttaaacaaattta

SEQ ID NO: 625498 - DNA, 20 bp, Artificial
  CRISPR gRNA sequence
gctcatcatcactggccatc

SEQ ID NO: 625499 - DNA, 20 bp, Artificial
  CRISPR gRNA sequence
gagataccatctcacaccag

SEQ ID NO: 625500 - DNA, 20 bp, Artificial
  CRISPR gRNA sequence
gcaggtgctggagaggatgt

SEQ ID NO: 625501 - DNA, 20 bp, Artificial
  CRISPR gRNA sequence
aattcctcagggatctagaa

SEQ ID NO: 625502 - DNA, 20 bp, Artificial
  CRISPR gRNA sequence
ccatcagtgatagactggat

SEQ ID NO: 625503 - DNA, 20 bp, Artificial
  CRISPR gRNA sequence
atgagcaaactatcgcaagg

SEQ ID NO: 625504 - DNA, 20 bp, Artificial
  CRISPR gRNA sequence
ttatgcaaatcaaagttccc

SEQ ID NO: 625505 - DNA, 20 bp, Artificial
  CRISPR gRNA sequence
tattgtggaaggtgttttat

SEQ ID NO: 625506 - DNA, 20 bp, Artificial
  CRISPR gRNA sequence
gaatagagtaaatatatatt

SEQ ID NO: 625507 - DNA, 20 bp, Artificial
  CRISPR gRNA sequence
cacacacattcatcttgtcc

SEQ ID NO: 625508 - DNA, 20 bp, Artificial
  CRISPR gRNA sequence
gcaacctccttaaggataat

SEQ ID NO: 625509 - DNA, 20 bp, Artificial
  CRISPR gRNA sequence
gtgtttctaagtgttttaaa

SEQ ID NO: 625510 - DNA, 20 bp, Artificial
  CRISPR gRNA sequence
aaagagaaagatgacttggg

SEQ ID NO: 625511 - DNA, 20 bp, Artificial
  CRISPR gRNA sequence
attaatttcaccaaaattgg

SEQ ID NO: 625512 - DNA, 20 bp, Artificial
  CRISPR gRNA sequence
tggaccttgaatcatgaaag

SEQ ID NO: 625513 - DNA, 20 bp, Artificial
  CRISPR gRNA sequence
gatattgggacttaatagta

SEQ ID NO: 625514 - DNA, 20 bp, Artificial
  CRISPR gRNA sequence
taatagtaacagaaaatact

SEQ ID NO: 625515 - DNA, 20 bp, Artificial
  CRISPR gRNA sequence
ttatcatcttatgatttttt

SEQ ID NO: 625516 - DNA, 20 bp, Artificial
  CRISPR gRNA sequence
cacttttctaacactgacca

SEQ ID NO: 625517 - DNA, 20 bp, Artificial
  CRISPR gRNA sequence
tgtgagtaaactgtagttta

SEQ ID NO: 625518 - DNA, 20 bp, Artificial
  CRISPR gRNA sequence
attctataactcatcataat

SEQ ID NO: 625519 - DNA, 20 bp, Artificial
  CRISPR gRNA sequence
gagaccagcctgaccaacat

SEQ ID NO: 625520 - DNA, 20 bp, Artificial
  CRISPR gRNA sequence
atcccagctaggctgaggca

SEQ ID NO: 625521 - DNA, 20 bp, Artificial
  CRISPR gRNA sequence
aaaaaaggttcgccgtccta

SEQ ID NO: 625522 - DNA, 20 bp, Artificial
  CRISPR gRNA sequence
ataagcagacatatgaagga

SEQ ID NO: 625523 - DNA, 20 bp, Artificial
  CRISPR gRNA sequence
taacaatgtatagaacaaaa

SEQ ID NO: 625524 - DNA, 20 bp, Artificial
  CRISPR gRNA sequence
tggaattcagtcatcttctt

SEQ ID NO: 625525 - DNA, 20 bp, Artificial
  CRISPR gRNA sequence
aatacatgttggacatataa

SEQ ID NO: 625526 - DNA, 20 bp, Artificial
  CRISPR gRNA sequence
tgttgcaattgtcaaaccta

SEQ ID NO: 625527 - DNA, 20 bp, Artificial
  CRISPR gRNA sequence
acatgaaaatttactagttg

SEQ ID NO: 625528 - DNA, 20 bp, Artificial
  CRISPR gRNA sequence
ttgtaaattatgggtgggca

SEQ ID NO: 625529 - DNA, 20 bp, Artificial
  CRISPR gRNA sequence
ttccatattatcacatcata

SEQ ID NO: 625530 - DNA, 20 bp, Artificial
  CRISPR gRNA sequence
tggcagggttccaggtgata

SEQ ID NO: 625531 - DNA, 20 bp, Artificial
  CRISPR gRNA sequence
tggttcatttagggtatgtc

SEQ ID NO: 625532 - DNA, 20 bp, Artificial
  CRISPR gRNA sequence
agttgctgctaggaaaacat

SEQ ID NO: 625533 - DNA, 20 bp, Artificial
  CRISPR gRNA sequence
ctttctctcttggtagtata

SEQ ID NO: 625534 - DNA, 20 bp, Artificial
  CRISPR gRNA sequence
cccttctccctcaacaaaaa

SEQ ID NO: 625535 - DNA, 20 bp, Artificial
  CRISPR gRNA sequence
tgtttctcataggtttggaa

SEQ ID NO: 625536 - DNA, 20 bp, Artificial
  CRISPR gRNA sequence
cagttggttaacatgggaga

SEQ ID NO: 625537 - DNA, 20 bp, Artificial
  CRISPR gRNA sequence
tggtttggcaggaaatgaca

SEQ ID NO: 625538 - DNA, 20 bp, Artificial
  CRISPR gRNA sequence
gactcacttttcaaagggat

SEQ ID NO: 625539 - DNA, 20 bp, Artificial
  CRISPR gRNA sequence
tacattataatataactcat

SEQ ID NO: 625540 - DNA, 20 bp, Artificial
  CRISPR gRNA sequence
gatactgattttgtttctgg

SEQ ID NO: 625541 - DNA, 20 bp, Artificial
  CRISPR gRNA sequence
attgagaactaatttaatgt

SEQ ID NO: 625542 - DNA, 20 bp, Artificial
  CRISPR gRNA sequence
aatttaatgttaagaaaagg

SEQ ID NO: 625543 - DNA, 20 bp, Artificial
  CRISPR gRNA sequence
aagaaaaacctttgttaaaa

SEQ ID NO: 625544 - DNA, 20 bp, Artificial
  CRISPR gRNA sequence
taaacaaagctagattttag

SEQ ID NO: 625545 - DNA, 20 bp, Artificial
  CRISPR gRNA sequence
gattttagagagaaatatag

SEQ ID NO: 625546 - DNA, 20 bp, Artificial
  CRISPR gRNA sequence
tgattaaaaaaaataagtac

SEQ ID NO: 625547 - DNA, 20 bp, Artificial
  CRISPR gRNA sequence
ctacttgggaggctggggca

SEQ ID NO: 625548 - DNA, 20 bp, Artificial
  CRISPR gRNA sequence
aaaaaaaaaaaaaaaagtac

SEQ ID NO: 625549 - DNA, 20 bp, Artificial
  CRISPR gRNA sequence
gtggtttaatataaattatt

SEQ ID NO: 625550 - DNA, 20 bp, Artificial
  CRISPR gRNA sequence
ttattagagaaaatttaaat

SEQ ID NO: 625551 - DNA, 20 bp, Artificial
  CRISPR gRNA sequence
aaatttaaatacagaaagtt

SEQ ID NO: 625552 - DNA, 20 bp, Artificial
  CRISPR gRNA sequence
attatcatattcatttggtg

SEQ ID NO: 625553 - DNA, 20 bp, Artificial
  CRISPR gRNA sequence
ggtgttagaattctgtaaat

SEQ ID NO: 625554 - DNA, 20 bp, Artificial
  CRISPR gRNA sequence
gtaaatgtagaattaagtca

SEQ ID NO: 625555 - DNA, 20 bp, Artificial
  CRISPR gRNA sequence
tcatttcttaatagtgaatt

SEQ ID NO: 625556 - DNA, 20 bp, Artificial
  CRISPR gRNA sequence
gtgaattgtagaatttggat

SEQ ID NO: 625557 - DNA, 20 bp, Artificial
  CRISPR gRNA sequence
ggaattttgtgtttattatt

SEQ ID NO: 625558 - DNA, 20 bp, Artificial
  CRISPR gRNA sequence
agtagttttgtttcggtgtt

SEQ ID NO: 625559 - DNA, 20 bp, Artificial
  CRISPR gRNA sequence
tgataatattattcccaggc

SEQ ID NO: 625560 - DNA, 20 bp, Artificial
  CRISPR gRNA sequence
tgaggattctagttttgtta

SEQ ID NO: 625561 - DNA, 20 bp, Artificial
  CRISPR gRNA sequence
aagaaaacttctgtgtgacc

SEQ ID NO: 625562 - DNA, 20 bp, Artificial
  CRISPR gRNA sequence
tctaaagcagcgattagctt

SEQ ID NO: 625563 - DNA, 20 bp, Artificial
  CRISPR gRNA sequence
ggaacagtttgaaagccact

SEQ ID NO: 625564 - DNA, 20 bp, Artificial
  CRISPR gRNA sequence
agccactttagaattgtctt

SEQ ID NO: 625565 - DNA, 20 bp, Artificial
  CRISPR gRNA sequence
aaataactggaagttagttt

SEQ ID NO: 625566 - DNA, 20 bp, Artificial
  CRISPR gRNA sequence
gtttgatgaatcaaattttt

SEQ ID NO: 625567 - DNA, 20 bp, Artificial
  CRISPR gRNA sequence
ttttcctaaatgaaataatt

SEQ ID NO: 625568 - DNA, 20 bp, Artificial
  CRISPR gRNA sequence
ggcaaagaccaaagtacaga

SEQ ID NO: 625569 - DNA, 20 bp, Artificial
  CRISPR gRNA sequence
atgtaatagttataaacatg

SEQ ID NO: 625570 - DNA, 20 bp, Artificial
  CRISPR gRNA sequence
acagagcaagactccatctc

SEQ ID NO: 625571 - DNA, 20 bp, Artificial
  CRISPR gRNA sequence
ttccacttcccccaaatcac

SEQ ID NO: 625572 - DNA, 20 bp, Artificial
  CRISPR gRNA sequence
agagtattgaagaagcttaa

SEQ ID NO: 625573 - DNA, 20 bp, Artificial
  CRISPR gRNA sequence
aaaagcttaaaataaaaaca

SEQ ID NO: 625574 - DNA, 20 bp, Artificial
  CRISPR gRNA sequence
tttgtaactaaagtcagtat

SEQ ID NO: 625575 - DNA, 20 bp, Artificial
  CRISPR gRNA sequence
tggcgacaaaatgagttttt

SEQ ID NO: 625576 - DNA, 20 bp, Artificial
  CRISPR gRNA sequence
acaaaatgagtttttaaaga

SEQ ID NO: 625577 - DNA, 20 bp, Artificial
  CRISPR gRNA sequence
tagggagatcatcagtcgaa

SEQ ID NO: 625578 - DNA, 20 bp, Artificial
  CRISPR gRNA sequence
ttttttttgaccaattagtg

SEQ ID NO: 625579 - DNA, 20 bp, Artificial
  CRISPR gRNA sequence
gttagctgatttgattggga

SEQ ID NO: 625580 - DNA, 20 bp, Artificial
  CRISPR gRNA sequence
tttacccctgtcatgctggg

SEQ ID NO: 625581 - DNA, 20 bp, Artificial
  CRISPR gRNA sequence
cttgcaactattatcagcat

SEQ ID NO: 625582 - DNA, 20 bp, Artificial
  CRISPR gRNA sequence
cttgtctccacctaatataa

SEQ ID NO: 625583 - DNA, 20 bp, Artificial
  CRISPR gRNA sequence
gactttgaattcccatattt

SEQ ID NO: 625584 - DNA, 20 bp, Artificial
  CRISPR gRNA sequence
caatttcacaaaactagccc

SEQ ID NO: 625585 - DNA, 20 bp, Artificial
  CRISPR gRNA sequence
atgcaataggtttaatctac

SEQ ID NO: 625586 - DNA, 20 bp, Artificial
  CRISPR gRNA sequence
cttagaaatagcactgtgag

SEQ ID NO: 625587 - DNA, 20 bp, Artificial
  CRISPR gRNA sequence
ctgatagtgtcagatcatgg

SEQ ID NO: 625588 - DNA, 20 bp, Artificial
  CRISPR gRNA sequence
agtgtcagatcatggaaaga

SEQ ID NO: 625589 - DNA, 20 bp, Artificial
  CRISPR gRNA sequence
ctcatcatttggaccttcct

SEQ ID NO: 625590 - DNA, 20 bp, Artificial
  CRISPR gRNA sequence
gagaagttgtgtcattattt

SEQ ID NO: 625591 - DNA, 20 bp, Artificial
  CRISPR gRNA sequence
attcatatgtttatagcctt

SEQ ID NO: 625592 - DNA, 20 bp, Artificial
  CRISPR gRNA sequence
catcctgacggggacaaagt

SEQ ID NO: 625593 - DNA, 20 bp, Artificial
  CRISPR gRNA sequence
cggggacaaagtagagaaaa

SEQ ID NO: 625594 - DNA, 20 bp, Artificial
  CRISPR gRNA sequence
catgcttttacctatgaccc

SEQ ID NO: 625595 - DNA, 20 bp, Artificial
  CRISPR gRNA sequence
cctcagaaacacctgaacac

SEQ ID NO: 625596 - DNA, 20 bp, Artificial
  CRISPR gRNA sequence
ttgttatttatggaaaactt

SEQ ID NO: 625597 - DNA, 20 bp, Artificial
  CRISPR gRNA sequence
ggtagcattacctttatttc

SEQ ID NO: 625598 - DNA, 20 bp, Artificial
  CRISPR gRNA sequence
tgctaaatcaccagttaata

SEQ ID NO: 625599 - DNA, 20 bp, Artificial
  CRISPR gRNA sequence
attttgatctacttacctga

SEQ ID NO: 625600 - DNA, 20 bp, Artificial
  CRISPR gRNA sequence
tcatacatacacaagtgtta

SEQ ID NO: 625601 - DNA, 20 bp, Artificial
  CRISPR gRNA sequence
acatactttagttatgagct

SEQ ID NO: 625602 - DNA, 20 bp, Artificial
  CRISPR gRNA sequence
aaagctgtttaaatggtgat

SEQ ID NO: 625603 - DNA, 20 bp, Artificial
  CRISPR gRNA sequence
tttttgaattagtgatctta

SEQ ID NO: 625604 - DNA, 20 bp, Artificial
  CRISPR gRNA sequence
cattattttgattttataga

SEQ ID NO: 625605 - DNA, 20 bp, Artificial
  CRISPR gRNA sequence
tgctcattcattcattagga

SEQ ID NO: 625606 - DNA, 20 bp, Artificial
  CRISPR gRNA sequence
tctgttgccgttgcccagtg

SEQ ID NO: 625607 - DNA, 20 bp, Artificial
  CRISPR gRNA sequence
acttcttacagaagttaggt

SEQ ID NO: 625608 - DNA, 20 bp, Artificial
  CRISPR gRNA sequence
ttggcatcatagggaaatag

SEQ ID NO: 625609 - DNA, 20 bp, Artificial
  CRISPR gRNA sequence
gaggtcttcgtaatttaaaa

SEQ ID NO: 625610 - DNA, 20 bp, Artificial
  CRISPR gRNA sequence
ggtgctttgtatgtgtaagg

SEQ ID NO: 625611 - DNA, 20 bp, Artificial
  CRISPR gRNA sequence
ataggagaagaactttttgc

SEQ ID NO: 625612 - DNA, 20 bp, Artificial
  CRISPR gRNA sequence
ttaatgatgtgctaattttt

SEQ ID NO: 625613 - DNA, 20 bp, Artificial
  CRISPR gRNA sequence
atagaaataggggaagtatc

SEQ ID NO: 625614 - DNA, 20 bp, Artificial
  CRISPR gRNA sequence
agaaaataaaagcaggtgct

SEQ ID NO: 625615 - DNA, 20 bp, Artificial
  CRISPR gRNA sequence
gtttgaaggaaagagaccag

SEQ ID NO: 625616 - DNA, 20 bp, Artificial
  CRISPR gRNA sequence
aactagttgtccgccaaaaa

SEQ ID NO: 625617 - DNA, 20 bp, Artificial
  CRISPR gRNA sequence
ttcatagcaggacaaggagt

SEQ ID NO: 625618 - DNA, 20 bp, Artificial
  CRISPR gRNA sequence
agacatgcatcccagttttg

SEQ ID NO: 625619 - DNA, 20 bp, Artificial
  CRISPR gRNA sequence
cagtcattctgagtatcaaa

SEQ ID NO: 625620 - DNA, 20 bp, Artificial
  CRISPR gRNA sequence
ttttatctagcctgctgttt

SEQ ID NO: 625621 - DNA, 20 bp, Artificial
  CRISPR gRNA sequence
gttggaataataacagtatt

SEQ ID NO: 625622 - DNA, 20 bp, Artificial
  CRISPR gRNA sequence
tggagtaactccagtgggtt

SEQ ID NO: 625623 - DNA, 20 bp, Artificial
  CRISPR gRNA sequence
atatagctatattgaacaga

SEQ ID NO: 625624 - DNA, 20 bp, Artificial
  CRISPR gRNA sequence
acagagaagaaagaggatgg

SEQ ID NO: 625625 - DNA, 20 bp, Artificial
  CRISPR gRNA sequence
aggtgatgtgatatacagat

SEQ ID NO: 625626 - DNA, 20 bp, Artificial
  CRISPR gRNA sequence
aaattctttaaggatgttgt

SEQ ID NO: 625627 - DNA, 20 bp, Artificial
  CRISPR gRNA sequence
atcatgtttggtgtttctgt

SEQ ID NO: 625628 - DNA, 20 bp, Artificial
  CRISPR gRNA sequence
cccacttgaattgccaggga

SEQ ID NO: 625629 - DNA, 20 bp, Artificial
  CRISPR gRNA sequence
actttttttcatttggtaag

SEQ ID NO: 625630 - DNA, 20 bp, Artificial
  CRISPR gRNA sequence
aaaaataagtcaccaatttc

SEQ ID NO: 625631 - DNA, 20 bp, Artificial
  CRISPR gRNA sequence
ccaatttcatagaaattaaa

SEQ ID NO: 625632 - DNA, 20 bp, Artificial
  CRISPR gRNA sequence
ataaatacatcactttaaat

SEQ ID NO: 625633 - DNA, 20 bp, Artificial
  CRISPR gRNA sequence
actaacttgtttgtagatta

SEQ ID NO: 625634 - DNA, 20 bp, Artificial
  CRISPR gRNA sequence
taataataaagttttaactt

SEQ ID NO: 625635 - DNA, 20 bp, Artificial
  CRISPR gRNA sequence
ataaaattctaatgatgagg

SEQ ID NO: 625636 - DNA, 20 bp, Artificial
  CRISPR gRNA sequence
ttcttaaaaattttaaaaat

SEQ ID NO: 625637 - DNA, 20 bp, Artificial
  CRISPR gRNA sequence
aattgagaattcatattatt

SEQ ID NO: 625638 - DNA, 20 bp, Artificial
  CRISPR gRNA sequence
actggtttaatgatttttta

SEQ ID NO: 625639 - DNA, 20 bp, Artificial
  CRISPR gRNA sequence
ttttcaagtacaatggtggc

SEQ ID NO: 625640 - DNA, 20 bp, Artificial
  CRISPR gRNA sequence
agcctttgattgtagagagc

SEQ ID NO: 625641 - DNA, 20 bp, Artificial
  CRISPR gRNA sequence
gtgccattacaactgaagta

SEQ ID NO: 625642 - DNA, 20 bp, Artificial
  CRISPR gRNA sequence
tacattctttatttcatatc

SEQ ID NO: 625643 - DNA, 20 bp, Artificial
  CRISPR gRNA sequence
tgaaaaataactcttggtat

SEQ ID NO: 625644 - DNA, 20 bp, Artificial
  CRISPR gRNA sequence
atatatatataagttataat

SEQ ID NO: 625645 - DNA, 20 bp, Artificial
  CRISPR gRNA sequence
atgggagagtttctatgagt

SEQ ID NO: 625646 - DNA, 20 bp, Artificial
  CRISPR gRNA sequence
ctatgtaatagttaagattc

SEQ ID NO: 625647 - DNA, 20 bp, Artificial
  CRISPR gRNA sequence
aaagaataattgcttttatt

SEQ ID NO: 625648 - DNA, 20 bp, Artificial
  CRISPR gRNA sequence
tacttctttatagtattgtt

SEQ ID NO: 625649 - DNA, 20 bp, Artificial
  CRISPR gRNA sequence
gattttaaaagtctccctta

SEQ ID NO: 625650 - DNA, 20 bp, Artificial
  CRISPR gRNA sequence
ttaccagaaaaaataccatg

SEQ ID NO: 625651 - DNA, 20 bp, Artificial
  CRISPR gRNA sequence
aaaacctgttgatgcaagat

SEQ ID NO: 625652 - DNA, 20 bp, Artificial
  CRISPR gRNA sequence
taaagagcatttaaattcag

SEQ ID NO: 625653 - DNA, 20 bp, Artificial
  CRISPR gRNA sequence
gagaaaagactgacaacctg

SEQ ID NO: 625654 - DNA, 20 bp, Artificial
  CRISPR gRNA sequence
acaactttgataaataattc

SEQ ID NO: 625655 - DNA, 20 bp, Artificial
  CRISPR gRNA sequence
taaaataatgtctgtaatag

SEQ ID NO: 625656 - DNA, 20 bp, Artificial
  CRISPR gRNA sequence
atgtctgtaatagcaagaaa

SEQ ID NO: 625657 - DNA, 20 bp, Artificial
  CRISPR gRNA sequence
tcaatatagttggtactctg

SEQ ID NO: 625658 - DNA, 20 bp, Artificial
  CRISPR gRNA sequence
cacagactgtgtggtttctc

SEQ ID NO: 625659 - DNA, 20 bp, Artificial
  CRISPR gRNA sequence
gtaactttgatatgacttct

SEQ ID NO: 625660 - DNA, 20 bp, Artificial
  CRISPR gRNA sequence
gaaaagactctgtcagcaat

SEQ ID NO: 625661 - DNA, 20 bp, Artificial
  CRISPR gRNA sequence
ttccataggtaattttttag

SEQ ID NO: 625662 - DNA, 20 bp, Artificial
  CRISPR gRNA sequence
caagtactctgatgtgaaac

SEQ ID NO: 625663 - DNA, 20 bp, Artificial
  CRISPR gRNA sequence
aaaaagcaaatgtctaagtg

SEQ ID NO: 625664 - DNA, 20 bp, Artificial
  CRISPR gRNA sequence
atttagtaggatgacaatga

SEQ ID NO: 625665 - DNA, 20 bp, Artificial
  CRISPR gRNA sequence
gagtagaaaagagatgtagg

SEQ ID NO: 625666 - DNA, 20 bp, Artificial
  CRISPR gRNA sequence
ttacagcaaattcagtaaag

SEQ ID NO: 625667 - DNA, 20 bp, Artificial
  CRISPR gRNA sequence
gtcacactggtaagcagctg

SEQ ID NO: 625668 - DNA, 20 bp, Artificial
  CRISPR gRNA sequence
cagtggtgaaaactaccttt

SEQ ID NO: 625669 - DNA, 20 bp, Artificial
  CRISPR gRNA sequence
aattctgctagtattggatt

SEQ ID NO: 625670 - DNA, 20 bp, Artificial
  CRISPR gRNA sequence
cttcaaatctgaatagcata

SEQ ID NO: 625671 - DNA, 20 bp, Artificial
  CRISPR gRNA sequence
ataagggttcaaaaggtata

SEQ ID NO: 625672 - DNA, 20 bp, Artificial
  CRISPR gRNA sequence
tttttttttcttaaaaagca

SEQ ID NO: 625673 - DNA, 20 bp, Artificial
  CRISPR gRNA sequence
ttttaaaatatacttttttg

SEQ ID NO: 625674 - DNA, 20 bp, Artificial
  CRISPR gRNA sequence
gaacctttcataatacacat

SEQ ID NO: 625675 - DNA, 20 bp, Artificial
  CRISPR gRNA sequence
tgcttggtatgtcagtatac

SEQ ID NO: 625676 - DNA, 20 bp, Artificial
  CRISPR gRNA sequence
ttctttaatttttaagtgtc

SEQ ID NO: 625677 - DNA, 20 bp, Artificial
  CRISPR gRNA sequence
tgatcttttatgttctgaat

SEQ ID NO: 625678 - DNA, 20 bp, Artificial
  CRISPR gRNA sequence
aaagaaccagagtacagttt

SEQ ID NO: 625679 - DNA, 20 bp, Artificial
  CRISPR gRNA sequence
actttaataccattttgaga

SEQ ID NO: 625680 - DNA, 20 bp, Artificial
  CRISPR gRNA sequence
ttctttaatttaaactagat

SEQ ID NO: 625681 - DNA, 20 bp, Artificial
  CRISPR gRNA sequence
ctagattgagaaaaatgtag

SEQ ID NO: 625682 - DNA, 20 bp, Artificial
  CRISPR gRNA sequence
ttaaaaccttataatgcctt

SEQ ID NO: 625683 - DNA, 20 bp, Artificial
  CRISPR gRNA sequence
tattttagtgtttttagttc

SEQ ID NO: 625684 - DNA, 20 bp, Artificial
  CRISPR gRNA sequence
atcgattggacattatacat

SEQ ID NO: 625685 - DNA, 20 bp, Artificial
  CRISPR gRNA sequence
ttgaatatttaaatgcaggt

SEQ ID NO: 625686 - DNA, 20 bp, Artificial
  CRISPR gRNA sequence
tttaaagaacaaattattta

SEQ ID NO: 625687 - DNA, 20 bp, Artificial
  CRISPR gRNA sequence
tgcatatgtaccatttgcat

SEQ ID NO: 625688 - DNA, 20 bp, Artificial
  CRISPR gRNA sequence
aaaagggttgctaatgtttt

SEQ ID NO: 625689 - DNA, 20 bp, Artificial
  CRISPR gRNA sequence
gaatataactatgtatactt

SEQ ID NO: 625690 - DNA, 20 bp, Artificial
  CRISPR gRNA sequence
ttttctcttaccaaaaaaag

SEQ ID NO: 625691 - DNA, 20 bp, Artificial
  CRISPR gRNA sequence
tttagactagcattattttt

SEQ ID NO: 625692 - DNA, 20 bp, Artificial
  CRISPR gRNA sequence
gcctgtgattccattaggaa

SEQ ID NO: 625693 - DNA, 20 bp, Artificial
  CRISPR gRNA sequence
cataagagctccagatttct

SEQ ID NO: 625694 - DNA, 20 bp, Artificial
  CRISPR gRNA sequence
ctcccaaaacactaaatact

SEQ ID NO: 625695 - DNA, 20 bp, Artificial
  CRISPR gRNA sequence
ttttataacaaatctatatg

SEQ ID NO: 625696 - DNA, 20 bp, Artificial
  CRISPR gRNA sequence
agaattttcaatagctgctg

SEQ ID NO: 625697 - DNA, 20 bp, Artificial
  CRISPR gRNA sequence
cctcttagctttctttaata

SEQ ID NO: 625698 - DNA, 20 bp, Artificial
  CRISPR gRNA sequence
tttttgaaaaactattaaaa

SEQ ID NO: 625699 - DNA, 20 bp, Artificial
  CRISPR gRNA sequence
atcatcatctaactgcaggt

SEQ ID NO: 625700 - DNA, 20 bp, Artificial
  CRISPR gRNA sequence
acttcatagcaatatcagta

SEQ ID NO: 625701 - DNA, 20 bp, Artificial
  CRISPR gRNA sequence
tatcagtaatagaaaaacgg

SEQ ID NO: 625702 - DNA, 20 bp, Artificial
  CRISPR gRNA sequence
ggttttactattagtgacca

SEQ ID NO: 625703 - DNA, 20 bp, Artificial
  CRISPR gRNA sequence
ctattagtgaccaggagaat

SEQ ID NO: 625704 - DNA, 20 bp, Artificial
  CRISPR gRNA sequence
tttaaagagatagcatggta

SEQ ID NO: 625705 - DNA, 20 bp, Artificial
  CRISPR gRNA sequence
caacctaattattgtcattg

SEQ ID NO: 625706 - DNA, 20 bp, Artificial
  CRISPR gRNA sequence
aagtgtcaccaactccttga

SEQ ID NO: 625707 - DNA, 20 bp, Artificial
  CRISPR gRNA sequence
tttttagactttacggcttg

SEQ ID NO: 625708 - DNA, 20 bp, Artificial
  CRISPR gRNA sequence
gagtatcttacttcaatata

SEQ ID NO: 625709 - DNA, 20 bp, Artificial
  CRISPR gRNA sequence
cttacttcaatatattagaa

SEQ ID NO: 625710 - DNA, 20 bp, Artificial
  CRISPR gRNA sequence
taattttaaaattttacaat

SEQ ID NO: 625711 - DNA, 20 bp, Artificial
  CRISPR gRNA sequence
ttttaaacttgaaaatatac

SEQ ID NO: 625712 - DNA, 20 bp, Artificial
  CRISPR gRNA sequence
tcataaatcatttaaaaaat

SEQ ID NO: 625713 - DNA, 20 bp, Artificial
  CRISPR gRNA sequence
atgacaaattcttgggaata

SEQ ID NO: 625714 - DNA, 20 bp, Artificial
  CRISPR gRNA sequence
aaaaataaatttaatgtttt

SEQ ID NO: 625715 - DNA, 20 bp, Artificial
  CRISPR gRNA sequence
tttaatgtttttaagaaatg

SEQ ID NO: 625716 - DNA, 20 bp, Artificial
  CRISPR gRNA sequence
gccagaatataacacataaa

SEQ ID NO: 625717 - DNA, 20 bp, Artificial
  CRISPR gRNA sequence
aatataacacataaaagaga

SEQ ID NO: 625718 - DNA, 20 bp, Artificial
  CRISPR gRNA sequence
cataaaagagaaaagaatga

SEQ ID NO: 625719 - DNA, 20 bp, Artificial
  CRISPR gRNA sequence
gttaaaggtggaaaattaat

SEQ ID NO: 625720 - DNA, 20 bp, Artificial
  CRISPR gRNA sequence
gtttttgctcctctaagttg

SEQ ID NO: 625721 - DNA, 20 bp, Artificial
  CRISPR gRNA sequence
ggaccagatctctgaaacct

SEQ ID NO: 625722 - DNA, 20 bp, Artificial
  CRISPR gRNA sequence
ggagcttgcaaaaatattga

SEQ ID NO: 625723 - DNA, 20 bp, Artificial
  CRISPR gRNA sequence
cactttgtacattggcccac

SEQ ID NO: 625724 - DNA, 20 bp, Artificial
  CRISPR gRNA sequence
ctacagtgaatgccctctgg

SEQ ID NO: 625725 - DNA, 20 bp, Artificial
  CRISPR gRNA sequence
gccctctggagagaatttac

SEQ ID NO: 625726 - DNA, 20 bp, Artificial
  CRISPR gRNA sequence
catcctcatcaactagtcac

SEQ ID NO: 625727 - DNA, 20 bp, Artificial
  CRISPR gRNA sequence
caaatggagattagttattg

SEQ ID NO: 625728 - DNA, 20 bp, Artificial
  CRISPR gRNA sequence
tgttatacaaattaccttaa

SEQ ID NO: 625729 - DNA, 20 bp, Artificial
  CRISPR gRNA sequence
ctactgtctgttattcatcc

SEQ ID NO: 625730 - DNA, 20 bp, Artificial
  CRISPR gRNA sequence
tttatcagtcaggatcctga

SEQ ID NO: 625731 - DNA, 20 bp, Artificial
  CRISPR gRNA sequence
atgaaagacaaatattcaca

SEQ ID NO: 625732 - DNA, 20 bp, Artificial
  CRISPR gRNA sequence
tttactagctctagcctgaa

SEQ ID NO: 625733 - DNA, 20 bp, Artificial
  CRISPR gRNA sequence
tctagaggtcactggaatta

SEQ ID NO: 625734 - DNA, 20 bp, Artificial
  CRISPR gRNA sequence
ttgagcactgaccttcggta

SEQ ID NO: 625735 - DNA, 20 bp, Artificial
  CRISPR gRNA sequence
aatggctatggcagccaaac

SEQ ID NO: 625736 - DNA, 20 bp, Artificial
  CRISPR gRNA sequence
cctacttggtgtgctcctta

SEQ ID NO: 625737 - DNA, 20 bp, Artificial
  CRISPR gRNA sequence
ttttatgaatattattattg

SEQ ID NO: 625738 - DNA, 20 bp, Artificial
  CRISPR gRNA sequence
ctgtgatagatgttacagtt

SEQ ID NO: 625739 - DNA, 20 bp, Artificial
  CRISPR gRNA sequence
gccaagctcttttctttcag

SEQ ID NO: 625740 - DNA, 20 bp, Artificial
  CRISPR gRNA sequence
ttttgcccacattcacttct

SEQ ID NO: 625741 - DNA, 20 bp, Artificial
  CRISPR gRNA sequence
aagtggtaaaatttggtttc

SEQ ID NO: 625742 - DNA, 20 bp, Artificial
  CRISPR gRNA sequence
aaagaagaacgtatgagctc

SEQ ID NO: 625743 - DNA, 20 bp, Artificial
  CRISPR gRNA sequence
tccattagtatgttttacaa

SEQ ID NO: 625744 - DNA, 20 bp, Artificial
  CRISPR gRNA sequence
tattcctattgtacactgag

SEQ ID NO: 625745 - DNA, 20 bp, Artificial
  CRISPR gRNA sequence
tctgatagccttgaagtgtc

SEQ ID NO: 625746 - DNA, 20 bp, Artificial
  CRISPR gRNA sequence
atagccttgaagtgtctaag

SEQ ID NO: 625747 - DNA, 20 bp, Artificial
  CRISPR gRNA sequence
cagtcaagttattagcccac

SEQ ID NO: 625748 - DNA, 20 bp, Artificial
  CRISPR gRNA sequence
tttaaaaattctaggaggaa

SEQ ID NO: 625749 - DNA, 20 bp, Artificial
  CRISPR gRNA sequence
gagtgtataattttaatata

SEQ ID NO: 625750 - DNA, 20 bp, Artificial
  CRISPR gRNA sequence
tttctttttataaattataa

SEQ ID NO: 625751 - DNA, 20 bp, Artificial
  CRISPR gRNA sequence
ataaagagaaaaatgatgag

SEQ ID NO: 625752 - DNA, 20 bp, Artificial
  CRISPR gRNA sequence
agtagagggtgggacgaagg

SEQ ID NO: 625753 - DNA, 20 bp, Artificial
  CRISPR gRNA sequence
tgggacgaaggagagaatca

SEQ ID NO: 625754 - DNA, 20 bp, Artificial
  CRISPR gRNA sequence
ttaaaataaaagttaaaaaa

SEQ ID NO: 625755 - DNA, 20 bp, Artificial
  CRISPR gRNA sequence
atgaaaaattcaattttggc

SEQ ID NO: 625756 - DNA, 20 bp, Artificial
  CRISPR gRNA sequence
ataagtaaaatgtccttaag

SEQ ID NO: 625757 - DNA, 20 bp, Artificial
  CRISPR gRNA sequence
atttttgttcatcctcattt

SEQ ID NO: 625758 - DNA, 20 bp, Artificial
  CRISPR gRNA sequence
attttatccacaaaaatagc

SEQ ID NO: 625759 - DNA, 20 bp, Artificial
  CRISPR gRNA sequence
agttatgccttcacctatta

SEQ ID NO: 625760 - DNA, 20 bp, Artificial
  CRISPR gRNA sequence
tatttccacatttatcttta

SEQ ID NO: 625761 - DNA, 20 bp, Artificial
  CRISPR gRNA sequence
ggtatatgctacatgccctc

SEQ ID NO: 625762 - DNA, 20 bp, Artificial
  CRISPR gRNA sequence
catctttgaccatattgttt

SEQ ID NO: 625763 - DNA, 20 bp, Artificial
  CRISPR gRNA sequence
ttgctctagttttaaatctc

SEQ ID NO: 625764 - DNA, 20 bp, Artificial
  CRISPR gRNA sequence
ttttttttttgtaatgactt

SEQ ID NO: 625765 - DNA, 20 bp, Artificial
  CRISPR gRNA sequence
gagtgagactctgtctcaaa

SEQ ID NO: 625766 - DNA, 20 bp, Artificial
  CRISPR gRNA sequence
agactctgtctcaaaaaaga

SEQ ID NO: 625767 - DNA, 20 bp, Artificial
  CRISPR gRNA sequence
ctgtctcaaaaaagaaaaga

SEQ ID NO: 625768 - DNA, 20 bp, Artificial
  CRISPR gRNA sequence
tcaaaaaagaaaagaaaaga

SEQ ID NO: 625769 - DNA, 20 bp, Artificial
  CRISPR gRNA sequence
ctttttttttttttttaagg

SEQ ID NO: 625770 - DNA, 20 bp, Artificial
  CRISPR gRNA sequence
ttgaattaaattatgctggt

SEQ ID NO: 625771 - DNA, 20 bp, Artificial
  CRISPR gRNA sequence
tatgctttgcaataaacact

SEQ ID NO: 625772 - DNA, 20 bp, Artificial
  CRISPR gRNA sequence
cttcgttattgtttctaata

SEQ ID NO: 625773 - DNA, 20 bp, Artificial
  CRISPR gRNA sequence
cctttattatcaggagttct

SEQ ID NO: 625774 - DNA, 20 bp, Artificial
  CRISPR gRNA sequence
ttgatctgtgtatgtgagtc

SEQ ID NO: 625775 - DNA, 20 bp, Artificial
  CRISPR gRNA sequence
tactatcttgccaaatactg

SEQ ID NO: 625776 - DNA, 20 bp, Artificial
  CRISPR gRNA sequence
tgtaagaaaactctcaaatg

SEQ ID NO: 625777 - DNA, 20 bp, Artificial
  CRISPR gRNA sequence
atggtagaaaatcagacaaa

SEQ ID NO: 625778 - DNA, 20 bp, Artificial
  CRISPR gRNA sequence
cataagcatgtaaaatatat

SEQ ID NO: 625779 - DNA, 20 bp, Artificial
  CRISPR gRNA sequence
ttaaagttttatgtaaggta

SEQ ID NO: 625780 - DNA, 20 bp, Artificial
  CRISPR gRNA sequence
gtggagtccttttaaattgt

SEQ ID NO: 625781 - DNA, 20 bp, Artificial
  CRISPR gRNA sequence
aatgattataagcaactgga

SEQ ID NO: 625782 - DNA, 20 bp, Artificial
  CRISPR gRNA sequence
tttgaatattcttatattaa

SEQ ID NO: 625783 - DNA, 20 bp, Artificial
  CRISPR gRNA sequence
agataagtagagtcaagttt

SEQ ID NO: 625784 - DNA, 20 bp, Artificial
  CRISPR gRNA sequence
acacccacagcacaataaaa

SEQ ID NO: 625785 - DNA, 20 bp, Artificial
  CRISPR gRNA sequence
atctattctccagatagcaa

SEQ ID NO: 625786 - DNA, 20 bp, Artificial
  CRISPR gRNA sequence
atcttaataaaaagcttgaa

SEQ ID NO: 625787 - DNA, 20 bp, Artificial
  CRISPR gRNA sequence
ttttaataaggggagacggg

SEQ ID NO: 625788 - DNA, 20 bp, Artificial
  CRISPR gRNA sequence
attaaaaaaaatatatactc

SEQ ID NO: 625789 - DNA, 20 bp, Artificial
  CRISPR gRNA sequence
acacacaactggcattaggg

SEQ ID NO: 625790 - DNA, 20 bp, Artificial
  CRISPR gRNA sequence
gttagaatttgagatccaag

SEQ ID NO: 625791 - DNA, 20 bp, Artificial
  CRISPR gRNA sequence
taagcctgagttcttgtaat

SEQ ID NO: 625792 - DNA, 20 bp, Artificial
  CRISPR gRNA sequence
ttctcactttaaatcaaaag

SEQ ID NO: 625793 - DNA, 20 bp, Artificial
  CRISPR gRNA sequence
aatgcaaaggaaatgttatt

SEQ ID NO: 625794 - DNA, 20 bp, Artificial
  CRISPR gRNA sequence
tccagtgaacacacaagtga

SEQ ID NO: 625795 - DNA, 20 bp, Artificial
  CRISPR gRNA sequence
actgccttacttctgattat

SEQ ID NO: 625796 - DNA, 20 bp, Artificial
  CRISPR gRNA sequence
cgagatgtgaggaaactgca

SEQ ID NO: 625797 - DNA, 20 bp, Artificial
  CRISPR gRNA sequence
tccaaaaattctaaggtcct

SEQ ID NO: 625798 - DNA, 20 bp, Artificial
  CRISPR gRNA sequence
gcctattgtttagacactgc

SEQ ID NO: 625799 - DNA, 20 bp, Artificial
  CRISPR gRNA sequence
gaaaaccttctggaaaggat

SEQ ID NO: 625800 - DNA, 20 bp, Artificial
  CRISPR gRNA sequence
ataaaggaactgcagatgtg

SEQ ID NO: 625801 - DNA, 20 bp, Artificial
  CRISPR gRNA sequence
agttgcttcttacaatgggc

SEQ ID NO: 625802 - DNA, 20 bp, Artificial
  CRISPR gRNA sequence
gagagttgaatccaattttg

SEQ ID NO: 625803 - DNA, 20 bp, Artificial
  CRISPR gRNA sequence
cttattttaggtgttaagtt

SEQ ID NO: 625804 - DNA, 20 bp, Artificial
  CRISPR gRNA sequence
aaatgtgttaacttaaagtg

SEQ ID NO: 625805 - DNA, 20 bp, Artificial
  CRISPR gRNA sequence
catggaatactggaggtgct

SEQ ID NO: 625806 - DNA, 20 bp, Artificial
  CRISPR gRNA sequence
ctactcaggaggctgaggct

SEQ ID NO: 625807 - DNA, 20 bp, Artificial
  CRISPR gRNA sequence
accaaacaaaaaaaaaaaaa

SEQ ID NO: 625808 - DNA, 20 bp, Artificial
  CRISPR gRNA sequence
tcatatacattgtaaatctc

SEQ ID NO: 625809 - DNA, 20 bp, Artificial
  CRISPR gRNA sequence
tcattaagacttctaaagat

SEQ ID NO: 625810 - DNA, 20 bp, Artificial
  CRISPR gRNA sequence
tctaaaaaattccatatcag

SEQ ID NO: 625811 - DNA, 20 bp, Artificial
  CRISPR gRNA sequence
attttaaaacttaaaacagt

SEQ ID NO: 625812 - DNA, 20 bp, Artificial
  CRISPR gRNA sequence
actaccaacaattttgacca

SEQ ID NO: 625813 - DNA, 20 bp, Artificial
  CRISPR gRNA sequence
cataagtcaaataggtaagt

SEQ ID NO: 625814 - DNA, 20 bp, Artificial
  CRISPR gRNA sequence
tcaatttctgatcaatttat

SEQ ID NO: 625815 - DNA, 20 bp, Artificial
  CRISPR gRNA sequence
gtttcactaatgcaagtgta

SEQ ID NO: 625816 - DNA, 20 bp, Artificial
  CRISPR gRNA sequence
aacacataatttggcatcat

SEQ ID NO: 625817 - DNA, 20 bp, Artificial
  CRISPR gRNA sequence
tcagctagatgaaataaaaa

SEQ ID NO: 625818 - DNA, 20 bp, Artificial
  CRISPR gRNA sequence
aattattgactctcattcag

SEQ ID NO: 625819 - DNA, 20 bp, Artificial
  CRISPR gRNA sequence
gaagttaaaaaccttcccac

SEQ ID NO: 625820 - DNA, 20 bp, Artificial
  CRISPR gRNA sequence
tatttaaggaaaatgtaatt

SEQ ID NO: 625821 - DNA, 20 bp, Artificial
  CRISPR gRNA sequence
ggaacaaattcctccagaca

SEQ ID NO: 625822 - DNA, 20 bp, Artificial
  CRISPR gRNA sequence
caccaaaatcaaagacatta

SEQ ID NO: 625823 - DNA, 20 bp, Artificial
  CRISPR gRNA sequence
ttccatattaacagactaaa

SEQ ID NO: 625824 - DNA, 20 bp, Artificial
  CRISPR gRNA sequence
tttagtctgtctttaaagtt

SEQ ID NO: 625825 - DNA, 20 bp, Artificial
  CRISPR gRNA sequence
taaaaattctctgcaactga

SEQ ID NO: 625826 - DNA, 20 bp, Artificial
  CRISPR gRNA sequence
ttatcatttgatgagtgtaa

SEQ ID NO: 625827 - DNA, 20 bp, Artificial
  CRISPR gRNA sequence
gaacagttggacattggaat

SEQ ID NO: 625828 - DNA, 20 bp, Artificial
  CRISPR gRNA sequence
aaatcccaacaagcttttta

SEQ ID NO: 625829 - DNA, 20 bp, Artificial
  CRISPR gRNA sequence
ttaatggaatggaatagagt

SEQ ID NO: 625830 - DNA, 20 bp, Artificial
  CRISPR gRNA sequence
cagagacatacgctcatatt

SEQ ID NO: 625831 - DNA, 20 bp, Artificial
  CRISPR gRNA sequence
tatttatataatacttttaa

SEQ ID NO: 625832 - DNA, 20 bp, Artificial
  CRISPR gRNA sequence
aaaaaggcttcaaaatgtta

SEQ ID NO: 625833 - DNA, 20 bp, Artificial
  CRISPR gRNA sequence
gggtaccatcagttccaact

SEQ ID NO: 625834 - DNA, 20 bp, Artificial
  CRISPR gRNA sequence
aggggtaagtggcactggat

SEQ ID NO: 625835 - DNA, 20 bp, Artificial
  CRISPR gRNA sequence
ttccatttctatactattaa

SEQ ID NO: 625836 - DNA, 20 bp, Artificial
  CRISPR gRNA sequence
ctattgaaagaccacagaag

SEQ ID NO: 625837 - DNA, 20 bp, Artificial
  CRISPR gRNA sequence
aaaaataacccacatattat

SEQ ID NO: 625838 - DNA, 20 bp, Artificial
  CRISPR gRNA sequence
ggcatatctaactatggtaa

SEQ ID NO: 625839 - DNA, 20 bp, Artificial
  CRISPR gRNA sequence
aaataatcattaacgtaata

SEQ ID NO: 625840 - DNA, 20 bp, Artificial
  CRISPR gRNA sequence
acgtaataaaagaaaaggac

SEQ ID NO: 625841 - DNA, 20 bp, Artificial
  CRISPR gRNA sequence
aattcagcattaccataaat

SEQ ID NO: 625842 - DNA, 20 bp, Artificial
  CRISPR gRNA sequence
taccataaatctagaatctg

SEQ ID NO: 625843 - DNA, 20 bp, Artificial
  CRISPR gRNA sequence
aaaaaatgcaagaggataat

SEQ ID NO: 625844 - DNA, 20 bp, Artificial
  CRISPR gRNA sequence
tgaatattttacatttgaaa

SEQ ID NO: 625845 - DNA, 20 bp, Artificial
  CRISPR gRNA sequence
tttgaaattagaaagagatt

SEQ ID NO: 625846 - DNA, 20 bp, Artificial
  CRISPR gRNA sequence
agagatttaagaaaaactaa

SEQ ID NO: 625847 - DNA, 20 bp, Artificial
  CRISPR gRNA sequence
aaagtcacagataatataag

SEQ ID NO: 625848 - DNA, 20 bp, Artificial
  CRISPR gRNA sequence
atacaggaatagttctttag

SEQ ID NO: 625849 - DNA, 20 bp, Artificial
  CRISPR gRNA sequence
gatgtggaggatttcaagag

SEQ ID NO: 625850 - DNA, 20 bp, Artificial
  CRISPR gRNA sequence
taaaataattacacacggga

SEQ ID NO: 625851 - DNA, 20 bp, Artificial
  CRISPR gRNA sequence
ctgaactaggacgttgattg

SEQ ID NO: 625852 - DNA, 20 bp, Artificial
  CRISPR gRNA sequence
atgaaaagaagggatcaact

SEQ ID NO: 625853 - DNA, 20 bp, Artificial
  CRISPR gRNA sequence
tcattttacgagtccagtat

SEQ ID NO: 625854 - DNA, 20 bp, Artificial
  CRISPR gRNA sequence
aaaacaggagacccaagaca

SEQ ID NO: 625855 - DNA, 20 bp, Artificial
  CRISPR gRNA sequence
tcaaaaatgtttcaataata

SEQ ID NO: 625856 - DNA, 20 bp, Artificial
  CRISPR gRNA sequence
atttttatgaactttatttt

SEQ ID NO: 625857 - DNA, 20 bp, Artificial
  CRISPR gRNA sequence
taagaaatagtatgaaatgg

SEQ ID NO: 625858 - DNA, 20 bp, Artificial
  CRISPR gRNA sequence
ttttcaaaggagtagtaagg

SEQ ID NO: 625859 - DNA, 20 bp, Artificial
  CRISPR gRNA sequence
aaaataaatgactacaggtc

SEQ ID NO: 625860 - DNA, 20 bp, Artificial
  CRISPR gRNA sequence
ccagagcaaatttattggaa

SEQ ID NO: 625861 - DNA, 20 bp, Artificial
  CRISPR gRNA sequence
tattggaaatagaatagttt

SEQ ID NO: 625862 - DNA, 20 bp, Artificial
  CRISPR gRNA sequence
ctaataattgggttgctgga

SEQ ID NO: 625863 - DNA, 20 bp, Artificial
  CRISPR gRNA sequence
atgagagtagtaaaaagtga

SEQ ID NO: 625864 - DNA, 20 bp, Artificial
  CRISPR gRNA sequence
agggttgtgagccaagggga

SEQ ID NO: 625865 - DNA, 20 bp, Artificial
  CRISPR gRNA sequence
agaaggtataatgattgctt

SEQ ID NO: 625866 - DNA, 20 bp, Artificial
  CRISPR gRNA sequence
attgcttacagaaataaggg

SEQ ID NO: 625867 - DNA, 20 bp, Artificial
  CRISPR gRNA sequence
aataaggggaagaaagtata

SEQ ID NO: 625868 - DNA, 20 bp, Artificial
  CRISPR gRNA sequence
ataaattcattactatttct

SEQ ID NO: 625869 - DNA, 20 bp, Artificial
  CRISPR gRNA sequence
acagtattctcagctacttc

SEQ ID NO: 625870 - DNA, 20 bp, Artificial
  CRISPR gRNA sequence
gtattataaaagctgatgag

SEQ ID NO: 625871 - DNA, 20 bp, Artificial
  CRISPR gRNA sequence
tttttaatcttcttggtacc

SEQ ID NO: 625872 - DNA, 20 bp, Artificial
  CRISPR gRNA sequence
aattctctgcccttacccga

SEQ ID NO: 625873 - DNA, 20 bp, Artificial
  CRISPR gRNA sequence
gatcaccaggccctcaaggt

SEQ ID NO: 625874 - DNA, 20 bp, Artificial
  CRISPR gRNA sequence
ggtctagaatacagtcagag

SEQ ID NO: 625875 - DNA, 20 bp, Artificial
  CRISPR gRNA sequence
gtcttcttgtctttgtcttg

SEQ ID NO: 625876 - DNA, 20 bp, Artificial
  CRISPR gRNA sequence
gaacgctgccacaactatct

SEQ ID NO: 625877 - DNA, 20 bp, Artificial
  CRISPR gRNA sequence
gtcatgagtcaccatggtgg

SEQ ID NO: 625878 - DNA, 20 bp, Artificial
  CRISPR gRNA sequence
attagtctgtaggctgccta

SEQ ID NO: 625879 - DNA, 20 bp, Artificial
  CRISPR gRNA sequence
aatcggccctttaattttta

SEQ ID NO: 625880 - DNA, 20 bp, Artificial
  CRISPR gRNA sequence
ccttctagtttctataatct

SEQ ID NO: 625881 - DNA, 20 bp, Artificial
  CRISPR gRNA sequence
tgttggcagattgaactttt

SEQ ID NO: 625882 - DNA, 20 bp, Artificial
  CRISPR gRNA sequence
ggtagcttctgataccattt

SEQ ID NO: 625883 - DNA, 20 bp, Artificial
  CRISPR gRNA sequence
aggagttgataaatactgta

SEQ ID NO: 625884 - DNA, 20 bp, Artificial
  CRISPR gRNA sequence
aagaggcattttcactttac

SEQ ID NO: 625885 - DNA, 20 bp, Artificial
  CRISPR gRNA sequence
agttctctgggaacatagat

SEQ ID NO: 625886 - DNA, 20 bp, Artificial
  CRISPR gRNA sequence
gcatatatcaggcaggatac

SEQ ID NO: 625887 - DNA, 20 bp, Artificial
  CRISPR gRNA sequence
tacagagaatgtatattcaa

SEQ ID NO: 625888 - DNA, 20 bp, Artificial
  CRISPR gRNA sequence
tattaatgaggtaatcaaat

SEQ ID NO: 625889 - DNA, 20 bp, Artificial
  CRISPR gRNA sequence
actggaaatgacaatgccaa

SEQ ID NO: 625890 - DNA, 20 bp, Artificial
  CRISPR gRNA sequence
attgaagacatatttaggag

SEQ ID NO: 625891 - DNA, 20 bp, Artificial
  CRISPR gRNA sequence
ggaggtagaataaaatggtc

SEQ ID NO: 625892 - DNA, 20 bp, Artificial
  CRISPR gRNA sequence
gtattagagacacaaataca

SEQ ID NO: 625893 - DNA, 20 bp, Artificial
  CRISPR gRNA sequence
aatggagaagggtgtttcct

SEQ ID NO: 625894 - DNA, 20 bp, Artificial
  CRISPR gRNA sequence
ggcagaagactggatgaaag

SEQ ID NO: 625895 - DNA, 20 bp, Artificial
  CRISPR gRNA sequence
atatggtaattaggaaaata

SEQ ID NO: 625896 - DNA, 20 bp, Artificial
  CRISPR gRNA sequence
ggtaattaggaaaatagaag

SEQ ID NO: 625897 - DNA, 20 bp, Artificial
  CRISPR gRNA sequence
tcagcactgccaaatgctgt

SEQ ID NO: 625898 - DNA, 20 bp, Artificial
  CRISPR gRNA sequence
ttttttagatcgggtaacac

SEQ ID NO: 625899 - DNA, 20 bp, Artificial
  CRISPR gRNA sequence
gtgaactgtttggtttttca

SEQ ID NO: 625900 - DNA, 20 bp, Artificial
  CRISPR gRNA sequence
aatgcattattgagatatct

SEQ ID NO: 625901 - DNA, 20 bp, Artificial
  CRISPR gRNA sequence
atgtttctagcaatgtatac

SEQ ID NO: 625902 - DNA, 20 bp, Artificial
  CRISPR gRNA sequence
ttattattattgccgatgtg

SEQ ID NO: 625903 - DNA, 20 bp, Artificial
  CRISPR gRNA sequence
atgaaaagggctattgtaaa

SEQ ID NO: 625904 - DNA, 20 bp, Artificial
  CRISPR gRNA sequence
cttttttagttgttactaaa

SEQ ID NO: 625905 - DNA, 20 bp, Artificial
  CRISPR gRNA sequence
ctgaacaagtaaagttattc

SEQ ID NO: 625906 - DNA, 20 bp, Artificial
  CRISPR gRNA sequence
gtactggcacaagtgcaact

SEQ ID NO: 625907 - DNA, 20 bp, Artificial
  CRISPR gRNA sequence
acagattagtccatagcaac

SEQ ID NO: 625908 - DNA, 20 bp, Artificial
  CRISPR gRNA sequence
tagtgagccaatgtgccaat

SEQ ID NO: 625909 - DNA, 20 bp, Artificial
  CRISPR gRNA sequence
tttactgtgcatagacatgt

SEQ ID NO: 625910 - DNA, 20 bp, Artificial
  CRISPR gRNA sequence
taaggctaacagctcatcaa

SEQ ID NO: 625911 - DNA, 20 bp, Artificial
  CRISPR gRNA sequence
ctgcaggaaaatacatgggt

SEQ ID NO: 625912 - DNA, 20 bp, Artificial
  CRISPR gRNA sequence
acactttcaggggaataaga

SEQ ID NO: 625913 - DNA, 20 bp, Artificial
  CRISPR gRNA sequence
tttgtatcatccaaaatgtt

SEQ ID NO: 625914 - DNA, 20 bp, Artificial
  CRISPR gRNA sequence
aaaaggcaagttcccatgta

SEQ ID NO: 625915 - DNA, 20 bp, Artificial
  CRISPR gRNA sequence
aaagtgaaataacatgtaaa

SEQ ID NO: 625916 - DNA, 20 bp, Artificial
  CRISPR gRNA sequence
ttaaaaaatagtcatacaga

SEQ ID NO: 625917 - DNA, 20 bp, Artificial
  CRISPR gRNA sequence
caaaaagcatggacttttta

SEQ ID NO: 625918 - DNA, 20 bp, Artificial
  CRISPR gRNA sequence
gaataatagagattcaataa

SEQ ID NO: 625919 - DNA, 20 bp, Artificial
  CRISPR gRNA sequence
attcaataaaaagaattgtt

SEQ ID NO: 625920 - DNA, 20 bp, Artificial
  CRISPR gRNA sequence
ttgtgggtaactatgaaaaa

SEQ ID NO: 625921 - DNA, 20 bp, Artificial
  CRISPR gRNA sequence
attttatttcactgcattcc

SEQ ID NO: 625922 - DNA, 20 bp, Artificial
  CRISPR gRNA sequence
tagaaaagagggacagcttt

SEQ ID NO: 625923 - DNA, 20 bp, Artificial
  CRISPR gRNA sequence
atttatattatatttttaat

SEQ ID NO: 625924 - DNA, 20 bp, Artificial
  CRISPR gRNA sequence
tatttttaattaagaatttg

SEQ ID NO: 625925 - DNA, 20 bp, Artificial
  CRISPR gRNA sequence
cctgcacatctggtactttt

SEQ ID NO: 625926 - DNA, 20 bp, Artificial
  CRISPR gRNA sequence
tcctatggagcagcatccct

SEQ ID NO: 625927 - DNA, 20 bp, Artificial
  CRISPR gRNA sequence
cttcaaagatgaaattgttg

SEQ ID NO: 625928 - DNA, 20 bp, Artificial
  CRISPR gRNA sequence
agaagctcctcatttcctga

SEQ ID NO: 625929 - DNA, 20 bp, Artificial
  CRISPR gRNA sequence
catctactaaatttcctagg

SEQ ID NO: 625930 - DNA, 20 bp, Artificial
  CRISPR gRNA sequence
cttccaaactgtaagttctt

SEQ ID NO: 625931 - DNA, 20 bp, Artificial
  CRISPR gRNA sequence
gagaccacattgtcttaggg

SEQ ID NO: 625932 - DNA, 20 bp, Artificial
  CRISPR gRNA sequence
aactgcaaacatgcttcaat

SEQ ID NO: 625933 - DNA, 20 bp, Artificial
  CRISPR gRNA sequence
atcacatacacatgtctaaa

SEQ ID NO: 625934 - DNA, 20 bp, Artificial
  CRISPR gRNA sequence
taatgacttttaaaaaatct

SEQ ID NO: 625935 - DNA, 20 bp, Artificial
  CRISPR gRNA sequence
ctccttgagctctattcaag

SEQ ID NO: 625936 - DNA, 20 bp, Artificial
  CRISPR gRNA sequence
ctattcaagtgagaatttta

SEQ ID NO: 625937 - DNA, 20 bp, Artificial
  CRISPR gRNA sequence
cttttatatttttttcatgt

SEQ ID NO: 625938 - DNA, 20 bp, Artificial
  CRISPR gRNA sequence
ctactcaggtggctgaggca

SEQ ID NO: 625939 - DNA, 20 bp, Artificial
  CRISPR gRNA sequence
aaaaatgtgtgtgagcatca

SEQ ID NO: 625940 - DNA, 20 bp, Artificial
  CRISPR gRNA sequence
aggtctatcatccaaatagg

SEQ ID NO: 625941 - DNA, 20 bp, Artificial
  CRISPR gRNA sequence
gctgcctggattccactgac

SEQ ID NO: 625942 - DNA, 20 bp, Artificial
  CRISPR gRNA sequence
tgaagtaaagaactgcacat

SEQ ID NO: 625943 - DNA, 20 bp, Artificial
  CRISPR gRNA sequence
ctctgcctaattacgataag

SEQ ID NO: 625944 - DNA, 20 bp, Artificial
  CRISPR gRNA sequence
ttctgatttgccactgatat

SEQ ID NO: 625945 - DNA, 20 bp, Artificial
  CRISPR gRNA sequence
aagtaactttattcttgaaa

SEQ ID NO: 625946 - DNA, 20 bp, Artificial
  CRISPR gRNA sequence
atagtatttttatgtagttt

SEQ ID NO: 625947 - DNA, 20 bp, Artificial
  CRISPR gRNA sequence
taatcagtgttaaccagtca

SEQ ID NO: 625948 - DNA, 20 bp, Artificial
  CRISPR gRNA sequence
taattatgctaacagtaggg

SEQ ID NO: 625949 - DNA, 20 bp, Artificial
  CRISPR gRNA sequence
agtagggggagaaaacccac

SEQ ID NO: 625950 - DNA, 20 bp, Artificial
  CRISPR gRNA sequence
gtatttactactcttgttgc

SEQ ID NO: 625951 - DNA, 20 bp, Artificial
  CRISPR gRNA sequence
tgtaccttggacaacagata

SEQ ID NO: 625952 - DNA, 20 bp, Artificial
  CRISPR gRNA sequence
agataaaagaaacaaaaaaa

SEQ ID NO: 625953 - DNA, 20 bp, Artificial
  CRISPR gRNA sequence
acttttacccttcttggagt

SEQ ID NO: 625954 - DNA, 20 bp, Artificial
  CRISPR gRNA sequence
tttaattgtgtaagtccttg

SEQ ID NO: 625955 - DNA, 20 bp, Artificial
  CRISPR gRNA sequence
atgaatctcaatcccttagt

SEQ ID NO: 625956 - DNA, 20 bp, Artificial
  CRISPR gRNA sequence
tatcttaatacagtgtggta

SEQ ID NO: 625957 - DNA, 20 bp, Artificial
  CRISPR gRNA sequence
gtatgagaattaccaagtca

SEQ ID NO: 625958 - DNA, 20 bp, Artificial
  CRISPR gRNA sequence
atgcaccaaaacagagatat

SEQ ID NO: 625959 - DNA, 20 bp, Artificial
  CRISPR gRNA sequence
tcttcctagcttcatgagga

SEQ ID NO: 625960 - DNA, 20 bp, Artificial
  CRISPR gRNA sequence
agtcaattcaaatttgtggg

SEQ ID NO: 625961 - DNA, 20 bp, Artificial
  CRISPR gRNA sequence
aattcaaatttgtgggtcag

SEQ ID NO: 625962 - DNA, 20 bp, Artificial
  CRISPR gRNA sequence
tttgtggacgtagtgttttt

SEQ ID NO: 625963 - DNA, 20 bp, Artificial
  CRISPR gRNA sequence
tttaggtgagatttcacatt

SEQ ID NO: 625964 - DNA, 20 bp, Artificial
  CRISPR gRNA sequence
ttttccagtttggcaaaagt

SEQ ID NO: 625965 - DNA, 20 bp, Artificial
  CRISPR gRNA sequence
ttgctttgccctaattttgc

SEQ ID NO: 625966 - DNA, 20 bp, Artificial
  CRISPR gRNA sequence
agggatcagtaggcggattg

SEQ ID NO: 625967 - DNA, 20 bp, Artificial
  CRISPR gRNA sequence
aagggacaaaattgggaaaa

SEQ ID NO: 625968 - DNA, 20 bp, Artificial
  CRISPR gRNA sequence
gacttagatttggctacgta

SEQ ID NO: 625969 - DNA, 20 bp, Artificial
  CRISPR gRNA sequence
ctacacacacattcttttaa

SEQ ID NO: 625970 - DNA, 20 bp, Artificial
  CRISPR gRNA sequence
gatgtattgcaaaaacatac

SEQ ID NO: 625971 - DNA, 20 bp, Artificial
  CRISPR gRNA sequence
atttaaatgacagttaatac

SEQ ID NO: 625972 - DNA, 20 bp, Artificial
  CRISPR gRNA sequence
tgtaaagttttttggaatac

SEQ ID NO: 625973 - DNA, 20 bp, Artificial
  CRISPR gRNA sequence
ttttggaatacgaagaaaat

SEQ ID NO: 625974 - DNA, 20 bp, Artificial
  CRISPR gRNA sequence
acagttacttattggcaaat

SEQ ID NO: 625975 - DNA, 20 bp, Artificial
  CRISPR gRNA sequence
tattggcaaatagagaaaga

SEQ ID NO: 625976 - DNA, 20 bp, Artificial
  CRISPR gRNA sequence
tgaatgaagactattctaaa

SEQ ID NO: 625977 - DNA, 20 bp, Artificial
  CRISPR gRNA sequence
cagaaaattccccaaatcca

SEQ ID NO: 625978 - DNA, 20 bp, Artificial
  CRISPR gRNA sequence
tctttagagcaatttctaat

SEQ ID NO: 625979 - DNA, 20 bp, Artificial
  CRISPR gRNA sequence
gtttttgttttgtttttaag

SEQ ID NO: 625980 - DNA, 20 bp, Artificial
  CRISPR gRNA sequence
agaataagttctgtatcaaa

SEQ ID NO: 625981 - DNA, 20 bp, Artificial
  CRISPR gRNA sequence
aatctgtattttctaatctg

SEQ ID NO: 625982 - DNA, 20 bp, Artificial
  CRISPR gRNA sequence
tgaatatttttacatttatt

SEQ ID NO: 625983 - DNA, 20 bp, Artificial
  CRISPR gRNA sequence
ttacctcaagtgacagatag

SEQ ID NO: 625984 - DNA, 20 bp, Artificial
  CRISPR gRNA sequence
caagtgtagttttctattaa

SEQ ID NO: 625985 - DNA, 20 bp, Artificial
  CRISPR gRNA sequence
agacagttatttgcaagtgt

SEQ ID NO: 625986 - DNA, 20 bp, Artificial
  CRISPR gRNA sequence
tcttaactttctcctaattg

SEQ ID NO: 625987 - DNA, 20 bp, Artificial
  CRISPR gRNA sequence
accatgtgttatttgcaatc

SEQ ID NO: 625988 - DNA, 20 bp, Artificial
  CRISPR gRNA sequence
cttcctttagctaatgacaa

SEQ ID NO: 625989 - DNA, 20 bp, Artificial
  CRISPR gRNA sequence
ttaaaggacacaacaagcaa

SEQ ID NO: 625990 - DNA, 20 bp, Artificial
  CRISPR gRNA sequence
cactccacaatcaaaagatt

SEQ ID NO: 625991 - DNA, 20 bp, Artificial
  CRISPR gRNA sequence
tttattttacttctcccctt

SEQ ID NO: 625992 - DNA, 20 bp, Artificial
  CRISPR gRNA sequence
acacttacatatcacctatt

SEQ ID NO: 625993 - DNA, 20 bp, Artificial
  CRISPR gRNA sequence
tttgtgttttagaagcaaaa

SEQ ID NO: 625994 - DNA, 20 bp, Artificial
  CRISPR gRNA sequence
aataaaaactattgtttaaa

SEQ ID NO: 625995 - DNA, 20 bp, Artificial
  CRISPR gRNA sequence
taaggctcaaataccatacc

SEQ ID NO: 625996 - DNA, 20 bp, Artificial
  CRISPR gRNA sequence
tgtgtacaactaaagaagct

SEQ ID NO: 625997 - DNA, 20 bp, Artificial
  CRISPR gRNA sequence
attaaataatatacagaatt

SEQ ID NO: 625998 - DNA, 20 bp, Artificial
  CRISPR gRNA sequence
aacatgtatgtgtgtgcatt

SEQ ID NO: 625999 - DNA, 20 bp, Artificial
  CRISPR gRNA sequence
cacattttagtctgcagtga

SEQ ID NO: 626000 - DNA, 20 bp, Artificial
  CRISPR gRNA sequence
gtatggtatttgagccttaa

SEQ ID NO: 626001 - DNA, 20 bp, Artificial
  CRISPR gRNA sequence
tttttttctttttttgcttc

SEQ ID NO: 626002 - DNA, 20 bp, Artificial
  CRISPR gRNA sequence
aaagaaatgttatcttttaa

SEQ ID NO: 626003 - DNA, 20 bp, Artificial
  CRISPR gRNA sequence
cctcttacttaaatttgtat

SEQ ID NO: 626004 - DNA, 20 bp, Artificial
  CRISPR gRNA sequence
ataggtgatatgtaagtgtt

SEQ ID NO: 626005 - DNA, 20 bp, Artificial
  CRISPR gRNA sequence
aaccacttttctttttaata

SEQ ID NO: 626006 - DNA, 20 bp, Artificial
  CRISPR gRNA sequence
cagaatttgaactacttaaa

SEQ ID NO: 626007 - DNA, 20 bp, Artificial
  CRISPR gRNA sequence
ctacttaaaaaaaacaagaa

SEQ ID NO: 626008 - DNA, 20 bp, Artificial
  CRISPR gRNA sequence
aaacaagaataaaacaacaa

SEQ ID NO: 626009 - DNA, 20 bp, Artificial
  CRISPR gRNA sequence
acaataaaaaggacatctta

SEQ ID NO: 626010 - DNA, 20 bp, Artificial
  CRISPR gRNA sequence
aaacttacagtacagcaaga

SEQ ID NO: 626011 - DNA, 20 bp, Artificial
  CRISPR gRNA sequence
ctagaaatagaatattacat

SEQ ID NO: 626012 - DNA, 20 bp, Artificial
  CRISPR gRNA sequence
tacagaacttattcttcctt

SEQ ID NO: 626013 - DNA, 20 bp, Artificial
  CRISPR gRNA sequence
aacttattcttccttaaaaa

SEQ ID NO: 626014 - DNA, 20 bp, Artificial
  CRISPR gRNA sequence
ttcttccttaaaaacaaaac

SEQ ID NO: 626015 - DNA, 20 bp, Artificial
  CRISPR gRNA sequence
acgtgaacaatccaaagtta

SEQ ID NO: 626016 - DNA, 20 bp, Artificial
  CRISPR gRNA sequence
gtgagttgtacaactgagat

SEQ ID NO: 626017 - DNA, 20 bp, Artificial
  CRISPR gRNA sequence
acaactgagataaaaactat

SEQ ID NO: 626018 - DNA, 20 bp, Artificial
  CRISPR gRNA sequence
tgaattttcttcgtattcca

SEQ ID NO: 626019 - DNA, 20 bp, Artificial
  CRISPR gRNA sequence
ctgggcatacaactgttatg

SEQ ID NO: 626020 - DNA, 20 bp, Artificial
  CRISPR gRNA sequence
taaccatccagagtttctcc

SEQ ID NO: 626021 - DNA, 20 bp, Artificial
  CRISPR gRNA sequence
caactactaactaccttcaa

SEQ ID NO: 626022 - DNA, 20 bp, Artificial
  CRISPR gRNA sequence
ggggggggtgagcgagtctc

SEQ ID NO: 626023 - DNA, 20 bp, Artificial
  CRISPR gRNA sequence
atgtggctggactgcaaaga

SEQ ID NO: 626024 - DNA, 20 bp, Artificial
  CRISPR gRNA sequence
ccgggaggtcacatcttgaa

SEQ ID NO: 626025 - DNA, 20 bp, Artificial
  CRISPR gRNA sequence
atcacattacaactttaaaa

SEQ ID NO: 626026 - DNA, 20 bp, Artificial
  CRISPR gRNA sequence
cttagaccatatgttattct

SEQ ID NO: 626027 - DNA, 20 bp, Artificial
  CRISPR gRNA sequence
gtctataaaatgccagtcat

SEQ ID NO: 626028 - DNA, 20 bp, Artificial
  CRISPR gRNA sequence
gccagtcatcaaaactatgg

SEQ ID NO: 626029 - DNA, 20 bp, Artificial
  CRISPR gRNA sequence
ttttgctatatggtacagtg

SEQ ID NO: 626030 - DNA, 20 bp, Artificial
  CRISPR gRNA sequence
aaccaccaaagtcctaccca

SEQ ID NO: 626031 - DNA, 20 bp, Artificial
  CRISPR gRNA sequence
cccctcgaacaatgtgtgat

SEQ ID NO: 626032 - DNA, 20 bp, Artificial
  CRISPR gRNA sequence
taggaggaagaatacccagt

SEQ ID NO: 626033 - DNA, 20 bp, Artificial
  CRISPR gRNA sequence
cttacagataaatgcttctt

SEQ ID NO: 626034 - DNA, 20 bp, Artificial
  CRISPR gRNA sequence
gagtaacaaaaatggaaaca

SEQ ID NO: 626035 - DNA, 20 bp, Artificial
  CRISPR gRNA sequence
gagagagagaacaatgtcat

SEQ ID NO: 626036 - DNA, 20 bp, Artificial
  CRISPR gRNA sequence
tttaatggagtgtgggaaag

SEQ ID NO: 626037 - DNA, 20 bp, Artificial
  CRISPR gRNA sequence
aatagaaaaaaaaaatcatt

SEQ ID NO: 626038 - DNA, 20 bp, Artificial
  CRISPR gRNA sequence
ctaagtcaggaaacatgaca

SEQ ID NO: 626039 - DNA, 20 bp, Artificial
  CRISPR gRNA sequence
caaaatcataggctggatga

SEQ ID NO: 626040 - DNA, 20 bp, Artificial
  CRISPR gRNA sequence
aaatgttaataggttaaaaa

SEQ ID NO: 626041 - DNA, 20 bp, Artificial
  CRISPR gRNA sequence
aggttaaaaaaaaaacagct

SEQ ID NO: 626042 - DNA, 20 bp, Artificial
  CRISPR gRNA sequence
cctgacactaatgaaaattt

SEQ ID NO: 626043 - DNA, 20 bp, Artificial
  CRISPR gRNA sequence
gaaaattttaaaacagatta

SEQ ID NO: 626044 - DNA, 20 bp, Artificial
  CRISPR gRNA sequence
cttccataggaggtactata

SEQ ID NO: 626045 - DNA, 20 bp, Artificial
  CRISPR gRNA sequence
gcttttagagtttattttta

SEQ ID NO: 626046 - DNA, 20 bp, Artificial
  CRISPR gRNA sequence
catagtgcagacaaagaact

SEQ ID NO: 626047 - DNA, 20 bp, Artificial
  CRISPR gRNA sequence
acaaggcgaatcagttgatt

SEQ ID NO: 626048 - DNA, 20 bp, Artificial
  CRISPR gRNA sequence
atgtcccaagatattatgta

SEQ ID NO: 626049 - DNA, 20 bp, Artificial
  CRISPR gRNA sequence
acaaaaaagcaaagaatttc

SEQ ID NO: 626050 - DNA, 20 bp, Artificial
  CRISPR gRNA sequence
tacattattagaaataacaa

SEQ ID NO: 626051 - DNA, 20 bp, Artificial
  CRISPR gRNA sequence
tgttgttgtaaattttgcta

SEQ ID NO: 626052 - DNA, 20 bp, Artificial
  CRISPR gRNA sequence
aaattttgctaaaaaactag

SEQ ID NO: 626053 - DNA, 20 bp, Artificial
  CRISPR gRNA sequence
ttgttctgaaatgagtagtc

SEQ ID NO: 626054 - DNA, 20 bp, Artificial
  CRISPR gRNA sequence
atttgaacgcatttaacact

SEQ ID NO: 626055 - DNA, 20 bp, Artificial
  CRISPR gRNA sequence
tgtatacattgctagaaaca

SEQ ID NO: 626056 - DNA, 20 bp, Artificial
  CRISPR gRNA sequence
tttgaggttataaccaagat

SEQ ID NO: 626057 - DNA, 20 bp, Artificial
  CRISPR gRNA sequence
cacgttgataaccataacgg

SEQ ID NO: 626058 - DNA, 20 bp, Artificial
  CRISPR gRNA sequence
attcccaatgtattcttttg

SEQ ID NO: 626059 - DNA, 20 bp, Artificial
  CRISPR gRNA sequence
ggaagggatgtcaggcaggc

SEQ ID NO: 626060 - DNA, 20 bp, Artificial
  CRISPR gRNA sequence
cgtgttacccgatctaaaaa

SEQ ID NO: 626061 - DNA, 20 bp, Artificial
  CRISPR gRNA sequence
cttatccgtattgccttatt

SEQ ID NO: 626062 - DNA, 20 bp, Artificial
  CRISPR gRNA sequence
tagttcacatttttgctttt

SEQ ID NO: 626063 - DNA, 20 bp, Artificial
  CRISPR gRNA sequence
tttttgtctttaggtttagg

SEQ ID NO: 626064 - DNA, 20 bp, Artificial
  CRISPR gRNA sequence
ttgaacaagataatctgcca

SEQ ID NO: 626065 - DNA, 20 bp, Artificial
  CRISPR gRNA sequence
ataagataaataatctgccc

SEQ ID NO: 626066 - DNA, 20 bp, Artificial
  CRISPR gRNA sequence
attatataaataatctgtca

SEQ ID NO: 626067 - DNA, 20 bp, Artificial
  CRISPR gRNA sequence
taaaactcaattattatttc

SEQ ID NO: 626068 - DNA, 20 bp, Artificial
  CRISPR gRNA sequence
actagaagaacaacacaggg

SEQ ID NO: 626069 - DNA, 20 bp, Artificial
  CRISPR gRNA sequence
aactatgtcagatatttttt

SEQ ID NO: 626070 - DNA, 20 bp, Artificial
  CRISPR gRNA sequence
tcatatctaccacaaaaaag

SEQ ID NO: 626071 - DNA, 20 bp, Artificial
  CRISPR gRNA sequence
aatgggagaatataatatag

SEQ ID NO: 626072 - DNA, 20 bp, Artificial
  CRISPR gRNA sequence
gttccatagtatatactcta

SEQ ID NO: 626073 - DNA, 20 bp, Artificial
  CRISPR gRNA sequence
tatactctataaaacaaaca

SEQ ID NO: 626074 - DNA, 20 bp, Artificial
  CRISPR gRNA sequence
cccgtctctactaaaaatac

SEQ ID NO: 626075 - DNA, 20 bp, Artificial
  CRISPR gRNA sequence
gatttttgtctttgtataaa

SEQ ID NO: 626076 - DNA, 20 bp, Artificial
  CRISPR gRNA sequence
gggcagagaattttacagaa

SEQ ID NO: 626077 - DNA, 20 bp, Artificial
  CRISPR gRNA sequence
aaaatgacagtaatattttc

SEQ ID NO: 626078 - DNA, 20 bp, Artificial
  CRISPR gRNA sequence
tactaagatgttcagttaaa

SEQ ID NO: 626079 - DNA, 20 bp, Artificial
  CRISPR gRNA sequence
ttcagttaaaaaaaacctta

SEQ ID NO: 626080 - DNA, 20 bp, Artificial
  CRISPR gRNA sequence
tgaatgaatacagaacaaca

SEQ ID NO: 626081 - DNA, 20 bp, Artificial
  CRISPR gRNA sequence
tgttggatttggacatttct

SEQ ID NO: 626082 - DNA, 20 bp, Artificial
  CRISPR gRNA sequence
tgaggctaaaatgtaaagtg

SEQ ID NO: 626083 - DNA, 20 bp, Artificial
  CRISPR gRNA sequence
gtgaatcccttccctacaac

SEQ ID NO: 626084 - DNA, 20 bp, Artificial
  CRISPR gRNA sequence
ttgcctcatggatattcccc

SEQ ID NO: 626085 - DNA, 20 bp, Artificial
  CRISPR gRNA sequence
aatcaaacattcaagatacc

SEQ ID NO: 626086 - DNA, 20 bp, Artificial
  CRISPR gRNA sequence
cccaaaactatcttcctcca

SEQ ID NO: 626087 - DNA, 20 bp, Artificial
  CRISPR gRNA sequence
aatatttacatatatacaga

SEQ ID NO: 626088 - DNA, 20 bp, Artificial
  CRISPR gRNA sequence
actgtggccatctaagatga

SEQ ID NO: 626089 - DNA, 20 bp, Artificial
  CRISPR gRNA sequence
ggccatctaagatgaaaaaa

SEQ ID NO: 626090 - DNA, 20 bp, Artificial
  CRISPR gRNA sequence
tctaagatgaaaaaacaaaa

SEQ ID NO: 626091 - DNA, 20 bp, Artificial
  CRISPR gRNA sequence
ataacaaaaaagcaaacaga

SEQ ID NO: 626092 - DNA, 20 bp, Artificial
  CRISPR gRNA sequence
tttaacccaacgttttccaa

SEQ ID NO: 626093 - DNA, 20 bp, Artificial
  CRISPR gRNA sequence
acagacatttgaaagcaaaa

SEQ ID NO: 626094 - DNA, 20 bp, Artificial
  CRISPR gRNA sequence
taataataaacattatattc

SEQ ID NO: 626095 - DNA, 20 bp, Artificial
  CRISPR gRNA sequence
tgtgcaacagaattgtgtat

SEQ ID NO: 626096 - DNA, 20 bp, Artificial
  CRISPR gRNA sequence
tctcatctctataaacaata

SEQ ID NO: 626097 - DNA, 20 bp, Artificial
  CRISPR gRNA sequence
tatgctgtattaacagccat

SEQ ID NO: 626098 - DNA, 20 bp, Artificial
  CRISPR gRNA sequence
aggtgtggttcgtggtatcc

SEQ ID NO: 626099 - DNA, 20 bp, Artificial
  CRISPR gRNA sequence
acaagaaagatcacagatca

SEQ ID NO: 626100 - DNA, 20 bp, Artificial
  CRISPR gRNA sequence
ccacaaactttcaatttgta

SEQ ID NO: 626101 - DNA, 20 bp, Artificial
  CRISPR gRNA sequence
tattttttttaatccatatg

SEQ ID NO: 626102 - DNA, 20 bp, Artificial
  CRISPR gRNA sequence
caactatgccaagatcttgg

SEQ ID NO: 626103 - DNA, 20 bp, Artificial
  CRISPR gRNA sequence
ctaggatcatccattagttc

SEQ ID NO: 626104 - DNA, 20 bp, Artificial
  CRISPR gRNA sequence
attttattataaaagcaatg

SEQ ID NO: 626105 - DNA, 20 bp, Artificial
  CRISPR gRNA sequence
cattgacctccatgaatctt

SEQ ID NO: 626106 - DNA, 20 bp, Artificial
  CRISPR gRNA sequence
tagatttctgataccttaca

SEQ ID NO: 626107 - DNA, 20 bp, Artificial
  CRISPR gRNA sequence
tggtaaaggttaggttagaa

SEQ ID NO: 626108 - DNA, 20 bp, Artificial
  CRISPR gRNA sequence
gttagaaaaaaacatccaaa

SEQ ID NO: 626109 - DNA, 20 bp, Artificial
  CRISPR gRNA sequence
cactaaatccatgcagggta

SEQ ID NO: 626110 - DNA, 20 bp, Artificial
  CRISPR gRNA sequence
ttttaaaataatgtaaatag

SEQ ID NO: 626111 - DNA, 20 bp, Artificial
  CRISPR gRNA sequence
ttttgtcctcaatcattcca

SEQ ID NO: 626112 - DNA, 20 bp, Artificial
  CRISPR gRNA sequence
tgcagctatcccatcttata

SEQ ID NO: 626113 - DNA, 20 bp, Artificial
  CRISPR gRNA sequence
agaagggaagataatttaaa

SEQ ID NO: 626114 - DNA, 20 bp, Artificial
  CRISPR gRNA sequence
gagactatttctatgagatt

SEQ ID NO: 626115 - DNA, 20 bp, Artificial
  CRISPR gRNA sequence
gaggatgaacaaaaatatta

SEQ ID NO: 626116 - DNA, 20 bp, Artificial
  CRISPR gRNA sequence
tacctgaaatgctaattaga

SEQ ID NO: 626117 - DNA, 20 bp, Artificial
  CRISPR gRNA sequence
gaaagaactataatcaccta

SEQ ID NO: 626118 - DNA, 20 bp, Artificial
  CRISPR gRNA sequence
taaaactgaaaaatctgaga

SEQ ID NO: 626119 - DNA, 20 bp, Artificial
  CRISPR gRNA sequence
ctttagctgatctttgttca

SEQ ID NO: 626120 - DNA, 20 bp, Artificial
  CRISPR gRNA sequence
agatgttaattcggtttcat

SEQ ID NO: 626121 - DNA, 20 bp, Artificial
  CRISPR gRNA sequence
aataaactagggcaaaatac

SEQ ID NO: 626122 - DNA, 20 bp, Artificial
  CRISPR gRNA sequence
aatttgcagcaaggccaccc

SEQ ID NO: 626123 - DNA, 20 bp, Artificial
  CRISPR gRNA sequence
ctgcctctccattctctttg

SEQ ID NO: 626124 - DNA, 20 bp, Artificial
  CRISPR gRNA sequence
aaacatactaatggataacc

SEQ ID NO: 626125 - DNA, 20 bp, Artificial
  CRISPR gRNA sequence
agagtcaggtatgactgtag

SEQ ID NO: 626126 - DNA, 20 bp, Artificial
  CRISPR gRNA sequence
acatttatattttttaaagt

SEQ ID NO: 626127 - DNA, 20 bp, Artificial
  CRISPR gRNA sequence
tttttaaagtaaaaactttt

SEQ ID NO: 626128 - DNA, 20 bp, Artificial
  CRISPR gRNA sequence
aactaccaggcctatgcaat

SEQ ID NO: 626129 - DNA, 20 bp, Artificial
  CRISPR gRNA sequence
catgataaataacaatacaa

SEQ ID NO: 626130 - DNA, 20 bp, Artificial
  CRISPR gRNA sequence
ctaccaataataatattcat

SEQ ID NO: 626131 - DNA, 20 bp, Artificial
  CRISPR gRNA sequence
tgaggtatagttaatataca

SEQ ID NO: 626132 - DNA, 20 bp, Artificial
  CRISPR gRNA sequence
tatacataaaactgtagtaa

SEQ ID NO: 626133 - DNA, 20 bp, Artificial
  CRISPR gRNA sequence
agacagtagtgaaaccatca

SEQ ID NO: 626134 - DNA, 20 bp, Artificial
  CRISPR gRNA sequence
ttgttcatcttgacattcca

SEQ ID NO: 626135 - DNA, 20 bp, Artificial
  CRISPR gRNA sequence
ttctggcaacttagaggagc

SEQ ID NO: 626136 - DNA, 20 bp, Artificial
  CRISPR gRNA sequence
gataacataatatgtacaca

SEQ ID NO: 626137 - DNA, 20 bp, Artificial
  CRISPR gRNA sequence
acacacaaaaccatgatatt

SEQ ID NO: 626138 - DNA, 20 bp, Artificial
  CRISPR gRNA sequence
tttattacatgaagttgagg

SEQ ID NO: 626139 - DNA, 20 bp, Artificial
  CRISPR gRNA sequence
caataaagaacttttcataa

SEQ ID NO: 626140 - DNA, 20 bp, Artificial
  CRISPR gRNA sequence
ttgatagcacaattttaaaa

SEQ ID NO: 626141 - DNA, 20 bp, Artificial
  CRISPR gRNA sequence
cacgattcacattcatgttt

SEQ ID NO: 626142 - DNA, 20 bp, Artificial
  CRISPR gRNA sequence
ttatgaacagaagaaacaaa

SEQ ID NO: 626143 - DNA, 20 bp, Artificial
  CRISPR gRNA sequence
gttatattctggcatttctt

SEQ ID NO: 626144 - DNA, 20 bp, Artificial
  CRISPR gRNA sequence
attctcctggtcactaatag

SEQ ID NO: 626145 - DNA, 20 bp, Artificial
  CRISPR gRNA sequence
tcaccaatgtcatcaaatat

SEQ ID NO: 626146 - DNA, 20 bp, Artificial
  CRISPR gRNA sequence
ttagaataaaaagaacatta

SEQ ID NO: 626147 - DNA, 20 bp, Artificial
  CRISPR gRNA sequence
cacacataataatgaataat

SEQ ID NO: 626148 - DNA, 20 bp, Artificial
  CRISPR gRNA sequence
tctatcatatagatttgtta

SEQ ID NO: 626149 - DNA, 20 bp, Artificial
  CRISPR gRNA sequence
atactgttagaaacaaggat

SEQ ID NO: 626150 - DNA, 20 bp, Artificial
  CRISPR gRNA sequence
ttttgataaagttatttcta

SEQ ID NO: 626151 - DNA, 20 bp, Artificial
  CRISPR gRNA sequence
tatgcaaatggtacatatgc

SEQ ID NO: 626152 - DNA, 20 bp, Artificial
  CRISPR gRNA sequence
ccatactgtctatgaaactt

SEQ ID NO: 626153 - DNA, 20 bp, Artificial
  CRISPR gRNA sequence
ttaatggagcaatccaagct

SEQ ID NO: 626154 - DNA, 20 bp, Artificial
  CRISPR gRNA sequence
ggcacaaaaatctagactaa

SEQ ID NO: 626155 - DNA, 20 bp, Artificial
  CRISPR gRNA sequence
aatgtacaaaatacggtgct

SEQ ID NO: 626156 - DNA, 20 bp, Artificial
  CRISPR gRNA sequence
tattagatattctatgaact

SEQ ID NO: 626157 - DNA, 20 bp, Artificial
  CRISPR gRNA sequence
ctagttcatggtattaagga

SEQ ID NO: 626158 - DNA, 20 bp, Artificial
  CRISPR gRNA sequence
ctgattaacctaaattttct

SEQ ID NO: 626159 - DNA, 20 bp, Artificial
  CRISPR gRNA sequence
actagtaatataaatatttt

SEQ ID NO: 626160 - DNA, 20 bp, Artificial
  CRISPR gRNA sequence
tgctgtttaaaaaggagata

SEQ ID NO: 626161 - DNA, 20 bp, Artificial
  CRISPR gRNA sequence
caagcaatagtgtgtctgaa

SEQ ID NO: 626162 - DNA, 20 bp, Artificial
  CRISPR gRNA sequence
caaaaccagtatgggcatca

SEQ ID NO: 626163 - DNA, 20 bp, Artificial
  CRISPR gRNA sequence
attgttaaactatttagaaa

SEQ ID NO: 626164 - DNA, 20 bp, Artificial
  CRISPR gRNA sequence
tcttccaaaaaagtatattt

SEQ ID NO: 626165 - DNA, 20 bp, Artificial
  CRISPR gRNA sequence
tcatttggttagttttcaca

SEQ ID NO: 626166 - DNA, 20 bp, Artificial
  CRISPR gRNA sequence
tggaagtgaagatagctcag

SEQ ID NO: 626167 - DNA, 20 bp, Artificial
  CRISPR gRNA sequence
gtcatatcaaagttactaag

SEQ ID NO: 626168 - DNA, 20 bp, Artificial
  CRISPR gRNA sequence
taatttcaccatgtccttta

SEQ ID NO: 626169 - DNA, 20 bp, Artificial
  CRISPR gRNA sequence
acccataaacatggcaaaga

SEQ ID NO: 626170 - DNA, 20 bp, Artificial
  CRISPR gRNA sequence
aacatggcaaagaaaaaaca

SEQ ID NO: 626171 - DNA, 20 bp, Artificial
  CRISPR gRNA sequence
gttctgtcaatctgacagat

SEQ ID NO: 626172 - DNA, 20 bp, Artificial
  CRISPR gRNA sequence
actaagtttaattgggaaat

SEQ ID NO: 626173 - DNA, 20 bp, Artificial
  CRISPR gRNA sequence
agaaaaaatgtatattttgc

SEQ ID NO: 626174 - DNA, 20 bp, Artificial
  CRISPR gRNA sequence
cataaatgggctataaagat

SEQ ID NO: 626175 - DNA, 20 bp, Artificial
  CRISPR gRNA sequence
ctgatatgaaataaagaatg

SEQ ID NO: 626176 - DNA, 20 bp, Artificial
  CRISPR gRNA sequence
gaaagaataagttaatagaa

SEQ ID NO: 626177 - DNA, 20 bp, Artificial
  CRISPR gRNA sequence
gaatgtaatcttgatgccat

SEQ ID NO: 626178 - DNA, 20 bp, Artificial
  CRISPR gRNA sequence
tgtgaaaaaaaagtagaatc

SEQ ID NO: 626179 - DNA, 20 bp, Artificial
  CRISPR gRNA sequence
tgttattttgtgaatctatt

SEQ ID NO: 626180 - DNA, 20 bp, Artificial
  CRISPR gRNA sequence
aaaaagtaaaaaaaaaaaat

SEQ ID NO: 626181 - DNA, 20 bp, Artificial
  CRISPR gRNA sequence
aatgtaaaaaggcacttctt

SEQ ID NO: 626182 - DNA, 20 bp, Artificial
  CRISPR gRNA sequence
atattaaactttctacaagt

SEQ ID NO: 626183 - DNA, 20 bp, Artificial
  CRISPR gRNA sequence
ctgtttaaataatgtgttag

SEQ ID NO: 626184 - DNA, 20 bp, Artificial
  CRISPR gRNA sequence
ttaggaaaacaaagtgcctt

SEQ ID NO: 626185 - DNA, 20 bp, Artificial
  CRISPR gRNA sequence
aacagtctaaacaattaaag

SEQ ID NO: 626186 - DNA, 20 bp, Artificial
  CRISPR gRNA sequence
aaataaatggatgagtcttg

SEQ ID NO: 626187 - DNA, 20 bp, Artificial
  CRISPR gRNA sequence
ttaccctgcacctgaaggca

SEQ ID NO: 626188 - DNA, 20 bp, Artificial
  CRISPR gRNA sequence
aaataacacttgatgtttct

SEQ ID NO: 626189 - DNA, 20 bp, Artificial
  CRISPR gRNA sequence
tgataataataatagaaaaa

SEQ ID NO: 626190 - DNA, 20 bp, Artificial
  CRISPR gRNA sequence
aacagttcttacggtagctg

SEQ ID NO: 626191 - DNA, 20 bp, Artificial
  CRISPR gRNA sequence
attgaattatgactttctat

SEQ ID NO: 626192 - DNA, 20 bp, Artificial
  CRISPR gRNA sequence
actgggatgcatgtctcact

SEQ ID NO: 626193 - DNA, 20 bp, Artificial
  CRISPR gRNA sequence
agctagtaatagtaaagaaa

SEQ ID NO: 626194 - DNA, 20 bp, Artificial
  CRISPR gRNA sequence
ctatcaagtagtgagaaaga

SEQ ID NO: 626195 - DNA, 20 bp, Artificial
  CRISPR gRNA sequence
gaatgcatataattaaaggc

SEQ ID NO: 626196 - DNA, 20 bp, Artificial
  CRISPR gRNA sequence
gaagataatatcctctacat

SEQ ID NO: 626197 - DNA, 20 bp, Artificial
  CRISPR gRNA sequence
atatacaatagaacatatcc

SEQ ID NO: 626198 - DNA, 20 bp, Artificial
  CRISPR gRNA sequence
gccagaatattcagctacta

SEQ ID NO: 626199 - DNA, 20 bp, Artificial
  CRISPR gRNA sequence
tggctagtatccaggaggga

SEQ ID NO: 626200 - DNA, 20 bp, Artificial
  CRISPR gRNA sequence
acacacacacacaacatact

SEQ ID NO: 626201 - DNA, 20 bp, Artificial
  CRISPR gRNA sequence
atagtttttcaaataatatg

SEQ ID NO: 626202 - DNA, 20 bp, Artificial
  CRISPR gRNA sequence
aagaatagcttttacagata

SEQ ID NO: 626203 - DNA, 20 bp, Artificial
  CRISPR gRNA sequence
tagcttcttcctttacatat

SEQ ID NO: 626204 - DNA, 20 bp, Artificial
  CRISPR gRNA sequence
tcactttcccataataacag

SEQ ID NO: 626205 - DNA, 20 bp, Artificial
  CRISPR gRNA sequence
aataaaaatatacaacattt

SEQ ID NO: 626206 - DNA, 20 bp, Artificial
  CRISPR gRNA sequence
acttagccctacaatgcaag

SEQ ID NO: 626207 - DNA, 20 bp, Artificial
  CRISPR gRNA sequence
cacacacacaatttttgaat

SEQ ID NO: 626208 - DNA, 20 bp, Artificial
  CRISPR gRNA sequence
gtcagctaattcttttcttt

SEQ ID NO: 626209 - DNA, 20 bp, Artificial
  CRISPR gRNA sequence
tcgccagcaaatatattgag

SEQ ID NO: 626210 - DNA, 20 bp, Artificial
  CRISPR gRNA sequence
ttttattttaagcttttgct

SEQ ID NO: 626211 - DNA, 20 bp, Artificial
  CRISPR gRNA sequence
tagatgtaaatattttactt

SEQ ID NO: 626212 - DNA, 20 bp, Artificial
  CRISPR gRNA sequence
agactgttttccactccttg

SEQ ID NO: 626213 - DNA, 20 bp, Artificial
  CRISPR gRNA sequence
aagtatacaaaaattaaaca

SEQ ID NO: 626214 - DNA, 20 bp, Artificial
  CRISPR gRNA sequence
gaaagaggtaacactacaag

SEQ ID NO: 626215 - DNA, 20 bp, Artificial
  CRISPR gRNA sequence
ccaacgaatcagaagtccat

SEQ ID NO: 626216 - DNA, 20 bp, Artificial
  CRISPR gRNA sequence
aatgaaaaagattgaaaaga

SEQ ID NO: 626217 - DNA, 20 bp, Artificial
  CRISPR gRNA sequence
agacacatccatctctaact

SEQ ID NO: 626218 - DNA, 20 bp, Artificial
  CRISPR gRNA sequence
ctttactttttaaccccata

SEQ ID NO: 626219 - DNA, 20 bp, Artificial
  CRISPR gRNA sequence
ttagaataacaaaagcctaa

SEQ ID NO: 626220 - DNA, 20 bp, Artificial
  CRISPR gRNA sequence
tgcaattatttcatttagga

SEQ ID NO: 626221 - DNA, 20 bp, Artificial
  CRISPR gRNA sequence
gaaaaggcggtttgttttct

SEQ ID NO: 626222 - DNA, 20 bp, Artificial
  CRISPR gRNA sequence
acacagaagttttcttttaa

SEQ ID NO: 626223 - DNA, 20 bp, Artificial
  CRISPR gRNA sequence
cagaaattcatatacaaatt

SEQ ID NO: 626224 - DNA, 20 bp, Artificial
  CRISPR gRNA sequence
ttttaaatcactgattgtaa

SEQ ID NO: 626225 - DNA, 20 bp, Artificial
  CRISPR gRNA sequence
aacttcatgaaaccccatta

SEQ ID NO: 626226 - DNA, 20 bp, Artificial
  CRISPR gRNA sequence
ttccactagaaaaaaaaata

SEQ ID NO: 626227 - DNA, 20 bp, Artificial
  CRISPR gRNA sequence
tatagaaattccatttattc

SEQ ID NO: 626228 - DNA, 20 bp, Artificial
  CRISPR gRNA sequence
tttattctaaaacaccgaaa

SEQ ID NO: 626229 - DNA, 20 bp, Artificial
  CRISPR gRNA sequence
cagattatgtgtcctttaaa

SEQ ID NO: 626230 - DNA, 20 bp, Artificial
  CRISPR gRNA sequence
aaattggctgaaattgctaa

SEQ ID NO: 626231 - DNA, 20 bp, Artificial
  CRISPR gRNA sequence
tatccccagtaaacgtacaa

SEQ ID NO: 626232 - DNA, 20 bp, Artificial
  CRISPR gRNA sequence
tacaagaaaactgaatcgca

SEQ ID NO: 626233 - DNA, 20 bp, Artificial
  CRISPR gRNA sequence
aagaaatttgactaacactt

SEQ ID NO: 626234 - DNA, 20 bp, Artificial
  CRISPR gRNA sequence
ttcaaaggaacaaaagaaat

SEQ ID NO: 626235 - DNA, 20 bp, Artificial
  CRISPR gRNA sequence
tttcaacattaaaggaaaga

SEQ ID NO: 626236 - DNA, 20 bp, Artificial
  CRISPR gRNA sequence
actgcaactattataattca

SEQ ID NO: 626237 - DNA, 20 bp, Artificial
  CRISPR gRNA sequence
ttgaaatagaaaataagtga

SEQ ID NO: 626238 - DNA, 20 bp, Artificial
  CRISPR gRNA sequence
acaggtgattggcaatgatc

SEQ ID NO: 626239 - DNA, 20 bp, Artificial
  CRISPR gRNA sequence
cattgttatgtgctatatgt

SEQ ID NO: 626240 - DNA, 20 bp, Artificial
  CRISPR gRNA sequence
atacttaaggcttgcaatag

SEQ ID NO: 626241 - DNA, 20 bp, Artificial
  CRISPR gRNA sequence
ttacagccaaattaaggaaa

SEQ ID NO: 626242 - DNA, 20 bp, Artificial
  CRISPR gRNA sequence
gaaataagatttataatgat

SEQ ID NO: 626243 - DNA, 20 bp, Artificial
  CRISPR gRNA sequence
ccctctgactaagtcaactt

SEQ ID NO: 626244 - DNA, 20 bp, Artificial
  CRISPR gRNA sequence
atatagttgaaaagtctatt

SEQ ID NO: 626245 - DNA, 20 bp, Artificial
  CRISPR gRNA sequence
taaacactactttaagtaat

SEQ ID NO: 626246 - DNA, 20 bp, Artificial
  CRISPR gRNA sequence
ctgggactatctagttgcag

SEQ ID NO: 626247 - DNA, 20 bp, Artificial
  CRISPR gRNA sequence
tgtggaaaaattgtcttcca

SEQ ID NO: 626248 - DNA, 20 bp, Artificial
  CRISPR gRNA sequence
ctaaaaaagaaattgaaaaa

SEQ ID NO: 626249 - DNA, 20 bp, Artificial
  CRISPR gRNA sequence
cccaagtcatctttctcttt

SEQ ID NO: 626250 - DNA, 20 bp, Artificial
  CRISPR gRNA sequence
gatagggaaactgacctgag

SEQ ID NO: 626251 - DNA, 20 bp, Artificial
  CRISPR gRNA sequence
gctaacttcaccaaattaaa

SEQ ID NO: 626252 - DNA, 20 bp, Artificial
  CRISPR gRNA sequence
cttcaccaaattaaagaaaa

SEQ ID NO: 626253 - DNA, 20 bp, Artificial
  CRISPR gRNA sequence
ataggaatcattactccact

SEQ ID NO: 626254 - DNA, 20 bp, Artificial
  CRISPR gRNA sequence
taaattacttggacttggaa

SEQ ID NO: 626255 - DNA, 20 bp, Artificial
  CRISPR gRNA sequence
aaaacttttgaattttcacc

SEQ ID NO: 626256 - DNA, 20 bp, Artificial
  CRISPR gRNA sequence
gatatgatgtatgatttaca

SEQ ID NO: 626257 - DNA, 20 bp, Artificial
  CRISPR gRNA sequence
caggttcaacactattgcca

SEQ ID NO: 626258 - DNA, 20 bp, Artificial
  CRISPR gRNA sequence
tatatttactctattctgaa

SEQ ID NO: 626259 - DNA, 20 bp, Artificial
  CRISPR gRNA sequence
taggggaagtcaaatcagtg

SEQ ID NO: 626260 - DNA, 20 bp, Artificial
  CRISPR gRNA sequence
tcattccaaagctgatattt

SEQ ID NO: 626261 - DNA, 20 bp, Artificial
  CRISPR gRNA sequence
ggtgaaacctcctctctagt

SEQ ID NO: 626262 - DNA, 20 bp, Artificial
  CRISPR gRNA sequence
agtgaggacactaagtctta

SEQ ID NO: 626263 - DNA, 20 bp, Artificial
  CRISPR gRNA sequence
actctcaagcttcacctgtt

SEQ ID NO: 626264 - DNA, 20 bp, Artificial
  CRISPR gRNA sequence
gctggggagagacctcctgc

SEQ ID NO: 626265 - DNA, 20 bp, Artificial
  CRISPR gRNA sequence
atatcatactcttttcacca

SEQ ID NO: 626266 - DNA, 20 bp, Artificial
  CRISPR gRNA sequence
accaaaaaacaagccaattt

SEQ ID NO: 626267 - DNA, 20 bp, Artificial
  CRISPR gRNA sequence
taatgacaagatgttaactt

SEQ ID NO: 626268 - DNA, 20 bp, Artificial
  CRISPR gRNA sequence
ttagagatgttaaccaagag

SEQ ID NO: 626269 - DNA, 20 bp, Artificial
  CRISPR gRNA sequence
tcaaagttacagactttggg

SEQ ID NO: 626270 - DNA, 20 bp, Artificial
  CRISPR gRNA sequence
taaagtaaattaaaattggc

SEQ ID NO: 626271 - DNA, 20 bp, Artificial
  CRISPR gRNA sequence
taaatatccaagattcattt

SEQ ID NO: 626272 - DNA, 20 bp, Artificial
  CRISPR gRNA sequence
acatagaagaatcaaaaatt

SEQ ID NO: 626273 - DNA, 20 bp, Artificial
  CRISPR gRNA sequence
taaagctgctaactataggt

SEQ ID NO: 626274 - DNA, 20 bp, Artificial
  CRISPR gRNA sequence
gtaacaatgcctcattatat

SEQ ID NO: 626275 - DNA, 20 bp, Artificial
  CRISPR gRNA sequence
cattataaagttcccatata

SEQ ID NO: 626276 - DNA, 20 bp, Artificial
  CRISPR gRNA sequence
aacttgcatgagtactgtgt

SEQ ID NO: 626277 - DNA, 20 bp, Artificial
  CRISPR gRNA sequence
taccaatgtaatgctatcaa

SEQ ID NO: 626278 - DNA, 20 bp, Artificial
  CRISPR gRNA sequence
atcatttataatatggtgag

SEQ ID NO: 626279 - DNA, 20 bp, Artificial
  CRISPR gRNA sequence
agattacaaaagtttttttg

SEQ ID NO: 626280 - DNA, 20 bp, Artificial
  CRISPR gRNA sequence
attgaaaaataaaataaaaa

SEQ ID NO: 626281 - DNA, 20 bp, Artificial
  CRISPR gRNA sequence
gctttttttacaagagtgat

SEQ ID NO: 626282 - DNA, 20 bp, Artificial
  CRISPR gRNA sequence
tctttgcttctgaatctgaa

SEQ ID NO: 626283 - DNA, 20 bp, Artificial
  CRISPR gRNA sequence
ttctctcactctgtcccggt

SEQ ID NO: 626284 - DNA, 20 bp, Artificial
  CRISPR gRNA sequence
aatcaaatggaccaaatgaa

SEQ ID NO: 626285 - DNA, 20 bp, Artificial
  CRISPR gRNA sequence
cacagctttacctacaagca

SEQ ID NO: 626286 - DNA, 20 bp, Artificial
  CRISPR gRNA sequence
ttacctcctcatttaaaaga

SEQ ID NO: 626287 - DNA, 20 bp, Artificial
  CRISPR gRNA sequence
ataatcaagtcaaatttgac

SEQ ID NO: 626288 - DNA, 20 bp, Artificial
  CRISPR gRNA sequence
agatattgactattttataa

SEQ ID NO: 626289 - DNA, 20 bp, Artificial
  CRISPR gRNA sequence
taataaaacaaactaaaatt

SEQ ID NO: 626290 - DNA, 20 bp, Artificial
  CRISPR gRNA sequence
tagtcactaaataaactatg

SEQ ID NO: 626291 - DNA, 20 bp, Artificial
  CRISPR gRNA sequence
tcattatttctccaacctgg

SEQ ID NO: 626292 - DNA, 20 bp, Artificial
  CRISPR gRNA sequence
ttcactgtagtctgcctaaa

SEQ ID NO: 626293 - DNA, 20 bp, Artificial
  CRISPR gRNA sequence
catgacaggttactagtatt

SEQ ID NO: 626294 - DNA, 20 bp, Artificial
  CRISPR gRNA sequence
atcttttttacttgttttgg

SEQ ID NO: 626295 - DNA, 20 bp, Artificial
  CRISPR gRNA sequence
tgactactttctgtacccgg

SEQ ID NO: 626296 - DNA, 20 bp, Artificial
  CRISPR gRNA sequence
atttgcaaattgataatttt

SEQ ID NO: 626297 - DNA, 20 bp, Artificial
  CRISPR gRNA sequence
tgctgctctacaacagtaag

SEQ ID NO: 626298 - DNA, 20 bp, Artificial
  CRISPR gRNA sequence
aaggaaatgtcttcttacaa

SEQ ID NO: 626299 - DNA, 20 bp, Artificial
  CRISPR gRNA sequence
agaattatatatttcctgga

SEQ ID NO: 626300 - DNA, 20 bp, Artificial
  CRISPR gRNA sequence
ctagaggtattgcaaacttg

SEQ ID NO: 626301 - DNA, 20 bp, Artificial
  CRISPR gRNA sequence
aaacacattaatagtacagt

SEQ ID NO: 626302 - DNA, 20 bp, Artificial
  CRISPR gRNA sequence
gaataccattagagcaaagg

SEQ ID NO: 626303 - DNA, 20 bp, Artificial
  CRISPR gRNA sequence
tattacatttttttcctaac

SEQ ID NO: 626304 - DNA, 20 bp, Artificial
  CRISPR gRNA sequence
tataaaattgtgaccaaaat

SEQ ID NO: 626305 - DNA, 20 bp, Artificial
  CRISPR gRNA sequence
tgatagggtaacatcatgct

SEQ ID NO: 626306 - DNA, 20 bp, Artificial
  CRISPR gRNA sequence
tgcttaaccagactcttctg

SEQ ID NO: 626307 - DNA, 20 bp, Artificial
  CRISPR gRNA sequence
gataaatgtacaatttgttt

SEQ ID NO: 626308 - DNA, 20 bp, Artificial
  CRISPR gRNA sequence
tcaggaattcttgcaggagg

SEQ ID NO: 626309 - DNA, 20 bp, Artificial
  CRISPR gRNA sequence
ggtcaatgtaaacttgggaa

SEQ ID NO: 626310 - DNA, 20 bp, Artificial
  CRISPR gRNA sequence
gacagaggggccagcttcta

SEQ ID NO: 626311 - DNA, 20 bp, Artificial
  CRISPR gRNA sequence
aataaacccctcctcaatag

SEQ ID NO: 626312 - DNA, 20 bp, Artificial
  CRISPR gRNA sequence
cctaccaaattctcagcaag

SEQ ID NO: 626313 - DNA, 20 bp, Artificial
  CRISPR gRNA sequence
agctattaaatgaatcctac

SEQ ID NO: 626314 - DNA, 20 bp, Artificial
  CRISPR gRNA sequence
caatactatatttcaagaag

SEQ ID NO: 626315 - DNA, 20 bp, Artificial
  CRISPR gRNA sequence
tttttgtacaactggtgttt

SEQ ID NO: 626316 - DNA, 20 bp, Artificial
  CRISPR gRNA sequence
tattaaatatacacaataaa

SEQ ID NO: 626317 - DNA, 20 bp, Artificial
  CRISPR gRNA sequence
ctatagaaatattttctcaa

SEQ ID NO: 626318 - DNA, 20 bp, Artificial
  CRISPR gRNA sequence
gtttcccatcttttgatatg

SEQ ID NO: 626319 - DNA, 20 bp, Artificial
  CRISPR gRNA sequence
ctattttgggtgaagttaag

SEQ ID NO: 626320 - DNA, 20 bp, Artificial
  CRISPR gRNA sequence
ttctctgcagtttatggata

SEQ ID NO: 626321 - DNA, 20 bp, Artificial
  CRISPR gRNA sequence
attatatttgatttgtttga

SEQ ID NO: 626322 - DNA, 20 bp, Artificial
  CRISPR gRNA sequence
ctacagttgctaaaaaaagc

SEQ ID NO: 626323 - DNA, 20 bp, Artificial
  CRISPR gRNA sequence
aacttgcatccccaaaatac

SEQ ID NO: 626324 - DNA, 20 bp, Artificial
  CRISPR gRNA sequence
gctgggatttatccattgta

SEQ ID NO: 626325 - DNA, 20 bp, Artificial
  CRISPR gRNA sequence
ttgtacaaaacaaatggtat

SEQ ID NO: 626326 - DNA, 20 bp, Artificial
  CRISPR gRNA sequence
tgcaaatgtctgtttctcta

SEQ ID NO: 626327 - DNA, 20 bp, Artificial
  CRISPR gRNA sequence
taaattgttacagaaacatc

SEQ ID NO: 626328 - DNA, 20 bp, Artificial
  CRISPR gRNA sequence
aatatgattttgatcaatgc

SEQ ID NO: 626329 - DNA, 20 bp, Artificial
  CRISPR gRNA sequence
taatttgaggtatgaggaag

SEQ ID NO: 626330 - DNA, 20 bp, Artificial
  CRISPR gRNA sequence
taaataaaattccataggca

SEQ ID NO: 626331 - DNA, 20 bp, Artificial
  CRISPR gRNA sequence
ttagaccaagtttttcccgt

SEQ ID NO: 626332 - DNA, 20 bp, Artificial
  CRISPR gRNA sequence
tttcttattttgtgtatggg

SEQ ID NO: 626333 - DNA, 20 bp, Artificial
  CRISPR gRNA sequence
ttgtgtatgggtaaaacaag

SEQ ID NO: 626334 - DNA, 20 bp, Artificial
  CRISPR gRNA sequence
taaaacaaggaaaacaaggc

SEQ ID NO: 626335 - DNA, 20 bp, Artificial
  CRISPR gRNA sequence
gttaataacactatttttag

SEQ ID NO: 626336 - DNA, 20 bp, Artificial
  CRISPR gRNA sequence
agtgggatcttgtctgtaca

SEQ ID NO: 626337 - DNA, 20 bp, Artificial
  CRISPR gRNA sequence
tctatcaaaaatgtttatta

SEQ ID NO: 626338 - DNA, 20 bp, Artificial
  CRISPR gRNA sequence
gcgaaagaaattaatttcac

SEQ ID NO: 626339 - DNA, 20 bp, Artificial
  CRISPR gRNA sequence
atttttaaagttgtcataca

SEQ ID NO: 626340 - DNA, 20 bp, Artificial
  CRISPR gRNA sequence
gtaaatgtgttctatatttg

SEQ ID NO: 626341 - DNA, 20 bp, Artificial
  CRISPR gRNA sequence
taactagaagttccttatat

SEQ ID NO: 626342 - DNA, 20 bp, Artificial
  CRISPR gRNA sequence
agaagttccttatattaaaa

SEQ ID NO: 626343 - DNA, 20 bp, Artificial
  CRISPR gRNA sequence
attaaaacaaaacaaaagta

SEQ ID NO: 626344 - DNA, 20 bp, Artificial
  CRISPR gRNA sequence
ttagctttacagatgccacc

SEQ ID NO: 626345 - DNA, 20 bp, Artificial
  CRISPR gRNA sequence
ttaatggtattaatttgaca

SEQ ID NO: 626346 - DNA, 20 bp, Artificial
  CRISPR gRNA sequence
ttaaagcatttatgccacta

SEQ ID NO: 626347 - DNA, 20 bp, Artificial
  CRISPR gRNA sequence
tattaaactatgtcagtctc

SEQ ID NO: 626348 - DNA, 20 bp, Artificial
  CRISPR gRNA sequence
aagaatagtaaaaggggccc

SEQ ID NO: 626349 - DNA, 20 bp, Artificial
  CRISPR gRNA sequence
tccttttagtcatttgttca

SEQ ID NO: 626350 - DNA, 20 bp, Artificial
  CRISPR gRNA sequence
taatatgggagacaaagaca

SEQ ID NO: 626351 - DNA, 20 bp, Artificial
  CRISPR gRNA sequence
tttgtaatagaagtaggtga

SEQ ID NO: 626352 - DNA, 20 bp, Artificial
  CRISPR gRNA sequence
ctctttgaggtacaataaag

SEQ ID NO: 626353 - DNA, 20 bp, Artificial
  CRISPR gRNA sequence
tgaggtacaataaagaaaaa

SEQ ID NO: 626354 - DNA, 20 bp, Artificial
  CRISPR gRNA sequence
cattattacatatttgtaca

SEQ ID NO: 626355 - DNA, 20 bp, Artificial
  CRISPR gRNA sequence
aaaatattcacatgatttta

SEQ ID NO: 626356 - DNA, 20 bp, Artificial
  CRISPR gRNA sequence
taaatccaataaaggcacag

SEQ ID NO: 626357 - DNA, 20 bp, Artificial
  CRISPR gRNA sequence
ttcttaagaaatgtcagctg

SEQ ID NO: 626358 - DNA, 20 bp, Artificial
  CRISPR gRNA sequence
tctaaatacaagggccaatg

SEQ ID NO: 626359 - DNA, 20 bp, Artificial
  CRISPR gRNA sequence
gggccaatgcaaaacactct

SEQ ID NO: 626360 - DNA, 20 bp, Artificial
  CRISPR gRNA sequence
ctaatacataacaaagcatc

SEQ ID NO: 626361 - DNA, 20 bp, Artificial
  CRISPR gRNA sequence
ccgggacagaccaggagcta

SEQ ID NO: 626362 - DNA, 20 bp, Artificial
  CRISPR gRNA sequence
aacatttgaaattatgttta

SEQ ID NO: 626363 - DNA, 20 bp, Artificial
  CRISPR gRNA sequence
atgcatttttgtcaagggga

SEQ ID NO: 626364 - DNA, 20 bp, Artificial
  CRISPR gRNA sequence
aacaatgtctacataataac

SEQ ID NO: 626365 - DNA, 20 bp, Artificial
  CRISPR gRNA sequence
tactgtcaaatacaatttca

SEQ ID NO: 626366 - DNA, 20 bp, Artificial
  CRISPR gRNA sequence
tacaatttcaaaaaacaaag

SEQ ID NO: 626367 - DNA, 20 bp, Artificial
  CRISPR gRNA sequence
gcacaaatttacacacacca

SEQ ID NO: 626368 - DNA, 20 bp, Artificial
  CRISPR gRNA sequence
tcttattattcattagctat

SEQ ID NO: 626369 - DNA, 20 bp, Artificial
  CRISPR gRNA sequence
caccagaatctctgtaacta

SEQ ID NO: 626370 - DNA, 20 bp, Artificial
  CRISPR gRNA sequence
aagatactattttccaaaaa

SEQ ID NO: 626371 - DNA, 20 bp, Artificial
  CRISPR gRNA sequence
aaaaaaggtattctaaatct

SEQ ID NO: 626372 - DNA, 20 bp, Artificial
  CRISPR gRNA sequence
ttctaaatcttaaaacaagg

SEQ ID NO: 626373 - DNA, 20 bp, Artificial
  CRISPR gRNA sequence
aattgttacatttatttctt

SEQ ID NO: 626374 - DNA, 20 bp, Artificial
  CRISPR gRNA sequence
gtcacacagctattaggttg

SEQ ID NO: 626375 - DNA, 20 bp, Artificial
  CRISPR gRNA sequence
acttctacagggcctcaccc

SEQ ID NO: 626376 - DNA, 20 bp, Artificial
  CRISPR gRNA sequence
ttagaatgaacactacagtg

SEQ ID NO: 626377 - DNA, 20 bp, Artificial
  CRISPR gRNA sequence
attaagtataataaagaaaa

SEQ ID NO: 626378 - DNA, 20 bp, Artificial
  CRISPR gRNA sequence
aaaagaaggaggctttcatg

SEQ ID NO: 626379 - DNA, 20 bp, Artificial
  CRISPR gRNA sequence
ctttcatgcaaaacaaggaa

SEQ ID NO: 626380 - DNA, 20 bp, Artificial
  CRISPR gRNA sequence
caggctctgtctattgtgtg

SEQ ID NO: 626381 - DNA, 20 bp, Artificial
  CRISPR gRNA sequence
tagccagtaatctagaaaat

SEQ ID NO: 626382 - DNA, 20 bp, Artificial
  CRISPR gRNA sequence
agaaaataaaaacacttggt

SEQ ID NO: 626383 - DNA, 20 bp, Artificial
  CRISPR gRNA sequence
aaaaacagaaactcagaaac

SEQ ID NO: 626384 - DNA, 20 bp, Artificial
  CRISPR gRNA sequence
aatttttttgtaacgttaaa

SEQ ID NO: 626385 - DNA, 20 bp, Artificial
  CRISPR gRNA sequence
tgattacaaacaaatgcttg

SEQ ID NO: 626386 - DNA, 20 bp, Artificial
  CRISPR gRNA sequence
ggggaatgtaaatgttggga

SEQ ID NO: 626387 - DNA, 20 bp, Artificial
  CRISPR gRNA sequence
ctactggattaaagtttatt

SEQ ID NO: 626388 - DNA, 20 bp, Artificial
  CRISPR gRNA sequence
catcgttagagcatttattt

SEQ ID NO: 626389 - DNA, 20 bp, Artificial
  CRISPR gRNA sequence
tattttacaaatgaggtaac

SEQ ID NO: 626390 - DNA, 20 bp, Artificial
  CRISPR gRNA sequence
ctcaagaaattaagcaatga

SEQ ID NO: 626391 - DNA, 20 bp, Artificial
  CRISPR gRNA sequence
caagtaaataagtccatcct

SEQ ID NO: 626392 - DNA, 20 bp, Artificial
  CRISPR gRNA sequence
ccacagagggagagaaacag

SEQ ID NO: 626393 - DNA, 20 bp, Artificial
  CRISPR gRNA sequence
tgctcaattctgtaattttt

SEQ ID NO: 626394 - DNA, 20 bp, Artificial
  CRISPR gRNA sequence
gactagcctgaccaacatgg

SEQ ID NO: 626395 - DNA, 20 bp, Artificial
  CRISPR gRNA sequence
acacttcgagaggaaaatgg

SEQ ID NO: 626396 - DNA, 20 bp, Artificial
  CRISPR gRNA sequence
aaaaccagcgatcagaggac

SEQ ID NO: 626397 - DNA, 20 bp, Artificial
  CRISPR gRNA sequence
cagaggacaaaaactggatg

SEQ ID NO: 626398 - DNA, 20 bp, Artificial
  CRISPR gRNA sequence
ctatgaatgaatattactca

SEQ ID NO: 626399 - DNA, 20 bp, Artificial
  CRISPR gRNA sequence
gaactatttagaataaaata

SEQ ID NO: 626400 - DNA, 20 bp, Artificial
  CRISPR gRNA sequence
acatgcacatatatgctttt

SEQ ID NO: 626401 - DNA, 20 bp, Artificial
  CRISPR gRNA sequence
actcaaaatgtaacaccaac

SEQ ID NO: 626402 - DNA, 20 bp, Artificial
  CRISPR gRNA sequence
aaactattcaaatgcatccc

SEQ ID NO: 626403 - DNA, 20 bp, Artificial
  CRISPR gRNA sequence
ttccaaaaaaaaattaaatc

SEQ ID NO: 626404 - DNA, 20 bp, Artificial
  CRISPR gRNA sequence
aattcatgcttcgagaactt

SEQ ID NO: 626405 - DNA, 20 bp, Artificial
  CRISPR gRNA sequence
aaatatacatcctcagccct

SEQ ID NO: 626406 - DNA, 20 bp, Artificial
  CRISPR gRNA sequence
aaatgtgtatttttaaacaa

SEQ ID NO: 626407 - DNA, 20 bp, Artificial
  CRISPR gRNA sequence
ttctcactgttaattcaact

SEQ ID NO: 626408 - DNA, 20 bp, Artificial
  CRISPR gRNA sequence
atgataatgagagcaatgac

SEQ ID NO: 626409 - DNA, 20 bp, Artificial
  CRISPR gRNA sequence
tccatcttgtacatgctact

SEQ ID NO: 626410 - DNA, 20 bp, Artificial
  CRISPR gRNA sequence
aacatggttgtatagaatca

SEQ ID NO: 626411 - DNA, 20 bp, Artificial
  CRISPR gRNA sequence
tccccaaagattcacatctg

SEQ ID NO: 626412 - DNA, 20 bp, Artificial
  CRISPR gRNA sequence
ctcaaatttacacacatttg

SEQ ID NO: 626413 - DNA, 20 bp, Artificial
  CRISPR gRNA sequence
gaagataccatccttctcta

SEQ ID NO: 626414 - DNA, 20 bp, Artificial
  CRISPR gRNA sequence
taatcttatgatttttttta

SEQ ID NO: 626415 - DNA, 20 bp, Artificial
  CRISPR gRNA sequence
tttattaaagcctgtgcaca

SEQ ID NO: 626416 - DNA, 20 bp, Artificial
  CRISPR gRNA sequence
actgaagtcacctacttcgt

SEQ ID NO: 626417 - DNA, 20 bp, Artificial
  CRISPR gRNA sequence
tgatttgctttacatatcat

SEQ ID NO: 626418 - DNA, 20 bp, Artificial
  CRISPR gRNA sequence
tttacatatcatcaaaacca

SEQ ID NO: 626419 - DNA, 20 bp, Artificial
  CRISPR gRNA sequence
tttcaaatagacttggattt

SEQ ID NO: 626420 - DNA, 20 bp, Artificial
  CRISPR gRNA sequence
taaatattccttacctatat

SEQ ID NO: 626421 - DNA, 20 bp, Artificial
  CRISPR gRNA sequence
aagaagggaaaaaagtaaag

SEQ ID NO: 626422 - DNA, 20 bp, Artificial
  CRISPR gRNA sequence
catacgttgttttgtttttt

SEQ ID NO: 626423 - DNA, 20 bp, Artificial
  CRISPR gRNA sequence
caaacctaagtatggcgact

SEQ ID NO: 626424 - DNA, 20 bp, Artificial
  CRISPR gRNA sequence
tgccaaactaagctacagaa

SEQ ID NO: 626425 - DNA, 20 bp, Artificial
  CRISPR gRNA sequence
gattattggtcagagccttg

SEQ ID NO: 626426 - DNA, 20 bp, Artificial
  CRISPR gRNA sequence
gttctctaagaaaattcatt

SEQ ID NO: 626427 - DNA, 20 bp, Artificial
  CRISPR gRNA sequence
ttatcttagatgctaaattt

SEQ ID NO: 626428 - DNA, 20 bp, Artificial
  CRISPR gRNA sequence
agatgctaaattttaaaacc

SEQ ID NO: 626429 - DNA, 20 bp, Artificial
  CRISPR gRNA sequence
atgcatgtaaagggatttag

SEQ ID NO: 626430 - DNA, 20 bp, Artificial
  CRISPR gRNA sequence
aaaattattccaagtcacag

SEQ ID NO: 626431 - DNA, 20 bp, Artificial
  CRISPR gRNA sequence
aactctttggaaaagaacct

SEQ ID NO: 626432 - DNA, 20 bp, Artificial
  CRISPR gRNA sequence
gaaaacacgtgcatcttagc

SEQ ID NO: 626433 - DNA, 20 bp, Artificial
  CRISPR gRNA sequence
tgccacaggctagtaagtta

SEQ ID NO: 626434 - DNA, 20 bp, Artificial
  CRISPR gRNA sequence
ctttctgaagcaagtacttg

SEQ ID NO: 626435 - DNA, 20 bp, Artificial
  CRISPR gRNA sequence
gtgtgagttatctgagaaat

SEQ ID NO: 626436 - DNA, 20 bp, Artificial
  CRISPR gRNA sequence
ttttatcaaatcaactagca

SEQ ID NO: 626437 - DNA, 20 bp, Artificial
  CRISPR gRNA sequence
gcctttccttcacatattgc

SEQ ID NO: 626438 - DNA, 20 bp, Artificial
  CRISPR gRNA sequence
cttcacatattgccaaaaca

SEQ ID NO: 626439 - DNA, 20 bp, Artificial
  CRISPR gRNA sequence
atataaatctaaagtataaa

SEQ ID NO: 626440 - DNA, 20 bp, Artificial
  CRISPR gRNA sequence
taagttgcatcttattacat

SEQ ID NO: 626441 - DNA, 20 bp, Artificial
  CRISPR gRNA sequence
tcagtaaatgaccctttatc

SEQ ID NO: 626442 - DNA, 20 bp, Artificial
  CRISPR gRNA sequence
cctttatcaaaaacagtagc

SEQ ID NO: 626443 - DNA, 20 bp, Artificial
  CRISPR gRNA sequence
actgtcttttcctacaaatt

SEQ ID NO: 626444 - DNA, 20 bp, Artificial
  CRISPR gRNA sequence
cagtcataaacctggcaagt

SEQ ID NO: 626445 - DNA, 20 bp, Artificial
  CRISPR gRNA sequence
cccacaataaaaaaaattaa

SEQ ID NO: 626446 - DNA, 20 bp, Artificial
  CRISPR gRNA sequence
aagtttcataatccaggaat

SEQ ID NO: 626447 - DNA, 20 bp, Artificial
  CRISPR gRNA sequence
attaccaataacaaatcaat

SEQ ID NO: 626448 - DNA, 20 bp, Artificial
  CRISPR gRNA sequence
atagtcaaagtgcaatgctg

SEQ ID NO: 626449 - DNA, 20 bp, Artificial
  CRISPR gRNA sequence
gggaggacaaacaaacataa

SEQ ID NO: 626450 - DNA, 20 bp, Artificial
  CRISPR gRNA sequence
gacaaacaaacataagaaaa

SEQ ID NO: 626451 - DNA, 20 bp, Artificial
  CRISPR gRNA sequence
acaaacataagaaaacaaaa

SEQ ID NO: 626452 - DNA, 20 bp, Artificial
  CRISPR gRNA sequence
taagaaaacaaaacaaaaca

SEQ ID NO: 626453 - DNA, 20 bp, Artificial
  CRISPR gRNA sequence
gagaatcatttaaaaaaaaa

SEQ ID NO: 626454 - DNA, 20 bp, Artificial
  CRISPR gRNA sequence
gtcctttttgcctttagttt

SEQ ID NO: 626455 - DNA, 20 bp, Artificial
  CRISPR gRNA sequence
aatttctccattacttactg

SEQ ID NO: 626456 - DNA, 20 bp, Artificial
  CRISPR gRNA sequence
gcagcttcacttcttgtctc

SEQ ID NO: 626457 - DNA, 20 bp, Artificial
  CRISPR gRNA sequence
cccttaccccccccccaaaa

SEQ ID NO: 626458 - DNA, 20 bp, Artificial
  CRISPR gRNA sequence
caaacagatcggctgataaa

SEQ ID NO: 626459 - DNA, 20 bp, Artificial
  CRISPR gRNA sequence
gcaatgcgattaacaagaga

SEQ ID NO: 626460 - DNA, 20 bp, Artificial
  CRISPR gRNA sequence
tcgaccaaaagctaagacaa

SEQ ID NO: 626461 - DNA, 20 bp, Artificial
  CRISPR gRNA sequence
tttcttcttggaattcaagt

SEQ ID NO: 626462 - DNA, 20 bp, Artificial
  CRISPR gRNA sequence
gaattcaagttaaaacaaag

SEQ ID NO: 626463 - DNA, 20 bp, Artificial
  CRISPR gRNA sequence
catttgatcacatcacagtg

SEQ ID NO: 626464 - DNA, 20 bp, Artificial
  CRISPR gRNA sequence
atataattacacttaacttt

SEQ ID NO: 626465 - DNA, 20 bp, Artificial
  CRISPR gRNA sequence
ataatctatgaatcagaaga

SEQ ID NO: 626466 - DNA, 20 bp, Artificial
  CRISPR gRNA sequence
tgctttaacagtgcaagttt

SEQ ID NO: 626467 - DNA, 20 bp, Artificial
  CRISPR gRNA sequence
cttaagtgaaccgtcaagag

SEQ ID NO: 626468 - DNA, 20 bp, Artificial
  CRISPR gRNA sequence
agtctggatggctgaaattt

SEQ ID NO: 626469 - DNA, 20 bp, Artificial
  CRISPR gRNA sequence
aattgtcataagtccttcct

SEQ ID NO: 626470 - DNA, 20 bp, Artificial
  CRISPR gRNA sequence
gagtgagactctgtctcaac

SEQ ID NO: 626471 - DNA, 20 bp, Artificial
  CRISPR gRNA sequence
agactctgtctcaacaaaaa

SEQ ID NO: 626472 - DNA, 20 bp, Artificial
  CRISPR gRNA sequence
tgtctcaacaaaaacaaaac

SEQ ID NO: 626473 - DNA, 20 bp, Artificial
  CRISPR gRNA sequence
aaccaaaacgaacaaacaaa

SEQ ID NO: 626474 - DNA, 20 bp, Artificial
  CRISPR gRNA sequence
tagactccacaggcatgaaa

SEQ ID NO: 626475 - DNA, 20 bp, Artificial
  CRISPR gRNA sequence
aaaacccccaatcttggtat

SEQ ID NO: 626476 - DNA, 20 bp, Artificial
  CRISPR gRNA sequence
tttcccaaatacgactttag

SEQ ID NO: 626477 - DNA, 20 bp, Artificial
  CRISPR gRNA sequence
ataatacattgtataggaaa

SEQ ID NO: 626478 - DNA, 20 bp, Artificial
  CRISPR gRNA sequence
tttttttctcagcagaaaaa

SEQ ID NO: 626479 - DNA, 20 bp, Artificial
  CRISPR gRNA sequence
ccaccaatcccagtttgaaa

SEQ ID NO: 626480 - DNA, 20 bp, Artificial
  CRISPR gRNA sequence
ctccaagcctccagccggca

SEQ ID NO: 626481 - DNA, 20 bp, Artificial
  CRISPR gRNA sequence
tcgctgaagatggaggaagt

SEQ ID NO: 626482 - DNA, 20 bp, Artificial
  CRISPR gRNA sequence
tgttggaattaaaaaaaaaa

SEQ ID NO: 626483 - DNA, 20 bp, Artificial
  CRISPR gRNA sequence
attaaaaaaaaaaaaaaacc

SEQ ID NO: 626484 - DNA, 20 bp, Artificial
  CRISPR gRNA sequence
tttcttttttgccaagggcc

SEQ ID NO: 626485 - DNA, 20 bp, Artificial
  CRISPR gRNA sequence
agagagaagggggaaacaca

SEQ ID NO: 626486 - DNA, 20 bp, Artificial
  CRISPR gRNA sequence
ttgtgggaagtagtgaatgg

SEQ ID NO: 626487 - DNA, 20 bp, Artificial
  CRISPR gRNA sequence
tcctgttcattctagtatta

SEQ ID NO: 626488 - DNA, 20 bp, Artificial
  CRISPR gRNA sequence
ctcgaaactgtaagttatta

SEQ ID NO: 626489 - DNA, 20 bp, Artificial
  CRISPR gRNA sequence
tcccgtatcatttagaaaga

SEQ ID NO: 626490 - DNA, 20 bp, Artificial
  CRISPR gRNA sequence
cctggagggtgcctgcttcc

SEQ ID NO: 626491 - DNA, 20 bp, Artificial
  CRISPR gRNA sequence
ttaaagctaaaagtaaatgt

SEQ ID NO: 626492 - DNA, 20 bp, Artificial
  CRISPR gRNA sequence
aattttttttttttttttag

SEQ ID NO: 626493 - DNA, 20 bp, Artificial
  CRISPR gRNA sequence
agaattaaagtccgttttca

SEQ ID NO: 626494 - DNA, 20 bp, Artificial
  CRISPR gRNA sequence
taaagtccgttttcaaaaaa

SEQ ID NO: 626495 - DNA, 20 bp, Artificial
  CRISPR gRNA sequence
ttactctattttataacact

SEQ ID NO: 626496 - DNA, 20 bp, Artificial
  CRISPR gRNA sequence
tatgaattttcctaattagt

SEQ ID NO: 626497 - DNA, 20 bp, Artificial
  CRISPR gRNA sequence
gtagtttaataccatatttt

SEQ ID NO: 626498 - DNA, 20 bp, Artificial
  CRISPR gRNA sequence
actgacattaaacaggttta

SEQ ID NO: 626499 - DNA, 20 bp, Artificial
  CRISPR gRNA sequence
gtttataggtcagaaggaaa

SEQ ID NO: 626500 - DNA, 20 bp, Artificial
  CRISPR gRNA sequence
taatttcttctacaagtata

SEQ ID NO: 626501 - DNA, 20 bp, Artificial
  CRISPR gRNA sequence
tttaaaatgacttacgcctt

SEQ ID NO: 626502 - DNA, 20 bp, Artificial
  CRISPR gRNA sequence
tattacattattacattttt

SEQ ID NO: 626503 - DNA, 20 bp, Artificial
  CRISPR gRNA sequence
tttaatttttttttggaaat

SEQ ID NO: 626504 - DNA, 20 bp, Artificial
  CRISPR gRNA sequence
gaaacacccccgtacctcaa

SEQ ID NO: 626505 - DNA, 20 bp, Artificial
  CRISPR gRNA sequence
gtgtatgcgtgtgaatgtgt

SEQ ID NO: 626506 - DNA, 20 bp, Artificial
  CRISPR gRNA sequence
taagaacaagaaggaaacgt

SEQ ID NO: 626507 - DNA, 20 bp, Artificial
  CRISPR gRNA sequence
taaaagaaagtatggagcca

SEQ ID NO: 626508 - DNA, 20 bp, Artificial
  CRISPR gRNA sequence
gaaatctgagtagaatgagt

SEQ ID NO: 626509 - DNA, 20 bp, Artificial
  CRISPR gRNA sequence
atgttgctaattttttacat

SEQ ID NO: 626510 - DNA, 20 bp, Artificial
  CRISPR gRNA sequence
tatatgtttaacttgcttaa

SEQ ID NO: 626511 - DNA, 20 bp, Artificial
  CRISPR gRNA sequence
ctagcatagaatgtgctgat

SEQ ID NO: 626512 - DNA, 20 bp, Artificial
  CRISPR gRNA sequence
ctcttgtgtagaatcaagga

SEQ ID NO: 626513 - DNA, 20 bp, Artificial
  CRISPR gRNA sequence
gaatttagagatggatttta

SEQ ID NO: 626514 - DNA, 20 bp, Artificial
  CRISPR gRNA sequence
tgaatcaaatggctctccct

SEQ ID NO: 626515 - DNA, 20 bp, Artificial
  CRISPR gRNA sequence
gatccagttagaggacatca

SEQ ID NO: 626516 - DNA, 20 bp, Artificial
  CRISPR gRNA sequence
tgccaattacttagtgagca

SEQ ID NO: 626517 - DNA, 20 bp, Artificial
  CRISPR gRNA sequence
atagacagagcctgactttc

SEQ ID NO: 626518 - DNA, 20 bp, Artificial
  CRISPR gRNA sequence
gagtagtacaacaacgatta

SEQ ID NO: 626519 - DNA, 20 bp, Artificial
  CRISPR gRNA sequence
agaaagtgagactctgtctg

SEQ ID NO: 626520 - DNA, 20 bp, Artificial
  CRISPR gRNA sequence
aaaaacaacaacaacaacaa

SEQ ID NO: 626521 - DNA, 20 bp, Artificial
  CRISPR gRNA sequence
ttttttattaaacagacaaa

SEQ ID NO: 626522 - DNA, 20 bp, Artificial
  CRISPR gRNA sequence
taggaagggaaatgctttat

SEQ ID NO: 626523 - DNA, 20 bp, Artificial
  CRISPR gRNA sequence
tttctttgaaaaattttatt

SEQ ID NO: 626524 - DNA, 20 bp, Artificial
  CRISPR gRNA sequence
gtaaaatacaattttaacct

SEQ ID NO: 626525 - DNA, 20 bp, Artificial
  CRISPR gRNA sequence
cttaaaacgataatctcata

SEQ ID NO: 626526 - DNA, 20 bp, Artificial
  CRISPR gRNA sequence
ataggaacatagtataaagt

SEQ ID NO: 626527 - DNA, 20 bp, Artificial
  CRISPR gRNA sequence
gtctgggagaaattataatt

SEQ ID NO: 626528 - DNA, 20 bp, Artificial
  CRISPR gRNA sequence
atgttaagtatggtaaataa

SEQ ID NO: 626529 - DNA, 20 bp, Artificial
  CRISPR gRNA sequence
gttaaaataaaattttgtac

SEQ ID NO: 626530 - DNA, 20 bp, Artificial
  CRISPR gRNA sequence
agaattttgagcagatacta

SEQ ID NO: 626531 - DNA, 20 bp, Artificial
  CRISPR gRNA sequence
aaggctatagggagatgtta

SEQ ID NO: 626532 - DNA, 20 bp, Artificial
  CRISPR gRNA sequence
tcttaggaaagaataatcct

SEQ ID NO: 626533 - DNA, 20 bp, Artificial
  CRISPR gRNA sequence
agttgtagctcttctcaaga

SEQ ID NO: 626534 - DNA, 20 bp, Artificial
  CRISPR gRNA sequence
agaaacggaatcagaaagca

SEQ ID NO: 626535 - DNA, 20 bp, Artificial
  CRISPR gRNA sequence
cagcagcttgggcaacatgg

SEQ ID NO: 626536 - DNA, 20 bp, Artificial
  CRISPR gRNA sequence
ctgtactttttctcaaccag

SEQ ID NO: 626537 - DNA, 20 bp, Artificial
  CRISPR gRNA sequence
caatctttctttattcaaac

SEQ ID NO: 626538 - DNA, 20 bp, Artificial
  CRISPR gRNA sequence
ccattttgataaagccccta

SEQ ID NO: 626539 - DNA, 20 bp, Artificial
  CRISPR gRNA sequence
tgtcttttggttttgacggg

SEQ ID NO: 626540 - DNA, 20 bp, Artificial
  CRISPR gRNA sequence
attttgagagacctcactat

SEQ ID NO: 626541 - DNA, 20 bp, Artificial
  CRISPR gRNA sequence
gaccagtgcctgacattgat

SEQ ID NO: 626542 - DNA, 20 bp, Artificial
  CRISPR gRNA sequence
cgccttctttgagccagatg

SEQ ID NO: 626543 - DNA, 20 bp, Artificial
  CRISPR gRNA sequence
gaagaaataggaaaggaaga

SEQ ID NO: 626544 - DNA, 20 bp, Artificial
  CRISPR gRNA sequence
gaatacttgtcagagtaaaa

SEQ ID NO: 626545 - DNA, 20 bp, Artificial
  CRISPR gRNA sequence
ggaagaaaattttttttcag

SEQ ID NO: 626546 - DNA, 20 bp, Artificial
  CRISPR gRNA sequence
ataaacactgaaaatatatt

SEQ ID NO: 626547 - DNA, 20 bp, Artificial
  CRISPR gRNA sequence
aggcacatttagaaacatgc

SEQ ID NO: 626548 - DNA, 20 bp, Artificial
  CRISPR gRNA sequence
catttagaaacatgctaaaa

SEQ ID NO: 626549 - DNA, 20 bp, Artificial
  CRISPR gRNA sequence
acctctctccactccttccc

SEQ ID NO: 626550 - DNA, 20 bp, Artificial
  CRISPR gRNA sequence
ccttccctaaaacaattaga

SEQ ID NO: 626551 - DNA, 20 bp, Artificial
  CRISPR gRNA sequence
agaaagagagataaggggaa

SEQ ID NO: 626552 - DNA, 20 bp, Artificial
  CRISPR gRNA sequence
taactttgaagaggccccaa

SEQ ID NO: 626553 - DNA, 20 bp, Artificial
  CRISPR gRNA sequence
tccagttcagattcacttta

SEQ ID NO: 626554 - DNA, 20 bp, Artificial
  CRISPR gRNA sequence
attaattcatttaatctcaa

SEQ ID NO: 626555 - DNA, 20 bp, Artificial
  CRISPR gRNA sequence
ttgccccgctgttatagatg

SEQ ID NO: 626556 - DNA, 20 bp, Artificial
  CRISPR gRNA sequence
agtaaaaatgatatggaata

SEQ ID NO: 626557 - DNA, 20 bp, Artificial
  CRISPR gRNA sequence
attttctctatagacagtga

SEQ ID NO: 626558 - DNA, 20 bp, Artificial
  CRISPR gRNA sequence
aaagccattatgattcatag

SEQ ID NO: 626559 - DNA, 20 bp, Artificial
  CRISPR gRNA sequence
atggcaaaaaatagcataaa

SEQ ID NO: 626560 - DNA, 20 bp, Artificial
  CRISPR gRNA sequence
cacccaaaataggaggtata

SEQ ID NO: 626561 - DNA, 20 bp, Artificial
  CRISPR gRNA sequence
tctaattcattatattagca

SEQ ID NO: 626562 - DNA, 20 bp, Artificial
  CRISPR gRNA sequence
aagaaaataagttgggtaaa

SEQ ID NO: 626563 - DNA, 20 bp, Artificial
  CRISPR gRNA sequence
gtttactaataattatattt

SEQ ID NO: 626564 - DNA, 20 bp, Artificial
  CRISPR gRNA sequence
atctacctatttgacaacat

SEQ ID NO: 626565 - DNA, 20 bp, Artificial
  CRISPR gRNA sequence
caacatcaaaacaaaaggaa

SEQ ID NO: 626566 - DNA, 20 bp, Artificial
  CRISPR gRNA sequence
gtgtaattaagtggtagttt

SEQ ID NO: 626567 - DNA, 20 bp, Artificial
  CRISPR gRNA sequence
tagaataaaatggagctgtt

SEQ ID NO: 626568 - DNA, 20 bp, Artificial
  CRISPR gRNA sequence
aatttgtaaaattttgtcag

SEQ ID NO: 626569 - DNA, 20 bp, Artificial
  CRISPR gRNA sequence
tctctttgttctagagatat

SEQ ID NO: 626570 - DNA, 20 bp, Artificial
  CRISPR gRNA sequence
aaattatctaaattttcact

SEQ ID NO: 626571 - DNA, 20 bp, Artificial
  CRISPR gRNA sequence
aaattatctaaattttcact

SEQ ID NO: 626572 - DNA, 20 bp, Artificial
  CRISPR gRNA sequence
tctgctttttccacagtgag

SEQ ID NO: 626573 - DNA, 20 bp, Artificial
  CRISPR gRNA sequence
agttcagtgatccctccttt

SEQ ID NO: 626574 - DNA, 20 bp, Artificial
  CRISPR gRNA sequence
gatatttagtctcagaaatg

SEQ ID NO: 626575 - DNA, 20 bp, Artificial
  CRISPR gRNA sequence
agaaatggaaaacctactta

SEQ ID NO: 626576 - DNA, 20 bp, Artificial
  CRISPR gRNA sequence
ttagaccaactcttccttta

SEQ ID NO: 626577 - DNA, 20 bp, Artificial
  CRISPR gRNA sequence
ataaaaatatactgattgaa

SEQ ID NO: 626578 - DNA, 20 bp, Artificial
  CRISPR gRNA sequence
ctatttttatctgagctagg

SEQ ID NO: 626579 - DNA, 20 bp, Artificial
  CRISPR gRNA sequence
aggtaaaacttaagtcagtg

SEQ ID NO: 626580 - DNA, 20 bp, Artificial
  CRISPR gRNA sequence
ggaaactcttaaatcttttt

SEQ ID NO: 626581 - DNA, 20 bp, Artificial
  CRISPR gRNA sequence
gtgtatagacaaaggtaaga

SEQ ID NO: 626582 - DNA, 20 bp, Artificial
  CRISPR gRNA sequence
atggtattcctcccttcccc

SEQ ID NO: 626583 - DNA, 20 bp, Artificial
  CRISPR gRNA sequence
ttttgggaacagttggaaag

SEQ ID NO: 626584 - DNA, 20 bp, Artificial
  CRISPR gRNA sequence
tcaatagttagaaaatgtgg

SEQ ID NO: 626585 - DNA, 20 bp, Artificial
  CRISPR gRNA sequence
agagattacacactaagctt

SEQ ID NO: 626586 - DNA, 20 bp, Artificial
  CRISPR gRNA sequence
actaagctttaaaaccacag

SEQ ID NO: 626587 - DNA, 20 bp, Artificial
  CRISPR gRNA sequence
gctttaaaaccacagcaaaa

SEQ ID NO: 626588 - DNA, 20 bp, Artificial
  CRISPR gRNA sequence
ccacagcaaaacaaaacttt

SEQ ID NO: 626589 - DNA, 20 bp, Artificial
  CRISPR gRNA sequence
cttgtgagcattaaaataat

SEQ ID NO: 626590 - DNA, 20 bp, Artificial
  CRISPR gRNA sequence
gagcattaaaataatgaaaa

SEQ ID NO: 626591 - DNA, 20 bp, Artificial
  CRISPR gRNA sequence
ccctaattattcaaagttta

SEQ ID NO: 626592 - DNA, 20 bp, Artificial
  CRISPR gRNA sequence
agcaaaccaagaacaggtgt

SEQ ID NO: 626593 - DNA, 20 bp, Artificial
  CRISPR gRNA sequence
agtttaaatacagaattatt

SEQ ID NO: 626594 - DNA, 20 bp, Artificial
  CRISPR gRNA sequence
tgcttctttcctggttttac

SEQ ID NO: 626595 - DNA, 20 bp, Artificial
  CRISPR gRNA sequence
taggtagtgtcagttgccag

SEQ ID NO: 626596 - DNA, 20 bp, Artificial
  CRISPR gRNA sequence
ctagtgtttaaataactaat

SEQ ID NO: 626597 - DNA, 20 bp, Artificial
  CRISPR gRNA sequence
attattaattttcattatgc

SEQ ID NO: 626598 - DNA, 20 bp, Artificial
  CRISPR gRNA sequence
tttcattatgccaaaactga

SEQ ID NO: 626599 - DNA, 20 bp, Artificial
  CRISPR gRNA sequence
agtattatctgttctgtaag

SEQ ID NO: 626600 - DNA, 20 bp, Artificial
  CRISPR gRNA sequence
atagaagttgagtaaatgct

SEQ ID NO: 626601 - DNA, 20 bp, Artificial
  CRISPR gRNA sequence
tgtgatgaattagaaattta

SEQ ID NO: 626602 - DNA, 20 bp, Artificial
  CRISPR gRNA sequence
cattaaaatataaacatatc

SEQ ID NO: 626603 - DNA, 20 bp, Artificial
  CRISPR gRNA sequence
ctaactaaaaaagctaacat

SEQ ID NO: 626604 - DNA, 20 bp, Artificial
  CRISPR gRNA sequence
agtgtttaaggattgaggat

SEQ ID NO: 626605 - DNA, 20 bp, Artificial
  CRISPR gRNA sequence
tagatatgattattaactaa

SEQ ID NO: 626606 - DNA, 20 bp, Artificial
  CRISPR gRNA sequence
tttaaattggcgtttttcaa

SEQ ID NO: 626607 - DNA, 20 bp, Artificial
  CRISPR gRNA sequence
tcataatcagaaaaagaata

SEQ ID NO: 626608 - DNA, 20 bp, Artificial
  CRISPR gRNA sequence
tctaccataagaaacttcag

SEQ ID NO: 626609 - DNA, 20 bp, Artificial
  CRISPR gRNA sequence
tttgaaagacatatttttac

SEQ ID NO: 626610 - DNA, 20 bp, Artificial
  CRISPR gRNA sequence
cattttcaagtcaataattt

SEQ ID NO: 626611 - DNA, 20 bp, Artificial
  CRISPR gRNA sequence
gcttgctctacagcagtgaa

SEQ ID NO: 626612 - DNA, 20 bp, Artificial
  CRISPR gRNA sequence
acaatcattgtcatagagca

SEQ ID NO: 626613 - DNA, 20 bp, Artificial
  CRISPR gRNA sequence
actgctttagtctcaaagtt

SEQ ID NO: 626614 - DNA, 20 bp, Artificial
  CRISPR gRNA sequence
agacggatgatttctggaat

SEQ ID NO: 626615 - DNA, 20 bp, Artificial
  CRISPR gRNA sequence
ttggtgaaaagagtatgata

SEQ ID NO: 626616 - DNA, 20 bp, Artificial
  CRISPR gRNA sequence
gccatcagagaaatgcaaat

SEQ ID NO: 626617 - DNA, 20 bp, Artificial
  CRISPR gRNA sequence
agcaaactatcgcaaggaca

SEQ ID NO: 626618 - DNA, 20 bp, Artificial
  CRISPR gRNA sequence
tacacacacactaatgtaaa

SEQ ID NO: 626619 - DNA, 20 bp, Artificial
  CRISPR gRNA sequence
acttcccctaccttttgttt

SEQ ID NO: 626620 - DNA, 20 bp, Artificial
  CRISPR gRNA sequence
gcaaaggccagatcacttaa

SEQ ID NO: 626621 - DNA, 20 bp, Artificial
  CRISPR gRNA sequence
catatattattttgcattgt

SEQ ID NO: 626622 - DNA, 20 bp, Artificial
  CRISPR gRNA sequence
ctgctcttctgtatgtatag

SEQ ID NO: 626623 - DNA, 20 bp, Artificial
  CRISPR gRNA sequence
gtccaaaaggctttttgttt

SEQ ID NO: 626624 - DNA, 20 bp, Artificial
  CRISPR gRNA sequence
agtctatacaatttactcct

SEQ ID NO: 626625 - DNA, 20 bp, Artificial
  CRISPR gRNA sequence
ggacctctaaatgaattgtt

SEQ ID NO: 626626 - DNA, 20 bp, Artificial
  CRISPR gRNA sequence
ttgcaaacatattttagaag

SEQ ID NO: 626627 - DNA, 20 bp, Artificial
  CRISPR gRNA sequence
tattgctgcttgatttcatg

SEQ ID NO: 626628 - DNA, 20 bp, Artificial
  CRISPR gRNA sequence
gcacataacaatgtatagaa

SEQ ID NO: 626629 - DNA, 20 bp, Artificial
  CRISPR gRNA sequence
ggtcttgagtttcttgccct

SEQ ID NO: 626630 - DNA, 20 bp, Artificial
  CRISPR gRNA sequence
ttgtaatagatttatactaa

SEQ ID NO: 626631 - DNA, 20 bp, Artificial
  CRISPR gRNA sequence
ggcatcaaactggagggtgg

SEQ ID NO: 626632 - DNA, 20 bp, Artificial
  CRISPR gRNA sequence
aaaatggaagttgctgctag

SEQ ID NO: 626633 - DNA, 20 bp, Artificial
  CRISPR gRNA sequence
ttctcataggtttggaaaca

SEQ ID NO: 626634 - DNA, 20 bp, Artificial
  CRISPR gRNA sequence
agtatttagagggcaaagca

SEQ ID NO: 626635 - DNA, 20 bp, Artificial
  CRISPR gRNA sequence
ttagagggcaaagcaaaaaa

SEQ ID NO: 626636 - DNA, 20 bp, Artificial
  CRISPR gRNA sequence
tctattgagatggaagattt

SEQ ID NO: 626637 - DNA, 20 bp, Artificial
  CRISPR gRNA sequence
taatgttaagaaaagggaag

SEQ ID NO: 626638 - DNA, 20 bp, Artificial
  CRISPR gRNA sequence
acccttctaaaataatatag

SEQ ID NO: 626639 - DNA, 20 bp, Artificial
  CRISPR gRNA sequence
aggtcaattaaaaaaattta

SEQ ID NO: 626640 - DNA, 20 bp, Artificial
  CRISPR gRNA sequence
ttctatttttttttctagtg

SEQ ID NO: 626641 - DNA, 20 bp, Artificial
  CRISPR gRNA sequence
gatgtgtaggaaagcgttgg

SEQ ID NO: 626642 - DNA, 20 bp, Artificial
  CRISPR gRNA sequence
ttttttacaatcagtgattt

SEQ ID NO: 626643 - DNA, 20 bp, Artificial
  CRISPR gRNA sequence
ggattctagttttgttaaaa

SEQ ID NO: 626644 - DNA, 20 bp, Artificial
  CRISPR gRNA sequence
ttcattttaaatattatggc

SEQ ID NO: 626645 - DNA, 20 bp, Artificial
  CRISPR gRNA sequence
aaagcagcgattagctttta

SEQ ID NO: 626646 - DNA, 20 bp, Artificial
  CRISPR gRNA sequence
attaagccagcagaacagaa

SEQ ID NO: 626647 - DNA, 20 bp, Artificial
  CRISPR gRNA sequence
taactggaagttagttttaa

SEQ ID NO: 626648 - DNA, 20 bp, Artificial
  CRISPR gRNA sequence
ttggcattctattactgtag

SEQ ID NO: 626649 - DNA, 20 bp, Artificial
  CRISPR gRNA sequence
gagcaagactccatctcaaa

SEQ ID NO: 626650 - DNA, 20 bp, Artificial
  CRISPR gRNA sequence
tttgaataactgtcatactc

SEQ ID NO: 626651 - DNA, 20 bp, Artificial
  CRISPR gRNA sequence
gtgatgtttttcaaggagtg

SEQ ID NO: 626652 - DNA, 20 bp, Artificial
  CRISPR gRNA sequence
cttaagcagaataaaattta

SEQ ID NO: 626653 - DNA, 20 bp, Artificial
  CRISPR gRNA sequence
tttcagcaaaagcttaaaat

SEQ ID NO: 626654 - DNA, 20 bp, Artificial
  CRISPR gRNA sequence
cagtcgaaacagaaaaaaaa

SEQ ID NO: 626655 - DNA, 20 bp, Artificial
  CRISPR gRNA sequence
aaaacaaaggaaaggaatct

SEQ ID NO: 626656 - DNA, 20 bp, Artificial
  CRISPR gRNA sequence
tgggcgagaattcactgttt

SEQ ID NO: 626657 - DNA, 20 bp, Artificial
  CRISPR gRNA sequence
ttccattgctaccaatttca

SEQ ID NO: 626658 - DNA, 20 bp, Artificial
  CRISPR gRNA sequence
tgtgttttccatattatttg

SEQ ID NO: 626659 - DNA, 20 bp, Artificial
  CRISPR gRNA sequence
agatcatggaaagaaaagaa

SEQ ID NO: 626660 - DNA, 20 bp, Artificial
  CRISPR gRNA sequence
aaaaacagcttactcttgcc

SEQ ID NO: 626661 - DNA, 20 bp, Artificial
  CRISPR gRNA sequence
ctttggaagatgagagtgac

SEQ ID NO: 626662 - DNA, 20 bp, Artificial
  CRISPR gRNA sequence
catatgtttatagcctttga

SEQ ID NO: 626663 - DNA, 20 bp, Artificial
  CRISPR gRNA sequence
aaacaaagactttaggcttc

SEQ ID NO: 626664 - DNA, 20 bp, Artificial
  CRISPR gRNA sequence
aatttcagtaacaaagagta

SEQ ID NO: 626665 - DNA, 20 bp, Artificial
  CRISPR gRNA sequence
tacacaaattgttatttatg

SEQ ID NO: 626666 - DNA, 20 bp, Artificial
  CRISPR gRNA sequence
tcaccagttaatagaagaaa

SEQ ID NO: 626667 - DNA, 20 bp, Artificial
  CRISPR gRNA sequence
tcattcattcattaggagta

SEQ ID NO: 626668 - DNA, 20 bp, Artificial
  CRISPR gRNA sequence
agtgtaagctggtcttcttc

SEQ ID NO: 626669 - DNA, 20 bp, Artificial
  CRISPR gRNA sequence
ctgtattccactgtggagta

SEQ ID NO: 626670 - DNA, 20 bp, Artificial
  CRISPR gRNA sequence
tgatattgatgatttgtgtt

SEQ ID NO: 626671 - DNA, 20 bp, Artificial
  CRISPR gRNA sequence
atgtgaggtcttcgtaattt

SEQ ID NO: 626672 - DNA, 20 bp, Artificial
  CRISPR gRNA sequence
ggagaagaactttttgctca

SEQ ID NO: 626673 - DNA, 20 bp, Artificial
  CRISPR gRNA sequence
ataaaagcaggtgcttgaga

SEQ ID NO: 626674 - DNA, 20 bp, Artificial
  CRISPR gRNA sequence
aggtgcttgagaaaaaacaa

SEQ ID NO: 626675 - DNA, 20 bp, Artificial
  CRISPR gRNA sequence
gatgtataaatgtgtttctg

SEQ ID NO: 626676 - DNA, 20 bp, Artificial
  CRISPR gRNA sequence
tgtattgcccaagaagatgc

SEQ ID NO: 626677 - DNA, 20 bp, Artificial
  CRISPR gRNA sequence
aataattgacacaagactgt

SEQ ID NO: 626678 - DNA, 20 bp, Artificial
  CRISPR gRNA sequence
gtcagtattttataaatcat

SEQ ID NO: 626679 - DNA, 20 bp, Artificial
  CRISPR gRNA sequence
tggacatgtcccaccgttta

SEQ ID NO: 626680 - DNA, 20 bp, Artificial
  CRISPR gRNA sequence
ataagaaacatctttatcat

SEQ ID NO: 626681 - DNA, 20 bp, Artificial
  CRISPR gRNA sequence
ggagagtttctatgagtgga

SEQ ID NO: 626682 - DNA, 20 bp, Artificial
  CRISPR gRNA sequence
agactcatagtttcaggttc

SEQ ID NO: 626683 - DNA, 20 bp, Artificial
  CRISPR gRNA sequence
aagaattacttagattatgg

SEQ ID NO: 626684 - DNA, 20 bp, Artificial
  CRISPR gRNA sequence
ataattttaaaatgcttttt

SEQ ID NO: 626685 - DNA, 20 bp, Artificial
  CRISPR gRNA sequence
acaaagcaagtttaaagcaa

SEQ ID NO: 626686 - DNA, 20 bp, Artificial
  CRISPR gRNA sequence
caataaaactcttaagttag

SEQ ID NO: 626687 - DNA, 20 bp, Artificial
  CRISPR gRNA sequence
atactgtcccaactcttttt

SEQ ID NO: 626688 - DNA, 20 bp, Artificial
  CRISPR gRNA sequence
gtaacaatttgtaaataggg

SEQ ID NO: 626689 - DNA, 20 bp, Artificial
  CRISPR gRNA sequence
ataagttgattgatcttcat

SEQ ID NO: 626690 - DNA, 20 bp, Artificial
  CRISPR gRNA sequence
agactgtgtggtttctctaa

SEQ ID NO: 626691 - DNA, 20 bp, Artificial
  CRISPR gRNA sequence
attttctatattactggata

SEQ ID NO: 626692 - DNA, 20 bp, Artificial
  CRISPR gRNA sequence
acttttctgtgggatgatcc

SEQ ID NO: 626693 - DNA, 20 bp, Artificial
  CRISPR gRNA sequence
gccaataccaggattattaa

SEQ ID NO: 626694 - DNA, 20 bp, Artificial
  CRISPR gRNA sequence
tattcaggggtggcagtggt

SEQ ID NO: 626695 - DNA, 20 bp, Artificial
  CRISPR gRNA sequence
ctgctagtattggattgcag

SEQ ID NO: 626696 - DNA, 20 bp, Artificial
  CRISPR gRNA sequence
agaggtgaaaagttttttgt

SEQ ID NO: 626697 - DNA, 20 bp, Artificial
  CRISPR gRNA sequence
tagtttaacaattacgtgct

SEQ ID NO: 626698 - DNA, 20 bp, Artificial
  CRISPR gRNA sequence
ctaattctaacgacagttct

SEQ ID NO: 626699 - DNA, 20 bp, Artificial
  CRISPR gRNA sequence
cctatctagtaaaatacaaa

SEQ ID NO: 626700 - DNA, 20 bp, Artificial
  CRISPR gRNA sequence
tttaagctaaaaaataaact

SEQ ID NO: 626701 - DNA, 20 bp, Artificial
  CRISPR gRNA sequence
tcatattaaagatactgtct

SEQ ID NO: 626702 - DNA, 20 bp, Artificial
  CRISPR gRNA sequence
gttctattgtatttaaaaat

SEQ ID NO: 626703 - DNA, 20 bp, Artificial
  CRISPR gRNA sequence
attgtatttaaaaataaaaa

SEQ ID NO: 626704 - DNA, 20 bp, Artificial
  CRISPR gRNA sequence
aactttagtttggaacacaa

SEQ ID NO: 626705 - DNA, 20 bp, Artificial
  CRISPR gRNA sequence
tctcttaccaaaaaaaggaa

SEQ ID NO: 626706 - DNA, 20 bp, Artificial
  CRISPR gRNA sequence
ctagagtattttgtaaatgt

SEQ ID NO: 626707 - DNA, 20 bp, Artificial
  CRISPR gRNA sequence
ttaccctttcattaatcgca

SEQ ID NO: 626708 - DNA, 20 bp, Artificial
  CRISPR gRNA sequence
tgccaaaattcaatttattt

SEQ ID NO: 626709 - DNA, 20 bp, Artificial
  CRISPR gRNA sequence
gagctccagatttcttaaga

SEQ ID NO: 626710 - DNA, 20 bp, Artificial
  CRISPR gRNA sequence
gtatgtacctcattaactcc

SEQ ID NO: 626711 - DNA, 20 bp, Artificial
  CRISPR gRNA sequence
tgcattatgtcaaagggcca

SEQ ID NO: 626712 - DNA, 20 bp, Artificial
  CRISPR gRNA sequence
atttcaatgtaagctttttg

SEQ ID NO: 626713 - DNA, 20 bp, Artificial
  CRISPR gRNA sequence
caaacttataattgaggctt

SEQ ID NO: 626714 - DNA, 20 bp, Artificial
  CRISPR gRNA sequence
catagcaatatcagtaatag

SEQ ID NO: 626715 - DNA, 20 bp, Artificial
  CRISPR gRNA sequence
ttcaaataataagtttcaca

SEQ ID NO: 626716 - DNA, 20 bp, Artificial
  CRISPR gRNA sequence
cttcatttgttaattaaaat

SEQ ID NO: 626717 - DNA, 20 bp, Artificial
  CRISPR gRNA sequence
aggggaaagatcatttgatg

SEQ ID NO: 626718 - DNA, 20 bp, Artificial
  CRISPR gRNA sequence
caactccttgagaagaaaag

SEQ ID NO: 626719 - DNA, 20 bp, Artificial
  CRISPR gRNA sequence
tgagaagaaaagtaaaacag

SEQ ID NO: 626720 - DNA, 20 bp, Artificial
  CRISPR gRNA sequence
acttcaatatattagaataa

SEQ ID NO: 626721 - DNA, 20 bp, Artificial
  CRISPR gRNA sequence
cgagttactgtagaggaaat

SEQ ID NO: 626722 - DNA, 20 bp, Artificial
  CRISPR gRNA sequence
aaacatgaatgtgaatcgtg

SEQ ID NO: 626723 - DNA, 20 bp, Artificial
  CRISPR gRNA sequence
aattaaattaatgcaaacac

SEQ ID NO: 626724 - DNA, 20 bp, Artificial
  CRISPR gRNA sequence
tcttcataatagatagaaca

SEQ ID NO: 626725 - DNA, 20 bp, Artificial
  CRISPR gRNA sequence
ccagatctctgaaacctgga

SEQ ID NO: 626726 - DNA, 20 bp, Artificial
  CRISPR gRNA sequence
cttttgggaactgagatctc

SEQ ID NO: 626727 - DNA, 20 bp, Artificial
  CRISPR gRNA sequence
atggagattagttattgtta

SEQ ID NO: 626728 - DNA, 20 bp, Artificial
  CRISPR gRNA sequence
aaaactgcatgtctttacta

SEQ ID NO: 626729 - DNA, 20 bp, Artificial
  CRISPR gRNA sequence
gctcctctagtgtgaaggga

SEQ ID NO: 626730 - DNA, 20 bp, Artificial
  CRISPR gRNA sequence
tccagtaaagattgtacagc

SEQ ID NO: 626731 - DNA, 20 bp, Artificial
  CRISPR gRNA sequence
ctcatcattgccccactacc

SEQ ID NO: 626732 - DNA, 20 bp, Artificial
  CRISPR gRNA sequence
atcagtcaggatcctgacaa

SEQ ID NO: 626733 - DNA, 20 bp, Artificial
  CRISPR gRNA sequence
ccaccacctgtcatttgtgg

SEQ ID NO: 626734 - DNA, 20 bp, Artificial
  CRISPR gRNA sequence
tttccatggtttctttaata

SEQ ID NO: 626735 - DNA, 20 bp, Artificial
  CRISPR gRNA sequence
agaaagtgaactgcactttt

SEQ ID NO: 626736 - DNA, 20 bp, Artificial
  CRISPR gRNA sequence
ctgtacccaaattaaaggtt

SEQ ID NO: 626737 - DNA, 20 bp, Artificial
  CRISPR gRNA sequence
aatttataccaaaaaaaaaa

SEQ ID NO: 626738 - DNA, 20 bp, Artificial
  CRISPR gRNA sequence
gaacttaaaataaaagttaa

SEQ ID NO: 626739 - DNA, 20 bp, Artificial
  CRISPR gRNA sequence
atgaaaattatgtattgctc

SEQ ID NO: 626740 - DNA, 20 bp, Artificial
  CRISPR gRNA sequence
tatatttaagatacttgttc

SEQ ID NO: 626741 - DNA, 20 bp, Artificial
  CRISPR gRNA sequence
taatgctattaaattctaag

SEQ ID NO: 626742 - DNA, 20 bp, Artificial
  CRISPR gRNA sequence
ccatataaatccccatctgt

SEQ ID NO: 626743 - DNA, 20 bp, Artificial
  CRISPR gRNA sequence
caacaacttcctcccaacta

SEQ ID NO: 626744 - DNA, 20 bp, Artificial
  CRISPR gRNA sequence
ttttcctatttacattattt

SEQ ID NO: 626745 - DNA, 20 bp, Artificial
  CRISPR gRNA sequence
aaaaagaaaagaaaagaaaa

SEQ ID NO: 626746 - DNA, 20 bp, Artificial
  CRISPR gRNA sequence
gaaaagaaaagaaaagaaaa

SEQ ID NO: 626747 - DNA, 20 bp, Artificial
  CRISPR gRNA sequence
gaaaagaaaagaaaacaaaa

SEQ ID NO: 626748 - DNA, 20 bp, Artificial
  CRISPR gRNA sequence
atattttcattcttgactct

SEQ ID NO: 626749 - DNA, 20 bp, Artificial
  CRISPR gRNA sequence
ttgtttctaataaaagaaag

SEQ ID NO: 626750 - DNA, 20 bp, Artificial
  CRISPR gRNA sequence
tatcttgccaaatactgtaa

SEQ ID NO: 626751 - DNA, 20 bp, Artificial
  CRISPR gRNA sequence
atcagacaaataagaaagat

SEQ ID NO: 626752 - DNA, 20 bp, Artificial
  CRISPR gRNA sequence
catacacacccacagcacaa

SEQ ID NO: 626753 - DNA, 20 bp, Artificial
  CRISPR gRNA sequence
gaggaaggtatgtcaacagg

SEQ ID NO: 626754 - DNA, 20 bp, Artificial
  CRISPR gRNA sequence
acacacaagtgataagaaag

SEQ ID NO: 626755 - DNA, 20 bp, Artificial
  CRISPR gRNA sequence
tggcagagtttcagtgtaga

SEQ ID NO: 626756 - DNA, 20 bp, Artificial
  CRISPR gRNA sequence
tgacaatgtaccttgtcacc

SEQ ID NO: 626757 - DNA, 20 bp, Artificial
  CRISPR gRNA sequence
ggatgtgggcaaagtaaact

SEQ ID NO: 626758 - DNA, 20 bp, Artificial
  CRISPR gRNA sequence
gtaccatctcctggccacat

SEQ ID NO: 626759 - DNA, 20 bp, Artificial
  CRISPR gRNA sequence
tatttttcttccagagtgcc

SEQ ID NO: 626760 - DNA, 20 bp, Artificial
  CRISPR gRNA sequence
tgaacattgttattacatta

SEQ ID NO: 626761 - DNA, 20 bp, Artificial
  CRISPR gRNA sequence
tactatatttagtttttttg

SEQ ID NO: 626762 - DNA, 20 bp, Artificial
  CRISPR gRNA sequence
ttccatatcaggcagaattt

SEQ ID NO: 626763 - DNA, 20 bp, Artificial
  CRISPR gRNA sequence
tcaggcagaattttaaaact

SEQ ID NO: 626764 - DNA, 20 bp, Artificial
  CRISPR gRNA sequence
attttgaccacaagaaaatg

SEQ ID NO: 626765 - DNA, 20 bp, Artificial
  CRISPR gRNA sequence
ataatatataaattgaaacc

SEQ ID NO: 626766 - DNA, 20 bp, Artificial
  CRISPR gRNA sequence
aatttggcatcatctagaat

SEQ ID NO: 626767 - DNA, 20 bp, Artificial
  CRISPR gRNA sequence
caggaattgaaattgaagtt

SEQ ID NO: 626768 - DNA, 20 bp, Artificial
  CRISPR gRNA sequence
gttaaaaaccttcccacaaa

SEQ ID NO: 626769 - DNA, 20 bp, Artificial
  CRISPR gRNA sequence
taaggaaaatgtaatttaag

SEQ ID NO: 626770 - DNA, 20 bp, Artificial
  CRISPR gRNA sequence
gttggtttaacattgggtga

SEQ ID NO: 626771 - DNA, 20 bp, Artificial
  CRISPR gRNA sequence
attctaaacccaacgaagag

SEQ ID NO: 626772 - DNA, 20 bp, Artificial
  CRISPR gRNA sequence
aaattagaaagagatttaag

SEQ ID NO: 626773 - DNA, 20 bp, Artificial
  CRISPR gRNA sequence
ttggaaattatatcattcat

SEQ ID NO: 626774 - DNA, 20 bp, Artificial
  CRISPR gRNA sequence
gaggcaattacagcaacaaa

SEQ ID NO: 626775 - DNA, 20 bp, Artificial
  CRISPR gRNA sequence
gggatttcaacttagttcaa

SEQ ID NO: 626776 - DNA, 20 bp, Artificial
  CRISPR gRNA sequence
attatcaatttaaaattgag

SEQ ID NO: 626777 - DNA, 20 bp, Artificial
  CRISPR gRNA sequence
aacatatttgcaagttagga

SEQ ID NO: 626778 - DNA, 20 bp, Artificial
  CRISPR gRNA sequence
taggatctgatctcagacgc

SEQ ID NO: 626779 - DNA, 20 bp, Artificial
  CRISPR gRNA sequence
agggattgttggcaatgtct

SEQ ID NO: 626780 - DNA, 20 bp, Artificial
  CRISPR gRNA sequence
agagtagtaaaaagtgagta

SEQ ID NO: 626781 - DNA, 20 bp, Artificial
  CRISPR gRNA sequence
aaaaagtgagtagaaaacat

SEQ ID NO: 626782 - DNA, 20 bp, Artificial
  CRISPR gRNA sequence
gagccaaggggaatagaatg

SEQ ID NO: 626783 - DNA, 20 bp, Artificial
  CRISPR gRNA sequence
agaaatattacagaagaacc

SEQ ID NO: 626784 - DNA, 20 bp, Artificial
  CRISPR gRNA sequence
tttacactagatgatttcag

SEQ ID NO: 626785 - DNA, 20 bp, Artificial
  CRISPR gRNA sequence
gttgtctgttattctctgag

SEQ ID NO: 626786 - DNA, 20 bp, Artificial
  CRISPR gRNA sequence
tatgttgttctgtattcatt

SEQ ID NO: 626787 - DNA, 20 bp, Artificial
  CRISPR gRNA sequence
ccttatgaagagtcatgcat

SEQ ID NO: 626788 - DNA, 20 bp, Artificial
  CRISPR gRNA sequence
tctctgcccttacccgaaaa

SEQ ID NO: 626789 - DNA, 20 bp, Artificial
  CRISPR gRNA sequence
cgaaaagaaaacaaacaaaa

SEQ ID NO: 626790 - DNA, 20 bp, Artificial
  CRISPR gRNA sequence
agataaaatcttatgctgtt

SEQ ID NO: 626791 - DNA, 20 bp, Artificial
  CRISPR gRNA sequence
attttgctttctacaatgtg

SEQ ID NO: 626792 - DNA, 20 bp, Artificial
  CRISPR gRNA sequence
agacaccatctctctccaca

SEQ ID NO: 626793 - DNA, 20 bp, Artificial
  CRISPR gRNA sequence
cacaaaaaacattctccaag

SEQ ID NO: 626794 - DNA, 20 bp, Artificial
  CRISPR gRNA sequence
ggggaataccaaatcttccc

SEQ ID NO: 626795 - DNA, 20 bp, Artificial
  CRISPR gRNA sequence
tgggtaggtagagcagaggg

SEQ ID NO: 626796 - DNA, 20 bp, Artificial
  CRISPR gRNA sequence
gttgataaatactgtaagag

SEQ ID NO: 626797 - DNA, 20 bp, Artificial
  CRISPR gRNA sequence
atttcctagtctttcttttc

SEQ ID NO: 626798 - DNA, 20 bp, Artificial
  CRISPR gRNA sequence
aggcattttcactttactca

SEQ ID NO: 626799 - DNA, 20 bp, Artificial
  CRISPR gRNA sequence
gctattggaagatagaccag

SEQ ID NO: 626800 - DNA, 20 bp, Artificial
  CRISPR gRNA sequence
acaactaccaatgtagcatc

SEQ ID NO: 626801 - DNA, 20 bp, Artificial
  CRISPR gRNA sequence
gtctccatgaaataggcaaa

SEQ ID NO: 626802 - DNA, 20 bp, Artificial
  CRISPR gRNA sequence
ttgcacccagatccatgaag

SEQ ID NO: 626803 - DNA, 20 bp, Artificial
  CRISPR gRNA sequence
aattattaaatgcaaagcct

SEQ ID NO: 626804 - DNA, 20 bp, Artificial
  CRISPR gRNA sequence
attcagggtgaaacttagag

SEQ ID NO: 626805 - DNA, 20 bp, Artificial
  CRISPR gRNA sequence
tgacccatctataggttaat

SEQ ID NO: 626806 - DNA, 20 bp, Artificial
  CRISPR gRNA sequence
tttaaacatgtccaaatcat

SEQ ID NO: 626807 - DNA, 20 bp, Artificial
  CRISPR gRNA sequence
ttgggcagtatttctactca

SEQ ID NO: 626808 - DNA, 20 bp, Artificial
  CRISPR gRNA sequence
aggaaaatacatgggttaag

SEQ ID NO: 626809 - DNA, 20 bp, Artificial
  CRISPR gRNA sequence
tattgattttagtcaatgct

SEQ ID NO: 626810 - DNA, 20 bp, Artificial
  CRISPR gRNA sequence
gatttaagagagactcaaat

SEQ ID NO: 626811 - DNA, 20 bp, Artificial
  CRISPR gRNA sequence
gaagctcacggggaatatgg

SEQ ID NO: 626812 - DNA, 20 bp, Artificial
  CRISPR gRNA sequence
caaggtctgattgcaaaaat

SEQ ID NO: 626813 - DNA, 20 bp, Artificial
  CRISPR gRNA sequence
ttatattataaatctaactg

SEQ ID NO: 626814 - DNA, 20 bp, Artificial
  CRISPR gRNA sequence
aaaagactaaatattctgtt

SEQ ID NO: 626815 - DNA, 20 bp, Artificial
  CRISPR gRNA sequence
agcaatatctggctaaaaat

SEQ ID NO: 626816 - DNA, 20 bp, Artificial
  CRISPR gRNA sequence
acttttcccgttgcaagcac

SEQ ID NO: 626817 - DNA, 20 bp, Artificial
  CRISPR gRNA sequence
gttgaggtgtatatttaagg

SEQ ID NO: 626818 - DNA, 20 bp, Artificial
  CRISPR gRNA sequence
tgaatattaatttcaagaag

SEQ ID NO: 626819 - DNA, 20 bp, Artificial
  CRISPR gRNA sequence
gaccagcctggctaacaggg

SEQ ID NO: 626820 - DNA, 20 bp, Artificial
  CRISPR gRNA sequence
gggaaactgctgatagtcat

SEQ ID NO: 626821 - DNA, 20 bp, Artificial
  CRISPR gRNA sequence
ttttacactgtaccatatag

SEQ ID NO: 626822 - DNA, 20 bp, Artificial
  CRISPR gRNA sequence
ttatgctaacagtaggggga

SEQ ID NO: 626823 - DNA, 20 bp, Artificial
  CRISPR gRNA sequence
cctgcacatttttctgtttc

SEQ ID NO: 626824 - DNA, 20 bp, Artificial
  CRISPR gRNA sequence
ttaaatctaagggaatgcac

SEQ ID NO: 626825 - DNA, 20 bp, Artificial
  CRISPR gRNA sequence
ggagtgatcagatgtattgc

SEQ ID NO: 626826 - DNA, 20 bp, Artificial
  CRISPR gRNA sequence
accagtggcaactcttaaac

SEQ ID NO: 626827 - DNA, 20 bp, Artificial
  CRISPR gRNA sequence
tatctcagttgtacaactca

SEQ ID NO: 626828 - DNA, 20 bp, Artificial
  CRISPR gRNA sequence
gggctgtaaaaatacaagca

SEQ ID NO: 626829 - DNA, 20 bp, Artificial
  CRISPR gRNA sequence
ttaattctccttgaacaaag

SEQ ID NO: 626830 - DNA, 20 bp, Artificial
  CRISPR gRNA sequence
actttcaaatattgggtacc

SEQ ID NO: 626831 - DNA, 20 bp, Artificial
  CRISPR gRNA sequence
aatactccccttgaagtctt

SEQ ID NO: 626832 - DNA, 20 bp, Artificial
  CRISPR gRNA sequence
aggacacaacaagcaaagag

SEQ ID NO: 626833 - DNA, 20 bp, Artificial
  CRISPR gRNA sequence
ttatacctgtgtccctgtag

SEQ ID NO: 626834 - DNA, 20 bp, Artificial
  CRISPR gRNA sequence
aactaataatttggggaaat

SEQ ID NO: 626835 - DNA, 20 bp, Artificial
  CRISPR gRNA sequence
tgacataaaaagtttgctat

SEQ ID NO: 626836 - DNA, 20 bp, Artificial
  CRISPR gRNA sequence
aagcctggtatagtcaacaa

SEQ ID NO: 626837 - DNA, 20 bp, Artificial
  CRISPR gRNA sequence
agcctggtatagtcaacaat

SEQ ID NO: 626838 - DNA, 20 bp, Artificial
  CRISPR gRNA sequence
gtatagtcaacaatttagtc

SEQ ID NO: 626839 - DNA, 20 bp, Artificial
  CRISPR gRNA sequence
agtcttctgtatttggaaga

SEQ ID NO: 626840 - DNA, 20 bp, Artificial
  CRISPR gRNA sequence
gtcttctgtatttggaagac

SEQ ID NO: 626841 - DNA, 20 bp, Artificial
  CRISPR gRNA sequence
ctgtatttggaagacatgtt

SEQ ID NO: 626842 - DNA, 20 bp, Artificial
  CRISPR gRNA sequence
tgtatttggaagacatgttt

SEQ ID NO: 626843 - DNA, 20 bp, Artificial
  CRISPR gRNA sequence
tatttggaagacatgtttgt

SEQ ID NO: 626844 - DNA, 20 bp, Artificial
  CRISPR gRNA sequence
ggaagacatgtttgtgtaca

SEQ ID NO: 626845 - DNA, 20 bp, Artificial
  CRISPR gRNA sequence
gaagacatgtttgtgtacag

SEQ ID NO: 626846 - DNA, 20 bp, Artificial
  CRISPR gRNA sequence
gtgtacagaattttcaccag

SEQ ID NO: 626847 - DNA, 20 bp, Artificial
  CRISPR gRNA sequence
tgtacagaattttcaccaga

SEQ ID NO: 626848 - DNA, 20 bp, Artificial
  CRISPR gRNA sequence
tcaccagaaagtttttatag

SEQ ID NO: 626849 - DNA, 20 bp, Artificial
  CRISPR gRNA sequence
caccagaaagtttttatagc

SEQ ID NO: 626850 - DNA, 20 bp, Artificial
  CRISPR gRNA sequence
accagaaagtttttatagca

SEQ ID NO: 626851 - DNA, 20 bp, Artificial
  CRISPR gRNA sequence
ttatagcaaactttttatgt

SEQ ID NO: 626852 - DNA, 20 bp, Artificial
  CRISPR gRNA sequence
tatagcaaactttttatgtc

SEQ ID NO: 626853 - DNA, 20 bp, Artificial
  CRISPR gRNA sequence
atagcaaactttttatgtca

SEQ ID NO: 626854 - DNA, 20 bp, Artificial
  CRISPR gRNA sequence
tagcaaactttttatgtcag

SEQ ID NO: 626855 - DNA, 20 bp, Artificial
  CRISPR gRNA sequence
tttatgtcagaagtttattt

SEQ ID NO: 626856 - DNA, 20 bp, Artificial
  CRISPR gRNA sequence
ttatgtcagaagtttatttt

SEQ ID NO: 626857 - DNA, 20 bp, Artificial
  CRISPR gRNA sequence
tatgtcagaagtttatttta

SEQ ID NO: 626858 - DNA, 20 bp, Artificial
  CRISPR gRNA sequence
atgtcagaagtttattttat

SEQ ID NO: 626859 - DNA, 20 bp, Artificial
  CRISPR gRNA sequence
tgtcagaagtttattttatt

SEQ ID NO: 626860 - DNA, 20 bp, Artificial
  CRISPR gRNA sequence
attttattggtaaaatatta

SEQ ID NO: 626861 - DNA, 20 bp, Artificial
  CRISPR gRNA sequence
ttttattggtaaaatattaa

SEQ ID NO: 626862 - DNA, 20 bp, Artificial
  CRISPR gRNA sequence
tattggtaaaatattaaata

SEQ ID NO: 626863 - DNA, 20 bp, Artificial
  CRISPR gRNA sequence
attggtaaaatattaaataa

SEQ ID NO: 626864 - DNA, 20 bp, Artificial
  CRISPR gRNA sequence
ttggtaaaatattaaataat

SEQ ID NO: 626865 - DNA, 20 bp, Artificial
  CRISPR gRNA sequence
gtaaaatattaaataatata

SEQ ID NO: 626866 - DNA, 20 bp, Artificial
  CRISPR gRNA sequence
aataatatacagaattaaaa

SEQ ID NO: 626867 - DNA, 20 bp, Artificial
  CRISPR gRNA sequence
aaaactgcacttacacttct

SEQ ID NO: 626868 - DNA, 20 bp, Artificial
  CRISPR gRNA sequence
cacttacacttctgagaaga

SEQ ID NO: 626869 - DNA, 20 bp, Artificial
  CRISPR gRNA sequence
acacttctgagaagaaataa

SEQ ID NO: 626870 - DNA, 20 bp, Artificial
  CRISPR gRNA sequence
cacttctgagaagaaataaa

SEQ ID NO: 626871 - DNA, 20 bp, Artificial
  CRISPR gRNA sequence
ctgagaagaaataaatcttg

SEQ ID NO: 626872 - DNA, 20 bp, Artificial
  CRISPR gRNA sequence
tgagaagaaataaatcttgg

SEQ ID NO: 626873 - DNA, 20 bp, Artificial
  CRISPR gRNA sequence
agaagaaataaatcttggac

SEQ ID NO: 626874 - DNA, 20 bp, Artificial
  CRISPR gRNA sequence
ggacaaattatatgcttgtt

SEQ ID NO: 626875 - DNA, 20 bp, Artificial
  CRISPR gRNA sequence
gacaaattatatgcttgttc

SEQ ID NO: 626876 - DNA, 20 bp, Artificial
  CRISPR gRNA sequence
tatgcttgttcctgagattc

SEQ ID NO: 626877 - DNA, 20 bp, Artificial
  CRISPR gRNA sequence
gttcctgagattccctaaat

SEQ ID NO: 626878 - DNA, 20 bp, Artificial
  CRISPR gRNA sequence
ttcctgagattccctaaatt

SEQ ID NO: 626879 - DNA, 20 bp, Artificial
  CRISPR gRNA sequence
ctgagattccctaaatttat

SEQ ID NO: 626880 - DNA, 20 bp, Artificial
  CRISPR gRNA sequence
agattccctaaatttattcc

SEQ ID NO: 626881 - DNA, 20 bp, Artificial
  CRISPR gRNA sequence
cctaaatttattccagtagc

SEQ ID NO: 626882 - DNA, 20 bp, Artificial
  CRISPR gRNA sequence
aatttattccagtagctgtg

SEQ ID NO: 626883 - DNA, 20 bp, Artificial
  CRISPR gRNA sequence
attccagtagctgtgcactc

SEQ ID NO: 626884 - DNA, 20 bp, Artificial
  CRISPR gRNA sequence
ttccagtagctgtgcactca

SEQ ID NO: 626885 - DNA, 20 bp, Artificial
  CRISPR gRNA sequence
cagtagctgtgcactcagac

SEQ ID NO: 626886 - DNA, 20 bp, Artificial
  CRISPR gRNA sequence
tgcactcagacagtacaaac

SEQ ID NO: 626887 - DNA, 20 bp, Artificial
  CRISPR gRNA sequence
agacagtacaaacctttata

SEQ ID NO: 626888 - DNA, 20 bp, Artificial
  CRISPR gRNA sequence
tataatataatccttttcac

SEQ ID NO: 626889 - DNA, 20 bp, Artificial
  CRISPR gRNA sequence
ataatataatccttttcaca

SEQ ID NO: 626890 - DNA, 20 bp, Artificial
  CRISPR gRNA sequence
taatataatccttttcacaa

SEQ ID NO: 626891 - DNA, 20 bp, Artificial
  CRISPR gRNA sequence
ttcacaaagtattacaaagt

SEQ ID NO: 626892 - DNA, 20 bp, Artificial
  CRISPR gRNA sequence
tcacaaagtattacaaagtt

SEQ ID NO: 626893 - DNA, 20 bp, Artificial
  CRISPR gRNA sequence
cacaaagtattacaaagttt

SEQ ID NO: 626894 - DNA, 20 bp, Artificial
  CRISPR gRNA sequence
acaaagtattacaaagtttc

SEQ ID NO: 626895 - DNA, 20 bp, Artificial
  CRISPR gRNA sequence
caaagtttctgcagcttctt

SEQ ID NO: 626896 - DNA, 20 bp, Artificial
  CRISPR gRNA sequence
ctgcagcttctttagttgta

SEQ ID NO: 626897 - DNA, 20 bp, Artificial
  CRISPR gRNA sequence
tgcagcttctttagttgtac

SEQ ID NO: 626898 - DNA, 20 bp, Artificial
  CRISPR gRNA sequence
cagcttctttagttgtacac

SEQ ID NO: 626899 - DNA, 20 bp, Artificial
  CRISPR gRNA sequence
ctttagttgtacacacatac

SEQ ID NO: 626900 - DNA, 20 bp, Artificial
  CRISPR gRNA sequence
tttagttgtacacacataca

SEQ ID NO: 626901 - DNA, 20 bp, Artificial
  CRISPR gRNA sequence
tagttgtacacacatacaga

SEQ ID NO: 626902 - DNA, 20 bp, Artificial
  CRISPR gRNA sequence
agttgtacacacatacagac

SEQ ID NO: 626903 - DNA, 20 bp, Artificial
  CRISPR gRNA sequence
gttgtacacacatacagaca

SEQ ID NO: 626904 - DNA, 20 bp, Artificial
  CRISPR gRNA sequence
tacacacatacagacacaca

SEQ ID NO: 626905 - DNA, 20 bp, Artificial
  CRISPR gRNA sequence
acacatgcatatacaacact

SEQ ID NO: 626906 - DNA, 20 bp, Artificial
  CRISPR gRNA sequence
atacacatatacacagtaac

SEQ ID NO: 626907 - DNA, 20 bp, Artificial
  CRISPR gRNA sequence
aaaacaaagaagatacaagt

SEQ ID NO: 626908 - DNA, 20 bp, Artificial
  CRISPR gRNA sequence
tagtctgcagtgataaaact

SEQ ID NO: 626909 - DNA, 20 bp, Artificial
  CRISPR gRNA sequence
agtctgcagtgataaaacta

SEQ ID NO: 626910 - DNA, 20 bp, Artificial
  CRISPR gRNA sequence
gtctgcagtgataaaactat

SEQ ID NO: 626911 - DNA, 20 bp, Artificial
  CRISPR gRNA sequence
cagtgataaaactatttagc

SEQ ID NO: 626912 - DNA, 20 bp, Artificial
  CRISPR gRNA sequence
tttagcggaggtctccaaat

SEQ ID NO: 626913 - DNA, 20 bp, Artificial
  CRISPR gRNA sequence
agcggaggtctccaaatcag

SEQ ID NO: 626914 - DNA, 20 bp, Artificial
  CRISPR gRNA sequence
gcggaggtctccaaatcagt

SEQ ID NO: 626915 - DNA, 20 bp, Artificial
  CRISPR gRNA sequence
caaatcagtatgtagtagag

SEQ ID NO: 626916 - DNA, 20 bp, Artificial
  CRISPR gRNA sequence
gtcacacagctgcaaagact

SEQ ID NO: 626917 - DNA, 20 bp, Artificial
  CRISPR gRNA sequence
tcacacagctgcaaagactg

SEQ ID NO: 626918 - DNA, 20 bp, Artificial
  CRISPR gRNA sequence
caaagactgtttcagtattt

SEQ ID NO: 626919 - DNA, 20 bp, Artificial
  CRISPR gRNA sequence
tttcagtatttccatagtaa

SEQ ID NO: 626920 - DNA, 20 bp, Artificial
  CRISPR gRNA sequence
cagtatttccatagtaaacc

SEQ ID NO: 626921 - DNA, 20 bp, Artificial
  CRISPR gRNA sequence
agtatttccatagtaaacct

SEQ ID NO: 626922 - DNA, 20 bp, Artificial
  CRISPR gRNA sequence
ccatagtaaacctcattttc

SEQ ID NO: 626923 - DNA, 20 bp, Artificial
  CRISPR gRNA sequence
catagtaaacctcattttct

SEQ ID NO: 626924 - DNA, 20 bp, Artificial
  CRISPR gRNA sequence
attttctgaggtatggtatt

SEQ ID NO: 626925 - DNA, 20 bp, Artificial
  CRISPR gRNA sequence
tctgaggtatggtatttgag

SEQ ID NO: 626926 - DNA, 20 bp, Artificial
  CRISPR gRNA sequence
ctgaggtatggtatttgagc

SEQ ID NO: 626927 - DNA, 20 bp, Artificial
  CRISPR gRNA sequence
tgaggtatggtatttgagcc

SEQ ID NO: 626928 - DNA, 20 bp, Artificial
  CRISPR gRNA sequence
aggtatggtatttgagcctt

SEQ ID NO: 626929 - DNA, 20 bp, Artificial
  CRISPR gRNA sequence
gagccttaaaaaaactacat

SEQ ID NO: 626930 - DNA, 20 bp, Artificial
  CRISPR gRNA sequence
agccttaaaaaaactacatt

SEQ ID NO: 626931 - DNA, 20 bp, Artificial
  CRISPR gRNA sequence
aaaaaaactacattacactt

SEQ ID NO: 626932 - DNA, 20 bp, Artificial
  CRISPR gRNA sequence
aaaaaactacattacactta

SEQ ID NO: 626933 - DNA, 20 bp, Artificial
  CRISPR gRNA sequence
cattacacttagcaaacctg

SEQ ID NO: 626934 - DNA, 20 bp, Artificial
  CRISPR gRNA sequence
cacttagcaaacctgacata

SEQ ID NO: 626935 - DNA, 20 bp, Artificial
  CRISPR gRNA sequence
agcaaacctgacatacaagg

SEQ ID NO: 626936 - DNA, 20 bp, Artificial
  CRISPR gRNA sequence
gcaaacctgacatacaaggt

SEQ ID NO: 626937 - DNA, 20 bp, Artificial
  CRISPR gRNA sequence
acatacaaggtatggaattt

SEQ ID NO: 626938 - DNA, 20 bp, Artificial
  CRISPR gRNA sequence
taactttacatatatattta

SEQ ID NO: 626939 - DNA, 20 bp, Artificial
  CRISPR gRNA sequence
aactttacatatatatttat

SEQ ID NO: 626940 - DNA, 20 bp, Artificial
  CRISPR gRNA sequence
actttacatatatatttata

SEQ ID NO: 626941 - DNA, 20 bp, Artificial
  CRISPR gRNA sequence
tacatatatatttatatata

SEQ ID NO: 626942 - DNA, 20 bp, Artificial
  CRISPR gRNA sequence
acatatatatttatatatat

SEQ ID NO: 626943 - DNA, 20 bp, Artificial
  CRISPR gRNA sequence
catatatatttatatatata

SEQ ID NO: 626944 - DNA, 20 bp, Artificial
  CRISPR gRNA sequence
atatatatatatatatattt

SEQ ID NO: 626945 - DNA, 20 bp, Artificial
  CRISPR gRNA sequence
tatatatatatatatatttc

SEQ ID NO: 626946 - DNA, 20 bp, Artificial
  CRISPR gRNA sequence
cttttttaaacaatagtttt

SEQ ID NO: 626947 - DNA, 20 bp, Artificial
  CRISPR gRNA sequence
ttttttaaacaatagttttt

SEQ ID NO: 626948 - DNA, 20 bp, Artificial
  CRISPR gRNA sequence
ttttaaacaatagtttttat

SEQ ID NO: 626949 - DNA, 20 bp, Artificial
  CRISPR gRNA sequence
tttaaacaatagtttttatt

SEQ ID NO: 626950 - DNA, 20 bp, Artificial
  CRISPR gRNA sequence
ttaaacaatagtttttattt

SEQ ID NO: 626951 - DNA, 20 bp, Artificial
  CRISPR gRNA sequence
taaacaatagtttttatttc

SEQ ID NO: 626952 - DNA, 20 bp, Artificial
  CRISPR gRNA sequence
aaacaatagtttttatttcc

SEQ ID NO: 626953 - DNA, 20 bp, Artificial
  CRISPR gRNA sequence
aacaatagtttttatttccc

SEQ ID NO: 626954 - DNA, 20 bp, Artificial
  CRISPR gRNA sequence
ttatttccccaaattattag

SEQ ID NO: 626955 - DNA, 20 bp, Artificial
  CRISPR gRNA sequence
tatttccccaaattattagt

SEQ ID NO: 626956 - DNA, 20 bp, Artificial
  CRISPR gRNA sequence
atttccccaaattattagtt

SEQ ID NO: 626957 - DNA, 20 bp, Artificial
  CRISPR gRNA sequence
tttccccaaattattagttt

SEQ ID NO: 626958 - DNA, 20 bp, Artificial
  CRISPR gRNA sequence
ccccaaattattagtttgaa

SEQ ID NO: 626959 - DNA, 20 bp, Artificial
  CRISPR gRNA sequence
cccaaattattagtttgaaa

SEQ ID NO: 626960 - DNA, 20 bp, Artificial
  CRISPR gRNA sequence
ttagtttgaaaaaaaatgag

SEQ ID NO: 626961 - DNA, 20 bp, Artificial
  CRISPR gRNA sequence
gtttgaaaaaaaatgaggtt

SEQ ID NO: 626962 - DNA, 20 bp, Artificial
  CRISPR gRNA sequence
gaaaaaaaatgaggtttact

SEQ ID NO: 626963 - DNA, 20 bp, Artificial
  CRISPR gRNA sequence
aaaaaaaatgaggtttactg

SEQ ID NO: 626964 - DNA, 20 bp, Artificial
  CRISPR gRNA sequence
actggtttgacctatttttt

SEQ ID NO: 626965 - DNA, 20 bp, Artificial
  CRISPR gRNA sequence
ctggtttgacctattttttt

SEQ ID NO: 626966 - DNA, 20 bp, Artificial
  CRISPR gRNA sequence
gtttgacctatttttttttc

SEQ ID NO: 626967 - DNA, 20 bp, Artificial
  CRISPR gRNA sequence
gacctatttttttttctttt

SEQ ID NO: 626968 - DNA, 20 bp, Artificial
  CRISPR gRNA sequence
acctatttttttttcttttt

SEQ ID NO: 626969 - DNA, 20 bp, Artificial
  CRISPR gRNA sequence
tttttttttctttttttgct

SEQ ID NO: 626970 - DNA, 20 bp, Artificial
  CRISPR gRNA sequence
ttttttctttttttgcttct

SEQ ID NO: 626971 - DNA, 20 bp, Artificial
  CRISPR gRNA sequence
tttttctttttttgcttcta

SEQ ID NO: 626972 - DNA, 20 bp, Artificial
  CRISPR gRNA sequence
ttttctttttttgcttctaa

SEQ ID NO: 626973 - DNA, 20 bp, Artificial
  CRISPR gRNA sequence
tttctttttttgcttctaaa

SEQ ID NO: 626974 - DNA, 20 bp, Artificial
  CRISPR gRNA sequence
ttctttttttgcttctaaaa

SEQ ID NO: 626975 - DNA, 20 bp, Artificial
  CRISPR gRNA sequence
tctttttttgcttctaaaac

SEQ ID NO: 626976 - DNA, 20 bp, Artificial
  CRISPR gRNA sequence
ctttttttgcttctaaaaca

SEQ ID NO: 626977 - DNA, 20 bp, Artificial
  CRISPR gRNA sequence
tttttttgcttctaaaacac

SEQ ID NO: 626978 - DNA, 20 bp, Artificial
  CRISPR gRNA sequence
tttttgcttctaaaacacaa

SEQ ID NO: 626979 - DNA, 20 bp, Artificial
  CRISPR gRNA sequence
ttttgcttctaaaacacaaa

SEQ ID NO: 626980 - DNA, 20 bp, Artificial
  CRISPR gRNA sequence
tttgcttctaaaacacaaaa

SEQ ID NO: 626981 - DNA, 20 bp, Artificial
  CRISPR gRNA sequence
ttgcttctaaaacacaaaat

SEQ ID NO: 626982 - DNA, 20 bp, Artificial
  CRISPR gRNA sequence
tgcttctaaaacacaaaata

SEQ ID NO: 626983 - DNA, 20 bp, Artificial
  CRISPR gRNA sequence
gcttctaaaacacaaaatac

SEQ ID NO: 626984 - DNA, 20 bp, Artificial
  CRISPR gRNA sequence
cttctaaaacacaaaatacc

SEQ ID NO: 626985 - DNA, 20 bp, Artificial
  CRISPR gRNA sequence
ctaaaacacaaaatacccta

SEQ ID NO: 626986 - DNA, 20 bp, Artificial
  CRISPR gRNA sequence
taaaacacaaaataccctag

SEQ ID NO: 626987 - DNA, 20 bp, Artificial
  CRISPR gRNA sequence
aaacacaaaataccctagaa

SEQ ID NO: 626988 - DNA, 20 bp, Artificial
  CRISPR gRNA sequence
gaaactgtcaagcaattagt

SEQ ID NO: 626989 - DNA, 20 bp, Artificial
  CRISPR gRNA sequence
tcaagcaattagtctttaaa

SEQ ID NO: 626990 - DNA, 20 bp, Artificial
  CRISPR gRNA sequence
gtctttaaaatagtctaatt

SEQ ID NO: 626991 - DNA, 20 bp, Artificial
  CRISPR gRNA sequence
taaaatagtctaattacctt

SEQ ID NO: 626992 - DNA, 20 bp, Artificial
  CRISPR gRNA sequence
aaaatagtctaattaccttt

SEQ ID NO: 626993 - DNA, 20 bp, Artificial
  CRISPR gRNA sequence
aaatagtctaattacctttg

SEQ ID NO: 626994 - DNA, 20 bp, Artificial
  CRISPR gRNA sequence
attacctttggtattgttaa

SEQ ID NO: 626995 - DNA, 20 bp, Artificial
  CRISPR gRNA sequence
cctttggtattgttaaagaa

SEQ ID NO: 626996 - DNA, 20 bp, Artificial
  CRISPR gRNA sequence
tggtattgttaaagaaagaa

SEQ ID NO: 626997 - DNA, 20 bp, Artificial
  CRISPR gRNA sequence
ggtattgttaaagaaagaat

SEQ ID NO: 626998 - DNA, 20 bp, Artificial
  CRISPR gRNA sequence
gtattgttaaagaaagaata

SEQ ID NO: 626999 - DNA, 20 bp, Artificial
  CRISPR gRNA sequence
ttaaagaaagaatatctaaa

SEQ ID NO: 627000 - DNA, 20 bp, Artificial
  CRISPR gRNA sequence
aagaaagaatatctaaaatg

SEQ ID NO: 627001 - DNA, 20 bp, Artificial
  CRISPR gRNA sequence
aaatggccaagacacatact

SEQ ID NO: 627002 - DNA, 20 bp, Artificial
  CRISPR gRNA sequence
tacaaatgcagaaatgcagt

SEQ ID NO: 627003 - DNA, 20 bp, Artificial
  CRISPR gRNA sequence
cctttaaaagaaatgccaaa

SEQ ID NO: 627004 - DNA, 20 bp, Artificial
  CRISPR gRNA sequence
taaaagaaatgccaaagaaa

SEQ ID NO: 627005 - DNA, 20 bp, Artificial
  CRISPR gRNA sequence
aaaagaaatgccaaagaaat

SEQ ID NO: 627006 - DNA, 20 bp, Artificial
  CRISPR gRNA sequence
aaagaaatgccaaagaaatg

SEQ ID NO: 627007 - DNA, 20 bp, Artificial
  CRISPR gRNA sequence
tcttttaacaaaacatgtat

SEQ ID NO: 627008 - DNA, 20 bp, Artificial
  CRISPR gRNA sequence
ttaacaaaacatgtatttat

SEQ ID NO: 627009 - DNA, 20 bp, Artificial
  CRISPR gRNA sequence
taacaaaacatgtatttata

SEQ ID NO: 627010 - DNA, 20 bp, Artificial
  CRISPR gRNA sequence
aacaaaacatgtatttatat

SEQ ID NO: 627011 - DNA, 20 bp, Artificial
  CRISPR gRNA sequence
acaaaacatgtatttatatt

SEQ ID NO: 627012 - DNA, 20 bp, Artificial
  CRISPR gRNA sequence
atattacagcagttttacta

SEQ ID NO: 627013 - DNA, 20 bp, Artificial
  CRISPR gRNA sequence
tattacagcagttttactac

SEQ ID NO: 627014 - DNA, 20 bp, Artificial
  CRISPR gRNA sequence
cagcagttttactacaggga

SEQ ID NO: 627015 - DNA, 20 bp, Artificial
  CRISPR gRNA sequence
tactacagggacacaggtat

SEQ ID NO: 627016 - DNA, 20 bp, Artificial
  CRISPR gRNA sequence
actacagggacacaggtata

SEQ ID NO: 627017 - DNA, 20 bp, Artificial
  CRISPR gRNA sequence
ctacagggacacaggtataa

SEQ ID NO: 627018 - DNA, 20 bp, Artificial
  CRISPR gRNA sequence
cagggacacaggtataaaaa

SEQ ID NO: 627019 - DNA, 20 bp, Artificial
  CRISPR gRNA sequence
gcacactacatataaatatg

SEQ ID NO: 627020 - DNA, 20 bp, Artificial
  CRISPR gRNA sequence
catataaatatgtataagaa

SEQ ID NO: 627021 - DNA, 20 bp, Artificial
  CRISPR gRNA sequence
ttacttaaatttgtatgaaa

SEQ ID NO: 627022 - DNA, 20 bp, Artificial
  CRISPR gRNA sequence
acttaaatttgtatgaaaac

SEQ ID NO: 627023 - DNA, 20 bp, Artificial
  CRISPR gRNA sequence
cttaaatttgtatgaaaaca

SEQ ID NO: 627024 - DNA, 20 bp, Artificial
  CRISPR gRNA sequence
aaatttgtatgaaaacagga

SEQ ID NO: 627025 - DNA, 20 bp, Artificial
  CRISPR gRNA sequence
aatttgtatgaaaacaggac

SEQ ID NO: 627026 - DNA, 20 bp, Artificial
  CRISPR gRNA sequence
gtatgaaaacaggactgctc

SEQ ID NO: 627027 - DNA, 20 bp, Artificial
  CRISPR gRNA sequence
tatgaaaacaggactgctcc

SEQ ID NO: 627028 - DNA, 20 bp, Artificial
  CRISPR gRNA sequence
ctccaaatatttttaaaaaa

SEQ ID NO: 627029 - DNA, 20 bp, Artificial
  CRISPR gRNA sequence
caaatatttttaaaaaaaat

SEQ ID NO: 627030 - DNA, 20 bp, Artificial
  CRISPR gRNA sequence
ttaaaaaaaatttctccaat

SEQ ID NO: 627031 - DNA, 20 bp, Artificial
  CRISPR gRNA sequence
taaaaaaaatttctccaata

SEQ ID NO: 627032 - DNA, 20 bp, Artificial
  CRISPR gRNA sequence
aaaaaaaatttctccaatag

SEQ ID NO: 627033 - DNA, 20 bp, Artificial
  CRISPR gRNA sequence
aaaaaaatttctccaatagg

SEQ ID NO: 627034 - DNA, 20 bp, Artificial
  CRISPR gRNA sequence
ctccaataggtgatatgtaa

SEQ ID NO: 627035 - DNA, 20 bp, Artificial
  CRISPR gRNA sequence
tccaataggtgatatgtaag

SEQ ID NO: 627036 - DNA, 20 bp, Artificial
  CRISPR gRNA sequence
caataggtgatatgtaagtg

SEQ ID NO: 627037 - DNA, 20 bp, Artificial
  CRISPR gRNA sequence
aaaactcagctaagtgcttt

SEQ ID NO: 627038 - DNA, 20 bp, Artificial
  CRISPR gRNA sequence
aaactcagctaagtgctttg

SEQ ID NO: 627039 - DNA, 20 bp, Artificial
  CRISPR gRNA sequence
agctaagtgctttgctttta

SEQ ID NO: 627040 - DNA, 20 bp, Artificial
  CRISPR gRNA sequence
agtgctttgcttttatttaa

SEQ ID NO: 627041 - DNA, 20 bp, Artificial
  CRISPR gRNA sequence
tgcttttatttaaaagttta

SEQ ID NO: 627042 - DNA, 20 bp, Artificial
  CRISPR gRNA sequence
gcttttatttaaaagtttat

SEQ ID NO: 627043 - DNA, 20 bp, Artificial
  CRISPR gRNA sequence
cttttatttaaaagtttatt

SEQ ID NO: 627044 - DNA, 20 bp, Artificial
  CRISPR gRNA sequence
ttatttaaaagtttatttct

SEQ ID NO: 627045 - DNA, 20 bp, Artificial
  CRISPR gRNA sequence
tatttaaaagtttatttcta

SEQ ID NO: 627046 - DNA, 20 bp, Artificial
  CRISPR gRNA sequence
atttaaaagtttatttctaa

SEQ ID NO: 627047 - DNA, 20 bp, Artificial
  CRISPR gRNA sequence
tttaaaagtttatttctaaa

SEQ ID NO: 627048 - DNA, 20 bp, Artificial
  CRISPR gRNA sequence
aaaagtttatttctaaaagg

SEQ ID NO: 627049 - DNA, 20 bp, Artificial
  CRISPR gRNA sequence
aaagtttatttctaaaaggg

SEQ ID NO: 627050 - DNA, 20 bp, Artificial
  CRISPR gRNA sequence
atttctaaaaggggagaagt

SEQ ID NO: 627051 - DNA, 20 bp, Artificial
  CRISPR gRNA sequence
tttctaaaaggggagaagta

SEQ ID NO: 627052 - DNA, 20 bp, Artificial
  CRISPR gRNA sequence
ctaaaaggggagaagtaaaa

SEQ ID NO: 627053 - DNA, 20 bp, Artificial
  CRISPR gRNA sequence
taaaaggggagaagtaaaat

SEQ ID NO: 627054 - DNA, 20 bp, Artificial
  CRISPR gRNA sequence
aaaggggagaagtaaaataa

SEQ ID NO: 627055 - DNA, 20 bp, Artificial
  CRISPR gRNA sequence
agtattaggttcttaattta

SEQ ID NO: 627056 - DNA, 20 bp, Artificial
  CRISPR gRNA sequence
ggttcttaatttagagcatt

SEQ ID NO: 627057 - DNA, 20 bp, Artificial
  CRISPR gRNA sequence
ttaatttagagcattgggcg

SEQ ID NO: 627058 - DNA, 20 bp, Artificial
  CRISPR gRNA sequence
aatttagagcattgggcgag

SEQ ID NO: 627059 - DNA, 20 bp, Artificial
  CRISPR gRNA sequence
atttagagcattgggcgagg

SEQ ID NO: 627060 - DNA, 20 bp, Artificial
  CRISPR gRNA sequence
agagcattgggcgagggtct

SEQ ID NO: 627061 - DNA, 20 bp, Artificial
  CRISPR gRNA sequence
gagcattgggcgagggtcta

SEQ ID NO: 627062 - DNA, 20 bp, Artificial
  CRISPR gRNA sequence
ggcgagggtctaagaagatt

SEQ ID NO: 627063 - DNA, 20 bp, Artificial
  CRISPR gRNA sequence
agaagattcaatctgtaaaa

SEQ ID NO: 627064 - DNA, 20 bp, Artificial
  CRISPR gRNA sequence
aatctgtaaaaagttcaact

SEQ ID NO: 627065 - DNA, 20 bp, Artificial
  CRISPR gRNA sequence
taaaaagttcaactttagga

SEQ ID NO: 627066 - DNA, 20 bp, Artificial
  CRISPR gRNA sequence
aactttaggacacatttttc

SEQ ID NO: 627067 - DNA, 20 bp, Artificial
  CRISPR gRNA sequence
taggacacatttttcaagca

SEQ ID NO: 627068 - DNA, 20 bp, Artificial
  CRISPR gRNA sequence
aggacacatttttcaagcaa

SEQ ID NO: 627069 - DNA, 20 bp, Artificial
  CRISPR gRNA sequence
ggacacatttttcaagcaaa

SEQ ID NO: 627070 - DNA, 20 bp, Artificial
  CRISPR gRNA sequence
ttcaagcaaaagattactaa

SEQ ID NO: 627071 - DNA, 20 bp, Artificial
  CRISPR gRNA sequence
tcaagcaaaagattactaat

SEQ ID NO: 627072 - DNA, 20 bp, Artificial
  CRISPR gRNA sequence
caagcaaaagattactaatt

SEQ ID NO: 627073 - DNA, 20 bp, Artificial
  CRISPR gRNA sequence
aagcaaaagattactaattt

SEQ ID NO: 627074 - DNA, 20 bp, Artificial
  CRISPR gRNA sequence
ctaatttccatggaaattta

SEQ ID NO: 627075 - DNA, 20 bp, Artificial
  CRISPR gRNA sequence
atttccatggaaatttagct

SEQ ID NO: 627076 - DNA, 20 bp, Artificial
  CRISPR gRNA sequence
ccatggaaatttagcttaaa

SEQ ID NO: 627077 - DNA, 20 bp, Artificial
  CRISPR gRNA sequence
catggaaatttagcttaaat

SEQ ID NO: 627078 - DNA, 20 bp, Artificial
  CRISPR gRNA sequence
agcttaaataaagataccat

SEQ ID NO: 627079 - DNA, 20 bp, Artificial
  CRISPR gRNA sequence
gcttaaataaagataccatg

SEQ ID NO: 627080 - DNA, 20 bp, Artificial
  CRISPR gRNA sequence
aaataaagataccatgagat

SEQ ID NO: 627081 - DNA, 20 bp, Artificial
  CRISPR gRNA sequence
aataaagataccatgagatc

SEQ ID NO: 627082 - DNA, 20 bp, Artificial
  CRISPR gRNA sequence
gtggtttccacattctgtaa

SEQ ID NO: 627083 - DNA, 20 bp, Artificial
  CRISPR gRNA sequence
ccacattctgtaatcttttg

SEQ ID NO: 627084 - DNA, 20 bp, Artificial
  CRISPR gRNA sequence
cacattctgtaatcttttga

SEQ ID NO: 627085 - DNA, 20 bp, Artificial
  CRISPR gRNA sequence
tgtaatcttttgattgtgga

SEQ ID NO: 627086 - DNA, 20 bp, Artificial
  CRISPR gRNA sequence
taatcttttgattgtggagt

SEQ ID NO: 627087 - DNA, 20 bp, Artificial
  CRISPR gRNA sequence
ttgattgtggagtgtttttc

SEQ ID NO: 627088 - DNA, 20 bp, Artificial
  CRISPR gRNA sequence
tgattgtggagtgtttttct

SEQ ID NO: 627089 - DNA, 20 bp, Artificial
  CRISPR gRNA sequence
gattgtggagtgtttttctc

SEQ ID NO: 627090 - DNA, 20 bp, Artificial
  CRISPR gRNA sequence
attgtggagtgtttttctct

SEQ ID NO: 627091 - DNA, 20 bp, Artificial
  CRISPR gRNA sequence
tggagtgtttttctctttgc

SEQ ID NO: 627092 - DNA, 20 bp, Artificial
  CRISPR gRNA sequence
ttctctttgcttgttgtgtc

SEQ ID NO: 627093 - DNA, 20 bp, Artificial
  CRISPR gRNA sequence
tctctttgcttgttgtgtcc

SEQ ID NO: 627094 - DNA, 20 bp, Artificial
  CRISPR gRNA sequence
ctctttgcttgttgtgtcct

SEQ ID NO: 627095 - DNA, 20 bp, Artificial
  CRISPR gRNA sequence
tctttgcttgttgtgtcctt

SEQ ID NO: 627096 - DNA, 20 bp, Artificial
  CRISPR gRNA sequence
tttgcttgttgtgtccttta

SEQ ID NO: 627097 - DNA, 20 bp, Artificial
  CRISPR gRNA sequence
tgcttgttgtgtcctttaac

SEQ ID NO: 627098 - DNA, 20 bp, Artificial
  CRISPR gRNA sequence
gcttgttgtgtcctttaaca

SEQ ID NO: 627099 - DNA, 20 bp, Artificial
  CRISPR gRNA sequence
cttgttgtgtcctttaacat

SEQ ID NO: 627100 - DNA, 20 bp, Artificial
  CRISPR gRNA sequence
gttgtgtcctttaacatact

SEQ ID NO: 627101 - DNA, 20 bp, Artificial
  CRISPR gRNA sequence
ttgtgtcctttaacatacta

SEQ ID NO: 627102 - DNA, 20 bp, Artificial
  CRISPR gRNA sequence
tgtcctttaacatactatga

SEQ ID NO: 627103 - DNA, 20 bp, Artificial
  CRISPR gRNA sequence
taacatactatgacttttat

SEQ ID NO: 627104 - DNA, 20 bp, Artificial
  CRISPR gRNA sequence
aacatactatgacttttatg

SEQ ID NO: 627105 - DNA, 20 bp, Artificial
  CRISPR gRNA sequence
acatactatgacttttatga

SEQ ID NO: 627106 - DNA, 20 bp, Artificial
  CRISPR gRNA sequence
tgacttttatgagtttcttt

SEQ ID NO: 627107 - DNA, 20 bp, Artificial
  CRISPR gRNA sequence
ttatgagtttctttttgtca

SEQ ID NO: 627108 - DNA, 20 bp, Artificial
  CRISPR gRNA sequence
tatgagtttctttttgtcat

SEQ ID NO: 627109 - DNA, 20 bp, Artificial
  CRISPR gRNA sequence
atgagtttctttttgtcatt

SEQ ID NO: 627110 - DNA, 20 bp, Artificial
  CRISPR gRNA sequence
tgagtttctttttgtcatta

SEQ ID NO: 627111 - DNA, 20 bp, Artificial
  CRISPR gRNA sequence
ctttttgtcattagctaaag

SEQ ID NO: 627112 - DNA, 20 bp, Artificial
  CRISPR gRNA sequence
tttttgtcattagctaaagg

SEQ ID NO: 627113 - DNA, 20 bp, Artificial
  CRISPR gRNA sequence
tttgtcattagctaaaggaa

SEQ ID NO: 627114 - DNA, 20 bp, Artificial
  CRISPR gRNA sequence
ttgtcattagctaaaggaag

SEQ ID NO: 627115 - DNA, 20 bp, Artificial
  CRISPR gRNA sequence
tgtcattagctaaaggaaga

SEQ ID NO: 627116 - DNA, 20 bp, Artificial
  CRISPR gRNA sequence
gtcattagctaaaggaagaa

SEQ ID NO: 627117 - DNA, 20 bp, Artificial
  CRISPR gRNA sequence
tcattagctaaaggaagaat

SEQ ID NO: 627118 - DNA, 20 bp, Artificial
  CRISPR gRNA sequence
gctaaaggaagaataggtca

SEQ ID NO: 627119 - DNA, 20 bp, Artificial
  CRISPR gRNA sequence
aaggaagaataggtcagaaa

SEQ ID NO: 627120 - DNA, 20 bp, Artificial
  CRISPR gRNA sequence
ttaagacttcaaggggagta

SEQ ID NO: 627121 - DNA, 20 bp, Artificial
  CRISPR gRNA sequence
taagacttcaaggggagtat

SEQ ID NO: 627122 - DNA, 20 bp, Artificial
  CRISPR gRNA sequence
aagacttcaaggggagtatt

SEQ ID NO: 627123 - DNA, 20 bp, Artificial
  CRISPR gRNA sequence
agacttcaaggggagtattg

SEQ ID NO: 627124 - DNA, 20 bp, Artificial
  CRISPR gRNA sequence
caaggggagtattgcacttg

SEQ ID NO: 627125 - DNA, 20 bp, Artificial
  CRISPR gRNA sequence
aaggggagtattgcacttgt

SEQ ID NO: 627126 - DNA, 20 bp, Artificial
  CRISPR gRNA sequence
cacttgtacagaaagaaaag

SEQ ID NO: 627127 - DNA, 20 bp, Artificial
  CRISPR gRNA sequence
gtacagaaagaaaagaatag

SEQ ID NO: 627128 - DNA, 20 bp, Artificial
  CRISPR gRNA sequence
tacagaaagaaaagaatagt

SEQ ID NO: 627129 - DNA, 20 bp, Artificial
  CRISPR gRNA sequence
tttaactaatagcagaagca

SEQ ID NO: 627130 - DNA, 20 bp, Artificial
  CRISPR gRNA sequence
ttaactaatagcagaagcaa

SEQ ID NO: 627131 - DNA, 20 bp, Artificial
  CRISPR gRNA sequence
taactaatagcagaagcaat

SEQ ID NO: 627132 - DNA, 20 bp, Artificial
  CRISPR gRNA sequence
aactaatagcagaagcaatc

SEQ ID NO: 627133 - DNA, 20 bp, Artificial
  CRISPR gRNA sequence
actaatagcagaagcaatca

SEQ ID NO: 627134 - DNA, 20 bp, Artificial
  CRISPR gRNA sequence
atagcagaagcaatcattct

SEQ ID NO: 627135 - DNA, 20 bp, Artificial
  CRISPR gRNA sequence
tgggattgcaaataacacat

SEQ ID NO: 627136 - DNA, 20 bp, Artificial
  CRISPR gRNA sequence
ggattgcaaataacacatgg

SEQ ID NO: 627137 - DNA, 20 bp, Artificial
  CRISPR gRNA sequence
caaataacacatggtctaaa

SEQ ID NO: 627138 - DNA, 20 bp, Artificial
  CRISPR gRNA sequence
aaaggtccaactattaacag

SEQ ID NO: 627139 - DNA, 20 bp, Artificial
  CRISPR gRNA sequence
ttaacagcaaatatggggcc

SEQ ID NO: 627140 - DNA, 20 bp, Artificial
  CRISPR gRNA sequence
acagcaaatatggggcctgg

SEQ ID NO: 627141 - DNA, 20 bp, Artificial
  CRISPR gRNA sequence
gagaccccctccaaacctgg

SEQ ID NO: 627142 - DNA, 20 bp, Artificial
  CRISPR gRNA sequence
caaacctggaatattattat

SEQ ID NO: 627143 - DNA, 20 bp, Artificial
  CRISPR gRNA sequence
gaatattattatagtaatgt

SEQ ID NO: 627144 - DNA, 20 bp, Artificial
  CRISPR gRNA sequence
ttatagtaatgttaaagcat

SEQ ID NO: 627145 - DNA, 20 bp, Artificial
  CRISPR gRNA sequence
tagtaatgttaaagcatttt

SEQ ID NO: 627146 - DNA, 20 bp, Artificial
  CRISPR gRNA sequence
aagcatttttctcccaatta

SEQ ID NO: 627147 - DNA, 20 bp, Artificial
  CRISPR gRNA sequence
ttctcccaattaggagaaag

SEQ ID NO: 627148 - DNA, 20 bp, Artificial
  CRISPR gRNA sequence
tctcccaattaggagaaagt

SEQ ID NO: 627149 - DNA, 20 bp, Artificial
  CRISPR gRNA sequence
ctcccaattaggagaaagtt

SEQ ID NO: 627150 - DNA, 20 bp, Artificial
  CRISPR gRNA sequence
tcccaattaggagaaagtta

SEQ ID NO: 627151 - DNA, 20 bp, Artificial
  CRISPR gRNA sequence
ccaattaggagaaagttaag

SEQ ID NO: 627152 - DNA, 20 bp, Artificial
  CRISPR gRNA sequence
ggagaaagttaagactcttt

SEQ ID NO: 627153 - DNA, 20 bp, Artificial
  CRISPR gRNA sequence
agactctttgctttacattt

SEQ ID NO: 627154 - DNA, 20 bp, Artificial
  CRISPR gRNA sequence
tttgctttacatttttaaca

SEQ ID NO: 627155 - DNA, 20 bp, Artificial
  CRISPR gRNA sequence
tgctttacatttttaacacc

SEQ ID NO: 627156 - DNA, 20 bp, Artificial
  CRISPR gRNA sequence
gctttacatttttaacacct

SEQ ID NO: 627157 - DNA, 20 bp, Artificial
  CRISPR gRNA sequence
ctttacatttttaacacctt

SEQ ID NO: 627158 - DNA, 20 bp, Artificial
  CRISPR gRNA sequence
tacatttttaacacctttct

SEQ ID NO: 627159 - DNA, 20 bp, Artificial
  CRISPR gRNA sequence
acatttttaacacctttcta

SEQ ID NO: 627160 - DNA, 20 bp, Artificial
  CRISPR gRNA sequence
catttttaacacctttctaa

SEQ ID NO: 627161 - DNA, 20 bp, Artificial
  CRISPR gRNA sequence
ttaacacctttctaaacact

SEQ ID NO: 627162 - DNA, 20 bp, Artificial
  CRISPR gRNA sequence
taacacctttctaaacactt

SEQ ID NO: 627163 - DNA, 20 bp, Artificial
  CRISPR gRNA sequence
aacacctttctaaacacttg

SEQ ID NO: 627164 - DNA, 20 bp, Artificial
  CRISPR gRNA sequence
acacctttctaaacacttgc

SEQ ID NO: 627165 - DNA, 20 bp, Artificial
  CRISPR gRNA sequence
tctaaacacttgcaaataac

SEQ ID NO: 627166 - DNA, 20 bp, Artificial
  CRISPR gRNA sequence
ctaaacacttgcaaataact

SEQ ID NO: 627167 - DNA, 20 bp, Artificial
  CRISPR gRNA sequence
taaacacttgcaaataactg

SEQ ID NO: 627168 - DNA, 20 bp, Artificial
  CRISPR gRNA sequence
aacacttgcaaataactgtc

SEQ ID NO: 627169 - DNA, 20 bp, Artificial
  CRISPR gRNA sequence
gcaaataactgtctagtctt

SEQ ID NO: 627170 - DNA, 20 bp, Artificial
  CRISPR gRNA sequence
caaataactgtctagtcttt

SEQ ID NO: 627171 - DNA, 20 bp, Artificial
  CRISPR gRNA sequence
tctagtctttcatgatatac

SEQ ID NO: 627172 - DNA, 20 bp, Artificial
  CRISPR gRNA sequence
gtctttcatgatatacattt

SEQ ID NO: 627173 - DNA, 20 bp, Artificial
  CRISPR gRNA sequence
tcatgatatacattttttgg

SEQ ID NO: 627174 - DNA, 20 bp, Artificial
  CRISPR gRNA sequence
catgatatacattttttgga

SEQ ID NO: 627175 - DNA, 20 bp, Artificial
  CRISPR gRNA sequence
atgatatacattttttggag

SEQ ID NO: 627176 - DNA, 20 bp, Artificial
  CRISPR gRNA sequence
tttggaggaaagccaaatca

SEQ ID NO: 627177 - DNA, 20 bp, Artificial
  CRISPR gRNA sequence
ttggaggaaagccaaatcag

SEQ ID NO: 627178 - DNA, 20 bp, Artificial
  CRISPR gRNA sequence
tggaggaaagccaaatcaga

SEQ ID NO: 627179 - DNA, 20 bp, Artificial
  CRISPR gRNA sequence
ggaggaaagccaaatcagaa

SEQ ID NO: 627180 - DNA, 20 bp, Artificial
  CRISPR gRNA sequence
gaggaaagccaaatcagaat

SEQ ID NO: 627181 - DNA, 20 bp, Artificial
  CRISPR gRNA sequence
taataggattacataatctc

SEQ ID NO: 627182 - DNA, 20 bp, Artificial
  CRISPR gRNA sequence
cataatctctgaagtaatgt

SEQ ID NO: 627183 - DNA, 20 bp, Artificial
  CRISPR gRNA sequence
tgaagtaatgttttaggtac

SEQ ID NO: 627184 - DNA, 20 bp, Artificial
  CRISPR gRNA sequence
aagtaatgttttaggtaccc

SEQ ID NO: 627185 - DNA, 20 bp, Artificial
  CRISPR gRNA sequence
taggtacccaatatttgaaa

SEQ ID NO: 627186 - DNA, 20 bp, Artificial
  CRISPR gRNA sequence
aggtacccaatatttgaaag

SEQ ID NO: 627187 - DNA, 20 bp, Artificial
  CRISPR gRNA sequence
ggtacccaatatttgaaagt

SEQ ID NO: 627188 - DNA, 20 bp, Artificial
  CRISPR gRNA sequence
gaaagtgaaagtaacatgag

SEQ ID NO: 627189 - DNA, 20 bp, Artificial
  CRISPR gRNA sequence
aaagtgaaagtaacatgagg

SEQ ID NO: 627190 - DNA, 20 bp, Artificial
  CRISPR gRNA sequence
catagcttactatttttaat

SEQ ID NO: 627191 - DNA, 20 bp, Artificial
  CRISPR gRNA sequence
actatttttaatccaaccac

SEQ ID NO: 627192 - DNA, 20 bp, Artificial
  CRISPR gRNA sequence
ctatttttaatccaaccact

SEQ ID NO: 627193 - DNA, 20 bp, Artificial
  CRISPR gRNA sequence
tttttaatccaaccactttt

SEQ ID NO: 627194 - DNA, 20 bp, Artificial
  CRISPR gRNA sequence
ttaatccaaccacttttctt

SEQ ID NO: 627195 - DNA, 20 bp, Artificial
  CRISPR gRNA sequence
taatccaaccacttttcttt

SEQ ID NO: 627196 - DNA, 20 bp, Artificial
  CRISPR gRNA sequence
aatccaaccacttttctttt

SEQ ID NO: 627197 - DNA, 20 bp, Artificial
  CRISPR gRNA sequence
atccaaccacttttcttttt

SEQ ID NO: 627198 - DNA, 20 bp, Artificial
  CRISPR gRNA sequence
ttctttttaatagaaaacta

SEQ ID NO: 627199 - DNA, 20 bp, Artificial
  CRISPR gRNA sequence
tctttttaatagaaaactac

SEQ ID NO: 627200 - DNA, 20 bp, Artificial
  CRISPR gRNA sequence
ctttttaatagaaaactaca

SEQ ID NO: 627201 - DNA, 20 bp, Artificial
  CRISPR gRNA sequence
tttttaatagaaaactacac

SEQ ID NO: 627202 - DNA, 20 bp, Artificial
  CRISPR gRNA sequence
tttaatagaaaactacactt

SEQ ID NO: 627203 - DNA, 20 bp, Artificial
  CRISPR gRNA sequence
ttaatagaaaactacacttg

SEQ ID NO: 627204 - DNA, 20 bp, Artificial
  CRISPR gRNA sequence
taatagaaaactacacttga

SEQ ID NO: 627205 - DNA, 20 bp, Artificial
  CRISPR gRNA sequence
aatagaaaactacacttgag

SEQ ID NO: 627206 - DNA, 20 bp, Artificial
  CRISPR gRNA sequence
atagaaaactacacttgagt

SEQ ID NO: 627207 - DNA, 20 bp, Artificial
  CRISPR gRNA sequence
cacttgagtataaaaatacg

SEQ ID NO: 627208 - DNA, 20 bp, Artificial
  CRISPR gRNA sequence
gagtataaaaatacgtcagc

SEQ ID NO: 627209 - DNA, 20 bp, Artificial
  CRISPR gRNA sequence
agtataaaaatacgtcagca

SEQ ID NO: 627210 - DNA, 20 bp, Artificial
  CRISPR gRNA sequence
tacaaccaacaaaaatcacg

SEQ ID NO: 627211 - DNA, 20 bp, Artificial
  CRISPR gRNA sequence
agattaaattaccaatgaac

SEQ ID NO: 627212 - DNA, 20 bp, Artificial
  CRISPR gRNA sequence
aattaccaatgaactagaaa

SEQ ID NO: 627213 - DNA, 20 bp, Artificial
  CRISPR gRNA sequence
ccaatgaactagaaataaga

SEQ ID NO: 627214 - DNA, 20 bp, Artificial
  CRISPR gRNA sequence
gaaataagagttgacctaat

SEQ ID NO: 627215 - DNA, 20 bp, Artificial
  CRISPR gRNA sequence
acctaatcttcaaactttta

SEQ ID NO: 627216 - DNA, 20 bp, Artificial
  CRISPR gRNA sequence
atcttcaaacttttaggaga

SEQ ID NO: 627217 - DNA, 20 bp, Artificial
  CRISPR gRNA sequence
caaacttttaggagaacaga

SEQ ID NO: 627218 - DNA, 20 bp, Artificial
  CRISPR gRNA sequence
aaacttttaggagaacagag

SEQ ID NO: 627219 - DNA, 20 bp, Artificial
  CRISPR gRNA sequence
ttaggagaacagagaggtaa

SEQ ID NO: 627220 - DNA, 20 bp, Artificial
  CRISPR gRNA sequence
taggagaacagagaggtaaa

SEQ ID NO: 627221 - DNA, 20 bp, Artificial
  CRISPR gRNA sequence
aggagaacagagaggtaaac

SEQ ID NO: 627222 - DNA, 20 bp, Artificial
  CRISPR gRNA sequence
ggagaacagagaggtaaaca

SEQ ID NO: 627223 - DNA, 20 bp, Artificial
  CRISPR gRNA sequence
agggagatgtaacaaaattt

SEQ ID NO: 627224 - DNA, 20 bp, Artificial
  CRISPR gRNA sequence
aagagataacagagagacct

SEQ ID NO: 627225 - DNA, 20 bp, Artificial
  CRISPR gRNA sequence
agagataacagagagacctt

SEQ ID NO: 627226 - DNA, 20 bp, Artificial
  CRISPR gRNA sequence
tgttacacagaaagggaagg

SEQ ID NO: 627227 - DNA, 20 bp, Artificial
  CRISPR gRNA sequence
gttacacagaaagggaaggg

SEQ ID NO: 627228 - DNA, 20 bp, Artificial
  CRISPR gRNA sequence
ttacacagaaagggaaggga

SEQ ID NO: 627229 - DNA, 20 bp, Artificial
  CRISPR gRNA sequence
cacagaaagggaagggagtt

SEQ ID NO: 627230 - DNA, 20 bp, Artificial
  CRISPR gRNA sequence
tgttcaaaatcagaatgctt

SEQ ID NO: 627231 - DNA, 20 bp, Artificial
  CRISPR gRNA sequence
aaaatcagaatgcttgactg

SEQ ID NO: 627232 - DNA, 20 bp, Artificial
  CRISPR gRNA sequence
gactgtaaaaaatttttaaa

SEQ ID NO: 627233 - DNA, 20 bp, Artificial
  CRISPR gRNA sequence
actgtaaaaaatttttaaat

SEQ ID NO: 627234 - DNA, 20 bp, Artificial
  CRISPR gRNA sequence
taaaaaatttttaaatcaca

SEQ ID NO: 627235 - DNA, 20 bp, Artificial
  CRISPR gRNA sequence
ttaaatcacagtttcagaat

SEQ ID NO: 627236 - DNA, 20 bp, Artificial
  CRISPR gRNA sequence
taaatcacagtttcagaatt

SEQ ID NO: 627237 - DNA, 20 bp, Artificial
  CRISPR gRNA sequence
aaatcacagtttcagaattt

SEQ ID NO: 627238 - DNA, 20 bp, Artificial
  CRISPR gRNA sequence
aatcacagtttcagaatttg

SEQ ID NO: 627239 - DNA, 20 bp, Artificial
  CRISPR gRNA sequence
cagaatttgaactacttaaa

SEQ ID NO: 627240 - DNA, 20 bp, Artificial
  CRISPR gRNA sequence
agaatttgaactacttaaaa

SEQ ID NO: 627241 - DNA, 20 bp, Artificial
  CRISPR gRNA sequence
gaactacttaaaaaaaacaa

SEQ ID NO: 627242 - DNA, 20 bp, Artificial
  CRISPR gRNA sequence
aactacttaaaaaaaacaag

SEQ ID NO: 627243 - DNA, 20 bp, Artificial
  CRISPR gRNA sequence
cttaaaaaaaacaagaataa

SEQ ID NO: 627244 - DNA, 20 bp, Artificial
  CRISPR gRNA sequence
aaaaaaaacaagaataaaac

SEQ ID NO: 627245 - DNA, 20 bp, Artificial
  CRISPR gRNA sequence
aaaaaaacaagaataaaaca

SEQ ID NO: 627246 - DNA, 20 bp, Artificial
  CRISPR gRNA sequence
cccttgttacagtgtagtca

SEQ ID NO: 627247 - DNA, 20 bp, Artificial
  CRISPR gRNA sequence
ccttgttacagtgtagtcat

SEQ ID NO: 627248 - DNA, 20 bp, Artificial
  CRISPR gRNA sequence
gttacagtgtagtcattttt

SEQ ID NO: 627249 - DNA, 20 bp, Artificial
  CRISPR gRNA sequence
ttacagtgtagtcatttttt

SEQ ID NO: 627250 - DNA, 20 bp, Artificial
  CRISPR gRNA sequence
cagtgtagtcattttttaaa

SEQ ID NO: 627251 - DNA, 20 bp, Artificial
  CRISPR gRNA sequence
tttaaaaaatcaatttccag

SEQ ID NO: 627252 - DNA, 20 bp, Artificial
  CRISPR gRNA sequence
ttaaaaaatcaatttccagt

SEQ ID NO: 627253 - DNA, 20 bp, Artificial
  CRISPR gRNA sequence
taaaaaatcaatttccagta

SEQ ID NO: 627254 - DNA, 20 bp, Artificial
  CRISPR gRNA sequence
aaaaaatcaatttccagtaa

SEQ ID NO: 627255 - DNA, 20 bp, Artificial
  CRISPR gRNA sequence
aaaaatcaatttccagtaaa

SEQ ID NO: 627256 - DNA, 20 bp, Artificial
  CRISPR gRNA sequence
ccagtaaattaaagtaagta

SEQ ID NO: 627257 - DNA, 20 bp, Artificial
  CRISPR gRNA sequence
cagtaaattaaagtaagtaa

SEQ ID NO: 627258 - DNA, 20 bp, Artificial
  CRISPR gRNA sequence
aagtaagtaaaatcttggta

SEQ ID NO: 627259 - DNA, 20 bp, Artificial
  CRISPR gRNA sequence
ggtaagtgcatagtagggga

SEQ ID NO: 627260 - DNA, 20 bp, Artificial
  CRISPR gRNA sequence
gtaagtgcatagtaggggat

SEQ ID NO: 627261 - DNA, 20 bp, Artificial
  CRISPR gRNA sequence
agtgacctccacctgctcaa

SEQ ID NO: 627262 - DNA, 20 bp, Artificial
  CRISPR gRNA sequence
cacctgctcaagaagctttt

SEQ ID NO: 627263 - DNA, 20 bp, Artificial
  CRISPR gRNA sequence
ctcaagaagcttttcttact

SEQ ID NO: 627264 - DNA, 20 bp, Artificial
  CRISPR gRNA sequence
aagaagcttttcttactatc

SEQ ID NO: 627265 - DNA, 20 bp, Artificial
  CRISPR gRNA sequence
ttcttactatctgtcacttg

SEQ ID NO: 627266 - DNA, 20 bp, Artificial
  CRISPR gRNA sequence
tcttactatctgtcacttga

SEQ ID NO: 627267 - DNA, 20 bp, Artificial
  CRISPR gRNA sequence
cttactatctgtcacttgag

SEQ ID NO: 627268 - DNA, 20 bp, Artificial
  CRISPR gRNA sequence
ttactatctgtcacttgagg

SEQ ID NO: 627269 - DNA, 20 bp, Artificial
  CRISPR gRNA sequence
actatctgtcacttgaggta

SEQ ID NO: 627270 - DNA, 20 bp, Artificial
  CRISPR gRNA sequence
ctatctgtcacttgaggtaa

SEQ ID NO: 627271 - DNA, 20 bp, Artificial
  CRISPR gRNA sequence
tctgtcacttgaggtaattt

SEQ ID NO: 627272 - DNA, 20 bp, Artificial
  CRISPR gRNA sequence
tcacttgaggtaatttgaag

SEQ ID NO: 627273 - DNA, 20 bp, Artificial
  CRISPR gRNA sequence
gaggtaatttgaaggcccaa

SEQ ID NO: 627274 - DNA, 20 bp, Artificial
  CRISPR gRNA sequence
aggtaatttgaaggcccaat

SEQ ID NO: 627275 - DNA, 20 bp, Artificial
  CRISPR gRNA sequence
gaaggcccaattcactgcaa

SEQ ID NO: 627276 - DNA, 20 bp, Artificial
  CRISPR gRNA sequence
aaggcccaattcactgcaaa

SEQ ID NO: 627277 - DNA, 20 bp, Artificial
  CRISPR gRNA sequence
actgcaaactcatttatttg

SEQ ID NO: 627278 - DNA, 20 bp, Artificial
  CRISPR gRNA sequence
caaactcatttatttgtacc

SEQ ID NO: 627279 - DNA, 20 bp, Artificial
  CRISPR gRNA sequence
atttatttgtacctatatga

SEQ ID NO: 627280 - DNA, 20 bp, Artificial
  CRISPR gRNA sequence
atttgtacctatatgaactt

SEQ ID NO: 627281 - DNA, 20 bp, Artificial
  CRISPR gRNA sequence
tttgtacctatatgaactta

SEQ ID NO: 627282 - DNA, 20 bp, Artificial
  CRISPR gRNA sequence
gtacctatatgaacttatat

SEQ ID NO: 627283 - DNA, 20 bp, Artificial
  CRISPR gRNA sequence
tacctatatgaacttatatg

SEQ ID NO: 627284 - DNA, 20 bp, Artificial
  CRISPR gRNA sequence
tatgaacttatatgctgtac

SEQ ID NO: 627285 - DNA, 20 bp, Artificial
  CRISPR gRNA sequence
atatgctgtactttatgtga

SEQ ID NO: 627286 - DNA, 20 bp, Artificial
  CRISPR gRNA sequence
tatgctgtactttatgtgac

SEQ ID NO: 627287 - DNA, 20 bp, Artificial
  CRISPR gRNA sequence
tactttatgtgacttagcag

SEQ ID NO: 627288 - DNA, 20 bp, Artificial
  CRISPR gRNA sequence
tatgtgacttagcagagggc

SEQ ID NO: 627289 - DNA, 20 bp, Artificial
  CRISPR gRNA sequence
atgtgacttagcagagggcc

SEQ ID NO: 627290 - DNA, 20 bp, Artificial
  CRISPR gRNA sequence
tgtgacttagcagagggcct

SEQ ID NO: 627291 - DNA, 20 bp, Artificial
  CRISPR gRNA sequence
agcagagggcctttaacttt

SEQ ID NO: 627292 - DNA, 20 bp, Artificial
  CRISPR gRNA sequence
gcagagggcctttaactttt

SEQ ID NO: 627293 - DNA, 20 bp, Artificial
  CRISPR gRNA sequence
taacttttatattttattca

SEQ ID NO: 627294 - DNA, 20 bp, Artificial
  CRISPR gRNA sequence
aacttttatattttattcac

SEQ ID NO: 627295 - DNA, 20 bp, Artificial
  CRISPR gRNA sequence
acttttatattttattcaca

SEQ ID NO: 627296 - DNA, 20 bp, Artificial
  CRISPR gRNA sequence
ttatattttattcacaataa

SEQ ID NO: 627297 - DNA, 20 bp, Artificial
  CRISPR gRNA sequence
tatattttattcacaataaa

SEQ ID NO: 627298 - DNA, 20 bp, Artificial
  CRISPR gRNA sequence
atattttattcacaataaaa

SEQ ID NO: 627299 - DNA, 20 bp, Artificial
  CRISPR gRNA sequence
tattttattcacaataaaaa

SEQ ID NO: 627300 - DNA, 20 bp, Artificial
  CRISPR gRNA sequence
tattcacaataaaaaggaca

SEQ ID NO: 627301 - DNA, 20 bp, Artificial
  CRISPR gRNA sequence
attcacaataaaaaggacat

SEQ ID NO: 627302 - DNA, 20 bp, Artificial
  CRISPR gRNA sequence
ttcacaataaaaaggacatc

SEQ ID NO: 627303 - DNA, 20 bp, Artificial
  CRISPR gRNA sequence
acaataaaaaggacatctta

SEQ ID NO: 627304 - DNA, 20 bp, Artificial
  CRISPR gRNA sequence
agaaaactagtcattcatgt

SEQ ID NO: 627305 - DNA, 20 bp, Artificial
  CRISPR gRNA sequence
gaaaactagtcattcatgta

SEQ ID NO: 627306 - DNA, 20 bp, Artificial
  CRISPR gRNA sequence
gtcattcatgtaccactctc

SEQ ID NO: 627307 - DNA, 20 bp, Artificial
  CRISPR gRNA sequence
atgtaccactctctgtatgg

SEQ ID NO: 627308 - DNA, 20 bp, Artificial
  CRISPR gRNA sequence
tctgtatgggataaaggtta

SEQ ID NO: 627309 - DNA, 20 bp, Artificial
  CRISPR gRNA sequence
tgtatgggataaaggttaat

SEQ ID NO: 627310 - DNA, 20 bp, Artificial
  CRISPR gRNA sequence
tatgggataaaggttaatac

SEQ ID NO: 627311 - DNA, 20 bp, Artificial
  CRISPR gRNA sequence
atacacaacacatattttat

SEQ ID NO: 627312 - DNA, 20 bp, Artificial
  CRISPR gRNA sequence
tatacagaaaatatacaaat

SEQ ID NO: 627313 - DNA, 20 bp, Artificial
  CRISPR gRNA sequence
atacagaaaatatacaaatg

SEQ ID NO: 627314 - DNA, 20 bp, Artificial
  CRISPR gRNA sequence
tacagaaaatatacaaatgc

SEQ ID NO: 627315 - DNA, 20 bp, Artificial
  CRISPR gRNA sequence
tgggaggaaagccccataaa

SEQ ID NO: 627316 - DNA, 20 bp, Artificial
  CRISPR gRNA sequence
tgaacttattcctaagagtg

SEQ ID NO: 627317 - DNA, 20 bp, Artificial
  CRISPR gRNA sequence
attcctaagagtgcaggtga

SEQ ID NO: 627318 - DNA, 20 bp, Artificial
  CRISPR gRNA sequence
ttcctaagagtgcaggtgaa

SEQ ID NO: 627319 - DNA, 20 bp, Artificial
  CRISPR gRNA sequence
ctaagagtgcaggtgaaaaa

SEQ ID NO: 627320 - DNA, 20 bp, Artificial
  CRISPR gRNA sequence
agagtgcaggtgaaaaatat

SEQ ID NO: 627321 - DNA, 20 bp, Artificial
  CRISPR gRNA sequence
aaacttacagtacagcaaga

SEQ ID NO: 627322 - DNA, 20 bp, Artificial
  CRISPR gRNA sequence
acagtacagcaagataaaac

SEQ ID NO: 627323 - DNA, 20 bp, Artificial
  CRISPR gRNA sequence
cagtacagcaagataaaact

SEQ ID NO: 627324 - DNA, 20 bp, Artificial
  CRISPR gRNA sequence
aaaagctagaaatagaatat

SEQ ID NO: 627325 - DNA, 20 bp, Artificial
  CRISPR gRNA sequence
gaaatagaatattacataaa

SEQ ID NO: 627326 - DNA, 20 bp, Artificial
  CRISPR gRNA sequence
cataaaaaccttatggaaat

SEQ ID NO: 627327 - DNA, 20 bp, Artificial
  CRISPR gRNA sequence
atggaaattccaaagtttaa

SEQ ID NO: 627328 - DNA, 20 bp, Artificial
  CRISPR gRNA sequence
tggaaattccaaagtttaag

SEQ ID NO: 627329 - DNA, 20 bp, Artificial
  CRISPR gRNA sequence
caaagtttaaggtttctgca

SEQ ID NO: 627330 - DNA, 20 bp, Artificial
  CRISPR gRNA sequence
aaggtttctgcaataaatgt

SEQ ID NO: 627331 - DNA, 20 bp, Artificial
  CRISPR gRNA sequence
aggtttctgcaataaatgta

SEQ ID NO: 627332 - DNA, 20 bp, Artificial
  CRISPR gRNA sequence
ctgcaataaatgtaaaaata

SEQ ID NO: 627333 - DNA, 20 bp, Artificial
  CRISPR gRNA sequence
tgcaataaatgtaaaaatat

SEQ ID NO: 627334 - DNA, 20 bp, Artificial
  CRISPR gRNA sequence
caataaatgtaaaaatattc

SEQ ID NO: 627335 - DNA, 20 bp, Artificial
  CRISPR gRNA sequence
aaggtgtcattatttggcct

SEQ ID NO: 627336 - DNA, 20 bp, Artificial
  CRISPR gRNA sequence
tttggcctagtaatacacta

SEQ ID NO: 627337 - DNA, 20 bp, Artificial
  CRISPR gRNA sequence
ggcctagtaatacactatga

SEQ ID NO: 627338 - DNA, 20 bp, Artificial
  CRISPR gRNA sequence
gcctagtaatacactatgat

SEQ ID NO: 627339 - DNA, 20 bp, Artificial
  CRISPR gRNA sequence
gtaatacactatgataaaaa

SEQ ID NO: 627340 - DNA, 20 bp, Artificial
  CRISPR gRNA sequence
tgataaaaagaaacactagc

SEQ ID NO: 627341 - DNA, 20 bp, Artificial
  CRISPR gRNA sequence
gcatatcacagcttcttggt

SEQ ID NO: 627342 - DNA, 20 bp, Artificial
  CRISPR gRNA sequence
cttggtcatatgccatttgc

SEQ ID NO: 627343 - DNA, 20 bp, Artificial
  CRISPR gRNA sequence
ttggtcatatgccatttgct

SEQ ID NO: 627344 - DNA, 20 bp, Artificial
  CRISPR gRNA sequence
ggtcatatgccatttgcttt

SEQ ID NO: 627345 - DNA, 20 bp, Artificial
  CRISPR gRNA sequence
gtcatatgccatttgctttg

SEQ ID NO: 627346 - DNA, 20 bp, Artificial
  CRISPR gRNA sequence
gctttgtataaccagcagct

SEQ ID NO: 627347 - DNA, 20 bp, Artificial
  CRISPR gRNA sequence
ctttgtataaccagcagctc

SEQ ID NO: 627348 - DNA, 20 bp, Artificial
  CRISPR gRNA sequence
tgtataaccagcagctcatt

SEQ ID NO: 627349 - DNA, 20 bp, Artificial
  CRISPR gRNA sequence
gtataaccagcagctcattt

SEQ ID NO: 627350 - DNA, 20 bp, Artificial
  CRISPR gRNA sequence
tataaccagcagctcatttt

SEQ ID NO: 627351 - DNA, 20 bp, Artificial
  CRISPR gRNA sequence
atttttttaaaaagctgtca

SEQ ID NO: 627352 - DNA, 20 bp, Artificial
  CRISPR gRNA sequence
ttttaaaaagctgtcatatc

SEQ ID NO: 627353 - DNA, 20 bp, Artificial
  CRISPR gRNA sequence
tttaaaaagctgtcatatcc

SEQ ID NO: 627354 - DNA, 20 bp, Artificial
  CRISPR gRNA sequence
ttaaaaagctgtcatatcct

SEQ ID NO: 627355 - DNA, 20 bp, Artificial
  CRISPR gRNA sequence
taaaaagctgtcatatccta

SEQ ID NO: 627356 - DNA, 20 bp, Artificial
  CRISPR gRNA sequence
aaaaagctgtcatatcctaa

SEQ ID NO: 627357 - DNA, 20 bp, Artificial
  CRISPR gRNA sequence
aaaagctgtcatatcctaac

SEQ ID NO: 627358 - DNA, 20 bp, Artificial
  CRISPR gRNA sequence
tcatatcctaacacacccat

SEQ ID NO: 627359 - DNA, 20 bp, Artificial
  CRISPR gRNA sequence
acacacccattgcaagtaat

SEQ ID NO: 627360 - DNA, 20 bp, Artificial
  CRISPR gRNA sequence
caagtaatacacaaccatga

SEQ ID NO: 627361 - DNA, 20 bp, Artificial
  CRISPR gRNA sequence
gagattatgctttggagaat

SEQ ID NO: 627362 - DNA, 20 bp, Artificial
  CRISPR gRNA sequence
agattatgctttggagaata

SEQ ID NO: 627363 - DNA, 20 bp, Artificial
  CRISPR gRNA sequence
tgctttggagaatagcaatg

SEQ ID NO: 627364 - DNA, 20 bp, Artificial
  CRISPR gRNA sequence
tggagaatagcaatgtgata

SEQ ID NO: 627365 - DNA, 20 bp, Artificial
  CRISPR gRNA sequence
ggagaatagcaatgtgatat

SEQ ID NO: 627366 - DNA, 20 bp, Artificial
  CRISPR gRNA sequence
gagaatagcaatgtgatatg

SEQ ID NO: 627367 - DNA, 20 bp, Artificial
  CRISPR gRNA sequence
ttcagttttgctttgttcaa

SEQ ID NO: 627368 - DNA, 20 bp, Artificial
  CRISPR gRNA sequence
agttttgctttgttcaagga

SEQ ID NO: 627369 - DNA, 20 bp, Artificial
  CRISPR gRNA sequence
tgctttgttcaaggagaatt

SEQ ID NO: 627370 - DNA, 20 bp, Artificial
  CRISPR gRNA sequence
gctttgttcaaggagaatta

SEQ ID NO: 627371 - DNA, 20 bp, Artificial
  CRISPR gRNA sequence
ctttgttcaaggagaattaa

SEQ ID NO: 627372 - DNA, 20 bp, Artificial
  CRISPR gRNA sequence
tgttcaaggagaattaatta

SEQ ID NO: 627373 - DNA, 20 bp, Artificial
  CRISPR gRNA sequence
gttcaaggagaattaattac

SEQ ID NO: 627374 - DNA, 20 bp, Artificial
  CRISPR gRNA sequence
ttcaaggagaattaattacc

SEQ ID NO: 627375 - DNA, 20 bp, Artificial
  CRISPR gRNA sequence
aaggagaattaattacctgc

SEQ ID NO: 627376 - DNA, 20 bp, Artificial
  CRISPR gRNA sequence
attacctgctttttcacatt

SEQ ID NO: 627377 - DNA, 20 bp, Artificial
  CRISPR gRNA sequence
cctgctttttcacattattc

SEQ ID NO: 627378 - DNA, 20 bp, Artificial
  CRISPR gRNA sequence
ctttttcacattattccatc

SEQ ID NO: 627379 - DNA, 20 bp, Artificial
  CRISPR gRNA sequence
tttcacattattccatcaat

SEQ ID NO: 627380 - DNA, 20 bp, Artificial
  CRISPR gRNA sequence
ttcacattattccatcaatt

SEQ ID NO: 627381 - DNA, 20 bp, Artificial
  CRISPR gRNA sequence
tcacattattccatcaattt

SEQ ID NO: 627382 - DNA, 20 bp, Artificial
  CRISPR gRNA sequence
cacattattccatcaatttt

SEQ ID NO: 627383 - DNA, 20 bp, Artificial
  CRISPR gRNA sequence
acattattccatcaattttc

SEQ ID NO: 627384 - DNA, 20 bp, Artificial
  CRISPR gRNA sequence
ttccatcaattttcaatctc

SEQ ID NO: 627385 - DNA, 20 bp, Artificial
  CRISPR gRNA sequence
catcaattttcaatctctat

SEQ ID NO: 627386 - DNA, 20 bp, Artificial
  CRISPR gRNA sequence
tcaatctctattttctaaca

SEQ ID NO: 627387 - DNA, 20 bp, Artificial
  CRISPR gRNA sequence
caatctctattttctaacag

SEQ ID NO: 627388 - DNA, 20 bp, Artificial
  CRISPR gRNA sequence
aatctctattttctaacaga

SEQ ID NO: 627389 - DNA, 20 bp, Artificial
  CRISPR gRNA sequence
tattttctaacagattagaa

SEQ ID NO: 627390 - DNA, 20 bp, Artificial
  CRISPR gRNA sequence
ttttctaacagattagaaaa

SEQ ID NO: 627391 - DNA, 20 bp, Artificial
  CRISPR gRNA sequence
tctaacagattagaaaatac

SEQ ID NO: 627392 - DNA, 20 bp, Artificial
  CRISPR gRNA sequence
ctaacagattagaaaataca

SEQ ID NO: 627393 - DNA, 20 bp, Artificial
  CRISPR gRNA sequence
taacagattagaaaatacag

SEQ ID NO: 627394 - DNA, 20 bp, Artificial
  CRISPR gRNA sequence
acagattagaaaatacagat

SEQ ID NO: 627395 - DNA, 20 bp, Artificial
  CRISPR gRNA sequence
gaaaatacagattccaagac

SEQ ID NO: 627396 - DNA, 20 bp, Artificial
  CRISPR gRNA sequence
caagactagaacaatactag

SEQ ID NO: 627397 - DNA, 20 bp, Artificial
  CRISPR gRNA sequence
gaacaatactagtctggaga

SEQ ID NO: 627398 - DNA, 20 bp, Artificial
  CRISPR gRNA sequence
gtctggagatgaaaatccaa

SEQ ID NO: 627399 - DNA, 20 bp, Artificial
  CRISPR gRNA sequence
gagatgaaaatccaaatgaa

SEQ ID NO: 627400 - DNA, 20 bp, Artificial
  CRISPR gRNA sequence
tattttattgaccaaaaaat

SEQ ID NO: 627401 - DNA, 20 bp, Artificial
  CRISPR gRNA sequence
tattgaccaaaaaattatct

SEQ ID NO: 627402 - DNA, 20 bp, Artificial
  CRISPR gRNA sequence
attgaccaaaaaattatcta

SEQ ID NO: 627403 - DNA, 20 bp, Artificial
  CRISPR gRNA sequence
ttgaccaaaaaattatctaa

SEQ ID NO: 627404 - DNA, 20 bp, Artificial
  CRISPR gRNA sequence
accaaaaaattatctaataa

SEQ ID NO: 627405 - DNA, 20 bp, Artificial
  CRISPR gRNA sequence
tctaataaattcttgtttga

SEQ ID NO: 627406 - DNA, 20 bp, Artificial
  CRISPR gRNA sequence
ataaattcttgtttgataca

SEQ ID NO: 627407 - DNA, 20 bp, Artificial
  CRISPR gRNA sequence
ttgtttgatacagaacttat

SEQ ID NO: 627408 - DNA, 20 bp, Artificial
  CRISPR gRNA sequence
gtttgatacagaacttattc

SEQ ID NO: 627409 - DNA, 20 bp, Artificial
  CRISPR gRNA sequence
tttgatacagaacttattct

SEQ ID NO: 627410 - DNA, 20 bp, Artificial
  CRISPR gRNA sequence
gatacagaacttattcttcc

SEQ ID NO: 627411 - DNA, 20 bp, Artificial
  CRISPR gRNA sequence
atacagaacttattcttcct

SEQ ID NO: 627412 - DNA, 20 bp, Artificial
  CRISPR gRNA sequence
attcttccttaaaaacaaaa

SEQ ID NO: 627413 - DNA, 20 bp, Artificial
  CRISPR gRNA sequence
ttcttccttaaaaacaaaac

SEQ ID NO: 627414 - DNA, 20 bp, Artificial
  CRISPR gRNA sequence
ttccttaaaaacaaaacaaa

SEQ ID NO: 627415 - DNA, 20 bp, Artificial
  CRISPR gRNA sequence
ccttaaaaacaaaacaaaaa

SEQ ID NO: 627416 - DNA, 20 bp, Artificial
  CRISPR gRNA sequence
cttaaaaacaaaacaaaaac

SEQ ID NO: 627417 - DNA, 20 bp, Artificial
  CRISPR gRNA sequence
aaaaacaaaacaaaaacaca

SEQ ID NO: 627418 - DNA, 20 bp, Artificial
  CRISPR gRNA sequence
aaaacaaaacaaaaacacaa

SEQ ID NO: 627419 - DNA, 20 bp, Artificial
  CRISPR gRNA sequence
taattcaattcacaggtaaa

SEQ ID NO: 627420 - DNA, 20 bp, Artificial
  CRISPR gRNA sequence
aattcacaggtaaagtttca

SEQ ID NO: 627421 - DNA, 20 bp, Artificial
  CRISPR gRNA sequence
acaggtaaagtttcactcta

SEQ ID NO: 627422 - DNA, 20 bp, Artificial
  CRISPR gRNA sequence
cactctatattttacctgca

SEQ ID NO: 627423 - DNA, 20 bp, Artificial
  CRISPR gRNA sequence
actctatattttacctgcat

SEQ ID NO: 627424 - DNA, 20 bp, Artificial
  CRISPR gRNA sequence
tatattttacctgcataatc

SEQ ID NO: 627425 - DNA, 20 bp, Artificial
  CRISPR gRNA sequence
tattttacctgcataatctt

SEQ ID NO: 627426 - DNA, 20 bp, Artificial
  CRISPR gRNA sequence
tacctgcataatcttgtaat

SEQ ID NO: 627427 - DNA, 20 bp, Artificial
  CRISPR gRNA sequence
acctgcataatcttgtaatc

SEQ ID NO: 627428 - DNA, 20 bp, Artificial
  CRISPR gRNA sequence
cctgcataatcttgtaatca

SEQ ID NO: 627429 - DNA, 20 bp, Artificial
  CRISPR gRNA sequence
cataatcttgtaatcatatt

SEQ ID NO: 627430 - DNA, 20 bp, Artificial
  CRISPR gRNA sequence
gtaatcatattcagaaatac

SEQ ID NO: 627431 - DNA, 20 bp, Artificial
  CRISPR gRNA sequence
taatcatattcagaaatact

SEQ ID NO: 627432 - DNA, 20 bp, Artificial
  CRISPR gRNA sequence
agaaatactatgaaactaaa

SEQ ID NO: 627433 - DNA, 20 bp, Artificial
  CRISPR gRNA sequence
tgaaactaaaaaggtagtaa

SEQ ID NO: 627434 - DNA, 20 bp, Artificial
  CRISPR gRNA sequence
aaaaggtagtaaagtctagt

SEQ ID NO: 627435 - DNA, 20 bp, Artificial
  CRISPR gRNA sequence
gtttcaaagtttccttttcc

SEQ ID NO: 627436 - DNA, 20 bp, Artificial
  CRISPR gRNA sequence
caaagtttccttttcctttt

SEQ ID NO: 627437 - DNA, 20 bp, Artificial
  CRISPR gRNA sequence
aaagtttccttttcctttta

SEQ ID NO: 627438 - DNA, 20 bp, Artificial
  CRISPR gRNA sequence
ccttttccttttaacagctg

SEQ ID NO: 627439 - DNA, 20 bp, Artificial
  CRISPR gRNA sequence
cttttccttttaacagctga

SEQ ID NO: 627440 - DNA, 20 bp, Artificial
  CRISPR gRNA sequence
ttccttttaacagctgagct

SEQ ID NO: 627441 - DNA, 20 bp, Artificial
  CRISPR gRNA sequence
tccttttaacagctgagctg

SEQ ID NO: 627442 - DNA, 20 bp, Artificial
  CRISPR gRNA sequence
ccttttaacagctgagctga

SEQ ID NO: 627443 - DNA, 20 bp, Artificial
  CRISPR gRNA sequence
cttttaacagctgagctgaa

SEQ ID NO: 627444 - DNA, 20 bp, Artificial
  CRISPR gRNA sequence
ttaacagctgagctgaaaat

SEQ ID NO: 627445 - DNA, 20 bp, Artificial
  CRISPR gRNA sequence
taacagctgagctgaaaatt

SEQ ID NO: 627446 - DNA, 20 bp, Artificial
  CRISPR gRNA sequence
aacagctgagctgaaaattt

SEQ ID NO: 627447 - DNA, 20 bp, Artificial
  CRISPR gRNA sequence
acagctgagctgaaaatttc

SEQ ID NO: 627448 - DNA, 20 bp, Artificial
  CRISPR gRNA sequence
agctgaaaatttctctatta

SEQ ID NO: 627449 - DNA, 20 bp, Artificial
  CRISPR gRNA sequence
aaaatttctctattagaaat

SEQ ID NO: 627450 - DNA, 20 bp, Artificial
  CRISPR gRNA sequence
ctctattagaaattgctcta

SEQ ID NO: 627451 - DNA, 20 bp, Artificial
  CRISPR gRNA sequence
tctattagaaattgctctaa

SEQ ID NO: 627452 - DNA, 20 bp, Artificial
  CRISPR gRNA sequence
tattagaaattgctctaaag

SEQ ID NO: 627453 - DNA, 20 bp, Artificial
  CRISPR gRNA sequence
ttagaaattgctctaaagat

SEQ ID NO: 627454 - DNA, 20 bp, Artificial
  CRISPR gRNA sequence
gaaattgctctaaagatttg

SEQ ID NO: 627455 - DNA, 20 bp, Artificial
  CRISPR gRNA sequence
ctctaaagatttgcactaaa

SEQ ID NO: 627456 - DNA, 20 bp, Artificial
  CRISPR gRNA sequence
taaagatttgcactaaaaat

SEQ ID NO: 627457 - DNA, 20 bp, Artificial
  CRISPR gRNA sequence
aagatttgcactaaaaatgc

SEQ ID NO: 627458 - DNA, 20 bp, Artificial
  CRISPR gRNA sequence
gcactaaaaatgcagagatg

SEQ ID NO: 627459 - DNA, 20 bp, Artificial
  CRISPR gRNA sequence
cactaaaaatgcagagatga

SEQ ID NO: 627460 - DNA, 20 bp, Artificial
  CRISPR gRNA sequence
aaaatgcagagatgaattat

SEQ ID NO: 627461 - DNA, 20 bp, Artificial
  CRISPR gRNA sequence
tatagtactcaattttaagt

SEQ ID NO: 627462 - DNA, 20 bp, Artificial
  CRISPR gRNA sequence
aattttaagtgatttttaaa

SEQ ID NO: 627463 - DNA, 20 bp, Artificial
  CRISPR gRNA sequence
taagtgatttttaaaaatgc

SEQ ID NO: 627464 - DNA, 20 bp, Artificial
  CRISPR gRNA sequence
aagtgatttttaaaaatgca

SEQ ID NO: 627465 - DNA, 20 bp, Artificial
  CRISPR gRNA sequence
agtgatttttaaaaatgcat

SEQ ID NO: 627466 - DNA, 20 bp, Artificial
  CRISPR gRNA sequence
ttaaaaatgcatattaaaag

SEQ ID NO: 627467 - DNA, 20 bp, Artificial
  CRISPR gRNA sequence
taaaaatgcatattaaaagt

SEQ ID NO: 627468 - DNA, 20 bp, Artificial
  CRISPR gRNA sequence
aaaaatgcatattaaaagtg

SEQ ID NO: 627469 - DNA, 20 bp, Artificial
  CRISPR gRNA sequence
aaaatgcatattaaaagtgt

SEQ ID NO: 627470 - DNA, 20 bp, Artificial
  CRISPR gRNA sequence
aaagtgttgtacagctgcaa

SEQ ID NO: 627471 - DNA, 20 bp, Artificial
  CRISPR gRNA sequence
tacagctgcaacagctaacc

SEQ ID NO: 627472 - DNA, 20 bp, Artificial
  CRISPR gRNA sequence
caacagctaaccaacactct

SEQ ID NO: 627473 - DNA, 20 bp, Artificial
  CRISPR gRNA sequence
accaacactctcaatgcatt

SEQ ID NO: 627474 - DNA, 20 bp, Artificial
  CRISPR gRNA sequence
tcaatgcattttaaaaaggc

SEQ ID NO: 627475 - DNA, 20 bp, Artificial
  CRISPR gRNA sequence
aatgcattttaaaaaggcac

SEQ ID NO: 627476 - DNA, 20 bp, Artificial
  CRISPR gRNA sequence
taaaaaggcaccaatataaa

SEQ ID NO: 627477 - DNA, 20 bp, Artificial
  CRISPR gRNA sequence
aaaaaggcaccaatataaag

SEQ ID NO: 627478 - DNA, 20 bp, Artificial
  CRISPR gRNA sequence
aaaaggcaccaatataaaga

SEQ ID NO: 627479 - DNA, 20 bp, Artificial
  CRISPR gRNA sequence
aatacattaaattcaggatt

SEQ ID NO: 627480 - DNA, 20 bp, Artificial
  CRISPR gRNA sequence
atacattaaattcaggattt

SEQ ID NO: 627481 - DNA, 20 bp, Artificial
  CRISPR gRNA sequence
aattcaggatttaggagacc

SEQ ID NO: 627482 - DNA, 20 bp, Artificial
  CRISPR gRNA sequence
aggatttaggagaccagtta

SEQ ID NO: 627483 - DNA, 20 bp, Artificial
  CRISPR gRNA sequence
aggagaccagttactgtata

SEQ ID NO: 627484 - DNA, 20 bp, Artificial
  CRISPR gRNA sequence
ggagaccagttactgtatat

SEQ ID NO: 627485 - DNA, 20 bp, Artificial
  CRISPR gRNA sequence
ctgtatattttaattatttt

SEQ ID NO: 627486 - DNA, 20 bp, Artificial
  CRISPR gRNA sequence
tatattttaattattttgca

SEQ ID NO: 627487 - DNA, 20 bp, Artificial
  CRISPR gRNA sequence
taattattttgcagaaactg

SEQ ID NO: 627488 - DNA, 20 bp, Artificial
  CRISPR gRNA sequence
aattattttgcagaaactgg

SEQ ID NO: 627489 - DNA, 20 bp, Artificial
  CRISPR gRNA sequence
attattttgcagaaactgga

SEQ ID NO: 627490 - DNA, 20 bp, Artificial
  CRISPR gRNA sequence
ttttgcagaaactggagaat

SEQ ID NO: 627491 - DNA, 20 bp, Artificial
  CRISPR gRNA sequence
tgcagaaactggagaattaa

SEQ ID NO: 627492 - DNA, 20 bp, Artificial
  CRISPR gRNA sequence
gcagaaactggagaattaaa

SEQ ID NO: 627493 - DNA, 20 bp, Artificial
  CRISPR gRNA sequence
cagaaactggagaattaaaa

SEQ ID NO: 627494 - DNA, 20 bp, Artificial
  CRISPR gRNA sequence
gagaattaaaaatatgtcta

SEQ ID NO: 627495 - DNA, 20 bp, Artificial
  CRISPR gRNA sequence
aaaatatgtctaagataact

SEQ ID NO: 627496 - DNA, 20 bp, Artificial
  CRISPR gRNA sequence
agataactttcatatacaca

SEQ ID NO: 627497 - DNA, 20 bp, Artificial
  CRISPR gRNA sequence
tcatatacacaaacttcaat

SEQ ID NO: 627498 - DNA, 20 bp, Artificial
  CRISPR gRNA sequence
catatacacaaacttcaatt

SEQ ID NO: 627499 - DNA, 20 bp, Artificial
  CRISPR gRNA sequence
atatacacaaacttcaattt

SEQ ID NO: 627500 - DNA, 20 bp, Artificial
  CRISPR gRNA sequence
caatttcacctcttcccact

SEQ ID NO: 627501 - DNA, 20 bp, Artificial
  CRISPR gRNA sequence
aatttcacctcttcccactt

SEQ ID NO: 627502 - DNA, 20 bp, Artificial
  CRISPR gRNA sequence
cacctcttcccacttttttt

SEQ ID NO: 627503 - DNA, 20 bp, Artificial
  CRISPR gRNA sequence
acctcttcccactttttttt

SEQ ID NO: 627504 - DNA, 20 bp, Artificial
  CRISPR gRNA sequence
ttcccactttttttttcttt

SEQ ID NO: 627505 - DNA, 20 bp, Artificial
  CRISPR gRNA sequence
cccactttttttttcttttg

SEQ ID NO: 627506 - DNA, 20 bp, Artificial
  CRISPR gRNA sequence
ccactttttttttcttttgg

SEQ ID NO: 627507 - DNA, 20 bp, Artificial
  CRISPR gRNA sequence
tttttttcttttggatttgg

SEQ ID NO: 627508 - DNA, 20 bp, Artificial
  CRISPR gRNA sequence
ttttttcttttggatttggg

SEQ ID NO: 627509 - DNA, 20 bp, Artificial
  CRISPR gRNA sequence
tttttcttttggatttgggg

SEQ ID NO: 627510 - DNA, 20 bp, Artificial
  CRISPR gRNA sequence
ttttcttttggatttgggga

SEQ ID NO: 627511 - DNA, 20 bp, Artificial
  CRISPR gRNA sequence
tttcttttggatttggggaa

SEQ ID NO: 627512 - DNA, 20 bp, Artificial
  CRISPR gRNA sequence
ttcttttggatttggggaat

SEQ ID NO: 627513 - DNA, 20 bp, Artificial
  CRISPR gRNA sequence
tcttttggatttggggaatt

SEQ ID NO: 627514 - DNA, 20 bp, Artificial
  CRISPR gRNA sequence
cttttggatttggggaattt

SEQ ID NO: 627515 - DNA, 20 bp, Artificial
  CRISPR gRNA sequence
ttttggatttggggaatttt

SEQ ID NO: 627516 - DNA, 20 bp, Artificial
  CRISPR gRNA sequence
ttggatttggggaattttct

SEQ ID NO: 627517 - DNA, 20 bp, Artificial
  CRISPR gRNA sequence
tggatttggggaattttctg

SEQ ID NO: 627518 - DNA, 20 bp, Artificial
  CRISPR gRNA sequence
ggatttggggaattttctgg

SEQ ID NO: 627519 - DNA, 20 bp, Artificial
  CRISPR gRNA sequence
gatttggggaattttctggt

SEQ ID NO: 627520 - DNA, 20 bp, Artificial
  CRISPR gRNA sequence
ggggaattttctggtttaga

SEQ ID NO: 627521 - DNA, 20 bp, Artificial
  CRISPR gRNA sequence
gggaattttctggtttagaa

SEQ ID NO: 627522 - DNA, 20 bp, Artificial
  CRISPR gRNA sequence
tctggtttagaatagtcttc

SEQ ID NO: 627523 - DNA, 20 bp, Artificial
  CRISPR gRNA sequence
ctggtttagaatagtcttca

SEQ ID NO: 627524 - DNA, 20 bp, Artificial
  CRISPR gRNA sequence
tggtttagaatagtcttcat

SEQ ID NO: 627525 - DNA, 20 bp, Artificial
  CRISPR gRNA sequence
gtttagaatagtcttcattc

SEQ ID NO: 627526 - DNA, 20 bp, Artificial
  CRISPR gRNA sequence
agaatagtcttcattcagat

SEQ ID NO: 627527 - DNA, 20 bp, Artificial
  CRISPR gRNA sequence
gaatagtcttcattcagata

SEQ ID NO: 627528 - DNA, 20 bp, Artificial
  CRISPR gRNA sequence
cattcagatagtatttatta

SEQ ID NO: 627529 - DNA, 20 bp, Artificial
  CRISPR gRNA sequence
attcagatagtatttattaa

SEQ ID NO: 627530 - DNA, 20 bp, Artificial
  CRISPR gRNA sequence
agatagtatttattaaaata

SEQ ID NO: 627531 - DNA, 20 bp, Artificial
  CRISPR gRNA sequence
attaaaataatacataaaat

SEQ ID NO: 627532 - DNA, 20 bp, Artificial
  CRISPR gRNA sequence
ttaaaataatacataaaatg

SEQ ID NO: 627533 - DNA, 20 bp, Artificial
  CRISPR gRNA sequence
aaataatacataaaatgcaa

SEQ ID NO: 627534 - DNA, 20 bp, Artificial
  CRISPR gRNA sequence
atgataaacacaaatgtaat

SEQ ID NO: 627535 - DNA, 20 bp, Artificial
  CRISPR gRNA sequence
atccatttttggacgtgaac

SEQ ID NO: 627536 - DNA, 20 bp, Artificial
  CRISPR gRNA sequence
tccatttttggacgtgaaca

SEQ ID NO: 627537 - DNA, 20 bp, Artificial
  CRISPR gRNA sequence
ttggacgtgaacaatccaaa

SEQ ID NO: 627538 - DNA, 20 bp, Artificial
  CRISPR gRNA sequence
tggacgtgaacaatccaaag

SEQ ID NO: 627539 - DNA, 20 bp, Artificial
  CRISPR gRNA sequence
ggacgtgaacaatccaaagt

SEQ ID NO: 627540 - DNA, 20 bp, Artificial
  CRISPR gRNA sequence
gacgtgaacaatccaaagtt

SEQ ID NO: 627541 - DNA, 20 bp, Artificial
  CRISPR gRNA sequence
aaaaacaaatcatgtagcta

SEQ ID NO: 627542 - DNA, 20 bp, Artificial
  CRISPR gRNA sequence
gtacctctgacagtttaagt

SEQ ID NO: 627543 - DNA, 20 bp, Artificial
  CRISPR gRNA sequence
tgacagtttaagttctgcct

SEQ ID NO: 627544 - DNA, 20 bp, Artificial
  CRISPR gRNA sequence
acagtttaagttctgcctga

SEQ ID NO: 627545 - DNA, 20 bp, Artificial
  CRISPR gRNA sequence
aagttctgcctgaaactagg

SEQ ID NO: 627546 - DNA, 20 bp, Artificial
  CRISPR gRNA sequence
agttctgcctgaaactaggg

SEQ ID NO: 627547 - DNA, 20 bp, Artificial
  CRISPR gRNA sequence
tgcctgaaactaggggcaca

SEQ ID NO: 627548 - DNA, 20 bp, Artificial
  CRISPR gRNA sequence
cctgaaactaggggcacaca

SEQ ID NO: 627549 - DNA, 20 bp, Artificial
  CRISPR gRNA sequence
aaactaggggcacacagttt

SEQ ID NO: 627550 - DNA, 20 bp, Artificial
  CRISPR gRNA sequence
ggggcacacagttttttgct

SEQ ID NO: 627551 - DNA, 20 bp, Artificial
  CRISPR gRNA sequence
tttgcttgtatttttacagc

SEQ ID NO: 627552 - DNA, 20 bp, Artificial
  CRISPR gRNA sequence
ttgcttgtatttttacagcc

SEQ ID NO: 627553 - DNA, 20 bp, Artificial
  CRISPR gRNA sequence
tgcttgtatttttacagccc

SEQ ID NO: 627554 - DNA, 20 bp, Artificial
  CRISPR gRNA sequence
gcttgtatttttacagcccc

SEQ ID NO: 627555 - DNA, 20 bp, Artificial
  CRISPR gRNA sequence
cttgtatttttacagccccg

SEQ ID NO: 627556 - DNA, 20 bp, Artificial
  CRISPR gRNA sequence
gtatttttacagccccgtct

SEQ ID NO: 627557 - DNA, 20 bp, Artificial
  CRISPR gRNA sequence
tatttttacagccccgtctg

SEQ ID NO: 627558 - DNA, 20 bp, Artificial
  CRISPR gRNA sequence
ttacagccccgtctgctctt

SEQ ID NO: 627559 - DNA, 20 bp, Artificial
  CRISPR gRNA sequence
tacagccccgtctgctcttt

SEQ ID NO: 627560 - DNA, 20 bp, Artificial
  CRISPR gRNA sequence
acagccccgtctgctctttt

SEQ ID NO: 627561 - DNA, 20 bp, Artificial
  CRISPR gRNA sequence
cagccccgtctgctcttttt

SEQ ID NO: 627562 - DNA, 20 bp, Artificial
  CRISPR gRNA sequence
ctctttttgtaccctaagaa

SEQ ID NO: 627563 - DNA, 20 bp, Artificial
  CRISPR gRNA sequence
tttttgtaccctaagaaatc

SEQ ID NO: 627564 - DNA, 20 bp, Artificial
  CRISPR gRNA sequence
tttgtaccctaagaaatcat

SEQ ID NO: 627565 - DNA, 20 bp, Artificial
  CRISPR gRNA sequence
ttgtaccctaagaaatcatt

SEQ ID NO: 627566 - DNA, 20 bp, Artificial
  CRISPR gRNA sequence
tgtaccctaagaaatcattt

SEQ ID NO: 627567 - DNA, 20 bp, Artificial
  CRISPR gRNA sequence
gtaccctaagaaatcatttt

SEQ ID NO: 627568 - DNA, 20 bp, Artificial
  CRISPR gRNA sequence
taccctaagaaatcattttg

SEQ ID NO: 627569 - DNA, 20 bp, Artificial
  CRISPR gRNA sequence
agaaatcattttggagatag

SEQ ID NO: 627570 - DNA, 20 bp, Artificial
  CRISPR gRNA sequence
tggagataggatgaaataaa

SEQ ID NO: 627571 - DNA, 20 bp, Artificial
  CRISPR gRNA sequence
ggagataggatgaaataaaa

SEQ ID NO: 627572 - DNA, 20 bp, Artificial
  CRISPR gRNA sequence
gagataggatgaaataaaat

SEQ ID NO: 627573 - DNA, 20 bp, Artificial
  CRISPR gRNA sequence
ggaagatagtgagaacataa

SEQ ID NO: 627574 - DNA, 20 bp, Artificial
  CRISPR gRNA sequence
gaagatagtgagaacataat

SEQ ID NO: 627575 - DNA, 20 bp, Artificial
  CRISPR gRNA sequence
tcatctaaatgccttaatct

SEQ ID NO: 627576 - DNA, 20 bp, Artificial
  CRISPR gRNA sequence
catctaaatgccttaatctg

SEQ ID NO: 627577 - DNA, 20 bp, Artificial
  CRISPR gRNA sequence
atctaaatgccttaatctga

SEQ ID NO: 627578 - DNA, 20 bp, Artificial
  CRISPR gRNA sequence
aatgccttaatctgatgtaa

SEQ ID NO: 627579 - DNA, 20 bp, Artificial
  CRISPR gRNA sequence
aatctgatgtaaattttgtt

SEQ ID NO: 627580 - DNA, 20 bp, Artificial
  CRISPR gRNA sequence
atctgatgtaaattttgtta

SEQ ID NO: 627581 - DNA, 20 bp, Artificial
  CRISPR gRNA sequence
atgtaaattttgttaaacat

SEQ ID NO: 627582 - DNA, 20 bp, Artificial
  CRISPR gRNA sequence
tgttaaacatttataaaata

SEQ ID NO: 627583 - DNA, 20 bp, Artificial
  CRISPR gRNA sequence
gttaaacatttataaaatac

SEQ ID NO: 627584 - DNA, 20 bp, Artificial
  CRISPR gRNA sequence
ttaaacatttataaaatacc

SEQ ID NO: 627585 - DNA, 20 bp, Artificial
  CRISPR gRNA sequence
aacatttataaaataccaaa

SEQ ID NO: 627586 - DNA, 20 bp, Artificial
  CRISPR gRNA sequence
ataaaataccaaagacttca

SEQ ID NO: 627587 - DNA, 20 bp, Artificial
  CRISPR gRNA sequence
taaaataccaaagacttcat

SEQ ID NO: 627588 - DNA, 20 bp, Artificial
  CRISPR gRNA sequence
catggttttgtgagttgtac

SEQ ID NO: 627589 - DNA, 20 bp, Artificial
  CRISPR gRNA sequence
atggttttgtgagttgtaca

SEQ ID NO: 627590 - DNA, 20 bp, Artificial
  CRISPR gRNA sequence
tgtgagttgtacaactgaga

SEQ ID NO: 627591 - DNA, 20 bp, Artificial
  CRISPR gRNA sequence
gtgagttgtacaactgagat

SEQ ID NO: 627592 - DNA, 20 bp, Artificial
  CRISPR gRNA sequence
tgagttgtacaactgagata

SEQ ID NO: 627593 - DNA, 20 bp, Artificial
  CRISPR gRNA sequence
tacaactgagataaaaacta

SEQ ID NO: 627594 - DNA, 20 bp, Artificial
  CRISPR gRNA sequence
agataaaaactataaaaaca

SEQ ID NO: 627595 - DNA, 20 bp, Artificial
  CRISPR gRNA sequence
taaaaacaaaataccgggct

SEQ ID NO: 627596 - DNA, 20 bp, Artificial
  CRISPR gRNA sequence
actaaactattcttgtcttt

SEQ ID NO: 627597 - DNA, 20 bp, Artificial
  CRISPR gRNA sequence
aactattcttgtctttctct

SEQ ID NO: 627598 - DNA, 20 bp, Artificial
  CRISPR gRNA sequence
ttcttgtctttctctatttg

SEQ ID NO: 627599 - DNA, 20 bp, Artificial
  CRISPR gRNA sequence
ttgtctttctctatttgcca

SEQ ID NO: 627600 - DNA, 20 bp, Artificial
  CRISPR gRNA sequence
gtctttctctatttgccaat

SEQ ID NO: 627601 - DNA, 20 bp, Artificial
  CRISPR gRNA sequence
tctttctctatttgccaata

SEQ ID NO: 627602 - DNA, 20 bp, Artificial
  CRISPR gRNA sequence
tctctatttgccaataagta

SEQ ID NO: 627603 - DNA, 20 bp, Artificial
  CRISPR gRNA sequence
ctctatttgccaataagtaa

SEQ ID NO: 627604 - DNA, 20 bp, Artificial
  CRISPR gRNA sequence
tctatttgccaataagtaac

SEQ ID NO: 627605 - DNA, 20 bp, Artificial
  CRISPR gRNA sequence
tatttgccaataagtaactg

SEQ ID NO: 627606 - DNA, 20 bp, Artificial
  CRISPR gRNA sequence
tttgccaataagtaactgtt

SEQ ID NO: 627607 - DNA, 20 bp, Artificial
  CRISPR gRNA sequence
gccaataagtaactgttgat

SEQ ID NO: 627608 - DNA, 20 bp, Artificial
  CRISPR gRNA sequence
ccaataagtaactgttgata

SEQ ID NO: 627609 - DNA, 20 bp, Artificial
  CRISPR gRNA sequence
ttgataatatttattttctg

SEQ ID NO: 627610 - DNA, 20 bp, Artificial
  CRISPR gRNA sequence
ataatatttattttctgaat

SEQ ID NO: 627611 - DNA, 20 bp, Artificial
  CRISPR gRNA sequence
attttctgaattttcttcgt

SEQ ID NO: 627612 - DNA, 20 bp, Artificial
  CRISPR gRNA sequence
ttttctgaattttcttcgta

SEQ ID NO: 627613 - DNA, 20 bp, Artificial
  CRISPR gRNA sequence
tctgaattttcttcgtattc

SEQ ID NO: 627614 - DNA, 20 bp, Artificial
  CRISPR gRNA sequence
ctgaattttcttcgtattcc

SEQ ID NO: 627615 - DNA, 20 bp, Artificial
  CRISPR gRNA sequence
tgaattttcttcgtattcca

SEQ ID NO: 627616 - DNA, 20 bp, Artificial
  CRISPR gRNA sequence
aattttcttcgtattccaaa

SEQ ID NO: 627617 - DNA, 20 bp, Artificial
  CRISPR gRNA sequence
tcttcgtattccaaaaaact

SEQ ID NO: 627618 - DNA, 20 bp, Artificial
  CRISPR gRNA sequence
cttcgtattccaaaaaactt

SEQ ID NO: 627619 - DNA, 20 bp, Artificial
  CRISPR gRNA sequence
ttcgtattccaaaaaacttt

SEQ ID NO: 627620 - DNA, 20 bp, Artificial
  CRISPR gRNA sequence
cgtattccaaaaaactttac

SEQ ID NO: 627621 - DNA, 20 bp, Artificial
  CRISPR gRNA sequence
gtattccaaaaaactttaca

SEQ ID NO: 627622 - DNA, 20 bp, Artificial
  CRISPR gRNA sequence
caaaaaactttacattaaat

SEQ ID NO: 627623 - DNA, 20 bp, Artificial
  CRISPR gRNA sequence
tacattaaatatctttgaat

SEQ ID NO: 627624 - DNA, 20 bp, Artificial
  CRISPR gRNA sequence
acattaaatatctttgaatg

SEQ ID NO: 627625 - DNA, 20 bp, Artificial
  CRISPR gRNA sequence
cattaaatatctttgaatgt

SEQ ID NO: 627626 - DNA, 20 bp, Artificial
  CRISPR gRNA sequence
aatatctttgaatgtatatc

SEQ ID NO: 627627 - DNA, 20 bp, Artificial
  CRISPR gRNA sequence
tgaatgtatatccaatcagc

SEQ ID NO: 627628 - DNA, 20 bp, Artificial
  CRISPR gRNA sequence
gaatgtatatccaatcagct

SEQ ID NO: 627629 - DNA, 20 bp, Artificial
  CRISPR gRNA sequence
aatgtatatccaatcagctt

SEQ ID NO: 627630 - DNA, 20 bp, Artificial
  CRISPR gRNA sequence
aatcattgtttgtttcactt

SEQ ID NO: 627631 - DNA, 20 bp, Artificial
  CRISPR gRNA sequence
atcattgtttgtttcacttt

SEQ ID NO: 627632 - DNA, 20 bp, Artificial
  CRISPR gRNA sequence
tttgtttcactttgttctgt

SEQ ID NO: 627633 - DNA, 20 bp, Artificial
  CRISPR gRNA sequence
gtttcactttgttctgtaag

SEQ ID NO: 627634 - DNA, 20 bp, Artificial
  CRISPR gRNA sequence
tttcactttgttctgtaagt

SEQ ID NO: 627635 - DNA, 20 bp, Artificial
  CRISPR gRNA sequence
cactttgttctgtaagtaga

SEQ ID NO: 627636 - DNA, 20 bp, Artificial
  CRISPR gRNA sequence
actttgttctgtaagtagat

SEQ ID NO: 627637 - DNA, 20 bp, Artificial
  CRISPR gRNA sequence
tgttctgtaagtagataata

SEQ ID NO: 627638 - DNA, 20 bp, Artificial
  CRISPR gRNA sequence
gttctgtaagtagataataa

SEQ ID NO: 627639 - DNA, 20 bp, Artificial
  CRISPR gRNA sequence
ttctgtaagtagataataag

SEQ ID NO: 627640 - DNA, 20 bp, Artificial
  CRISPR gRNA sequence
tgtaagtagataataaggac

SEQ ID NO: 627641 - DNA, 20 bp, Artificial
  CRISPR gRNA sequence
taagtagataataaggaccc

SEQ ID NO: 627642 - DNA, 20 bp, Artificial
  CRISPR gRNA sequence
tagtttaagagttgccactg

SEQ ID NO: 627643 - DNA, 20 bp, Artificial
  CRISPR gRNA sequence
agtttaagagttgccactgg

SEQ ID NO: 627644 - DNA, 20 bp, Artificial
  CRISPR gRNA sequence
gtttaagagttgccactggt

SEQ ID NO: 627645 - DNA, 20 bp, Artificial
  CRISPR gRNA sequence
aagagttgccactggtccta

SEQ ID NO: 627646 - DNA, 20 bp, Artificial
  CRISPR gRNA sequence
agagttgccactggtcctaa

SEQ ID NO: 627647 - DNA, 20 bp, Artificial
  CRISPR gRNA sequence
ccactggtcctaaagacaca

SEQ ID NO: 627648 - DNA, 20 bp, Artificial
  CRISPR gRNA sequence
gtcctaaagacacactagta

SEQ ID NO: 627649 - DNA, 20 bp, Artificial
  CRISPR gRNA sequence
aagacacactagtaacttct

SEQ ID NO: 627650 - DNA, 20 bp, Artificial
  CRISPR gRNA sequence
gtaacttctttagtgattcc

SEQ ID NO: 627651 - DNA, 20 bp, Artificial
  CRISPR gRNA sequence
ctttagtgattcctattacg

SEQ ID NO: 627652 - DNA, 20 bp, Artificial
  CRISPR gRNA sequence
tttagtgattcctattacga

SEQ ID NO: 627653 - DNA, 20 bp, Artificial
  CRISPR gRNA sequence
tagtgattcctattacgacc

SEQ ID NO: 627654 - DNA, 20 bp, Artificial
  CRISPR gRNA sequence
agtgattcctattacgacct

SEQ ID NO: 627655 - DNA, 20 bp, Artificial
  CRISPR gRNA sequence
gtgattcctattacgacctg

SEQ ID NO: 627656 - DNA, 20 bp, Artificial
  CRISPR gRNA sequence
ctattacgacctgataaagt

SEQ ID NO: 627657 - DNA, 20 bp, Artificial
  CRISPR gRNA sequence
ttacgacctgataaagtaaa

SEQ ID NO: 627658 - DNA, 20 bp, Artificial
  CRISPR gRNA sequence
cgacctgataaagtaaaccc

SEQ ID NO: 627659 - DNA, 20 bp, Artificial
  CRISPR gRNA sequence
ataaagtaaacccaactaat

SEQ ID NO: 627660 - DNA, 20 bp, Artificial
  CRISPR gRNA sequence
atttcttggtattaactgtc

SEQ ID NO: 627661 - DNA, 20 bp, Artificial
  CRISPR gRNA sequence
cttggtattaactgtcattt

SEQ ID NO: 627662 - DNA, 20 bp, Artificial
  CRISPR gRNA sequence
ttggtattaactgtcattta

SEQ ID NO: 627663 - DNA, 20 bp, Artificial
  CRISPR gRNA sequence
ggtattaactgtcatttaaa

SEQ ID NO: 627664 - DNA, 20 bp, Artificial
  CRISPR gRNA sequence
gtattaactgtcatttaaat

SEQ ID NO: 627665 - DNA, 20 bp, Artificial
  CRISPR gRNA sequence
actgtcatttaaattctctg

SEQ ID NO: 627666 - DNA, 20 bp, Artificial
  CRISPR gRNA sequence
tcatttaaattctctgtatg

SEQ ID NO: 627667 - DNA, 20 bp, Artificial
  CRISPR gRNA sequence
aaattctctgtatgtttttg

SEQ ID NO: 627668 - DNA, 20 bp, Artificial
  CRISPR gRNA sequence
aattctctgtatgtttttgc

SEQ ID NO: 627669 - DNA, 20 bp, Artificial
  CRISPR gRNA sequence
tctgtatgtttttgcaatac

SEQ ID NO: 627670 - DNA, 20 bp, Artificial
  CRISPR gRNA sequence
tgtatgtttttgcaatacat

SEQ ID NO: 627671 - DNA, 20 bp, Artificial
  CRISPR gRNA sequence
tatgtttttgcaatacatct

SEQ ID NO: 627672 - DNA, 20 bp, Artificial
  CRISPR gRNA sequence
ttgcaatacatctgatcact

SEQ ID NO: 627673 - DNA, 20 bp, Artificial
  CRISPR gRNA sequence
tgcaatacatctgatcactc

SEQ ID NO: 627674 - DNA, 20 bp, Artificial
  CRISPR gRNA sequence
gcaatacatctgatcactcc

SEQ ID NO: 627675 - DNA, 20 bp, Artificial
  CRISPR gRNA sequence
caatacatctgatcactcca

SEQ ID NO: 627676 - DNA, 20 bp, Artificial
  CRISPR gRNA sequence
atcactccaactgctttttt

SEQ ID NO: 627677 - DNA, 20 bp, Artificial
  CRISPR gRNA sequence
caactgcttttttttccatg

SEQ ID NO: 627678 - DNA, 20 bp, Artificial
  CRISPR gRNA sequence
cttttttttccatgaattct

SEQ ID NO: 627679 - DNA, 20 bp, Artificial
  CRISPR gRNA sequence
ttttttccatgaattctctt

SEQ ID NO: 627680 - DNA, 20 bp, Artificial
  CRISPR gRNA sequence
tttttccatgaattctcttt

SEQ ID NO: 627681 - DNA, 20 bp, Artificial
  CRISPR gRNA sequence
ttttccatgaattctcttta

SEQ ID NO: 627682 - DNA, 20 bp, Artificial
  CRISPR gRNA sequence
tttccatgaattctctttaa

SEQ ID NO: 627683 - DNA, 20 bp, Artificial
  CRISPR gRNA sequence
ttccatgaattctctttaaa

SEQ ID NO: 627684 - DNA, 20 bp, Artificial
  CRISPR gRNA sequence
tccatgaattctctttaaaa

SEQ ID NO: 627685 - DNA, 20 bp, Artificial
  CRISPR gRNA sequence
ccatgaattctctttaaaag

SEQ ID NO: 627686 - DNA, 20 bp, Artificial
  CRISPR gRNA sequence
catgaattctctttaaaaga

SEQ ID NO: 627687 - DNA, 20 bp, Artificial
  CRISPR gRNA sequence
tctttaaaagaatgtgtgtg

SEQ ID NO: 627688 - DNA, 20 bp, Artificial
  CRISPR gRNA sequence
tttaaaagaatgtgtgtgta

SEQ ID NO: 627689 - DNA, 20 bp, Artificial
  CRISPR gRNA sequence
taaaagaatgtgtgtgtagt

SEQ ID NO: 627690 - DNA, 20 bp, Artificial
  CRISPR gRNA sequence
aaaagaatgtgtgtgtagta

SEQ ID NO: 627691 - DNA, 20 bp, Artificial
  CRISPR gRNA sequence
aaagaatgtgtgtgtagtat

SEQ ID NO: 627692 - DNA, 20 bp, Artificial
  CRISPR gRNA sequence
tgattcatacatacaattgc

SEQ ID NO: 627693 - DNA, 20 bp, Artificial
  CRISPR gRNA sequence
atacatacaattgcctgtat

SEQ ID NO: 627694 - DNA, 20 bp, Artificial
  CRISPR gRNA sequence
cctgtatgtatgtaggggag

SEQ ID NO: 627695 - DNA, 20 bp, Artificial
  CRISPR gRNA sequence
tatgtatgtaggggagatac

SEQ ID NO: 627696 - DNA, 20 bp, Artificial
  CRISPR gRNA sequence
tctactacgtagccaaatct

SEQ ID NO: 627697 - DNA, 20 bp, Artificial
  CRISPR gRNA sequence
ctactacgtagccaaatcta

SEQ ID NO: 627698 - DNA, 20 bp, Artificial
  CRISPR gRNA sequence
tactacgtagccaaatctaa

SEQ ID NO: 627699 - DNA, 20 bp, Artificial
  CRISPR gRNA sequence
ctacgtagccaaatctaagt

SEQ ID NO: 627700 - DNA, 20 bp, Artificial
  CRISPR gRNA sequence
cgtagccaaatctaagtcgt

SEQ ID NO: 627701 - DNA, 20 bp, Artificial
  CRISPR gRNA sequence
agtcgtagtttcttattttc

SEQ ID NO: 627702 - DNA, 20 bp, Artificial
  CRISPR gRNA sequence
cttattttcccaattttgtc

SEQ ID NO: 627703 - DNA, 20 bp, Artificial
  CRISPR gRNA sequence
ttattttcccaattttgtcc

SEQ ID NO: 627704 - DNA, 20 bp, Artificial
  CRISPR gRNA sequence
attttcccaattttgtccct

SEQ ID NO: 627705 - DNA, 20 bp, Artificial
  CRISPR gRNA sequence
ttttcccaattttgtccctt

SEQ ID NO: 627706 - DNA, 20 bp, Artificial
  CRISPR gRNA sequence
tcccaattttgtccctttag

SEQ ID NO: 627707 - DNA, 20 bp, Artificial
  CRISPR gRNA sequence
cccaattttgtccctttagg

SEQ ID NO: 627708 - DNA, 20 bp, Artificial
  CRISPR gRNA sequence
ccaattttgtccctttagga

SEQ ID NO: 627709 - DNA, 20 bp, Artificial
  CRISPR gRNA sequence
tgtccctttaggaaatctca

SEQ ID NO: 627710 - DNA, 20 bp, Artificial
  CRISPR gRNA sequence
gtccctttaggaaatctcaa

SEQ ID NO: 627711 - DNA, 20 bp, Artificial
  CRISPR gRNA sequence
tccctttaggaaatctcaat

SEQ ID NO: 627712 - DNA, 20 bp, Artificial
  CRISPR gRNA sequence
taggaaatctcaatggaata

SEQ ID NO: 627713 - DNA, 20 bp, Artificial
  CRISPR gRNA sequence
aggaaatctcaatggaatat

SEQ ID NO: 627714 - DNA, 20 bp, Artificial
  CRISPR gRNA sequence
ggaaatctcaatggaatatt

SEQ ID NO: 627715 - DNA, 20 bp, Artificial
  CRISPR gRNA sequence
aatggaatatttcaatgact

SEQ ID NO: 627716 - DNA, 20 bp, Artificial
  CRISPR gRNA sequence
caatgacttgaaatttcttc

SEQ ID NO: 627717 - DNA, 20 bp, Artificial
  CRISPR gRNA sequence
aatgacttgaaatttcttcc

SEQ ID NO: 627718 - DNA, 20 bp, Artificial
  CRISPR gRNA sequence
gaaatttcttccaatccgcc

SEQ ID NO: 627719 - DNA, 20 bp, Artificial
  CRISPR gRNA sequence
aaatttcttccaatccgcct

SEQ ID NO: 627720 - DNA, 20 bp, Artificial
  CRISPR gRNA sequence
cttccaatccgcctactgat

SEQ ID NO: 627721 - DNA, 20 bp, Artificial
  CRISPR gRNA sequence
ttccaatccgcctactgatc

SEQ ID NO: 627722 - DNA, 20 bp, Artificial
  CRISPR gRNA sequence
ccaatccgcctactgatccc

SEQ ID NO: 627723 - DNA, 20 bp, Artificial
  CRISPR gRNA sequence
caatccgcctactgatccct

SEQ ID NO: 627724 - DNA, 20 bp, Artificial
  CRISPR gRNA sequence
ctgatccctttccctgtctt

SEQ ID NO: 627725 - DNA, 20 bp, Artificial
  CRISPR gRNA sequence
atccctttccctgtcttaaa

SEQ ID NO: 627726 - DNA, 20 bp, Artificial
  CRISPR gRNA sequence
tccctgtcttaaaaaggtcc

SEQ ID NO: 627727 - DNA, 20 bp, Artificial
  CRISPR gRNA sequence
ccctgtcttaaaaaggtcca

SEQ ID NO: 627728 - DNA, 20 bp, Artificial
  CRISPR gRNA sequence
cctgtcttaaaaaggtccaa

SEQ ID NO: 627729 - DNA, 20 bp, Artificial
  CRISPR gRNA sequence
tcttaaaaaggtccaattag

SEQ ID NO: 627730 - DNA, 20 bp, Artificial
  CRISPR gRNA sequence
aaaaaggtccaattagaatg

SEQ ID NO: 627731 - DNA, 20 bp, Artificial
  CRISPR gRNA sequence
aaaaggtccaattagaatgg

SEQ ID NO: 627732 - DNA, 20 bp, Artificial
  CRISPR gRNA sequence
gaatggcttttgagcatgat

SEQ ID NO: 627733 - DNA, 20 bp, Artificial
  CRISPR gRNA sequence
ttgagcatgattcatcactg

SEQ ID NO: 627734 - DNA, 20 bp, Artificial
  CRISPR gRNA sequence
tgagcatgattcatcactgt

SEQ ID NO: 627735 - DNA, 20 bp, Artificial
  CRISPR gRNA sequence
gagcatgattcatcactgtc

SEQ ID NO: 627736 - DNA, 20 bp, Artificial
  CRISPR gRNA sequence
agcatgattcatcactgtca

SEQ ID NO: 627737 - DNA, 20 bp, Artificial
  CRISPR gRNA sequence
atcactgtcagagagaggct

SEQ ID NO: 627738 - DNA, 20 bp, Artificial
  CRISPR gRNA sequence
tcagagagaggctaagataa

SEQ ID NO: 627739 - DNA, 20 bp, Artificial
  CRISPR gRNA sequence
agataaaattctgggcaaaa

SEQ ID NO: 627740 - DNA, 20 bp, Artificial
  CRISPR gRNA sequence
tgggcaaaattagggcaaag

SEQ ID NO: 627741 - DNA, 20 bp, Artificial
  CRISPR gRNA sequence
ggcaaaattagggcaaagca

SEQ ID NO: 627742 - DNA, 20 bp, Artificial
  CRISPR gRNA sequence
gggcaaagcaatgtgatgaa

SEQ ID NO: 627743 - DNA, 20 bp, Artificial
  CRISPR gRNA sequence
tgaacttttgccaaactgga

SEQ ID NO: 627744 - DNA, 20 bp, Artificial
  CRISPR gRNA sequence
aacttttgccaaactggaaa

SEQ ID NO: 627745 - DNA, 20 bp, Artificial
  CRISPR gRNA sequence
ttgccaaactggaaaataca

SEQ ID NO: 627746 - DNA, 20 bp, Artificial
  CRISPR gRNA sequence
tgccaaactggaaaatacag

SEQ ID NO: 627747 - DNA, 20 bp, Artificial
  CRISPR gRNA sequence
gccaaactggaaaatacaga

SEQ ID NO: 627748 - DNA, 20 bp, Artificial
  CRISPR gRNA sequence
ccaaactggaaaatacagaa

SEQ ID NO: 627749 - DNA, 20 bp, Artificial
  CRISPR gRNA sequence
gaaaatacagaagataaccc

SEQ ID NO: 627750 - DNA, 20 bp, Artificial
  CRISPR gRNA sequence
tcatgctcctcaaatacttt

SEQ ID NO: 627751 - DNA, 20 bp, Artificial
  CRISPR gRNA sequence
catgctcctcaaatactttc

SEQ ID NO: 627752 - DNA, 20 bp, Artificial
  CRISPR gRNA sequence
atgctcctcaaatactttct

SEQ ID NO: 627753 - DNA, 20 bp, Artificial
  CRISPR gRNA sequence
ctcaaatactttctgtaatg

SEQ ID NO: 627754 - DNA, 20 bp, Artificial
  CRISPR gRNA sequence
aaatactttctgtaatgtga

SEQ ID NO: 627755 - DNA, 20 bp, Artificial
  CRISPR gRNA sequence
tctgtaatgtgaaatctcac

SEQ ID NO: 627756 - DNA, 20 bp, Artificial
  CRISPR gRNA sequence
ctgtaatgtgaaatctcacc

SEQ ID NO: 627757 - DNA, 20 bp, Artificial
  CRISPR gRNA sequence
tgtaatgtgaaatctcacct

SEQ ID NO: 627758 - DNA, 20 bp, Artificial
  CRISPR gRNA sequence
taatgtgaaatctcacctaa

SEQ ID NO: 627759 - DNA, 20 bp, Artificial
  CRISPR gRNA sequence
acctaaacaaactgggcata

SEQ ID NO: 627760 - DNA, 20 bp, Artificial
  CRISPR gRNA sequence
aacaaactgggcatacaact

SEQ ID NO: 627761 - DNA, 20 bp, Artificial
  CRISPR gRNA sequence
ggcatacaactgttatgtaa

SEQ ID NO: 627762 - DNA, 20 bp, Artificial
  CRISPR gRNA sequence
ttatgtaaaacttgatttat

SEQ ID NO: 627763 - DNA, 20 bp, Artificial
  CRISPR gRNA sequence
tgtaaaacttgatttatttg

SEQ ID NO: 627764 - DNA, 20 bp, Artificial
  CRISPR gRNA sequence
gatttatttggtgtctgact

SEQ ID NO: 627765 - DNA, 20 bp, Artificial
  CRISPR gRNA sequence
atttatttggtgtctgactc

SEQ ID NO: 627766 - DNA, 20 bp, Artificial
  CRISPR gRNA sequence
atttggtgtctgactcttat

SEQ ID NO: 627767 - DNA, 20 bp, Artificial
  CRISPR gRNA sequence
tttggtgtctgactcttatg

SEQ ID NO: 627768 - DNA, 20 bp, Artificial
  CRISPR gRNA sequence
ggtgtctgactcttatgttt

SEQ ID NO: 627769 - DNA, 20 bp, Artificial
  CRISPR gRNA sequence
gtgtctgactcttatgttta

SEQ ID NO: 627770 - DNA, 20 bp, Artificial
  CRISPR gRNA sequence
actcttatgtttatttttag

SEQ ID NO: 627771 - DNA, 20 bp, Artificial
  CRISPR gRNA sequence
ttatgtttatttttagatgc

SEQ ID NO: 627772 - DNA, 20 bp, Artificial
  CRISPR gRNA sequence
atgtttatttttagatgcta

SEQ ID NO: 627773 - DNA, 20 bp, Artificial
  CRISPR gRNA sequence
tgtttatttttagatgctac

SEQ ID NO: 627774 - DNA, 20 bp, Artificial
  CRISPR gRNA sequence
atttttagatgctacaacct

SEQ ID NO: 627775 - DNA, 20 bp, Artificial
  CRISPR gRNA sequence
tttttagatgctacaacctt

SEQ ID NO: 627776 - DNA, 20 bp, Artificial
  CRISPR gRNA sequence
ttagatgctacaaccttgcg

SEQ ID NO: 627777 - DNA, 20 bp, Artificial
  CRISPR gRNA sequence
tagatgctacaaccttgcgt

SEQ ID NO: 627778 - DNA, 20 bp, Artificial
  CRISPR gRNA sequence
agatgctacaaccttgcgta

SEQ ID NO: 627779 - DNA, 20 bp, Artificial
  CRISPR gRNA sequence
gatgctacaaccttgcgtat

SEQ ID NO: 627780 - DNA, 20 bp, Artificial
  CRISPR gRNA sequence
caaccttgcgtatttccttt

SEQ ID NO: 627781 - DNA, 20 bp, Artificial
  CRISPR gRNA sequence
gcgtatttccttttgaagaa

SEQ ID NO: 627782 - DNA, 20 bp, Artificial
  CRISPR gRNA sequence
cgtatttccttttgaagaaa

SEQ ID NO: 627783 - DNA, 20 bp, Artificial
  CRISPR gRNA sequence
ccttttgaagaaaaggcatg

SEQ ID NO: 627784 - DNA, 20 bp, Artificial
  CRISPR gRNA sequence
cttttgaagaaaaggcatgc

SEQ ID NO: 627785 - DNA, 20 bp, Artificial
  CRISPR gRNA sequence
ttgaagaaaaggcatgcaca

SEQ ID NO: 627786 - DNA, 20 bp, Artificial
  CRISPR gRNA sequence
tgaagaaaaggcatgcacat

SEQ ID NO: 627787 - DNA, 20 bp, Artificial
  CRISPR gRNA sequence
gaagaaaaggcatgcacata

SEQ ID NO: 627788 - DNA, 20 bp, Artificial
  CRISPR gRNA sequence
aagaaaaggcatgcacatat

SEQ ID NO: 627789 - DNA, 20 bp, Artificial
  CRISPR gRNA sequence
ctccaaaaacactacgtcca

SEQ ID NO: 627790 - DNA, 20 bp, Artificial
  CRISPR gRNA sequence
tccaaaaacactacgtccac

SEQ ID NO: 627791 - DNA, 20 bp, Artificial
  CRISPR gRNA sequence
caaaaacactacgtccacaa

SEQ ID NO: 627792 - DNA, 20 bp, Artificial
  CRISPR gRNA sequence
cgtccacaaaaattctttct

SEQ ID NO: 627793 - DNA, 20 bp, Artificial
  CRISPR gRNA sequence
tttctgacccacaaatttga

SEQ ID NO: 627794 - DNA, 20 bp, Artificial
  CRISPR gRNA sequence
tctgacccacaaatttgaat

SEQ ID NO: 627795 - DNA, 20 bp, Artificial
  CRISPR gRNA sequence
ctgacccacaaatttgaatt

SEQ ID NO: 627796 - DNA, 20 bp, Artificial
  CRISPR gRNA sequence
tgacccacaaatttgaattg

SEQ ID NO: 627797 - DNA, 20 bp, Artificial
  CRISPR gRNA sequence
acccacaaatttgaattgac

SEQ ID NO: 627798 - DNA, 20 bp, Artificial
  CRISPR gRNA sequence
gaattgactttgtcctcaat

SEQ ID NO: 627799 - DNA, 20 bp, Artificial
  CRISPR gRNA sequence
aattgactttgtcctcaatt

SEQ ID NO: 627800 - DNA, 20 bp, Artificial
  CRISPR gRNA sequence
actttgtcctcaattgtccc

SEQ ID NO: 627801 - DNA, 20 bp, Artificial
  CRISPR gRNA sequence
tgtcctcaattgtccctgcc

SEQ ID NO: 627802 - DNA, 20 bp, Artificial
  CRISPR gRNA sequence
gtcctcaattgtccctgcca

SEQ ID NO: 627803 - DNA, 20 bp, Artificial
  CRISPR gRNA sequence
tcctcaattgtccctgccac

SEQ ID NO: 627804 - DNA, 20 bp, Artificial
  CRISPR gRNA sequence
aattgtccctgccacaccct

SEQ ID NO: 627805 - DNA, 20 bp, Artificial
  CRISPR gRNA sequence
tccctgccacaccctgagcc

SEQ ID NO: 627806 - DNA, 20 bp, Artificial
  CRISPR gRNA sequence
ccacaccctgagccatatcc

SEQ ID NO: 627807 - DNA, 20 bp, Artificial
  CRISPR gRNA sequence
agccatatccacctctttct

SEQ ID NO: 627808 - DNA, 20 bp, Artificial
  CRISPR gRNA sequence
tttctgttcctcatgaagct

SEQ ID NO: 627809 - DNA, 20 bp, Artificial
  CRISPR gRNA sequence
tctgttcctcatgaagctag

SEQ ID NO: 627810 - DNA, 20 bp, Artificial
  CRISPR gRNA sequence
ctgttcctcatgaagctagg

SEQ ID NO: 627811 - DNA, 20 bp, Artificial
  CRISPR gRNA sequence
tgttcctcatgaagctagga

SEQ ID NO: 627812 - DNA, 20 bp, Artificial
  CRISPR gRNA sequence
ttcctcatgaagctaggaag

SEQ ID NO: 627813 - DNA, 20 bp, Artificial
  CRISPR gRNA sequence
ctcatgaagctaggaagata

SEQ ID NO: 627814 - DNA, 20 bp, Artificial
  CRISPR gRNA sequence
atgaagctaggaagatacaa

SEQ ID NO: 627815 - DNA, 20 bp, Artificial
  CRISPR gRNA sequence
ggaagatacaagtatatgct

SEQ ID NO: 627816 - DNA, 20 bp, Artificial
  CRISPR gRNA sequence
gtagcaaatgcactctcaac

SEQ ID NO: 627817 - DNA, 20 bp, Artificial
  CRISPR gRNA sequence
tagcaaatgcactctcaact

SEQ ID NO: 627818 - DNA, 20 bp, Artificial
  CRISPR gRNA sequence
tcaactactaactaccttca

SEQ ID NO: 627819 - DNA, 20 bp, Artificial
  CRISPR gRNA sequence
aactactaactaccttcaat

SEQ ID NO: 627820 - DNA, 20 bp, Artificial
  CRISPR gRNA sequence
ctaactaccttcaataaaac

SEQ ID NO: 627821 - DNA, 20 bp, Artificial
  CRISPR gRNA sequence
actaccttcaataaaacaga

SEQ ID NO: 627822 - DNA, 20 bp, Artificial
  CRISPR gRNA sequence
ccttcaataaaacagattcc

SEQ ID NO: 627823 - DNA, 20 bp, Artificial
  CRISPR gRNA sequence
caataaaacagattcccaaa

SEQ ID NO: 627824 - DNA, 20 bp, Artificial
  CRISPR gRNA sequence
aataaaacagattcccaaaa

SEQ ID NO: 627825 - DNA, 20 bp, Artificial
  CRISPR gRNA sequence
ccaaaaagatgaaatcagaa

SEQ ID NO: 627826 - DNA, 20 bp, Artificial
  CRISPR gRNA sequence
agcactgtcttcataaggtt

SEQ ID NO: 627827 - DNA, 20 bp, Artificial
  CRISPR gRNA sequence
tcttcataaggtttagggtc

SEQ ID NO: 627828 - DNA, 20 bp, Artificial
  CRISPR gRNA sequence
cataaggtttagggtccacc

SEQ ID NO: 627829 - DNA, 20 bp, Artificial
  CRISPR gRNA sequence
ataaggtttagggtccacct

SEQ ID NO: 627830 - DNA, 20 bp, Artificial
  CRISPR gRNA sequence
agggtccacctaaatttagt

SEQ ID NO: 627831 - DNA, 20 bp, Artificial
  CRISPR gRNA sequence
gggtccacctaaatttagtt

SEQ ID NO: 627832 - DNA, 20 bp, Artificial
  CRISPR gRNA sequence
aatttagtttcatcctgggg

SEQ ID NO: 627833 - DNA, 20 bp, Artificial
  CRISPR gRNA sequence
agtttcatcctggggcaggt

SEQ ID NO: 627834 - DNA, 20 bp, Artificial
  CRISPR gRNA sequence
gtttcatcctggggcaggta

SEQ ID NO: 627835 - DNA, 20 bp, Artificial
  CRISPR gRNA sequence
catcctggggcaggtagata

SEQ ID NO: 627836 - DNA, 20 bp, Artificial
  CRISPR gRNA sequence
atcctggggcaggtagatac

SEQ ID NO: 627837 - DNA, 20 bp, Artificial
  CRISPR gRNA sequence
gggcaggtagatacatgatt

SEQ ID NO: 627838 - DNA, 20 bp, Artificial
  CRISPR gRNA sequence
ttcatatactgaaaaaaaaa

SEQ ID NO: 627839 - DNA, 20 bp, Artificial
  CRISPR gRNA sequence
atatactgaaaaaaaaataa

SEQ ID NO: 627840 - DNA, 20 bp, Artificial
  CRISPR gRNA sequence
aaaaaaaaataagtaggaag

SEQ ID NO: 627841 - DNA, 20 bp, Artificial
  CRISPR gRNA sequence
atagataatgccagcagaaa

SEQ ID NO: 627842 - DNA, 20 bp, Artificial
  CRISPR gRNA sequence
gcacacagccaaaattatga

SEQ ID NO: 627843 - DNA, 20 bp, Artificial
  CRISPR gRNA sequence
tgaacatattgactgacatc

SEQ ID NO: 627844 - DNA, 20 bp, Artificial
  CRISPR gRNA sequence
actgacatccaaatgtttcc

SEQ ID NO: 627845 - DNA, 20 bp, Artificial
  CRISPR gRNA sequence
acatccaaatgtttccttaa

SEQ ID NO: 627846 - DNA, 20 bp, Artificial
  CRISPR gRNA sequence
ccttaaattgcagtaaaaga

SEQ ID NO: 627847 - DNA, 20 bp, Artificial
  CRISPR gRNA sequence
cttaaattgcagtaaaagac

SEQ ID NO: 627848 - DNA, 20 bp, Artificial
  CRISPR gRNA sequence
aaattgcagtaaaagacaaa

SEQ ID NO: 627849 - DNA, 20 bp, Artificial
  CRISPR gRNA sequence
aattgcagtaaaagacaaaa

SEQ ID NO: 627850 - DNA, 20 bp, Artificial
  CRISPR gRNA sequence
cagtaaaagacaaaattgtg

SEQ ID NO: 627851 - DNA, 20 bp, Artificial
  CRISPR gRNA sequence
tgaaccttaaaattatttac

SEQ ID NO: 627852 - DNA, 20 bp, Artificial
  CRISPR gRNA sequence
aaaattatttacctcatcca

SEQ ID NO: 627853 - DNA, 20 bp, Artificial
  CRISPR gRNA sequence
aaattatttacctcatccaa

SEQ ID NO: 627854 - DNA, 20 bp, Artificial
  CRISPR gRNA sequence
tttacctcatccaaaaggaa

SEQ ID NO: 627855 - DNA, 20 bp, Artificial
  CRISPR gRNA sequence
acctcatccaaaaggaaaaa

SEQ ID NO: 627856 - DNA, 20 bp, Artificial
  CRISPR gRNA sequence
cctcatccaaaaggaaaaaa

SEQ ID NO: 627857 - DNA, 20 bp, Artificial
  CRISPR gRNA sequence
atccaaaaggaaaaaaaatg

SEQ ID NO: 627858 - DNA, 20 bp, Artificial
  CRISPR gRNA sequence
ttatttgggagtggttgggt

SEQ ID NO: 627859 - DNA, 20 bp, Artificial
  CRISPR gRNA sequence
tttgggagtggttgggtggg

SEQ ID NO: 627860 - DNA, 20 bp, Artificial
  CRISPR gRNA sequence
gggagtggttgggtgggggg

SEQ ID NO: 627861 - DNA, 20 bp, Artificial
  CRISPR gRNA sequence
ggagtggttgggtggggggg

SEQ ID NO: 627862 - DNA, 20 bp, Artificial
  CRISPR gRNA sequence
ggtgggggggggtgagcgag

SEQ ID NO: 627863 - DNA, 20 bp, Artificial
  CRISPR gRNA sequence
aaaaacatgctttatcttta

SEQ ID NO: 627864 - DNA, 20 bp, Artificial
  CRISPR gRNA sequence
tatctttaaataggttgtat

SEQ ID NO: 627865 - DNA, 20 bp, Artificial
  CRISPR gRNA sequence
atctttaaataggttgtatg

SEQ ID NO: 627866 - DNA, 20 bp, Artificial
  CRISPR gRNA sequence
tctttaaataggttgtatgt

SEQ ID NO: 627867 - DNA, 20 bp, Artificial
  CRISPR gRNA sequence
taaataggttgtatgttcac

SEQ ID NO: 627868 - DNA, 20 bp, Artificial
  CRISPR gRNA sequence
aaataggttgtatgttcact

SEQ ID NO: 627869 - DNA, 20 bp, Artificial
  CRISPR gRNA sequence
aataggttgtatgttcacta

SEQ ID NO: 627870 - DNA, 20 bp, Artificial
  CRISPR gRNA sequence
tatgttcactatgtaccaag

SEQ ID NO: 627871 - DNA, 20 bp, Artificial
  CRISPR gRNA sequence
actatgtaccaaggcatgca

SEQ ID NO: 627872 - DNA, 20 bp, Artificial
  CRISPR gRNA sequence
tgtaccaaggcatgcagaaa

SEQ ID NO: 627873 - DNA, 20 bp, Artificial
  CRISPR gRNA sequence
acattctatatatctctgtt

SEQ ID NO: 627874 - DNA, 20 bp, Artificial
  CRISPR gRNA sequence
tatatatctctgttttggtg

SEQ ID NO: 627875 - DNA, 20 bp, Artificial
  CRISPR gRNA sequence
tatatctctgttttggtgca

SEQ ID NO: 627876 - DNA, 20 bp, Artificial
  CRISPR gRNA sequence
tgttttggtgcattccctta

SEQ ID NO: 627877 - DNA, 20 bp, Artificial
  CRISPR gRNA sequence
ttttggtgcattcccttaga

SEQ ID NO: 627878 - DNA, 20 bp, Artificial
  CRISPR gRNA sequence
tggtgcattcccttagattt

SEQ ID NO: 627879 - DNA, 20 bp, Artificial
  CRISPR gRNA sequence
ggtgcattcccttagattta

SEQ ID NO: 627880 - DNA, 20 bp, Artificial
  CRISPR gRNA sequence
gtgcattcccttagatttaa

SEQ ID NO: 627881 - DNA, 20 bp, Artificial
  CRISPR gRNA sequence
ccttagatttaaagggggca

SEQ ID NO: 627882 - DNA, 20 bp, Artificial
  CRISPR gRNA sequence
agatttaaagggggcagttt

SEQ ID NO: 627883 - DNA, 20 bp, Artificial
  CRISPR gRNA sequence
gatttaaagggggcagtttg

SEQ ID NO: 627884 - DNA, 20 bp, Artificial
  CRISPR gRNA sequence
aaagggggcagtttggacat

SEQ ID NO: 627885 - DNA, 20 bp, Artificial
  CRISPR gRNA sequence
aagggggcagtttggacatt

SEQ ID NO: 627886 - DNA, 20 bp, Artificial
  CRISPR gRNA sequence
ggacattttcccaaaaataa

SEQ ID NO: 627887 - DNA, 20 bp, Artificial
  CRISPR gRNA sequence
gacattttcccaaaaataat

SEQ ID NO: 627888 - DNA, 20 bp, Artificial
  CRISPR gRNA sequence
tcccaaaaataattatgaca

SEQ ID NO: 627889 - DNA, 20 bp, Artificial
  CRISPR gRNA sequence
cccaaaaataattatgacag

SEQ ID NO: 627890 - DNA, 20 bp, Artificial
  CRISPR gRNA sequence
ccaaaaataattatgacagg

SEQ ID NO: 627891 - DNA, 20 bp, Artificial
  CRISPR gRNA sequence
tgacagggactagtagaaga

SEQ ID NO: 627892 - DNA, 20 bp, Artificial
  CRISPR gRNA sequence
gtagaagagagctgagttct

SEQ ID NO: 627893 - DNA, 20 bp, Artificial
  CRISPR gRNA sequence
agttctaaccatttttgcct

SEQ ID NO: 627894 - DNA, 20 bp, Artificial
  CRISPR gRNA sequence
taaccatttttgcctagttc

SEQ ID NO: 627895 - DNA, 20 bp, Artificial
  CRISPR gRNA sequence
accatttttgcctagttcta

SEQ ID NO: 627896 - DNA, 20 bp, Artificial
  CRISPR gRNA sequence
ttgcctagttctagctgtgt

SEQ ID NO: 627897 - DNA, 20 bp, Artificial
  CRISPR gRNA sequence
tgcctagttctagctgtgtt

SEQ ID NO: 627898 - DNA, 20 bp, Artificial
  CRISPR gRNA sequence
gcctagttctagctgtgtta

SEQ ID NO: 627899 - DNA, 20 bp, Artificial
  CRISPR gRNA sequence
cctagttctagctgtgttag

SEQ ID NO: 627900 - DNA, 20 bp, Artificial
  CRISPR gRNA sequence
gttctagctgtgttagtgct

SEQ ID NO: 627901 - DNA, 20 bp, Artificial
  CRISPR gRNA sequence
tagctgtgttagtgcttaga

SEQ ID NO: 627902 - DNA, 20 bp, Artificial
  CRISPR gRNA sequence
gctgtgttagtgcttagaag

SEQ ID NO: 627903 - DNA, 20 bp, Artificial
  CRISPR gRNA sequence
tgttagtgcttagaagtgct

SEQ ID NO: 627904 - DNA, 20 bp, Artificial
  CRISPR gRNA sequence
gtgcttagaagtgcttagct

SEQ ID NO: 627905 - DNA, 20 bp, Artificial
  CRISPR gRNA sequence
agaagtgcttagctggtgcc

SEQ ID NO: 627906 - DNA, 20 bp, Artificial
  CRISPR gRNA sequence
gaagtgcttagctggtgcct

SEQ ID NO: 627907 - DNA, 20 bp, Artificial
  CRISPR gRNA sequence
agctggtgcctaccatttaa

SEQ ID NO: 627908 - DNA, 20 bp, Artificial
  CRISPR gRNA sequence
gctggtgcctaccatttaaa

SEQ ID NO: 627909 - DNA, 20 bp, Artificial
  CRISPR gRNA sequence
gtgcctaccatttaaatagc

SEQ ID NO: 627910 - DNA, 20 bp, Artificial
  CRISPR gRNA sequence
ccatttaaatagcaaatagt

SEQ ID NO: 627911 - DNA, 20 bp, Artificial
  CRISPR gRNA sequence
aaatagcaaatagtaagctg

SEQ ID NO: 627912 - DNA, 20 bp, Artificial
  CRISPR gRNA sequence
aatagcaaatagtaagctgg

SEQ ID NO: 627913 - DNA, 20 bp, Artificial
  CRISPR gRNA sequence
gaaaatgagttaagagcagt

SEQ ID NO: 627914 - DNA, 20 bp, Artificial
  CRISPR gRNA sequence
agagcagtattggggccaaa

SEQ ID NO: 627915 - DNA, 20 bp, Artificial
  CRISPR gRNA sequence
gggccaaacttgcttatgtc

SEQ ID NO: 627916 - DNA, 20 bp, Artificial
  CRISPR gRNA sequence
gcttatgtccacaattctct

SEQ ID NO: 627917 - DNA, 20 bp, Artificial
  CRISPR gRNA sequence
cttatgtccacaattctctt

SEQ ID NO: 627918 - DNA, 20 bp, Artificial
  CRISPR gRNA sequence
atgtccacaattctcttgac

SEQ ID NO: 627919 - DNA, 20 bp, Artificial
  CRISPR gRNA sequence
tgtccacaattctcttgact

SEQ ID NO: 627920 - DNA, 20 bp, Artificial
  CRISPR gRNA sequence
tcttgacttggtaattctca

SEQ ID NO: 627921 - DNA, 20 bp, Artificial
  CRISPR gRNA sequence
ttgacttggtaattctcata

SEQ ID NO: 627922 - DNA, 20 bp, Artificial
  CRISPR gRNA sequence
gacttggtaattctcatacc

SEQ ID NO: 627923 - DNA, 20 bp, Artificial
  CRISPR gRNA sequence
acttggtaattctcatacca

SEQ ID NO: 627924 - DNA, 20 bp, Artificial
  CRISPR gRNA sequence
ggtaattctcataccacact

SEQ ID NO: 627925 - DNA, 20 bp, Artificial
  CRISPR gRNA sequence
gtaattctcataccacactg

SEQ ID NO: 627926 - DNA, 20 bp, Artificial
  CRISPR gRNA sequence
tcataccacactgtattaag

SEQ ID NO: 627927 - DNA, 20 bp, Artificial
  CRISPR gRNA sequence
ataccacactgtattaagat

SEQ ID NO: 627928 - DNA, 20 bp, Artificial
  CRISPR gRNA sequence
tattaagatacataatttca

SEQ ID NO: 627929 - DNA, 20 bp, Artificial
  CRISPR gRNA sequence
agatacataatttcagcatc

SEQ ID NO: 627930 - DNA, 20 bp, Artificial
  CRISPR gRNA sequence
cagcatcctatttaatgatc

SEQ ID NO: 627931 - DNA, 20 bp, Artificial
  CRISPR gRNA sequence
agcatcctatttaatgatcc

SEQ ID NO: 627932 - DNA, 20 bp, Artificial
  CRISPR gRNA sequence
tttaatgatcctttagagca

SEQ ID NO: 627933 - DNA, 20 bp, Artificial
  CRISPR gRNA sequence
aatgatcctttagagcagtt

SEQ ID NO: 627934 - DNA, 20 bp, Artificial
  CRISPR gRNA sequence
atgatcctttagagcagtta

SEQ ID NO: 627935 - DNA, 20 bp, Artificial
  CRISPR gRNA sequence
tagagcagttatcagttact

SEQ ID NO: 627936 - DNA, 20 bp, Artificial
  CRISPR gRNA sequence
agagcagttatcagttactg

SEQ ID NO: 627937 - DNA, 20 bp, Artificial
  CRISPR gRNA sequence
gagcagttatcagttactgc

SEQ ID NO: 627938 - DNA, 20 bp, Artificial
  CRISPR gRNA sequence
tcagttactgcctaacagaa

SEQ ID NO: 627939 - DNA, 20 bp, Artificial
  CRISPR gRNA sequence
ctgcctaacagaatttcagt

SEQ ID NO: 627940 - DNA, 20 bp, Artificial
  CRISPR gRNA sequence
cctaacagaatttcagtatt

SEQ ID NO: 627941 - DNA, 20 bp, Artificial
  CRISPR gRNA sequence
acagaatttcagtattcaca

SEQ ID NO: 627942 - DNA, 20 bp, Artificial
  CRISPR gRNA sequence
cagtattcacaaatggttat

SEQ ID NO: 627943 - DNA, 20 bp, Artificial
  CRISPR gRNA sequence
agtattcacaaatggttatc

SEQ ID NO: 627944 - DNA, 20 bp, Artificial
  CRISPR gRNA sequence
acaaatggttatcagataat

SEQ ID NO: 627945 - DNA, 20 bp, Artificial
  CRISPR gRNA sequence
tcagataatccagtcacagt

SEQ ID NO: 627946 - DNA, 20 bp, Artificial
  CRISPR gRNA sequence
tcctccccaaacagaagcag

SEQ ID NO: 627947 - DNA, 20 bp, Artificial
  CRISPR gRNA sequence
cccaaacagaagcagcaagt

SEQ ID NO: 627948 - DNA, 20 bp, Artificial
  CRISPR gRNA sequence
tgccttccaagtatgtcccc

SEQ ID NO: 627949 - DNA, 20 bp, Artificial
  CRISPR gRNA sequence
ccttccaagtatgtccccct

SEQ ID NO: 627950 - DNA, 20 bp, Artificial
  CRISPR gRNA sequence
ccaagtatgtccccctaaaa

SEQ ID NO: 627951 - DNA, 20 bp, Artificial
  CRISPR gRNA sequence
caagtatgtccccctaaaat

SEQ ID NO: 627952 - DNA, 20 bp, Artificial
  CRISPR gRNA sequence
aaatgacttgaatcaatatc

SEQ ID NO: 627953 - DNA, 20 bp, Artificial
  CRISPR gRNA sequence
gaatcaatatcactcggttc

SEQ ID NO: 627954 - DNA, 20 bp, Artificial
  CRISPR gRNA sequence
aatcaatatcactcggttcc

SEQ ID NO: 627955 - DNA, 20 bp, Artificial
  CRISPR gRNA sequence
ggttcctcccctctaatgtg

SEQ ID NO: 627956 - DNA, 20 bp, Artificial
  CRISPR gRNA sequence
ctcccctctaatgtggctgg

SEQ ID NO: 627957 - DNA, 20 bp, Artificial
  CRISPR gRNA sequence
ccctctaatgtggctggact

SEQ ID NO: 627958 - DNA, 20 bp, Artificial
  CRISPR gRNA sequence
taatgtggctggactgcaaa

SEQ ID NO: 627959 - DNA, 20 bp, Artificial
  CRISPR gRNA sequence
atgtggctggactgcaaaga

SEQ ID NO: 627960 - DNA, 20 bp, Artificial
  CRISPR gRNA sequence
gactgcaaagaaaaaacaga

SEQ ID NO: 627961 - DNA, 20 bp, Artificial
  CRISPR gRNA sequence
caaagaaaaaacagagcgcc

SEQ ID NO: 627962 - DNA, 20 bp, Artificial
  CRISPR gRNA sequence
aaatctgcacatgaaatatg

SEQ ID NO: 627963 - DNA, 20 bp, Artificial
  CRISPR gRNA sequence
cacatgaaatatggcaacct

SEQ ID NO: 627964 - DNA, 20 bp, Artificial
  CRISPR gRNA sequence
taccatgtaaggggaattct

SEQ ID NO: 627965 - DNA, 20 bp, Artificial
  CRISPR gRNA sequence
tatactaagggattgagatt

SEQ ID NO: 627966 - DNA, 20 bp, Artificial
  CRISPR gRNA sequence
tactaagggattgagattca

SEQ ID NO: 627967 - DNA, 20 bp, Artificial
  CRISPR gRNA sequence
agggattgagattcatttct

SEQ ID NO: 627968 - DNA, 20 bp, Artificial
  CRISPR gRNA sequence
agattcatttctgacaagga

SEQ ID NO: 627969 - DNA, 20 bp, Artificial
  CRISPR gRNA sequence
atttctgacaaggacttaca

SEQ ID NO: 627970 - DNA, 20 bp, Artificial
  CRISPR gRNA sequence
ctgacaaggacttacacaat

SEQ ID NO: 627971 - DNA, 20 bp, Artificial
  CRISPR gRNA sequence
tgacaaggacttacacaatt

SEQ ID NO: 627972 - DNA, 20 bp, Artificial
  CRISPR gRNA sequence
acaaggacttacacaattaa

SEQ ID NO: 627973 - DNA, 20 bp, Artificial
  CRISPR gRNA sequence
acacaattaaatgttttgga

SEQ ID NO: 627974 - DNA, 20 bp, Artificial
  CRISPR gRNA sequence
cacaattaaatgttttggaa

SEQ ID NO: 627975 - DNA, 20 bp, Artificial
  CRISPR gRNA sequence
aatgttttggaaacagaaaa

SEQ ID NO: 627976 - DNA, 20 bp, Artificial
  CRISPR gRNA sequence
tggaaacagaaaaatgtgca

SEQ ID NO: 627977 - DNA, 20 bp, Artificial
  CRISPR gRNA sequence
ggaaacagaaaaatgtgcag

SEQ ID NO: 627978 - DNA, 20 bp, Artificial
  CRISPR gRNA sequence
gaaacagaaaaatgtgcagg

SEQ ID NO: 627979 - DNA, 20 bp, Artificial
  CRISPR gRNA sequence
tcctttgggggttctgtcac

SEQ ID NO: 627980 - DNA, 20 bp, Artificial
  CRISPR gRNA sequence
cctttgggggttctgtcaca

SEQ ID NO: 627981 - DNA, 20 bp, Artificial
  CRISPR gRNA sequence
ctttgggggttctgtcacat

SEQ ID NO: 627982 - DNA, 20 bp, Artificial
  CRISPR gRNA sequence
tgggggttctgtcacattct

SEQ ID NO: 627983 - DNA, 20 bp, Artificial
  CRISPR gRNA sequence
gggggttctgtcacattcta

SEQ ID NO: 627984 - DNA, 20 bp, Artificial
  CRISPR gRNA sequence
ggggttctgtcacattctag

SEQ ID NO: 627985 - DNA, 20 bp, Artificial
  CRISPR gRNA sequence
tgtcacattctagactccaa

SEQ ID NO: 627986 - DNA, 20 bp, Artificial
  CRISPR gRNA sequence
tcacattctagactccaaga

SEQ ID NO: 627987 - DNA, 20 bp, Artificial
  CRISPR gRNA sequence
tagactccaagaagggtaaa

SEQ ID NO: 627988 - DNA, 20 bp, Artificial
  CRISPR gRNA sequence
gactccaagaagggtaaaag

SEQ ID NO: 627989 - DNA, 20 bp, Artificial
  CRISPR gRNA sequence
caagaagggtaaaagtaaac

SEQ ID NO: 627990 - DNA, 20 bp, Artificial
  CRISPR gRNA sequence
tcttatttttttgtttcttt

SEQ ID NO: 627991 - DNA, 20 bp, Artificial
  CRISPR gRNA sequence
cttatttttttgtttctttt

SEQ ID NO: 627992 - DNA, 20 bp, Artificial
  CRISPR gRNA sequence
ttatttttttgtttctttta

SEQ ID NO: 627993 - DNA, 20 bp, Artificial
  CRISPR gRNA sequence
atttttttgtttcttttatc

SEQ ID NO: 627994 - DNA, 20 bp, Artificial
  CRISPR gRNA sequence
tttttttgtttcttttatct

SEQ ID NO: 627995 - DNA, 20 bp, Artificial
  CRISPR gRNA sequence
ttttgtttcttttatctgtt

SEQ ID NO: 627996 - DNA, 20 bp, Artificial
  CRISPR gRNA sequence
tttgtttcttttatctgttg

SEQ ID NO: 627997 - DNA, 20 bp, Artificial
  CRISPR gRNA sequence
ttgtttcttttatctgttgt

SEQ ID NO: 627998 - DNA, 20 bp, Artificial
  CRISPR gRNA sequence
tgtttcttttatctgttgtc

SEQ ID NO: 627999 - DNA, 20 bp, Artificial
  CRISPR gRNA sequence
gtttcttttatctgttgtcc

SEQ ID NO: 628000 - DNA, 20 bp, Artificial
  CRISPR gRNA sequence
tttcttttatctgttgtcca

SEQ ID NO: 628001 - DNA, 20 bp, Artificial
  CRISPR gRNA sequence
cttttatctgttgtccaagg

SEQ ID NO: 628002 - DNA, 20 bp, Artificial
  CRISPR gRNA sequence
ttttatctgttgtccaaggt

SEQ ID NO: 628003 - DNA, 20 bp, Artificial
  CRISPR gRNA sequence
ttatctgttgtccaaggtac

SEQ ID NO: 628004 - DNA, 20 bp, Artificial
  CRISPR gRNA sequence
tatctgttgtccaaggtaca

SEQ ID NO: 628005 - DNA, 20 bp, Artificial
  CRISPR gRNA sequence
atctgttgtccaaggtacag

SEQ ID NO: 628006 - DNA, 20 bp, Artificial
  CRISPR gRNA sequence
tctgttgtccaaggtacagg

SEQ ID NO: 628007 - DNA, 20 bp, Artificial
  CRISPR gRNA sequence
ttgtccaaggtacaggttac

SEQ ID NO: 628008 - DNA, 20 bp, Artificial
  CRISPR gRNA sequence
tccaaggtacaggttacaaa

SEQ ID NO: 628009 - DNA, 20 bp, Artificial
  CRISPR gRNA sequence
caaagaagtcccattccctt

SEQ ID NO: 628010 - DNA, 20 bp, Artificial
  CRISPR gRNA sequence
ccttttctttgcaacaagag

SEQ ID NO: 628011 - DNA, 20 bp, Artificial
  CRISPR gRNA sequence
ttctttgcaacaagagtagt

SEQ ID NO: 628012 - DNA, 20 bp, Artificial
  CRISPR gRNA sequence
tctttgcaacaagagtagta

SEQ ID NO: 628013 - DNA, 20 bp, Artificial
  CRISPR gRNA sequence
ctttgcaacaagagtagtaa

SEQ ID NO: 628014 - DNA, 20 bp, Artificial
  CRISPR gRNA sequence
tttgcaacaagagtagtaaa

SEQ ID NO: 628015 - DNA, 20 bp, Artificial
  CRISPR gRNA sequence
tgcaacaagagtagtaaata

SEQ ID NO: 628016 - DNA, 20 bp, Artificial
  CRISPR gRNA sequence
gcaacaagagtagtaaatac

SEQ ID NO: 628017 - DNA, 20 bp, Artificial
  CRISPR gRNA sequence
caacaagagtagtaaatact

SEQ ID NO: 628018 - DNA, 20 bp, Artificial
  CRISPR gRNA sequence
ctgaagaaatgctaaaataa

SEQ ID NO: 628019 - DNA, 20 bp, Artificial
  CRISPR gRNA sequence
aagaaatgctaaaataaata

SEQ ID NO: 628020 - DNA, 20 bp, Artificial
  CRISPR gRNA sequence
aaataaatagccctagttct

SEQ ID NO: 628021 - DNA, 20 bp, Artificial
  CRISPR gRNA sequence
gttctgtaaccttacagggt

SEQ ID NO: 628022 - DNA, 20 bp, Artificial
  CRISPR gRNA sequence
tgtaaccttacagggttcaa

SEQ ID NO: 628023 - DNA, 20 bp, Artificial
  CRISPR gRNA sequence
taaccttacagggttcaagt

SEQ ID NO: 628024 - DNA, 20 bp, Artificial
  CRISPR gRNA sequence
acagggttcaagttaccaga

SEQ ID NO: 628025 - DNA, 20 bp, Artificial
  CRISPR gRNA sequence
cagggttcaagttaccagat

SEQ ID NO: 628026 - DNA, 20 bp, Artificial
  CRISPR gRNA sequence
aagttaccagattcaggcca

SEQ ID NO: 628027 - DNA, 20 bp, Artificial
  CRISPR gRNA sequence
ccagattcaggccaaattag

SEQ ID NO: 628028 - DNA, 20 bp, Artificial
  CRISPR gRNA sequence
aggccaaattagcaattgct

SEQ ID NO: 628029 - DNA, 20 bp, Artificial
  CRISPR gRNA sequence
gcaattgctctgaggagatt

SEQ ID NO: 628030 - DNA, 20 bp, Artificial
  CRISPR gRNA sequence
ctctgaggagattttgaaag

SEQ ID NO: 628031 - DNA, 20 bp, Artificial
  CRISPR gRNA sequence
tgaggagattttgaaagaaa

SEQ ID NO: 628032 - DNA, 20 bp, Artificial
  CRISPR gRNA sequence
aggagattttgaaagaaaca

SEQ ID NO: 628033 - DNA, 20 bp, Artificial
  CRISPR gRNA sequence
tgaaagaaacagccgacagg

SEQ ID NO: 628034 - DNA, 20 bp, Artificial
  CRISPR gRNA sequence
gaaagaaacagccgacagga

SEQ ID NO: 628035 - DNA, 20 bp, Artificial
  CRISPR gRNA sequence
aaagaaacagccgacaggaa

SEQ ID NO: 628036 - DNA, 20 bp, Artificial
  CRISPR gRNA sequence
ttaagaccttctactcgaag

SEQ ID NO: 628037 - DNA, 20 bp, Artificial
  CRISPR gRNA sequence
taagaccttctactcgaaga

SEQ ID NO: 628038 - DNA, 20 bp, Artificial
  CRISPR gRNA sequence
aagaccttctactcgaagag

SEQ ID NO: 628039 - DNA, 20 bp, Artificial
  CRISPR gRNA sequence
agaccttctactcgaagagt

SEQ ID NO: 628040 - DNA, 20 bp, Artificial
  CRISPR gRNA sequence
ctactcgaagagtaaaggat

SEQ ID NO: 628041 - DNA, 20 bp, Artificial
  CRISPR gRNA sequence
tactcgaagagtaaaggatg

SEQ ID NO: 628042 - DNA, 20 bp, Artificial
  CRISPR gRNA sequence
ctcgaagagtaaaggatgaa

SEQ ID NO: 628043 - DNA, 20 bp, Artificial
  CRISPR gRNA sequence
gaagagtaaaggatgaatga

SEQ ID NO: 628044 - DNA, 20 bp, Artificial
  CRISPR gRNA sequence
tggacagaacaccgggaggt

SEQ ID NO: 628045 - DNA, 20 bp, Artificial
  CRISPR gRNA sequence
gaaaaaaactagtgaaaaga

SEQ ID NO: 628046 - DNA, 20 bp, Artificial
  CRISPR gRNA sequence
aaaaaaactagtgaaaagag

SEQ ID NO: 628047 - DNA, 20 bp, Artificial
  CRISPR gRNA sequence
gtgaaaagagaaataccaga

SEQ ID NO: 628048 - DNA, 20 bp, Artificial
  CRISPR gRNA sequence
ctaagtgggttttctccccc

SEQ ID NO: 628049 - DNA, 20 bp, Artificial
  CRISPR gRNA sequence
taagtgggttttctccccct

SEQ ID NO: 628050 - DNA, 20 bp, Artificial
  CRISPR gRNA sequence
agtgggttttctccccctac

SEQ ID NO: 628051 - DNA, 20 bp, Artificial
  CRISPR gRNA sequence
tctccccctactgttagcat

SEQ ID NO: 628052 - DNA, 20 bp, Artificial
  CRISPR gRNA sequence
ctccccctactgttagcata

SEQ ID NO: 628053 - DNA, 20 bp, Artificial
  CRISPR gRNA sequence
tccccctactgttagcataa

SEQ ID NO: 628054 - DNA, 20 bp, Artificial
  CRISPR gRNA sequence
cccctactgttagcataatt

SEQ ID NO: 628055 - DNA, 20 bp, Artificial
  CRISPR gRNA sequence
ctgttagcataattatattt

SEQ ID NO: 628056 - DNA, 20 bp, Artificial
  CRISPR gRNA sequence
ttagcataattatatttttc

SEQ ID NO: 628057 - DNA, 20 bp, Artificial
  CRISPR gRNA sequence
gcataattatatttttctgc

SEQ ID NO: 628058 - DNA, 20 bp, Artificial
  CRISPR gRNA sequence
tatttttctgctgactggtt

SEQ ID NO: 628059 - DNA, 20 bp, Artificial
  CRISPR gRNA sequence
ttctgctgactggttaacac

SEQ ID NO: 628060 - DNA, 20 bp, Artificial
  CRISPR gRNA sequence
tctgctgactggttaacact

SEQ ID NO: 628061 - DNA, 20 bp, Artificial
  CRISPR gRNA sequence
ctgctgactggttaacactg

SEQ ID NO: 628062 - DNA, 20 bp, Artificial
  CRISPR gRNA sequence
tgctgactggttaacactga

SEQ ID NO: 628063 - DNA, 20 bp, Artificial
  CRISPR gRNA sequence
ctgactggttaacactgatt

SEQ ID NO: 628064 - DNA, 20 bp, Artificial
  CRISPR gRNA sequence
actggttaacactgattaaa

SEQ ID NO: 628065 - DNA, 20 bp, Artificial
  CRISPR gRNA sequence
gttaacactgattaaatgct

SEQ ID NO: 628066 - DNA, 20 bp, Artificial
  CRISPR gRNA sequence
acactgattaaatgctgata

SEQ ID NO: 628067 - DNA, 20 bp, Artificial
  CRISPR gRNA sequence
attaaatgctgataaagtga

SEQ ID NO: 628068 - DNA, 20 bp, Artificial
  CRISPR gRNA sequence
aatgctgataaagtgacaat

SEQ ID NO: 628069 - DNA, 20 bp, Artificial
  CRISPR gRNA sequence
ataaagtgacaatcgtaagc

SEQ ID NO: 628070 - DNA, 20 bp, Artificial
  CRISPR gRNA sequence
ttagaaacaaatacatatac

SEQ ID NO: 628071 - DNA, 20 bp, Artificial
  CRISPR gRNA sequence
tagaaacaaatacatatact

SEQ ID NO: 628072 - DNA, 20 bp, Artificial
  CRISPR gRNA sequence
agaaacaaatacatatacta

SEQ ID NO: 628073 - DNA, 20 bp, Artificial
  CRISPR gRNA sequence
gaaacaaatacatatactat

SEQ ID NO: 628074 - DNA, 20 bp, Artificial
  CRISPR gRNA sequence
tgctgccatcacattacaac

SEQ ID NO: 628075 - DNA, 20 bp, Artificial
  CRISPR gRNA sequence
ccatcacattacaactttaa

SEQ ID NO: 628076 - DNA, 20 bp, Artificial
  CRISPR gRNA sequence
caactttaaaagaaaacctc

SEQ ID NO: 628077 - DNA, 20 bp, Artificial
  CRISPR gRNA sequence
taaaagaaaacctctcaaac

SEQ ID NO: 628078 - DNA, 20 bp, Artificial
  CRISPR gRNA sequence
aaaagaaaacctctcaaaca

SEQ ID NO: 628079 - DNA, 20 bp, Artificial
  CRISPR gRNA sequence
aaagaaaacctctcaaacaa

SEQ ID NO: 628080 - DNA, 20 bp, Artificial
  CRISPR gRNA sequence
tcaaacaaatttatgaaagt

SEQ ID NO: 628081 - DNA, 20 bp, Artificial
  CRISPR gRNA sequence
aaacaaatttatgaaagtag

SEQ ID NO: 628082 - DNA, 20 bp, Artificial
  CRISPR gRNA sequence
atgaaagtagaagtccctcc

SEQ ID NO: 628083 - DNA, 20 bp, Artificial
  CRISPR gRNA sequence
tgaaagtagaagtccctccc

SEQ ID NO: 628084 - DNA, 20 bp, Artificial
  CRISPR gRNA sequence
ccagaaattattgactgcct

SEQ ID NO: 628085 - DNA, 20 bp, Artificial
  CRISPR gRNA sequence
ttgactgccttttatccact

SEQ ID NO: 628086 - DNA, 20 bp, Artificial
  CRISPR gRNA sequence
actgccttttatccactctt

SEQ ID NO: 628087 - DNA, 20 bp, Artificial
  CRISPR gRNA sequence
ccttttatccactcttagac

SEQ ID NO: 628088 - DNA, 20 bp, Artificial
  CRISPR gRNA sequence
ttatccactcttagaccata

SEQ ID NO: 628089 - DNA, 20 bp, Artificial
  CRISPR gRNA sequence
tatccactcttagaccatat

SEQ ID NO: 628090 - DNA, 20 bp, Artificial
  CRISPR gRNA sequence
atccactcttagaccatatg

SEQ ID NO: 628091 - DNA, 20 bp, Artificial
  CRISPR gRNA sequence
tccactcttagaccatatgt

SEQ ID NO: 628092 - DNA, 20 bp, Artificial
  CRISPR gRNA sequence
ttagaccatatgttattctg

SEQ ID NO: 628093 - DNA, 20 bp, Artificial
  CRISPR gRNA sequence
agaccatatgttattctgaa

SEQ ID NO: 628094 - DNA, 20 bp, Artificial
  CRISPR gRNA sequence
gaccatatgttattctgaaa

SEQ ID NO: 628095 - DNA, 20 bp, Artificial
  CRISPR gRNA sequence
ttctgaaaactacataaaaa

SEQ ID NO: 628096 - DNA, 20 bp, Artificial
  CRISPR gRNA sequence
tgaaaactacataaaaatac

SEQ ID NO: 628097 - DNA, 20 bp, Artificial
  CRISPR gRNA sequence
aaaactacataaaaatacta

SEQ ID NO: 628098 - DNA, 20 bp, Artificial
  CRISPR gRNA sequence
cataaaaatactattcctta

SEQ ID NO: 628099 - DNA, 20 bp, Artificial
  CRISPR gRNA sequence
ttccttaaaggtgttaaaag

SEQ ID NO: 628100 - DNA, 20 bp, Artificial
  CRISPR gRNA sequence
cttaaaggtgttaaaagtaa

SEQ ID NO: 628101 - DNA, 20 bp, Artificial
  CRISPR gRNA sequence
aaaggtgttaaaagtaaggc

SEQ ID NO: 628102 - DNA, 20 bp, Artificial
  CRISPR gRNA sequence
aaggtgttaaaagtaaggct

SEQ ID NO: 628103 - DNA, 20 bp, Artificial
  CRISPR gRNA sequence
aaagtaaggctgccagggtg

SEQ ID NO: 628104 - DNA, 20 bp, Artificial
  CRISPR gRNA sequence
ccagggtgtctataaaatgc

SEQ ID NO: 628105 - DNA, 20 bp, Artificial
  CRISPR gRNA sequence
taaaatgccagtcatcaaaa

SEQ ID NO: 628106 - DNA, 20 bp, Artificial
  CRISPR gRNA sequence
tggaaaaacagtgcttacgt

SEQ ID NO: 628107 - DNA, 20 bp, Artificial
  CRISPR gRNA sequence
acgtttagaaaaataagatc

SEQ ID NO: 628108 - DNA, 20 bp, Artificial
  CRISPR gRNA sequence
cgtttagaaaaataagatca

SEQ ID NO: 628109 - DNA, 20 bp, Artificial
  CRISPR gRNA sequence
agaaaaataagatcacagga

SEQ ID NO: 628110 - DNA, 20 bp, Artificial
  CRISPR gRNA sequence
gaaaaataagatcacaggac

SEQ ID NO: 628111 - DNA, 20 bp, Artificial
  CRISPR gRNA sequence
agatgtattgtaggtggccc

SEQ ID NO: 628112 - DNA, 20 bp, Artificial
  CRISPR gRNA sequence
taggtggcccttaactacct

SEQ ID NO: 628113 - DNA, 20 bp, Artificial
  CRISPR gRNA sequence
aactacctgtagtttaaaag

SEQ ID NO: 628114 - DNA, 20 bp, Artificial
  CRISPR gRNA sequence
actacctgtagtttaaaagt

SEQ ID NO: 628115 - DNA, 20 bp, Artificial
  CRISPR gRNA sequence
cctgtagtttaaaagttttg

SEQ ID NO: 628116 - DNA, 20 bp, Artificial
  CRISPR gRNA sequence
tagtttaaaagttttgctat

SEQ ID NO: 628117 - DNA, 20 bp, Artificial
  CRISPR gRNA sequence
aaaagttttgctatatggta

SEQ ID NO: 628118 - DNA, 20 bp, Artificial
  CRISPR gRNA sequence
aaagttttgctatatggtac

SEQ ID NO: 628119 - DNA, 20 bp, Artificial
  CRISPR gRNA sequence
tgctatatggtacagtgtaa

SEQ ID NO: 628120 - DNA, 20 bp, Artificial
  CRISPR gRNA sequence
gctatatggtacagtgtaaa

SEQ ID NO: 628121 - DNA, 20 bp, Artificial
  CRISPR gRNA sequence
ctatatggtacagtgtaaaa

SEQ ID NO: 628122 - DNA, 20 bp, Artificial
  CRISPR gRNA sequence
tatggtacagtgtaaaacat

SEQ ID NO: 628123 - DNA, 20 bp, Artificial
  CRISPR gRNA sequence
aattataaattccatagggg

SEQ ID NO: 628124 - DNA, 20 bp, Artificial
  CRISPR gRNA sequence
taaattccataggggaagta

SEQ ID NO: 628125 - DNA, 20 bp, Artificial
  CRISPR gRNA sequence
cataggggaagtaaacatag

SEQ ID NO: 628126 - DNA, 20 bp, Artificial
  CRISPR gRNA sequence
agctcctcttaggagttatc

SEQ ID NO: 628127 - DNA, 20 bp, Artificial
  CRISPR gRNA sequence
ctcttaggagttatcactga

SEQ ID NO: 628128 - DNA, 20 bp, Artificial
  CRISPR gRNA sequence
ttaggagttatcactgaaaa

SEQ ID NO: 628129 - DNA, 20 bp, Artificial
  CRISPR gRNA sequence
aggagttatcactgaaaata

SEQ ID NO: 628130 - DNA, 20 bp, Artificial
  CRISPR gRNA sequence
ggagttatcactgaaaataa

SEQ ID NO: 628131 - DNA, 20 bp, Artificial
  CRISPR gRNA sequence
tcactgaaaataacaatgtg

SEQ ID NO: 628132 - DNA, 20 bp, Artificial
  CRISPR gRNA sequence
aaaataacaatgtgtttgtg

SEQ ID NO: 628133 - DNA, 20 bp, Artificial
  CRISPR gRNA sequence
gtgttccatgatctctgaag

SEQ ID NO: 628134 - DNA, 20 bp, Artificial
  CRISPR gRNA sequence
tgttccatgatctctgaaga

SEQ ID NO: 628135 - DNA, 20 bp, Artificial
  CRISPR gRNA sequence
catgatctctgaagaacaaa

SEQ ID NO: 628136 - DNA, 20 bp, Artificial
  CRISPR gRNA sequence
tgaagaacaaaaaattggtt

SEQ ID NO: 628137 - DNA, 20 bp, Artificial
  CRISPR gRNA sequence
aagaacaaaaaattggttta

SEQ ID NO: 628138 - DNA, 20 bp, Artificial
  CRISPR gRNA sequence
gtttacagtttgaaacacat

SEQ ID NO: 628139 - DNA, 20 bp, Artificial
  CRISPR gRNA sequence
acagtttgaaacacattctt

SEQ ID NO: 628140 - DNA, 20 bp, Artificial
  CRISPR gRNA sequence
cagtttgaaacacattcttc

SEQ ID NO: 628141 - DNA, 20 bp, Artificial
  CRISPR gRNA sequence
gaaacacattcttctttcaa

SEQ ID NO: 628142 - DNA, 20 bp, Artificial
  CRISPR gRNA sequence
aaacacattcttctttcaag

SEQ ID NO: 628143 - DNA, 20 bp, Artificial
  CRISPR gRNA sequence
ttctttcaagaataaagtta

SEQ ID NO: 628144 - DNA, 20 bp, Artificial
  CRISPR gRNA sequence
ctttcaagaataaagttact

SEQ ID NO: 628145 - DNA, 20 bp, Artificial
  CRISPR gRNA sequence
tttcaagaataaagttactt

SEQ ID NO: 628146 - DNA, 20 bp, Artificial
  CRISPR gRNA sequence
tcaagaataaagttacttat

SEQ ID NO: 628147 - DNA, 20 bp, Artificial
  CRISPR gRNA sequence
caagaataaagttacttata

SEQ ID NO: 628148 - DNA, 20 bp, Artificial
  CRISPR gRNA sequence
aagaataaagttacttatac

SEQ ID NO: 628149 - DNA, 20 bp, Artificial
  CRISPR gRNA sequence
cttataccatttttaaacca

SEQ ID NO: 628150 - DNA, 20 bp, Artificial
  CRISPR gRNA sequence
ataccatttttaaaccacca

SEQ ID NO: 628151 - DNA, 20 bp, Artificial
  CRISPR gRNA sequence
taccatttttaaaccaccaa

SEQ ID NO: 628152 - DNA, 20 bp, Artificial
  CRISPR gRNA sequence
ttaaaccaccaaagtcctac

SEQ ID NO: 628153 - DNA, 20 bp, Artificial
  CRISPR gRNA sequence
taaaccaccaaagtcctacc

SEQ ID NO: 628154 - DNA, 20 bp, Artificial
  CRISPR gRNA sequence
aaaccaccaaagtcctaccc

SEQ ID NO: 628155 - DNA, 20 bp, Artificial
  CRISPR gRNA sequence
aaccaccaaagtcctaccca

SEQ ID NO: 628156 - DNA, 20 bp, Artificial
  CRISPR gRNA sequence
cccagaaaactctgaacttt

SEQ ID NO: 628157 - DNA, 20 bp, Artificial
  CRISPR gRNA sequence
tgaactttcctgtcttccat

SEQ ID NO: 628158 - DNA, 20 bp, Artificial
  CRISPR gRNA sequence
aactttcctgtcttccatca

SEQ ID NO: 628159 - DNA, 20 bp, Artificial
  CRISPR gRNA sequence
tcctgtcttccatcataatt

SEQ ID NO: 628160 - DNA, 20 bp, Artificial
  CRISPR gRNA sequence
cctgtcttccatcataattc

SEQ ID NO: 628161 - DNA, 20 bp, Artificial
  CRISPR gRNA sequence
ctgtcttccatcataattct

SEQ ID NO: 628162 - DNA, 20 bp, Artificial
  CRISPR gRNA sequence
tcttccatcataattctgaa

SEQ ID NO: 628163 - DNA, 20 bp, Artificial
  CRISPR gRNA sequence
ccatcataattctgaatatc

SEQ ID NO: 628164 - DNA, 20 bp, Artificial
  CRISPR gRNA sequence
catcataattctgaatatca

SEQ ID NO: 628165 - DNA, 20 bp, Artificial
  CRISPR gRNA sequence
tgaatatcagtggcaaatca

SEQ ID NO: 628166 - DNA, 20 bp, Artificial
  CRISPR gRNA sequence
aatatcagtggcaaatcaga

SEQ ID NO: 628167 - DNA, 20 bp, Artificial
  CRISPR gRNA sequence
ttaggtgaatctttatgaat

SEQ ID NO: 628168 - DNA, 20 bp, Artificial
  CRISPR gRNA sequence
aggtgaatctttatgaatca

SEQ ID NO: 628169 - DNA, 20 bp, Artificial
  CRISPR gRNA sequence
ggtgaatctttatgaatcaa

SEQ ID NO: 628170 - DNA, 20 bp, Artificial
  CRISPR gRNA sequence
tatgaatcaagtgatttttc

SEQ ID NO: 628171 - DNA, 20 bp, Artificial
  CRISPR gRNA sequence
atgaatcaagtgatttttca

SEQ ID NO: 628172 - DNA, 20 bp, Artificial
  CRISPR gRNA sequence
tgaatcaagtgatttttcaa

SEQ ID NO: 628173 - DNA, 20 bp, Artificial
  CRISPR gRNA sequence
ttcaaagcatgatatgcctt

SEQ ID NO: 628174 - DNA, 20 bp, Artificial
  CRISPR gRNA sequence
tcaaagcatgatatgccttg

SEQ ID NO: 628175 - DNA, 20 bp, Artificial
  CRISPR gRNA sequence
caaagcatgatatgccttgg

SEQ ID NO: 628176 - DNA, 20 bp, Artificial
  CRISPR gRNA sequence
aaagcatgatatgccttggt

SEQ ID NO: 628177 - DNA, 20 bp, Artificial
  CRISPR gRNA sequence
ggtagaaatggactgctctt

SEQ ID NO: 628178 - DNA, 20 bp, Artificial
  CRISPR gRNA sequence
gtagaaatggactgctctta

SEQ ID NO: 628179 - DNA, 20 bp, Artificial
  CRISPR gRNA sequence
ctcttaaattcccacaaaat

SEQ ID NO: 628180 - DNA, 20 bp, Artificial
  CRISPR gRNA sequence
ttaaattcccacaaaataaa

SEQ ID NO: 628181 - DNA, 20 bp, Artificial
  CRISPR gRNA sequence
aaattcccacaaaataaaca

SEQ ID NO: 628182 - DNA, 20 bp, Artificial
  CRISPR gRNA sequence
aattcccacaaaataaacaa

SEQ ID NO: 628183 - DNA, 20 bp, Artificial
  CRISPR gRNA sequence
ccacaaaataaacaagccag

SEQ ID NO: 628184 - DNA, 20 bp, Artificial
  CRISPR gRNA sequence
ccgccccttctctcttctgt

SEQ ID NO: 628185 - DNA, 20 bp, Artificial
  CRISPR gRNA sequence
ctctcttctgtttcttcctt

SEQ ID NO: 628186 - DNA, 20 bp, Artificial
  CRISPR gRNA sequence
tctcttctgtttcttcctta

SEQ ID NO: 628187 - DNA, 20 bp, Artificial
  CRISPR gRNA sequence
tcttctgtttcttccttatc

SEQ ID NO: 628188 - DNA, 20 bp, Artificial
  CRISPR gRNA sequence
ttctgtttcttccttatcgt

SEQ ID NO: 628189 - DNA, 20 bp, Artificial
  CRISPR gRNA sequence
ctgtttcttccttatcgtaa

SEQ ID NO: 628190 - DNA, 20 bp, Artificial
  CRISPR gRNA sequence
tgtttcttccttatcgtaat

SEQ ID NO: 628191 - DNA, 20 bp, Artificial
  CRISPR gRNA sequence
tttcttccttatcgtaatta

SEQ ID NO: 628192 - DNA, 20 bp, Artificial
  CRISPR gRNA sequence
cttccttatcgtaattaggc

SEQ ID NO: 628193 - DNA, 20 bp, Artificial
  CRISPR gRNA sequence
ttccttatcgtaattaggca

SEQ ID NO: 628194 - DNA, 20 bp, Artificial
  CRISPR gRNA sequence
ccttatcgtaattaggcaga

SEQ ID NO: 628195 - DNA, 20 bp, Artificial
  CRISPR gRNA sequence
cttatcgtaattaggcagag

SEQ ID NO: 628196 - DNA, 20 bp, Artificial
  CRISPR gRNA sequence
atcgtaattaggcagagcaa

SEQ ID NO: 628197 - DNA, 20 bp, Artificial
  CRISPR gRNA sequence
tcgtaattaggcagagcaaa

SEQ ID NO: 628198 - DNA, 20 bp, Artificial
  CRISPR gRNA sequence
ggcagagcaaatgacactgc

SEQ ID NO: 628199 - DNA, 20 bp, Artificial
  CRISPR gRNA sequence
cctccacaaaataagaatta

SEQ ID NO: 628200 - DNA, 20 bp, Artificial
  CRISPR gRNA sequence
cacaaaataagaattatcaa

SEQ ID NO: 628201 - DNA, 20 bp, Artificial
  CRISPR gRNA sequence
tcaacagtaataatattaaa

SEQ ID NO: 628202 - DNA, 20 bp, Artificial
  CRISPR gRNA sequence
aaaaaaataaaaggtatgtc

SEQ ID NO: 628203 - DNA, 20 bp, Artificial
  CRISPR gRNA sequence
gaggaaaggtgggattgtaa

SEQ ID NO: 628204 - DNA, 20 bp, Artificial
  CRISPR gRNA sequence
aggaaaggtgggattgtaag

SEQ ID NO: 628205 - DNA, 20 bp, Artificial
  CRISPR gRNA sequence
taagtgcagtatttcttcat

SEQ ID NO: 628206 - DNA, 20 bp, Artificial
  CRISPR gRNA sequence
cttcatgtgcagttctttac

SEQ ID NO: 628207 - DNA, 20 bp, Artificial
  CRISPR gRNA sequence
ttcatgtgcagttctttact

SEQ ID NO: 628208 - DNA, 20 bp, Artificial
  CRISPR gRNA sequence
catgtgcagttctttacttc

SEQ ID NO: 628209 - DNA, 20 bp, Artificial
  CRISPR gRNA sequence
atgtgcagttctttacttca

SEQ ID NO: 628210 - DNA, 20 bp, Artificial
  CRISPR gRNA sequence
tttacttcataggggtcccc

SEQ ID NO: 628211 - DNA, 20 bp, Artificial
  CRISPR gRNA sequence
tacttcataggggtcccctt

SEQ ID NO: 628212 - DNA, 20 bp, Artificial
  CRISPR gRNA sequence
acttcataggggtccccttt

SEQ ID NO: 628213 - DNA, 20 bp, Artificial
  CRISPR gRNA sequence
cttcataggggtcccctttg

SEQ ID NO: 628214 - DNA, 20 bp, Artificial
  CRISPR gRNA sequence
cataggggtcccctttggaa

SEQ ID NO: 628215 - DNA, 20 bp, Artificial
  CRISPR gRNA sequence
ataggggtcccctttggaat

SEQ ID NO: 628216 - DNA, 20 bp, Artificial
  CRISPR gRNA sequence
tggaatgaaaaggcctagtg

SEQ ID NO: 628217 - DNA, 20 bp, Artificial
  CRISPR gRNA sequence
ggaatgaaaaggcctagtgg

SEQ ID NO: 628218 - DNA, 20 bp, Artificial
  CRISPR gRNA sequence
gaatgaaaaggcctagtgga

SEQ ID NO: 628219 - DNA, 20 bp, Artificial
  CRISPR gRNA sequence
gtggaatgtgtgctcccctc

SEQ ID NO: 628220 - DNA, 20 bp, Artificial
  CRISPR gRNA sequence
ccctcgaacaatgtgtgatg

SEQ ID NO: 628221 - DNA, 20 bp, Artificial
  CRISPR gRNA sequence
gaacaatgtgtgatgaaaac

SEQ ID NO: 628222 - DNA, 20 bp, Artificial
  CRISPR gRNA sequence
ataacggtcctggcttctgt

SEQ ID NO: 628223 - DNA, 20 bp, Artificial
  CRISPR gRNA sequence
gcttctgtagccacagatgt

SEQ ID NO: 628224 - DNA, 20 bp, Artificial
  CRISPR gRNA sequence
ctgtagccacagatgttgca

SEQ ID NO: 628225 - DNA, 20 bp, Artificial
  CRISPR gRNA sequence
tgtagccacagatgttgcat

SEQ ID NO: 628226 - DNA, 20 bp, Artificial
  CRISPR gRNA sequence
tagccacagatgttgcattc

SEQ ID NO: 628227 - DNA, 20 bp, Artificial
  CRISPR gRNA sequence
cattccagtgggtcccggta

SEQ ID NO: 628228 - DNA, 20 bp, Artificial
  CRISPR gRNA sequence
cagtgggtcccggtagccat

SEQ ID NO: 628229 - DNA, 20 bp, Artificial
  CRISPR gRNA sequence
ggaaaaggactcggcagtgc

SEQ ID NO: 628230 - DNA, 20 bp, Artificial
  CRISPR gRNA sequence
ggcagtgctcacacttgaag

SEQ ID NO: 628231 - DNA, 20 bp, Artificial
  CRISPR gRNA sequence
acacttgaaggccctaatct

SEQ ID NO: 628232 - DNA, 20 bp, Artificial
  CRISPR gRNA sequence
gaaggccctaatctgttctc

SEQ ID NO: 628233 - DNA, 20 bp, Artificial
  CRISPR gRNA sequence
aaggccctaatctgttctcc

SEQ ID NO: 628234 - DNA, 20 bp, Artificial
  CRISPR gRNA sequence
atctgttctccttctccatt

SEQ ID NO: 628235 - DNA, 20 bp, Artificial
  CRISPR gRNA sequence
ttctccttctccattgaaga

SEQ ID NO: 628236 - DNA, 20 bp, Artificial
  CRISPR gRNA sequence
tccttctccattgaagacct

SEQ ID NO: 628237 - DNA, 20 bp, Artificial
  CRISPR gRNA sequence
cttctccattgaagaccttg

SEQ ID NO: 628238 - DNA, 20 bp, Artificial
  CRISPR gRNA sequence
ctccattgaagaccttgtag

SEQ ID NO: 628239 - DNA, 20 bp, Artificial
  CRISPR gRNA sequence
tccattgaagaccttgtaga

SEQ ID NO: 628240 - DNA, 20 bp, Artificial
  CRISPR gRNA sequence
cattgaagaccttgtagatg

SEQ ID NO: 628241 - DNA, 20 bp, Artificial
  CRISPR gRNA sequence
aagaccttgtagatgtcctt

SEQ ID NO: 628242 - DNA, 20 bp, Artificial
  CRISPR gRNA sequence
gtagatgtccttcagagagc

SEQ ID NO: 628243 - DNA, 20 bp, Artificial
  CRISPR gRNA sequence
tagatgtccttcagagagcc

SEQ ID NO: 628244 - DNA, 20 bp, Artificial
  CRISPR gRNA sequence
cagagagcccttaggagcct

SEQ ID NO: 628245 - DNA, 20 bp, Artificial
  CRISPR gRNA sequence
agagagcccttaggagcctt

SEQ ID NO: 628246 - DNA, 20 bp, Artificial
  CRISPR gRNA sequence
aggagccttggtagtatcca

SEQ ID NO: 628247 - DNA, 20 bp, Artificial
  CRISPR gRNA sequence
ggagccttggtagtatccaa

SEQ ID NO: 628248 - DNA, 20 bp, Artificial
  CRISPR gRNA sequence
ggtagtatccaaagctttga

SEQ ID NO: 628249 - DNA, 20 bp, Artificial
  CRISPR gRNA sequence
gtagtatccaaagctttgac

SEQ ID NO: 628250 - DNA, 20 bp, Artificial
  CRISPR gRNA sequence
tgacatcctccttcatgtaa

SEQ ID NO: 628251 - DNA, 20 bp, Artificial
  CRISPR gRNA sequence
gacatcctccttcatgtaag

SEQ ID NO: 628252 - DNA, 20 bp, Artificial
  CRISPR gRNA sequence
acatcctccttcatgtaagc

SEQ ID NO: 628253 - DNA, 20 bp, Artificial
  CRISPR gRNA sequence
cttcatgtaagctgggcttt

SEQ ID NO: 628254 - DNA, 20 bp, Artificial
  CRISPR gRNA sequence
catgtaagctgggctttgtt

SEQ ID NO: 628255 - DNA, 20 bp, Artificial
  CRISPR gRNA sequence
atgtaagctgggctttgttt

SEQ ID NO: 628256 - DNA, 20 bp, Artificial
  CRISPR gRNA sequence
ggctttgtttcctcttggga

SEQ ID NO: 628257 - DNA, 20 bp, Artificial
  CRISPR gRNA sequence
tgtttcctcttgggatttaa

SEQ ID NO: 628258 - DNA, 20 bp, Artificial
  CRISPR gRNA sequence
gtttcctcttgggatttaag

SEQ ID NO: 628259 - DNA, 20 bp, Artificial
  CRISPR gRNA sequence
tttcctcttgggatttaagg

SEQ ID NO: 628260 - DNA, 20 bp, Artificial
  CRISPR gRNA sequence
cctcttgggatttaaggcag

SEQ ID NO: 628261 - DNA, 20 bp, Artificial
  CRISPR gRNA sequence
ctcttgggatttaaggcagg

SEQ ID NO: 628262 - DNA, 20 bp, Artificial
  CRISPR gRNA sequence
ttgggatttaaggcagggtg

SEQ ID NO: 628263 - DNA, 20 bp, Artificial
  CRISPR gRNA sequence
gggatttaaggcagggtgtc

SEQ ID NO: 628264 - DNA, 20 bp, Artificial
  CRISPR gRNA sequence
ggatttaaggcagggtgtcc

SEQ ID NO: 628265 - DNA, 20 bp, Artificial
  CRISPR gRNA sequence
aaggcagggtgtccttggta

SEQ ID NO: 628266 - DNA, 20 bp, Artificial
  CRISPR gRNA sequence
aggcagggtgtccttggtag

SEQ ID NO: 628267 - DNA, 20 bp, Artificial
  CRISPR gRNA sequence
ggtaggactggtggtcatca

SEQ ID NO: 628268 - DNA, 20 bp, Artificial
  CRISPR gRNA sequence
gtaggactggtggtcatcat

SEQ ID NO: 628269 - DNA, 20 bp, Artificial
  CRISPR gRNA sequence
gtggtcatcatggctgcttt

SEQ ID NO: 628270 - DNA, 20 bp, Artificial
  CRISPR gRNA sequence
ctttctgagtcagtggaatc

SEQ ID NO: 628271 - DNA, 20 bp, Artificial
  CRISPR gRNA sequence
tctgagtcagtggaatccag

SEQ ID NO: 628272 - DNA, 20 bp, Artificial
  CRISPR gRNA sequence
ctgagtcagtggaatccagg

SEQ ID NO: 628273 - DNA, 20 bp, Artificial
  CRISPR gRNA sequence
tgagtcagtggaatccaggc

SEQ ID NO: 628274 - DNA, 20 bp, Artificial
  CRISPR gRNA sequence
agtcagtggaatccaggcag

SEQ ID NO: 628275 - DNA, 20 bp, Artificial
  CRISPR gRNA sequence
ttgctgggagaggcctctct

SEQ ID NO: 628276 - DNA, 20 bp, Artificial
  CRISPR gRNA sequence
ctgggagaggcctctctttc

SEQ ID NO: 628277 - DNA, 20 bp, Artificial
  CRISPR gRNA sequence
ggagaggcctctctttcctg

SEQ ID NO: 628278 - DNA, 20 bp, Artificial
  CRISPR gRNA sequence
tctttcctggggtcgactct

SEQ ID NO: 628279 - DNA, 20 bp, Artificial
  CRISPR gRNA sequence
tttcctggggtcgactcttt

SEQ ID NO: 628280 - DNA, 20 bp, Artificial
  CRISPR gRNA sequence
tcctggggtcgactctttgg

SEQ ID NO: 628281 - DNA, 20 bp, Artificial
  CRISPR gRNA sequence
cctggggtcgactctttggt

SEQ ID NO: 628282 - DNA, 20 bp, Artificial
  CRISPR gRNA sequence
ctggggtcgactctttggtc

SEQ ID NO: 628283 - DNA, 20 bp, Artificial
  CRISPR gRNA sequence
gggtcgactctttggtctga

SEQ ID NO: 628284 - DNA, 20 bp, Artificial
  CRISPR gRNA sequence
tttggtctgatgagagagat

SEQ ID NO: 628285 - DNA, 20 bp, Artificial
  CRISPR gRNA sequence
tggtctgatgagagagatgg

SEQ ID NO: 628286 - DNA, 20 bp, Artificial
  CRISPR gRNA sequence
ggtctgatgagagagatggg

SEQ ID NO: 628287 - DNA, 20 bp, Artificial
  CRISPR gRNA sequence
gtctgatgagagagatgggg

SEQ ID NO: 628288 - DNA, 20 bp, Artificial
  CRISPR gRNA sequence
atgagagagatggggccatc

SEQ ID NO: 628289 - DNA, 20 bp, Artificial
  CRISPR gRNA sequence
ttttcatgactatcagcagt

SEQ ID NO: 628290 - DNA, 20 bp, Artificial
  CRISPR gRNA sequence
tcatgactatcagcagtttc

SEQ ID NO: 628291 - DNA, 20 bp, Artificial
  CRISPR gRNA sequence
catgactatcagcagtttcc

SEQ ID NO: 628292 - DNA, 20 bp, Artificial
  CRISPR gRNA sequence
atgactatcagcagtttccc

SEQ ID NO: 628293 - DNA, 20 bp, Artificial
  CRISPR gRNA sequence
tcagcagtttccctgctaat

SEQ ID NO: 628294 - DNA, 20 bp, Artificial
  CRISPR gRNA sequence
ccctgctaatgggtctttct

SEQ ID NO: 628295 - DNA, 20 bp, Artificial
  CRISPR gRNA sequence
cctgctaatgggtctttcta

SEQ ID NO: 628296 - DNA, 20 bp, Artificial
  CRISPR gRNA sequence
ctaatgggtctttctatcct

SEQ ID NO: 628297 - DNA, 20 bp, Artificial
  CRISPR gRNA sequence
atgggtctttctatcctatt

SEQ ID NO: 628298 - DNA, 20 bp, Artificial
  CRISPR gRNA sequence
tctatcctatttggatgata

SEQ ID NO: 628299 - DNA, 20 bp, Artificial
  CRISPR gRNA sequence
ctatcctatttggatgatag

SEQ ID NO: 628300 - DNA, 20 bp, Artificial
  CRISPR gRNA sequence
tatcctatttggatgataga

SEQ ID NO: 628301 - DNA, 20 bp, Artificial
  CRISPR gRNA sequence
tcctatttggatgatagacc

SEQ ID NO: 628302 - DNA, 20 bp, Artificial
  CRISPR gRNA sequence
tttggatgatagacctgaga

SEQ ID NO: 628303 - DNA, 20 bp, Artificial
  CRISPR gRNA sequence
ggatgatagacctgagaata

SEQ ID NO: 628304 - DNA, 20 bp, Artificial
  CRISPR gRNA sequence
gatgatagacctgagaataa

SEQ ID NO: 628305 - DNA, 20 bp, Artificial
  CRISPR gRNA sequence
agaataagctgagcttataa

SEQ ID NO: 628306 - DNA, 20 bp, Artificial
  CRISPR gRNA sequence
agcttataactggggccact

SEQ ID NO: 628307 - DNA, 20 bp, Artificial
  CRISPR gRNA sequence
ataactggggccacttcagc

SEQ ID NO: 628308 - DNA, 20 bp, Artificial
  CRISPR gRNA sequence
taactggggccacttcagcg

SEQ ID NO: 628309 - DNA, 20 bp, Artificial
  CRISPR gRNA sequence
gggccacttcagcgattgtg

SEQ ID NO: 628310 - DNA, 20 bp, Artificial
  CRISPR gRNA sequence
cagcgattgtgcttggcggg

SEQ ID NO: 628311 - DNA, 20 bp, Artificial
  CRISPR gRNA sequence
agcgattgtgcttggcgggt

SEQ ID NO: 628312 - DNA, 20 bp, Artificial
  CRISPR gRNA sequence
tgcttggcgggtgctgcatc

SEQ ID NO: 628313 - DNA, 20 bp, Artificial
  CRISPR gRNA sequence
ggcgggtgctgcatcagagg

SEQ ID NO: 628314 - DNA, 20 bp, Artificial
  CRISPR gRNA sequence
gcgggtgctgcatcagaggg

SEQ ID NO: 628315 - DNA, 20 bp, Artificial
  CRISPR gRNA sequence
catcagagggtgaagggcct

SEQ ID NO: 628316 - DNA, 20 bp, Artificial
  CRISPR gRNA sequence
agctccaaggtaggtgattg

SEQ ID NO: 628317 - DNA, 20 bp, Artificial
  CRISPR gRNA sequence
caaggtaggtgattgcattg

SEQ ID NO: 628318 - DNA, 20 bp, Artificial
  CRISPR gRNA sequence
cattgttgatggcttggtcc

SEQ ID NO: 628319 - DNA, 20 bp, Artificial
  CRISPR gRNA sequence
ttgatggcttggtccatcat

SEQ ID NO: 628320 - DNA, 20 bp, Artificial
  CRISPR gRNA sequence
atggcttggtccatcatatg

SEQ ID NO: 628321 - DNA, 20 bp, Artificial
  CRISPR gRNA sequence
ggtccatcatatgagactgc

SEQ ID NO: 628322 - DNA, 20 bp, Artificial
  CRISPR gRNA sequence
gtccatcatatgagactgca

SEQ ID NO: 628323 - DNA, 20 bp, Artificial
  CRISPR gRNA sequence
catcagctcagcctccttct

SEQ ID NO: 628324 - DNA, 20 bp, Artificial
  CRISPR gRNA sequence
agcctccttctcatatgtta

SEQ ID NO: 628325 - DNA, 20 bp, Artificial
  CRISPR gRNA sequence
cttctcatatgttaagttca

SEQ ID NO: 628326 - DNA, 20 bp, Artificial
  CRISPR gRNA sequence
ctcatatgttaagttcatat

SEQ ID NO: 628327 - DNA, 20 bp, Artificial
  CRISPR gRNA sequence
tcatatgttaagttcatatc

SEQ ID NO: 628328 - DNA, 20 bp, Artificial
  CRISPR gRNA sequence
atatgttaagttcatatcaa

SEQ ID NO: 628329 - DNA, 20 bp, Artificial
  CRISPR gRNA sequence
agttcatatcaaagtgaata

SEQ ID NO: 628330 - DNA, 20 bp, Artificial
  CRISPR gRNA sequence
atatcaaagtgaatatctgg

SEQ ID NO: 628331 - DNA, 20 bp, Artificial
  CRISPR gRNA sequence
ggtagctgaatcgcatgagc

SEQ ID NO: 628332 - DNA, 20 bp, Artificial
  CRISPR gRNA sequence
aatcgcatgagcttttcccc

SEQ ID NO: 628333 - DNA, 20 bp, Artificial
  CRISPR gRNA sequence
ttcccctggaagggagtggg

SEQ ID NO: 628334 - DNA, 20 bp, Artificial
  CRISPR gRNA sequence
tcccctggaagggagtggga

SEQ ID NO: 628335 - DNA, 20 bp, Artificial
  CRISPR gRNA sequence
cccctggaagggagtgggag

SEQ ID NO: 628336 - DNA, 20 bp, Artificial
  CRISPR gRNA sequence
ccctggaagggagtgggagg

SEQ ID NO: 628337 - DNA, 20 bp, Artificial
  CRISPR gRNA sequence
gaagggagtgggaggtgaaa

SEQ ID NO: 628338 - DNA, 20 bp, Artificial
  CRISPR gRNA sequence
gtatcagattaaaaatatga

SEQ ID NO: 628339 - DNA, 20 bp, Artificial
  CRISPR gRNA sequence
aaaatatgaaagggtacgaa

SEQ ID NO: 628340 - DNA, 20 bp, Artificial
  CRISPR gRNA sequence
actgattgcctccatttttc

SEQ ID NO: 628341 - DNA, 20 bp, Artificial
  CRISPR gRNA sequence
attgcctccatttttcataa

SEQ ID NO: 628342 - DNA, 20 bp, Artificial
  CRISPR gRNA sequence
cctccatttttcataatttg

SEQ ID NO: 628343 - DNA, 20 bp, Artificial
  CRISPR gRNA sequence
catttttcataatttggtat

SEQ ID NO: 628344 - DNA, 20 bp, Artificial
  CRISPR gRNA sequence
ttcataatttggtatatatt

SEQ ID NO: 628345 - DNA, 20 bp, Artificial
  CRISPR gRNA sequence
tcataatttggtatatatta

SEQ ID NO: 628346 - DNA, 20 bp, Artificial
  CRISPR gRNA sequence
cataatttggtatatattac

SEQ ID NO: 628347 - DNA, 20 bp, Artificial
  CRISPR gRNA sequence
ataatttggtatatattact

SEQ ID NO: 628348 - DNA, 20 bp, Artificial
  CRISPR gRNA sequence
ggtatatattactctataag

SEQ ID NO: 628349 - DNA, 20 bp, Artificial
  CRISPR gRNA sequence
gtatatattactctataagt

SEQ ID NO: 628350 - DNA, 20 bp, Artificial
  CRISPR gRNA sequence
ctctataagtcaagtatttg

SEQ ID NO: 628351 - DNA, 20 bp, Artificial
  CRISPR gRNA sequence
tataagtcaagtatttgggc

SEQ ID NO: 628352 - DNA, 20 bp, Artificial
  CRISPR gRNA sequence
taagtcaagtatttgggcaa

SEQ ID NO: 628353 - DNA, 20 bp, Artificial
  CRISPR gRNA sequence
gggcaattctgctgatgctc

SEQ ID NO: 628354 - DNA, 20 bp, Artificial
  CRISPR gRNA sequence
ggcaattctgctgatgctca

SEQ ID NO: 628355 - DNA, 20 bp, Artificial
  CRISPR gRNA sequence
tgctgatgctcacacacatt

SEQ ID NO: 628356 - DNA, 20 bp, Artificial
  CRISPR gRNA sequence
ctgatgctcacacacatttt

SEQ ID NO: 628357 - DNA, 20 bp, Artificial
  CRISPR gRNA sequence
atgctcacacacattttttt

SEQ ID NO: 628358 - DNA, 20 bp, Artificial
  CRISPR gRNA sequence
acacacattttttttttttt

SEQ ID NO: 628359 - DNA, 20 bp, Artificial
  CRISPR gRNA sequence
tttttttttttgagacagag

SEQ ID NO: 628360 - DNA, 20 bp, Artificial
  CRISPR gRNA sequence
ttttttttttgagacagagt

SEQ ID NO: 628361 - DNA, 20 bp, Artificial
  CRISPR gRNA sequence
tttttttttgagacagagtc

SEQ ID NO: 628362 - DNA, 20 bp, Artificial
  CRISPR gRNA sequence
ttttttttgagacagagtct

SEQ ID NO: 628363 - DNA, 20 bp, Artificial
  CRISPR gRNA sequence
tttttttgagacagagtctc

SEQ ID NO: 628364 - DNA, 20 bp, Artificial
  CRISPR gRNA sequence
ttttttgagacagagtctca

SEQ ID NO: 628365 - DNA, 20 bp, Artificial
  CRISPR gRNA sequence
tttttgagacagagtctcag

SEQ ID NO: 628366 - DNA, 20 bp, Artificial
  CRISPR gRNA sequence
ttttgagacagagtctcagg

SEQ ID NO: 628367 - DNA, 20 bp, Artificial
  CRISPR gRNA sequence
tttgagacagagtctcaggg

SEQ ID NO: 628368 - DNA, 20 bp, Artificial
  CRISPR gRNA sequence
ttgagacagagtctcagggt

SEQ ID NO: 628369 - DNA, 20 bp, Artificial
  CRISPR gRNA sequence
tgagacagagtctcagggtg

SEQ ID NO: 628370 - DNA, 20 bp, Artificial
  CRISPR gRNA sequence
gagacagagtctcagggtgt

SEQ ID NO: 628371 - DNA, 20 bp, Artificial
  CRISPR gRNA sequence
agacagagtctcagggtgtg

SEQ ID NO: 628372 - DNA, 20 bp, Artificial
  CRISPR gRNA sequence
agggtgtgatctctgctcac

SEQ ID NO: 628373 - DNA, 20 bp, Artificial
  CRISPR gRNA sequence
tgctcactgcaacctccacc

SEQ ID NO: 628374 - DNA, 20 bp, Artificial
  CRISPR gRNA sequence
ctcactgcaacctccacctc

SEQ ID NO: 628375 - DNA, 20 bp, Artificial
  CRISPR gRNA sequence
actgcaacctccacctctcc

SEQ ID NO: 628376 - DNA, 20 bp, Artificial
  CRISPR gRNA sequence
caacctccacctctccagtt

SEQ ID NO: 628377 - DNA, 20 bp, Artificial
  CRISPR gRNA sequence
cacctctccagttcaaggga

SEQ ID NO: 628378 - DNA, 20 bp, Artificial
  CRISPR gRNA sequence
tccagttcaagggattctca

SEQ ID NO: 628379 - DNA, 20 bp, Artificial
  CRISPR gRNA sequence
cagttcaagggattctcatg

SEQ ID NO: 628380 - DNA, 20 bp, Artificial
  CRISPR gRNA sequence
aagggattctcatgcctcag

SEQ ID NO: 628381 - DNA, 20 bp, Artificial
  CRISPR gRNA sequence
tcatgcctcagccacctgag

SEQ ID NO: 628382 - DNA, 20 bp, Artificial
  CRISPR gRNA sequence
atgcctcagccacctgagta

SEQ ID NO: 628383 - DNA, 20 bp, Artificial
  CRISPR gRNA sequence
agccacctgagtagctggaa

SEQ ID NO: 628384 - DNA, 20 bp, Artificial
  CRISPR gRNA sequence
agtagctggaattacaggca

SEQ ID NO: 628385 - DNA, 20 bp, Artificial
  CRISPR gRNA sequence
gaattacaggcatgcgcccc

SEQ ID NO: 628386 - DNA, 20 bp, Artificial
  CRISPR gRNA sequence
caggcatgcgcccccatacc

SEQ ID NO: 628387 - DNA, 20 bp, Artificial
  CRISPR gRNA sequence
gctaatttttgtatttttag

SEQ ID NO: 628388 - DNA, 20 bp, Artificial
  CRISPR gRNA sequence
atttttgtatttttagtaga

SEQ ID NO: 628389 - DNA, 20 bp, Artificial
  CRISPR gRNA sequence
ttgtatttttagtagagata

SEQ ID NO: 628390 - DNA, 20 bp, Artificial
  CRISPR gRNA sequence
tgtatttttagtagagatag

SEQ ID NO: 628391 - DNA, 20 bp, Artificial
  CRISPR gRNA sequence
gtatttttagtagagatagg

SEQ ID NO: 628392 - DNA, 20 bp, Artificial
  CRISPR gRNA sequence
tatttttagtagagataggg

SEQ ID NO: 628393 - DNA, 20 bp, Artificial
  CRISPR gRNA sequence
ttagtagagatagggttttg

SEQ ID NO: 628394 - DNA, 20 bp, Artificial
  CRISPR gRNA sequence
tagtagagatagggttttgc

SEQ ID NO: 628395 - DNA, 20 bp, Artificial
  CRISPR gRNA sequence
agtagagatagggttttgcc

SEQ ID NO: 628396 - DNA, 20 bp, Artificial
  CRISPR gRNA sequence
gtagagatagggttttgccc

SEQ ID NO: 628397 - DNA, 20 bp, Artificial
  CRISPR gRNA sequence
tgccctgttagccaggctgg

SEQ ID NO: 628398 - DNA, 20 bp, Artificial
  CRISPR gRNA sequence
gccctgttagccaggctggt

SEQ ID NO: 628399 - DNA, 20 bp, Artificial
  CRISPR gRNA sequence
ccctgttagccaggctggtc

SEQ ID NO: 628400 - DNA, 20 bp, Artificial
  CRISPR gRNA sequence
ttagccaggctggtctagaa

SEQ ID NO: 628401 - DNA, 20 bp, Artificial
  CRISPR gRNA sequence
gccaggctggtctagaactc

SEQ ID NO: 628402 - DNA, 20 bp, Artificial
  CRISPR gRNA sequence
gtctagaactcctggcctca

SEQ ID NO: 628403 - DNA, 20 bp, Artificial
  CRISPR gRNA sequence
gaactcctggcctcaagtga

SEQ ID NO: 628404 - DNA, 20 bp, Artificial
  CRISPR gRNA sequence
ctggcctcaagtgatccacc

SEQ ID NO: 628405 - DNA, 20 bp, Artificial
  CRISPR gRNA sequence
gcctcaagtgatccacccac

SEQ ID NO: 628406 - DNA, 20 bp, Artificial
  CRISPR gRNA sequence
aagtgatccacccaccttgg

SEQ ID NO: 628407 - DNA, 20 bp, Artificial
  CRISPR gRNA sequence
ggcctcccaaagtgttacga

SEQ ID NO: 628408 - DNA, 20 bp, Artificial
  CRISPR gRNA sequence
gcctcccaaagtgttacgat

SEQ ID NO: 628409 - DNA, 20 bp, Artificial
  CRISPR gRNA sequence
ccaaagtgttacgattacag

SEQ ID NO: 628410 - DNA, 20 bp, Artificial
  CRISPR gRNA sequence
cgattacaggcatgagacac

SEQ ID NO: 628411 - DNA, 20 bp, Artificial
  CRISPR gRNA sequence
caggcatgagacactgggtc

SEQ ID NO: 628412 - DNA, 20 bp, Artificial
  CRISPR gRNA sequence
ggtctggccacaaatattct

SEQ ID NO: 628413 - DNA, 20 bp, Artificial
  CRISPR gRNA sequence
gccacaaatattcttgacat

SEQ ID NO: 628414 - DNA, 20 bp, Artificial
  CRISPR gRNA sequence
ttgacatgaaaaaaatataa

SEQ ID NO: 628415 - DNA, 20 bp, Artificial
  CRISPR gRNA sequence
gacatgaaaaaaatataaaa

SEQ ID NO: 628416 - DNA, 20 bp, Artificial
  CRISPR gRNA sequence
acatgaaaaaaatataaaag

SEQ ID NO: 628417 - DNA, 20 bp, Artificial
  CRISPR gRNA sequence
tgtaagccatttgcatttgt

SEQ ID NO: 628418 - DNA, 20 bp, Artificial
  CRISPR gRNA sequence
gtaagccatttgcatttgtt

SEQ ID NO: 628419 - DNA, 20 bp, Artificial
  CRISPR gRNA sequence
taagccatttgcatttgttc

SEQ ID NO: 628420 - DNA, 20 bp, Artificial
  CRISPR gRNA sequence
gcatttgttctgatgccatc

SEQ ID NO: 628421 - DNA, 20 bp, Artificial
  CRISPR gRNA sequence
catttgttctgatgccatca

SEQ ID NO: 628422 - DNA, 20 bp, Artificial
  CRISPR gRNA sequence
gttctgatgccatcatgaga

SEQ ID NO: 628423 - DNA, 20 bp, Artificial
  CRISPR gRNA sequence
ttctgatgccatcatgagaa

SEQ ID NO: 628424 - DNA, 20 bp, Artificial
  CRISPR gRNA sequence
tgatgccatcatgagaatgc

SEQ ID NO: 628425 - DNA, 20 bp, Artificial
  CRISPR gRNA sequence
atgccatcatgagaatgcat

SEQ ID NO: 628426 - DNA, 20 bp, Artificial
  CRISPR gRNA sequence
gtctgaaagatatgattgag

SEQ ID NO: 628427 - DNA, 20 bp, Artificial
  CRISPR gRNA sequence
aaagatatgattgagtttat

SEQ ID NO: 628428 - DNA, 20 bp, Artificial
  CRISPR gRNA sequence
agtttatcatattttcattt

SEQ ID NO: 628429 - DNA, 20 bp, Artificial
  CRISPR gRNA sequence
atcatattttcattttcttt

SEQ ID NO: 628430 - DNA, 20 bp, Artificial
  CRISPR gRNA sequence
tcatattttcattttctttt

SEQ ID NO: 628431 - DNA, 20 bp, Artificial
  CRISPR gRNA sequence
tcattttcttttaaaattct

SEQ ID NO: 628432 - DNA, 20 bp, Artificial
  CRISPR gRNA sequence
cattttcttttaaaattctc

SEQ ID NO: 628433 - DNA, 20 bp, Artificial
  CRISPR gRNA sequence
attttcttttaaaattctca

SEQ ID NO: 628434 - DNA, 20 bp, Artificial
  CRISPR gRNA sequence
tcttttaaaattctcacttg

SEQ ID NO: 628435 - DNA, 20 bp, Artificial
  CRISPR gRNA sequence
cttttaaaattctcacttga

SEQ ID NO: 628436 - DNA, 20 bp, Artificial
  CRISPR gRNA sequence
ttttaaaattctcacttgaa

SEQ ID NO: 628437 - DNA, 20 bp, Artificial
  CRISPR gRNA sequence
ttaaaattctcacttgaata

SEQ ID NO: 628438 - DNA, 20 bp, Artificial
  CRISPR gRNA sequence
taaaattctcacttgaatag

SEQ ID NO: 628439 - DNA, 20 bp, Artificial
  CRISPR gRNA sequence
aaaattctcacttgaataga

SEQ ID NO: 628440 - DNA, 20 bp, Artificial
  CRISPR gRNA sequence
aaattctcacttgaatagag

SEQ ID NO: 628441 - DNA, 20 bp, Artificial
  CRISPR gRNA sequence
tcacttgaatagagctcaag

SEQ ID NO: 628442 - DNA, 20 bp, Artificial
  CRISPR gRNA sequence
acttgaatagagctcaagga

SEQ ID NO: 628443 - DNA, 20 bp, Artificial
  CRISPR gRNA sequence
gaatagagctcaaggagaat

SEQ ID NO: 628444 - DNA, 20 bp, Artificial
  CRISPR gRNA sequence
aatagagctcaaggagaata

SEQ ID NO: 628445 - DNA, 20 bp, Artificial
  CRISPR gRNA sequence
aaggagaataggaggaagaa

SEQ ID NO: 628446 - DNA, 20 bp, Artificial
  CRISPR gRNA sequence
tgcttgattttgcatatttt

SEQ ID NO: 628447 - DNA, 20 bp, Artificial
  CRISPR gRNA sequence
gattttgcatattttaaaca

SEQ ID NO: 628448 - DNA, 20 bp, Artificial
  CRISPR gRNA sequence
attttgcatattttaaacat

SEQ ID NO: 628449 - DNA, 20 bp, Artificial
  CRISPR gRNA sequence
tgcatattttaaacattagt

SEQ ID NO: 628450 - DNA, 20 bp, Artificial
  CRISPR gRNA sequence
gcatattttaaacattagtg

SEQ ID NO: 628451 - DNA, 20 bp, Artificial
  CRISPR gRNA sequence
catattttaaacattagtga

SEQ ID NO: 628452 - DNA, 20 bp, Artificial
  CRISPR gRNA sequence
taaacattagtgaccaagct

SEQ ID NO: 628453 - DNA, 20 bp, Artificial
  CRISPR gRNA sequence
aaacattagtgaccaagcta

SEQ ID NO: 628454 - DNA, 20 bp, Artificial
  CRISPR gRNA sequence
aacattagtgaccaagctac

SEQ ID NO: 628455 - DNA, 20 bp, Artificial
  CRISPR gRNA sequence
gtgaccaagctacaaagatc

SEQ ID NO: 628456 - DNA, 20 bp, Artificial
  CRISPR gRNA sequence
caaagatcataaaagtgaga

SEQ ID NO: 628457 - DNA, 20 bp, Artificial
  CRISPR gRNA sequence
gttataacatatggcacctc

SEQ ID NO: 628458 - DNA, 20 bp, Artificial
  CRISPR gRNA sequence
taacatatggcacctcactg

SEQ ID NO: 628459 - DNA, 20 bp, Artificial
  CRISPR gRNA sequence
actgttgtgtagggttaagt

SEQ ID NO: 628460 - DNA, 20 bp, Artificial
  CRISPR gRNA sequence
ttgtgtagggttaagttggt

SEQ ID NO: 628461 - DNA, 20 bp, Artificial
  CRISPR gRNA sequence
tgtagggttaagttggttga

SEQ ID NO: 628462 - DNA, 20 bp, Artificial
  CRISPR gRNA sequence
agttggttgattcggccact

SEQ ID NO: 628463 - DNA, 20 bp, Artificial
  CRISPR gRNA sequence
gttgattcggccactatttc

SEQ ID NO: 628464 - DNA, 20 bp, Artificial
  CRISPR gRNA sequence
attcggccactatttcagaa

SEQ ID NO: 628465 - DNA, 20 bp, Artificial
  CRISPR gRNA sequence
ggccactatttcagaaaaaa

SEQ ID NO: 628466 - DNA, 20 bp, Artificial
  CRISPR gRNA sequence
tttcagaaaaaatatatata

SEQ ID NO: 628467 - DNA, 20 bp, Artificial
  CRISPR gRNA sequence
cagaaaaaatatatataacc

SEQ ID NO: 628468 - DNA, 20 bp, Artificial
  CRISPR gRNA sequence
agaaaaaatatatataaccc

SEQ ID NO: 628469 - DNA, 20 bp, Artificial
  CRISPR gRNA sequence
tggagattttttaaaagtca

SEQ ID NO: 628470 - DNA, 20 bp, Artificial
  CRISPR gRNA sequence
gagattttttaaaagtcatt

SEQ ID NO: 628471 - DNA, 20 bp, Artificial
  CRISPR gRNA sequence
tttaaaagtcattattaaaa

SEQ ID NO: 628472 - DNA, 20 bp, Artificial
  CRISPR gRNA sequence
ttaaaagtcattattaaaat

SEQ ID NO: 628473 - DNA, 20 bp, Artificial
  CRISPR gRNA sequence
taaaagtcattattaaaata

SEQ ID NO: 628474 - DNA, 20 bp, Artificial
  CRISPR gRNA sequence
aaaagtcattattaaaatac

SEQ ID NO: 628475 - DNA, 20 bp, Artificial
  CRISPR gRNA sequence
aaagtcattattaaaatact

SEQ ID NO: 628476 - DNA, 20 bp, Artificial
  CRISPR gRNA sequence
ttaaaatacttttaaaagta

SEQ ID NO: 628477 - DNA, 20 bp, Artificial
  CRISPR gRNA sequence
aaatacttttaaaagtagta

SEQ ID NO: 628478 - DNA, 20 bp, Artificial
  CRISPR gRNA sequence
ttaaaagtagtaccacctaa

SEQ ID NO: 628479 - DNA, 20 bp, Artificial
  CRISPR gRNA sequence
taaaagtagtaccacctaat

SEQ ID NO: 628480 - DNA, 20 bp, Artificial
  CRISPR gRNA sequence
aaaagtagtaccacctaata

SEQ ID NO: 628481 - DNA, 20 bp, Artificial
  CRISPR gRNA sequence
aaagtagtaccacctaataa

SEQ ID NO: 628482 - DNA, 20 bp, Artificial
  CRISPR gRNA sequence
ataaaaatgaatgaaatgta

SEQ ID NO: 628483 - DNA, 20 bp, Artificial
  CRISPR gRNA sequence
tttaaaaataaaattaagag

SEQ ID NO: 628484 - DNA, 20 bp, Artificial
  CRISPR gRNA sequence
aaaaataaaattaagagtta

SEQ ID NO: 628485 - DNA, 20 bp, Artificial
  CRISPR gRNA sequence
aaaataaaattaagagttat

SEQ ID NO: 628486 - DNA, 20 bp, Artificial
  CRISPR gRNA sequence
agagttatttcaaaaagtat

SEQ ID NO: 628487 - DNA, 20 bp, Artificial
  CRISPR gRNA sequence
tttcaaaaagtatttgctca

SEQ ID NO: 628488 - DNA, 20 bp, Artificial
  CRISPR gRNA sequence
caaaaagtatttgctcataa

SEQ ID NO: 628489 - DNA, 20 bp, Artificial
  CRISPR gRNA sequence
aaaaagtatttgctcataaa

SEQ ID NO: 628490 - DNA, 20 bp, Artificial
  CRISPR gRNA sequence
gctcataaactcggaaaatc

SEQ ID NO: 628491 - DNA, 20 bp, Artificial
  CRISPR gRNA sequence
ctcataaactcggaaaatct

SEQ ID NO: 628492 - DNA, 20 bp, Artificial
  CRISPR gRNA sequence
ataaactcggaaaatcttgt

SEQ ID NO: 628493 - DNA, 20 bp, Artificial
  CRISPR gRNA sequence
ggaaaatcttgtctcattgt

SEQ ID NO: 628494 - DNA, 20 bp, Artificial
  CRISPR gRNA sequence
gtctcattgttttgcttctt

SEQ ID NO: 628495 - DNA, 20 bp, Artificial
  CRISPR gRNA sequence
tctcattgttttgcttcttg

SEQ ID NO: 628496 - DNA, 20 bp, Artificial
  CRISPR gRNA sequence
attgttttgcttcttgaaat

SEQ ID NO: 628497 - DNA, 20 bp, Artificial
  CRISPR gRNA sequence
ttttgcttcttgaaattaat

SEQ ID NO: 628498 - DNA, 20 bp, Artificial
  CRISPR gRNA sequence
tgcttcttgaaattaatatt

SEQ ID NO: 628499 - DNA, 20 bp, Artificial
  CRISPR gRNA sequence
gcttcttgaaattaatattc

SEQ ID NO: 628500 - DNA, 20 bp, Artificial
  CRISPR gRNA sequence
cttcttgaaattaatattca

SEQ ID NO: 628501 - DNA, 20 bp, Artificial
  CRISPR gRNA sequence
cttgaaattaatattcattt

SEQ ID NO: 628502 - DNA, 20 bp, Artificial
  CRISPR gRNA sequence
ttgaaattaatattcatttt

SEQ ID NO: 628503 - DNA, 20 bp, Artificial
  CRISPR gRNA sequence
gaaattaatattcattttta

SEQ ID NO: 628504 - DNA, 20 bp, Artificial
  CRISPR gRNA sequence
aaattaatattcatttttat

SEQ ID NO: 628505 - DNA, 20 bp, Artificial
  CRISPR gRNA sequence
atattcatttttatatcatc

SEQ ID NO: 628506 - DNA, 20 bp, Artificial
  CRISPR gRNA sequence
atttttatatcatcctttct

SEQ ID NO: 628507 - DNA, 20 bp, Artificial
  CRISPR gRNA sequence
ttatatcatcctttcttatt

SEQ ID NO: 628508 - DNA, 20 bp, Artificial
  CRISPR gRNA sequence
tatatcatcctttcttattt

SEQ ID NO: 628509 - DNA, 20 bp, Artificial
  CRISPR gRNA sequence
atatcatcctttcttattta

SEQ ID NO: 628510 - DNA, 20 bp, Artificial
  CRISPR gRNA sequence
tatcatcctttcttatttag

SEQ ID NO: 628511 - DNA, 20 bp, Artificial
  CRISPR gRNA sequence
tcttatttagacatgtgtat

SEQ ID NO: 628512 - DNA, 20 bp, Artificial
  CRISPR gRNA sequence
cttatttagacatgtgtatg

SEQ ID NO: 628513 - DNA, 20 bp, Artificial
  CRISPR gRNA sequence
ttatttagacatgtgtatgt

SEQ ID NO: 628514 - DNA, 20 bp, Artificial
  CRISPR gRNA sequence
atttagacatgtgtatgtga

SEQ ID NO: 628515 - DNA, 20 bp, Artificial
  CRISPR gRNA sequence
tttagacatgtgtatgtgat

SEQ ID NO: 628516 - DNA, 20 bp, Artificial
  CRISPR gRNA sequence
agacatgtgtatgtgatagt

SEQ ID NO: 628517 - DNA, 20 bp, Artificial
  CRISPR gRNA sequence
gacatgtgtatgtgatagtg

SEQ ID NO: 628518 - DNA, 20 bp, Artificial
  CRISPR gRNA sequence
gtacgtacacccattgctag

SEQ ID NO: 628519 - DNA, 20 bp, Artificial
  CRISPR gRNA sequence
ctagcttcccatactttttc

SEQ ID NO: 628520 - DNA, 20 bp, Artificial
  CRISPR gRNA sequence
gcttcccatactttttcttg

SEQ ID NO: 628521 - DNA, 20 bp, Artificial
  CRISPR gRNA sequence
cccatactttttcttgattg

SEQ ID NO: 628522 - DNA, 20 bp, Artificial
  CRISPR gRNA sequence
ccatactttttcttgattga

SEQ ID NO: 628523 - DNA, 20 bp, Artificial
  CRISPR gRNA sequence
tttcttgattgaagcatgtt

SEQ ID NO: 628524 - DNA, 20 bp, Artificial
  CRISPR gRNA sequence
ttcttgattgaagcatgttt

SEQ ID NO: 628525 - DNA, 20 bp, Artificial
  CRISPR gRNA sequence
tcttgattgaagcatgtttg

SEQ ID NO: 628526 - DNA, 20 bp, Artificial
  CRISPR gRNA sequence
cttgattgaagcatgtttgc

SEQ ID NO: 628527 - DNA, 20 bp, Artificial
  CRISPR gRNA sequence
ttgattgaagcatgtttgca

SEQ ID NO: 628528 - DNA, 20 bp, Artificial
  CRISPR gRNA sequence
gattgaagcatgtttgcagt

SEQ ID NO: 628529 - DNA, 20 bp, Artificial
  CRISPR gRNA sequence
attgaagcatgtttgcagtt

SEQ ID NO: 628530 - DNA, 20 bp, Artificial
  CRISPR gRNA sequence
aagcatgtttgcagtttttc

SEQ ID NO: 628531 - DNA, 20 bp, Artificial
  CRISPR gRNA sequence
gcagtttttccttaaatata

SEQ ID NO: 628532 - DNA, 20 bp, Artificial
  CRISPR gRNA sequence
cagtttttccttaaatatac

SEQ ID NO: 628533 - DNA, 20 bp, Artificial
  CRISPR gRNA sequence
ttccttaaatatacacctca

SEQ ID NO: 628534 - DNA, 20 bp, Artificial
  CRISPR gRNA sequence
tccttaaatatacacctcaa

SEQ ID NO: 628535 - DNA, 20 bp, Artificial
  CRISPR gRNA sequence
ccttaaatatacacctcaac

SEQ ID NO: 628536 - DNA, 20 bp, Artificial
  CRISPR gRNA sequence
cttaaatatacacctcaaca

SEQ ID NO: 628537 - DNA, 20 bp, Artificial
  CRISPR gRNA sequence
aaatatacacctcaacaaat

SEQ ID NO: 628538 - DNA, 20 bp, Artificial
  CRISPR gRNA sequence
aatatacacctcaacaaata

SEQ ID NO: 628539 - DNA, 20 bp, Artificial
  CRISPR gRNA sequence
aacaaatataattttactcc

SEQ ID NO: 628540 - DNA, 20 bp, Artificial
  CRISPR gRNA sequence
tactccaatattttacatca

SEQ ID NO: 628541 - DNA, 20 bp, Artificial
  CRISPR gRNA sequence
actccaatattttacatcaa

SEQ ID NO: 628542 - DNA, 20 bp, Artificial
  CRISPR gRNA sequence
ctccaatattttacatcaac

SEQ ID NO: 628543 - DNA, 20 bp, Artificial
  CRISPR gRNA sequence
caatattttacatcaacata

SEQ ID NO: 628544 - DNA, 20 bp, Artificial
  CRISPR gRNA sequence
tacatcaacataatgtctga

SEQ ID NO: 628545 - DNA, 20 bp, Artificial
  CRISPR gRNA sequence
acatcaacataatgtctgac

SEQ ID NO: 628546 - DNA, 20 bp, Artificial
  CRISPR gRNA sequence
catcaacataatgtctgact

SEQ ID NO: 628547 - DNA, 20 bp, Artificial
  CRISPR gRNA sequence
actgttaactataaaagagt

SEQ ID NO: 628548 - DNA, 20 bp, Artificial
  CRISPR gRNA sequence
ttaactataaaagagttttg

SEQ ID NO: 628549 - DNA, 20 bp, Artificial
  CRISPR gRNA sequence
actataaaagagttttggtg

SEQ ID NO: 628550 - DNA, 20 bp, Artificial
  CRISPR gRNA sequence
taaaagagttttggtgcttg

SEQ ID NO: 628551 - DNA, 20 bp, Artificial
  CRISPR gRNA sequence
tggtgcttgcaacgggaaaa

SEQ ID NO: 628552 - DNA, 20 bp, Artificial
  CRISPR gRNA sequence
ggtgcttgcaacgggaaaag

SEQ ID NO: 628553 - DNA, 20 bp, Artificial
  CRISPR gRNA sequence
gtgcttgcaacgggaaaagt

SEQ ID NO: 628554 - DNA, 20 bp, Artificial
  CRISPR gRNA sequence
gcaacgggaaaagtagtttt

SEQ ID NO: 628555 - DNA, 20 bp, Artificial
  CRISPR gRNA sequence
caacgggaaaagtagttttg

SEQ ID NO: 628556 - DNA, 20 bp, Artificial
  CRISPR gRNA sequence
tgatttttagccagatattg

SEQ ID NO: 628557 - DNA, 20 bp, Artificial
  CRISPR gRNA sequence
gatttttagccagatattgc

SEQ ID NO: 628558 - DNA, 20 bp, Artificial
  CRISPR gRNA sequence
atttttagccagatattgct

SEQ ID NO: 628559 - DNA, 20 bp, Artificial
  CRISPR gRNA sequence
ttagccagatattgctggtt

SEQ ID NO: 628560 - DNA, 20 bp, Artificial
  CRISPR gRNA sequence
tagccagatattgctggttt

SEQ ID NO: 628561 - DNA, 20 bp, Artificial
  CRISPR gRNA sequence
agccagatattgctggtttt

SEQ ID NO: 628562 - DNA, 20 bp, Artificial
  CRISPR gRNA sequence
gccagatattgctggttttg

SEQ ID NO: 628563 - DNA, 20 bp, Artificial
  CRISPR gRNA sequence
ctggttttgaacagaatatt

SEQ ID NO: 628564 - DNA, 20 bp, Artificial
  CRISPR gRNA sequence
gttttgaacagaatatttag

SEQ ID NO: 628565 - DNA, 20 bp, Artificial
  CRISPR gRNA sequence
tgaacagaatatttagtctt

SEQ ID NO: 628566 - DNA, 20 bp, Artificial
  CRISPR gRNA sequence
gaacagaatatttagtcttt

SEQ ID NO: 628567 - DNA, 20 bp, Artificial
  CRISPR gRNA sequence
aacagaatatttagtctttt

SEQ ID NO: 628568 - DNA, 20 bp, Artificial
  CRISPR gRNA sequence
agtcttttacaaattctgtc

SEQ ID NO: 628569 - DNA, 20 bp, Artificial
  CRISPR gRNA sequence
gtcttttacaaattctgtcc

SEQ ID NO: 628570 - DNA, 20 bp, Artificial
  CRISPR gRNA sequence
ttacaaattctgtccctaag

SEQ ID NO: 628571 - DNA, 20 bp, Artificial
  CRISPR gRNA sequence
tacaaattctgtccctaaga

SEQ ID NO: 628572 - DNA, 20 bp, Artificial
  CRISPR gRNA sequence
acaaattctgtccctaagac

SEQ ID NO: 628573 - DNA, 20 bp, Artificial
  CRISPR gRNA sequence
caaattctgtccctaagaca

SEQ ID NO: 628574 - DNA, 20 bp, Artificial
  CRISPR gRNA sequence
tgtccctaagacaatgtggt

SEQ ID NO: 628575 - DNA, 20 bp, Artificial
  CRISPR gRNA sequence
tccctaagacaatgtggtct

SEQ ID NO: 628576 - DNA, 20 bp, Artificial
  CRISPR gRNA sequence
agacaatgtggtctctattt

SEQ ID NO: 628577 - DNA, 20 bp, Artificial
  CRISPR gRNA sequence
tatttaccagttactttcat

SEQ ID NO: 628578 - DNA, 20 bp, Artificial
  CRISPR gRNA sequence
tttaccagttactttcatag

SEQ ID NO: 628579 - DNA, 20 bp, Artificial
  CRISPR gRNA sequence
accagttactttcataggta

SEQ ID NO: 628580 - DNA, 20 bp, Artificial
  CRISPR gRNA sequence
ccagttactttcataggtaa

SEQ ID NO: 628581 - DNA, 20 bp, Artificial
  CRISPR gRNA sequence
ctttcataggtaaatcttac

SEQ ID NO: 628582 - DNA, 20 bp, Artificial
  CRISPR gRNA sequence
tcataggtaaatcttacaga

SEQ ID NO: 628583 - DNA, 20 bp, Artificial
  CRISPR gRNA sequence
cataggtaaatcttacagat

SEQ ID NO: 628584 - DNA, 20 bp, Artificial
  CRISPR gRNA sequence
ataggtaaatcttacagata

SEQ ID NO: 628585 - DNA, 20 bp, Artificial
  CRISPR gRNA sequence
acagataaatgcttcttaaa

SEQ ID NO: 628586 - DNA, 20 bp, Artificial
  CRISPR gRNA sequence
cagataaatgcttcttaaaa

SEQ ID NO: 628587 - DNA, 20 bp, Artificial
  CRISPR gRNA sequence
cttaaaaacatatgtgggtt

SEQ ID NO: 628588 - DNA, 20 bp, Artificial
  CRISPR gRNA sequence
ttaaaaacatatgtgggttt

SEQ ID NO: 628589 - DNA, 20 bp, Artificial
  CRISPR gRNA sequence
aaaaacatatgtgggtttcc

SEQ ID NO: 628590 - DNA, 20 bp, Artificial
  CRISPR gRNA sequence
aaaacatatgtgggtttccc

SEQ ID NO: 628591 - DNA, 20 bp, Artificial
  CRISPR gRNA sequence
cccataaatggttaatatgt

SEQ ID NO: 628592 - DNA, 20 bp, Artificial
  CRISPR gRNA sequence
ccataaatggttaatatgtt

SEQ ID NO: 628593 - DNA, 20 bp, Artificial
  CRISPR gRNA sequence
atatgttgttgtggatggat

SEQ ID NO: 628594 - DNA, 20 bp, Artificial
  CRISPR gRNA sequence
ttgtggatggatgcttaact

SEQ ID NO: 628595 - DNA, 20 bp, Artificial
  CRISPR gRNA sequence
tggatggatgcttaacttgt

SEQ ID NO: 628596 - DNA, 20 bp, Artificial
  CRISPR gRNA sequence
aacttgtaattttggcagat

SEQ ID NO: 628597 - DNA, 20 bp, Artificial
  CRISPR gRNA sequence
acttgtaattttggcagata

SEQ ID NO: 628598 - DNA, 20 bp, Artificial
  CRISPR gRNA sequence
gtaattttggcagatactct

SEQ ID NO: 628599 - DNA, 20 bp, Artificial
  CRISPR gRNA sequence
taattttggcagatactctc

SEQ ID NO: 628600 - DNA, 20 bp, Artificial
  CRISPR gRNA sequence
tggcagatactctcagattg

SEQ ID NO: 628601 - DNA, 20 bp, Artificial
  CRISPR gRNA sequence
ggcagatactctcagattgg

SEQ ID NO: 628602 - DNA, 20 bp, Artificial
  CRISPR gRNA sequence
gcagatactctcagattgga

SEQ ID NO: 628603 - DNA, 20 bp, Artificial
  CRISPR gRNA sequence
tcagattggaagaaatggcc

SEQ ID NO: 628604 - DNA, 20 bp, Artificial
  CRISPR gRNA sequence
agattggaagaaatggcccc

SEQ ID NO: 628605 - DNA, 20 bp, Artificial
  CRISPR gRNA sequence
gaagaaatggcccctacgtg

SEQ ID NO: 628606 - DNA, 20 bp, Artificial
  CRISPR gRNA sequence
cgtgagatcagtgtaatgat

SEQ ID NO: 628607 - DNA, 20 bp, Artificial
  CRISPR gRNA sequence
gagtaacaaaaatggaaaca

SEQ ID NO: 628608 - DNA, 20 bp, Artificial
  CRISPR gRNA sequence
tttcatggcactcaacttaa

SEQ ID NO: 628609 - DNA, 20 bp, Artificial
  CRISPR gRNA sequence
catggcactcaacttaagat

SEQ ID NO: 628610 - DNA, 20 bp, Artificial
  CRISPR gRNA sequence
atggcactcaacttaagata

SEQ ID NO: 628611 - DNA, 20 bp, Artificial
  CRISPR gRNA sequence
aacttaagatatatgcaatg

SEQ ID NO: 628612 - DNA, 20 bp, Artificial
  CRISPR gRNA sequence
aagatatatgcaatgtcaaa

SEQ ID NO: 628613 - DNA, 20 bp, Artificial
  CRISPR gRNA sequence
agatatatgcaatgtcaaac

SEQ ID NO: 628614 - DNA, 20 bp, Artificial
  CRISPR gRNA sequence
ccaaattaagctagacaaac

SEQ ID NO: 628615 - DNA, 20 bp, Artificial
  CRISPR gRNA sequence
caaattaagctagacaaacc

SEQ ID NO: 628616 - DNA, 20 bp, Artificial
  CRISPR gRNA sequence
agctagacaaacctgatcta

SEQ ID NO: 628617 - DNA, 20 bp, Artificial
  CRISPR gRNA sequence
gacaaacctgatctatattc

SEQ ID NO: 628618 - DNA, 20 bp, Artificial
  CRISPR gRNA sequence
atctatattcttaaagaact

SEQ ID NO: 628619 - DNA, 20 bp, Artificial
  CRISPR gRNA sequence
tattcttaaagaacttacag

SEQ ID NO: 628620 - DNA, 20 bp, Artificial
  CRISPR gRNA sequence
ttaaagaacttacagtttgg

SEQ ID NO: 628621 - DNA, 20 bp, Artificial
  CRISPR gRNA sequence
aaagaacttacagtttggaa

SEQ ID NO: 628622 - DNA, 20 bp, Artificial
  CRISPR gRNA sequence
aagaacttacagtttggaag

SEQ ID NO: 628623 - DNA, 20 bp, Artificial
  CRISPR gRNA sequence
acagtttggaaggaacaata

SEQ ID NO: 628624 - DNA, 20 bp, Artificial
  CRISPR gRNA sequence
cagtttggaaggaacaatag

SEQ ID NO: 628625 - DNA, 20 bp, Artificial
  CRISPR gRNA sequence
ggaaggaacaatagcaattt

SEQ ID NO: 628626 - DNA, 20 bp, Artificial
  CRISPR gRNA sequence
gaaggaacaatagcaattta

SEQ ID NO: 628627 - DNA, 20 bp, Artificial
  CRISPR gRNA sequence
aaggatcatttacaacatag

SEQ ID NO: 628628 - DNA, 20 bp, Artificial
  CRISPR gRNA sequence
aggatcatttacaacatagt

SEQ ID NO: 628629 - DNA, 20 bp, Artificial
  CRISPR gRNA sequence
acaacatagtgtggtatgtg

SEQ ID NO: 628630 - DNA, 20 bp, Artificial
  CRISPR gRNA sequence
caacatagtgtggtatgtgt

SEQ ID NO: 628631 - DNA, 20 bp, Artificial
  CRISPR gRNA sequence
agctcataccaggggactaa

SEQ ID NO: 628632 - DNA, 20 bp, Artificial
  CRISPR gRNA sequence
gctcataccaggggactaaa

SEQ ID NO: 628633 - DNA, 20 bp, Artificial
  CRISPR gRNA sequence
ataccaggggactaaaggaa

SEQ ID NO: 628634 - DNA, 20 bp, Artificial
  CRISPR gRNA sequence
aaggaacacttcttgaagga

SEQ ID NO: 628635 - DNA, 20 bp, Artificial
  CRISPR gRNA sequence
cttgaaggaaatggaatcaa

SEQ ID NO: 628636 - DNA, 20 bp, Artificial
  CRISPR gRNA sequence
ttgaaggaaatggaatcaag

SEQ ID NO: 628637 - DNA, 20 bp, Artificial
  CRISPR gRNA sequence
gaaggaaatggaatcaagga

SEQ ID NO: 628638 - DNA, 20 bp, Artificial
  CRISPR gRNA sequence
aaggaaatggaatcaaggac

SEQ ID NO: 628639 - DNA, 20 bp, Artificial
  CRISPR gRNA sequence
taaacatagccaagtgaaga

SEQ ID NO: 628640 - DNA, 20 bp, Artificial
  CRISPR gRNA sequence
gtagaaaggatcagaggcaa

SEQ ID NO: 628641 - DNA, 20 bp, Artificial
  CRISPR gRNA sequence
ataaaggaggaattacttat

SEQ ID NO: 628642 - DNA, 20 bp, Artificial
  CRISPR gRNA sequence
taaaggaggaattacttata

SEQ ID NO: 628643 - DNA, 20 bp, Artificial
  CRISPR gRNA sequence
cttatacttcaataaggctg

SEQ ID NO: 628644 - DNA, 20 bp, Artificial
  CRISPR gRNA sequence
atacttcaataaggctgaga

SEQ ID NO: 628645 - DNA, 20 bp, Artificial
  CRISPR gRNA sequence
tacttcaataaggctgagag

SEQ ID NO: 628646 - DNA, 20 bp, Artificial
  CRISPR gRNA sequence
caataaggctgagagtagaa

SEQ ID NO: 628647 - DNA, 20 bp, Artificial
  CRISPR gRNA sequence
aataaggctgagagtagaaa

SEQ ID NO: 628648 - DNA, 20 bp, Artificial
  CRISPR gRNA sequence
agagtagaaacaagtgcgaa

SEQ ID NO: 628649 - DNA, 20 bp, Artificial
  CRISPR gRNA sequence
gataatataaggctaaatat

SEQ ID NO: 628650 - DNA, 20 bp, Artificial
  CRISPR gRNA sequence
aatatgctaaaaatttgaat

SEQ ID NO: 628651 - DNA, 20 bp, Artificial
  CRISPR gRNA sequence
aaaatttgaatatttcccta

SEQ ID NO: 628652 - DNA, 20 bp, Artificial
  CRISPR gRNA sequence
gaatatttccctaaaggaat

SEQ ID NO: 628653 - DNA, 20 bp, Artificial
  CRISPR gRNA sequence
aatatttccctaaaggaata

SEQ ID NO: 628654 - DNA, 20 bp, Artificial
  CRISPR gRNA sequence
ccctaaaggaatacagattg

SEQ ID NO: 628655 - DNA, 20 bp, Artificial
  CRISPR gRNA sequence
cctaaaggaatacagattga

SEQ ID NO: 628656 - DNA, 20 bp, Artificial
  CRISPR gRNA sequence
aaggaatacagattgaaggg

SEQ ID NO: 628657 - DNA, 20 bp, Artificial
  CRISPR gRNA sequence
aaggggataaacaaggaagt

SEQ ID NO: 628658 - DNA, 20 bp, Artificial
  CRISPR gRNA sequence
aaggtattcatttagcaaag

SEQ ID NO: 628659 - DNA, 20 bp, Artificial
  CRISPR gRNA sequence
atttagcaaaggggtttagg

SEQ ID NO: 628660 - DNA, 20 bp, Artificial
  CRISPR gRNA sequence
agcaaaggggtttaggaaat

SEQ ID NO: 628661 - DNA, 20 bp, Artificial
  CRISPR gRNA sequence
gcaaaggggtttaggaaatt

SEQ ID NO: 628662 - DNA, 20 bp, Artificial
  CRISPR gRNA sequence
aggaaattgctgctctaggt

SEQ ID NO: 628663 - DNA, 20 bp, Artificial
  CRISPR gRNA sequence
ggaaattgctgctctaggtt

SEQ ID NO: 628664 - DNA, 20 bp, Artificial
  CRISPR gRNA sequence
ctgctctaggtttctggcct

SEQ ID NO: 628665 - DNA, 20 bp, Artificial
  CRISPR gRNA sequence
ctctaggtttctggcctagg

SEQ ID NO: 628666 - DNA, 20 bp, Artificial
  CRISPR gRNA sequence
taggtttctggcctaggaaa

SEQ ID NO: 628667 - DNA, 20 bp, Artificial
  CRISPR gRNA sequence
ggtttctggcctaggaaatt

SEQ ID NO: 628668 - DNA, 20 bp, Artificial
  CRISPR gRNA sequence
ctggcctaggaaatttagta

SEQ ID NO: 628669 - DNA, 20 bp, Artificial
  CRISPR gRNA sequence
tggcctaggaaatttagtag

SEQ ID NO: 628670 - DNA, 20 bp, Artificial
  CRISPR gRNA sequence
gcctaggaaatttagtagat

SEQ ID NO: 628671 - DNA, 20 bp, Artificial
  CRISPR gRNA sequence
ggaaatttagtagatgacaa

SEQ ID NO: 628672 - DNA, 20 bp, Artificial
  CRISPR gRNA sequence
agtagatgacaatgagatag

SEQ ID NO: 628673 - DNA, 20 bp, Artificial
  CRISPR gRNA sequence
gtagatgacaatgagataga

SEQ ID NO: 628674 - DNA, 20 bp, Artificial
  CRISPR gRNA sequence
agtttgggaggactatgagt

SEQ ID NO: 628675 - DNA, 20 bp, Artificial
  CRISPR gRNA sequence
gggaggactatgagtaataa

SEQ ID NO: 628676 - DNA, 20 bp, Artificial
  CRISPR gRNA sequence
ggaggactatgagtaataat

SEQ ID NO: 628677 - DNA, 20 bp, Artificial
  CRISPR gRNA sequence
tgagtaataataatgtccag

SEQ ID NO: 628678 - DNA, 20 bp, Artificial
  CRISPR gRNA sequence
agtctcaaattcagaagaga

SEQ ID NO: 628679 - DNA, 20 bp, Artificial
  CRISPR gRNA sequence
gtctcaaattcagaagagag

SEQ ID NO: 628680 - DNA, 20 bp, Artificial
  CRISPR gRNA sequence
aaattcagaagagagacctg

SEQ ID NO: 628681 - DNA, 20 bp, Artificial
  CRISPR gRNA sequence
agaagagagacctgggcttg

SEQ ID NO: 628682 - DNA, 20 bp, Artificial
  CRISPR gRNA sequence
ggcttgagatgtagaaatga

SEQ ID NO: 628683 - DNA, 20 bp, Artificial
  CRISPR gRNA sequence
gagatgtagaaatgagtcat

SEQ ID NO: 628684 - DNA, 20 bp, Artificial
  CRISPR gRNA sequence
agatgtagaaatgagtcatc

SEQ ID NO: 628685 - DNA, 20 bp, Artificial
  CRISPR gRNA sequence
atagaaagcaacttctgaag

SEQ ID NO: 628686 - DNA, 20 bp, Artificial
  CRISPR gRNA sequence
ctgaagccaaggaaataact

SEQ ID NO: 628687 - DNA, 20 bp, Artificial
  CRISPR gRNA sequence
tgaagccaaggaaataactg

SEQ ID NO: 628688 - DNA, 20 bp, Artificial
  CRISPR gRNA sequence
aagccaaggaaataactgat

SEQ ID NO: 628689 - DNA, 20 bp, Artificial
  CRISPR gRNA sequence
atatcacccaggtagagtgt

SEQ ID NO: 628690 - DNA, 20 bp, Artificial
  CRISPR gRNA sequence
gaataacactaagatttgtc

SEQ ID NO: 628691 - DNA, 20 bp, Artificial
  CRISPR gRNA sequence
agatttgtctgcctactcat

SEQ ID NO: 628692 - DNA, 20 bp, Artificial
  CRISPR gRNA sequence
gtctgcctactcatagatca

SEQ ID NO: 628693 - DNA, 20 bp, Artificial
  CRISPR gRNA sequence
tctgcctactcatagatcag

SEQ ID NO: 628694 - DNA, 20 bp, Artificial
  CRISPR gRNA sequence
cctactcatagatcagggaa

SEQ ID NO: 628695 - DNA, 20 bp, Artificial
  CRISPR gRNA sequence
ctcatagatcagggaaagtg

SEQ ID NO: 628696 - DNA, 20 bp, Artificial
  CRISPR gRNA sequence
atagatcagggaaagtgggg

SEQ ID NO: 628697 - DNA, 20 bp, Artificial
  CRISPR gRNA sequence
gcactgggccccatgtttag

SEQ ID NO: 628698 - DNA, 20 bp, Artificial
  CRISPR gRNA sequence
cactgggccccatgtttagg

SEQ ID NO: 628699 - DNA, 20 bp, Artificial
  CRISPR gRNA sequence
ggccccatgtttagggagcc

SEQ ID NO: 628700 - DNA, 20 bp, Artificial
  CRISPR gRNA sequence
agggagccctgggcctttct

SEQ ID NO: 628701 - DNA, 20 bp, Artificial
  CRISPR gRNA sequence
gggagccctgggcctttctt

SEQ ID NO: 628702 - DNA, 20 bp, Artificial
  CRISPR gRNA sequence
ggcctttcttctcaggaaat

SEQ ID NO: 628703 - DNA, 20 bp, Artificial
  CRISPR gRNA sequence
tcttctcaggaaatgaggag

SEQ ID NO: 628704 - DNA, 20 bp, Artificial
  CRISPR gRNA sequence
cttctcaggaaatgaggagc

SEQ ID NO: 628705 - DNA, 20 bp, Artificial
  CRISPR gRNA sequence
ttctcaggaaatgaggagct

SEQ ID NO: 628706 - DNA, 20 bp, Artificial
  CRISPR gRNA sequence
ctcaggaaatgaggagcttc

SEQ ID NO: 628707 - DNA, 20 bp, Artificial
  CRISPR gRNA sequence
tcaggaaatgaggagcttct

SEQ ID NO: 628708 - DNA, 20 bp, Artificial
  CRISPR gRNA sequence
aggaaatgaggagcttctag

SEQ ID NO: 628709 - DNA, 20 bp, Artificial
  CRISPR gRNA sequence
ctagggccaagggaatgtgc

SEQ ID NO: 628710 - DNA, 20 bp, Artificial
  CRISPR gRNA sequence
tagggccaagggaatgtgct

SEQ ID NO: 628711 - DNA, 20 bp, Artificial
  CRISPR gRNA sequence
gggccaagggaatgtgctga

SEQ ID NO: 628712 - DNA, 20 bp, Artificial
  CRISPR gRNA sequence
atctgaagctcactcagacc

SEQ ID NO: 628713 - DNA, 20 bp, Artificial
  CRISPR gRNA sequence
aagctcactcagaccccaga

SEQ ID NO: 628714 - DNA, 20 bp, Artificial
  CRISPR gRNA sequence
actcagaccccagaattcct

SEQ ID NO: 628715 - DNA, 20 bp, Artificial
  CRISPR gRNA sequence
agaccccagaattccttgcc

SEQ ID NO: 628716 - DNA, 20 bp, Artificial
  CRISPR gRNA sequence
cttgcccaaatggttctgag

SEQ ID NO: 628717 - DNA, 20 bp, Artificial
  CRISPR gRNA sequence
gcccaaatggttctgagcct

SEQ ID NO: 628718 - DNA, 20 bp, Artificial
  CRISPR gRNA sequence
cccaaatggttctgagcctg

SEQ ID NO: 628719 - DNA, 20 bp, Artificial
  CRISPR gRNA sequence
tgagcctgcttctagggact

SEQ ID NO: 628720 - DNA, 20 bp, Artificial
  CRISPR gRNA sequence
agcctgcttctagggactac

SEQ ID NO: 628721 - DNA, 20 bp, Artificial
  CRISPR gRNA sequence
cttctagggactacacagtc

SEQ ID NO: 628722 - DNA, 20 bp, Artificial
  CRISPR gRNA sequence
ctagggactacacagtcctc

SEQ ID NO: 628723 - DNA, 20 bp, Artificial
  CRISPR gRNA sequence
tagggactacacagtcctct

SEQ ID NO: 628724 - DNA, 20 bp, Artificial
  CRISPR gRNA sequence
gggactacacagtcctcttc

SEQ ID NO: 628725 - DNA, 20 bp, Artificial
  CRISPR gRNA sequence
cacagtcctcttcatagggt

SEQ ID NO: 628726 - DNA, 20 bp, Artificial
  CRISPR gRNA sequence
ttcatagggtccataatact

SEQ ID NO: 628727 - DNA, 20 bp, Artificial
  CRISPR gRNA sequence
catagggtccataatacttc

SEQ ID NO: 628728 - DNA, 20 bp, Artificial
  CRISPR gRNA sequence
atagggtccataatacttca

SEQ ID NO: 628729 - DNA, 20 bp, Artificial
  CRISPR gRNA sequence
cataccaactgtgctactgg

SEQ ID NO: 628730 - DNA, 20 bp, Artificial
  CRISPR gRNA sequence
ataccaactgtgctactggt

SEQ ID NO: 628731 - DNA, 20 bp, Artificial
  CRISPR gRNA sequence
tgctactggtaagcacacac

SEQ ID NO: 628732 - DNA, 20 bp, Artificial
  CRISPR gRNA sequence
ctggtaagcacacacctagg

SEQ ID NO: 628733 - DNA, 20 bp, Artificial
  CRISPR gRNA sequence
gtaagcacacacctaggcct

SEQ ID NO: 628734 - DNA, 20 bp, Artificial
  CRISPR gRNA sequence
ggcctgatggccaaggcact

SEQ ID NO: 628735 - DNA, 20 bp, Artificial
  CRISPR gRNA sequence
atggccaaggcactggtctt

SEQ ID NO: 628736 - DNA, 20 bp, Artificial
  CRISPR gRNA sequence
gtctttatgtgcaatgtaaa

SEQ ID NO: 628737 - DNA, 20 bp, Artificial
  CRISPR gRNA sequence
tatgtgcaatgtaaaaagaa

SEQ ID NO: 628738 - DNA, 20 bp, Artificial
  CRISPR gRNA sequence
atgtgcaatgtaaaaagaac

SEQ ID NO: 628739 - DNA, 20 bp, Artificial
  CRISPR gRNA sequence
tgtgcaatgtaaaaagaacc

SEQ ID NO: 628740 - DNA, 20 bp, Artificial
  CRISPR gRNA sequence
gatatgcaggctggggtgtc

SEQ ID NO: 628741 - DNA, 20 bp, Artificial
  CRISPR gRNA sequence
gggtgtccatacatgtgtgt

SEQ ID NO: 628742 - DNA, 20 bp, Artificial
  CRISPR gRNA sequence
tggtaatggagagaactagg

SEQ ID NO: 628743 - DNA, 20 bp, Artificial
  CRISPR gRNA sequence
ggtaatggagagaactagga

SEQ ID NO: 628744 - DNA, 20 bp, Artificial
  CRISPR gRNA sequence
gtaatggagagaactaggag

SEQ ID NO: 628745 - DNA, 20 bp, Artificial
  CRISPR gRNA sequence
ggagtgggtctaagagagga

SEQ ID NO: 628746 - DNA, 20 bp, Artificial
  CRISPR gRNA sequence
agagaggagcctagctgtaa

SEQ ID NO: 628747 - DNA, 20 bp, Artificial
  CRISPR gRNA sequence
gctgtaagccagtgggtggt

SEQ ID NO: 628748 - DNA, 20 bp, Artificial
  CRISPR gRNA sequence
taagccagtgggtggttctg

SEQ ID NO: 628749 - DNA, 20 bp, Artificial
  CRISPR gRNA sequence
tgctcgtgctgccaaggtgt

SEQ ID NO: 628750 - DNA, 20 bp, Artificial
  CRISPR gRNA sequence
ctcgtgctgccaaggtgtag

SEQ ID NO: 628751 - DNA, 20 bp, Artificial
  CRISPR gRNA sequence
gtgctgccaaggtgtagtgt

SEQ ID NO: 628752 - DNA, 20 bp, Artificial
  CRISPR gRNA sequence
ccaaggtgtagtgtagagct

SEQ ID NO: 628753 - DNA, 20 bp, Artificial
  CRISPR gRNA sequence
caggaaatctgagaattgca

SEQ ID NO: 628754 - DNA, 20 bp, Artificial
  CRISPR gRNA sequence
agaattgcatatttatttga

SEQ ID NO: 628755 - DNA, 20 bp, Artificial
  CRISPR gRNA sequence
catatttatttgaacttagt

SEQ ID NO: 628756 - DNA, 20 bp, Artificial
  CRISPR gRNA sequence
atttgaacttagtcaagttg

SEQ ID NO: 628757 - DNA, 20 bp, Artificial
  CRISPR gRNA sequence
tttgaacttagtcaagttgg

SEQ ID NO: 628758 - DNA, 20 bp, Artificial
  CRISPR gRNA sequence
gaacttagtcaagttggaag

SEQ ID NO: 628759 - DNA, 20 bp, Artificial
  CRISPR gRNA sequence
aacttagtcaagttggaagg

SEQ ID NO: 628760 - DNA, 20 bp, Artificial
  CRISPR gRNA sequence
agtcaagttggaagggtaga

SEQ ID NO: 628761 - DNA, 20 bp, Artificial
  CRISPR gRNA sequence
gtcaagttggaagggtagaa

SEQ ID NO: 628762 - DNA, 20 bp, Artificial
  CRISPR gRNA sequence
gaagggtagaaaataagttt

SEQ ID NO: 628763 - DNA, 20 bp, Artificial
  CRISPR gRNA sequence
tacagttagatttataatat

SEQ ID NO: 628764 - DNA, 20 bp, Artificial
  CRISPR gRNA sequence
acagttagatttataatata

SEQ ID NO: 628765 - DNA, 20 bp, Artificial
  CRISPR gRNA sequence
cagttagatttataatataa

SEQ ID NO: 628766 - DNA, 20 bp, Artificial
  CRISPR gRNA sequence
gatttataatataaaaatat

SEQ ID NO: 628767 - DNA, 20 bp, Artificial
  CRISPR gRNA sequence
ataatataaaaatatttagg

SEQ ID NO: 628768 - DNA, 20 bp, Artificial
  CRISPR gRNA sequence
taatataaaaatatttaggc

SEQ ID NO: 628769 - DNA, 20 bp, Artificial
  CRISPR gRNA sequence
aggcatatgaatgggggcct

SEQ ID NO: 628770 - DNA, 20 bp, Artificial
  CRISPR gRNA sequence
ggcatatgaatgggggcctc

SEQ ID NO: 628771 - DNA, 20 bp, Artificial
  CRISPR gRNA sequence
catttgtactttggccaact

SEQ ID NO: 628772 - DNA, 20 bp, Artificial
  CRISPR gRNA sequence
gtactttggccaacttgcat

SEQ ID NO: 628773 - DNA, 20 bp, Artificial
  CRISPR gRNA sequence
tactttggccaacttgcata

SEQ ID NO: 628774 - DNA, 20 bp, Artificial
  CRISPR gRNA sequence
tggccaacttgcatagctgt

SEQ ID NO: 628775 - DNA, 20 bp, Artificial
  CRISPR gRNA sequence
ggccaacttgcatagctgtt

SEQ ID NO: 628776 - DNA, 20 bp, Artificial
  CRISPR gRNA sequence
gccaacttgcatagctgtta

SEQ ID NO: 628777 - DNA, 20 bp, Artificial
  CRISPR gRNA sequence
gcatagctgttaaggataag

SEQ ID NO: 628778 - DNA, 20 bp, Artificial
  CRISPR gRNA sequence
catagctgttaaggataagt

SEQ ID NO: 628779 - DNA, 20 bp, Artificial
  CRISPR gRNA sequence
ttaaggataagtctgaaaga

SEQ ID NO: 628780 - DNA, 20 bp, Artificial
  CRISPR gRNA sequence
aggataagtctgaaagaata

SEQ ID NO: 628781 - DNA, 20 bp, Artificial
  CRISPR gRNA sequence
aaagaatactgaacacagtc

SEQ ID NO: 628782 - DNA, 20 bp, Artificial
  CRISPR gRNA sequence
aacacagtcagagagagaga

SEQ ID NO: 628783 - DNA, 20 bp, Artificial
  CRISPR gRNA sequence
ccaaaggaattgactattca

SEQ ID NO: 628784 - DNA, 20 bp, Artificial
  CRISPR gRNA sequence
caaaggaattgactattcaa

SEQ ID NO: 628785 - DNA, 20 bp, Artificial
  CRISPR gRNA sequence
actattcaatagtggcagat

SEQ ID NO: 628786 - DNA, 20 bp, Artificial
  CRISPR gRNA sequence
ttcaatagtggcagatactc

SEQ ID NO: 628787 - DNA, 20 bp, Artificial
  CRISPR gRNA sequence
aatagtggcagatactctct

SEQ ID NO: 628788 - DNA, 20 bp, Artificial
  CRISPR gRNA sequence
tctaggagctgtgtaagata

SEQ ID NO: 628789 - DNA, 20 bp, Artificial
  CRISPR gRNA sequence
taggagctgtgtaagatact

SEQ ID NO: 628790 - DNA, 20 bp, Artificial
  CRISPR gRNA sequence
ggagctgtgtaagatactgt

SEQ ID NO: 628791 - DNA, 20 bp, Artificial
  CRISPR gRNA sequence
tgtaagatactgtcttaaaa

SEQ ID NO: 628792 - DNA, 20 bp, Artificial
  CRISPR gRNA sequence
tcttaaaagagtctactcga

SEQ ID NO: 628793 - DNA, 20 bp, Artificial
  CRISPR gRNA sequence
aaaagagtctactcgatttg

SEQ ID NO: 628794 - DNA, 20 bp, Artificial
  CRISPR gRNA sequence
aaagagtctactcgatttgg

SEQ ID NO: 628795 - DNA, 20 bp, Artificial
  CRISPR gRNA sequence
ctcgatttggcactacagaa

SEQ ID NO: 628796 - DNA, 20 bp, Artificial
  CRISPR gRNA sequence
gatttggcactacagaagct

SEQ ID NO: 628797 - DNA, 20 bp, Artificial
  CRISPR gRNA sequence
ggcactacagaagctagttg

SEQ ID NO: 628798 - DNA, 20 bp, Artificial
  CRISPR gRNA sequence
gcactacagaagctagttgt

SEQ ID NO: 628799 - DNA, 20 bp, Artificial
  CRISPR gRNA sequence
cagaagctagttgtgacctc

SEQ ID NO: 628800 - DNA, 20 bp, Artificial
  CRISPR gRNA sequence
gttgtgacctcagtgagaat

SEQ ID NO: 628801 - DNA, 20 bp, Artificial
  CRISPR gRNA sequence
tgacctcagtgagaataatt

SEQ ID NO: 628802 - DNA, 20 bp, Artificial
  CRISPR gRNA sequence
agtgagaataattttaatgg

SEQ ID NO: 628803 - DNA, 20 bp, Artificial
  CRISPR gRNA sequence
taatggagtgtgggaaagaa

SEQ ID NO: 628804 - DNA, 20 bp, Artificial
  CRISPR gRNA sequence
aatggagtgtgggaaagaaa

SEQ ID NO: 628805 - DNA, 20 bp, Artificial
  CRISPR gRNA sequence
atggagtgtgggaaagaaaa

SEQ ID NO: 628806 - DNA, 20 bp, Artificial
  CRISPR gRNA sequence
catggacttggaaatgaata

SEQ ID NO: 628807 - DNA, 20 bp, Artificial
  CRISPR gRNA sequence
ggaaatgaatagaaaaaaaa

SEQ ID NO: 628808 - DNA, 20 bp, Artificial
  CRISPR gRNA sequence
gaaatgaatagaaaaaaaaa

SEQ ID NO: 628809 - DNA, 20 bp, Artificial
  CRISPR gRNA sequence
aaaacaagcacagagattct

SEQ ID NO: 628810 - DNA, 20 bp, Artificial
  CRISPR gRNA sequence
tttcaacaatttcatctttg

SEQ ID NO: 628811 - DNA, 20 bp, Artificial
  CRISPR gRNA sequence
tcaacaatttcatctttgaa

SEQ ID NO: 628812 - DNA, 20 bp, Artificial
  CRISPR gRNA sequence
caacaatttcatctttgaag

SEQ ID NO: 628813 - DNA, 20 bp, Artificial
  CRISPR gRNA sequence
aacaatttcatctttgaaga

SEQ ID NO: 628814 - DNA, 20 bp, Artificial
  CRISPR gRNA sequence
catctttgaagaaaaggaga

SEQ ID NO: 628815 - DNA, 20 bp, Artificial
  CRISPR gRNA sequence
atctttgaagaaaaggagac

SEQ ID NO: 628816 - DNA, 20 bp, Artificial
  CRISPR gRNA sequence
tgaagaaaaggagactacag

SEQ ID NO: 628817 - DNA, 20 bp, Artificial
  CRISPR gRNA sequence
gaagaaaaggagactacagg

SEQ ID NO: 628818 - DNA, 20 bp, Artificial
  CRISPR gRNA sequence
aagaaaaggagactacaggt

SEQ ID NO: 628819 - DNA, 20 bp, Artificial
  CRISPR gRNA sequence
caggtgtacctggaaggaga

SEQ ID NO: 628820 - DNA, 20 bp, Artificial
  CRISPR gRNA sequence
gaaggagatggggcttaaag

SEQ ID NO: 628821 - DNA, 20 bp, Artificial
  CRISPR gRNA sequence
aaaggaagattttttttaat

SEQ ID NO: 628822 - DNA, 20 bp, Artificial
  CRISPR gRNA sequence
aaggaagattttttttaatt

SEQ ID NO: 628823 - DNA, 20 bp, Artificial
  CRISPR gRNA sequence
tttttaattatgagaattta

SEQ ID NO: 628824 - DNA, 20 bp, Artificial
  CRISPR gRNA sequence
ttttaattatgagaatttat

SEQ ID NO: 628825 - DNA, 20 bp, Artificial
  CRISPR gRNA sequence
tttaattatgagaatttatt

SEQ ID NO: 628826 - DNA, 20 bp, Artificial
  CRISPR gRNA sequence
ttaattatgagaatttattg

SEQ ID NO: 628827 - DNA, 20 bp, Artificial
  CRISPR gRNA sequence
taattatgagaatttattgc

SEQ ID NO: 628828 - DNA, 20 bp, Artificial
  CRISPR gRNA sequence
aattatgagaatttattgca

SEQ ID NO: 628829 - DNA, 20 bp, Artificial
  CRISPR gRNA sequence
attatgagaatttattgcat

SEQ ID NO: 628830 - DNA, 20 bp, Artificial
  CRISPR gRNA sequence
tgagaatttattgcattaaa

SEQ ID NO: 628831 - DNA, 20 bp, Artificial
  CRISPR gRNA sequence
attgcattaaatgctgatag

SEQ ID NO: 628832 - DNA, 20 bp, Artificial
  CRISPR gRNA sequence
ttgcattaaatgctgatagg

SEQ ID NO: 628833 - DNA, 20 bp, Artificial
  CRISPR gRNA sequence
cattaaatgctgataggaaa

SEQ ID NO: 628834 - DNA, 20 bp, Artificial
  CRISPR gRNA sequence
aatgctgataggaaatgccc

SEQ ID NO: 628835 - DNA, 20 bp, Artificial
  CRISPR gRNA sequence
ataggaaatgcccaatagag

SEQ ID NO: 628836 - DNA, 20 bp, Artificial
  CRISPR gRNA sequence
aaaatgtaagtgagaaagag

SEQ ID NO: 628837 - DNA, 20 bp, Artificial
  CRISPR gRNA sequence
gggggccaggataggagaat

SEQ ID NO: 628838 - DNA, 20 bp, Artificial
  CRISPR gRNA sequence
ctgtgcacaagagggggaat

SEQ ID NO: 628839 - DNA, 20 bp, Artificial
  CRISPR gRNA sequence
tgcacaagagggggaatgaa

SEQ ID NO: 628840 - DNA, 20 bp, Artificial
  CRISPR gRNA sequence
taattagaaagagggatagt

SEQ ID NO: 628841 - DNA, 20 bp, Artificial
  CRISPR gRNA sequence
aattagaaagagggatagtt

SEQ ID NO: 628842 - DNA, 20 bp, Artificial
  CRISPR gRNA sequence
attagaaagagggatagttg

SEQ ID NO: 628843 - DNA, 20 bp, Artificial
  CRISPR gRNA sequence
gaaagagggatagttgtttc

SEQ ID NO: 628844 - DNA, 20 bp, Artificial
  CRISPR gRNA sequence
tttcattgaaataaggaaaa

SEQ ID NO: 628845 - DNA, 20 bp, Artificial
  CRISPR gRNA sequence
cattgaaataaggaaaaaag

SEQ ID NO: 628846 - DNA, 20 bp, Artificial
  CRISPR gRNA sequence
attgaaataaggaaaaaaga

SEQ ID NO: 628847 - DNA, 20 bp, Artificial
  CRISPR gRNA sequence
aaataaggaaaaaagataaa

SEQ ID NO: 628848 - DNA, 20 bp, Artificial
  CRISPR gRNA sequence
acatggatgcatacaatcct

SEQ ID NO: 628849 - DNA, 20 bp, Artificial
  CRISPR gRNA sequence
catggatgcatacaatccta

SEQ ID NO: 628850 - DNA, 20 bp, Artificial
  CRISPR gRNA sequence
tagaattggtaatattatgt

SEQ ID NO: 628851 - DNA, 20 bp, Artificial
  CRISPR gRNA sequence
gtaatattatgttgaaatca

SEQ ID NO: 628852 - DNA, 20 bp, Artificial
  CRISPR gRNA sequence
tgttgaaatcagttccagcg

SEQ ID NO: 628853 - DNA, 20 bp, Artificial
  CRISPR gRNA sequence
aaatcagttccagcgatttt

SEQ ID NO: 628854 - DNA, 20 bp, Artificial
  CRISPR gRNA sequence
cagcgattttatcccctgtg

SEQ ID NO: 628855 - DNA, 20 bp, Artificial
  CRISPR gRNA sequence
tatcccctgtgaatatagat

SEQ ID NO: 628856 - DNA, 20 bp, Artificial
  CRISPR gRNA sequence
atcccctgtgaatatagata

SEQ ID NO: 628857 - DNA, 20 bp, Artificial
  CRISPR gRNA sequence
tcccctgtgaatatagatat

SEQ ID NO: 628858 - DNA, 20 bp, Artificial
  CRISPR gRNA sequence
tgaatatagatataagatca

SEQ ID NO: 628859 - DNA, 20 bp, Artificial
  CRISPR gRNA sequence
gcagagagtacagaaggttg

SEQ ID NO: 628860 - DNA, 20 bp, Artificial
  CRISPR gRNA sequence
cagagagtacagaaggttgg

SEQ ID NO: 628861 - DNA, 20 bp, Artificial
  CRISPR gRNA sequence
gcactgtcatggtggagagc

SEQ ID NO: 628862 - DNA, 20 bp, Artificial
  CRISPR gRNA sequence
tcatggtggagagcaggaga

SEQ ID NO: 628863 - DNA, 20 bp, Artificial
  CRISPR gRNA sequence
ttcagggatgctgctccata

SEQ ID NO: 628864 - DNA, 20 bp, Artificial
  CRISPR gRNA sequence
cagggatgctgctccatagg

SEQ ID NO: 628865 - DNA, 20 bp, Artificial
  CRISPR gRNA sequence
agggatgctgctccatagga

SEQ ID NO: 628866 - DNA, 20 bp, Artificial
  CRISPR gRNA sequence
ctccataggatggataggcc

SEQ ID NO: 628867 - DNA, 20 bp, Artificial
  CRISPR gRNA sequence
cataggatggataggccagc

SEQ ID NO: 628868 - DNA, 20 bp, Artificial
  CRISPR gRNA sequence
atatttgggatcagttattc

SEQ ID NO: 628869 - DNA, 20 bp, Artificial
  CRISPR gRNA sequence
gggatcagttattcattcat

SEQ ID NO: 628870 - DNA, 20 bp, Artificial
  CRISPR gRNA sequence
ggatcagttattcattcata

SEQ ID NO: 628871 - DNA, 20 bp, Artificial
  CRISPR gRNA sequence
ttcattcatatatattgatg

SEQ ID NO: 628872 - DNA, 20 bp, Artificial
  CRISPR gRNA sequence
attcatatatattgatgcca

SEQ ID NO: 628873 - DNA, 20 bp, Artificial
  CRISPR gRNA sequence
atatatattgatgccaactc

SEQ ID NO: 628874 - DNA, 20 bp, Artificial
  CRISPR gRNA sequence
atgccaactcatcagcctgt

SEQ ID NO: 628875 - DNA, 20 bp, Artificial
  CRISPR gRNA sequence
atcagcctgtggaattttct

SEQ ID NO: 628876 - DNA, 20 bp, Artificial
  CRISPR gRNA sequence
tggaattttctccaaaagta

SEQ ID NO: 628877 - DNA, 20 bp, Artificial
  CRISPR gRNA sequence
tctccaaaagtaccagatgt

SEQ ID NO: 628878 - DNA, 20 bp, Artificial
  CRISPR gRNA sequence
ctccaaaagtaccagatgtg

SEQ ID NO: 628879 - DNA, 20 bp, Artificial
  CRISPR gRNA sequence
tccaaaagtaccagatgtgc

SEQ ID NO: 628880 - DNA, 20 bp, Artificial
  CRISPR gRNA sequence
caaaagtaccagatgtgcag

SEQ ID NO: 628881 - DNA, 20 bp, Artificial
  CRISPR gRNA sequence
gggtgcacatctagtgagat

SEQ ID NO: 628882 - DNA, 20 bp, Artificial
  CRISPR gRNA sequence
gtgagatataagtatggaaa

SEQ ID NO: 628883 - DNA, 20 bp, Artificial
  CRISPR gRNA sequence
agtcagctttacaagacagt

SEQ ID NO: 628884 - DNA, 20 bp, Artificial
  CRISPR gRNA sequence
tacaagacagtagggtttca

SEQ ID NO: 628885 - DNA, 20 bp, Artificial
  CRISPR gRNA sequence
acaagacagtagggtttcat

SEQ ID NO: 628886 - DNA, 20 bp, Artificial
  CRISPR gRNA sequence
caagacagtagggtttcatc

SEQ ID NO: 628887 - DNA, 20 bp, Artificial
  CRISPR gRNA sequence
catcaggagaaggggatgat

SEQ ID NO: 628888 - DNA, 20 bp, Artificial
  CRISPR gRNA sequence
atcaggagaaggggatgata

SEQ ID NO: 628889 - DNA, 20 bp, Artificial
  CRISPR gRNA sequence
gcaagagagatgtagaagtg

SEQ ID NO: 628890 - DNA, 20 bp, Artificial
  CRISPR gRNA sequence
agctgaataagaaaagagag

SEQ ID NO: 628891 - DNA, 20 bp, Artificial
  CRISPR gRNA sequence
aataagaaaagagagggaga

SEQ ID NO: 628892 - DNA, 20 bp, Artificial
  CRISPR gRNA sequence
agggatcattggtctggaga

SEQ ID NO: 628893 - DNA, 20 bp, Artificial
  CRISPR gRNA sequence
gtctggagaatttgataagg

SEQ ID NO: 628894 - DNA, 20 bp, Artificial
  CRISPR gRNA sequence
gagaatttgataaggtcaaa

SEQ ID NO: 628895 - DNA, 20 bp, Artificial
  CRISPR gRNA sequence
gataaggtcaaagaatagta

SEQ ID NO: 628896 - DNA, 20 bp, Artificial
  CRISPR gRNA sequence
ataaggtcaaagaatagtat

SEQ ID NO: 628897 - DNA, 20 bp, Artificial
  CRISPR gRNA sequence
aactgaggcacatggagaag

SEQ ID NO: 628898 - DNA, 20 bp, Artificial
  CRISPR gRNA sequence
actgaggcacatggagaagg

SEQ ID NO: 628899 - DNA, 20 bp, Artificial
  CRISPR gRNA sequence
aggcacatggagaaggcaat

SEQ ID NO: 628900 - DNA, 20 bp, Artificial
  CRISPR gRNA sequence
ataataagtgtggaatgatg

SEQ ID NO: 628901 - DNA, 20 bp, Artificial
  CRISPR gRNA sequence
taataagtgtggaatgatga

SEQ ID NO: 628902 - DNA, 20 bp, Artificial
  CRISPR gRNA sequence
tttgtttcaagaacaataac

SEQ ID NO: 628903 - DNA, 20 bp, Artificial
  CRISPR gRNA sequence
ttgtttcaagaacaataaca

SEQ ID NO: 628904 - DNA, 20 bp, Artificial
  CRISPR gRNA sequence
tgtttcaagaacaataacag

SEQ ID NO: 628905 - DNA, 20 bp, Artificial
  CRISPR gRNA sequence
gtttcaagaacaataacaga

SEQ ID NO: 628906 - DNA, 20 bp, Artificial
  CRISPR gRNA sequence
tttcaagaacaataacagaa

SEQ ID NO: 628907 - DNA, 20 bp, Artificial
  CRISPR gRNA sequence
caagaacaataacagaagta

SEQ ID NO: 628908 - DNA, 20 bp, Artificial
  CRISPR gRNA sequence
aagaacaataacagaagtag

SEQ ID NO: 628909 - DNA, 20 bp, Artificial
  CRISPR gRNA sequence
ctatggctactgtttgttat

SEQ ID NO: 628910 - DNA, 20 bp, Artificial
  CRISPR gRNA sequence
tggctactgtttgttatata

SEQ ID NO: 628911 - DNA, 20 bp, Artificial
  CRISPR gRNA sequence
ctgtttgttatatattacta

SEQ ID NO: 628912 - DNA, 20 bp, Artificial
  CRISPR gRNA sequence
tttgttatatattactagga

SEQ ID NO: 628913 - DNA, 20 bp, Artificial
  CRISPR gRNA sequence
gttatatattactaggatag

SEQ ID NO: 628914 - DNA, 20 bp, Artificial
  CRISPR gRNA sequence
ttatatattactaggataga

SEQ ID NO: 628915 - DNA, 20 bp, Artificial
  CRISPR gRNA sequence
tatattactaggatagaatc

SEQ ID NO: 628916 - DNA, 20 bp, Artificial
  CRISPR gRNA sequence
ctaggatagaatccaaataa

SEQ ID NO: 628917 - DNA, 20 bp, Artificial
  CRISPR gRNA sequence
ggatagaatccaaataaaga

SEQ ID NO: 628918 - DNA, 20 bp, Artificial
  CRISPR gRNA sequence
tctcaaattcttaattaaaa

SEQ ID NO: 628919 - DNA, 20 bp, Artificial
  CRISPR gRNA sequence
tcaaattcttaattaaaaat

SEQ ID NO: 628920 - DNA, 20 bp, Artificial
  CRISPR gRNA sequence
aaattcttaattaaaaatat

SEQ ID NO: 628921 - DNA, 20 bp, Artificial
  CRISPR gRNA sequence
ttaattaaaaatataatata

SEQ ID NO: 628922 - DNA, 20 bp, Artificial
  CRISPR gRNA sequence
aattaaaaatataatataaa

SEQ ID NO: 628923 - DNA, 20 bp, Artificial
  CRISPR gRNA sequence
attaaaaatataatataaat

SEQ ID NO: 628924 - DNA, 20 bp, Artificial
  CRISPR gRNA sequence
aaaatataatataaatattt

SEQ ID NO: 628925 - DNA, 20 bp, Artificial
  CRISPR gRNA sequence
tagaatcataatgtaatttt

SEQ ID NO: 628926 - DNA, 20 bp, Artificial
  CRISPR gRNA sequence
agaatcataatgtaattttc

SEQ ID NO: 628927 - DNA, 20 bp, Artificial
  CRISPR gRNA sequence
gaatcataatgtaattttct

SEQ ID NO: 628928 - DNA, 20 bp, Artificial
  CRISPR gRNA sequence
tctaaaaagctgtccctctt

SEQ ID NO: 628929 - DNA, 20 bp, Artificial
  CRISPR gRNA sequence
ctaaaaagctgtccctcttt

SEQ ID NO: 628930 - DNA, 20 bp, Artificial
  CRISPR gRNA sequence
taaaaagctgtccctctttt

SEQ ID NO: 628931 - DNA, 20 bp, Artificial
  CRISPR gRNA sequence
aaaagctgtccctcttttct

SEQ ID NO: 628932 - DNA, 20 bp, Artificial
  CRISPR gRNA sequence
tccctcttttctaaggaatg

SEQ ID NO: 628933 - DNA, 20 bp, Artificial
  CRISPR gRNA sequence
ttttctaaggaatgcagtga

SEQ ID NO: 628934 - DNA, 20 bp, Artificial
  CRISPR gRNA sequence
ttctaaggaatgcagtgaaa

SEQ ID NO: 628935 - DNA, 20 bp, Artificial
  CRISPR gRNA sequence
tctaaggaatgcagtgaaat

SEQ ID NO: 628936 - DNA, 20 bp, Artificial
  CRISPR gRNA sequence
ctaaggaatgcagtgaaata

SEQ ID NO: 628937 - DNA, 20 bp, Artificial
  CRISPR gRNA sequence
taaggaatgcagtgaaataa

SEQ ID NO: 628938 - DNA, 20 bp, Artificial
  CRISPR gRNA sequence
aggaatgcagtgaaataaaa

SEQ ID NO: 628939 - DNA, 20 bp, Artificial
  CRISPR gRNA sequence
agagtaacatctctaagtca

SEQ ID NO: 628940 - DNA, 20 bp, Artificial
  CRISPR gRNA sequence
taagtcaggaaacatgacaa

SEQ ID NO: 628941 - DNA, 20 bp, Artificial
  CRISPR gRNA sequence
agtcaggaaacatgacaaaa

SEQ ID NO: 628942 - DNA, 20 bp, Artificial
  CRISPR gRNA sequence
caaagagtagactatataaa

SEQ ID NO: 628943 - DNA, 20 bp, Artificial
  CRISPR gRNA sequence
tataaattcagaagacagaa

SEQ ID NO: 628944 - DNA, 20 bp, Artificial
  CRISPR gRNA sequence
agaagacagaaagaataata

SEQ ID NO: 628945 - DNA, 20 bp, Artificial
  CRISPR gRNA sequence
tattttttccaactacatta

SEQ ID NO: 628946 - DNA, 20 bp, Artificial
  CRISPR gRNA sequence
attttttccaactacattag

SEQ ID NO: 628947 - DNA, 20 bp, Artificial
  CRISPR gRNA sequence
ttttttccaactacattaga

SEQ ID NO: 628948 - DNA, 20 bp, Artificial
  CRISPR gRNA sequence
tttccaactacattagagtc

SEQ ID NO: 628949 - DNA, 20 bp, Artificial
  CRISPR gRNA sequence
ttccaactacattagagtct

SEQ ID NO: 628950 - DNA, 20 bp, Artificial
  CRISPR gRNA sequence
tccaactacattagagtcta

SEQ ID NO: 628951 - DNA, 20 bp, Artificial
  CRISPR gRNA sequence
ccaactacattagagtctag

SEQ ID NO: 628952 - DNA, 20 bp, Artificial
  CRISPR gRNA sequence
caactacattagagtctagt

SEQ ID NO: 628953 - DNA, 20 bp, Artificial
  CRISPR gRNA sequence
cattagagtctagttagatt

SEQ ID NO: 628954 - DNA, 20 bp, Artificial
  CRISPR gRNA sequence
gagtctagttagatttaagc

SEQ ID NO: 628955 - DNA, 20 bp, Artificial
  CRISPR gRNA sequence
gttagatttaagcatttaat

SEQ ID NO: 628956 - DNA, 20 bp, Artificial
  CRISPR gRNA sequence
gatttaagcatttaatgaca

SEQ ID NO: 628957 - DNA, 20 bp, Artificial
  CRISPR gRNA sequence
aagcatttaatgacatccaa

SEQ ID NO: 628958 - DNA, 20 bp, Artificial
  CRISPR gRNA sequence
agcatttaatgacatccaac

SEQ ID NO: 628959 - DNA, 20 bp, Artificial
  CRISPR gRNA sequence
aatgacatccaacaaaaaaa

SEQ ID NO: 628960 - DNA, 20 bp, Artificial
  CRISPR gRNA sequence
atgacatccaacaaaaaaat

SEQ ID NO: 628961 - DNA, 20 bp, Artificial
  CRISPR gRNA sequence
aaaataagtaaactggctct

SEQ ID NO: 628962 - DNA, 20 bp, Artificial
  CRISPR gRNA sequence
gctctttatttctttttttt

SEQ ID NO: 628963 - DNA, 20 bp, Artificial
  CRISPR gRNA sequence
tttatttcttttttttcata

SEQ ID NO: 628964 - DNA, 20 bp, Artificial
  CRISPR gRNA sequence
tatttcttttttttcatagt

SEQ ID NO: 628965 - DNA, 20 bp, Artificial
  CRISPR gRNA sequence
atttcttttttttcatagtt

SEQ ID NO: 628966 - DNA, 20 bp, Artificial
  CRISPR gRNA sequence
tttcttttttttcatagtta

SEQ ID NO: 628967 - DNA, 20 bp, Artificial
  CRISPR gRNA sequence
cttttttttcatagttaccc

SEQ ID NO: 628968 - DNA, 20 bp, Artificial
  CRISPR gRNA sequence
ttttttttcatagttaccca

SEQ ID NO: 628969 - DNA, 20 bp, Artificial
  CRISPR gRNA sequence
ttttttcatagttacccaca

SEQ ID NO: 628970 - DNA, 20 bp, Artificial
  CRISPR gRNA sequence
tttttcatagttacccacaa

SEQ ID NO: 628971 - DNA, 20 bp, Artificial
  CRISPR gRNA sequence
ttttcatagttacccacaag

SEQ ID NO: 628972 - DNA, 20 bp, Artificial
  CRISPR gRNA sequence
tttcatagttacccacaaga

SEQ ID NO: 628973 - DNA, 20 bp, Artificial
  CRISPR gRNA sequence
ttcatagttacccacaagaa

SEQ ID NO: 628974 - DNA, 20 bp, Artificial
  CRISPR gRNA sequence
tcatagttacccacaagaac

SEQ ID NO: 628975 - DNA, 20 bp, Artificial
  CRISPR gRNA sequence
catagttacccacaagaaca

SEQ ID NO: 628976 - DNA, 20 bp, Artificial
  CRISPR gRNA sequence
atagttacccacaagaacag

SEQ ID NO: 628977 - DNA, 20 bp, Artificial
  CRISPR gRNA sequence
cccacaagaacagaaaaaaa

SEQ ID NO: 628978 - DNA, 20 bp, Artificial
  CRISPR gRNA sequence
ccaaaggcctgaggcagtcc

SEQ ID NO: 628979 - DNA, 20 bp, Artificial
  CRISPR gRNA sequence
aggcagtcctttgtgtataa

SEQ ID NO: 628980 - DNA, 20 bp, Artificial
  CRISPR gRNA sequence
tgtgtataactcaggggctt

SEQ ID NO: 628981 - DNA, 20 bp, Artificial
  CRISPR gRNA sequence
gtgtataactcaggggcttc

SEQ ID NO: 628982 - DNA, 20 bp, Artificial
  CRISPR gRNA sequence
tgtataactcaggggcttca

SEQ ID NO: 628983 - DNA, 20 bp, Artificial
  CRISPR gRNA sequence
aggggcttcaactgacataa

SEQ ID NO: 628984 - DNA, 20 bp, Artificial
  CRISPR gRNA sequence
caactgacataatataaact

SEQ ID NO: 628985 - DNA, 20 bp, Artificial
  CRISPR gRNA sequence
aactgacataatataaacta

SEQ ID NO: 628986 - DNA, 20 bp, Artificial
  CRISPR gRNA sequence
acataatataaactatggcc

SEQ ID NO: 628987 - DNA, 20 bp, Artificial
  CRISPR gRNA sequence
tggcccttatagtcaccctt

SEQ ID NO: 628988 - DNA, 20 bp, Artificial
  CRISPR gRNA sequence
atagtcacccttaggccttc

SEQ ID NO: 628989 - DNA, 20 bp, Artificial
  CRISPR gRNA sequence
tagtcacccttaggccttct

SEQ ID NO: 628990 - DNA, 20 bp, Artificial
  CRISPR gRNA sequence
aggccttctttcaatgagtt

SEQ ID NO: 628991 - DNA, 20 bp, Artificial
  CRISPR gRNA sequence
ggccttctttcaatgagttc

SEQ ID NO: 628992 - DNA, 20 bp, Artificial
  CRISPR gRNA sequence
ctttcaatgagttctcaata

SEQ ID NO: 628993 - DNA, 20 bp, Artificial
  CRISPR gRNA sequence
tttcaatgagttctcaataa

SEQ ID NO: 628994 - DNA, 20 bp, Artificial
  CRISPR gRNA sequence
tcaatgagttctcaataaat

SEQ ID NO: 628995 - DNA, 20 bp, Artificial
  CRISPR gRNA sequence
caatgagttctcaataaatc

SEQ ID NO: 628996 - DNA, 20 bp, Artificial
  CRISPR gRNA sequence
aatgagttctcaataaatcc

SEQ ID NO: 628997 - DNA, 20 bp, Artificial
  CRISPR gRNA sequence
tcaataaatccctccagcta

SEQ ID NO: 628998 - DNA, 20 bp, Artificial
  CRISPR gRNA sequence
aataaatccctccagctagt

SEQ ID NO: 628999 - DNA, 20 bp, Artificial
  CRISPR gRNA sequence
cagctagtcttagagtgcta

SEQ ID NO: 629000 - DNA, 20 bp, Artificial
  CRISPR gRNA sequence
gtcttagagtgctattttgg

SEQ ID NO: 629001 - DNA, 20 bp, Artificial
  CRISPR gRNA sequence
agagtgctattttggtgatg

SEQ ID NO: 629002 - DNA, 20 bp, Artificial
  CRISPR gRNA sequence
gagtgctattttggtgatgt

SEQ ID NO: 629003 - DNA, 20 bp, Artificial
  CRISPR gRNA sequence
ttttggtgatgtgttagttc

SEQ ID NO: 629004 - DNA, 20 bp, Artificial
  CRISPR gRNA sequence
tggtgatgtgttagttcttc

SEQ ID NO: 629005 - DNA, 20 bp, Artificial
  CRISPR gRNA sequence
ggtgatgtgttagttcttca

SEQ ID NO: 629006 - DNA, 20 bp, Artificial
  CRISPR gRNA sequence
gtgatgtgttagttcttcaa

SEQ ID NO: 629007 - DNA, 20 bp, Artificial
  CRISPR gRNA sequence
gttcttcaatttcagattga

SEQ ID NO: 629008 - DNA, 20 bp, Artificial
  CRISPR gRNA sequence
ttcaatttcagattgaaagg

SEQ ID NO: 629009 - DNA, 20 bp, Artificial
  CRISPR gRNA sequence
caatttcagattgaaaggaa

SEQ ID NO: 629010 - DNA, 20 bp, Artificial
  CRISPR gRNA sequence
aatttcagattgaaaggaaa

SEQ ID NO: 629011 - DNA, 20 bp, Artificial
  CRISPR gRNA sequence
cagattgaaaggaaaccttc

SEQ ID NO: 629012 - DNA, 20 bp, Artificial
  CRISPR gRNA sequence
agattgaaaggaaaccttct

SEQ ID NO: 629013 - DNA, 20 bp, Artificial
  CRISPR gRNA sequence
aaaggaaaccttctttaagt

SEQ ID NO: 629014 - DNA, 20 bp, Artificial
  CRISPR gRNA sequence
ctttaagtgtttattgaagt

SEQ ID NO: 629015 - DNA, 20 bp, Artificial
  CRISPR gRNA sequence
tttaagtgtttattgaagta

SEQ ID NO: 629016 - DNA, 20 bp, Artificial
  CRISPR gRNA sequence
taagtgtttattgaagtaat

SEQ ID NO: 629017 - DNA, 20 bp, Artificial
  CRISPR gRNA sequence
aagtgtttattgaagtaatg

SEQ ID NO: 629018 - DNA, 20 bp, Artificial
  CRISPR gRNA sequence
agtgtttattgaagtaatgg

SEQ ID NO: 629019 - DNA, 20 bp, Artificial
  CRISPR gRNA sequence
attgaagtaatggaattgtg

SEQ ID NO: 629020 - DNA, 20 bp, Artificial
  CRISPR gRNA sequence
ttgaagtaatggaattgtgt

SEQ ID NO: 629021 - DNA, 20 bp, Artificial
  CRISPR gRNA sequence
aagtaatggaattgtgttat

SEQ ID NO: 629022 - DNA, 20 bp, Artificial
  CRISPR gRNA sequence
tgttatcctctcctccctga

SEQ ID NO: 629023 - DNA, 20 bp, Artificial
  CRISPR gRNA sequence
tcctctcctccctgaaataa

SEQ ID NO: 629024 - DNA, 20 bp, Artificial
  CRISPR gRNA sequence
tcctccctgaaataaccaaa

SEQ ID NO: 629025 - DNA, 20 bp, Artificial
  CRISPR gRNA sequence
ctccctgaaataaccaaagc

SEQ ID NO: 629026 - DNA, 20 bp, Artificial
  CRISPR gRNA sequence
cctgaaataaccaaagcaaa

SEQ ID NO: 629027 - DNA, 20 bp, Artificial
  CRISPR gRNA sequence
aaataaccaaagcaaagatt

SEQ ID NO: 629028 - DNA, 20 bp, Artificial
  CRISPR gRNA sequence
ttgtctcaatcaccatttaa

SEQ ID NO: 629029 - DNA, 20 bp, Artificial
  CRISPR gRNA sequence
tgtctcaatcaccatttaat

SEQ ID NO: 629030 - DNA, 20 bp, Artificial
  CRISPR gRNA sequence
gtctcaatcaccatttaatc

SEQ ID NO: 629031 - DNA, 20 bp, Artificial
  CRISPR gRNA sequence
tctcaatcaccatttaatca

SEQ ID NO: 629032 - DNA, 20 bp, Artificial
  CRISPR gRNA sequence
aatcaccatttaatcaggat

SEQ ID NO: 629033 - DNA, 20 bp, Artificial
  CRISPR gRNA sequence
aatcaggatgtcccacaatg

SEQ ID NO: 629034 - DNA, 20 bp, Artificial
  CRISPR gRNA sequence
atcaggatgtcccacaatgc

SEQ ID NO: 629035 - DNA, 20 bp, Artificial
  CRISPR gRNA sequence
acactagaatgtcagaatct

SEQ ID NO: 629036 - DNA, 20 bp, Artificial
  CRISPR gRNA sequence
gaatgtcagaatctgtttga

SEQ ID NO: 629037 - DNA, 20 bp, Artificial
  CRISPR gRNA sequence
tttgaatatttttatcctaa

SEQ ID NO: 629038 - DNA, 20 bp, Artificial
  CRISPR gRNA sequence
gaatatttttatcctaatag

SEQ ID NO: 629039 - DNA, 20 bp, Artificial
  CRISPR gRNA sequence
aatatttttatcctaataga

SEQ ID NO: 629040 - DNA, 20 bp, Artificial
  CRISPR gRNA sequence
ttatcctaatagatatatat

SEQ ID NO: 629041 - DNA, 20 bp, Artificial
  CRISPR gRNA sequence
tatcctaatagatatatata

SEQ ID NO: 629042 - DNA, 20 bp, Artificial
  CRISPR gRNA sequence
atcctaatagatatatatac

SEQ ID NO: 629043 - DNA, 20 bp, Artificial
  CRISPR gRNA sequence
tcctaatagatatatataca

SEQ ID NO: 629044 - DNA, 20 bp, Artificial
  CRISPR gRNA sequence
atagatatatatacaatgaa

SEQ ID NO: 629045 - DNA, 20 bp, Artificial
  CRISPR gRNA sequence
tttaacaattctttttattg

SEQ ID NO: 629046 - DNA, 20 bp, Artificial
  CRISPR gRNA sequence
taacaattctttttattgaa

SEQ ID NO: 629047 - DNA, 20 bp, Artificial
  CRISPR gRNA sequence
aacaattctttttattgaat

SEQ ID NO: 629048 - DNA, 20 bp, Artificial
  CRISPR gRNA sequence
acaattctttttattgaatc

SEQ ID NO: 629049 - DNA, 20 bp, Artificial
  CRISPR gRNA sequence
tttttattgaatctctatta

SEQ ID NO: 629050 - DNA, 20 bp, Artificial
  CRISPR gRNA sequence
tttattgaatctctattatt

SEQ ID NO: 629051 - DNA, 20 bp, Artificial
  CRISPR gRNA sequence
ttattgaatctctattattc

SEQ ID NO: 629052 - DNA, 20 bp, Artificial
  CRISPR gRNA sequence
tattgaatctctattattca

SEQ ID NO: 629053 - DNA, 20 bp, Artificial
  CRISPR gRNA sequence
attgaatctctattattcat

SEQ ID NO: 629054 - DNA, 20 bp, Artificial
  CRISPR gRNA sequence
ttgaatctctattattcata

SEQ ID NO: 629055 - DNA, 20 bp, Artificial
  CRISPR gRNA sequence
aatctctattattcatattt

SEQ ID NO: 629056 - DNA, 20 bp, Artificial
  CRISPR gRNA sequence
tattattcatatttctttta

SEQ ID NO: 629057 - DNA, 20 bp, Artificial
  CRISPR gRNA sequence
ttattcatatttcttttaaa

SEQ ID NO: 629058 - DNA, 20 bp, Artificial
  CRISPR gRNA sequence
ttcatatttcttttaaaaag

SEQ ID NO: 629059 - DNA, 20 bp, Artificial
  CRISPR gRNA sequence
atatttcttttaaaaagtcc

SEQ ID NO: 629060 - DNA, 20 bp, Artificial
  CRISPR gRNA sequence
cttttaaaaagtccatgctt

SEQ ID NO: 629061 - DNA, 20 bp, Artificial
  CRISPR gRNA sequence
ttttaaaaagtccatgcttt

SEQ ID NO: 629062 - DNA, 20 bp, Artificial
  CRISPR gRNA sequence
ttaaaaagtccatgcttttt

SEQ ID NO: 629063 - DNA, 20 bp, Artificial
  CRISPR gRNA sequence
taaaaagtccatgctttttg

SEQ ID NO: 629064 - DNA, 20 bp, Artificial
  CRISPR gRNA sequence
aaaaagtccatgctttttgt

SEQ ID NO: 629065 - DNA, 20 bp, Artificial
  CRISPR gRNA sequence
aaaagtccatgctttttgta

SEQ ID NO: 629066 - DNA, 20 bp, Artificial
  CRISPR gRNA sequence
tttgtatcctcagagacaat

SEQ ID NO: 629067 - DNA, 20 bp, Artificial
  CRISPR gRNA sequence
ttgtatcctcagagacaatc

SEQ ID NO: 629068 - DNA, 20 bp, Artificial
  CRISPR gRNA sequence
tgtatcctcagagacaatct

SEQ ID NO: 629069 - DNA, 20 bp, Artificial
  CRISPR gRNA sequence
gtatcctcagagacaatcta

SEQ ID NO: 629070 - DNA, 20 bp, Artificial
  CRISPR gRNA sequence
tatcctcagagacaatctat

SEQ ID NO: 629071 - DNA, 20 bp, Artificial
  CRISPR gRNA sequence
agagacaatctatgacttac

SEQ ID NO: 629072 - DNA, 20 bp, Artificial
  CRISPR gRNA sequence
tgacttacagcatgcatcca

SEQ ID NO: 629073 - DNA, 20 bp, Artificial
  CRISPR gRNA sequence
acagcatgcatccagaatga

SEQ ID NO: 629074 - DNA, 20 bp, Artificial
  CRISPR gRNA sequence
cagcatgcatccagaatgat

SEQ ID NO: 629075 - DNA, 20 bp, Artificial
  CRISPR gRNA sequence
ggcgtatcaaagaatatcta

SEQ ID NO: 629076 - DNA, 20 bp, Artificial
  CRISPR gRNA sequence
agggttcggaaatgaaaagg

SEQ ID NO: 629077 - DNA, 20 bp, Artificial
  CRISPR gRNA sequence
ggaaatgaaaagggaaagtc

SEQ ID NO: 629078 - DNA, 20 bp, Artificial
  CRISPR gRNA sequence
aatatatgatatttaatctt

SEQ ID NO: 629079 - DNA, 20 bp, Artificial
  CRISPR gRNA sequence
aatcttttcagttcaaaatc

SEQ ID NO: 629080 - DNA, 20 bp, Artificial
  CRISPR gRNA sequence
atcttttcagttcaaaatca

SEQ ID NO: 629081 - DNA, 20 bp, Artificial
  CRISPR gRNA sequence
ttcagttcaaaatcataggc

SEQ ID NO: 629082 - DNA, 20 bp, Artificial
  CRISPR gRNA sequence
tcagttcaaaatcataggct

SEQ ID NO: 629083 - DNA, 20 bp, Artificial
  CRISPR gRNA sequence
cagttcaaaatcataggctg

SEQ ID NO: 629084 - DNA, 20 bp, Artificial
  CRISPR gRNA sequence
agttcaaaatcataggctgg

SEQ ID NO: 629085 - DNA, 20 bp, Artificial
  CRISPR gRNA sequence
aaaatcataggctggatgaa

SEQ ID NO: 629086 - DNA, 20 bp, Artificial
  CRISPR gRNA sequence
gatgaaaaaacaaagattaa

SEQ ID NO: 629087 - DNA, 20 bp, Artificial
  CRISPR gRNA sequence
aaatatgaaataaagatcca

SEQ ID NO: 629088 - DNA, 20 bp, Artificial
  CRISPR gRNA sequence
gaatgtaggttgctgcatta

SEQ ID NO: 629089 - DNA, 20 bp, Artificial
  CRISPR gRNA sequence
aatgtaggttgctgcattat

SEQ ID NO: 629090 - DNA, 20 bp, Artificial
  CRISPR gRNA sequence
ctgcattatttttccaatgc

SEQ ID NO: 629091 - DNA, 20 bp, Artificial
  CRISPR gRNA sequence
cattatttttccaatgcaga

SEQ ID NO: 629092 - DNA, 20 bp, Artificial
  CRISPR gRNA sequence
tttttccaatgcagaatttt

SEQ ID NO: 629093 - DNA, 20 bp, Artificial
  CRISPR gRNA sequence
ttccaatgcagaattttgaa

SEQ ID NO: 629094 - DNA, 20 bp, Artificial
  CRISPR gRNA sequence
tccaatgcagaattttgaaa

SEQ ID NO: 629095 - DNA, 20 bp, Artificial
  CRISPR gRNA sequence
ccaatgcagaattttgaaaa

SEQ ID NO: 629096 - DNA, 20 bp, Artificial
  CRISPR gRNA sequence
caatgcagaattttgaaaaa

SEQ ID NO: 629097 - DNA, 20 bp, Artificial
  CRISPR gRNA sequence
tgaaaaaaagaaaaattatc

SEQ ID NO: 629098 - DNA, 20 bp, Artificial
  CRISPR gRNA sequence
gaaaaaaagaaaaattatct

SEQ ID NO: 629099 - DNA, 20 bp, Artificial
  CRISPR gRNA sequence
aaaaaaagaaaaattatctt

SEQ ID NO: 629100 - DNA, 20 bp, Artificial
  CRISPR gRNA sequence
tcttcattccagataaaata

SEQ ID NO: 629101 - DNA, 20 bp, Artificial
  CRISPR gRNA sequence
cattccagataaaatacgaa

SEQ ID NO: 629102 - DNA, 20 bp, Artificial
  CRISPR gRNA sequence
attccagataaaatacgaaa

SEQ ID NO: 629103 - DNA, 20 bp, Artificial
  CRISPR gRNA sequence
cagataaaatacgaaaataa

SEQ ID NO: 629104 - DNA, 20 bp, Artificial
  CRISPR gRNA sequence
acccatttatgcctgaggtt

SEQ ID NO: 629105 - DNA, 20 bp, Artificial
  CRISPR gRNA sequence
atgcctgaggttgaaatttt

SEQ ID NO: 629106 - DNA, 20 bp, Artificial
  CRISPR gRNA sequence
tgcctgaggttgaaattttg

SEQ ID NO: 629107 - DNA, 20 bp, Artificial
  CRISPR gRNA sequence
aggttgaaattttgttttaa

SEQ ID NO: 629108 - DNA, 20 bp, Artificial
  CRISPR gRNA sequence
aaattttgttttaatttttg

SEQ ID NO: 629109 - DNA, 20 bp, Artificial
  CRISPR gRNA sequence
tgttttaatttttgcaatca

SEQ ID NO: 629110 - DNA, 20 bp, Artificial
  CRISPR gRNA sequence
gttttaatttttgcaatcag

SEQ ID NO: 629111 - DNA, 20 bp, Artificial
  CRISPR gRNA sequence
ttttaatttttgcaatcaga

SEQ ID NO: 629112 - DNA, 20 bp, Artificial
  CRISPR gRNA sequence
taatttttgcaatcagacct

SEQ ID NO: 629113 - DNA, 20 bp, Artificial
  CRISPR gRNA sequence
aatttttgcaatcagacctt

SEQ ID NO: 629114 - DNA, 20 bp, Artificial
  CRISPR gRNA sequence
atttttgcaatcagaccttg

SEQ ID NO: 629115 - DNA, 20 bp, Artificial
  CRISPR gRNA sequence
ttgcaatcagaccttggcga

SEQ ID NO: 629116 - DNA, 20 bp, Artificial
  CRISPR gRNA sequence
tgcaatcagaccttggcgat

SEQ ID NO: 629117 - DNA, 20 bp, Artificial
  CRISPR gRNA sequence
gcaatcagaccttggcgatg

SEQ ID NO: 629118 - DNA, 20 bp, Artificial
  CRISPR gRNA sequence
caatcagaccttggcgatga

SEQ ID NO: 629119 - DNA, 20 bp, Artificial
  CRISPR gRNA sequence
ggcgatgaccttgagcagta

SEQ ID NO: 629120 - DNA, 20 bp, Artificial
  CRISPR gRNA sequence
gcgatgaccttgagcagtag

SEQ ID NO: 629121 - DNA, 20 bp, Artificial
  CRISPR gRNA sequence
gagcagtaggatataaataa

SEQ ID NO: 629122 - DNA, 20 bp, Artificial
  CRISPR gRNA sequence
agcagtaggatataaataac

SEQ ID NO: 629123 - DNA, 20 bp, Artificial
  CRISPR gRNA sequence
ccacatgcttagcgttccaa

SEQ ID NO: 629124 - DNA, 20 bp, Artificial
  CRISPR gRNA sequence
agcgttccaataatgggaca

SEQ ID NO: 629125 - DNA, 20 bp, Artificial
  CRISPR gRNA sequence
gcgttccaataatgggacac

SEQ ID NO: 629126 - DNA, 20 bp, Artificial
  CRISPR gRNA sequence
caataatgggacactaggca

SEQ ID NO: 629127 - DNA, 20 bp, Artificial
  CRISPR gRNA sequence
ggcataaatgttaataggtt

SEQ ID NO: 629128 - DNA, 20 bp, Artificial
  CRISPR gRNA sequence
ataggttaaaaaaaaaacag

SEQ ID NO: 629129 - DNA, 20 bp, Artificial
  CRISPR gRNA sequence
aaaaaaaaacagctaaaaac

SEQ ID NO: 629130 - DNA, 20 bp, Artificial
  CRISPR gRNA sequence
aaaacctgacactaatgaaa

SEQ ID NO: 629131 - DNA, 20 bp, Artificial
  CRISPR gRNA sequence
acactaatgaaaattttaaa

SEQ ID NO: 629132 - DNA, 20 bp, Artificial
  CRISPR gRNA sequence
atgaaaattttaaaacagat

SEQ ID NO: 629133 - DNA, 20 bp, Artificial
  CRISPR gRNA sequence
taaaacagattacaaaactg

SEQ ID NO: 629134 - DNA, 20 bp, Artificial
  CRISPR gRNA sequence
aaaacagattacaaaactgg

SEQ ID NO: 629135 - DNA, 20 bp, Artificial
  CRISPR gRNA sequence
aaacagattacaaaactggc

SEQ ID NO: 629136 - DNA, 20 bp, Artificial
  CRISPR gRNA sequence
caaaactggccaataggctg

SEQ ID NO: 629137 - DNA, 20 bp, Artificial
  CRISPR gRNA sequence
gccaataggctggaccgttt

SEQ ID NO: 629138 - DNA, 20 bp, Artificial
  CRISPR gRNA sequence
gaccgtttctcttctgtatg

SEQ ID NO: 629139 - DNA, 20 bp, Artificial
  CRISPR gRNA sequence
ctcttctgtatgactatttt

SEQ ID NO: 629140 - DNA, 20 bp, Artificial
  CRISPR gRNA sequence
tcttctgtatgactattttt

SEQ ID NO: 629141 - DNA, 20 bp, Artificial
  CRISPR gRNA sequence
ttctgtatgactatttttta

SEQ ID NO: 629142 - DNA, 20 bp, Artificial
  CRISPR gRNA sequence
ctgtatgactattttttaaa

SEQ ID NO: 629143 - DNA, 20 bp, Artificial
  CRISPR gRNA sequence
tgtatgactattttttaaag

SEQ ID NO: 629144 - DNA, 20 bp, Artificial
  CRISPR gRNA sequence
tatgactattttttaaagaa

SEQ ID NO: 629145 - DNA, 20 bp, Artificial
  CRISPR gRNA sequence
ttttttaaagaaattaatat

SEQ ID NO: 629146 - DNA, 20 bp, Artificial
  CRISPR gRNA sequence
tttaaagaaattaatatttt

SEQ ID NO: 629147 - DNA, 20 bp, Artificial
  CRISPR gRNA sequence
ttaaagaaattaatattttc

SEQ ID NO: 629148 - DNA, 20 bp, Artificial
  CRISPR gRNA sequence
taaagaaattaatattttct

SEQ ID NO: 629149 - DNA, 20 bp, Artificial
  CRISPR gRNA sequence
aaagaaattaatattttcta

SEQ ID NO: 629150 - DNA, 20 bp, Artificial
  CRISPR gRNA sequence
aagaaattaatattttctat

SEQ ID NO: 629151 - DNA, 20 bp, Artificial
  CRISPR gRNA sequence
atattttctattttacatgt

SEQ ID NO: 629152 - DNA, 20 bp, Artificial
  CRISPR gRNA sequence
tctattttacatgttatttc

SEQ ID NO: 629153 - DNA, 20 bp, Artificial
  CRISPR gRNA sequence
ctattttacatgttatttca

SEQ ID NO: 629154 - DNA, 20 bp, Artificial
  CRISPR gRNA sequence
tattttacatgttatttcac

SEQ ID NO: 629155 - DNA, 20 bp, Artificial
  CRISPR gRNA sequence
ttttacatgttatttcactt

SEQ ID NO: 629156 - DNA, 20 bp, Artificial
  CRISPR gRNA sequence
tacatgttatttcactttat

SEQ ID NO: 629157 - DNA, 20 bp, Artificial
  CRISPR gRNA sequence
acatgttatttcactttata

SEQ ID NO: 629158 - DNA, 20 bp, Artificial
  CRISPR gRNA sequence
catgttatttcactttatat

SEQ ID NO: 629159 - DNA, 20 bp, Artificial
  CRISPR gRNA sequence
tttcactttatatatcatca

SEQ ID NO: 629160 - DNA, 20 bp, Artificial
  CRISPR gRNA sequence
cactttatatatcatcatat

SEQ ID NO: 629161 - DNA, 20 bp, Artificial
  CRISPR gRNA sequence
actttatatatcatcatatt

SEQ ID NO: 629162 - DNA, 20 bp, Artificial
  CRISPR gRNA sequence
tatatatcatcatattttga

SEQ ID NO: 629163 - DNA, 20 bp, Artificial
  CRISPR gRNA sequence
atatatcatcatattttgag

SEQ ID NO: 629164 - DNA, 20 bp, Artificial
  CRISPR gRNA sequence
tatatcatcatattttgaga

SEQ ID NO: 629165 - DNA, 20 bp, Artificial
  CRISPR gRNA sequence
tgagatggtgaccactatca

SEQ ID NO: 629166 - DNA, 20 bp, Artificial
  CRISPR gRNA sequence
gagatggtgaccactatcag

SEQ ID NO: 629167 - DNA, 20 bp, Artificial
  CRISPR gRNA sequence
agatggtgaccactatcagt

SEQ ID NO: 629168 - DNA, 20 bp, Artificial
  CRISPR gRNA sequence
tcagtctttatctctcatat

SEQ ID NO: 629169 - DNA, 20 bp, Artificial
  CRISPR gRNA sequence
tatctctcatatgtatttgt

SEQ ID NO: 629170 - DNA, 20 bp, Artificial
  CRISPR gRNA sequence
atctctcatatgtatttgtg

SEQ ID NO: 629171 - DNA, 20 bp, Artificial
  CRISPR gRNA sequence
tctctcatatgtatttgtgt

SEQ ID NO: 629172 - DNA, 20 bp, Artificial
  CRISPR gRNA sequence
tcatatgtatttgtgtgtgt

SEQ ID NO: 629173 - DNA, 20 bp, Artificial
  CRISPR gRNA sequence
atatgtatttgtgtgtgttg

SEQ ID NO: 629174 - DNA, 20 bp, Artificial
  CRISPR gRNA sequence
gtgtgtgttggtgtaagtgt

SEQ ID NO: 629175 - DNA, 20 bp, Artificial
  CRISPR gRNA sequence
tgtgtgttggtgtaagtgtg

SEQ ID NO: 629176 - DNA, 20 bp, Artificial
  CRISPR gRNA sequence
gtgtaagtgtggtgtacaca

SEQ ID NO: 629177 - DNA, 20 bp, Artificial
  CRISPR gRNA sequence
atttcatgaactgaaacaca

SEQ ID NO: 629178 - DNA, 20 bp, Artificial
  CRISPR gRNA sequence
tttcatgaactgaaacacac

SEQ ID NO: 629179 - DNA, 20 bp, Artificial
  CRISPR gRNA sequence
catgaactgaaacacaccat

SEQ ID NO: 629180 - DNA, 20 bp, Artificial
  CRISPR gRNA sequence
atgaactgaaacacaccata

SEQ ID NO: 629181 - DNA, 20 bp, Artificial
  CRISPR gRNA sequence
aaacacaccatatatatttc

SEQ ID NO: 629182 - DNA, 20 bp, Artificial
  CRISPR gRNA sequence
ctaatacatgggaacttgcc

SEQ ID NO: 629183 - DNA, 20 bp, Artificial
  CRISPR gRNA sequence
taatacatgggaacttgcct

SEQ ID NO: 629184 - DNA, 20 bp, Artificial
  CRISPR gRNA sequence
atacatgggaacttgccttt

SEQ ID NO: 629185 - DNA, 20 bp, Artificial
  CRISPR gRNA sequence
gccttttcctattaacatca

SEQ ID NO: 629186 - DNA, 20 bp, Artificial
  CRISPR gRNA sequence
ccttttcctattaacatcac

SEQ ID NO: 629187 - DNA, 20 bp, Artificial
  CRISPR gRNA sequence
ttcctattaacatcaccttg

SEQ ID NO: 629188 - DNA, 20 bp, Artificial
  CRISPR gRNA sequence
tcctattaacatcaccttgc

SEQ ID NO: 629189 - DNA, 20 bp, Artificial
  CRISPR gRNA sequence
cctattaacatcaccttgca

SEQ ID NO: 629190 - DNA, 20 bp, Artificial
  CRISPR gRNA sequence
ctattaacatcaccttgcaa

SEQ ID NO: 629191 - DNA, 20 bp, Artificial
  CRISPR gRNA sequence
ttaacatcaccttgcaaaga

SEQ ID NO: 629192 - DNA, 20 bp, Artificial
  CRISPR gRNA sequence
acatcaccttgcaaagaaac

SEQ ID NO: 629193 - DNA, 20 bp, Artificial
  CRISPR gRNA sequence
gcaaagaaacaaaagcattt

SEQ ID NO: 629194 - DNA, 20 bp, Artificial
  CRISPR gRNA sequence
caaagaaacaaaagcatttg

SEQ ID NO: 629195 - DNA, 20 bp, Artificial
  CRISPR gRNA sequence
gtaatgcttacccacaaact

SEQ ID NO: 629196 - DNA, 20 bp, Artificial
  CRISPR gRNA sequence
taatgcttacccacaaactt

SEQ ID NO: 629197 - DNA, 20 bp, Artificial
  CRISPR gRNA sequence
acccacaaacttttgtggag

SEQ ID NO: 629198 - DNA, 20 bp, Artificial
  CRISPR gRNA sequence
cccacaaacttttgtggagt

SEQ ID NO: 629199 - DNA, 20 bp, Artificial
  CRISPR gRNA sequence
ttgtggagtggagcttttac

SEQ ID NO: 629200 - DNA, 20 bp, Artificial
  CRISPR gRNA sequence
tgtggagtggagcttttacg

SEQ ID NO: 629201 - DNA, 20 bp, Artificial
  CRISPR gRNA sequence
gtggagtggagcttttacgt

SEQ ID NO: 629202 - DNA, 20 bp, Artificial
  CRISPR gRNA sequence
tggagtggagcttttacgtt

SEQ ID NO: 629203 - DNA, 20 bp, Artificial
  CRISPR gRNA sequence
ttacgttttcccatattccc

SEQ ID NO: 629204 - DNA, 20 bp, Artificial
  CRISPR gRNA sequence
tacgttttcccatattcccc

SEQ ID NO: 629205 - DNA, 20 bp, Artificial
  CRISPR gRNA sequence
acgttttcccatattccccg

SEQ ID NO: 629206 - DNA, 20 bp, Artificial
  CRISPR gRNA sequence
cgttttcccatattccccgt

SEQ ID NO: 629207 - DNA, 20 bp, Artificial
  CRISPR gRNA sequence
tcccatattccccgtgagct

SEQ ID NO: 629208 - DNA, 20 bp, Artificial
  CRISPR gRNA sequence
cccatattccccgtgagctt

SEQ ID NO: 629209 - DNA, 20 bp, Artificial
  CRISPR gRNA sequence
ccatattccccgtgagcttc

SEQ ID NO: 629210 - DNA, 20 bp, Artificial
  CRISPR gRNA sequence
cccgtgagcttctctatgac

SEQ ID NO: 629211 - DNA, 20 bp, Artificial
  CRISPR gRNA sequence
ctctatgacagcaggtctct

SEQ ID NO: 629212 - DNA, 20 bp, Artificial
  CRISPR gRNA sequence
tctatgacagcaggtctctc

SEQ ID NO: 629213 - DNA, 20 bp, Artificial
  CRISPR gRNA sequence
tatgacagcaggtctctcaa

SEQ ID NO: 629214 - DNA, 20 bp, Artificial
  CRISPR gRNA sequence
tgacagcaggtctctcaaaa

SEQ ID NO: 629215 - DNA, 20 bp, Artificial
  CRISPR gRNA sequence
tcaaaaggcaccagagaaat

SEQ ID NO: 629216 - DNA, 20 bp, Artificial
  CRISPR gRNA sequence
aaaaggcaccagagaaatat

SEQ ID NO: 629217 - DNA, 20 bp, Artificial
  CRISPR gRNA sequence
ttgtccataataggctcttg

SEQ ID NO: 629218 - DNA, 20 bp, Artificial
  CRISPR gRNA sequence
tccataataggctcttgttc

SEQ ID NO: 629219 - DNA, 20 bp, Artificial
  CRISPR gRNA sequence
ttgttccttacaatcttcca

SEQ ID NO: 629220 - DNA, 20 bp, Artificial
  CRISPR gRNA sequence
gttccttacaatcttccata

SEQ ID NO: 629221 - DNA, 20 bp, Artificial
  CRISPR gRNA sequence
ttccttacaatcttccatag

SEQ ID NO: 629222 - DNA, 20 bp, Artificial
  CRISPR gRNA sequence
cttacaatcttccataggag

SEQ ID NO: 629223 - DNA, 20 bp, Artificial
  CRISPR gRNA sequence
acaatcttccataggaggta

SEQ ID NO: 629224 - DNA, 20 bp, Artificial
  CRISPR gRNA sequence
caatcttccataggaggtac

SEQ ID NO: 629225 - DNA, 20 bp, Artificial
  CRISPR gRNA sequence
ccataggaggtactatacaa

SEQ ID NO: 629226 - DNA, 20 bp, Artificial
  CRISPR gRNA sequence
cataggaggtactatacaaa

SEQ ID NO: 629227 - DNA, 20 bp, Artificial
  CRISPR gRNA sequence
tacaaaaccatagaaaaatg

SEQ ID NO: 629228 - DNA, 20 bp, Artificial
  CRISPR gRNA sequence
ataatttcttcaacattttg

SEQ ID NO: 629229 - DNA, 20 bp, Artificial
  CRISPR gRNA sequence
cttcaacattttggatgata

SEQ ID NO: 629230 - DNA, 20 bp, Artificial
  CRISPR gRNA sequence
ttcaacattttggatgatac

SEQ ID NO: 629231 - DNA, 20 bp, Artificial
  CRISPR gRNA sequence
caacattttggatgatacaa

SEQ ID NO: 629232 - DNA, 20 bp, Artificial
  CRISPR gRNA sequence
aacattttggatgatacaaa

SEQ ID NO: 629233 - DNA, 20 bp, Artificial
  CRISPR gRNA sequence
tggatgatacaaagctggat

SEQ ID NO: 629234 - DNA, 20 bp, Artificial
  CRISPR gRNA sequence
ggatgatacaaagctggata

SEQ ID NO: 629235 - DNA, 20 bp, Artificial
  CRISPR gRNA sequence
gatgatacaaagctggatat

SEQ ID NO: 629236 - DNA, 20 bp, Artificial
  CRISPR gRNA sequence
gatatgccatctcgatatgt

SEQ ID NO: 629237 - DNA, 20 bp, Artificial
  CRISPR gRNA sequence
gatatgtgttataaaagcta

SEQ ID NO: 629238 - DNA, 20 bp, Artificial
  CRISPR gRNA sequence
taaaagctagtatgcttcag

SEQ ID NO: 629239 - DNA, 20 bp, Artificial
  CRISPR gRNA sequence
gtatgcttcagtagaagcaa

SEQ ID NO: 629240 - DNA, 20 bp, Artificial
  CRISPR gRNA sequence
cagtagaagcaagtagaaag

SEQ ID NO: 629241 - DNA, 20 bp, Artificial
  CRISPR gRNA sequence
agtagaagcaagtagaaaga

SEQ ID NO: 629242 - DNA, 20 bp, Artificial
  CRISPR gRNA sequence
tagtgtgaaagtatactctt

SEQ ID NO: 629243 - DNA, 20 bp, Artificial
  CRISPR gRNA sequence
gtgtgaaagtatactcttta

SEQ ID NO: 629244 - DNA, 20 bp, Artificial
  CRISPR gRNA sequence
tttaaatttgcacacacaca

SEQ ID NO: 629245 - DNA, 20 bp, Artificial
  CRISPR gRNA sequence
taaatttgcacacacacata

SEQ ID NO: 629246 - DNA, 20 bp, Artificial
  CRISPR gRNA sequence
aaatttgcacacacacatat

SEQ ID NO: 629247 - DNA, 20 bp, Artificial
  CRISPR gRNA sequence
aatttgcacacacacatata

SEQ ID NO: 629248 - DNA, 20 bp, Artificial
  CRISPR gRNA sequence
gcacacacacatatacacca

SEQ ID NO: 629249 - DNA, 20 bp, Artificial
  CRISPR gRNA sequence
cacacacacatatacaccag

SEQ ID NO: 629250 - DNA, 20 bp, Artificial
  CRISPR gRNA sequence
gtttttatttgagtctctct

SEQ ID NO: 629251 - DNA, 20 bp, Artificial
  CRISPR gRNA sequence
tttttatttgagtctctctt

SEQ ID NO: 629252 - DNA, 20 bp, Artificial
  CRISPR gRNA sequence
ttatttgagtctctcttaaa

SEQ ID NO: 629253 - DNA, 20 bp, Artificial
  CRISPR gRNA sequence
tatttgagtctctcttaaat

SEQ ID NO: 629254 - DNA, 20 bp, Artificial
  CRISPR gRNA sequence
atttgagtctctcttaaatc

SEQ ID NO: 629255 - DNA, 20 bp, Artificial
  CRISPR gRNA sequence
tttgagtctctcttaaatcc

SEQ ID NO: 629256 - DNA, 20 bp, Artificial
  CRISPR gRNA sequence
gagtctctcttaaatccatg

SEQ ID NO: 629257 - DNA, 20 bp, Artificial
  CRISPR gRNA sequence
agtctctcttaaatccatga

SEQ ID NO: 629258 - DNA, 20 bp, Artificial
  CRISPR gRNA sequence
tcttaaatccatgacataca

SEQ ID NO: 629259 - DNA, 20 bp, Artificial
  CRISPR gRNA sequence
ttaaatccatgacatacata

SEQ ID NO: 629260 - DNA, 20 bp, Artificial
  CRISPR gRNA sequence
aaatccatgacatacataca

SEQ ID NO: 629261 - DNA, 20 bp, Artificial
  CRISPR gRNA sequence
aatccatgacatacatacac

SEQ ID NO: 629262 - DNA, 20 bp, Artificial
  CRISPR gRNA sequence
ttgccactattggtggcaaa

SEQ ID NO: 629263 - DNA, 20 bp, Artificial
  CRISPR gRNA sequence
ccactattggtggcaaactt

SEQ ID NO: 629264 - DNA, 20 bp, Artificial
  CRISPR gRNA sequence
ttggtggcaaacttgttcat

SEQ ID NO: 629265 - DNA, 20 bp, Artificial
  CRISPR gRNA sequence
gtggcaaacttgttcatgtg

SEQ ID NO: 629266 - DNA, 20 bp, Artificial
  CRISPR gRNA sequence
gttcatgtggtttctcatct

SEQ ID NO: 629267 - DNA, 20 bp, Artificial
  CRISPR gRNA sequence
ttcatgtggtttctcatctt

SEQ ID NO: 629268 - DNA, 20 bp, Artificial
  CRISPR gRNA sequence
atgtggtttctcatcttatt

SEQ ID NO: 629269 - DNA, 20 bp, Artificial
  CRISPR gRNA sequence
ctcatcttattcccctgaaa

SEQ ID NO: 629270 - DNA, 20 bp, Artificial
  CRISPR gRNA sequence
tcatcttattcccctgaaag

SEQ ID NO: 629271 - DNA, 20 bp, Artificial
  CRISPR gRNA sequence
atcttattcccctgaaagtg

SEQ ID NO: 629272 - DNA, 20 bp, Artificial
  CRISPR gRNA sequence
attcccctgaaagtgttttt

SEQ ID NO: 629273 - DNA, 20 bp, Artificial
  CRISPR gRNA sequence
ttcccctgaaagtgttttta

SEQ ID NO: 629274 - DNA, 20 bp, Artificial
  CRISPR gRNA sequence
ccctgaaagtgtttttagca

SEQ ID NO: 629275 - DNA, 20 bp, Artificial
  CRISPR gRNA sequence
aaagtgtttttagcattgac

SEQ ID NO: 629276 - DNA, 20 bp, Artificial
  CRISPR gRNA sequence
ttagcattgactaaaatcaa

SEQ ID NO: 629277 - DNA, 20 bp, Artificial
  CRISPR gRNA sequence
tagcattgactaaaatcaat

SEQ ID NO: 629278 - DNA, 20 bp, Artificial
  CRISPR gRNA sequence
agcattgactaaaatcaata

SEQ ID NO: 629279 - DNA, 20 bp, Artificial
  CRISPR gRNA sequence
gcattgactaaaatcaatac

SEQ ID NO: 629280 - DNA, 20 bp, Artificial
  CRISPR gRNA sequence
actaaaatcaatactacttt

SEQ ID NO: 629281 - DNA, 20 bp, Artificial
  CRISPR gRNA sequence
aaatcaatactacttttaag

SEQ ID NO: 629282 - DNA, 20 bp, Artificial
  CRISPR gRNA sequence
cttttaagactgcactattt

SEQ ID NO: 629283 - DNA, 20 bp, Artificial
  CRISPR gRNA sequence
ttaagactgcactattttca

SEQ ID NO: 629284 - DNA, 20 bp, Artificial
  CRISPR gRNA sequence
taagactgcactattttcaa

SEQ ID NO: 629285 - DNA, 20 bp, Artificial
  CRISPR gRNA sequence
aagactgcactattttcaag

SEQ ID NO: 629286 - DNA, 20 bp, Artificial
  CRISPR gRNA sequence
agactgcactattttcaagg

SEQ ID NO: 629287 - DNA, 20 bp, Artificial
  CRISPR gRNA sequence
cactattttcaaggctttta

SEQ ID NO: 629288 - DNA, 20 bp, Artificial
  CRISPR gRNA sequence
ttttcaaggcttttagagtt

SEQ ID NO: 629289 - DNA, 20 bp, Artificial
  CRISPR gRNA sequence
tcaaggcttttagagtttat

SEQ ID NO: 629290 - DNA, 20 bp, Artificial
  CRISPR gRNA sequence
caaggcttttagagtttatt

SEQ ID NO: 629291 - DNA, 20 bp, Artificial
  CRISPR gRNA sequence
aaggcttttagagtttattt

SEQ ID NO: 629292 - DNA, 20 bp, Artificial
  CRISPR gRNA sequence
ttagagtttatttttaaaaa

SEQ ID NO: 629293 - DNA, 20 bp, Artificial
  CRISPR gRNA sequence
tagagtttatttttaaaaaa

SEQ ID NO: 629294 - DNA, 20 bp, Artificial
  CRISPR gRNA sequence
agagtttatttttaaaaaac

SEQ ID NO: 629295 - DNA, 20 bp, Artificial
  CRISPR gRNA sequence
gagtttatttttaaaaaaca

SEQ ID NO: 629296 - DNA, 20 bp, Artificial
  CRISPR gRNA sequence
atttttaaaaaacaatttaa

SEQ ID NO: 629297 - DNA, 20 bp, Artificial
  CRISPR gRNA sequence
tttttaaaaaacaatttaag

SEQ ID NO: 629298 - DNA, 20 bp, Artificial
  CRISPR gRNA sequence
ttaaaaaacaatttaagtaa

SEQ ID NO: 629299 - DNA, 20 bp, Artificial
  CRISPR gRNA sequence
taaaaaacaatttaagtaag

SEQ ID NO: 629300 - DNA, 20 bp, Artificial
  CRISPR gRNA sequence
aaaaaacaatttaagtaagt

SEQ ID NO: 629301 - DNA, 20 bp, Artificial
  CRISPR gRNA sequence
aaaaacaatttaagtaagtc

SEQ ID NO: 629302 - DNA, 20 bp, Artificial
  CRISPR gRNA sequence
aagtaagtcaacttgtttga

SEQ ID NO: 629303 - DNA, 20 bp, Artificial
  CRISPR gRNA sequence
agtaagtcaacttgtttgag

SEQ ID NO: 629304 - DNA, 20 bp, Artificial
  CRISPR gRNA sequence
gtttgagagaaaagcttaaa

SEQ ID NO: 629305 - DNA, 20 bp, Artificial
  CRISPR gRNA sequence
tttgagagaaaagcttaaac

SEQ ID NO: 629306 - DNA, 20 bp, Artificial
  CRISPR gRNA sequence
gagagaaaagcttaaacaga

SEQ ID NO: 629307 - DNA, 20 bp, Artificial
  CRISPR gRNA sequence
agagaaaagcttaaacagac

SEQ ID NO: 629308 - DNA, 20 bp, Artificial
  CRISPR gRNA sequence
aaacagacatacaaaataac

SEQ ID NO: 629309 - DNA, 20 bp, Artificial
  CRISPR gRNA sequence
aacagacatacaaaataaca

SEQ ID NO: 629310 - DNA, 20 bp, Artificial
  CRISPR gRNA sequence
aactgtttttcttaacccat

SEQ ID NO: 629311 - DNA, 20 bp, Artificial
  CRISPR gRNA sequence
actgtttttcttaacccatg

SEQ ID NO: 629312 - DNA, 20 bp, Artificial
  CRISPR gRNA sequence
tttttcttaacccatgtatt

SEQ ID NO: 629313 - DNA, 20 bp, Artificial
  CRISPR gRNA sequence
ttcttaacccatgtattttc

SEQ ID NO: 629314 - DNA, 20 bp, Artificial
  CRISPR gRNA sequence
tcttaacccatgtattttcc

SEQ ID NO: 629315 - DNA, 20 bp, Artificial
  CRISPR gRNA sequence
cttaacccatgtattttcct

SEQ ID NO: 629316 - DNA, 20 bp, Artificial
  CRISPR gRNA sequence
ttaacccatgtattttcctg

SEQ ID NO: 629317 - DNA, 20 bp, Artificial
  CRISPR gRNA sequence
aacccatgtattttcctgca

SEQ ID NO: 629318 - DNA, 20 bp, Artificial
  CRISPR gRNA sequence
acccatgtattttcctgcag

SEQ ID NO: 629319 - DNA, 20 bp, Artificial
  CRISPR gRNA sequence
tcctgcagcgtattttctat

SEQ ID NO: 629320 - DNA, 20 bp, Artificial
  CRISPR gRNA sequence
cctgcagcgtattttctatt

SEQ ID NO: 629321 - DNA, 20 bp, Artificial
  CRISPR gRNA sequence
ctgcagcgtattttctattt

SEQ ID NO: 629322 - DNA, 20 bp, Artificial
  CRISPR gRNA sequence
cagcgtattttctatttgat

SEQ ID NO: 629323 - DNA, 20 bp, Artificial
  CRISPR gRNA sequence
tctatttgatgagctgttag

SEQ ID NO: 629324 - DNA, 20 bp, Artificial
  CRISPR gRNA sequence
ctatttgatgagctgttagc

SEQ ID NO: 629325 - DNA, 20 bp, Artificial
  CRISPR gRNA sequence
tatttgatgagctgttagcc

SEQ ID NO: 629326 - DNA, 20 bp, Artificial
  CRISPR gRNA sequence
tttgatgagctgttagcctt

SEQ ID NO: 629327 - DNA, 20 bp, Artificial
  CRISPR gRNA sequence
gatgagctgttagccttatt

SEQ ID NO: 629328 - DNA, 20 bp, Artificial
  CRISPR gRNA sequence
atgagctgttagccttattg

SEQ ID NO: 629329 - DNA, 20 bp, Artificial
  CRISPR gRNA sequence
ttagccttattggcagtagc

SEQ ID NO: 629330 - DNA, 20 bp, Artificial
  CRISPR gRNA sequence
gccttattggcagtagctta

SEQ ID NO: 629331 - DNA, 20 bp, Artificial
  CRISPR gRNA sequence
attggcagtagcttaaatac

SEQ ID NO: 629332 - DNA, 20 bp, Artificial
  CRISPR gRNA sequence
ttggcagtagcttaaatacc

SEQ ID NO: 629333 - DNA, 20 bp, Artificial
  CRISPR gRNA sequence
gcagtagcttaaatacctgc

SEQ ID NO: 629334 - DNA, 20 bp, Artificial
  CRISPR gRNA sequence
aaatacctgcaccaagcagc

SEQ ID NO: 629335 - DNA, 20 bp, Artificial
  CRISPR gRNA sequence
aatacctgcaccaagcagcc

SEQ ID NO: 629336 - DNA, 20 bp, Artificial
  CRISPR gRNA sequence
caccaagcagccctcatgaa

SEQ ID NO: 629337 - DNA, 20 bp, Artificial
  CRISPR gRNA sequence
atgaagaagagccaattctg

SEQ ID NO: 629338 - DNA, 20 bp, Artificial
  CRISPR gRNA sequence
tgaacatgtctatgcacagt

SEQ ID NO: 629339 - DNA, 20 bp, Artificial
  CRISPR gRNA sequence
aacatgtctatgcacagtaa

SEQ ID NO: 629340 - DNA, 20 bp, Artificial
  CRISPR gRNA sequence
tgcacagtaaactgtggcag

SEQ ID NO: 629341 - DNA, 20 bp, Artificial
  CRISPR gRNA sequence
tggcagctttatgattgtaa

SEQ ID NO: 629342 - DNA, 20 bp, Artificial
  CRISPR gRNA sequence
tatgattgtaatttatttta

SEQ ID NO: 629343 - DNA, 20 bp, Artificial
  CRISPR gRNA sequence
atgattgtaatttattttaa

SEQ ID NO: 629344 - DNA, 20 bp, Artificial
  CRISPR gRNA sequence
tgattgtaatttattttaaa

SEQ ID NO: 629345 - DNA, 20 bp, Artificial
  CRISPR gRNA sequence
taatttattttaaaaagagc

SEQ ID NO: 629346 - DNA, 20 bp, Artificial
  CRISPR gRNA sequence
attttaaaaagagctcttca

SEQ ID NO: 629347 - DNA, 20 bp, Artificial
  CRISPR gRNA sequence
ttttaaaaagagctcttcag

SEQ ID NO: 629348 - DNA, 20 bp, Artificial
  CRISPR gRNA sequence
taaaaagagctcttcagcag

SEQ ID NO: 629349 - DNA, 20 bp, Artificial
  CRISPR gRNA sequence
aaaaagagctcttcagcagg

SEQ ID NO: 629350 - DNA, 20 bp, Artificial
  CRISPR gRNA sequence
aaaagagctcttcagcagga

SEQ ID NO: 629351 - DNA, 20 bp, Artificial
  CRISPR gRNA sequence
ttcagcaggaagaagaatcc

SEQ ID NO: 629352 - DNA, 20 bp, Artificial
  CRISPR gRNA sequence
cagcaggaagaagaatccat

SEQ ID NO: 629353 - DNA, 20 bp, Artificial
  CRISPR gRNA sequence
agcaggaagaagaatccatt

SEQ ID NO: 629354 - DNA, 20 bp, Artificial
  CRISPR gRNA sequence
ctaaattggcacattggctc

SEQ ID NO: 629355 - DNA, 20 bp, Artificial
  CRISPR gRNA sequence
taaattggcacattggctca

SEQ ID NO: 629356 - DNA, 20 bp, Artificial
  CRISPR gRNA sequence
aattggcacattggctcact

SEQ ID NO: 629357 - DNA, 20 bp, Artificial
  CRISPR gRNA sequence
gcacattggctcactaaact

SEQ ID NO: 629358 - DNA, 20 bp, Artificial
  CRISPR gRNA sequence
gctcactaaactactgccct

SEQ ID NO: 629359 - DNA, 20 bp, Artificial
  CRISPR gRNA sequence
actaaactactgccctaatt

SEQ ID NO: 629360 - DNA, 20 bp, Artificial
  CRISPR gRNA sequence
aactactgccctaattcatt

SEQ ID NO: 629361 - DNA, 20 bp, Artificial
  CRISPR gRNA sequence
ctgccctaattcatttgaca

SEQ ID NO: 629362 - DNA, 20 bp, Artificial
  CRISPR gRNA sequence
ccctaattcatttgacatat

SEQ ID NO: 629363 - DNA, 20 bp, Artificial
  CRISPR gRNA sequence
attcatttgacatatactct

SEQ ID NO: 629364 - DNA, 20 bp, Artificial
  CRISPR gRNA sequence
atttgacatatactctccaa

SEQ ID NO: 629365 - DNA, 20 bp, Artificial
  CRISPR gRNA sequence
gacatatactctccaatgct

SEQ ID NO: 629366 - DNA, 20 bp, Artificial
  CRISPR gRNA sequence
acatatactctccaatgctg

SEQ ID NO: 629367 - DNA, 20 bp, Artificial
  CRISPR gRNA sequence
tccaatgctgttccctattc

SEQ ID NO: 629368 - DNA, 20 bp, Artificial
  CRISPR gRNA sequence
caatgctgttccctattcat

SEQ ID NO: 629369 - DNA, 20 bp, Artificial
  CRISPR gRNA sequence
ttccctattcatcccttttt

SEQ ID NO: 629370 - DNA, 20 bp, Artificial
  CRISPR gRNA sequence
cctattcatcccttttttct

SEQ ID NO: 629371 - DNA, 20 bp, Artificial
  CRISPR gRNA sequence
ttcatcccttttttctaagt

SEQ ID NO: 629372 - DNA, 20 bp, Artificial
  CRISPR gRNA sequence
atcccttttttctaagttgc

SEQ ID NO: 629373 - DNA, 20 bp, Artificial
  CRISPR gRNA sequence
ttttctaagttgctatggac

SEQ ID NO: 629374 - DNA, 20 bp, Artificial
  CRISPR gRNA sequence
tttctaagttgctatggact

SEQ ID NO: 629375 - DNA, 20 bp, Artificial
  CRISPR gRNA sequence
ttctaagttgctatggacta

SEQ ID NO: 629376 - DNA, 20 bp, Artificial
  CRISPR gRNA sequence
tctaagttgctatggactaa

SEQ ID NO: 629377 - DNA, 20 bp, Artificial
  CRISPR gRNA sequence
ctaagttgctatggactaat

SEQ ID NO: 629378 - DNA, 20 bp, Artificial
  CRISPR gRNA sequence
taagttgctatggactaatc

SEQ ID NO: 629379 - DNA, 20 bp, Artificial
  CRISPR gRNA sequence
agttgctatggactaatctg

SEQ ID NO: 629380 - DNA, 20 bp, Artificial
  CRISPR gRNA sequence
ctatggactaatctgttagc

SEQ ID NO: 629381 - DNA, 20 bp, Artificial
  CRISPR gRNA sequence
tggactaatctgttagccct

SEQ ID NO: 629382 - DNA, 20 bp, Artificial
  CRISPR gRNA sequence
atctgttagcccttagacac

SEQ ID NO: 629383 - DNA, 20 bp, Artificial
  CRISPR gRNA sequence
ttagcccttagacactgaca

SEQ ID NO: 629384 - DNA, 20 bp, Artificial
  CRISPR gRNA sequence
gcccttagacactgacattc

SEQ ID NO: 629385 - DNA, 20 bp, Artificial
  CRISPR gRNA sequence
agacactgacattcatagtg

SEQ ID NO: 629386 - DNA, 20 bp, Artificial
  CRISPR gRNA sequence
gacactgacattcatagtgc

SEQ ID NO: 629387 - DNA, 20 bp, Artificial
  CRISPR gRNA sequence
acattcatagtgcagacaaa

SEQ ID NO: 629388 - DNA, 20 bp, Artificial
  CRISPR gRNA sequence
atagtgcagacaaagaactt

SEQ ID NO: 629389 - DNA, 20 bp, Artificial
  CRISPR gRNA sequence
aaaacagttgttttttgagt

SEQ ID NO: 629390 - DNA, 20 bp, Artificial
  CRISPR gRNA sequence
aaacagttgttttttgagta

SEQ ID NO: 629391 - DNA, 20 bp, Artificial
  CRISPR gRNA sequence
ttttttgagtagaaatactg

SEQ ID NO: 629392 - DNA, 20 bp, Artificial
  CRISPR gRNA sequence
tttgagtagaaatactgccc

SEQ ID NO: 629393 - DNA, 20 bp, Artificial
  CRISPR gRNA sequence
ttgagtagaaatactgccca

SEQ ID NO: 629394 - DNA, 20 bp, Artificial
  CRISPR gRNA sequence
tgagtagaaatactgcccaa

SEQ ID NO: 629395 - DNA, 20 bp, Artificial
  CRISPR gRNA sequence
gagtagaaatactgcccaag

SEQ ID NO: 629396 - DNA, 20 bp, Artificial
  CRISPR gRNA sequence
agtagaaatactgcccaagg

SEQ ID NO: 629397 - DNA, 20 bp, Artificial
  CRISPR gRNA sequence
cccaaggatgtttaattaag

SEQ ID NO: 629398 - DNA, 20 bp, Artificial
  CRISPR gRNA sequence
aattaaggatagggtaacaa

SEQ ID NO: 629399 - DNA, 20 bp, Artificial
  CRISPR gRNA sequence
attaaggatagggtaacaac

SEQ ID NO: 629400 - DNA, 20 bp, Artificial
  CRISPR gRNA sequence
aggatagggtaacaactcag

SEQ ID NO: 629401 - DNA, 20 bp, Artificial
  CRISPR gRNA sequence
agacaaggcgaatcagttga

SEQ ID NO: 629402 - DNA, 20 bp, Artificial
  CRISPR gRNA sequence
attaaaaacagtgttctcag

SEQ ID NO: 629403 - DNA, 20 bp, Artificial
  CRISPR gRNA sequence
aaaacagtgttctcaggaaa

SEQ ID NO: 629404 - DNA, 20 bp, Artificial
  CRISPR gRNA sequence
tcaggaaagaacataactta

SEQ ID NO: 629405 - DNA, 20 bp, Artificial
  CRISPR gRNA sequence
aggaaagaacataacttatt

SEQ ID NO: 629406 - DNA, 20 bp, Artificial
  CRISPR gRNA sequence
attacttgttgtttattgtt

SEQ ID NO: 629407 - DNA, 20 bp, Artificial
  CRISPR gRNA sequence
ttacttgttgtttattgttg

SEQ ID NO: 629408 - DNA, 20 bp, Artificial
  CRISPR gRNA sequence
cttgttgtttattgttgctt

SEQ ID NO: 629409 - DNA, 20 bp, Artificial
  CRISPR gRNA sequence
gttgtttattgttgctttct

SEQ ID NO: 629410 - DNA, 20 bp, Artificial
  CRISPR gRNA sequence
ttgtttattgttgctttctc

SEQ ID NO: 629411 - DNA, 20 bp, Artificial
  CRISPR gRNA sequence
tttattgttgctttctccag

SEQ ID NO: 629412 - DNA, 20 bp, Artificial
  CRISPR gRNA sequence
attgttgctttctccagttg

SEQ ID NO: 629413 - DNA, 20 bp, Artificial
  CRISPR gRNA sequence
ttgttgctttctccagttgc

SEQ ID NO: 629414 - DNA, 20 bp, Artificial
  CRISPR gRNA sequence
ttgctttctccagttgcact

SEQ ID NO: 629415 - DNA, 20 bp, Artificial
  CRISPR gRNA sequence
ctttctccagttgcacttgt

SEQ ID NO: 629416 - DNA, 20 bp, Artificial
  CRISPR gRNA sequence
tctccagttgcacttgtgcc

SEQ ID NO: 629417 - DNA, 20 bp, Artificial
  CRISPR gRNA sequence
ctccagttgcacttgtgcca

SEQ ID NO: 629418 - DNA, 20 bp, Artificial
  CRISPR gRNA sequence
tccagttgcacttgtgccag

SEQ ID NO: 629419 - DNA, 20 bp, Artificial
  CRISPR gRNA sequence
cagttgcacttgtgccagta

SEQ ID NO: 629420 - DNA, 20 bp, Artificial
  CRISPR gRNA sequence
cacttgtgccagtactgttt

SEQ ID NO: 629421 - DNA, 20 bp, Artificial
  CRISPR gRNA sequence
gtgccagtactgtttggaaa

SEQ ID NO: 629422 - DNA, 20 bp, Artificial
  CRISPR gRNA sequence
tgccagtactgtttggaaac

SEQ ID NO: 629423 - DNA, 20 bp, Artificial
  CRISPR gRNA sequence
tttggaaacctaaagctttc

SEQ ID NO: 629424 - DNA, 20 bp, Artificial
  CRISPR gRNA sequence
ggaaacctaaagctttcatt

SEQ ID NO: 629425 - DNA, 20 bp, Artificial
  CRISPR gRNA sequence
gaaacctaaagctttcattt

SEQ ID NO: 629426 - DNA, 20 bp, Artificial
  CRISPR gRNA sequence
aagctttcatttcttagaat

SEQ ID NO: 629427 - DNA, 20 bp, Artificial
  CRISPR gRNA sequence
tcatttcttagaataacttt

SEQ ID NO: 629428 - DNA, 20 bp, Artificial
  CRISPR gRNA sequence
catttcttagaataacttta

SEQ ID NO: 629429 - DNA, 20 bp, Artificial
  CRISPR gRNA sequence
atttcttagaataactttac

SEQ ID NO: 629430 - DNA, 20 bp, Artificial
  CRISPR gRNA sequence
cttagaataactttacttgt

SEQ ID NO: 629431 - DNA, 20 bp, Artificial
  CRISPR gRNA sequence
ttagaataactttacttgtt

SEQ ID NO: 629432 - DNA, 20 bp, Artificial
  CRISPR gRNA sequence
agaataactttacttgttca

SEQ ID NO: 629433 - DNA, 20 bp, Artificial
  CRISPR gRNA sequence
gaataactttacttgttcag

SEQ ID NO: 629434 - DNA, 20 bp, Artificial
  CRISPR gRNA sequence
tacttgttcagtatgccctg

SEQ ID NO: 629435 - DNA, 20 bp, Artificial
  CRISPR gRNA sequence
acttgttcagtatgccctgt

SEQ ID NO: 629436 - DNA, 20 bp, Artificial
  CRISPR gRNA sequence
cttgttcagtatgccctgta

SEQ ID NO: 629437 - DNA, 20 bp, Artificial
  CRISPR gRNA sequence
gttcagtatgccctgtaaaa

SEQ ID NO: 629438 - DNA, 20 bp, Artificial
  CRISPR gRNA sequence
ttcagtatgccctgtaaaaa

SEQ ID NO: 629439 - DNA, 20 bp, Artificial
  CRISPR gRNA sequence
agtatgccctgtaaaaatga

SEQ ID NO: 629440 - DNA, 20 bp, Artificial
  CRISPR gRNA sequence
taaaaatgatttactctgat

SEQ ID NO: 629441 - DNA, 20 bp, Artificial
  CRISPR gRNA sequence
actctgatcctttcatttgt

SEQ ID NO: 629442 - DNA, 20 bp, Artificial
  CRISPR gRNA sequence
ctctgatcctttcatttgta

SEQ ID NO: 629443 - DNA, 20 bp, Artificial
  CRISPR gRNA sequence
tgatcctttcatttgtataa

SEQ ID NO: 629444 - DNA, 20 bp, Artificial
  CRISPR gRNA sequence
atcctttcatttgtataaga

SEQ ID NO: 629445 - DNA, 20 bp, Artificial
  CRISPR gRNA sequence
tcatttgtataagatagtcc

SEQ ID NO: 629446 - DNA, 20 bp, Artificial
  CRISPR gRNA sequence
catttgtataagatagtccc

SEQ ID NO: 629447 - DNA, 20 bp, Artificial
  CRISPR gRNA sequence
atttgtataagatagtccca

SEQ ID NO: 629448 - DNA, 20 bp, Artificial
  CRISPR gRNA sequence
gtataagatagtcccactgt

SEQ ID NO: 629449 - DNA, 20 bp, Artificial
  CRISPR gRNA sequence
tataagatagtcccactgtg

SEQ ID NO: 629450 - DNA, 20 bp, Artificial
  CRISPR gRNA sequence
tgtacaaaaaaatgtagtct

SEQ ID NO: 629451 - DNA, 20 bp, Artificial
  CRISPR gRNA sequence
atttataaggggatcctctt

SEQ ID NO: 629452 - DNA, 20 bp, Artificial
  CRISPR gRNA sequence
ataaggggatcctcttggca

SEQ ID NO: 629453 - DNA, 20 bp, Artificial
  CRISPR gRNA sequence
taaggggatcctcttggcag

SEQ ID NO: 629454 - DNA, 20 bp, Artificial
  CRISPR gRNA sequence
ttggcagacacaaaaataag

SEQ ID NO: 629455 - DNA, 20 bp, Artificial
  CRISPR gRNA sequence
ggcagacacaaaaataagtg

SEQ ID NO: 629456 - DNA, 20 bp, Artificial
  CRISPR gRNA sequence
gcagacacaaaaataagtga

SEQ ID NO: 629457 - DNA, 20 bp, Artificial
  CRISPR gRNA sequence
agtgcacaattcagttgatg

SEQ ID NO: 629458 - DNA, 20 bp, Artificial
  CRISPR gRNA sequence
agttgatgtatttaataacc

SEQ ID NO: 629459 - DNA, 20 bp, Artificial
  CRISPR gRNA sequence
atgtatttaataaccaatag

SEQ ID NO: 629460 - DNA, 20 bp, Artificial
  CRISPR gRNA sequence
aataaccaataggttaccaa

SEQ ID NO: 629461 - DNA, 20 bp, Artificial
  CRISPR gRNA sequence
ataaccaataggttaccaat

SEQ ID NO: 629462 - DNA, 20 bp, Artificial
  CRISPR gRNA sequence
ccaattttgaagaaaatgaa

SEQ ID NO: 629463 - DNA, 20 bp, Artificial
  CRISPR gRNA sequence
tgaagaaaatgaaacatagt

SEQ ID NO: 629464 - DNA, 20 bp, Artificial
  CRISPR gRNA sequence
gaagaaaatgaaacatagtg

SEQ ID NO: 629465 - DNA, 20 bp, Artificial
  CRISPR gRNA sequence
aagaaaatgaaacatagtgt

SEQ ID NO: 629466 - DNA, 20 bp, Artificial
  CRISPR gRNA sequence
tcatgatttggacatgttta

SEQ ID NO: 629467 - DNA, 20 bp, Artificial
  CRISPR gRNA sequence
catgatttggacatgtttaa

SEQ ID NO: 629468 - DNA, 20 bp, Artificial
  CRISPR gRNA sequence
atgatttggacatgtttaaa

SEQ ID NO: 629469 - DNA, 20 bp, Artificial
  CRISPR gRNA sequence
ggacatgtttaaagaaatca

SEQ ID NO: 629470 - DNA, 20 bp, Artificial
  CRISPR gRNA sequence
gacatgtttaaagaaatcaa

SEQ ID NO: 629471 - DNA, 20 bp, Artificial
  CRISPR gRNA sequence
aaagaaatcaacattccatc

SEQ ID NO: 629472 - DNA, 20 bp, Artificial
  CRISPR gRNA sequence
aagaaatcaacattccatcc

SEQ ID NO: 629473 - DNA, 20 bp, Artificial
  CRISPR gRNA sequence
catccaagttttgattaacc

SEQ ID NO: 629474 - DNA, 20 bp, Artificial
  CRISPR gRNA sequence
tgattaacctatagatgggt

SEQ ID NO: 629475 - DNA, 20 bp, Artificial
  CRISPR gRNA sequence
gattaacctatagatgggtc

SEQ ID NO: 629476 - DNA, 20 bp, Artificial
  CRISPR gRNA sequence
attaacctatagatgggtca

SEQ ID NO: 629477 - DNA, 20 bp, Artificial
  CRISPR gRNA sequence
acctatagatgggtcaaaaa

SEQ ID NO: 629478 - DNA, 20 bp, Artificial
  CRISPR gRNA sequence
tagatgggtcaaaaaaattg

SEQ ID NO: 629479 - DNA, 20 bp, Artificial
  CRISPR gRNA sequence
aattgtaatctacatttaat

SEQ ID NO: 629480 - DNA, 20 bp, Artificial
  CRISPR gRNA sequence
taatctacatttaataagaa

SEQ ID NO: 629481 - DNA, 20 bp, Artificial
  CRISPR gRNA sequence
catttaataagaagtcctct

SEQ ID NO: 629482 - DNA, 20 bp, Artificial
  CRISPR gRNA sequence
aataagaagtcctctggcta

SEQ ID NO: 629483 - DNA, 20 bp, Artificial
  CRISPR gRNA sequence
ataagaagtcctctggctat

SEQ ID NO: 629484 - DNA, 20 bp, Artificial
  CRISPR gRNA sequence
tggctatgaatagcaaggga

SEQ ID NO: 629485 - DNA, 20 bp, Artificial
  CRISPR gRNA sequence
gctatgaatagcaagggatt

SEQ ID NO: 629486 - DNA, 20 bp, Artificial
  CRISPR gRNA sequence
tgaatagcaagggattgtgc

SEQ ID NO: 629487 - DNA, 20 bp, Artificial
  CRISPR gRNA sequence
tgcaattattagatgttaat

SEQ ID NO: 629488 - DNA, 20 bp, Artificial
  CRISPR gRNA sequence
ttagatgttaatttggaaaa

SEQ ID NO: 629489 - DNA, 20 bp, Artificial
  CRISPR gRNA sequence
gatgttaatttggaaaaaag

SEQ ID NO: 629490 - DNA, 20 bp, Artificial
  CRISPR gRNA sequence
atttggaaaaaagtttcaag

SEQ ID NO: 629491 - DNA, 20 bp, Artificial
  CRISPR gRNA sequence
ggaaaaaagtttcaaggtga

SEQ ID NO: 629492 - DNA, 20 bp, Artificial
  CRISPR gRNA sequence
gaaaaaagtttcaaggtgag

SEQ ID NO: 629493 - DNA, 20 bp, Artificial
  CRISPR gRNA sequence
caaggtgagactgaggaaca

SEQ ID NO: 629494 - DNA, 20 bp, Artificial
  CRISPR gRNA sequence
aaggtgagactgaggaacaa

SEQ ID NO: 629495 - DNA, 20 bp, Artificial
  CRISPR gRNA sequence
aggaacaaggaaacagatca

SEQ ID NO: 629496 - DNA, 20 bp, Artificial
  CRISPR gRNA sequence
tctgcactatatcattaatg

SEQ ID NO: 629497 - DNA, 20 bp, Artificial
  CRISPR gRNA sequence
cactatatcattaatgatgt

SEQ ID NO: 629498 - DNA, 20 bp, Artificial
  CRISPR gRNA sequence
tatcattaatgatgttatca

SEQ ID NO: 629499 - DNA, 20 bp, Artificial
  CRISPR gRNA sequence
atgatgttatcacattgaaa

SEQ ID NO: 629500 - DNA, 20 bp, Artificial
  CRISPR gRNA sequence
tcacattgaaaaagtatgtc

SEQ ID NO: 629501 - DNA, 20 bp, Artificial
  CRISPR gRNA sequence
aaaaagtatgtcccaagata

SEQ ID NO: 629502 - DNA, 20 bp, Artificial
  CRISPR gRNA sequence
tgtataaaacattatattct

SEQ ID NO: 629503 - DNA, 20 bp, Artificial
  CRISPR gRNA sequence
tattctcttttagtaacaac

SEQ ID NO: 629504 - DNA, 20 bp, Artificial
  CRISPR gRNA sequence
tcttttagtaacaactaaaa

SEQ ID NO: 629505 - DNA, 20 bp, Artificial
  CRISPR gRNA sequence
ttttagtaacaactaaaaaa

SEQ ID NO: 629506 - DNA, 20 bp, Artificial
  CRISPR gRNA sequence
ttagtaacaactaaaaaagt

SEQ ID NO: 629507 - DNA, 20 bp, Artificial
  CRISPR gRNA sequence
tagtaacaactaaaaaagtg

SEQ ID NO: 629508 - DNA, 20 bp, Artificial
  CRISPR gRNA sequence
agtaacaactaaaaaagtga

SEQ ID NO: 629509 - DNA, 20 bp, Artificial
  CRISPR gRNA sequence
gtaacaactaaaaaagtgac

SEQ ID NO: 629510 - DNA, 20 bp, Artificial
  CRISPR gRNA sequence
aaaaagtgacacaaaagtaa

SEQ ID NO: 629511 - DNA, 20 bp, Artificial
  CRISPR gRNA sequence
caaaaacattcaaggatgac

SEQ ID NO: 629512 - DNA, 20 bp, Artificial
  CRISPR gRNA sequence
aaaaacattcaaggatgacc

SEQ ID NO: 629513 - DNA, 20 bp, Artificial
  CRISPR gRNA sequence
aaggatgaccaattcacgta

SEQ ID NO: 629514 - DNA, 20 bp, Artificial
  CRISPR gRNA sequence
acgtaaggggagtcagaaga

SEQ ID NO: 629515 - DNA, 20 bp, Artificial
  CRISPR gRNA sequence
tggtcaaaatcttaactttt

SEQ ID NO: 629516 - DNA, 20 bp, Artificial
  CRISPR gRNA sequence
aactttttgtttggatgatg

SEQ ID NO: 629517 - DNA, 20 bp, Artificial
  CRISPR gRNA sequence
actttttgtttggatgatgg

SEQ ID NO: 629518 - DNA, 20 bp, Artificial
  CRISPR gRNA sequence
tttgtttggatgatggattt

SEQ ID NO: 629519 - DNA, 20 bp, Artificial
  CRISPR gRNA sequence
ttgtttggatgatggattta

SEQ ID NO: 629520 - DNA, 20 bp, Artificial
  CRISPR gRNA sequence
tgtttggatgatggatttac

SEQ ID NO: 629521 - DNA, 20 bp, Artificial
  CRISPR gRNA sequence
gtttggatgatggatttaca

SEQ ID NO: 629522 - DNA, 20 bp, Artificial
  CRISPR gRNA sequence
tttggatgatggatttacaa

SEQ ID NO: 629523 - DNA, 20 bp, Artificial
  CRISPR gRNA sequence
ggatgatggatttacaagca

SEQ ID NO: 629524 - DNA, 20 bp, Artificial
  CRISPR gRNA sequence
gatgatggatttacaagcac

SEQ ID NO: 629525 - DNA, 20 bp, Artificial
  CRISPR gRNA sequence
acaagcacttactacattat

SEQ ID NO: 629526 - DNA, 20 bp, Artificial
  CRISPR gRNA sequence
caagcacttactacattatt

SEQ ID NO: 629527 - DNA, 20 bp, Artificial
  CRISPR gRNA sequence
actacattattagaaataac

SEQ ID NO: 629528 - DNA, 20 bp, Artificial
  CRISPR gRNA sequence
ctacattattagaaataaca

SEQ ID NO: 629529 - DNA, 20 bp, Artificial
  CRISPR gRNA sequence
cattattagaaataacaata

SEQ ID NO: 629530 - DNA, 20 bp, Artificial
  CRISPR gRNA sequence
ttagaaataacaataaaact

SEQ ID NO: 629531 - DNA, 20 bp, Artificial
  CRISPR gRNA sequence
gaaataacaataaaactaaa

SEQ ID NO: 629532 - DNA, 20 bp, Artificial
  CRISPR gRNA sequence
aaaagcagtccaagtatgga

SEQ ID NO: 629533 - DNA, 20 bp, Artificial
  CRISPR gRNA sequence
ggcaagaaaaaaaaaatgtt

SEQ ID NO: 629534 - DNA, 20 bp, Artificial
  CRISPR gRNA sequence
gcaagaaaaaaaaaatgttg

SEQ ID NO: 629535 - DNA, 20 bp, Artificial
  CRISPR gRNA sequence
ttgtaaattttgctaaaaaa

SEQ ID NO: 629536 - DNA, 20 bp, Artificial
  CRISPR gRNA sequence
taaattttgctaaaaaacta

SEQ ID NO: 629537 - DNA, 20 bp, Artificial
  CRISPR gRNA sequence
tgctaaaaaactagcaaaac

SEQ ID NO: 629538 - DNA, 20 bp, Artificial
  CRISPR gRNA sequence
gctaaaaaactagcaaaact

SEQ ID NO: 629539 - DNA, 20 bp, Artificial
  CRISPR gRNA sequence
ctaaaaaactagcaaaactg

SEQ ID NO: 629540 - DNA, 20 bp, Artificial
  CRISPR gRNA sequence
aaaaactagcaaaactggtt

SEQ ID NO: 629541 - DNA, 20 bp, Artificial
  CRISPR gRNA sequence
gcaaaactggttaacgggtt

SEQ ID NO: 629542 - DNA, 20 bp, Artificial
  CRISPR gRNA sequence
gttaacgggtttgcccccaa

SEQ ID NO: 629543 - DNA, 20 bp, Artificial
  CRISPR gRNA sequence
acgggtttgcccccaaaatt

SEQ ID NO: 629544 - DNA, 20 bp, Artificial
  CRISPR gRNA sequence
gcccccaaaattaaatatgc

SEQ ID NO: 629545 - DNA, 20 bp, Artificial
  CRISPR gRNA sequence
cccccaaaattaaatatgct

SEQ ID NO: 629546 - DNA, 20 bp, Artificial
  CRISPR gRNA sequence
aatatgctaatttgttctga

SEQ ID NO: 629547 - DNA, 20 bp, Artificial
  CRISPR gRNA sequence
atttgttctgaaatgagtag

SEQ ID NO: 629548 - DNA, 20 bp, Artificial
  CRISPR gRNA sequence
gttctgaaatgagtagtcca

SEQ ID NO: 629549 - DNA, 20 bp, Artificial
  CRISPR gRNA sequence
ttctgaaatgagtagtccaa

SEQ ID NO: 629550 - DNA, 20 bp, Artificial
  CRISPR gRNA sequence
tgaaatgagtagtccaaaac

SEQ ID NO: 629551 - DNA, 20 bp, Artificial
  CRISPR gRNA sequence
aaatgagtagtccaaaacct

SEQ ID NO: 629552 - DNA, 20 bp, Artificial
  CRISPR gRNA sequence
gcagttttgctctaagtttc

SEQ ID NO: 629553 - DNA, 20 bp, Artificial
  CRISPR gRNA sequence
tgctctaagtttcaccctga

SEQ ID NO: 629554 - DNA, 20 bp, Artificial
  CRISPR gRNA sequence
gctctaagtttcaccctgaa

SEQ ID NO: 629555 - DNA, 20 bp, Artificial
  CRISPR gRNA sequence
ctctaagtttcaccctgaat

SEQ ID NO: 629556 - DNA, 20 bp, Artificial
  CRISPR gRNA sequence
taagtttcaccctgaatttt

SEQ ID NO: 629557 - DNA, 20 bp, Artificial
  CRISPR gRNA sequence
agtttcaccctgaattttca

SEQ ID NO: 629558 - DNA, 20 bp, Artificial
  CRISPR gRNA sequence
caccctgaattttcatattt

SEQ ID NO: 629559 - DNA, 20 bp, Artificial
  CRISPR gRNA sequence
accctgaattttcatatttg

SEQ ID NO: 629560 - DNA, 20 bp, Artificial
  CRISPR gRNA sequence
aattttcatatttgaacgca

SEQ ID NO: 629561 - DNA, 20 bp, Artificial
  CRISPR gRNA sequence
tcatatttgaacgcatttaa

SEQ ID NO: 629562 - DNA, 20 bp, Artificial
  CRISPR gRNA sequence
catatttgaacgcatttaac

SEQ ID NO: 629563 - DNA, 20 bp, Artificial
  CRISPR gRNA sequence
atatttgaacgcatttaaca

SEQ ID NO: 629564 - DNA, 20 bp, Artificial
  CRISPR gRNA sequence
gaacgcatttaacactcaaa

SEQ ID NO: 629565 - DNA, 20 bp, Artificial
  CRISPR gRNA sequence
aacgcatttaacactcaaaa

SEQ ID NO: 629566 - DNA, 20 bp, Artificial
  CRISPR gRNA sequence
aacactcaaaacgaaacctg

SEQ ID NO: 629567 - DNA, 20 bp, Artificial
  CRISPR gRNA sequence
acactcaaaacgaaacctgg

SEQ ID NO: 629568 - DNA, 20 bp, Artificial
  CRISPR gRNA sequence
aaaacgaaacctgggtgtgg

SEQ ID NO: 629569 - DNA, 20 bp, Artificial
  CRISPR gRNA sequence
ggtgtgggaactgtcccaca

SEQ ID NO: 629570 - DNA, 20 bp, Artificial
  CRISPR gRNA sequence
tcccacaccacatccacctc

SEQ ID NO: 629571 - DNA, 20 bp, Artificial
  CRISPR gRNA sequence
aattcagatgatttgtcccg

SEQ ID NO: 629572 - DNA, 20 bp, Artificial
  CRISPR gRNA sequence
agatgatttgtcccgagttc

SEQ ID NO: 629573 - DNA, 20 bp, Artificial
  CRISPR gRNA sequence
gtcccgagttcaatgaagct

SEQ ID NO: 629574 - DNA, 20 bp, Artificial
  CRISPR gRNA sequence
tcccgagttcaatgaagctc

SEQ ID NO: 629575 - DNA, 20 bp, Artificial
  CRISPR gRNA sequence
aatgaagctcatgtgaactg

SEQ ID NO: 629576 - DNA, 20 bp, Artificial
  CRISPR gRNA sequence
atgtgaactgaaaatgatga

SEQ ID NO: 629577 - DNA, 20 bp, Artificial
  CRISPR gRNA sequence
aaaatgatgattttggcaga

SEQ ID NO: 629578 - DNA, 20 bp, Artificial
  CRISPR gRNA sequence
tggcagagttctgatctaat

SEQ ID NO: 629579 - DNA, 20 bp, Artificial
  CRISPR gRNA sequence
ggcagagttctgatctaatt

SEQ ID NO: 629580 - DNA, 20 bp, Artificial
  CRISPR gRNA sequence
gcagagttctgatctaattt

SEQ ID NO: 629581 - DNA, 20 bp, Artificial
  CRISPR gRNA sequence
tgatctaatttctactttac

SEQ ID NO: 629582 - DNA, 20 bp, Artificial
  CRISPR gRNA sequence
atctaatttctactttacaa

SEQ ID NO: 629583 - DNA, 20 bp, Artificial
  CRISPR gRNA sequence
atttctactttacaatagcc

SEQ ID NO: 629584 - DNA, 20 bp, Artificial
  CRISPR gRNA sequence
ctactttacaatagcccttt

SEQ ID NO: 629585 - DNA, 20 bp, Artificial
  CRISPR gRNA sequence
tactttacaatagccctttt

SEQ ID NO: 629586 - DNA, 20 bp, Artificial
  CRISPR gRNA sequence
ctttacaatagcccttttca

SEQ ID NO: 629587 - DNA, 20 bp, Artificial
  CRISPR gRNA sequence
tacaatagcccttttcatgt

SEQ ID NO: 629588 - DNA, 20 bp, Artificial
  CRISPR gRNA sequence
acaatagcccttttcatgtc

SEQ ID NO: 629589 - DNA, 20 bp, Artificial
  CRISPR gRNA sequence
caatagcccttttcatgtca

SEQ ID NO: 629590 - DNA, 20 bp, Artificial
  CRISPR gRNA sequence
ttcatgtcaaaaattgatct

SEQ ID NO: 629591 - DNA, 20 bp, Artificial
  CRISPR gRNA sequence
tcatgtcaaaaattgatctt

SEQ ID NO: 629592 - DNA, 20 bp, Artificial
  CRISPR gRNA sequence
catgtcaaaaattgatcttg

SEQ ID NO: 629593 - DNA, 20 bp, Artificial
  CRISPR gRNA sequence
atgtcaaaaattgatcttgt

SEQ ID NO: 629594 - DNA, 20 bp, Artificial
  CRISPR gRNA sequence
atcttgtttctaccacatcg

SEQ ID NO: 629595 - DNA, 20 bp, Artificial
  CRISPR gRNA sequence
gtttctaccacatcggcaat

SEQ ID NO: 629596 - DNA, 20 bp, Artificial
  CRISPR gRNA sequence
tttctaccacatcggcaata

SEQ ID NO: 629597 - DNA, 20 bp, Artificial
  CRISPR gRNA sequence
ctaccacatcggcaataata

SEQ ID NO: 629598 - DNA, 20 bp, Artificial
  CRISPR gRNA sequence
taccacatcggcaataataa

SEQ ID NO: 629599 - DNA, 20 bp, Artificial
  CRISPR gRNA sequence
ccacatcggcaataataata

SEQ ID NO: 629600 - DNA, 20 bp, Artificial
  CRISPR gRNA sequence
acgtatactatgtgctgtgt

SEQ ID NO: 629601 - DNA, 20 bp, Artificial
  CRISPR gRNA sequence
tgtgctgtgtgctgttttaa

SEQ ID NO: 629602 - DNA, 20 bp, Artificial
  CRISPR gRNA sequence
tgtgctgttttaaggctttg

SEQ ID NO: 629603 - DNA, 20 bp, Artificial
  CRISPR gRNA sequence
ttttaaggctttgcatttaa

SEQ ID NO: 629604 - DNA, 20 bp, Artificial
  CRISPR gRNA sequence
taaggctttgcatttaataa

SEQ ID NO: 629605 - DNA, 20 bp, Artificial
  CRISPR gRNA sequence
aaggctttgcatttaataat

SEQ ID NO: 629606 - DNA, 20 bp, Artificial
  CRISPR gRNA sequence
aggctttgcatttaataatt

SEQ ID NO: 629607 - DNA, 20 bp, Artificial
  CRISPR gRNA sequence
tgcatttaataattaattta

SEQ ID NO: 629608 - DNA, 20 bp, Artificial
  CRISPR gRNA sequence
gcatttaataattaatttaa

SEQ ID NO: 629609 - DNA, 20 bp, Artificial
  CRISPR gRNA sequence
catttaataattaatttaat

SEQ ID NO: 629610 - DNA, 20 bp, Artificial
  CRISPR gRNA sequence
aataattaatttaattcatc

SEQ ID NO: 629611 - DNA, 20 bp, Artificial
  CRISPR gRNA sequence
ataattaatttaattcatcc

SEQ ID NO: 629612 - DNA, 20 bp, Artificial
  CRISPR gRNA sequence
atttaattcatccagaaact

SEQ ID NO: 629613 - DNA, 20 bp, Artificial
  CRISPR gRNA sequence
aattcatccagaaactccat

SEQ ID NO: 629614 - DNA, 20 bp, Artificial
  CRISPR gRNA sequence
attcatccagaaactccatg

SEQ ID NO: 629615 - DNA, 20 bp, Artificial
  CRISPR gRNA sequence
atccagaaactccatgaaat

SEQ ID NO: 629616 - DNA, 20 bp, Artificial
  CRISPR gRNA sequence
catgaaataggtgtaatacc

SEQ ID NO: 629617 - DNA, 20 bp, Artificial
  CRISPR gRNA sequence
cactgtacagatgagaacag

SEQ ID NO: 629618 - DNA, 20 bp, Artificial
  CRISPR gRNA sequence
actgtacagatgagaacaga

SEQ ID NO: 629619 - DNA, 20 bp, Artificial
  CRISPR gRNA sequence
tacagatgagaacagaaaga

SEQ ID NO: 629620 - DNA, 20 bp, Artificial
  CRISPR gRNA sequence
agtaatttcctcagggttta

SEQ ID NO: 629621 - DNA, 20 bp, Artificial
  CRISPR gRNA sequence
cctcagggtttacatctagt

SEQ ID NO: 629622 - DNA, 20 bp, Artificial
  CRISPR gRNA sequence
ctcagggtttacatctagtt

SEQ ID NO: 629623 - DNA, 20 bp, Artificial
  CRISPR gRNA sequence
agggtttacatctagttagt

SEQ ID NO: 629624 - DNA, 20 bp, Artificial
  CRISPR gRNA sequence
acatctagttagtagagaat

SEQ ID NO: 629625 - DNA, 20 bp, Artificial
  CRISPR gRNA sequence
catctagttagtagagaatg

SEQ ID NO: 629626 - DNA, 20 bp, Artificial
  CRISPR gRNA sequence
gttagtagagaatgttatta

SEQ ID NO: 629627 - DNA, 20 bp, Artificial
  CRISPR gRNA sequence
gtagagaatgttattactac

SEQ ID NO: 629628 - DNA, 20 bp, Artificial
  CRISPR gRNA sequence
ttactactaggagtctggct

SEQ ID NO: 629629 - DNA, 20 bp, Artificial
  CRISPR gRNA sequence
ctactaggagtctggctcca

SEQ ID NO: 629630 - DNA, 20 bp, Artificial
  CRISPR gRNA sequence
ctaggagtctggctccagag

SEQ ID NO: 629631 - DNA, 20 bp, Artificial
  CRISPR gRNA sequence
ggagtctggctccagagcct

SEQ ID NO: 629632 - DNA, 20 bp, Artificial
  CRISPR gRNA sequence
gctccagagcctggctcaac

SEQ ID NO: 629633 - DNA, 20 bp, Artificial
  CRISPR gRNA sequence
cagagcctggctcaaccatt

SEQ ID NO: 629634 - DNA, 20 bp, Artificial
  CRISPR gRNA sequence
gctcaaccattacgctatac

SEQ ID NO: 629635 - DNA, 20 bp, Artificial
  CRISPR gRNA sequence
aaccattacgctatactact

SEQ ID NO: 629636 - DNA, 20 bp, Artificial
  CRISPR gRNA sequence
cgctatactactctttgtag

SEQ ID NO: 629637 - DNA, 20 bp, Artificial
  CRISPR gRNA sequence
tactactctttgtagaggta

SEQ ID NO: 629638 - DNA, 20 bp, Artificial
  CRISPR gRNA sequence
ctctttgtagaggtattttg

SEQ ID NO: 629639 - DNA, 20 bp, Artificial
  CRISPR gRNA sequence
tttgtagaggtattttgagc

SEQ ID NO: 629640 - DNA, 20 bp, Artificial
  CRISPR gRNA sequence
tgtagaggtattttgagcat

SEQ ID NO: 629641 - DNA, 20 bp, Artificial
  CRISPR gRNA sequence
gtagaggtattttgagcatt

SEQ ID NO: 629642 - DNA, 20 bp, Artificial
  CRISPR gRNA sequence
tagaggtattttgagcattg

SEQ ID NO: 629643 - DNA, 20 bp, Artificial
  CRISPR gRNA sequence
tgagcattgactttttgtaa

SEQ ID NO: 629644 - DNA, 20 bp, Artificial
  CRISPR gRNA sequence
gagcattgactttttgtaaa

SEQ ID NO: 629645 - DNA, 20 bp, Artificial
  CRISPR gRNA sequence
agcattgactttttgtaaac

SEQ ID NO: 629646 - DNA, 20 bp, Artificial
  CRISPR gRNA sequence
actttttgtaaaccagtcag

SEQ ID NO: 629647 - DNA, 20 bp, Artificial
  CRISPR gRNA sequence
tttgtaaaccagtcagacat

SEQ ID NO: 629648 - DNA, 20 bp, Artificial
  CRISPR gRNA sequence
ttgtaaaccagtcagacata

SEQ ID NO: 629649 - DNA, 20 bp, Artificial
  CRISPR gRNA sequence
tgtaaaccagtcagacatat

SEQ ID NO: 629650 - DNA, 20 bp, Artificial
  CRISPR gRNA sequence
gtaaaccagtcagacatatt

SEQ ID NO: 629651 - DNA, 20 bp, Artificial
  CRISPR gRNA sequence
taaaccagtcagacatattt

SEQ ID NO: 629652 - DNA, 20 bp, Artificial
  CRISPR gRNA sequence
gtaaggtctgccattgggta

SEQ ID NO: 629653 - DNA, 20 bp, Artificial
  CRISPR gRNA sequence
taaggtctgccattgggtaa

SEQ ID NO: 629654 - DNA, 20 bp, Artificial
  CRISPR gRNA sequence
ccattgggtaaagacctgat

SEQ ID NO: 629655 - DNA, 20 bp, Artificial
  CRISPR gRNA sequence
ggtaaagacctgatacattt

SEQ ID NO: 629656 - DNA, 20 bp, Artificial
  CRISPR gRNA sequence
atacatttttccttaattat

SEQ ID NO: 629657 - DNA, 20 bp, Artificial
  CRISPR gRNA sequence
ttccttaattatgtaaccaa

SEQ ID NO: 629658 - DNA, 20 bp, Artificial
  CRISPR gRNA sequence
tccttaattatgtaaccaat

SEQ ID NO: 629659 - DNA, 20 bp, Artificial
  CRISPR gRNA sequence
ccttaattatgtaaccaatc

SEQ ID NO: 629660 - DNA, 20 bp, Artificial
  CRISPR gRNA sequence
cttaattatgtaaccaatct

SEQ ID NO: 629661 - DNA, 20 bp, Artificial
  CRISPR gRNA sequence
aattatgtaaccaatctgat

SEQ ID NO: 629662 - DNA, 20 bp, Artificial
  CRISPR gRNA sequence
attatgtaaccaatctgatt

SEQ ID NO: 629663 - DNA, 20 bp, Artificial
  CRISPR gRNA sequence
tgtaaccaatctgattttgt

SEQ ID NO: 629664 - DNA, 20 bp, Artificial
  CRISPR gRNA sequence
attttgttttgcttcatgga

SEQ ID NO: 629665 - DNA, 20 bp, Artificial
  CRISPR gRNA sequence
tgttttgcttcatggatctg

SEQ ID NO: 629666 - DNA, 20 bp, Artificial
  CRISPR gRNA sequence
gttttgcttcatggatctgg

SEQ ID NO: 629667 - DNA, 20 bp, Artificial
  CRISPR gRNA sequence
ttttgcttcatggatctggg

SEQ ID NO: 629668 - DNA, 20 bp, Artificial
  CRISPR gRNA sequence
tgcttcatggatctgggtgc

SEQ ID NO: 629669 - DNA, 20 bp, Artificial
  CRISPR gRNA sequence
gcttcatggatctgggtgca

SEQ ID NO: 629670 - DNA, 20 bp, Artificial
  CRISPR gRNA sequence
cttcatggatctgggtgcaa

SEQ ID NO: 629671 - DNA, 20 bp, Artificial
  CRISPR gRNA sequence
catggatctgggtgcaactc

SEQ ID NO: 629672 - DNA, 20 bp, Artificial
  CRISPR gRNA sequence
atggatctgggtgcaactca

SEQ ID NO: 629673 - DNA, 20 bp, Artificial
  CRISPR gRNA sequence
ggtgcaactcatcaaaatat

SEQ ID NO: 629674 - DNA, 20 bp, Artificial
  CRISPR gRNA sequence
atcaaaatatttctgtgtat

SEQ ID NO: 629675 - DNA, 20 bp, Artificial
  CRISPR gRNA sequence
ctgtgtatacattgctagaa

SEQ ID NO: 629676 - DNA, 20 bp, Artificial
  CRISPR gRNA sequence
tgtgtatacattgctagaaa

SEQ ID NO: 629677 - DNA, 20 bp, Artificial
  CRISPR gRNA sequence
tgtatacattgctagaaaca

SEQ ID NO: 629678 - DNA, 20 bp, Artificial
  CRISPR gRNA sequence
ctagaaacataaaacaaatt

SEQ ID NO: 629679 - DNA, 20 bp, Artificial
  CRISPR gRNA sequence
gaaacataaaacaaattctc

SEQ ID NO: 629680 - DNA, 20 bp, Artificial
  CRISPR gRNA sequence
tctagatatctcaataatgc

SEQ ID NO: 629681 - DNA, 20 bp, Artificial
  CRISPR gRNA sequence
tagatatctcaataatgcat

SEQ ID NO: 629682 - DNA, 20 bp, Artificial
  CRISPR gRNA sequence
gatatctcaataatgcatta

SEQ ID NO: 629683 - DNA, 20 bp, Artificial
  CRISPR gRNA sequence
aataatgcattaatcacata

SEQ ID NO: 629684 - DNA, 20 bp, Artificial
  CRISPR gRNA sequence
atcacatagacattaatctg

SEQ ID NO: 629685 - DNA, 20 bp, Artificial
  CRISPR gRNA sequence
atctgggctaaagatatacc

SEQ ID NO: 629686 - DNA, 20 bp, Artificial
  CRISPR gRNA sequence
ggctaaagatataccaataa

SEQ ID NO: 629687 - DNA, 20 bp, Artificial
  CRISPR gRNA sequence
aagatataccaataaggtaa

SEQ ID NO: 629688 - DNA, 20 bp, Artificial
  CRISPR gRNA sequence
cccctgtttgaacaaacttt

SEQ ID NO: 629689 - DNA, 20 bp, Artificial
  CRISPR gRNA sequence
ccctgtttgaacaaacttta

SEQ ID NO: 629690 - DNA, 20 bp, Artificial
  CRISPR gRNA sequence
tttgaacaaactttataacc

SEQ ID NO: 629691 - DNA, 20 bp, Artificial
  CRISPR gRNA sequence
gaacaaactttataaccaaa

SEQ ID NO: 629692 - DNA, 20 bp, Artificial
  CRISPR gRNA sequence
aacaaactttataaccaaac

SEQ ID NO: 629693 - DNA, 20 bp, Artificial
  CRISPR gRNA sequence
tataaccaaacatcctcttt

SEQ ID NO: 629694 - DNA, 20 bp, Artificial
  CRISPR gRNA sequence
ataaccaaacatcctctttg

SEQ ID NO: 629695 - DNA, 20 bp, Artificial
  CRISPR gRNA sequence
taaccaaacatcctctttga

SEQ ID NO: 629696 - DNA, 20 bp, Artificial
  CRISPR gRNA sequence
tttgaccttatatttgaggt

SEQ ID NO: 629697 - DNA, 20 bp, Artificial
  CRISPR gRNA sequence
tgaccttatatttgaggtta

SEQ ID NO: 629698 - DNA, 20 bp, Artificial
  CRISPR gRNA sequence
gaccttatatttgaggttat

SEQ ID NO: 629699 - DNA, 20 bp, Artificial
  CRISPR gRNA sequence
accttatatttgaggttata

SEQ ID NO: 629700 - DNA, 20 bp, Artificial
  CRISPR gRNA sequence
atatttgaggttataaccaa

SEQ ID NO: 629701 - DNA, 20 bp, Artificial
  CRISPR gRNA sequence
tatttgaggttataaccaag

SEQ ID NO: 629702 - DNA, 20 bp, Artificial
  CRISPR gRNA sequence
gaggttataaccaagataaa

SEQ ID NO: 629703 - DNA, 20 bp, Artificial
  CRISPR gRNA sequence
aggttataaccaagataaaa

SEQ ID NO: 629704 - DNA, 20 bp, Artificial
  CRISPR gRNA sequence
taaccaagataaaaacataa

SEQ ID NO: 629705 - DNA, 20 bp, Artificial
  CRISPR gRNA sequence
cattagatcactgtttcatc

SEQ ID NO: 629706 - DNA, 20 bp, Artificial
  CRISPR gRNA sequence
gatcactgtttcatcacgtt

SEQ ID NO: 629707 - DNA, 20 bp, Artificial
  CRISPR gRNA sequence
tttcatcacgttgataacca

SEQ ID NO: 629708 - DNA, 20 bp, Artificial
  CRISPR gRNA sequence
catcacgttgataaccataa

SEQ ID NO: 629709 - DNA, 20 bp, Artificial
  CRISPR gRNA sequence
atcacgttgataaccataac

SEQ ID NO: 629710 - DNA, 20 bp, Artificial
  CRISPR gRNA sequence
ataaccataacggcaaaacc

SEQ ID NO: 629711 - DNA, 20 bp, Artificial
  CRISPR gRNA sequence
ccaatgtattcttttgaaaa

SEQ ID NO: 629712 - DNA, 20 bp, Artificial
  CRISPR gRNA sequence
ttttgaaaaaccaaacagtt

SEQ ID NO: 629713 - DNA, 20 bp, Artificial
  CRISPR gRNA sequence
ttgaaaaaccaaacagttca

SEQ ID NO: 629714 - DNA, 20 bp, Artificial
  CRISPR gRNA sequence
tgaaaaaccaaacagttcac

SEQ ID NO: 629715 - DNA, 20 bp, Artificial
  CRISPR gRNA sequence
gaaaaaccaaacagttcacc

SEQ ID NO: 629716 - DNA, 20 bp, Artificial
  CRISPR gRNA sequence
aaaaaccaaacagttcaccc

SEQ ID NO: 629717 - DNA, 20 bp, Artificial
  CRISPR gRNA sequence
acccaaattcaaattccaag

SEQ ID NO: 629718 - DNA, 20 bp, Artificial
  CRISPR gRNA sequence
aaattccaagtctgagggac

SEQ ID NO: 629719 - DNA, 20 bp, Artificial
  CRISPR gRNA sequence
caagtctgagggacctaggt

SEQ ID NO: 629720 - DNA, 20 bp, Artificial
  CRISPR gRNA sequence
agggacctaggttagatcac

SEQ ID NO: 629721 - DNA, 20 bp, Artificial
  CRISPR gRNA sequence
ggttagatcacatgtctagc

SEQ ID NO: 629722 - DNA, 20 bp, Artificial
  CRISPR gRNA sequence
gatcacatgtctagctcctg

SEQ ID NO: 629723 - DNA, 20 bp, Artificial
  CRISPR gRNA sequence
gctcctgagcaggagagggc

SEQ ID NO: 629724 - DNA, 20 bp, Artificial
  CRISPR gRNA sequence
ctgagcaggagagggcagag

SEQ ID NO: 629725 - DNA, 20 bp, Artificial
  CRISPR gRNA sequence
agcaggagagggcagagtac

SEQ ID NO: 629726 - DNA, 20 bp, Artificial
  CRISPR gRNA sequence
gactgagggtcccaccacag

SEQ ID NO: 629727 - DNA, 20 bp, Artificial
  CRISPR gRNA sequence
agggtcccaccacagctaca

SEQ ID NO: 629728 - DNA, 20 bp, Artificial
  CRISPR gRNA sequence
catgcaacaggaaagttctc

SEQ ID NO: 629729 - DNA, 20 bp, Artificial
  CRISPR gRNA sequence
tctaaaggtaaatgggcact

SEQ ID NO: 629730 - DNA, 20 bp, Artificial
  CRISPR gRNA sequence
taaaggtaaatgggcactct

SEQ ID NO: 629731 - DNA, 20 bp, Artificial
  CRISPR gRNA sequence
aaggtaaatgggcactcttg

SEQ ID NO: 629732 - DNA, 20 bp, Artificial
  CRISPR gRNA sequence
ttgttatcaagagaaggagg

SEQ ID NO: 629733 - DNA, 20 bp, Artificial
  CRISPR gRNA sequence
gttatcaagagaaggaggaa

SEQ ID NO: 629734 - DNA, 20 bp, Artificial
  CRISPR gRNA sequence
ttatcaagagaaggaggaag

SEQ ID NO: 629735 - DNA, 20 bp, Artificial
  CRISPR gRNA sequence
tcaagagaaggaggaaggga

SEQ ID NO: 629736 - DNA, 20 bp, Artificial
  CRISPR gRNA sequence
ctatattgttgcaaattttc

SEQ ID NO: 629737 - DNA, 20 bp, Artificial
  CRISPR gRNA sequence
tatattgttgcaaattttct

SEQ ID NO: 629738 - DNA, 20 bp, Artificial
  CRISPR gRNA sequence
tattgttgcaaattttctcc

SEQ ID NO: 629739 - DNA, 20 bp, Artificial
  CRISPR gRNA sequence
ttgcaaattttctccgtgtt

SEQ ID NO: 629740 - DNA, 20 bp, Artificial
  CRISPR gRNA sequence
caaattttctccgtgttacc

SEQ ID NO: 629741 - DNA, 20 bp, Artificial
  CRISPR gRNA sequence
tctccgtgttacccgatcta

SEQ ID NO: 629742 - DNA, 20 bp, Artificial
  CRISPR gRNA sequence
ctccgtgttacccgatctaa

SEQ ID NO: 629743 - DNA, 20 bp, Artificial
  CRISPR gRNA sequence
tccgtgttacccgatctaaa

SEQ ID NO: 629744 - DNA, 20 bp, Artificial
  CRISPR gRNA sequence
cgtgttacccgatctaaaaa

SEQ ID NO: 629745 - DNA, 20 bp, Artificial
  CRISPR gRNA sequence
cccgatctaaaaaaaaaact

SEQ ID NO: 629746 - DNA, 20 bp, Artificial
  CRISPR gRNA sequence
aaaaaaaaactttacagtta

SEQ ID NO: 629747 - DNA, 20 bp, Artificial
  CRISPR gRNA sequence
tacagttatcttagttattt

SEQ ID NO: 629748 - DNA, 20 bp, Artificial
  CRISPR gRNA sequence
acagttatcttagttatttt

SEQ ID NO: 629749 - DNA, 20 bp, Artificial
  CRISPR gRNA sequence
cagttatcttagttattttc

SEQ ID NO: 629750 - DNA, 20 bp, Artificial
  CRISPR gRNA sequence
tcttagttattttcttgaca

SEQ ID NO: 629751 - DNA, 20 bp, Artificial
  CRISPR gRNA sequence
agttattttcttgacagcat

SEQ ID NO: 629752 - DNA, 20 bp, Artificial
  CRISPR gRNA sequence
gttattttcttgacagcatt

SEQ ID NO: 629753 - DNA, 20 bp, Artificial
  CRISPR gRNA sequence
ttttcttgacagcatttggc

SEQ ID NO: 629754 - DNA, 20 bp, Artificial
  CRISPR gRNA sequence
tcttgacagcatttggcagt

SEQ ID NO: 629755 - DNA, 20 bp, Artificial
  CRISPR gRNA sequence
cttgacagcatttggcagtg

SEQ ID NO: 629756 - DNA, 20 bp, Artificial
  CRISPR gRNA sequence
ttgacagcatttggcagtgc

SEQ ID NO: 629757 - DNA, 20 bp, Artificial
  CRISPR gRNA sequence
gacagcatttggcagtgctg

SEQ ID NO: 629758 - DNA, 20 bp, Artificial
  CRISPR gRNA sequence
acagcatttggcagtgctga

SEQ ID NO: 629759 - DNA, 20 bp, Artificial
  CRISPR gRNA sequence
ggcagtgctgacacttgctt

SEQ ID NO: 629760 - DNA, 20 bp, Artificial
  CRISPR gRNA sequence
gcagtgctgacacttgcttt

SEQ ID NO: 629761 - DNA, 20 bp, Artificial
  CRISPR gRNA sequence
acacttgctttggcttctgt

SEQ ID NO: 629762 - DNA, 20 bp, Artificial
  CRISPR gRNA sequence
gctttggcttctgtgaaatc

SEQ ID NO: 629763 - DNA, 20 bp, Artificial
  CRISPR gRNA sequence
ctttggcttctgtgaaatca

SEQ ID NO: 629764 - DNA, 20 bp, Artificial
  CRISPR gRNA sequence
tggcttctgtgaaatcactc

SEQ ID NO: 629765 - DNA, 20 bp, Artificial
  CRISPR gRNA sequence
ggcttctgtgaaatcactct

SEQ ID NO: 629766 - DNA, 20 bp, Artificial
  CRISPR gRNA sequence
gcttctgtgaaatcactctt

SEQ ID NO: 629767 - DNA, 20 bp, Artificial
  CRISPR gRNA sequence
ctgtgaaatcactctttcca

SEQ ID NO: 629768 - DNA, 20 bp, Artificial
  CRISPR gRNA sequence
tgtgaaatcactctttccat

SEQ ID NO: 629769 - DNA, 20 bp, Artificial
  CRISPR gRNA sequence
tgaaatcactctttccatgt

SEQ ID NO: 629770 - DNA, 20 bp, Artificial
  CRISPR gRNA sequence
tttccatgttcctactctgc

SEQ ID NO: 629771 - DNA, 20 bp, Artificial
  CRISPR gRNA sequence
tccatgttcctactctgctc

SEQ ID NO: 629772 - DNA, 20 bp, Artificial
  CRISPR gRNA sequence
ccatgttcctactctgctct

SEQ ID NO: 629773 - DNA, 20 bp, Artificial
  CRISPR gRNA sequence
catgttcctactctgctctt

SEQ ID NO: 629774 - DNA, 20 bp, Artificial
  CRISPR gRNA sequence
ctactctgctcttactcatc

SEQ ID NO: 629775 - DNA, 20 bp, Artificial
  CRISPR gRNA sequence
ctctgctcttactcatcttc

SEQ ID NO: 629776 - DNA, 20 bp, Artificial
  CRISPR gRNA sequence
tgctcttactcatcttcatg

SEQ ID NO: 629777 - DNA, 20 bp, Artificial
  CRISPR gRNA sequence
ctcttactcatcttcatgaa

SEQ ID NO: 629778 - DNA, 20 bp, Artificial
  CRISPR gRNA sequence
ttactcatcttcatgaaatt

SEQ ID NO: 629779 - DNA, 20 bp, Artificial
  CRISPR gRNA sequence
actcatcttcatgaaatttt

SEQ ID NO: 629780 - DNA, 20 bp, Artificial
  CRISPR gRNA sequence
ctcatcttcatgaaattttt

SEQ ID NO: 629781 - DNA, 20 bp, Artificial
  CRISPR gRNA sequence
atcttcatgaaatttttttc

SEQ ID NO: 629782 - DNA, 20 bp, Artificial
  CRISPR gRNA sequence
catgaaatttttttcctgct

SEQ ID NO: 629783 - DNA, 20 bp, Artificial
  CRISPR gRNA sequence
atgaaatttttttcctgcta

SEQ ID NO: 629784 - DNA, 20 bp, Artificial
  CRISPR gRNA sequence
ttttcctgctagtgtgttct

SEQ ID NO: 629785 - DNA, 20 bp, Artificial
  CRISPR gRNA sequence
tttcctgctagtgtgttctt

SEQ ID NO: 629786 - DNA, 20 bp, Artificial
  CRISPR gRNA sequence
ttcctgctagtgtgttcttg

SEQ ID NO: 629787 - DNA, 20 bp, Artificial
  CRISPR gRNA sequence
tcctgctagtgtgttcttgg

SEQ ID NO: 629788 - DNA, 20 bp, Artificial
  CRISPR gRNA sequence
cctgctagtgtgttcttggc

SEQ ID NO: 629789 - DNA, 20 bp, Artificial
  CRISPR gRNA sequence
ctgctagtgtgttcttggcc

SEQ ID NO: 629790 - DNA, 20 bp, Artificial
  CRISPR gRNA sequence
ctagtgtgttcttggccttc

SEQ ID NO: 629791 - DNA, 20 bp, Artificial
  CRISPR gRNA sequence
gtgtgttcttggccttcttg

SEQ ID NO: 629792 - DNA, 20 bp, Artificial
  CRISPR gRNA sequence
ttggccttcttgatgtctca

SEQ ID NO: 629793 - DNA, 20 bp, Artificial
  CRISPR gRNA sequence
ggccttcttgatgtctcact

SEQ ID NO: 629794 - DNA, 20 bp, Artificial
  CRISPR gRNA sequence
gccttcttgatgtctcactc

SEQ ID NO: 629795 - DNA, 20 bp, Artificial
  CRISPR gRNA sequence
cttgatgtctcactctgtac

SEQ ID NO: 629796 - DNA, 20 bp, Artificial
  CRISPR gRNA sequence
ttgatgtctcactctgtact

SEQ ID NO: 629797 - DNA, 20 bp, Artificial
  CRISPR gRNA sequence
gatgtctcactctgtactta

SEQ ID NO: 629798 - DNA, 20 bp, Artificial
  CRISPR gRNA sequence
atgtctcactctgtacttat

SEQ ID NO: 629799 - DNA, 20 bp, Artificial
  CRISPR gRNA sequence
actctgtacttatccgtatt

SEQ ID NO: 629800 - DNA, 20 bp, Artificial
  CRISPR gRNA sequence
tgtacttatccgtattgcct

SEQ ID NO: 629801 - DNA, 20 bp, Artificial
  CRISPR gRNA sequence
tacttatccgtattgcctta

SEQ ID NO: 629802 - DNA, 20 bp, Artificial
  CRISPR gRNA sequence
atccgtattgccttattaaa

SEQ ID NO: 629803 - DNA, 20 bp, Artificial
  CRISPR gRNA sequence
tccgtattgccttattaaaa

SEQ ID NO: 629804 - DNA, 20 bp, Artificial
  CRISPR gRNA sequence
ccttattaaaaactactacg

SEQ ID NO: 629805 - DNA, 20 bp, Artificial
  CRISPR gRNA sequence
attaaaaactactacgttgg

SEQ ID NO: 629806 - DNA, 20 bp, Artificial
  CRISPR gRNA sequence
ttaaaaactactacgttggg

SEQ ID NO: 629807 - DNA, 20 bp, Artificial
  CRISPR gRNA sequence
aaaactactacgttgggcca

SEQ ID NO: 629808 - DNA, 20 bp, Artificial
  CRISPR gRNA sequence
ctacgttgggccactacata

SEQ ID NO: 629809 - DNA, 20 bp, Artificial
  CRISPR gRNA sequence
cgttgggccactacataaat

SEQ ID NO: 629810 - DNA, 20 bp, Artificial
  CRISPR gRNA sequence
ggccactacataaattatga

SEQ ID NO: 629811 - DNA, 20 bp, Artificial
  CRISPR gRNA sequence
cataaattatgatggatcct

SEQ ID NO: 629812 - DNA, 20 bp, Artificial
  CRISPR gRNA sequence
tgatggatcctgcatctttg

SEQ ID NO: 629813 - DNA, 20 bp, Artificial
  CRISPR gRNA sequence
catctttgtttcctactcag

SEQ ID NO: 629814 - DNA, 20 bp, Artificial
  CRISPR gRNA sequence
tgtttcctactcagacccct

SEQ ID NO: 629815 - DNA, 20 bp, Artificial
  CRISPR gRNA sequence
gtttcctactcagacccctc

SEQ ID NO: 629816 - DNA, 20 bp, Artificial
  CRISPR gRNA sequence
tttcctactcagacccctct

SEQ ID NO: 629817 - DNA, 20 bp, Artificial
  CRISPR gRNA sequence
cctactcagacccctctcaa

SEQ ID NO: 629818 - DNA, 20 bp, Artificial
  CRISPR gRNA sequence
ctactcagacccctctcaag

SEQ ID NO: 629819 - DNA, 20 bp, Artificial
  CRISPR gRNA sequence
ctcagacccctctcaagagc

SEQ ID NO: 629820 - DNA, 20 bp, Artificial
  CRISPR gRNA sequence
agacccctctcaagagcttg

SEQ ID NO: 629821 - DNA, 20 bp, Artificial
  CRISPR gRNA sequence
tcaagagcttgagatctata

SEQ ID NO: 629822 - DNA, 20 bp, Artificial
  CRISPR gRNA sequence
aagagcttgagatctatata

SEQ ID NO: 629823 - DNA, 20 bp, Artificial
  CRISPR gRNA sequence
gagatctatatatttaacat

SEQ ID NO: 629824 - DNA, 20 bp, Artificial
  CRISPR gRNA sequence
agatctatatatttaacatc

SEQ ID NO: 629825 - DNA, 20 bp, Artificial
  CRISPR gRNA sequence
tatatttaacatcttcctag

SEQ ID NO: 629826 - DNA, 20 bp, Artificial
  CRISPR gRNA sequence
aacatcttcctagacagttt

SEQ ID NO: 629827 - DNA, 20 bp, Artificial
  CRISPR gRNA sequence
acatcttcctagacagtttt

SEQ ID NO: 629828 - DNA, 20 bp, Artificial
  CRISPR gRNA sequence
cctagacagttttatttgcc

SEQ ID NO: 629829 - DNA, 20 bp, Artificial
  CRISPR gRNA sequence
ctagacagttttatttgcct

SEQ ID NO: 629830 - DNA, 20 bp, Artificial
  CRISPR gRNA sequence
gacagttttatttgcctatt

SEQ ID NO: 629831 - DNA, 20 bp, Artificial
  CRISPR gRNA sequence
tatttgcctatttcatggag

SEQ ID NO: 629832 - DNA, 20 bp, Artificial
  CRISPR gRNA sequence
atttgcctatttcatggaga

SEQ ID NO: 629833 - DNA, 20 bp, Artificial
  CRISPR gRNA sequence
tttgcctatttcatggagac

SEQ ID NO: 629834 - DNA, 20 bp, Artificial
  CRISPR gRNA sequence
gcctatttcatggagacata

SEQ ID NO: 629835 - DNA, 20 bp, Artificial
  CRISPR gRNA sequence
cctatttcatggagacataa

SEQ ID NO: 629836 - DNA, 20 bp, Artificial
  CRISPR gRNA sequence
tttcatggagacataaaaga

SEQ ID NO: 629837 - DNA, 20 bp, Artificial
  CRISPR gRNA sequence
catggagacataaaagaata

SEQ ID NO: 629838 - DNA, 20 bp, Artificial
  CRISPR gRNA sequence
atggagacataaaagaatat

SEQ ID NO: 629839 - DNA, 20 bp, Artificial
  CRISPR gRNA sequence
catttacctttctttcttct

SEQ ID NO: 629840 - DNA, 20 bp, Artificial
  CRISPR gRNA sequence
acctttctttcttctatttt

SEQ ID NO: 629841 - DNA, 20 bp, Artificial
  CRISPR gRNA sequence
cctttctttcttctattttc

SEQ ID NO: 629842 - DNA, 20 bp, Artificial
  CRISPR gRNA sequence
tctttcttctattttcctaa

SEQ ID NO: 629843 - DNA, 20 bp, Artificial
  CRISPR gRNA sequence
ctttcttctattttcctaat

SEQ ID NO: 629844 - DNA, 20 bp, Artificial
  CRISPR gRNA sequence
tttcttctattttcctaatt

SEQ ID NO: 629845 - DNA, 20 bp, Artificial
  CRISPR gRNA sequence
tcttctattttcctaattac

SEQ ID NO: 629846 - DNA, 20 bp, Artificial
  CRISPR gRNA sequence
cttctattttcctaattacc

SEQ ID NO: 629847 - DNA, 20 bp, Artificial
  CRISPR gRNA sequence
ttctattttcctaattacca

SEQ ID NO: 629848 - DNA, 20 bp, Artificial
  CRISPR gRNA sequence
ctattttcctaattaccata

SEQ ID NO: 629849 - DNA, 20 bp, Artificial
  CRISPR gRNA sequence
tattttcctaattaccatat

SEQ ID NO: 629850 - DNA, 20 bp, Artificial
  CRISPR gRNA sequence
ttttcctaattaccatatca

SEQ ID NO: 629851 - DNA, 20 bp, Artificial
  CRISPR gRNA sequence
tcctaattaccatatcactg

SEQ ID NO: 629852 - DNA, 20 bp, Artificial
  CRISPR gRNA sequence
cctaattaccatatcactga

SEQ ID NO: 629853 - DNA, 20 bp, Artificial
  CRISPR gRNA sequence
ctaattaccatatcactgaa

SEQ ID NO: 629854 - DNA, 20 bp, Artificial
  CRISPR gRNA sequence
attaccatatcactgaatga

SEQ ID NO: 629855 - DNA, 20 bp, Artificial
  CRISPR gRNA sequence
ccatatcactgaatgacact

SEQ ID NO: 629856 - DNA, 20 bp, Artificial
  CRISPR gRNA sequence
aatgacactactaattacca

SEQ ID NO: 629857 - DNA, 20 bp, Artificial
  CRISPR gRNA sequence
ctaattaccatatcactgaa

SEQ ID NO: 629858 - DNA, 20 bp, Artificial
  CRISPR gRNA sequence
attaccatatcactgaatga

SEQ ID NO: 629859 - DNA, 20 bp, Artificial
  CRISPR gRNA sequence
ccatatcactgaatgacact

SEQ ID NO: 629860 - DNA, 20 bp, Artificial
  CRISPR gRNA sequence
aatgacactactatttactc

SEQ ID NO: 629861 - DNA, 20 bp, Artificial
  CRISPR gRNA sequence
ctatttactccatcagccat

SEQ ID NO: 629862 - DNA, 20 bp, Artificial
  CRISPR gRNA sequence
tttactccatcagccatgct

SEQ ID NO: 629863 - DNA, 20 bp, Artificial
  CRISPR gRNA sequence
actccatcagccatgctggt

SEQ ID NO: 629864 - DNA, 20 bp, Artificial
  CRISPR gRNA sequence
ctccatcagccatgctggtc

SEQ ID NO: 629865 - DNA, 20 bp, Artificial
  CRISPR gRNA sequence
catcagccatgctggtcacc

SEQ ID NO: 629866 - DNA, 20 bp, Artificial
  CRISPR gRNA sequence
gtcacctgtggaaaatccta

SEQ ID NO: 629867 - DNA, 20 bp, Artificial
  CRISPR gRNA sequence
tggaaaatcctagatttctt

SEQ ID NO: 629868 - DNA, 20 bp, Artificial
  CRISPR gRNA sequence
gatttcttcctttcatccag

SEQ ID NO: 629869 - DNA, 20 bp, Artificial
  CRISPR gRNA sequence
cttcctttcatccagtcttc

SEQ ID NO: 629870 - DNA, 20 bp, Artificial
  CRISPR gRNA sequence
ttcctttcatccagtcttct

SEQ ID NO: 629871 - DNA, 20 bp, Artificial
  CRISPR gRNA sequence
cctttcatccagtcttctgc

SEQ ID NO: 629872 - DNA, 20 bp, Artificial
  CRISPR gRNA sequence
ctttcatccagtcttctgcc

SEQ ID NO: 629873 - DNA, 20 bp, Artificial
  CRISPR gRNA sequence
tcatccagtcttctgcctct

SEQ ID NO: 629874 - DNA, 20 bp, Artificial
  CRISPR gRNA sequence
catccagtcttctgcctctc

SEQ ID NO: 629875 - DNA, 20 bp, Artificial
  CRISPR gRNA sequence
atccagtcttctgcctctcc

SEQ ID NO: 629876 - DNA, 20 bp, Artificial
  CRISPR gRNA sequence
ctgcctctcctcctccctac

SEQ ID NO: 629877 - DNA, 20 bp, Artificial
  CRISPR gRNA sequence
tgcctctcctcctccctacc

SEQ ID NO: 629878 - DNA, 20 bp, Artificial
  CRISPR gRNA sequence
cctctcctcctccctaccac

SEQ ID NO: 629879 - DNA, 20 bp, Artificial
  CRISPR gRNA sequence
tcctcctccctaccacatct

SEQ ID NO: 629880 - DNA, 20 bp, Artificial
  CRISPR gRNA sequence
ctcctccctaccacatctct

SEQ ID NO: 629881 - DNA, 20 bp, Artificial
  CRISPR gRNA sequence
ctccctaccacatctcttta

SEQ ID NO: 629882 - DNA, 20 bp, Artificial
  CRISPR gRNA sequence
cctaccacatctctttacaa

SEQ ID NO: 629883 - DNA, 20 bp, Artificial
  CRISPR gRNA sequence
ccacatctctttacaaacac

SEQ ID NO: 629884 - DNA, 20 bp, Artificial
  CRISPR gRNA sequence
tttacaaacacacatggagg

SEQ ID NO: 629885 - DNA, 20 bp, Artificial
  CRISPR gRNA sequence
tacaaacacacatggaggta

SEQ ID NO: 629886 - DNA, 20 bp, Artificial
  CRISPR gRNA sequence
acaaacacacatggaggtac

SEQ ID NO: 629887 - DNA, 20 bp, Artificial
  CRISPR gRNA sequence
caaacacacatggaggtacc

SEQ ID NO: 629888 - DNA, 20 bp, Artificial
  CRISPR gRNA sequence
tagatgctacattggtagtt

SEQ ID NO: 629889 - DNA, 20 bp, Artificial
  CRISPR gRNA sequence
agatgctacattggtagttg

SEQ ID NO: 629890 - DNA, 20 bp, Artificial
  CRISPR gRNA sequence
gatgctacattggtagttgt

SEQ ID NO: 629891 - DNA, 20 bp, Artificial
  CRISPR gRNA sequence
cattggtagttgttcacata

SEQ ID NO: 629892 - DNA, 20 bp, Artificial
  CRISPR gRNA sequence
gtagttgttcacatatgttg

SEQ ID NO: 629893 - DNA, 20 bp, Artificial
  CRISPR gRNA sequence
ttcacatatgttgttctttc

SEQ ID NO: 629894 - DNA, 20 bp, Artificial
  CRISPR gRNA sequence
acatatgttgttctttctgc

SEQ ID NO: 629895 - DNA, 20 bp, Artificial
  CRISPR gRNA sequence
ttctttctgcaggaaacacc

SEQ ID NO: 629896 - DNA, 20 bp, Artificial
  CRISPR gRNA sequence
tttctgcaggaaacaccctt

SEQ ID NO: 629897 - DNA, 20 bp, Artificial
  CRISPR gRNA sequence
tctgcaggaaacacccttct

SEQ ID NO: 629898 - DNA, 20 bp, Artificial
  CRISPR gRNA sequence
ctgcaggaaacacccttctc

SEQ ID NO: 629899 - DNA, 20 bp, Artificial
  CRISPR gRNA sequence
tgcaggaaacacccttctcc

SEQ ID NO: 629900 - DNA, 20 bp, Artificial
  CRISPR gRNA sequence
caggaaacacccttctccat

SEQ ID NO: 629901 - DNA, 20 bp, Artificial
  CRISPR gRNA sequence
ctccatttattagttcacat

SEQ ID NO: 629902 - DNA, 20 bp, Artificial
  CRISPR gRNA sequence
tccatttattagttcacatt

SEQ ID NO: 629903 - DNA, 20 bp, Artificial
  CRISPR gRNA sequence
catttattagttcacatttt

SEQ ID NO: 629904 - DNA, 20 bp, Artificial
  CRISPR gRNA sequence
attagttcacatttttgctt

SEQ ID NO: 629905 - DNA, 20 bp, Artificial
  CRISPR gRNA sequence
ttagttcacatttttgcttt

SEQ ID NO: 629906 - DNA, 20 bp, Artificial
  CRISPR gRNA sequence
gttcacatttttgcttttta

SEQ ID NO: 629907 - DNA, 20 bp, Artificial
  CRISPR gRNA sequence
acatttttgctttttaaaac

SEQ ID NO: 629908 - DNA, 20 bp, Artificial
  CRISPR gRNA sequence
ttgctttttaaaactaagct

SEQ ID NO: 629909 - DNA, 20 bp, Artificial
  CRISPR gRNA sequence
tgctttttaaaactaagctc

SEQ ID NO: 629910 - DNA, 20 bp, Artificial
  CRISPR gRNA sequence
gctttttaaaactaagctca

SEQ ID NO: 629911 - DNA, 20 bp, Artificial
  CRISPR gRNA sequence
ctttttaaaactaagctcaa

SEQ ID NO: 629912 - DNA, 20 bp, Artificial
  CRISPR gRNA sequence
tttaaaactaagctcaatcc

SEQ ID NO: 629913 - DNA, 20 bp, Artificial
  CRISPR gRNA sequence
ttaaaactaagctcaatccc

SEQ ID NO: 629914 - DNA, 20 bp, Artificial
  CRISPR gRNA sequence
taaaactaagctcaatcccg

SEQ ID NO: 629915 - DNA, 20 bp, Artificial
  CRISPR gRNA sequence
aaaactaagctcaatcccgg

SEQ ID NO: 629916 - DNA, 20 bp, Artificial
  CRISPR gRNA sequence
aaactaagctcaatcccggg

SEQ ID NO: 629917 - DNA, 20 bp, Artificial
  CRISPR gRNA sequence
agctcaatcccgggaaattc

SEQ ID NO: 629918 - DNA, 20 bp, Artificial
  CRISPR gRNA sequence
aatcccgggaaattcctctt

SEQ ID NO: 629919 - DNA, 20 bp, Artificial
  CRISPR gRNA sequence
ctcttggatgttctgctgat

SEQ ID NO: 629920 - DNA, 20 bp, Artificial
  CRISPR gRNA sequence
ttggatgttctgctgattta

SEQ ID NO: 629921 - DNA, 20 bp, Artificial
  CRISPR gRNA sequence
ggatgttctgctgatttagg

SEQ ID NO: 629922 - DNA, 20 bp, Artificial
  CRISPR gRNA sequence
gatgttctgctgatttaggt

SEQ ID NO: 629923 - DNA, 20 bp, Artificial
  CRISPR gRNA sequence
tgctgatttaggtatgtcct

SEQ ID NO: 629924 - DNA, 20 bp, Artificial
  CRISPR gRNA sequence
ctgatttaggtatgtcctct

SEQ ID NO: 629925 - DNA, 20 bp, Artificial
  CRISPR gRNA sequence
atttaggtatgtcctctctg

SEQ ID NO: 629926 - DNA, 20 bp, Artificial
  CRISPR gRNA sequence
aggtatgtcctctctgtctc

SEQ ID NO: 629927 - DNA, 20 bp, Artificial
  CRISPR gRNA sequence
ggtatgtcctctctgtctcc

SEQ ID NO: 629928 - DNA, 20 bp, Artificial
  CRISPR gRNA sequence
tctgtctccataatgcttat

SEQ ID NO: 629929 - DNA, 20 bp, Artificial
  CRISPR gRNA sequence
tgtctccataatgcttatca

SEQ ID NO: 629930 - DNA, 20 bp, Artificial
  CRISPR gRNA sequence
tctccataatgcttatcaca

SEQ ID NO: 629931 - DNA, 20 bp, Artificial
  CRISPR gRNA sequence
cataatgcttatcacatagt

SEQ ID NO: 629932 - DNA, 20 bp, Artificial
  CRISPR gRNA sequence
atcacatagtactataattg

SEQ ID NO: 629933 - DNA, 20 bp, Artificial
  CRISPR gRNA sequence
tcacatagtactataattgt

SEQ ID NO: 629934 - DNA, 20 bp, Artificial
  CRISPR gRNA sequence
taattgttgttttactggtc

SEQ ID NO: 629935 - DNA, 20 bp, Artificial
  CRISPR gRNA sequence
ttgttttactggtctatctt

SEQ ID NO: 629936 - DNA, 20 bp, Artificial
  CRISPR gRNA sequence
ttttactggtctatcttcca

SEQ ID NO: 629937 - DNA, 20 bp, Artificial
  CRISPR gRNA sequence
tactggtctatcttccaata

SEQ ID NO: 629938 - DNA, 20 bp, Artificial
  CRISPR gRNA sequence
actggtctatcttccaatag

SEQ ID NO: 629939 - DNA, 20 bp, Artificial
  CRISPR gRNA sequence
ctggtctatcttccaatagc

SEQ ID NO: 629940 - DNA, 20 bp, Artificial
  CRISPR gRNA sequence
gtctatcttccaatagctgg

SEQ ID NO: 629941 - DNA, 20 bp, Artificial
  CRISPR gRNA sequence
tcttccaatagctggtaaat

SEQ ID NO: 629942 - DNA, 20 bp, Artificial
  CRISPR gRNA sequence
ccaatagctggtaaataacc

SEQ ID NO: 629943 - DNA, 20 bp, Artificial
  CRISPR gRNA sequence
caatagctggtaaataacct

SEQ ID NO: 629944 - DNA, 20 bp, Artificial
  CRISPR gRNA sequence
gtaaataacctcaggggttg

SEQ ID NO: 629945 - DNA, 20 bp, Artificial
  CRISPR gRNA sequence
aggggttgcattctgttgta

SEQ ID NO: 629946 - DNA, 20 bp, Artificial
  CRISPR gRNA sequence
cattctgttgtatttgtgtc

SEQ ID NO: 629947 - DNA, 20 bp, Artificial
  CRISPR gRNA sequence
tgttgtatttgtgtctctaa

SEQ ID NO: 629948 - DNA, 20 bp, Artificial
  CRISPR gRNA sequence
ttgtatttgtgtctctaata

SEQ ID NO: 629949 - DNA, 20 bp, Artificial
  CRISPR gRNA sequence
tatttgtgtctctaatacct

SEQ ID NO: 629950 - DNA, 20 bp, Artificial
  CRISPR gRNA sequence
gtgtctctaataccttttat

SEQ ID NO: 629951 - DNA, 20 bp, Artificial
  CRISPR gRNA sequence
tgtctctaataccttttatg

SEQ ID NO: 629952 - DNA, 20 bp, Artificial
  CRISPR gRNA sequence
taataccttttatgatacaa

SEQ ID NO: 629953 - DNA, 20 bp, Artificial
  CRISPR gRNA sequence
ataccttttatgatacaaga

SEQ ID NO: 629954 - DNA, 20 bp, Artificial
  CRISPR gRNA sequence
ttatgatacaagagagatat

SEQ ID NO: 629955 - DNA, 20 bp, Artificial
  CRISPR gRNA sequence
tatgatacaagagagatata

SEQ ID NO: 629956 - DNA, 20 bp, Artificial
  CRISPR gRNA sequence
atgatacaagagagatataa

SEQ ID NO: 629957 - DNA, 20 bp, Artificial
  CRISPR gRNA sequence
tgatacaagagagatataat

SEQ ID NO: 629958 - DNA, 20 bp, Artificial
  CRISPR gRNA sequence
aatggatgttcactgaatga

SEQ ID NO: 629959 - DNA, 20 bp, Artificial
  CRISPR gRNA sequence
actgaatgatgtcacccaat

SEQ ID NO: 629960 - DNA, 20 bp, Artificial
  CRISPR gRNA sequence
aatgatgtcacccaatagaa

SEQ ID NO: 629961 - DNA, 20 bp, Artificial
  CRISPR gRNA sequence
attccaaagtttgggggtgc

SEQ ID NO: 629962 - DNA, 20 bp, Artificial
  CRISPR gRNA sequence
ttccaaagtttgggggtgcc

SEQ ID NO: 629963 - DNA, 20 bp, Artificial
  CRISPR gRNA sequence
caaagtttgggggtgcccaa

SEQ ID NO: 629964 - DNA, 20 bp, Artificial
  CRISPR gRNA sequence
gggggtgcccaataatgcct

SEQ ID NO: 629965 - DNA, 20 bp, Artificial
  CRISPR gRNA sequence
ggggtgcccaataatgcctc

SEQ ID NO: 629966 - DNA, 20 bp, Artificial
  CRISPR gRNA sequence
tatactgtgaaaaagaacct

SEQ ID NO: 629967 - DNA, 20 bp, Artificial
  CRISPR gRNA sequence
tactgtgaaaaagaacctcc

SEQ ID NO: 629968 - DNA, 20 bp, Artificial
  CRISPR gRNA sequence
tgaaaaagaacctccctttc

SEQ ID NO: 629969 - DNA, 20 bp, Artificial
  CRISPR gRNA sequence
cctttcctaaacaattcaaa

SEQ ID NO: 629970 - DNA, 20 bp, Artificial
  CRISPR gRNA sequence
tcctaaacaattcaaagcat

SEQ ID NO: 629971 - DNA, 20 bp, Artificial
  CRISPR gRNA sequence
cctaaacaattcaaagcata

SEQ ID NO: 629972 - DNA, 20 bp, Artificial
  CRISPR gRNA sequence
ctaaacaattcaaagcataa

SEQ ID NO: 629973 - DNA, 20 bp, Artificial
  CRISPR gRNA sequence
aacaattcaaagcataaacc

SEQ ID NO: 629974 - DNA, 20 bp, Artificial
  CRISPR gRNA sequence
aaagcataaacctaacaata

SEQ ID NO: 629975 - DNA, 20 bp, Artificial
  CRISPR gRNA sequence
acaatatatatagattttaa

SEQ ID NO: 629976 - DNA, 20 bp, Artificial
  CRISPR gRNA sequence
taagctggctatccttctgc

SEQ ID NO: 629977 - DNA, 20 bp, Artificial
  CRISPR gRNA sequence
aagctggctatccttctgct

SEQ ID NO: 629978 - DNA, 20 bp, Artificial
  CRISPR gRNA sequence
agctggctatccttctgctt

SEQ ID NO: 629979 - DNA, 20 bp, Artificial
  CRISPR gRNA sequence
gctatccttctgctttgcac

SEQ ID NO: 629980 - DNA, 20 bp, Artificial
  CRISPR gRNA sequence
tccttctgctttgcactttc

SEQ ID NO: 629981 - DNA, 20 bp, Artificial
  CRISPR gRNA sequence
ctgctttgcactttcatttt

SEQ ID NO: 629982 - DNA, 20 bp, Artificial
  CRISPR gRNA sequence
tgctttgcactttcattttt

SEQ ID NO: 629983 - DNA, 20 bp, Artificial
  CRISPR gRNA sequence
ctttgcactttcatttttgt

SEQ ID NO: 629984 - DNA, 20 bp, Artificial
  CRISPR gRNA sequence
tgcactttcatttttgtctt

SEQ ID NO: 629985 - DNA, 20 bp, Artificial
  CRISPR gRNA sequence
gcactttcatttttgtcttt

SEQ ID NO: 629986 - DNA, 20 bp, Artificial
  CRISPR gRNA sequence
cactttcatttttgtcttta

SEQ ID NO: 629987 - DNA, 20 bp, Artificial
  CRISPR gRNA sequence
tcatttttgtctttaggttt

SEQ ID NO: 629988 - DNA, 20 bp, Artificial
  CRISPR gRNA sequence
catttttgtctttaggttta

SEQ ID NO: 629989 - DNA, 20 bp, Artificial
  CRISPR gRNA sequence
atttttgtctttaggtttag

SEQ ID NO: 629990 - DNA, 20 bp, Artificial
  CRISPR gRNA sequence
ttgtctttaggtttaggtaa

SEQ ID NO: 629991 - DNA, 20 bp, Artificial
  CRISPR gRNA sequence
tgtctttaggtttaggtaaa

SEQ ID NO: 629992 - DNA, 20 bp, Artificial
  CRISPR gRNA sequence
gtctttaggtttaggtaaaa

SEQ ID NO: 629993 - DNA, 20 bp, Artificial
  CRISPR gRNA sequence
tctttaggtttaggtaaaac

SEQ ID NO: 629994 - DNA, 20 bp, Artificial
  CRISPR gRNA sequence
taggtttaggtaaaacaggt

SEQ ID NO: 629995 - DNA, 20 bp, Artificial
  CRISPR gRNA sequence
aggtttaggtaaaacaggta

SEQ ID NO: 629996 - DNA, 20 bp, Artificial
  CRISPR gRNA sequence
ggtttaggtaaaacaggtaa

SEQ ID NO: 629997 - DNA, 20 bp, Artificial
  CRISPR gRNA sequence
aggtaaaacaggtaataaca

SEQ ID NO: 629998 - DNA, 20 bp, Artificial
  CRISPR gRNA sequence
ggtaaaacaggtaataacat

SEQ ID NO: 629999 - DNA, 20 bp, Artificial
  CRISPR gRNA sequence
gattttaaagcttttccttc

SEQ ID NO: 630000 - DNA, 20 bp, Artificial
  CRISPR gRNA sequence
attttaaagcttttccttca

SEQ ID NO: 630001 - DNA, 20 bp, Artificial
  CRISPR gRNA sequence
taaagcttttccttcaagct

SEQ ID NO: 630002 - DNA, 20 bp, Artificial
  CRISPR gRNA sequence
aaagcttttccttcaagcta

SEQ ID NO: 630003 - DNA, 20 bp, Artificial
  CRISPR gRNA sequence
aagcttttccttcaagctaa

SEQ ID NO: 630004 - DNA, 20 bp, Artificial
  CRISPR gRNA sequence
ttccttcaagctaagcagac

SEQ ID NO: 630005 - DNA, 20 bp, Artificial
  CRISPR gRNA sequence
tccttcaagctaagcagact

SEQ ID NO: 630006 - DNA, 20 bp, Artificial
  CRISPR gRNA sequence
ccttcaagctaagcagactt

SEQ ID NO: 630007 - DNA, 20 bp, Artificial
  CRISPR gRNA sequence
cttcaagctaagcagacttg

SEQ ID NO: 630008 - DNA, 20 bp, Artificial
  CRISPR gRNA sequence
caagctaagcagacttgaaa

SEQ ID NO: 630009 - DNA, 20 bp, Artificial
  CRISPR gRNA sequence
aagctaagcagacttgaaaa

SEQ ID NO: 630010 - DNA, 20 bp, Artificial
  CRISPR gRNA sequence
agcagacttgaaaaagcaac

SEQ ID NO: 630011 - DNA, 20 bp, Artificial
  CRISPR gRNA sequence
gaaaaagcaacataaagata

SEQ ID NO: 630012 - DNA, 20 bp, Artificial
  CRISPR gRNA sequence
aaaaagcaacataaagataa

SEQ ID NO: 630013 - DNA, 20 bp, Artificial
  CRISPR gRNA sequence
aacaagataatctgccataa

SEQ ID NO: 630014 - DNA, 20 bp, Artificial
  CRISPR gRNA sequence
ccataaaacctaattaaata

SEQ ID NO: 630015 - DNA, 20 bp, Artificial
  CRISPR gRNA sequence
attaaataagataaataatc

SEQ ID NO: 630016 - DNA, 20 bp, Artificial
  CRISPR gRNA sequence
aataagataaataatctgcc

SEQ ID NO: 630017 - DNA, 20 bp, Artificial
  CRISPR gRNA sequence
ccctaaaacccaataaaata

SEQ ID NO: 630018 - DNA, 20 bp, Artificial
  CRISPR gRNA sequence
aaacccaataaaataaataa

SEQ ID NO: 630019 - DNA, 20 bp, Artificial
  CRISPR gRNA sequence
atcaaacccaattaaataat

SEQ ID NO: 630020 - DNA, 20 bp, Artificial
  CRISPR gRNA sequence
aataatttaattatataaat

SEQ ID NO: 630021 - DNA, 20 bp, Artificial
  CRISPR gRNA sequence
aattatataaataatctgtc

SEQ ID NO: 630022 - DNA, 20 bp, Artificial
  CRISPR gRNA sequence
attatataaataatctgtca

SEQ ID NO: 630023 - DNA, 20 bp, Artificial
  CRISPR gRNA sequence
tataaataatctgtcataaa

SEQ ID NO: 630024 - DNA, 20 bp, Artificial
  CRISPR gRNA sequence
tcataaaactcaattattat

SEQ ID NO: 630025 - DNA, 20 bp, Artificial
  CRISPR gRNA sequence
aattattatttccaaaacta

SEQ ID NO: 630026 - DNA, 20 bp, Artificial
  CRISPR gRNA sequence
ttatttccaaaactatgagt

SEQ ID NO: 630027 - DNA, 20 bp, Artificial
  CRISPR gRNA sequence
tttccaaaactatgagtcat

SEQ ID NO: 630028 - DNA, 20 bp, Artificial
  CRISPR gRNA sequence
ccaaaactatgagtcatgat

SEQ ID NO: 630029 - DNA, 20 bp, Artificial
  CRISPR gRNA sequence
caaaactatgagtcatgata

SEQ ID NO: 630030 - DNA, 20 bp, Artificial
  CRISPR gRNA sequence
tgagtcatgatattcctcct

SEQ ID NO: 630031 - DNA, 20 bp, Artificial
  CRISPR gRNA sequence
ctcctttttcctcaaactca

SEQ ID NO: 630032 - DNA, 20 bp, Artificial
  CRISPR gRNA sequence
ctttttcctcaaactcaatc

SEQ ID NO: 630033 - DNA, 20 bp, Artificial
  CRISPR gRNA sequence
tttcctcaaactcaatcaac

SEQ ID NO: 630034 - DNA, 20 bp, Artificial
  CRISPR gRNA sequence
ttcctcaaactcaatcaact

SEQ ID NO: 630035 - DNA, 20 bp, Artificial
  CRISPR gRNA sequence
tcctcaaactcaatcaactt

SEQ ID NO: 630036 - DNA, 20 bp, Artificial
  CRISPR gRNA sequence
cctcaaactcaatcaacttt

SEQ ID NO: 630037 - DNA, 20 bp, Artificial
  CRISPR gRNA sequence
ctcaaactcaatcaactttt

SEQ ID NO: 630038 - DNA, 20 bp, Artificial
  CRISPR gRNA sequence
aaactcaatcaacttttcta

SEQ ID NO: 630039 - DNA, 20 bp, Artificial
  CRISPR gRNA sequence
aatcaacttttctaagacca

SEQ ID NO: 630040 - DNA, 20 bp, Artificial
  CRISPR gRNA sequence
ttctaagaccattttattct

SEQ ID NO: 630041 - DNA, 20 bp, Artificial
  CRISPR gRNA sequence
tctaagaccattttattcta

SEQ ID NO: 630042 - DNA, 20 bp, Artificial
  CRISPR gRNA sequence
ctaagaccattttattctac

SEQ ID NO: 630043 - DNA, 20 bp, Artificial
  CRISPR gRNA sequence
taagaccattttattctacc

SEQ ID NO: 630044 - DNA, 20 bp, Artificial
  CRISPR gRNA sequence
agaccattttattctacctc

SEQ ID NO: 630045 - DNA, 20 bp, Artificial
  CRISPR gRNA sequence
tattctacctcctaaatatg

SEQ ID NO: 630046 - DNA, 20 bp, Artificial
  CRISPR gRNA sequence
attctacctcctaaatatgt

SEQ ID NO: 630047 - DNA, 20 bp, Artificial
  CRISPR gRNA sequence
ttctacctcctaaatatgtc

SEQ ID NO: 630048 - DNA, 20 bp, Artificial
  CRISPR gRNA sequence
tacctcctaaatatgtcttc

SEQ ID NO: 630049 - DNA, 20 bp, Artificial
  CRISPR gRNA sequence
cctcctaaatatgtcttcaa

SEQ ID NO: 630050 - DNA, 20 bp, Artificial
  CRISPR gRNA sequence
ctaaatatgtcttcaatatt

SEQ ID NO: 630051 - DNA, 20 bp, Artificial
  CRISPR gRNA sequence
aatatgtcttcaatatttca

SEQ ID NO: 630052 - DNA, 20 bp, Artificial
  CRISPR gRNA sequence
caatatttcaccttgttctc

SEQ ID NO: 630053 - DNA, 20 bp, Artificial
  CRISPR gRNA sequence
aatatttcaccttgttctct

SEQ ID NO: 630054 - DNA, 20 bp, Artificial
  CRISPR gRNA sequence
caccttgttctcttctgcag

SEQ ID NO: 630055 - DNA, 20 bp, Artificial
  CRISPR gRNA sequence
accttgttctcttctgcagt

SEQ ID NO: 630056 - DNA, 20 bp, Artificial
  CRISPR gRNA sequence
gttctcttctgcagttgcct

SEQ ID NO: 630057 - DNA, 20 bp, Artificial
  CRISPR gRNA sequence
ttctcttctgcagttgcctc

SEQ ID NO: 630058 - DNA, 20 bp, Artificial
  CRISPR gRNA sequence
tcttctgcagttgcctcttc

SEQ ID NO: 630059 - DNA, 20 bp, Artificial
  CRISPR gRNA sequence
ttctgcagttgcctcttcat

SEQ ID NO: 630060 - DNA, 20 bp, Artificial
  CRISPR gRNA sequence
ctgcagttgcctcttcatct

SEQ ID NO: 630061 - DNA, 20 bp, Artificial
  CRISPR gRNA sequence
tgcagttgcctcttcatctt

SEQ ID NO: 630062 - DNA, 20 bp, Artificial
  CRISPR gRNA sequence
cagttgcctcttcatctttt

SEQ ID NO: 630063 - DNA, 20 bp, Artificial
  CRISPR gRNA sequence
cctcttcatctttttctttt

SEQ ID NO: 630064 - DNA, 20 bp, Artificial
  CRISPR gRNA sequence
ttcatctttttctttttggc

SEQ ID NO: 630065 - DNA, 20 bp, Artificial
  CRISPR gRNA sequence
catctttttctttttggcat

SEQ ID NO: 630066 - DNA, 20 bp, Artificial
  CRISPR gRNA sequence
atctttttctttttggcatt

SEQ ID NO: 630067 - DNA, 20 bp, Artificial
  CRISPR gRNA sequence
tttctttttggcattgtcat

SEQ ID NO: 630068 - DNA, 20 bp, Artificial
  CRISPR gRNA sequence
ttctttttggcattgtcatt

SEQ ID NO: 630069 - DNA, 20 bp, Artificial
  CRISPR gRNA sequence
tctttttggcattgtcattt

SEQ ID NO: 630070 - DNA, 20 bp, Artificial
  CRISPR gRNA sequence
ctttttggcattgtcatttc

SEQ ID NO: 630071 - DNA, 20 bp, Artificial
  CRISPR gRNA sequence
tttttggcattgtcatttcc

SEQ ID NO: 630072 - DNA, 20 bp, Artificial
  CRISPR gRNA sequence
tttggcattgtcatttccag

SEQ ID NO: 630073 - DNA, 20 bp, Artificial
  CRISPR gRNA sequence
ttggcattgtcatttccagt

SEQ ID NO: 630074 - DNA, 20 bp, Artificial
  CRISPR gRNA sequence
tggcattgtcatttccagtc

SEQ ID NO: 630075 - DNA, 20 bp, Artificial
  CRISPR gRNA sequence
ggcattgtcatttccagtct

SEQ ID NO: 630076 - DNA, 20 bp, Artificial
  CRISPR gRNA sequence
gcattgtcatttccagtctc

SEQ ID NO: 630077 - DNA, 20 bp, Artificial
  CRISPR gRNA sequence
tcatttccagtctctcctca

SEQ ID NO: 630078 - DNA, 20 bp, Artificial
  CRISPR gRNA sequence
ccagtctctcctcacaccat

SEQ ID NO: 630079 - DNA, 20 bp, Artificial
  CRISPR gRNA sequence
cagtctctcctcacaccata

SEQ ID NO: 630080 - DNA, 20 bp, Artificial
  CRISPR gRNA sequence
tcctcacaccataccccctg

SEQ ID NO: 630081 - DNA, 20 bp, Artificial
  CRISPR gRNA sequence
ctcacaccataccccctgcc

SEQ ID NO: 630082 - DNA, 20 bp, Artificial
  CRISPR gRNA sequence
acaccataccccctgcccca

SEQ ID NO: 630083 - DNA, 20 bp, Artificial
  CRISPR gRNA sequence
ccccaggtaggcatttatca

SEQ ID NO: 630084 - DNA, 20 bp, Artificial
  CRISPR gRNA sequence
atcatgtatcctcattggag

SEQ ID NO: 630085 - DNA, 20 bp, Artificial
  CRISPR gRNA sequence
tcatgtatcctcattggaga

SEQ ID NO: 630086 - DNA, 20 bp, Artificial
  CRISPR gRNA sequence
attggagacatttttcttga

SEQ ID NO: 630087 - DNA, 20 bp, Artificial
  CRISPR gRNA sequence
gagacatttttcttgatttg

SEQ ID NO: 630088 - DNA, 20 bp, Artificial
  CRISPR gRNA sequence
ttcttgatttgattacctca

SEQ ID NO: 630089 - DNA, 20 bp, Artificial
  CRISPR gRNA sequence
tcttgatttgattacctcat

SEQ ID NO: 630090 - DNA, 20 bp, Artificial
  CRISPR gRNA sequence
cttgatttgattacctcatt

SEQ ID NO: 630091 - DNA, 20 bp, Artificial
  CRISPR gRNA sequence
ttgatttgattacctcatta

SEQ ID NO: 630092 - DNA, 20 bp, Artificial
  CRISPR gRNA sequence
gatttgattacctcattaat

SEQ ID NO: 630093 - DNA, 20 bp, Artificial
  CRISPR gRNA sequence
atttgattacctcattaata

SEQ ID NO: 630094 - DNA, 20 bp, Artificial
  CRISPR gRNA sequence
gattacctcattaataacaa

SEQ ID NO: 630095 - DNA, 20 bp, Artificial
  CRISPR gRNA sequence
attacctcattaataacaaa

SEQ ID NO: 630096 - DNA, 20 bp, Artificial
  CRISPR gRNA sequence
cctcattaataacaaatttg

SEQ ID NO: 630097 - DNA, 20 bp, Artificial
  CRISPR gRNA sequence
attaataacaaatttggtta

SEQ ID NO: 630098 - DNA, 20 bp, Artificial
  CRISPR gRNA sequence
ataacaaatttggttaccct

SEQ ID NO: 630099 - DNA, 20 bp, Artificial
  CRISPR gRNA sequence
ggttaccctagtggcccccc

SEQ ID NO: 630100 - DNA, 20 bp, Artificial
  CRISPR gRNA sequence
gttaccctagtggcccccca

SEQ ID NO: 630101 - DNA, 20 bp, Artificial
  CRISPR gRNA sequence
ccctagtggccccccatcag

SEQ ID NO: 630102 - DNA, 20 bp, Artificial
  CRISPR gRNA sequence
gtggccccccatcagttaca

SEQ ID NO: 630103 - DNA, 20 bp, Artificial
  CRISPR gRNA sequence
cacaatgaaattcaaacact

SEQ ID NO: 630104 - DNA, 20 bp, Artificial
  CRISPR gRNA sequence
aaacactagcttagcagaga

SEQ ID NO: 630105 - DNA, 20 bp, Artificial
  CRISPR gRNA sequence
gcttagcagagaagactctg

SEQ ID NO: 630106 - DNA, 20 bp, Artificial
  CRISPR gRNA sequence
agcagagaagactctgtctt

SEQ ID NO: 630107 - DNA, 20 bp, Artificial
  CRISPR gRNA sequence
gcagagaagactctgtcttt

SEQ ID NO: 630108 - DNA, 20 bp, Artificial
  CRISPR gRNA sequence
tgtctttgcatcacaaccta

SEQ ID NO: 630109 - DNA, 20 bp, Artificial
  CRISPR gRNA sequence
tctttgcatcacaacctact

SEQ ID NO: 630110 - DNA, 20 bp, Artificial
  CRISPR gRNA sequence
tgcatcacaacctactaatt

SEQ ID NO: 630111 - DNA, 20 bp, Artificial
  CRISPR gRNA sequence
gcatcacaacctactaattc

SEQ ID NO: 630112 - DNA, 20 bp, Artificial
  CRISPR gRNA sequence
catcacaacctactaattca

SEQ ID NO: 630113 - DNA, 20 bp, Artificial
  CRISPR gRNA sequence
ctaattcagaagcttcattt

SEQ ID NO: 630114 - DNA, 20 bp, Artificial
  CRISPR gRNA sequence
attcagaagcttcatttcct

SEQ ID NO: 630115 - DNA, 20 bp, Artificial
  CRISPR gRNA sequence
agaagcttcatttcctacca

SEQ ID NO: 630116 - DNA, 20 bp, Artificial
  CRISPR gRNA sequence
catttcctaccactccttaa

SEQ ID NO: 630117 - DNA, 20 bp, Artificial
  CRISPR gRNA sequence
atttcctaccactccttaaa

SEQ ID NO: 630118 - DNA, 20 bp, Artificial
  CRISPR gRNA sequence
cctaccactccttaaactgc

SEQ ID NO: 630119 - DNA, 20 bp, Artificial
  CRISPR gRNA sequence
ctaccactccttaaactgca

SEQ ID NO: 630120 - DNA, 20 bp, Artificial
  CRISPR gRNA sequence
ccactccttaaactgcagtt

SEQ ID NO: 630121 - DNA, 20 bp, Artificial
  CRISPR gRNA sequence
cttaaactgcagttacactc

SEQ ID NO: 630122 - DNA, 20 bp, Artificial
  CRISPR gRNA sequence
aaactgcagttacactcaac

SEQ ID NO: 630123 - DNA, 20 bp, Artificial
  CRISPR gRNA sequence
aactgcagttacactcaaca

SEQ ID NO: 630124 - DNA, 20 bp, Artificial
  CRISPR gRNA sequence
cagttacactcaacatcagg

SEQ ID NO: 630125 - DNA, 20 bp, Artificial
  CRISPR gRNA sequence
cactcaacatcagggaagct

SEQ ID NO: 630126 - DNA, 20 bp, Artificial
  CRISPR gRNA sequence
aacatcagggaagctgttaa

SEQ ID NO: 630127 - DNA, 20 bp, Artificial
  CRISPR gRNA sequence
ttaattatcttttatatctc

SEQ ID NO: 630128 - DNA, 20 bp, Artificial
  CRISPR gRNA sequence
attatcttttatatctccaa

SEQ ID NO: 630129 - DNA, 20 bp, Artificial
  CRISPR gRNA sequence
tcttttatatctccaagcct

SEQ ID NO: 630130 - DNA, 20 bp, Artificial
  CRISPR gRNA sequence
ttatatctccaagcctcttt

SEQ ID NO: 630131 - DNA, 20 bp, Artificial
  CRISPR gRNA sequence
tatatctccaagcctctttt

SEQ ID NO: 630132 - DNA, 20 bp, Artificial
  CRISPR gRNA sequence
atatctccaagcctcttttt

SEQ ID NO: 630133 - DNA, 20 bp, Artificial
  CRISPR gRNA sequence
tatctccaagcctctttttc

SEQ ID NO: 630134 - DNA, 20 bp, Artificial
  CRISPR gRNA sequence
caagcctctttttctccttg

SEQ ID NO: 630135 - DNA, 20 bp, Artificial
  CRISPR gRNA sequence
tttttctccttgaatataca

SEQ ID NO: 630136 - DNA, 20 bp, Artificial
  CRISPR gRNA sequence
tttctccttgaatatacatt

SEQ ID NO: 630137 - DNA, 20 bp, Artificial
  CRISPR gRNA sequence
ttctccttgaatatacattc

SEQ ID NO: 630138 - DNA, 20 bp, Artificial
  CRISPR gRNA sequence
tctccttgaatatacattct

SEQ ID NO: 630139 - DNA, 20 bp, Artificial
  CRISPR gRNA sequence
ctccttgaatatacattctc

SEQ ID NO: 630140 - DNA, 20 bp, Artificial
  CRISPR gRNA sequence
tccttgaatatacattctct

SEQ ID NO: 630141 - DNA, 20 bp, Artificial
  CRISPR gRNA sequence
cttgaatatacattctctgt

SEQ ID NO: 630142 - DNA, 20 bp, Artificial
  CRISPR gRNA sequence
gaatatacattctctgtatc

SEQ ID NO: 630143 - DNA, 20 bp, Artificial
  CRISPR gRNA sequence
aatatacattctctgtatcc

SEQ ID NO: 630144 - DNA, 20 bp, Artificial
  CRISPR gRNA sequence
tctgtatcctgcctgatata

SEQ ID NO: 630145 - DNA, 20 bp, Artificial
  CRISPR gRNA sequence
tgtatcctgcctgatatatg

SEQ ID NO: 630146 - DNA, 20 bp, Artificial
  CRISPR gRNA sequence
tatcctgcctgatatatgca

SEQ ID NO: 630147 - DNA, 20 bp, Artificial
  CRISPR gRNA sequence
cctgatatatgcaattttta

SEQ ID NO: 630148 - DNA, 20 bp, Artificial
  CRISPR gRNA sequence
atatatgcaatttttactca

SEQ ID NO: 630149 - DNA, 20 bp, Artificial
  CRISPR gRNA sequence
ttactcatccctcatgtttg

SEQ ID NO: 630150 - DNA, 20 bp, Artificial
  CRISPR gRNA sequence
tactcatccctcatgtttgg

SEQ ID NO: 630151 - DNA, 20 bp, Artificial
  CRISPR gRNA sequence
actcatccctcatgtttgga

SEQ ID NO: 630152 - DNA, 20 bp, Artificial
  CRISPR gRNA sequence
ctcatccctcatgtttggat

SEQ ID NO: 630153 - DNA, 20 bp, Artificial
  CRISPR gRNA sequence
atccctcatgtttggattga

SEQ ID NO: 630154 - DNA, 20 bp, Artificial
  CRISPR gRNA sequence
atgtttggattgaacactcc

SEQ ID NO: 630155 - DNA, 20 bp, Artificial
  CRISPR gRNA sequence
ggattgaacactcctgcatg

SEQ ID NO: 630156 - DNA, 20 bp, Artificial
  CRISPR gRNA sequence
gattgaacactcctgcatgt

SEQ ID NO: 630157 - DNA, 20 bp, Artificial
  CRISPR gRNA sequence
aacactcctgcatgtaagaa

SEQ ID NO: 630158 - DNA, 20 bp, Artificial
  CRISPR gRNA sequence
ctgcatgtaagaagcctctc

SEQ ID NO: 630159 - DNA, 20 bp, Artificial
  CRISPR gRNA sequence
catgtaagaagcctctcttg

SEQ ID NO: 630160 - DNA, 20 bp, Artificial
  CRISPR gRNA sequence
tcttgacttttccagagtta

SEQ ID NO: 630161 - DNA, 20 bp, Artificial
  CRISPR gRNA sequence
ttgacttttccagagttagg

SEQ ID NO: 630162 - DNA, 20 bp, Artificial
  CRISPR gRNA sequence
gacttttccagagttaggtt

SEQ ID NO: 630163 - DNA, 20 bp, Artificial
  CRISPR gRNA sequence
acttttccagagttaggtta

SEQ ID NO: 630164 - DNA, 20 bp, Artificial
  CRISPR gRNA sequence
ttccagagttaggttaattc

SEQ ID NO: 630165 - DNA, 20 bp, Artificial
  CRISPR gRNA sequence
tccagagttaggttaattct

SEQ ID NO: 630166 - DNA, 20 bp, Artificial
  CRISPR gRNA sequence
ccagagttaggttaattcta

SEQ ID NO: 630167 - DNA, 20 bp, Artificial
  CRISPR gRNA sequence
cagagttaggttaattctac

SEQ ID NO: 630168 - DNA, 20 bp, Artificial
  CRISPR gRNA sequence
ggttaattctacatctatgt

SEQ ID NO: 630169 - DNA, 20 bp, Artificial
  CRISPR gRNA sequence
attctacatctatgttccca

SEQ ID NO: 630170 - DNA, 20 bp, Artificial
  CRISPR gRNA sequence
tacatctatgttcccagaga

SEQ ID NO: 630171 - DNA, 20 bp, Artificial
  CRISPR gRNA sequence
catctatgttcccagagaac

SEQ ID NO: 630172 - DNA, 20 bp, Artificial
  CRISPR gRNA sequence
tgttcccagagaactgtgta

SEQ ID NO: 630173 - DNA, 20 bp, Artificial
  CRISPR gRNA sequence
ccagagaactgtgtatgcat

SEQ ID NO: 630174 - DNA, 20 bp, Artificial
  CRISPR gRNA sequence
tgtatgcatccttattagag

SEQ ID NO: 630175 - DNA, 20 bp, Artificial
  CRISPR gRNA sequence
attagagcttttgtttcatt

SEQ ID NO: 630176 - DNA, 20 bp, Artificial
  CRISPR gRNA sequence
ttagagcttttgtttcattt

SEQ ID NO: 630177 - DNA, 20 bp, Artificial
  CRISPR gRNA sequence
gagcttttgtttcattttat

SEQ ID NO: 630178 - DNA, 20 bp, Artificial
  CRISPR gRNA sequence
ttgtttcattttattttatt

SEQ ID NO: 630179 - DNA, 20 bp, Artificial
  CRISPR gRNA sequence
tgtttcattttattttattt

SEQ ID NO: 630180 - DNA, 20 bp, Artificial
  CRISPR gRNA sequence
gtttcattttattttatttt

SEQ ID NO: 630181 - DNA, 20 bp, Artificial
  CRISPR gRNA sequence
tttcattttattttattttt

SEQ ID NO: 630182 - DNA, 20 bp, Artificial
  CRISPR gRNA sequence
cattttattttattttttta

SEQ ID NO: 630183 - DNA, 20 bp, Artificial
  CRISPR gRNA sequence
attttattttatttttttaa

SEQ ID NO: 630184 - DNA, 20 bp, Artificial
  CRISPR gRNA sequence
tattttatttttttaaagta

SEQ ID NO: 630185 - DNA, 20 bp, Artificial
  CRISPR gRNA sequence
attttatttttttaaagtat

SEQ ID NO: 630186 - DNA, 20 bp, Artificial
  CRISPR gRNA sequence
ttttatttttttaaagtatg

SEQ ID NO: 630187 - DNA, 20 bp, Artificial
  CRISPR gRNA sequence
tatttttttaaagtatgtat

SEQ ID NO: 630188 - DNA, 20 bp, Artificial
  CRISPR gRNA sequence
atttttttaaagtatgtatt

SEQ ID NO: 630189 - DNA, 20 bp, Artificial
  CRISPR gRNA sequence
tttttttaaagtatgtattt

SEQ ID NO: 630190 - DNA, 20 bp, Artificial
  CRISPR gRNA sequence
ttttaaagtatgtatttcct

SEQ ID NO: 630191 - DNA, 20 bp, Artificial
  CRISPR gRNA sequence
tttaaagtatgtatttccta

SEQ ID NO: 630192 - DNA, 20 bp, Artificial
  CRISPR gRNA sequence
ttaaagtatgtatttcctac

SEQ ID NO: 630193 - DNA, 20 bp, Artificial
  CRISPR gRNA sequence
taaagtatgtatttcctacc

SEQ ID NO: 630194 - DNA, 20 bp, Artificial
  CRISPR gRNA sequence
aaagtatgtatttcctacca

SEQ ID NO: 630195 - DNA, 20 bp, Artificial
  CRISPR gRNA sequence
aagtatgtatttcctaccag

SEQ ID NO: 630196 - DNA, 20 bp, Artificial
  CRISPR gRNA sequence
cctaccagactataaagtaa

SEQ ID NO: 630197 - DNA, 20 bp, Artificial
  CRISPR gRNA sequence
ctaccagactataaagtaag

SEQ ID NO: 630198 - DNA, 20 bp, Artificial
  CRISPR gRNA sequence
ccagactataaagtaagtgt

SEQ ID NO: 630199 - DNA, 20 bp, Artificial
  CRISPR gRNA sequence
taaagtaagtgtattaaaag

SEQ ID NO: 630200 - DNA, 20 bp, Artificial
  CRISPR gRNA sequence
aaagactgggtccatttatt

SEQ ID NO: 630201 - DNA, 20 bp, Artificial
  CRISPR gRNA sequence
ggtccatttatttttatacc

SEQ ID NO: 630202 - DNA, 20 bp, Artificial
  CRISPR gRNA sequence
atttttataccccagaatgt

SEQ ID NO: 630203 - DNA, 20 bp, Artificial
  CRISPR gRNA sequence
tttttataccccagaatgtt

SEQ ID NO: 630204 - DNA, 20 bp, Artificial
  CRISPR gRNA sequence
ttataccccagaatgttcta

SEQ ID NO: 630205 - DNA, 20 bp, Artificial
  CRISPR gRNA sequence
tataccccagaatgttctat

SEQ ID NO: 630206 - DNA, 20 bp, Artificial
  CRISPR gRNA sequence
ataccccagaatgttctata

SEQ ID NO: 630207 - DNA, 20 bp, Artificial
  CRISPR gRNA sequence
taccccagaatgttctatat

SEQ ID NO: 630208 - DNA, 20 bp, Artificial
  CRISPR gRNA sequence
tatataacttggcacatagt

SEQ ID NO: 630209 - DNA, 20 bp, Artificial
  CRISPR gRNA sequence
tataacttggcacatagtaa

SEQ ID NO: 630210 - DNA, 20 bp, Artificial
  CRISPR gRNA sequence
ggcacatagtaagctcttga

SEQ ID NO: 630211 - DNA, 20 bp, Artificial
  CRISPR gRNA sequence
gcacatagtaagctcttgat

SEQ ID NO: 630212 - DNA, 20 bp, Artificial
  CRISPR gRNA sequence
ttgataaatgttttctgagt

SEQ ID NO: 630213 - DNA, 20 bp, Artificial
  CRISPR gRNA sequence
gataaatgttttctgagtaa

SEQ ID NO: 630214 - DNA, 20 bp, Artificial
  CRISPR gRNA sequence
ataaatgttttctgagtaaa

SEQ ID NO: 630215 - DNA, 20 bp, Artificial
  CRISPR gRNA sequence
tctgagtaaagtgaaaatgc

SEQ ID NO: 630216 - DNA, 20 bp, Artificial
  CRISPR gRNA sequence
ctgagtaaagtgaaaatgcc

SEQ ID NO: 630217 - DNA, 20 bp, Artificial
  CRISPR gRNA sequence
tgagtaaagtgaaaatgcct

SEQ ID NO: 630218 - DNA, 20 bp, Artificial
  CRISPR gRNA sequence
agtaaagtgaaaatgcctct

SEQ ID NO: 630219 - DNA, 20 bp, Artificial
  CRISPR gRNA sequence
ttttcctttaaaaaattcca

SEQ ID NO: 630220 - DNA, 20 bp, Artificial
  CRISPR gRNA sequence
ttcctttaaaaaattccata

SEQ ID NO: 630221 - DNA, 20 bp, Artificial
  CRISPR gRNA sequence
tcctttaaaaaattccatac

SEQ ID NO: 630222 - DNA, 20 bp, Artificial
  CRISPR gRNA sequence
cctttaaaaaattccatact

SEQ ID NO: 630223 - DNA, 20 bp, Artificial
  CRISPR gRNA sequence
ctttaaaaaattccatacta

SEQ ID NO: 630224 - DNA, 20 bp, Artificial
  CRISPR gRNA sequence
taaaaaattccatactagaa

SEQ ID NO: 630225 - DNA, 20 bp, Artificial
  CRISPR gRNA sequence
aaaaaattccatactagaag

SEQ ID NO: 630226 - DNA, 20 bp, Artificial
  CRISPR gRNA sequence
aaaaattccatactagaaga

SEQ ID NO: 630227 - DNA, 20 bp, Artificial
  CRISPR gRNA sequence
catactagaagaacaacaca

SEQ ID NO: 630228 - DNA, 20 bp, Artificial
  CRISPR gRNA sequence
gaagaacaacacagggaaaa

SEQ ID NO: 630229 - DNA, 20 bp, Artificial
  CRISPR gRNA sequence
tagaaaagaaagactaggaa

SEQ ID NO: 630230 - DNA, 20 bp, Artificial
  CRISPR gRNA sequence
agaaaagaaagactaggaaa

SEQ ID NO: 630231 - DNA, 20 bp, Artificial
  CRISPR gRNA sequence
gaaaagaaagactaggaaat

SEQ ID NO: 630232 - DNA, 20 bp, Artificial
  CRISPR gRNA sequence
ggaaatataactatgtcaga

SEQ ID NO: 630233 - DNA, 20 bp, Artificial
  CRISPR gRNA sequence
tgtcagatattttttaaaaa

SEQ ID NO: 630234 - DNA, 20 bp, Artificial
  CRISPR gRNA sequence
tttaaaaacaagtaatagtt

SEQ ID NO: 630235 - DNA, 20 bp, Artificial
  CRISPR gRNA sequence
ttaaaaacaagtaatagtta

SEQ ID NO: 630236 - DNA, 20 bp, Artificial
  CRISPR gRNA sequence
taaaaacaagtaatagttaa

SEQ ID NO: 630237 - DNA, 20 bp, Artificial
  CRISPR gRNA sequence
aaaaacaagtaatagttaaa

SEQ ID NO: 630238 - DNA, 20 bp, Artificial
  CRISPR gRNA sequence
aaaacaagtaatagttaaat

SEQ ID NO: 630239 - DNA, 20 bp, Artificial
  CRISPR gRNA sequence
aatcatttcatggagctaat

SEQ ID NO: 630240 - DNA, 20 bp, Artificial
  CRISPR gRNA sequence
catggagctaatggcaacca

SEQ ID NO: 630241 - DNA, 20 bp, Artificial
  CRISPR gRNA sequence
atggagctaatggcaaccaa

SEQ ID NO: 630242 - DNA, 20 bp, Artificial
  CRISPR gRNA sequence
atggcaaccaaaatgacagc

SEQ ID NO: 630243 - DNA, 20 bp, Artificial
  CRISPR gRNA sequence
tcatatctaccacaaaaaag

SEQ ID NO: 630244 - DNA, 20 bp, Artificial
  CRISPR gRNA sequence
atatctaccacaaaaaagga

SEQ ID NO: 630245 - DNA, 20 bp, Artificial
  CRISPR gRNA sequence
ccacaaaaaaggaaaacaaa

SEQ ID NO: 630246 - DNA, 20 bp, Artificial
  CRISPR gRNA sequence
catcatggttctgtttaaaa

SEQ ID NO: 630247 - DNA, 20 bp, Artificial
  CRISPR gRNA sequence
atcatggttctgtttaaaaa

SEQ ID NO: 630248 - DNA, 20 bp, Artificial
  CRISPR gRNA sequence
tgtttaaaaagagacatatg

SEQ ID NO: 630249 - DNA, 20 bp, Artificial
  CRISPR gRNA sequence
tttaaaaagagacatatgcc

SEQ ID NO: 630250 - DNA, 20 bp, Artificial
  CRISPR gRNA sequence
aaaaagagacatatgccaag

SEQ ID NO: 630251 - DNA, 20 bp, Artificial
  CRISPR gRNA sequence
aaaagagacatatgccaagc

SEQ ID NO: 630252 - DNA, 20 bp, Artificial
  CRISPR gRNA sequence
tttatatgagacgtatgtta

SEQ ID NO: 630253 - DNA, 20 bp, Artificial
  CRISPR gRNA sequence
atatgagacgtatgttaatg

SEQ ID NO: 630254 - DNA, 20 bp, Artificial
  CRISPR gRNA sequence
tatgagacgtatgttaatga

SEQ ID NO: 630255 - DNA, 20 bp, Artificial
  CRISPR gRNA sequence
atgatgaactctagcagcat

SEQ ID NO: 630256 - DNA, 20 bp, Artificial
  CRISPR gRNA sequence
tagcagcattttacagaacc

SEQ ID NO: 630257 - DNA, 20 bp, Artificial
  CRISPR gRNA sequence
gcagcattttacagaaccat

SEQ ID NO: 630258 - DNA, 20 bp, Artificial
  CRISPR gRNA sequence
tacagaaccatgtttttctc

SEQ ID NO: 630259 - DNA, 20 bp, Artificial
  CRISPR gRNA sequence
acagaaccatgtttttctct

SEQ ID NO: 630260 - DNA, 20 bp, Artificial
  CRISPR gRNA sequence
cagaaccatgtttttctctt

SEQ ID NO: 630261 - DNA, 20 bp, Artificial
  CRISPR gRNA sequence
ttctcttacagtatttatca

SEQ ID NO: 630262 - DNA, 20 bp, Artificial
  CRISPR gRNA sequence
tctcttacagtatttatcaa

SEQ ID NO: 630263 - DNA, 20 bp, Artificial
  CRISPR gRNA sequence
ctcttacagtatttatcaac

SEQ ID NO: 630264 - DNA, 20 bp, Artificial
  CRISPR gRNA sequence
tcttacagtatttatcaact

SEQ ID NO: 630265 - DNA, 20 bp, Artificial
  CRISPR gRNA sequence
ttacagtatttatcaactcc

SEQ ID NO: 630266 - DNA, 20 bp, Artificial
  CRISPR gRNA sequence
acagtatttatcaactccta

SEQ ID NO: 630267 - DNA, 20 bp, Artificial
  CRISPR gRNA sequence
cagtatttatcaactcctac

SEQ ID NO: 630268 - DNA, 20 bp, Artificial
  CRISPR gRNA sequence
atcaactcctacctcgtatg

SEQ ID NO: 630269 - DNA, 20 bp, Artificial
  CRISPR gRNA sequence
tcaactcctacctcgtatgg

SEQ ID NO: 630270 - DNA, 20 bp, Artificial
  CRISPR gRNA sequence
ctacctcgtatggccaattt

SEQ ID NO: 630271 - DNA, 20 bp, Artificial
  CRISPR gRNA sequence
cctcgtatggccaatttccc

SEQ ID NO: 630272 - DNA, 20 bp, Artificial
  CRISPR gRNA sequence
gtatggccaatttcccatta

SEQ ID NO: 630273 - DNA, 20 bp, Artificial
  CRISPR gRNA sequence
cccattaggcatgttaacaa

SEQ ID NO: 630274 - DNA, 20 bp, Artificial
  CRISPR gRNA sequence
ccattaggcatgttaacaac

SEQ ID NO: 630275 - DNA, 20 bp, Artificial
  CRISPR gRNA sequence
ggcatgttaacaacagatag

SEQ ID NO: 630276 - DNA, 20 bp, Artificial
  CRISPR gRNA sequence
acaacagatagaggagatta

SEQ ID NO: 630277 - DNA, 20 bp, Artificial
  CRISPR gRNA sequence
aggataatctcaaattattg

SEQ ID NO: 630278 - DNA, 20 bp, Artificial
  CRISPR gRNA sequence
aaattattgttataacaaac

SEQ ID NO: 630279 - DNA, 20 bp, Artificial
  CRISPR gRNA sequence
ttgttataacaaacccagaa

SEQ ID NO: 630280 - DNA, 20 bp, Artificial
  CRISPR gRNA sequence
ttataacaaacccagaaaaa

SEQ ID NO: 630281 - DNA, 20 bp, Artificial
  CRISPR gRNA sequence
taacaaacccagaaaaagta

SEQ ID NO: 630282 - DNA, 20 bp, Artificial
  CRISPR gRNA sequence
atgtggttaaaatgatatcc

SEQ ID NO: 630283 - DNA, 20 bp, Artificial
  CRISPR gRNA sequence
tgtggttaaaatgatatcca

SEQ ID NO: 630284 - DNA, 20 bp, Artificial
  CRISPR gRNA sequence
aaatgatatccagtatttaa

SEQ ID NO: 630285 - DNA, 20 bp, Artificial
  CRISPR gRNA sequence
aagaatatttgtttctataa

SEQ ID NO: 630286 - DNA, 20 bp, Artificial
  CRISPR gRNA sequence
agaatatttgtttctataaa

SEQ ID NO: 630287 - DNA, 20 bp, Artificial
  CRISPR gRNA sequence
gtttctataaatggtatcag

SEQ ID NO: 630288 - DNA, 20 bp, Artificial
  CRISPR gRNA sequence
tttctataaatggtatcaga

SEQ ID NO: 630289 - DNA, 20 bp, Artificial
  CRISPR gRNA sequence
ctataaatggtatcagaagc

SEQ ID NO: 630290 - DNA, 20 bp, Artificial
  CRISPR gRNA sequence
tataaatggtatcagaagct

SEQ ID NO: 630291 - DNA, 20 bp, Artificial
  CRISPR gRNA sequence
taaatggtatcagaagctac

SEQ ID NO: 630292 - DNA, 20 bp, Artificial
  CRISPR gRNA sequence
ccctcaatcccttctcctct

SEQ ID NO: 630293 - DNA, 20 bp, Artificial
  CRISPR gRNA sequence
aatcccttctcctctttggt

SEQ ID NO: 630294 - DNA, 20 bp, Artificial
  CRISPR gRNA sequence
ctcctctttggttttaccct

SEQ ID NO: 630295 - DNA, 20 bp, Artificial
  CRISPR gRNA sequence
tcctctttggttttaccctc

SEQ ID NO: 630296 - DNA, 20 bp, Artificial
  CRISPR gRNA sequence
ctctttggttttaccctctg

SEQ ID NO: 630297 - DNA, 20 bp, Artificial
  CRISPR gRNA sequence
tttggttttaccctctgctc

SEQ ID NO: 630298 - DNA, 20 bp, Artificial
  CRISPR gRNA sequence
tggttttaccctctgctcta

SEQ ID NO: 630299 - DNA, 20 bp, Artificial
  CRISPR gRNA sequence
ggttttaccctctgctctac

SEQ ID NO: 630300 - DNA, 20 bp, Artificial
  CRISPR gRNA sequence
gttttaccctctgctctacc

SEQ ID NO: 630301 - DNA, 20 bp, Artificial
  CRISPR gRNA sequence
taccctctgctctacctacc

SEQ ID NO: 630302 - DNA, 20 bp, Artificial
  CRISPR gRNA sequence
accctctgctctacctaccc

SEQ ID NO: 630303 - DNA, 20 bp, Artificial
  CRISPR gRNA sequence
ccctctgctctacctaccca

SEQ ID NO: 630304 - DNA, 20 bp, Artificial
  CRISPR gRNA sequence
tgctctacctacccagtgcc

SEQ ID NO: 630305 - DNA, 20 bp, Artificial
  CRISPR gRNA sequence
ctctacctacccagtgcccc

SEQ ID NO: 630306 - DNA, 20 bp, Artificial
  CRISPR gRNA sequence
tacctacccagtgcccctac

SEQ ID NO: 630307 - DNA, 20 bp, Artificial
  CRISPR gRNA sequence
cctacccagtgcccctaccc

SEQ ID NO: 630308 - DNA, 20 bp, Artificial
  CRISPR gRNA sequence
cccagtgcccctaccccttt

SEQ ID NO: 630309 - DNA, 20 bp, Artificial
  CRISPR gRNA sequence
cccctttcccactttccccc

SEQ ID NO: 630310 - DNA, 20 bp, Artificial
  CRISPR gRNA sequence
tcccactttcccccacttgg

SEQ ID NO: 630311 - DNA, 20 bp, Artificial
  CRISPR gRNA sequence
cccactttcccccacttggt

SEQ ID NO: 630312 - DNA, 20 bp, Artificial
  CRISPR gRNA sequence
ccactttcccccacttggtt

SEQ ID NO: 630313 - DNA, 20 bp, Artificial
  CRISPR gRNA sequence
tcccccacttggttccagct

SEQ ID NO: 630314 - DNA, 20 bp, Artificial
  CRISPR gRNA sequence
cccccacttggttccagctt

SEQ ID NO: 630315 - DNA, 20 bp, Artificial
  CRISPR gRNA sequence
ccccacttggttccagcttc

SEQ ID NO: 630316 - DNA, 20 bp, Artificial
  CRISPR gRNA sequence
ggttccagcttcagcaccac

SEQ ID NO: 630317 - DNA, 20 bp, Artificial
  CRISPR gRNA sequence
gttccagcttcagcaccacc

SEQ ID NO: 630318 - DNA, 20 bp, Artificial
  CRISPR gRNA sequence
cagcttcagcaccacctgta

SEQ ID NO: 630319 - DNA, 20 bp, Artificial
  CRISPR gRNA sequence
cagcaccacctgtaaagggc

SEQ ID NO: 630320 - DNA, 20 bp, Artificial
  CRISPR gRNA sequence
agcaccacctgtaaagggcc

SEQ ID NO: 630321 - DNA, 20 bp, Artificial
  CRISPR gRNA sequence
taaagggcctgtgcctacgg

SEQ ID NO: 630322 - DNA, 20 bp, Artificial
  CRISPR gRNA sequence
tgcctacggagggctaagca

SEQ ID NO: 630323 - DNA, 20 bp, Artificial
  CRISPR gRNA sequence
cggagggctaagcaatctgg

SEQ ID NO: 630324 - DNA, 20 bp, Artificial
  CRISPR gRNA sequence
agcaatctggggaatagggg

SEQ ID NO: 630325 - DNA, 20 bp, Artificial
  CRISPR gRNA sequence
gggaatagggggtaagactg

SEQ ID NO: 630326 - DNA, 20 bp, Artificial
  CRISPR gRNA sequence
aggccccagttgtttagggg

SEQ ID NO: 630327 - DNA, 20 bp, Artificial
  CRISPR gRNA sequence
tttaggggacatatctttgc

SEQ ID NO: 630328 - DNA, 20 bp, Artificial
  CRISPR gRNA sequence
aggggacatatctttgcttc

SEQ ID NO: 630329 - DNA, 20 bp, Artificial
  CRISPR gRNA sequence
ggggacatatctttgcttct

SEQ ID NO: 630330 - DNA, 20 bp, Artificial
  CRISPR gRNA sequence
tgcttctctcaaaatatact

SEQ ID NO: 630331 - DNA, 20 bp, Artificial
  CRISPR gRNA sequence
gcttctctcaaaatatactt

SEQ ID NO: 630332 - DNA, 20 bp, Artificial
  CRISPR gRNA sequence
cttctctcaaaatatacttg

SEQ ID NO: 630333 - DNA, 20 bp, Artificial
  CRISPR gRNA sequence
ctctcaaaatatacttgttt

SEQ ID NO: 630334 - DNA, 20 bp, Artificial
  CRISPR gRNA sequence
tctcaaaatatacttgttta

SEQ ID NO: 630335 - DNA, 20 bp, Artificial
  CRISPR gRNA sequence
tcaaaatatacttgtttaaa

SEQ ID NO: 630336 - DNA, 20 bp, Artificial
  CRISPR gRNA sequence
aaaatatacttgtttaaatt

SEQ ID NO: 630337 - DNA, 20 bp, Artificial
  CRISPR gRNA sequence
gtttaaatttttcgttagca

SEQ ID NO: 630338 - DNA, 20 bp, Artificial
  CRISPR gRNA sequence
tttaaatttttcgttagcat

SEQ ID NO: 630339 - DNA, 20 bp, Artificial
  CRISPR gRNA sequence
aaatttttcgttagcatttg

SEQ ID NO: 630340 - DNA, 20 bp, Artificial
  CRISPR gRNA sequence
aatttttcgttagcatttga

SEQ ID NO: 630341 - DNA, 20 bp, Artificial
  CRISPR gRNA sequence
ttcgttagcatttgattctc

SEQ ID NO: 630342 - DNA, 20 bp, Artificial
  CRISPR gRNA sequence
tcgttagcatttgattctct

SEQ ID NO: 630343 - DNA, 20 bp, Artificial
  CRISPR gRNA sequence
cgttagcatttgattctcta

SEQ ID NO: 630344 - DNA, 20 bp, Artificial
  CRISPR gRNA sequence
gttagcatttgattctctaa

SEQ ID NO: 630345 - DNA, 20 bp, Artificial
  CRISPR gRNA sequence
gcatttgattctctaaaagt

SEQ ID NO: 630346 - DNA, 20 bp, Artificial
  CRISPR gRNA sequence
gattctctaaaagttcaatc

SEQ ID NO: 630347 - DNA, 20 bp, Artificial
  CRISPR gRNA sequence
attctctaaaagttcaatct

SEQ ID NO: 630348 - DNA, 20 bp, Artificial
  CRISPR gRNA sequence
tctaaaagttcaatctgcca

SEQ ID NO: 630349 - DNA, 20 bp, Artificial
  CRISPR gRNA sequence
taaaagttcaatctgccaac

SEQ ID NO: 630350 - DNA, 20 bp, Artificial
  CRISPR gRNA sequence
aaagttcaatctgccaacag

SEQ ID NO: 630351 - DNA, 20 bp, Artificial
  CRISPR gRNA sequence
aatctgccaacagataattc

SEQ ID NO: 630352 - DNA, 20 bp, Artificial
  CRISPR gRNA sequence
ccaacagataattcaatgtt

SEQ ID NO: 630353 - DNA, 20 bp, Artificial
  CRISPR gRNA sequence
aatgttgattataataattt

SEQ ID NO: 630354 - DNA, 20 bp, Artificial
  CRISPR gRNA sequence
attataataatttatttaca

SEQ ID NO: 630355 - DNA, 20 bp, Artificial
  CRISPR gRNA sequence
taataatttatttacatttt

SEQ ID NO: 630356 - DNA, 20 bp, Artificial
  CRISPR gRNA sequence
atttacattttacctcccta

SEQ ID NO: 630357 - DNA, 20 bp, Artificial
  CRISPR gRNA sequence
tttacattttacctccctat

SEQ ID NO: 630358 - DNA, 20 bp, Artificial
  CRISPR gRNA sequence
acattttacctccctattac

SEQ ID NO: 630359 - DNA, 20 bp, Artificial
  CRISPR gRNA sequence
cattttacctccctattacc

SEQ ID NO: 630360 - DNA, 20 bp, Artificial
  CRISPR gRNA sequence
tacctccctattaccatata

SEQ ID NO: 630361 - DNA, 20 bp, Artificial
  CRISPR gRNA sequence
acctccctattaccatatag

SEQ ID NO: 630362 - DNA, 20 bp, Artificial
  CRISPR gRNA sequence
cctccctattaccatatagt

SEQ ID NO: 630363 - DNA, 20 bp, Artificial
  CRISPR gRNA sequence
cctattaccatatagtcttt

SEQ ID NO: 630364 - DNA, 20 bp, Artificial
  CRISPR gRNA sequence
ttaccatatagtcttttagg

SEQ ID NO: 630365 - DNA, 20 bp, Artificial
  CRISPR gRNA sequence
ccatatagtcttttaggagt

SEQ ID NO: 630366 - DNA, 20 bp, Artificial
  CRISPR gRNA sequence
ttaggagtatgtatgcaata

SEQ ID NO: 630367 - DNA, 20 bp, Artificial
  CRISPR gRNA sequence
taggagtatgtatgcaatac

SEQ ID NO: 630368 - DNA, 20 bp, Artificial
  CRISPR gRNA sequence
aggagtatgtatgcaataca

SEQ ID NO: 630369 - DNA, 20 bp, Artificial
  CRISPR gRNA sequence
ggagtatgtatgcaatacag

SEQ ID NO: 630370 - DNA, 20 bp, Artificial
  CRISPR gRNA sequence
cataaataactaggaatgca

SEQ ID NO: 630371 - DNA, 20 bp, Artificial
  CRISPR gRNA sequence
ggaatgcaaaaataataaat

SEQ ID NO: 630372 - DNA, 20 bp, Artificial
  CRISPR gRNA sequence
gaaatgcataacgccatcaa

SEQ ID NO: 630373 - DNA, 20 bp, Artificial
  CRISPR gRNA sequence
caatgggagaatataatata

SEQ ID NO: 630374 - DNA, 20 bp, Artificial
  CRISPR gRNA sequence
gtagcaatgccataaggtgt

SEQ ID NO: 630375 - DNA, 20 bp, Artificial
  CRISPR gRNA sequence
tggggaagatttggtattcc

SEQ ID NO: 630376 - DNA, 20 bp, Artificial
  CRISPR gRNA sequence
ggggaagatttggtattccc

SEQ ID NO: 630377 - DNA, 20 bp, Artificial
  CRISPR gRNA sequence
gggaagatttggtattcccc

SEQ ID NO: 630378 - DNA, 20 bp, Artificial
  CRISPR gRNA sequence
ggtattcccccaagcttcca

SEQ ID NO: 630379 - DNA, 20 bp, Artificial
  CRISPR gRNA sequence
gtattcccccaagcttccat

SEQ ID NO: 630380 - DNA, 20 bp, Artificial
  CRISPR gRNA sequence
ccccaagcttccatcagctt

SEQ ID NO: 630381 - DNA, 20 bp, Artificial
  CRISPR gRNA sequence
ccatcagcttccagcctcaa

SEQ ID NO: 630382 - DNA, 20 bp, Artificial
  CRISPR gRNA sequence
catcagcttccagcctcaat

SEQ ID NO: 630383 - DNA, 20 bp, Artificial
  CRISPR gRNA sequence
ccagcctcaatttaccctta

SEQ ID NO: 630384 - DNA, 20 bp, Artificial
  CRISPR gRNA sequence
cagcctcaatttacccttaa

SEQ ID NO: 630385 - DNA, 20 bp, Artificial
  CRISPR gRNA sequence
aatttacccttaaatccatc

SEQ ID NO: 630386 - DNA, 20 bp, Artificial
  CRISPR gRNA sequence
acccttaaatccatcaattt

SEQ ID NO: 630387 - DNA, 20 bp, Artificial
  CRISPR gRNA sequence
cccttaaatccatcaattta

SEQ ID NO: 630388 - DNA, 20 bp, Artificial
  CRISPR gRNA sequence
aaatccatcaatttaaatag

SEQ ID NO: 630389 - DNA, 20 bp, Artificial
  CRISPR gRNA sequence
aatccatcaatttaaatagt

SEQ ID NO: 630390 - DNA, 20 bp, Artificial
  CRISPR gRNA sequence
aaatagtaacagtgtatttg

SEQ ID NO: 630391 - DNA, 20 bp, Artificial
  CRISPR gRNA sequence
aatagtaacagtgtatttgg

SEQ ID NO: 630392 - DNA, 20 bp, Artificial
  CRISPR gRNA sequence
ggtcagcaaatgaaacttct

SEQ ID NO: 630393 - DNA, 20 bp, Artificial
  CRISPR gRNA sequence
gtcagcaaatgaaacttcta

SEQ ID NO: 630394 - DNA, 20 bp, Artificial
  CRISPR gRNA sequence
ctaatgcttaagttactgct

SEQ ID NO: 630395 - DNA, 20 bp, Artificial
  CRISPR gRNA sequence
taatgcttaagttactgctg

SEQ ID NO: 630396 - DNA, 20 bp, Artificial
  CRISPR gRNA sequence
atgcttaagttactgctggt

SEQ ID NO: 630397 - DNA, 20 bp, Artificial
  CRISPR gRNA sequence
aagttactgctggtaaataa

SEQ ID NO: 630398 - DNA, 20 bp, Artificial
  CRISPR gRNA sequence
agttactgctggtaaataac

SEQ ID NO: 630399 - DNA, 20 bp, Artificial
  CRISPR gRNA sequence
ctgctggtaaataacaaatt

SEQ ID NO: 630400 - DNA, 20 bp, Artificial
  CRISPR gRNA sequence
ctggtaaataacaaatttat

SEQ ID NO: 630401 - DNA, 20 bp, Artificial
  CRISPR gRNA sequence
gtaaataacaaatttatagg

SEQ ID NO: 630402 - DNA, 20 bp, Artificial
  CRISPR gRNA sequence
atagggaatagcacatttac

SEQ ID NO: 630403 - DNA, 20 bp, Artificial
  CRISPR gRNA sequence
tagggaatagcacatttact

SEQ ID NO: 630404 - DNA, 20 bp, Artificial
  CRISPR gRNA sequence
actgttattcagttatttaa

SEQ ID NO: 630405 - DNA, 20 bp, Artificial
  CRISPR gRNA sequence
ctgttattcagttatttaat

SEQ ID NO: 630406 - DNA, 20 bp, Artificial
  CRISPR gRNA sequence
ttattcagttatttaatgtt

SEQ ID NO: 630407 - DNA, 20 bp, Artificial
  CRISPR gRNA sequence
ttcagttatttaatgttctc

SEQ ID NO: 630408 - DNA, 20 bp, Artificial
  CRISPR gRNA sequence
agttatttaatgttctcaaa

SEQ ID NO: 630409 - DNA, 20 bp, Artificial
  CRISPR gRNA sequence
tttaatgttctcaaatgtta

SEQ ID NO: 630410 - DNA, 20 bp, Artificial
  CRISPR gRNA sequence
aatgttctcaaatgttaaca

SEQ ID NO: 630411 - DNA, 20 bp, Artificial
  CRISPR gRNA sequence
atgttctcaaatgttaacag

SEQ ID NO: 630412 - DNA, 20 bp, Artificial
  CRISPR gRNA sequence
tcaaatgttaacagtaaagc

SEQ ID NO: 630413 - DNA, 20 bp, Artificial
  CRISPR gRNA sequence
aaatgttaacagtaaagcaa

SEQ ID NO: 630414 - DNA, 20 bp, Artificial
  CRISPR gRNA sequence
acagtaaagcaaaccattta

SEQ ID NO: 630415 - DNA, 20 bp, Artificial
  CRISPR gRNA sequence
attgggcatttattacatat

SEQ ID NO: 630416 - DNA, 20 bp, Artificial
  CRISPR gRNA sequence
ttgggcatttattacatatc

SEQ ID NO: 630417 - DNA, 20 bp, Artificial
  CRISPR gRNA sequence
ggcatttattacatatccag

SEQ ID NO: 630418 - DNA, 20 bp, Artificial
  CRISPR gRNA sequence
attacatatccagtcacatt

SEQ ID NO: 630419 - DNA, 20 bp, Artificial
  CRISPR gRNA sequence
ttacatatccagtcacattt

SEQ ID NO: 630420 - DNA, 20 bp, Artificial
  CRISPR gRNA sequence
catatccagtcacatttaat

SEQ ID NO: 630421 - DNA, 20 bp, Artificial
  CRISPR gRNA sequence
aatcctcaaacccagcctat

SEQ ID NO: 630422 - DNA, 20 bp, Artificial
  CRISPR gRNA sequence
atcctcaaacccagcctatg

SEQ ID NO: 630423 - DNA, 20 bp, Artificial
  CRISPR gRNA sequence
aaacccagcctatgagtgac

SEQ ID NO: 630424 - DNA, 20 bp, Artificial
  CRISPR gRNA sequence
tgagtgacacacccagacac

SEQ ID NO: 630425 - DNA, 20 bp, Artificial
  CRISPR gRNA sequence
ggcagactccgagacgcacc

SEQ ID NO: 630426 - DNA, 20 bp, Artificial
  CRISPR gRNA sequence
gcagactccgagacgcacca

SEQ ID NO: 630427 - DNA, 20 bp, Artificial
  CRISPR gRNA sequence
cgagacgcaccattttgtaa

SEQ ID NO: 630428 - DNA, 20 bp, Artificial
  CRISPR gRNA sequence
tgtaatctctatgttccaga

SEQ ID NO: 630429 - DNA, 20 bp, Artificial
  CRISPR gRNA sequence
gtaatctctatgttccagat

SEQ ID NO: 630430 - DNA, 20 bp, Artificial
  CRISPR gRNA sequence
taatctctatgttccagatc

SEQ ID NO: 630431 - DNA, 20 bp, Artificial
  CRISPR gRNA sequence
tatgttccagatcctatgct

SEQ ID NO: 630432 - DNA, 20 bp, Artificial
  CRISPR gRNA sequence
tgttccagatcctatgctat

SEQ ID NO: 630433 - DNA, 20 bp, Artificial
  CRISPR gRNA sequence
cagatcctatgctatcatca

SEQ ID NO: 630434 - DNA, 20 bp, Artificial
  CRISPR gRNA sequence
tgctatcatcatcagcccag

SEQ ID NO: 630435 - DNA, 20 bp, Artificial
  CRISPR gRNA sequence
tcatcatcagcccaggtaat

SEQ ID NO: 630436 - DNA, 20 bp, Artificial
  CRISPR gRNA sequence
gaaatatcaaatttaccaag

SEQ ID NO: 630437 - DNA, 20 bp, Artificial
  CRISPR gRNA sequence
aaatatcaaatttaccaaga

SEQ ID NO: 630438 - DNA, 20 bp, Artificial
  CRISPR gRNA sequence
accaagacttgatacacaga

SEQ ID NO: 630439 - DNA, 20 bp, Artificial
  CRISPR gRNA sequence
ccaagacttgatacacagat

SEQ ID NO: 630440 - DNA, 20 bp, Artificial
  CRISPR gRNA sequence
gatacacagataggtttgta

SEQ ID NO: 630441 - DNA, 20 bp, Artificial
  CRISPR gRNA sequence
atacacagataggtttgtaa

SEQ ID NO: 630442 - DNA, 20 bp, Artificial
  CRISPR gRNA sequence
gtaaaaaatgttaatgatga

SEQ ID NO: 630443 - DNA, 20 bp, Artificial
  CRISPR gRNA sequence
taaaaaatgttaatgatgat

SEQ ID NO: 630444 - DNA, 20 bp, Artificial
  CRISPR gRNA sequence
atgatgataatataaaaata

SEQ ID NO: 630445 - DNA, 20 bp, Artificial
  CRISPR gRNA sequence
gatcacaaatcaatagaatt

SEQ ID NO: 630446 - DNA, 20 bp, Artificial
  CRISPR gRNA sequence
atcacaaatcaatagaatta

SEQ ID NO: 630447 - DNA, 20 bp, Artificial
  CRISPR gRNA sequence
gattctttagattatagaaa

SEQ ID NO: 630448 - DNA, 20 bp, Artificial
  CRISPR gRNA sequence
tttagattatagaaactaga

SEQ ID NO: 630449 - DNA, 20 bp, Artificial
  CRISPR gRNA sequence
tagattatagaaactagaag

SEQ ID NO: 630450 - DNA, 20 bp, Artificial
  CRISPR gRNA sequence
agattatagaaactagaagg

SEQ ID NO: 630451 - DNA, 20 bp, Artificial
  CRISPR gRNA sequence
gattatagaaactagaagga

SEQ ID NO: 630452 - DNA, 20 bp, Artificial
  CRISPR gRNA sequence
tagaaactagaaggaaatgc

SEQ ID NO: 630453 - DNA, 20 bp, Artificial
  CRISPR gRNA sequence
gaaggaaatgcttcagttgt

SEQ ID NO: 630454 - DNA, 20 bp, Artificial
  CRISPR gRNA sequence
cagttgttcaggataacaag

SEQ ID NO: 630455 - DNA, 20 bp, Artificial
  CRISPR gRNA sequence
agttgttcaggataacaaga

SEQ ID NO: 630456 - DNA, 20 bp, Artificial
  CRISPR gRNA sequence
ttcaggataacaagaaaatt

SEQ ID NO: 630457 - DNA, 20 bp, Artificial
  CRISPR gRNA sequence
aggataacaagaaaatttta

SEQ ID NO: 630458 - DNA, 20 bp, Artificial
  CRISPR gRNA sequence
taaattaaaaaaattcccaa

SEQ ID NO: 630459 - DNA, 20 bp, Artificial
  CRISPR gRNA sequence
aaattaaaaaaattcccaac

SEQ ID NO: 630460 - DNA, 20 bp, Artificial
  CRISPR gRNA sequence
aattaaaaaaattcccaact

SEQ ID NO: 630461 - DNA, 20 bp, Artificial
  CRISPR gRNA sequence
aaaaaattcccaactcaaca

SEQ ID NO: 630462 - DNA, 20 bp, Artificial
  CRISPR gRNA sequence
ccaactcaacaacacataat

SEQ ID NO: 630463 - DNA, 20 bp, Artificial
  CRISPR gRNA sequence
aacaacacataatcactagc

SEQ ID NO: 630464 - DNA, 20 bp, Artificial
  CRISPR gRNA sequence
gctgtccaacaaacacagtt

SEQ ID NO: 630465 - DNA, 20 bp, Artificial
  CRISPR gRNA sequence
tccaacaaacacagttccat

SEQ ID NO: 630466 - DNA, 20 bp, Artificial
  CRISPR gRNA sequence
catagtatatactctataaa

SEQ ID NO: 630467 - DNA, 20 bp, Artificial
  CRISPR gRNA sequence
tataaaacaaacagaaaacc

SEQ ID NO: 630468 - DNA, 20 bp, Artificial
  CRISPR gRNA sequence
taaaacaaacagaaaacccc

SEQ ID NO: 630469 - DNA, 20 bp, Artificial
  CRISPR gRNA sequence
gacctggctatgtataagcc

SEQ ID NO: 630470 - DNA, 20 bp, Artificial
  CRISPR gRNA sequence
acctggctatgtataagcca

SEQ ID NO: 630471 - DNA, 20 bp, Artificial
  CRISPR gRNA sequence
gctatgtataagccaataca

SEQ ID NO: 630472 - DNA, 20 bp, Artificial
  CRISPR gRNA sequence
tgtataagccaatacataga

SEQ ID NO: 630473 - DNA, 20 bp, Artificial
  CRISPR gRNA sequence
atattttaaaagtgactgtc

SEQ ID NO: 630474 - DNA, 20 bp, Artificial
  CRISPR gRNA sequence
tattttaaaagtgactgtcg

SEQ ID NO: 630475 - DNA, 20 bp, Artificial
  CRISPR gRNA sequence
taaaagtgactgtcgcaatc

SEQ ID NO: 630476 - DNA, 20 bp, Artificial
  CRISPR gRNA sequence
aaaagtgactgtcgcaatcc

SEQ ID NO: 630477 - DNA, 20 bp, Artificial
  CRISPR gRNA sequence
aaagtgactgtcgcaatccc

SEQ ID NO: 630478 - DNA, 20 bp, Artificial
  CRISPR gRNA sequence
tcgcaatccccaactatacc

SEQ ID NO: 630479 - DNA, 20 bp, Artificial
  CRISPR gRNA sequence
taccatttaatactgggcaa

SEQ ID NO: 630480 - DNA, 20 bp, Artificial
  CRISPR gRNA sequence
aatactgggcaaaccttttt

SEQ ID NO: 630481 - DNA, 20 bp, Artificial
  CRISPR gRNA sequence
atactgggcaaacctttttt

SEQ ID NO: 630482 - DNA, 20 bp, Artificial
  CRISPR gRNA sequence
ggcaaaccttttttaaataa

SEQ ID NO: 630483 - DNA, 20 bp, Artificial
  CRISPR gRNA sequence
ttttaaataaaagatataca

SEQ ID NO: 630484 - DNA, 20 bp, Artificial
  CRISPR gRNA sequence
tttaaataaaagatatacaa

SEQ ID NO: 630485 - DNA, 20 bp, Artificial
  CRISPR gRNA sequence
ttaaataaaagatatacaag

SEQ ID NO: 630486 - DNA, 20 bp, Artificial
  CRISPR gRNA sequence
taaataaaagatatacaagt

SEQ ID NO: 630487 - DNA, 20 bp, Artificial
  CRISPR gRNA sequence
aaataaaagatatacaagtg

SEQ ID NO: 630488 - DNA, 20 bp, Artificial
  CRISPR gRNA sequence
aataaaagatatacaagtgg

SEQ ID NO: 630489 - DNA, 20 bp, Artificial
  CRISPR gRNA sequence
acacctgtaatcccagaact

SEQ ID NO: 630490 - DNA, 20 bp, Artificial
  CRISPR gRNA sequence
taatcccagaactttgggaa

SEQ ID NO: 630491 - DNA, 20 bp, Artificial
  CRISPR gRNA sequence
tgggaaggcaaggcgggcag

SEQ ID NO: 630492 - DNA, 20 bp, Artificial
  CRISPR gRNA sequence
gggaaggcaaggcgggcagc

SEQ ID NO: 630493 - DNA, 20 bp, Artificial
  CRISPR gRNA sequence
ggaaggcaaggcgggcagct

SEQ ID NO: 630494 - DNA, 20 bp, Artificial
  CRISPR gRNA sequence
acctgaggtcaggagtttga

SEQ ID NO: 630495 - DNA, 20 bp, Artificial
  CRISPR gRNA sequence
aggtcaggagtttgagacca

SEQ ID NO: 630496 - DNA, 20 bp, Artificial
  CRISPR gRNA sequence
gagaccagcctggccaacat

SEQ ID NO: 630497 - DNA, 20 bp, Artificial
  CRISPR gRNA sequence
agaccagcctggccaacatg

SEQ ID NO: 630498 - DNA, 20 bp, Artificial
  CRISPR gRNA sequence
gccaacatggcgaaaccccg

SEQ ID NO: 630499 - DNA, 20 bp, Artificial
  CRISPR gRNA sequence
tactaaaaatacaaaaacta

SEQ ID NO: 630500 - DNA, 20 bp, Artificial
  CRISPR gRNA sequence
ctaaaaatacaaaaactagc

SEQ ID NO: 630501 - DNA, 20 bp, Artificial
  CRISPR gRNA sequence
aaaatacaaaaactagccag

SEQ ID NO: 630502 - DNA, 20 bp, Artificial
  CRISPR gRNA sequence
gccaggcctggtggtacatg

SEQ ID NO: 630503 - DNA, 20 bp, Artificial
  CRISPR gRNA sequence
gtggtacatgcctgtaatcc

SEQ ID NO: 630504 - DNA, 20 bp, Artificial
  CRISPR gRNA sequence
taatcccagttacttggcag

SEQ ID NO: 630505 - DNA, 20 bp, Artificial
  CRISPR gRNA sequence
cttggcaggctgaagcagga

SEQ ID NO: 630506 - DNA, 20 bp, Artificial
  CRISPR gRNA sequence
ggcaggctgaagcaggagaa

SEQ ID NO: 630507 - DNA, 20 bp, Artificial
  CRISPR gRNA sequence
gcaggctgaagcaggagaat

SEQ ID NO: 630508 - DNA, 20 bp, Artificial
  CRISPR gRNA sequence
aagcaggagaatcgcttgaa

SEQ ID NO: 630509 - DNA, 20 bp, Artificial
  CRISPR gRNA sequence
gaaccggggaggcagaggtt

SEQ ID NO: 630510 - DNA, 20 bp, Artificial
  CRISPR gRNA sequence
aaccggggaggcagaggttg

SEQ ID NO: 630511 - DNA, 20 bp, Artificial
  CRISPR gRNA sequence
tggtgagctgagatcgtgcc

SEQ ID NO: 630512 - DNA, 20 bp, Artificial
  CRISPR gRNA sequence
agatcgtgccactgcactcc

SEQ ID NO: 630513 - DNA, 20 bp, Artificial
  CRISPR gRNA sequence
cactccagcctgggtggcaa

SEQ ID NO: 630514 - DNA, 20 bp, Artificial
  CRISPR gRNA sequence
cagcctgggtggcaaagtga

SEQ ID NO: 630515 - DNA, 20 bp, Artificial
  CRISPR gRNA sequence
ggtggcaaagtgagagtcca

SEQ ID NO: 630516 - DNA, 20 bp, Artificial
  CRISPR gRNA sequence
aaaaaaaataaaataaaata

SEQ ID NO: 630517 - DNA, 20 bp, Artificial
  CRISPR gRNA sequence
aaaaaaataaataaaagata

SEQ ID NO: 630518 - DNA, 20 bp, Artificial
  CRISPR gRNA sequence
aaaaaataaataaaagatat

SEQ ID NO: 630519 - DNA, 20 bp, Artificial
  CRISPR gRNA sequence
ataagttgagatttttgtct

SEQ ID NO: 630520 - DNA, 20 bp, Artificial
  CRISPR gRNA sequence
agatttttgtctttgtataa

SEQ ID NO: 630521 - DNA, 20 bp, Artificial
  CRISPR gRNA sequence
ttgtctttgtataaataaaa

SEQ ID NO: 630522 - DNA, 20 bp, Artificial
  CRISPR gRNA sequence
tgtctttgtataaataaaac

SEQ ID NO: 630523 - DNA, 20 bp, Artificial
  CRISPR gRNA sequence
gtctttgtataaataaaact

SEQ ID NO: 630524 - DNA, 20 bp, Artificial
  CRISPR gRNA sequence
tctttgtataaataaaactt

SEQ ID NO: 630525 - DNA, 20 bp, Artificial
  CRISPR gRNA sequence
tgtataaataaaacttatca

SEQ ID NO: 630526 - DNA, 20 bp, Artificial
  CRISPR gRNA sequence
gtataaataaaacttatcag

SEQ ID NO: 630527 - DNA, 20 bp, Artificial
  CRISPR gRNA sequence
tataaataaaacttatcagt

SEQ ID NO: 630528 - DNA, 20 bp, Artificial
  CRISPR gRNA sequence
atcagtagacaaatctaatt

SEQ ID NO: 630529 - DNA, 20 bp, Artificial
  CRISPR gRNA sequence
tcagtagacaaatctaatta

SEQ ID NO: 630530 - DNA, 20 bp, Artificial
  CRISPR gRNA sequence
attagtaagacaagatagac

SEQ ID NO: 630531 - DNA, 20 bp, Artificial
  CRISPR gRNA sequence
gtaagacaagatagacatta

SEQ ID NO: 630532 - DNA, 20 bp, Artificial
  CRISPR gRNA sequence
caaatcttaagaactgaaat

SEQ ID NO: 630533 - DNA, 20 bp, Artificial
  CRISPR gRNA sequence
aagaactgaaattcattatt

SEQ ID NO: 630534 - DNA, 20 bp, Artificial
  CRISPR gRNA sequence
agaactgaaattcattattt

SEQ ID NO: 630535 - DNA, 20 bp, Artificial
  CRISPR gRNA sequence
aaattcattattttcctata

SEQ ID NO: 630536 - DNA, 20 bp, Artificial
  CRISPR gRNA sequence
attattttcctatataaggc

SEQ ID NO: 630537 - DNA, 20 bp, Artificial
  CRISPR gRNA sequence
ttttcctatataaggctgat

SEQ ID NO: 630538 - DNA, 20 bp, Artificial
  CRISPR gRNA sequence
tcctatataaggctgattat

SEQ ID NO: 630539 - DNA, 20 bp, Artificial
  CRISPR gRNA sequence
cctatataaggctgattatt

SEQ ID NO: 630540 - DNA, 20 bp, Artificial
  CRISPR gRNA sequence
ctatataaggctgattatta

SEQ ID NO: 630541 - DNA, 20 bp, Artificial
  CRISPR gRNA sequence
tataaggctgattattaaaa

SEQ ID NO: 630542 - DNA, 20 bp, Artificial
  CRISPR gRNA sequence
attattaaaattaacttttc

SEQ ID NO: 630543 - DNA, 20 bp, Artificial
  CRISPR gRNA sequence
ttaaaattaacttttcagga

SEQ ID NO: 630544 - DNA, 20 bp, Artificial
  CRISPR gRNA sequence
aaattaacttttcaggaaca

SEQ ID NO: 630545 - DNA, 20 bp, Artificial
  CRISPR gRNA sequence
acttttcaggaacagagaat

SEQ ID NO: 630546 - DNA, 20 bp, Artificial
  CRISPR gRNA sequence
ttcaggaacagagaattatt

SEQ ID NO: 630547 - DNA, 20 bp, Artificial
  CRISPR gRNA sequence
tcaggaacagagaattattc

SEQ ID NO: 630548 - DNA, 20 bp, Artificial
  CRISPR gRNA sequence
caggaacagagaattattca

SEQ ID NO: 630549 - DNA, 20 bp, Artificial
  CRISPR gRNA sequence
aggaacagagaattattcat

SEQ ID NO: 630550 - DNA, 20 bp, Artificial
  CRISPR gRNA sequence
ttcattgataaaccttaggg

SEQ ID NO: 630551 - DNA, 20 bp, Artificial
  CRISPR gRNA sequence
attgataaaccttagggatt

SEQ ID NO: 630552 - DNA, 20 bp, Artificial
  CRISPR gRNA sequence
ataaaccttagggattgcct

SEQ ID NO: 630553 - DNA, 20 bp, Artificial
  CRISPR gRNA sequence
agggattgccttcctacctg

SEQ ID NO: 630554 - DNA, 20 bp, Artificial
  CRISPR gRNA sequence
gggattgccttcctacctgc

SEQ ID NO: 630555 - DNA, 20 bp, Artificial
  CRISPR gRNA sequence
ccttcctacctgccgtagtg

SEQ ID NO: 630556 - DNA, 20 bp, Artificial
  CRISPR gRNA sequence
cctacctgccgtagtgtatt

SEQ ID NO: 630557 - DNA, 20 bp, Artificial
  CRISPR gRNA sequence
ctacctgccgtagtgtattt

SEQ ID NO: 630558 - DNA, 20 bp, Artificial
  CRISPR gRNA sequence
cctgccgtagtgtatttaga

SEQ ID NO: 630559 - DNA, 20 bp, Artificial
  CRISPR gRNA sequence
ccgtagtgtatttagagatc

SEQ ID NO: 630560 - DNA, 20 bp, Artificial
  CRISPR gRNA sequence
agagatcaggatgttttgct

SEQ ID NO: 630561 - DNA, 20 bp, Artificial
  CRISPR gRNA sequence
gagatcaggatgttttgctt

SEQ ID NO: 630562 - DNA, 20 bp, Artificial
  CRISPR gRNA sequence
tgcttggagaatgttttttg

SEQ ID NO: 630563 - DNA, 20 bp, Artificial
  CRISPR gRNA sequence
gcttggagaatgttttttgt

SEQ ID NO: 630564 - DNA, 20 bp, Artificial
  CRISPR gRNA sequence
cttggagaatgttttttgtg

SEQ ID NO: 630565 - DNA, 20 bp, Artificial
  CRISPR gRNA sequence
ggagaatgttttttgtggag

SEQ ID NO: 630566 - DNA, 20 bp, Artificial
  CRISPR gRNA sequence
gagaatgttttttgtggaga

SEQ ID NO: 630567 - DNA, 20 bp, Artificial
  CRISPR gRNA sequence
tttgtggagagagatggtgt

SEQ ID NO: 630568 - DNA, 20 bp, Artificial
  CRISPR gRNA sequence
ttgtggagagagatggtgtc

SEQ ID NO: 630569 - DNA, 20 bp, Artificial
  CRISPR gRNA sequence
tgtggagagagatggtgtct

SEQ ID NO: 630570 - DNA, 20 bp, Artificial
  CRISPR gRNA sequence
gtggagagagatggtgtcta

SEQ ID NO: 630571 - DNA, 20 bp, Artificial
  CRISPR gRNA sequence
tggagagagatggtgtctaa

SEQ ID NO: 630572 - DNA, 20 bp, Artificial
  CRISPR gRNA sequence
atgttggtctagattgtttt

SEQ ID NO: 630573 - DNA, 20 bp, Artificial
  CRISPR gRNA sequence
gtctagattgttttgcacat

SEQ ID NO: 630574 - DNA, 20 bp, Artificial
  CRISPR gRNA sequence
gattgttttgcacattgtag

SEQ ID NO: 630575 - DNA, 20 bp, Artificial
  CRISPR gRNA sequence
ttttgcacattgtagaaagc

SEQ ID NO: 630576 - DNA, 20 bp, Artificial
  CRISPR gRNA sequence
tgcacattgtagaaagcaaa

SEQ ID NO: 630577 - DNA, 20 bp, Artificial
  CRISPR gRNA sequence
gcacattgtagaaagcaaaa

SEQ ID NO: 630578 - DNA, 20 bp, Artificial
  CRISPR gRNA sequence
cacattgtagaaagcaaaat

SEQ ID NO: 630579 - DNA, 20 bp, Artificial
  CRISPR gRNA sequence
tagaaagcaaaatcagtaat

SEQ ID NO: 630580 - DNA, 20 bp, Artificial
  CRISPR gRNA sequence
ctcataaaaattaaagggcc

SEQ ID NO: 630581 - DNA, 20 bp, Artificial
  CRISPR gRNA sequence
tcataaaaattaaagggccg

SEQ ID NO: 630582 - DNA, 20 bp, Artificial
  CRISPR gRNA sequence
ataaaaattaaagggccgat

SEQ ID NO: 630583 - DNA, 20 bp, Artificial
  CRISPR gRNA sequence
aagggccgattggagaaatt

SEQ ID NO: 630584 - DNA, 20 bp, Artificial
  CRISPR gRNA sequence
gagaaatttcaaattatatg

SEQ ID NO: 630585 - DNA, 20 bp, Artificial
  CRISPR gRNA sequence
caaattatatgactgatcac

SEQ ID NO: 630586 - DNA, 20 bp, Artificial
  CRISPR gRNA sequence
aaattatatgactgatcact

SEQ ID NO: 630587 - DNA, 20 bp, Artificial
  CRISPR gRNA sequence
tatgactgatcacttacctg

SEQ ID NO: 630588 - DNA, 20 bp, Artificial
  CRISPR gRNA sequence
atcacttacctgagatgaaa

SEQ ID NO: 630589 - DNA, 20 bp, Artificial
  CRISPR gRNA sequence
acctgagatgaaaatattca

SEQ ID NO: 630590 - DNA, 20 bp, Artificial
  CRISPR gRNA sequence
cctgagatgaaaatattcaa

SEQ ID NO: 630591 - DNA, 20 bp, Artificial
  CRISPR gRNA sequence
agatgaaaatattcaaataa

SEQ ID NO: 630592 - DNA, 20 bp, Artificial
  CRISPR gRNA sequence
aaataaccaattcattcttt

SEQ ID NO: 630593 - DNA, 20 bp, Artificial
  CRISPR gRNA sequence
attcttttaggcagcctaca

SEQ ID NO: 630594 - DNA, 20 bp, Artificial
  CRISPR gRNA sequence
ttttaggcagcctacagact

SEQ ID NO: 630595 - DNA, 20 bp, Artificial
  CRISPR gRNA sequence
ttaggcagcctacagactaa

SEQ ID NO: 630596 - DNA, 20 bp, Artificial
  CRISPR gRNA sequence
taggcagcctacagactaat

SEQ ID NO: 630597 - DNA, 20 bp, Artificial
  CRISPR gRNA sequence
aggcagcctacagactaatg

SEQ ID NO: 630598 - DNA, 20 bp, Artificial
  CRISPR gRNA sequence
ggcagcctacagactaatgt

SEQ ID NO: 630599 - DNA, 20 bp, Artificial
  CRISPR gRNA sequence
cagactaatgtggaatcagc

SEQ ID NO: 630600 - DNA, 20 bp, Artificial
  CRISPR gRNA sequence
atgtggaatcagctctaact

SEQ ID NO: 630601 - DNA, 20 bp, Artificial
  CRISPR gRNA sequence
taactatctggttagaaaaa

SEQ ID NO: 630602 - DNA, 20 bp, Artificial
  CRISPR gRNA sequence
actatctggttagaaaaatg

SEQ ID NO: 630603 - DNA, 20 bp, Artificial
  CRISPR gRNA sequence
tctggttagaaaaatgaaaa

SEQ ID NO: 630604 - DNA, 20 bp, Artificial
  CRISPR gRNA sequence
gttagaaaaatgaaaaagaa

SEQ ID NO: 630605 - DNA, 20 bp, Artificial
  CRISPR gRNA sequence
gaaaaatgaaaaagaagagt

SEQ ID NO: 630606 - DNA, 20 bp, Artificial
  CRISPR gRNA sequence
cctttggtatatgaaaggtt

SEQ ID NO: 630607 - DNA, 20 bp, Artificial
  CRISPR gRNA sequence
ctttggtatatgaaaggttg

SEQ ID NO: 630608 - DNA, 20 bp, Artificial
  CRISPR gRNA sequence
tggtatatgaaaggttggtt

SEQ ID NO: 630609 - DNA, 20 bp, Artificial
  CRISPR gRNA sequence
ggtatatgaaaggttggttg

SEQ ID NO: 630610 - DNA, 20 bp, Artificial
  CRISPR gRNA sequence
gtatatgaaaggttggttgt

SEQ ID NO: 630611 - DNA, 20 bp, Artificial
  CRISPR gRNA sequence
gttgtcattattatgctaat

SEQ ID NO: 630612 - DNA, 20 bp, Artificial
  CRISPR gRNA sequence
tcattattatgctaattcaa

SEQ ID NO: 630613 - DNA, 20 bp, Artificial
  CRISPR gRNA sequence
ttatgctaattcaaacatta

SEQ ID NO: 630614 - DNA, 20 bp, Artificial
  CRISPR gRNA sequence
tgctaattcaaacattatca

SEQ ID NO: 630615 - DNA, 20 bp, Artificial
  CRISPR gRNA sequence
attcaaacattatcagaaat

SEQ ID NO: 630616 - DNA, 20 bp, Artificial
  CRISPR gRNA sequence
aaacattatcagaaataatt

SEQ ID NO: 630617 - DNA, 20 bp, Artificial
  CRISPR gRNA sequence
tcagaaataatttgggagta

SEQ ID NO: 630618 - DNA, 20 bp, Artificial
  CRISPR gRNA sequence
gggagtattgcaaaatttca

SEQ ID NO: 630619 - DNA, 20 bp, Artificial
  CRISPR gRNA sequence
ggagtattgcaaaatttcaa

SEQ ID NO: 630620 - DNA, 20 bp, Artificial
  CRISPR gRNA sequence
caaaatttcaatacagatta

SEQ ID NO: 630621 - DNA, 20 bp, Artificial
  CRISPR gRNA sequence
caatacagattatttgcaat

SEQ ID NO: 630622 - DNA, 20 bp, Artificial
  CRISPR gRNA sequence
aatacagattatttgcaatg

SEQ ID NO: 630623 - DNA, 20 bp, Artificial
  CRISPR gRNA sequence
tttgcaatgtatcccaaagc

SEQ ID NO: 630624 - DNA, 20 bp, Artificial
  CRISPR gRNA sequence
gcaatgtatcccaaagctca

SEQ ID NO: 630625 - DNA, 20 bp, Artificial
  CRISPR gRNA sequence
caatgtatcccaaagctcaa

SEQ ID NO: 630626 - DNA, 20 bp, Artificial
  CRISPR gRNA sequence
aactcatttaagttaaagtg

SEQ ID NO: 630627 - DNA, 20 bp, Artificial
  CRISPR gRNA sequence
atttaagttaaagtgatcta

SEQ ID NO: 630628 - DNA, 20 bp, Artificial
  CRISPR gRNA sequence
aagttaaagtgatctaaaat

SEQ ID NO: 630629 - DNA, 20 bp, Artificial
  CRISPR gRNA sequence
agttaaagtgatctaaaata

SEQ ID NO: 630630 - DNA, 20 bp, Artificial
  CRISPR gRNA sequence
aagtgatctaaaatagtttt

SEQ ID NO: 630631 - DNA, 20 bp, Artificial
  CRISPR gRNA sequence
aaatagttttaaacagcata

SEQ ID NO: 630632 - DNA, 20 bp, Artificial
  CRISPR gRNA sequence
taaacagcataagattttat

SEQ ID NO: 630633 - DNA, 20 bp, Artificial
  CRISPR gRNA sequence
aaacagcataagattttatc

SEQ ID NO: 630634 - DNA, 20 bp, Artificial
  CRISPR gRNA sequence
aacagcataagattttatct

SEQ ID NO: 630635 - DNA, 20 bp, Artificial
  CRISPR gRNA sequence
tatcttcatgttgaactaca

SEQ ID NO: 630636 - DNA, 20 bp, Artificial
  CRISPR gRNA sequence
atcttcatgttgaactacaa

SEQ ID NO: 630637 - DNA, 20 bp, Artificial
  CRISPR gRNA sequence
tcttcatgttgaactacaaa

SEQ ID NO: 630638 - DNA, 20 bp, Artificial
  CRISPR gRNA sequence
catgttgaactacaaaagca

SEQ ID NO: 630639 - DNA, 20 bp, Artificial
  CRISPR gRNA sequence
atgttgaactacaaaagcag

SEQ ID NO: 630640 - DNA, 20 bp, Artificial
  CRISPR gRNA sequence
aactacaaaagcagtagggg

SEQ ID NO: 630641 - DNA, 20 bp, Artificial
  CRISPR gRNA sequence
caaaagcagtagggggaaat

SEQ ID NO: 630642 - DNA, 20 bp, Artificial
  CRISPR gRNA sequence
ctacccaccatggtgactca

SEQ ID NO: 630643 - DNA, 20 bp, Artificial
  CRISPR gRNA sequence
tacccaccatggtgactcat

SEQ ID NO: 630644 - DNA, 20 bp, Artificial
  CRISPR gRNA sequence
cccaccatggtgactcatga

SEQ ID NO: 630645 - DNA, 20 bp, Artificial
  CRISPR gRNA sequence
atgacctgcccagcagcctc

SEQ ID NO: 630646 - DNA, 20 bp, Artificial
  CRISPR gRNA sequence
cccagcagcctccatgctga

SEQ ID NO: 630647 - DNA, 20 bp, Artificial
  CRISPR gRNA sequence
catgctgacattctggagat

SEQ ID NO: 630648 - DNA, 20 bp, Artificial
  CRISPR gRNA sequence
acattctggagatagttgtg

SEQ ID NO: 630649 - DNA, 20 bp, Artificial
  CRISPR gRNA sequence
tggagatagttgtggcagcg

SEQ ID NO: 630650 - DNA, 20 bp, Artificial
  CRISPR gRNA sequence
gagatagttgtggcagcgtt

SEQ ID NO: 630651 - DNA, 20 bp, Artificial
  CRISPR gRNA sequence
tggcagcgttccttgtgctc

SEQ ID NO: 630652 - DNA, 20 bp, Artificial
  CRISPR gRNA sequence
cttgtgctcctccagtgaac

SEQ ID NO: 630653 - DNA, 20 bp, Artificial
  CRISPR gRNA sequence
gtgctcctccagtgaactgc

SEQ ID NO: 630654 - DNA, 20 bp, Artificial
  CRISPR gRNA sequence
tgctcctccagtgaactgcg

SEQ ID NO: 630655 - DNA, 20 bp, Artificial
  CRISPR gRNA sequence
ctccagtgaactgcgctgct

SEQ ID NO: 630656 - DNA, 20 bp, Artificial
  CRISPR gRNA sequence
cagtgaactgcgctgcttgt

SEQ ID NO: 630657 - DNA, 20 bp, Artificial
  CRISPR gRNA sequence
cgctgcttgtagcttcgtcc

SEQ ID NO: 630658 - DNA, 20 bp, Artificial
  CRISPR gRNA sequence
cttgtagcttcgtccacagt

SEQ ID NO: 630659 - DNA, 20 bp, Artificial
  CRISPR gRNA sequence
gtagcttcgtccacagtagt

SEQ ID NO: 630660 - DNA, 20 bp, Artificial
  CRISPR gRNA sequence
tagcttcgtccacagtagtt

SEQ ID NO: 630661 - DNA, 20 bp, Artificial
  CRISPR gRNA sequence
cgtccacagtagttgcactt

SEQ ID NO: 630662 - DNA, 20 bp, Artificial
  CRISPR gRNA sequence
gtccacagtagttgcacttg

SEQ ID NO: 630663 - DNA, 20 bp, Artificial
  CRISPR gRNA sequence
cacttgtgaggtttacccac

SEQ ID NO: 630664 - DNA, 20 bp, Artificial
  CRISPR gRNA sequence
gtgaggtttacccactgtga

SEQ ID NO: 630665 - DNA, 20 bp, Artificial
  CRISPR gRNA sequence
tgaggtttacccactgtgaa

SEQ ID NO: 630666 - DNA, 20 bp, Artificial
  CRISPR gRNA sequence
acccactgtgaagagaactc

SEQ ID NO: 630667 - DNA, 20 bp, Artificial
  CRISPR gRNA sequence
cccactgtgaagagaactca

SEQ ID NO: 630668 - DNA, 20 bp, Artificial
  CRISPR gRNA sequence
tgaagagaactcaaggtcag

SEQ ID NO: 630669 - DNA, 20 bp, Artificial
  CRISPR gRNA sequence
aaggtcagtgtgctgttagt

SEQ ID NO: 630670 - DNA, 20 bp, Artificial
  CRISPR gRNA sequence
ttagtctcatcaacattcaa

SEQ ID NO: 630671 - DNA, 20 bp, Artificial
  CRISPR gRNA sequence
gtctcatcaacattcaaagc

SEQ ID NO: 630672 - DNA, 20 bp, Artificial
  CRISPR gRNA sequence
atcaacattcaaagcaaaat

SEQ ID NO: 630673 - DNA, 20 bp, Artificial
  CRISPR gRNA sequence
aaagcaaaatcaatagctaa

SEQ ID NO: 630674 - DNA, 20 bp, Artificial
  CRISPR gRNA sequence
acttttgatagtctggagga

SEQ ID NO: 630675 - DNA, 20 bp, Artificial
  CRISPR gRNA sequence
ttgatagtctggaggaagca

SEQ ID NO: 630676 - DNA, 20 bp, Artificial
  CRISPR gRNA sequence
tgatagtctggaggaagcac

SEQ ID NO: 630677 - DNA, 20 bp, Artificial
  CRISPR gRNA sequence
gatagtctggaggaagcact

SEQ ID NO: 630678 - DNA, 20 bp, Artificial
  CRISPR gRNA sequence
atagtctggaggaagcactc

SEQ ID NO: 630679 - DNA, 20 bp, Artificial
  CRISPR gRNA sequence
gaggaagcactcatataatt

SEQ ID NO: 630680 - DNA, 20 bp, Artificial
  CRISPR gRNA sequence
atataattttcagacttaaa

SEQ ID NO: 630681 - DNA, 20 bp, Artificial
  CRISPR gRNA sequence
tcagacttaaatctcttcct

SEQ ID NO: 630682 - DNA, 20 bp, Artificial
  CRISPR gRNA sequence
cagacttaaatctcttcctc

SEQ ID NO: 630683 - DNA, 20 bp, Artificial
  CRISPR gRNA sequence
agacttaaatctcttcctcc

SEQ ID NO: 630684 - DNA, 20 bp, Artificial
  CRISPR gRNA sequence
aaatctcttcctcctttaca

SEQ ID NO: 630685 - DNA, 20 bp, Artificial
  CRISPR gRNA sequence
aatctcttcctcctttacat

SEQ ID NO: 630686 - DNA, 20 bp, Artificial
  CRISPR gRNA sequence
ttcctcctttacattccaat

SEQ ID NO: 630687 - DNA, 20 bp, Artificial
  CRISPR gRNA sequence
cctcctttacattccaattt

SEQ ID NO: 630688 - DNA, 20 bp, Artificial
  CRISPR gRNA sequence
ctcctttacattccaatttt

SEQ ID NO: 630689 - DNA, 20 bp, Artificial
  CRISPR gRNA sequence
ctttacattccaattttggt

SEQ ID NO: 630690 - DNA, 20 bp, Artificial
  CRISPR gRNA sequence
tacattccaattttggtaag

SEQ ID NO: 630691 - DNA, 20 bp, Artificial
  CRISPR gRNA sequence
acattccaattttggtaaga

SEQ ID NO: 630692 - DNA, 20 bp, Artificial
  CRISPR gRNA sequence
cattccaattttggtaagaa

SEQ ID NO: 630693 - DNA, 20 bp, Artificial
  CRISPR gRNA sequence
caattttggtaagaaaagat

SEQ ID NO: 630694 - DNA, 20 bp, Artificial
  CRISPR gRNA sequence
tggtaagaaaagataataca

SEQ ID NO: 630695 - DNA, 20 bp, Artificial
  CRISPR gRNA sequence
ggtaagaaaagataatacat

SEQ ID NO: 630696 - DNA, 20 bp, Artificial
  CRISPR gRNA sequence
gtaagaaaagataatacatt

SEQ ID NO: 630697 - DNA, 20 bp, Artificial
  CRISPR gRNA sequence
ctaccaagacaaagacaaga

SEQ ID NO: 630698 - DNA, 20 bp, Artificial
  CRISPR gRNA sequence
taccaagacaaagacaagaa

SEQ ID NO: 630699 - DNA, 20 bp, Artificial
  CRISPR gRNA sequence
ccaagacaaagacaagaaga

SEQ ID NO: 630700 - DNA, 20 bp, Artificial
  CRISPR gRNA sequence
tggcaacaggggaaatactg

SEQ ID NO: 630701 - DNA, 20 bp, Artificial
  CRISPR gRNA sequence
gcaacaggggaaatactgaa

SEQ ID NO: 630702 - DNA, 20 bp, Artificial
  CRISPR gRNA sequence
aatcaaattcttgctctgac

SEQ ID NO: 630703 - DNA, 20 bp, Artificial
  CRISPR gRNA sequence
ttgctctgactgtattctag

SEQ ID NO: 630704 - DNA, 20 bp, Artificial
  CRISPR gRNA sequence
gctctgactgtattctagac

SEQ ID NO: 630705 - DNA, 20 bp, Artificial
  CRISPR gRNA sequence
ctctgactgtattctagacc

SEQ ID NO: 630706 - DNA, 20 bp, Artificial
  CRISPR gRNA sequence
tgactgtattctagaccttg

SEQ ID NO: 630707 - DNA, 20 bp, Artificial
  CRISPR gRNA sequence
actgtattctagaccttgag

SEQ ID NO: 630708 - DNA, 20 bp, Artificial
  CRISPR gRNA sequence
tattctagaccttgagggcc

SEQ ID NO: 630709 - DNA, 20 bp, Artificial
  CRISPR gRNA sequence
tagaccttgagggcctggtg

SEQ ID NO: 630710 - DNA, 20 bp, Artificial
  CRISPR gRNA sequence
gaccttgagggcctggtgat

SEQ ID NO: 630711 - DNA, 20 bp, Artificial
  CRISPR gRNA sequence
gagggcctggtgatcagtct

SEQ ID NO: 630712 - DNA, 20 bp, Artificial
  CRISPR gRNA sequence
agggcctggtgatcagtctt

SEQ ID NO: 630713 - DNA, 20 bp, Artificial
  CRISPR gRNA sequence
gtgatcagtcttcaaattat

SEQ ID NO: 630714 - DNA, 20 bp, Artificial
  CRISPR gRNA sequence
caaattatctcactcttaat

SEQ ID NO: 630715 - DNA, 20 bp, Artificial
  CRISPR gRNA sequence
aaattatctcactcttaata

SEQ ID NO: 630716 - DNA, 20 bp, Artificial
  CRISPR gRNA sequence
tctcactcttaatacactga

SEQ ID NO: 630717 - DNA, 20 bp, Artificial
  CRISPR gRNA sequence
actcttaatacactgactct

SEQ ID NO: 630718 - DNA, 20 bp, Artificial
  CRISPR gRNA sequence
ttaatacactgactctcagc

SEQ ID NO: 630719 - DNA, 20 bp, Artificial
  CRISPR gRNA sequence
aatacactgactctcagctt

SEQ ID NO: 630720 - DNA, 20 bp, Artificial
  CRISPR gRNA sequence
atacactgactctcagcttt

SEQ ID NO: 630721 - DNA, 20 bp, Artificial
  CRISPR gRNA sequence
actctcagctttgactcatt

SEQ ID NO: 630722 - DNA, 20 bp, Artificial
  CRISPR gRNA sequence
tcagctttgactcattcaag

SEQ ID NO: 630723 - DNA, 20 bp, Artificial
  CRISPR gRNA sequence
agctttgactcattcaagac

SEQ ID NO: 630724 - DNA, 20 bp, Artificial
  CRISPR gRNA sequence
tgactcattcaagacaaatc

SEQ ID NO: 630725 - DNA, 20 bp, Artificial
  CRISPR gRNA sequence
gactcattcaagacaaatca

SEQ ID NO: 630726 - DNA, 20 bp, Artificial
  CRISPR gRNA sequence
actcattcaagacaaatcag

SEQ ID NO: 630727 - DNA, 20 bp, Artificial
  CRISPR gRNA sequence
attcaagacaaatcaggagt

SEQ ID NO: 630728 - DNA, 20 bp, Artificial
  CRISPR gRNA sequence
aagacaaatcaggagtatcc

SEQ ID NO: 630729 - DNA, 20 bp, Artificial
  CRISPR gRNA sequence
gatacatcaagagttgtggt

SEQ ID NO: 630730 - DNA, 20 bp, Artificial
  CRISPR gRNA sequence
tggtttttttttgtttgttt

SEQ ID NO: 630731 - DNA, 20 bp, Artificial
  CRISPR gRNA sequence
ttttttgtttgttttctttt

SEQ ID NO: 630732 - DNA, 20 bp, Artificial
  CRISPR gRNA sequence
tttttgtttgttttcttttc

SEQ ID NO: 630733 - DNA, 20 bp, Artificial
  CRISPR gRNA sequence
ttttgtttgttttcttttcg

SEQ ID NO: 630734 - DNA, 20 bp, Artificial
  CRISPR gRNA sequence
tttgtttgttttcttttcgg

SEQ ID NO: 630735 - DNA, 20 bp, Artificial
  CRISPR gRNA sequence
ttgtttgttttcttttcggg

SEQ ID NO: 630736 - DNA, 20 bp, Artificial
  CRISPR gRNA sequence
tgtttgttttcttttcgggt

SEQ ID NO: 630737 - DNA, 20 bp, Artificial
  CRISPR gRNA sequence
gtttgttttcttttcgggta

SEQ ID NO: 630738 - DNA, 20 bp, Artificial
  CRISPR gRNA sequence
tttgttttcttttcgggtaa

SEQ ID NO: 630739 - DNA, 20 bp, Artificial
  CRISPR gRNA sequence
gttttcttttcgggtaaggg

SEQ ID NO: 630740 - DNA, 20 bp, Artificial
  CRISPR gRNA sequence
ttttcttttcgggtaagggc

SEQ ID NO: 630741 - DNA, 20 bp, Artificial
  CRISPR gRNA sequence
tcttttcgggtaagggcaga

SEQ ID NO: 630742 - DNA, 20 bp, Artificial
  CRISPR gRNA sequence
cttttcgggtaagggcagag

SEQ ID NO: 630743 - DNA, 20 bp, Artificial
  CRISPR gRNA sequence
ttttcgggtaagggcagaga

SEQ ID NO: 630744 - DNA, 20 bp, Artificial
  CRISPR gRNA sequence
ttcgggtaagggcagagaat

SEQ ID NO: 630745 - DNA, 20 bp, Artificial
  CRISPR gRNA sequence
tcgggtaagggcagagaatt

SEQ ID NO: 630746 - DNA, 20 bp, Artificial
  CRISPR gRNA sequence
cgggtaagggcagagaattt

SEQ ID NO: 630747 - DNA, 20 bp, Artificial
  CRISPR gRNA sequence
gggtaagggcagagaatttt

SEQ ID NO: 630748 - DNA, 20 bp, Artificial
  CRISPR gRNA sequence
tacagaagaaaacttaaaat

SEQ ID NO: 630749 - DNA, 20 bp, Artificial
  CRISPR gRNA sequence
acagaagaaaacttaaaatg

SEQ ID NO: 630750 - DNA, 20 bp, Artificial
  CRISPR gRNA sequence
cagaagaaaacttaaaatgc

SEQ ID NO: 630751 - DNA, 20 bp, Artificial
  CRISPR gRNA sequence
aaaatgcaacaacttgaaat

SEQ ID NO: 630752 - DNA, 20 bp, Artificial
  CRISPR gRNA sequence
aaatgcaacaacttgaaatg

SEQ ID NO: 630753 - DNA, 20 bp, Artificial
  CRISPR gRNA sequence
gaaatgtcacagtttaataa

SEQ ID NO: 630754 - DNA, 20 bp, Artificial
  CRISPR gRNA sequence
aaatgtcacagtttaataaa

SEQ ID NO: 630755 - DNA, 20 bp, Artificial
  CRISPR gRNA sequence
aataaagagattattcttgg

SEQ ID NO: 630756 - DNA, 20 bp, Artificial
  CRISPR gRNA sequence
ataaagagattattcttggg

SEQ ID NO: 630757 - DNA, 20 bp, Artificial
  CRISPR gRNA sequence
ttcttgggtaccaagaagat

SEQ ID NO: 630758 - DNA, 20 bp, Artificial
  CRISPR gRNA sequence
ttgggtaccaagaagattaa

SEQ ID NO: 630759 - DNA, 20 bp, Artificial
  CRISPR gRNA sequence
gggtaccaagaagattaaaa

SEQ ID NO: 630760 - DNA, 20 bp, Artificial
  CRISPR gRNA sequence
ggtaccaagaagattaaaaa

SEQ ID NO: 630761 - DNA, 20 bp, Artificial
  CRISPR gRNA sequence
aaaagaactcaagtggtgag

SEQ ID NO: 630762 - DNA, 20 bp, Artificial
  CRISPR gRNA sequence
aagtggtgagaaaaagtaca

SEQ ID NO: 630763 - DNA, 20 bp, Artificial
  CRISPR gRNA sequence
cctttcctttcaccttggta

SEQ ID NO: 630764 - DNA, 20 bp, Artificial
  CRISPR gRNA sequence
ctttcctttcaccttggtaa

SEQ ID NO: 630765 - DNA, 20 bp, Artificial
  CRISPR gRNA sequence
tcctttcaccttggtaacaa

SEQ ID NO: 630766 - DNA, 20 bp, Artificial
  CRISPR gRNA sequence
cctttcaccttggtaacaac

SEQ ID NO: 630767 - DNA, 20 bp, Artificial
  CRISPR gRNA sequence
ctttcaccttggtaacaact

SEQ ID NO: 630768 - DNA, 20 bp, Artificial
  CRISPR gRNA sequence
tcaccttggtaacaactatt

SEQ ID NO: 630769 - DNA, 20 bp, Artificial
  CRISPR gRNA sequence
caccttggtaacaactattc

SEQ ID NO: 630770 - DNA, 20 bp, Artificial
  CRISPR gRNA sequence
accttggtaacaactattca

SEQ ID NO: 630771 - DNA, 20 bp, Artificial
  CRISPR gRNA sequence
ggtaacaactattcacacat

SEQ ID NO: 630772 - DNA, 20 bp, Artificial
  CRISPR gRNA sequence
gtaacaactattcacacatg

SEQ ID NO: 630773 - DNA, 20 bp, Artificial
  CRISPR gRNA sequence
ttcacacatgcaaaattttg

SEQ ID NO: 630774 - DNA, 20 bp, Artificial
  CRISPR gRNA sequence
acacatgcaaaattttgtgg

SEQ ID NO: 630775 - DNA, 20 bp, Artificial
  CRISPR gRNA sequence
tgtggcaggtaagtatattc

SEQ ID NO: 630776 - DNA, 20 bp, Artificial
  CRISPR gRNA sequence
gtggcaggtaagtatattct

SEQ ID NO: 630777 - DNA, 20 bp, Artificial
  CRISPR gRNA sequence
tggcaggtaagtatattctc

SEQ ID NO: 630778 - DNA, 20 bp, Artificial
  CRISPR gRNA sequence
tccctcatcagcttttataa

SEQ ID NO: 630779 - DNA, 20 bp, Artificial
  CRISPR gRNA sequence
cctcatcagcttttataata

SEQ ID NO: 630780 - DNA, 20 bp, Artificial
  CRISPR gRNA sequence
atcagcttttataataccaa

SEQ ID NO: 630781 - DNA, 20 bp, Artificial
  CRISPR gRNA sequence
ttataataccaagaattaac

SEQ ID NO: 630782 - DNA, 20 bp, Artificial
  CRISPR gRNA sequence
tataataccaagaattaacc

SEQ ID NO: 630783 - DNA, 20 bp, Artificial
  CRISPR gRNA sequence
ataataccaagaattaacct

SEQ ID NO: 630784 - DNA, 20 bp, Artificial
  CRISPR gRNA sequence
taataccaagaattaaccta

SEQ ID NO: 630785 - DNA, 20 bp, Artificial
  CRISPR gRNA sequence
acctactaggtgctttgagt

SEQ ID NO: 630786 - DNA, 20 bp, Artificial
  CRISPR gRNA sequence
ctaggtgctttgagtcagga

SEQ ID NO: 630787 - DNA, 20 bp, Artificial
  CRISPR gRNA sequence
ggtgctttgagtcaggatta

SEQ ID NO: 630788 - DNA, 20 bp, Artificial
  CRISPR gRNA sequence
tgagtcaggattattacaca

SEQ ID NO: 630789 - DNA, 20 bp, Artificial
  CRISPR gRNA sequence
gagtcaggattattacacaa

SEQ ID NO: 630790 - DNA, 20 bp, Artificial
  CRISPR gRNA sequence
agtcaggattattacacaat

SEQ ID NO: 630791 - DNA, 20 bp, Artificial
  CRISPR gRNA sequence
ttacacaatatgtagttaca

SEQ ID NO: 630792 - DNA, 20 bp, Artificial
  CRISPR gRNA sequence
cacaatatgtagttacaaaa

SEQ ID NO: 630793 - DNA, 20 bp, Artificial
  CRISPR gRNA sequence
caaaatgacagtaatatttt

SEQ ID NO: 630794 - DNA, 20 bp, Artificial
  CRISPR gRNA sequence
tccaaaacatctcacattaa

SEQ ID NO: 630795 - DNA, 20 bp, Artificial
  CRISPR gRNA sequence
ccaaaacatctcacattaag

SEQ ID NO: 630796 - DNA, 20 bp, Artificial
  CRISPR gRNA sequence
caaaacatctcacattaagg

SEQ ID NO: 630797 - DNA, 20 bp, Artificial
  CRISPR gRNA sequence
acattaaggaaatgaattat

SEQ ID NO: 630798 - DNA, 20 bp, Artificial
  CRISPR gRNA sequence
aggaaatgaattattcccta

SEQ ID NO: 630799 - DNA, 20 bp, Artificial
  CRISPR gRNA sequence
ttccctaatagctagggagc

SEQ ID NO: 630800 - DNA, 20 bp, Artificial
  CRISPR gRNA sequence
cctaatagctagggagccat

SEQ ID NO: 630801 - DNA, 20 bp, Artificial
  CRISPR gRNA sequence
atagctagggagccattatc

SEQ ID NO: 630802 - DNA, 20 bp, Artificial
  CRISPR gRNA sequence
gggagccattatctcagtgt

SEQ ID NO: 630803 - DNA, 20 bp, Artificial
  CRISPR gRNA sequence
tctcagtgtcattatctcaa

SEQ ID NO: 630804 - DNA, 20 bp, Artificial
  CRISPR gRNA sequence
agtgtcattatctcaataca

SEQ ID NO: 630805 - DNA, 20 bp, Artificial
  CRISPR gRNA sequence
tctcaatacatctgttaaaa

SEQ ID NO: 630806 - DNA, 20 bp, Artificial
  CRISPR gRNA sequence
aatacatctgttaaaatact

SEQ ID NO: 630807 - DNA, 20 bp, Artificial
  CRISPR gRNA sequence
ttaaaatactaagatgttca

SEQ ID NO: 630808 - DNA, 20 bp, Artificial
  CRISPR gRNA sequence
aaatactaagatgttcagtt

SEQ ID NO: 630809 - DNA, 20 bp, Artificial
  CRISPR gRNA sequence
agatgttcagttaaaaaaaa

SEQ ID NO: 630810 - DNA, 20 bp, Artificial
  CRISPR gRNA sequence
agttaaaaaaaaccttaaaa

SEQ ID NO: 630811 - DNA, 20 bp, Artificial
  CRISPR gRNA sequence
aaaaaaaccttaaaaaacaa

SEQ ID NO: 630812 - DNA, 20 bp, Artificial
  CRISPR gRNA sequence
aaaaaacaaagaagaaaaat

SEQ ID NO: 630813 - DNA, 20 bp, Artificial
  CRISPR gRNA sequence
aaaaacaaagaagaaaaata

SEQ ID NO: 630814 - DNA, 20 bp, Artificial
  CRISPR gRNA sequence
tatggaaagaagcatgtttt

SEQ ID NO: 630815 - DNA, 20 bp, Artificial
  CRISPR gRNA sequence
tggaaagaagcatgttttaa

SEQ ID NO: 630816 - DNA, 20 bp, Artificial
  CRISPR gRNA sequence
taatgcatgactcttcataa

SEQ ID NO: 630817 - DNA, 20 bp, Artificial
  CRISPR gRNA sequence
aatgcatgactcttcataag

SEQ ID NO: 630818 - DNA, 20 bp, Artificial
  CRISPR gRNA sequence
atgcatgactcttcataagg

SEQ ID NO: 630819 - DNA, 20 bp, Artificial
  CRISPR gRNA sequence
ttcataaggacatcacagag

SEQ ID NO: 630820 - DNA, 20 bp, Artificial
  CRISPR gRNA sequence
cataaggacatcacagagca

SEQ ID NO: 630821 - DNA, 20 bp, Artificial
  CRISPR gRNA sequence
ataaggacatcacagagcac

SEQ ID NO: 630822 - DNA, 20 bp, Artificial
  CRISPR gRNA sequence
tgactcttggttttgaatga

SEQ ID NO: 630823 - DNA, 20 bp, Artificial
  CRISPR gRNA sequence
gactcttggttttgaatgaa

SEQ ID NO: 630824 - DNA, 20 bp, Artificial
  CRISPR gRNA sequence
actcttggttttgaatgaat

SEQ ID NO: 630825 - DNA, 20 bp, Artificial
  CRISPR gRNA sequence
ttggttttgaatgaatacag

SEQ ID NO: 630826 - DNA, 20 bp, Artificial
  CRISPR gRNA sequence
ggttttgaatgaatacagaa

SEQ ID NO: 630827 - DNA, 20 bp, Artificial
  CRISPR gRNA sequence
gttttgaatgaatacagaac

SEQ ID NO: 630828 - DNA, 20 bp, Artificial
  CRISPR gRNA sequence
tgaatgaatacagaacaaca

SEQ ID NO: 630829 - DNA, 20 bp, Artificial
  CRISPR gRNA sequence
gaatgaatacagaacaacat

SEQ ID NO: 630830 - DNA, 20 bp, Artificial
  CRISPR gRNA sequence
aatgaatacagaacaacata

SEQ ID NO: 630831 - DNA, 20 bp, Artificial
  CRISPR gRNA sequence
tgccaaagccctcaatagta

SEQ ID NO: 630832 - DNA, 20 bp, Artificial
  CRISPR gRNA sequence
aatagtaaagcaccgtgtga

SEQ ID NO: 630833 - DNA, 20 bp, Artificial
  CRISPR gRNA sequence
tatttgactcccagaggaat

SEQ ID NO: 630834 - DNA, 20 bp, Artificial
  CRISPR gRNA sequence
tttgactcccagaggaatta

SEQ ID NO: 630835 - DNA, 20 bp, Artificial
  CRISPR gRNA sequence
gactcccagaggaattattt

SEQ ID NO: 630836 - DNA, 20 bp, Artificial
  CRISPR gRNA sequence
actcccagaggaattattta

SEQ ID NO: 630837 - DNA, 20 bp, Artificial
  CRISPR gRNA sequence
ccagaggaattatttagttt

SEQ ID NO: 630838 - DNA, 20 bp, Artificial
  CRISPR gRNA sequence
tttagttttgctcagagaat

SEQ ID NO: 630839 - DNA, 20 bp, Artificial
  CRISPR gRNA sequence
agttttgctcagagaataac

SEQ ID NO: 630840 - DNA, 20 bp, Artificial
  CRISPR gRNA sequence
gttttgctcagagaataaca

SEQ ID NO: 630841 - DNA, 20 bp, Artificial
  CRISPR gRNA sequence
tgctcagagaataacagaca

SEQ ID NO: 630842 - DNA, 20 bp, Artificial
  CRISPR gRNA sequence
gctcagagaataacagacaa

SEQ ID NO: 630843 - DNA, 20 bp, Artificial
  CRISPR gRNA sequence
ctcagagaataacagacaac

SEQ ID NO: 630844 - DNA, 20 bp, Artificial
  CRISPR gRNA sequence
agagaataacagacaactct

SEQ ID NO: 630845 - DNA, 20 bp, Artificial
  CRISPR gRNA sequence
tttttcatgaccaaagatag

SEQ ID NO: 630846 - DNA, 20 bp, Artificial
  CRISPR gRNA sequence
tttcatgaccaaagatagca

SEQ ID NO: 630847 - DNA, 20 bp, Artificial
  CRISPR gRNA sequence
ttcatgaccaaagatagcat

SEQ ID NO: 630848 - DNA, 20 bp, Artificial
  CRISPR gRNA sequence
tcatgaccaaagatagcatc

SEQ ID NO: 630849 - DNA, 20 bp, Artificial
  CRISPR gRNA sequence
catgaccaaagatagcatcc

SEQ ID NO: 630850 - DNA, 20 bp, Artificial
  CRISPR gRNA sequence
atgaccaaagatagcatccc

SEQ ID NO: 630851 - DNA, 20 bp, Artificial
  CRISPR gRNA sequence
actccagttaacttataaac

SEQ ID NO: 630852 - DNA, 20 bp, Artificial
  CRISPR gRNA sequence
cagttaacttataaacccat

SEQ ID NO: 630853 - DNA, 20 bp, Artificial
  CRISPR gRNA sequence
acttataaacccatgctatg

SEQ ID NO: 630854 - DNA, 20 bp, Artificial
  CRISPR gRNA sequence
ataaacccatgctatgacac

SEQ ID NO: 630855 - DNA, 20 bp, Artificial
  CRISPR gRNA sequence
taaacccatgctatgacact

SEQ ID NO: 630856 - DNA, 20 bp, Artificial
  CRISPR gRNA sequence
tgacactggtcacaagagga

SEQ ID NO: 630857 - DNA, 20 bp, Artificial
  CRISPR gRNA sequence
gtcacaagaggaactgaaat

SEQ ID NO: 630858 - DNA, 20 bp, Artificial
  CRISPR gRNA sequence
aaatactataacaaggcaag

SEQ ID NO: 630859 - DNA, 20 bp, Artificial
  CRISPR gRNA sequence
taacaaggcaaggtattcat

SEQ ID NO: 630860 - DNA, 20 bp, Artificial
  CRISPR gRNA sequence
atggctgcctgaaagtttca

SEQ ID NO: 630861 - DNA, 20 bp, Artificial
  CRISPR gRNA sequence
cctgaaagtttcactgtact

SEQ ID NO: 630862 - DNA, 20 bp, Artificial
  CRISPR gRNA sequence
aaagtttcactgtactgatg

SEQ ID NO: 630863 - DNA, 20 bp, Artificial
  CRISPR gRNA sequence
cactgtactgatgaaaaaga

SEQ ID NO: 630864 - DNA, 20 bp, Artificial
  CRISPR gRNA sequence
actgtactgatgaaaaagaa

SEQ ID NO: 630865 - DNA, 20 bp, Artificial
  CRISPR gRNA sequence
tactgatgaaaaagaaagct

SEQ ID NO: 630866 - DNA, 20 bp, Artificial
  CRISPR gRNA sequence
atgaaaaagaaagctacacc

SEQ ID NO: 630867 - DNA, 20 bp, Artificial
  CRISPR gRNA sequence
caccaaacctttagattgta

SEQ ID NO: 630868 - DNA, 20 bp, Artificial
  CRISPR gRNA sequence
tagattgtaattgaggtaca

SEQ ID NO: 630869 - DNA, 20 bp, Artificial
  CRISPR gRNA sequence
agattgtaattgaggtacac

SEQ ID NO: 630870 - DNA, 20 bp, Artificial
  CRISPR gRNA sequence
gattgtaattgaggtacaca

SEQ ID NO: 630871 - DNA, 20 bp, Artificial
  CRISPR gRNA sequence
taattgaggtacacataaat

SEQ ID NO: 630872 - DNA, 20 bp, Artificial
  CRISPR gRNA sequence
aggtacacataaattaagat

SEQ ID NO: 630873 - DNA, 20 bp, Artificial
  CRISPR gRNA sequence
agatcagttatttcataatc

SEQ ID NO: 630874 - DNA, 20 bp, Artificial
  CRISPR gRNA sequence
tttcataatcataattgttt

SEQ ID NO: 630875 - DNA, 20 bp, Artificial
  CRISPR gRNA sequence
cataatcataattgtttgta

SEQ ID NO: 630876 - DNA, 20 bp, Artificial
  CRISPR gRNA sequence
ataatcataattgtttgtaa

SEQ ID NO: 630877 - DNA, 20 bp, Artificial
  CRISPR gRNA sequence
tttgtaaactatcataaaag

SEQ ID NO: 630878 - DNA, 20 bp, Artificial
  CRISPR gRNA sequence
gtaaactatcataaaagtta

SEQ ID NO: 630879 - DNA, 20 bp, Artificial
  CRISPR gRNA sequence
taaactatcataaaagttat

SEQ ID NO: 630880 - DNA, 20 bp, Artificial
  CRISPR gRNA sequence
tcataaaagttatttatgga

SEQ ID NO: 630881 - DNA, 20 bp, Artificial
  CRISPR gRNA sequence
tttatggagtgattattcat

SEQ ID NO: 630882 - DNA, 20 bp, Artificial
  CRISPR gRNA sequence
atggagtgattattcatttt

SEQ ID NO: 630883 - DNA, 20 bp, Artificial
  CRISPR gRNA sequence
tggagtgattattcattttt

SEQ ID NO: 630884 - DNA, 20 bp, Artificial
  CRISPR gRNA sequence
ttcatttttttaaaaatgct

SEQ ID NO: 630885 - DNA, 20 bp, Artificial
  CRISPR gRNA sequence
atttttttaaaaatgcttgg

SEQ ID NO: 630886 - DNA, 20 bp, Artificial
  CRISPR gRNA sequence
ttttaaaaatgcttggcaaa

SEQ ID NO: 630887 - DNA, 20 bp, Artificial
  CRISPR gRNA sequence
tttaaaaatgcttggcaaac

SEQ ID NO: 630888 - DNA, 20 bp, Artificial
  CRISPR gRNA sequence
ttaaaaatgcttggcaaacc

SEQ ID NO: 630889 - DNA, 20 bp, Artificial
  CRISPR gRNA sequence
taaaaatgcttggcaaacca

SEQ ID NO: 630890 - DNA, 20 bp, Artificial
  CRISPR gRNA sequence
aaaaatgcttggcaaaccag

SEQ ID NO: 630891 - DNA, 20 bp, Artificial
  CRISPR gRNA sequence
aaaatgcttggcaaaccagc

SEQ ID NO: 630892 - DNA, 20 bp, Artificial
  CRISPR gRNA sequence
ggcaaaccagcttctatttt

SEQ ID NO: 630893 - DNA, 20 bp, Artificial
  CRISPR gRNA sequence
gcaaaccagcttctattttt

SEQ ID NO: 630894 - DNA, 20 bp, Artificial
  CRISPR gRNA sequence
ctattttttggaaccatgga

SEQ ID NO: 630895 - DNA, 20 bp, Artificial
  CRISPR gRNA sequence
tattttttggaaccatggat

SEQ ID NO: 630896 - DNA, 20 bp, Artificial
  CRISPR gRNA sequence
ttttttggaaccatggattt

SEQ ID NO: 630897 - DNA, 20 bp, Artificial
  CRISPR gRNA sequence
tttggaaccatggatttctg

SEQ ID NO: 630898 - DNA, 20 bp, Artificial
  CRISPR gRNA sequence
ttggaaccatggatttctgg

SEQ ID NO: 630899 - DNA, 20 bp, Artificial
  CRISPR gRNA sequence
tggaaccatggatttctggg

SEQ ID NO: 630900 - DNA, 20 bp, Artificial
  CRISPR gRNA sequence
ggaaccatggatttctggga

SEQ ID NO: 630901 - DNA, 20 bp, Artificial
  CRISPR gRNA sequence
gaaccatggatttctgggaa

SEQ ID NO: 630902 - DNA, 20 bp, Artificial
  CRISPR gRNA sequence
ctgggaagtagctgagaata

SEQ ID NO: 630903 - DNA, 20 bp, Artificial
  CRISPR gRNA sequence
tgggaagtagctgagaatac

SEQ ID NO: 630904 - DNA, 20 bp, Artificial
  CRISPR gRNA sequence
ggaagtagctgagaatactg

SEQ ID NO: 630905 - DNA, 20 bp, Artificial
  CRISPR gRNA sequence
agaatactgtgcagaacttg

SEQ ID NO: 630906 - DNA, 20 bp, Artificial
  CRISPR gRNA sequence
tgcagaacttgtatcaccat

SEQ ID NO: 630907 - DNA, 20 bp, Artificial
  CRISPR gRNA sequence
gtatcaccatgtgacagcat

SEQ ID NO: 630908 - DNA, 20 bp, Artificial
  CRISPR gRNA sequence
tatcaccatgtgacagcatt

SEQ ID NO: 630909 - DNA, 20 bp, Artificial
  CRISPR gRNA sequence
aaaatacaaaaaataagttt

SEQ ID NO: 630910 - DNA, 20 bp, Artificial
  CRISPR gRNA sequence
tgctgaaatcatctagtgta

SEQ ID NO: 630911 - DNA, 20 bp, Artificial
  CRISPR gRNA sequence
gctgaaatcatctagtgtaa

SEQ ID NO: 630912 - DNA, 20 bp, Artificial
  CRISPR gRNA sequence
ctgaaatcatctagtgtaaa

SEQ ID NO: 630913 - DNA, 20 bp, Artificial
  CRISPR gRNA sequence
aaatcatctagtgtaaatac

SEQ ID NO: 630914 - DNA, 20 bp, Artificial
  CRISPR gRNA sequence
gtgtaaatactataaataaa

SEQ ID NO: 630915 - DNA, 20 bp, Artificial
  CRISPR gRNA sequence
taaataaatttacatgtaat

SEQ ID NO: 630916 - DNA, 20 bp, Artificial
  CRISPR gRNA sequence
acatgtaattatgttccaag

SEQ ID NO: 630917 - DNA, 20 bp, Artificial
  CRISPR gRNA sequence
catgtaattatgttccaaga

SEQ ID NO: 630918 - DNA, 20 bp, Artificial
  CRISPR gRNA sequence
tgttccaagatatgggacta

SEQ ID NO: 630919 - DNA, 20 bp, Artificial
  CRISPR gRNA sequence
caagatatgggactacataa

SEQ ID NO: 630920 - DNA, 20 bp, Artificial
  CRISPR gRNA sequence
cataacaaaaagtatctgtt

SEQ ID NO: 630921 - DNA, 20 bp, Artificial
  CRISPR gRNA sequence
tttactattagcattactca

SEQ ID NO: 630922 - DNA, 20 bp, Artificial
  CRISPR gRNA sequence
actattagcattactcagtt

SEQ ID NO: 630923 - DNA, 20 bp, Artificial
  CRISPR gRNA sequence
ctattagcattactcagttt

SEQ ID NO: 630924 - DNA, 20 bp, Artificial
  CRISPR gRNA sequence
ttagcattactcagttttgg

SEQ ID NO: 630925 - DNA, 20 bp, Artificial
  CRISPR gRNA sequence
gcattactcagttttgggtt

SEQ ID NO: 630926 - DNA, 20 bp, Artificial
  CRISPR gRNA sequence
ctcagttttgggttcttctg

SEQ ID NO: 630927 - DNA, 20 bp, Artificial
  CRISPR gRNA sequence
agttttgggttcttctgtaa

SEQ ID NO: 630928 - DNA, 20 bp, Artificial
  CRISPR gRNA sequence
tgggttcttctgtaatattt

SEQ ID NO: 630929 - DNA, 20 bp, Artificial
  CRISPR gRNA sequence
gggttcttctgtaatatttc

SEQ ID NO: 630930 - DNA, 20 bp, Artificial
  CRISPR gRNA sequence
ggttcttctgtaatatttct

SEQ ID NO: 630931 - DNA, 20 bp, Artificial
  CRISPR gRNA sequence
ttctgtaatatttctctaga

SEQ ID NO: 630932 - DNA, 20 bp, Artificial
  CRISPR gRNA sequence
ctgtaatatttctctagaaa

SEQ ID NO: 630933 - DNA, 20 bp, Artificial
  CRISPR gRNA sequence
tgtaatatttctctagaaat

SEQ ID NO: 630934 - DNA, 20 bp, Artificial
  CRISPR gRNA sequence
taatatttctctagaaatag

SEQ ID NO: 630935 - DNA, 20 bp, Artificial
  CRISPR gRNA sequence
ctctagaaatagtaatgaat

SEQ ID NO: 630936 - DNA, 20 bp, Artificial
  CRISPR gRNA sequence
tctagaaatagtaatgaatt

SEQ ID NO: 630937 - DNA, 20 bp, Artificial
  CRISPR gRNA sequence
tagaaatagtaatgaattta

SEQ ID NO: 630938 - DNA, 20 bp, Artificial
  CRISPR gRNA sequence
gaaatagtaatgaatttata

SEQ ID NO: 630939 - DNA, 20 bp, Artificial
  CRISPR gRNA sequence
atactgaacaagtttattaa

SEQ ID NO: 630940 - DNA, 20 bp, Artificial
  CRISPR gRNA sequence
tactgaacaagtttattaac

SEQ ID NO: 630941 - DNA, 20 bp, Artificial
  CRISPR gRNA sequence
aacaagtttattaaccaatt

SEQ ID NO: 630942 - DNA, 20 bp, Artificial
  CRISPR gRNA sequence
attaaccaattaatacttat

SEQ ID NO: 630943 - DNA, 20 bp, Artificial
  CRISPR gRNA sequence
ttaaccaattaatacttatt

SEQ ID NO: 630944 - DNA, 20 bp, Artificial
  CRISPR gRNA sequence
accaattaatacttattaag

SEQ ID NO: 630945 - DNA, 20 bp, Artificial
  CRISPR gRNA sequence
atacttattaagcacttaca

SEQ ID NO: 630946 - DNA, 20 bp, Artificial
  CRISPR gRNA sequence
attaagcacttacattgaag

SEQ ID NO: 630947 - DNA, 20 bp, Artificial
  CRISPR gRNA sequence
ttaagcacttacattgaagc

SEQ ID NO: 630948 - DNA, 20 bp, Artificial
  CRISPR gRNA sequence
agcacttacattgaagctaa

SEQ ID NO: 630949 - DNA, 20 bp, Artificial
  CRISPR gRNA sequence
acattgaagctaatagcccg

SEQ ID NO: 630950 - DNA, 20 bp, Artificial
  CRISPR gRNA sequence
cattgaagctaatagcccgc

SEQ ID NO: 630951 - DNA, 20 bp, Artificial
  CRISPR gRNA sequence
aagctaatagcccgctgtaa

SEQ ID NO: 630952 - DNA, 20 bp, Artificial
  CRISPR gRNA sequence
atagcccgctgtaaactact

SEQ ID NO: 630953 - DNA, 20 bp, Artificial
  CRISPR gRNA sequence
taaactacttcagtcatttc

SEQ ID NO: 630954 - DNA, 20 bp, Artificial
  CRISPR gRNA sequence
cttcagtcatttccgggtct

SEQ ID NO: 630955 - DNA, 20 bp, Artificial
  CRISPR gRNA sequence
cagtcatttccgggtcttcc

SEQ ID NO: 630956 - DNA, 20 bp, Artificial
  CRISPR gRNA sequence
agtcatttccgggtcttccc

SEQ ID NO: 630957 - DNA, 20 bp, Artificial
  CRISPR gRNA sequence
ccgggtcttccctggtatta

SEQ ID NO: 630958 - DNA, 20 bp, Artificial
  CRISPR gRNA sequence
cgggtcttccctggtattag

SEQ ID NO: 630959 - DNA, 20 bp, Artificial
  CRISPR gRNA sequence
ccctggtattagtcccatca

SEQ ID NO: 630960 - DNA, 20 bp, Artificial
  CRISPR gRNA sequence
cctggtattagtcccatcac

SEQ ID NO: 630961 - DNA, 20 bp, Artificial
  CRISPR gRNA sequence
gtattagtcccatcacatta

SEQ ID NO: 630962 - DNA, 20 bp, Artificial
  CRISPR gRNA sequence
gtcccatcacattatgatgc

SEQ ID NO: 630963 - DNA, 20 bp, Artificial
  CRISPR gRNA sequence
tgatgcctctgttgtactat

SEQ ID NO: 630964 - DNA, 20 bp, Artificial
  CRISPR gRNA sequence
tgttgtactatgagcatatt

SEQ ID NO: 630965 - DNA, 20 bp, Artificial
  CRISPR gRNA sequence
ttgtactatgagcatattct

SEQ ID NO: 630966 - DNA, 20 bp, Artificial
  CRISPR gRNA sequence
tactatgagcatattctcct

SEQ ID NO: 630967 - DNA, 20 bp, Artificial
  CRISPR gRNA sequence
tgagcatattctcctatact

SEQ ID NO: 630968 - DNA, 20 bp, Artificial
  CRISPR gRNA sequence
tcctatactttcttcccctt

SEQ ID NO: 630969 - DNA, 20 bp, Artificial
  CRISPR gRNA sequence
ctatactttcttccccttat

SEQ ID NO: 630970 - DNA, 20 bp, Artificial
  CRISPR gRNA sequence
tactttcttccccttatttc

SEQ ID NO: 630971 - DNA, 20 bp, Artificial
  CRISPR gRNA sequence
tcttccccttatttctgtaa

SEQ ID NO: 630972 - DNA, 20 bp, Artificial
  CRISPR gRNA sequence
cttccccttatttctgtaag

SEQ ID NO: 630973 - DNA, 20 bp, Artificial
  CRISPR gRNA sequence
ttccccttatttctgtaagc

SEQ ID NO: 630974 - DNA, 20 bp, Artificial
  CRISPR gRNA sequence
ccccttatttctgtaagcaa

SEQ ID NO: 630975 - DNA, 20 bp, Artificial
  CRISPR gRNA sequence
cccttatttctgtaagcaat

SEQ ID NO: 630976 - DNA, 20 bp, Artificial
  CRISPR gRNA sequence
atttctgtaagcaatcatta

SEQ ID NO: 630977 - DNA, 20 bp, Artificial
  CRISPR gRNA sequence
tttctgtaagcaatcattat

SEQ ID NO: 630978 - DNA, 20 bp, Artificial
  CRISPR gRNA sequence
ctgtaagcaatcattatacc

SEQ ID NO: 630979 - DNA, 20 bp, Artificial
  CRISPR gRNA sequence
tgtaagcaatcattatacct

SEQ ID NO: 630980 - DNA, 20 bp, Artificial
  CRISPR gRNA sequence
taagcaatcattataccttc

SEQ ID NO: 630981 - DNA, 20 bp, Artificial
  CRISPR gRNA sequence
taccttctcaatttaattga

SEQ ID NO: 630982 - DNA, 20 bp, Artificial
  CRISPR gRNA sequence
ctcaatttaattgaaacatg

SEQ ID NO: 630983 - DNA, 20 bp, Artificial
  CRISPR gRNA sequence
tcaatttaattgaaacatgg

SEQ ID NO: 630984 - DNA, 20 bp, Artificial
  CRISPR gRNA sequence
aatttaattgaaacatggtt

SEQ ID NO: 630985 - DNA, 20 bp, Artificial
  CRISPR gRNA sequence
aattgaaacatggtttttca

SEQ ID NO: 630986 - DNA, 20 bp, Artificial
  CRISPR gRNA sequence
attgaaacatggtttttcat

SEQ ID NO: 630987 - DNA, 20 bp, Artificial
  CRISPR gRNA sequence
aaacatggtttttcattcta

SEQ ID NO: 630988 - DNA, 20 bp, Artificial
  CRISPR gRNA sequence
ttcattctattccccttggc

SEQ ID NO: 630989 - DNA, 20 bp, Artificial
  CRISPR gRNA sequence
tcattctattccccttggct

SEQ ID NO: 630990 - DNA, 20 bp, Artificial
  CRISPR gRNA sequence
cattctattccccttggctc

SEQ ID NO: 630991 - DNA, 20 bp, Artificial
  CRISPR gRNA sequence
attctattccccttggctca

SEQ ID NO: 630992 - DNA, 20 bp, Artificial
  CRISPR gRNA sequence
tattccccttggctcacaac

SEQ ID NO: 630993 - DNA, 20 bp, Artificial
  CRISPR gRNA sequence
ttccccttggctcacaaccc

SEQ ID NO: 630994 - DNA, 20 bp, Artificial
  CRISPR gRNA sequence
cccttggctcacaaccctct

SEQ ID NO: 630995 - DNA, 20 bp, Artificial
  CRISPR gRNA sequence
ggctcacaaccctctaaaag

SEQ ID NO: 630996 - DNA, 20 bp, Artificial
  CRISPR gRNA sequence
gctcacaaccctctaaaagt

SEQ ID NO: 630997 - DNA, 20 bp, Artificial
  CRISPR gRNA sequence
acaaccctctaaaagtccca

SEQ ID NO: 630998 - DNA, 20 bp, Artificial
  CRISPR gRNA sequence
taaaagtcccaactcacctg

SEQ ID NO: 630999 - DNA, 20 bp, Artificial
  CRISPR gRNA sequence
aaagtcccaactcacctgat

SEQ ID NO: 631000 - DNA, 20 bp, Artificial
  CRISPR gRNA sequence
acctgataagaaggaagaga

SEQ ID NO: 631001 - DNA, 20 bp, Artificial
  CRISPR gRNA sequence
ataagaaggaagagacatgt

SEQ ID NO: 631002 - DNA, 20 bp, Artificial
  CRISPR gRNA sequence
ttatgttttctactcacttt

SEQ ID NO: 631003 - DNA, 20 bp, Artificial
  CRISPR gRNA sequence
tatgttttctactcactttt

SEQ ID NO: 631004 - DNA, 20 bp, Artificial
  CRISPR gRNA sequence
atgttttctactcacttttt

SEQ ID NO: 631005 - DNA, 20 bp, Artificial
  CRISPR gRNA sequence
tgttttctactcacttttta

SEQ ID NO: 631006 - DNA, 20 bp, Artificial
  CRISPR gRNA sequence
tctactcactttttactact

SEQ ID NO: 631007 - DNA, 20 bp, Artificial
  CRISPR gRNA sequence
ctactcactttttactactc

SEQ ID NO: 631008 - DNA, 20 bp, Artificial
  CRISPR gRNA sequence
tactcactttttactactct

SEQ ID NO: 631009 - DNA, 20 bp, Artificial
  CRISPR gRNA sequence
ctcactttttactactctca

SEQ ID NO: 631010 - DNA, 20 bp, Artificial
  CRISPR gRNA sequence
actttttactactctcatta

SEQ ID NO: 631011 - DNA, 20 bp, Artificial
  CRISPR gRNA sequence
tttactactctcattactat

SEQ ID NO: 631012 - DNA, 20 bp, Artificial
  CRISPR gRNA sequence
ttactactctcattactatc

SEQ ID NO: 631013 - DNA, 20 bp, Artificial
  CRISPR gRNA sequence
tactactctcattactatcc

SEQ ID NO: 631014 - DNA, 20 bp, Artificial
  CRISPR gRNA sequence
actactctcattactatccc

SEQ ID NO: 631015 - DNA, 20 bp, Artificial
  CRISPR gRNA sequence
ctactctcattactatccca

SEQ ID NO: 631016 - DNA, 20 bp, Artificial
  CRISPR gRNA sequence
ctctcattactatcccatct

SEQ ID NO: 631017 - DNA, 20 bp, Artificial
  CRISPR gRNA sequence
tcattactatcccatctgct

SEQ ID NO: 631018 - DNA, 20 bp, Artificial
  CRISPR gRNA sequence
attactatcccatctgcttt

SEQ ID NO: 631019 - DNA, 20 bp, Artificial
  CRISPR gRNA sequence
ctatcccatctgctttattt

SEQ ID NO: 631020 - DNA, 20 bp, Artificial
  CRISPR gRNA sequence
tcccatctgctttatttcag

SEQ ID NO: 631021 - DNA, 20 bp, Artificial
  CRISPR gRNA sequence
ctttatttcagcttctccca

SEQ ID NO: 631022 - DNA, 20 bp, Artificial
  CRISPR gRNA sequence
tatttcagcttctcccattt

SEQ ID NO: 631023 - DNA, 20 bp, Artificial
  CRISPR gRNA sequence
atttcagcttctcccatttt

SEQ ID NO: 631024 - DNA, 20 bp, Artificial
  CRISPR gRNA sequence
tttcagcttctcccattttg

SEQ ID NO: 631025 - DNA, 20 bp, Artificial
  CRISPR gRNA sequence
cagcttctcccattttgtcc

SEQ ID NO: 631026 - DNA, 20 bp, Artificial
  CRISPR gRNA sequence
agcttctcccattttgtcct

SEQ ID NO: 631027 - DNA, 20 bp, Artificial
  CRISPR gRNA sequence
ctcccattttgtcctctatt

SEQ ID NO: 631028 - DNA, 20 bp, Artificial
  CRISPR gRNA sequence
tcccattttgtcctctattt

SEQ ID NO: 631029 - DNA, 20 bp, Artificial
  CRISPR gRNA sequence
ccattttgtcctctatttta

SEQ ID NO: 631030 - DNA, 20 bp, Artificial
  CRISPR gRNA sequence
tgtcctctattttaaagcat

SEQ ID NO: 631031 - DNA, 20 bp, Artificial
  CRISPR gRNA sequence
gtcctctattttaaagcatc

SEQ ID NO: 631032 - DNA, 20 bp, Artificial
  CRISPR gRNA sequence
tcctctattttaaagcatca

SEQ ID NO: 631033 - DNA, 20 bp, Artificial
  CRISPR gRNA sequence
tattttaaagcatcactcct

SEQ ID NO: 631034 - DNA, 20 bp, Artificial
  CRISPR gRNA sequence
ttttaaagcatcactccttc

SEQ ID NO: 631035 - DNA, 20 bp, Artificial
  CRISPR gRNA sequence
taaagcatcactccttcctc

SEQ ID NO: 631036 - DNA, 20 bp, Artificial
  CRISPR gRNA sequence
aaagcatcactccttcctct

SEQ ID NO: 631037 - DNA, 20 bp, Artificial
  CRISPR gRNA sequence
aagcatcactccttcctctt

SEQ ID NO: 631038 - DNA, 20 bp, Artificial
  CRISPR gRNA sequence
cttcctcttcatcccatcat

SEQ ID NO: 631039 - DNA, 20 bp, Artificial
  CRISPR gRNA sequence
cctcttcatcccatcattga

SEQ ID NO: 631040 - DNA, 20 bp, Artificial
  CRISPR gRNA sequence
ctcttcatcccatcattgag

SEQ ID NO: 631041 - DNA, 20 bp, Artificial
  CRISPR gRNA sequence
ttcatcccatcattgagtcc

SEQ ID NO: 631042 - DNA, 20 bp, Artificial
  CRISPR gRNA sequence
catcccatcattgagtccaa

SEQ ID NO: 631043 - DNA, 20 bp, Artificial
  CRISPR gRNA sequence
atcccatcattgagtccaac

SEQ ID NO: 631044 - DNA, 20 bp, Artificial
  CRISPR gRNA sequence
agtccaacagggatctgagt

SEQ ID NO: 631045 - DNA, 20 bp, Artificial
  CRISPR gRNA sequence
agttgggctttgttctaaat

SEQ ID NO: 631046 - DNA, 20 bp, Artificial
  CRISPR gRNA sequence
ggctttgttctaaatgtata

SEQ ID NO: 631047 - DNA, 20 bp, Artificial
  CRISPR gRNA sequence
tgttctaaatgtataaccct

SEQ ID NO: 631048 - DNA, 20 bp, Artificial
  CRISPR gRNA sequence
gttctaaatgtataacccta

SEQ ID NO: 631049 - DNA, 20 bp, Artificial
  CRISPR gRNA sequence
ttctaaatgtataaccctaa

SEQ ID NO: 631050 - DNA, 20 bp, Artificial
  CRISPR gRNA sequence
taaatgtataaccctaattt

SEQ ID NO: 631051 - DNA, 20 bp, Artificial
  CRISPR gRNA sequence
aatgtataaccctaattttc

SEQ ID NO: 631052 - DNA, 20 bp, Artificial
  CRISPR gRNA sequence
attttcccaactcttcatct

SEQ ID NO: 631053 - DNA, 20 bp, Artificial
  CRISPR gRNA sequence
tcccaactcttcatctccat

SEQ ID NO: 631054 - DNA, 20 bp, Artificial
  CRISPR gRNA sequence
cccaactcttcatctccatt

SEQ ID NO: 631055 - DNA, 20 bp, Artificial
  CRISPR gRNA sequence
ccaactcttcatctccattc

SEQ ID NO: 631056 - DNA, 20 bp, Artificial
  CRISPR gRNA sequence
ttcatctccattctattcca

SEQ ID NO: 631057 - DNA, 20 bp, Artificial
  CRISPR gRNA sequence
catctccattctattccagc

SEQ ID NO: 631058 - DNA, 20 bp, Artificial
  CRISPR gRNA sequence
atctccattctattccagca

SEQ ID NO: 631059 - DNA, 20 bp, Artificial
  CRISPR gRNA sequence
cattctattccagcaaccca

SEQ ID NO: 631060 - DNA, 20 bp, Artificial
  CRISPR gRNA sequence
tattccagcaacccaattat

SEQ ID NO: 631061 - DNA, 20 bp, Artificial
  CRISPR gRNA sequence
ttccagcaacccaattatta

SEQ ID NO: 631062 - DNA, 20 bp, Artificial
  CRISPR gRNA sequence
cagcaacccaattattaggt

SEQ ID NO: 631063 - DNA, 20 bp, Artificial
  CRISPR gRNA sequence
ttaggtgacatgttggattt

SEQ ID NO: 631064 - DNA, 20 bp, Artificial
  CRISPR gRNA sequence
ggtgacatgttggatttgga

SEQ ID NO: 631065 - DNA, 20 bp, Artificial
  CRISPR gRNA sequence
gatttggacatttcttaaaa

SEQ ID NO: 631066 - DNA, 20 bp, Artificial
  CRISPR gRNA sequence
ggacatttcttaaaactatt

SEQ ID NO: 631067 - DNA, 20 bp, Artificial
  CRISPR gRNA sequence
gacatttcttaaaactattc

SEQ ID NO: 631068 - DNA, 20 bp, Artificial
  CRISPR gRNA sequence
cttaaaactattctatttcc

SEQ ID NO: 631069 - DNA, 20 bp, Artificial
  CRISPR gRNA sequence
ttaaaactattctatttcca

SEQ ID NO: 631070 - DNA, 20 bp, Artificial
  CRISPR gRNA sequence
aaaactattctatttccaat

SEQ ID NO: 631071 - DNA, 20 bp, Artificial
  CRISPR gRNA sequence
aaactattctatttccaata

SEQ ID NO: 631072 - DNA, 20 bp, Artificial
  CRISPR gRNA sequence
ttctatttccaataaatttg

SEQ ID NO: 631073 - DNA, 20 bp, Artificial
  CRISPR gRNA sequence
tatttccaataaatttgctc

SEQ ID NO: 631074 - DNA, 20 bp, Artificial
  CRISPR gRNA sequence
tttccaataaatttgctctg

SEQ ID NO: 631075 - DNA, 20 bp, Artificial
  CRISPR gRNA sequence
ccaataaatttgctctggag

SEQ ID NO: 631076 - DNA, 20 bp, Artificial
  CRISPR gRNA sequence
caataaatttgctctggaga

SEQ ID NO: 631077 - DNA, 20 bp, Artificial
  CRISPR gRNA sequence
gctctggagacaatctatcc

SEQ ID NO: 631078 - DNA, 20 bp, Artificial
  CRISPR gRNA sequence
ctctggagacaatctatcct

SEQ ID NO: 631079 - DNA, 20 bp, Artificial
  CRISPR gRNA sequence
tggagacaatctatcctttt

SEQ ID NO: 631080 - DNA, 20 bp, Artificial
  CRISPR gRNA sequence
gagacaatctatccttttac

SEQ ID NO: 631081 - DNA, 20 bp, Artificial
  CRISPR gRNA sequence
tccttttacctctctcattc

SEQ ID NO: 631082 - DNA, 20 bp, Artificial
  CRISPR gRNA sequence
ttacctctctcattcattca

SEQ ID NO: 631083 - DNA, 20 bp, Artificial
  CRISPR gRNA sequence
tacctctctcattcattcaa

SEQ ID NO: 631084 - DNA, 20 bp, Artificial
  CRISPR gRNA sequence
acctctctcattcattcaat

SEQ ID NO: 631085 - DNA, 20 bp, Artificial
  CRISPR gRNA sequence
cctctctcattcattcaata

SEQ ID NO: 631086 - DNA, 20 bp, Artificial
  CRISPR gRNA sequence
tctcattcattcaataacag

SEQ ID NO: 631087 - DNA, 20 bp, Artificial
  CRISPR gRNA sequence
tcattcattcaataacagac

SEQ ID NO: 631088 - DNA, 20 bp, Artificial
  CRISPR gRNA sequence
attcattcaataacagacta

SEQ ID NO: 631089 - DNA, 20 bp, Artificial
  CRISPR gRNA sequence
attcaataacagactactat

SEQ ID NO: 631090 - DNA, 20 bp, Artificial
  CRISPR gRNA sequence
aataacagactactatgtac

SEQ ID NO: 631091 - DNA, 20 bp, Artificial
  CRISPR gRNA sequence
ctatgtaccaatgctcatga

SEQ ID NO: 631092 - DNA, 20 bp, Artificial
  CRISPR gRNA sequence
tgtaccaatgctcatgaggc

SEQ ID NO: 631093 - DNA, 20 bp, Artificial
  CRISPR gRNA sequence
atgaggctaaaatgtaaagt

SEQ ID NO: 631094 - DNA, 20 bp, Artificial
  CRISPR gRNA sequence
aaatgtaaagtggaaaacaa

SEQ ID NO: 631095 - DNA, 20 bp, Artificial
  CRISPR gRNA sequence
ccatggtgcctatccgtatg

SEQ ID NO: 631096 - DNA, 20 bp, Artificial
  CRISPR gRNA sequence
tccgtatgcaactgacagtc

SEQ ID NO: 631097 - DNA, 20 bp, Artificial
  CRISPR gRNA sequence
acagtctggtgaggcagaca

SEQ ID NO: 631098 - DNA, 20 bp, Artificial
  CRISPR gRNA sequence
gtgaggcagacagacattta

SEQ ID NO: 631099 - DNA, 20 bp, Artificial
  CRISPR gRNA sequence
aaaaaatacacaagcaatgt

SEQ ID NO: 631100 - DNA, 20 bp, Artificial
  CRISPR gRNA sequence
aaaaatacacaagcaatgta

SEQ ID NO: 631101 - DNA, 20 bp, Artificial
  CRISPR gRNA sequence
caaattgtgggcagttgcat

SEQ ID NO: 631102 - DNA, 20 bp, Artificial
  CRISPR gRNA sequence
tgggcagttgcatggagcaa

SEQ ID NO: 631103 - DNA, 20 bp, Artificial
  CRISPR gRNA sequence
catggagcaaaagaatggtg

SEQ ID NO: 631104 - DNA, 20 bp, Artificial
  CRISPR gRNA sequence
gtttgaaaaggttgaacaag

SEQ ID NO: 631105 - DNA, 20 bp, Artificial
  CRISPR gRNA sequence
gaaaaggttgaacaagaagg

SEQ ID NO: 631106 - DNA, 20 bp, Artificial
  CRISPR gRNA sequence
aaaaggttgaacaagaaggt

SEQ ID NO: 631107 - DNA, 20 bp, Artificial
  CRISPR gRNA sequence
aacaagaaggtctgtttgaa

SEQ ID NO: 631108 - DNA, 20 bp, Artificial
  CRISPR gRNA sequence
tttgaagtaggaacatttca

SEQ ID NO: 631109 - DNA, 20 bp, Artificial
  CRISPR gRNA sequence
gaagtaggaacatttcaggt

SEQ ID NO: 631110 - DNA, 20 bp, Artificial
  CRISPR gRNA sequence
aagtaggaacatttcaggtg

SEQ ID NO: 631111 - DNA, 20 bp, Artificial
  CRISPR gRNA sequence
caggtgacaactgaagaaaa

SEQ ID NO: 631112 - DNA, 20 bp, Artificial
  CRISPR gRNA sequence
aggtgacaactgaagaaaaa

SEQ ID NO: 631113 - DNA, 20 bp, Artificial
  CRISPR gRNA sequence
aagaaaaagtagtcattata

SEQ ID NO: 631114 - DNA, 20 bp, Artificial
  CRISPR gRNA sequence
tataattggggagtgagggt

SEQ ID NO: 631115 - DNA, 20 bp, Artificial
  CRISPR gRNA sequence
gggagtgagggtggaaaggc

SEQ ID NO: 631116 - DNA, 20 bp, Artificial
  CRISPR gRNA sequence
caggatttctgagacctgta

SEQ ID NO: 631117 - DNA, 20 bp, Artificial
  CRISPR gRNA sequence
aggatttctgagacctgtag

SEQ ID NO: 631118 - DNA, 20 bp, Artificial
  CRISPR gRNA sequence
ctgagacctgtagtcattta

SEQ ID NO: 631119 - DNA, 20 bp, Artificial
  CRISPR gRNA sequence
tgagacctgtagtcatttat

SEQ ID NO: 631120 - DNA, 20 bp, Artificial
  CRISPR gRNA sequence
agacctgtagtcatttattt

SEQ ID NO: 631121 - DNA, 20 bp, Artificial
  CRISPR gRNA sequence
tagtcatttattttcctcta

SEQ ID NO: 631122 - DNA, 20 bp, Artificial
  CRISPR gRNA sequence
attttcctctatatacttag

SEQ ID NO: 631123 - DNA, 20 bp, Artificial
  CRISPR gRNA sequence
ttttcctctatatacttagc

SEQ ID NO: 631124 - DNA, 20 bp, Artificial
  CRISPR gRNA sequence
tcctctatatacttagctcc

SEQ ID NO: 631125 - DNA, 20 bp, Artificial
  CRISPR gRNA sequence
cctctatatacttagctcct

SEQ ID NO: 631126 - DNA, 20 bp, Artificial
  CRISPR gRNA sequence
ctctatatacttagctcctt

SEQ ID NO: 631127 - DNA, 20 bp, Artificial
  CRISPR gRNA sequence
tatatacttagctccttcaa

SEQ ID NO: 631128 - DNA, 20 bp, Artificial
  CRISPR gRNA sequence
tatacttagctccttcaaag

SEQ ID NO: 631129 - DNA, 20 bp, Artificial
  CRISPR gRNA sequence
agctccttcaaagtctacat

SEQ ID NO: 631130 - DNA, 20 bp, Artificial
  CRISPR gRNA sequence
gctccttcaaagtctacatt

SEQ ID NO: 631131 - DNA, 20 bp, Artificial
  CRISPR gRNA sequence
cttcaaagtctacattctgc

SEQ ID NO: 631132 - DNA, 20 bp, Artificial
  CRISPR gRNA sequence
caaagtctacattctgccct

SEQ ID NO: 631133 - DNA, 20 bp, Artificial
  CRISPR gRNA sequence
aaagtctacattctgccctt

SEQ ID NO: 631134 - DNA, 20 bp, Artificial
  CRISPR gRNA sequence
cattctgcccttactactcc

SEQ ID NO: 631135 - DNA, 20 bp, Artificial
  CRISPR gRNA sequence
tgcccttactactcctttga

SEQ ID NO: 631136 - DNA, 20 bp, Artificial
  CRISPR gRNA sequence
cccttactactcctttgaaa

SEQ ID NO: 631137 - DNA, 20 bp, Artificial
  CRISPR gRNA sequence
actactcctttgaaaattgt

SEQ ID NO: 631138 - DNA, 20 bp, Artificial
  CRISPR gRNA sequence
ctactcctttgaaaattgtt

SEQ ID NO: 631139 - DNA, 20 bp, Artificial
  CRISPR gRNA sequence
ctcctttgaaaattgttttc

SEQ ID NO: 631140 - DNA, 20 bp, Artificial
  CRISPR gRNA sequence
ctttgaaaattgttttcaga

SEQ ID NO: 631141 - DNA, 20 bp, Artificial
  CRISPR gRNA sequence
tgaaaattgttttcagacat

SEQ ID NO: 631142 - DNA, 20 bp, Artificial
  CRISPR gRNA sequence
gaaaattgttttcagacatt

SEQ ID NO: 631143 - DNA, 20 bp, Artificial
  CRISPR gRNA sequence
aaaattgttttcagacattg

SEQ ID NO: 631144 - DNA, 20 bp, Artificial
  CRISPR gRNA sequence
ttttcagacattgccaacaa

SEQ ID NO: 631145 - DNA, 20 bp, Artificial
  CRISPR gRNA sequence
tcagacattgccaacaatcc

SEQ ID NO: 631146 - DNA, 20 bp, Artificial
  CRISPR gRNA sequence
cagacattgccaacaatccc

SEQ ID NO: 631147 - DNA, 20 bp, Artificial
  CRISPR gRNA sequence
agacattgccaacaatccct

SEQ ID NO: 631148 - DNA, 20 bp, Artificial
  CRISPR gRNA sequence
ccaacaatccctgcaaattc

SEQ ID NO: 631149 - DNA, 20 bp, Artificial
  CRISPR gRNA sequence
caaattcaatggctctgcta

SEQ ID NO: 631150 - DNA, 20 bp, Artificial
  CRISPR gRNA sequence
aatggctctgctatctccac

SEQ ID NO: 631151 - DNA, 20 bp, Artificial
  CRISPR gRNA sequence
tgctatctccacaagaccat

SEQ ID NO: 631152 - DNA, 20 bp, Artificial
  CRISPR gRNA sequence
ctatctccacaagaccattt

SEQ ID NO: 631153 - DNA, 20 bp, Artificial
  CRISPR gRNA sequence
tctccacaagaccattttct

SEQ ID NO: 631154 - DNA, 20 bp, Artificial
  CRISPR gRNA sequence
cacaagaccattttctatcc

SEQ ID NO: 631155 - DNA, 20 bp, Artificial
  CRISPR gRNA sequence
tctatccatttcatactatt

SEQ ID NO: 631156 - DNA, 20 bp, Artificial
  CRISPR gRNA sequence
ctatccatttcatactattt

SEQ ID NO: 631157 - DNA, 20 bp, Artificial
  CRISPR gRNA sequence
tatccatttcatactatttc

SEQ ID NO: 631158 - DNA, 20 bp, Artificial
  CRISPR gRNA sequence
tccatttcatactatttctt

SEQ ID NO: 631159 - DNA, 20 bp, Artificial
  CRISPR gRNA sequence
catactatttcttaaaaata

SEQ ID NO: 631160 - DNA, 20 bp, Artificial
  CRISPR gRNA sequence
atactatttcttaaaaataa

SEQ ID NO: 631161 - DNA, 20 bp, Artificial
  CRISPR gRNA sequence
tttcttaaaaataaagttca

SEQ ID NO: 631162 - DNA, 20 bp, Artificial
  CRISPR gRNA sequence
cttaaaaataaagttcataa

SEQ ID NO: 631163 - DNA, 20 bp, Artificial
  CRISPR gRNA sequence
ttaaaaataaagttcataaa

SEQ ID NO: 631164 - DNA, 20 bp, Artificial
  CRISPR gRNA sequence
aaaaataaagttcataaaaa

SEQ ID NO: 631165 - DNA, 20 bp, Artificial
  CRISPR gRNA sequence
aaaataaagttcataaaaat

SEQ ID NO: 631166 - DNA, 20 bp, Artificial
  CRISPR gRNA sequence
ataaaaatattgtttatact

SEQ ID NO: 631167 - DNA, 20 bp, Artificial
  CRISPR gRNA sequence
tttatacttactccctatac

SEQ ID NO: 631168 - DNA, 20 bp, Artificial
  CRISPR gRNA sequence
atacttactccctatacatg

SEQ ID NO: 631169 - DNA, 20 bp, Artificial
  CRISPR gRNA sequence
tacttactccctatacatgt

SEQ ID NO: 631170 - DNA, 20 bp, Artificial
  CRISPR gRNA sequence
actccctatacatgtgttta

SEQ ID NO: 631171 - DNA, 20 bp, Artificial
  CRISPR gRNA sequence
ctccctatacatgtgtttat

SEQ ID NO: 631172 - DNA, 20 bp, Artificial
  CRISPR gRNA sequence
cctatacatgtgtttatctg

SEQ ID NO: 631173 - DNA, 20 bp, Artificial
  CRISPR gRNA sequence
tacatgtgtttatctgtaca

SEQ ID NO: 631174 - DNA, 20 bp, Artificial
  CRISPR gRNA sequence
atctgtacatgagtttatct

SEQ ID NO: 631175 - DNA, 20 bp, Artificial
  CRISPR gRNA sequence
tctgtacatgagtttatctt

SEQ ID NO: 631176 - DNA, 20 bp, Artificial
  CRISPR gRNA sequence
tacatgagtttatctttaaa

SEQ ID NO: 631177 - DNA, 20 bp, Artificial
  CRISPR gRNA sequence
atctttaaagtaatacataa

SEQ ID NO: 631178 - DNA, 20 bp, Artificial
  CRISPR gRNA sequence
tctttaaagtaatacataat

SEQ ID NO: 631179 - DNA, 20 bp, Artificial
  CRISPR gRNA sequence
taaagtaatacataattaat

SEQ ID NO: 631180 - DNA, 20 bp, Artificial
  CRISPR gRNA sequence
aaagtaatacataattaata

SEQ ID NO: 631181 - DNA, 20 bp, Artificial
  CRISPR gRNA sequence
aagtaatacataattaatac

SEQ ID NO: 631182 - DNA, 20 bp, Artificial
  CRISPR gRNA sequence
atacatataacatatatatt

SEQ ID NO: 631183 - DNA, 20 bp, Artificial
  CRISPR gRNA sequence
atataaaaggaccaatattt

SEQ ID NO: 631184 - DNA, 20 bp, Artificial
  CRISPR gRNA sequence
cactacctttatttttataa

SEQ ID NO: 631185 - DNA, 20 bp, Artificial
  CRISPR gRNA sequence
actacctttatttttataat

SEQ ID NO: 631186 - DNA, 20 bp, Artificial
  CRISPR gRNA sequence
cctttatttttataatagtt

SEQ ID NO: 631187 - DNA, 20 bp, Artificial
  CRISPR gRNA sequence
tatttttataatagttatta

SEQ ID NO: 631188 - DNA, 20 bp, Artificial
  CRISPR gRNA sequence
atttttataatagttattat

SEQ ID NO: 631189 - DNA, 20 bp, Artificial
  CRISPR gRNA sequence
tttttataatagttattatt

SEQ ID NO: 631190 - DNA, 20 bp, Artificial
  CRISPR gRNA sequence
ttataatagttattattatt

SEQ ID NO: 631191 - DNA, 20 bp, Artificial
  CRISPR gRNA sequence
tataatagttattattatta

SEQ ID NO: 631192 - DNA, 20 bp, Artificial
  CRISPR gRNA sequence
ataatagttattattattat

SEQ ID NO: 631193 - DNA, 20 bp, Artificial
  CRISPR gRNA sequence
taatagttattattattatt

SEQ ID NO: 631194 - DNA, 20 bp, Artificial
  CRISPR gRNA sequence
ttattattattacttcatat

SEQ ID NO: 631195 - DNA, 20 bp, Artificial
  CRISPR gRNA sequence
ttattattacttcatattgt

SEQ ID NO: 631196 - DNA, 20 bp, Artificial
  CRISPR gRNA sequence
ttattacttcatattgttac

SEQ ID NO: 631197 - DNA, 20 bp, Artificial
  CRISPR gRNA sequence
ttacttcatattgttaccaa

SEQ ID NO: 631198 - DNA, 20 bp, Artificial
  CRISPR gRNA sequence
cttcatattgttaccaactg

SEQ ID NO: 631199 - DNA, 20 bp, Artificial
  CRISPR gRNA sequence
catattgttaccaactgaag

SEQ ID NO: 631200 - DNA, 20 bp, Artificial
  CRISPR gRNA sequence
atattgttaccaactgaagc

SEQ ID NO: 631201 - DNA, 20 bp, Artificial
  CRISPR gRNA sequence
ttaccaactgaagcggactt

SEQ ID NO: 631202 - DNA, 20 bp, Artificial
  CRISPR gRNA sequence
ccaactgaagcggacttttt

SEQ ID NO: 631203 - DNA, 20 bp, Artificial
  CRISPR gRNA sequence
aagcggactttttctgctat

SEQ ID NO: 631204 - DNA, 20 bp, Artificial
  CRISPR gRNA sequence
tttctgctattattgaaaca

SEQ ID NO: 631205 - DNA, 20 bp, Artificial
  CRISPR gRNA sequence
ttctgctattattgaaacat

SEQ ID NO: 631206 - DNA, 20 bp, Artificial
  CRISPR gRNA sequence
tctgctattattgaaacatt

SEQ ID NO: 631207 - DNA, 20 bp, Artificial
  CRISPR gRNA sequence
ctgctattattgaaacattt

SEQ ID NO: 631208 - DNA, 20 bp, Artificial
  CRISPR gRNA sequence
tgctattattgaaacatttt

SEQ ID NO: 631209 - DNA, 20 bp, Artificial
  CRISPR gRNA sequence
ctattattgaaacatttttg

SEQ ID NO: 631210 - DNA, 20 bp, Artificial
  CRISPR gRNA sequence
ttattgaaacatttttgaaa

SEQ ID NO: 631211 - DNA, 20 bp, Artificial
  CRISPR gRNA sequence
ttgaaacatttttgaaaagt

SEQ ID NO: 631212 - DNA, 20 bp, Artificial
  CRISPR gRNA sequence
aaacatttttgaaaagtcag

SEQ ID NO: 631213 - DNA, 20 bp, Artificial
  CRISPR gRNA sequence
ttgaaaagtcagtggtctct

SEQ ID NO: 631214 - DNA, 20 bp, Artificial
  CRISPR gRNA sequence
tgaaaagtcagtggtctctg

SEQ ID NO: 631215 - DNA, 20 bp, Artificial
  CRISPR gRNA sequence
gaaaagtcagtggtctctga

SEQ ID NO: 631216 - DNA, 20 bp, Artificial
  CRISPR gRNA sequence
aaaagtcagtggtctctgaa

SEQ ID NO: 631217 - DNA, 20 bp, Artificial
  CRISPR gRNA sequence
tgaatcactaaatccatagg

SEQ ID NO: 631218 - DNA, 20 bp, Artificial
  CRISPR gRNA sequence
aatcactaaatccataggct

SEQ ID NO: 631219 - DNA, 20 bp, Artificial
  CRISPR gRNA sequence
aatccataggcttttattaa

SEQ ID NO: 631220 - DNA, 20 bp, Artificial
  CRISPR gRNA sequence
ttattaatcctctgtcttcc

SEQ ID NO: 631221 - DNA, 20 bp, Artificial
  CRISPR gRNA sequence
tattaatcctctgtcttcct

SEQ ID NO: 631222 - DNA, 20 bp, Artificial
  CRISPR gRNA sequence
attaatcctctgtcttccta

SEQ ID NO: 631223 - DNA, 20 bp, Artificial
  CRISPR gRNA sequence
ttaatcctctgtcttcctaa

SEQ ID NO: 631224 - DNA, 20 bp, Artificial
  CRISPR gRNA sequence
atcctctgtcttcctaatct

SEQ ID NO: 631225 - DNA, 20 bp, Artificial
  CRISPR gRNA sequence
tgtcttcctaatctcttggc

SEQ ID NO: 631226 - DNA, 20 bp, Artificial
  CRISPR gRNA sequence
tcttcctaatctcttggcca

SEQ ID NO: 631227 - DNA, 20 bp, Artificial
  CRISPR gRNA sequence
cctaatctcttggccactat

SEQ ID NO: 631228 - DNA, 20 bp, Artificial
  CRISPR gRNA sequence
ctaatctcttggccactatc

SEQ ID NO: 631229 - DNA, 20 bp, Artificial
  CRISPR gRNA sequence
atctcttggccactatcaag

SEQ ID NO: 631230 - DNA, 20 bp, Artificial
  CRISPR gRNA sequence
ttggccactatcaagctttc

SEQ ID NO: 631231 - DNA, 20 bp, Artificial
  CRISPR gRNA sequence
ggccactatcaagctttctt

SEQ ID NO: 631232 - DNA, 20 bp, Artificial
  CRISPR gRNA sequence
gccactatcaagctttcttg

SEQ ID NO: 631233 - DNA, 20 bp, Artificial
  CRISPR gRNA sequence
tcaagctttcttgtgtcttg

SEQ ID NO: 631234 - DNA, 20 bp, Artificial
  CRISPR gRNA sequence
tcttgtgtcttgggtctcct

SEQ ID NO: 631235 - DNA, 20 bp, Artificial
  CRISPR gRNA sequence
cttgtgtcttgggtctcctg

SEQ ID NO: 631236 - DNA, 20 bp, Artificial
  CRISPR gRNA sequence
ttgtgtcttgggtctcctgt

SEQ ID NO: 631237 - DNA, 20 bp, Artificial
  CRISPR gRNA sequence
gtgtcttgggtctcctgttt

SEQ ID NO: 631238 - DNA, 20 bp, Artificial
  CRISPR gRNA sequence
tgtcttgggtctcctgtttt

SEQ ID NO: 631239 - DNA, 20 bp, Artificial
  CRISPR gRNA sequence
gggtctcctgttttagcgtc

SEQ ID NO: 631240 - DNA, 20 bp, Artificial
  CRISPR gRNA sequence
ggtctcctgttttagcgtct

SEQ ID NO: 631241 - DNA, 20 bp, Artificial
  CRISPR gRNA sequence
ctgttttagcgtctgagatc

SEQ ID NO: 631242 - DNA, 20 bp, Artificial
  CRISPR gRNA sequence
ttttagcgtctgagatcaga

SEQ ID NO: 631243 - DNA, 20 bp, Artificial
  CRISPR gRNA sequence
tagcgtctgagatcagatcc

SEQ ID NO: 631244 - DNA, 20 bp, Artificial
  CRISPR gRNA sequence
agcgtctgagatcagatcct

SEQ ID NO: 631245 - DNA, 20 bp, Artificial
  CRISPR gRNA sequence
gcgtctgagatcagatccta

SEQ ID NO: 631246 - DNA, 20 bp, Artificial
  CRISPR gRNA sequence
agatcagatcctacattcgc

SEQ ID NO: 631247 - DNA, 20 bp, Artificial
  CRISPR gRNA sequence
cattcgccctcactgcttct

SEQ ID NO: 631248 - DNA, 20 bp, Artificial
  CRISPR gRNA sequence
gccctcactgcttctcagtt

SEQ ID NO: 631249 - DNA, 20 bp, Artificial
  CRISPR gRNA sequence
actgcttctcagttttttcc

SEQ ID NO: 631250 - DNA, 20 bp, Artificial
  CRISPR gRNA sequence
cttctcagttttttcctaac

SEQ ID NO: 631251 - DNA, 20 bp, Artificial
  CRISPR gRNA sequence
ctcagttttttcctaacttg

SEQ ID NO: 631252 - DNA, 20 bp, Artificial
  CRISPR gRNA sequence
tcagttttttcctaacttgc

SEQ ID NO: 631253 - DNA, 20 bp, Artificial
  CRISPR gRNA sequence
agttttttcctaacttgcaa

SEQ ID NO: 631254 - DNA, 20 bp, Artificial
  CRISPR gRNA sequence
tttcctaacttgcaaatatg

SEQ ID NO: 631255 - DNA, 20 bp, Artificial
  CRISPR gRNA sequence
ttcctaacttgcaaatatgt

SEQ ID NO: 631256 - DNA, 20 bp, Artificial
  CRISPR gRNA sequence
tcctaacttgcaaatatgtt

SEQ ID NO: 631257 - DNA, 20 bp, Artificial
  CRISPR gRNA sequence
cctaacttgcaaatatgtta

SEQ ID NO: 631258 - DNA, 20 bp, Artificial
  CRISPR gRNA sequence
ctaacttgcaaatatgttat

SEQ ID NO: 631259 - DNA, 20 bp, Artificial
  CRISPR gRNA sequence
acttgcaaatatgttatatg

SEQ ID NO: 631260 - DNA, 20 bp, Artificial
  CRISPR gRNA sequence
gcaaatatgttatatgcatc

SEQ ID NO: 631261 - DNA, 20 bp, Artificial
  CRISPR gRNA sequence
caaatatgttatatgcatcc

SEQ ID NO: 631262 - DNA, 20 bp, Artificial
  CRISPR gRNA sequence
tatgcatcccttcagatatt

SEQ ID NO: 631263 - DNA, 20 bp, Artificial
  CRISPR gRNA sequence
cagatattgttctcagtaca

SEQ ID NO: 631264 - DNA, 20 bp, Artificial
  CRISPR gRNA sequence
agatattgttctcagtacaa

SEQ ID NO: 631265 - DNA, 20 bp, Artificial
  CRISPR gRNA sequence
ttctcagtacaatgttctcc

SEQ ID NO: 631266 - DNA, 20 bp, Artificial
  CRISPR gRNA sequence
tcagtacaatgttctccctc

SEQ ID NO: 631267 - DNA, 20 bp, Artificial
  CRISPR gRNA sequence
agtacaatgttctccctctt

SEQ ID NO: 631268 - DNA, 20 bp, Artificial
  CRISPR gRNA sequence
tccctctttgctctctaaat

SEQ ID NO: 631269 - DNA, 20 bp, Artificial
  CRISPR gRNA sequence
cctctttgctctctaaatga

SEQ ID NO: 631270 - DNA, 20 bp, Artificial
  CRISPR gRNA sequence
tttgctctctaaatgaagtg

SEQ ID NO: 631271 - DNA, 20 bp, Artificial
  CRISPR gRNA sequence
tgctctctaaatgaagtgct

SEQ ID NO: 631272 - DNA, 20 bp, Artificial
  CRISPR gRNA sequence
gctctctaaatgaagtgctc

SEQ ID NO: 631273 - DNA, 20 bp, Artificial
  CRISPR gRNA sequence
ctctctaaatgaagtgctca

SEQ ID NO: 631274 - DNA, 20 bp, Artificial
  CRISPR gRNA sequence
tctaaatgaagtgctcattt

SEQ ID NO: 631275 - DNA, 20 bp, Artificial
  CRISPR gRNA sequence
taaatgaagtgctcattttt

SEQ ID NO: 631276 - DNA, 20 bp, Artificial
  CRISPR gRNA sequence
aatgaagtgctcatttttat

SEQ ID NO: 631277 - DNA, 20 bp, Artificial
  CRISPR gRNA sequence
atttttatgaaacatccaca

SEQ ID NO: 631278 - DNA, 20 bp, Artificial
  CRISPR gRNA sequence
ttatgaaacatccacatcag

SEQ ID NO: 631279 - DNA, 20 bp, Artificial
  CRISPR gRNA sequence
tatgaaacatccacatcagg

SEQ ID NO: 631280 - DNA, 20 bp, Artificial
  CRISPR gRNA sequence
atgaaacatccacatcaggt

SEQ ID NO: 631281 - DNA, 20 bp, Artificial
  CRISPR gRNA sequence
tgaaacatccacatcaggtc

SEQ ID NO: 631282 - DNA, 20 bp, Artificial
  CRISPR gRNA sequence
cccatgtttgtaagctccaa

SEQ ID NO: 631283 - DNA, 20 bp, Artificial
  CRISPR gRNA sequence
ccatgtttgtaagctccaac

SEQ ID NO: 631284 - DNA, 20 bp, Artificial
  CRISPR gRNA sequence
gtaagctccaactggccatg

SEQ ID NO: 631285 - DNA, 20 bp, Artificial
  CRISPR gRNA sequence
taagctccaactggccatgt

SEQ ID NO: 631286 - DNA, 20 bp, Artificial
  CRISPR gRNA sequence
caactggccatgtacatctt

SEQ ID NO: 631287 - DNA, 20 bp, Artificial
  CRISPR gRNA sequence
gccatgtacatctttcaatg

SEQ ID NO: 631288 - DNA, 20 bp, Artificial
  CRISPR gRNA sequence
tcaatgtctgagtgaatccc

SEQ ID NO: 631289 - DNA, 20 bp, Artificial
  CRISPR gRNA sequence
caatgtctgagtgaatccct

SEQ ID NO: 631290 - DNA, 20 bp, Artificial
  CRISPR gRNA sequence
aatgtctgagtgaatccctt

SEQ ID NO: 631291 - DNA, 20 bp, Artificial
  CRISPR gRNA sequence
agtgaatcccttccctacaa

SEQ ID NO: 631292 - DNA, 20 bp, Artificial
  CRISPR gRNA sequence
ccctacaaccaaaacgaaga

SEQ ID NO: 631293 - DNA, 20 bp, Artificial
  CRISPR gRNA sequence
cctacaaccaaaacgaagag

SEQ ID NO: 631294 - DNA, 20 bp, Artificial
  CRISPR gRNA sequence
caaccaaaacgaagagcatc

SEQ ID NO: 631295 - DNA, 20 bp, Artificial
  CRISPR gRNA sequence
tctcctctgctctcacagaa

SEQ ID NO: 631296 - DNA, 20 bp, Artificial
  CRISPR gRNA sequence
ctctgctctcacagaactct

SEQ ID NO: 631297 - DNA, 20 bp, Artificial
  CRISPR gRNA sequence
tgctctcacagaactctgtt

SEQ ID NO: 631298 - DNA, 20 bp, Artificial
  CRISPR gRNA sequence
ctctcacagaactctgttcg

SEQ ID NO: 631299 - DNA, 20 bp, Artificial
  CRISPR gRNA sequence
tcacagaactctgttcgtac

SEQ ID NO: 631300 - DNA, 20 bp, Artificial
  CRISPR gRNA sequence
acagaactctgttcgtactc

SEQ ID NO: 631301 - DNA, 20 bp, Artificial
  CRISPR gRNA sequence
tgttcgtactctgttgatgc

SEQ ID NO: 631302 - DNA, 20 bp, Artificial
  CRISPR gRNA sequence
ttcgtactctgttgatgcat

SEQ ID NO: 631303 - DNA, 20 bp, Artificial
  CRISPR gRNA sequence
gtactctgttgatgcattac

SEQ ID NO: 631304 - DNA, 20 bp, Artificial
  CRISPR gRNA sequence
tgttgatgcattacttataa

SEQ ID NO: 631305 - DNA, 20 bp, Artificial
  CRISPR gRNA sequence
ttgatgcattacttataaca

SEQ ID NO: 631306 - DNA, 20 bp, Artificial
  CRISPR gRNA sequence
atgcattacttataacaact

SEQ ID NO: 631307 - DNA, 20 bp, Artificial
  CRISPR gRNA sequence
cttataacaactgtgttgta

SEQ ID NO: 631308 - DNA, 20 bp, Artificial
  CRISPR gRNA sequence
ataacaactgtgttgtaatt

SEQ ID NO: 631309 - DNA, 20 bp, Artificial
  CRISPR gRNA sequence
taacaactgtgttgtaatta

SEQ ID NO: 631310 - DNA, 20 bp, Artificial
  CRISPR gRNA sequence
tgttgtaattaaccatcgga

SEQ ID NO: 631311 - DNA, 20 bp, Artificial
  CRISPR gRNA sequence
taattaaccatcggatacct

SEQ ID NO: 631312 - DNA, 20 bp, Artificial
  CRISPR gRNA sequence
accatcggatacctatttat

SEQ ID NO: 631313 - DNA, 20 bp, Artificial
  CRISPR gRNA sequence
tttatttccctagtccaaac

SEQ ID NO: 631314 - DNA, 20 bp, Artificial
  CRISPR gRNA sequence
atttccctagtccaaacgat

SEQ ID NO: 631315 - DNA, 20 bp, Artificial
  CRISPR gRNA sequence
tttccctagtccaaacgatg

SEQ ID NO: 631316 - DNA, 20 bp, Artificial
  CRISPR gRNA sequence
ccctagtccaaacgatgagc

SEQ ID NO: 631317 - DNA, 20 bp, Artificial
  CRISPR gRNA sequence
cctagtccaaacgatgagct

SEQ ID NO: 631318 - DNA, 20 bp, Artificial
  CRISPR gRNA sequence
gtccaaacgatgagcttcat

SEQ ID NO: 631319 - DNA, 20 bp, Artificial
  CRISPR gRNA sequence
catgaggagagagatcttgt

SEQ ID NO: 631320 - DNA, 20 bp, Artificial
  CRISPR gRNA sequence
atgaggagagagatcttgtt

SEQ ID NO: 631321 - DNA, 20 bp, Artificial
  CRISPR gRNA sequence
gttttactcaattttaaatt

SEQ ID NO: 631322 - DNA, 20 bp, Artificial
  CRISPR gRNA sequence
ttttactcaattttaaattg

SEQ ID NO: 631323 - DNA, 20 bp, Artificial
  CRISPR gRNA sequence
tactcaattttaaattgata

SEQ ID NO: 631324 - DNA, 20 bp, Artificial
  CRISPR gRNA sequence
actcaattttaaattgataa

SEQ ID NO: 631325 - DNA, 20 bp, Artificial
  CRISPR gRNA sequence
ctcaattttaaattgataat

SEQ ID NO: 631326 - DNA, 20 bp, Artificial
  CRISPR gRNA sequence
aattttaaattgataataca

SEQ ID NO: 631327 - DNA, 20 bp, Artificial
  CRISPR gRNA sequence
taaattgataatacatatcg

SEQ ID NO: 631328 - DNA, 20 bp, Artificial
  CRISPR gRNA sequence
aaattgataatacatatcga

SEQ ID NO: 631329 - DNA, 20 bp, Artificial
  CRISPR gRNA sequence
aattgataatacatatcgag

SEQ ID NO: 631330 - DNA, 20 bp, Artificial
  CRISPR gRNA sequence
ataatacatatcgagttatt

SEQ ID NO: 631331 - DNA, 20 bp, Artificial
  CRISPR gRNA sequence
ttaaacacaggagacaatat

SEQ ID NO: 631332 - DNA, 20 bp, Artificial
  CRISPR gRNA sequence
aacacaggagacaatatata

SEQ ID NO: 631333 - DNA, 20 bp, Artificial
  CRISPR gRNA sequence
gctgaatgactacttcaaat

SEQ ID NO: 631334 - DNA, 20 bp, Artificial
  CRISPR gRNA sequence
ctgaatgactacttcaaatc

SEQ ID NO: 631335 - DNA, 20 bp, Artificial
  CRISPR gRNA sequence
aatgactacttcaaatccat

SEQ ID NO: 631336 - DNA, 20 bp, Artificial
  CRISPR gRNA sequence
cttcaaatccatacttgcaa

SEQ ID NO: 631337 - DNA, 20 bp, Artificial
  CRISPR gRNA sequence
caaatccatacttgcaactg

SEQ ID NO: 631338 - DNA, 20 bp, Artificial
  CRISPR gRNA sequence
aaatccatacttgcaactgc

SEQ ID NO: 631339 - DNA, 20 bp, Artificial
  CRISPR gRNA sequence
gcaactgccttttgagtctt

SEQ ID NO: 631340 - DNA, 20 bp, Artificial
  CRISPR gRNA sequence
caactgccttttgagtcttg

SEQ ID NO: 631341 - DNA, 20 bp, Artificial
  CRISPR gRNA sequence
ccttttgagtcttgcctcat

SEQ ID NO: 631342 - DNA, 20 bp, Artificial
  CRISPR gRNA sequence
ttgagtcttgcctcatggat

SEQ ID NO: 631343 - DNA, 20 bp, Artificial
  CRISPR gRNA sequence
tgagtcttgcctcatggata

SEQ ID NO: 631344 - DNA, 20 bp, Artificial
  CRISPR gRNA sequence
gagtcttgcctcatggatat

SEQ ID NO: 631345 - DNA, 20 bp, Artificial
  CRISPR gRNA sequence
agtcttgcctcatggatatt

SEQ ID NO: 631346 - DNA, 20 bp, Artificial
  CRISPR gRNA sequence
gcctcatggatattccccca

SEQ ID NO: 631347 - DNA, 20 bp, Artificial
  CRISPR gRNA sequence
cctcatggatattcccccaa

SEQ ID NO: 631348 - DNA, 20 bp, Artificial
  CRISPR gRNA sequence
atggatattcccccaaaacc

SEQ ID NO: 631349 - DNA, 20 bp, Artificial
  CRISPR gRNA sequence
ccccaaaaccaaatcaaaca

SEQ ID NO: 631350 - DNA, 20 bp, Artificial
  CRISPR gRNA sequence
aagatacccaaaactatctt

SEQ ID NO: 631351 - DNA, 20 bp, Artificial
  CRISPR gRNA sequence
tcttcctccacaaaactccc

SEQ ID NO: 631352 - DNA, 20 bp, Artificial
  CRISPR gRNA sequence
cctccacaaaactccctctt

SEQ ID NO: 631353 - DNA, 20 bp, Artificial
  CRISPR gRNA sequence
ctccacaaaactccctcttt

SEQ ID NO: 631354 - DNA, 20 bp, Artificial
  CRISPR gRNA sequence
cacaaaactccctctttgtt

SEQ ID NO: 631355 - DNA, 20 bp, Artificial
  CRISPR gRNA sequence
cctctttgttctgactgccc

SEQ ID NO: 631356 - DNA, 20 bp, Artificial
  CRISPR gRNA sequence
tttgttctgactgcccttct

SEQ ID NO: 631357 - DNA, 20 bp, Artificial
  CRISPR gRNA sequence
tgttctgactgcccttcttt

SEQ ID NO: 631358 - DNA, 20 bp, Artificial
  CRISPR gRNA sequence
gttctgactgcccttctttg

SEQ ID NO: 631359 - DNA, 20 bp, Artificial
  CRISPR gRNA sequence
ttctgactgcccttctttgc

SEQ ID NO: 631360 - DNA, 20 bp, Artificial
  CRISPR gRNA sequence
tgactgcccttctttgctag

SEQ ID NO: 631361 - DNA, 20 bp, Artificial
  CRISPR gRNA sequence
actgcccttctttgctagtg

SEQ ID NO: 631362 - DNA, 20 bp, Artificial
  CRISPR gRNA sequence
cccttctttgctagtgttac

SEQ ID NO: 631363 - DNA, 20 bp, Artificial
  CRISPR gRNA sequence
ctttgctagtgttaccactg

SEQ ID NO: 631364 - DNA, 20 bp, Artificial
  CRISPR gRNA sequence
tttgctagtgttaccactgt

SEQ ID NO: 631365 - DNA, 20 bp, Artificial
  CRISPR gRNA sequence
tgctagtgttaccactgttc

SEQ ID NO: 631366 - DNA, 20 bp, Artificial
  CRISPR gRNA sequence
gctagtgttaccactgttct

SEQ ID NO: 631367 - DNA, 20 bp, Artificial
  CRISPR gRNA sequence
ctagtgttaccactgttcta

SEQ ID NO: 631368 - DNA, 20 bp, Artificial
  CRISPR gRNA sequence
gtgttaccactgttctaata

SEQ ID NO: 631369 - DNA, 20 bp, Artificial
  CRISPR gRNA sequence
ccactgttctaatactcaag

SEQ ID NO: 631370 - DNA, 20 bp, Artificial
  CRISPR gRNA sequence
ttctaatactcaagattcac

SEQ ID NO: 631371 - DNA, 20 bp, Artificial
  CRISPR gRNA sequence
taatactcaagattcacaac

SEQ ID NO: 631372 - DNA, 20 bp, Artificial
  CRISPR gRNA sequence
atactcaagattcacaacaa

SEQ ID NO: 631373 - DNA, 20 bp, Artificial
  CRISPR gRNA sequence
aagattcacaacaatgcacc

SEQ ID NO: 631374 - DNA, 20 bp, Artificial
  CRISPR gRNA sequence
acaacaatgcacccacttct

SEQ ID NO: 631375 - DNA, 20 bp, Artificial
  CRISPR gRNA sequence
ctgttaccttctacctcttt

SEQ ID NO: 631376 - DNA, 20 bp, Artificial
  CRISPR gRNA sequence
tgttaccttctacctctttt

SEQ ID NO: 631377 - DNA, 20 bp, Artificial
  CRISPR gRNA sequence
ttaccttctacctcttttcc

SEQ ID NO: 631378 - DNA, 20 bp, Artificial
  CRISPR gRNA sequence
ccttctacctcttttcctac

SEQ ID NO: 631379 - DNA, 20 bp, Artificial
  CRISPR gRNA sequence
ctacctcttttcctacttcc

SEQ ID NO: 631380 - DNA, 20 bp, Artificial
  CRISPR gRNA sequence
tacctcttttcctacttcca

SEQ ID NO: 631381 - DNA, 20 bp, Artificial
  CRISPR gRNA sequence
cctcttttcctacttccaaa

SEQ ID NO: 631382 - DNA, 20 bp, Artificial
  CRISPR gRNA sequence
ttttcctacttccaaatagc

SEQ ID NO: 631383 - DNA, 20 bp, Artificial
  CRISPR gRNA sequence
ttcctacttccaaatagctg

SEQ ID NO: 631384 - DNA, 20 bp, Artificial
  CRISPR gRNA sequence
tcctacttccaaatagctgc

SEQ ID NO: 631385 - DNA, 20 bp, Artificial
  CRISPR gRNA sequence
cctacttccaaatagctgct

SEQ ID NO: 631386 - DNA, 20 bp, Artificial
  CRISPR gRNA sequence
ctacttccaaatagctgcta

SEQ ID NO: 631387 - DNA, 20 bp, Artificial
  CRISPR gRNA sequence
cttccaaatagctgctaaat

SEQ ID NO: 631388 - DNA, 20 bp, Artificial
  CRISPR gRNA sequence
ccaaatagctgctaaattct

SEQ ID NO: 631389 - DNA, 20 bp, Artificial
  CRISPR gRNA sequence
caaatagctgctaaattcta

SEQ ID NO: 631390 - DNA, 20 bp, Artificial
  CRISPR gRNA sequence
ctaaattctatatactggac

SEQ ID NO: 631391 - DNA, 20 bp, Artificial
  CRISPR gRNA sequence
aattctatatactggactcg

SEQ ID NO: 631392 - DNA, 20 bp, Artificial
  CRISPR gRNA sequence
tatatactggactcgtaaaa

SEQ ID NO: 631393 - DNA, 20 bp, Artificial
  CRISPR gRNA sequence
tatactggactcgtaaaatg

SEQ ID NO: 631394 - DNA, 20 bp, Artificial
  CRISPR gRNA sequence
gactcgtaaaatgattctca

SEQ ID NO: 631395 - DNA, 20 bp, Artificial
  CRISPR gRNA sequence
gtaaaatgattctcaagttg

SEQ ID NO: 631396 - DNA, 20 bp, Artificial
  CRISPR gRNA sequence
tcaagttgatcccttctttt

SEQ ID NO: 631397 - DNA, 20 bp, Artificial
  CRISPR gRNA sequence
aagttgatcccttcttttca

SEQ ID NO: 631398 - DNA, 20 bp, Artificial
  CRISPR gRNA sequence
atcccttcttttcattctca

SEQ ID NO: 631399 - DNA, 20 bp, Artificial
  CRISPR gRNA sequence
cttttcattctcacaatcaa

SEQ ID NO: 631400 - DNA, 20 bp, Artificial
  CRISPR gRNA sequence
ttttcattctcacaatcaac

SEQ ID NO: 631401 - DNA, 20 bp, Artificial
  CRISPR gRNA sequence
ttcattctcacaatcaacgt

SEQ ID NO: 631402 - DNA, 20 bp, Artificial
  CRISPR gRNA sequence
tcattctcacaatcaacgtc

SEQ ID NO: 631403 - DNA, 20 bp, Artificial
  CRISPR gRNA sequence
cattctcacaatcaacgtcc

SEQ ID NO: 631404 - DNA, 20 bp, Artificial
  CRISPR gRNA sequence
attctcacaatcaacgtcct

SEQ ID NO: 631405 - DNA, 20 bp, Artificial
  CRISPR gRNA sequence
tcacaatcaacgtcctagtt

SEQ ID NO: 631406 - DNA, 20 bp, Artificial
  CRISPR gRNA sequence
acaatcaacgtcctagttca

SEQ ID NO: 631407 - DNA, 20 bp, Artificial
  CRISPR gRNA sequence
gttcaggccttcattattgc

SEQ ID NO: 631408 - DNA, 20 bp, Artificial
  CRISPR gRNA sequence
aggccttcattattgctcac

SEQ ID NO: 631409 - DNA, 20 bp, Artificial
  CRISPR gRNA sequence
cattattgctcacctgggcc

SEQ ID NO: 631410 - DNA, 20 bp, Artificial
  CRISPR gRNA sequence
attattgctcacctgggcct

SEQ ID NO: 631411 - DNA, 20 bp, Artificial
  CRISPR gRNA sequence
ttgctcacctgggcctggca

SEQ ID NO: 631412 - DNA, 20 bp, Artificial
  CRISPR gRNA sequence
ctcacctgggcctggcataa

SEQ ID NO: 631413 - DNA, 20 bp, Artificial
  CRISPR gRNA sequence
acctgggcctggcataatag

SEQ ID NO: 631414 - DNA, 20 bp, Artificial
  CRISPR gRNA sequence
ggcctggcataatagacttc

SEQ ID NO: 631415 - DNA, 20 bp, Artificial
  CRISPR gRNA sequence
gcataatagacttcaaatag

SEQ ID NO: 631416 - DNA, 20 bp, Artificial
  CRISPR gRNA sequence
caaataggctttctcttccc

SEQ ID NO: 631417 - DNA, 20 bp, Artificial
  CRISPR gRNA sequence
aaataggctttctcttcccg

SEQ ID NO: 631418 - DNA, 20 bp, Artificial
  CRISPR gRNA sequence
tctcttcccgtgtgtaatta

SEQ ID NO: 631419 - DNA, 20 bp, Artificial
  CRISPR gRNA sequence
ctcttcccgtgtgtaattat

SEQ ID NO: 631420 - DNA, 20 bp, Artificial
  CRISPR gRNA sequence
tcttcccgtgtgtaattatt

SEQ ID NO: 631421 - DNA, 20 bp, Artificial
  CRISPR gRNA sequence
ttcccgtgtgtaattatttt

SEQ ID NO: 631422 - DNA, 20 bp, Artificial
  CRISPR gRNA sequence
cccgtgtgtaattattttat

SEQ ID NO: 631423 - DNA, 20 bp, Artificial
  CRISPR gRNA sequence
ccgtgtgtaattattttatt

SEQ ID NO: 631424 - DNA, 20 bp, Artificial
  CRISPR gRNA sequence
ttttattcctctctccaaca

SEQ ID NO: 631425 - DNA, 20 bp, Artificial
  CRISPR gRNA sequence
tattcctctctccaacaact

SEQ ID NO: 631426 - DNA, 20 bp, Artificial
  CRISPR gRNA sequence
attcctctctccaacaactt

SEQ ID NO: 631427 - DNA, 20 bp, Artificial
  CRISPR gRNA sequence
ttcctctctccaacaacttt

SEQ ID NO: 631428 - DNA, 20 bp, Artificial
  CRISPR gRNA sequence
ctctctccaacaactttcaa

SEQ ID NO: 631429 - DNA, 20 bp, Artificial
  CRISPR gRNA sequence
tctccaacaactttcaataa

SEQ ID NO: 631430 - DNA, 20 bp, Artificial
  CRISPR gRNA sequence
tccaacaactttcaataact

SEQ ID NO: 631431 - DNA, 20 bp, Artificial
  CRISPR gRNA sequence
caacaactttcaataactgt

SEQ ID NO: 631432 - DNA, 20 bp, Artificial
  CRISPR gRNA sequence
tcaataactgttaagtttta

SEQ ID NO: 631433 - DNA, 20 bp, Artificial
  CRISPR gRNA sequence
caataactgttaagttttat

SEQ ID NO: 631434 - DNA, 20 bp, Artificial
  CRISPR gRNA sequence
aataactgttaagttttatt

SEQ ID NO: 631435 - DNA, 20 bp, Artificial
  CRISPR gRNA sequence
ttaagttttattgaactaag

SEQ ID NO: 631436 - DNA, 20 bp, Artificial
  CRISPR gRNA sequence
agttttattgaactaagttg

SEQ ID NO: 631437 - DNA, 20 bp, Artificial
  CRISPR gRNA sequence
tattgaactaagttgaaatc

SEQ ID NO: 631438 - DNA, 20 bp, Artificial
  CRISPR gRNA sequence
attgaactaagttgaaatcc

SEQ ID NO: 631439 - DNA, 20 bp, Artificial
  CRISPR gRNA sequence
ttgaactaagttgaaatccc

SEQ ID NO: 631440 - DNA, 20 bp, Artificial
  CRISPR gRNA sequence
aactaagttgaaatcccttt

SEQ ID NO: 631441 - DNA, 20 bp, Artificial
  CRISPR gRNA sequence
agttgaaatccctttacctg

SEQ ID NO: 631442 - DNA, 20 bp, Artificial
  CRISPR gRNA sequence
aaatccctttacctggcatt

SEQ ID NO: 631443 - DNA, 20 bp, Artificial
  CRISPR gRNA sequence
tacctggcattcagcaccct

SEQ ID NO: 631444 - DNA, 20 bp, Artificial
  CRISPR gRNA sequence
acctggcattcagcacccta

SEQ ID NO: 631445 - DNA, 20 bp, Artificial
  CRISPR gRNA sequence
cctggcattcagcaccctat

SEQ ID NO: 631446 - DNA, 20 bp, Artificial
  CRISPR gRNA sequence
gcattcagcaccctatacca

SEQ ID NO: 631447 - DNA, 20 bp, Artificial
  CRISPR gRNA sequence
agcaccctataccatctggt

SEQ ID NO: 631448 - DNA, 20 bp, Artificial
  CRISPR gRNA sequence
taccatctggtcccaaagca

SEQ ID NO: 631449 - DNA, 20 bp, Artificial
  CRISPR gRNA sequence
gtcccaaagcacacatccca

SEQ ID NO: 631450 - DNA, 20 bp, Artificial
  CRISPR gRNA sequence
ctaccccaggccccagtcaa

SEQ ID NO: 631451 - DNA, 20 bp, Artificial
  CRISPR gRNA sequence
ccccaggccccagtcaaaat

SEQ ID NO: 631452 - DNA, 20 bp, Artificial
  CRISPR gRNA sequence
ctttacacctacacttctga

SEQ ID NO: 631453 - DNA, 20 bp, Artificial
  CRISPR gRNA sequence
tacacctacacttctgagtt

SEQ ID NO: 631454 - DNA, 20 bp, Artificial
  CRISPR gRNA sequence
acacctacacttctgagttt

SEQ ID NO: 631455 - DNA, 20 bp, Artificial
  CRISPR gRNA sequence
cacctacacttctgagtttt

SEQ ID NO: 631456 - DNA, 20 bp, Artificial
  CRISPR gRNA sequence
cacttctgagttttgtttgt

SEQ ID NO: 631457 - DNA, 20 bp, Artificial
  CRISPR gRNA sequence
ctgagttttgtttgttgctg

SEQ ID NO: 631458 - DNA, 20 bp, Artificial
  CRISPR gRNA sequence
tgagttttgtttgttgctgt

SEQ ID NO: 631459 - DNA, 20 bp, Artificial
  CRISPR gRNA sequence
agttttgtttgttgctgtaa

SEQ ID NO: 631460 - DNA, 20 bp, Artificial
  CRISPR gRNA sequence
tgtttgttgctgtaattgcc

SEQ ID NO: 631461 - DNA, 20 bp, Artificial
  CRISPR gRNA sequence
gtttgttgctgtaattgcct

SEQ ID NO: 631462 - DNA, 20 bp, Artificial
  CRISPR gRNA sequence
tttgttgctgtaattgcctc

SEQ ID NO: 631463 - DNA, 20 bp, Artificial
  CRISPR gRNA sequence
gttgctgtaattgcctcaca

SEQ ID NO: 631464 - DNA, 20 bp, Artificial
  CRISPR gRNA sequence
ttgctgtaattgcctcacat

SEQ ID NO: 631465 - DNA, 20 bp, Artificial
  CRISPR gRNA sequence
ctgtaattgcctcacatgat

SEQ ID NO: 631466 - DNA, 20 bp, Artificial
  CRISPR gRNA sequence
taattgcctcacatgatttc

SEQ ID NO: 631467 - DNA, 20 bp, Artificial
  CRISPR gRNA sequence
cctcacatgatttctacctc

SEQ ID NO: 631468 - DNA, 20 bp, Artificial
  CRISPR gRNA sequence
acatgatttctacctcttga

SEQ ID NO: 631469 - DNA, 20 bp, Artificial
  CRISPR gRNA sequence
ctacctcttgaaatcctcca

SEQ ID NO: 631470 - DNA, 20 bp, Artificial
  CRISPR gRNA sequence
tacctcttgaaatcctccac

SEQ ID NO: 631471 - DNA, 20 bp, Artificial
  CRISPR gRNA sequence
cctcttgaaatcctccacat

SEQ ID NO: 631472 - DNA, 20 bp, Artificial
  CRISPR gRNA sequence
ttgaaatcctccacatccct

SEQ ID NO: 631473 - DNA, 20 bp, Artificial
  CRISPR gRNA sequence
gaaatcctccacatccctcc

SEQ ID NO: 631474 - DNA, 20 bp, Artificial
  CRISPR gRNA sequence
aaatcctccacatccctcca

SEQ ID NO: 631475 - DNA, 20 bp, Artificial
  CRISPR gRNA sequence
cacatccctccacttccaac

SEQ ID NO: 631476 - DNA, 20 bp, Artificial
  CRISPR gRNA sequence
cacttccaacctccttaact

SEQ ID NO: 631477 - DNA, 20 bp, Artificial
  CRISPR gRNA sequence
ccaacctccttaactctgtt

SEQ ID NO: 631478 - DNA, 20 bp, Artificial
  CRISPR gRNA sequence
caacctccttaactctgttc

SEQ ID NO: 631479 - DNA, 20 bp, Artificial
  CRISPR gRNA sequence
cttaactctgttccatttta

SEQ ID NO: 631480 - DNA, 20 bp, Artificial
  CRISPR gRNA sequence
aactctgttccattttaacg

SEQ ID NO: 631481 - DNA, 20 bp, Artificial
  CRISPR gRNA sequence
actctgttccattttaacgt

SEQ ID NO: 631482 - DNA, 20 bp, Artificial
  CRISPR gRNA sequence
tgttccattttaacgtgatc

SEQ ID NO: 631483 - DNA, 20 bp, Artificial
  CRISPR gRNA sequence
ttccattttaacgtgatctt

SEQ ID NO: 631484 - DNA, 20 bp, Artificial
  CRISPR gRNA sequence
cattttaacgtgatctttct

SEQ ID NO: 631485 - DNA, 20 bp, Artificial
  CRISPR gRNA sequence
taacgtgatctttctcacta

SEQ ID NO: 631486 - DNA, 20 bp, Artificial
  CRISPR gRNA sequence
aacgtgatctttctcactaa

SEQ ID NO: 631487 - DNA, 20 bp, Artificial
  CRISPR gRNA sequence
acgtgatctttctcactaaa

SEQ ID NO: 631488 - DNA, 20 bp, Artificial
  CRISPR gRNA sequence
tctcactaaagaactattcc

SEQ ID NO: 631489 - DNA, 20 bp, Artificial
  CRISPR gRNA sequence
ctcactaaagaactattcct

SEQ ID NO: 631490 - DNA, 20 bp, Artificial
  CRISPR gRNA sequence
tcactaaagaactattcctg

SEQ ID NO: 631491 - DNA, 20 bp, Artificial
  CRISPR gRNA sequence
actaaagaactattcctgta

SEQ ID NO: 631492 - DNA, 20 bp, Artificial
  CRISPR gRNA sequence
aagaactattcctgtattga

SEQ ID NO: 631493 - DNA, 20 bp, Artificial
  CRISPR gRNA sequence
ttcctgtattgaccctcatg

SEQ ID NO: 631494 - DNA, 20 bp, Artificial
  CRISPR gRNA sequence
ctgtattgaccctcatgctt

SEQ ID NO: 631495 - DNA, 20 bp, Artificial
  CRISPR gRNA sequence
tattgaccctcatgcttaga

SEQ ID NO: 631496 - DNA, 20 bp, Artificial
  CRISPR gRNA sequence
accctcatgcttagaacact

SEQ ID NO: 631497 - DNA, 20 bp, Artificial
  CRISPR gRNA sequence
atgcttagaacacttccaac

SEQ ID NO: 631498 - DNA, 20 bp, Artificial
  CRISPR gRNA sequence
agaacacttccaacactcta

SEQ ID NO: 631499 - DNA, 20 bp, Artificial
  CRISPR gRNA sequence
gaacacttccaacactctat

SEQ ID NO: 631500 - DNA, 20 bp, Artificial
  CRISPR gRNA sequence
ccaacactctatcattctat

SEQ ID NO: 631501 - DNA, 20 bp, Artificial
  CRISPR gRNA sequence
caacactctatcattctatc

SEQ ID NO: 631502 - DNA, 20 bp, Artificial
  CRISPR gRNA sequence
tatcattctatcttatatta

SEQ ID NO: 631503 - DNA, 20 bp, Artificial
  CRISPR gRNA sequence
tcattctatcttatattatc

SEQ ID NO: 631504 - DNA, 20 bp, Artificial
  CRISPR gRNA sequence
tatcttatattatctgtgac

SEQ ID NO: 631505 - DNA, 20 bp, Artificial
  CRISPR gRNA sequence
tcttatattatctgtgactt

SEQ ID NO: 631506 - DNA, 20 bp, Artificial
  CRISPR gRNA sequence
atattatctgtgacttttat

SEQ ID NO: 631507 - DNA, 20 bp, Artificial
  CRISPR gRNA sequence
tattatctgtgacttttata

SEQ ID NO: 631508 - DNA, 20 bp, Artificial
  CRISPR gRNA sequence
tctgtgacttttatactggt

SEQ ID NO: 631509 - DNA, 20 bp, Artificial
  CRISPR gRNA sequence
tgacttttatactggtattt

SEQ ID NO: 631510 - DNA, 20 bp, Artificial
  CRISPR gRNA sequence
ttatactggtatttacacac

SEQ ID NO: 631511 - DNA, 20 bp, Artificial
  CRISPR gRNA sequence
tatactggtatttacacact

SEQ ID NO: 631512 - DNA, 20 bp, Artificial
  CRISPR gRNA sequence
atactggtatttacacacta

SEQ ID NO: 631513 - DNA, 20 bp, Artificial
  CRISPR gRNA sequence
tactggtatttacacactaa

SEQ ID NO: 631514 - DNA, 20 bp, Artificial
  CRISPR gRNA sequence
gtatttacacactaattttc

SEQ ID NO: 631515 - DNA, 20 bp, Artificial
  CRISPR gRNA sequence
acacactaattttcatctcc

SEQ ID NO: 631516 - DNA, 20 bp, Artificial
  CRISPR gRNA sequence
cacactaattttcatctcca

SEQ ID NO: 631517 - DNA, 20 bp, Artificial
  CRISPR gRNA sequence
attttcatctccatgttaga

SEQ ID NO: 631518 - DNA, 20 bp, Artificial
  CRISPR gRNA sequence
tcatctccatgttagatctt

SEQ ID NO: 631519 - DNA, 20 bp, Artificial
  CRISPR gRNA sequence
catctccatgttagatcttg

SEQ ID NO: 631520 - DNA, 20 bp, Artificial
  CRISPR gRNA sequence
atctccatgttagatcttga

SEQ ID NO: 631521 - DNA, 20 bp, Artificial
  CRISPR gRNA sequence
catgttagatcttgaccttt

SEQ ID NO: 631522 - DNA, 20 bp, Artificial
  CRISPR gRNA sequence
gatcttgacctttttgagaa

SEQ ID NO: 631523 - DNA, 20 bp, Artificial
  CRISPR gRNA sequence
gacctttttgagaaattata

SEQ ID NO: 631524 - DNA, 20 bp, Artificial
  CRISPR gRNA sequence
acctttttgagaaattataa

SEQ ID NO: 631525 - DNA, 20 bp, Artificial
  CRISPR gRNA sequence
tttgagaaattataacaata

SEQ ID NO: 631526 - DNA, 20 bp, Artificial
  CRISPR gRNA sequence
ttgagaaattataacaatat

SEQ ID NO: 631527 - DNA, 20 bp, Artificial
  CRISPR gRNA sequence
tgagaaattataacaatatc

SEQ ID NO: 631528 - DNA, 20 bp, Artificial
  CRISPR gRNA sequence
gagaaattataacaatatct

SEQ ID NO: 631529 - DNA, 20 bp, Artificial
  CRISPR gRNA sequence
agaaattataacaatatctt

SEQ ID NO: 631530 - DNA, 20 bp, Artificial
  CRISPR gRNA sequence
taacaatatcttatgtgtct

SEQ ID NO: 631531 - DNA, 20 bp, Artificial
  CRISPR gRNA sequence
atgtgtctttgtaacttccg

SEQ ID NO: 631532 - DNA, 20 bp, Artificial
  CRISPR gRNA sequence
tgtgtctttgtaacttccga

SEQ ID NO: 631533 - DNA, 20 bp, Artificial
  CRISPR gRNA sequence
tgtaacttccgaagagttta

SEQ ID NO: 631534 - DNA, 20 bp, Artificial
  CRISPR gRNA sequence
gtaacttccgaagagtttag

SEQ ID NO: 631535 - DNA, 20 bp, Artificial
  CRISPR gRNA sequence
taacttccgaagagtttagc

SEQ ID NO: 631536 - DNA, 20 bp, Artificial
  CRISPR gRNA sequence
ccgaagagtttagcagggtg

SEQ ID NO: 631537 - DNA, 20 bp, Artificial
  CRISPR gRNA sequence
cgaagagtttagcagggtgc

SEQ ID NO: 631538 - DNA, 20 bp, Artificial
  CRISPR gRNA sequence
agcagggtgctttgctcata

SEQ ID NO: 631539 - DNA, 20 bp, Artificial
  CRISPR gRNA sequence
gcagggtgctttgctcatag

SEQ ID NO: 631540 - DNA, 20 bp, Artificial
  CRISPR gRNA sequence
tgctcatagaaagaactaat

SEQ ID NO: 631541 - DNA, 20 bp, Artificial
  CRISPR gRNA sequence
gctcatagaaagaactaata

SEQ ID NO: 631542 - DNA, 20 bp, Artificial
  CRISPR gRNA sequence
ctcatagaaagaactaataa

SEQ ID NO: 631543 - DNA, 20 bp, Artificial
  CRISPR gRNA sequence
atagaaagaactaataagtg

SEQ ID NO: 631544 - DNA, 20 bp, Artificial
  CRISPR gRNA sequence
ataagtggagtttttatgaa

SEQ ID NO: 631545 - DNA, 20 bp, Artificial
  CRISPR gRNA sequence
ttatgaatgatataatttcc

SEQ ID NO: 631546 - DNA, 20 bp, Artificial
  CRISPR gRNA sequence
tatgaatgatataatttcca

SEQ ID NO: 631547 - DNA, 20 bp, Artificial
  CRISPR gRNA sequence
atgaatgatataatttccaa

SEQ ID NO: 631548 - DNA, 20 bp, Artificial
  CRISPR gRNA sequence
tgaatgatataatttccaaa

SEQ ID NO: 631549 - DNA, 20 bp, Artificial
  CRISPR gRNA sequence
ccaaactctttaaatagctt

SEQ ID NO: 631550 - DNA, 20 bp, Artificial
  CRISPR gRNA sequence
caaactctttaaatagcttt

SEQ ID NO: 631551 - DNA, 20 bp, Artificial
  CRISPR gRNA sequence
tttaaatagctttttctcat

SEQ ID NO: 631552 - DNA, 20 bp, Artificial
  CRISPR gRNA sequence
taaatagctttttctcatta

SEQ ID NO: 631553 - DNA, 20 bp, Artificial
  CRISPR gRNA sequence
aaatagctttttctcattag

SEQ ID NO: 631554 - DNA, 20 bp, Artificial
  CRISPR gRNA sequence
aatagctttttctcattagt

SEQ ID NO: 631555 - DNA, 20 bp, Artificial
  CRISPR gRNA sequence
tttctcattagtttttctta

SEQ ID NO: 631556 - DNA, 20 bp, Artificial
  CRISPR gRNA sequence
ttctcattagtttttcttaa

SEQ ID NO: 631557 - DNA, 20 bp, Artificial
  CRISPR gRNA sequence
tctcattagtttttcttaaa

SEQ ID NO: 631558 - DNA, 20 bp, Artificial
  CRISPR gRNA sequence
ctcattagtttttcttaaat

SEQ ID NO: 631559 - DNA, 20 bp, Artificial
  CRISPR gRNA sequence
tcattagtttttcttaaatc

SEQ ID NO: 631560 - DNA, 20 bp, Artificial
  CRISPR gRNA sequence
attagtttttcttaaatctc

SEQ ID NO: 631561 - DNA, 20 bp, Artificial
  CRISPR gRNA sequence
gtttttcttaaatctctttc

SEQ ID NO: 631562 - DNA, 20 bp, Artificial
  CRISPR gRNA sequence
ttcttaaatctctttctaat

SEQ ID NO: 631563 - DNA, 20 bp, Artificial
  CRISPR gRNA sequence
tcttaaatctctttctaatt

SEQ ID NO: 631564 - DNA, 20 bp, Artificial
  CRISPR gRNA sequence
cttaaatctctttctaattt

SEQ ID NO: 631565 - DNA, 20 bp, Artificial
  CRISPR gRNA sequence
ttaaatctctttctaatttc

SEQ ID NO: 631566 - DNA, 20 bp, Artificial
  CRISPR gRNA sequence
aaatctctttctaatttcaa

SEQ ID NO: 631567 - DNA, 20 bp, Artificial
  CRISPR gRNA sequence
aatctctttctaatttcaaa

SEQ ID NO: 631568 - DNA, 20 bp, Artificial
  CRISPR gRNA sequence
tttctaatttcaaatgtaaa

SEQ ID NO: 631569 - DNA, 20 bp, Artificial
  CRISPR gRNA sequence
tctaatttcaaatgtaaaat

SEQ ID NO: 631570 - DNA, 20 bp, Artificial
  CRISPR gRNA sequence
ctaatttcaaatgtaaaata

SEQ ID NO: 631571 - DNA, 20 bp, Artificial
  CRISPR gRNA sequence
taatttcaaatgtaaaatat

SEQ ID NO: 631572 - DNA, 20 bp, Artificial
  CRISPR gRNA sequence
atttcaaatgtaaaatattc

SEQ ID NO: 631573 - DNA, 20 bp, Artificial
  CRISPR gRNA sequence
caaatgtaaaatattcatat

SEQ ID NO: 631574 - DNA, 20 bp, Artificial
  CRISPR gRNA sequence
aaatgtaaaatattcatata

SEQ ID NO: 631575 - DNA, 20 bp, Artificial
  CRISPR gRNA sequence
atataaaatttttttaatca

SEQ ID NO: 631576 - DNA, 20 bp, Artificial
  CRISPR gRNA sequence
ttttaatcaccagtaaaatc

SEQ ID NO: 631577 - DNA, 20 bp, Artificial
  CRISPR gRNA sequence
tttaatcaccagtaaaatcc

SEQ ID NO: 631578 - DNA, 20 bp, Artificial
  CRISPR gRNA sequence
ttaatcaccagtaaaatcca

SEQ ID NO: 631579 - DNA, 20 bp, Artificial
  CRISPR gRNA sequence
taatcaccagtaaaatccat

SEQ ID NO: 631580 - DNA, 20 bp, Artificial
  CRISPR gRNA sequence
aatcaccagtaaaatccata

SEQ ID NO: 631581 - DNA, 20 bp, Artificial
  CRISPR gRNA sequence
atcaccagtaaaatccataa

SEQ ID NO: 631582 - DNA, 20 bp, Artificial
  CRISPR gRNA sequence
tatcatttagaaataactgt

SEQ ID NO: 631583 - DNA, 20 bp, Artificial
  CRISPR gRNA sequence
agaaataactgtctttggta

SEQ ID NO: 631584 - DNA, 20 bp, Artificial
  CRISPR gRNA sequence
gaaataactgtctttggtat

SEQ ID NO: 631585 - DNA, 20 bp, Artificial
  CRISPR gRNA sequence
tctttggtatttctgtatta

SEQ ID NO: 631586 - DNA, 20 bp, Artificial
  CRISPR gRNA sequence
tggtatttctgtattatcct

SEQ ID NO: 631587 - DNA, 20 bp, Artificial
  CRISPR gRNA sequence
ggtatttctgtattatcctc

SEQ ID NO: 631588 - DNA, 20 bp, Artificial
  CRISPR gRNA sequence
gtatttctgtattatcctct

SEQ ID NO: 631589 - DNA, 20 bp, Artificial
  CRISPR gRNA sequence
ctgtattatcctcttgcatt

SEQ ID NO: 631590 - DNA, 20 bp, Artificial
  CRISPR gRNA sequence
tgtattatcctcttgcattt

SEQ ID NO: 631591 - DNA, 20 bp, Artificial
  CRISPR gRNA sequence
tattatcctcttgcattttt

SEQ ID NO: 631592 - DNA, 20 bp, Artificial
  CRISPR gRNA sequence
tcctcttgcatttttttaat

SEQ ID NO: 631593 - DNA, 20 bp, Artificial
  CRISPR gRNA sequence
ttgcatttttttaatgcatg

SEQ ID NO: 631594 - DNA, 20 bp, Artificial
  CRISPR gRNA sequence
gcatttttttaatgcatgca

SEQ ID NO: 631595 - DNA, 20 bp, Artificial
  CRISPR gRNA sequence
catttttttaatgcatgcaa

SEQ ID NO: 631596 - DNA, 20 bp, Artificial
  CRISPR gRNA sequence
ttttaatgcatgcaaagata

SEQ ID NO: 631597 - DNA, 20 bp, Artificial
  CRISPR gRNA sequence
tttaatgcatgcaaagataa

SEQ ID NO: 631598 - DNA, 20 bp, Artificial
  CRISPR gRNA sequence
ttaatgcatgcaaagataaa

SEQ ID NO: 631599 - DNA, 20 bp, Artificial
  CRISPR gRNA sequence
taatgcatgcaaagataaat

SEQ ID NO: 631600 - DNA, 20 bp, Artificial
  CRISPR gRNA sequence
aatgcatgcaaagataaatt

SEQ ID NO: 631601 - DNA, 20 bp, Artificial
  CRISPR gRNA sequence
atgcatgcaaagataaattt

SEQ ID NO: 631602 - DNA, 20 bp, Artificial
  CRISPR gRNA sequence
tggtatgaaaatgagttatt

SEQ ID NO: 631603 - DNA, 20 bp, Artificial
  CRISPR gRNA sequence
ggtatgaaaatgagttattt

SEQ ID NO: 631604 - DNA, 20 bp, Artificial
  CRISPR gRNA sequence
gtatgaaaatgagttatttt

SEQ ID NO: 631605 - DNA, 20 bp, Artificial
  CRISPR gRNA sequence
ttttatacactgttatttta

SEQ ID NO: 631606 - DNA, 20 bp, Artificial
  CRISPR gRNA sequence
tatacactgttattttataa

SEQ ID NO: 631607 - DNA, 20 bp, Artificial
  CRISPR gRNA sequence
atacactgttattttataac

SEQ ID NO: 631608 - DNA, 20 bp, Artificial
  CRISPR gRNA sequence
tacactgttattttataacc

SEQ ID NO: 631609 - DNA, 20 bp, Artificial
  CRISPR gRNA sequence
ttattttataacctgcttat

SEQ ID NO: 631610 - DNA, 20 bp, Artificial
  CRISPR gRNA sequence
ttttataacctgcttatttt

SEQ ID NO: 631611 - DNA, 20 bp, Artificial
  CRISPR gRNA sequence
tataacctgcttattttact

SEQ ID NO: 631612 - DNA, 20 bp, Artificial
  CRISPR gRNA sequence
ataacctgcttattttactg

SEQ ID NO: 631613 - DNA, 20 bp, Artificial
  CRISPR gRNA sequence
taacctgcttattttactga

SEQ ID NO: 631614 - DNA, 20 bp, Artificial
  CRISPR gRNA sequence
cttattttactgaacaatat

SEQ ID NO: 631615 - DNA, 20 bp, Artificial
  CRISPR gRNA sequence
attttactgaacaatatatt

SEQ ID NO: 631616 - DNA, 20 bp, Artificial
  CRISPR gRNA sequence
ttttactgaacaatatattt

SEQ ID NO: 631617 - DNA, 20 bp, Artificial
  CRISPR gRNA sequence
tactgaacaatatattttga

SEQ ID NO: 631618 - DNA, 20 bp, Artificial
  CRISPR gRNA sequence
actgaacaatatattttgaa

SEQ ID NO: 631619 - DNA, 20 bp, Artificial
  CRISPR gRNA sequence
ctgaacaatatattttgaac

SEQ ID NO: 631620 - DNA, 20 bp, Artificial
  CRISPR gRNA sequence
aacaatatattttgaacatt

SEQ ID NO: 631621 - DNA, 20 bp, Artificial
  CRISPR gRNA sequence
tgaacatttccccattatta

SEQ ID NO: 631622 - DNA, 20 bp, Artificial
  CRISPR gRNA sequence
gaacatttccccattattat

SEQ ID NO: 631623 - DNA, 20 bp, Artificial
  CRISPR gRNA sequence
aacatttccccattattatg

SEQ ID NO: 631624 - DNA, 20 bp, Artificial
  CRISPR gRNA sequence
ccccattattatgaaatgat

SEQ ID NO: 631625 - DNA, 20 bp, Artificial
  CRISPR gRNA sequence
cccattattatgaaatgata

SEQ ID NO: 631626 - DNA, 20 bp, Artificial
  CRISPR gRNA sequence
ttatgaaatgatatttttgt

SEQ ID NO: 631627 - DNA, 20 bp, Artificial
  CRISPR gRNA sequence
tgaaatgatatttttgttgc

SEQ ID NO: 631628 - DNA, 20 bp, Artificial
  CRISPR gRNA sequence
ttgttgctgctgttaggtaa

SEQ ID NO: 631629 - DNA, 20 bp, Artificial
  CRISPR gRNA sequence
tgttgctgctgttaggtaac

SEQ ID NO: 631630 - DNA, 20 bp, Artificial
  CRISPR gRNA sequence
gttgctgctgttaggtaaca

SEQ ID NO: 631631 - DNA, 20 bp, Artificial
  CRISPR gRNA sequence
ttgctgctgttaggtaacac

SEQ ID NO: 631632 - DNA, 20 bp, Artificial
  CRISPR gRNA sequence
ctgctgttaggtaacacttt

SEQ ID NO: 631633 - DNA, 20 bp, Artificial
  CRISPR gRNA sequence
ctgttaggtaacactttctc

SEQ ID NO: 631634 - DNA, 20 bp, Artificial
  CRISPR gRNA sequence
ttaggtaacactttctccca

SEQ ID NO: 631635 - DNA, 20 bp, Artificial
  CRISPR gRNA sequence
ggtaacactttctcccagat

SEQ ID NO: 631636 - DNA, 20 bp, Artificial
  CRISPR gRNA sequence
tctcccagattctagattta

SEQ ID NO: 631637 - DNA, 20 bp, Artificial
  CRISPR gRNA sequence
ctcccagattctagatttat

SEQ ID NO: 631638 - DNA, 20 bp, Artificial
  CRISPR gRNA sequence
tcccagattctagatttatg

SEQ ID NO: 631639 - DNA, 20 bp, Artificial
  CRISPR gRNA sequence
ccagattctagatttatggt

SEQ ID NO: 631640 - DNA, 20 bp, Artificial
  CRISPR gRNA sequence
tagatttatggtaatgctga

SEQ ID NO: 631641 - DNA, 20 bp, Artificial
  CRISPR gRNA sequence
gatttatggtaatgctgaat

SEQ ID NO: 631642 - DNA, 20 bp, Artificial
  CRISPR gRNA sequence
atggtaatgctgaattattc

SEQ ID NO: 631643 - DNA, 20 bp, Artificial
  CRISPR gRNA sequence
tggtaatgctgaattattca

SEQ ID NO: 631644 - DNA, 20 bp, Artificial
  CRISPR gRNA sequence
aattattcagtttgctcagc

SEQ ID NO: 631645 - DNA, 20 bp, Artificial
  CRISPR gRNA sequence
ttcagtttgctcagcattct

SEQ ID NO: 631646 - DNA, 20 bp, Artificial
  CRISPR gRNA sequence
agtttgctcagcattctgag

SEQ ID NO: 631647 - DNA, 20 bp, Artificial
  CRISPR gRNA sequence
gctcagcattctgagtcctt

SEQ ID NO: 631648 - DNA, 20 bp, Artificial
  CRISPR gRNA sequence
ctcagcattctgagtccttt

SEQ ID NO: 631649 - DNA, 20 bp, Artificial
  CRISPR gRNA sequence
agcattctgagtccttttct

SEQ ID NO: 631650 - DNA, 20 bp, Artificial
  CRISPR gRNA sequence
tgagtccttttcttttatta

SEQ ID NO: 631651 - DNA, 20 bp, Artificial
  CRISPR gRNA sequence
agtccttttcttttattacg

SEQ ID NO: 631652 - DNA, 20 bp, Artificial
  CRISPR gRNA sequence
ttcttttattacgttaatga

SEQ ID NO: 631653 - DNA, 20 bp, Artificial
  CRISPR gRNA sequence
tcttttattacgttaatgat

SEQ ID NO: 631654 - DNA, 20 bp, Artificial
  CRISPR gRNA sequence
cttttattacgttaatgatt

SEQ ID NO: 631655 - DNA, 20 bp, Artificial
  CRISPR gRNA sequence
ttttattacgttaatgatta

SEQ ID NO: 631656 - DNA, 20 bp, Artificial
  CRISPR gRNA sequence
ttattacgttaatgattatt

SEQ ID NO: 631657 - DNA, 20 bp, Artificial
  CRISPR gRNA sequence
tattacgttaatgattattt

SEQ ID NO: 631658 - DNA, 20 bp, Artificial
  CRISPR gRNA sequence
attacgttaatgattatttt

SEQ ID NO: 631659 - DNA, 20 bp, Artificial
  CRISPR gRNA sequence
ttacgttaatgattattttt

SEQ ID NO: 631660 - DNA, 20 bp, Artificial
  CRISPR gRNA sequence
cgttaatgattatttttctt

SEQ ID NO: 631661 - DNA, 20 bp, Artificial
  CRISPR gRNA sequence
atgattatttttctttttac

SEQ ID NO: 631662 - DNA, 20 bp, Artificial
  CRISPR gRNA sequence
tttttctttttaccatagtt

SEQ ID NO: 631663 - DNA, 20 bp, Artificial
  CRISPR gRNA sequence
ttctttttaccatagttaga

SEQ ID NO: 631664 - DNA, 20 bp, Artificial
  CRISPR gRNA sequence
tctttttaccatagttagat

SEQ ID NO: 631665 - DNA, 20 bp, Artificial
  CRISPR gRNA sequence
ctttttaccatagttagata

SEQ ID NO: 631666 - DNA, 20 bp, Artificial
  CRISPR gRNA sequence
tttttaccatagttagatat

SEQ ID NO: 631667 - DNA, 20 bp, Artificial
  CRISPR gRNA sequence
tttaccatagttagatatgc

SEQ ID NO: 631668 - DNA, 20 bp, Artificial
  CRISPR gRNA sequence
ttaccatagttagatatgcc

SEQ ID NO: 631669 - DNA, 20 bp, Artificial
  CRISPR gRNA sequence
taccatagttagatatgccc

SEQ ID NO: 631670 - DNA, 20 bp, Artificial
  CRISPR gRNA sequence
accatagttagatatgccca

SEQ ID NO: 631671 - DNA, 20 bp, Artificial
  CRISPR gRNA sequence
ccatagttagatatgcccat

SEQ ID NO: 631672 - DNA, 20 bp, Artificial
  CRISPR gRNA sequence
gatatgcccataaaaaaaat

SEQ ID NO: 631673 - DNA, 20 bp, Artificial
  CRISPR gRNA sequence
aatgaaatacatagtctctt

SEQ ID NO: 631674 - DNA, 20 bp, Artificial
  CRISPR gRNA sequence
atgaaatacatagtctcttc

SEQ ID NO: 631675 - DNA, 20 bp, Artificial
  CRISPR gRNA sequence
ttccccatgctgccctacct

SEQ ID NO: 631676 - DNA, 20 bp, Artificial
  CRISPR gRNA sequence
ccccatgctgccctacctgc

SEQ ID NO: 631677 - DNA, 20 bp, Artificial
  CRISPR gRNA sequence
cccatgctgccctacctgcc

SEQ ID NO: 631678 - DNA, 20 bp, Artificial
  CRISPR gRNA sequence
ccctacctgcccccaagcaa

SEQ ID NO: 631679 - DNA, 20 bp, Artificial
  CRISPR gRNA sequence
cctgcccccaagcaatctaa

SEQ ID NO: 631680 - DNA, 20 bp, Artificial
  CRISPR gRNA sequence
cccccaagcaatctaatcaa

SEQ ID NO: 631681 - DNA, 20 bp, Artificial
  CRISPR gRNA sequence
atcaaaatcccaaaaagcaa

SEQ ID NO: 631682 - DNA, 20 bp, Artificial
  CRISPR gRNA sequence
tcagctccttcttttggtga

SEQ ID NO: 631683 - DNA, 20 bp, Artificial
  CRISPR gRNA sequence
cagctccttcttttggtgat

SEQ ID NO: 631684 - DNA, 20 bp, Artificial
  CRISPR gRNA sequence
agctccttcttttggtgatt

SEQ ID NO: 631685 - DNA, 20 bp, Artificial
  CRISPR gRNA sequence
cttcttttggtgattatatt

SEQ ID NO: 631686 - DNA, 20 bp, Artificial
  CRISPR gRNA sequence
cttttggtgattatattcat

SEQ ID NO: 631687 - DNA, 20 bp, Artificial
  CRISPR gRNA sequence
ttttggtgattatattcata

SEQ ID NO: 631688 - DNA, 20 bp, Artificial
  CRISPR gRNA sequence
ttggtgattatattcatatt

SEQ ID NO: 631689 - DNA, 20 bp, Artificial
  CRISPR gRNA sequence
tggtgattatattcatattt

SEQ ID NO: 631690 - DNA, 20 bp, Artificial
  CRISPR gRNA sequence
ggtgattatattcatatttc

SEQ ID NO: 631691 - DNA, 20 bp, Artificial
  CRISPR gRNA sequence
gtgattatattcatatttct

SEQ ID NO: 631692 - DNA, 20 bp, Artificial
  CRISPR gRNA sequence
tattcatatttctaaataat

SEQ ID NO: 631693 - DNA, 20 bp, Artificial
  CRISPR gRNA sequence
atatttctaaataatatgtg

SEQ ID NO: 631694 - DNA, 20 bp, Artificial
  CRISPR gRNA sequence
ctaaataatatgtgggttat

SEQ ID NO: 631695 - DNA, 20 bp, Artificial
  CRISPR gRNA sequence
taaataatatgtgggttatt

SEQ ID NO: 631696 - DNA, 20 bp, Artificial
  CRISPR gRNA sequence
aataatatgtgggttatttt

SEQ ID NO: 631697 - DNA, 20 bp, Artificial
  CRISPR gRNA sequence
tttttattcatcaggtttag

SEQ ID NO: 631698 - DNA, 20 bp, Artificial
  CRISPR gRNA sequence
ttattcatcaggtttagaga

SEQ ID NO: 631699 - DNA, 20 bp, Artificial
  CRISPR gRNA sequence
tattcatcaggtttagagat

SEQ ID NO: 631700 - DNA, 20 bp, Artificial
  CRISPR gRNA sequence
attcatcaggtttagagata

SEQ ID NO: 631701 - DNA, 20 bp, Artificial
  CRISPR gRNA sequence
ttcatcaggtttagagataa

SEQ ID NO: 631702 - DNA, 20 bp, Artificial
  CRISPR gRNA sequence
atcaggtttagagataatct

SEQ ID NO: 631703 - DNA, 20 bp, Artificial
  CRISPR gRNA sequence
agagataatctattgcttct

SEQ ID NO: 631704 - DNA, 20 bp, Artificial
  CRISPR gRNA sequence
gagataatctattgcttctc

SEQ ID NO: 631705 - DNA, 20 bp, Artificial
  CRISPR gRNA sequence
ttgcttctctgtcctggtag

SEQ ID NO: 631706 - DNA, 20 bp, Artificial
  CRISPR gRNA sequence
cttctctgtcctggtagtta

SEQ ID NO: 631707 - DNA, 20 bp, Artificial
  CRISPR gRNA sequence
ctctgtcctggtagttaagg

SEQ ID NO: 631708 - DNA, 20 bp, Artificial
  CRISPR gRNA sequence
tctgtcctggtagttaagga

SEQ ID NO: 631709 - DNA, 20 bp, Artificial
  CRISPR gRNA sequence
tgtcctggtagttaaggatt

SEQ ID NO: 631710 - DNA, 20 bp, Artificial
  CRISPR gRNA sequence
tcctggtagttaaggattca

SEQ ID NO: 631711 - DNA, 20 bp, Artificial
  CRISPR gRNA sequence
gtagttaaggattcagctct

SEQ ID NO: 631712 - DNA, 20 bp, Artificial
  CRISPR gRNA sequence
aggattcagctctcttacaa

SEQ ID NO: 631713 - DNA, 20 bp, Artificial
  CRISPR gRNA sequence
agctctcttacaaacaccct

SEQ ID NO: 631714 - DNA, 20 bp, Artificial
  CRISPR gRNA sequence
tcttacaaacaccctctcaa

SEQ ID NO: 631715 - DNA, 20 bp, Artificial
  CRISPR gRNA sequence
ttacaaacaccctctcaatt

SEQ ID NO: 631716 - DNA, 20 bp, Artificial
  CRISPR gRNA sequence
acaaacaccctctcaattct

SEQ ID NO: 631717 - DNA, 20 bp, Artificial
  CRISPR gRNA sequence
caaacaccctctcaattctc

SEQ ID NO: 631718 - DNA, 20 bp, Artificial
  CRISPR gRNA sequence
tcaattctcacttctgtggt

SEQ ID NO: 631719 - DNA, 20 bp, Artificial
  CRISPR gRNA sequence
aattctcacttctgtggtct

SEQ ID NO: 631720 - DNA, 20 bp, Artificial
  CRISPR gRNA sequence
tcacttctgtggtctttcaa

SEQ ID NO: 631721 - DNA, 20 bp, Artificial
  CRISPR gRNA sequence
acttctgtggtctttcaata

SEQ ID NO: 631722 - DNA, 20 bp, Artificial
  CRISPR gRNA sequence
ctgtggtctttcaatagtta

SEQ ID NO: 631723 - DNA, 20 bp, Artificial
  CRISPR gRNA sequence
tgtggtctttcaatagttac

SEQ ID NO: 631724 - DNA, 20 bp, Artificial
  CRISPR gRNA sequence
tggtctttcaatagttacat

SEQ ID NO: 631725 - DNA, 20 bp, Artificial
  CRISPR gRNA sequence
tcaatagttacataatcatt

SEQ ID NO: 631726 - DNA, 20 bp, Artificial
  CRISPR gRNA sequence
caatagttacataatcattt

SEQ ID NO: 631727 - DNA, 20 bp, Artificial
  CRISPR gRNA sequence
aatagttacataatcatttc

SEQ ID NO: 631728 - DNA, 20 bp, Artificial
  CRISPR gRNA sequence
cataatcatttctgattaat

SEQ ID NO: 631729 - DNA, 20 bp, Artificial
  CRISPR gRNA sequence
ctgattaatagtatagaaat

SEQ ID NO: 631730 - DNA, 20 bp, Artificial
  CRISPR gRNA sequence
tgattaatagtatagaaatg

SEQ ID NO: 631731 - DNA, 20 bp, Artificial
  CRISPR gRNA sequence
attaatagtatagaaatgga

SEQ ID NO: 631732 - DNA, 20 bp, Artificial
  CRISPR gRNA sequence
atagtatagaaatggaaatt

SEQ ID NO: 631733 - DNA, 20 bp, Artificial
  CRISPR gRNA sequence
ccagtagtcatagaaatatt

SEQ ID NO: 631734 - DNA, 20 bp, Artificial
  CRISPR gRNA sequence
cagtagtcatagaaatatta

SEQ ID NO: 631735 - DNA, 20 bp, Artificial
  CRISPR gRNA sequence
atcataacatactatttggc

SEQ ID NO: 631736 - DNA, 20 bp, Artificial
  CRISPR gRNA sequence
tttggctcaacagtgattac

SEQ ID NO: 631737 - DNA, 20 bp, Artificial
  CRISPR gRNA sequence
ggctcaacagtgattacatt

SEQ ID NO: 631738 - DNA, 20 bp, Artificial
  CRISPR gRNA sequence
gctcaacagtgattacattt

SEQ ID NO: 631739 - DNA, 20 bp, Artificial
  CRISPR gRNA sequence
aacagtgattacatttcctt

SEQ ID NO: 631740 - DNA, 20 bp, Artificial
  CRISPR gRNA sequence
catttccttttttgtgcagc

SEQ ID NO: 631741 - DNA, 20 bp, Artificial
  CRISPR gRNA sequence
ccttttttgtgcagctttta

SEQ ID NO: 631742 - DNA, 20 bp, Artificial
  CRISPR gRNA sequence
cttttttgtgcagcttttaa

SEQ ID NO: 631743 - DNA, 20 bp, Artificial
  CRISPR gRNA sequence
ttttgtgcagcttttaattt

SEQ ID NO: 631744 - DNA, 20 bp, Artificial
  CRISPR gRNA sequence
tttgtgcagcttttaatttt

SEQ ID NO: 631745 - DNA, 20 bp, Artificial
  CRISPR gRNA sequence
ttgtgcagcttttaattttt

SEQ ID NO: 631746 - DNA, 20 bp, Artificial
  CRISPR gRNA sequence
tgtgcagcttttaatttttc

SEQ ID NO: 631747 - DNA, 20 bp, Artificial
  CRISPR gRNA sequence
gtgcagcttttaatttttcc

SEQ ID NO: 631748 - DNA, 20 bp, Artificial
  CRISPR gRNA sequence
tgcagcttttaatttttcct

SEQ ID NO: 631749 - DNA, 20 bp, Artificial
  CRISPR gRNA sequence
ttaatttttcctagagttaa

SEQ ID NO: 631750 - DNA, 20 bp, Artificial
  CRISPR gRNA sequence
taatttttcctagagttaat

SEQ ID NO: 631751 - DNA, 20 bp, Artificial
  CRISPR gRNA sequence
aatttttcctagagttaata

SEQ ID NO: 631752 - DNA, 20 bp, Artificial
  CRISPR gRNA sequence
atttttcctagagttaataa

SEQ ID NO: 631753 - DNA, 20 bp, Artificial
  CRISPR gRNA sequence
ttcctagagttaataatcgt

SEQ ID NO: 631754 - DNA, 20 bp, Artificial
  CRISPR gRNA sequence
tcctagagttaataatcgtc

SEQ ID NO: 631755 - DNA, 20 bp, Artificial
  CRISPR gRNA sequence
cctagagttaataatcgtct

SEQ ID NO: 631756 - DNA, 20 bp, Artificial
  CRISPR gRNA sequence
ctagagttaataatcgtctc

SEQ ID NO: 631757 - DNA, 20 bp, Artificial
  CRISPR gRNA sequence
gagttaataatcgtctcact

SEQ ID NO: 631758 - DNA, 20 bp, Artificial
  CRISPR gRNA sequence
ataatcgtctcactttttat

SEQ ID NO: 631759 - DNA, 20 bp, Artificial
  CRISPR gRNA sequence
actttttattttgcttgtgt

SEQ ID NO: 631760 - DNA, 20 bp, Artificial
  CRISPR gRNA sequence
tttattttgcttgtgtttct

SEQ ID NO: 631761 - DNA, 20 bp, Artificial
  CRISPR gRNA sequence
ttattttgcttgtgtttctg

SEQ ID NO: 631762 - DNA, 20 bp, Artificial
  CRISPR gRNA sequence
tattttgcttgtgtttctgt

SEQ ID NO: 631763 - DNA, 20 bp, Artificial
  CRISPR gRNA sequence
attttgcttgtgtttctgta

SEQ ID NO: 631764 - DNA, 20 bp, Artificial
  CRISPR gRNA sequence
ttttgcttgtgtttctgtat

SEQ ID NO: 631765 - DNA, 20 bp, Artificial
  CRISPR gRNA sequence
tgcttgtgtttctgtatcca

SEQ ID NO: 631766 - DNA, 20 bp, Artificial
  CRISPR gRNA sequence
gcttgtgtttctgtatccag

SEQ ID NO: 631767 - DNA, 20 bp, Artificial
  CRISPR gRNA sequence
cttgtgtttctgtatccagt

SEQ ID NO: 631768 - DNA, 20 bp, Artificial
  CRISPR gRNA sequence
gtgtttctgtatccagtgcc

SEQ ID NO: 631769 - DNA, 20 bp, Artificial
  CRISPR gRNA sequence
tgtttctgtatccagtgcca

SEQ ID NO: 631770 - DNA, 20 bp, Artificial
  CRISPR gRNA sequence
ctgtatccagtgccacttac

SEQ ID NO: 631771 - DNA, 20 bp, Artificial
  CRISPR gRNA sequence
tgtatccagtgccacttacc

SEQ ID NO: 631772 - DNA, 20 bp, Artificial
  CRISPR gRNA sequence
tatccagtgccacttacccc

SEQ ID NO: 631773 - DNA, 20 bp, Artificial
  CRISPR gRNA sequence
accccttcctctgaggttct

SEQ ID NO: 631774 - DNA, 20 bp, Artificial
  CRISPR gRNA sequence
ccccttcctctgaggttctc

SEQ ID NO: 631775 - DNA, 20 bp, Artificial
  CRISPR gRNA sequence
cctctgaggttctcacacct

SEQ ID NO: 631776 - DNA, 20 bp, Artificial
  CRISPR gRNA sequence
ctctgaggttctcacacctt

SEQ ID NO: 631777 - DNA, 20 bp, Artificial
  CRISPR gRNA sequence
tgaggttctcacaccttact

SEQ ID NO: 631778 - DNA, 20 bp, Artificial
  CRISPR gRNA sequence
aggttctcacaccttactga

SEQ ID NO: 631779 - DNA, 20 bp, Artificial
  CRISPR gRNA sequence
tcacaccttactgataactc

SEQ ID NO: 631780 - DNA, 20 bp, Artificial
  CRISPR gRNA sequence
acaccttactgataactcag

SEQ ID NO: 631781 - DNA, 20 bp, Artificial
  CRISPR gRNA sequence
actgataactcagagtccag

SEQ ID NO: 631782 - DNA, 20 bp, Artificial
  CRISPR gRNA sequence
ctgataactcagagtccaga

SEQ ID NO: 631783 - DNA, 20 bp, Artificial
  CRISPR gRNA sequence
ataactcagagtccagaaca

SEQ ID NO: 631784 - DNA, 20 bp, Artificial
  CRISPR gRNA sequence
agagtccagaacaatgtcat

SEQ ID NO: 631785 - DNA, 20 bp, Artificial
  CRISPR gRNA sequence
gccagtctcactttcctctt

SEQ ID NO: 631786 - DNA, 20 bp, Artificial
  CRISPR gRNA sequence
ccagtctcactttcctcttg

SEQ ID NO: 631787 - DNA, 20 bp, Artificial
  CRISPR gRNA sequence
actttcctcttgccttctca

SEQ ID NO: 631788 - DNA, 20 bp, Artificial
  CRISPR gRNA sequence
tcctcttgccttctcacaac

SEQ ID NO: 631789 - DNA, 20 bp, Artificial
  CRISPR gRNA sequence
cctcttgccttctcacaacc

SEQ ID NO: 631790 - DNA, 20 bp, Artificial
  CRISPR gRNA sequence
ctcttgccttctcacaacca

SEQ ID NO: 631791 - DNA, 20 bp, Artificial
  CRISPR gRNA sequence
ttgccttctcacaaccattg

SEQ ID NO: 631792 - DNA, 20 bp, Artificial
  CRISPR gRNA sequence
gccttctcacaaccattggc

SEQ ID NO: 631793 - DNA, 20 bp, Artificial
  CRISPR gRNA sequence
ccttctcacaaccattggca

SEQ ID NO: 631794 - DNA, 20 bp, Artificial
  CRISPR gRNA sequence
ctcacaaccattggcacccc

SEQ ID NO: 631795 - DNA, 20 bp, Artificial
  CRISPR gRNA sequence
tcacaaccattggcacccct

SEQ ID NO: 631796 - DNA, 20 bp, Artificial
  CRISPR gRNA sequence
acaaccattggcaccccttt

SEQ ID NO: 631797 - DNA, 20 bp, Artificial
  CRISPR gRNA sequence
gcacccctttctccagttgg

SEQ ID NO: 631798 - DNA, 20 bp, Artificial
  CRISPR gRNA sequence
tctccagttggaactgatgg

SEQ ID NO: 631799 - DNA, 20 bp, Artificial
  CRISPR gRNA sequence
ctccagttggaactgatggt

SEQ ID NO: 631800 - DNA, 20 bp, Artificial
  CRISPR gRNA sequence
tccagttggaactgatggta

SEQ ID NO: 631801 - DNA, 20 bp, Artificial
  CRISPR gRNA sequence
cagttggaactgatggtacc

SEQ ID NO: 631802 - DNA, 20 bp, Artificial
  CRISPR gRNA sequence
gaactgatggtaccctgggt

SEQ ID NO: 631803 - DNA, 20 bp, Artificial
  CRISPR gRNA sequence
atggtaccctgggtttatta

SEQ ID NO: 631804 - DNA, 20 bp, Artificial
  CRISPR gRNA sequence
ggtttattacagagttgtta

SEQ ID NO: 631805 - DNA, 20 bp, Artificial
  CRISPR gRNA sequence
attacagagttgttatccag

SEQ ID NO: 631806 - DNA, 20 bp, Artificial
  CRISPR gRNA sequence
ttacagagttgttatccaga

SEQ ID NO: 631807 - DNA, 20 bp, Artificial
  CRISPR gRNA sequence
cagagttgttatccagaact

SEQ ID NO: 631808 - DNA, 20 bp, Artificial
  CRISPR gRNA sequence
ttatccagaactttcctttg

SEQ ID NO: 631809 - DNA, 20 bp, Artificial
  CRISPR gRNA sequence
tccagaactttcctttgtcc

SEQ ID NO: 631810 - DNA, 20 bp, Artificial
  CRISPR gRNA sequence
tcctttgtccccctcatgat

SEQ ID NO: 631811 - DNA, 20 bp, Artificial
  CRISPR gRNA sequence
cctttgtccccctcatgatt

SEQ ID NO: 631812 - DNA, 20 bp, Artificial
  CRISPR gRNA sequence
ctttgtccccctcatgatta

SEQ ID NO: 631813 - DNA, 20 bp, Artificial
  CRISPR gRNA sequence
tgtccccctcatgattagtc

SEQ ID NO: 631814 - DNA, 20 bp, Artificial
  CRISPR gRNA sequence
gtccccctcatgattagtct

SEQ ID NO: 631815 - DNA, 20 bp, Artificial
  CRISPR gRNA sequence
tccccctcatgattagtctt

SEQ ID NO: 631816 - DNA, 20 bp, Artificial
  CRISPR gRNA sequence
atgattagtcttctgctgcc

SEQ ID NO: 631817 - DNA, 20 bp, Artificial
  CRISPR gRNA sequence
gtcttctgctgcctgaatcc

SEQ ID NO: 631818 - DNA, 20 bp, Artificial
  CRISPR gRNA sequence
ctgctgcctgaatcccatgt

SEQ ID NO: 631819 - DNA, 20 bp, Artificial
  CRISPR gRNA sequence
tgctgcctgaatcccatgtt

SEQ ID NO: 631820 - DNA, 20 bp, Artificial
  CRISPR gRNA sequence
ctgcctgaatcccatgtttt

SEQ ID NO: 631821 - DNA, 20 bp, Artificial
  CRISPR gRNA sequence
cctgaatcccatgttttcct

SEQ ID NO: 631822 - DNA, 20 bp, Artificial
  CRISPR gRNA sequence
aatcccatgttttcctcttc

SEQ ID NO: 631823 - DNA, 20 bp, Artificial
  CRISPR gRNA sequence
tcctcttcgttgggtttaga

SEQ ID NO: 631824 - DNA, 20 bp, Artificial
  CRISPR gRNA sequence
cctcttcgttgggtttagaa

SEQ ID NO: 631825 - DNA, 20 bp, Artificial
  CRISPR gRNA sequence
ctcttcgttgggtttagaat

SEQ ID NO: 631826 - DNA, 20 bp, Artificial
  CRISPR gRNA sequence
ttcgttgggtttagaatttc

SEQ ID NO: 631827 - DNA, 20 bp, Artificial
  CRISPR gRNA sequence
cgttgggtttagaatttcca

SEQ ID NO: 631828 - DNA, 20 bp, Artificial
  CRISPR gRNA sequence
gttgggtttagaatttccag

SEQ ID NO: 631829 - DNA, 20 bp, Artificial
  CRISPR gRNA sequence
ggtttagaatttccaggttg

SEQ ID NO: 631830 - DNA, 20 bp, Artificial
  CRISPR gRNA sequence
agaatttccaggttgaaact

SEQ ID NO: 631831 - DNA, 20 bp, Artificial
  CRISPR gRNA sequence
gaatttccaggttgaaactc

SEQ ID NO: 631832 - DNA, 20 bp, Artificial
  CRISPR gRNA sequence
ccaggttgaaactcattttc

SEQ ID NO: 631833 - DNA, 20 bp, Artificial
  CRISPR gRNA sequence
caggttgaaactcattttct

SEQ ID NO: 631834 - DNA, 20 bp, Artificial
  CRISPR gRNA sequence
aaactcattttctcttaaca

SEQ ID NO: 631835 - DNA, 20 bp, Artificial
  CRISPR gRNA sequence
attttctcttaacattttga

SEQ ID NO: 631836 - DNA, 20 bp, Artificial
  CRISPR gRNA sequence
tctcttaacattttgaagcc

SEQ ID NO: 631837 - DNA, 20 bp, Artificial
  CRISPR gRNA sequence
ctcttaacattttgaagcct

SEQ ID NO: 631838 - DNA, 20 bp, Artificial
  CRISPR gRNA sequence
tcttaacattttgaagcctt

SEQ ID NO: 631839 - DNA, 20 bp, Artificial
  CRISPR gRNA sequence
ttaacattttgaagcctttt

SEQ ID NO: 631840 - DNA, 20 bp, Artificial
  CRISPR gRNA sequence
aacattttgaagcctttttt

SEQ ID NO: 631841 - DNA, 20 bp, Artificial
  CRISPR gRNA sequence
acattttgaagccttttttt

SEQ ID NO: 631842 - DNA, 20 bp, Artificial
  CRISPR gRNA sequence
tgaagcctttttttcactgg

SEQ ID NO: 631843 - DNA, 20 bp, Artificial
  CRISPR gRNA sequence
gaagcctttttttcactggg

SEQ ID NO: 631844 - DNA, 20 bp, Artificial
  CRISPR gRNA sequence
aagcctttttttcactgggc

SEQ ID NO: 631845 - DNA, 20 bp, Artificial
  CRISPR gRNA sequence
tttttcactgggctactaac

SEQ ID NO: 631846 - DNA, 20 bp, Artificial
  CRISPR gRNA sequence
ttttcactgggctactaacc

SEQ ID NO: 631847 - DNA, 20 bp, Artificial
  CRISPR gRNA sequence
tttcactgggctactaacct

SEQ ID NO: 631848 - DNA, 20 bp, Artificial
  CRISPR gRNA sequence
ttcactgggctactaacctc

SEQ ID NO: 631849 - DNA, 20 bp, Artificial
  CRISPR gRNA sequence
tcactgggctactaacctcc

SEQ ID NO: 631850 - DNA, 20 bp, Artificial
  CRISPR gRNA sequence
cactgggctactaacctcca

SEQ ID NO: 631851 - DNA, 20 bp, Artificial
  CRISPR gRNA sequence
actgggctactaacctccaa

SEQ ID NO: 631852 - DNA, 20 bp, Artificial
  CRISPR gRNA sequence
ggctactaacctccaaagtt

SEQ ID NO: 631853 - DNA, 20 bp, Artificial
  CRISPR gRNA sequence
ctaacctccaaagtttcttt

SEQ ID NO: 631854 - DNA, 20 bp, Artificial
  CRISPR gRNA sequence
acctccaaagtttcttttta

SEQ ID NO: 631855 - DNA, 20 bp, Artificial
  CRISPR gRNA sequence
caaagtttctttttaaaagt

SEQ ID NO: 631856 - DNA, 20 bp, Artificial
  CRISPR gRNA sequence
ctttttaaaagtattatata

SEQ ID NO: 631857 - DNA, 20 bp, Artificial
  CRISPR gRNA sequence
tttttaaaagtattatataa

SEQ ID NO: 631858 - DNA, 20 bp, Artificial
  CRISPR gRNA sequence
tttaaaagtattatataaat

SEQ ID NO: 631859 - DNA, 20 bp, Artificial
  CRISPR gRNA sequence
ttaaaagtattatataaata

SEQ ID NO: 631860 - DNA, 20 bp, Artificial
  CRISPR gRNA sequence
taaaagtattatataaatat

SEQ ID NO: 631861 - DNA, 20 bp, Artificial
  CRISPR gRNA sequence
aaaagtattatataaatata

SEQ ID NO: 631862 - DNA, 20 bp, Artificial
  CRISPR gRNA sequence
aaagtattatataaatatag

SEQ ID NO: 631863 - DNA, 20 bp, Artificial
  CRISPR gRNA sequence
tataaatatagctttatatg

SEQ ID NO: 631864 - DNA, 20 bp, Artificial
  CRISPR gRNA sequence
tatatgtggcctgtttgtct

SEQ ID NO: 631865 - DNA, 20 bp, Artificial
  CRISPR gRNA sequence
atatgtggcctgtttgtctg

SEQ ID NO: 631866 - DNA, 20 bp, Artificial
  CRISPR gRNA sequence
tatgtggcctgtttgtctga

SEQ ID NO: 631867 - DNA, 20 bp, Artificial
  CRISPR gRNA sequence
tttgtctgaaagctcttagt

SEQ ID NO: 631868 - DNA, 20 bp, Artificial
  CRISPR gRNA sequence
gtctgaaagctcttagtaac

SEQ ID NO: 631869 - DNA, 20 bp, Artificial
  CRISPR gRNA sequence
tctgaaagctcttagtaact

SEQ ID NO: 631870 - DNA, 20 bp, Artificial
  CRISPR gRNA sequence
aaagctcttagtaacttcag

SEQ ID NO: 631871 - DNA, 20 bp, Artificial
  CRISPR gRNA sequence
ttagtaacttcagtttgtcc

SEQ ID NO: 631872 - DNA, 20 bp, Artificial
  CRISPR gRNA sequence
agtaacttcagtttgtcctt

SEQ ID NO: 631873 - DNA, 20 bp, Artificial
  CRISPR gRNA sequence
gtaacttcagtttgtccttg

SEQ ID NO: 631874 - DNA, 20 bp, Artificial
  CRISPR gRNA sequence
cagtttgtccttgatgttct

SEQ ID NO: 631875 - DNA, 20 bp, Artificial
  CRISPR gRNA sequence
agtttgtccttgatgttctg

SEQ ID NO: 631876 - DNA, 20 bp, Artificial
  CRISPR gRNA sequence
gtccttgatgttctgaaatt

SEQ ID NO: 631877 - DNA, 20 bp, Artificial
  CRISPR gRNA sequence
tccttgatgttctgaaattc

SEQ ID NO: 631878 - DNA, 20 bp, Artificial
  CRISPR gRNA sequence
gatgttctgaaattctgaaa

SEQ ID NO: 631879 - DNA, 20 bp, Artificial
  CRISPR gRNA sequence
atgttctgaaattctgaaat

SEQ ID NO: 631880 - DNA, 20 bp, Artificial
  CRISPR gRNA sequence
tgaaattctgaaatatgagc

SEQ ID NO: 631881 - DNA, 20 bp, Artificial
  CRISPR gRNA sequence
aaattctgaaatatgagcgt

SEQ ID NO: 631882 - DNA, 20 bp, Artificial
  CRISPR gRNA sequence
tgaaatatgagcgtatgtct

SEQ ID NO: 631883 - DNA, 20 bp, Artificial
  CRISPR gRNA sequence
aaatatgagcgtatgtctct

SEQ ID NO: 631884 - DNA, 20 bp, Artificial
  CRISPR gRNA sequence
tggtctaaagtctctaattt

SEQ ID NO: 631885 - DNA, 20 bp, Artificial
  CRISPR gRNA sequence
gtctaaagtctctaatttgg

SEQ ID NO: 631886 - DNA, 20 bp, Artificial
  CRISPR gRNA sequence
aagtctctaatttggatgtt

SEQ ID NO: 631887 - DNA, 20 bp, Artificial
  CRISPR gRNA sequence
taatttggatgtttgtccct

SEQ ID NO: 631888 - DNA, 20 bp, Artificial
  CRISPR gRNA sequence
atttggatgtttgtccctta

SEQ ID NO: 631889 - DNA, 20 bp, Artificial
  CRISPR gRNA sequence
ggatgtttgtcccttacctc

SEQ ID NO: 631890 - DNA, 20 bp, Artificial
  CRISPR gRNA sequence
gatgtttgtcccttacctct

SEQ ID NO: 631891 - DNA, 20 bp, Artificial
  CRISPR gRNA sequence
gtcccttacctctcaagaaa

SEQ ID NO: 631892 - DNA, 20 bp, Artificial
  CRISPR gRNA sequence
tcccttacctctcaagaaat

SEQ ID NO: 631893 - DNA, 20 bp, Artificial
  CRISPR gRNA sequence
acctctcaagaaatatgtgt

SEQ ID NO: 631894 - DNA, 20 bp, Artificial
  CRISPR gRNA sequence
cctctcaagaaatatgtgtc

SEQ ID NO: 631895 - DNA, 20 bp, Artificial
  CRISPR gRNA sequence
tcaagaaatatgtgtctgta

SEQ ID NO: 631896 - DNA, 20 bp, Artificial
  CRISPR gRNA sequence
aagaaatatgtgtctgtact

SEQ ID NO: 631897 - DNA, 20 bp, Artificial
  CRISPR gRNA sequence
tactatatataataagtata

SEQ ID NO: 631898 - DNA, 20 bp, Artificial
  CRISPR gRNA sequence
tatataataagtatatacta

SEQ ID NO: 631899 - DNA, 20 bp, Artificial
  CRISPR gRNA sequence
gttcacatattgcagaatat

SEQ ID NO: 631900 - DNA, 20 bp, Artificial
  CRISPR gRNA sequence
acatattgcagaatatttac

SEQ ID NO: 631901 - DNA, 20 bp, Artificial
  CRISPR gRNA sequence
cagaatatttacatatatac

SEQ ID NO: 631902 - DNA, 20 bp, Artificial
  CRISPR gRNA sequence
acatatatacagataaaaca

SEQ ID NO: 631903 - DNA, 20 bp, Artificial
  CRISPR gRNA sequence
catatatacagataaaacaa

SEQ ID NO: 631904 - DNA, 20 bp, Artificial
  CRISPR gRNA sequence
aacatcgattcacataatta

SEQ ID NO: 631905 - DNA, 20 bp, Artificial
  CRISPR gRNA sequence
acatcgattcacataattac

SEQ ID NO: 631906 - DNA, 20 bp, Artificial
  CRISPR gRNA sequence
acataattactatagttgtc

SEQ ID NO: 631907 - DNA, 20 bp, Artificial
  CRISPR gRNA sequence
ctatagttgtcaaaagtcta

SEQ ID NO: 631908 - DNA, 20 bp, Artificial
  CRISPR gRNA sequence
tagttgtcaaaagtctatgg

SEQ ID NO: 631909 - DNA, 20 bp, Artificial
  CRISPR gRNA sequence
tcaaaagtctatggctattt

SEQ ID NO: 631910 - DNA, 20 bp, Artificial
  CRISPR gRNA sequence
tggctatttcaacttaattt

SEQ ID NO: 631911 - DNA, 20 bp, Artificial
  CRISPR gRNA sequence
tttcaacttaatttttatat

SEQ ID NO: 631912 - DNA, 20 bp, Artificial
  CRISPR gRNA sequence
caacttaatttttatatatg

SEQ ID NO: 631913 - DNA, 20 bp, Artificial
  CRISPR gRNA sequence
aacttaatttttatatatgg

SEQ ID NO: 631914 - DNA, 20 bp, Artificial
  CRISPR gRNA sequence
aatttttatatatggcataa

SEQ ID NO: 631915 - DNA, 20 bp, Artificial
  CRISPR gRNA sequence
atttttatatatggcataag

SEQ ID NO: 631916 - DNA, 20 bp, Artificial
  CRISPR gRNA sequence
ttatatatggcataagagtc

SEQ ID NO: 631917 - DNA, 20 bp, Artificial
  CRISPR gRNA sequence
tatatatggcataagagtct

SEQ ID NO: 631918 - DNA, 20 bp, Artificial
  CRISPR gRNA sequence
atatatggcataagagtctt

SEQ ID NO: 631919 - DNA, 20 bp, Artificial
  CRISPR gRNA sequence
tatatggcataagagtctta

SEQ ID NO: 631920 - DNA, 20 bp, Artificial
  CRISPR gRNA sequence
agaccatttttttcaaaaat

SEQ ID NO: 631921 - DNA, 20 bp, Artificial
  CRISPR gRNA sequence
gaccatttttttcaaaaata

SEQ ID NO: 631922 - DNA, 20 bp, Artificial
  CRISPR gRNA sequence
ttttcaaaaatatgggtatt

SEQ ID NO: 631923 - DNA, 20 bp, Artificial
  CRISPR gRNA sequence
tttcaaaaatatgggtattc

SEQ ID NO: 631924 - DNA, 20 bp, Artificial
  CRISPR gRNA sequence
ttcaaaaatatgggtattca

SEQ ID NO: 631925 - DNA, 20 bp, Artificial
  CRISPR gRNA sequence
tcaaaaatatgggtattcag

SEQ ID NO: 631926 - DNA, 20 bp, Artificial
  CRISPR gRNA sequence
caaaaatatgggtattcagt

SEQ ID NO: 631927 - DNA, 20 bp, Artificial
  CRISPR gRNA sequence
aaaaatatgggtattcagtt

SEQ ID NO: 631928 - DNA, 20 bp, Artificial
  CRISPR gRNA sequence
agttgttctagacccattta

SEQ ID NO: 631929 - DNA, 20 bp, Artificial
  CRISPR gRNA sequence
ttctagacccatttatagaa

SEQ ID NO: 631930 - DNA, 20 bp, Artificial
  CRISPR gRNA sequence
tagacccatttatagaaaat

SEQ ID NO: 631931 - DNA, 20 bp, Artificial
  CRISPR gRNA sequence
gacccatttatagaaaatat

SEQ ID NO: 631932 - DNA, 20 bp, Artificial
  CRISPR gRNA sequence
atagaaaatattatcctttc

SEQ ID NO: 631933 - DNA, 20 bp, Artificial
  CRISPR gRNA sequence
tagaaaatattatcctttcc

SEQ ID NO: 631934 - DNA, 20 bp, Artificial
  CRISPR gRNA sequence
tcctttccccccttaaatta

SEQ ID NO: 631935 - DNA, 20 bp, Artificial
  CRISPR gRNA sequence
tccccccttaaattatctca

SEQ ID NO: 631936 - DNA, 20 bp, Artificial
  CRISPR gRNA sequence
ccccccttaaattatctcag

SEQ ID NO: 631937 - DNA, 20 bp, Artificial
  CRISPR gRNA sequence
cccccttaaattatctcagt

SEQ ID NO: 631938 - DNA, 20 bp, Artificial
  CRISPR gRNA sequence
aaattatctcagtacctttg

SEQ ID NO: 631939 - DNA, 20 bp, Artificial
  CRISPR gRNA sequence
aattatctcagtacctttgt

SEQ ID NO: 631940 - DNA, 20 bp, Artificial
  CRISPR gRNA sequence
tctcagtacctttgttgaaa

SEQ ID NO: 631941 - DNA, 20 bp, Artificial
  CRISPR gRNA sequence
agtacctttgttgaaaatca

SEQ ID NO: 631942 - DNA, 20 bp, Artificial
  CRISPR gRNA sequence
tgttgaaaatcaactgacca

SEQ ID NO: 631943 - DNA, 20 bp, Artificial
  CRISPR gRNA sequence
gttgaaaatcaactgaccaa

SEQ ID NO: 631944 - DNA, 20 bp, Artificial
  CRISPR gRNA sequence
ttgaaaatcaactgaccaat

SEQ ID NO: 631945 - DNA, 20 bp, Artificial
  CRISPR gRNA sequence
aaaatcaactgaccaatttg

SEQ ID NO: 631946 - DNA, 20 bp, Artificial
  CRISPR gRNA sequence
accaatttgggttctatttc

SEQ ID NO: 631947 - DNA, 20 bp, Artificial
  CRISPR gRNA sequence
gggttctatttctggactct

SEQ ID NO: 631948 - DNA, 20 bp, Artificial
  CRISPR gRNA sequence
ggttctatttctggactcta

SEQ ID NO: 631949 - DNA, 20 bp, Artificial
  CRISPR gRNA sequence
tatttctggactctattcca

SEQ ID NO: 631950 - DNA, 20 bp, Artificial
  CRISPR gRNA sequence
tttctggactctattccatt

SEQ ID NO: 631951 - DNA, 20 bp, Artificial
  CRISPR gRNA sequence
ctggactctattccattcca

SEQ ID NO: 631952 - DNA, 20 bp, Artificial
  CRISPR gRNA sequence
tggactctattccattccat

SEQ ID NO: 631953 - DNA, 20 bp, Artificial
  CRISPR gRNA sequence
gactctattccattccatta

SEQ ID NO: 631954 - DNA, 20 bp, Artificial
  CRISPR gRNA sequence
tattccattccattaacctc

SEQ ID NO: 631955 - DNA, 20 bp, Artificial
  CRISPR gRNA sequence
ttccattccattaacctcta

SEQ ID NO: 631956 - DNA, 20 bp, Artificial
  CRISPR gRNA sequence
cattccattaacctctatgt

SEQ ID NO: 631957 - DNA, 20 bp, Artificial
  CRISPR gRNA sequence
cattaacctctatgtctata

SEQ ID NO: 631958 - DNA, 20 bp, Artificial
  CRISPR gRNA sequence
acctctatgtctatacttaa

SEQ ID NO: 631959 - DNA, 20 bp, Artificial
  CRISPR gRNA sequence
tatgtctatacttaaaccaa

SEQ ID NO: 631960 - DNA, 20 bp, Artificial
  CRISPR gRNA sequence
tgtctatacttaaaccaaca

SEQ ID NO: 631961 - DNA, 20 bp, Artificial
  CRISPR gRNA sequence
tacttaaaccaacagagcaa

SEQ ID NO: 631962 - DNA, 20 bp, Artificial
  CRISPR gRNA sequence
aaaccaacagagcaagtctt

SEQ ID NO: 631963 - DNA, 20 bp, Artificial
  CRISPR gRNA sequence
aaccaacagagcaagtctta

SEQ ID NO: 631964 - DNA, 20 bp, Artificial
  CRISPR gRNA sequence
aggaatagatttggaatcag

SEQ ID NO: 631965 - DNA, 20 bp, Artificial
  CRISPR gRNA sequence
ggaatagatttggaatcagg

SEQ ID NO: 631966 - DNA, 20 bp, Artificial
  CRISPR gRNA sequence
ggaatcaggcagtgcaagtc

SEQ ID NO: 631967 - DNA, 20 bp, Artificial
  CRISPR gRNA sequence
gaatcaggcagtgcaagtca

SEQ ID NO: 631968 - DNA, 20 bp, Artificial
  CRISPR gRNA sequence
ggcttttcaaaattattttg

SEQ ID NO: 631969 - DNA, 20 bp, Artificial
  CRISPR gRNA sequence
gcttttcaaaattattttgg

SEQ ID NO: 631970 - DNA, 20 bp, Artificial
  CRISPR gRNA sequence
ttcaaaattattttggctat

SEQ ID NO: 631971 - DNA, 20 bp, Artificial
  CRISPR gRNA sequence
tcaaaattattttggctatt

SEQ ID NO: 631972 - DNA, 20 bp, Artificial
  CRISPR gRNA sequence
caaaattattttggctattt

SEQ ID NO: 631973 - DNA, 20 bp, Artificial
  CRISPR gRNA sequence
aaaattattttggctatttt

SEQ ID NO: 631974 - DNA, 20 bp, Artificial
  CRISPR gRNA sequence
ttttggctattttaggtcta

SEQ ID NO: 631975 - DNA, 20 bp, Artificial
  CRISPR gRNA sequence
tggctattttaggtctacat

SEQ ID NO: 631976 - DNA, 20 bp, Artificial
  CRISPR gRNA sequence
ggctattttaggtctacatt

SEQ ID NO: 631977 - DNA, 20 bp, Artificial
  CRISPR gRNA sequence
gctattttaggtctacattt

SEQ ID NO: 631978 - DNA, 20 bp, Artificial
  CRISPR gRNA sequence
ttttaggtctacatttccaa

SEQ ID NO: 631979 - DNA, 20 bp, Artificial
  CRISPR gRNA sequence
taggtctacatttccaaaca

SEQ ID NO: 631980 - DNA, 20 bp, Artificial
  CRISPR gRNA sequence
aggtctacatttccaaacaa

SEQ ID NO: 631981 - DNA, 20 bp, Artificial
  CRISPR gRNA sequence
ggtctacatttccaaacaaa

SEQ ID NO: 631982 - DNA, 20 bp, Artificial
  CRISPR gRNA sequence
catttccaaacaaagtttgt

SEQ ID NO: 631983 - DNA, 20 bp, Artificial
  CRISPR gRNA sequence
ccaaacaaagtttgtaatca

SEQ ID NO: 631984 - DNA, 20 bp, Artificial
  CRISPR gRNA sequence
caaacaaagtttgtaatcag

SEQ ID NO: 631985 - DNA, 20 bp, Artificial
  CRISPR gRNA sequence
gtaatcagtttgccaatttc

SEQ ID NO: 631986 - DNA, 20 bp, Artificial
  CRISPR gRNA sequence
taatcagtttgccaatttct

SEQ ID NO: 631987 - DNA, 20 bp, Artificial
  CRISPR gRNA sequence
gccaatttctgttaaaaagc

SEQ ID NO: 631988 - DNA, 20 bp, Artificial
  CRISPR gRNA sequence
ccaatttctgttaaaaagct

SEQ ID NO: 631989 - DNA, 20 bp, Artificial
  CRISPR gRNA sequence
ctgttaaaaagcttgttggg

SEQ ID NO: 631990 - DNA, 20 bp, Artificial
  CRISPR gRNA sequence
tgttaaaaagcttgttggga

SEQ ID NO: 631991 - DNA, 20 bp, Artificial
  CRISPR gRNA sequence
ttaaaaagcttgttgggatt

SEQ ID NO: 631992 - DNA, 20 bp, Artificial
  CRISPR gRNA sequence
aaaagcttgttgggattttg

SEQ ID NO: 631993 - DNA, 20 bp, Artificial
  CRISPR gRNA sequence
gttgggattttgactgaaat

SEQ ID NO: 631994 - DNA, 20 bp, Artificial
  CRISPR gRNA sequence
ttgggattttgactgaaatt

SEQ ID NO: 631995 - DNA, 20 bp, Artificial
  CRISPR gRNA sequence
ggattttgactgaaattgcc

SEQ ID NO: 631996 - DNA, 20 bp, Artificial
  CRISPR gRNA sequence
tgactgaaattgccctgaac

SEQ ID NO: 631997 - DNA, 20 bp, Artificial
  CRISPR gRNA sequence
gactgaaattgccctgaact

SEQ ID NO: 631998 - DNA, 20 bp, Artificial
  CRISPR gRNA sequence
actgaaattgccctgaactg

SEQ ID NO: 631999 - DNA, 20 bp, Artificial
  CRISPR gRNA sequence
aaattgccctgaactgacag

SEQ ID NO: 632000 - DNA, 20 bp, Artificial
  CRISPR gRNA sequence
ccctgaactgacagactcga

SEQ ID NO: 632001 - DNA, 20 bp, Artificial
  CRISPR gRNA sequence
aactgacagactcgatttca

SEQ ID NO: 632002 - DNA, 20 bp, Artificial
  CRISPR gRNA sequence
acagactcgatttcaggaga

SEQ ID NO: 632003 - DNA, 20 bp, Artificial
  CRISPR gRNA sequence
gatttcaggagaaaccaaca

SEQ ID NO: 632004 - DNA, 20 bp, Artificial
  CRISPR gRNA sequence
caggagaaaccaacatctta

SEQ ID NO: 632005 - DNA, 20 bp, Artificial
  CRISPR gRNA sequence
aggagaaaccaacatcttaa

SEQ ID NO: 632006 - DNA, 20 bp, Artificial
  CRISPR gRNA sequence
aacaatactgaatcttttaa

SEQ ID NO: 632007 - DNA, 20 bp, Artificial
  CRISPR gRNA sequence
acaatactgaatcttttaaa

SEQ ID NO: 632008 - DNA, 20 bp, Artificial
  CRISPR gRNA sequence
aatcttttaaatcatgataa

SEQ ID NO: 632009 - DNA, 20 bp, Artificial
  CRISPR gRNA sequence
ttaaatcatgataatgtctc

SEQ ID NO: 632010 - DNA, 20 bp, Artificial
  CRISPR gRNA sequence
taaatcatgataatgtctca

SEQ ID NO: 632011 - DNA, 20 bp, Artificial
  CRISPR gRNA sequence
aaatcatgataatgtctcat

SEQ ID NO: 632012 - DNA, 20 bp, Artificial
  CRISPR gRNA sequence
aatcatgataatgtctcatc

SEQ ID NO: 632013 - DNA, 20 bp, Artificial
  CRISPR gRNA sequence
atctctgcatttattgaagt

SEQ ID NO: 632014 - DNA, 20 bp, Artificial
  CRISPR gRNA sequence
tgcatttattgaagtcttta

SEQ ID NO: 632015 - DNA, 20 bp, Artificial
  CRISPR gRNA sequence
catttattgaagtctttaat

SEQ ID NO: 632016 - DNA, 20 bp, Artificial
  CRISPR gRNA sequence
attgaagtctttaatttatc

SEQ ID NO: 632017 - DNA, 20 bp, Artificial
  CRISPR gRNA sequence
ttgaagtctttaatttatct

SEQ ID NO: 632018 - DNA, 20 bp, Artificial
  CRISPR gRNA sequence
aagtctttaatttatctcag

SEQ ID NO: 632019 - DNA, 20 bp, Artificial
  CRISPR gRNA sequence
taatttatctcagcaatgtg

SEQ ID NO: 632020 - DNA, 20 bp, Artificial
  CRISPR gRNA sequence
aatttatctcagcaatgtgt

SEQ ID NO: 632021 - DNA, 20 bp, Artificial
  CRISPR gRNA sequence
atttatctcagcaatgtgtt

SEQ ID NO: 632022 - DNA, 20 bp, Artificial
  CRISPR gRNA sequence
atctcagcaatgtgttatga

SEQ ID NO: 632023 - DNA, 20 bp, Artificial
  CRISPR gRNA sequence
tctcagcaatgtgttatgat

SEQ ID NO: 632024 - DNA, 20 bp, Artificial
  CRISPR gRNA sequence
agcaatgtgttatgatttta

SEQ ID NO: 632025 - DNA, 20 bp, Artificial
  CRISPR gRNA sequence
tgattttacgtacacagttc

SEQ ID NO: 632026 - DNA, 20 bp, Artificial
  CRISPR gRNA sequence
tacgtacacagttcttacac

SEQ ID NO: 632027 - DNA, 20 bp, Artificial
  CRISPR gRNA sequence
acgtacacagttcttacaca

SEQ ID NO: 632028 - DNA, 20 bp, Artificial
  CRISPR gRNA sequence
cgtacacagttcttacacat

SEQ ID NO: 632029 - DNA, 20 bp, Artificial
  CRISPR gRNA sequence
ttacacatattacttaattt

SEQ ID NO: 632030 - DNA, 20 bp, Artificial
  CRISPR gRNA sequence
acacatattacttaatttaa

SEQ ID NO: 632031 - DNA, 20 bp, Artificial
  CRISPR gRNA sequence
cacatattacttaatttaac

SEQ ID NO: 632032 - DNA, 20 bp, Artificial
  CRISPR gRNA sequence
cttaatttaactctaagtat

SEQ ID NO: 632033 - DNA, 20 bp, Artificial
  CRISPR gRNA sequence
aatttaactctaagtatttc

SEQ ID NO: 632034 - DNA, 20 bp, Artificial
  CRISPR gRNA sequence
atttaactctaagtatttca

SEQ ID NO: 632035 - DNA, 20 bp, Artificial
  CRISPR gRNA sequence
aactctaagtatttcataca

SEQ ID NO: 632036 - DNA, 20 bp, Artificial
  CRISPR gRNA sequence
actctaagtatttcatacat

SEQ ID NO: 632037 - DNA, 20 bp, Artificial
  CRISPR gRNA sequence
taagtatttcatacattttg

SEQ ID NO: 632038 - DNA, 20 bp, Artificial
  CRISPR gRNA sequence
agtatttcatacattttggg

SEQ ID NO: 632039 - DNA, 20 bp, Artificial
  CRISPR gRNA sequence
catacattttgggatgttat

SEQ ID NO: 632040 - DNA, 20 bp, Artificial
  CRISPR gRNA sequence
atacattttgggatgttata

SEQ ID NO: 632041 - DNA, 20 bp, Artificial
  CRISPR gRNA sequence
tgggatgttataatcaatgg

SEQ ID NO: 632042 - DNA, 20 bp, Artificial
  CRISPR gRNA sequence
gggatgttataatcaatggc

SEQ ID NO: 632043 - DNA, 20 bp, Artificial
  CRISPR gRNA sequence
ggatgttataatcaatggca

SEQ ID NO: 632044 - DNA, 20 bp, Artificial
  CRISPR gRNA sequence
taatcaatggcattgctttc

SEQ ID NO: 632045 - DNA, 20 bp, Artificial
  CRISPR gRNA sequence
ctttctaaattccaatgtcc

SEQ ID NO: 632046 - DNA, 20 bp, Artificial
  CRISPR gRNA sequence
tctaaattccaatgtccaac

SEQ ID NO: 632047 - DNA, 20 bp, Artificial
  CRISPR gRNA sequence
ctaaattccaatgtccaact

SEQ ID NO: 632048 - DNA, 20 bp, Artificial
  CRISPR gRNA sequence
taaattccaatgtccaactg

SEQ ID NO: 632049 - DNA, 20 bp, Artificial
  CRISPR gRNA sequence
aattccaatgtccaactgtt

SEQ ID NO: 632050 - DNA, 20 bp, Artificial
  CRISPR gRNA sequence
caatgtccaactgttcattc

SEQ ID NO: 632051 - DNA, 20 bp, Artificial
  CRISPR gRNA sequence
ttcattcctagcatatagaa

SEQ ID NO: 632052 - DNA, 20 bp, Artificial
  CRISPR gRNA sequence
attcctagcatatagaaata

SEQ ID NO: 632053 - DNA, 20 bp, Artificial
  CRISPR gRNA sequence
ctagcatatagaaatacatt

SEQ ID NO: 632054 - DNA, 20 bp, Artificial
  CRISPR gRNA sequence
gcatatagaaatacatttga

SEQ ID NO: 632055 - DNA, 20 bp, Artificial
  CRISPR gRNA sequence
gatttaatctcagtatgtca

SEQ ID NO: 632056 - DNA, 20 bp, Artificial
  CRISPR gRNA sequence
atttaatctcagtatgtcaa

SEQ ID NO: 632057 - DNA, 20 bp, Artificial
  CRISPR gRNA sequence
aatctcagtatgtcaaagaa

SEQ ID NO: 632058 - DNA, 20 bp, Artificial
  CRISPR gRNA sequence
atctcagtatgtcaaagaaa

SEQ ID NO: 632059 - DNA, 20 bp, Artificial
  CRISPR gRNA sequence
agtatgtcaaagaaatattt

SEQ ID NO: 632060 - DNA, 20 bp, Artificial
  CRISPR gRNA sequence
gcattaccatgtttattaca

SEQ ID NO: 632061 - DNA, 20 bp, Artificial
  CRISPR gRNA sequence
cattaccatgtttattacat

SEQ ID NO: 632062 - DNA, 20 bp, Artificial
  CRISPR gRNA sequence
ccatgtttattacatcattt

SEQ ID NO: 632063 - DNA, 20 bp, Artificial
  CRISPR gRNA sequence
attacatcatttcacaatag

SEQ ID NO: 632064 - DNA, 20 bp, Artificial
  CRISPR gRNA sequence
ttacatcatttcacaatagc

SEQ ID NO: 632065 - DNA, 20 bp, Artificial
  CRISPR gRNA sequence
catcatttcacaatagccaa

SEQ ID NO: 632066 - DNA, 20 bp, Artificial
  CRISPR gRNA sequence
cacaatagccaagatatggc

SEQ ID NO: 632067 - DNA, 20 bp, Artificial
  CRISPR gRNA sequence
acaatagccaagatatggca

SEQ ID NO: 632068 - DNA, 20 bp, Artificial
  CRISPR gRNA sequence
agtgtccatattttcttatt

SEQ ID NO: 632069 - DNA, 20 bp, Artificial
  CRISPR gRNA sequence
tcttattacactcatcaaat

SEQ ID NO: 632070 - DNA, 20 bp, Artificial
  CRISPR gRNA sequence
cttattacactcatcaaatg

SEQ ID NO: 632071 - DNA, 20 bp, Artificial
  CRISPR gRNA sequence
ttattacactcatcaaatga

SEQ ID NO: 632072 - DNA, 20 bp, Artificial
  CRISPR gRNA sequence
attacactcatcaaatgata

SEQ ID NO: 632073 - DNA, 20 bp, Artificial
  CRISPR gRNA sequence
ttacactcatcaaatgataa

SEQ ID NO: 632074 - DNA, 20 bp, Artificial
  CRISPR gRNA sequence
cactcatcaaatgataacca

SEQ ID NO: 632075 - DNA, 20 bp, Artificial
  CRISPR gRNA sequence
atcaaatgataaccatcatg

SEQ ID NO: 632076 - DNA, 20 bp, Artificial
  CRISPR gRNA sequence
ttttctactcagttgcagag

SEQ ID NO: 632077 - DNA, 20 bp, Artificial
  CRISPR gRNA sequence
ttctactcagttgcagagaa

SEQ ID NO: 632078 - DNA, 20 bp, Artificial
  CRISPR gRNA sequence
tctactcagttgcagagaat

SEQ ID NO: 632079 - DNA, 20 bp, Artificial
  CRISPR gRNA sequence
ctactcagttgcagagaatt

SEQ ID NO: 632080 - DNA, 20 bp, Artificial
  CRISPR gRNA sequence
tactcagttgcagagaattt

SEQ ID NO: 632081 - DNA, 20 bp, Artificial
  CRISPR gRNA sequence
ctcagttgcagagaattttt

SEQ ID NO: 632082 - DNA, 20 bp, Artificial
  CRISPR gRNA sequence
agttgcagagaatttttata

SEQ ID NO: 632083 - DNA, 20 bp, Artificial
  CRISPR gRNA sequence
cagagaatttttataatatg

SEQ ID NO: 632084 - DNA, 20 bp, Artificial
  CRISPR gRNA sequence
ttataatatgtgaaagctga

SEQ ID NO: 632085 - DNA, 20 bp, Artificial
  CRISPR gRNA sequence
tataatatgtgaaagctgaa

SEQ ID NO: 632086 - DNA, 20 bp, Artificial
  CRISPR gRNA sequence
ataatatgtgaaagctgaat

SEQ ID NO: 632087 - DNA, 20 bp, Artificial
  CRISPR gRNA sequence
taatatgtgaaagctgaatt

SEQ ID NO: 632088 - DNA, 20 bp, Artificial
  CRISPR gRNA sequence
aattatgtcaaatacttttt

SEQ ID NO: 632089 - DNA, 20 bp, Artificial
  CRISPR gRNA sequence
tgtcaaatactttttctgaa

SEQ ID NO: 632090 - DNA, 20 bp, Artificial
  CRISPR gRNA sequence
tttctgaaactttaaagaca

SEQ ID NO: 632091 - DNA, 20 bp, Artificial
  CRISPR gRNA sequence
ttctgaaactttaaagacag

SEQ ID NO: 632092 - DNA, 20 bp, Artificial
  CRISPR gRNA sequence
tctgaaactttaaagacaga

SEQ ID NO: 632093 - DNA, 20 bp, Artificial
  CRISPR gRNA sequence
ctgaaactttaaagacagac

SEQ ID NO: 632094 - DNA, 20 bp, Artificial
  CRISPR gRNA sequence
tgaaactttaaagacagact

SEQ ID NO: 632095 - DNA, 20 bp, Artificial
  CRISPR gRNA sequence
aaactttaaagacagactaa

SEQ ID NO: 632096 - DNA, 20 bp, Artificial
  CRISPR gRNA sequence
taaagacagactaaaatctt

SEQ ID NO: 632097 - DNA, 20 bp, Artificial
  CRISPR gRNA sequence
aaagacagactaaaatcttt

SEQ ID NO: 632098 - DNA, 20 bp, Artificial
  CRISPR gRNA sequence
aagacagactaaaatctttt

SEQ ID NO: 632099 - DNA, 20 bp, Artificial
  CRISPR gRNA sequence
aaatcttttcttttttagtc

SEQ ID NO: 632100 - DNA, 20 bp, Artificial
  CRISPR gRNA sequence
ttcttttttagtctgttaat

SEQ ID NO: 632101 - DNA, 20 bp, Artificial
  CRISPR gRNA sequence
tcttttttagtctgttaata

SEQ ID NO: 632102 - DNA, 20 bp, Artificial
  CRISPR gRNA sequence
cttttttagtctgttaatat

SEQ ID NO: 632103 - DNA, 20 bp, Artificial
  CRISPR gRNA sequence
ttttttagtctgttaatatg

SEQ ID NO: 632104 - DNA, 20 bp, Artificial
  CRISPR gRNA sequence
ttttagtctgttaatatgga

SEQ ID NO: 632105 - DNA, 20 bp, Artificial
  CRISPR gRNA sequence
tttagtctgttaatatggaa

SEQ ID NO: 632106 - DNA, 20 bp, Artificial
  CRISPR gRNA sequence
ttagtctgttaatatggaaa

SEQ ID NO: 632107 - DNA, 20 bp, Artificial
  CRISPR gRNA sequence
tagtctgttaatatggaaaa

SEQ ID NO: 632108 - DNA, 20 bp, Artificial
  CRISPR gRNA sequence
agtctgttaatatggaaaat

SEQ ID NO: 632109 - DNA, 20 bp, Artificial
  CRISPR gRNA sequence
gtctgttaatatggaaaatt

SEQ ID NO: 632110 - DNA, 20 bp, Artificial
  CRISPR gRNA sequence
ttaatatggaaaattacatt

SEQ ID NO: 632111 - DNA, 20 bp, Artificial
  CRISPR gRNA sequence
atatggaaaattacattgtg

SEQ ID NO: 632112 - DNA, 20 bp, Artificial
  CRISPR gRNA sequence
cattgtgatgttttttcacc

SEQ ID NO: 632113 - DNA, 20 bp, Artificial
  CRISPR gRNA sequence
tgatgttttttcacccaatg

SEQ ID NO: 632114 - DNA, 20 bp, Artificial
  CRISPR gRNA sequence
tttcacccaatgttaaacca

SEQ ID NO: 632115 - DNA, 20 bp, Artificial
  CRISPR gRNA sequence
ttcacccaatgttaaaccaa

SEQ ID NO: 632116 - DNA, 20 bp, Artificial
  CRISPR gRNA sequence
tcacccaatgttaaaccaac

SEQ ID NO: 632117 - DNA, 20 bp, Artificial
  CRISPR gRNA sequence
cacccaatgttaaaccaact

SEQ ID NO: 632118 - DNA, 20 bp, Artificial
  CRISPR gRNA sequence
acccaatgttaaaccaactt

SEQ ID NO: 632119 - DNA, 20 bp, Artificial
  CRISPR gRNA sequence
aaccaactttaaattcctaa

SEQ ID NO: 632120 - DNA, 20 bp, Artificial
  CRISPR gRNA sequence
taaattcctaagataaatcc

SEQ ID NO: 632121 - DNA, 20 bp, Artificial
  CRISPR gRNA sequence
aaattcctaagataaatccc

SEQ ID NO: 632122 - DNA, 20 bp, Artificial
  CRISPR gRNA sequence
aattcctaagataaatccca

SEQ ID NO: 632123 - DNA, 20 bp, Artificial
  CRISPR gRNA sequence
ctaagataaatcccacttgg

SEQ ID NO: 632124 - DNA, 20 bp, Artificial
  CRISPR gRNA sequence
agataaatcccacttggtca

SEQ ID NO: 632125 - DNA, 20 bp, Artificial
  CRISPR gRNA sequence
ggtcatgatatattatcctt

SEQ ID NO: 632126 - DNA, 20 bp, Artificial
  CRISPR gRNA sequence
gtcatgatatattatccttt

SEQ ID NO: 632127 - DNA, 20 bp, Artificial
  CRISPR gRNA sequence
tcctttttatatattccaga

SEQ ID NO: 632128 - DNA, 20 bp, Artificial
  CRISPR gRNA sequence
tttatatattccagattcaa

SEQ ID NO: 632129 - DNA, 20 bp, Artificial
  CRISPR gRNA sequence
ttatatattccagattcaat

SEQ ID NO: 632130 - DNA, 20 bp, Artificial
  CRISPR gRNA sequence
tatatattccagattcaatg

SEQ ID NO: 632131 - DNA, 20 bp, Artificial
  CRISPR gRNA sequence
atatattccagattcaatgt

SEQ ID NO: 632132 - DNA, 20 bp, Artificial
  CRISPR gRNA sequence
tatattccagattcaatgtg

SEQ ID NO: 632133 - DNA, 20 bp, Artificial
  CRISPR gRNA sequence
cagattcaatgtgttaaaat

SEQ ID NO: 632134 - DNA, 20 bp, Artificial
  CRISPR gRNA sequence
aatgtgttaaaattttaagg

SEQ ID NO: 632135 - DNA, 20 bp, Artificial
  CRISPR gRNA sequence
aaattttaaggacttttgca

SEQ ID NO: 632136 - DNA, 20 bp, Artificial
  CRISPR gRNA sequence
taaggacttttgcatctgca

SEQ ID NO: 632137 - DNA, 20 bp, Artificial
  CRISPR gRNA sequence
aaggacttttgcatctgcat

SEQ ID NO: 632138 - DNA, 20 bp, Artificial
  CRISPR gRNA sequence
aggacttttgcatctgcatc

SEQ ID NO: 632139 - DNA, 20 bp, Artificial
  CRISPR gRNA sequence
ttgcatctgcatcatgaaga

SEQ ID NO: 632140 - DNA, 20 bp, Artificial
  CRISPR gRNA sequence
tgcatctgcatcatgaagaa

SEQ ID NO: 632141 - DNA, 20 bp, Artificial
  CRISPR gRNA sequence
gcatctgcatcatgaagaat

SEQ ID NO: 632142 - DNA, 20 bp, Artificial
  CRISPR gRNA sequence
catctgcatcatgaagaata

SEQ ID NO: 632143 - DNA, 20 bp, Artificial
  CRISPR gRNA sequence
catcatgaagaataccgtta

SEQ ID NO: 632144 - DNA, 20 bp, Artificial
  CRISPR gRNA sequence
tgcagtatttttttcttgta

SEQ ID NO: 632145 - DNA, 20 bp, Artificial
  CRISPR gRNA sequence
ttttcttgtaatgtctttga

SEQ ID NO: 632146 - DNA, 20 bp, Artificial
  CRISPR gRNA sequence
tttcttgtaatgtctttgat

SEQ ID NO: 632147 - DNA, 20 bp, Artificial
  CRISPR gRNA sequence
ttcttgtaatgtctttgatt

SEQ ID NO: 632148 - DNA, 20 bp, Artificial
  CRISPR gRNA sequence
tcttgtaatgtctttgattt

SEQ ID NO: 632149 - DNA, 20 bp, Artificial
  CRISPR gRNA sequence
cttgtaatgtctttgatttt

SEQ ID NO: 632150 - DNA, 20 bp, Artificial
  CRISPR gRNA sequence
ttgtaatgtctttgattttg

SEQ ID NO: 632151 - DNA, 20 bp, Artificial
  CRISPR gRNA sequence
gtaatgtctttgattttggt

SEQ ID NO: 632152 - DNA, 20 bp, Artificial
  CRISPR gRNA sequence
taatgtctttgattttggtg

SEQ ID NO: 632153 - DNA, 20 bp, Artificial
  CRISPR gRNA sequence
tgattttggtgtcagagtaa

SEQ ID NO: 632154 - DNA, 20 bp, Artificial
  CRISPR gRNA sequence
gattttggtgtcagagtaat

SEQ ID NO: 632155 - DNA, 20 bp, Artificial
  CRISPR gRNA sequence
attttggtgtcagagtaatg

SEQ ID NO: 632156 - DNA, 20 bp, Artificial
  CRISPR gRNA sequence
tggtgtcagagtaatgctga

SEQ ID NO: 632157 - DNA, 20 bp, Artificial
  CRISPR gRNA sequence
ggtgtcagagtaatgctgaa

SEQ ID NO: 632158 - DNA, 20 bp, Artificial
  CRISPR gRNA sequence
gtgtcagagtaatgctgaat

SEQ ID NO: 632159 - DNA, 20 bp, Artificial
  CRISPR gRNA sequence
aatataataatttgtttgga

SEQ ID NO: 632160 - DNA, 20 bp, Artificial
  CRISPR gRNA sequence
gtttggaggcctccctcctc

SEQ ID NO: 632161 - DNA, 20 bp, Artificial
  CRISPR gRNA sequence
tttggaggcctccctcctcc

SEQ ID NO: 632162 - DNA, 20 bp, Artificial
  CRISPR gRNA sequence
ggaggcctccctcctccctt

SEQ ID NO: 632163 - DNA, 20 bp, Artificial
  CRISPR gRNA sequence
gaggcctccctcctcccttt

SEQ ID NO: 632164 - DNA, 20 bp, Artificial
  CRISPR gRNA sequence
cctcctcccttttctattgt

SEQ ID NO: 632165 - DNA, 20 bp, Artificial
  CRISPR gRNA sequence
ctcccttttctattgtctgg

SEQ ID NO: 632166 - DNA, 20 bp, Artificial
  CRISPR gRNA sequence
ccttttctattgtctggagg

SEQ ID NO: 632167 - DNA, 20 bp, Artificial
  CRISPR gRNA sequence
ttctattgtctggaggaatt

SEQ ID NO: 632168 - DNA, 20 bp, Artificial
  CRISPR gRNA sequence
tctattgtctggaggaattt

SEQ ID NO: 632169 - DNA, 20 bp, Artificial
  CRISPR gRNA sequence
ctattgtctggaggaatttg

SEQ ID NO: 632170 - DNA, 20 bp, Artificial
  CRISPR gRNA sequence
tattgtctggaggaatttgt

SEQ ID NO: 632171 - DNA, 20 bp, Artificial
  CRISPR gRNA sequence
ttgtctggaggaatttgttc

SEQ ID NO: 632172 - DNA, 20 bp, Artificial
  CRISPR gRNA sequence
tctggaggaatttgttcctt

SEQ ID NO: 632173 - DNA, 20 bp, Artificial
  CRISPR gRNA sequence
gaggaatttgttcctttagt

SEQ ID NO: 632174 - DNA, 20 bp, Artificial
  CRISPR gRNA sequence
gttcctttagtgtttttctt

SEQ ID NO: 632175 - DNA, 20 bp, Artificial
  CRISPR gRNA sequence
ttcctttagtgtttttctta

SEQ ID NO: 632176 - DNA, 20 bp, Artificial
  CRISPR gRNA sequence
ctttagtgtttttcttaaat

SEQ ID NO: 632177 - DNA, 20 bp, Artificial
  CRISPR gRNA sequence
tagtgtttttcttaaattac

SEQ ID NO: 632178 - DNA, 20 bp, Artificial
  CRISPR gRNA sequence
agtgtttttcttaaattaca

SEQ ID NO: 632179 - DNA, 20 bp, Artificial
  CRISPR gRNA sequence
gtgtttttcttaaattacat

SEQ ID NO: 632180 - DNA, 20 bp, Artificial
  CRISPR gRNA sequence
ttcttaaattacattttcct

SEQ ID NO: 632181 - DNA, 20 bp, Artificial
  CRISPR gRNA sequence
tcttaaattacattttcctt

SEQ ID NO: 632182 - DNA, 20 bp, Artificial
  CRISPR gRNA sequence
cttaaattacattttcctta

SEQ ID NO: 632183 - DNA, 20 bp, Artificial
  CRISPR gRNA sequence
ttaaattacattttccttaa

SEQ ID NO: 632184 - DNA, 20 bp, Artificial
  CRISPR gRNA sequence
aaattacattttccttaaat

SEQ ID NO: 632185 - DNA, 20 bp, Artificial
  CRISPR gRNA sequence
aattacattttccttaaata

SEQ ID NO: 632186 - DNA, 20 bp, Artificial
  CRISPR gRNA sequence
cattttccttaaatatttga

SEQ ID NO: 632187 - DNA, 20 bp, Artificial
  CRISPR gRNA sequence
tccttaaatatttgacagaa

SEQ ID NO: 632188 - DNA, 20 bp, Artificial
  CRISPR gRNA sequence
ccttaaatatttgacagaat

SEQ ID NO: 632189 - DNA, 20 bp, Artificial
  CRISPR gRNA sequence
cttaaatatttgacagaatt

SEQ ID NO: 632190 - DNA, 20 bp, Artificial
  CRISPR gRNA sequence
aaatatttgacagaatttac

SEQ ID NO: 632191 - DNA, 20 bp, Artificial
  CRISPR gRNA sequence
aatatttgacagaatttacc

SEQ ID NO: 632192 - DNA, 20 bp, Artificial
  CRISPR gRNA sequence
gacagaatttaccagtgaag

SEQ ID NO: 632193 - DNA, 20 bp, Artificial
  CRISPR gRNA sequence
acagaatttaccagtgaagt

SEQ ID NO: 632194 - DNA, 20 bp, Artificial
  CRISPR gRNA sequence
accagtgaagtcatctggag

SEQ ID NO: 632195 - DNA, 20 bp, Artificial
  CRISPR gRNA sequence
ccagtgaagtcatctggagt

SEQ ID NO: 632196 - DNA, 20 bp, Artificial
  CRISPR gRNA sequence
gagttttctttgtgggaagg

SEQ ID NO: 632197 - DNA, 20 bp, Artificial
  CRISPR gRNA sequence
tctttgtgggaaggttttta

SEQ ID NO: 632198 - DNA, 20 bp, Artificial
  CRISPR gRNA sequence
ctttgtgggaaggtttttaa

SEQ ID NO: 632199 - DNA, 20 bp, Artificial
  CRISPR gRNA sequence
tttgtgggaaggtttttaac

SEQ ID NO: 632200 - DNA, 20 bp, Artificial
  CRISPR gRNA sequence
tgtgggaaggtttttaactt

SEQ ID NO: 632201 - DNA, 20 bp, Artificial
  CRISPR gRNA sequence
gtgggaaggtttttaacttc

SEQ ID NO: 632202 - DNA, 20 bp, Artificial
  CRISPR gRNA sequence
tgggaaggtttttaacttca

SEQ ID NO: 632203 - DNA, 20 bp, Artificial
  CRISPR gRNA sequence
ttaacttcaatttcaattcc

SEQ ID NO: 632204 - DNA, 20 bp, Artificial
  CRISPR gRNA sequence
taacttcaatttcaattcct

SEQ ID NO: 632205 - DNA, 20 bp, Artificial
  CRISPR gRNA sequence
aacttcaatttcaattcctg

SEQ ID NO: 632206 - DNA, 20 bp, Artificial
  CRISPR gRNA sequence
acttcaatttcaattcctgg

SEQ ID NO: 632207 - DNA, 20 bp, Artificial
  CRISPR gRNA sequence
caatttcaattcctggaata

SEQ ID NO: 632208 - DNA, 20 bp, Artificial
  CRISPR gRNA sequence
aatttcaattcctggaataa

SEQ ID NO: 632209 - DNA, 20 bp, Artificial
  CRISPR gRNA sequence
caattcctggaataaatgtg

SEQ ID NO: 632210 - DNA, 20 bp, Artificial
  CRISPR gRNA sequence
aattcctggaataaatgtgg

SEQ ID NO: 632211 - DNA, 20 bp, Artificial
  CRISPR gRNA sequence
ctggaataaatgtgggctat

SEQ ID NO: 632212 - DNA, 20 bp, Artificial
  CRISPR gRNA sequence
gaataaatgtgggctattca

SEQ ID NO: 632213 - DNA, 20 bp, Artificial
  CRISPR gRNA sequence
ttcagagtgtatatttcttc

SEQ ID NO: 632214 - DNA, 20 bp, Artificial
  CRISPR gRNA sequence
agagtgtatatttcttcctg

SEQ ID NO: 632215 - DNA, 20 bp, Artificial
  CRISPR gRNA sequence
cttcctgaatgagagtcaat

SEQ ID NO: 632216 - DNA, 20 bp, Artificial
  CRISPR gRNA sequence
ttcctgaatgagagtcaata

SEQ ID NO: 632217 - DNA, 20 bp, Artificial
  CRISPR gRNA sequence
cctgaatgagagtcaataat

SEQ ID NO: 632218 - DNA, 20 bp, Artificial
  CRISPR gRNA sequence
ctgaatgagagtcaataatt

SEQ ID NO: 632219 - DNA, 20 bp, Artificial
  CRISPR gRNA sequence
aatgagagtcaataatttct

SEQ ID NO: 632220 - DNA, 20 bp, Artificial
  CRISPR gRNA sequence
ctattttttatttcatctag

SEQ ID NO: 632221 - DNA, 20 bp, Artificial
  CRISPR gRNA sequence
tattttttatttcatctagc

SEQ ID NO: 632222 - DNA, 20 bp, Artificial
  CRISPR gRNA sequence
ttttttatttcatctagctg

SEQ ID NO: 632223 - DNA, 20 bp, Artificial
  CRISPR gRNA sequence
tttatttcatctagctgaat

SEQ ID NO: 632224 - DNA, 20 bp, Artificial
  CRISPR gRNA sequence
ttatttcatctagctgaatt

SEQ ID NO: 632225 - DNA, 20 bp, Artificial
  CRISPR gRNA sequence
tatttcatctagctgaattt

SEQ ID NO: 632226 - DNA, 20 bp, Artificial
  CRISPR gRNA sequence
atttcatctagctgaatttg

SEQ ID NO: 632227 - DNA, 20 bp, Artificial
  CRISPR gRNA sequence
tttcatctagctgaatttga

SEQ ID NO: 632228 - DNA, 20 bp, Artificial
  CRISPR gRNA sequence
catctagctgaatttgacat

SEQ ID NO: 632229 - DNA, 20 bp, Artificial
  CRISPR gRNA sequence
atctagctgaatttgacata

SEQ ID NO: 632230 - DNA, 20 bp, Artificial
  CRISPR gRNA sequence
gctgaatttgacataaagtt

SEQ ID NO: 632231 - DNA, 20 bp, Artificial
  CRISPR gRNA sequence
aatttgacataaagttgttc

SEQ ID NO: 632232 - DNA, 20 bp, Artificial
  CRISPR gRNA sequence
gacataaagttgttcaaaat

SEQ ID NO: 632233 - DNA, 20 bp, Artificial
  CRISPR gRNA sequence
acataaagttgttcaaaata

SEQ ID NO: 632234 - DNA, 20 bp, Artificial
  CRISPR gRNA sequence
ttcaaaatatccccatatta

SEQ ID NO: 632235 - DNA, 20 bp, Artificial
  CRISPR gRNA sequence
aaaatatccccatattatgc

SEQ ID NO: 632236 - DNA, 20 bp, Artificial
  CRISPR gRNA sequence
tgcctccaatggctacagga

SEQ ID NO: 632237 - DNA, 20 bp, Artificial
  CRISPR gRNA sequence
caatggctacaggattttta

SEQ ID NO: 632238 - DNA, 20 bp, Artificial
  CRISPR gRNA sequence
caggatttttagtgatttcc

SEQ ID NO: 632239 - DNA, 20 bp, Artificial
  CRISPR gRNA sequence
ttagtgatttccggttttta

SEQ ID NO: 632240 - DNA, 20 bp, Artificial
  CRISPR gRNA sequence
tagtgatttccggtttttat

SEQ ID NO: 632241 - DNA, 20 bp, Artificial
  CRISPR gRNA sequence
agtgatttccggtttttatt

SEQ ID NO: 632242 - DNA, 20 bp, Artificial
  CRISPR gRNA sequence
gtgatttccggtttttattc

SEQ ID NO: 632243 - DNA, 20 bp, Artificial
  CRISPR gRNA sequence
ccggtttttattctagatga

SEQ ID NO: 632244 - DNA, 20 bp, Artificial
  CRISPR gRNA sequence
cggtttttattctagatgat

SEQ ID NO: 632245 - DNA, 20 bp, Artificial
  CRISPR gRNA sequence
ttattctagatgatgccaaa

SEQ ID NO: 632246 - DNA, 20 bp, Artificial
  CRISPR gRNA sequence
tattctagatgatgccaaat

SEQ ID NO: 632247 - DNA, 20 bp, Artificial
  CRISPR gRNA sequence
attctagatgatgccaaatt

SEQ ID NO: 632248 - DNA, 20 bp, Artificial
  CRISPR gRNA sequence
ttctagatgatgccaaatta

SEQ ID NO: 632249 - DNA, 20 bp, Artificial
  CRISPR gRNA sequence
tagatgatgccaaattatgt

SEQ ID NO: 632250 - DNA, 20 bp, Artificial
  CRISPR gRNA sequence
gatgatgccaaattatgtgt

SEQ ID NO: 632251 - DNA, 20 bp, Artificial
  CRISPR gRNA sequence
tgtgttcttttaatattgat

SEQ ID NO: 632252 - DNA, 20 bp, Artificial
  CRISPR gRNA sequence
ttttaatattgattgatctt

SEQ ID NO: 632253 - DNA, 20 bp, Artificial
  CRISPR gRNA sequence
ttaatattgattgatcttgc

SEQ ID NO: 632254 - DNA, 20 bp, Artificial
  CRISPR gRNA sequence
taatattgattgatcttgct

SEQ ID NO: 632255 - DNA, 20 bp, Artificial
  CRISPR gRNA sequence
aatattgattgatcttgcta

SEQ ID NO: 632256 - DNA, 20 bp, Artificial
  CRISPR gRNA sequence
atattgattgatcttgctag

SEQ ID NO: 632257 - DNA, 20 bp, Artificial
  CRISPR gRNA sequence
attgatcttgctagaggttt

SEQ ID NO: 632258 - DNA, 20 bp, Artificial
  CRISPR gRNA sequence
atcttgctagaggtttatct

SEQ ID NO: 632259 - DNA, 20 bp, Artificial
  CRISPR gRNA sequence
gctagaggtttatctatttt

SEQ ID NO: 632260 - DNA, 20 bp, Artificial
  CRISPR gRNA sequence
ctagaggtttatctatttta

SEQ ID NO: 632261 - DNA, 20 bp, Artificial
  CRISPR gRNA sequence
gaggtttatctattttattg

SEQ ID NO: 632262 - DNA, 20 bp, Artificial
  CRISPR gRNA sequence
atctattttattgatcttct

SEQ ID NO: 632263 - DNA, 20 bp, Artificial
  CRISPR gRNA sequence
tctattttattgatcttctc

SEQ ID NO: 632264 - DNA, 20 bp, Artificial
  CRISPR gRNA sequence
ttttattgatcttctcatat

SEQ ID NO: 632265 - DNA, 20 bp, Artificial
  CRISPR gRNA sequence
tattgatcttctcatataat

SEQ ID NO: 632266 - DNA, 20 bp, Artificial
  CRISPR gRNA sequence
attgatcttctcatataatc

SEQ ID NO: 632267 - DNA, 20 bp, Artificial
  CRISPR gRNA sequence
ttgatcttctcatataatca

SEQ ID NO: 632268 - DNA, 20 bp, Artificial
  CRISPR gRNA sequence
atcttctcatataatcagtc

SEQ ID NO: 632269 - DNA, 20 bp, Artificial
  CRISPR gRNA sequence
ctcatataatcagtcttcga

SEQ ID NO: 632270 - DNA, 20 bp, Artificial
  CRISPR gRNA sequence
tcatataatcagtcttcgat

SEQ ID NO: 632271 - DNA, 20 bp, Artificial
  CRISPR gRNA sequence
atataatcagtcttcgattt

SEQ ID NO: 632272 - DNA, 20 bp, Artificial
  CRISPR gRNA sequence
cgatttcacttactaatggt

SEQ ID NO: 632273 - DNA, 20 bp, Artificial
  CRISPR gRNA sequence
gatttcacttactaatggta

SEQ ID NO: 632274 - DNA, 20 bp, Artificial
  CRISPR gRNA sequence
cacttactaatggtatgccc

SEQ ID NO: 632275 - DNA, 20 bp, Artificial
  CRISPR gRNA sequence
acttactaatggtatgccca

SEQ ID NO: 632276 - DNA, 20 bp, Artificial
  CRISPR gRNA sequence
actaatggtatgcccaacaa

SEQ ID NO: 632277 - DNA, 20 bp, Artificial
  CRISPR gRNA sequence
ctaatggtatgcccaacaag

SEQ ID NO: 632278 - DNA, 20 bp, Artificial
  CRISPR gRNA sequence
atggtatgcccaacaaggca

SEQ ID NO: 632279 - DNA, 20 bp, Artificial
  CRISPR gRNA sequence
gtaagtaactgtggccatct

SEQ ID NO: 632280 - DNA, 20 bp, Artificial
  CRISPR gRNA sequence
tggccatctaagatgaaaaa

SEQ ID NO: 632281 - DNA, 20 bp, Artificial
  CRISPR gRNA sequence
agatgaaaaaacaaaacaaa

SEQ ID NO: 632282 - DNA, 20 bp, Artificial
  CRISPR gRNA sequence
ttttgggtttcaatttatat

SEQ ID NO: 632283 - DNA, 20 bp, Artificial
  CRISPR gRNA sequence
tgggtttcaatttatatatt

SEQ ID NO: 632284 - DNA, 20 bp, Artificial
  CRISPR gRNA sequence
gggtttcaatttatatatta

SEQ ID NO: 632285 - DNA, 20 bp, Artificial
  CRISPR gRNA sequence
ggtttcaatttatatattat

SEQ ID NO: 632286 - DNA, 20 bp, Artificial
  CRISPR gRNA sequence
caatttatatattataattt

SEQ ID NO: 632287 - DNA, 20 bp, Artificial
  CRISPR gRNA sequence
aatttatatattataatttt

SEQ ID NO: 632288 - DNA, 20 bp, Artificial
  CRISPR gRNA sequence
atatattataattttcccaa

SEQ ID NO: 632289 - DNA, 20 bp, Artificial
  CRISPR gRNA sequence
tatattataattttcccaaa

SEQ ID NO: 632290 - DNA, 20 bp, Artificial
  CRISPR gRNA sequence
taattttcccaaatggataa

SEQ ID NO: 632291 - DNA, 20 bp, Artificial
  CRISPR gRNA sequence
tcccaaatggataaaaagtt

SEQ ID NO: 632292 - DNA, 20 bp, Artificial
  CRISPR gRNA sequence
cccaaatggataaaaagttg

SEQ ID NO: 632293 - DNA, 20 bp, Artificial
  CRISPR gRNA sequence
ccaaatggataaaaagttgt

SEQ ID NO: 632294 - DNA, 20 bp, Artificial
  CRISPR gRNA sequence
ttagggcacaaatcattatt

SEQ ID NO: 632295 - DNA, 20 bp, Artificial
  CRISPR gRNA sequence
gggcacaaatcattattaag

SEQ ID NO: 632296 - DNA, 20 bp, Artificial
  CRISPR gRNA sequence
ttaagttgtttggaccttac

SEQ ID NO: 632297 - DNA, 20 bp, Artificial
  CRISPR gRNA sequence
agttgtttggaccttactac

SEQ ID NO: 632298 - DNA, 20 bp, Artificial
  CRISPR gRNA sequence
tttggaccttactacttaat

SEQ ID NO: 632299 - DNA, 20 bp, Artificial
  CRISPR gRNA sequence
ggaccttactacttaataaa

SEQ ID NO: 632300 - DNA, 20 bp, Artificial
  CRISPR gRNA sequence
gaccttactacttaataaaa

SEQ ID NO: 632301 - DNA, 20 bp, Artificial
  CRISPR gRNA sequence
actacttaataaaatgaaac

SEQ ID NO: 632302 - DNA, 20 bp, Artificial
  CRISPR gRNA sequence
ctacttaataaaatgaaact

SEQ ID NO: 632303 - DNA, 20 bp, Artificial
  CRISPR gRNA sequence
cttaataaaatgaaactttt

SEQ ID NO: 632304 - DNA, 20 bp, Artificial
  CRISPR gRNA sequence
aataaaatgaaacttttcag

SEQ ID NO: 632305 - DNA, 20 bp, Artificial
  CRISPR gRNA sequence
ataaaatgaaacttttcagt

SEQ ID NO: 632306 - DNA, 20 bp, Artificial
  CRISPR gRNA sequence
ttcagtattacttttagccc

SEQ ID NO: 632307 - DNA, 20 bp, Artificial
  CRISPR gRNA sequence
tcagtattacttttagccct

SEQ ID NO: 632308 - DNA, 20 bp, Artificial
  CRISPR gRNA sequence
cagtattacttttagcccta

SEQ ID NO: 632309 - DNA, 20 bp, Artificial
  CRISPR gRNA sequence
agtattacttttagccctaa

SEQ ID NO: 632310 - DNA, 20 bp, Artificial
  CRISPR gRNA sequence
cttttagccctaaatgaact

SEQ ID NO: 632311 - DNA, 20 bp, Artificial
  CRISPR gRNA sequence
ttagccctaaatgaactttg

SEQ ID NO: 632312 - DNA, 20 bp, Artificial
  CRISPR gRNA sequence
tagccctaaatgaactttga

SEQ ID NO: 632313 - DNA, 20 bp, Artificial
  CRISPR gRNA sequence
agccctaaatgaactttgac

SEQ ID NO: 632314 - DNA, 20 bp, Artificial
  CRISPR gRNA sequence
gccctaaatgaactttgaca

SEQ ID NO: 632315 - DNA, 20 bp, Artificial
  CRISPR gRNA sequence
aatgaactttgacaaaatta

SEQ ID NO: 632316 - DNA, 20 bp, Artificial
  CRISPR gRNA sequence
tgacaaaattattaagacac

SEQ ID NO: 632317 - DNA, 20 bp, Artificial
  CRISPR gRNA sequence
gacaaaattattaagacact

SEQ ID NO: 632318 - DNA, 20 bp, Artificial
  CRISPR gRNA sequence
acaaaattattaagacacta

SEQ ID NO: 632319 - DNA, 20 bp, Artificial
  CRISPR gRNA sequence
ttaagacactacagtcacaa

SEQ ID NO: 632320 - DNA, 20 bp, Artificial
  CRISPR gRNA sequence
agacactacagtcacaatga

SEQ ID NO: 632321 - DNA, 20 bp, Artificial
  CRISPR gRNA sequence
cagtcacaatgaaccaagaa

SEQ ID NO: 632322 - DNA, 20 bp, Artificial
  CRISPR gRNA sequence
gggaaacactgagctaggta

SEQ ID NO: 632323 - DNA, 20 bp, Artificial
  CRISPR gRNA sequence
ggaaacactgagctaggtaa

SEQ ID NO: 632324 - DNA, 20 bp, Artificial
  CRISPR gRNA sequence
agctaggtaataaaatgtaa

SEQ ID NO: 632325 - DNA, 20 bp, Artificial
  CRISPR gRNA sequence
ggtaataaaatgtaatttgt

SEQ ID NO: 632326 - DNA, 20 bp, Artificial
  CRISPR gRNA sequence
gtatttcttttacacttgca

SEQ ID NO: 632327 - DNA, 20 bp, Artificial
  CRISPR gRNA sequence
tatttcttttacacttgcat

SEQ ID NO: 632328 - DNA, 20 bp, Artificial
  CRISPR gRNA sequence
cttttacacttgcattagtg

SEQ ID NO: 632329 - DNA, 20 bp, Artificial
  CRISPR gRNA sequence
ttttacacttgcattagtga

SEQ ID NO: 632330 - DNA, 20 bp, Artificial
  CRISPR gRNA sequence
ttacacttgcattagtgaaa

SEQ ID NO: 632331 - DNA, 20 bp, Artificial
  CRISPR gRNA sequence
tacacttgcattagtgaaac

SEQ ID NO: 632332 - DNA, 20 bp, Artificial
  CRISPR gRNA sequence
acacttgcattagtgaaacg

SEQ ID NO: 632333 - DNA, 20 bp, Artificial
  CRISPR gRNA sequence
cacttgcattagtgaaacga

SEQ ID NO: 632334 - DNA, 20 bp, Artificial
  CRISPR gRNA sequence
gcattagtgaaacgaaatat

SEQ ID NO: 632335 - DNA, 20 bp, Artificial
  CRISPR gRNA sequence
cattagtgaaacgaaatatt

SEQ ID NO: 632336 - DNA, 20 bp, Artificial
  CRISPR gRNA sequence
gtgaaacgaaatattaaaca

SEQ ID NO: 632337 - DNA, 20 bp, Artificial
  CRISPR gRNA sequence
aacaaaaaaatcattagaca

SEQ ID NO: 632338 - DNA, 20 bp, Artificial
  CRISPR gRNA sequence
gacatttgtttgctgtcctt

SEQ ID NO: 632339 - DNA, 20 bp, Artificial
  CRISPR gRNA sequence
gtttgctgtcctttcaaatg

SEQ ID NO: 632340 - DNA, 20 bp, Artificial
  CRISPR gRNA sequence
tttgctgtcctttcaaatga

SEQ ID NO: 632341 - DNA, 20 bp, Artificial
  CRISPR gRNA sequence
gctgtcctttcaaatgatct

SEQ ID NO: 632342 - DNA, 20 bp, Artificial
  CRISPR gRNA sequence
ctgtcctttcaaatgatcta

SEQ ID NO: 632343 - DNA, 20 bp, Artificial
  CRISPR gRNA sequence
tcctttcaaatgatctattt

SEQ ID NO: 632344 - DNA, 20 bp, Artificial
  CRISPR gRNA sequence
tcaaatgatctatttcatgc

SEQ ID NO: 632345 - DNA, 20 bp, Artificial
  CRISPR gRNA sequence
caaatgatctatttcatgcc

SEQ ID NO: 632346 - DNA, 20 bp, Artificial
  CRISPR gRNA sequence
aaatgatctatttcatgcct

SEQ ID NO: 632347 - DNA, 20 bp, Artificial
  CRISPR gRNA sequence
tttcatgccttcacctattt

SEQ ID NO: 632348 - DNA, 20 bp, Artificial
  CRISPR gRNA sequence
catgccttcacctattttta

SEQ ID NO: 632349 - DNA, 20 bp, Artificial
  CRISPR gRNA sequence
atgccttcacctatttttaa

SEQ ID NO: 632350 - DNA, 20 bp, Artificial
  CRISPR gRNA sequence
cacctatttttaaattatgg

SEQ ID NO: 632351 - DNA, 20 bp, Artificial
  CRISPR gRNA sequence
acctatttttaaattatggt

SEQ ID NO: 632352 - DNA, 20 bp, Artificial
  CRISPR gRNA sequence
tttttaaattatggtcttac

SEQ ID NO: 632353 - DNA, 20 bp, Artificial
  CRISPR gRNA sequence
ttaaattatggtcttactgc

SEQ ID NO: 632354 - DNA, 20 bp, Artificial
  CRISPR gRNA sequence
taaattatggtcttactgct

SEQ ID NO: 632355 - DNA, 20 bp, Artificial
  CRISPR gRNA sequence
aaattatggtcttactgctt

SEQ ID NO: 632356 - DNA, 20 bp, Artificial
  CRISPR gRNA sequence
aattatggtcttactgcttt

SEQ ID NO: 632357 - DNA, 20 bp, Artificial
  CRISPR gRNA sequence
tggtcttactgcttttgtct

SEQ ID NO: 632358 - DNA, 20 bp, Artificial
  CRISPR gRNA sequence
actgcttttgtctttctgaa

SEQ ID NO: 632359 - DNA, 20 bp, Artificial
  CRISPR gRNA sequence
ctgcttttgtctttctgaat

SEQ ID NO: 632360 - DNA, 20 bp, Artificial
  CRISPR gRNA sequence
cttttgtctttctgaataaa

SEQ ID NO: 632361 - DNA, 20 bp, Artificial
  CRISPR gRNA sequence
ttgtctttctgaataaattg

SEQ ID NO: 632362 - DNA, 20 bp, Artificial
  CRISPR gRNA sequence
tgtctttctgaataaattga

SEQ ID NO: 632363 - DNA, 20 bp, Artificial
  CRISPR gRNA sequence
gtctttctgaataaattgat

SEQ ID NO: 632364 - DNA, 20 bp, Artificial
  CRISPR gRNA sequence
tctttctgaataaattgatc

SEQ ID NO: 632365 - DNA, 20 bp, Artificial
  CRISPR gRNA sequence
tctgaataaattgatcagaa

SEQ ID NO: 632366 - DNA, 20 bp, Artificial
  CRISPR gRNA sequence
ctgaataaattgatcagaaa

SEQ ID NO: 632367 - DNA, 20 bp, Artificial
  CRISPR gRNA sequence
tgaataaattgatcagaaat

SEQ ID NO: 632368 - DNA, 20 bp, Artificial
  CRISPR gRNA sequence
aataaattgatcagaaattg

SEQ ID NO: 632369 - DNA, 20 bp, Artificial
  CRISPR gRNA sequence
atcagaaattgatctctgta

SEQ ID NO: 632370 - DNA, 20 bp, Artificial
  CRISPR gRNA sequence
atctctgtatatattaacgc

SEQ ID NO: 632371 - DNA, 20 bp, Artificial
  CRISPR gRNA sequence
tgtatatattaacgcctttg

SEQ ID NO: 632372 - DNA, 20 bp, Artificial
  CRISPR gRNA sequence
tatatattaacgcctttgac

SEQ ID NO: 632373 - DNA, 20 bp, Artificial
  CRISPR gRNA sequence
acgcctttgacttatttctt

SEQ ID NO: 632374 - DNA, 20 bp, Artificial
  CRISPR gRNA sequence
tgacttatttcttgacttac

SEQ ID NO: 632375 - DNA, 20 bp, Artificial
  CRISPR gRNA sequence
gacttatttcttgacttacc

SEQ ID NO: 632376 - DNA, 20 bp, Artificial
  CRISPR gRNA sequence
acttatttcttgacttacct

SEQ ID NO: 632377 - DNA, 20 bp, Artificial
  CRISPR gRNA sequence
atttcttgacttacctattt

SEQ ID NO: 632378 - DNA, 20 bp, Artificial
  CRISPR gRNA sequence
tttcttgacttacctatttg

SEQ ID NO: 632379 - DNA, 20 bp, Artificial
  CRISPR gRNA sequence
cttgacttacctatttgact

SEQ ID NO: 632380 - DNA, 20 bp, Artificial
  CRISPR gRNA sequence
ttgacttacctatttgactt

SEQ ID NO: 632381 - DNA, 20 bp, Artificial
  CRISPR gRNA sequence
gacttacctatttgacttat

SEQ ID NO: 632382 - DNA, 20 bp, Artificial
  CRISPR gRNA sequence
acttacctatttgacttatg

SEQ ID NO: 632383 - DNA, 20 bp, Artificial
  CRISPR gRNA sequence
acctatttgacttatgcttt

SEQ ID NO: 632384 - DNA, 20 bp, Artificial
  CRISPR gRNA sequence
cctatttgacttatgctttt

SEQ ID NO: 632385 - DNA, 20 bp, Artificial
  CRISPR gRNA sequence
tttgacttatgctttttttg

SEQ ID NO: 632386 - DNA, 20 bp, Artificial
  CRISPR gRNA sequence
gacttatgctttttttgagg

SEQ ID NO: 632387 - DNA, 20 bp, Artificial
  CRISPR gRNA sequence
acttatgctttttttgaggt

SEQ ID NO: 632388 - DNA, 20 bp, Artificial
  CRISPR gRNA sequence
atgctttttttgaggtttag

SEQ ID NO: 632389 - DNA, 20 bp, Artificial
  CRISPR gRNA sequence
tgctttttttgaggtttaga

SEQ ID NO: 632390 - DNA, 20 bp, Artificial
  CRISPR gRNA sequence
tttttgaggtttagaggttt

SEQ ID NO: 632391 - DNA, 20 bp, Artificial
  CRISPR gRNA sequence
ttttgaggtttagaggtttt

SEQ ID NO: 632392 - DNA, 20 bp, Artificial
  CRISPR gRNA sequence
tttgaggtttagaggtttta

SEQ ID NO: 632393 - DNA, 20 bp, Artificial
  CRISPR gRNA sequence
ttgaggtttagaggttttac

SEQ ID NO: 632394 - DNA, 20 bp, Artificial
  CRISPR gRNA sequence
tgaggtttagaggttttaca

SEQ ID NO: 632395 - DNA, 20 bp, Artificial
  CRISPR gRNA sequence
gaggtttagaggttttacat

SEQ ID NO: 632396 - DNA, 20 bp, Artificial
  CRISPR gRNA sequence
aggtttagaggttttacatt

SEQ ID NO: 632397 - DNA, 20 bp, Artificial
  CRISPR gRNA sequence
agaggttttacattttcttg

SEQ ID NO: 632398 - DNA, 20 bp, Artificial
  CRISPR gRNA sequence
gaggttttacattttcttgt

SEQ ID NO: 632399 - DNA, 20 bp, Artificial
  CRISPR gRNA sequence
tacattttcttgtggtcaaa

SEQ ID NO: 632400 - DNA, 20 bp, Artificial
  CRISPR gRNA sequence
acattttcttgtggtcaaaa

SEQ ID NO: 632401 - DNA, 20 bp, Artificial
  CRISPR gRNA sequence
cattttcttgtggtcaaaat

SEQ ID NO: 632402 - DNA, 20 bp, Artificial
  CRISPR gRNA sequence
tcttgtggtcaaaattgttg

SEQ ID NO: 632403 - DNA, 20 bp, Artificial
  CRISPR gRNA sequence
cttgtggtcaaaattgttgg

SEQ ID NO: 632404 - DNA, 20 bp, Artificial
  CRISPR gRNA sequence
ttgtggtcaaaattgttggt

SEQ ID NO: 632405 - DNA, 20 bp, Artificial
  CRISPR gRNA sequence
gtggtcaaaattgttggtag

SEQ ID NO: 632406 - DNA, 20 bp, Artificial
  CRISPR gRNA sequence
tggtcaaaattgttggtagt

SEQ ID NO: 632407 - DNA, 20 bp, Artificial
  CRISPR gRNA sequence
ttggtagtttcccacgttgt

SEQ ID NO: 632408 - DNA, 20 bp, Artificial
  CRISPR gRNA sequence
gtagtttcccacgttgtgat

SEQ ID NO: 632409 - DNA, 20 bp, Artificial
  CRISPR gRNA sequence
cccacgttgtgatttcttta

SEQ ID NO: 632410 - DNA, 20 bp, Artificial
  CRISPR gRNA sequence
ccacgttgtgatttctttac

SEQ ID NO: 632411 - DNA, 20 bp, Artificial
  CRISPR gRNA sequence
tgatttctttactgttttaa

SEQ ID NO: 632412 - DNA, 20 bp, Artificial
  CRISPR gRNA sequence
ctttactgttttaagtttta

SEQ ID NO: 632413 - DNA, 20 bp, Artificial
  CRISPR gRNA sequence
tttactgttttaagttttaa

SEQ ID NO: 632414 - DNA, 20 bp, Artificial
  CRISPR gRNA sequence
tactgttttaagttttaaaa

SEQ ID NO: 632415 - DNA, 20 bp, Artificial
  CRISPR gRNA sequence
actgttttaagttttaaaat

SEQ ID NO: 632416 - DNA, 20 bp, Artificial
  CRISPR gRNA sequence
ctgttttaagttttaaaatt

SEQ ID NO: 632417 - DNA, 20 bp, Artificial
  CRISPR gRNA sequence
ttttaagttttaaaattctg

SEQ ID NO: 632418 - DNA, 20 bp, Artificial
  CRISPR gRNA sequence
taagttttaaaattctgcct

SEQ ID NO: 632419 - DNA, 20 bp, Artificial
  CRISPR gRNA sequence
aagttttaaaattctgcctg

SEQ ID NO: 632420 - DNA, 20 bp, Artificial
  CRISPR gRNA sequence
agttttaaaattctgcctga

SEQ ID NO: 632421 - DNA, 20 bp, Artificial
  CRISPR gRNA sequence
taaaattctgcctgatatgg

SEQ ID NO: 632422 - DNA, 20 bp, Artificial
  CRISPR gRNA sequence
aaaattctgcctgatatgga

SEQ ID NO: 632423 - DNA, 20 bp, Artificial
  CRISPR gRNA sequence
aaattctgcctgatatggaa

SEQ ID NO: 632424 - DNA, 20 bp, Artificial
  CRISPR gRNA sequence
tgcctgatatggaatttttt

SEQ ID NO: 632425 - DNA, 20 bp, Artificial
  CRISPR gRNA sequence
cctgatatggaattttttag

SEQ ID NO: 632426 - DNA, 20 bp, Artificial
  CRISPR gRNA sequence
atatggaattttttagaaat

SEQ ID NO: 632427 - DNA, 20 bp, Artificial
  CRISPR gRNA sequence
tttagaaatatccacaccta

SEQ ID NO: 632428 - DNA, 20 bp, Artificial
  CRISPR gRNA sequence
ttagaaatatccacacctac

SEQ ID NO: 632429 - DNA, 20 bp, Artificial
  CRISPR gRNA sequence
tagaaatatccacacctact

SEQ ID NO: 632430 - DNA, 20 bp, Artificial
  CRISPR gRNA sequence
agaaatatccacacctactt

SEQ ID NO: 632431 - DNA, 20 bp, Artificial
  CRISPR gRNA sequence
gaaatatccacacctacttt

SEQ ID NO: 632432 - DNA, 20 bp, Artificial
  CRISPR gRNA sequence
ctttttttttctaaatcttt

SEQ ID NO: 632433 - DNA, 20 bp, Artificial
  CRISPR gRNA sequence
tttttttctaaatctttaga

SEQ ID NO: 632434 - DNA, 20 bp, Artificial
  CRISPR gRNA sequence
ttttttctaaatctttagaa

SEQ ID NO: 632435 - DNA, 20 bp, Artificial
  CRISPR gRNA sequence
tttttctaaatctttagaag

SEQ ID NO: 632436 - DNA, 20 bp, Artificial
  CRISPR gRNA sequence
ttttctaaatctttagaagt

SEQ ID NO: 632437 - DNA, 20 bp, Artificial
  CRISPR gRNA sequence
tttctaaatctttagaagtc

SEQ ID NO: 632438 - DNA, 20 bp, Artificial
  CRISPR gRNA sequence
ttctaaatctttagaagtct

SEQ ID NO: 632439 - DNA, 20 bp, Artificial
  CRISPR gRNA sequence
tctaaatctttagaagtctt

SEQ ID NO: 632440 - DNA, 20 bp, Artificial
  CRISPR gRNA sequence
ctaaatctttagaagtctta

SEQ ID NO: 632441 - DNA, 20 bp, Artificial
  CRISPR gRNA sequence
taaatctttagaagtcttaa

SEQ ID NO: 632442 - DNA, 20 bp, Artificial
  CRISPR gRNA sequence
aatctttagaagtcttaatg

SEQ ID NO: 632443 - DNA, 20 bp, Artificial
  CRISPR gRNA sequence
tagaagtcttaatgactcta

SEQ ID NO: 632444 - DNA, 20 bp, Artificial
  CRISPR gRNA sequence
agaagtcttaatgactctag

SEQ ID NO: 632445 - DNA, 20 bp, Artificial
  CRISPR gRNA sequence
gaagtcttaatgactctagg

SEQ ID NO: 632446 - DNA, 20 bp, Artificial
  CRISPR gRNA sequence
aatgactctaggtttatttt

SEQ ID NO: 632447 - DNA, 20 bp, Artificial
  CRISPR gRNA sequence
atgactctaggtttattttt

SEQ ID NO: 632448 - DNA, 20 bp, Artificial
  CRISPR gRNA sequence
taggtttatttttttaatga

SEQ ID NO: 632449 - DNA, 20 bp, Artificial
  CRISPR gRNA sequence
ggtttatttttttaatgaaa

SEQ ID NO: 632450 - DNA, 20 bp, Artificial
  CRISPR gRNA sequence
atttttttaatgaaatgatt

SEQ ID NO: 632451 - DNA, 20 bp, Artificial
  CRISPR gRNA sequence
tttttttaatgaaatgatta

SEQ ID NO: 632452 - DNA, 20 bp, Artificial
  CRISPR gRNA sequence
ttttaatgaaatgattaagt

SEQ ID NO: 632453 - DNA, 20 bp, Artificial
  CRISPR gRNA sequence
tttaatgaaatgattaagtg

SEQ ID NO: 632454 - DNA, 20 bp, Artificial
  CRISPR gRNA sequence
ttaatgaaatgattaagtgg

SEQ ID NO: 632455 - DNA, 20 bp, Artificial
  CRISPR gRNA sequence
taatgaaatgattaagtggg

SEQ ID NO: 632456 - DNA, 20 bp, Artificial
  CRISPR gRNA sequence
aatgaaatgattaagtggga

SEQ ID NO: 632457 - DNA, 20 bp, Artificial
  CRISPR gRNA sequence
atgaaatgattaagtgggaa

SEQ ID NO: 632458 - DNA, 20 bp, Artificial
  CRISPR gRNA sequence
agtgggaaaagaatatttta

SEQ ID NO: 632459 - DNA, 20 bp, Artificial
  CRISPR gRNA sequence
tagaaaggaaacagatctct

SEQ ID NO: 632460 - DNA, 20 bp, Artificial
  CRISPR gRNA sequence
agaaaggaaacagatctcta

SEQ ID NO: 632461 - DNA, 20 bp, Artificial
  CRISPR gRNA sequence
gaaaggaaacagatctctac

SEQ ID NO: 632462 - DNA, 20 bp, Artificial
  CRISPR gRNA sequence
tacctgaaaagtgagatatc

SEQ ID NO: 632463 - DNA, 20 bp, Artificial
  CRISPR gRNA sequence
cctgaaaagtgagatatctt

SEQ ID NO: 632464 - DNA, 20 bp, Artificial
  CRISPR gRNA sequence
aaaagtgagatatctttcaa

SEQ ID NO: 632465 - DNA, 20 bp, Artificial
  CRISPR gRNA sequence
tcaaagagaatctctttata

SEQ ID NO: 632466 - DNA, 20 bp, Artificial
  CRISPR gRNA sequence
caaagagaatctctttatat

SEQ ID NO: 632467 - DNA, 20 bp, Artificial
  CRISPR gRNA sequence
aaagagaatctctttatatg

SEQ ID NO: 632468 - DNA, 20 bp, Artificial
  CRISPR gRNA sequence
tttatatgaaatcatttcag

SEQ ID NO: 632469 - DNA, 20 bp, Artificial
  CRISPR gRNA sequence
tatatgaaatcatttcagga

SEQ ID NO: 632470 - DNA, 20 bp, Artificial
  CRISPR gRNA sequence
atatgaaatcatttcaggat

SEQ ID NO: 632471 - DNA, 20 bp, Artificial
  CRISPR gRNA sequence
tatgaaatcatttcaggata

SEQ ID NO: 632472 - DNA, 20 bp, Artificial
  CRISPR gRNA sequence
caggataattaggtgtctgt

SEQ ID NO: 632473 - DNA, 20 bp, Artificial
  CRISPR gRNA sequence
aggataattaggtgtctgtc

SEQ ID NO: 632474 - DNA, 20 bp, Artificial
  CRISPR gRNA sequence
ggtgtctgtcaaaaatcatt

SEQ ID NO: 632475 - DNA, 20 bp, Artificial
  CRISPR gRNA sequence
tcaaaaatcattacagtaaa

SEQ ID NO: 632476 - DNA, 20 bp, Artificial
  CRISPR gRNA sequence
cagtaaaataacttttatct

SEQ ID NO: 632477 - DNA, 20 bp, Artificial
  CRISPR gRNA sequence
ttatctctctaaggacagtt

SEQ ID NO: 632478 - DNA, 20 bp, Artificial
  CRISPR gRNA sequence
tatctctctaaggacagttt

SEQ ID NO: 632479 - DNA, 20 bp, Artificial
  CRISPR gRNA sequence
atctctctaaggacagttta

SEQ ID NO: 632480 - DNA, 20 bp, Artificial
  CRISPR gRNA sequence
tctctctaaggacagtttac

SEQ ID NO: 632481 - DNA, 20 bp, Artificial
  CRISPR gRNA sequence
tctaaggacagtttactaaa

SEQ ID NO: 632482 - DNA, 20 bp, Artificial
  CRISPR gRNA sequence
taaggacagtttactaaagt

SEQ ID NO: 632483 - DNA, 20 bp, Artificial
  CRISPR gRNA sequence
aggacagtttactaaagtag

SEQ ID NO: 632484 - DNA, 20 bp, Artificial
  CRISPR gRNA sequence
actaaagtagttgagggtgg

SEQ ID NO: 632485 - DNA, 20 bp, Artificial
  CRISPR gRNA sequence
ctaaagtagttgagggtggg

SEQ ID NO: 632486 - DNA, 20 bp, Artificial
  CRISPR gRNA sequence
aagtagttgagggtgggggg

SEQ ID NO: 632487 - DNA, 20 bp, Artificial
  CRISPR gRNA sequence
agggtggggggatgaatgtt

SEQ ID NO: 632488 - DNA, 20 bp, Artificial
  CRISPR gRNA sequence
aatgtttaaacaagtctgtg

SEQ ID NO: 632489 - DNA, 20 bp, Artificial
  CRISPR gRNA sequence
aaacaagtctgtgagacagt

SEQ ID NO: 632490 - DNA, 20 bp, Artificial
  CRISPR gRNA sequence
aacaagtctgtgagacagta

SEQ ID NO: 632491 - DNA, 20 bp, Artificial
  CRISPR gRNA sequence
tgagacagtatatttaatgc

SEQ ID NO: 632492 - DNA, 20 bp, Artificial
  CRISPR gRNA sequence
aatgcagatttcttagagat

SEQ ID NO: 632493 - DNA, 20 bp, Artificial
  CRISPR gRNA sequence
atgcagatttcttagagatt

SEQ ID NO: 632494 - DNA, 20 bp, Artificial
  CRISPR gRNA sequence
cttagagatttacaatgtat

SEQ ID NO: 632495 - DNA, 20 bp, Artificial
  CRISPR gRNA sequence
ttagagatttacaatgtata

SEQ ID NO: 632496 - DNA, 20 bp, Artificial
  CRISPR gRNA sequence
agagatttacaatgtatatg

SEQ ID NO: 632497 - DNA, 20 bp, Artificial
  CRISPR gRNA sequence
gagatttacaatgtatatga

SEQ ID NO: 632498 - DNA, 20 bp, Artificial
  CRISPR gRNA sequence
acaatgtatatgagcattat

SEQ ID NO: 632499 - DNA, 20 bp, Artificial
  CRISPR gRNA sequence
caatgtatatgagcattatc

SEQ ID NO: 632500 - DNA, 20 bp, Artificial
  CRISPR gRNA sequence
tcagaggttcttttggatgt

SEQ ID NO: 632501 - DNA, 20 bp, Artificial
  CRISPR gRNA sequence
ttttggatgtttagcttcaa

SEQ ID NO: 632502 - DNA, 20 bp, Artificial
  CRISPR gRNA sequence
ttggatgtttagcttcaata

SEQ ID NO: 632503 - DNA, 20 bp, Artificial
  CRISPR gRNA sequence
tggatgtttagcttcaataa

SEQ ID NO: 632504 - DNA, 20 bp, Artificial
  CRISPR gRNA sequence
ggatgtttagcttcaataac

SEQ ID NO: 632505 - DNA, 20 bp, Artificial
  CRISPR gRNA sequence
gatgtttagcttcaataaca

SEQ ID NO: 632506 - DNA, 20 bp, Artificial
  CRISPR gRNA sequence
agcttcaataacaaaaaagc

SEQ ID NO: 632507 - DNA, 20 bp, Artificial
  CRISPR gRNA sequence
gcttcaataacaaaaaagca

SEQ ID NO: 632508 - DNA, 20 bp, Artificial
  CRISPR gRNA sequence
caataacaaaaaagcaaaca

SEQ ID NO: 632509 - DNA, 20 bp, Artificial
  CRISPR gRNA sequence
aataacaaaaaagcaaacag

SEQ ID NO: 632510 - DNA, 20 bp, Artificial
  CRISPR gRNA sequence
atttaacccaacgttttcca

SEQ ID NO: 632511 - DNA, 20 bp, Artificial
  CRISPR gRNA sequence
tttaacccaacgttttccaa

SEQ ID NO: 632512 - DNA, 20 bp, Artificial
  CRISPR gRNA sequence
aacccaacgttttccaaaaa

SEQ ID NO: 632513 - DNA, 20 bp, Artificial
  CRISPR gRNA sequence
acccaacgttttccaaaaaa

SEQ ID NO: 632514 - DNA, 20 bp, Artificial
  CRISPR gRNA sequence
tccaaaaaaactaaatatag

SEQ ID NO: 632515 - DNA, 20 bp, Artificial
  CRISPR gRNA sequence
ccaaaaaaactaaatatagt

SEQ ID NO: 632516 - DNA, 20 bp, Artificial
  CRISPR gRNA sequence
caaaaaaactaaatatagta

SEQ ID NO: 632517 - DNA, 20 bp, Artificial
  CRISPR gRNA sequence
aatatagtacaattttttat

SEQ ID NO: 632518 - DNA, 20 bp, Artificial
  CRISPR gRNA sequence
tttattttagcaactattaa

SEQ ID NO: 632519 - DNA, 20 bp, Artificial
  CRISPR gRNA sequence
ttattttagcaactattaat

SEQ ID NO: 632520 - DNA, 20 bp, Artificial
  CRISPR gRNA sequence
tattttagcaactattaatt

SEQ ID NO: 632521 - DNA, 20 bp, Artificial
  CRISPR gRNA sequence
attttagcaactattaattt

SEQ ID NO: 632522 - DNA, 20 bp, Artificial
  CRISPR gRNA sequence
ttttagcaactattaatttc

SEQ ID NO: 632523 - DNA, 20 bp, Artificial
  CRISPR gRNA sequence
tagcaactattaatttcgca

SEQ ID NO: 632524 - DNA, 20 bp, Artificial
  CRISPR gRNA sequence
agcaactattaatttcgcaa

SEQ ID NO: 632525 - DNA, 20 bp, Artificial
  CRISPR gRNA sequence
gcaactattaatttcgcaag

SEQ ID NO: 632526 - DNA, 20 bp, Artificial
  CRISPR gRNA sequence
ttaatttcgcaagtaaatat

SEQ ID NO: 632527 - DNA, 20 bp, Artificial
  CRISPR gRNA sequence
atttcgcaagtaaatatttt

SEQ ID NO: 632528 - DNA, 20 bp, Artificial
  CRISPR gRNA sequence
cgcaagtaaatatttttttg

SEQ ID NO: 632529 - DNA, 20 bp, Artificial
  CRISPR gRNA sequence
gcaagtaaatatttttttgt

SEQ ID NO: 632530 - DNA, 20 bp, Artificial
  CRISPR gRNA sequence
ttttgtgaacatactgtgaa

SEQ ID NO: 632531 - DNA, 20 bp, Artificial
  CRISPR gRNA sequence
tttgtgaacatactgtgaag

SEQ ID NO: 632532 - DNA, 20 bp, Artificial
  CRISPR gRNA sequence
ttgtgaacatactgtgaaga

SEQ ID NO: 632533 - DNA, 20 bp, Artificial
  CRISPR gRNA sequence
tgtgaacatactgtgaagaa

SEQ ID NO: 632534 - DNA, 20 bp, Artificial
  CRISPR gRNA sequence
gtgaacatactgtgaagaac

SEQ ID NO: 632535 - DNA, 20 bp, Artificial
  CRISPR gRNA sequence
tgaacatactgtgaagaaca

SEQ ID NO: 632536 - DNA, 20 bp, Artificial
  CRISPR gRNA sequence
tgaagaacactgcattatga

SEQ ID NO: 632537 - DNA, 20 bp, Artificial
  CRISPR gRNA sequence
cattatgacaataaaagagg

SEQ ID NO: 632538 - DNA, 20 bp, Artificial
  CRISPR gRNA sequence
tgacaataaaagaggcaaaa

SEQ ID NO: 632539 - DNA, 20 bp, Artificial
  CRISPR gRNA sequence
gtactatttttctttttttt

SEQ ID NO: 632540 - DNA, 20 bp, Artificial
  CRISPR gRNA sequence
tttttctttttttttttttt

SEQ ID NO: 632541 - DNA, 20 bp, Artificial
  CRISPR gRNA sequence
ttcttttttttttttttttg

SEQ ID NO: 632542 - DNA, 20 bp, Artificial
  CRISPR gRNA sequence
tcttttttttttttttttgt

SEQ ID NO: 632543 - DNA, 20 bp, Artificial
  CRISPR gRNA sequence
cttttttttttttttttgtt

SEQ ID NO: 632544 - DNA, 20 bp, Artificial
  CRISPR gRNA sequence
ttttttttttttttttgttt

SEQ ID NO: 632545 - DNA, 20 bp, Artificial
  CRISPR gRNA sequence
ttttttttttttttgtttgg

SEQ ID NO: 632546 - DNA, 20 bp, Artificial
  CRISPR gRNA sequence
tttttttttttttgtttggt

SEQ ID NO: 632547 - DNA, 20 bp, Artificial
  CRISPR gRNA sequence
ttttttttttttgtttggtg

SEQ ID NO: 632548 - DNA, 20 bp, Artificial
  CRISPR gRNA sequence
tttttttttttgtttggtga

SEQ ID NO: 632549 - DNA, 20 bp, Artificial
  CRISPR gRNA sequence
ttttttttttgtttggtgag

SEQ ID NO: 632550 - DNA, 20 bp, Artificial
  CRISPR gRNA sequence
tttttttttgtttggtgaga

SEQ ID NO: 632551 - DNA, 20 bp, Artificial
  CRISPR gRNA sequence
ttttttttgtttggtgagat

SEQ ID NO: 632552 - DNA, 20 bp, Artificial
  CRISPR gRNA sequence
tttttttgtttggtgagatg

SEQ ID NO: 632553 - DNA, 20 bp, Artificial
  CRISPR gRNA sequence
ttttttgtttggtgagatgg

SEQ ID NO: 632554 - DNA, 20 bp, Artificial
  CRISPR gRNA sequence
tttttgtttggtgagatgga

SEQ ID NO: 632555 - DNA, 20 bp, Artificial
  CRISPR gRNA sequence
ttttgtttggtgagatggag

SEQ ID NO: 632556 - DNA, 20 bp, Artificial
  CRISPR gRNA sequence
tttgtttggtgagatggagt

SEQ ID NO: 632557 - DNA, 20 bp, Artificial
  CRISPR gRNA sequence
ttgtttggtgagatggagtc

SEQ ID NO: 632558 - DNA, 20 bp, Artificial
  CRISPR gRNA sequence
tgtttggtgagatggagtct

SEQ ID NO: 632559 - DNA, 20 bp, Artificial
  CRISPR gRNA sequence
gtttggtgagatggagtctc

SEQ ID NO: 632560 - DNA, 20 bp, Artificial
  CRISPR gRNA sequence
tttggtgagatggagtctcg

SEQ ID NO: 632561 - DNA, 20 bp, Artificial
  CRISPR gRNA sequence
ggtgagatggagtctcgctc

SEQ ID NO: 632562 - DNA, 20 bp, Artificial
  CRISPR gRNA sequence
gtgagatggagtctcgctct

SEQ ID NO: 632563 - DNA, 20 bp, Artificial
  CRISPR gRNA sequence
gctctgtcgcccagactgga

SEQ ID NO: 632564 - DNA, 20 bp, Artificial
  CRISPR gRNA sequence
tgtcgcccagactggagggc

SEQ ID NO: 632565 - DNA, 20 bp, Artificial
  CRISPR gRNA sequence
tcgcccagactggagggcag

SEQ ID NO: 632566 - DNA, 20 bp, Artificial
  CRISPR gRNA sequence
gagggcaggagtgcactggt

SEQ ID NO: 632567 - DNA, 20 bp, Artificial
  CRISPR gRNA sequence
gtgccacctcggatcactgc

SEQ ID NO: 632568 - DNA, 20 bp, Artificial
  CRISPR gRNA sequence
ggatcactgcaacctccacc

SEQ ID NO: 632569 - DNA, 20 bp, Artificial
  CRISPR gRNA sequence
caacctccacctcctgggtt

SEQ ID NO: 632570 - DNA, 20 bp, Artificial
  CRISPR gRNA sequence
cacctcctgggttcaaatga

SEQ ID NO: 632571 - DNA, 20 bp, Artificial
  CRISPR gRNA sequence
ctgggttcaaatgattctcc

SEQ ID NO: 632572 - DNA, 20 bp, Artificial
  CRISPR gRNA sequence
ggttcaaatgattctccagc

SEQ ID NO: 632573 - DNA, 20 bp, Artificial
  CRISPR gRNA sequence
aaatgattctccagcctcag

SEQ ID NO: 632574 - DNA, 20 bp, Artificial
  CRISPR gRNA sequence
tccagcctcagcctcctgag

SEQ ID NO: 632575 - DNA, 20 bp, Artificial
  CRISPR gRNA sequence
cagcctcagcctcctgagta

SEQ ID NO: 632576 - DNA, 20 bp, Artificial
  CRISPR gRNA sequence
agcctcctgagtagctggga

SEQ ID NO: 632577 - DNA, 20 bp, Artificial
  CRISPR gRNA sequence
ctgagtagctgggactacag

SEQ ID NO: 632578 - DNA, 20 bp, Artificial
  CRISPR gRNA sequence
agtagctgggactacaggca

SEQ ID NO: 632579 - DNA, 20 bp, Artificial
  CRISPR gRNA sequence
ggactacaggcacgtgccac

SEQ ID NO: 632580 - DNA, 20 bp, Artificial
  CRISPR gRNA sequence
caggcacgtgccaccacgtc

SEQ ID NO: 632581 - DNA, 20 bp, Artificial
  CRISPR gRNA sequence
gctaatttttgtatttttag

SEQ ID NO: 632582 - DNA, 20 bp, Artificial
  CRISPR gRNA sequence
atttttgtatttttagtaga

SEQ ID NO: 632583 - DNA, 20 bp, Artificial
  CRISPR gRNA sequence
ttgtatttttagtagagacg

SEQ ID NO: 632584 - DNA, 20 bp, Artificial
  CRISPR gRNA sequence
tgtatttttagtagagacgg

SEQ ID NO: 632585 - DNA, 20 bp, Artificial
  CRISPR gRNA sequence
gtatttttagtagagacggg

SEQ ID NO: 632586 - DNA, 20 bp, Artificial
  CRISPR gRNA sequence
tatttttagtagagacgggg

SEQ ID NO: 632587 - DNA, 20 bp, Artificial
  CRISPR gRNA sequence
ttagtagagacggggtttca

SEQ ID NO: 632588 - DNA, 20 bp, Artificial
  CRISPR gRNA sequence
tagtagagacggggtttcac

SEQ ID NO: 632589 - DNA, 20 bp, Artificial
  CRISPR gRNA sequence
agtagagacggggtttcacc

SEQ ID NO: 632590 - DNA, 20 bp, Artificial
  CRISPR gRNA sequence
gtagagacggggtttcacca

SEQ ID NO: 632591 - DNA, 20 bp, Artificial
  CRISPR gRNA sequence
caccacgttggccaggctgg

SEQ ID NO: 632592 - DNA, 20 bp, Artificial
  CRISPR gRNA sequence
accacgttggccaggctggt

SEQ ID NO: 632593 - DNA, 20 bp, Artificial
  CRISPR gRNA sequence
gccaggctggtcttgaactc

SEQ ID NO: 632594 - DNA, 20 bp, Artificial
  CRISPR gRNA sequence
gtcttgaactcctgacctca

SEQ ID NO: 632595 - DNA, 20 bp, Artificial
  CRISPR gRNA sequence
gaactcctgacctcaagtga

SEQ ID NO: 632596 - DNA, 20 bp, Artificial
  CRISPR gRNA sequence
aactcctgacctcaagtgat

SEQ ID NO: 632597 - DNA, 20 bp, Artificial
  CRISPR gRNA sequence
ctgacctcaagtgatccgcc

SEQ ID NO: 632598 - DNA, 20 bp, Artificial
  CRISPR gRNA sequence
acctcaagtgatccgcccgc

SEQ ID NO: 632599 - DNA, 20 bp, Artificial
  CRISPR gRNA sequence
aagtgatccgcccgcctcag

SEQ ID NO: 632600 - DNA, 20 bp, Artificial
  CRISPR gRNA sequence
agcctcccaaagtgctggga

SEQ ID NO: 632601 - DNA, 20 bp, Artificial
  CRISPR gRNA sequence
ccaaagtgctgggattacag

SEQ ID NO: 632602 - DNA, 20 bp, Artificial
  CRISPR gRNA sequence
ggattacaggcgtgtgccac

SEQ ID NO: 632603 - DNA, 20 bp, Artificial
  CRISPR gRNA sequence
caggcgtgtgccactgcgcc

SEQ ID NO: 632604 - DNA, 20 bp, Artificial
  CRISPR gRNA sequence
cgccaggctgtgttaatact

SEQ ID NO: 632605 - DNA, 20 bp, Artificial
  CRISPR gRNA sequence
tgttaatactgtttactctt

SEQ ID NO: 632606 - DNA, 20 bp, Artificial
  CRISPR gRNA sequence
atactgtttactcttcttta

SEQ ID NO: 632607 - DNA, 20 bp, Artificial
  CRISPR gRNA sequence
tttactcttctttaacagga

SEQ ID NO: 632608 - DNA, 20 bp, Artificial
  CRISPR gRNA sequence
actcttctttaacaggatgt

SEQ ID NO: 632609 - DNA, 20 bp, Artificial
  CRISPR gRNA sequence
ctcttctttaacaggatgtg

SEQ ID NO: 632610 - DNA, 20 bp, Artificial
  CRISPR gRNA sequence
ttctttaacaggatgtgcca

SEQ ID NO: 632611 - DNA, 20 bp, Artificial
  CRISPR gRNA sequence
ctttaacaggatgtgccagg

SEQ ID NO: 632612 - DNA, 20 bp, Artificial
  CRISPR gRNA sequence
tttaacaggatgtgccaggt

SEQ ID NO: 632613 - DNA, 20 bp, Artificial
  CRISPR gRNA sequence
taacaggatgtgccaggtgt

SEQ ID NO: 632614 - DNA, 20 bp, Artificial
  CRISPR gRNA sequence
aacaggatgtgccaggtgtt

SEQ ID NO: 632615 - DNA, 20 bp, Artificial
  CRISPR gRNA sequence
acaggatgtgccaggtgttg

SEQ ID NO: 632616 - DNA, 20 bp, Artificial
  CRISPR gRNA sequence
agcaaagacatctagttcct

SEQ ID NO: 632617 - DNA, 20 bp, Artificial
  CRISPR gRNA sequence
gttcctttaacataaatttc

SEQ ID NO: 632618 - DNA, 20 bp, Artificial
  CRISPR gRNA sequence
ctttaacataaatttcttga

SEQ ID NO: 632619 - DNA, 20 bp, Artificial
  CRISPR gRNA sequence
taacataaatttcttgagca

SEQ ID NO: 632620 - DNA, 20 bp, Artificial
  CRISPR gRNA sequence
aacataaatttcttgagcac

SEQ ID NO: 632621 - DNA, 20 bp, Artificial
  CRISPR gRNA sequence
acataaatttcttgagcacc

SEQ ID NO: 632622 - DNA, 20 bp, Artificial
  CRISPR gRNA sequence
cttgagcacctccagtattc

SEQ ID NO: 632623 - DNA, 20 bp, Artificial
  CRISPR gRNA sequence
ttgagcacctccagtattcc

SEQ ID NO: 632624 - DNA, 20 bp, Artificial
  CRISPR gRNA sequence
gagcacctccagtattccat

SEQ ID NO: 632625 - DNA, 20 bp, Artificial
  CRISPR gRNA sequence
agcacctccagtattccatg

SEQ ID NO: 632626 - DNA, 20 bp, Artificial
  CRISPR gRNA sequence
cagtattccatgtccacgtt

SEQ ID NO: 632627 - DNA, 20 bp, Artificial
  CRISPR gRNA sequence
catgtccacgttctaggtgc

SEQ ID NO: 632628 - DNA, 20 bp, Artificial
  CRISPR gRNA sequence
taggtgctgtagatacagca

SEQ ID NO: 632629 - DNA, 20 bp, Artificial
  CRISPR gRNA sequence
ggtgctgtagatacagcact

SEQ ID NO: 632630 - DNA, 20 bp, Artificial
  CRISPR gRNA sequence
tagatacagcactgaacgag

SEQ ID NO: 632631 - DNA, 20 bp, Artificial
  CRISPR gRNA sequence
aacgagacaaatgtcattcc

SEQ ID NO: 632632 - DNA, 20 bp, Artificial
  CRISPR gRNA sequence
ctgcatccacagagctaaca

SEQ ID NO: 632633 - DNA, 20 bp, Artificial
  CRISPR gRNA sequence
catccacagagctaacatta

SEQ ID NO: 632634 - DNA, 20 bp, Artificial
  CRISPR gRNA sequence
acattattaaccatccaaat

SEQ ID NO: 632635 - DNA, 20 bp, Artificial
  CRISPR gRNA sequence
ttaaccatccaaatattgcc

SEQ ID NO: 632636 - DNA, 20 bp, Artificial
  CRISPR gRNA sequence
accatccaaatattgccatt

SEQ ID NO: 632637 - DNA, 20 bp, Artificial
  CRISPR gRNA sequence
ccatttgttttataatgtaa

SEQ ID NO: 632638 - DNA, 20 bp, Artificial
  CRISPR gRNA sequence
gttttataatgtaataacaa

SEQ ID NO: 632639 - DNA, 20 bp, Artificial
  CRISPR gRNA sequence
ttttataatgtaataacaat

SEQ ID NO: 632640 - DNA, 20 bp, Artificial
  CRISPR gRNA sequence
tataatgtaataacaatgtt

SEQ ID NO: 632641 - DNA, 20 bp, Artificial
  CRISPR gRNA sequence
ataatgtaataacaatgttc

SEQ ID NO: 632642 - DNA, 20 bp, Artificial
  CRISPR gRNA sequence
taatgtaataacaatgttca

SEQ ID NO: 632643 - DNA, 20 bp, Artificial
  CRISPR gRNA sequence
aaagtaaactgaaaatctta

SEQ ID NO: 632644 - DNA, 20 bp, Artificial
  CRISPR gRNA sequence
aaaatcttatacaggacaca

SEQ ID NO: 632645 - DNA, 20 bp, Artificial
  CRISPR gRNA sequence
atacaggacacaaacaccag

SEQ ID NO: 632646 - DNA, 20 bp, Artificial
  CRISPR gRNA sequence
tacaggacacaaacaccagg

SEQ ID NO: 632647 - DNA, 20 bp, Artificial
  CRISPR gRNA sequence
tatataaaaaagtatgtatg

SEQ ID NO: 632648 - DNA, 20 bp, Artificial
  CRISPR gRNA sequence
taaagtaaaatcacagacat

SEQ ID NO: 632649 - DNA, 20 bp, Artificial
  CRISPR gRNA sequence
aaagtaaaatcacagacatt

SEQ ID NO: 632650 - DNA, 20 bp, Artificial
  CRISPR gRNA sequence
aagtaaaatcacagacattt

SEQ ID NO: 632651 - DNA, 20 bp, Artificial
  CRISPR gRNA sequence
gaaagcaaaagaaaactgct

SEQ ID NO: 632652 - DNA, 20 bp, Artificial
  CRISPR gRNA sequence
aaagcaaaagaaaactgctt

SEQ ID NO: 632653 - DNA, 20 bp, Artificial
  CRISPR gRNA sequence
ctttttattgttttgggcac

SEQ ID NO: 632654 - DNA, 20 bp, Artificial
  CRISPR gRNA sequence
tttattgttttgggcactct

SEQ ID NO: 632655 - DNA, 20 bp, Artificial
  CRISPR gRNA sequence
ttattgttttgggcactctg

SEQ ID NO: 632656 - DNA, 20 bp, Artificial
  CRISPR gRNA sequence
tattgttttgggcactctgg

SEQ ID NO: 632657 - DNA, 20 bp, Artificial
  CRISPR gRNA sequence
attgttttgggcactctgga

SEQ ID NO: 632658 - DNA, 20 bp, Artificial
  CRISPR gRNA sequence
ttgttttgggcactctggaa

SEQ ID NO: 632659 - DNA, 20 bp, Artificial
  CRISPR gRNA sequence
ttttgggcactctggaagaa

SEQ ID NO: 632660 - DNA, 20 bp, Artificial
  CRISPR gRNA sequence
tgggcactctggaagaaaaa

SEQ ID NO: 632661 - DNA, 20 bp, Artificial
  CRISPR gRNA sequence
gggcactctggaagaaaaat

SEQ ID NO: 632662 - DNA, 20 bp, Artificial
  CRISPR gRNA sequence
ggcactctggaagaaaaata

SEQ ID NO: 632663 - DNA, 20 bp, Artificial
  CRISPR gRNA sequence
tggaagaaaaatagtcacaa

SEQ ID NO: 632664 - DNA, 20 bp, Artificial
  CRISPR gRNA sequence
gaagaaaaatagtcacaatt

SEQ ID NO: 632665 - DNA, 20 bp, Artificial
  CRISPR gRNA sequence
aaacaagaaaatgtcttatg

SEQ ID NO: 632666 - DNA, 20 bp, Artificial
  CRISPR gRNA sequence
atgtaagattatttttataa

SEQ ID NO: 632667 - DNA, 20 bp, Artificial
  CRISPR gRNA sequence
tgtaagattatttttataag

SEQ ID NO: 632668 - DNA, 20 bp, Artificial
  CRISPR gRNA sequence
tttttataagagtctaagtt

SEQ ID NO: 632669 - DNA, 20 bp, Artificial
  CRISPR gRNA sequence
ttataagagtctaagttgtt

SEQ ID NO: 632670 - DNA, 20 bp, Artificial
  CRISPR gRNA sequence
tataagagtctaagttgttg

SEQ ID NO: 632671 - DNA, 20 bp, Artificial
  CRISPR gRNA sequence
ataagagtctaagttgttgg

SEQ ID NO: 632672 - DNA, 20 bp, Artificial
  CRISPR gRNA sequence
taagagtctaagttgttggc

SEQ ID NO: 632673 - DNA, 20 bp, Artificial
  CRISPR gRNA sequence
agttgttggcatctactttt

SEQ ID NO: 632674 - DNA, 20 bp, Artificial
  CRISPR gRNA sequence
ttggcatctacttttctatc

SEQ ID NO: 632675 - DNA, 20 bp, Artificial
  CRISPR gRNA sequence
gcatctacttttctatcact

SEQ ID NO: 632676 - DNA, 20 bp, Artificial
  CRISPR gRNA sequence
cttttctatcactttaagtt

SEQ ID NO: 632677 - DNA, 20 bp, Artificial
  CRISPR gRNA sequence
ttctatcactttaagttaac

SEQ ID NO: 632678 - DNA, 20 bp, Artificial
  CRISPR gRNA sequence
tctatcactttaagttaaca

SEQ ID NO: 632679 - DNA, 20 bp, Artificial
  CRISPR gRNA sequence
ctatcactttaagttaacac

SEQ ID NO: 632680 - DNA, 20 bp, Artificial
  CRISPR gRNA sequence
tatcactttaagttaacaca

SEQ ID NO: 632681 - DNA, 20 bp, Artificial
  CRISPR gRNA sequence
tcactttaagttaacacatt

SEQ ID NO: 632682 - DNA, 20 bp, Artificial
  CRISPR gRNA sequence
taagttaacacatttcctca

SEQ ID NO: 632683 - DNA, 20 bp, Artificial
  CRISPR gRNA sequence
aagttaacacatttcctcag

SEQ ID NO: 632684 - DNA, 20 bp, Artificial
  CRISPR gRNA sequence
agttaacacatttcctcaga

SEQ ID NO: 632685 - DNA, 20 bp, Artificial
  CRISPR gRNA sequence
acacatttcctcagatttct

SEQ ID NO: 632686 - DNA, 20 bp, Artificial
  CRISPR gRNA sequence
cctcagatttcttgaactta

SEQ ID NO: 632687 - DNA, 20 bp, Artificial
  CRISPR gRNA sequence
ctcagatttcttgaacttaa

SEQ ID NO: 632688 - DNA, 20 bp, Artificial
  CRISPR gRNA sequence
agatttcttgaacttaacac

SEQ ID NO: 632689 - DNA, 20 bp, Artificial
  CRISPR gRNA sequence
cttgaacttaacacctaaaa

SEQ ID NO: 632690 - DNA, 20 bp, Artificial
  CRISPR gRNA sequence
ttgaacttaacacctaaaat

SEQ ID NO: 632691 - DNA, 20 bp, Artificial
  CRISPR gRNA sequence
gaacttaacacctaaaataa

SEQ ID NO: 632692 - DNA, 20 bp, Artificial
  CRISPR gRNA sequence
aacttaacacctaaaataag

SEQ ID NO: 632693 - DNA, 20 bp, Artificial
  CRISPR gRNA sequence
aacacctaaaataaggaagc

SEQ ID NO: 632694 - DNA, 20 bp, Artificial
  CRISPR gRNA sequence
acacctaaaataaggaagca

SEQ ID NO: 632695 - DNA, 20 bp, Artificial
  CRISPR gRNA sequence
aaataaggaagcaaaatggg

SEQ ID NO: 632696 - DNA, 20 bp, Artificial
  CRISPR gRNA sequence
taacatattttggcagtgta

SEQ ID NO: 632697 - DNA, 20 bp, Artificial
  CRISPR gRNA sequence
tggcagtgtaacagttatgc

SEQ ID NO: 632698 - DNA, 20 bp, Artificial
  CRISPR gRNA sequence
ggcagtgtaacagttatgct

SEQ ID NO: 632699 - DNA, 20 bp, Artificial
  CRISPR gRNA sequence
gcagtgtaacagttatgctt

SEQ ID NO: 632700 - DNA, 20 bp, Artificial
  CRISPR gRNA sequence
tgcttccccagcatttcctt

SEQ ID NO: 632701 - DNA, 20 bp, Artificial
  CRISPR gRNA sequence
ccccagcatttccttaccac

SEQ ID NO: 632702 - DNA, 20 bp, Artificial
  CRISPR gRNA sequence
cccagcatttccttaccaca

SEQ ID NO: 632703 - DNA, 20 bp, Artificial
  CRISPR gRNA sequence
ccttaccacataaaatattt

SEQ ID NO: 632704 - DNA, 20 bp, Artificial
  CRISPR gRNA sequence
cttaccacataaaatatttt

SEQ ID NO: 632705 - DNA, 20 bp, Artificial
  CRISPR gRNA sequence
accacataaaatattttatt

SEQ ID NO: 632706 - DNA, 20 bp, Artificial
  CRISPR gRNA sequence
ccacataaaatattttattg

SEQ ID NO: 632707 - DNA, 20 bp, Artificial
  CRISPR gRNA sequence
tattgcttattttgaacatt

SEQ ID NO: 632708 - DNA, 20 bp, Artificial
  CRISPR gRNA sequence
attgcttattttgaacattg

SEQ ID NO: 632709 - DNA, 20 bp, Artificial
  CRISPR gRNA sequence
ttgcttattttgaacattgc

SEQ ID NO: 632710 - DNA, 20 bp, Artificial
  CRISPR gRNA sequence
cttattttgaacattgctaa

SEQ ID NO: 632711 - DNA, 20 bp, Artificial
  CRISPR gRNA sequence
attttgaacattgctaataa

SEQ ID NO: 632712 - DNA, 20 bp, Artificial
  CRISPR gRNA sequence
ttttgaacattgctaataaa

SEQ ID NO: 632713 - DNA, 20 bp, Artificial
  CRISPR gRNA sequence
tgaacattgctaataaaata

SEQ ID NO: 632714 - DNA, 20 bp, Artificial
  CRISPR gRNA sequence
gaacattgctaataaaataa

SEQ ID NO: 632715 - DNA, 20 bp, Artificial
  CRISPR gRNA sequence
aacattgctaataaaataat

SEQ ID NO: 632716 - DNA, 20 bp, Artificial
  CRISPR gRNA sequence
ctaataaaataattaaacaa

SEQ ID NO: 632717 - DNA, 20 bp, Artificial
  CRISPR gRNA sequence
ataaaataattaaacaataa

SEQ ID NO: 632718 - DNA, 20 bp, Artificial
  CRISPR gRNA sequence
aacaataaatggaagtagat

SEQ ID NO: 632719 - DNA, 20 bp, Artificial
  CRISPR gRNA sequence
aatctctctaaatttttaca

SEQ ID NO: 632720 - DNA, 20 bp, Artificial
  CRISPR gRNA sequence
atctctctaaatttttacac

SEQ ID NO: 632721 - DNA, 20 bp, Artificial
  CRISPR gRNA sequence
tctaaatttttacacttctg

SEQ ID NO: 632722 - DNA, 20 bp, Artificial
  CRISPR gRNA sequence
taaatttttacacttctgtt

SEQ ID NO: 632723 - DNA, 20 bp, Artificial
  CRISPR gRNA sequence
aatttttacacttctgttaa

SEQ ID NO: 632724 - DNA, 20 bp, Artificial
  CRISPR gRNA sequence
ttacacttctgttaaaaata

SEQ ID NO: 632725 - DNA, 20 bp, Artificial
  CRISPR gRNA sequence
tacacttctgttaaaaatat

SEQ ID NO: 632726 - DNA, 20 bp, Artificial
  CRISPR gRNA sequence
acacttctgttaaaaatata

SEQ ID NO: 632727 - DNA, 20 bp, Artificial
  CRISPR gRNA sequence
cacttctgttaaaaatatat

SEQ ID NO: 632728 - DNA, 20 bp, Artificial
  CRISPR gRNA sequence
ctgttaaaaatatatacata

SEQ ID NO: 632729 - DNA, 20 bp, Artificial
  CRISPR gRNA sequence
tgttaaaaatatatacatat

SEQ ID NO: 632730 - DNA, 20 bp, Artificial
  CRISPR gRNA sequence
ttaaaaatatatacatatca

SEQ ID NO: 632731 - DNA, 20 bp, Artificial
  CRISPR gRNA sequence
aaaatatatacatatcaatt

SEQ ID NO: 632732 - DNA, 20 bp, Artificial
  CRISPR gRNA sequence
tttattcatacaacatgtat

SEQ ID NO: 632733 - DNA, 20 bp, Artificial
  CRISPR gRNA sequence
attcatacaacatgtattta

SEQ ID NO: 632734 - DNA, 20 bp, Artificial
  CRISPR gRNA sequence
ttcatacaacatgtatttac

SEQ ID NO: 632735 - DNA, 20 bp, Artificial
  CRISPR gRNA sequence
atacaacatgtatttaccag

SEQ ID NO: 632736 - DNA, 20 bp, Artificial
  CRISPR gRNA sequence
accagctgcctaaaatgtgg

SEQ ID NO: 632737 - DNA, 20 bp, Artificial
  CRISPR gRNA sequence
ccagctgcctaaaatgtggc

SEQ ID NO: 632738 - DNA, 20 bp, Artificial
  CRISPR gRNA sequence
cctaaaatgtggcatatata

SEQ ID NO: 632739 - DNA, 20 bp, Artificial
  CRISPR gRNA sequence
aaatgtggcatatataatca

SEQ ID NO: 632740 - DNA, 20 bp, Artificial
  CRISPR gRNA sequence
tattcaaaaaccatttaacc

SEQ ID NO: 632741 - DNA, 20 bp, Artificial
  CRISPR gRNA sequence
aaaaaccatttaacccctag

SEQ ID NO: 632742 - DNA, 20 bp, Artificial
  CRISPR gRNA sequence
aacccctagggatgctcact

SEQ ID NO: 632743 - DNA, 20 bp, Artificial
  CRISPR gRNA sequence
acccctagggatgctcactt

SEQ ID NO: 632744 - DNA, 20 bp, Artificial
  CRISPR gRNA sequence
gggatgctcacttctttcac

SEQ ID NO: 632745 - DNA, 20 bp, Artificial
  CRISPR gRNA sequence
acttctttcactgtaagtgt

SEQ ID NO: 632746 - DNA, 20 bp, Artificial
  CRISPR gRNA sequence
ctttcactgtaagtgtaaca

SEQ ID NO: 632747 - DNA, 20 bp, Artificial
  CRISPR gRNA sequence
tttcactgtaagtgtaacat

SEQ ID NO: 632748 - DNA, 20 bp, Artificial
  CRISPR gRNA sequence
tcactgtaagtgtaacataa

SEQ ID NO: 632749 - DNA, 20 bp, Artificial
  CRISPR gRNA sequence
cactgtaagtgtaacataag

SEQ ID NO: 632750 - DNA, 20 bp, Artificial
  CRISPR gRNA sequence
actgtaagtgtaacataagt

SEQ ID NO: 632751 - DNA, 20 bp, Artificial
  CRISPR gRNA sequence
taagtgtaacataagtcatt

SEQ ID NO: 632752 - DNA, 20 bp, Artificial
  CRISPR gRNA sequence
aacagattggttgatgaatt

SEQ ID NO: 632753 - DNA, 20 bp, Artificial
  CRISPR gRNA sequence
acagattggttgatgaattt

SEQ ID NO: 632754 - DNA, 20 bp, Artificial
  CRISPR gRNA sequence
gttgatgaatttaggaaaaa

SEQ ID NO: 632755 - DNA, 20 bp, Artificial
  CRISPR gRNA sequence
atgaatttaggaaaaagagc

SEQ ID NO: 632756 - DNA, 20 bp, Artificial
  CRISPR gRNA sequence
aggaaaaagagctagagaaa

SEQ ID NO: 632757 - DNA, 20 bp, Artificial
  CRISPR gRNA sequence
ggaaaaagagctagagaaag

SEQ ID NO: 632758 - DNA, 20 bp, Artificial
  CRISPR gRNA sequence
gagaaagtataaaggtgcaa

SEQ ID NO: 632759 - DNA, 20 bp, Artificial
  CRISPR gRNA sequence
taatgtggccaggagatggt

SEQ ID NO: 632760 - DNA, 20 bp, Artificial
  CRISPR gRNA sequence
aatgtggccaggagatggta

SEQ ID NO: 632761 - DNA, 20 bp, Artificial
  CRISPR gRNA sequence
atgtggccaggagatggtac

SEQ ID NO: 632762 - DNA, 20 bp, Artificial
  CRISPR gRNA sequence
agacacaagggaaacagcag

SEQ ID NO: 632763 - DNA, 20 bp, Artificial
  CRISPR gRNA sequence
gatactgtttcattattaca

SEQ ID NO: 632764 - DNA, 20 bp, Artificial
  CRISPR gRNA sequence
atactgtttcattattacaa

SEQ ID NO: 632765 - DNA, 20 bp, Artificial
  CRISPR gRNA sequence
tttcattattacaaatgtgc

SEQ ID NO: 632766 - DNA, 20 bp, Artificial
  CRISPR gRNA sequence
cattattacaaatgtgcaaa

SEQ ID NO: 632767 - DNA, 20 bp, Artificial
  CRISPR gRNA sequence
attattacaaatgtgcaaaa

SEQ ID NO: 632768 - DNA, 20 bp, Artificial
  CRISPR gRNA sequence
ttacaaatgtgcaaaatatt

SEQ ID NO: 632769 - DNA, 20 bp, Artificial
  CRISPR gRNA sequence
caaatgtgcaaaatattcat

SEQ ID NO: 632770 - DNA, 20 bp, Artificial
  CRISPR gRNA sequence
attatggggaataaaaagta

SEQ ID NO: 632771 - DNA, 20 bp, Artificial
  CRISPR gRNA sequence
tggggaataaaaagtaaaca

SEQ ID NO: 632772 - DNA, 20 bp, Artificial
  CRISPR gRNA sequence
gtaagaatttactaggcata

SEQ ID NO: 632773 - DNA, 20 bp, Artificial
  CRISPR gRNA sequence
actaggcatacagattaaat

SEQ ID NO: 632774 - DNA, 20 bp, Artificial
  CRISPR gRNA sequence
ctaggcatacagattaaatg

SEQ ID NO: 632775 - DNA, 20 bp, Artificial
  CRISPR gRNA sequence
ggcatacagattaaatgaat

SEQ ID NO: 632776 - DNA, 20 bp, Artificial
  CRISPR gRNA sequence
aatgaataatccaaattata

SEQ ID NO: 632777 - DNA, 20 bp, Artificial
  CRISPR gRNA sequence
tatagactcttccttttaat

SEQ ID NO: 632778 - DNA, 20 bp, Artificial
  CRISPR gRNA sequence
ttccttttaatgagatttca

SEQ ID NO: 632779 - DNA, 20 bp, Artificial
  CRISPR gRNA sequence
ccttttaatgagatttcaat

SEQ ID NO: 632780 - DNA, 20 bp, Artificial
  CRISPR gRNA sequence
cttttaatgagatttcaatt

SEQ ID NO: 632781 - DNA, 20 bp, Artificial
  CRISPR gRNA sequence
ttaatgagatttcaattaat

SEQ ID NO: 632782 - DNA, 20 bp, Artificial
  CRISPR gRNA sequence
taatgagatttcaattaatc

SEQ ID NO: 632783 - DNA, 20 bp, Artificial
  CRISPR gRNA sequence
aatgagatttcaattaatca

SEQ ID NO: 632784 - DNA, 20 bp, Artificial
  CRISPR gRNA sequence
atgagatttcaattaatcaa

SEQ ID NO: 632785 - DNA, 20 bp, Artificial
  CRISPR gRNA sequence
caattaatcaaaccactggc

SEQ ID NO: 632786 - DNA, 20 bp, Artificial
  CRISPR gRNA sequence
aattaatcaaaccactggca

SEQ ID NO: 632787 - DNA, 20 bp, Artificial
  CRISPR gRNA sequence
atcaaaccactggcatatct

SEQ ID NO: 632788 - DNA, 20 bp, Artificial
  CRISPR gRNA sequence
gcatatcttggagatattgc

SEQ ID NO: 632789 - DNA, 20 bp, Artificial
  CRISPR gRNA sequence
ggagatattgcaggttgagt

SEQ ID NO: 632790 - DNA, 20 bp, Artificial
  CRISPR gRNA sequence
gagatattgcaggttgagtt

SEQ ID NO: 632791 - DNA, 20 bp, Artificial
  CRISPR gRNA sequence
caggttgagttccaccccat

SEQ ID NO: 632792 - DNA, 20 bp, Artificial
  CRISPR gRNA sequence
agttccaccccatcacaata

SEQ ID NO: 632793 - DNA, 20 bp, Artificial
  CRISPR gRNA sequence
caccccatcacaataaagaa

SEQ ID NO: 632794 - DNA, 20 bp, Artificial
  CRISPR gRNA sequence
ataaagtgggtcactcagat

SEQ ID NO: 632795 - DNA, 20 bp, Artificial
  CRISPR gRNA sequence
agatagaagttatgtttata

SEQ ID NO: 632796 - DNA, 20 bp, Artificial
  CRISPR gRNA sequence
tgtttatatcataccataat

SEQ ID NO: 632797 - DNA, 20 bp, Artificial
  CRISPR gRNA sequence
atatcataccataatctatt

SEQ ID NO: 632798 - DNA, 20 bp, Artificial
  CRISPR gRNA sequence
tatcataccataatctatta

SEQ ID NO: 632799 - DNA, 20 bp, Artificial
  CRISPR gRNA sequence
ttaagtgtgcaacagaattg

SEQ ID NO: 632800 - DNA, 20 bp, Artificial
  CRISPR gRNA sequence
agtgtgcaacagaattgtgt

SEQ ID NO: 632801 - DNA, 20 bp, Artificial
  CRISPR gRNA sequence
tgtataaaaacaatgtatat

SEQ ID NO: 632802 - DNA, 20 bp, Artificial
  CRISPR gRNA sequence
aattttaaaaatactttgct

SEQ ID NO: 632803 - DNA, 20 bp, Artificial
  CRISPR gRNA sequence
attttaaaaatactttgctg

SEQ ID NO: 632804 - DNA, 20 bp, Artificial
  CRISPR gRNA sequence
taaaaatactttgctgctaa

SEQ ID NO: 632805 - DNA, 20 bp, Artificial
  CRISPR gRNA sequence
aaaaatactttgctgctaaa

SEQ ID NO: 632806 - DNA, 20 bp, Artificial
  CRISPR gRNA sequence
aaaatactttgctgctaaaa

SEQ ID NO: 632807 - DNA, 20 bp, Artificial
  CRISPR gRNA sequence
tgctgctaaaaaatgctaaa

SEQ ID NO: 632808 - DNA, 20 bp, Artificial
  CRISPR gRNA sequence
gctgctaaaaaatgctaaag

SEQ ID NO: 632809 - DNA, 20 bp, Artificial
  CRISPR gRNA sequence
ctgctaaaaaatgctaaaga

SEQ ID NO: 632810 - DNA, 20 bp, Artificial
  CRISPR gRNA sequence
ctaaaaaatgctaaagaggc

SEQ ID NO: 632811 - DNA, 20 bp, Artificial
  CRISPR gRNA sequence
aaaaatgctaaagaggccag

SEQ ID NO: 632812 - DNA, 20 bp, Artificial
  CRISPR gRNA sequence
aagaggccaggtgcagtggc

SEQ ID NO: 632813 - DNA, 20 bp, Artificial
  CRISPR gRNA sequence
acacctgtaatacaagcact

SEQ ID NO: 632814 - DNA, 20 bp, Artificial
  CRISPR gRNA sequence
taatacaagcactttgggaa

SEQ ID NO: 632815 - DNA, 20 bp, Artificial
  CRISPR gRNA sequence
tgggaagtggaggcaggagg

SEQ ID NO: 632816 - DNA, 20 bp, Artificial
  CRISPR gRNA sequence
gggaagtggaggcaggagga

SEQ ID NO: 632817 - DNA, 20 bp, Artificial
  CRISPR gRNA sequence
ggaagtggaggcaggaggat

SEQ ID NO: 632818 - DNA, 20 bp, Artificial
  CRISPR gRNA sequence
aagcccaggagttctagacc

SEQ ID NO: 632819 - DNA, 20 bp, Artificial
  CRISPR gRNA sequence
tagaccagcctgggcaacat

SEQ ID NO: 632820 - DNA, 20 bp, Artificial
  CRISPR gRNA sequence
gaccagcctgggcaacatga

SEQ ID NO: 632821 - DNA, 20 bp, Artificial
  CRISPR gRNA sequence
ggcaacatgatgaaatctca

SEQ ID NO: 632822 - DNA, 20 bp, Artificial
  CRISPR gRNA sequence
atctctataaacaatacaaa

SEQ ID NO: 632823 - DNA, 20 bp, Artificial
  CRISPR gRNA sequence
tataaacaatacaaaactag

SEQ ID NO: 632824 - DNA, 20 bp, Artificial
  CRISPR gRNA sequence
taaacaatacaaaactagca

SEQ ID NO: 632825 - DNA, 20 bp, Artificial
  CRISPR gRNA sequence
gcaaaattagccagggtgtg

SEQ ID NO: 632826 - DNA, 20 bp, Artificial
  CRISPR gRNA sequence
gccagggtgtggtagcatgc

SEQ ID NO: 632827 - DNA, 20 bp, Artificial
  CRISPR gRNA sequence
ctcgggaggctgagaggctg

SEQ ID NO: 632828 - DNA, 20 bp, Artificial
  CRISPR gRNA sequence
gggaggctgagaggctgagg

SEQ ID NO: 632829 - DNA, 20 bp, Artificial
  CRISPR gRNA sequence
agaggctgaggtgggaggat

SEQ ID NO: 632830 - DNA, 20 bp, Artificial
  CRISPR gRNA sequence
aggtgggaggatcacttgag

SEQ ID NO: 632831 - DNA, 20 bp, Artificial
  CRISPR gRNA sequence
gagcccagacagtcaaggct

SEQ ID NO: 632832 - DNA, 20 bp, Artificial
  CRISPR gRNA sequence
agcccagacagtcaaggcta

SEQ ID NO: 632833 - DNA, 20 bp, Artificial
  CRISPR gRNA sequence
cagtcagttgtgattgcacc

SEQ ID NO: 632834 - DNA, 20 bp, Artificial
  CRISPR gRNA sequence
tgattgcaccactgcactgc

SEQ ID NO: 632835 - DNA, 20 bp, Artificial
  CRISPR gRNA sequence
caccactgcactgcacatac

SEQ ID NO: 632836 - DNA, 20 bp, Artificial
  CRISPR gRNA sequence
cactgcacatacatacacat

SEQ ID NO: 632837 - DNA, 20 bp, Artificial
  CRISPR gRNA sequence
cacatacatacacatacact

SEQ ID NO: 632838 - DNA, 20 bp, Artificial
  CRISPR gRNA sequence
taaagataatctgagccttc

SEQ ID NO: 632839 - DNA, 20 bp, Artificial
  CRISPR gRNA sequence
agccttcagactcatcatct

SEQ ID NO: 632840 - DNA, 20 bp, Artificial
  CRISPR gRNA sequence
cagactcatcatctttccac

SEQ ID NO: 632841 - DNA, 20 bp, Artificial
  CRISPR gRNA sequence
agactcatcatctttccact

SEQ ID NO: 632842 - DNA, 20 bp, Artificial
  CRISPR gRNA sequence
atcatctttccactggtgga

SEQ ID NO: 632843 - DNA, 20 bp, Artificial
  CRISPR gRNA sequence
tccactggtggaggagggtg

SEQ ID NO: 632844 - DNA, 20 bp, Artificial
  CRISPR gRNA sequence
ccactggtggaggagggtgt

SEQ ID NO: 632845 - DNA, 20 bp, Artificial
  CRISPR gRNA sequence
cactggtggaggagggtgtt

SEQ ID NO: 632846 - DNA, 20 bp, Artificial
  CRISPR gRNA sequence
gtggaggagggtgttgcctt

SEQ ID NO: 632847 - DNA, 20 bp, Artificial
  CRISPR gRNA sequence
ccttgatgtcgatggctact

SEQ ID NO: 632848 - DNA, 20 bp, Artificial
  CRISPR gRNA sequence
gatgtcgatggctactgatt

SEQ ID NO: 632849 - DNA, 20 bp, Artificial
  CRISPR gRNA sequence
atgtcgatggctactgattg

SEQ ID NO: 632850 - DNA, 20 bp, Artificial
  CRISPR gRNA sequence
ctgattgataaggctggtgg

SEQ ID NO: 632851 - DNA, 20 bp, Artificial
  CRISPR gRNA sequence
attgataaggctggtggttg

SEQ ID NO: 632852 - DNA, 20 bp, Artificial
  CRISPR gRNA sequence
ataaggctggtggttgttga

SEQ ID NO: 632853 - DNA, 20 bp, Artificial
  CRISPR gRNA sequence
gtggttgttgaaggctggga

SEQ ID NO: 632854 - DNA, 20 bp, Artificial
  CRISPR gRNA sequence
ttgaaggctgggatggatgt

SEQ ID NO: 632855 - DNA, 20 bp, Artificial
  CRISPR gRNA sequence
aaggctgggatggatgtggc

SEQ ID NO: 632856 - DNA, 20 bp, Artificial
  CRISPR gRNA sequence
ggatggatgtggcaattcct

SEQ ID NO: 632857 - DNA, 20 bp, Artificial
  CRISPR gRNA sequence
cttaacataaggcaacaatg

SEQ ID NO: 632858 - DNA, 20 bp, Artificial
  CRISPR gRNA sequence
aacataaggcaacaatgaag

SEQ ID NO: 632859 - DNA, 20 bp, Artificial
  CRISPR gRNA sequence
acataaggcaacaatgaagt

SEQ ID NO: 632860 - DNA, 20 bp, Artificial
  CRISPR gRNA sequence
gccacatcagtcaacacttc

SEQ ID NO: 632861 - DNA, 20 bp, Artificial
  CRISPR gRNA sequence
ccacatcagtcaacacttcc

SEQ ID NO: 632862 - DNA, 20 bp, Artificial
  CRISPR gRNA sequence
cctttcacaaaggacttctc

SEQ ID NO: 632863 - DNA, 20 bp, Artificial
  CRISPR gRNA sequence
ctttcacaaaggacttctct

SEQ ID NO: 632864 - DNA, 20 bp, Artificial
  CRISPR gRNA sequence
tcacaaaggacttctctgta

SEQ ID NO: 632865 - DNA, 20 bp, Artificial
  CRISPR gRNA sequence
cacaaaggacttctctgtag

SEQ ID NO: 632866 - DNA, 20 bp, Artificial
  CRISPR gRNA sequence
acaaaggacttctctgtagc

SEQ ID NO: 632867 - DNA, 20 bp, Artificial
  CRISPR gRNA sequence
ctctgtagcatgtgatgcta

SEQ ID NO: 632868 - DNA, 20 bp, Artificial
  CRISPR gRNA sequence
tctgtagcatgtgatgctat

SEQ ID NO: 632869 - DNA, 20 bp, Artificial
  CRISPR gRNA sequence
tgtagcatgtgatgctattt

SEQ ID NO: 632870 - DNA, 20 bp, Artificial
  CRISPR gRNA sequence
tagcatgtgatgctatttga

SEQ ID NO: 632871 - DNA, 20 bp, Artificial
  CRISPR gRNA sequence
tttgatacgattttacccag

SEQ ID NO: 632872 - DNA, 20 bp, Artificial
  CRISPR gRNA sequence
gatacgattttacccagagt

SEQ ID NO: 632873 - DNA, 20 bp, Artificial
  CRISPR gRNA sequence
atacgattttacccagagta

SEQ ID NO: 632874 - DNA, 20 bp, Artificial
  CRISPR gRNA sequence
tacccagagtagaatttctt

SEQ ID NO: 632875 - DNA, 20 bp, Artificial
  CRISPR gRNA sequence
acccagagtagaatttcttt

SEQ ID NO: 632876 - DNA, 20 bp, Artificial
  CRISPR gRNA sequence
cccagagtagaatttctttc

SEQ ID NO: 632877 - DNA, 20 bp, Artificial
  CRISPR gRNA sequence
ctttcaaaattggattcaac

SEQ ID NO: 632878 - DNA, 20 bp, Artificial
  CRISPR gRNA sequence
tttcaaaattggattcaact

SEQ ID NO: 632879 - DNA, 20 bp, Artificial
  CRISPR gRNA sequence
tcaaaattggattcaactct

SEQ ID NO: 632880 - DNA, 20 bp, Artificial
  CRISPR gRNA sequence
caaaattggattcaactctc

SEQ ID NO: 632881 - DNA, 20 bp, Artificial
  CRISPR gRNA sequence
aaaattggattcaactctct

SEQ ID NO: 632882 - DNA, 20 bp, Artificial
  CRISPR gRNA sequence
gattcaactctctcaaactc

SEQ ID NO: 632883 - DNA, 20 bp, Artificial
  CRISPR gRNA sequence
aactctctcaaactctgcta

SEQ ID NO: 632884 - DNA, 20 bp, Artificial
  CRISPR gRNA sequence
tctcaaactctgctactgct

SEQ ID NO: 632885 - DNA, 20 bp, Artificial
  CRISPR gRNA sequence
tcaaactctgctactgcttt

SEQ ID NO: 632886 - DNA, 20 bp, Artificial
  CRISPR gRNA sequence
aaactctgctactgctttgt

SEQ ID NO: 632887 - DNA, 20 bp, Artificial
  CRISPR gRNA sequence
tgctactgctttgtcaacta

SEQ ID NO: 632888 - DNA, 20 bp, Artificial
  CRISPR gRNA sequence
ctactgctttgtcaactaag

SEQ ID NO: 632889 - DNA, 20 bp, Artificial
  CRISPR gRNA sequence
ctgctttgtcaactaagttt

SEQ ID NO: 632890 - DNA, 20 bp, Artificial
  CRISPR gRNA sequence
ctttgtcaactaagtttatg

SEQ ID NO: 632891 - DNA, 20 bp, Artificial
  CRISPR gRNA sequence
tgtcaactaagtttatgtaa

SEQ ID NO: 632892 - DNA, 20 bp, Artificial
  CRISPR gRNA sequence
gtcaactaagtttatgtaat

SEQ ID NO: 632893 - DNA, 20 bp, Artificial
  CRISPR gRNA sequence
tcaactaagtttatgtaata

SEQ ID NO: 632894 - DNA, 20 bp, Artificial
  CRISPR gRNA sequence
agtttatgtaatattccaaa

SEQ ID NO: 632895 - DNA, 20 bp, Artificial
  CRISPR gRNA sequence
atgtaatattccaaatcctc

SEQ ID NO: 632896 - DNA, 20 bp, Artificial
  CRISPR gRNA sequence
tgtaatattccaaatcctct

SEQ ID NO: 632897 - DNA, 20 bp, Artificial
  CRISPR gRNA sequence
caaatcctctgttgtcattt

SEQ ID NO: 632898 - DNA, 20 bp, Artificial
  CRISPR gRNA sequence
tgttgtcatttcaacaatat

SEQ ID NO: 632899 - DNA, 20 bp, Artificial
  CRISPR gRNA sequence
ttgtcatttcaacaatattc

SEQ ID NO: 632900 - DNA, 20 bp, Artificial
  CRISPR gRNA sequence
tcatttcaacaatattcaca

SEQ ID NO: 632901 - DNA, 20 bp, Artificial
  CRISPR gRNA sequence
caacaatattcacaggatct

SEQ ID NO: 632902 - DNA, 20 bp, Artificial
  CRISPR gRNA sequence
aacaatattcacaggatcta

SEQ ID NO: 632903 - DNA, 20 bp, Artificial
  CRISPR gRNA sequence
acaggatctacactagaaga

SEQ ID NO: 632904 - DNA, 20 bp, Artificial
  CRISPR gRNA sequence
cactagaagattcgatctca

SEQ ID NO: 632905 - DNA, 20 bp, Artificial
  CRISPR gRNA sequence
gaagattcgatctcaagaaa

SEQ ID NO: 632906 - DNA, 20 bp, Artificial
  CRISPR gRNA sequence
gatctcaagaaaccactttc

SEQ ID NO: 632907 - DNA, 20 bp, Artificial
  CRISPR gRNA sequence
aagaaaccactttctttgcc

SEQ ID NO: 632908 - DNA, 20 bp, Artificial
  CRISPR gRNA sequence
tctttgcccattgtaagaag

SEQ ID NO: 632909 - DNA, 20 bp, Artificial
  CRISPR gRNA sequence
ctttgcccattgtaagaagc

SEQ ID NO: 632910 - DNA, 20 bp, Artificial
  CRISPR gRNA sequence
tttgcccattgtaagaagca

SEQ ID NO: 632911 - DNA, 20 bp, Artificial
  CRISPR gRNA sequence
tgcccattgtaagaagcaac

SEQ ID NO: 632912 - DNA, 20 bp, Artificial
  CRISPR gRNA sequence
gcccattgtaagaagcaact

SEQ ID NO: 632913 - DNA, 20 bp, Artificial
  CRISPR gRNA sequence
cccattgtaagaagcaactc

SEQ ID NO: 632914 - DNA, 20 bp, Artificial
  CRISPR gRNA sequence
taagaagcaactcttcatcc

SEQ ID NO: 632915 - DNA, 20 bp, Artificial
  CRISPR gRNA sequence
ttcatccattcacattttat

SEQ ID NO: 632916 - DNA, 20 bp, Artificial
  CRISPR gRNA sequence
catccattcacattttataa

SEQ ID NO: 632917 - DNA, 20 bp, Artificial
  CRISPR gRNA sequence
atccattcacattttataac

SEQ ID NO: 632918 - DNA, 20 bp, Artificial
  CRISPR gRNA sequence
acattttataacgagactgc

SEQ ID NO: 632919 - DNA, 20 bp, Artificial
  CRISPR gRNA sequence
tataacgagactgcagtaat

SEQ ID NO: 632920 - DNA, 20 bp, Artificial
  CRISPR gRNA sequence
ataacgagactgcagtaatt

SEQ ID NO: 632921 - DNA, 20 bp, Artificial
  CRISPR gRNA sequence
taacgagactgcagtaattc

SEQ ID NO: 632922 - DNA, 20 bp, Artificial
  CRISPR gRNA sequence
cagtaattcagtcacatctt

SEQ ID NO: 632923 - DNA, 20 bp, Artificial
  CRISPR gRNA sequence
agtcacatcttcaggctcca

SEQ ID NO: 632924 - DNA, 20 bp, Artificial
  CRISPR gRNA sequence
caggctccacttctaactct

SEQ ID NO: 632925 - DNA, 20 bp, Artificial
  CRISPR gRNA sequence
aggctccacttctaactcta

SEQ ID NO: 632926 - DNA, 20 bp, Artificial
  CRISPR gRNA sequence
cacttctaactctagttatg

SEQ ID NO: 632927 - DNA, 20 bp, Artificial
  CRISPR gRNA sequence
ctaactctagttatgttgct

SEQ ID NO: 632928 - DNA, 20 bp, Artificial
  CRISPR gRNA sequence
taactctagttatgttgctg

SEQ ID NO: 632929 - DNA, 20 bp, Artificial
  CRISPR gRNA sequence
actctagttatgttgctgtt

SEQ ID NO: 632930 - DNA, 20 bp, Artificial
  CRISPR gRNA sequence
tagttatgttgctgtttcta

SEQ ID NO: 632931 - DNA, 20 bp, Artificial
  CRISPR gRNA sequence
gttatgttgctgtttctatc

SEQ ID NO: 632932 - DNA, 20 bp, Artificial
  CRISPR gRNA sequence
tgttgctgtttctatcacat

SEQ ID NO: 632933 - DNA, 20 bp, Artificial
  CRISPR gRNA sequence
ctgtttctatcacatctgca

SEQ ID NO: 632934 - DNA, 20 bp, Artificial
  CRISPR gRNA sequence
tttctatcacatctgcagtt

SEQ ID NO: 632935 - DNA, 20 bp, Artificial
  CRISPR gRNA sequence
ctatcacatctgcagttcct

SEQ ID NO: 632936 - DNA, 20 bp, Artificial
  CRISPR gRNA sequence
tatcacatctgcagttcctt

SEQ ID NO: 632937 - DNA, 20 bp, Artificial
  CRISPR gRNA sequence
tcacatctgcagttccttta

SEQ ID NO: 632938 - DNA, 20 bp, Artificial
  CRISPR gRNA sequence
cagttcctttatccactgaa

SEQ ID NO: 632939 - DNA, 20 bp, Artificial
  CRISPR gRNA sequence
ctttatccactgaagtcctg

SEQ ID NO: 632940 - DNA, 20 bp, Artificial
  CRISPR gRNA sequence
tatccactgaagtcctgaac

SEQ ID NO: 632941 - DNA, 20 bp, Artificial
  CRISPR gRNA sequence
atccactgaagtcctgaacc

SEQ ID NO: 632942 - DNA, 20 bp, Artificial
  CRISPR gRNA sequence
tccactgaagtcctgaacct

SEQ ID NO: 632943 - DNA, 20 bp, Artificial
  CRISPR gRNA sequence
aagtcctgaacctcctgaaa

SEQ ID NO: 632944 - DNA, 20 bp, Artificial
  CRISPR gRNA sequence
aacctcctgaaagtcatcca

SEQ ID NO: 632945 - DNA, 20 bp, Artificial
  CRISPR gRNA sequence
ctgaaagtcatccatgaggt

SEQ ID NO: 632946 - DNA, 20 bp, Artificial
  CRISPR gRNA sequence
aaagtcatccatgaggttga

SEQ ID NO: 632947 - DNA, 20 bp, Artificial
  CRISPR gRNA sequence
aaatcaactttttcccaact

SEQ ID NO: 632948 - DNA, 20 bp, Artificial
  CRISPR gRNA sequence
tttcccaactcctgttaata

SEQ ID NO: 632949 - DNA, 20 bp, Artificial
  CRISPR gRNA sequence
ttcccaactcctgttaatat

SEQ ID NO: 632950 - DNA, 20 bp, Artificial
  CRISPR gRNA sequence
tcccaactcctgttaatatc

SEQ ID NO: 632951 - DNA, 20 bp, Artificial
  CRISPR gRNA sequence
cccaactcctgttaatatct

SEQ ID NO: 632952 - DNA, 20 bp, Artificial
  CRISPR gRNA sequence
ccaactcctgttaatatctt

SEQ ID NO: 632953 - DNA, 20 bp, Artificial
  CRISPR gRNA sequence
ctgttaatatcttgaccttc

SEQ ID NO: 632954 - DNA, 20 bp, Artificial
  CRISPR gRNA sequence
ttaatatcttgaccttctca

SEQ ID NO: 632955 - DNA, 20 bp, Artificial
  CRISPR gRNA sequence
atatcttgaccttctcagat

SEQ ID NO: 632956 - DNA, 20 bp, Artificial
  CRISPR gRNA sequence
gaccttctcagatgaatcac

SEQ ID NO: 632957 - DNA, 20 bp, Artificial
  CRISPR gRNA sequence
accttctcagatgaatcaca

SEQ ID NO: 632958 - DNA, 20 bp, Artificial
  CRISPR gRNA sequence
ctcagatgaatcacaaatgt

SEQ ID NO: 632959 - DNA, 20 bp, Artificial
  CRISPR gRNA sequence
tcagatgaatcacaaatgtt

SEQ ID NO: 632960 - DNA, 20 bp, Artificial
  CRISPR gRNA sequence
agatgaatcacaaatgttct

SEQ ID NO: 632961 - DNA, 20 bp, Artificial
  CRISPR gRNA sequence
tcaatgacatctagaattct

SEQ ID NO: 632962 - DNA, 20 bp, Artificial
  CRISPR gRNA sequence
aatgacatctagaattctga

SEQ ID NO: 632963 - DNA, 20 bp, Artificial
  CRISPR gRNA sequence
gaattctgaatcctttccag

SEQ ID NO: 632964 - DNA, 20 bp, Artificial
  CRISPR gRNA sequence
tgaatcctttccagaaggtt

SEQ ID NO: 632965 - DNA, 20 bp, Artificial
  CRISPR gRNA sequence
aatcctttccagaaggtttt

SEQ ID NO: 632966 - DNA, 20 bp, Artificial
  CRISPR gRNA sequence
tccagaaggttttcagttta

SEQ ID NO: 632967 - DNA, 20 bp, Artificial
  CRISPR gRNA sequence
ccagaaggttttcagtttac

SEQ ID NO: 632968 - DNA, 20 bp, Artificial
  CRISPR gRNA sequence
cagaaggttttcagtttact

SEQ ID NO: 632969 - DNA, 20 bp, Artificial
  CRISPR gRNA sequence
tcagtttactttgcccacat

SEQ ID NO: 632970 - DNA, 20 bp, Artificial
  CRISPR gRNA sequence
cagtttactttgcccacatc

SEQ ID NO: 632971 - DNA, 20 bp, Artificial
  CRISPR gRNA sequence
agtttactttgcccacatcc

SEQ ID NO: 632972 - DNA, 20 bp, Artificial
  CRISPR gRNA sequence
actttgcccacatccatcat

SEQ ID NO: 632973 - DNA, 20 bp, Artificial
  CRISPR gRNA sequence
ctttgcccacatccatcata

SEQ ID NO: 632974 - DNA, 20 bp, Artificial
  CRISPR gRNA sequence
tgcccacatccatcatagaa

SEQ ID NO: 632975 - DNA, 20 bp, Artificial
  CRISPR gRNA sequence
gcccacatccatcatagaaa

SEQ ID NO: 632976 - DNA, 20 bp, Artificial
  CRISPR gRNA sequence
cccacatccatcatagaaat

SEQ ID NO: 632977 - DNA, 20 bp, Artificial
  CRISPR gRNA sequence
tctatggcacctctagcctt

SEQ ID NO: 632978 - DNA, 20 bp, Artificial
  CRISPR gRNA sequence
tggcacctctagccttataa

SEQ ID NO: 632979 - DNA, 20 bp, Artificial
  CRISPR gRNA sequence
tagccttataaaatgtatgt

SEQ ID NO: 632980 - DNA, 20 bp, Artificial
  CRISPR gRNA sequence
gccttataaaatgtatgtct

SEQ ID NO: 632981 - DNA, 20 bp, Artificial
  CRISPR gRNA sequence
ataaaatgtatgtcttaagt

SEQ ID NO: 632982 - DNA, 20 bp, Artificial
  CRISPR gRNA sequence
taaaatgtatgtcttaagta

SEQ ID NO: 632983 - DNA, 20 bp, Artificial
  CRISPR gRNA sequence
aagtaataagacttgaaagt

SEQ ID NO: 632984 - DNA, 20 bp, Artificial
  CRISPR gRNA sequence
agtaataagacttgaaagtt

SEQ ID NO: 632985 - DNA, 20 bp, Artificial
  CRISPR gRNA sequence
gaaagtttaaattaaccctt

SEQ ID NO: 632986 - DNA, 20 bp, Artificial
  CRISPR gRNA sequence
aaagtttaaattaacccttg

SEQ ID NO: 632987 - DNA, 20 bp, Artificial
  CRISPR gRNA sequence
aaattaacccttgagcgtgg

SEQ ID NO: 632988 - DNA, 20 bp, Artificial
  CRISPR gRNA sequence
aattaacccttgagcgtggg

SEQ ID NO: 632989 - DNA, 20 bp, Artificial
  CRISPR gRNA sequence
acccttgagcgtgggctgaa

SEQ ID NO: 632990 - DNA, 20 bp, Artificial
  CRISPR gRNA sequence
gagcgtgggctgaagaatat

SEQ ID NO: 632991 - DNA, 20 bp, Artificial
  CRISPR gRNA sequence
agcgtgggctgaagaatata

SEQ ID NO: 632992 - DNA, 20 bp, Artificial
  CRISPR gRNA sequence
aagaatatatgctgtattaa

SEQ ID NO: 632993 - DNA, 20 bp, Artificial
  CRISPR gRNA sequence
tattaacagccatgaaaaca

SEQ ID NO: 632994 - DNA, 20 bp, Artificial
  CRISPR gRNA sequence
acagccatgaaaacaacatt

SEQ ID NO: 632995 - DNA, 20 bp, Artificial
  CRISPR gRNA sequence
atctgcttgtacatctccat

SEQ ID NO: 632996 - DNA, 20 bp, Artificial
  CRISPR gRNA sequence
cttgtacatctccatcagaa

SEQ ID NO: 632997 - DNA, 20 bp, Artificial
  CRISPR gRNA sequence
gtacatctccatcagaagtt

SEQ ID NO: 632998 - DNA, 20 bp, Artificial
  CRISPR gRNA sequence
tacatctccatcagaagttt

SEQ ID NO: 632999 - DNA, 20 bp, Artificial
  CRISPR gRNA sequence
catcagaagttttgggtgac

SEQ ID NO: 633000 - DNA, 20 bp, Artificial
  CRISPR gRNA sequence
tgggtgacaaggtacattgt

SEQ ID NO: 633001 - DNA, 20 bp, Artificial
  CRISPR gRNA sequence
gggtgacaaggtacattgtc

SEQ ID NO: 633002 - DNA, 20 bp, Artificial
  CRISPR gRNA sequence
ggtgacaaggtacattgtca

SEQ ID NO: 633003 - DNA, 20 bp, Artificial
  CRISPR gRNA sequence
tcaatgaactgtaatatttt

SEQ ID NO: 633004 - DNA, 20 bp, Artificial
  CRISPR gRNA sequence
taatattttgaaaggaattt

SEQ ID NO: 633005 - DNA, 20 bp, Artificial
  CRISPR gRNA sequence
tgaaaggaatttttgtttct

SEQ ID NO: 633006 - DNA, 20 bp, Artificial
  CRISPR gRNA sequence
gaaaggaatttttgtttctg

SEQ ID NO: 633007 - DNA, 20 bp, Artificial
  CRISPR gRNA sequence
aaaggaatttttgtttctga

SEQ ID NO: 633008 - DNA, 20 bp, Artificial
  CRISPR gRNA sequence
ttgtttctgagcagtgtcta

SEQ ID NO: 633009 - DNA, 20 bp, Artificial
  CRISPR gRNA sequence
tgtttctgagcagtgtctaa

SEQ ID NO: 633010 - DNA, 20 bp, Artificial
  CRISPR gRNA sequence
gtttctgagcagtgtctaaa

SEQ ID NO: 633011 - DNA, 20 bp, Artificial
  CRISPR gRNA sequence
tttctgagcagtgtctaaac

SEQ ID NO: 633012 - DNA, 20 bp, Artificial
  CRISPR gRNA sequence
ctgagcagtgtctaaacaat

SEQ ID NO: 633013 - DNA, 20 bp, Artificial
  CRISPR gRNA sequence
tgagcagtgtctaaacaata

SEQ ID NO: 633014 - DNA, 20 bp, Artificial
  CRISPR gRNA sequence
agcagtgtctaaacaatagg

SEQ ID NO: 633015 - DNA, 20 bp, Artificial
  CRISPR gRNA sequence
aacaataggcttattcacta

SEQ ID NO: 633016 - DNA, 20 bp, Artificial
  CRISPR gRNA sequence
attcactaaaccatattgta

SEQ ID NO: 633017 - DNA, 20 bp, Artificial
  CRISPR gRNA sequence
ttcactaaaccatattgtaa

SEQ ID NO: 633018 - DNA, 20 bp, Artificial
  CRISPR gRNA sequence
actaaaccatattgtaaaca

SEQ ID NO: 633019 - DNA, 20 bp, Artificial
  CRISPR gRNA sequence
aaccatattgtaaacaaatg

SEQ ID NO: 633020 - DNA, 20 bp, Artificial
  CRISPR gRNA sequence
taaacaaatgtgctgtcacc

SEQ ID NO: 633021 - DNA, 20 bp, Artificial
  CRISPR gRNA sequence
tcacccagactttgctgttc

SEQ ID NO: 633022 - DNA, 20 bp, Artificial
  CRISPR gRNA sequence
tgctgttccatttatagagc

SEQ ID NO: 633023 - DNA, 20 bp, Artificial
  CRISPR gRNA sequence
gctgttccatttatagagca

SEQ ID NO: 633024 - DNA, 20 bp, Artificial
  CRISPR gRNA sequence
ctgttccatttatagagcac

SEQ ID NO: 633025 - DNA, 20 bp, Artificial
  CRISPR gRNA sequence
ttccatttatagagcacagg

SEQ ID NO: 633026 - DNA, 20 bp, Artificial
  CRISPR gRNA sequence
catttatagagcacaggcag

SEQ ID NO: 633027 - DNA, 20 bp, Artificial
  CRISPR gRNA sequence
atagagcacaggcagagtag

SEQ ID NO: 633028 - DNA, 20 bp, Artificial
  CRISPR gRNA sequence
tagagcacaggcagagtaga

SEQ ID NO: 633029 - DNA, 20 bp, Artificial
  CRISPR gRNA sequence
ttaaggaccttagaattttt

SEQ ID NO: 633030 - DNA, 20 bp, Artificial
  CRISPR gRNA sequence
aaggaccttagaatttttgg

SEQ ID NO: 633031 - DNA, 20 bp, Artificial
  CRISPR gRNA sequence
aggaccttagaatttttgga

SEQ ID NO: 633032 - DNA, 20 bp, Artificial
  CRISPR gRNA sequence
agaatttttggaatggtcaa

SEQ ID NO: 633033 - DNA, 20 bp, Artificial
  CRISPR gRNA sequence
gaatttttggaatggtcaat

SEQ ID NO: 633034 - DNA, 20 bp, Artificial
  CRISPR gRNA sequence
ttggaatggtcaatgagcat

SEQ ID NO: 633035 - DNA, 20 bp, Artificial
  CRISPR gRNA sequence
tggaatggtcaatgagcatt

SEQ ID NO: 633036 - DNA, 20 bp, Artificial
  CRISPR gRNA sequence
ggaatggtcaatgagcattg

SEQ ID NO: 633037 - DNA, 20 bp, Artificial
  CRISPR gRNA sequence
gaatggtcaatgagcattgg

SEQ ID NO: 633038 - DNA, 20 bp, Artificial
  CRISPR gRNA sequence
gctacaactttaagtcacca

SEQ ID NO: 633039 - DNA, 20 bp, Artificial
  CRISPR gRNA sequence
caactttaagtcaccagctg

SEQ ID NO: 633040 - DNA, 20 bp, Artificial
  CRISPR gRNA sequence
taagtcaccagctgcattgt

SEQ ID NO: 633041 - DNA, 20 bp, Artificial
  CRISPR gRNA sequence
aagtcaccagctgcattgtc

SEQ ID NO: 633042 - DNA, 20 bp, Artificial
  CRISPR gRNA sequence
agtcaccagctgcattgtcc

SEQ ID NO: 633043 - DNA, 20 bp, Artificial
  CRISPR gRNA sequence
cattgtcctaccaagagagt

SEQ ID NO: 633044 - DNA, 20 bp, Artificial
  CRISPR gRNA sequence
tcctaccaagagagtcagcc

SEQ ID NO: 633045 - DNA, 20 bp, Artificial
  CRISPR gRNA sequence
ccaagagagtcagcctgtcc

SEQ ID NO: 633046 - DNA, 20 bp, Artificial
  CRISPR gRNA sequence
tcctttgaagcttttaaccc

SEQ ID NO: 633047 - DNA, 20 bp, Artificial
  CRISPR gRNA sequence
tgaagcttttaacccaggca

SEQ ID NO: 633048 - DNA, 20 bp, Artificial
  CRISPR gRNA sequence
gaagcttttaacccaggcac

SEQ ID NO: 633049 - DNA, 20 bp, Artificial
  CRISPR gRNA sequence
aagcttttaacccaggcact

SEQ ID NO: 633050 - DNA, 20 bp, Artificial
  CRISPR gRNA sequence
ttaacccaggcactgacttc

SEQ ID NO: 633051 - DNA, 20 bp, Artificial
  CRISPR gRNA sequence
taacccaggcactgacttct

SEQ ID NO: 633052 - DNA, 20 bp, Artificial
  CRISPR gRNA sequence
aacccaggcactgacttctc

SEQ ID NO: 633053 - DNA, 20 bp, Artificial
  CRISPR gRNA sequence
acccaggcactgacttctcc

SEQ ID NO: 633054 - DNA, 20 bp, Artificial
  CRISPR gRNA sequence
acttctcctctctagatggc

SEQ ID NO: 633055 - DNA, 20 bp, Artificial
  CRISPR gRNA sequence
ctcctctctagatggcctct

SEQ ID NO: 633056 - DNA, 20 bp, Artificial
  CRISPR gRNA sequence
tcctctctagatggcctctt

SEQ ID NO: 633057 - DNA, 20 bp, Artificial
  CRISPR gRNA sequence
ctctctagatggcctcttct

SEQ ID NO: 633058 - DNA, 20 bp, Artificial
  CRISPR gRNA sequence
tctagatggcctcttcttct

SEQ ID NO: 633059 - DNA, 20 bp, Artificial
  CRISPR gRNA sequence
tagatggcctcttcttctaa

SEQ ID NO: 633060 - DNA, 20 bp, Artificial
  CRISPR gRNA sequence
gatggcctcttcttctaata

SEQ ID NO: 633061 - DNA, 20 bp, Artificial
  CRISPR gRNA sequence
ttcttctaatagaaggctgt

SEQ ID NO: 633062 - DNA, 20 bp, Artificial
  CRISPR gRNA sequence
cttctaatagaaggctgttt

SEQ ID NO: 633063 - DNA, 20 bp, Artificial
  CRISPR gRNA sequence
ttctaatagaaggctgtttt

SEQ ID NO: 633064 - DNA, 20 bp, Artificial
  CRISPR gRNA sequence
ctaatagaaggctgttttgt

SEQ ID NO: 633065 - DNA, 20 bp, Artificial
  CRISPR gRNA sequence
taatagaaggctgttttgtc

SEQ ID NO: 633066 - DNA, 20 bp, Artificial
  CRISPR gRNA sequence
atagaaggctgttttgtcta

SEQ ID NO: 633067 - DNA, 20 bp, Artificial
  CRISPR gRNA sequence
ttttgtctacactgaaactc

SEQ ID NO: 633068 - DNA, 20 bp, Artificial
  CRISPR gRNA sequence
tgtctacactgaaactctgc

SEQ ID NO: 633069 - DNA, 20 bp, Artificial
  CRISPR gRNA sequence
gtctacactgaaactctgcc

SEQ ID NO: 633070 - DNA, 20 bp, Artificial
  CRISPR gRNA sequence
tctacactgaaactctgcca

SEQ ID NO: 633071 - DNA, 20 bp, Artificial
  CRISPR gRNA sequence
cactgaaactctgccattta

SEQ ID NO: 633072 - DNA, 20 bp, Artificial
  CRISPR gRNA sequence
aaactctgccatttatcaca

SEQ ID NO: 633073 - DNA, 20 bp, Artificial
  CRISPR gRNA sequence
tgccatttatcacaaccacc

SEQ ID NO: 633074 - DNA, 20 bp, Artificial
  CRISPR gRNA sequence
ccatttatcacaaccacctt

SEQ ID NO: 633075 - DNA, 20 bp, Artificial
  CRISPR gRNA sequence
atcacaaccaccttcattaa

SEQ ID NO: 633076 - DNA, 20 bp, Artificial
  CRISPR gRNA sequence
tcacaaccaccttcattaat

SEQ ID NO: 633077 - DNA, 20 bp, Artificial
  CRISPR gRNA sequence
cattaattagcttagctagt

SEQ ID NO: 633078 - DNA, 20 bp, Artificial
  CRISPR gRNA sequence
attaattagcttagctagtt

SEQ ID NO: 633079 - DNA, 20 bp, Artificial
  CRISPR gRNA sequence
attagcttagctagttcttc

SEQ ID NO: 633080 - DNA, 20 bp, Artificial
  CRISPR gRNA sequence
gcttagctagttcttctgga

SEQ ID NO: 633081 - DNA, 20 bp, Artificial
  CRISPR gRNA sequence
agctagttcttctggatgaa

SEQ ID NO: 633082 - DNA, 20 bp, Artificial
  CRISPR gRNA sequence
gctagttcttctggatgaat

SEQ ID NO: 633083 - DNA, 20 bp, Artificial
  CRISPR gRNA sequence
gttcttctggatgaattact

SEQ ID NO: 633084 - DNA, 20 bp, Artificial
  CRISPR gRNA sequence
ttctggatgaattactgtag

SEQ ID NO: 633085 - DNA, 20 bp, Artificial
  CRISPR gRNA sequence
ctggatgaattactgtagcc

SEQ ID NO: 633086 - DNA, 20 bp, Artificial
  CRISPR gRNA sequence
tggatgaattactgtagcct

SEQ ID NO: 633087 - DNA, 20 bp, Artificial
  CRISPR gRNA sequence
gatgaattactgtagcctct

SEQ ID NO: 633088 - DNA, 20 bp, Artificial
  CRISPR gRNA sequence
ctgtagcctctacatcagca

SEQ ID NO: 633089 - DNA, 20 bp, Artificial
  CRISPR gRNA sequence
tagcctctacatcagcactt

SEQ ID NO: 633090 - DNA, 20 bp, Artificial
  CRISPR gRNA sequence
tacatcagcacttgctgcct

SEQ ID NO: 633091 - DNA, 20 bp, Artificial
  CRISPR gRNA sequence
catcagcacttgctgcctca

SEQ ID NO: 633092 - DNA, 20 bp, Artificial
  CRISPR gRNA sequence
gctgcctcaccttgcacttt

SEQ ID NO: 633093 - DNA, 20 bp, Artificial
  CRISPR gRNA sequence
ctgcctcaccttgcactttt

SEQ ID NO: 633094 - DNA, 20 bp, Artificial
  CRISPR gRNA sequence
cctcaccttgcacttttatg

SEQ ID NO: 633095 - DNA, 20 bp, Artificial
  CRISPR gRNA sequence
accttgcacttttatgttat

SEQ ID NO: 633096 - DNA, 20 bp, Artificial
  CRISPR gRNA sequence
gcacttttatgttatagaga

SEQ ID NO: 633097 - DNA, 20 bp, Artificial
  CRISPR gRNA sequence
cacttttatgttatagagat

SEQ ID NO: 633098 - DNA, 20 bp, Artificial
  CRISPR gRNA sequence
ttatgttatagagatggctt

SEQ ID NO: 633099 - DNA, 20 bp, Artificial
  CRISPR gRNA sequence
tatgttatagagatggcttc

SEQ ID NO: 633100 - DNA, 20 bp, Artificial
  CRISPR gRNA sequence
atgttatagagatggcttct

SEQ ID NO: 633101 - DNA, 20 bp, Artificial
  CRISPR gRNA sequence
tgttatagagatggcttctt

SEQ ID NO: 633102 - DNA, 20 bp, Artificial
  CRISPR gRNA sequence
tagagatggcttctttcctt

SEQ ID NO: 633103 - DNA, 20 bp, Artificial
  CRISPR gRNA sequence
ctttccttaaacctcatgaa

SEQ ID NO: 633104 - DNA, 20 bp, Artificial
  CRISPR gRNA sequence
tttccttaaacctcatgaac

SEQ ID NO: 633105 - DNA, 20 bp, Artificial
  CRISPR gRNA sequence
tccttaaacctcatgaacca

SEQ ID NO: 633106 - DNA, 20 bp, Artificial
  CRISPR gRNA sequence
ccttaaacctcatgaaccaa

SEQ ID NO: 633107 - DNA, 20 bp, Artificial
  CRISPR gRNA sequence
cttaaacctcatgaaccaac

SEQ ID NO: 633108 - DNA, 20 bp, Artificial
  CRISPR gRNA sequence
aaacctcatgaaccaacctc

SEQ ID NO: 633109 - DNA, 20 bp, Artificial
  CRISPR gRNA sequence
aacctcatgaaccaacctct

SEQ ID NO: 633110 - DNA, 20 bp, Artificial
  CRISPR gRNA sequence
atgaaccaacctctgctagc

SEQ ID NO: 633111 - DNA, 20 bp, Artificial
  CRISPR gRNA sequence
tgctagcttccaacttttct

SEQ ID NO: 633112 - DNA, 20 bp, Artificial
  CRISPR gRNA sequence
ctagcttccaacttttcttc

SEQ ID NO: 633113 - DNA, 20 bp, Artificial
  CRISPR gRNA sequence
gcttccaacttttcttctgc

SEQ ID NO: 633114 - DNA, 20 bp, Artificial
  CRISPR gRNA sequence
ccaacttttcttctgcagtt

SEQ ID NO: 633115 - DNA, 20 bp, Artificial
  CRISPR gRNA sequence
caacttttcttctgcagttt

SEQ ID NO: 633116 - DNA, 20 bp, Artificial
  CRISPR gRNA sequence
ttcttctgcagtttcctcac

SEQ ID NO: 633117 - DNA, 20 bp, Artificial
  CRISPR gRNA sequence
tcttctgcagtttcctcaca

SEQ ID NO: 633118 - DNA, 20 bp, Artificial
  CRISPR gRNA sequence
cttctgcagtttcctcacat

SEQ ID NO: 633119 - DNA, 20 bp, Artificial
  CRISPR gRNA sequence
ttctgcagtttcctcacatc

SEQ ID NO: 633120 - DNA, 20 bp, Artificial
  CRISPR gRNA sequence
ctgcagtttcctcacatctc

SEQ ID NO: 633121 - DNA, 20 bp, Artificial
  CRISPR gRNA sequence
tgcagtttcctcacatctcg

SEQ ID NO: 633122 - DNA, 20 bp, Artificial
  CRISPR gRNA sequence
cagtttcctcacatctcgtg

SEQ ID NO: 633123 - DNA, 20 bp, Artificial
  CRISPR gRNA sequence
cctcacatctcgtggccttc

SEQ ID NO: 633124 - DNA, 20 bp, Artificial
  CRISPR gRNA sequence
ctcacatctcgtggccttca

SEQ ID NO: 633125 - DNA, 20 bp, Artificial
  CRISPR gRNA sequence
acatctcgtggccttcagaa

SEQ ID NO: 633126 - DNA, 20 bp, Artificial
  CRISPR gRNA sequence
gtggccttcagaaaattgaa

SEQ ID NO: 633127 - DNA, 20 bp, Artificial
  CRISPR gRNA sequence
cagaaaattgaatattgtta

SEQ ID NO: 633128 - DNA, 20 bp, Artificial
  CRISPR gRNA sequence
agaaaattgaatattgttag

SEQ ID NO: 633129 - DNA, 20 bp, Artificial
  CRISPR gRNA sequence
aatattgttagggtcttcct

SEQ ID NO: 633130 - DNA, 20 bp, Artificial
  CRISPR gRNA sequence
ttagggtcttcctcaggatt

SEQ ID NO: 633131 - DNA, 20 bp, Artificial
  CRISPR gRNA sequence
gggtcttcctcaggattagg

SEQ ID NO: 633132 - DNA, 20 bp, Artificial
  CRISPR gRNA sequence
cctcaggattaggctttgat

SEQ ID NO: 633133 - DNA, 20 bp, Artificial
  CRISPR gRNA sequence
ctcaggattaggctttgatt

SEQ ID NO: 633134 - DNA, 20 bp, Artificial
  CRISPR gRNA sequence
aggattaggctttgatttaa

SEQ ID NO: 633135 - DNA, 20 bp, Artificial
  CRISPR gRNA sequence
ggctttgatttaagagaatg

SEQ ID NO: 633136 - DNA, 20 bp, Artificial
  CRISPR gRNA sequence
tgatttaagagaatgttgtg

SEQ ID NO: 633137 - DNA, 20 bp, Artificial
  CRISPR gRNA sequence
gatttaagagaatgttgtgg

SEQ ID NO: 633138 - DNA, 20 bp, Artificial
  CRISPR gRNA sequence
atttaagagaatgttgtggc

SEQ ID NO: 633139 - DNA, 20 bp, Artificial
  CRISPR gRNA sequence
aagagaatgttgtggctggt

SEQ ID NO: 633140 - DNA, 20 bp, Artificial
  CRISPR gRNA sequence
agagaatgttgtggctggtt

SEQ ID NO: 633141 - DNA, 20 bp, Artificial
  CRISPR gRNA sequence
tggctggtttgatcttctat

SEQ ID NO: 633142 - DNA, 20 bp, Artificial
  CRISPR gRNA sequence
gtttgatcttctatccagac

SEQ ID NO: 633143 - DNA, 20 bp, Artificial
  CRISPR gRNA sequence
gatcttctatccagaccact

SEQ ID NO: 633144 - DNA, 20 bp, Artificial
  CRISPR gRNA sequence
atcttctatccagaccactg

SEQ ID NO: 633145 - DNA, 20 bp, Artificial
  CRISPR gRNA sequence
ctatccagaccactgaaact

SEQ ID NO: 633146 - DNA, 20 bp, Artificial
  CRISPR gRNA sequence
tatccagaccactgaaactt

SEQ ID NO: 633147 - DNA, 20 bp, Artificial
  CRISPR gRNA sequence
tccagaccactgaaactttc

SEQ ID NO: 633148 - DNA, 20 bp, Artificial
  CRISPR gRNA sequence
aaactttctccataatcaga

SEQ ID NO: 633149 - DNA, 20 bp, Artificial
  CRISPR gRNA sequence
tctccataatcagaagtaag

SEQ ID NO: 633150 - DNA, 20 bp, Artificial
  CRISPR gRNA sequence
ctccataatcagaagtaagg

SEQ ID NO: 633151 - DNA, 20 bp, Artificial
  CRISPR gRNA sequence
tccataatcagaagtaaggc

SEQ ID NO: 633152 - DNA, 20 bp, Artificial
  CRISPR gRNA sequence
cataatcagaagtaaggcag

SEQ ID NO: 633153 - DNA, 20 bp, Artificial
  CRISPR gRNA sequence
tgctttcttatcacttgtgt

SEQ ID NO: 633154 - DNA, 20 bp, Artificial
  CRISPR gRNA sequence
gctttcttatcacttgtgtg

SEQ ID NO: 633155 - DNA, 20 bp, Artificial
  CRISPR gRNA sequence
ctttcttatcacttgtgtgt

SEQ ID NO: 633156 - DNA, 20 bp, Artificial
  CRISPR gRNA sequence
tcttatcacttgtgtgttca

SEQ ID NO: 633157 - DNA, 20 bp, Artificial
  CRISPR gRNA sequence
cttatcacttgtgtgttcac

SEQ ID NO: 633158 - DNA, 20 bp, Artificial
  CRISPR gRNA sequence
ttatcacttgtgtgttcact

SEQ ID NO: 633159 - DNA, 20 bp, Artificial
  CRISPR gRNA sequence
atcacttgtgtgttcactgg

SEQ ID NO: 633160 - DNA, 20 bp, Artificial
  CRISPR gRNA sequence
tcacttgtgtgttcactgga

SEQ ID NO: 633161 - DNA, 20 bp, Artificial
  CRISPR gRNA sequence
gtgtgttcactggagtagca

SEQ ID NO: 633162 - DNA, 20 bp, Artificial
  CRISPR gRNA sequence
tgtgttcactggagtagcat

SEQ ID NO: 633163 - DNA, 20 bp, Artificial
  CRISPR gRNA sequence
actggagtagcattttaaat

SEQ ID NO: 633164 - DNA, 20 bp, Artificial
  CRISPR gRNA sequence
gagtagcattttaaattttc

SEQ ID NO: 633165 - DNA, 20 bp, Artificial
  CRISPR gRNA sequence
taaattttcttcaataacat

SEQ ID NO: 633166 - DNA, 20 bp, Artificial
  CRISPR gRNA sequence
aaattttcttcaataacatt

SEQ ID NO: 633167 - DNA, 20 bp, Artificial
  CRISPR gRNA sequence
aattttcttcaataacattt

SEQ ID NO: 633168 - DNA, 20 bp, Artificial
  CRISPR gRNA sequence
tcttcaataacatttccttt

SEQ ID NO: 633169 - DNA, 20 bp, Artificial
  CRISPR gRNA sequence
cttcaataacatttcctttg

SEQ ID NO: 633170 - DNA, 20 bp, Artificial
  CRISPR gRNA sequence
ttcaataacatttcctttgc

SEQ ID NO: 633171 - DNA, 20 bp, Artificial
  CRISPR gRNA sequence
caataacatttcctttgcat

SEQ ID NO: 633172 - DNA, 20 bp, Artificial
  CRISPR gRNA sequence
aataacatttcctttgcatt

SEQ ID NO: 633173 - DNA, 20 bp, Artificial
  CRISPR gRNA sequence
cctttgcattcacaatgtgg

SEQ ID NO: 633174 - DNA, 20 bp, Artificial
  CRISPR gRNA sequence
ctttgcattcacaatgtggc

SEQ ID NO: 633175 - DNA, 20 bp, Artificial
  CRISPR gRNA sequence
tgcattcacaatgtggctgt

SEQ ID NO: 633176 - DNA, 20 bp, Artificial
  CRISPR gRNA sequence
gcattcacaatgtggctgtt

SEQ ID NO: 633177 - DNA, 20 bp, Artificial
  CRISPR gRNA sequence
cattcacaatgtggctgttt

SEQ ID NO: 633178 - DNA, 20 bp, Artificial
  CRISPR gRNA sequence
acaatgtggctgtttggcac

SEQ ID NO: 633179 - DNA, 20 bp, Artificial
  CRISPR gRNA sequence
tttggcacaggaggcctatc

SEQ ID NO: 633180 - DNA, 20 bp, Artificial
  CRISPR gRNA sequence
ggcacaggaggcctatcttt

SEQ ID NO: 633181 - DNA, 20 bp, Artificial
  CRISPR gRNA sequence
gcacaggaggcctatctttt

SEQ ID NO: 633182 - DNA, 20 bp, Artificial
  CRISPR gRNA sequence
tcttttggcatgttttgcct

SEQ ID NO: 633183 - DNA, 20 bp, Artificial
  CRISPR gRNA sequence
ttggcatgttttgcctgttg

SEQ ID NO: 633184 - DNA, 20 bp, Artificial
  CRISPR gRNA sequence
tggcatgttttgcctgttga

SEQ ID NO: 633185 - DNA, 20 bp, Artificial
  CRISPR gRNA sequence
ggcatgttttgcctgttgac

SEQ ID NO: 633186 - DNA, 20 bp, Artificial
  CRISPR gRNA sequence
gcatgttttgcctgttgaca

SEQ ID NO: 633187 - DNA, 20 bp, Artificial
  CRISPR gRNA sequence
tgcctgttgacataccttcc

SEQ ID NO: 633188 - DNA, 20 bp, Artificial
  CRISPR gRNA sequence
gcctgttgacataccttcct

SEQ ID NO: 633189 - DNA, 20 bp, Artificial
  CRISPR gRNA sequence
cctgttgacataccttcctc

SEQ ID NO: 633190 - DNA, 20 bp, Artificial
  CRISPR gRNA sequence
ttgacataccttcctcacta

SEQ ID NO: 633191 - DNA, 20 bp, Artificial
  CRISPR gRNA sequence
acataccttcctcactaagc

SEQ ID NO: 633192 - DNA, 20 bp, Artificial
  CRISPR gRNA sequence
cctcactaagcctcatcatt

SEQ ID NO: 633193 - DNA, 20 bp, Artificial
  CRISPR gRNA sequence
ctcactaagcctcatcattt

SEQ ID NO: 633194 - DNA, 20 bp, Artificial
  CRISPR gRNA sequence
actaagcctcatcatttcta

SEQ ID NO: 633195 - DNA, 20 bp, Artificial
  CRISPR gRNA sequence
agcctcatcatttctagctt

SEQ ID NO: 633196 - DNA, 20 bp, Artificial
  CRISPR gRNA sequence
atcatttctagcttttgatt

SEQ ID NO: 633197 - DNA, 20 bp, Artificial
  CRISPR gRNA sequence
ctagcttttgatttaaagtg

SEQ ID NO: 633198 - DNA, 20 bp, Artificial
  CRISPR gRNA sequence
tagcttttgatttaaagtga

SEQ ID NO: 633199 - DNA, 20 bp, Artificial
  CRISPR gRNA sequence
gcttttgatttaaagtgaga

SEQ ID NO: 633200 - DNA, 20 bp, Artificial
  CRISPR gRNA sequence
ttgatttaaagtgagaaatg

SEQ ID NO: 633201 - DNA, 20 bp, Artificial
  CRISPR gRNA sequence
tgatttaaagtgagaaatgt

SEQ ID NO: 633202 - DNA, 20 bp, Artificial
  CRISPR gRNA sequence
gatttaaagtgagaaatgtg

SEQ ID NO: 633203 - DNA, 20 bp, Artificial
  CRISPR gRNA sequence
atttaaagtgagaaatgtga

SEQ ID NO: 633204 - DNA, 20 bp, Artificial
  CRISPR gRNA sequence
aaagtgagaaatgtgagtct

SEQ ID NO: 633205 - DNA, 20 bp, Artificial
  CRISPR gRNA sequence
aagtgagaaatgtgagtctt

SEQ ID NO: 633206 - DNA, 20 bp, Artificial
  CRISPR gRNA sequence
cctttaacttgaacacttag

SEQ ID NO: 633207 - DNA, 20 bp, Artificial
  CRISPR gRNA sequence
ctttaacttgaacacttaga

SEQ ID NO: 633208 - DNA, 20 bp, Artificial
  CRISPR gRNA sequence
taacttgaacacttagaggc

SEQ ID NO: 633209 - DNA, 20 bp, Artificial
  CRISPR gRNA sequence
aacttgaacacttagaggcc

SEQ ID NO: 633210 - DNA, 20 bp, Artificial
  CRISPR gRNA sequence
acttgaacacttagaggcca

SEQ ID NO: 633211 - DNA, 20 bp, Artificial
  CRISPR gRNA sequence
gaacacttagaggccattgt

SEQ ID NO: 633212 - DNA, 20 bp, Artificial
  CRISPR gRNA sequence
aacacttagaggccattgta

SEQ ID NO: 633213 - DNA, 20 bp, Artificial
  CRISPR gRNA sequence
agaggccattgtacagttat

SEQ ID NO: 633214 - DNA, 20 bp, Artificial
  CRISPR gRNA sequence
gaggccattgtacagttatt

SEQ ID NO: 633215 - DNA, 20 bp, Artificial
  CRISPR gRNA sequence
tacagttattaagtggccta

SEQ ID NO: 633216 - DNA, 20 bp, Artificial
  CRISPR gRNA sequence
ttaagtggcctaatttcagt

SEQ ID NO: 633217 - DNA, 20 bp, Artificial
  CRISPR gRNA sequence
agtggcctaatttcagtatt

SEQ ID NO: 633218 - DNA, 20 bp, Artificial
  CRISPR gRNA sequence
atttcagtatttttgcattt

SEQ ID NO: 633219 - DNA, 20 bp, Artificial
  CRISPR gRNA sequence
cagtatttttgcatttcagg

SEQ ID NO: 633220 - DNA, 20 bp, Artificial
  CRISPR gRNA sequence
agtatttttgcatttcagga

SEQ ID NO: 633221 - DNA, 20 bp, Artificial
  CRISPR gRNA sequence
ttgcatttcaggaatataga

SEQ ID NO: 633222 - DNA, 20 bp, Artificial
  CRISPR gRNA sequence
tgcatttcaggaatatagag

SEQ ID NO: 633223 - DNA, 20 bp, Artificial
  CRISPR gRNA sequence
gcatttcaggaatatagagg

SEQ ID NO: 633224 - DNA, 20 bp, Artificial
  CRISPR gRNA sequence
catttcaggaatatagaggc

SEQ ID NO: 633225 - DNA, 20 bp, Artificial
  CRISPR gRNA sequence
caggaatatagaggccaggt

SEQ ID NO: 633226 - DNA, 20 bp, Artificial
  CRISPR gRNA sequence
aggaatatagaggccaggtg

SEQ ID NO: 633227 - DNA, 20 bp, Artificial
  CRISPR gRNA sequence
gccagttggtgaagcagtca

SEQ ID NO: 633228 - DNA, 20 bp, Artificial
  CRISPR gRNA sequence
gtgaagcagtcagagcttac

SEQ ID NO: 633229 - DNA, 20 bp, Artificial
  CRISPR gRNA sequence
acacaacatttatcaacaca

SEQ ID NO: 633230 - DNA, 20 bp, Artificial
  CRISPR gRNA sequence
cacaacatttatcaacacaa

SEQ ID NO: 633231 - DNA, 20 bp, Artificial
  CRISPR gRNA sequence
atcaacacaaaaattcaagt

SEQ ID NO: 633232 - DNA, 20 bp, Artificial
  CRISPR gRNA sequence
tcaacacaaaaattcaagtt

SEQ ID NO: 633233 - DNA, 20 bp, Artificial
  CRISPR gRNA sequence
aagtttgccagcctgtatag

SEQ ID NO: 633234 - DNA, 20 bp, Artificial
  CRISPR gRNA sequence
gccagcctgtataggtgtgg

SEQ ID NO: 633235 - DNA, 20 bp, Artificial
  CRISPR gRNA sequence
ccagcctgtataggtgtggt

SEQ ID NO: 633236 - DNA, 20 bp, Artificial
  CRISPR gRNA sequence
tataggtgtggttcgtggta

SEQ ID NO: 633237 - DNA, 20 bp, Artificial
  CRISPR gRNA sequence
gtggtatcctaaaacagtta

SEQ ID NO: 633238 - DNA, 20 bp, Artificial
  CRISPR gRNA sequence
aaacagttataataataaca

SEQ ID NO: 633239 - DNA, 20 bp, Artificial
  CRISPR gRNA sequence
taataataacaagaaagatc

SEQ ID NO: 633240 - DNA, 20 bp, Artificial
  CRISPR gRNA sequence
caagaattatttaaatgtga

SEQ ID NO: 633241 - DNA, 20 bp, Artificial
  CRISPR gRNA sequence
tttaaatgtgacagagagac

SEQ ID NO: 633242 - DNA, 20 bp, Artificial
  CRISPR gRNA sequence
aaatgtgacagagagacatg

SEQ ID NO: 633243 - DNA, 20 bp, Artificial
  CRISPR gRNA sequence
aatgtgacagagagacatga

SEQ ID NO: 633244 - DNA, 20 bp, Artificial
  CRISPR gRNA sequence
gaaaaatggtatcaaccgac

SEQ ID NO: 633245 - DNA, 20 bp, Artificial
  CRISPR gRNA sequence
gcttggaattagggttacca

SEQ ID NO: 633246 - DNA, 20 bp, Artificial
  CRISPR gRNA sequence
cttggaattagggttaccac

SEQ ID NO: 633247 - DNA, 20 bp, Artificial
  CRISPR gRNA sequence
ggaattagggttaccacaaa

SEQ ID NO: 633248 - DNA, 20 bp, Artificial
  CRISPR gRNA sequence
gaattagggttaccacaaac

SEQ ID NO: 633249 - DNA, 20 bp, Artificial
  CRISPR gRNA sequence
gggttaccacaaactttcaa

SEQ ID NO: 633250 - DNA, 20 bp, Artificial
  CRISPR gRNA sequence
ccacaaactttcaatttgta

SEQ ID NO: 633251 - DNA, 20 bp, Artificial
  CRISPR gRNA sequence
tcaatttgtaaaaaacgcag

SEQ ID NO: 633252 - DNA, 20 bp, Artificial
  CRISPR gRNA sequence
caatttgtaaaaaacgcagt

SEQ ID NO: 633253 - DNA, 20 bp, Artificial
  CRISPR gRNA sequence
aatttgtaaaaaacgcagtt

SEQ ID NO: 633254 - DNA, 20 bp, Artificial
  CRISPR gRNA sequence
gtaaaaaacgcagttatctg

SEQ ID NO: 633255 - DNA, 20 bp, Artificial
  CRISPR gRNA sequence
taaaaaacgcagttatctgt

SEQ ID NO: 633256 - DNA, 20 bp, Artificial
  CRISPR gRNA sequence
tctgtgaagtgcaataaagt

SEQ ID NO: 633257 - DNA, 20 bp, Artificial
  CRISPR gRNA sequence
tgaagtgcaataaagtaagg

SEQ ID NO: 633258 - DNA, 20 bp, Artificial
  CRISPR gRNA sequence
tgcttgtatttcctttcatc

SEQ ID NO: 633259 - DNA, 20 bp, Artificial
  CRISPR gRNA sequence
gtatttcctttcatctgact

SEQ ID NO: 633260 - DNA, 20 bp, Artificial
  CRISPR gRNA sequence
tatttcctttcatctgactt

SEQ ID NO: 633261 - DNA, 20 bp, Artificial
  CRISPR gRNA sequence
cctttcatctgactttctat

SEQ ID NO: 633262 - DNA, 20 bp, Artificial
  CRISPR gRNA sequence
ctttcatctgactttctata

SEQ ID NO: 633263 - DNA, 20 bp, Artificial
  CRISPR gRNA sequence
tcatctgactttctatatta

SEQ ID NO: 633264 - DNA, 20 bp, Artificial
  CRISPR gRNA sequence
catctgactttctatattac

SEQ ID NO: 633265 - DNA, 20 bp, Artificial
  CRISPR gRNA sequence
atctgactttctatattaca

SEQ ID NO: 633266 - DNA, 20 bp, Artificial
  CRISPR gRNA sequence
actttctatattacaagaac

SEQ ID NO: 633267 - DNA, 20 bp, Artificial
  CRISPR gRNA sequence
tctatattacaagaactcag

SEQ ID NO: 633268 - DNA, 20 bp, Artificial
  CRISPR gRNA sequence
ctatattacaagaactcagg

SEQ ID NO: 633269 - DNA, 20 bp, Artificial
  CRISPR gRNA sequence
tatattacaagaactcaggc

SEQ ID NO: 633270 - DNA, 20 bp, Artificial
  CRISPR gRNA sequence
tattacaagaactcaggctt

SEQ ID NO: 633271 - DNA, 20 bp, Artificial
  CRISPR gRNA sequence
caagaactcaggcttatgag

SEQ ID NO: 633272 - DNA, 20 bp, Artificial
  CRISPR gRNA sequence
aggcttatgagtaagcaaat

SEQ ID NO: 633273 - DNA, 20 bp, Artificial
  CRISPR gRNA sequence
atgagtaagcaaataatttg

SEQ ID NO: 633274 - DNA, 20 bp, Artificial
  CRISPR gRNA sequence
tgagtaagcaaataatttgg

SEQ ID NO: 633275 - DNA, 20 bp, Artificial
  CRISPR gRNA sequence
ggatagcaaacagctcccaa

SEQ ID NO: 633276 - DNA, 20 bp, Artificial
  CRISPR gRNA sequence
gatagcaaacagctcccaaa

SEQ ID NO: 633277 - DNA, 20 bp, Artificial
  CRISPR gRNA sequence
ccaaaataatcaattcagaa

SEQ ID NO: 633278 - DNA, 20 bp, Artificial
  CRISPR gRNA sequence
agaagcaaatagcttgctct

SEQ ID NO: 633279 - DNA, 20 bp, Artificial
  CRISPR gRNA sequence
gctctaacttatggaatatt

SEQ ID NO: 633280 - DNA, 20 bp, Artificial
  CRISPR gRNA sequence
ctctaacttatggaatattc

SEQ ID NO: 633281 - DNA, 20 bp, Artificial
  CRISPR gRNA sequence
taacttatggaatattcata

SEQ ID NO: 633282 - DNA, 20 bp, Artificial
  CRISPR gRNA sequence
acttatggaatattcatata

SEQ ID NO: 633283 - DNA, 20 bp, Artificial
  CRISPR gRNA sequence
atggaatattcatataaaga

SEQ ID NO: 633284 - DNA, 20 bp, Artificial
  CRISPR gRNA sequence
tggaatattcatataaagaa

SEQ ID NO: 633285 - DNA, 20 bp, Artificial
  CRISPR gRNA sequence
atataaagaatatgtatttg

SEQ ID NO: 633286 - DNA, 20 bp, Artificial
  CRISPR gRNA sequence
gtatatccagaatgtggttt

SEQ ID NO: 633287 - DNA, 20 bp, Artificial
  CRISPR gRNA sequence
tatatccagaatgtggtttc

SEQ ID NO: 633288 - DNA, 20 bp, Artificial
  CRISPR gRNA sequence
cttacttggatctcaaattc

SEQ ID NO: 633289 - DNA, 20 bp, Artificial
  CRISPR gRNA sequence
ttacttggatctcaaattct

SEQ ID NO: 633290 - DNA, 20 bp, Artificial
  CRISPR gRNA sequence
acttggatctcaaattctaa

SEQ ID NO: 633291 - DNA, 20 bp, Artificial
  CRISPR gRNA sequence
cttggatctcaaattctaac

SEQ ID NO: 633292 - DNA, 20 bp, Artificial
  CRISPR gRNA sequence
ggatctcaaattctaaccct

SEQ ID NO: 633293 - DNA, 20 bp, Artificial
  CRISPR gRNA sequence
gatctcaaattctaacccta

SEQ ID NO: 633294 - DNA, 20 bp, Artificial
  CRISPR gRNA sequence
aaattctaaccctaatgcca

SEQ ID NO: 633295 - DNA, 20 bp, Artificial
  CRISPR gRNA sequence
taaccctaatgccagttgtg

SEQ ID NO: 633296 - DNA, 20 bp, Artificial
  CRISPR gRNA sequence
accctaatgccagttgtgtg

SEQ ID NO: 633297 - DNA, 20 bp, Artificial
  CRISPR gRNA sequence
atgccagttgtgtgtgaagc

SEQ ID NO: 633298 - DNA, 20 bp, Artificial
  CRISPR gRNA sequence
tgtgtgaagcctaggttacg

SEQ ID NO: 633299 - DNA, 20 bp, Artificial
  CRISPR gRNA sequence
ggttacgttaaattaggaaa

SEQ ID NO: 633300 - DNA, 20 bp, Artificial
  CRISPR gRNA sequence
cgttaaattaggaaatagtt

SEQ ID NO: 633301 - DNA, 20 bp, Artificial
  CRISPR gRNA sequence
aattaggaaatagttgtacc

SEQ ID NO: 633302 - DNA, 20 bp, Artificial
  CRISPR gRNA sequence
ggaaatagttgtacctaact

SEQ ID NO: 633303 - DNA, 20 bp, Artificial
  CRISPR gRNA sequence
tacctaactcacagcatttc

SEQ ID NO: 633304 - DNA, 20 bp, Artificial
  CRISPR gRNA sequence
actcacagcatttctgtgag

SEQ ID NO: 633305 - DNA, 20 bp, Artificial
  CRISPR gRNA sequence
acagcatttctgtgagtata

SEQ ID NO: 633306 - DNA, 20 bp, Artificial
  CRISPR gRNA sequence
ctgtgagtatatattttttt

SEQ ID NO: 633307 - DNA, 20 bp, Artificial
  CRISPR gRNA sequence
tgtgagtatatatttttttt

SEQ ID NO: 633308 - DNA, 20 bp, Artificial
  CRISPR gRNA sequence
tgagtatatattttttttaa

SEQ ID NO: 633309 - DNA, 20 bp, Artificial
  CRISPR gRNA sequence
tttttaatccatatggaaaa

SEQ ID NO: 633310 - DNA, 20 bp, Artificial
  CRISPR gRNA sequence
ttttaatccatatggaaaac

SEQ ID NO: 633311 - DNA, 20 bp, Artificial
  CRISPR gRNA sequence
tttaatccatatggaaaact

SEQ ID NO: 633312 - DNA, 20 bp, Artificial
  CRISPR gRNA sequence
ttaatccatatggaaaactc

SEQ ID NO: 633313 - DNA, 20 bp, Artificial
  CRISPR gRNA sequence
taatccatatggaaaactca

SEQ ID NO: 633314 - DNA, 20 bp, Artificial
  CRISPR gRNA sequence
aatccatatggaaaactcaa

SEQ ID NO: 633315 - DNA, 20 bp, Artificial
  CRISPR gRNA sequence
atccatatggaaaactcaag

SEQ ID NO: 633316 - DNA, 20 bp, Artificial
  CRISPR gRNA sequence
aaggtacttaacacacaata

SEQ ID NO: 633317 - DNA, 20 bp, Artificial
  CRISPR gRNA sequence
aacacacaataaatgatcaa

SEQ ID NO: 633318 - DNA, 20 bp, Artificial
  CRISPR gRNA sequence
acacacaataaatgatcaat

SEQ ID NO: 633319 - DNA, 20 bp, Artificial
  CRISPR gRNA sequence
tttttttccctgtagcagtc

SEQ ID NO: 633320 - DNA, 20 bp, Artificial
  CRISPR gRNA sequence
ttttttccctgtagcagtca

SEQ ID NO: 633321 - DNA, 20 bp, Artificial
  CRISPR gRNA sequence
tttttccctgtagcagtcaa

SEQ ID NO: 633322 - DNA, 20 bp, Artificial
  CRISPR gRNA sequence
ttttccctgtagcagtcaac

SEQ ID NO: 633323 - DNA, 20 bp, Artificial
  CRISPR gRNA sequence
tttccctgtagcagtcaaca

SEQ ID NO: 633324 - DNA, 20 bp, Artificial
  CRISPR gRNA sequence
ttccctgtagcagtcaacat

SEQ ID NO: 633325 - DNA, 20 bp, Artificial
  CRISPR gRNA sequence
tccctgtagcagtcaacatc

SEQ ID NO: 633326 - DNA, 20 bp, Artificial
  CRISPR gRNA sequence
ccctgtagcagtcaacatct

SEQ ID NO: 633327 - DNA, 20 bp, Artificial
  CRISPR gRNA sequence
cctgtagcagtcaacatctt

SEQ ID NO: 633328 - DNA, 20 bp, Artificial
  CRISPR gRNA sequence
tagcagtcaacatcttctaa

SEQ ID NO: 633329 - DNA, 20 bp, Artificial
  CRISPR gRNA sequence
ctaacatattatatgatttt

SEQ ID NO: 633330 - DNA, 20 bp, Artificial
  CRISPR gRNA sequence
taacatattatatgattttt

SEQ ID NO: 633331 - DNA, 20 bp, Artificial
  CRISPR gRNA sequence
acatattatatgatttttta

SEQ ID NO: 633332 - DNA, 20 bp, Artificial
  CRISPR gRNA sequence
tatgattttttaactgattc

SEQ ID NO: 633333 - DNA, 20 bp, Artificial
  CRISPR gRNA sequence
tttaactgattcttgcccgt

SEQ ID NO: 633334 - DNA, 20 bp, Artificial
  CRISPR gRNA sequence
ttaactgattcttgcccgtc

SEQ ID NO: 633335 - DNA, 20 bp, Artificial
  CRISPR gRNA sequence
taactgattcttgcccgtct

SEQ ID NO: 633336 - DNA, 20 bp, Artificial
  CRISPR gRNA sequence
aactgattcttgcccgtctc

SEQ ID NO: 633337 - DNA, 20 bp, Artificial
  CRISPR gRNA sequence
actgattcttgcccgtctcc

SEQ ID NO: 633338 - DNA, 20 bp, Artificial
  CRISPR gRNA sequence
attcttgcccgtctcccctt

SEQ ID NO: 633339 - DNA, 20 bp, Artificial
  CRISPR gRNA sequence
ttgcccgtctccccttatta

SEQ ID NO: 633340 - DNA, 20 bp, Artificial
  CRISPR gRNA sequence
gcccgtctccccttattaaa

SEQ ID NO: 633341 - DNA, 20 bp, Artificial
  CRISPR gRNA sequence
cccgtctccccttattaaaa

SEQ ID NO: 633342 - DNA, 20 bp, Artificial
  CRISPR gRNA sequence
cccttattaaaatgtaagct

SEQ ID NO: 633343 - DNA, 20 bp, Artificial
  CRISPR gRNA sequence
attaaaatgtaagctccaca

SEQ ID NO: 633344 - DNA, 20 bp, Artificial
  CRISPR gRNA sequence
ttaaaatgtaagctccacaa

SEQ ID NO: 633345 - DNA, 20 bp, Artificial
  CRISPR gRNA sequence
aaatgtaagctccacaaaga

SEQ ID NO: 633346 - DNA, 20 bp, Artificial
  CRISPR gRNA sequence
cacaaagacagtcttgcagt

SEQ ID NO: 633347 - DNA, 20 bp, Artificial
  CRISPR gRNA sequence
gcagtccacaatctcacaga

SEQ ID NO: 633348 - DNA, 20 bp, Artificial
  CRISPR gRNA sequence
cagtccacaatctcacagag

SEQ ID NO: 633349 - DNA, 20 bp, Artificial
  CRISPR gRNA sequence
acagagcttacattcgagtg

SEQ ID NO: 633350 - DNA, 20 bp, Artificial
  CRISPR gRNA sequence
acattcgagtgaggtgggat

SEQ ID NO: 633351 - DNA, 20 bp, Artificial
  CRISPR gRNA sequence
cattcgagtgaggtgggatg

SEQ ID NO: 633352 - DNA, 20 bp, Artificial
  CRISPR gRNA sequence
gagtgaggtgggatggcaca

SEQ ID NO: 633353 - DNA, 20 bp, Artificial
  CRISPR gRNA sequence
aacaccaacataaccacaga

SEQ ID NO: 633354 - DNA, 20 bp, Artificial
  CRISPR gRNA sequence
tgattcaagctttttattaa

SEQ ID NO: 633355 - DNA, 20 bp, Artificial
  CRISPR gRNA sequence
attcaagctttttattaaga

SEQ ID NO: 633356 - DNA, 20 bp, Artificial
  CRISPR gRNA sequence
aagctttttattaagataga

SEQ ID NO: 633357 - DNA, 20 bp, Artificial
  CRISPR gRNA sequence
tttattaagatagagatagc

SEQ ID NO: 633358 - DNA, 20 bp, Artificial
  CRISPR gRNA sequence
ttattaagatagagatagca

SEQ ID NO: 633359 - DNA, 20 bp, Artificial
  CRISPR gRNA sequence
tattaagatagagatagcaa

SEQ ID NO: 633360 - DNA, 20 bp, Artificial
  CRISPR gRNA sequence
attaagatagagatagcaaa

SEQ ID NO: 633361 - DNA, 20 bp, Artificial
  CRISPR gRNA sequence
ttaagatagagatagcaaaa

SEQ ID NO: 633362 - DNA, 20 bp, Artificial
  CRISPR gRNA sequence
agatagagatagcaaaatag

SEQ ID NO: 633363 - DNA, 20 bp, Artificial
  CRISPR gRNA sequence
aggggatgcttctggtaggt

SEQ ID NO: 633364 - DNA, 20 bp, Artificial
  CRISPR gRNA sequence
ctggtaggttgcttatggat

SEQ ID NO: 633365 - DNA, 20 bp, Artificial
  CRISPR gRNA sequence
tggtaggttgcttatggatg

SEQ ID NO: 633366 - DNA, 20 bp, Artificial
  CRISPR gRNA sequence
gtaggttgcttatggatgcc

SEQ ID NO: 633367 - DNA, 20 bp, Artificial
  CRISPR gRNA sequence
cttatggatgccactatttt

SEQ ID NO: 633368 - DNA, 20 bp, Artificial
  CRISPR gRNA sequence
atggatgccactattttcaa

SEQ ID NO: 633369 - DNA, 20 bp, Artificial
  CRISPR gRNA sequence
tggatgccactattttcaaa

SEQ ID NO: 633370 - DNA, 20 bp, Artificial
  CRISPR gRNA sequence
ttttcaaagagatgacattt

SEQ ID NO: 633371 - DNA, 20 bp, Artificial
  CRISPR gRNA sequence
tcaaagagatgacatttaaa

SEQ ID NO: 633372 - DNA, 20 bp, Artificial
  CRISPR gRNA sequence
caaagagatgacatttaaac

SEQ ID NO: 633373 - DNA, 20 bp, Artificial
  CRISPR gRNA sequence
aaagagatgacatttaaact

SEQ ID NO: 633374 - DNA, 20 bp, Artificial
  CRISPR gRNA sequence
aaactaacatctgaaagata

SEQ ID NO: 633375 - DNA, 20 bp, Artificial
  CRISPR gRNA sequence
aactaacatctgaaagataa

SEQ ID NO: 633376 - DNA, 20 bp, Artificial
  CRISPR gRNA sequence
acatctgaaagataataagg

SEQ ID NO: 633377 - DNA, 20 bp, Artificial
  CRISPR gRNA sequence
aaagataataaggcaactat

SEQ ID NO: 633378 - DNA, 20 bp, Artificial
  CRISPR gRNA sequence
tgccaagatcttgggaaaac

SEQ ID NO: 633379 - DNA, 20 bp, Artificial
  CRISPR gRNA sequence
gggaaaacgctgaaggtgtt

SEQ ID NO: 633380 - DNA, 20 bp, Artificial
  CRISPR gRNA sequence
ggaaaacgctgaaggtgttg

SEQ ID NO: 633381 - DNA, 20 bp, Artificial
  CRISPR gRNA sequence
aaggtgttgacttctaggat

SEQ ID NO: 633382 - DNA, 20 bp, Artificial
  CRISPR gRNA sequence
acttctaggatcatccatta

SEQ ID NO: 633383 - DNA, 20 bp, Artificial
  CRISPR gRNA sequence
ctaggatcatccattagttc

SEQ ID NO: 633384 - DNA, 20 bp, Artificial
  CRISPR gRNA sequence
taggatcatccattagttca

SEQ ID NO: 633385 - DNA, 20 bp, Artificial
  CRISPR gRNA sequence
ggatcatccattagttcaaa

SEQ ID NO: 633386 - DNA, 20 bp, Artificial
  CRISPR gRNA sequence
gttcaaaaacagtaggaaag

SEQ ID NO: 633387 - DNA, 20 bp, Artificial
  CRISPR gRNA sequence
aaaaacagtaggaaagaata

SEQ ID NO: 633388 - DNA, 20 bp, Artificial
  CRISPR gRNA sequence
gggttgcaaagaacccagag

SEQ ID NO: 633389 - DNA, 20 bp, Artificial
  CRISPR gRNA sequence
caaagaacccagagtgaggc

SEQ ID NO: 633390 - DNA, 20 bp, Artificial
  CRISPR gRNA sequence
gtagtttgattttattataa

SEQ ID NO: 633391 - DNA, 20 bp, Artificial
  CRISPR gRNA sequence
gattttattataaaagcaat

SEQ ID NO: 633392 - DNA, 20 bp, Artificial
  CRISPR gRNA sequence
attttattataaaagcaatg

SEQ ID NO: 633393 - DNA, 20 bp, Artificial
  CRISPR gRNA sequence
tattataaaagcaatggaaa

SEQ ID NO: 633394 - DNA, 20 bp, Artificial
  CRISPR gRNA sequence
attataaaagcaatggaaaa

SEQ ID NO: 633395 - DNA, 20 bp, Artificial
  CRISPR gRNA sequence
ttataaaagcaatggaaaac

SEQ ID NO: 633396 - DNA, 20 bp, Artificial
  CRISPR gRNA sequence
taaaagcaatggaaaaccat

SEQ ID NO: 633397 - DNA, 20 bp, Artificial
  CRISPR gRNA sequence
aaatattttaagaagaggag

SEQ ID NO: 633398 - DNA, 20 bp, Artificial
  CRISPR gRNA sequence
taagaagaggagtgacatgg

SEQ ID NO: 633399 - DNA, 20 bp, Artificial
  CRISPR gRNA sequence
aagaagaggagtgacatggt

SEQ ID NO: 633400 - DNA, 20 bp, Artificial
  CRISPR gRNA sequence
agaagaggagtgacatggtt

SEQ ID NO: 633401 - DNA, 20 bp, Artificial
  CRISPR gRNA sequence
aaatcagattttaaagtaac

SEQ ID NO: 633402 - DNA, 20 bp, Artificial
  CRISPR gRNA sequence
aatcagattttaaagtaaca

SEQ ID NO: 633403 - DNA, 20 bp, Artificial
  CRISPR gRNA sequence
taaagtaacattctggttgc

SEQ ID NO: 633404 - DNA, 20 bp, Artificial
  CRISPR gRNA sequence
aaagtaacattctggttgct

SEQ ID NO: 633405 - DNA, 20 bp, Artificial
  CRISPR gRNA sequence
aagtaacattctggttgcta

SEQ ID NO: 633406 - DNA, 20 bp, Artificial
  CRISPR gRNA sequence
tggttgctatctggagaata

SEQ ID NO: 633407 - DNA, 20 bp, Artificial
  CRISPR gRNA sequence
gttgctatctggagaataga

SEQ ID NO: 633408 - DNA, 20 bp, Artificial
  CRISPR gRNA sequence
ctatctggagaatagattgg

SEQ ID NO: 633409 - DNA, 20 bp, Artificial
  CRISPR gRNA sequence
tctggagaatagattgggaa

SEQ ID NO: 633410 - DNA, 20 bp, Artificial
  CRISPR gRNA sequence
gagaatagattgggaagcag

SEQ ID NO: 633411 - DNA, 20 bp, Artificial
  CRISPR gRNA sequence
ggaagcaggagtatagtggc

SEQ ID NO: 633412 - DNA, 20 bp, Artificial
  CRISPR gRNA sequence
agagcagagaccctagattc

SEQ ID NO: 633413 - DNA, 20 bp, Artificial
  CRISPR gRNA sequence
gattcagacagaccagagct

SEQ ID NO: 633414 - DNA, 20 bp, Artificial
  CRISPR gRNA sequence
agacagaccagagcttatat

SEQ ID NO: 633415 - DNA, 20 bp, Artificial
  CRISPR gRNA sequence
atatctcagctttcatgagt

SEQ ID NO: 633416 - DNA, 20 bp, Artificial
  CRISPR gRNA sequence
tatctcagctttcatgagta

SEQ ID NO: 633417 - DNA, 20 bp, Artificial
  CRISPR gRNA sequence
agctttcatgagtatattgg

SEQ ID NO: 633418 - DNA, 20 bp, Artificial
  CRISPR gRNA sequence
tcatgagtatattggaagtt

SEQ ID NO: 633419 - DNA, 20 bp, Artificial
  CRISPR gRNA sequence
catgagtatattggaagttg

SEQ ID NO: 633420 - DNA, 20 bp, Artificial
  CRISPR gRNA sequence
atgagtatattggaagttgg

SEQ ID NO: 633421 - DNA, 20 bp, Artificial
  CRISPR gRNA sequence
gaagttggataaaatgtaaa

SEQ ID NO: 633422 - DNA, 20 bp, Artificial
  CRISPR gRNA sequence
gataaaatgtaaacatatag

SEQ ID NO: 633423 - DNA, 20 bp, Artificial
  CRISPR gRNA sequence
tcaaggtatgattttttttg

SEQ ID NO: 633424 - DNA, 20 bp, Artificial
  CRISPR gRNA sequence
tttttgctatatcagatcat

SEQ ID NO: 633425 - DNA, 20 bp, Artificial
  CRISPR gRNA sequence
ttttgctatatcagatcata

SEQ ID NO: 633426 - DNA, 20 bp, Artificial
  CRISPR gRNA sequence
tttgctatatcagatcataa

SEQ ID NO: 633427 - DNA, 20 bp, Artificial
  CRISPR gRNA sequence
ttgctatatcagatcataat

SEQ ID NO: 633428 - DNA, 20 bp, Artificial
  CRISPR gRNA sequence
tgctatatcagatcataatt

SEQ ID NO: 633429 - DNA, 20 bp, Artificial
  CRISPR gRNA sequence
gctatatcagatcataattt

SEQ ID NO: 633430 - DNA, 20 bp, Artificial
  CRISPR gRNA sequence
ctatatcagatcataatttt

SEQ ID NO: 633431 - DNA, 20 bp, Artificial
  CRISPR gRNA sequence
tatcagatcataatttttaa

SEQ ID NO: 633432 - DNA, 20 bp, Artificial
  CRISPR gRNA sequence
ttaaagtactctcacaaata

SEQ ID NO: 633433 - DNA, 20 bp, Artificial
  CRISPR gRNA sequence
taaagtactctcacaaatat

SEQ ID NO: 633434 - DNA, 20 bp, Artificial
  CRISPR gRNA sequence
aaagtactctcacaaatata

SEQ ID NO: 633435 - DNA, 20 bp, Artificial
  CRISPR gRNA sequence
aagtactctcacaaatataa

SEQ ID NO: 633436 - DNA, 20 bp, Artificial
  CRISPR gRNA sequence
tcacaaatataatttatact

SEQ ID NO: 633437 - DNA, 20 bp, Artificial
  CRISPR gRNA sequence
acaaatataatttatactat

SEQ ID NO: 633438 - DNA, 20 bp, Artificial
  CRISPR gRNA sequence
atactattgttagatttatt

SEQ ID NO: 633439 - DNA, 20 bp, Artificial
  CRISPR gRNA sequence
tactattgttagatttattt

SEQ ID NO: 633440 - DNA, 20 bp, Artificial
  CRISPR gRNA sequence
ttgttagatttattttgttc

SEQ ID NO: 633441 - DNA, 20 bp, Artificial
  CRISPR gRNA sequence
ttagatttattttgttctaa

SEQ ID NO: 633442 - DNA, 20 bp, Artificial
  CRISPR gRNA sequence
gatttattttgttctaagct

SEQ ID NO: 633443 - DNA, 20 bp, Artificial
  CRISPR gRNA sequence
attttgttctaagctgctat

SEQ ID NO: 633444 - DNA, 20 bp, Artificial
  CRISPR gRNA sequence
ttttgttctaagctgctata

SEQ ID NO: 633445 - DNA, 20 bp, Artificial
  CRISPR gRNA sequence
tgttctaagctgctatatgt

SEQ ID NO: 633446 - DNA, 20 bp, Artificial
  CRISPR gRNA sequence
gttctaagctgctatatgtc

SEQ ID NO: 633447 - DNA, 20 bp, Artificial
  CRISPR gRNA sequence
ttctaagctgctatatgtct

SEQ ID NO: 633448 - DNA, 20 bp, Artificial
  CRISPR gRNA sequence
taagctgctatatgtcttca

SEQ ID NO: 633449 - DNA, 20 bp, Artificial
  CRISPR gRNA sequence
agctgctatatgtcttcaag

SEQ ID NO: 633450 - DNA, 20 bp, Artificial
  CRISPR gRNA sequence
ctatatgtcttcaagcctca

SEQ ID NO: 633451 - DNA, 20 bp, Artificial
  CRISPR gRNA sequence
tatgtcttcaagcctcatga

SEQ ID NO: 633452 - DNA, 20 bp, Artificial
  CRISPR gRNA sequence
caagcctcatgatagatttt

SEQ ID NO: 633453 - DNA, 20 bp, Artificial
  CRISPR gRNA sequence
aagcctcatgatagattttt

SEQ ID NO: 633454 - DNA, 20 bp, Artificial
  CRISPR gRNA sequence
atgatagatttttgtttata

SEQ ID NO: 633455 - DNA, 20 bp, Artificial
  CRISPR gRNA sequence
ttgtttataagagcatgata

SEQ ID NO: 633456 - DNA, 20 bp, Artificial
  CRISPR gRNA sequence
tgtttataagagcatgatac

SEQ ID NO: 633457 - DNA, 20 bp, Artificial
  CRISPR gRNA sequence
gtttataagagcatgataca

SEQ ID NO: 633458 - DNA, 20 bp, Artificial
  CRISPR gRNA sequence
tttataagagcatgatacaa

SEQ ID NO: 633459 - DNA, 20 bp, Artificial
  CRISPR gRNA sequence
ataagagcatgatacaattc

SEQ ID NO: 633460 - DNA, 20 bp, Artificial
  CRISPR gRNA sequence
taagagcatgatacaattct

SEQ ID NO: 633461 - DNA, 20 bp, Artificial
  CRISPR gRNA sequence
ttgttttattgtgctgtggg

SEQ ID NO: 633462 - DNA, 20 bp, Artificial
  CRISPR gRNA sequence
gttttattgtgctgtgggtg

SEQ ID NO: 633463 - DNA, 20 bp, Artificial
  CRISPR gRNA sequence
ttttattgtgctgtgggtgt

SEQ ID NO: 633464 - DNA, 20 bp, Artificial
  CRISPR gRNA sequence
tattgtgctgtgggtgtgta

SEQ ID NO: 633465 - DNA, 20 bp, Artificial
  CRISPR gRNA sequence
attgtgctgtgggtgtgtat

SEQ ID NO: 633466 - DNA, 20 bp, Artificial
  CRISPR gRNA sequence
ttgtgctgtgggtgtgtatg

SEQ ID NO: 633467 - DNA, 20 bp, Artificial
  CRISPR gRNA sequence
tgctgtgggtgtgtatgtgt

SEQ ID NO: 633468 - DNA, 20 bp, Artificial
  CRISPR gRNA sequence
tgggtgtgtatgtgtgtgtt

SEQ ID NO: 633469 - DNA, 20 bp, Artificial
  CRISPR gRNA sequence
gaaatctaatccaataatac

SEQ ID NO: 633470 - DNA, 20 bp, Artificial
  CRISPR gRNA sequence
aaatctaatccaataataca

SEQ ID NO: 633471 - DNA, 20 bp, Artificial
  CRISPR gRNA sequence
atccaataatacattgttgc

SEQ ID NO: 633472 - DNA, 20 bp, Artificial
  CRISPR gRNA sequence
ttgccaaaccatggaaaata

SEQ ID NO: 633473 - DNA, 20 bp, Artificial
  CRISPR gRNA sequence
ccaaaccatggaaaataaaa

SEQ ID NO: 633474 - DNA, 20 bp, Artificial
  CRISPR gRNA sequence
tataagctgaggaggcatac

SEQ ID NO: 633475 - DNA, 20 bp, Artificial
  CRISPR gRNA sequence
aggaggcatacatgtaatat

SEQ ID NO: 633476 - DNA, 20 bp, Artificial
  CRISPR gRNA sequence
cgtgaggacattaggtaaca

SEQ ID NO: 633477 - DNA, 20 bp, Artificial
  CRISPR gRNA sequence
ggtaacatctctttctttaa

SEQ ID NO: 633478 - DNA, 20 bp, Artificial
  CRISPR gRNA sequence
tttctttaaacttgactcta

SEQ ID NO: 633479 - DNA, 20 bp, Artificial
  CRISPR gRNA sequence
tctttaaacttgactctact

SEQ ID NO: 633480 - DNA, 20 bp, Artificial
  CRISPR gRNA sequence
ctttaaacttgactctactt

SEQ ID NO: 633481 - DNA, 20 bp, Artificial
  CRISPR gRNA sequence
tttaaacttgactctactta

SEQ ID NO: 633482 - DNA, 20 bp, Artificial
  CRISPR gRNA sequence
taaacttgactctacttatc

SEQ ID NO: 633483 - DNA, 20 bp, Artificial
  CRISPR gRNA sequence
aaacttgactctacttatct

SEQ ID NO: 633484 - DNA, 20 bp, Artificial
  CRISPR gRNA sequence
aacttgactctacttatctg

SEQ ID NO: 633485 - DNA, 20 bp, Artificial
  CRISPR gRNA sequence
gactctacttatctgcaaaa

SEQ ID NO: 633486 - DNA, 20 bp, Artificial
  CRISPR gRNA sequence
actctacttatctgcaaaat

SEQ ID NO: 633487 - DNA, 20 bp, Artificial
  CRISPR gRNA sequence
tacttatctgcaaaataagg

SEQ ID NO: 633488 - DNA, 20 bp, Artificial
  CRISPR gRNA sequence
cttatctgcaaaataaggcc

SEQ ID NO: 633489 - DNA, 20 bp, Artificial
  CRISPR gRNA sequence
atctgcaaaataaggccctt

SEQ ID NO: 633490 - DNA, 20 bp, Artificial
  CRISPR gRNA sequence
tctgcaaaataaggccctta

SEQ ID NO: 633491 - DNA, 20 bp, Artificial
  CRISPR gRNA sequence
caaaataaggcccttaacat

SEQ ID NO: 633492 - DNA, 20 bp, Artificial
  CRISPR gRNA sequence
aacataatgcttgtcacaaa

SEQ ID NO: 633493 - DNA, 20 bp, Artificial
  CRISPR gRNA sequence
acataatgcttgtcacaaaa

SEQ ID NO: 633494 - DNA, 20 bp, Artificial
  CRISPR gRNA sequence
gtcacaaaataagaacttat

SEQ ID NO: 633495 - DNA, 20 bp, Artificial
  CRISPR gRNA sequence
tcacaaaataagaacttatt

SEQ ID NO: 633496 - DNA, 20 bp, Artificial
  CRISPR gRNA sequence
attaaatatacccataattt

SEQ ID NO: 633497 - DNA, 20 bp, Artificial
  CRISPR gRNA sequence
ttaaatatacccataatttt

SEQ ID NO: 633498 - DNA, 20 bp, Artificial
  CRISPR gRNA sequence
aatatacccataatttttaa

SEQ ID NO: 633499 - DNA, 20 bp, Artificial
  CRISPR gRNA sequence
ttaatttttgtaatagacta

SEQ ID NO: 633500 - DNA, 20 bp, Artificial
  CRISPR gRNA sequence
taatttttgtaatagactaa

SEQ ID NO: 633501 - DNA, 20 bp, Artificial
  CRISPR gRNA sequence
aatttttgtaatagactaat

SEQ ID NO: 633502 - DNA, 20 bp, Artificial
  CRISPR gRNA sequence
atttttgtaatagactaata

SEQ ID NO: 633503 - DNA, 20 bp, Artificial
  CRISPR gRNA sequence
ttgtaatagactaatactta

SEQ ID NO: 633504 - DNA, 20 bp, Artificial
  CRISPR gRNA sequence
tgtaatagactaatacttat

SEQ ID NO: 633505 - DNA, 20 bp, Artificial
  CRISPR gRNA sequence
gtaatagactaatacttatc

SEQ ID NO: 633506 - DNA, 20 bp, Artificial
  CRISPR gRNA sequence
taatagactaatacttatca

SEQ ID NO: 633507 - DNA, 20 bp, Artificial
  CRISPR gRNA sequence
atacttatcatgtactagga

SEQ ID NO: 633508 - DNA, 20 bp, Artificial
  CRISPR gRNA sequence
atcatgtactaggaaacata

SEQ ID NO: 633509 - DNA, 20 bp, Artificial
  CRISPR gRNA sequence
tcatgtactaggaaacatac

SEQ ID NO: 633510 - DNA, 20 bp, Artificial
  CRISPR gRNA sequence
ggaaacatactcaaccacca

SEQ ID NO: 633511 - DNA, 20 bp, Artificial
  CRISPR gRNA sequence
aaccaccattgacctccatg

SEQ ID NO: 633512 - DNA, 20 bp, Artificial
  CRISPR gRNA sequence
acctccatgaatctttaaaa

SEQ ID NO: 633513 - DNA, 20 bp, Artificial
  CRISPR gRNA sequence
catgaatctttaaaaccttt

SEQ ID NO: 633514 - DNA, 20 bp, Artificial
  CRISPR gRNA sequence
taaaacctttctagttaata

SEQ ID NO: 633515 - DNA, 20 bp, Artificial
  CRISPR gRNA sequence
aaaacctttctagttaatat

SEQ ID NO: 633516 - DNA, 20 bp, Artificial
  CRISPR gRNA sequence
aaacctttctagttaatata

SEQ ID NO: 633517 - DNA, 20 bp, Artificial
  CRISPR gRNA sequence
tctagttaatataagaatat

SEQ ID NO: 633518 - DNA, 20 bp, Artificial
  CRISPR gRNA sequence
ctagttaatataagaatatt

SEQ ID NO: 633519 - DNA, 20 bp, Artificial
  CRISPR gRNA sequence
tagttaatataagaatattc

SEQ ID NO: 633520 - DNA, 20 bp, Artificial
  CRISPR gRNA sequence
gttaatataagaatattcaa

SEQ ID NO: 633521 - DNA, 20 bp, Artificial
  CRISPR gRNA sequence
atataagaatattcaaataa

SEQ ID NO: 633522 - DNA, 20 bp, Artificial
  CRISPR gRNA sequence
aaataaaataatctgtccat

SEQ ID NO: 633523 - DNA, 20 bp, Artificial
  CRISPR gRNA sequence
tccattaattcattcaatca

SEQ ID NO: 633524 - DNA, 20 bp, Artificial
  CRISPR gRNA sequence
attcattcaatcaatatggt

SEQ ID NO: 633525 - DNA, 20 bp, Artificial
  CRISPR gRNA sequence
attcaatcaatatggtatat

SEQ ID NO: 633526 - DNA, 20 bp, Artificial
  CRISPR gRNA sequence
aatcaatatggtatataagg

SEQ ID NO: 633527 - DNA, 20 bp, Artificial
  CRISPR gRNA sequence
ttctttgagatgctggatct

SEQ ID NO: 633528 - DNA, 20 bp, Artificial
  CRISPR gRNA sequence
ctttgagatgctggatctag

SEQ ID NO: 633529 - DNA, 20 bp, Artificial
  CRISPR gRNA sequence
tttgagatgctggatctagg

SEQ ID NO: 633530 - DNA, 20 bp, Artificial
  CRISPR gRNA sequence
tgagatgctggatctaggac

SEQ ID NO: 633531 - DNA, 20 bp, Artificial
  CRISPR gRNA sequence
gagatgctggatctaggacc

SEQ ID NO: 633532 - DNA, 20 bp, Artificial
  CRISPR gRNA sequence
agatgctggatctaggacct

SEQ ID NO: 633533 - DNA, 20 bp, Artificial
  CRISPR gRNA sequence
gatctaggaccttttattct

SEQ ID NO: 633534 - DNA, 20 bp, Artificial
  CRISPR gRNA sequence
ggaccttttattcttatcca

SEQ ID NO: 633535 - DNA, 20 bp, Artificial
  CRISPR gRNA sequence
ttattcttatccagttgctt

SEQ ID NO: 633536 - DNA, 20 bp, Artificial
  CRISPR gRNA sequence
tattcttatccagttgctta

SEQ ID NO: 633537 - DNA, 20 bp, Artificial
  CRISPR gRNA sequence
attcttatccagttgcttat

SEQ ID NO: 633538 - DNA, 20 bp, Artificial
  CRISPR gRNA sequence
ttcttatccagttgcttata

SEQ ID NO: 633539 - DNA, 20 bp, Artificial
  CRISPR gRNA sequence
ttatccagttgcttataatc

SEQ ID NO: 633540 - DNA, 20 bp, Artificial
  CRISPR gRNA sequence
atccagttgcttataatcat

SEQ ID NO: 633541 - DNA, 20 bp, Artificial
  CRISPR gRNA sequence
tccagttgcttataatcatt

SEQ ID NO: 633542 - DNA, 20 bp, Artificial
  CRISPR gRNA sequence
cttataatcattatcatcat

SEQ ID NO: 633543 - DNA, 20 bp, Artificial
  CRISPR gRNA sequence
ataatcattatcatcatatt

SEQ ID NO: 633544 - DNA, 20 bp, Artificial
  CRISPR gRNA sequence
taatcattatcatcatattt

SEQ ID NO: 633545 - DNA, 20 bp, Artificial
  CRISPR gRNA sequence
tcatcatatttctatacaat

SEQ ID NO: 633546 - DNA, 20 bp, Artificial
  CRISPR gRNA sequence
ctatacaatttaaaaggact

SEQ ID NO: 633547 - DNA, 20 bp, Artificial
  CRISPR gRNA sequence
tatacaatttaaaaggactc

SEQ ID NO: 633548 - DNA, 20 bp, Artificial
  CRISPR gRNA sequence
tacaatttaaaaggactcca

SEQ ID NO: 633549 - DNA, 20 bp, Artificial
  CRISPR gRNA sequence
aaaaggactccactctgata

SEQ ID NO: 633550 - DNA, 20 bp, Artificial
  CRISPR gRNA sequence
aaaggactccactctgatag

SEQ ID NO: 633551 - DNA, 20 bp, Artificial
  CRISPR gRNA sequence
cactctgatagatttctgat

SEQ ID NO: 633552 - DNA, 20 bp, Artificial
  CRISPR gRNA sequence
tgatagatttctgatacctt

SEQ ID NO: 633553 - DNA, 20 bp, Artificial
  CRISPR gRNA sequence
atagatttctgataccttac

SEQ ID NO: 633554 - DNA, 20 bp, Artificial
  CRISPR gRNA sequence
ctgataccttacataaaact

SEQ ID NO: 633555 - DNA, 20 bp, Artificial
  CRISPR gRNA sequence
tgataccttacataaaactt

SEQ ID NO: 633556 - DNA, 20 bp, Artificial
  CRISPR gRNA sequence
ataccttacataaaacttta

SEQ ID NO: 633557 - DNA, 20 bp, Artificial
  CRISPR gRNA sequence
acataaaactttaattatat

SEQ ID NO: 633558 - DNA, 20 bp, Artificial
  CRISPR gRNA sequence
cataaaactttaattatatt

SEQ ID NO: 633559 - DNA, 20 bp, Artificial
  CRISPR gRNA sequence
taattatattctaaatatat

SEQ ID NO: 633560 - DNA, 20 bp, Artificial
  CRISPR gRNA sequence
aattatattctaaatatatt

SEQ ID NO: 633561 - DNA, 20 bp, Artificial
  CRISPR gRNA sequence
attatattctaaatatattt

SEQ ID NO: 633562 - DNA, 20 bp, Artificial
  CRISPR gRNA sequence
tattctaaatatattttaca

SEQ ID NO: 633563 - DNA, 20 bp, Artificial
  CRISPR gRNA sequence
taaatatattttacatgctt

SEQ ID NO: 633564 - DNA, 20 bp, Artificial
  CRISPR gRNA sequence
aatatattttacatgcttat

SEQ ID NO: 633565 - DNA, 20 bp, Artificial
  CRISPR gRNA sequence
tacatgcttatgatgaatga

SEQ ID NO: 633566 - DNA, 20 bp, Artificial
  CRISPR gRNA sequence
acatgcttatgatgaatgat

SEQ ID NO: 633567 - DNA, 20 bp, Artificial
  CRISPR gRNA sequence
catgcttatgatgaatgata

SEQ ID NO: 633568 - DNA, 20 bp, Artificial
  CRISPR gRNA sequence
atgatgaatgatacttggtt

SEQ ID NO: 633569 - DNA, 20 bp, Artificial
  CRISPR gRNA sequence
tgatgaatgatacttggttt

SEQ ID NO: 633570 - DNA, 20 bp, Artificial
  CRISPR gRNA sequence
ggtttttatctttcttattt

SEQ ID NO: 633571 - DNA, 20 bp, Artificial
  CRISPR gRNA sequence
gtttttatctttcttatttg

SEQ ID NO: 633572 - DNA, 20 bp, Artificial
  CRISPR gRNA sequence
ttatctttcttatttgtctg

SEQ ID NO: 633573 - DNA, 20 bp, Artificial
  CRISPR gRNA sequence
tatctttcttatttgtctga

SEQ ID NO: 633574 - DNA, 20 bp, Artificial
  CRISPR gRNA sequence
atctttcttatttgtctgat

SEQ ID NO: 633575 - DNA, 20 bp, Artificial
  CRISPR gRNA sequence
tctttcttatttgtctgatt

SEQ ID NO: 633576 - DNA, 20 bp, Artificial
  CRISPR gRNA sequence
tcttatttgtctgattttct

SEQ ID NO: 633577 - DNA, 20 bp, Artificial
  CRISPR gRNA sequence
cttatttgtctgattttcta

SEQ ID NO: 633578 - DNA, 20 bp, Artificial
  CRISPR gRNA sequence
ttatttgtctgattttctac

SEQ ID NO: 633579 - DNA, 20 bp, Artificial
  CRISPR gRNA sequence
atttgtctgattttctacca

SEQ ID NO: 633580 - DNA, 20 bp, Artificial
  CRISPR gRNA sequence
tttgtctgattttctaccat

SEQ ID NO: 633581 - DNA, 20 bp, Artificial
  CRISPR gRNA sequence
gtctgattttctaccatttg

SEQ ID NO: 633582 - DNA, 20 bp, Artificial
  CRISPR gRNA sequence
tctgattttctaccatttga

SEQ ID NO: 633583 - DNA, 20 bp, Artificial
  CRISPR gRNA sequence
attttctaccatttgagagt

SEQ ID NO: 633584 - DNA, 20 bp, Artificial
  CRISPR gRNA sequence
tctaccatttgagagttttc

SEQ ID NO: 633585 - DNA, 20 bp, Artificial
  CRISPR gRNA sequence
ctaccatttgagagttttct

SEQ ID NO: 633586 - DNA, 20 bp, Artificial
  CRISPR gRNA sequence
taccatttgagagttttctt

SEQ ID NO: 633587 - DNA, 20 bp, Artificial
  CRISPR gRNA sequence
ccatttgagagttttcttac

SEQ ID NO: 633588 - DNA, 20 bp, Artificial
  CRISPR gRNA sequence
gagagttttcttacagtatt

SEQ ID NO: 633589 - DNA, 20 bp, Artificial
  CRISPR gRNA sequence
agagttttcttacagtattt

SEQ ID NO: 633590 - DNA, 20 bp, Artificial
  CRISPR gRNA sequence
tcttacagtatttggcaaga

SEQ ID NO: 633591 - DNA, 20 bp, Artificial
  CRISPR gRNA sequence
cttacagtatttggcaagat

SEQ ID NO: 633592 - DNA, 20 bp, Artificial
  CRISPR gRNA sequence
ttacagtatttggcaagata

SEQ ID NO: 633593 - DNA, 20 bp, Artificial
  CRISPR gRNA sequence
acagtatttggcaagatagt

SEQ ID NO: 633594 - DNA, 20 bp, Artificial
  CRISPR gRNA sequence
cagtatttggcaagatagta

SEQ ID NO: 633595 - DNA, 20 bp, Artificial
  CRISPR gRNA sequence
ggcaagatagtataggctgt

SEQ ID NO: 633596 - DNA, 20 bp, Artificial
  CRISPR gRNA sequence
gcaagatagtataggctgtg

SEQ ID NO: 633597 - DNA, 20 bp, Artificial
  CRISPR gRNA sequence
tggatgaacaggtttctttg

SEQ ID NO: 633598 - DNA, 20 bp, Artificial
  CRISPR gRNA sequence
ctttgactcacatacacaga

SEQ ID NO: 633599 - DNA, 20 bp, Artificial
  CRISPR gRNA sequence
tttgactcacatacacagat

SEQ ID NO: 633600 - DNA, 20 bp, Artificial
  CRISPR gRNA sequence
tgactcacatacacagatca

SEQ ID NO: 633601 - DNA, 20 bp, Artificial
  CRISPR gRNA sequence
gactcacatacacagatcaa

SEQ ID NO: 633602 - DNA, 20 bp, Artificial
  CRISPR gRNA sequence
actcacatacacagatcaag

SEQ ID NO: 633603 - DNA, 20 bp, Artificial
  CRISPR gRNA sequence
acatacacagatcaagtagg

SEQ ID NO: 633604 - DNA, 20 bp, Artificial
  CRISPR gRNA sequence
aaagaaatggtaaaggttag

SEQ ID NO: 633605 - DNA, 20 bp, Artificial
  CRISPR gRNA sequence
ggttagaaaaaaacatccaa

SEQ ID NO: 633606 - DNA, 20 bp, Artificial
  CRISPR gRNA sequence
gaaaaaaacatccaaacaaa

SEQ ID NO: 633607 - DNA, 20 bp, Artificial
  CRISPR gRNA sequence
ctggatactaggtgagtaat

SEQ ID NO: 633608 - DNA, 20 bp, Artificial
  CRISPR gRNA sequence
tggatactaggtgagtaata

SEQ ID NO: 633609 - DNA, 20 bp, Artificial
  CRISPR gRNA sequence
gatactaggtgagtaataaa

SEQ ID NO: 633610 - DNA, 20 bp, Artificial
  CRISPR gRNA sequence
ggtgagtaataaagtttgcg

SEQ ID NO: 633611 - DNA, 20 bp, Artificial
  CRISPR gRNA sequence
gcgtgcagcctctccacttc

SEQ ID NO: 633612 - DNA, 20 bp, Artificial
  CRISPR gRNA sequence
cgtgcagcctctccacttct

SEQ ID NO: 633613 - DNA, 20 bp, Artificial
  CRISPR gRNA sequence
tccacttctgttgtggagtt

SEQ ID NO: 633614 - DNA, 20 bp, Artificial
  CRISPR gRNA sequence
cacttctgttgtggagttcc

SEQ ID NO: 633615 - DNA, 20 bp, Artificial
  CRISPR gRNA sequence
ctgttgtggagttccaaaca

SEQ ID NO: 633616 - DNA, 20 bp, Artificial
  CRISPR gRNA sequence
tgttgtggagttccaaacat

SEQ ID NO: 633617 - DNA, 20 bp, Artificial
  CRISPR gRNA sequence
ttgtggagttccaaacatgc

SEQ ID NO: 633618 - DNA, 20 bp, Artificial
  CRISPR gRNA sequence
tggagttccaaacatgccag

SEQ ID NO: 633619 - DNA, 20 bp, Artificial
  CRISPR gRNA sequence
caaacatgccaggcctgcag

SEQ ID NO: 633620 - DNA, 20 bp, Artificial
  CRISPR gRNA sequence
cagactcatggtgtggaagg

SEQ ID NO: 633621 - DNA, 20 bp, Artificial
  CRISPR gRNA sequence
atggtgtggaagggaaaatg

SEQ ID NO: 633622 - DNA, 20 bp, Artificial
  CRISPR gRNA sequence
agactgtccacactaaatcc

SEQ ID NO: 633623 - DNA, 20 bp, Artificial
  CRISPR gRNA sequence
tccacactaaatccatgcag

SEQ ID NO: 633624 - DNA, 20 bp, Artificial
  CRISPR gRNA sequence
aatccatgcagggtacaaaa

SEQ ID NO: 633625 - DNA, 20 bp, Artificial
  CRISPR gRNA sequence
tggtagcaagctttggaatg

SEQ ID NO: 633626 - DNA, 20 bp, Artificial
  CRISPR gRNA sequence
tggaatgaggacagtgtaga

SEQ ID NO: 633627 - DNA, 20 bp, Artificial
  CRISPR gRNA sequence
ggaatgaggacagtgtagat

SEQ ID NO: 633628 - DNA, 20 bp, Artificial
  CRISPR gRNA sequence
gaatgaggacagtgtagatt

SEQ ID NO: 633629 - DNA, 20 bp, Artificial
  CRISPR gRNA sequence
ttcagaacaatgagaaagca

SEQ ID NO: 633630 - DNA, 20 bp, Artificial
  CRISPR gRNA sequence
agaacaatgagaaagcagct

SEQ ID NO: 633631 - DNA, 20 bp, Artificial
  CRISPR gRNA sequence
agaatcttgtccatttcttt

SEQ ID NO: 633632 - DNA, 20 bp, Artificial
  CRISPR gRNA sequence
gtccatttctttagaactcc

SEQ ID NO: 633633 - DNA, 20 bp, Artificial
  CRISPR gRNA sequence
tccatttctttagaactcct

SEQ ID NO: 633634 - DNA, 20 bp, Artificial
  CRISPR gRNA sequence
ctttagaactcctgataata

SEQ ID NO: 633635 - DNA, 20 bp, Artificial
  CRISPR gRNA sequence
tttagaactcctgataataa

SEQ ID NO: 633636 - DNA, 20 bp, Artificial
  CRISPR gRNA sequence
tagaactcctgataataaag

SEQ ID NO: 633637 - DNA, 20 bp, Artificial
  CRISPR gRNA sequence
agaactcctgataataaagg

SEQ ID NO: 633638 - DNA, 20 bp, Artificial
  CRISPR gRNA sequence
gaactcctgataataaagga

SEQ ID NO: 633639 - DNA, 20 bp, Artificial
  CRISPR gRNA sequence
ctgataataaaggaggaagg

SEQ ID NO: 633640 - DNA, 20 bp, Artificial
  CRISPR gRNA sequence
ataataaaggaggaaggaaa

SEQ ID NO: 633641 - DNA, 20 bp, Artificial
  CRISPR gRNA sequence
cctacaataaattgatcttc

SEQ ID NO: 633642 - DNA, 20 bp, Artificial
  CRISPR gRNA sequence
ctacaataaattgatcttct

SEQ ID NO: 633643 - DNA, 20 bp, Artificial
  CRISPR gRNA sequence
caataaattgatcttctaaa

SEQ ID NO: 633644 - DNA, 20 bp, Artificial
  CRISPR gRNA sequence
atcttctaaatgacttgcac

SEQ ID NO: 633645 - DNA, 20 bp, Artificial
  CRISPR gRNA sequence
ctaaatgacttgcaccaaag

SEQ ID NO: 633646 - DNA, 20 bp, Artificial
  CRISPR gRNA sequence
taaatgacttgcaccaaagt

SEQ ID NO: 633647 - DNA, 20 bp, Artificial
  CRISPR gRNA sequence
aatgacttgcaccaaagtga

SEQ ID NO: 633648 - DNA, 20 bp, Artificial
  CRISPR gRNA sequence
gcaccaaagtgaaaagagct

SEQ ID NO: 633649 - DNA, 20 bp, Artificial
  CRISPR gRNA sequence
caccaaagtgaaaagagctg

SEQ ID NO: 633650 - DNA, 20 bp, Artificial
  CRISPR gRNA sequence
catagaattataaaagaaag

SEQ ID NO: 633651 - DNA, 20 bp, Artificial
  CRISPR gRNA sequence
taaaagaaaggcttattaat

SEQ ID NO: 633652 - DNA, 20 bp, Artificial
  CRISPR gRNA sequence
attaattccttctagaaata

SEQ ID NO: 633653 - DNA, 20 bp, Artificial
  CRISPR gRNA sequence
ttaattccttctagaaatag

SEQ ID NO: 633654 - DNA, 20 bp, Artificial
  CRISPR gRNA sequence
attccttctagaaatagggt

SEQ ID NO: 633655 - DNA, 20 bp, Artificial
  CRISPR gRNA sequence
cttctagaaatagggtctga

SEQ ID NO: 633656 - DNA, 20 bp, Artificial
  CRISPR gRNA sequence
ctagaaatagggtctgaaag

SEQ ID NO: 633657 - DNA, 20 bp, Artificial
  CRISPR gRNA sequence
tagaaatagggtctgaaaga

SEQ ID NO: 633658 - DNA, 20 bp, Artificial
  CRISPR gRNA sequence
gaaatagggtctgaaagaag

SEQ ID NO: 633659 - DNA, 20 bp, Artificial
  CRISPR gRNA sequence
aaagaagcatgactactaca

SEQ ID NO: 633660 - DNA, 20 bp, Artificial
  CRISPR gRNA sequence
ctacaattcataaaagatgt

SEQ ID NO: 633661 - DNA, 20 bp, Artificial
  CRISPR gRNA sequence
caattcataaaagatgtgat

SEQ ID NO: 633662 - DNA, 20 bp, Artificial
  CRISPR gRNA sequence
ataaaagatgtgattgtata

SEQ ID NO: 633663 - DNA, 20 bp, Artificial
  CRISPR gRNA sequence
tatatgctattaaaagtttt

SEQ ID NO: 633664 - DNA, 20 bp, Artificial
  CRISPR gRNA sequence
ttaaaagttttactttcttt

SEQ ID NO: 633665 - DNA, 20 bp, Artificial
  CRISPR gRNA sequence
aaagttttactttcttttat

SEQ ID NO: 633666 - DNA, 20 bp, Artificial
  CRISPR gRNA sequence
tactttcttttattagaaac

SEQ ID NO: 633667 - DNA, 20 bp, Artificial
  CRISPR gRNA sequence
actttcttttattagaaaca

SEQ ID NO: 633668 - DNA, 20 bp, Artificial
  CRISPR gRNA sequence
ctttcttttattagaaacaa

SEQ ID NO: 633669 - DNA, 20 bp, Artificial
  CRISPR gRNA sequence
tcttttattagaaacaataa

SEQ ID NO: 633670 - DNA, 20 bp, Artificial
  CRISPR gRNA sequence
cttttattagaaacaataac

SEQ ID NO: 633671 - DNA, 20 bp, Artificial
  CRISPR gRNA sequence
ttttattagaaacaataacg

SEQ ID NO: 633672 - DNA, 20 bp, Artificial
  CRISPR gRNA sequence
ttattagaaacaataacgaa

SEQ ID NO: 633673 - DNA, 20 bp, Artificial
  CRISPR gRNA sequence
tattagaaacaataacgaag

SEQ ID NO: 633674 - DNA, 20 bp, Artificial
  CRISPR gRNA sequence
attagaaacaataacgaaga

SEQ ID NO: 633675 - DNA, 20 bp, Artificial
  CRISPR gRNA sequence
ttagaaacaataacgaagag

SEQ ID NO: 633676 - DNA, 20 bp, Artificial
  CRISPR gRNA sequence
gaaacaataacgaagagtag

SEQ ID NO: 633677 - DNA, 20 bp, Artificial
  CRISPR gRNA sequence
ttggtctggggtagggggaa

SEQ ID NO: 633678 - DNA, 20 bp, Artificial
  CRISPR gRNA sequence
gtctggggtagggggaaaga

SEQ ID NO: 633679 - DNA, 20 bp, Artificial
  CRISPR gRNA sequence
gggtagggggaaagaggcgt

SEQ ID NO: 633680 - DNA, 20 bp, Artificial
  CRISPR gRNA sequence
tacctggtggaaatcaaatg

SEQ ID NO: 633681 - DNA, 20 bp, Artificial
  CRISPR gRNA sequence
cctggtggaaatcaaatggg

SEQ ID NO: 633682 - DNA, 20 bp, Artificial
  CRISPR gRNA sequence
gtggaaatcaaatgggctgt

SEQ ID NO: 633683 - DNA, 20 bp, Artificial
  CRISPR gRNA sequence
tcttacagccggcctgactg

SEQ ID NO: 633684 - DNA, 20 bp, Artificial
  CRISPR gRNA sequence
acagccggcctgactgaaag

SEQ ID NO: 633685 - DNA, 20 bp, Artificial
  CRISPR gRNA sequence
cagccggcctgactgaaagt

SEQ ID NO: 633686 - DNA, 20 bp, Artificial
  CRISPR gRNA sequence
actgaaagtggcttttacct

SEQ ID NO: 633687 - DNA, 20 bp, Artificial
  CRISPR gRNA sequence
aaagtggcttttaccttcta

SEQ ID NO: 633688 - DNA, 20 bp, Artificial
  CRISPR gRNA sequence
ttaccttctaggtaaatttc

SEQ ID NO: 633689 - DNA, 20 bp, Artificial
  CRISPR gRNA sequence
taccttctaggtaaatttca

SEQ ID NO: 633690 - DNA, 20 bp, Artificial
  CRISPR gRNA sequence
accttctaggtaaatttcaa

SEQ ID NO: 633691 - DNA, 20 bp, Artificial
  CRISPR gRNA sequence
ccttctaggtaaatttcaat

SEQ ID NO: 633692 - DNA, 20 bp, Artificial
  CRISPR gRNA sequence
ctaggtaaatttcaatgagt

SEQ ID NO: 633693 - DNA, 20 bp, Artificial
  CRISPR gRNA sequence
taggtaaatttcaatgagta

SEQ ID NO: 633694 - DNA, 20 bp, Artificial
  CRISPR gRNA sequence
ggtaaatttcaatgagtagg

SEQ ID NO: 633695 - DNA, 20 bp, Artificial
  CRISPR gRNA sequence
caatgagtaggacctcaagt

SEQ ID NO: 633696 - DNA, 20 bp, Artificial
  CRISPR gRNA sequence
aatgagtaggacctcaagtg

SEQ ID NO: 633697 - DNA, 20 bp, Artificial
  CRISPR gRNA sequence
aagtgtgtgttttaagagtc

SEQ ID NO: 633698 - DNA, 20 bp, Artificial
  CRISPR gRNA sequence
taagagtcaagaatgaaaat

SEQ ID NO: 633699 - DNA, 20 bp, Artificial
  CRISPR gRNA sequence
aagagtcaagaatgaaaata

SEQ ID NO: 633700 - DNA, 20 bp, Artificial
  CRISPR gRNA sequence
agagtcaagaatgaaaatat

SEQ ID NO: 633701 - DNA, 20 bp, Artificial
  CRISPR gRNA sequence
atcccatctcctttcttcag

SEQ ID NO: 633702 - DNA, 20 bp, Artificial
  CRISPR gRNA sequence
ctttcttcagtgtttattgc

SEQ ID NO: 633703 - DNA, 20 bp, Artificial
  CRISPR gRNA sequence
tcttcagtgtttattgcaaa

SEQ ID NO: 633704 - DNA, 20 bp, Artificial
  CRISPR gRNA sequence
cttcagtgtttattgcaaag

SEQ ID NO: 633705 - DNA, 20 bp, Artificial
  CRISPR gRNA sequence
ttcagtgtttattgcaaagc

SEQ ID NO: 633706 - DNA, 20 bp, Artificial
  CRISPR gRNA sequence
cagtgtttattgcaaagcat

SEQ ID NO: 633707 - DNA, 20 bp, Artificial
  CRISPR gRNA sequence
agtgtttattgcaaagcata

SEQ ID NO: 633708 - DNA, 20 bp, Artificial
  CRISPR gRNA sequence
attgcaaagcatacagtgag

SEQ ID NO: 633709 - DNA, 20 bp, Artificial
  CRISPR gRNA sequence
ttgcaaagcatacagtgagg

SEQ ID NO: 633710 - DNA, 20 bp, Artificial
  CRISPR gRNA sequence
caaagcatacagtgaggcac

SEQ ID NO: 633711 - DNA, 20 bp, Artificial
  CRISPR gRNA sequence
gatggatgaaatcagcacag

SEQ ID NO: 633712 - DNA, 20 bp, Artificial
  CRISPR gRNA sequence
atggatgaaatcagcacagc

SEQ ID NO: 633713 - DNA, 20 bp, Artificial
  CRISPR gRNA sequence
tgcaaatcatgtgtgcaact

SEQ ID NO: 633714 - DNA, 20 bp, Artificial
  CRISPR gRNA sequence
acactgcttgtgtaattatc

SEQ ID NO: 633715 - DNA, 20 bp, Artificial
  CRISPR gRNA sequence
cttgtgtaattatcagtata

SEQ ID NO: 633716 - DNA, 20 bp, Artificial
  CRISPR gRNA sequence
gtgtaattatcagtataatc

SEQ ID NO: 633717 - DNA, 20 bp, Artificial
  CRISPR gRNA sequence
tgtaattatcagtataatcc

SEQ ID NO: 633718 - DNA, 20 bp, Artificial
  CRISPR gRNA sequence
tcagtataatccacctctat

SEQ ID NO: 633719 - DNA, 20 bp, Artificial
  CRISPR gRNA sequence
tatcagccacctccaggaag

SEQ ID NO: 633720 - DNA, 20 bp, Artificial
  CRISPR gRNA sequence
tcagccacctccaggaagga

SEQ ID NO: 633721 - DNA, 20 bp, Artificial
  CRISPR gRNA sequence
caggaaggaaaggaggggct

SEQ ID NO: 633722 - DNA, 20 bp, Artificial
  CRISPR gRNA sequence
agggtagggaaagttcacac

SEQ ID NO: 633723 - DNA, 20 bp, Artificial
  CRISPR gRNA sequence
acacttgggagatcacccag

SEQ ID NO: 633724 - DNA, 20 bp, Artificial
  CRISPR gRNA sequence
gggagatcacccagaaagtg

SEQ ID NO: 633725 - DNA, 20 bp, Artificial
  CRISPR gRNA sequence
ggagatcacccagaaagtgg

SEQ ID NO: 633726 - DNA, 20 bp, Artificial
  CRISPR gRNA sequence
caatcagtttaaaatagttc

SEQ ID NO: 633727 - DNA, 20 bp, Artificial
  CRISPR gRNA sequence
aaaatagttccttctcatga

SEQ ID NO: 633728 - DNA, 20 bp, Artificial
  CRISPR gRNA sequence
aaatagttccttctcatgag

SEQ ID NO: 633729 - DNA, 20 bp, Artificial
  CRISPR gRNA sequence
cttctcatgagaagcctgca

SEQ ID NO: 633730 - DNA, 20 bp, Artificial
  CRISPR gRNA sequence
ctcatgagaagcctgcaaga

SEQ ID NO: 633731 - DNA, 20 bp, Artificial
  CRISPR gRNA sequence
tcatgagaagcctgcaagac

SEQ ID NO: 633732 - DNA, 20 bp, Artificial
  CRISPR gRNA sequence
atgagaagcctgcaagacaa

SEQ ID NO: 633733 - DNA, 20 bp, Artificial
  CRISPR gRNA sequence
caagacaaattatactacat

SEQ ID NO: 633734 - DNA, 20 bp, Artificial
  CRISPR gRNA sequence
tactacatttaatgcaccat

SEQ ID NO: 633735 - DNA, 20 bp, Artificial
  CRISPR gRNA sequence
catttaatgcaccatcacta

SEQ ID NO: 633736 - DNA, 20 bp, Artificial
  CRISPR gRNA sequence
aatgcaccatcactattatg

SEQ ID NO: 633737 - DNA, 20 bp, Artificial
  CRISPR gRNA sequence
atgcaccatcactattatga

SEQ ID NO: 633738 - DNA, 20 bp, Artificial
  CRISPR gRNA sequence
ttatgaatgagctgcactgg

SEQ ID NO: 633739 - DNA, 20 bp, Artificial
  CRISPR gRNA sequence
tgaatgagctgcactggatt

SEQ ID NO: 633740 - DNA, 20 bp, Artificial
  CRISPR gRNA sequence
cactggattcaatttctaaa

SEQ ID NO: 633741 - DNA, 20 bp, Artificial
  CRISPR gRNA sequence
gattcaatttctaaaccagc

SEQ ID NO: 633742 - DNA, 20 bp, Artificial
  CRISPR gRNA sequence
aatttctaaaccagcataat

SEQ ID NO: 633743 - DNA, 20 bp, Artificial
  CRISPR gRNA sequence
ctaaaccagcataatttaat

SEQ ID NO: 633744 - DNA, 20 bp, Artificial
  CRISPR gRNA sequence
taaaccagcataatttaatt

SEQ ID NO: 633745 - DNA, 20 bp, Artificial
  CRISPR gRNA sequence
aaccagcataatttaattca

SEQ ID NO: 633746 - DNA, 20 bp, Artificial
  CRISPR gRNA sequence
aattcaatgtttctatcctt

SEQ ID NO: 633747 - DNA, 20 bp, Artificial
  CRISPR gRNA sequence
attcaatgtttctatcctta

SEQ ID NO: 633748 - DNA, 20 bp, Artificial
  CRISPR gRNA sequence
aatgtttctatccttaaaaa

SEQ ID NO: 633749 - DNA, 20 bp, Artificial
  CRISPR gRNA sequence
ctatccttaaaaaaaaaaaa

SEQ ID NO: 633750 - DNA, 20 bp, Artificial
  CRISPR gRNA sequence
tatccttaaaaaaaaaaaaa

SEQ ID NO: 633751 - DNA, 20 bp, Artificial
  CRISPR gRNA sequence
tccttaaaaaaaaaaaaaaa

SEQ ID NO: 633752 - DNA, 20 bp, Artificial
  CRISPR gRNA sequence
aaaaaaaaaaaaaaagtcat

SEQ ID NO: 633753 - DNA, 20 bp, Artificial
  CRISPR gRNA sequence
aaaaaaaaaaaaaagtcatg

SEQ ID NO: 633754 - DNA, 20 bp, Artificial
  CRISPR gRNA sequence
ttttgttttgttttcttttc

SEQ ID NO: 633755 - DNA, 20 bp, Artificial
  CRISPR gRNA sequence
tgttttgttttcttttcttt

SEQ ID NO: 633756 - DNA, 20 bp, Artificial
  CRISPR gRNA sequence
gttttgttttcttttctttt

SEQ ID NO: 633757 - DNA, 20 bp, Artificial
  CRISPR gRNA sequence
ttttgttttcttttcttttc

SEQ ID NO: 633758 - DNA, 20 bp, Artificial
  CRISPR gRNA sequence
tgttttcttttcttttcttt

SEQ ID NO: 633759 - DNA, 20 bp, Artificial
  CRISPR gRNA sequence
gttttcttttcttttctttt

SEQ ID NO: 633760 - DNA, 20 bp, Artificial
  CRISPR gRNA sequence
ttttcttttcttttcttttc

SEQ ID NO: 633761 - DNA, 20 bp, Artificial
  CRISPR gRNA sequence
tcttttcttttcttttcttt

SEQ ID NO: 633762 - DNA, 20 bp, Artificial
  CRISPR gRNA sequence
cttttcttttcttttctttt

SEQ ID NO: 633763 - DNA, 20 bp, Artificial
  CRISPR gRNA sequence
ttttcttttcttttcttttt

SEQ ID NO: 633764 - DNA, 20 bp, Artificial
  CRISPR gRNA sequence
ttcttttcttttcttttttg

SEQ ID NO: 633765 - DNA, 20 bp, Artificial
  CRISPR gRNA sequence
tcttttcttttcttttttga

SEQ ID NO: 633766 - DNA, 20 bp, Artificial
  CRISPR gRNA sequence
cttttcttttcttttttgag

SEQ ID NO: 633767 - DNA, 20 bp, Artificial
  CRISPR gRNA sequence
ttttcttttcttttttgaga

SEQ ID NO: 633768 - DNA, 20 bp, Artificial
  CRISPR gRNA sequence
ttcttttcttttttgagaca

SEQ ID NO: 633769 - DNA, 20 bp, Artificial
  CRISPR gRNA sequence
tcttttcttttttgagacag

SEQ ID NO: 633770 - DNA, 20 bp, Artificial
  CRISPR gRNA sequence
cttttcttttttgagacaga

SEQ ID NO: 633771 - DNA, 20 bp, Artificial
  CRISPR gRNA sequence
ttttcttttttgagacagag

SEQ ID NO: 633772 - DNA, 20 bp, Artificial
  CRISPR gRNA sequence
ttcttttttgagacagagtc

SEQ ID NO: 633773 - DNA, 20 bp, Artificial
  CRISPR gRNA sequence
tcttttttgagacagagtct

SEQ ID NO: 633774 - DNA, 20 bp, Artificial
  CRISPR gRNA sequence
cttttttgagacagagtctc

SEQ ID NO: 633775 - DNA, 20 bp, Artificial
  CRISPR gRNA sequence
ttttttgagacagagtctca

SEQ ID NO: 633776 - DNA, 20 bp, Artificial
  CRISPR gRNA sequence
ttttgagacagagtctcact

SEQ ID NO: 633777 - DNA, 20 bp, Artificial
  CRISPR gRNA sequence
tttgagacagagtctcactc

SEQ ID NO: 633778 - DNA, 20 bp, Artificial
  CRISPR gRNA sequence
ttgagacagagtctcactct

SEQ ID NO: 633779 - DNA, 20 bp, Artificial
  CRISPR gRNA sequence
tgagacagagtctcactctg

SEQ ID NO: 633780 - DNA, 20 bp, Artificial
  CRISPR gRNA sequence
gagacagagtctcactctgt

SEQ ID NO: 633781 - DNA, 20 bp, Artificial
  CRISPR gRNA sequence
agacagagtctcactctgtc

SEQ ID NO: 633782 - DNA, 20 bp, Artificial
  CRISPR gRNA sequence
actctgtcacccaggctgga

SEQ ID NO: 633783 - DNA, 20 bp, Artificial
  CRISPR gRNA sequence
tgtcacccaggctggagtgc

SEQ ID NO: 633784 - DNA, 20 bp, Artificial
  CRISPR gRNA sequence
tcacccaggctggagtgcag

SEQ ID NO: 633785 - DNA, 20 bp, Artificial
  CRISPR gRNA sequence
gagtgcagtggcaggatctc

SEQ ID NO: 633786 - DNA, 20 bp, Artificial
  CRISPR gRNA sequence
tgttcactacaagctccgcc

SEQ ID NO: 633787 - DNA, 20 bp, Artificial
  CRISPR gRNA sequence
ttcactacaagctccgcctc

SEQ ID NO: 633788 - DNA, 20 bp, Artificial
  CRISPR gRNA sequence
actacaagctccgcctccca

SEQ ID NO: 633789 - DNA, 20 bp, Artificial
  CRISPR gRNA sequence
caagctccgcctcccagatg

SEQ ID NO: 633790 - DNA, 20 bp, Artificial
  CRISPR gRNA sequence
cgcctcccagatgcacgccg

SEQ ID NO: 633791 - DNA, 20 bp, Artificial
  CRISPR gRNA sequence
ccagatgcacgccgttctcc

SEQ ID NO: 633792 - DNA, 20 bp, Artificial
  CRISPR gRNA sequence
tcctgcctcagcctcccgta

SEQ ID NO: 633793 - DNA, 20 bp, Artificial
  CRISPR gRNA sequence
ctgcctcagcctcccgtagc

SEQ ID NO: 633794 - DNA, 20 bp, Artificial
  CRISPR gRNA sequence
cctcagcctcccgtagctgg

SEQ ID NO: 633795 - DNA, 20 bp, Artificial
  CRISPR gRNA sequence
agcctcccgtagctggaact

SEQ ID NO: 633796 - DNA, 20 bp, Artificial
  CRISPR gRNA sequence
ccgtagctggaactacaggg

SEQ ID NO: 633797 - DNA, 20 bp, Artificial
  CRISPR gRNA sequence
gaactacaggggcctgccac

SEQ ID NO: 633798 - DNA, 20 bp, Artificial
  CRISPR gRNA sequence
caggggcctgccaccacgcc

SEQ ID NO: 633799 - DNA, 20 bp, Artificial
  CRISPR gRNA sequence
ccaccacgcccagctaattt

SEQ ID NO: 633800 - DNA, 20 bp, Artificial
  CRISPR gRNA sequence
atttttttgtattttgagta

SEQ ID NO: 633801 - DNA, 20 bp, Artificial
  CRISPR gRNA sequence
ttttgtattttgagtagaga

SEQ ID NO: 633802 - DNA, 20 bp, Artificial
  CRISPR gRNA sequence
tttgtattttgagtagagac

SEQ ID NO: 633803 - DNA, 20 bp, Artificial
  CRISPR gRNA sequence
ttgtattttgagtagagacg

SEQ ID NO: 633804 - DNA, 20 bp, Artificial
  CRISPR gRNA sequence
tgtattttgagtagagacgg

SEQ ID NO: 633805 - DNA, 20 bp, Artificial
  CRISPR gRNA sequence
gtattttgagtagagacggg

SEQ ID NO: 633806 - DNA, 20 bp, Artificial
  CRISPR gRNA sequence
tattttgagtagagacgggg

SEQ ID NO: 633807 - DNA, 20 bp, Artificial
  CRISPR gRNA sequence
tgagtagagacggggtttca

SEQ ID NO: 633808 - DNA, 20 bp, Artificial
  CRISPR gRNA sequence
gagtagagacggggtttcac

SEQ ID NO: 633809 - DNA, 20 bp, Artificial
  CRISPR gRNA sequence
agtagagacggggtttcacc

SEQ ID NO: 633810 - DNA, 20 bp, Artificial
  CRISPR gRNA sequence
caccgtgttagccaggatgg

SEQ ID NO: 633811 - DNA, 20 bp, Artificial
  CRISPR gRNA sequence
accgtgttagccaggatggt

SEQ ID NO: 633812 - DNA, 20 bp, Artificial
  CRISPR gRNA sequence
gccaggatggtctcgatctc

SEQ ID NO: 633813 - DNA, 20 bp, Artificial
  CRISPR gRNA sequence
gatctcctggcctcgtgatc

SEQ ID NO: 633814 - DNA, 20 bp, Artificial
  CRISPR gRNA sequence
ctggcctcgtgatctgcccg

SEQ ID NO: 633815 - DNA, 20 bp, Artificial
  CRISPR gRNA sequence
gcctcgtgatctgcccgtct

SEQ ID NO: 633816 - DNA, 20 bp, Artificial
  CRISPR gRNA sequence
gtgatctgcccgtctcggcc

SEQ ID NO: 633817 - DNA, 20 bp, Artificial
  CRISPR gRNA sequence
cccgtctcggcctcccaaag

SEQ ID NO: 633818 - DNA, 20 bp, Artificial
  CRISPR gRNA sequence
ggcctcccaaagtgctgaga

SEQ ID NO: 633819 - DNA, 20 bp, Artificial
  CRISPR gRNA sequence
ccaaagtgctgagactacag

SEQ ID NO: 633820 - DNA, 20 bp, Artificial
  CRISPR gRNA sequence
agactacaggcgtgagccac

SEQ ID NO: 633821 - DNA, 20 bp, Artificial
  CRISPR gRNA sequence
caggcgtgagccaccgtgtc

SEQ ID NO: 633822 - DNA, 20 bp, Artificial
  CRISPR gRNA sequence
gtctggttttaaaataatgt

SEQ ID NO: 633823 - DNA, 20 bp, Artificial
  CRISPR gRNA sequence
gttttaaaataatgtaaata

SEQ ID NO: 633824 - DNA, 20 bp, Artificial
  CRISPR gRNA sequence
taaaataatgtaaataggaa

SEQ ID NO: 633825 - DNA, 20 bp, Artificial
  CRISPR gRNA sequence
aaaataatgtaaataggaaa

SEQ ID NO: 633826 - DNA, 20 bp, Artificial
  CRISPR gRNA sequence
aaataatgtaaataggaaaa

SEQ ID NO: 633827 - DNA, 20 bp, Artificial
  CRISPR gRNA sequence
tcataatcttctggccaagt

SEQ ID NO: 633828 - DNA, 20 bp, Artificial
  CRISPR gRNA sequence
ctggccaagtacctaatttt

SEQ ID NO: 633829 - DNA, 20 bp, Artificial
  CRISPR gRNA sequence
tggccaagtacctaattttc

SEQ ID NO: 633830 - DNA, 20 bp, Artificial
  CRISPR gRNA sequence
gccaagtacctaattttcag

SEQ ID NO: 633831 - DNA, 20 bp, Artificial
  CRISPR gRNA sequence
attttcagaaatttttgtcc

SEQ ID NO: 633832 - DNA, 20 bp, Artificial
  CRISPR gRNA sequence
tcagaaatttttgtcctcaa

SEQ ID NO: 633833 - DNA, 20 bp, Artificial
  CRISPR gRNA sequence
cagaaatttttgtcctcaat

SEQ ID NO: 633834 - DNA, 20 bp, Artificial
  CRISPR gRNA sequence
agaaatttttgtcctcaatc

SEQ ID NO: 633835 - DNA, 20 bp, Artificial
  CRISPR gRNA sequence
ttgtcctcaatcattccaca

SEQ ID NO: 633836 - DNA, 20 bp, Artificial
  CRISPR gRNA sequence
tgtcctcaatcattccacaa

SEQ ID NO: 633837 - DNA, 20 bp, Artificial
  CRISPR gRNA sequence
gtcctcaatcattccacaaa

SEQ ID NO: 633838 - DNA, 20 bp, Artificial
  CRISPR gRNA sequence
tcctcaatcattccacaaaa

SEQ ID NO: 633839 - DNA, 20 bp, Artificial
  CRISPR gRNA sequence
aatcattccacaaaactatc

SEQ ID NO: 633840 - DNA, 20 bp, Artificial
  CRISPR gRNA sequence
cacaaaactatcactactat

SEQ ID NO: 633841 - DNA, 20 bp, Artificial
  CRISPR gRNA sequence
tcactactattaatatccaa

SEQ ID NO: 633842 - DNA, 20 bp, Artificial
  CRISPR gRNA sequence
ctattaatatccaaaggtgt

SEQ ID NO: 633843 - DNA, 20 bp, Artificial
  CRISPR gRNA sequence
ttaatatccaaaggtgtata

SEQ ID NO: 633844 - DNA, 20 bp, Artificial
  CRISPR gRNA sequence
atatccaaaggtgtataact

SEQ ID NO: 633845 - DNA, 20 bp, Artificial
  CRISPR gRNA sequence
gcagctatcccatcttatac

SEQ ID NO: 633846 - DNA, 20 bp, Artificial
  CRISPR gRNA sequence
cagctatcccatcttataca

SEQ ID NO: 633847 - DNA, 20 bp, Artificial
  CRISPR gRNA sequence
tcccatcttatacaaaacat

SEQ ID NO: 633848 - DNA, 20 bp, Artificial
  CRISPR gRNA sequence
atacaaaacattttgcatga

SEQ ID NO: 633849 - DNA, 20 bp, Artificial
  CRISPR gRNA sequence
tacaaaacattttgcatgat

SEQ ID NO: 633850 - DNA, 20 bp, Artificial
  CRISPR gRNA sequence
tgcatgatacatacactgaa

SEQ ID NO: 633851 - DNA, 20 bp, Artificial
  CRISPR gRNA sequence
gcatgatacatacactgaag

SEQ ID NO: 633852 - DNA, 20 bp, Artificial
  CRISPR gRNA sequence
catgatacatacactgaaga

SEQ ID NO: 633853 - DNA, 20 bp, Artificial
  CRISPR gRNA sequence
aagaagttatttatgtactt

SEQ ID NO: 633854 - DNA, 20 bp, Artificial
  CRISPR gRNA sequence
tttatgtactttttttctgg

SEQ ID NO: 633855 - DNA, 20 bp, Artificial
  CRISPR gRNA sequence
atgtactttttttctggaag

SEQ ID NO: 633856 - DNA, 20 bp, Artificial
  CRISPR gRNA sequence
tgtactttttttctggaagt

SEQ ID NO: 633857 - DNA, 20 bp, Artificial
  CRISPR gRNA sequence
tttttctggaagtcattaca

SEQ ID NO: 633858 - DNA, 20 bp, Artificial
  CRISPR gRNA sequence
ttttctggaagtcattacaa

SEQ ID NO: 633859 - DNA, 20 bp, Artificial
  CRISPR gRNA sequence
tttctggaagtcattacaaa

SEQ ID NO: 633860 - DNA, 20 bp, Artificial
  CRISPR gRNA sequence
ttctggaagtcattacaaaa

SEQ ID NO: 633861 - DNA, 20 bp, Artificial
  CRISPR gRNA sequence
tctggaagtcattacaaaaa

SEQ ID NO: 633862 - DNA, 20 bp, Artificial
  CRISPR gRNA sequence
ctggaagtcattacaaaaaa

SEQ ID NO: 633863 - DNA, 20 bp, Artificial
  CRISPR gRNA sequence
tggaagtcattacaaaaaaa

SEQ ID NO: 633864 - DNA, 20 bp, Artificial
  CRISPR gRNA sequence
gaagtcattacaaaaaaaaa

SEQ ID NO: 633865 - DNA, 20 bp, Artificial
  CRISPR gRNA sequence
caaaaaaaaaaagtgaagta

SEQ ID NO: 633866 - DNA, 20 bp, Artificial
  CRISPR gRNA sequence
agggaaaaagaattataaga

SEQ ID NO: 633867 - DNA, 20 bp, Artificial
  CRISPR gRNA sequence
taagaaagacaagaaagagc

SEQ ID NO: 633868 - DNA, 20 bp, Artificial
  CRISPR gRNA sequence
aaaagaagaagggaagataa

SEQ ID NO: 633869 - DNA, 20 bp, Artificial
  CRISPR gRNA sequence
aaataaaacaaaatagaaac

SEQ ID NO: 633870 - DNA, 20 bp, Artificial
  CRISPR gRNA sequence
aataaaacaaaatagaaact

SEQ ID NO: 633871 - DNA, 20 bp, Artificial
  CRISPR gRNA sequence
gtgtattataaaagagagta

SEQ ID NO: 633872 - DNA, 20 bp, Artificial
  CRISPR gRNA sequence
taaaagagagtaagtgatga

SEQ ID NO: 633873 - DNA, 20 bp, Artificial
  CRISPR gRNA sequence
cagtacattagaaaatactt

SEQ ID NO: 633874 - DNA, 20 bp, Artificial
  CRISPR gRNA sequence
gaaaatactttagcttatga

SEQ ID NO: 633875 - DNA, 20 bp, Artificial
  CRISPR gRNA sequence
tagcttatgaaatcactgat

SEQ ID NO: 633876 - DNA, 20 bp, Artificial
  CRISPR gRNA sequence
agcttatgaaatcactgatc

SEQ ID NO: 633877 - DNA, 20 bp, Artificial
  CRISPR gRNA sequence
gcttatgaaatcactgatca

SEQ ID NO: 633878 - DNA, 20 bp, Artificial
  CRISPR gRNA sequence
atgaaatcactgatcagttg

SEQ ID NO: 633879 - DNA, 20 bp, Artificial
  CRISPR gRNA sequence
tgaaatcactgatcagttgt

SEQ ID NO: 633880 - DNA, 20 bp, Artificial
  CRISPR gRNA sequence
atcagttgtcaatttaaaga

SEQ ID NO: 633881 - DNA, 20 bp, Artificial
  CRISPR gRNA sequence
tcaatttaaagaaacgatgt

SEQ ID NO: 633882 - DNA, 20 bp, Artificial
  CRISPR gRNA sequence
aaagaaacgatgtgattgtg

SEQ ID NO: 633883 - DNA, 20 bp, Artificial
  CRISPR gRNA sequence
aagaaacgatgtgattgtga

SEQ ID NO: 633884 - DNA, 20 bp, Artificial
  CRISPR gRNA sequence
tgataataaattccttagta

SEQ ID NO: 633885 - DNA, 20 bp, Artificial
  CRISPR gRNA sequence
cttagtaagagacaacaatg

SEQ ID NO: 633886 - DNA, 20 bp, Artificial
  CRISPR gRNA sequence
agtaagagacaacaatgcgt

SEQ ID NO: 633887 - DNA, 20 bp, Artificial
  CRISPR gRNA sequence
gtaagagacaacaatgcgtt

SEQ ID NO: 633888 - DNA, 20 bp, Artificial
  CRISPR gRNA sequence
gagggtacactactctcatg

SEQ ID NO: 633889 - DNA, 20 bp, Artificial
  CRISPR gRNA sequence
agggtacactactctcatga

SEQ ID NO: 633890 - DNA, 20 bp, Artificial
  CRISPR gRNA sequence
ctctcatgacaaattaagag

SEQ ID NO: 633891 - DNA, 20 bp, Artificial
  CRISPR gRNA sequence
tcatgacaaattaagagact

SEQ ID NO: 633892 - DNA, 20 bp, Artificial
  CRISPR gRNA sequence
atgacaaattaagagactat

SEQ ID NO: 633893 - DNA, 20 bp, Artificial
  CRISPR gRNA sequence
agagactatttctatgagat

SEQ ID NO: 633894 - DNA, 20 bp, Artificial
  CRISPR gRNA sequence
tttctatgagatttaaaact

SEQ ID NO: 633895 - DNA, 20 bp, Artificial
  CRISPR gRNA sequence
ctatgagatttaaaactaga

SEQ ID NO: 633896 - DNA, 20 bp, Artificial
  CRISPR gRNA sequence
tatgagatttaaaactagag

SEQ ID NO: 633897 - DNA, 20 bp, Artificial
  CRISPR gRNA sequence
tgagatttaaaactagagca

SEQ ID NO: 633898 - DNA, 20 bp, Artificial
  CRISPR gRNA sequence
aaaactagagcaactaacat

SEQ ID NO: 633899 - DNA, 20 bp, Artificial
  CRISPR gRNA sequence
aaactagagcaactaacatt

SEQ ID NO: 633900 - DNA, 20 bp, Artificial
  CRISPR gRNA sequence
gagcaactaacattatgttg

SEQ ID NO: 633901 - DNA, 20 bp, Artificial
  CRISPR gRNA sequence
acattatgttgtttctttaa

SEQ ID NO: 633902 - DNA, 20 bp, Artificial
  CRISPR gRNA sequence
tgttgtttctttaaacaata

SEQ ID NO: 633903 - DNA, 20 bp, Artificial
  CRISPR gRNA sequence
tttctttaaacaatatggtc

SEQ ID NO: 633904 - DNA, 20 bp, Artificial
  CRISPR gRNA sequence
ctttaaacaatatggtcaaa

SEQ ID NO: 633905 - DNA, 20 bp, Artificial
  CRISPR gRNA sequence
tttaaacaatatggtcaaag

SEQ ID NO: 633906 - DNA, 20 bp, Artificial
  CRISPR gRNA sequence
taaacaatatggtcaaagat

SEQ ID NO: 633907 - DNA, 20 bp, Artificial
  CRISPR gRNA sequence
aaacaatatggtcaaagatg

SEQ ID NO: 633908 - DNA, 20 bp, Artificial
  CRISPR gRNA sequence
aacaatatggtcaaagatga

SEQ ID NO: 633909 - DNA, 20 bp, Artificial
  CRISPR gRNA sequence
catcttgatccaagccacat

SEQ ID NO: 633910 - DNA, 20 bp, Artificial
  CRISPR gRNA sequence
gatccaagccacatggtaat

SEQ ID NO: 633911 - DNA, 20 bp, Artificial
  CRISPR gRNA sequence
atccaagccacatggtaatt

SEQ ID NO: 633912 - DNA, 20 bp, Artificial
  CRISPR gRNA sequence
tttttttttatttttaagaa

SEQ ID NO: 633913 - DNA, 20 bp, Artificial
  CRISPR gRNA sequence
ttttttttatttttaagaaa

SEQ ID NO: 633914 - DNA, 20 bp, Artificial
  CRISPR gRNA sequence
tttttttatttttaagaaat

SEQ ID NO: 633915 - DNA, 20 bp, Artificial
  CRISPR gRNA sequence
ttttttatttttaagaaatt

SEQ ID NO: 633916 - DNA, 20 bp, Artificial
  CRISPR gRNA sequence
tttttatttttaagaaattt

SEQ ID NO: 633917 - DNA, 20 bp, Artificial
  CRISPR gRNA sequence
ttttatttttaagaaatttg

SEQ ID NO: 633918 - DNA, 20 bp, Artificial
  CRISPR gRNA sequence
tttatttttaagaaatttga

SEQ ID NO: 633919 - DNA, 20 bp, Artificial
  CRISPR gRNA sequence
ttatttttaagaaatttgaa

SEQ ID NO: 633920 - DNA, 20 bp, Artificial
  CRISPR gRNA sequence
tatttttaagaaatttgaag

SEQ ID NO: 633921 - DNA, 20 bp, Artificial
  CRISPR gRNA sequence
atttttaagaaatttgaaga

SEQ ID NO: 633922 - DNA, 20 bp, Artificial
  CRISPR gRNA sequence
tttttaagaaatttgaagat

SEQ ID NO: 633923 - DNA, 20 bp, Artificial
  CRISPR gRNA sequence
ttaagaaatttgaagatatg

SEQ ID NO: 633924 - DNA, 20 bp, Artificial
  CRISPR gRNA sequence
taagaaatttgaagatatga

SEQ ID NO: 633925 - DNA, 20 bp, Artificial
  CRISPR gRNA sequence
aagaaatttgaagatatgaa

SEQ ID NO: 633926 - DNA, 20 bp, Artificial
  CRISPR gRNA sequence
agaaatttgaagatatgaag

SEQ ID NO: 633927 - DNA, 20 bp, Artificial
  CRISPR gRNA sequence
gaagatatgaagaagaccat

SEQ ID NO: 633928 - DNA, 20 bp, Artificial
  CRISPR gRNA sequence
aagatatgaagaagaccatc

SEQ ID NO: 633929 - DNA, 20 bp, Artificial
  CRISPR gRNA sequence
gtcttaccagtttctctgag

SEQ ID NO: 633930 - DNA, 20 bp, Artificial
  CRISPR gRNA sequence
tcttaccagtttctctgagg

SEQ ID NO: 633931 - DNA, 20 bp, Artificial
  CRISPR gRNA sequence
accagtttctctgagggcat

SEQ ID NO: 633932 - DNA, 20 bp, Artificial
  CRISPR gRNA sequence
ccagtttctctgagggcatg

SEQ ID NO: 633933 - DNA, 20 bp, Artificial
  CRISPR gRNA sequence
ctctgagggcatgtagcata

SEQ ID NO: 633934 - DNA, 20 bp, Artificial
  CRISPR gRNA sequence
tctgagggcatgtagcatat

SEQ ID NO: 633935 - DNA, 20 bp, Artificial
  CRISPR gRNA sequence
tgagggcatgtagcatatac

SEQ ID NO: 633936 - DNA, 20 bp, Artificial
  CRISPR gRNA sequence
agggcatgtagcatatacct

SEQ ID NO: 633937 - DNA, 20 bp, Artificial
  CRISPR gRNA sequence
aaaaatgcatgttagtttga

SEQ ID NO: 633938 - DNA, 20 bp, Artificial
  CRISPR gRNA sequence
aaaatgcatgttagtttgaa

SEQ ID NO: 633939 - DNA, 20 bp, Artificial
  CRISPR gRNA sequence
gtttgaaattctattaaaga

SEQ ID NO: 633940 - DNA, 20 bp, Artificial
  CRISPR gRNA sequence
gaaattctattaaagataaa

SEQ ID NO: 633941 - DNA, 20 bp, Artificial
  CRISPR gRNA sequence
aaattctattaaagataaat

SEQ ID NO: 633942 - DNA, 20 bp, Artificial
  CRISPR gRNA sequence
tattaaagataaatgtggaa

SEQ ID NO: 633943 - DNA, 20 bp, Artificial
  CRISPR gRNA sequence
ttaaagataaatgtggaaat

SEQ ID NO: 633944 - DNA, 20 bp, Artificial
  CRISPR gRNA sequence
aagataaatgtggaaatata

SEQ ID NO: 633945 - DNA, 20 bp, Artificial
  CRISPR gRNA sequence
aaacataggatgagtcataa

SEQ ID NO: 633946 - DNA, 20 bp, Artificial
  CRISPR gRNA sequence
aacataggatgagtcataat

SEQ ID NO: 633947 - DNA, 20 bp, Artificial
  CRISPR gRNA sequence
tacaggaattttctcataat

SEQ ID NO: 633948 - DNA, 20 bp, Artificial
  CRISPR gRNA sequence
acaggaattttctcataata

SEQ ID NO: 633949 - DNA, 20 bp, Artificial
  CRISPR gRNA sequence
caggaattttctcataatag

SEQ ID NO: 633950 - DNA, 20 bp, Artificial
  CRISPR gRNA sequence
tctcataataggtgaaggca

SEQ ID NO: 633951 - DNA, 20 bp, Artificial
  CRISPR gRNA sequence
ctcataataggtgaaggcat

SEQ ID NO: 633952 - DNA, 20 bp, Artificial
  CRISPR gRNA sequence
tcataataggtgaaggcata

SEQ ID NO: 633953 - DNA, 20 bp, Artificial
  CRISPR gRNA sequence
ataataggtgaaggcataac

SEQ ID NO: 633954 - DNA, 20 bp, Artificial
  CRISPR gRNA sequence
aacaaaatataaactaggct

SEQ ID NO: 633955 - DNA, 20 bp, Artificial
  CRISPR gRNA sequence
ggctatttaattgggatttt

SEQ ID NO: 633956 - DNA, 20 bp, Artificial
  CRISPR gRNA sequence
tttaattgggatttttaaaa

SEQ ID NO: 633957 - DNA, 20 bp, Artificial
  CRISPR gRNA sequence
aattgggatttttaaaagtc

SEQ ID NO: 633958 - DNA, 20 bp, Artificial
  CRISPR gRNA sequence
attgggatttttaaaagtca

SEQ ID NO: 633959 - DNA, 20 bp, Artificial
  CRISPR gRNA sequence
ggatttttaaaagtcaatat

SEQ ID NO: 633960 - DNA, 20 bp, Artificial
  CRISPR gRNA sequence
ttaaaagtcaatattaggaa

SEQ ID NO: 633961 - DNA, 20 bp, Artificial
  CRISPR gRNA sequence
taaaagtcaatattaggaac

SEQ ID NO: 633962 - DNA, 20 bp, Artificial
  CRISPR gRNA sequence
aaaagtcaatattaggaact

SEQ ID NO: 633963 - DNA, 20 bp, Artificial
  CRISPR gRNA sequence
aaagtcaatattaggaacta

SEQ ID NO: 633964 - DNA, 20 bp, Artificial
  CRISPR gRNA sequence
ggaactagtataagcattca

SEQ ID NO: 633965 - DNA, 20 bp, Artificial
  CRISPR gRNA sequence
gtataagcattcaatatttc

SEQ ID NO: 633966 - DNA, 20 bp, Artificial
  CRISPR gRNA sequence
aatatttctgagctattttt

SEQ ID NO: 633967 - DNA, 20 bp, Artificial
  CRISPR gRNA sequence
ctgagctatttttgtggata

SEQ ID NO: 633968 - DNA, 20 bp, Artificial
  CRISPR gRNA sequence
tgagctatttttgtggataa

SEQ ID NO: 633969 - DNA, 20 bp, Artificial
  CRISPR gRNA sequence
agctatttttgtggataaaa

SEQ ID NO: 633970 - DNA, 20 bp, Artificial
  CRISPR gRNA sequence
tttttgtggataaaatatag

SEQ ID NO: 633971 - DNA, 20 bp, Artificial
  CRISPR gRNA sequence
ttgtggataaaatatagtcc

SEQ ID NO: 633972 - DNA, 20 bp, Artificial
  CRISPR gRNA sequence
tgtggataaaatatagtcct

SEQ ID NO: 633973 - DNA, 20 bp, Artificial
  CRISPR gRNA sequence
gtggataaaatatagtcctt

SEQ ID NO: 633974 - DNA, 20 bp, Artificial
  CRISPR gRNA sequence
tggataaaatatagtccttg

SEQ ID NO: 633975 - DNA, 20 bp, Artificial
  CRISPR gRNA sequence
ggaactatagggacttgaaa

SEQ ID NO: 633976 - DNA, 20 bp, Artificial
  CRISPR gRNA sequence
gaactatagggacttgaaaa

SEQ ID NO: 633977 - DNA, 20 bp, Artificial
  CRISPR gRNA sequence
tagggacttgaaaaataaag

SEQ ID NO: 633978 - DNA, 20 bp, Artificial
  CRISPR gRNA sequence
gaaaaataaagatagtccat

SEQ ID NO: 633979 - DNA, 20 bp, Artificial
  CRISPR gRNA sequence
aaaaataaagatagtccata

SEQ ID NO: 633980 - DNA, 20 bp, Artificial
  CRISPR gRNA sequence
aaaatgttttttagttggga

SEQ ID NO: 633981 - DNA, 20 bp, Artificial
  CRISPR gRNA sequence
tttagttgggaggaagttgt

SEQ ID NO: 633982 - DNA, 20 bp, Artificial
  CRISPR gRNA sequence
ttagttgggaggaagttgtt

SEQ ID NO: 633983 - DNA, 20 bp, Artificial
  CRISPR gRNA sequence
tagttgggaggaagttgttg

SEQ ID NO: 633984 - DNA, 20 bp, Artificial
  CRISPR gRNA sequence
agttgggaggaagttgttgt

SEQ ID NO: 633985 - DNA, 20 bp, Artificial
  CRISPR gRNA sequence
gttgggaggaagttgttgtt

SEQ ID NO: 633986 - DNA, 20 bp, Artificial
  CRISPR gRNA sequence
ggaggaagttgttgttttaa

SEQ ID NO: 633987 - DNA, 20 bp, Artificial
  CRISPR gRNA sequence
ttgttttaacagatggggat

SEQ ID NO: 633988 - DNA, 20 bp, Artificial
  CRISPR gRNA sequence
ttttaacagatggggattta

SEQ ID NO: 633989 - DNA, 20 bp, Artificial
  CRISPR gRNA sequence
taacagatggggatttatat

SEQ ID NO: 633990 - DNA, 20 bp, Artificial
  CRISPR gRNA sequence
aacagatggggatttatatg

SEQ ID NO: 633991 - DNA, 20 bp, Artificial
  CRISPR gRNA sequence
acagatggggatttatatgg

SEQ ID NO: 633992 - DNA, 20 bp, Artificial
  CRISPR gRNA sequence
atatggtacatctggtccag

SEQ ID NO: 633993 - DNA, 20 bp, Artificial
  CRISPR gRNA sequence
tatggtacatctggtccagt

SEQ ID NO: 633994 - DNA, 20 bp, Artificial
  CRISPR gRNA sequence
gtccagttcctttttatgga

SEQ ID NO: 633995 - DNA, 20 bp, Artificial
  CRISPR gRNA sequence
ctttttatggaacagaatag

SEQ ID NO: 633996 - DNA, 20 bp, Artificial
  CRISPR gRNA sequence
tttatggaacagaatagctt

SEQ ID NO: 633997 - DNA, 20 bp, Artificial
  CRISPR gRNA sequence
ttatggaacagaatagcttt

SEQ ID NO: 633998 - DNA, 20 bp, Artificial
  CRISPR gRNA sequence
tatggaacagaatagcttta

SEQ ID NO: 633999 - DNA, 20 bp, Artificial
  CRISPR gRNA sequence
atggaacagaatagctttaa

SEQ ID NO: 634000 - DNA, 20 bp, Artificial
  CRISPR gRNA sequence
tggaacagaatagctttaaa

SEQ ID NO: 634001 - DNA, 20 bp, Artificial
  CRISPR gRNA sequence
taaactgacaattagacata

SEQ ID NO: 634002 - DNA, 20 bp, Artificial
  CRISPR gRNA sequence
aaactgacaattagacataa

SEQ ID NO: 634003 - DNA, 20 bp, Artificial
  CRISPR gRNA sequence
aactgacaattagacataaa

SEQ ID NO: 634004 - DNA, 20 bp, Artificial
  CRISPR gRNA sequence
acaattagacataaacaaca

SEQ ID NO: 634005 - DNA, 20 bp, Artificial
  CRISPR gRNA sequence
gacataaacaacaaacttca

SEQ ID NO: 634006 - DNA, 20 bp, Artificial
  CRISPR gRNA sequence
cataagctgaaaattgtcaa

SEQ ID NO: 634007 - DNA, 20 bp, Artificial
  CRISPR gRNA sequence
ataagctgaaaattgtcaaa

SEQ ID NO: 634008 - DNA, 20 bp, Artificial
  CRISPR gRNA sequence
aaaattgtcaaacactgagt

SEQ ID NO: 634009 - DNA, 20 bp, Artificial
  CRISPR gRNA sequence
tcaaacactgagtaggtcac

SEQ ID NO: 634010 - DNA, 20 bp, Artificial
  CRISPR gRNA sequence
agtaggtcacaaagtagtgt

SEQ ID NO: 634011 - DNA, 20 bp, Artificial
  CRISPR gRNA sequence
taaaaatcaacattcctaaa

SEQ ID NO: 634012 - DNA, 20 bp, Artificial
  CRISPR gRNA sequence
ctaaagtgtttggaagtaag

SEQ ID NO: 634013 - DNA, 20 bp, Artificial
  CRISPR gRNA sequence
aagtgtttggaagtaagata

SEQ ID NO: 634014 - DNA, 20 bp, Artificial
  CRISPR gRNA sequence
ggaagtaagatagatacatg

SEQ ID NO: 634015 - DNA, 20 bp, Artificial
  CRISPR gRNA sequence
gaagtaagatagatacatgt

SEQ ID NO: 634016 - DNA, 20 bp, Artificial
  CRISPR gRNA sequence
agaatagtttaggcatatca

SEQ ID NO: 634017 - DNA, 20 bp, Artificial
  CRISPR gRNA sequence
aggcatatcaaccctaagtc

SEQ ID NO: 634018 - DNA, 20 bp, Artificial
  CRISPR gRNA sequence
ggcatatcaaccctaagtca

SEQ ID NO: 634019 - DNA, 20 bp, Artificial
  CRISPR gRNA sequence
agtcaaaagaactttgacat

SEQ ID NO: 634020 - DNA, 20 bp, Artificial
  CRISPR gRNA sequence
tgacattgtaaggttcctca

SEQ ID NO: 634021 - DNA, 20 bp, Artificial
  CRISPR gRNA sequence
gacattgtaaggttcctcaa

SEQ ID NO: 634022 - DNA, 20 bp, Artificial
  CRISPR gRNA sequence
acattgtaaggttcctcaaa

SEQ ID NO: 634023 - DNA, 20 bp, Artificial
  CRISPR gRNA sequence
taaggttcctcaaatctctc

SEQ ID NO: 634024 - DNA, 20 bp, Artificial
  CRISPR gRNA sequence
ctcaaatctctcttactcca

SEQ ID NO: 634025 - DNA, 20 bp, Artificial
  CRISPR gRNA sequence
aaatctctcttactccaaag

SEQ ID NO: 634026 - DNA, 20 bp, Artificial
  CRISPR gRNA sequence
tcttactccaaagttatgtg

SEQ ID NO: 634027 - DNA, 20 bp, Artificial
  CRISPR gRNA sequence
ttactccaaagttatgtgat

SEQ ID NO: 634028 - DNA, 20 bp, Artificial
  CRISPR gRNA sequence
actccaaagttatgtgatac

SEQ ID NO: 634029 - DNA, 20 bp, Artificial
  CRISPR gRNA sequence
ctccaaagttatgtgataca

SEQ ID NO: 634030 - DNA, 20 bp, Artificial
  CRISPR gRNA sequence
caaagttatgtgatacagat

SEQ ID NO: 634031 - DNA, 20 bp, Artificial
  CRISPR gRNA sequence
tgtgatacagataactaatt

SEQ ID NO: 634032 - DNA, 20 bp, Artificial
  CRISPR gRNA sequence
attttacaaagtagttattt

SEQ ID NO: 634033 - DNA, 20 bp, Artificial
  CRISPR gRNA sequence
tacaaagtagttatttttaa

SEQ ID NO: 634034 - DNA, 20 bp, Artificial
  CRISPR gRNA sequence
acaaagtagttatttttaag

SEQ ID NO: 634035 - DNA, 20 bp, Artificial
  CRISPR gRNA sequence
caaagtagttatttttaagt

SEQ ID NO: 634036 - DNA, 20 bp, Artificial
  CRISPR gRNA sequence
tttttaagtgatatacacaa

SEQ ID NO: 634037 - DNA, 20 bp, Artificial
  CRISPR gRNA sequence
ttaagtgatatacacaaata

SEQ ID NO: 634038 - DNA, 20 bp, Artificial
  CRISPR gRNA sequence
taagtgatatacacaaataa

SEQ ID NO: 634039 - DNA, 20 bp, Artificial
  CRISPR gRNA sequence
aagtgatatacacaaataaa

SEQ ID NO: 634040 - DNA, 20 bp, Artificial
  CRISPR gRNA sequence
agtgatatacacaaataaat

SEQ ID NO: 634041 - DNA, 20 bp, Artificial
  CRISPR gRNA sequence
tatcatatgctcaatgctgg

SEQ ID NO: 634042 - DNA, 20 bp, Artificial
  CRISPR gRNA sequence
aatgctggttcaattgaaag

SEQ ID NO: 634043 - DNA, 20 bp, Artificial
  CRISPR gRNA sequence
gttcaattgaaagctgaggt

SEQ ID NO: 634044 - DNA, 20 bp, Artificial
  CRISPR gRNA sequence
aattgaaagctgaggtttta

SEQ ID NO: 634045 - DNA, 20 bp, Artificial
  CRISPR gRNA sequence
aaagctgaggttttacttag

SEQ ID NO: 634046 - DNA, 20 bp, Artificial
  CRISPR gRNA sequence
aggttttacttagaatttaa

SEQ ID NO: 634047 - DNA, 20 bp, Artificial
  CRISPR gRNA sequence
tacttagaatttaatagcat

SEQ ID NO: 634048 - DNA, 20 bp, Artificial
  CRISPR gRNA sequence
acttagaatttaatagcatt

SEQ ID NO: 634049 - DNA, 20 bp, Artificial
  CRISPR gRNA sequence
cttagaatttaatagcatta

SEQ ID NO: 634050 - DNA, 20 bp, Artificial
  CRISPR gRNA sequence
agaatttaatagcattattg

SEQ ID NO: 634051 - DNA, 20 bp, Artificial
  CRISPR gRNA sequence
gaatttaatagcattattga

SEQ ID NO: 634052 - DNA, 20 bp, Artificial
  CRISPR gRNA sequence
aatagcattattgaaaatat

SEQ ID NO: 634053 - DNA, 20 bp, Artificial
  CRISPR gRNA sequence
atagcattattgaaaatatg

SEQ ID NO: 634054 - DNA, 20 bp, Artificial
  CRISPR gRNA sequence
ttgaaaatatgaaataatta

SEQ ID NO: 634055 - DNA, 20 bp, Artificial
  CRISPR gRNA sequence
aaaatatgaaataattattt

SEQ ID NO: 634056 - DNA, 20 bp, Artificial
  CRISPR gRNA sequence
ttttcttaaaatgaggatga

SEQ ID NO: 634057 - DNA, 20 bp, Artificial
  CRISPR gRNA sequence
tcttaaaatgaggatgaaca

SEQ ID NO: 634058 - DNA, 20 bp, Artificial
  CRISPR gRNA sequence
cttaaaatgaggatgaacaa

SEQ ID NO: 634059 - DNA, 20 bp, Artificial
  CRISPR gRNA sequence
ttaaaatgaggatgaacaaa

SEQ ID NO: 634060 - DNA, 20 bp, Artificial
  CRISPR gRNA sequence
aaaatgaggatgaacaaaaa

SEQ ID NO: 634061 - DNA, 20 bp, Artificial
  CRISPR gRNA sequence
aaatgaggatgaacaaaaat

SEQ ID NO: 634062 - DNA, 20 bp, Artificial
  CRISPR gRNA sequence
gaaaacaattcctttactta

SEQ ID NO: 634063 - DNA, 20 bp, Artificial
  CRISPR gRNA sequence
ctttacttattttcttactt

SEQ ID NO: 634064 - DNA, 20 bp, Artificial
  CRISPR gRNA sequence
tacttattttcttacttaag

SEQ ID NO: 634065 - DNA, 20 bp, Artificial
  CRISPR gRNA sequence
acttattttcttacttaagg

SEQ ID NO: 634066 - DNA, 20 bp, Artificial
  CRISPR gRNA sequence
cttattttcttacttaagga

SEQ ID NO: 634067 - DNA, 20 bp, Artificial
  CRISPR gRNA sequence
attttcttacttaaggacat

SEQ ID NO: 634068 - DNA, 20 bp, Artificial
  CRISPR gRNA sequence
ttttcttacttaaggacatt

SEQ ID NO: 634069 - DNA, 20 bp, Artificial
  CRISPR gRNA sequence
tcttacttaaggacatttta

SEQ ID NO: 634070 - DNA, 20 bp, Artificial
  CRISPR gRNA sequence
cttacttaaggacattttac

SEQ ID NO: 634071 - DNA, 20 bp, Artificial
  CRISPR gRNA sequence
ttacttaaggacattttact

SEQ ID NO: 634072 - DNA, 20 bp, Artificial
  CRISPR gRNA sequence
acttaaggacattttactta

SEQ ID NO: 634073 - DNA, 20 bp, Artificial
  CRISPR gRNA sequence
cttaaggacattttacttat

SEQ ID NO: 634074 - DNA, 20 bp, Artificial
  CRISPR gRNA sequence
aaggacattttacttataaa

SEQ ID NO: 634075 - DNA, 20 bp, Artificial
  CRISPR gRNA sequence
aggacattttacttataaat

SEQ ID NO: 634076 - DNA, 20 bp, Artificial
  CRISPR gRNA sequence
tacttataaatctttgaaaa

SEQ ID NO: 634077 - DNA, 20 bp, Artificial
  CRISPR gRNA sequence
acttataaatctttgaaaaa

SEQ ID NO: 634078 - DNA, 20 bp, Artificial
  CRISPR gRNA sequence
cttataaatctttgaaaaat

SEQ ID NO: 634079 - DNA, 20 bp, Artificial
  CRISPR gRNA sequence
ataaatctttgaaaaataac

SEQ ID NO: 634080 - DNA, 20 bp, Artificial
  CRISPR gRNA sequence
taaatctttgaaaaataact

SEQ ID NO: 634081 - DNA, 20 bp, Artificial
  CRISPR gRNA sequence
tgaaaaataacttagtttta

SEQ ID NO: 634082 - DNA, 20 bp, Artificial
  CRISPR gRNA sequence
gaaaaataacttagttttag

SEQ ID NO: 634083 - DNA, 20 bp, Artificial
  CRISPR gRNA sequence
aaaaataacttagttttaga

SEQ ID NO: 634084 - DNA, 20 bp, Artificial
  CRISPR gRNA sequence
agttttagaacaagtatctt

SEQ ID NO: 634085 - DNA, 20 bp, Artificial
  CRISPR gRNA sequence
gttttagaacaagtatctta

SEQ ID NO: 634086 - DNA, 20 bp, Artificial
  CRISPR gRNA sequence
tagaacaagtatcttaaata

SEQ ID NO: 634087 - DNA, 20 bp, Artificial
  CRISPR gRNA sequence
agaacaagtatcttaaatat

SEQ ID NO: 634088 - DNA, 20 bp, Artificial
  CRISPR gRNA sequence
gaacaagtatcttaaatata

SEQ ID NO: 634089 - DNA, 20 bp, Artificial
  CRISPR gRNA sequence
aaatatatggttctcttaat

SEQ ID NO: 634090 - DNA, 20 bp, Artificial
  CRISPR gRNA sequence
aatatatggttctcttaata

SEQ ID NO: 634091 - DNA, 20 bp, Artificial
  CRISPR gRNA sequence
tcttaataagtatttggctt

SEQ ID NO: 634092 - DNA, 20 bp, Artificial
  CRISPR gRNA sequence
ttaataagtatttggctttt

SEQ ID NO: 634093 - DNA, 20 bp, Artificial
  CRISPR gRNA sequence
aataagtatttggctttttt

SEQ ID NO: 634094 - DNA, 20 bp, Artificial
  CRISPR gRNA sequence
ataagtatttggctttttta

SEQ ID NO: 634095 - DNA, 20 bp, Artificial
  CRISPR gRNA sequence
ggcttttttagatttataag

SEQ ID NO: 634096 - DNA, 20 bp, Artificial
  CRISPR gRNA sequence
gcttttttagatttataaga

SEQ ID NO: 634097 - DNA, 20 bp, Artificial
  CRISPR gRNA sequence
ttttagatttataagagaca

SEQ ID NO: 634098 - DNA, 20 bp, Artificial
  CRISPR gRNA sequence
tttagatttataagagacaa

SEQ ID NO: 634099 - DNA, 20 bp, Artificial
  CRISPR gRNA sequence
ttagatttataagagacaat

SEQ ID NO: 634100 - DNA, 20 bp, Artificial
  CRISPR gRNA sequence
tagatttataagagacaatg

SEQ ID NO: 634101 - DNA, 20 bp, Artificial
  CRISPR gRNA sequence
agatttataagagacaatga

SEQ ID NO: 634102 - DNA, 20 bp, Artificial
  CRISPR gRNA sequence
gatttataagagacaatgaa

SEQ ID NO: 634103 - DNA, 20 bp, Artificial
  CRISPR gRNA sequence
ataagagacaatgaataaat

SEQ ID NO: 634104 - DNA, 20 bp, Artificial
  CRISPR gRNA sequence
taagagacaatgaataaatg

SEQ ID NO: 634105 - DNA, 20 bp, Artificial
  CRISPR gRNA sequence
tgggaaattaagatttttaa

SEQ ID NO: 634106 - DNA, 20 bp, Artificial
  CRISPR gRNA sequence
gggaaattaagatttttaat

SEQ ID NO: 634107 - DNA, 20 bp, Artificial
  CRISPR gRNA sequence
ggaaattaagatttttaatt

SEQ ID NO: 634108 - DNA, 20 bp, Artificial
  CRISPR gRNA sequence
agatttttaattttcaaatg

SEQ ID NO: 634109 - DNA, 20 bp, Artificial
  CRISPR gRNA sequence
ttaattttcaaatgtatttg

SEQ ID NO: 634110 - DNA, 20 bp, Artificial
  CRISPR gRNA sequence
taattttcaaatgtatttgg

SEQ ID NO: 634111 - DNA, 20 bp, Artificial
  CRISPR gRNA sequence
aattttcaaatgtatttgga

SEQ ID NO: 634112 - DNA, 20 bp, Artificial
  CRISPR gRNA sequence
attttcaaatgtatttggat

SEQ ID NO: 634113 - DNA, 20 bp, Artificial
  CRISPR gRNA sequence
tcaaatgtatttggatgatt

SEQ ID NO: 634114 - DNA, 20 bp, Artificial
  CRISPR gRNA sequence
caaatgtatttggatgattc

SEQ ID NO: 634115 - DNA, 20 bp, Artificial
  CRISPR gRNA sequence
aaatgtatttggatgattcc

SEQ ID NO: 634116 - DNA, 20 bp, Artificial
  CRISPR gRNA sequence
ggatgattccgtttttgagc

SEQ ID NO: 634117 - DNA, 20 bp, Artificial
  CRISPR gRNA sequence
gatgattccgtttttgagca

SEQ ID NO: 634118 - DNA, 20 bp, Artificial
  CRISPR gRNA sequence
cgtttttgagcaatacataa

SEQ ID NO: 634119 - DNA, 20 bp, Artificial
  CRISPR gRNA sequence
ttgagcaatacataattttc

SEQ ID NO: 634120 - DNA, 20 bp, Artificial
  CRISPR gRNA sequence
tgagcaatacataattttca

SEQ ID NO: 634121 - DNA, 20 bp, Artificial
  CRISPR gRNA sequence
gagcaatacataattttcat

SEQ ID NO: 634122 - DNA, 20 bp, Artificial
  CRISPR gRNA sequence
agcaatacataattttcata

SEQ ID NO: 634123 - DNA, 20 bp, Artificial
  CRISPR gRNA sequence
tcatagtaatctgaaccagt

SEQ ID NO: 634124 - DNA, 20 bp, Artificial
  CRISPR gRNA sequence
catagtaatctgaaccagta

SEQ ID NO: 634125 - DNA, 20 bp, Artificial
  CRISPR gRNA sequence
atagtaatctgaaccagtat

SEQ ID NO: 634126 - DNA, 20 bp, Artificial
  CRISPR gRNA sequence
aaccagtataattcttagcc

SEQ ID NO: 634127 - DNA, 20 bp, Artificial
  CRISPR gRNA sequence
ttagccaaaattgaattttt

SEQ ID NO: 634128 - DNA, 20 bp, Artificial
  CRISPR gRNA sequence
agccaaaattgaatttttca

SEQ ID NO: 634129 - DNA, 20 bp, Artificial
  CRISPR gRNA sequence
gccaaaattgaatttttcat

SEQ ID NO: 634130 - DNA, 20 bp, Artificial
  CRISPR gRNA sequence
aatttttcatctggtagaaa

SEQ ID NO: 634131 - DNA, 20 bp, Artificial
  CRISPR gRNA sequence
ttcatctggtagaaaaatat

SEQ ID NO: 634132 - DNA, 20 bp, Artificial
  CRISPR gRNA sequence
tcatctggtagaaaaatatt

SEQ ID NO: 634133 - DNA, 20 bp, Artificial
  CRISPR gRNA sequence
catctggtagaaaaatattt

SEQ ID NO: 634134 - DNA, 20 bp, Artificial
  CRISPR gRNA sequence
atctggtagaaaaatatttt

SEQ ID NO: 634135 - DNA, 20 bp, Artificial
  CRISPR gRNA sequence
gtagaaaaatattttgagac

SEQ ID NO: 634136 - DNA, 20 bp, Artificial
  CRISPR gRNA sequence
tgagactctatgagatgcat

SEQ ID NO: 634137 - DNA, 20 bp, Artificial
  CRISPR gRNA sequence
gagactctatgagatgcatt

SEQ ID NO: 634138 - DNA, 20 bp, Artificial
  CRISPR gRNA sequence
agactctatgagatgcattc

SEQ ID NO: 634139 - DNA, 20 bp, Artificial
  CRISPR gRNA sequence
tatgagatgcattctgtttt

SEQ ID NO: 634140 - DNA, 20 bp, Artificial
  CRISPR gRNA sequence
tgagatgcattctgtttttt

SEQ ID NO: 634141 - DNA, 20 bp, Artificial
  CRISPR gRNA sequence
tgtttttttaacttttattt

SEQ ID NO: 634142 - DNA, 20 bp, Artificial
  CRISPR gRNA sequence
tttttttaacttttatttta

SEQ ID NO: 634143 - DNA, 20 bp, Artificial
  CRISPR gRNA sequence
ttttaacttttattttaagt

SEQ ID NO: 634144 - DNA, 20 bp, Artificial
  CRISPR gRNA sequence
tttaacttttattttaagtt

SEQ ID NO: 634145 - DNA, 20 bp, Artificial
  CRISPR gRNA sequence
ttaacttttattttaagttc

SEQ ID NO: 634146 - DNA, 20 bp, Artificial
  CRISPR gRNA sequence
taacttttattttaagttca

SEQ ID NO: 634147 - DNA, 20 bp, Artificial
  CRISPR gRNA sequence
aacttttattttaagttcag

SEQ ID NO: 634148 - DNA, 20 bp, Artificial
  CRISPR gRNA sequence
acttttattttaagttcaga

SEQ ID NO: 634149 - DNA, 20 bp, Artificial
  CRISPR gRNA sequence
ttattttaagttcagaggta

SEQ ID NO: 634150 - DNA, 20 bp, Artificial
  CRISPR gRNA sequence
tattttaagttcagaggtac

SEQ ID NO: 634151 - DNA, 20 bp, Artificial
  CRISPR gRNA sequence
attttaagttcagaggtaca

SEQ ID NO: 634152 - DNA, 20 bp, Artificial
  CRISPR gRNA sequence
ttttaagttcagaggtacat

SEQ ID NO: 634153 - DNA, 20 bp, Artificial
  CRISPR gRNA sequence
taagttcagaggtacatgtg

SEQ ID NO: 634154 - DNA, 20 bp, Artificial
  CRISPR gRNA sequence
aagttcagaggtacatgtgc

SEQ ID NO: 634155 - DNA, 20 bp, Artificial
  CRISPR gRNA sequence
agttcagaggtacatgtgca

SEQ ID NO: 634156 - DNA, 20 bp, Artificial
  CRISPR gRNA sequence
agaggtacatgtgcaggttt

SEQ ID NO: 634157 - DNA, 20 bp, Artificial
  CRISPR gRNA sequence
gttatataggtaaacttgtg

SEQ ID NO: 634158 - DNA, 20 bp, Artificial
  CRISPR gRNA sequence
ttatataggtaaacttgtgt

SEQ ID NO: 634159 - DNA, 20 bp, Artificial
  CRISPR gRNA sequence
tataggtaaacttgtgtcat

SEQ ID NO: 634160 - DNA, 20 bp, Artificial
  CRISPR gRNA sequence
gtgtcatgggtttttttttt

SEQ ID NO: 634161 - DNA, 20 bp, Artificial
  CRISPR gRNA sequence
tgtcatgggttttttttttt

SEQ ID NO: 634162 - DNA, 20 bp, Artificial
  CRISPR gRNA sequence
ttttttttttttggtataaa

SEQ ID NO: 634163 - DNA, 20 bp, Artificial
  CRISPR gRNA sequence
tttttttttttggtataaat

SEQ ID NO: 634164 - DNA, 20 bp, Artificial
  CRISPR gRNA sequence
ttttttttttggtataaatt

SEQ ID NO: 634165 - DNA, 20 bp, Artificial
  CRISPR gRNA sequence
tttttttttggtataaatta

SEQ ID NO: 634166 - DNA, 20 bp, Artificial
  CRISPR gRNA sequence
ttttttttggtataaattat

SEQ ID NO: 634167 - DNA, 20 bp, Artificial
  CRISPR gRNA sequence
tttttttggtataaattatt

SEQ ID NO: 634168 - DNA, 20 bp, Artificial
  CRISPR gRNA sequence
ttttttggtataaattattt

SEQ ID NO: 634169 - DNA, 20 bp, Artificial
  CRISPR gRNA sequence
tttttggtataaattatttt

SEQ ID NO: 634170 - DNA, 20 bp, Artificial
  CRISPR gRNA sequence
ttttggtataaattattttg

SEQ ID NO: 634171 - DNA, 20 bp, Artificial
  CRISPR gRNA sequence
tttggtataaattattttgt

SEQ ID NO: 634172 - DNA, 20 bp, Artificial
  CRISPR gRNA sequence
ttggtataaattattttgtc

SEQ ID NO: 634173 - DNA, 20 bp, Artificial
  CRISPR gRNA sequence
tggtataaattattttgtca

SEQ ID NO: 634174 - DNA, 20 bp, Artificial
  CRISPR gRNA sequence
ggtataaattattttgtcat

SEQ ID NO: 634175 - DNA, 20 bp, Artificial
  CRISPR gRNA sequence
gtataaattattttgtcatc

SEQ ID NO: 634176 - DNA, 20 bp, Artificial
  CRISPR gRNA sequence
ttttgtcatccaggtattaa

SEQ ID NO: 634177 - DNA, 20 bp, Artificial
  CRISPR gRNA sequence
tgtcatccaggtattaaggc

SEQ ID NO: 634178 - DNA, 20 bp, Artificial
  CRISPR gRNA sequence
gtcatccaggtattaaggct

SEQ ID NO: 634179 - DNA, 20 bp, Artificial
  CRISPR gRNA sequence
tcatccaggtattaaggcta

SEQ ID NO: 634180 - DNA, 20 bp, Artificial
  CRISPR gRNA sequence
aggctagcaccattagttat

SEQ ID NO: 634181 - DNA, 20 bp, Artificial
  CRISPR gRNA sequence
gcaccattagttattttctc

SEQ ID NO: 634182 - DNA, 20 bp, Artificial
  CRISPR gRNA sequence
gttattttctcctgattctc

SEQ ID NO: 634183 - DNA, 20 bp, Artificial
  CRISPR gRNA sequence
ttttctcctgattctctcct

SEQ ID NO: 634184 - DNA, 20 bp, Artificial
  CRISPR gRNA sequence
tctcctgattctctccttcg

SEQ ID NO: 634185 - DNA, 20 bp, Artificial
  CRISPR gRNA sequence
ctcctgattctctccttcgt

SEQ ID NO: 634186 - DNA, 20 bp, Artificial
  CRISPR gRNA sequence
tcctgattctctccttcgtc

SEQ ID NO: 634187 - DNA, 20 bp, Artificial
  CRISPR gRNA sequence
ctgattctctccttcgtccc

SEQ ID NO: 634188 - DNA, 20 bp, Artificial
  CRISPR gRNA sequence
attctctccttcgtcccacc

SEQ ID NO: 634189 - DNA, 20 bp, Artificial
  CRISPR gRNA sequence
tctccttcgtcccaccctct

SEQ ID NO: 634190 - DNA, 20 bp, Artificial
  CRISPR gRNA sequence
tccttcgtcccaccctctac

SEQ ID NO: 634191 - DNA, 20 bp, Artificial
  CRISPR gRNA sequence
cttcgtcccaccctctactc

SEQ ID NO: 634192 - DNA, 20 bp, Artificial
  CRISPR gRNA sequence
cgtcccaccctctactctcc

SEQ ID NO: 634193 - DNA, 20 bp, Artificial
  CRISPR gRNA sequence
gtcccaccctctactctcca

SEQ ID NO: 634194 - DNA, 20 bp, Artificial
  CRISPR gRNA sequence
tactctccaataggccccag

SEQ ID NO: 634195 - DNA, 20 bp, Artificial
  CRISPR gRNA sequence
ctctccaataggccccagta

SEQ ID NO: 634196 - DNA, 20 bp, Artificial
  CRISPR gRNA sequence
tccaataggccccagtatgt

SEQ ID NO: 634197 - DNA, 20 bp, Artificial
  CRISPR gRNA sequence
caataggccccagtatgtgt

SEQ ID NO: 634198 - DNA, 20 bp, Artificial
  CRISPR gRNA sequence
ttcccctctatggagacaca

SEQ ID NO: 634199 - DNA, 20 bp, Artificial
  CRISPR gRNA sequence
ccctctatggagacacattc

SEQ ID NO: 634200 - DNA, 20 bp, Artificial
  CRISPR gRNA sequence
tatggagacacattcttact

SEQ ID NO: 634201 - DNA, 20 bp, Artificial
  CRISPR gRNA sequence
tggagacacattcttactca

SEQ ID NO: 634202 - DNA, 20 bp, Artificial
  CRISPR gRNA sequence
ttactcatcatttttctctt

SEQ ID NO: 634203 - DNA, 20 bp, Artificial
  CRISPR gRNA sequence
actcatcatttttctcttta

SEQ ID NO: 634204 - DNA, 20 bp, Artificial
  CRISPR gRNA sequence
ctcatcatttttctctttat

SEQ ID NO: 634205 - DNA, 20 bp, Artificial
  CRISPR gRNA sequence
atcatttttctctttataat

SEQ ID NO: 634206 - DNA, 20 bp, Artificial
  CRISPR gRNA sequence
ttctctttataatttataaa

SEQ ID NO: 634207 - DNA, 20 bp, Artificial
  CRISPR gRNA sequence
tctctttataatttataaaa

SEQ ID NO: 634208 - DNA, 20 bp, Artificial
  CRISPR gRNA sequence
ctctttataatttataaaaa

SEQ ID NO: 634209 - DNA, 20 bp, Artificial
  CRISPR gRNA sequence
tctttataatttataaaaag

SEQ ID NO: 634210 - DNA, 20 bp, Artificial
  CRISPR gRNA sequence
tttataatttataaaaagaa

SEQ ID NO: 634211 - DNA, 20 bp, Artificial
  CRISPR gRNA sequence
tataatttataaaaagaaat

SEQ ID NO: 634212 - DNA, 20 bp, Artificial
  CRISPR gRNA sequence
ataatttataaaaagaaatg

SEQ ID NO: 634213 - DNA, 20 bp, Artificial
  CRISPR gRNA sequence
taatttataaaaagaaatgt

SEQ ID NO: 634214 - DNA, 20 bp, Artificial
  CRISPR gRNA sequence
ataaaaagaaatgtttaaca

SEQ ID NO: 634215 - DNA, 20 bp, Artificial
  CRISPR gRNA sequence
taaaaagaaatgtttaacac

SEQ ID NO: 634216 - DNA, 20 bp, Artificial
  CRISPR gRNA sequence
aacacacatatatgtttctc

SEQ ID NO: 634217 - DNA, 20 bp, Artificial
  CRISPR gRNA sequence
acacacatatatgtttctca

SEQ ID NO: 634218 - DNA, 20 bp, Artificial
  CRISPR gRNA sequence
ctcatatattaaaattatac

SEQ ID NO: 634219 - DNA, 20 bp, Artificial
  CRISPR gRNA sequence
tcatatattaaaattataca

SEQ ID NO: 634220 - DNA, 20 bp, Artificial
  CRISPR gRNA sequence
atatattaaaattatacact

SEQ ID NO: 634221 - DNA, 20 bp, Artificial
  CRISPR gRNA sequence
aaattatacactcttctgtt

SEQ ID NO: 634222 - DNA, 20 bp, Artificial
  CRISPR gRNA sequence
tacactcttctgttttaaac

SEQ ID NO: 634223 - DNA, 20 bp, Artificial
  CRISPR gRNA sequence
ttctgttttaaacctttaat

SEQ ID NO: 634224 - DNA, 20 bp, Artificial
  CRISPR gRNA sequence
ctgttttaaacctttaattt

SEQ ID NO: 634225 - DNA, 20 bp, Artificial
  CRISPR gRNA sequence
tgttttaaacctttaatttg

SEQ ID NO: 634226 - DNA, 20 bp, Artificial
  CRISPR gRNA sequence
ttttaaacctttaatttggg

SEQ ID NO: 634227 - DNA, 20 bp, Artificial
  CRISPR gRNA sequence
taaacctttaatttgggtac

SEQ ID NO: 634228 - DNA, 20 bp, Artificial
  CRISPR gRNA sequence
aaacctttaatttgggtaca

SEQ ID NO: 634229 - DNA, 20 bp, Artificial
  CRISPR gRNA sequence
aacctttaatttgggtacag

SEQ ID NO: 634230 - DNA, 20 bp, Artificial
  CRISPR gRNA sequence
taatttgggtacagcataag

SEQ ID NO: 634231 - DNA, 20 bp, Artificial
  CRISPR gRNA sequence
aatttgggtacagcataaga

SEQ ID NO: 634232 - DNA, 20 bp, Artificial
  CRISPR gRNA sequence
atttgggtacagcataagag

SEQ ID NO: 634233 - DNA, 20 bp, Artificial
  CRISPR gRNA sequence
gggtacagcataagagtata

SEQ ID NO: 634234 - DNA, 20 bp, Artificial
  CRISPR gRNA sequence
ggtacagcataagagtatat

SEQ ID NO: 634235 - DNA, 20 bp, Artificial
  CRISPR gRNA sequence
aaatgctaattagaaaaaac

SEQ ID NO: 634236 - DNA, 20 bp, Artificial
  CRISPR gRNA sequence
attagaaaaaacatgtaatt

SEQ ID NO: 634237 - DNA, 20 bp, Artificial
  CRISPR gRNA sequence
gaaaaaacatgtaattctat

SEQ ID NO: 634238 - DNA, 20 bp, Artificial
  CRISPR gRNA sequence
tatttcctcctagaattttt

SEQ ID NO: 634239 - DNA, 20 bp, Artificial
  CRISPR gRNA sequence
tttcctcctagaatttttaa

SEQ ID NO: 634240 - DNA, 20 bp, Artificial
  CRISPR gRNA sequence
cctcctagaatttttaaaat

SEQ ID NO: 634241 - DNA, 20 bp, Artificial
  CRISPR gRNA sequence
ctcctagaatttttaaaata

SEQ ID NO: 634242 - DNA, 20 bp, Artificial
  CRISPR gRNA sequence
ctagaatttttaaaataaca

SEQ ID NO: 634243 - DNA, 20 bp, Artificial
  CRISPR gRNA sequence
gaatttttaaaataacaagt

SEQ ID NO: 634244 - DNA, 20 bp, Artificial
  CRISPR gRNA sequence
ttaaaataacaagtatgcta

SEQ ID NO: 634245 - DNA, 20 bp, Artificial
  CRISPR gRNA sequence
taaaataacaagtatgctaa

SEQ ID NO: 634246 - DNA, 20 bp, Artificial
  CRISPR gRNA sequence
aaaataacaagtatgctaaa

SEQ ID NO: 634247 - DNA, 20 bp, Artificial
  CRISPR gRNA sequence
aaataacaagtatgctaaat

SEQ ID NO: 634248 - DNA, 20 bp, Artificial
  CRISPR gRNA sequence
aatattattttgactaatag

SEQ ID NO: 634249 - DNA, 20 bp, Artificial
  CRISPR gRNA sequence
ttttgactaataggggtcca

SEQ ID NO: 634250 - DNA, 20 bp, Artificial
  CRISPR gRNA sequence
tgactaataggggtccaggg

SEQ ID NO: 634251 - DNA, 20 bp, Artificial
  CRISPR gRNA sequence
gactaataggggtccagggc

SEQ ID NO: 634252 - DNA, 20 bp, Artificial
  CRISPR gRNA sequence
actaataggggtccagggct

SEQ ID NO: 634253 - DNA, 20 bp, Artificial
  CRISPR gRNA sequence
ataggggtccagggcttaat

SEQ ID NO: 634254 - DNA, 20 bp, Artificial
  CRISPR gRNA sequence
aatttaaacactatcccctc

SEQ ID NO: 634255 - DNA, 20 bp, Artificial
  CRISPR gRNA sequence
atttaaacactatcccctca

SEQ ID NO: 634256 - DNA, 20 bp, Artificial
  CRISPR gRNA sequence
aaacactatcccctcagagt

SEQ ID NO: 634257 - DNA, 20 bp, Artificial
  CRISPR gRNA sequence
aacactatcccctcagagta

SEQ ID NO: 634258 - DNA, 20 bp, Artificial
  CRISPR gRNA sequence
tcccctcagagtattaggta

SEQ ID NO: 634259 - DNA, 20 bp, Artificial
  CRISPR gRNA sequence
agagtattaggtataataaa

SEQ ID NO: 634260 - DNA, 20 bp, Artificial
  CRISPR gRNA sequence
ggtataataaagaaagtaaa

SEQ ID NO: 634261 - DNA, 20 bp, Artificial
  CRISPR gRNA sequence
ataagaatgaaagaactata

SEQ ID NO: 634262 - DNA, 20 bp, Artificial
  CRISPR gRNA sequence
taagaatgaaagaactataa

SEQ ID NO: 634263 - DNA, 20 bp, Artificial
  CRISPR gRNA sequence
taatcacctataaaactgaa

SEQ ID NO: 634264 - DNA, 20 bp, Artificial
  CRISPR gRNA sequence
taaaactgaaaaatctgaga

SEQ ID NO: 634265 - DNA, 20 bp, Artificial
  CRISPR gRNA sequence
aaaaatctgagacaaaacta

SEQ ID NO: 634266 - DNA, 20 bp, Artificial
  CRISPR gRNA sequence
agacaaaactaataaaaatc

SEQ ID NO: 634267 - DNA, 20 bp, Artificial
  CRISPR gRNA sequence
ataaaaatcatttttgtagc

SEQ ID NO: 634268 - DNA, 20 bp, Artificial
  CRISPR gRNA sequence
ttgtagcagaagcattgatt

SEQ ID NO: 634269 - DNA, 20 bp, Artificial
  CRISPR gRNA sequence
tgtagcagaagcattgattc

SEQ ID NO: 634270 - DNA, 20 bp, Artificial
  CRISPR gRNA sequence
gtagcagaagcattgattca

SEQ ID NO: 634271 - DNA, 20 bp, Artificial
  CRISPR gRNA sequence
tagcagaagcattgattcat

SEQ ID NO: 634272 - DNA, 20 bp, Artificial
  CRISPR gRNA sequence
attcatcattaaatagtcac

SEQ ID NO: 634273 - DNA, 20 bp, Artificial
  CRISPR gRNA sequence
atcattaaatagtcacttaa

SEQ ID NO: 634274 - DNA, 20 bp, Artificial
  CRISPR gRNA sequence
aatagtcacttaagggtggg

SEQ ID NO: 634275 - DNA, 20 bp, Artificial
  CRISPR gRNA sequence
aagggtgggcgcagtggctc

SEQ ID NO: 634276 - DNA, 20 bp, Artificial
  CRISPR gRNA sequence
agggtgggcgcagtggctca

SEQ ID NO: 634277 - DNA, 20 bp, Artificial
  CRISPR gRNA sequence
acgcctgtaatcccagcact

SEQ ID NO: 634278 - DNA, 20 bp, Artificial
  CRISPR gRNA sequence
taatcccagcactttgggag

SEQ ID NO: 634279 - DNA, 20 bp, Artificial
  CRISPR gRNA sequence
tgggaggctgaggcaggcga

SEQ ID NO: 634280 - DNA, 20 bp, Artificial
  CRISPR gRNA sequence
gggaggctgaggcaggcgaa

SEQ ID NO: 634281 - DNA, 20 bp, Artificial
  CRISPR gRNA sequence
ggaggctgaggcaggcgaat

SEQ ID NO: 634282 - DNA, 20 bp, Artificial
  CRISPR gRNA sequence
aggcaggcgaatcacctgag

SEQ ID NO: 634283 - DNA, 20 bp, Artificial
  CRISPR gRNA sequence
aggtcaggagttcaagacca

SEQ ID NO: 634284 - DNA, 20 bp, Artificial
  CRISPR gRNA sequence
aagaccagcctggccaacac

SEQ ID NO: 634285 - DNA, 20 bp, Artificial
  CRISPR gRNA sequence
gccaacacggtgaaaccccg

SEQ ID NO: 634286 - DNA, 20 bp, Artificial
  CRISPR gRNA sequence
tactaaaaatacaaaaatta

SEQ ID NO: 634287 - DNA, 20 bp, Artificial
  CRISPR gRNA sequence
ctaaaaatacaaaaattagt

SEQ ID NO: 634288 - DNA, 20 bp, Artificial
  CRISPR gRNA sequence
aaaatacaaaaattagttgg

SEQ ID NO: 634289 - DNA, 20 bp, Artificial
  CRISPR gRNA sequence
gttgggcgtggtggtgcacg

SEQ ID NO: 634290 - DNA, 20 bp, Artificial
  CRISPR gRNA sequence
ggcgtggtggtgcacgcctg

SEQ ID NO: 634291 - DNA, 20 bp, Artificial
  CRISPR gRNA sequence
taattccagctacttgggag

SEQ ID NO: 634292 - DNA, 20 bp, Artificial
  CRISPR gRNA sequence
cagctacttgggaggctgag

SEQ ID NO: 634293 - DNA, 20 bp, Artificial
  CRISPR gRNA sequence
cttgggaggctgaggcgggg

SEQ ID NO: 634294 - DNA, 20 bp, Artificial
  CRISPR gRNA sequence
gggaggctgaggcgggggaa

SEQ ID NO: 634295 - DNA, 20 bp, Artificial
  CRISPR gRNA sequence
ggaggctgaggcgggggaac

SEQ ID NO: 634296 - DNA, 20 bp, Artificial
  CRISPR gRNA sequence
aggcgggggaaccacttaaa

SEQ ID NO: 634297 - DNA, 20 bp, Artificial
  CRISPR gRNA sequence
aaacccaggaggcggaggtt

SEQ ID NO: 634298 - DNA, 20 bp, Artificial
  CRISPR gRNA sequence
aacccaggaggcggaggttg

SEQ ID NO: 634299 - DNA, 20 bp, Artificial
  CRISPR gRNA sequence
cagtgagccgagatcacgcc

SEQ ID NO: 634300 - DNA, 20 bp, Artificial
  CRISPR gRNA sequence
cactccagcctgggccacag

SEQ ID NO: 634301 - DNA, 20 bp, Artificial
  CRISPR gRNA sequence
cagcctgggccacagagtga

SEQ ID NO: 634302 - DNA, 20 bp, Artificial
  CRISPR gRNA sequence
ggccacagagtgagaccctg

SEQ ID NO: 634303 - DNA, 20 bp, Artificial
  CRISPR gRNA sequence
tctcagaaaaaaaaaaaagt

SEQ ID NO: 634304 - DNA, 20 bp, Artificial
  CRISPR gRNA sequence
agaaaaaaaaaaaagtcact

SEQ ID NO: 634305 - DNA, 20 bp, Artificial
  CRISPR gRNA sequence
aaatactatgttaaaagttc

SEQ ID NO: 634306 - DNA, 20 bp, Artificial
  CRISPR gRNA sequence
aatactatgttaaaagttca

SEQ ID NO: 634307 - DNA, 20 bp, Artificial
  CRISPR gRNA sequence
tgttaaaagttcacatgaag

SEQ ID NO: 634308 - DNA, 20 bp, Artificial
  CRISPR gRNA sequence
aaagttcacatgaagcaaag

SEQ ID NO: 634309 - DNA, 20 bp, Artificial
  CRISPR gRNA sequence
acatgaagcaaagtagatga

SEQ ID NO: 634310 - DNA, 20 bp, Artificial
  CRISPR gRNA sequence
gtatagtaaatctcaagatt

SEQ ID NO: 634311 - DNA, 20 bp, Artificial
  CRISPR gRNA sequence
tatagtaaatctcaagatta

SEQ ID NO: 634312 - DNA, 20 bp, Artificial
  CRISPR gRNA sequence
aagattactgaatagcaaga

SEQ ID NO: 634313 - DNA, 20 bp, Artificial
  CRISPR gRNA sequence
ctgaatagcaagagtttcaa

SEQ ID NO: 634314 - DNA, 20 bp, Artificial
  CRISPR gRNA sequence
aatagcaagagtttcaagta

SEQ ID NO: 634315 - DNA, 20 bp, Artificial
  CRISPR gRNA sequence
caagtatagactaatacctt

SEQ ID NO: 634316 - DNA, 20 bp, Artificial
  CRISPR gRNA sequence
aagtatagactaataccttt

SEQ ID NO: 634317 - DNA, 20 bp, Artificial
  CRISPR gRNA sequence
ataccttttattttcctata

SEQ ID NO: 634318 - DNA, 20 bp, Artificial
  CRISPR gRNA sequence
ttattttcctataactttat

SEQ ID NO: 634319 - DNA, 20 bp, Artificial
  CRISPR gRNA sequence
tattttcctataactttatg

SEQ ID NO: 634320 - DNA, 20 bp, Artificial
  CRISPR gRNA sequence
attttcctataactttatgt

SEQ ID NO: 634321 - DNA, 20 bp, Artificial
  CRISPR gRNA sequence
ttttcctataactttatgta

SEQ ID NO: 634322 - DNA, 20 bp, Artificial
  CRISPR gRNA sequence
tcctataactttatgtaatg

SEQ ID NO: 634323 - DNA, 20 bp, Artificial
  CRISPR gRNA sequence
cctataactttatgtaatgt

SEQ ID NO: 634324 - DNA, 20 bp, Artificial
  CRISPR gRNA sequence
ctataactttatgtaatgta

SEQ ID NO: 634325 - DNA, 20 bp, Artificial
  CRISPR gRNA sequence
taactttatgtaatgtatct

SEQ ID NO: 634326 - DNA, 20 bp, Artificial
  CRISPR gRNA sequence
tatgtaatgtatctctggga

SEQ ID NO: 634327 - DNA, 20 bp, Artificial
  CRISPR gRNA sequence
atgtaatgtatctctgggac

SEQ ID NO: 634328 - DNA, 20 bp, Artificial
  CRISPR gRNA sequence
tgtaatgtatctctgggaca

SEQ ID NO: 634329 - DNA, 20 bp, Artificial
  CRISPR gRNA sequence
tgggacatgtttttaaaagt

SEQ ID NO: 634330 - DNA, 20 bp, Artificial
  CRISPR gRNA sequence
ggacatgtttttaaaagtgc

SEQ ID NO: 634331 - DNA, 20 bp, Artificial
  CRISPR gRNA sequence
ttaaaagtgcagttcacttt

SEQ ID NO: 634332 - DNA, 20 bp, Artificial
  CRISPR gRNA sequence
taaaagtgcagttcactttc

SEQ ID NO: 634333 - DNA, 20 bp, Artificial
  CRISPR gRNA sequence
aaaagtgcagttcactttct

SEQ ID NO: 634334 - DNA, 20 bp, Artificial
  CRISPR gRNA sequence
aaagtgcagttcactttctc

SEQ ID NO: 634335 - DNA, 20 bp, Artificial
  CRISPR gRNA sequence
actttctcagtgggctaata

SEQ ID NO: 634336 - DNA, 20 bp, Artificial
  CRISPR gRNA sequence
tctcagtgggctaataactt

SEQ ID NO: 634337 - DNA, 20 bp, Artificial
  CRISPR gRNA sequence
ctcagtgggctaataacttg

SEQ ID NO: 634338 - DNA, 20 bp, Artificial
  CRISPR gRNA sequence
tcagtgggctaataacttga

SEQ ID NO: 634339 - DNA, 20 bp, Artificial
  CRISPR gRNA sequence
agtgggctaataacttgact

SEQ ID NO: 634340 - DNA, 20 bp, Artificial
  CRISPR gRNA sequence
ataacttgactgtaatcttt

SEQ ID NO: 634341 - DNA, 20 bp, Artificial
  CRISPR gRNA sequence
gactgtaatctttttttggg

SEQ ID NO: 634342 - DNA, 20 bp, Artificial
  CRISPR gRNA sequence
actgtaatctttttttgggg

SEQ ID NO: 634343 - DNA, 20 bp, Artificial
  CRISPR gRNA sequence
taatctttttttgggggggg

SEQ ID NO: 634344 - DNA, 20 bp, Artificial
  CRISPR gRNA sequence
tttttggggggggtgggagg

SEQ ID NO: 634345 - DNA, 20 bp, Artificial
  CRISPR gRNA sequence
ttttggggggggtgggagga

SEQ ID NO: 634346 - DNA, 20 bp, Artificial
  CRISPR gRNA sequence
tttggggggggtgggaggat

SEQ ID NO: 634347 - DNA, 20 bp, Artificial
  CRISPR gRNA sequence
ttggggggggtgggaggatg

SEQ ID NO: 634348 - DNA, 20 bp, Artificial
  CRISPR gRNA sequence
tggggggggtgggaggatgg

SEQ ID NO: 634349 - DNA, 20 bp, Artificial
  CRISPR gRNA sequence
ggggggggtgggaggatgga

SEQ ID NO: 634350 - DNA, 20 bp, Artificial
  CRISPR gRNA sequence
gggggggtgggaggatggag

SEQ ID NO: 634351 - DNA, 20 bp, Artificial
  CRISPR gRNA sequence
cgctctgtcacccaggctgg

SEQ ID NO: 634352 - DNA, 20 bp, Artificial
  CRISPR gRNA sequence
gctctgtcacccaggctggt

SEQ ID NO: 634353 - DNA, 20 bp, Artificial
  CRISPR gRNA sequence
tgtcacccaggctggtgtcc

SEQ ID NO: 634354 - DNA, 20 bp, Artificial
  CRISPR gRNA sequence
tcacccaggctggtgtccgc

SEQ ID NO: 634355 - DNA, 20 bp, Artificial
  CRISPR gRNA sequence
gtgtccgcctcccgggatca

SEQ ID NO: 634356 - DNA, 20 bp, Artificial
  CRISPR gRNA sequence
ccgggatcaagcaatcctcc

SEQ ID NO: 634357 - DNA, 20 bp, Artificial
  CRISPR gRNA sequence
ctgcctcagcctcccgagta

SEQ ID NO: 634358 - DNA, 20 bp, Artificial
  CRISPR gRNA sequence
cctcagcctcccgagtagct

SEQ ID NO: 634359 - DNA, 20 bp, Artificial
  CRISPR gRNA sequence
agcctcccgagtagctggga

SEQ ID NO: 634360 - DNA, 20 bp, Artificial
  CRISPR gRNA sequence
ccgagtagctgggactacag

SEQ ID NO: 634361 - DNA, 20 bp, Artificial
  CRISPR gRNA sequence
ggactacaggcgtgtgctat

SEQ ID NO: 634362 - DNA, 20 bp, Artificial
  CRISPR gRNA sequence
caggcgtgtgctatcacgcc

SEQ ID NO: 634363 - DNA, 20 bp, Artificial
  CRISPR gRNA sequence
tcacgcccagataatttttt

SEQ ID NO: 634364 - DNA, 20 bp, Artificial
  CRISPR gRNA sequence
tttgtatttttagtagaaac

SEQ ID NO: 634365 - DNA, 20 bp, Artificial
  CRISPR gRNA sequence
ttgtatttttagtagaaaca

SEQ ID NO: 634366 - DNA, 20 bp, Artificial
  CRISPR gRNA sequence
tgtatttttagtagaaacac

SEQ ID NO: 634367 - DNA, 20 bp, Artificial
  CRISPR gRNA sequence
gtatttttagtagaaacacg

SEQ ID NO: 634368 - DNA, 20 bp, Artificial
  CRISPR gRNA sequence
tatttttagtagaaacacgg

SEQ ID NO: 634369 - DNA, 20 bp, Artificial
  CRISPR gRNA sequence
ttagtagaaacacggtttca

SEQ ID NO: 634370 - DNA, 20 bp, Artificial
  CRISPR gRNA sequence
tagtagaaacacggtttcac

SEQ ID NO: 634371 - DNA, 20 bp, Artificial
  CRISPR gRNA sequence
agtagaaacacggtttcacc

SEQ ID NO: 634372 - DNA, 20 bp, Artificial
  CRISPR gRNA sequence
gtagaaacacggtttcacca

SEQ ID NO: 634373 - DNA, 20 bp, Artificial
  CRISPR gRNA sequence
caccatgttaaccagaatgg

SEQ ID NO: 634374 - DNA, 20 bp, Artificial
  CRISPR gRNA sequence
accatgttaaccagaatggt

SEQ ID NO: 634375 - DNA, 20 bp, Artificial
  CRISPR gRNA sequence
accagaatggtctcgatctc

SEQ ID NO: 634376 - DNA, 20 bp, Artificial
  CRISPR gRNA sequence
gatctcctgacctcatgatc

SEQ ID NO: 634377 - DNA, 20 bp, Artificial
  CRISPR gRNA sequence
ctgacctcatgatccgccca

SEQ ID NO: 634378 - DNA, 20 bp, Artificial
  CRISPR gRNA sequence
acctcatgatccgcccacct

SEQ ID NO: 634379 - DNA, 20 bp, Artificial
  CRISPR gRNA sequence
atgatccgcccacctcggcc

SEQ ID NO: 634380 - DNA, 20 bp, Artificial
  CRISPR gRNA sequence
ggcctcccaaagtgttagga

SEQ ID NO: 634381 - DNA, 20 bp, Artificial
  CRISPR gRNA sequence
ccaaagtgttaggattacag

SEQ ID NO: 634382 - DNA, 20 bp, Artificial
  CRISPR gRNA sequence
ggattacaggtgtgagccac

SEQ ID NO: 634383 - DNA, 20 bp, Artificial
  CRISPR gRNA sequence
caggtgtgagccaccgtgcc

SEQ ID NO: 634384 - DNA, 20 bp, Artificial
  CRISPR gRNA sequence
gactgtaatctttagctgat

SEQ ID NO: 634385 - DNA, 20 bp, Artificial
  CRISPR gRNA sequence
actgtaatctttagctgatc

SEQ ID NO: 634386 - DNA, 20 bp, Artificial
  CRISPR gRNA sequence
taatctttagctgatctttg

SEQ ID NO: 634387 - DNA, 20 bp, Artificial
  CRISPR gRNA sequence
tagctgatctttgttcataa

SEQ ID NO: 634388 - DNA, 20 bp, Artificial
  CRISPR gRNA sequence
agctgatctttgttcataaa

SEQ ID NO: 634389 - DNA, 20 bp, Artificial
  CRISPR gRNA sequence
gctgatctttgttcataaaa

SEQ ID NO: 634390 - DNA, 20 bp, Artificial
  CRISPR gRNA sequence
atctttgttcataaaacatt

SEQ ID NO: 634391 - DNA, 20 bp, Artificial
  CRISPR gRNA sequence
tgttcataaaacatttcaat

SEQ ID NO: 634392 - DNA, 20 bp, Artificial
  CRISPR gRNA sequence
gttcataaaacatttcaatt

SEQ ID NO: 634393 - DNA, 20 bp, Artificial
  CRISPR gRNA sequence
ttcataaaacatttcaatta

SEQ ID NO: 634394 - DNA, 20 bp, Artificial
  CRISPR gRNA sequence
ataaaacatttcaattattt

SEQ ID NO: 634395 - DNA, 20 bp, Artificial
  CRISPR gRNA sequence
caattatttatttgtctccc

SEQ ID NO: 634396 - DNA, 20 bp, Artificial
  CRISPR gRNA sequence
aattatttatttgtctcccc

SEQ ID NO: 634397 - DNA, 20 bp, Artificial
  CRISPR gRNA sequence
tttatttgtctcccctttcc

SEQ ID NO: 634398 - DNA, 20 bp, Artificial
  CRISPR gRNA sequence
atttgtctcccctttccctc

SEQ ID NO: 634399 - DNA, 20 bp, Artificial
  CRISPR gRNA sequence
tttgtctcccctttccctct

SEQ ID NO: 634400 - DNA, 20 bp, Artificial
  CRISPR gRNA sequence
gtctcccctttccctcttct

SEQ ID NO: 634401 - DNA, 20 bp, Artificial
  CRISPR gRNA sequence
tctcccctttccctcttctc

SEQ ID NO: 634402 - DNA, 20 bp, Artificial
  CRISPR gRNA sequence
ccctttccctcttctccttc

SEQ ID NO: 634403 - DNA, 20 bp, Artificial
  CRISPR gRNA sequence
tccctcttctccttcccctt

SEQ ID NO: 634404 - DNA, 20 bp, Artificial
  CRISPR gRNA sequence
ccctcttctccttccccttc

SEQ ID NO: 634405 - DNA, 20 bp, Artificial
  CRISPR gRNA sequence
cctcttctccttccccttct

SEQ ID NO: 634406 - DNA, 20 bp, Artificial
  CRISPR gRNA sequence
ttctccttccccttcttaaa

SEQ ID NO: 634407 - DNA, 20 bp, Artificial
  CRISPR gRNA sequence
ctccttccccttcttaaaat

SEQ ID NO: 634408 - DNA, 20 bp, Artificial
  CRISPR gRNA sequence
tccttccccttcttaaaatg

SEQ ID NO: 634409 - DNA, 20 bp, Artificial
  CRISPR gRNA sequence
cttccccttcttaaaatgtc

SEQ ID NO: 634410 - DNA, 20 bp, Artificial
  CRISPR gRNA sequence
ccccttcttaaaatgtcatt

SEQ ID NO: 634411 - DNA, 20 bp, Artificial
  CRISPR gRNA sequence
cccttcttaaaatgtcattt

SEQ ID NO: 634412 - DNA, 20 bp, Artificial
  CRISPR gRNA sequence
cttaaaatgtcatttacatt

SEQ ID NO: 634413 - DNA, 20 bp, Artificial
  CRISPR gRNA sequence
ttaaaatgtcatttacattt

SEQ ID NO: 634414 - DNA, 20 bp, Artificial
  CRISPR gRNA sequence
aaaatgtcatttacatttca

SEQ ID NO: 634415 - DNA, 20 bp, Artificial
  CRISPR gRNA sequence
aaatgtcatttacatttcac

SEQ ID NO: 634416 - DNA, 20 bp, Artificial
  CRISPR gRNA sequence
acatttcacataaaaaaagt

SEQ ID NO: 634417 - DNA, 20 bp, Artificial
  CRISPR gRNA sequence
catttcacataaaaaaagtt

SEQ ID NO: 634418 - DNA, 20 bp, Artificial
  CRISPR gRNA sequence
cacataaaaaaagttattat

SEQ ID NO: 634419 - DNA, 20 bp, Artificial
  CRISPR gRNA sequence
acataaaaaaagttattatt

SEQ ID NO: 634420 - DNA, 20 bp, Artificial
  CRISPR gRNA sequence
ttatttttttctttcttaga

SEQ ID NO: 634421 - DNA, 20 bp, Artificial
  CRISPR gRNA sequence
tttttttctttcttagacac

SEQ ID NO: 634422 - DNA, 20 bp, Artificial
  CRISPR gRNA sequence
ttttctttcttagacacttc

SEQ ID NO: 634423 - DNA, 20 bp, Artificial
  CRISPR gRNA sequence
tttctttcttagacacttca

SEQ ID NO: 634424 - DNA, 20 bp, Artificial
  CRISPR gRNA sequence
ttctttcttagacacttcaa

SEQ ID NO: 634425 - DNA, 20 bp, Artificial
  CRISPR gRNA sequence
tctttcttagacacttcaag

SEQ ID NO: 634426 - DNA, 20 bp, Artificial
  CRISPR gRNA sequence
ctttcttagacacttcaagg

SEQ ID NO: 634427 - DNA, 20 bp, Artificial
  CRISPR gRNA sequence
tttcttagacacttcaaggc

SEQ ID NO: 634428 - DNA, 20 bp, Artificial
  CRISPR gRNA sequence
tcttagacacttcaaggcta

SEQ ID NO: 634429 - DNA, 20 bp, Artificial
  CRISPR gRNA sequence
cttagacacttcaaggctat

SEQ ID NO: 634430 - DNA, 20 bp, Artificial
  CRISPR gRNA sequence
ttagacacttcaaggctatc

SEQ ID NO: 634431 - DNA, 20 bp, Artificial
  CRISPR gRNA sequence
agacacttcaaggctatcag

SEQ ID NO: 634432 - DNA, 20 bp, Artificial
  CRISPR gRNA sequence
gacacttcaaggctatcaga

SEQ ID NO: 634433 - DNA, 20 bp, Artificial
  CRISPR gRNA sequence
caaggctatcagatgtagga

SEQ ID NO: 634434 - DNA, 20 bp, Artificial
  CRISPR gRNA sequence
aaggctatcagatgtaggat

SEQ ID NO: 634435 - DNA, 20 bp, Artificial
  CRISPR gRNA sequence
tcagatgtaggatatcagac

SEQ ID NO: 634436 - DNA, 20 bp, Artificial
  CRISPR gRNA sequence
gtagacaagaaatattggca

SEQ ID NO: 634437 - DNA, 20 bp, Artificial
  CRISPR gRNA sequence
gcactgtgaagactcaatat

SEQ ID NO: 634438 - DNA, 20 bp, Artificial
  CRISPR gRNA sequence
tgaagactcaatataaacct

SEQ ID NO: 634439 - DNA, 20 bp, Artificial
  CRISPR gRNA sequence
aatataaaccttaagatgtt

SEQ ID NO: 634440 - DNA, 20 bp, Artificial
  CRISPR gRNA sequence
aagatgttaattcggtttca

SEQ ID NO: 634441 - DNA, 20 bp, Artificial
  CRISPR gRNA sequence
agatgttaattcggtttcat

SEQ ID NO: 634442 - DNA, 20 bp, Artificial
  CRISPR gRNA sequence
attcggtttcatgaaaactt

SEQ ID NO: 634443 - DNA, 20 bp, Artificial
  CRISPR gRNA sequence
ggtttcatgaaaacttattt

SEQ ID NO: 634444 - DNA, 20 bp, Artificial
  CRISPR gRNA sequence
catgaaaacttattttaaaa

SEQ ID NO: 634445 - DNA, 20 bp, Artificial
  CRISPR gRNA sequence
atgaaaacttattttaaaat

SEQ ID NO: 634446 - DNA, 20 bp, Artificial
  CRISPR gRNA sequence
attttaaaataaactagggc

SEQ ID NO: 634447 - DNA, 20 bp, Artificial
  CRISPR gRNA sequence
ttttaaaataaactagggca

SEQ ID NO: 634448 - DNA, 20 bp, Artificial
  CRISPR gRNA sequence
taaaataaactagggcaaaa

SEQ ID NO: 634449 - DNA, 20 bp, Artificial
  CRISPR gRNA sequence
aaaataaactagggcaaaat

SEQ ID NO: 634450 - DNA, 20 bp, Artificial
  CRISPR gRNA sequence
aaataaactagggcaaaata

SEQ ID NO: 634451 - DNA, 20 bp, Artificial
  CRISPR gRNA sequence
gggcaaaatactaaaacaaa

SEQ ID NO: 634452 - DNA, 20 bp, Artificial
  CRISPR gRNA sequence
aaacaaacaaacaaacaaac

SEQ ID NO: 634453 - DNA, 20 bp, Artificial
  CRISPR gRNA sequence
ggagggagtggagactactc

SEQ ID NO: 634454 - DNA, 20 bp, Artificial
  CRISPR gRNA sequence
gagggagtggagactactct

SEQ ID NO: 634455 - DNA, 20 bp, Artificial
  CRISPR gRNA sequence
ctctttaaggtgtggtagta

SEQ ID NO: 634456 - DNA, 20 bp, Artificial
  CRISPR gRNA sequence
tttaaggtgtggtagtagtg

SEQ ID NO: 634457 - DNA, 20 bp, Artificial
  CRISPR gRNA sequence
taaggtgtggtagtagtgac

SEQ ID NO: 634458 - DNA, 20 bp, Artificial
  CRISPR gRNA sequence
aaggtgtggtagtagtgact

SEQ ID NO: 634459 - DNA, 20 bp, Artificial
  CRISPR gRNA sequence
aggtgtggtagtagtgactg

SEQ ID NO: 634460 - DNA, 20 bp, Artificial
  CRISPR gRNA sequence
attagcaaaatccagggaga

SEQ ID NO: 634461 - DNA, 20 bp, Artificial
  CRISPR gRNA sequence
gcaaaatccagggagaaaag

SEQ ID NO: 634462 - DNA, 20 bp, Artificial
  CRISPR gRNA sequence
tagttcgcatcatataatag

SEQ ID NO: 634463 - DNA, 20 bp, Artificial
  CRISPR gRNA sequence
gcatcatataatagcagcac

SEQ ID NO: 634464 - DNA, 20 bp, Artificial
  CRISPR gRNA sequence
aaagagtaaattaagtgact

SEQ ID NO: 634465 - DNA, 20 bp, Artificial
  CRISPR gRNA sequence
aagagtaaattaagtgactt

SEQ ID NO: 634466 - DNA, 20 bp, Artificial
  CRISPR gRNA sequence
agtgacttgacaacgtccca

SEQ ID NO: 634467 - DNA, 20 bp, Artificial
  CRISPR gRNA sequence
gacaacgtcccatagctaat

SEQ ID NO: 634468 - DNA, 20 bp, Artificial
  CRISPR gRNA sequence
acaacgtcccatagctaatt

SEQ ID NO: 634469 - DNA, 20 bp, Artificial
  CRISPR gRNA sequence
atttgcagcaaggccaccct

SEQ ID NO: 634470 - DNA, 20 bp, Artificial
  CRISPR gRNA sequence
gcagcaaggccaccctaaaa

SEQ ID NO: 634471 - DNA, 20 bp, Artificial
  CRISPR gRNA sequence
cagcaaggccaccctaaaac

SEQ ID NO: 634472 - DNA, 20 bp, Artificial
  CRISPR gRNA sequence
aaacccacatgccttgatct

SEQ ID NO: 634473 - DNA, 20 bp, Artificial
  CRISPR gRNA sequence
gatctcctgacttctagaca

SEQ ID NO: 634474 - DNA, 20 bp, Artificial
  CRISPR gRNA sequence
atctcctgacttctagacag

SEQ ID NO: 634475 - DNA, 20 bp, Artificial
  CRISPR gRNA sequence
ctgacttctagacagcacat

SEQ ID NO: 634476 - DNA, 20 bp, Artificial
  CRISPR gRNA sequence
acttctagacagcacatttt

SEQ ID NO: 634477 - DNA, 20 bp, Artificial
  CRISPR gRNA sequence
ctagacagcacatttttttt

SEQ ID NO: 634478 - DNA, 20 bp, Artificial
  CRISPR gRNA sequence
tagacagcacattttttttt

SEQ ID NO: 634479 - DNA, 20 bp, Artificial
  CRISPR gRNA sequence
gacagcacattttttttttc

SEQ ID NO: 634480 - DNA, 20 bp, Artificial
  CRISPR gRNA sequence
tttttttcaatcattaggag

SEQ ID NO: 634481 - DNA, 20 bp, Artificial
  CRISPR gRNA sequence
ttttttcaatcattaggagt

SEQ ID NO: 634482 - DNA, 20 bp, Artificial
  CRISPR gRNA sequence
tttttcaatcattaggagtt

SEQ ID NO: 634483 - DNA, 20 bp, Artificial
  CRISPR gRNA sequence
ttttcaatcattaggagtta

SEQ ID NO: 634484 - DNA, 20 bp, Artificial
  CRISPR gRNA sequence
tttcaatcattaggagttac

SEQ ID NO: 634485 - DNA, 20 bp, Artificial
  CRISPR gRNA sequence
ttcaatcattaggagttact

SEQ ID NO: 634486 - DNA, 20 bp, Artificial
  CRISPR gRNA sequence
tcaatcattaggagttactt

SEQ ID NO: 634487 - DNA, 20 bp, Artificial
  CRISPR gRNA sequence
caatcattaggagttacttc

SEQ ID NO: 634488 - DNA, 20 bp, Artificial
  CRISPR gRNA sequence
aatcattaggagttacttca

SEQ ID NO: 634489 - DNA, 20 bp, Artificial
  CRISPR gRNA sequence
ggagttacttcagtagagtt

SEQ ID NO: 634490 - DNA, 20 bp, Artificial
  CRISPR gRNA sequence
cttcagtagagttaaagctt

SEQ ID NO: 634491 - DNA, 20 bp, Artificial
  CRISPR gRNA sequence
cagtagagttaaagctttat

SEQ ID NO: 634492 - DNA, 20 bp, Artificial
  CRISPR gRNA sequence
agtagagttaaagctttata

SEQ ID NO: 634493 - DNA, 20 bp, Artificial
  CRISPR gRNA sequence
aagctttatagaataaacat

SEQ ID NO: 634494 - DNA, 20 bp, Artificial
  CRISPR gRNA sequence
tatagaataaacatacgagc

SEQ ID NO: 634495 - DNA, 20 bp, Artificial
  CRISPR gRNA sequence
atagaataaacatacgagct

SEQ ID NO: 634496 - DNA, 20 bp, Artificial
  CRISPR gRNA sequence
tagaataaacatacgagctg

SEQ ID NO: 634497 - DNA, 20 bp, Artificial
  CRISPR gRNA sequence
tgtcatttatcacttagcag

SEQ ID NO: 634498 - DNA, 20 bp, Artificial
  CRISPR gRNA sequence
atcacttagcagggtgtgat

SEQ ID NO: 634499 - DNA, 20 bp, Artificial
  CRISPR gRNA sequence
tcacttagcagggtgtgatg

SEQ ID NO: 634500 - DNA, 20 bp, Artificial
  CRISPR gRNA sequence
agcagggtgtgatgagcaca

SEQ ID NO: 634501 - DNA, 20 bp, Artificial
  CRISPR gRNA sequence
gcagggtgtgatgagcacaa

SEQ ID NO: 634502 - DNA, 20 bp, Artificial
  CRISPR gRNA sequence
tggagtttgctgccttagtt

SEQ ID NO: 634503 - DNA, 20 bp, Artificial
  CRISPR gRNA sequence
gctgccttagtttaaatcca

SEQ ID NO: 634504 - DNA, 20 bp, Artificial
  CRISPR gRNA sequence
ctgccttagtttaaatccag

SEQ ID NO: 634505 - DNA, 20 bp, Artificial
  CRISPR gRNA sequence
ccttagtttaaatccagggt

SEQ ID NO: 634506 - DNA, 20 bp, Artificial
  CRISPR gRNA sequence
agtttaaatccagggtctgc

SEQ ID NO: 634507 - DNA, 20 bp, Artificial
  CRISPR gRNA sequence
gtttaaatccagggtctgcc

SEQ ID NO: 634508 - DNA, 20 bp, Artificial
  CRISPR gRNA sequence
aaatccagggtctgcctgtg

SEQ ID NO: 634509 - DNA, 20 bp, Artificial
  CRISPR gRNA sequence
aatccagggtctgcctgtgt

SEQ ID NO: 634510 - DNA, 20 bp, Artificial
  CRISPR gRNA sequence
cctgtgtgacttcttttctg

SEQ ID NO: 634511 - DNA, 20 bp, Artificial
  CRISPR gRNA sequence
tgtgacttcttttctgcctc

SEQ ID NO: 634512 - DNA, 20 bp, Artificial
  CRISPR gRNA sequence
cttttctgcctcagtgtaca

SEQ ID NO: 634513 - DNA, 20 bp, Artificial
  CRISPR gRNA sequence
ttttctgcctcagtgtacaa

SEQ ID NO: 634514 - DNA, 20 bp, Artificial
  CRISPR gRNA sequence
ttctgcctcagtgtacaata

SEQ ID NO: 634515 - DNA, 20 bp, Artificial
  CRISPR gRNA sequence
tctgcctcagtgtacaatag

SEQ ID NO: 634516 - DNA, 20 bp, Artificial
  CRISPR gRNA sequence
ctgcctcagtgtacaatagg

SEQ ID NO: 634517 - DNA, 20 bp, Artificial
  CRISPR gRNA sequence
tgcctcagtgtacaatagga

SEQ ID NO: 634518 - DNA, 20 bp, Artificial
  CRISPR gRNA sequence
cctcagtgtacaataggaat

SEQ ID NO: 634519 - DNA, 20 bp, Artificial
  CRISPR gRNA sequence
agtgtacaataggaataacc

SEQ ID NO: 634520 - DNA, 20 bp, Artificial
  CRISPR gRNA sequence
tcataatgaacctgcctctc

SEQ ID NO: 634521 - DNA, 20 bp, Artificial
  CRISPR gRNA sequence
ataatgaacctgcctctcca

SEQ ID NO: 634522 - DNA, 20 bp, Artificial
  CRISPR gRNA sequence
cctctccattctctttgtaa

SEQ ID NO: 634523 - DNA, 20 bp, Artificial
  CRISPR gRNA sequence
tccattctctttgtaaaaca

SEQ ID NO: 634524 - DNA, 20 bp, Artificial
  CRISPR gRNA sequence
cattctctttgtaaaacata

SEQ ID NO: 634525 - DNA, 20 bp, Artificial
  CRISPR gRNA sequence
tctttgtaaaacatactaat

SEQ ID NO: 634526 - DNA, 20 bp, Artificial
  CRISPR gRNA sequence
tttgtaaaacatactaatgg

SEQ ID NO: 634527 - DNA, 20 bp, Artificial
  CRISPR gRNA sequence
tgtaaaacatactaatggat

SEQ ID NO: 634528 - DNA, 20 bp, Artificial
  CRISPR gRNA sequence
gtaaaacatactaatggata

SEQ ID NO: 634529 - DNA, 20 bp, Artificial
  CRISPR gRNA sequence
taaaacatactaatggataa

SEQ ID NO: 634530 - DNA, 20 bp, Artificial
  CRISPR gRNA sequence
atggataaccaaaaacactg

SEQ ID NO: 634531 - DNA, 20 bp, Artificial
  CRISPR gRNA sequence
aattcttggagctcatacgt

SEQ ID NO: 634532 - DNA, 20 bp, Artificial
  CRISPR gRNA sequence
ttggagctcatacgttcttc

SEQ ID NO: 634533 - DNA, 20 bp, Artificial
  CRISPR gRNA sequence
ggagctcatacgttcttctt

SEQ ID NO: 634534 - DNA, 20 bp, Artificial
  CRISPR gRNA sequence
gagctcatacgttcttcttt

SEQ ID NO: 634535 - DNA, 20 bp, Artificial
  CRISPR gRNA sequence
atacgttcttctttggtacg

SEQ ID NO: 634536 - DNA, 20 bp, Artificial
  CRISPR gRNA sequence
ttctttggtacgtccgagta

SEQ ID NO: 634537 - DNA, 20 bp, Artificial
  CRISPR gRNA sequence
ctttggtacgtccgagtata

SEQ ID NO: 634538 - DNA, 20 bp, Artificial
  CRISPR gRNA sequence
tttggtacgtccgagtatac

SEQ ID NO: 634539 - DNA, 20 bp, Artificial
  CRISPR gRNA sequence
tggtacgtccgagtatactt

SEQ ID NO: 634540 - DNA, 20 bp, Artificial
  CRISPR gRNA sequence
ggtacgtccgagtatacttc

SEQ ID NO: 634541 - DNA, 20 bp, Artificial
  CRISPR gRNA sequence
gtacgtccgagtatacttct

SEQ ID NO: 634542 - DNA, 20 bp, Artificial
  CRISPR gRNA sequence
ctagcagttgagctgtatgt

SEQ ID NO: 634543 - DNA, 20 bp, Artificial
  CRISPR gRNA sequence
tagcagttgagctgtatgtg

SEQ ID NO: 634544 - DNA, 20 bp, Artificial
  CRISPR gRNA sequence
gcagttgagctgtatgtgta

SEQ ID NO: 634545 - DNA, 20 bp, Artificial
  CRISPR gRNA sequence
agctgtatgtgtagtcacta

SEQ ID NO: 634546 - DNA, 20 bp, Artificial
  CRISPR gRNA sequence
tatgtgtagtcactaagagt

SEQ ID NO: 634547 - DNA, 20 bp, Artificial
  CRISPR gRNA sequence
agagtcaggtatgactgtag

SEQ ID NO: 634548 - DNA, 20 bp, Artificial
  CRISPR gRNA sequence
tagcaaaacctatttatgcc

SEQ ID NO: 634549 - DNA, 20 bp, Artificial
  CRISPR gRNA sequence
tttatgccagtttacctgct

SEQ ID NO: 634550 - DNA, 20 bp, Artificial
  CRISPR gRNA sequence
atgccagtttacctgctata

SEQ ID NO: 634551 - DNA, 20 bp, Artificial
  CRISPR gRNA sequence
tgccagtttacctgctataa

SEQ ID NO: 634552 - DNA, 20 bp, Artificial
  CRISPR gRNA sequence
acctgctataattatttcca

SEQ ID NO: 634553 - DNA, 20 bp, Artificial
  CRISPR gRNA sequence
cctgctataattatttccaa

SEQ ID NO: 634554 - DNA, 20 bp, Artificial
  CRISPR gRNA sequence
ctataattatttccaacgaa

SEQ ID NO: 634555 - DNA, 20 bp, Artificial
  CRISPR gRNA sequence
taattatttccaacgaaata

SEQ ID NO: 634556 - DNA, 20 bp, Artificial
  CRISPR gRNA sequence
tttccaacgaaataattaca

SEQ ID NO: 634557 - DNA, 20 bp, Artificial
  CRISPR gRNA sequence
ccaacgaaataattacaaaa

SEQ ID NO: 634558 - DNA, 20 bp, Artificial
  CRISPR gRNA sequence
caacgaaataattacaaaaa

SEQ ID NO: 634559 - DNA, 20 bp, Artificial
  CRISPR gRNA sequence
caaaaagaatactgtttcta

SEQ ID NO: 634560 - DNA, 20 bp, Artificial
  CRISPR gRNA sequence
tttctatgaaaccaaatttt

SEQ ID NO: 634561 - DNA, 20 bp, Artificial
  CRISPR gRNA sequence
ctatgaaaccaaattttacc

SEQ ID NO: 634562 - DNA, 20 bp, Artificial
  CRISPR gRNA sequence
tatgaaaccaaattttacca

SEQ ID NO: 634563 - DNA, 20 bp, Artificial
  CRISPR gRNA sequence
tgaaaccaaattttaccact

SEQ ID NO: 634564 - DNA, 20 bp, Artificial
  CRISPR gRNA sequence
taccactttgaaaagattca

SEQ ID NO: 634565 - DNA, 20 bp, Artificial
  CRISPR gRNA sequence
accactttgaaaagattcaa

SEQ ID NO: 634566 - DNA, 20 bp, Artificial
  CRISPR gRNA sequence
ccactttgaaaagattcaat

SEQ ID NO: 634567 - DNA, 20 bp, Artificial
  CRISPR gRNA sequence
tgaaaagattcaataaagat

SEQ ID NO: 634568 - DNA, 20 bp, Artificial
  CRISPR gRNA sequence
gaaaagattcaataaagata

SEQ ID NO: 634569 - DNA, 20 bp, Artificial
  CRISPR gRNA sequence
aaaagattcaataaagataa

SEQ ID NO: 634570 - DNA, 20 bp, Artificial
  CRISPR gRNA sequence
aataaagataagctgataaa

SEQ ID NO: 634571 - DNA, 20 bp, Artificial
  CRISPR gRNA sequence
ataaaaatatttctaaagaa

SEQ ID NO: 634572 - DNA, 20 bp, Artificial
  CRISPR gRNA sequence
ctaaagaagtgaatgtgggc

SEQ ID NO: 634573 - DNA, 20 bp, Artificial
  CRISPR gRNA sequence
taaagaagtgaatgtgggca

SEQ ID NO: 634574 - DNA, 20 bp, Artificial
  CRISPR gRNA sequence
aagaagtgaatgtgggcaaa

SEQ ID NO: 634575 - DNA, 20 bp, Artificial
  CRISPR gRNA sequence
gtgaaaaaatctttaaaaat

SEQ ID NO: 634576 - DNA, 20 bp, Artificial
  CRISPR gRNA sequence
taaaaatgaatagaagtctg

SEQ ID NO: 634577 - DNA, 20 bp, Artificial
  CRISPR gRNA sequence
aaaaatgaatagaagtctga

SEQ ID NO: 634578 - DNA, 20 bp, Artificial
  CRISPR gRNA sequence
aaaatgaatagaagtctgac

SEQ ID NO: 634579 - DNA, 20 bp, Artificial
  CRISPR gRNA sequence
actgcttcacaggatcttta

SEQ ID NO: 634580 - DNA, 20 bp, Artificial
  CRISPR gRNA sequence
cttcacaggatctttaagtt

SEQ ID NO: 634581 - DNA, 20 bp, Artificial
  CRISPR gRNA sequence
cacaggatctttaagttctt

SEQ ID NO: 634582 - DNA, 20 bp, Artificial
  CRISPR gRNA sequence
acaggatctttaagttctta

SEQ ID NO: 634583 - DNA, 20 bp, Artificial
  CRISPR gRNA sequence
taagttcttaaagacactga

SEQ ID NO: 634584 - DNA, 20 bp, Artificial
  CRISPR gRNA sequence
aagttcttaaagacactgaa

SEQ ID NO: 634585 - DNA, 20 bp, Artificial
  CRISPR gRNA sequence
agttcttaaagacactgaaa

SEQ ID NO: 634586 - DNA, 20 bp, Artificial
  CRISPR gRNA sequence
ttaaagacactgaaaatgta

SEQ ID NO: 634587 - DNA, 20 bp, Artificial
  CRISPR gRNA sequence
aaagacactgaaaatgtaac

SEQ ID NO: 634588 - DNA, 20 bp, Artificial
  CRISPR gRNA sequence
aagacactgaaaatgtaact

SEQ ID NO: 634589 - DNA, 20 bp, Artificial
  CRISPR gRNA sequence
aaaatgtaactaaagataat

SEQ ID NO: 634590 - DNA, 20 bp, Artificial
  CRISPR gRNA sequence
aagataatgtgttatgggta

SEQ ID NO: 634591 - DNA, 20 bp, Artificial
  CRISPR gRNA sequence
tgggtatggtttagaccaga

SEQ ID NO: 634592 - DNA, 20 bp, Artificial
  CRISPR gRNA sequence
agaccagaaaaattacatgc

SEQ ID NO: 634593 - DNA, 20 bp, Artificial
  CRISPR gRNA sequence
gaccagaaaaattacatgct

SEQ ID NO: 634594 - DNA, 20 bp, Artificial
  CRISPR gRNA sequence
catgctattcaacaaccaaa

SEQ ID NO: 634595 - DNA, 20 bp, Artificial
  CRISPR gRNA sequence
ttcaacaaccaaatttctca

SEQ ID NO: 634596 - DNA, 20 bp, Artificial
  CRISPR gRNA sequence
aacaaccaaatttctcactg

SEQ ID NO: 634597 - DNA, 20 bp, Artificial
  CRISPR gRNA sequence
ctcactgaaagaaaagagct

SEQ ID NO: 634598 - DNA, 20 bp, Artificial
  CRISPR gRNA sequence
tcactgaaagaaaagagctt

SEQ ID NO: 634599 - DNA, 20 bp, Artificial
  CRISPR gRNA sequence
actgaaagaaaagagcttgg

SEQ ID NO: 634600 - DNA, 20 bp, Artificial
  CRISPR gRNA sequence
aaagaaaagagcttggcctt

SEQ ID NO: 634601 - DNA, 20 bp, Artificial
  CRISPR gRNA sequence
ggccttaaataaaaaaataa

SEQ ID NO: 634602 - DNA, 20 bp, Artificial
  CRISPR gRNA sequence
gccttaaataaaaaaataaa

SEQ ID NO: 634603 - DNA, 20 bp, Artificial
  CRISPR gRNA sequence
aaataaaaaaataaataaca

SEQ ID NO: 634604 - DNA, 20 bp, Artificial
  CRISPR gRNA sequence
aataaaaaaataaataacaa

SEQ ID NO: 634605 - DNA, 20 bp, Artificial
  CRISPR gRNA sequence
catttatattttttaaagta

SEQ ID NO: 634606 - DNA, 20 bp, Artificial
  CRISPR gRNA sequence
atattttttaaagtaaaaac

SEQ ID NO: 634607 - DNA, 20 bp, Artificial
  CRISPR gRNA sequence
tattttttaaagtaaaaact

SEQ ID NO: 634608 - DNA, 20 bp, Artificial
  CRISPR gRNA sequence
tttaaagtaaaaacttttca

SEQ ID NO: 634609 - DNA, 20 bp, Artificial
  CRISPR gRNA sequence
ttaaagtaaaaacttttcaa

SEQ ID NO: 634610 - DNA, 20 bp, Artificial
  CRISPR gRNA sequence
taaagtaaaaacttttcaaa

SEQ ID NO: 634611 - DNA, 20 bp, Artificial
  CRISPR gRNA sequence
aaagtaaaaacttttcaaaa

SEQ ID NO: 634612 - DNA, 20 bp, Artificial
  CRISPR gRNA sequence
aagtaaaaacttttcaaaac

SEQ ID NO: 634613 - DNA, 20 bp, Artificial
  CRISPR gRNA sequence
ttcaaaactgcattttccat

SEQ ID NO: 634614 - DNA, 20 bp, Artificial
  CRISPR gRNA sequence
tcaaaactgcattttccatg

SEQ ID NO: 634615 - DNA, 20 bp, Artificial
  CRISPR gRNA sequence
caaaactgcattttccatgt

SEQ ID NO: 634616 - DNA, 20 bp, Artificial
  CRISPR gRNA sequence
aaaactgcattttccatgtt

SEQ ID NO: 634617 - DNA, 20 bp, Artificial
  CRISPR gRNA sequence
cattttccatgttactagac

SEQ ID NO: 634618 - DNA, 20 bp, Artificial
  CRISPR gRNA sequence
tccatgttactagacttatt

SEQ ID NO: 634619 - DNA, 20 bp, Artificial
  CRISPR gRNA sequence
ccatgttactagacttattg

SEQ ID NO: 634620 - DNA, 20 bp, Artificial
  CRISPR gRNA sequence
catgttactagacttattgc

SEQ ID NO: 634621 - DNA, 20 bp, Artificial
  CRISPR gRNA sequence
ctagacttattgctattaat

SEQ ID NO: 634622 - DNA, 20 bp, Artificial
  CRISPR gRNA sequence
gacttattgctattaatcta

SEQ ID NO: 634623 - DNA, 20 bp, Artificial
  CRISPR gRNA sequence
attgctattaatctacaatc

SEQ ID NO: 634624 - DNA, 20 bp, Artificial
  CRISPR gRNA sequence
ttgctattaatctacaatct

SEQ ID NO: 634625 - DNA, 20 bp, Artificial
  CRISPR gRNA sequence
ctattaatctacaatctctt

SEQ ID NO: 634626 - DNA, 20 bp, Artificial
  CRISPR gRNA sequence
ttaatctacaatctcttttt

SEQ ID NO: 634627 - DNA, 20 bp, Artificial
  CRISPR gRNA sequence
atctacaatctctttttgct

SEQ ID NO: 634628 - DNA, 20 bp, Artificial
  CRISPR gRNA sequence
caatctctttttgcttatgt

SEQ ID NO: 634629 - DNA, 20 bp, Artificial
  CRISPR gRNA sequence
tttttgcttatgttagataa

SEQ ID NO: 634630 - DNA, 20 bp, Artificial
  CRISPR gRNA sequence
tttgcttatgttagataaaa

SEQ ID NO: 634631 - DNA, 20 bp, Artificial
  CRISPR gRNA sequence
ttgcttatgttagataaaaa

SEQ ID NO: 634632 - DNA, 20 bp, Artificial
  CRISPR gRNA sequence
tgcttatgttagataaaaag

SEQ ID NO: 634633 - DNA, 20 bp, Artificial
  CRISPR gRNA sequence
gcttatgttagataaaaagg

SEQ ID NO: 634634 - DNA, 20 bp, Artificial
  CRISPR gRNA sequence
cttatgttagataaaaaggt

SEQ ID NO: 634635 - DNA, 20 bp, Artificial
  CRISPR gRNA sequence
atgttagataaaaaggtttt

SEQ ID NO: 634636 - DNA, 20 bp, Artificial
  CRISPR gRNA sequence
tgttagataaaaaggttttt

SEQ ID NO: 634637 - DNA, 20 bp, Artificial
  CRISPR gRNA sequence
gataaaaaggttttttatta

SEQ ID NO: 634638 - DNA, 20 bp, Artificial
  CRISPR gRNA sequence
tttattaaagaaaccatgga

SEQ ID NO: 634639 - DNA, 20 bp, Artificial
  CRISPR gRNA sequence
ttattaaagaaaccatggaa

SEQ ID NO: 634640 - DNA, 20 bp, Artificial
  CRISPR gRNA sequence
tattaaagaaaccatggaaa

SEQ ID NO: 634641 - DNA, 20 bp, Artificial
  CRISPR gRNA sequence
attaaagaaaccatggaaaa

SEQ ID NO: 634642 - DNA, 20 bp, Artificial
  CRISPR gRNA sequence
ttaaagaaaccatggaaaat

SEQ ID NO: 634643 - DNA, 20 bp, Artificial
  CRISPR gRNA sequence
aagaaaccatggaaaatgct

SEQ ID NO: 634644 - DNA, 20 bp, Artificial
  CRISPR gRNA sequence
agtacagtgtctactgtcta

SEQ ID NO: 634645 - DNA, 20 bp, Artificial
  CRISPR gRNA sequence
gtacagtgtctactgtctag

SEQ ID NO: 634646 - DNA, 20 bp, Artificial
  CRISPR gRNA sequence
ctgtctagggaaagctcaag

SEQ ID NO: 634647 - DNA, 20 bp, Artificial
  CRISPR gRNA sequence
tctagggaaagctcaagaaa

SEQ ID NO: 634648 - DNA, 20 bp, Artificial
  CRISPR gRNA sequence
gggaaagctcaagaaattcc

SEQ ID NO: 634649 - DNA, 20 bp, Artificial
  CRISPR gRNA sequence
aagaaattccagataaataa

SEQ ID NO: 634650 - DNA, 20 bp, Artificial
  CRISPR gRNA sequence
cagataaataacctaactac

SEQ ID NO: 634651 - DNA, 20 bp, Artificial
  CRISPR gRNA sequence
actaccaggcctatgcaata

SEQ ID NO: 634652 - DNA, 20 bp, Artificial
  CRISPR gRNA sequence
ccaggcctatgcaataaaaa

SEQ ID NO: 634653 - DNA, 20 bp, Artificial
  CRISPR gRNA sequence
tgcaataaaaaccaagacac

SEQ ID NO: 634654 - DNA, 20 bp, Artificial
  CRISPR gRNA sequence
cttggtgtcctctagaggac

SEQ ID NO: 634655 - DNA, 20 bp, Artificial
  CRISPR gRNA sequence
ggtgtcctctagaggacaag

SEQ ID NO: 634656 - DNA, 20 bp, Artificial
  CRISPR gRNA sequence
gtgtcctctagaggacaaga

SEQ ID NO: 634657 - DNA, 20 bp, Artificial
  CRISPR gRNA sequence
tagaggacaagaagagttcc

SEQ ID NO: 634658 - DNA, 20 bp, Artificial
  CRISPR gRNA sequence
gaggacaagaagagttccta

SEQ ID NO: 634659 - DNA, 20 bp, Artificial
  CRISPR gRNA sequence
ctaagcagaaaaataccacc

SEQ ID NO: 634660 - DNA, 20 bp, Artificial
  CRISPR gRNA sequence
agcagaaaaataccaccttg

SEQ ID NO: 634661 - DNA, 20 bp, Artificial
  CRISPR gRNA sequence
gtacagggatcatgcaaggt

SEQ ID NO: 634662 - DNA, 20 bp, Artificial
  CRISPR gRNA sequence
tacagggatcatgcaaggta

SEQ ID NO: 634663 - DNA, 20 bp, Artificial
  CRISPR gRNA sequence
gtatttacttaatacatatt

SEQ ID NO: 634664 - DNA, 20 bp, Artificial
  CRISPR gRNA sequence
acttaatacatattgtattc

SEQ ID NO: 634665 - DNA, 20 bp, Artificial
  CRISPR gRNA sequence
cttaatacatattgtattcc

SEQ ID NO: 634666 - DNA, 20 bp, Artificial
  CRISPR gRNA sequence
aatacatattgtattccaga

SEQ ID NO: 634667 - DNA, 20 bp, Artificial
  CRISPR gRNA sequence
atacatattgtattccagat

SEQ ID NO: 634668 - DNA, 20 bp, Artificial
  CRISPR gRNA sequence
tattccagatatttttcaaa

SEQ ID NO: 634669 - DNA, 20 bp, Artificial
  CRISPR gRNA sequence
cagatatttttcaaagtatt

SEQ ID NO: 634670 - DNA, 20 bp, Artificial
  CRISPR gRNA sequence
ttcaaagtatttttcatttc

SEQ ID NO: 634671 - DNA, 20 bp, Artificial
  CRISPR gRNA sequence
tcaaagtatttttcatttct

SEQ ID NO: 634672 - DNA, 20 bp, Artificial
  CRISPR gRNA sequence
caaagtatttttcatttctt

SEQ ID NO: 634673 - DNA, 20 bp, Artificial
  CRISPR gRNA sequence
aaagtatttttcatttctta

SEQ ID NO: 634674 - DNA, 20 bp, Artificial
  CRISPR gRNA sequence
ttcatttcttaaactgtaac

SEQ ID NO: 634675 - DNA, 20 bp, Artificial
  CRISPR gRNA sequence
tcatttcttaaactgtaaca

SEQ ID NO: 634676 - DNA, 20 bp, Artificial
  CRISPR gRNA sequence
catttcttaaactgtaacat

SEQ ID NO: 634677 - DNA, 20 bp, Artificial
  CRISPR gRNA sequence
atttcttaaactgtaacatc

SEQ ID NO: 634678 - DNA, 20 bp, Artificial
  CRISPR gRNA sequence
cttaaactgtaacatctatc

SEQ ID NO: 634679 - DNA, 20 bp, Artificial
  CRISPR gRNA sequence
ttaaactgtaacatctatca

SEQ ID NO: 634680 - DNA, 20 bp, Artificial
  CRISPR gRNA sequence
aaactgtaacatctatcaca

SEQ ID NO: 634681 - DNA, 20 bp, Artificial
  CRISPR gRNA sequence
aactgtaacatctatcacag

SEQ ID NO: 634682 - DNA, 20 bp, Artificial
  CRISPR gRNA sequence
taacatctatcacagtaatg

SEQ ID NO: 634683 - DNA, 20 bp, Artificial
  CRISPR gRNA sequence
tcacagtaatgtattcatgc

SEQ ID NO: 634684 - DNA, 20 bp, Artificial
  CRISPR gRNA sequence
atgcacatctgtgctgggct

SEQ ID NO: 634685 - DNA, 20 bp, Artificial
  CRISPR gRNA sequence
tgctgggcttgttgttacca

SEQ ID NO: 634686 - DNA, 20 bp, Artificial
  CRISPR gRNA sequence
ggcttgttgttaccaaccta

SEQ ID NO: 634687 - DNA, 20 bp, Artificial
  CRISPR gRNA sequence
gttgttaccaacctactaaa

SEQ ID NO: 634688 - DNA, 20 bp, Artificial
  CRISPR gRNA sequence
ttgttaccaacctactaaat

SEQ ID NO: 634689 - DNA, 20 bp, Artificial
  CRISPR gRNA sequence
ttaccaacctactaaatgaa

SEQ ID NO: 634690 - DNA, 20 bp, Artificial
  CRISPR gRNA sequence
ccaacctactaaatgaaaat

SEQ ID NO: 634691 - DNA, 20 bp, Artificial
  CRISPR gRNA sequence
ctaaatgaaaatcaagatga

SEQ ID NO: 634692 - DNA, 20 bp, Artificial
  CRISPR gRNA sequence
aatgaaaatcaagatgagaa

SEQ ID NO: 634693 - DNA, 20 bp, Artificial
  CRISPR gRNA sequence
ttaagtctacaatataggaa

SEQ ID NO: 634694 - DNA, 20 bp, Artificial
  CRISPR gRNA sequence
taagtctacaatataggaag

SEQ ID NO: 634695 - DNA, 20 bp, Artificial
  CRISPR gRNA sequence
aagtctacaatataggaagc

SEQ ID NO: 634696 - DNA, 20 bp, Artificial
  CRISPR gRNA sequence
agtctacaatataggaagca

SEQ ID NO: 634697 - DNA, 20 bp, Artificial
  CRISPR gRNA sequence
caatataggaagcagaaatg

SEQ ID NO: 634698 - DNA, 20 bp, Artificial
  CRISPR gRNA sequence
atatccaacatgataaataa

SEQ ID NO: 634699 - DNA, 20 bp, Artificial
  CRISPR gRNA sequence
ttacctggaggaaaaaggga

SEQ ID NO: 634700 - DNA, 20 bp, Artificial
  CRISPR gRNA sequence
cctggaggaaaaagggaggc

SEQ ID NO: 634701 - DNA, 20 bp, Artificial
  CRISPR gRNA sequence
gaggaaaaagggaggctaat

SEQ ID NO: 634702 - DNA, 20 bp, Artificial
  CRISPR gRNA sequence
atactttctaccaataataa

SEQ ID NO: 634703 - DNA, 20 bp, Artificial
  CRISPR gRNA sequence
tctaccaataataatattca

SEQ ID NO: 634704 - DNA, 20 bp, Artificial
  CRISPR gRNA sequence
ctaccaataataatattcat

SEQ ID NO: 634705 - DNA, 20 bp, Artificial
  CRISPR gRNA sequence
taccaataataatattcata

SEQ ID NO: 634706 - DNA, 20 bp, Artificial
  CRISPR gRNA sequence
ccaataataatattcataaa

SEQ ID NO: 634707 - DNA, 20 bp, Artificial
  CRISPR gRNA sequence
ataaaaacagagattaaatt

SEQ ID NO: 634708 - DNA, 20 bp, Artificial
  CRISPR gRNA sequence
aatttaaaatcattatattc

SEQ ID NO: 634709 - DNA, 20 bp, Artificial
  CRISPR gRNA sequence
aaaatcattatattcccctt

SEQ ID NO: 634710 - DNA, 20 bp, Artificial
  CRISPR gRNA sequence
aaatcattatattcccctta

SEQ ID NO: 634711 - DNA, 20 bp, Artificial
  CRISPR gRNA sequence
tattccccttaatactctat

SEQ ID NO: 634712 - DNA, 20 bp, Artificial
  CRISPR gRNA sequence
cccttaatactctatatcag

SEQ ID NO: 634713 - DNA, 20 bp, Artificial
  CRISPR gRNA sequence
aatactctatatcagcagtt

SEQ ID NO: 634714 - DNA, 20 bp, Artificial
  CRISPR gRNA sequence
atactctatatcagcagttc

SEQ ID NO: 634715 - DNA, 20 bp, Artificial
  CRISPR gRNA sequence
tatatcagcagttcccaacc

SEQ ID NO: 634716 - DNA, 20 bp, Artificial
  CRISPR gRNA sequence
tatcagcagttcccaacctt

SEQ ID NO: 634717 - DNA, 20 bp, Artificial
  CRISPR gRNA sequence
ccaaccttttcaccaccagg

SEQ ID NO: 634718 - DNA, 20 bp, Artificial
  CRISPR gRNA sequence
ttcaccaccagggaccagtt

SEQ ID NO: 634719 - DNA, 20 bp, Artificial
  CRISPR gRNA sequence
tcaccaccagggaccagttt

SEQ ID NO: 634720 - DNA, 20 bp, Artificial
  CRISPR gRNA sequence
caccaccagggaccagtttc

SEQ ID NO: 634721 - DNA, 20 bp, Artificial
  CRISPR gRNA sequence
accaccagggaccagtttca

SEQ ID NO: 634722 - DNA, 20 bp, Artificial
  CRISPR gRNA sequence
catggaagacagtttttcca

SEQ ID NO: 634723 - DNA, 20 bp, Artificial
  CRISPR gRNA sequence
atggaagacagtttttccac

SEQ ID NO: 634724 - DNA, 20 bp, Artificial
  CRISPR gRNA sequence
ttccacaaatgacaggtggt

SEQ ID NO: 634725 - DNA, 20 bp, Artificial
  CRISPR gRNA sequence
tccacaaatgacaggtggtg

SEQ ID NO: 634726 - DNA, 20 bp, Artificial
  CRISPR gRNA sequence
ccacaaatgacaggtggtgg

SEQ ID NO: 634727 - DNA, 20 bp, Artificial
  CRISPR gRNA sequence
cacaaatgacaggtggtggg

SEQ ID NO: 634728 - DNA, 20 bp, Artificial
  CRISPR gRNA sequence
cagaatgaaactattccacc

SEQ ID NO: 634729 - DNA, 20 bp, Artificial
  CRISPR gRNA sequence
agaatgaaactattccacct

SEQ ID NO: 634730 - DNA, 20 bp, Artificial
  CRISPR gRNA sequence
ttccacctcagatcatcagg

SEQ ID NO: 634731 - DNA, 20 bp, Artificial
  CRISPR gRNA sequence
cacctcagatcatcaggcat

SEQ ID NO: 634732 - DNA, 20 bp, Artificial
  CRISPR gRNA sequence
agatcatcaggcattagatt

SEQ ID NO: 634733 - DNA, 20 bp, Artificial
  CRISPR gRNA sequence
gattctcataaggagcacac

SEQ ID NO: 634734 - DNA, 20 bp, Artificial
  CRISPR gRNA sequence
tcataaggagcacaccaagt

SEQ ID NO: 634735 - DNA, 20 bp, Artificial
  CRISPR gRNA sequence
ataaggagcacaccaagtag

SEQ ID NO: 634736 - DNA, 20 bp, Artificial
  CRISPR gRNA sequence
gcatgcgcagttcacaatag

SEQ ID NO: 634737 - DNA, 20 bp, Artificial
  CRISPR gRNA sequence
catgcgcagttcacaatagg

SEQ ID NO: 634738 - DNA, 20 bp, Artificial
  CRISPR gRNA sequence
acaatagggtgcgtgcctat

SEQ ID NO: 634739 - DNA, 20 bp, Artificial
  CRISPR gRNA sequence
tgagaatctaatgctgtcac

SEQ ID NO: 634740 - DNA, 20 bp, Artificial
  CRISPR gRNA sequence
atgctgtcactgatctgaca

SEQ ID NO: 634741 - DNA, 20 bp, Artificial
  CRISPR gRNA sequence
tcactgatctgacaggaaga

SEQ ID NO: 634742 - DNA, 20 bp, Artificial
  CRISPR gRNA sequence
atctgacaggaagaggagct

SEQ ID NO: 634743 - DNA, 20 bp, Artificial
  CRISPR gRNA sequence
acaggaagaggagctcaggc

SEQ ID NO: 634744 - DNA, 20 bp, Artificial
  CRISPR gRNA sequence
aggcagtaatgcttgctcac

SEQ ID NO: 634745 - DNA, 20 bp, Artificial
  CRISPR gRNA sequence
gctcactgctgctcacctcc

SEQ ID NO: 634746 - DNA, 20 bp, Artificial
  CRISPR gRNA sequence
ctcactgctgctcacctcct

SEQ ID NO: 634747 - DNA, 20 bp, Artificial
  CRISPR gRNA sequence
actgctgctcacctcctgct

SEQ ID NO: 634748 - DNA, 20 bp, Artificial
  CRISPR gRNA sequence
ctgctcacctcctgctatgc

SEQ ID NO: 634749 - DNA, 20 bp, Artificial
  CRISPR gRNA sequence
ctcacctcctgctatgcggc

SEQ ID NO: 634750 - DNA, 20 bp, Artificial
  CRISPR gRNA sequence
acctcctgctatgcggctca

SEQ ID NO: 634751 - DNA, 20 bp, Artificial
  CRISPR gRNA sequence
ctgctatgcggctcaatttg

SEQ ID NO: 634752 - DNA, 20 bp, Artificial
  CRISPR gRNA sequence
ctatgcggctcaatttgtaa

SEQ ID NO: 634753 - DNA, 20 bp, Artificial
  CRISPR gRNA sequence
tgcggctcaatttgtaagag

SEQ ID NO: 634754 - DNA, 20 bp, Artificial
  CRISPR gRNA sequence
aatttgtaagaggccaccca

SEQ ID NO: 634755 - DNA, 20 bp, Artificial
  CRISPR gRNA sequence
gtaagaggccacccagtgac

SEQ ID NO: 634756 - DNA, 20 bp, Artificial
  CRISPR gRNA sequence
taagaggccacccagtgact

SEQ ID NO: 634757 - DNA, 20 bp, Artificial
  CRISPR gRNA sequence
gtactggtctgcagccagga

SEQ ID NO: 634758 - DNA, 20 bp, Artificial
  CRISPR gRNA sequence
gtctgcagccaggaggttga

SEQ ID NO: 634759 - DNA, 20 bp, Artificial
  CRISPR gRNA sequence
cagccaggaggttgaggacc

SEQ ID NO: 634760 - DNA, 20 bp, Artificial
  CRISPR gRNA sequence
aggacccctgctctatacta

SEQ ID NO: 634761 - DNA, 20 bp, Artificial
  CRISPR gRNA sequence
ctctatactagtaattttaa

SEQ ID NO: 634762 - DNA, 20 bp, Artificial
  CRISPR gRNA sequence
tatactagtaattttaagca

SEQ ID NO: 634763 - DNA, 20 bp, Artificial
  CRISPR gRNA sequence
tactagtaattttaagcact

SEQ ID NO: 634764 - DNA, 20 bp, Artificial
  CRISPR gRNA sequence
gtaattttaagcactagttc

SEQ ID NO: 634765 - DNA, 20 bp, Artificial
  CRISPR gRNA sequence
taagcactagttcttaaatt

SEQ ID NO: 634766 - DNA, 20 bp, Artificial
  CRISPR gRNA sequence
aagcactagttcttaaattt

SEQ ID NO: 634767 - DNA, 20 bp, Artificial
  CRISPR gRNA sequence
agcactagttcttaaatttt

SEQ ID NO: 634768 - DNA, 20 bp, Artificial
  CRISPR gRNA sequence
gttcttaaattttagttaat

SEQ ID NO: 634769 - DNA, 20 bp, Artificial
  CRISPR gRNA sequence
ttaaattttagttaatctgt

SEQ ID NO: 634770 - DNA, 20 bp, Artificial
  CRISPR gRNA sequence
aaattttagttaatctgtgg

SEQ ID NO: 634771 - DNA, 20 bp, Artificial
  CRISPR gRNA sequence
aattttagttaatctgtggc

SEQ ID NO: 634772 - DNA, 20 bp, Artificial
  CRISPR gRNA sequence
tagttaatctgtggcacatt

SEQ ID NO: 634773 - DNA, 20 bp, Artificial
  CRISPR gRNA sequence
agttaatctgtggcacattc

SEQ ID NO: 634774 - DNA, 20 bp, Artificial
  CRISPR gRNA sequence
gttaatctgtggcacattct

SEQ ID NO: 634775 - DNA, 20 bp, Artificial
  CRISPR gRNA sequence
atctgtggcacattctctgt

SEQ ID NO: 634776 - DNA, 20 bp, Artificial
  CRISPR gRNA sequence
tggcacattctctgtttggc

SEQ ID NO: 634777 - DNA, 20 bp, Artificial
  CRISPR gRNA sequence
tctgtttggctgccatagcc

SEQ ID NO: 634778 - DNA, 20 bp, Artificial
  CRISPR gRNA sequence
tgtttggctgccatagccat

SEQ ID NO: 634779 - DNA, 20 bp, Artificial
  CRISPR gRNA sequence
tttggctgccatagccattt

SEQ ID NO: 634780 - DNA, 20 bp, Artificial
  CRISPR gRNA sequence
ggctgccatagccattttcc

SEQ ID NO: 634781 - DNA, 20 bp, Artificial
  CRISPR gRNA sequence
gctgccatagccattttcca

SEQ ID NO: 634782 - DNA, 20 bp, Artificial
  CRISPR gRNA sequence
ccatagccattttccacact

SEQ ID NO: 634783 - DNA, 20 bp, Artificial
  CRISPR gRNA sequence
tccacacttctttgctctgc

SEQ ID NO: 634784 - DNA, 20 bp, Artificial
  CRISPR gRNA sequence
ccacacttctttgctctgct

SEQ ID NO: 634785 - DNA, 20 bp, Artificial
  CRISPR gRNA sequence
cacacttctttgctctgctc

SEQ ID NO: 634786 - DNA, 20 bp, Artificial
  CRISPR gRNA sequence
ctttgctctgctcccgcaaa

SEQ ID NO: 634787 - DNA, 20 bp, Artificial
  CRISPR gRNA sequence
tttgctctgctcccgcaaaa

SEQ ID NO: 634788 - DNA, 20 bp, Artificial
  CRISPR gRNA sequence
tgctctgctcccgcaaaagc

SEQ ID NO: 634789 - DNA, 20 bp, Artificial
  CRISPR gRNA sequence
gctctgctcccgcaaaagct

SEQ ID NO: 634790 - DNA, 20 bp, Artificial
  CRISPR gRNA sequence
ctctgctcccgcaaaagcta

SEQ ID NO: 634791 - DNA, 20 bp, Artificial
  CRISPR gRNA sequence
tgctcccgcaaaagctaatt

SEQ ID NO: 634792 - DNA, 20 bp, Artificial
  CRISPR gRNA sequence
ctcccgcaaaagctaatttt

SEQ ID NO: 634793 - DNA, 20 bp, Artificial
  CRISPR gRNA sequence
ccgcaaaagctaatttttat

SEQ ID NO: 634794 - DNA, 20 bp, Artificial
  CRISPR gRNA sequence
atttttattggctttaatca

SEQ ID NO: 634795 - DNA, 20 bp, Artificial
  CRISPR gRNA sequence
ttattggctttaatcaattg

SEQ ID NO: 634796 - DNA, 20 bp, Artificial
  CRISPR gRNA sequence
tattggctttaatcaattgg

SEQ ID NO: 634797 - DNA, 20 bp, Artificial
  CRISPR gRNA sequence
attggctttaatcaattggc

SEQ ID NO: 634798 - DNA, 20 bp, Artificial
  CRISPR gRNA sequence
ttggctttaatcaattggct

SEQ ID NO: 634799 - DNA, 20 bp, Artificial
  CRISPR gRNA sequence
gctttaatcaattggctccg

SEQ ID NO: 634800 - DNA, 20 bp, Artificial
  CRISPR gRNA sequence
taatcaattggctccgttgt

SEQ ID NO: 634801 - DNA, 20 bp, Artificial
  CRISPR gRNA sequence
aatcaattggctccgttgtc

SEQ ID NO: 634802 - DNA, 20 bp, Artificial
  CRISPR gRNA sequence
atcaattggctccgttgtcc

SEQ ID NO: 634803 - DNA, 20 bp, Artificial
  CRISPR gRNA sequence
gctccgttgtcctctggctt

SEQ ID NO: 634804 - DNA, 20 bp, Artificial
  CRISPR gRNA sequence
cgttgtcctctggcttctgg

SEQ ID NO: 634805 - DNA, 20 bp, Artificial
  CRISPR gRNA sequence
tcctctggcttctggttaag

SEQ ID NO: 634806 - DNA, 20 bp, Artificial
  CRISPR gRNA sequence
tggcttctggttaagtttag

SEQ ID NO: 634807 - DNA, 20 bp, Artificial
  CRISPR gRNA sequence
gcttctggttaagtttagtc

SEQ ID NO: 634808 - DNA, 20 bp, Artificial
  CRISPR gRNA sequence
ctggttaagtttagtcaatg

SEQ ID NO: 634809 - DNA, 20 bp, Artificial
  CRISPR gRNA sequence
tggttaagtttagtcaatgt

SEQ ID NO: 634810 - DNA, 20 bp, Artificial
  CRISPR gRNA sequence
gttaagtttagtcaatgtga

SEQ ID NO: 634811 - DNA, 20 bp, Artificial
  CRISPR gRNA sequence
agtttagtcaatgtgaggca

SEQ ID NO: 634812 - DNA, 20 bp, Artificial
  CRISPR gRNA sequence
agtcaatgtgaggcaccagt

SEQ ID NO: 634813 - DNA, 20 bp, Artificial
  CRISPR gRNA sequence
gtcaatgtgaggcaccagta

SEQ ID NO: 634814 - DNA, 20 bp, Artificial
  CRISPR gRNA sequence
aagggtggaaagagtgaggt

SEQ ID NO: 634815 - DNA, 20 bp, Artificial
  CRISPR gRNA sequence
attccccaagtcacaggtta

SEQ ID NO: 634816 - DNA, 20 bp, Artificial
  CRISPR gRNA sequence
ttccccaagtcacaggttag

SEQ ID NO: 634817 - DNA, 20 bp, Artificial
  CRISPR gRNA sequence
cccaagtcacaggttagcaa

SEQ ID NO: 634818 - DNA, 20 bp, Artificial
  CRISPR gRNA sequence
gcaaaggctacattcttcta

SEQ ID NO: 634819 - DNA, 20 bp, Artificial
  CRISPR gRNA sequence
cattcttctaccgaaggtca

SEQ ID NO: 634820 - DNA, 20 bp, Artificial
  CRISPR gRNA sequence
ttctaccgaaggtcagtgct

SEQ ID NO: 634821 - DNA, 20 bp, Artificial
  CRISPR gRNA sequence
ctaccgaaggtcagtgctca

SEQ ID NO: 634822 - DNA, 20 bp, Artificial
  CRISPR gRNA sequence
taccgaaggtcagtgctcaa

SEQ ID NO: 634823 - DNA, 20 bp, Artificial
  CRISPR gRNA sequence
ccgaaggtcagtgctcaaga

SEQ ID NO: 634824 - DNA, 20 bp, Artificial
  CRISPR gRNA sequence
aagaccctttcctatttctc

SEQ ID NO: 634825 - DNA, 20 bp, Artificial
  CRISPR gRNA sequence
tcctatttctcttaattcca

SEQ ID NO: 634826 - DNA, 20 bp, Artificial
  CRISPR gRNA sequence
cctatttctcttaattccag

SEQ ID NO: 634827 - DNA, 20 bp, Artificial
  CRISPR gRNA sequence
ctatttctcttaattccagt

SEQ ID NO: 634828 - DNA, 20 bp, Artificial
  CRISPR gRNA sequence
tttctcttaattccagtgac

SEQ ID NO: 634829 - DNA, 20 bp, Artificial
  CRISPR gRNA sequence
ctcttaattccagtgacctc

SEQ ID NO: 634830 - DNA, 20 bp, Artificial
  CRISPR gRNA sequence
tcttaattccagtgacctct

SEQ ID NO: 634831 - DNA, 20 bp, Artificial
  CRISPR gRNA sequence
ttaattccagtgacctctag

SEQ ID NO: 634832 - DNA, 20 bp, Artificial
  CRISPR gRNA sequence
aattccagtgacctctagat

SEQ ID NO: 634833 - DNA, 20 bp, Artificial
  CRISPR gRNA sequence
attccagtgacctctagatc

SEQ ID NO: 634834 - DNA, 20 bp, Artificial
  CRISPR gRNA sequence
cagtgacctctagatcccct

SEQ ID NO: 634835 - DNA, 20 bp, Artificial
  CRISPR gRNA sequence
tagatcccctttctctttca

SEQ ID NO: 634836 - DNA, 20 bp, Artificial
  CRISPR gRNA sequence
gatcccctttctctttcagg

SEQ ID NO: 634837 - DNA, 20 bp, Artificial
  CRISPR gRNA sequence
tctctttcaggctagagcta

SEQ ID NO: 634838 - DNA, 20 bp, Artificial
  CRISPR gRNA sequence
ctctttcaggctagagctag

SEQ ID NO: 634839 - DNA, 20 bp, Artificial
  CRISPR gRNA sequence
tctttcaggctagagctagt

SEQ ID NO: 634840 - DNA, 20 bp, Artificial
  CRISPR gRNA sequence
tttcaggctagagctagtaa

SEQ ID NO: 634841 - DNA, 20 bp, Artificial
  CRISPR gRNA sequence
tcaggctagagctagtaaat

SEQ ID NO: 634842 - DNA, 20 bp, Artificial
  CRISPR gRNA sequence
caggctagagctagtaaatg

SEQ ID NO: 634843 - DNA, 20 bp, Artificial
  CRISPR gRNA sequence
aggctagagctagtaaatgg

SEQ ID NO: 634844 - DNA, 20 bp, Artificial
  CRISPR gRNA sequence
gagctagtaaatggcttcct

SEQ ID NO: 634845 - DNA, 20 bp, Artificial
  CRISPR gRNA sequence
gtaaatggcttcctactact

SEQ ID NO: 634846 - DNA, 20 bp, Artificial
  CRISPR gRNA sequence
cctactactgtaaacccagc

SEQ ID NO: 634847 - DNA, 20 bp, Artificial
  CRISPR gRNA sequence
ctactactgtaaacccagcc

SEQ ID NO: 634848 - DNA, 20 bp, Artificial
  CRISPR gRNA sequence
ctactgtaaacccagccatc

SEQ ID NO: 634849 - DNA, 20 bp, Artificial
  CRISPR gRNA sequence
ctgtaaacccagccatcttt

SEQ ID NO: 634850 - DNA, 20 bp, Artificial
  CRISPR gRNA sequence
taaacccagccatctttttg

SEQ ID NO: 634851 - DNA, 20 bp, Artificial
  CRISPR gRNA sequence
tttgtagactacccttattc

SEQ ID NO: 634852 - DNA, 20 bp, Artificial
  CRISPR gRNA sequence
ttgtagactacccttattcc

SEQ ID NO: 634853 - DNA, 20 bp, Artificial
  CRISPR gRNA sequence
tgtagactacccttattcct

SEQ ID NO: 634854 - DNA, 20 bp, Artificial
  CRISPR gRNA sequence
gtagactacccttattccta

SEQ ID NO: 634855 - DNA, 20 bp, Artificial
  CRISPR gRNA sequence
tagactacccttattcctaa

SEQ ID NO: 634856 - DNA, 20 bp, Artificial
  CRISPR gRNA sequence
cccttattcctaaccattct

SEQ ID NO: 634857 - DNA, 20 bp, Artificial
  CRISPR gRNA sequence
attcctaaccattcttttgt

SEQ ID NO: 634858 - DNA, 20 bp, Artificial
  CRISPR gRNA sequence
ttcctaaccattcttttgtg

SEQ ID NO: 634859 - DNA, 20 bp, Artificial
  CRISPR gRNA sequence
ctaaccattcttttgtgaat

SEQ ID NO: 634860 - DNA, 20 bp, Artificial
  CRISPR gRNA sequence
accattcttttgtgaatatt

SEQ ID NO: 634861 - DNA, 20 bp, Artificial
  CRISPR gRNA sequence
ttttgtgaatatttgtcttt

SEQ ID NO: 634862 - DNA, 20 bp, Artificial
  CRISPR gRNA sequence
ttgtgaatatttgtctttca

SEQ ID NO: 634863 - DNA, 20 bp, Artificial
  CRISPR gRNA sequence
tgtgaatatttgtctttcat

SEQ ID NO: 634864 - DNA, 20 bp, Artificial
  CRISPR gRNA sequence
gtgaatatttgtctttcatg

SEQ ID NO: 634865 - DNA, 20 bp, Artificial
  CRISPR gRNA sequence
tgaatatttgtctttcatgc

SEQ ID NO: 634866 - DNA, 20 bp, Artificial
  CRISPR gRNA sequence
gtctttcatgcatgtcccca

SEQ ID NO: 634867 - DNA, 20 bp, Artificial
  CRISPR gRNA sequence
tctttcatgcatgtccccaa

SEQ ID NO: 634868 - DNA, 20 bp, Artificial
  CRISPR gRNA sequence
tcatgcatgtccccaaattt

SEQ ID NO: 634869 - DNA, 20 bp, Artificial
  CRISPR gRNA sequence
catgcatgtccccaaatttt

SEQ ID NO: 634870 - DNA, 20 bp, Artificial
  CRISPR gRNA sequence
atgcatgtccccaaattttc

SEQ ID NO: 634871 - DNA, 20 bp, Artificial
  CRISPR gRNA sequence
tccccacttgagtgtcttac

SEQ ID NO: 634872 - DNA, 20 bp, Artificial
  CRISPR gRNA sequence
ccccacttgagtgtcttact

SEQ ID NO: 634873 - DNA, 20 bp, Artificial
  CRISPR gRNA sequence
cccacttgagtgtcttactg

SEQ ID NO: 634874 - DNA, 20 bp, Artificial
  CRISPR gRNA sequence
gagtgtcttactgttttctt

SEQ ID NO: 634875 - DNA, 20 bp, Artificial
  CRISPR gRNA sequence
agtgtcttactgttttcttg

SEQ ID NO: 634876 - DNA, 20 bp, Artificial
  CRISPR gRNA sequence
actgttttcttgtcaggatc

SEQ ID NO: 634877 - DNA, 20 bp, Artificial
  CRISPR gRNA sequence
ctgttttcttgtcaggatcc

SEQ ID NO: 634878 - DNA, 20 bp, Artificial
  CRISPR gRNA sequence
ttttcttgtcaggatcctga

SEQ ID NO: 634879 - DNA, 20 bp, Artificial
  CRISPR gRNA sequence
tcttgtcaggatcctgactg

SEQ ID NO: 634880 - DNA, 20 bp, Artificial
  CRISPR gRNA sequence
cttgtcaggatcctgactga

SEQ ID NO: 634881 - DNA, 20 bp, Artificial
  CRISPR gRNA sequence
ttgtcaggatcctgactgat

SEQ ID NO: 634882 - DNA, 20 bp, Artificial
  CRISPR gRNA sequence
gtcaggatcctgactgataa

SEQ ID NO: 634883 - DNA, 20 bp, Artificial
  CRISPR gRNA sequence
tcaggatcctgactgataaa

SEQ ID NO: 634884 - DNA, 20 bp, Artificial
  CRISPR gRNA sequence
actgataaagagttactgat

SEQ ID NO: 634885 - DNA, 20 bp, Artificial
  CRISPR gRNA sequence
ataaagagttactgatatca

SEQ ID NO: 634886 - DNA, 20 bp, Artificial
  CRISPR gRNA sequence
ctgatatcagaaatggccca

SEQ ID NO: 634887 - DNA, 20 bp, Artificial
  CRISPR gRNA sequence
atatcagaaatggcccaaag

SEQ ID NO: 634888 - DNA, 20 bp, Artificial
  CRISPR gRNA sequence
cagtcaaaatggaattcaag

SEQ ID NO: 634889 - DNA, 20 bp, Artificial
  CRISPR gRNA sequence
aaggatagcaggatagcctc

SEQ ID NO: 634890 - DNA, 20 bp, Artificial
  CRISPR gRNA sequence
cttatcacagagttaatggg

SEQ ID NO: 634891 - DNA, 20 bp, Artificial
  CRISPR gRNA sequence
atcacagagttaatgggaca

SEQ ID NO: 634892 - DNA, 20 bp, Artificial
  CRISPR gRNA sequence
tcacagagttaatgggacag

SEQ ID NO: 634893 - DNA, 20 bp, Artificial
  CRISPR gRNA sequence
atgggacagtagtgatccaa

SEQ ID NO: 634894 - DNA, 20 bp, Artificial
  CRISPR gRNA sequence
gcaagatgattattcaaatt

SEQ ID NO: 634895 - DNA, 20 bp, Artificial
  CRISPR gRNA sequence
ttcaaattgtcactggtggt

SEQ ID NO: 634896 - DNA, 20 bp, Artificial
  CRISPR gRNA sequence
aaattgtcactggtggtagc

SEQ ID NO: 634897 - DNA, 20 bp, Artificial
  CRISPR gRNA sequence
tcactggtggtagcatggaa

SEQ ID NO: 634898 - DNA, 20 bp, Artificial
  CRISPR gRNA sequence
gtggtagcatggaaggatgt

SEQ ID NO: 634899 - DNA, 20 bp, Artificial
  CRISPR gRNA sequence
tgggagccatggcattactt

SEQ ID NO: 634900 - DNA, 20 bp, Artificial
  CRISPR gRNA sequence
gggagccatggcattacttg

SEQ ID NO: 634901 - DNA, 20 bp, Artificial
  CRISPR gRNA sequence
ggagccatggcattacttgc

SEQ ID NO: 634902 - DNA, 20 bp, Artificial
  CRISPR gRNA sequence
cttgctaaagcagcaatggt

SEQ ID NO: 634903 - DNA, 20 bp, Artificial
  CRISPR gRNA sequence
gctaaagcagcaatggtagt

SEQ ID NO: 634904 - DNA, 20 bp, Artificial
  CRISPR gRNA sequence
ctaaagcagcaatggtagtg

SEQ ID NO: 634905 - DNA, 20 bp, Artificial
  CRISPR gRNA sequence
aagcagcaatggtagtgtat

SEQ ID NO: 634906 - DNA, 20 bp, Artificial
  CRISPR gRNA sequence
cagcatgatatggctgatgg

SEQ ID NO: 634907 - DNA, 20 bp, Artificial
  CRISPR gRNA sequence
atggccctaaggagcacaca

SEQ ID NO: 634908 - DNA, 20 bp, Artificial
  CRISPR gRNA sequence
aggagcacacaaaggtggaa

SEQ ID NO: 634909 - DNA, 20 bp, Artificial
  CRISPR gRNA sequence
agtgcctggaatactcaagt

SEQ ID NO: 634910 - DNA, 20 bp, Artificial
  CRISPR gRNA sequence
gaatactcaagtcagaatac

SEQ ID NO: 634911 - DNA, 20 bp, Artificial
  CRISPR gRNA sequence
aagtcagaatacaggcaaaa

SEQ ID NO: 634912 - DNA, 20 bp, Artificial
  CRISPR gRNA sequence
atgtcagctttaaaagggtc

SEQ ID NO: 634913 - DNA, 20 bp, Artificial
  CRISPR gRNA sequence
tgtcagctttaaaagggtcc

SEQ ID NO: 634914 - DNA, 20 bp, Artificial
  CRISPR gRNA sequence
taaaagggtcccttatccac

SEQ ID NO: 634915 - DNA, 20 bp, Artificial
  CRISPR gRNA sequence
aaaagggtcccttatccact

SEQ ID NO: 634916 - DNA, 20 bp, Artificial
  CRISPR gRNA sequence
aaagggtcccttatccactt

SEQ ID NO: 634917 - DNA, 20 bp, Artificial
  CRISPR gRNA sequence
atccacttaagcctcaaggc

SEQ ID NO: 634918 - DNA, 20 bp, Artificial
  CRISPR gRNA sequence
tccacttaagcctcaaggca

SEQ ID NO: 634919 - DNA, 20 bp, Artificial
  CRISPR gRNA sequence
aagcctcaaggcaaataagg

SEQ ID NO: 634920 - DNA, 20 bp, Artificial
  CRISPR gRNA sequence
agcctcaaggcaaataaggc

SEQ ID NO: 634921 - DNA, 20 bp, Artificial
  CRISPR gRNA sequence
aaggcaaataaggctgaaga

SEQ ID NO: 634922 - DNA, 20 bp, Artificial
  CRISPR gRNA sequence
aagaccaactccagaatctg

SEQ ID NO: 634923 - DNA, 20 bp, Artificial
  CRISPR gRNA sequence
cagaatctgatttgaagggt

SEQ ID NO: 634924 - DNA, 20 bp, Artificial
  CRISPR gRNA sequence
atttgaagggttatagaatt

SEQ ID NO: 634925 - DNA, 20 bp, Artificial
  CRISPR gRNA sequence
gaagggttatagaattgcaa

SEQ ID NO: 634926 - DNA, 20 bp, Artificial
  CRISPR gRNA sequence
aagggttatagaattgcaat

SEQ ID NO: 634927 - DNA, 20 bp, Artificial
  CRISPR gRNA sequence
tagaattgcaatgctaaata

SEQ ID NO: 634928 - DNA, 20 bp, Artificial
  CRISPR gRNA sequence
caatgctaaatacaatggac

SEQ ID NO: 634929 - DNA, 20 bp, Artificial
  CRISPR gRNA sequence
aatacaatggacaatactaa

SEQ ID NO: 634930 - DNA, 20 bp, Artificial
  CRISPR gRNA sequence
agaccattagtttttggtag

SEQ ID NO: 634931 - DNA, 20 bp, Artificial
  CRISPR gRNA sequence
gtttttggtagtggggcaat

SEQ ID NO: 634932 - DNA, 20 bp, Artificial
  CRISPR gRNA sequence
ttggtagtggggcaatgatg

SEQ ID NO: 634933 - DNA, 20 bp, Artificial
  CRISPR gRNA sequence
tggtagtggggcaatgatga

SEQ ID NO: 634934 - DNA, 20 bp, Artificial
  CRISPR gRNA sequence
ggtagtggggcaatgatgag

SEQ ID NO: 634935 - DNA, 20 bp, Artificial
  CRISPR gRNA sequence
gtagtggggcaatgatgaga

SEQ ID NO: 634936 - DNA, 20 bp, Artificial
  CRISPR gRNA sequence
ctccctccccctcaacaact

SEQ ID NO: 634937 - DNA, 20 bp, Artificial
  CRISPR gRNA sequence
tccctccccctcaacaactt

SEQ ID NO: 634938 - DNA, 20 bp, Artificial
  CRISPR gRNA sequence
cctccccctcaacaacttca

SEQ ID NO: 634939 - DNA, 20 bp, Artificial
  CRISPR gRNA sequence
cccctcaacaacttcattga

SEQ ID NO: 634940 - DNA, 20 bp, Artificial
  CRISPR gRNA sequence
aacaacttcattgaggtata

SEQ ID NO: 634941 - DNA, 20 bp, Artificial
  CRISPR gRNA sequence
cattgaggtatagttaatat

SEQ ID NO: 634942 - DNA, 20 bp, Artificial
  CRISPR gRNA sequence
attgaggtatagttaatata

SEQ ID NO: 634943 - DNA, 20 bp, Artificial
  CRISPR gRNA sequence
aggtatagttaatatacata

SEQ ID NO: 634944 - DNA, 20 bp, Artificial
  CRISPR gRNA sequence
atatacataaaactgtagta

SEQ ID NO: 634945 - DNA, 20 bp, Artificial
  CRISPR gRNA sequence
tagtaaaaaaacaagaaaaa

SEQ ID NO: 634946 - DNA, 20 bp, Artificial
  CRISPR gRNA sequence
tttcaacatgtagcactagc

SEQ ID NO: 634947 - DNA, 20 bp, Artificial
  CRISPR gRNA sequence
caacatgtagcactagccat

SEQ ID NO: 634948 - DNA, 20 bp, Artificial
  CRISPR gRNA sequence
aacatgtagcactagccata

SEQ ID NO: 634949 - DNA, 20 bp, Artificial
  CRISPR gRNA sequence
gccatatttaggtgtttagt

SEQ ID NO: 634950 - DNA, 20 bp, Artificial
  CRISPR gRNA sequence
aggtgtttagtaaccacatg

SEQ ID NO: 634951 - DNA, 20 bp, Artificial
  CRISPR gRNA sequence
ggtgtttagtaaccacatga

SEQ ID NO: 634952 - DNA, 20 bp, Artificial
  CRISPR gRNA sequence
agtaaccacatgaggctagt

SEQ ID NO: 634953 - DNA, 20 bp, Artificial
  CRISPR gRNA sequence
gtaaccacatgaggctagtg

SEQ ID NO: 634954 - DNA, 20 bp, Artificial
  CRISPR gRNA sequence
gtggctaccatattggacag

SEQ ID NO: 634955 - DNA, 20 bp, Artificial
  CRISPR gRNA sequence
ccatattggacagcgtagcc

SEQ ID NO: 634956 - DNA, 20 bp, Artificial
  CRISPR gRNA sequence
gacagcgtagccctacaact

SEQ ID NO: 634957 - DNA, 20 bp, Artificial
  CRISPR gRNA sequence
caactatcacctctcccaag

SEQ ID NO: 634958 - DNA, 20 bp, Artificial
  CRISPR gRNA sequence
tcacctctcccaagacagca

SEQ ID NO: 634959 - DNA, 20 bp, Artificial
  CRISPR gRNA sequence
tcccaagacagcaaactaaa

SEQ ID NO: 634960 - DNA, 20 bp, Artificial
  CRISPR gRNA sequence
ccaagacagcaaactaaaag

SEQ ID NO: 634961 - DNA, 20 bp, Artificial
  CRISPR gRNA sequence
aaagaaataataattctatg

SEQ ID NO: 634962 - DNA, 20 bp, Artificial
  CRISPR gRNA sequence
tatggatgaataacagacag

SEQ ID NO: 634963 - DNA, 20 bp, Artificial
  CRISPR gRNA sequence
tggatgaataacagacagta

SEQ ID NO: 634964 - DNA, 20 bp, Artificial
  CRISPR gRNA sequence
aaagatgttaggggtgataa

SEQ ID NO: 634965 - DNA, 20 bp, Artificial
  CRISPR gRNA sequence
ggggtgataattcacactat

SEQ ID NO: 634966 - DNA, 20 bp, Artificial
  CRISPR gRNA sequence
acactatacacccatttaaa

SEQ ID NO: 634967 - DNA, 20 bp, Artificial
  CRISPR gRNA sequence
tacacccatttaaactgttt

SEQ ID NO: 634968 - DNA, 20 bp, Artificial
  CRISPR gRNA sequence
aaactgtttattaggctaag

SEQ ID NO: 634969 - DNA, 20 bp, Artificial
  CRISPR gRNA sequence
aactgtttattaggctaagg

SEQ ID NO: 634970 - DNA, 20 bp, Artificial
  CRISPR gRNA sequence
tttattaggctaaggcatgg

SEQ ID NO: 634971 - DNA, 20 bp, Artificial
  CRISPR gRNA sequence
attaggctaaggcatggcat

SEQ ID NO: 634972 - DNA, 20 bp, Artificial
  CRISPR gRNA sequence
ttaggctaaggcatggcatt

SEQ ID NO: 634973 - DNA, 20 bp, Artificial
  CRISPR gRNA sequence
ggctaaggcatggcattgat

SEQ ID NO: 634974 - DNA, 20 bp, Artificial
  CRISPR gRNA sequence
aggcatggcattgatgcaga

SEQ ID NO: 634975 - DNA, 20 bp, Artificial
  CRISPR gRNA sequence
atgcagacttaatcatttca

SEQ ID NO: 634976 - DNA, 20 bp, Artificial
  CRISPR gRNA sequence
aatcatttcataatgctaac

SEQ ID NO: 634977 - DNA, 20 bp, Artificial
  CRISPR gRNA sequence
atcatttcataatgctaact

SEQ ID NO: 634978 - DNA, 20 bp, Artificial
  CRISPR gRNA sequence
cataatgctaactgtagatg

SEQ ID NO: 634979 - DNA, 20 bp, Artificial
  CRISPR gRNA sequence
ataatgctaactgtagatgc

SEQ ID NO: 634980 - DNA, 20 bp, Artificial
  CRISPR gRNA sequence
actgtagatgcagttttagc

SEQ ID NO: 634981 - DNA, 20 bp, Artificial
  CRISPR gRNA sequence
tagatgcagttttagctgta

SEQ ID NO: 634982 - DNA, 20 bp, Artificial
  CRISPR gRNA sequence
tagctgtacaatctttactg

SEQ ID NO: 634983 - DNA, 20 bp, Artificial
  CRISPR gRNA sequence
agctgtacaatctttactgg

SEQ ID NO: 634984 - DNA, 20 bp, Artificial
  CRISPR gRNA sequence
gctgtacaatctttactgga

SEQ ID NO: 634985 - DNA, 20 bp, Artificial
  CRISPR gRNA sequence
tacaatctttactggagcat

SEQ ID NO: 634986 - DNA, 20 bp, Artificial
  CRISPR gRNA sequence
tactggagcatattaacata

SEQ ID NO: 634987 - DNA, 20 bp, Artificial
  CRISPR gRNA sequence
actggagcatattaacatag

SEQ ID NO: 634988 - DNA, 20 bp, Artificial
  CRISPR gRNA sequence
ctggagcatattaacatagc

SEQ ID NO: 634989 - DNA, 20 bp, Artificial
  CRISPR gRNA sequence
gagcatattaacatagccac

SEQ ID NO: 634990 - DNA, 20 bp, Artificial
  CRISPR gRNA sequence
acatagccactgacactagg

SEQ ID NO: 634991 - DNA, 20 bp, Artificial
  CRISPR gRNA sequence
acactaggtatgaagcaatg

SEQ ID NO: 634992 - DNA, 20 bp, Artificial
  CRISPR gRNA sequence
ggtatgaagcaatgaacttg

SEQ ID NO: 634993 - DNA, 20 bp, Artificial
  CRISPR gRNA sequence
gatttctgtttaaggtaatt

SEQ ID NO: 634994 - DNA, 20 bp, Artificial
  CRISPR gRNA sequence
atttctgtttaaggtaattt

SEQ ID NO: 634995 - DNA, 20 bp, Artificial
  CRISPR gRNA sequence
ctgtttaaggtaatttgtat

SEQ ID NO: 634996 - DNA, 20 bp, Artificial
  CRISPR gRNA sequence
tgtttaaggtaatttgtata

SEQ ID NO: 634997 - DNA, 20 bp, Artificial
  CRISPR gRNA sequence
tttaaggtaatttgtataac

SEQ ID NO: 634998 - DNA, 20 bp, Artificial
  CRISPR gRNA sequence
aaggtaatttgtataacaaa

SEQ ID NO: 634999 - DNA, 20 bp, Artificial
  CRISPR gRNA sequence
aggtaatttgtataacaaag

SEQ ID NO: 635000 - DNA, 20 bp, Artificial
  CRISPR gRNA sequence
gtataacaaagataatcaga

SEQ ID NO: 635001 - DNA, 20 bp, Artificial
  CRISPR gRNA sequence
tataacaaagataatcagaa

SEQ ID NO: 635002 - DNA, 20 bp, Artificial
  CRISPR gRNA sequence
tttcccttcacactagagga

SEQ ID NO: 635003 - DNA, 20 bp, Artificial
  CRISPR gRNA sequence
ttcccttcacactagaggag

SEQ ID NO: 635004 - DNA, 20 bp, Artificial
  CRISPR gRNA sequence
tcccttcacactagaggagc

SEQ ID NO: 635005 - DNA, 20 bp, Artificial
  CRISPR gRNA sequence
cccttcacactagaggagca

SEQ ID NO: 635006 - DNA, 20 bp, Artificial
  CRISPR gRNA sequence
ccttcacactagaggagcaa

SEQ ID NO: 635007 - DNA, 20 bp, Artificial
  CRISPR gRNA sequence
cacactagaggagcaacata

SEQ ID NO: 635008 - DNA, 20 bp, Artificial
  CRISPR gRNA sequence
acactagaggagcaacatac

SEQ ID NO: 635009 - DNA, 20 bp, Artificial
  CRISPR gRNA sequence
gaggagcaacatacttttac

SEQ ID NO: 635010 - DNA, 20 bp, Artificial
  CRISPR gRNA sequence
ttactctcttaccttaaggc

SEQ ID NO: 635011 - DNA, 20 bp, Artificial
  CRISPR gRNA sequence
tactctcttaccttaaggct

SEQ ID NO: 635012 - DNA, 20 bp, Artificial
  CRISPR gRNA sequence
actctcttaccttaaggcta

SEQ ID NO: 635013 - DNA, 20 bp, Artificial
  CRISPR gRNA sequence
ctctcttaccttaaggctag

SEQ ID NO: 635014 - DNA, 20 bp, Artificial
  CRISPR gRNA sequence
tcttaccttaaggctaggtc

SEQ ID NO: 635015 - DNA, 20 bp, Artificial
  CRISPR gRNA sequence
ttaccttaaggctaggtcaa

SEQ ID NO: 635016 - DNA, 20 bp, Artificial
  CRISPR gRNA sequence
accttaaggctaggtcaact

SEQ ID NO: 635017 - DNA, 20 bp, Artificial
  CRISPR gRNA sequence
ccttaaggctaggtcaactc

SEQ ID NO: 635018 - DNA, 20 bp, Artificial
  CRISPR gRNA sequence
aaggctaggtcaactctgct

SEQ ID NO: 635019 - DNA, 20 bp, Artificial
  CRISPR gRNA sequence
aggctaggtcaactctgctc

SEQ ID NO: 635020 - DNA, 20 bp, Artificial
  CRISPR gRNA sequence
ggtcaactctgctctctttg

SEQ ID NO: 635021 - DNA, 20 bp, Artificial
  CRISPR gRNA sequence
tgctctctttgtcataacat

SEQ ID NO: 635022 - DNA, 20 bp, Artificial
  CRISPR gRNA sequence
ctctctttgtcataacatag

SEQ ID NO: 635023 - DNA, 20 bp, Artificial
  CRISPR gRNA sequence
tctttgtcataacatagtct

SEQ ID NO: 635024 - DNA, 20 bp, Artificial
  CRISPR gRNA sequence
tttgtcataacatagtctgg

SEQ ID NO: 635025 - DNA, 20 bp, Artificial
  CRISPR gRNA sequence
tgtcataacatagtctggag

SEQ ID NO: 635026 - DNA, 20 bp, Artificial
  CRISPR gRNA sequence
gtcataacatagtctggaga

SEQ ID NO: 635027 - DNA, 20 bp, Artificial
  CRISPR gRNA sequence
tcataacatagtctggagaa

SEQ ID NO: 635028 - DNA, 20 bp, Artificial
  CRISPR gRNA sequence
gagaaatcttgttcatcttg

SEQ ID NO: 635029 - DNA, 20 bp, Artificial
  CRISPR gRNA sequence
gttcatcttgacattccaaa

SEQ ID NO: 635030 - DNA, 20 bp, Artificial
  CRISPR gRNA sequence
ttcatcttgacattccaaaa

SEQ ID NO: 635031 - DNA, 20 bp, Artificial
  CRISPR gRNA sequence
atcttgacattccaaaaaac

SEQ ID NO: 635032 - DNA, 20 bp, Artificial
  CRISPR gRNA sequence
gacattccaaaaaacatcaa

SEQ ID NO: 635033 - DNA, 20 bp, Artificial
  CRISPR gRNA sequence
acattccaaaaaacatcaag

SEQ ID NO: 635034 - DNA, 20 bp, Artificial
  CRISPR gRNA sequence
caaaaaacatcaagctggaa

SEQ ID NO: 635035 - DNA, 20 bp, Artificial
  CRISPR gRNA sequence
gaatattatattcatgacat

SEQ ID NO: 635036 - DNA, 20 bp, Artificial
  CRISPR gRNA sequence
tattcatgacattacactga

SEQ ID NO: 635037 - DNA, 20 bp, Artificial
  CRISPR gRNA sequence
atgacattacactgagtgaa

SEQ ID NO: 635038 - DNA, 20 bp, Artificial
  CRISPR gRNA sequence
cactgagtgaacttgggagc

SEQ ID NO: 635039 - DNA, 20 bp, Artificial
  CRISPR gRNA sequence
agtgaacttgggagcaggat

SEQ ID NO: 635040 - DNA, 20 bp, Artificial
  CRISPR gRNA sequence
gggagcaggatatagtaaat

SEQ ID NO: 635041 - DNA, 20 bp, Artificial
  CRISPR gRNA sequence
ggagcaggatatagtaaata

SEQ ID NO: 635042 - DNA, 20 bp, Artificial
  CRISPR gRNA sequence
agatgcctcagtaagagata

SEQ ID NO: 635043 - DNA, 20 bp, Artificial
  CRISPR gRNA sequence
agtaagagatatatgctata

SEQ ID NO: 635044 - DNA, 20 bp, Artificial
  CRISPR gRNA sequence
tagaataggagataaactcc

SEQ ID NO: 635045 - DNA, 20 bp, Artificial
  CRISPR gRNA sequence
caagaaagttcagggacttt

SEQ ID NO: 635046 - DNA, 20 bp, Artificial
  CRISPR gRNA sequence
agggactttcagcattggta

SEQ ID NO: 635047 - DNA, 20 bp, Artificial
  CRISPR gRNA sequence
tcagcattggtaaaatttta

SEQ ID NO: 635048 - DNA, 20 bp, Artificial
  CRISPR gRNA sequence
cagcattggtaaaattttac

SEQ ID NO: 635049 - DNA, 20 bp, Artificial
  CRISPR gRNA sequence
agcattggtaaaattttaca

SEQ ID NO: 635050 - DNA, 20 bp, Artificial
  CRISPR gRNA sequence
gtaaaattttacaggccact

SEQ ID NO: 635051 - DNA, 20 bp, Artificial
  CRISPR gRNA sequence
tacaggccactgatctgtgc

SEQ ID NO: 635052 - DNA, 20 bp, Artificial
  CRISPR gRNA sequence
acaggccactgatctgtgca

SEQ ID NO: 635053 - DNA, 20 bp, Artificial
  CRISPR gRNA sequence
caggccactgatctgtgcat

SEQ ID NO: 635054 - DNA, 20 bp, Artificial
  CRISPR gRNA sequence
atctgtgcatgctgaaatag

SEQ ID NO: 635055 - DNA, 20 bp, Artificial
  CRISPR gRNA sequence
tgcatgctgaaatagatcct

SEQ ID NO: 635056 - DNA, 20 bp, Artificial
  CRISPR gRNA sequence
aaatagatcctccattgtaa

SEQ ID NO: 635057 - DNA, 20 bp, Artificial
  CRISPR gRNA sequence
cattgtaagtgagaaattgc

SEQ ID NO: 635058 - DNA, 20 bp, Artificial
  CRISPR gRNA sequence
taagtgagaaattgctgcac

SEQ ID NO: 635059 - DNA, 20 bp, Artificial
  CRISPR gRNA sequence
ctgcaccctgcaccttcctt

SEQ ID NO: 635060 - DNA, 20 bp, Artificial
  CRISPR gRNA sequence
caccctgcaccttccttcgt

SEQ ID NO: 635061 - DNA, 20 bp, Artificial
  CRISPR gRNA sequence
caccttccttcgtgaaaatg

SEQ ID NO: 635062 - DNA, 20 bp, Artificial
  CRISPR gRNA sequence
ccttcgtgaaaatgaagcac

SEQ ID NO: 635063 - DNA, 20 bp, Artificial
  CRISPR gRNA sequence
cttcgtgaaaatgaagcaca

SEQ ID NO: 635064 - DNA, 20 bp, Artificial
  CRISPR gRNA sequence
cgtgaaaatgaagcacaaaa

SEQ ID NO: 635065 - DNA, 20 bp, Artificial
  CRISPR gRNA sequence
gtgaaaatgaagcacaaaat

SEQ ID NO: 635066 - DNA, 20 bp, Artificial
  CRISPR gRNA sequence
tctagattttagaagcaaca

SEQ ID NO: 635067 - DNA, 20 bp, Artificial
  CRISPR gRNA sequence
tagattttagaagcaacata

SEQ ID NO: 635068 - DNA, 20 bp, Artificial
  CRISPR gRNA sequence
gattttagaagcaacataga

SEQ ID NO: 635069 - DNA, 20 bp, Artificial
  CRISPR gRNA sequence
tagaagcaacatagaccata

SEQ ID NO: 635070 - DNA, 20 bp, Artificial
  CRISPR gRNA sequence
agaagcaacatagaccatat

SEQ ID NO: 635071 - DNA, 20 bp, Artificial
  CRISPR gRNA sequence
gaagcaacatagaccatatt

SEQ ID NO: 635072 - DNA, 20 bp, Artificial
  CRISPR gRNA sequence
gggtatacttctgtggtgca

SEQ ID NO: 635073 - DNA, 20 bp, Artificial
  CRISPR gRNA sequence
ggtatacttctgtggtgcat

SEQ ID NO: 635074 - DNA, 20 bp, Artificial
  CRISPR gRNA sequence
ctgtggtgcatatactaggt

SEQ ID NO: 635075 - DNA, 20 bp, Artificial
  CRISPR gRNA sequence
tgtggtgcatatactaggta

SEQ ID NO: 635076 - DNA, 20 bp, Artificial
  CRISPR gRNA sequence
tggtgcatatactaggtaat

SEQ ID NO: 635077 - DNA, 20 bp, Artificial
  CRISPR gRNA sequence
ggtaatccacaggctgtcca

SEQ ID NO: 635078 - DNA, 20 bp, Artificial
  CRISPR gRNA sequence
tccattttgagagcagcctg

SEQ ID NO: 635079 - DNA, 20 bp, Artificial
  CRISPR gRNA sequence
tgagagcagcctggggcaag

SEQ ID NO: 635080 - DNA, 20 bp, Artificial
  CRISPR gRNA sequence
gagagcagcctggggcaaga

SEQ ID NO: 635081 - DNA, 20 bp, Artificial
  CRISPR gRNA sequence
agagcagcctggggcaagaa

SEQ ID NO: 635082 - DNA, 20 bp, Artificial
  CRISPR gRNA sequence
gggcaagaaaaggatctaca

SEQ ID NO: 635083 - DNA, 20 bp, Artificial
  CRISPR gRNA sequence
catcataccctgccatgatg

SEQ ID NO: 635084 - DNA, 20 bp, Artificial
  CRISPR gRNA sequence
ccatgatgaaagctccctct

SEQ ID NO: 635085 - DNA, 20 bp, Artificial
  CRISPR gRNA sequence
cctctacttttgactctaag

SEQ ID NO: 635086 - DNA, 20 bp, Artificial
  CRISPR gRNA sequence
tacttttgactctaagattc

SEQ ID NO: 635087 - DNA, 20 bp, Artificial
  CRISPR gRNA sequence
cttttgactctaagattcag

SEQ ID NO: 635088 - DNA, 20 bp, Artificial
  CRISPR gRNA sequence
ttgactctaagattcagcag

SEQ ID NO: 635089 - DNA, 20 bp, Artificial
  CRISPR gRNA sequence
tgactctaagattcagcaga

SEQ ID NO: 635090 - DNA, 20 bp, Artificial
  CRISPR gRNA sequence
gactctaagattcagcagat

SEQ ID NO: 635091 - DNA, 20 bp, Artificial
  CRISPR gRNA sequence
actctaagattcagcagatg

SEQ ID NO: 635092 - DNA, 20 bp, Artificial
  CRISPR gRNA sequence
taagattcagcagatgcaat

SEQ ID NO: 635093 - DNA, 20 bp, Artificial
  CRISPR gRNA sequence
agattcagcagatgcaatga

SEQ ID NO: 635094 - DNA, 20 bp, Artificial
  CRISPR gRNA sequence
agcagatgcaatgatttttg

SEQ ID NO: 635095 - DNA, 20 bp, Artificial
  CRISPR gRNA sequence
ttggaaatgtctgtggcaaa

SEQ ID NO: 635096 - DNA, 20 bp, Artificial
  CRISPR gRNA sequence
tggaaatgtctgtggcaaat

SEQ ID NO: 635097 - DNA, 20 bp, Artificial
  CRISPR gRNA sequence
ggaaatgtctgtggcaaatg

SEQ ID NO: 635098 - DNA, 20 bp, Artificial
  CRISPR gRNA sequence
gaaatgtctgtggcaaatgg

SEQ ID NO: 635099 - DNA, 20 bp, Artificial
  CRISPR gRNA sequence
tggcaaatggagatgctgta

SEQ ID NO: 635100 - DNA, 20 bp, Artificial
  CRISPR gRNA sequence
tatgacatctctgtcaatgg

SEQ ID NO: 635101 - DNA, 20 bp, Artificial
  CRISPR gRNA sequence
tgtcaatggaagcctcagtg

SEQ ID NO: 635102 - DNA, 20 bp, Artificial
  CRISPR gRNA sequence
tcaatggaagcctcagtgtg

SEQ ID NO: 635103 - DNA, 20 bp, Artificial
  CRISPR gRNA sequence
agtgtgtagatccctcgtgg

SEQ ID NO: 635104 - DNA, 20 bp, Artificial
  CRISPR gRNA sequence
gtggttttatagtaaagaca

SEQ ID NO: 635105 - DNA, 20 bp, Artificial
  CRISPR gRNA sequence
tatagtaaagacatgcagtt

SEQ ID NO: 635106 - DNA, 20 bp, Artificial
  CRISPR gRNA sequence
atagtaaagacatgcagttt

SEQ ID NO: 635107 - DNA, 20 bp, Artificial
  CRISPR gRNA sequence
tagtaaagacatgcagtttt

SEQ ID NO: 635108 - DNA, 20 bp, Artificial
  CRISPR gRNA sequence
tctaacaataactaatctcc

SEQ ID NO: 635109 - DNA, 20 bp, Artificial
  CRISPR gRNA sequence
ctaacaataactaatctcca

SEQ ID NO: 635110 - DNA, 20 bp, Artificial
  CRISPR gRNA sequence
taacaataactaatctccat

SEQ ID NO: 635111 - DNA, 20 bp, Artificial
  CRISPR gRNA sequence
acaataactaatctccattt

SEQ ID NO: 635112 - DNA, 20 bp, Artificial
  CRISPR gRNA sequence
atctccatttgaaaagccac

SEQ ID NO: 635113 - DNA, 20 bp, Artificial
  CRISPR gRNA sequence
catttgaaaagccactcctt

SEQ ID NO: 635114 - DNA, 20 bp, Artificial
  CRISPR gRNA sequence
gaaaagccactccttacttg

SEQ ID NO: 635115 - DNA, 20 bp, Artificial
  CRISPR gRNA sequence
aaaagccactccttacttgc

SEQ ID NO: 635116 - DNA, 20 bp, Artificial
  CRISPR gRNA sequence
cttacttgctaatgaacttt

SEQ ID NO: 635117 - DNA, 20 bp, Artificial
  CRISPR gRNA sequence
acttgctaatgaactttggt

SEQ ID NO: 635118 - DNA, 20 bp, Artificial
  CRISPR gRNA sequence
cttgctaatgaactttggtt

SEQ ID NO: 635119 - DNA, 20 bp, Artificial
  CRISPR gRNA sequence
gctaatgaactttggttaag

SEQ ID NO: 635120 - DNA, 20 bp, Artificial
  CRISPR gRNA sequence
ctaatgaactttggttaaga

SEQ ID NO: 635121 - DNA, 20 bp, Artificial
  CRISPR gRNA sequence
atgaactttggttaagactg

SEQ ID NO: 635122 - DNA, 20 bp, Artificial
  CRISPR gRNA sequence
tggttaagactgtgtactgg

SEQ ID NO: 635123 - DNA, 20 bp, Artificial
  CRISPR gRNA sequence
ggttaagactgtgtactggg

SEQ ID NO: 635124 - DNA, 20 bp, Artificial
  CRISPR gRNA sequence
gttaagactgtgtactgggc

SEQ ID NO: 635125 - DNA, 20 bp, Artificial
  CRISPR gRNA sequence
agactgtgtactgggccata

SEQ ID NO: 635126 - DNA, 20 bp, Artificial
  CRISPR gRNA sequence
tgtactgggccataggactc

SEQ ID NO: 635127 - DNA, 20 bp, Artificial
  CRISPR gRNA sequence
ggccataggactcggaatga

SEQ ID NO: 635128 - DNA, 20 bp, Artificial
  CRISPR gRNA sequence
ggaatgacaatgtagcccaa

SEQ ID NO: 635129 - DNA, 20 bp, Artificial
  CRISPR gRNA sequence
ggtgttatctaattcaacat

SEQ ID NO: 635130 - DNA, 20 bp, Artificial
  CRISPR gRNA sequence
tctaattcaacatatcaaaa

SEQ ID NO: 635131 - DNA, 20 bp, Artificial
  CRISPR gRNA sequence
attcaacatatcaaaaatgt

SEQ ID NO: 635132 - DNA, 20 bp, Artificial
  CRISPR gRNA sequence
aacatatcaaaaatgtacac

SEQ ID NO: 635133 - DNA, 20 bp, Artificial
  CRISPR gRNA sequence
ccttggtatattttccttcc

SEQ ID NO: 635134 - DNA, 20 bp, Artificial
  CRISPR gRNA sequence
cttggtatattttccttccc

SEQ ID NO: 635135 - DNA, 20 bp, Artificial
  CRISPR gRNA sequence
ggtatattttccttccctgc

SEQ ID NO: 635136 - DNA, 20 bp, Artificial
  CRISPR gRNA sequence
gtatattttccttccctgca

SEQ ID NO: 635137 - DNA, 20 bp, Artificial
  CRISPR gRNA sequence
tccttccctgcagccttctt

SEQ ID NO: 635138 - DNA, 20 bp, Artificial
  CRISPR gRNA sequence
ccttccctgcagccttctta

SEQ ID NO: 635139 - DNA, 20 bp, Artificial
  CRISPR gRNA sequence
cttccctgcagccttcttat

SEQ ID NO: 635140 - DNA, 20 bp, Artificial
  CRISPR gRNA sequence
ccctgcagccttcttatgct

SEQ ID NO: 635141 - DNA, 20 bp, Artificial
  CRISPR gRNA sequence
cctgcagccttcttatgcta

SEQ ID NO: 635142 - DNA, 20 bp, Artificial
  CRISPR gRNA sequence
cagccttcttatgctagttg

SEQ ID NO: 635143 - DNA, 20 bp, Artificial
  CRISPR gRNA sequence
cttatgctagttgaggaagc

SEQ ID NO: 635144 - DNA, 20 bp, Artificial
  CRISPR gRNA sequence
ttatgctagttgaggaagcc

SEQ ID NO: 635145 - DNA, 20 bp, Artificial
  CRISPR gRNA sequence
atgctagttgaggaagccca

SEQ ID NO: 635146 - DNA, 20 bp, Artificial
  CRISPR gRNA sequence
tgctagttgaggaagcccaa

SEQ ID NO: 635147 - DNA, 20 bp, Artificial
  CRISPR gRNA sequence
gttgaggaagcccaagtata

SEQ ID NO: 635148 - DNA, 20 bp, Artificial
  CRISPR gRNA sequence
aggaagcccaagtatactgt

SEQ ID NO: 635149 - DNA, 20 bp, Artificial
  CRISPR gRNA sequence
tatgagcaagtagctcagag

SEQ ID NO: 635150 - DNA, 20 bp, Artificial
  CRISPR gRNA sequence
agaggtccctaatacctgct

SEQ ID NO: 635151 - DNA, 20 bp, Artificial
  CRISPR gRNA sequence
atacctgctactactgcttc

SEQ ID NO: 635152 - DNA, 20 bp, Artificial
  CRISPR gRNA sequence
ctactactgcttctcaatct

SEQ ID NO: 635153 - DNA, 20 bp, Artificial
  CRISPR gRNA sequence
ctactgcttctcaatctttt

SEQ ID NO: 635154 - DNA, 20 bp, Artificial
  CRISPR gRNA sequence
ctgcttctcaatctttttgc

SEQ ID NO: 635155 - DNA, 20 bp, Artificial
  CRISPR gRNA sequence
cttctcaatctttttgcttc

SEQ ID NO: 635156 - DNA, 20 bp, Artificial
  CRISPR gRNA sequence
ctcaatctttttgcttcaac

SEQ ID NO: 635157 - DNA, 20 bp, Artificial
  CRISPR gRNA sequence
tcaatctttttgcttcaacc

SEQ ID NO: 635158 - DNA, 20 bp, Artificial
  CRISPR gRNA sequence
aatctttttgcttcaacccg

SEQ ID NO: 635159 - DNA, 20 bp, Artificial
  CRISPR gRNA sequence
tttgcttcaacccgtatgta

SEQ ID NO: 635160 - DNA, 20 bp, Artificial
  CRISPR gRNA sequence
ttgcttcaacccgtatgtat

SEQ ID NO: 635161 - DNA, 20 bp, Artificial
  CRISPR gRNA sequence
tgcttcaacccgtatgtatg

SEQ ID NO: 635162 - DNA, 20 bp, Artificial
  CRISPR gRNA sequence
gcttcaacccgtatgtatgg

SEQ ID NO: 635163 - DNA, 20 bp, Artificial
  CRISPR gRNA sequence
cttcaacccgtatgtatggc

SEQ ID NO: 635164 - DNA, 20 bp, Artificial
  CRISPR gRNA sequence
caacccgtatgtatggcctc

SEQ ID NO: 635165 - DNA, 20 bp, Artificial
  CRISPR gRNA sequence
aacccgtatgtatggcctca

SEQ ID NO: 635166 - DNA, 20 bp, Artificial
  CRISPR gRNA sequence
atggggtattctcagtgact

SEQ ID NO: 635167 - DNA, 20 bp, Artificial
  CRISPR gRNA sequence
tcagtgactagttgatgagg

SEQ ID NO: 635168 - DNA, 20 bp, Artificial
  CRISPR gRNA sequence
agtgactagttgatgaggat

SEQ ID NO: 635169 - DNA, 20 bp, Artificial
  CRISPR gRNA sequence
gttgatgaggatgaaacagt

SEQ ID NO: 635170 - DNA, 20 bp, Artificial
  CRISPR gRNA sequence
atgaggatgaaacagtgtgg

SEQ ID NO: 635171 - DNA, 20 bp, Artificial
  CRISPR gRNA sequence
gtttgtaaatagaatgtctg

SEQ ID NO: 635172 - DNA, 20 bp, Artificial
  CRISPR gRNA sequence
gtaaatagaatgtctggaat

SEQ ID NO: 635173 - DNA, 20 bp, Artificial
  CRISPR gRNA sequence
taaatagaatgtctggaatt

SEQ ID NO: 635174 - DNA, 20 bp, Artificial
  CRISPR gRNA sequence
gaattcaataccagctatga

SEQ ID NO: 635175 - DNA, 20 bp, Artificial
  CRISPR gRNA sequence
aataccagctatgactatgg

SEQ ID NO: 635176 - DNA, 20 bp, Artificial
  CRISPR gRNA sequence
tgactatggtgtttacaggt

SEQ ID NO: 635177 - DNA, 20 bp, Artificial
  CRISPR gRNA sequence
tggtgtttacaggtccactt

SEQ ID NO: 635178 - DNA, 20 bp, Artificial
  CRISPR gRNA sequence
acaggtccacttaagggaga

SEQ ID NO: 635179 - DNA, 20 bp, Artificial
  CRISPR gRNA sequence
caggtccacttaagggagag

SEQ ID NO: 635180 - DNA, 20 bp, Artificial
  CRISPR gRNA sequence
aagggagagggccctgaaat

SEQ ID NO: 635181 - DNA, 20 bp, Artificial
  CRISPR gRNA sequence
agggagagggccctgaaata

SEQ ID NO: 635182 - DNA, 20 bp, Artificial
  CRISPR gRNA sequence
aaatacagtggctatcccac

SEQ ID NO: 635183 - DNA, 20 bp, Artificial
  CRISPR gRNA sequence
tcccaccagcagccagaatt

SEQ ID NO: 635184 - DNA, 20 bp, Artificial
  CRISPR gRNA sequence
cattcagctagtacatttaa

SEQ ID NO: 635185 - DNA, 20 bp, Artificial
  CRISPR gRNA sequence
attcagctagtacatttaac

SEQ ID NO: 635186 - DNA, 20 bp, Artificial
  CRISPR gRNA sequence
agctagtacatttaactgca

SEQ ID NO: 635187 - DNA, 20 bp, Artificial
  CRISPR gRNA sequence
gtacatttaactgcacactt

SEQ ID NO: 635188 - DNA, 20 bp, Artificial
  CRISPR gRNA sequence
aactgcacactttgcatgga

SEQ ID NO: 635189 - DNA, 20 bp, Artificial
  CRISPR gRNA sequence
actgcacactttgcatggaa

SEQ ID NO: 635190 - DNA, 20 bp, Artificial
  CRISPR gRNA sequence
cacactttgcatggaagaag

SEQ ID NO: 635191 - DNA, 20 bp, Artificial
  CRISPR gRNA sequence
tgcatggaagaagagatagt

SEQ ID NO: 635192 - DNA, 20 bp, Artificial
  CRISPR gRNA sequence
gcatggaagaagagatagtt

SEQ ID NO: 635193 - DNA, 20 bp, Artificial
  CRISPR gRNA sequence
catggaagaagagatagttg

SEQ ID NO: 635194 - DNA, 20 bp, Artificial
  CRISPR gRNA sequence
aggtaatgacatatggcatg

SEQ ID NO: 635195 - DNA, 20 bp, Artificial
  CRISPR gRNA sequence
caaagaacaaaattggacga

SEQ ID NO: 635196 - DNA, 20 bp, Artificial
  CRISPR gRNA sequence
aaagaacaaaattggacgac

SEQ ID NO: 635197 - DNA, 20 bp, Artificial
  CRISPR gRNA sequence
gacgactggtgacagaaagt

SEQ ID NO: 635198 - DNA, 20 bp, Artificial
  CRISPR gRNA sequence
gtgacagaaagtctagggaa

SEQ ID NO: 635199 - DNA, 20 bp, Artificial
  CRISPR gRNA sequence
gggaagagttatgaggatat

SEQ ID NO: 635200 - DNA, 20 bp, Artificial
  CRISPR gRNA sequence
tgaggatatatccttcagaa

SEQ ID NO: 635201 - DNA, 20 bp, Artificial
  CRISPR gRNA sequence
cagaattggtacaaaatgta

SEQ ID NO: 635202 - DNA, 20 bp, Artificial
  CRISPR gRNA sequence
agaattggtacaaaatgtaa

SEQ ID NO: 635203 - DNA, 20 bp, Artificial
  CRISPR gRNA sequence
gtacaaaatgtaatgatatg

SEQ ID NO: 635204 - DNA, 20 bp, Artificial
  CRISPR gRNA sequence
tatgtaaattctctccagag

SEQ ID NO: 635205 - DNA, 20 bp, Artificial
  CRISPR gRNA sequence
tgtaaattctctccagaggg

SEQ ID NO: 635206 - DNA, 20 bp, Artificial
  CRISPR gRNA sequence
tctccagagggcattcactg

SEQ ID NO: 635207 - DNA, 20 bp, Artificial
  CRISPR gRNA sequence
tccagagggcattcactgta

SEQ ID NO: 635208 - DNA, 20 bp, Artificial
  CRISPR gRNA sequence
cagagggcattcactgtagt

SEQ ID NO: 635209 - DNA, 20 bp, Artificial
  CRISPR gRNA sequence
actgtagtgaaggctgttag

SEQ ID NO: 635210 - DNA, 20 bp, Artificial
  CRISPR gRNA sequence
tagtgaaggctgttagtaat

SEQ ID NO: 635211 - DNA, 20 bp, Artificial
  CRISPR gRNA sequence
ttagtaatctgaagggggta

SEQ ID NO: 635212 - DNA, 20 bp, Artificial
  CRISPR gRNA sequence
gtaatctgaagggggtaatc

SEQ ID NO: 635213 - DNA, 20 bp, Artificial
  CRISPR gRNA sequence
aagggggtaatctcatgaat

SEQ ID NO: 635214 - DNA, 20 bp, Artificial
  CRISPR gRNA sequence
atgaatctcagactctttac

SEQ ID NO: 635215 - DNA, 20 bp, Artificial
  CRISPR gRNA sequence
agactctttaccaggcttac

SEQ ID NO: 635216 - DNA, 20 bp, Artificial
  CRISPR gRNA sequence
tttaccaggcttacctggta

SEQ ID NO: 635217 - DNA, 20 bp, Artificial
  CRISPR gRNA sequence
taccaggcttacctggtact

SEQ ID NO: 635218 - DNA, 20 bp, Artificial
  CRISPR gRNA sequence
accaggcttacctggtactt

SEQ ID NO: 635219 - DNA, 20 bp, Artificial
  CRISPR gRNA sequence
ccaggcttacctggtacttt

SEQ ID NO: 635220 - DNA, 20 bp, Artificial
  CRISPR gRNA sequence
acctggtactttctcagtgg

SEQ ID NO: 635221 - DNA, 20 bp, Artificial
  CRISPR gRNA sequence
cctggtactttctcagtggg

SEQ ID NO: 635222 - DNA, 20 bp, Artificial
  CRISPR gRNA sequence
gtactttctcagtgggccaa

SEQ ID NO: 635223 - DNA, 20 bp, Artificial
  CRISPR gRNA sequence
tctcagtgggccaatgtaca

SEQ ID NO: 635224 - DNA, 20 bp, Artificial
  CRISPR gRNA sequence
ctcagtgggccaatgtacaa

SEQ ID NO: 635225 - DNA, 20 bp, Artificial
  CRISPR gRNA sequence
tcagtgggccaatgtacaaa

SEQ ID NO: 635226 - DNA, 20 bp, Artificial
  CRISPR gRNA sequence
agtgggccaatgtacaaagt

SEQ ID NO: 635227 - DNA, 20 bp, Artificial
  CRISPR gRNA sequence
tgaacagattcaattacatg

SEQ ID NO: 635228 - DNA, 20 bp, Artificial
  CRISPR gRNA sequence
aattacatggacttcctctt

SEQ ID NO: 635229 - DNA, 20 bp, Artificial
  CRISPR gRNA sequence
catggacttcctcttctcta

SEQ ID NO: 635230 - DNA, 20 bp, Artificial
  CRISPR gRNA sequence
cctcttctctatgactgatt

SEQ ID NO: 635231 - DNA, 20 bp, Artificial
  CRISPR gRNA sequence
ctcttctctatgactgattt

SEQ ID NO: 635232 - DNA, 20 bp, Artificial
  CRISPR gRNA sequence
ttctctatgactgatttaac

SEQ ID NO: 635233 - DNA, 20 bp, Artificial
  CRISPR gRNA sequence
ctctatgactgatttaacta

SEQ ID NO: 635234 - DNA, 20 bp, Artificial
  CRISPR gRNA sequence
tctatgactgatttaactac

SEQ ID NO: 635235 - DNA, 20 bp, Artificial
  CRISPR gRNA sequence
tatgactgatttaactacca

SEQ ID NO: 635236 - DNA, 20 bp, Artificial
  CRISPR gRNA sequence
tgactgatttaactaccacc

SEQ ID NO: 635237 - DNA, 20 bp, Artificial
  CRISPR gRNA sequence
atttaactaccaccactgct

SEQ ID NO: 635238 - DNA, 20 bp, Artificial
  CRISPR gRNA sequence
aactaccaccactgctgagc

SEQ ID NO: 635239 - DNA, 20 bp, Artificial
  CRISPR gRNA sequence
actaccaccactgctgagct

SEQ ID NO: 635240 - DNA, 20 bp, Artificial
  CRISPR gRNA sequence
ccaccactgctgagctcaca

SEQ ID NO: 635241 - DNA, 20 bp, Artificial
  CRISPR gRNA sequence
ctgagctcacaattttccag

SEQ ID NO: 635242 - DNA, 20 bp, Artificial
  CRISPR gRNA sequence
agctcacaattttccagtgc

SEQ ID NO: 635243 - DNA, 20 bp, Artificial
  CRISPR gRNA sequence
acaattttccagtgctgaga

SEQ ID NO: 635244 - DNA, 20 bp, Artificial
  CRISPR gRNA sequence
tccagtgctgagaccctgat

SEQ ID NO: 635245 - DNA, 20 bp, Artificial
  CRISPR gRNA sequence
ccagtgctgagaccctgata

SEQ ID NO: 635246 - DNA, 20 bp, Artificial
  CRISPR gRNA sequence
cagtgctgagaccctgatat

SEQ ID NO: 635247 - DNA, 20 bp, Artificial
  CRISPR gRNA sequence
agaccctgatatggcaccat

SEQ ID NO: 635248 - DNA, 20 bp, Artificial
  CRISPR gRNA sequence
atatggcaccattcctgaga

SEQ ID NO: 635249 - DNA, 20 bp, Artificial
  CRISPR gRNA sequence
ctgagagagatcaaccaagc

SEQ ID NO: 635250 - DNA, 20 bp, Artificial
  CRISPR gRNA sequence
agagagatcaaccaagcaag

SEQ ID NO: 635251 - DNA, 20 bp, Artificial
  CRISPR gRNA sequence
catttgactctttccaacat

SEQ ID NO: 635252 - DNA, 20 bp, Artificial
  CRISPR gRNA sequence
gactctttccaacatggaag

SEQ ID NO: 635253 - DNA, 20 bp, Artificial
  CRISPR gRNA sequence
actctttccaacatggaaga

SEQ ID NO: 635254 - DNA, 20 bp, Artificial
  CRISPR gRNA sequence
tttccaacatggaagaggca

SEQ ID NO: 635255 - DNA, 20 bp, Artificial
  CRISPR gRNA sequence
tccaacatggaagaggcaga

SEQ ID NO: 635256 - DNA, 20 bp, Artificial
  CRISPR gRNA sequence
ccaacatggaagaggcagaa

SEQ ID NO: 635257 - DNA, 20 bp, Artificial
  CRISPR gRNA sequence
caacatggaagaggcagaaa

SEQ ID NO: 635258 - DNA, 20 bp, Artificial
  CRISPR gRNA sequence
ataggatatgccttcccttt

SEQ ID NO: 635259 - DNA, 20 bp, Artificial
  CRISPR gRNA sequence
ccctttctcttcaatatttt

SEQ ID NO: 635260 - DNA, 20 bp, Artificial
  CRISPR gRNA sequence
cctttctcttcaatattttt

SEQ ID NO: 635261 - DNA, 20 bp, Artificial
  CRISPR gRNA sequence
tctcttcaatatttttgcaa

SEQ ID NO: 635262 - DNA, 20 bp, Artificial
  CRISPR gRNA sequence
ctcttcaatatttttgcaag

SEQ ID NO: 635263 - DNA, 20 bp, Artificial
  CRISPR gRNA sequence
tcttcaatatttttgcaagc

SEQ ID NO: 635264 - DNA, 20 bp, Artificial
  CRISPR gRNA sequence
ttcaatatttttgcaagctc

SEQ ID NO: 635265 - DNA, 20 bp, Artificial
  CRISPR gRNA sequence
caatatttttgcaagctccc

SEQ ID NO: 635266 - DNA, 20 bp, Artificial
  CRISPR gRNA sequence
aatatttttgcaagctccct

SEQ ID NO: 635267 - DNA, 20 bp, Artificial
  CRISPR gRNA sequence
ttgcaagctccctcaaatat

SEQ ID NO: 635268 - DNA, 20 bp, Artificial
  CRISPR gRNA sequence
tgcaagctccctcaaatatg

SEQ ID NO: 635269 - DNA, 20 bp, Artificial
  CRISPR gRNA sequence
gcaagctccctcaaatatgg

SEQ ID NO: 635270 - DNA, 20 bp, Artificial
  CRISPR gRNA sequence
caagctccctcaaatatgga

SEQ ID NO: 635271 - DNA, 20 bp, Artificial
  CRISPR gRNA sequence
cctcaaatatggatttaaca

SEQ ID NO: 635272 - DNA, 20 bp, Artificial
  CRISPR gRNA sequence
aaatatggatttaacagaat

SEQ ID NO: 635273 - DNA, 20 bp, Artificial
  CRISPR gRNA sequence
aacagaatgccttaccaatt

SEQ ID NO: 635274 - DNA, 20 bp, Artificial
  CRISPR gRNA sequence
acagaatgccttaccaatta

SEQ ID NO: 635275 - DNA, 20 bp, Artificial
  CRISPR gRNA sequence
accaattacccttgtattcc

SEQ ID NO: 635276 - DNA, 20 bp, Artificial
  CRISPR gRNA sequence
ccaattacccttgtattcct

SEQ ID NO: 635277 - DNA, 20 bp, Artificial
  CRISPR gRNA sequence
cccttgtattccttgctata

SEQ ID NO: 635278 - DNA, 20 bp, Artificial
  CRISPR gRNA sequence
gtattccttgctatactgcc

SEQ ID NO: 635279 - DNA, 20 bp, Artificial
  CRISPR gRNA sequence
tattccttgctatactgcct

SEQ ID NO: 635280 - DNA, 20 bp, Artificial
  CRISPR gRNA sequence
cttgctatactgccttcaac

SEQ ID NO: 635281 - DNA, 20 bp, Artificial
  CRISPR gRNA sequence
gctatactgccttcaaccag

SEQ ID NO: 635282 - DNA, 20 bp, Artificial
  CRISPR gRNA sequence
ctatactgccttcaaccagg

SEQ ID NO: 635283 - DNA, 20 bp, Artificial
  CRISPR gRNA sequence
tactgccttcaaccaggaaa

SEQ ID NO: 635284 - DNA, 20 bp, Artificial
  CRISPR gRNA sequence
ccttcaaccaggaaactcct

SEQ ID NO: 635285 - DNA, 20 bp, Artificial
  CRISPR gRNA sequence
caaccaggaaactccttttt

SEQ ID NO: 635286 - DNA, 20 bp, Artificial
  CRISPR gRNA sequence
aaccaggaaactccttttta

SEQ ID NO: 635287 - DNA, 20 bp, Artificial
  CRISPR gRNA sequence
ctttttatggcaagacaaat

SEQ ID NO: 635288 - DNA, 20 bp, Artificial
  CRISPR gRNA sequence
tttatggcaagacaaataca

SEQ ID NO: 635289 - DNA, 20 bp, Artificial
  CRISPR gRNA sequence
ttatggcaagacaaatacaa

SEQ ID NO: 635290 - DNA, 20 bp, Artificial
  CRISPR gRNA sequence
tatggcaagacaaatacaat

SEQ ID NO: 635291 - DNA, 20 bp, Artificial
  CRISPR gRNA sequence
atggcaagacaaatacaatt

SEQ ID NO: 635292 - DNA, 20 bp, Artificial
  CRISPR gRNA sequence
tggcaagacaaatacaatta

SEQ ID NO: 635293 - DNA, 20 bp, Artificial
  CRISPR gRNA sequence
gcgcaaatctatagaatgca

SEQ ID NO: 635294 - DNA, 20 bp, Artificial
  CRISPR gRNA sequence
tagaatgcatgggtcataca

SEQ ID NO: 635295 - DNA, 20 bp, Artificial
  CRISPR gRNA sequence
gctacatggagtggtgaaat

SEQ ID NO: 635296 - DNA, 20 bp, Artificial
  CRISPR gRNA sequence
catggagtggtgaaatggcc

SEQ ID NO: 635297 - DNA, 20 bp, Artificial
  CRISPR gRNA sequence
ccaaaggagtggttcatgta

SEQ ID NO: 635298 - DNA, 20 bp, Artificial
  CRISPR gRNA sequence
atgtatggttgccagctggg

SEQ ID NO: 635299 - DNA, 20 bp, Artificial
  CRISPR gRNA sequence
ccagctgggaggagtttggg

SEQ ID NO: 635300 - DNA, 20 bp, Artificial
  CRISPR gRNA sequence
ggaggagtttgggtgtgttc

SEQ ID NO: 635301 - DNA, 20 bp, Artificial
  CRISPR gRNA sequence
gggtgtgttctacaggatat

SEQ ID NO: 635302 - DNA, 20 bp, Artificial
  CRISPR gRNA sequence
ggtgtgttctacaggatatt

SEQ ID NO: 635303 - DNA, 20 bp, Artificial
  CRISPR gRNA sequence
tacaggatattatatatggc

SEQ ID NO: 635304 - DNA, 20 bp, Artificial
  CRISPR gRNA sequence
caggatattatatatggcca

SEQ ID NO: 635305 - DNA, 20 bp, Artificial
  CRISPR gRNA sequence
tatatggccaacatcatctc

SEQ ID NO: 635306 - DNA, 20 bp, Artificial
  CRISPR gRNA sequence
ctccatagccagaaggcatg

SEQ ID NO: 635307 - DNA, 20 bp, Artificial
  CRISPR gRNA sequence
catagccagaaggcatgagt

SEQ ID NO: 635308 - DNA, 20 bp, Artificial
  CRISPR gRNA sequence
agaacaaagaggttaaggta

SEQ ID NO: 635309 - DNA, 20 bp, Artificial
  CRISPR gRNA sequence
aggtagaggtggccactcta

SEQ ID NO: 635310 - DNA, 20 bp, Artificial
  CRISPR gRNA sequence
taataacatcaaataaccca

SEQ ID NO: 635311 - DNA, 20 bp, Artificial
  CRISPR gRNA sequence
ataacatcaaataacccatt

SEQ ID NO: 635312 - DNA, 20 bp, Artificial
  CRISPR gRNA sequence
aaaggctttttactctgtgt

SEQ ID NO: 635313 - DNA, 20 bp, Artificial
  CRISPR gRNA sequence
aaggctttttactctgtgtc

SEQ ID NO: 635314 - DNA, 20 bp, Artificial
  CRISPR gRNA sequence
tttactctgtgtcctgaaac

SEQ ID NO: 635315 - DNA, 20 bp, Artificial
  CRISPR gRNA sequence
ttactctgtgtcctgaaacc

SEQ ID NO: 635316 - DNA, 20 bp, Artificial
  CRISPR gRNA sequence
tactctgtgtcctgaaacct

SEQ ID NO: 635317 - DNA, 20 bp, Artificial
  CRISPR gRNA sequence
actctgtgtcctgaaacctt

SEQ ID NO: 635318 - DNA, 20 bp, Artificial
  CRISPR gRNA sequence
ctctgtgtcctgaaaccttc

SEQ ID NO: 635319 - DNA, 20 bp, Artificial
  CRISPR gRNA sequence
tgtgtcctgaaaccttcaga

SEQ ID NO: 635320 - DNA, 20 bp, Artificial
  CRISPR gRNA sequence
tgtcctgaaaccttcagatt

SEQ ID NO: 635321 - DNA, 20 bp, Artificial
  CRISPR gRNA sequence
aaaccttcagattggtggtt

SEQ ID NO: 635322 - DNA, 20 bp, Artificial
  CRISPR gRNA sequence
cagattggtggttttggaga

SEQ ID NO: 635323 - DNA, 20 bp, Artificial
  CRISPR gRNA sequence
agattggtggttttggagat

SEQ ID NO: 635324 - DNA, 20 bp, Artificial
  CRISPR gRNA sequence
gtggttttggagatctcagt

SEQ ID NO: 635325 - DNA, 20 bp, Artificial
  CRISPR gRNA sequence
tggagatctcagttcccaaa

SEQ ID NO: 635326 - DNA, 20 bp, Artificial
  CRISPR gRNA sequence
ggagatctcagttcccaaaa

SEQ ID NO: 635327 - DNA, 20 bp, Artificial
  CRISPR gRNA sequence
gagatctcagttcccaaaag

SEQ ID NO: 635328 - DNA, 20 bp, Artificial
  CRISPR gRNA sequence
agttcccaaaagaagaatgt

SEQ ID NO: 635329 - DNA, 20 bp, Artificial
  CRISPR gRNA sequence
ccaaaagaagaatgttttct

SEQ ID NO: 635330 - DNA, 20 bp, Artificial
  CRISPR gRNA sequence
tctccaggtttcagagatct

SEQ ID NO: 635331 - DNA, 20 bp, Artificial
  CRISPR gRNA sequence
ctccaggtttcagagatctg

SEQ ID NO: 635332 - DNA, 20 bp, Artificial
  CRISPR gRNA sequence
tccaggtttcagagatctgg

SEQ ID NO: 635333 - DNA, 20 bp, Artificial
  CRISPR gRNA sequence
caggtttcagagatctggtc

SEQ ID NO: 635334 - DNA, 20 bp, Artificial
  CRISPR gRNA sequence
cagagatctggtcctgttgt

SEQ ID NO: 635335 - DNA, 20 bp, Artificial
  CRISPR gRNA sequence
agagatctggtcctgttgta

SEQ ID NO: 635336 - DNA, 20 bp, Artificial
  CRISPR gRNA sequence
gtcctgttgtattggaagct

SEQ ID NO: 635337 - DNA, 20 bp, Artificial
  CRISPR gRNA sequence
ttgtattggaagctgagaat

SEQ ID NO: 635338 - DNA, 20 bp, Artificial
  CRISPR gRNA sequence
tattggaagctgagaatact

SEQ ID NO: 635339 - DNA, 20 bp, Artificial
  CRISPR gRNA sequence
gaagctgagaatactcacta

SEQ ID NO: 635340 - DNA, 20 bp, Artificial
  CRISPR gRNA sequence
agaatactcactagctattt

SEQ ID NO: 635341 - DNA, 20 bp, Artificial
  CRISPR gRNA sequence
actagctattttgggcatgt

SEQ ID NO: 635342 - DNA, 20 bp, Artificial
  CRISPR gRNA sequence
gctattttgggcatgtcaag

SEQ ID NO: 635343 - DNA, 20 bp, Artificial
  CRISPR gRNA sequence
ttttgggcatgtcaagctgc

SEQ ID NO: 635344 - DNA, 20 bp, Artificial
  CRISPR gRNA sequence
tgggcatgtcaagctgctaa

SEQ ID NO: 635345 - DNA, 20 bp, Artificial
  CRISPR gRNA sequence
gggcatgtcaagctgctaaa

SEQ ID NO: 635346 - DNA, 20 bp, Artificial
  CRISPR gRNA sequence
ggcatgtcaagctgctaaat

SEQ ID NO: 635347 - DNA, 20 bp, Artificial
  CRISPR gRNA sequence
ctaaataaacagggactggc

SEQ ID NO: 635348 - DNA, 20 bp, Artificial
  CRISPR gRNA sequence
aataaacagggactggctta

SEQ ID NO: 635349 - DNA, 20 bp, Artificial
  CRISPR gRNA sequence
gcttataatttttccagact

SEQ ID NO: 635350 - DNA, 20 bp, Artificial
  CRISPR gRNA sequence
ataatttttccagactacca

SEQ ID NO: 635351 - DNA, 20 bp, Artificial
  CRISPR gRNA sequence
taatttttccagactaccag

SEQ ID NO: 635352 - DNA, 20 bp, Artificial
  CRISPR gRNA sequence
ttccagactaccagaatgat

SEQ ID NO: 635353 - DNA, 20 bp, Artificial
  CRISPR gRNA sequence
tccagactaccagaatgatt

SEQ ID NO: 635354 - DNA, 20 bp, Artificial
  CRISPR gRNA sequence
ccagactaccagaatgattt

SEQ ID NO: 635355 - DNA, 20 bp, Artificial
  CRISPR gRNA sequence
cagactaccagaatgatttg

SEQ ID NO: 635356 - DNA, 20 bp, Artificial
  CRISPR gRNA sequence
ccagaatgatttggagctgt

SEQ ID NO: 635357 - DNA, 20 bp, Artificial
  CRISPR gRNA sequence
ggagctgttgctatacaatg

SEQ ID NO: 635358 - DNA, 20 bp, Artificial
  CRISPR gRNA sequence
gagctgttgctatacaatga

SEQ ID NO: 635359 - DNA, 20 bp, Artificial
  CRISPR gRNA sequence
ttgctatacaatgaggacaa

SEQ ID NO: 635360 - DNA, 20 bp, Artificial
  CRISPR gRNA sequence
ctatacaatgaggacaagaa

SEQ ID NO: 635361 - DNA, 20 bp, Artificial
  CRISPR gRNA sequence
tacaatgaggacaagaagaa

SEQ ID NO: 635362 - DNA, 20 bp, Artificial
  CRISPR gRNA sequence
tgcttggaactcaggggatt

SEQ ID NO: 635363 - DNA, 20 bp, Artificial
  CRISPR gRNA sequence
ggaactcaggggatttactg

SEQ ID NO: 635364 - DNA, 20 bp, Artificial
  CRISPR gRNA sequence
gaactcaggggatttactgg

SEQ ID NO: 635365 - DNA, 20 bp, Artificial
  CRISPR gRNA sequence
aggggatttactggggcatc

SEQ ID NO: 635366 - DNA, 20 bp, Artificial
  CRISPR gRNA sequence
actggggcatctctttagaa

SEQ ID NO: 635367 - DNA, 20 bp, Artificial
  CRISPR gRNA sequence
ctggggcatctctttagaaa

SEQ ID NO: 635368 - DNA, 20 bp, Artificial
  CRISPR gRNA sequence
gggcatctctttagaaatac

SEQ ID NO: 635369 - DNA, 20 bp, Artificial
  CRISPR gRNA sequence
tttagaaatacttacctcat

SEQ ID NO: 635370 - DNA, 20 bp, Artificial
  CRISPR gRNA sequence
tagaaatacttacctcataa

SEQ ID NO: 635371 - DNA, 20 bp, Artificial
  CRISPR gRNA sequence
agaaatacttacctcataat

SEQ ID NO: 635372 - DNA, 20 bp, Artificial
  CRISPR gRNA sequence
gaaatacttacctcataatt

SEQ ID NO: 635373 - DNA, 20 bp, Artificial
  CRISPR gRNA sequence
acctcataattttggttatt

SEQ ID NO: 635374 - DNA, 20 bp, Artificial
  CRISPR gRNA sequence
cctcataattttggttattg

SEQ ID NO: 635375 - DNA, 20 bp, Artificial
  CRISPR gRNA sequence
ataattttggttattgaaaa

SEQ ID NO: 635376 - DNA, 20 bp, Artificial
  CRISPR gRNA sequence
tggttattgaaaaattatag

SEQ ID NO: 635377 - DNA, 20 bp, Artificial
  CRISPR gRNA sequence
ggttattgaaaaattatagt

SEQ ID NO: 635378 - DNA, 20 bp, Artificial
  CRISPR gRNA sequence
gttattgaaaaattatagta

SEQ ID NO: 635379 - DNA, 20 bp, Artificial
  CRISPR gRNA sequence
ttgaaaaattatagtaatat

SEQ ID NO: 635380 - DNA, 20 bp, Artificial
  CRISPR gRNA sequence
aaaaattatagtaatataag

SEQ ID NO: 635381 - DNA, 20 bp, Artificial
  CRISPR gRNA sequence
tagtaatataagaaagacag

SEQ ID NO: 635382 - DNA, 20 bp, Artificial
  CRISPR gRNA sequence
agaacctataaaattttagt

SEQ ID NO: 635383 - DNA, 20 bp, Artificial
  CRISPR gRNA sequence
taaaattttagtcacctatc

SEQ ID NO: 635384 - DNA, 20 bp, Artificial
  CRISPR gRNA sequence
tagtcacctatcagataaag

SEQ ID NO: 635385 - DNA, 20 bp, Artificial
  CRISPR gRNA sequence
agtcacctatcagataaaga

SEQ ID NO: 635386 - DNA, 20 bp, Artificial
  CRISPR gRNA sequence
gtcacctatcagataaagaa

SEQ ID NO: 635387 - DNA, 20 bp, Artificial
  CRISPR gRNA sequence
tcagataaagaaccttattt

SEQ ID NO: 635388 - DNA, 20 bp, Artificial
  CRISPR gRNA sequence
atttagccgatgtgctaaac

SEQ ID NO: 635389 - DNA, 20 bp, Artificial
  CRISPR gRNA sequence
tttagccgatgtgctaaaca

SEQ ID NO: 635390 - DNA, 20 bp, Artificial
  CRISPR gRNA sequence
agccgatgtgctaaacagag

SEQ ID NO: 635391 - DNA, 20 bp, Artificial
  CRISPR gRNA sequence
gccgatgtgctaaacagagt

SEQ ID NO: 635392 - DNA, 20 bp, Artificial
  CRISPR gRNA sequence
aacagagtaagagtaagggg

SEQ ID NO: 635393 - DNA, 20 bp, Artificial
  CRISPR gRNA sequence
gattggaagaagaacactat

SEQ ID NO: 635394 - DNA, 20 bp, Artificial
  CRISPR gRNA sequence
attggaagaagaacactata

SEQ ID NO: 635395 - DNA, 20 bp, Artificial
  CRISPR gRNA sequence
gaagaagaacactataatga

SEQ ID NO: 635396 - DNA, 20 bp, Artificial
  CRISPR gRNA sequence
taatgatcaattttgagctt

SEQ ID NO: 635397 - DNA, 20 bp, Artificial
  CRISPR gRNA sequence
tgagctttctggcaacttag

SEQ ID NO: 635398 - DNA, 20 bp, Artificial
  CRISPR gRNA sequence
gagctttctggcaacttaga

SEQ ID NO: 635399 - DNA, 20 bp, Artificial
  CRISPR gRNA sequence
agctttctggcaacttagag

SEQ ID NO: 635400 - DNA, 20 bp, Artificial
  CRISPR gRNA sequence
tctggcaacttagaggagca

SEQ ID NO: 635401 - DNA, 20 bp, Artificial
  CRISPR gRNA sequence
ctggcaacttagaggagcaa

SEQ ID NO: 635402 - DNA, 20 bp, Artificial
  CRISPR gRNA sequence
tggcaacttagaggagcaaa

SEQ ID NO: 635403 - DNA, 20 bp, Artificial
  CRISPR gRNA sequence
gcaacttagaggagcaaaaa

SEQ ID NO: 635404 - DNA, 20 bp, Artificial
  CRISPR gRNA sequence
agaggagcaaaaactgtagc

SEQ ID NO: 635405 - DNA, 20 bp, Artificial
  CRISPR gRNA sequence
gaggagcaaaaactgtagca

SEQ ID NO: 635406 - DNA, 20 bp, Artificial
  CRISPR gRNA sequence
tagcaactctgttttatgtt

SEQ ID NO: 635407 - DNA, 20 bp, Artificial
  CRISPR gRNA sequence
tgttttatgttctatctatt

SEQ ID NO: 635408 - DNA, 20 bp, Artificial
  CRISPR gRNA sequence
ttttatgttctatctattat

SEQ ID NO: 635409 - DNA, 20 bp, Artificial
  CRISPR gRNA sequence
tatgttctatctattatgaa

SEQ ID NO: 635410 - DNA, 20 bp, Artificial
  CRISPR gRNA sequence
atgttctatctattatgaag

SEQ ID NO: 635411 - DNA, 20 bp, Artificial
  CRISPR gRNA sequence
tgttctatctattatgaaga

SEQ ID NO: 635412 - DNA, 20 bp, Artificial
  CRISPR gRNA sequence
tatctattatgaagaaaatt

SEQ ID NO: 635413 - DNA, 20 bp, Artificial
  CRISPR gRNA sequence
tctattatgaagaaaattag

SEQ ID NO: 635414 - DNA, 20 bp, Artificial
  CRISPR gRNA sequence
ttatgaagaaaattagggat

SEQ ID NO: 635415 - DNA, 20 bp, Artificial
  CRISPR gRNA sequence
tgaagaaaattagggatggc

SEQ ID NO: 635416 - DNA, 20 bp, Artificial
  CRISPR gRNA sequence
gggatggctagtattttaga

SEQ ID NO: 635417 - DNA, 20 bp, Artificial
  CRISPR gRNA sequence
gtattttagattccaattgg

SEQ ID NO: 635418 - DNA, 20 bp, Artificial
  CRISPR gRNA sequence
tagattccaattggaagcat

SEQ ID NO: 635419 - DNA, 20 bp, Artificial
  CRISPR gRNA sequence
agattccaattggaagcatg

SEQ ID NO: 635420 - DNA, 20 bp, Artificial
  CRISPR gRNA sequence
gattccaattggaagcatga

SEQ ID NO: 635421 - DNA, 20 bp, Artificial
  CRISPR gRNA sequence
caattggaagcatgattgaa

SEQ ID NO: 635422 - DNA, 20 bp, Artificial
  CRISPR gRNA sequence
gaagcatgattgaattggta

SEQ ID NO: 635423 - DNA, 20 bp, Artificial
  CRISPR gRNA sequence
aattggtatcagctcttggt

SEQ ID NO: 635424 - DNA, 20 bp, Artificial
  CRISPR gRNA sequence
gtatcagctcttggtgatgc

SEQ ID NO: 635425 - DNA, 20 bp, Artificial
  CRISPR gRNA sequence
ttggtgatgcagtagctgga

SEQ ID NO: 635426 - DNA, 20 bp, Artificial
  CRISPR gRNA sequence
ggtgatgcagtagctggatg

SEQ ID NO: 635427 - DNA, 20 bp, Artificial
  CRISPR gRNA sequence
gtgatgcagtagctggatgc

SEQ ID NO: 635428 - DNA, 20 bp, Artificial
  CRISPR gRNA sequence
gatgccccctctccaatagg

SEQ ID NO: 635429 - DNA, 20 bp, Artificial
  CRISPR gRNA sequence
tccaatagggactccattaa

SEQ ID NO: 635430 - DNA, 20 bp, Artificial
  CRISPR gRNA sequence
caatagggactccattaaac

SEQ ID NO: 635431 - DNA, 20 bp, Artificial
  CRISPR gRNA sequence
cattaaactctcttgaatta

SEQ ID NO: 635432 - DNA, 20 bp, Artificial
  CRISPR gRNA sequence
aactctcttgaattacccaa

SEQ ID NO: 635433 - DNA, 20 bp, Artificial
  CRISPR gRNA sequence
tcttgaattacccaatttga

SEQ ID NO: 635434 - DNA, 20 bp, Artificial
  CRISPR gRNA sequence
ttgaattacccaatttgaat

SEQ ID NO: 635435 - DNA, 20 bp, Artificial
  CRISPR gRNA sequence
gaattacccaatttgaatat

SEQ ID NO: 635436 - DNA, 20 bp, Artificial
  CRISPR gRNA sequence
aattacccaatttgaatata

SEQ ID NO: 635437 - DNA, 20 bp, Artificial
  CRISPR gRNA sequence
cccaatttgaatatatctat

SEQ ID NO: 635438 - DNA, 20 bp, Artificial
  CRISPR gRNA sequence
gaatatatctatttatatat

SEQ ID NO: 635439 - DNA, 20 bp, Artificial
  CRISPR gRNA sequence
aatatatctatttatatatc

SEQ ID NO: 635440 - DNA, 20 bp, Artificial
  CRISPR gRNA sequence
tttatatatctgcaaaaatc

SEQ ID NO: 635441 - DNA, 20 bp, Artificial
  CRISPR gRNA sequence
atatatctgcaaaaatcata

SEQ ID NO: 635442 - DNA, 20 bp, Artificial
  CRISPR gRNA sequence
tatatctgcaaaaatcataa

SEQ ID NO: 635443 - DNA, 20 bp, Artificial
  CRISPR gRNA sequence
caaaaatcataacttgatat

SEQ ID NO: 635444 - DNA, 20 bp, Artificial
  CRISPR gRNA sequence
gatatactaaattgcaaaat

SEQ ID NO: 635445 - DNA, 20 bp, Artificial
  CRISPR gRNA sequence
atatactaaattgcaaaatg

SEQ ID NO: 635446 - DNA, 20 bp, Artificial
  CRISPR gRNA sequence
aattgcaaaatgagcacgat

SEQ ID NO: 635447 - DNA, 20 bp, Artificial
  CRISPR gRNA sequence
caaaatgagcacgatggcag

SEQ ID NO: 635448 - DNA, 20 bp, Artificial
  CRISPR gRNA sequence
taaggaccatgtctttgttt

SEQ ID NO: 635449 - DNA, 20 bp, Artificial
  CRISPR gRNA sequence
tgtttatgaagacagataac

SEQ ID NO: 635450 - DNA, 20 bp, Artificial
  CRISPR gRNA sequence
gtttatgaagacagataaca

SEQ ID NO: 635451 - DNA, 20 bp, Artificial
  CRISPR gRNA sequence
tttatgaagacagataacat

SEQ ID NO: 635452 - DNA, 20 bp, Artificial
  CRISPR gRNA sequence
atgaagacagataacataat

SEQ ID NO: 635453 - DNA, 20 bp, Artificial
  CRISPR gRNA sequence
tgaagacagataacataata

SEQ ID NO: 635454 - DNA, 20 bp, Artificial
  CRISPR gRNA sequence
aaaacaacatgatttcaaca

SEQ ID NO: 635455 - DNA, 20 bp, Artificial
  CRISPR gRNA sequence
caacaaaaataagatggatg

SEQ ID NO: 635456 - DNA, 20 bp, Artificial
  CRISPR gRNA sequence
aacaaaaataagatggatgt

SEQ ID NO: 635457 - DNA, 20 bp, Artificial
  CRISPR gRNA sequence
aaagttatttattacatgaa

SEQ ID NO: 635458 - DNA, 20 bp, Artificial
  CRISPR gRNA sequence
aagttatttattacatgaag

SEQ ID NO: 635459 - DNA, 20 bp, Artificial
  CRISPR gRNA sequence
tttattacatgaagttgagg

SEQ ID NO: 635460 - DNA, 20 bp, Artificial
  CRISPR gRNA sequence
attacatgaagttgaggcaa

SEQ ID NO: 635461 - DNA, 20 bp, Artificial
  CRISPR gRNA sequence
ttacatgaagttgaggcaaa

SEQ ID NO: 635462 - DNA, 20 bp, Artificial
  CRISPR gRNA sequence
catgaagttgaggcaaaact

SEQ ID NO: 635463 - DNA, 20 bp, Artificial
  CRISPR gRNA sequence
aggcaaaactatatgttcac

SEQ ID NO: 635464 - DNA, 20 bp, Artificial
  CRISPR gRNA sequence
tatgttcacgaagatctatt

SEQ ID NO: 635465 - DNA, 20 bp, Artificial
  CRISPR gRNA sequence
acgaagatctatttgttata

SEQ ID NO: 635466 - DNA, 20 bp, Artificial
  CRISPR gRNA sequence
tttgttatataatgtttgga

SEQ ID NO: 635467 - DNA, 20 bp, Artificial
  CRISPR gRNA sequence
gttatataatgtttggacaa

SEQ ID NO: 635468 - DNA, 20 bp, Artificial
  CRISPR gRNA sequence
ttatataatgtttggacaac

SEQ ID NO: 635469 - DNA, 20 bp, Artificial
  CRISPR gRNA sequence
tataatgtttggacaactca

SEQ ID NO: 635470 - DNA, 20 bp, Artificial
  CRISPR gRNA sequence
ggacaactcaataataattt

SEQ ID NO: 635471 - DNA, 20 bp, Artificial
  CRISPR gRNA sequence
gacaactcaataataattta

SEQ ID NO: 635472 - DNA, 20 bp, Artificial
  CRISPR gRNA sequence
aataataatttaactctggc

SEQ ID NO: 635473 - DNA, 20 bp, Artificial
  CRISPR gRNA sequence
aactctggctagagtacatg

SEQ ID NO: 635474 - DNA, 20 bp, Artificial
  CRISPR gRNA sequence
actctggctagagtacatga

SEQ ID NO: 635475 - DNA, 20 bp, Artificial
  CRISPR gRNA sequence
tggctagagtacatgacaag

SEQ ID NO: 635476 - DNA, 20 bp, Artificial
  CRISPR gRNA sequence
gctagagtacatgacaagct

SEQ ID NO: 635477 - DNA, 20 bp, Artificial
  CRISPR gRNA sequence
gagtacatgacaagctaatg

SEQ ID NO: 635478 - DNA, 20 bp, Artificial
  CRISPR gRNA sequence
atggaaatgcctatcatgtc

SEQ ID NO: 635479 - DNA, 20 bp, Artificial
  CRISPR gRNA sequence
tcatgtcctagaagtatatt

SEQ ID NO: 635480 - DNA, 20 bp, Artificial
  CRISPR gRNA sequence
gaagtatatttcaataaaga

SEQ ID NO: 635481 - DNA, 20 bp, Artificial
  CRISPR gRNA sequence
caataaagaacttttcataa

SEQ ID NO: 635482 - DNA, 20 bp, Artificial
  CRISPR gRNA sequence
aataaagaacttttcataag

SEQ ID NO: 635483 - DNA, 20 bp, Artificial
  CRISPR gRNA sequence
ttcataagaaaacactgctt

SEQ ID NO: 635484 - DNA, 20 bp, Artificial
  CRISPR gRNA sequence
tcataagaaaacactgcttt

SEQ ID NO: 635485 - DNA, 20 bp, Artificial
  CRISPR gRNA sequence
cataagaaaacactgcttta

SEQ ID NO: 635486 - DNA, 20 bp, Artificial
  CRISPR gRNA sequence
ataagaaaacactgctttaa

SEQ ID NO: 635487 - DNA, 20 bp, Artificial
  CRISPR gRNA sequence
ctttaagatataattttgat

SEQ ID NO: 635488 - DNA, 20 bp, Artificial
  CRISPR gRNA sequence
taagatataattttgatagc

SEQ ID NO: 635489 - DNA, 20 bp, Artificial
  CRISPR gRNA sequence
aagatataattttgatagca

SEQ ID NO: 635490 - DNA, 20 bp, Artificial
  CRISPR gRNA sequence
agatataattttgatagcac

SEQ ID NO: 635491 - DNA, 20 bp, Artificial
  CRISPR gRNA sequence
tgatagcacaattttaaaat

SEQ ID NO: 635492 - DNA, 20 bp, Artificial
  CRISPR gRNA sequence
gatagcacaattttaaaata

SEQ ID NO: 635493 - DNA, 20 bp, Artificial
  CRISPR gRNA sequence
atagcacaattttaaaataa

SEQ ID NO: 635494 - DNA, 20 bp, Artificial
  CRISPR gRNA sequence
taaaataaaacataaaatgt

SEQ ID NO: 635495 - DNA, 20 bp, Artificial
  CRISPR gRNA sequence
aaaataaaacataaaatgtt

SEQ ID NO: 635496 - DNA, 20 bp, Artificial
  CRISPR gRNA sequence
aaataaaacataaaatgttg

SEQ ID NO: 635497 - DNA, 20 bp, Artificial
  CRISPR gRNA sequence
tagttggaagtaagtgaatt

SEQ ID NO: 635498 - DNA, 20 bp, Artificial
  CRISPR gRNA sequence
gaagtaagtgaattccttta

SEQ ID NO: 635499 - DNA, 20 bp, Artificial
  CRISPR gRNA sequence
ctttaactcagggaggaaag

SEQ ID NO: 635500 - DNA, 20 bp, Artificial
  CRISPR gRNA sequence
taactcagggaggaaagaaa

SEQ ID NO: 635501 - DNA, 20 bp, Artificial
  CRISPR gRNA sequence
aactcagggaggaaagaaaa

SEQ ID NO: 635502 - DNA, 20 bp, Artificial
  CRISPR gRNA sequence
actcagggaggaaagaaaaa

SEQ ID NO: 635503 - DNA, 20 bp, Artificial
  CRISPR gRNA sequence
agggaggaaagaaaaatata

SEQ ID NO: 635504 - DNA, 20 bp, Artificial
  CRISPR gRNA sequence
aaaatattttgttttcgtgt

SEQ ID NO: 635505 - DNA, 20 bp, Artificial
  CRISPR gRNA sequence
aaatattttgttttcgtgtt

SEQ ID NO: 635506 - DNA, 20 bp, Artificial
  CRISPR gRNA sequence
tgttttcgtgtttgcattaa

SEQ ID NO: 635507 - DNA, 20 bp, Artificial
  CRISPR gRNA sequence
gttttcgtgtttgcattaat

SEQ ID NO: 635508 - DNA, 20 bp, Artificial
  CRISPR gRNA sequence
ttttcgtgtttgcattaatt

SEQ ID NO: 635509 - DNA, 20 bp, Artificial
  CRISPR gRNA sequence
tcgtgtttgcattaatttaa

SEQ ID NO: 635510 - DNA, 20 bp, Artificial
  CRISPR gRNA sequence
cgtgtttgcattaatttaat

SEQ ID NO: 635511 - DNA, 20 bp, Artificial
  CRISPR gRNA sequence
gtgtttgcattaatttaatt

SEQ ID NO: 635512 - DNA, 20 bp, Artificial
  CRISPR gRNA sequence
gcattaatttaatttttttg

SEQ ID NO: 635513 - DNA, 20 bp, Artificial
  CRISPR gRNA sequence
cattaatttaatttttttgt

SEQ ID NO: 635514 - DNA, 20 bp, Artificial
  CRISPR gRNA sequence
atttaatttttttgtaactg

SEQ ID NO: 635515 - DNA, 20 bp, Artificial
  CRISPR gRNA sequence
aatttttttgtaactgcccc

SEQ ID NO: 635516 - DNA, 20 bp, Artificial
  CRISPR gRNA sequence
atttttttgtaactgcccca

SEQ ID NO: 635517 - DNA, 20 bp, Artificial
  CRISPR gRNA sequence
ttttgtaactgccccaaatt

SEQ ID NO: 635518 - DNA, 20 bp, Artificial
  CRISPR gRNA sequence
tttgtaactgccccaaattt

SEQ ID NO: 635519 - DNA, 20 bp, Artificial
  CRISPR gRNA sequence
ttgtaactgccccaaattta

SEQ ID NO: 635520 - DNA, 20 bp, Artificial
  CRISPR gRNA sequence
tgtaactgccccaaatttaa

SEQ ID NO: 635521 - DNA, 20 bp, Artificial
  CRISPR gRNA sequence
gtaactgccccaaatttaag

SEQ ID NO: 635522 - DNA, 20 bp, Artificial
  CRISPR gRNA sequence
taactgccccaaatttaaga

SEQ ID NO: 635523 - DNA, 20 bp, Artificial
  CRISPR gRNA sequence
ccccaaatttaagagttaat

SEQ ID NO: 635524 - DNA, 20 bp, Artificial
  CRISPR gRNA sequence
aagagttaatgtttaaaata

SEQ ID NO: 635525 - DNA, 20 bp, Artificial
  CRISPR gRNA sequence
agagttaatgtttaaaatag

SEQ ID NO: 635526 - DNA, 20 bp, Artificial
  CRISPR gRNA sequence
atgtttaaaatagttttaca

SEQ ID NO: 635527 - DNA, 20 bp, Artificial
  CRISPR gRNA sequence
aaaatagttttacacgattc

SEQ ID NO: 635528 - DNA, 20 bp, Artificial
  CRISPR gRNA sequence
aaatagttttacacgattca

SEQ ID NO: 635529 - DNA, 20 bp, Artificial
  CRISPR gRNA sequence
tacacgattcacattcatgt

SEQ ID NO: 635530 - DNA, 20 bp, Artificial
  CRISPR gRNA sequence
acacgattcacattcatgtt

SEQ ID NO: 635531 - DNA, 20 bp, Artificial
  CRISPR gRNA sequence
cacgattcacattcatgttt

SEQ ID NO: 635532 - DNA, 20 bp, Artificial
  CRISPR gRNA sequence
acattcatgtttaaaaactt

SEQ ID NO: 635533 - DNA, 20 bp, Artificial
  CRISPR gRNA sequence
atgtttaaaaacttagtaca

SEQ ID NO: 635534 - DNA, 20 bp, Artificial
  CRISPR gRNA sequence
aaaaacttagtacagcctta

SEQ ID NO: 635535 - DNA, 20 bp, Artificial
  CRISPR gRNA sequence
aaaacttagtacagccttaa

SEQ ID NO: 635536 - DNA, 20 bp, Artificial
  CRISPR gRNA sequence
agtacagccttaaggataaa

SEQ ID NO: 635537 - DNA, 20 bp, Artificial
  CRISPR gRNA sequence
gtacagccttaaggataaaa

SEQ ID NO: 635538 - DNA, 20 bp, Artificial
  CRISPR gRNA sequence
aaggataaaaaggaaaaatg

SEQ ID NO: 635539 - DNA, 20 bp, Artificial
  CRISPR gRNA sequence
aggataaaaaggaaaaatgt

SEQ ID NO: 635540 - DNA, 20 bp, Artificial
  CRISPR gRNA sequence
tctcacaacctcagcactct

SEQ ID NO: 635541 - DNA, 20 bp, Artificial
  CRISPR gRNA sequence
acaacctcagcactctctaa

SEQ ID NO: 635542 - DNA, 20 bp, Artificial
  CRISPR gRNA sequence
agcactctctaatacgattt

SEQ ID NO: 635543 - DNA, 20 bp, Artificial
  CRISPR gRNA sequence
tctaatacgatttgtcaatg

SEQ ID NO: 635544 - DNA, 20 bp, Artificial
  CRISPR gRNA sequence
taatacgatttgtcaatgta

SEQ ID NO: 635545 - DNA, 20 bp, Artificial
  CRISPR gRNA sequence
atacgatttgtcaatgtaga

SEQ ID NO: 635546 - DNA, 20 bp, Artificial
  CRISPR gRNA sequence
gtcaatgtagattaaaatat

SEQ ID NO: 635547 - DNA, 20 bp, Artificial
  CRISPR gRNA sequence
tcaatgtagattaaaatatc

SEQ ID NO: 635548 - DNA, 20 bp, Artificial
  CRISPR gRNA sequence
aaatatcacttccatcatat

SEQ ID NO: 635549 - DNA, 20 bp, Artificial
  CRISPR gRNA sequence
ccatcatatcttcatattaa

SEQ ID NO: 635550 - DNA, 20 bp, Artificial
  CRISPR gRNA sequence
catcatatcttcatattaaa

SEQ ID NO: 635551 - DNA, 20 bp, Artificial
  CRISPR gRNA sequence
catattaaaattaaaattta

SEQ ID NO: 635552 - DNA, 20 bp, Artificial
  CRISPR gRNA sequence
atattaaaattaaaatttag

SEQ ID NO: 635553 - DNA, 20 bp, Artificial
  CRISPR gRNA sequence
aaattaaaatttagtatgtc

SEQ ID NO: 635554 - DNA, 20 bp, Artificial
  CRISPR gRNA sequence
aaatttagtatgtcattatg

SEQ ID NO: 635555 - DNA, 20 bp, Artificial
  CRISPR gRNA sequence
agtatgtcattatgaacaga

SEQ ID NO: 635556 - DNA, 20 bp, Artificial
  CRISPR gRNA sequence
gtatgtcattatgaacagaa

SEQ ID NO: 635557 - DNA, 20 bp, Artificial
  CRISPR gRNA sequence
tgaacagaagaaacaaataa

SEQ ID NO: 635558 - DNA, 20 bp, Artificial
  CRISPR gRNA sequence
gcttgagagtattctatatt

SEQ ID NO: 635559 - DNA, 20 bp, Artificial
  CRISPR gRNA sequence
gagagtattctatattaatt

SEQ ID NO: 635560 - DNA, 20 bp, Artificial
  CRISPR gRNA sequence
agagtattctatattaattt

SEQ ID NO: 635561 - DNA, 20 bp, Artificial
  CRISPR gRNA sequence
tatattaattttccaccttt

SEQ ID NO: 635562 - DNA, 20 bp, Artificial
  CRISPR gRNA sequence
tattaattttccacctttaa

SEQ ID NO: 635563 - DNA, 20 bp, Artificial
  CRISPR gRNA sequence
attttccacctttaacttct

SEQ ID NO: 635564 - DNA, 20 bp, Artificial
  CRISPR gRNA sequence
tccacctttaacttcttggt

SEQ ID NO: 635565 - DNA, 20 bp, Artificial
  CRISPR gRNA sequence
ccacctttaacttcttggtt

SEQ ID NO: 635566 - DNA, 20 bp, Artificial
  CRISPR gRNA sequence
cacctttaacttcttggtta

SEQ ID NO: 635567 - DNA, 20 bp, Artificial
  CRISPR gRNA sequence
taacttcttggttatgaaaa

SEQ ID NO: 635568 - DNA, 20 bp, Artificial
  CRISPR gRNA sequence
aacttcttggttatgaaaat

SEQ ID NO: 635569 - DNA, 20 bp, Artificial
  CRISPR gRNA sequence
acttcttggttatgaaaatt

SEQ ID NO: 635570 - DNA, 20 bp, Artificial
  CRISPR gRNA sequence
cttggttatgaaaatttatg

SEQ ID NO: 635571 - DNA, 20 bp, Artificial
  CRISPR gRNA sequence
ttggttatgaaaatttatgc

SEQ ID NO: 635572 - DNA, 20 bp, Artificial
  CRISPR gRNA sequence
ggttatgaaaatttatgcta

SEQ ID NO: 635573 - DNA, 20 bp, Artificial
  CRISPR gRNA sequence
gttatgaaaatttatgctaa

SEQ ID NO: 635574 - DNA, 20 bp, Artificial
  CRISPR gRNA sequence
tgaaaatttatgctaaaagt

SEQ ID NO: 635575 - DNA, 20 bp, Artificial
  CRISPR gRNA sequence
atgctaaaagtcaaatgaga

SEQ ID NO: 635576 - DNA, 20 bp, Artificial
  CRISPR gRNA sequence
tgctaaaagtcaaatgagat

SEQ ID NO: 635577 - DNA, 20 bp, Artificial
  CRISPR gRNA sequence
aaagtcaaatgagattcatt

SEQ ID NO: 635578 - DNA, 20 bp, Artificial
  CRISPR gRNA sequence
atttggatttctgatcattc

SEQ ID NO: 635579 - DNA, 20 bp, Artificial
  CRISPR gRNA sequence
ggatttctgatcattctttt

SEQ ID NO: 635580 - DNA, 20 bp, Artificial
  CRISPR gRNA sequence
gatttctgatcattcttttc

SEQ ID NO: 635581 - DNA, 20 bp, Artificial
  CRISPR gRNA sequence
ctgatcattcttttctcttt

SEQ ID NO: 635582 - DNA, 20 bp, Artificial
  CRISPR gRNA sequence
tgatcattcttttctctttt

SEQ ID NO: 635583 - DNA, 20 bp, Artificial
  CRISPR gRNA sequence
atcattcttttctcttttat

SEQ ID NO: 635584 - DNA, 20 bp, Artificial
  CRISPR gRNA sequence
ttttctcttttatgtgttat

SEQ ID NO: 635585 - DNA, 20 bp, Artificial
  CRISPR gRNA sequence
ttctcttttatgtgttatat

SEQ ID NO: 635586 - DNA, 20 bp, Artificial
  CRISPR gRNA sequence
tctcttttatgtgttatatt

SEQ ID NO: 635587 - DNA, 20 bp, Artificial
  CRISPR gRNA sequence
ctcttttatgtgttatattc

SEQ ID NO: 635588 - DNA, 20 bp, Artificial
  CRISPR gRNA sequence
tcttttatgtgttatattct

SEQ ID NO: 635589 - DNA, 20 bp, Artificial
  CRISPR gRNA sequence
ttttatgtgttatattctgg

SEQ ID NO: 635590 - DNA, 20 bp, Artificial
  CRISPR gRNA sequence
ttatgtgttatattctggca

SEQ ID NO: 635591 - DNA, 20 bp, Artificial
  CRISPR gRNA sequence
tatgtgttatattctggcat

SEQ ID NO: 635592 - DNA, 20 bp, Artificial
  CRISPR gRNA sequence
atgtgttatattctggcatt

SEQ ID NO: 635593 - DNA, 20 bp, Artificial
  CRISPR gRNA sequence
tgtgttatattctggcattt

SEQ ID NO: 635594 - DNA, 20 bp, Artificial
  CRISPR gRNA sequence
tattctggcatttcttaaaa

SEQ ID NO: 635595 - DNA, 20 bp, Artificial
  CRISPR gRNA sequence
tggcatttcttaaaaacatt

SEQ ID NO: 635596 - DNA, 20 bp, Artificial
  CRISPR gRNA sequence
gcatttcttaaaaacattaa

SEQ ID NO: 635597 - DNA, 20 bp, Artificial
  CRISPR gRNA sequence
cttaaaaacattaaatttat

SEQ ID NO: 635598 - DNA, 20 bp, Artificial
  CRISPR gRNA sequence
ttaaaaacattaaatttatt

SEQ ID NO: 635599 - DNA, 20 bp, Artificial
  CRISPR gRNA sequence
aaaaacattaaatttatttt

SEQ ID NO: 635600 - DNA, 20 bp, Artificial
  CRISPR gRNA sequence
aaaacattaaatttattttt

SEQ ID NO: 635601 - DNA, 20 bp, Artificial
  CRISPR gRNA sequence
aatttatttttttcttttat

SEQ ID NO: 635602 - DNA, 20 bp, Artificial
  CRISPR gRNA sequence
atttttttcttttattccca

SEQ ID NO: 635603 - DNA, 20 bp, Artificial
  CRISPR gRNA sequence
tttttttcttttattcccaa

SEQ ID NO: 635604 - DNA, 20 bp, Artificial
  CRISPR gRNA sequence
ttttcttttattcccaagaa

SEQ ID NO: 635605 - DNA, 20 bp, Artificial
  CRISPR gRNA sequence
tttcttttattcccaagaat

SEQ ID NO: 635606 - DNA, 20 bp, Artificial
  CRISPR gRNA sequence
ttcttttattcccaagaatt

SEQ ID NO: 635607 - DNA, 20 bp, Artificial
  CRISPR gRNA sequence
tcttttattcccaagaattt

SEQ ID NO: 635608 - DNA, 20 bp, Artificial
  CRISPR gRNA sequence
cttttattcccaagaatttg

SEQ ID NO: 635609 - DNA, 20 bp, Artificial
  CRISPR gRNA sequence
ttttattcccaagaatttgt

SEQ ID NO: 635610 - DNA, 20 bp, Artificial
  CRISPR gRNA sequence
ttattcccaagaatttgtca

SEQ ID NO: 635611 - DNA, 20 bp, Artificial
  CRISPR gRNA sequence
tattcccaagaatttgtcat

SEQ ID NO: 635612 - DNA, 20 bp, Artificial
  CRISPR gRNA sequence
attcccaagaatttgtcata

SEQ ID NO: 635613 - DNA, 20 bp, Artificial
  CRISPR gRNA sequence
ttcccaagaatttgtcatat

SEQ ID NO: 635614 - DNA, 20 bp, Artificial
  CRISPR gRNA sequence
ccaagaatttgtcatattct

SEQ ID NO: 635615 - DNA, 20 bp, Artificial
  CRISPR gRNA sequence
gtcatattctacatttttta

SEQ ID NO: 635616 - DNA, 20 bp, Artificial
  CRISPR gRNA sequence
tcatattctacattttttaa

SEQ ID NO: 635617 - DNA, 20 bp, Artificial
  CRISPR gRNA sequence
tacattttttaaatgattta

SEQ ID NO: 635618 - DNA, 20 bp, Artificial
  CRISPR gRNA sequence
cattttttaaatgatttatg

SEQ ID NO: 635619 - DNA, 20 bp, Artificial
  CRISPR gRNA sequence
tttaaatgatttatgaaaca

SEQ ID NO: 635620 - DNA, 20 bp, Artificial
  CRISPR gRNA sequence
ttaaatgatttatgaaacac

SEQ ID NO: 635621 - DNA, 20 bp, Artificial
  CRISPR gRNA sequence
taaatgatttatgaaacaca

SEQ ID NO: 635622 - DNA, 20 bp, Artificial
  CRISPR gRNA sequence
aaatgatttatgaaacacag

SEQ ID NO: 635623 - DNA, 20 bp, Artificial
  CRISPR gRNA sequence
aatgatttatgaaacacagc

SEQ ID NO: 635624 - DNA, 20 bp, Artificial
  CRISPR gRNA sequence
atgaaacacagcaaagtttc

SEQ ID NO: 635625 - DNA, 20 bp, Artificial
  CRISPR gRNA sequence
tgaaacacagcaaagtttca

SEQ ID NO: 635626 - DNA, 20 bp, Artificial
  CRISPR gRNA sequence
cagagtacccaatgactatt

SEQ ID NO: 635627 - DNA, 20 bp, Artificial
  CRISPR gRNA sequence
agagtacccaatgactattg

SEQ ID NO: 635628 - DNA, 20 bp, Artificial
  CRISPR gRNA sequence
ttgtttgagagctaaagata

SEQ ID NO: 635629 - DNA, 20 bp, Artificial
  CRISPR gRNA sequence
tttgagagctaaagatacaa

SEQ ID NO: 635630 - DNA, 20 bp, Artificial
  CRISPR gRNA sequence
gagagctaaagatacaagga

SEQ ID NO: 635631 - DNA, 20 bp, Artificial
  CRISPR gRNA sequence
agagctaaagatacaaggag

SEQ ID NO: 635632 - DNA, 20 bp, Artificial
  CRISPR gRNA sequence
aagatacaaggagagttaaa

SEQ ID NO: 635633 - DNA, 20 bp, Artificial
  CRISPR gRNA sequence
aaattagaatataaaatact

SEQ ID NO: 635634 - DNA, 20 bp, Artificial
  CRISPR gRNA sequence
gaatataaaatactcgaaaa

SEQ ID NO: 635635 - DNA, 20 bp, Artificial
  CRISPR gRNA sequence
gaaaagccaattttctgagt

SEQ ID NO: 635636 - DNA, 20 bp, Artificial
  CRISPR gRNA sequence
tctgagtatattttcaagtt

SEQ ID NO: 635637 - DNA, 20 bp, Artificial
  CRISPR gRNA sequence
ctgagtatattttcaagttt

SEQ ID NO: 635638 - DNA, 20 bp, Artificial
  CRISPR gRNA sequence
tgagtatattttcaagttta

SEQ ID NO: 635639 - DNA, 20 bp, Artificial
  CRISPR gRNA sequence
agtatattttcaagtttaaa

SEQ ID NO: 635640 - DNA, 20 bp, Artificial
  CRISPR gRNA sequence
tcaagtttaaaagaaacaat

SEQ ID NO: 635641 - DNA, 20 bp, Artificial
  CRISPR gRNA sequence
caagtttaaaagaaacaatt

SEQ ID NO: 635642 - DNA, 20 bp, Artificial
  CRISPR gRNA sequence
aagtttaaaagaaacaattt

SEQ ID NO: 635643 - DNA, 20 bp, Artificial
  CRISPR gRNA sequence
aaaagaaacaattttatttt

SEQ ID NO: 635644 - DNA, 20 bp, Artificial
  CRISPR gRNA sequence
aaagaaacaattttattttc

SEQ ID NO: 635645 - DNA, 20 bp, Artificial
  CRISPR gRNA sequence
tattttccacagagatccca

SEQ ID NO: 635646 - DNA, 20 bp, Artificial
  CRISPR gRNA sequence
attttccacagagatcccag

SEQ ID NO: 635647 - DNA, 20 bp, Artificial
  CRISPR gRNA sequence
ttttccacagagatcccagc

SEQ ID NO: 635648 - DNA, 20 bp, Artificial
  CRISPR gRNA sequence
tccacagagatcccagcctg

SEQ ID NO: 635649 - DNA, 20 bp, Artificial
  CRISPR gRNA sequence
ccacagagatcccagcctga

SEQ ID NO: 635650 - DNA, 20 bp, Artificial
  CRISPR gRNA sequence
cacagagatcccagcctgag

SEQ ID NO: 635651 - DNA, 20 bp, Artificial
  CRISPR gRNA sequence
agcactgtatcagtcaaaaa

SEQ ID NO: 635652 - DNA, 20 bp, Artificial
  CRISPR gRNA sequence
tatcagtcaaaaaaaatcag

SEQ ID NO: 635653 - DNA, 20 bp, Artificial
  CRISPR gRNA sequence
tcatttcctctacagtaact

SEQ ID NO: 635654 - DNA, 20 bp, Artificial
  CRISPR gRNA sequence
catttcctctacagtaactc

SEQ ID NO: 635655 - DNA, 20 bp, Artificial
  CRISPR gRNA sequence
atttcctctacagtaactcg

SEQ ID NO: 635656 - DNA, 20 bp, Artificial
  CRISPR gRNA sequence
cctctacagtaactcgaaac

SEQ ID NO: 635657 - DNA, 20 bp, Artificial
  CRISPR gRNA sequence
ctctacagtaactcgaaaca

SEQ ID NO: 635658 - DNA, 20 bp, Artificial
  CRISPR gRNA sequence
tacagtaactcgaaacataa

SEQ ID NO: 635659 - DNA, 20 bp, Artificial
  CRISPR gRNA sequence
cagtaactcgaaacataact

SEQ ID NO: 635660 - DNA, 20 bp, Artificial
  CRISPR gRNA sequence
gaaacataactgatattata

SEQ ID NO: 635661 - DNA, 20 bp, Artificial
  CRISPR gRNA sequence
atattatactggatcttcac

SEQ ID NO: 635662 - DNA, 20 bp, Artificial
  CRISPR gRNA sequence
tactggatcttcacttatct

SEQ ID NO: 635663 - DNA, 20 bp, Artificial
  CRISPR gRNA sequence
gatcttcacttatcttggat

SEQ ID NO: 635664 - DNA, 20 bp, Artificial
  CRISPR gRNA sequence
cacttatcttggattaacca

SEQ ID NO: 635665 - DNA, 20 bp, Artificial
  CRISPR gRNA sequence
acttatcttggattaaccat

SEQ ID NO: 635666 - DNA, 20 bp, Artificial
  CRISPR gRNA sequence
atcttggattaaccataatg

SEQ ID NO: 635667 - DNA, 20 bp, Artificial
  CRISPR gRNA sequence
tcttggattaaccataatga

SEQ ID NO: 635668 - DNA, 20 bp, Artificial
  CRISPR gRNA sequence
ggattaaccataatgactgc

SEQ ID NO: 635669 - DNA, 20 bp, Artificial
  CRISPR gRNA sequence
gattaaccataatgactgca

SEQ ID NO: 635670 - DNA, 20 bp, Artificial
  CRISPR gRNA sequence
accataatgactgcattctt

SEQ ID NO: 635671 - DNA, 20 bp, Artificial
  CRISPR gRNA sequence
cattcttaattgtaaaattt

SEQ ID NO: 635672 - DNA, 20 bp, Artificial
  CRISPR gRNA sequence
ttaattgtaaaattttaaaa

SEQ ID NO: 635673 - DNA, 20 bp, Artificial
  CRISPR gRNA sequence
aattgtaaaattttaaaatt

SEQ ID NO: 635674 - DNA, 20 bp, Artificial
  CRISPR gRNA sequence
attgtaaaattttaaaatta

SEQ ID NO: 635675 - DNA, 20 bp, Artificial
  CRISPR gRNA sequence
taaaattttaaaattataga

SEQ ID NO: 635676 - DNA, 20 bp, Artificial
  CRISPR gRNA sequence
taaaattatagaaaatatat

SEQ ID NO: 635677 - DNA, 20 bp, Artificial
  CRISPR gRNA sequence
aaaattatagaaaatatata

SEQ ID NO: 635678 - DNA, 20 bp, Artificial
  CRISPR gRNA sequence
aaattatagaaaatatataa

SEQ ID NO: 635679 - DNA, 20 bp, Artificial
  CRISPR gRNA sequence
tagaaaatatataacagctg

SEQ ID NO: 635680 - DNA, 20 bp, Artificial
  CRISPR gRNA sequence
ttttcttattctaatatatt

SEQ ID NO: 635681 - DNA, 20 bp, Artificial
  CRISPR gRNA sequence
tcttattctaatatattgaa

SEQ ID NO: 635682 - DNA, 20 bp, Artificial
  CRISPR gRNA sequence
cttattctaatatattgaag

SEQ ID NO: 635683 - DNA, 20 bp, Artificial
  CRISPR gRNA sequence
ttattctaatatattgaagt

SEQ ID NO: 635684 - DNA, 20 bp, Artificial
  CRISPR gRNA sequence
attctaatatattgaagtaa

SEQ ID NO: 635685 - DNA, 20 bp, Artificial
  CRISPR gRNA sequence
ttctaatatattgaagtaag

SEQ ID NO: 635686 - DNA, 20 bp, Artificial
  CRISPR gRNA sequence
taatatattgaagtaagata

SEQ ID NO: 635687 - DNA, 20 bp, Artificial
  CRISPR gRNA sequence
atatattgaagtaagatact

SEQ ID NO: 635688 - DNA, 20 bp, Artificial
  CRISPR gRNA sequence
aagtaagatactcttcagtt

SEQ ID NO: 635689 - DNA, 20 bp, Artificial
  CRISPR gRNA sequence
ttcagttgacagtgctcctt

SEQ ID NO: 635690 - DNA, 20 bp, Artificial
  CRISPR gRNA sequence
cagttgacagtgctcctttc

SEQ ID NO: 635691 - DNA, 20 bp, Artificial
  CRISPR gRNA sequence
agttgacagtgctcctttct

SEQ ID NO: 635692 - DNA, 20 bp, Artificial
  CRISPR gRNA sequence
acagtgctcctttctgccaa

SEQ ID NO: 635693 - DNA, 20 bp, Artificial
  CRISPR gRNA sequence
ctttctgccaagccgtaaag

SEQ ID NO: 635694 - DNA, 20 bp, Artificial
  CRISPR gRNA sequence
tctgccaagccgtaaagtct

SEQ ID NO: 635695 - DNA, 20 bp, Artificial
  CRISPR gRNA sequence
ctgccaagccgtaaagtcta

SEQ ID NO: 635696 - DNA, 20 bp, Artificial
  CRISPR gRNA sequence
tgccaagccgtaaagtctaa

SEQ ID NO: 635697 - DNA, 20 bp, Artificial
  CRISPR gRNA sequence
ccaagccgtaaagtctaaaa

SEQ ID NO: 635698 - DNA, 20 bp, Artificial
  CRISPR gRNA sequence
aaaatgaaagatacatgcat

SEQ ID NO: 635699 - DNA, 20 bp, Artificial
  CRISPR gRNA sequence
caagatttatcaattattta

SEQ ID NO: 635700 - DNA, 20 bp, Artificial
  CRISPR gRNA sequence
atcaattatttaatgtacac

SEQ ID NO: 635701 - DNA, 20 bp, Artificial
  CRISPR gRNA sequence
tcaattatttaatgtacacc

SEQ ID NO: 635702 - DNA, 20 bp, Artificial
  CRISPR gRNA sequence
tttaatgtacaccaataaca

SEQ ID NO: 635703 - DNA, 20 bp, Artificial
  CRISPR gRNA sequence
aatgtacaccaataacaaga

SEQ ID NO: 635704 - DNA, 20 bp, Artificial
  CRISPR gRNA sequence
atgtacaccaataacaagat

SEQ ID NO: 635705 - DNA, 20 bp, Artificial
  CRISPR gRNA sequence
tcttggtcattaccgactac

SEQ ID NO: 635706 - DNA, 20 bp, Artificial
  CRISPR gRNA sequence
ggtcattaccgactacataa

SEQ ID NO: 635707 - DNA, 20 bp, Artificial
  CRISPR gRNA sequence
gtcattaccgactacataac

SEQ ID NO: 635708 - DNA, 20 bp, Artificial
  CRISPR gRNA sequence
ccgactacataacaaagcca

SEQ ID NO: 635709 - DNA, 20 bp, Artificial
  CRISPR gRNA sequence
cataacaaagccatgttact

SEQ ID NO: 635710 - DNA, 20 bp, Artificial
  CRISPR gRNA sequence
ctatcattcaatagtactct

SEQ ID NO: 635711 - DNA, 20 bp, Artificial
  CRISPR gRNA sequence
tcattcaatagtactcttct

SEQ ID NO: 635712 - DNA, 20 bp, Artificial
  CRISPR gRNA sequence
aatagtactcttctaagttt

SEQ ID NO: 635713 - DNA, 20 bp, Artificial
  CRISPR gRNA sequence
ttctaagttttcctgtttta

SEQ ID NO: 635714 - DNA, 20 bp, Artificial
  CRISPR gRNA sequence
ctaagttttcctgttttact

SEQ ID NO: 635715 - DNA, 20 bp, Artificial
  CRISPR gRNA sequence
taagttttcctgttttactt

SEQ ID NO: 635716 - DNA, 20 bp, Artificial
  CRISPR gRNA sequence
agttttcctgttttactttt

SEQ ID NO: 635717 - DNA, 20 bp, Artificial
  CRISPR gRNA sequence
tcctgttttacttttcttct

SEQ ID NO: 635718 - DNA, 20 bp, Artificial
  CRISPR gRNA sequence
cctgttttacttttcttctc

SEQ ID NO: 635719 - DNA, 20 bp, Artificial
  CRISPR gRNA sequence
ctgttttacttttcttctca

SEQ ID NO: 635720 - DNA, 20 bp, Artificial
  CRISPR gRNA sequence
ttttacttttcttctcaagg

SEQ ID NO: 635721 - DNA, 20 bp, Artificial
  CRISPR gRNA sequence
tacttttcttctcaaggagt

SEQ ID NO: 635722 - DNA, 20 bp, Artificial
  CRISPR gRNA sequence
acttttcttctcaaggagtt

SEQ ID NO: 635723 - DNA, 20 bp, Artificial
  CRISPR gRNA sequence
cttttcttctcaaggagttg

SEQ ID NO: 635724 - DNA, 20 bp, Artificial
  CRISPR gRNA sequence
ttcttctcaaggagttggtg

SEQ ID NO: 635725 - DNA, 20 bp, Artificial
  CRISPR gRNA sequence
tcttctcaaggagttggtga

SEQ ID NO: 635726 - DNA, 20 bp, Artificial
  CRISPR gRNA sequence
cttctcaaggagttggtgac

SEQ ID NO: 635727 - DNA, 20 bp, Artificial
  CRISPR gRNA sequence
ttctcaaggagttggtgaca

SEQ ID NO: 635728 - DNA, 20 bp, Artificial
  CRISPR gRNA sequence
ctcaaggagttggtgacact

SEQ ID NO: 635729 - DNA, 20 bp, Artificial
  CRISPR gRNA sequence
tcaaggagttggtgacactt

SEQ ID NO: 635730 - DNA, 20 bp, Artificial
  CRISPR gRNA sequence
aaggagttggtgacacttac

SEQ ID NO: 635731 - DNA, 20 bp, Artificial
  CRISPR gRNA sequence
gtgacacttaccagaatggg

SEQ ID NO: 635732 - DNA, 20 bp, Artificial
  CRISPR gRNA sequence
accagaatgggtcctgaggt

SEQ ID NO: 635733 - DNA, 20 bp, Artificial
  CRISPR gRNA sequence
ccagaatgggtcctgaggtg

SEQ ID NO: 635734 - DNA, 20 bp, Artificial
  CRISPR gRNA sequence
aggtgtcctgtgagggcgtc

SEQ ID NO: 635735 - DNA, 20 bp, Artificial
  CRISPR gRNA sequence
tgagggcgtcccttcttcta

SEQ ID NO: 635736 - DNA, 20 bp, Artificial
  CRISPR gRNA sequence
cttctacaggcgtagctaca

SEQ ID NO: 635737 - DNA, 20 bp, Artificial
  CRISPR gRNA sequence
ttctacaggcgtagctacag

SEQ ID NO: 635738 - DNA, 20 bp, Artificial
  CRISPR gRNA sequence
ctacaggcgtagctacagaa

SEQ ID NO: 635739 - DNA, 20 bp, Artificial
  CRISPR gRNA sequence
tacaggcgtagctacagaaa

SEQ ID NO: 635740 - DNA, 20 bp, Artificial
  CRISPR gRNA sequence
caggcgtagctacagaaagg

SEQ ID NO: 635741 - DNA, 20 bp, Artificial
  CRISPR gRNA sequence
cagaaaggacatttgaacgg

SEQ ID NO: 635742 - DNA, 20 bp, Artificial
  CRISPR gRNA sequence
gaacggcttctctccagagt

SEQ ID NO: 635743 - DNA, 20 bp, Artificial
  CRISPR gRNA sequence
aacggcttctctccagagtg

SEQ ID NO: 635744 - DNA, 20 bp, Artificial
  CRISPR gRNA sequence
ctctccagagtgtaacttta

SEQ ID NO: 635745 - DNA, 20 bp, Artificial
  CRISPR gRNA sequence
tctccagagtgtaactttat

SEQ ID NO: 635746 - DNA, 20 bp, Artificial
  CRISPR gRNA sequence
tccagagtgtaactttatgt

SEQ ID NO: 635747 - DNA, 20 bp, Artificial
  CRISPR gRNA sequence
cagagtgtaactttatgtgt

SEQ ID NO: 635748 - DNA, 20 bp, Artificial
  CRISPR gRNA sequence
tatgtgtctcagaaggttgc

SEQ ID NO: 635749 - DNA, 20 bp, Artificial
  CRISPR gRNA sequence
atgtgtctcagaaggttgcc

SEQ ID NO: 635750 - DNA, 20 bp, Artificial
  CRISPR gRNA sequence
tgtgtctcagaaggttgccc

SEQ ID NO: 635751 - DNA, 20 bp, Artificial
  CRISPR gRNA sequence
agaaggttgcccttctgagt

SEQ ID NO: 635752 - DNA, 20 bp, Artificial
  CRISPR gRNA sequence
cccttctgagtaaaagaagc

SEQ ID NO: 635753 - DNA, 20 bp, Artificial
  CRISPR gRNA sequence
ctgagtaaaagaagctccac

SEQ ID NO: 635754 - DNA, 20 bp, Artificial
  CRISPR gRNA sequence
tgagtaaaagaagctccaca

SEQ ID NO: 635755 - DNA, 20 bp, Artificial
  CRISPR gRNA sequence
agtaaaagaagctccacact

SEQ ID NO: 635756 - DNA, 20 bp, Artificial
  CRISPR gRNA sequence
cacactggttacagtggaag

SEQ ID NO: 635757 - DNA, 20 bp, Artificial
  CRISPR gRNA sequence
gttacagtggaaggggcgtt

SEQ ID NO: 635758 - DNA, 20 bp, Artificial
  CRISPR gRNA sequence
cagtggaaggggcgttcacc

SEQ ID NO: 635759 - DNA, 20 bp, Artificial
  CRISPR gRNA sequence
acctgcagtaaggagaagaa

SEQ ID NO: 635760 - DNA, 20 bp, Artificial
  CRISPR gRNA sequence
cagtaaggagaagaaatggg

SEQ ID NO: 635761 - DNA, 20 bp, Artificial
  CRISPR gRNA sequence
gggtatgtgcaagtgactaa

SEQ ID NO: 635762 - DNA, 20 bp, Artificial
  CRISPR gRNA sequence
atttgccatccactgttaac

SEQ ID NO: 635763 - DNA, 20 bp, Artificial
  CRISPR gRNA sequence
gccatccactgttaaccaaa

SEQ ID NO: 635764 - DNA, 20 bp, Artificial
  CRISPR gRNA sequence
ccatccactgttaaccaaag

SEQ ID NO: 635765 - DNA, 20 bp, Artificial
  CRISPR gRNA sequence
ttaaccaaagccagttctct

SEQ ID NO: 635766 - DNA, 20 bp, Artificial
  CRISPR gRNA sequence
accaaagccagttctctatg

SEQ ID NO: 635767 - DNA, 20 bp, Artificial
  CRISPR gRNA sequence
tctatgctaaaaatgttcat

SEQ ID NO: 635768 - DNA, 20 bp, Artificial
  CRISPR gRNA sequence
tatgctaaaaatgttcatct

SEQ ID NO: 635769 - DNA, 20 bp, Artificial
  CRISPR gRNA sequence
tgctaaaaatgttcatctcc

SEQ ID NO: 635770 - DNA, 20 bp, Artificial
  CRISPR gRNA sequence
aaaatgttcatctccctcat

SEQ ID NO: 635771 - DNA, 20 bp, Artificial
  CRISPR gRNA sequence
atctccctcataagtctttt

SEQ ID NO: 635772 - DNA, 20 bp, Artificial
  CRISPR gRNA sequence
cctcataagtcttttaaaca

SEQ ID NO: 635773 - DNA, 20 bp, Artificial
  CRISPR gRNA sequence
ataagtcttttaaacattta

SEQ ID NO: 635774 - DNA, 20 bp, Artificial
  CRISPR gRNA sequence
ttaaacatttatctgcccag

SEQ ID NO: 635775 - DNA, 20 bp, Artificial
  CRISPR gRNA sequence
taaacatttatctgcccaga

SEQ ID NO: 635776 - DNA, 20 bp, Artificial
  CRISPR gRNA sequence
aaacatttatctgcccagaa

SEQ ID NO: 635777 - DNA, 20 bp, Artificial
  CRISPR gRNA sequence
aacatttatctgcccagaat

SEQ ID NO: 635778 - DNA, 20 bp, Artificial
  CRISPR gRNA sequence
atctgcccagaatttgcttt

SEQ ID NO: 635779 - DNA, 20 bp, Artificial
  CRISPR gRNA sequence
tctgcccagaatttgctttg

SEQ ID NO: 635780 - DNA, 20 bp, Artificial
  CRISPR gRNA sequence
cccagaatttgctttgtcaa

SEQ ID NO: 635781 - DNA, 20 bp, Artificial
  CRISPR gRNA sequence
gctttgtcaatacagttacc

SEQ ID NO: 635782 - DNA, 20 bp, Artificial
  CRISPR gRNA sequence
ctttgtcaatacagttacca

SEQ ID NO: 635783 - DNA, 20 bp, Artificial
  CRISPR gRNA sequence
tgtcaatacagttaccaaag

SEQ ID NO: 635784 - DNA, 20 bp, Artificial
  CRISPR gRNA sequence
gtcaatacagttaccaaagt

SEQ ID NO: 635785 - DNA, 20 bp, Artificial
  CRISPR gRNA sequence
tcaatacagttaccaaagtc

SEQ ID NO: 635786 - DNA, 20 bp, Artificial
  CRISPR gRNA sequence
ccaaagtcttaagttttaca

SEQ ID NO: 635787 - DNA, 20 bp, Artificial
  CRISPR gRNA sequence
aagttttacatcaaatgatc

SEQ ID NO: 635788 - DNA, 20 bp, Artificial
  CRISPR gRNA sequence
agttttacatcaaatgatct

SEQ ID NO: 635789 - DNA, 20 bp, Artificial
  CRISPR gRNA sequence
tacatcaaatgatctttccc

SEQ ID NO: 635790 - DNA, 20 bp, Artificial
  CRISPR gRNA sequence
acatcaaatgatctttcccc

SEQ ID NO: 635791 - DNA, 20 bp, Artificial
  CRISPR gRNA sequence
catcaaatgatctttcccct

SEQ ID NO: 635792 - DNA, 20 bp, Artificial
  CRISPR gRNA sequence
tccccttttatgtataaatg

SEQ ID NO: 635793 - DNA, 20 bp, Artificial
  CRISPR gRNA sequence
ccccttttatgtataaatgt

SEQ ID NO: 635794 - DNA, 20 bp, Artificial
  CRISPR gRNA sequence
cccttttatgtataaatgtg

SEQ ID NO: 635795 - DNA, 20 bp, Artificial
  CRISPR gRNA sequence
ttatgtataaatgtgacaaa

SEQ ID NO: 635796 - DNA, 20 bp, Artificial
  CRISPR gRNA sequence
tatgtataaatgtgacaaaa

SEQ ID NO: 635797 - DNA, 20 bp, Artificial
  CRISPR gRNA sequence
atgtataaatgtgacaaaag

SEQ ID NO: 635798 - DNA, 20 bp, Artificial
  CRISPR gRNA sequence
tgtataaatgtgacaaaagt

SEQ ID NO: 635799 - DNA, 20 bp, Artificial
  CRISPR gRNA sequence
tcattgactcagaagaataa

SEQ ID NO: 635800 - DNA, 20 bp, Artificial
  CRISPR gRNA sequence
actcagaagaataacaataa

SEQ ID NO: 635801 - DNA, 20 bp, Artificial
  CRISPR gRNA sequence
agaagaataacaataatagc

SEQ ID NO: 635802 - DNA, 20 bp, Artificial
  CRISPR gRNA sequence
atcattggttgaacaatgag

SEQ ID NO: 635803 - DNA, 20 bp, Artificial
  CRISPR gRNA sequence
tcattggttgaacaatgagg

SEQ ID NO: 635804 - DNA, 20 bp, Artificial
  CRISPR gRNA sequence
gttgaacaatgaggtgctgt

SEQ ID NO: 635805 - DNA, 20 bp, Artificial
  CRISPR gRNA sequence
aacaatgaggtgctgtcact

SEQ ID NO: 635806 - DNA, 20 bp, Artificial
  CRISPR gRNA sequence
tcactttagggccttacaca

SEQ ID NO: 635807 - DNA, 20 bp, Artificial
  CRISPR gRNA sequence
tagggccttacacacaattg

SEQ ID NO: 635808 - DNA, 20 bp, Artificial
  CRISPR gRNA sequence
agggccttacacacaattgg

SEQ ID NO: 635809 - DNA, 20 bp, Artificial
  CRISPR gRNA sequence
gggccttacacacaattgga

SEQ ID NO: 635810 - DNA, 20 bp, Artificial
  CRISPR gRNA sequence
acacacaattggatgctttc

SEQ ID NO: 635811 - DNA, 20 bp, Artificial
  CRISPR gRNA sequence
cacacaattggatgctttcc

SEQ ID NO: 635812 - DNA, 20 bp, Artificial
  CRISPR gRNA sequence
gatgctttccatagaatatt

SEQ ID NO: 635813 - DNA, 20 bp, Artificial
  CRISPR gRNA sequence
tccatagaatatttcaatcc

SEQ ID NO: 635814 - DNA, 20 bp, Artificial
  CRISPR gRNA sequence
ccatagaatatttcaatcct

SEQ ID NO: 635815 - DNA, 20 bp, Artificial
  CRISPR gRNA sequence
catagaatatttcaatcctt

SEQ ID NO: 635816 - DNA, 20 bp, Artificial
  CRISPR gRNA sequence
caatcctttcttacaatgac

SEQ ID NO: 635817 - DNA, 20 bp, Artificial
  CRISPR gRNA sequence
aatcctttcttacaatgaca

SEQ ID NO: 635818 - DNA, 20 bp, Artificial
  CRISPR gRNA sequence
tcttacaatgacaataatta

SEQ ID NO: 635819 - DNA, 20 bp, Artificial
  CRISPR gRNA sequence
cttacaatgacaataattag

SEQ ID NO: 635820 - DNA, 20 bp, Artificial
  CRISPR gRNA sequence
ttacaatgacaataattagg

SEQ ID NO: 635821 - DNA, 20 bp, Artificial
  CRISPR gRNA sequence
acaatgacaataattaggtt

SEQ ID NO: 635822 - DNA, 20 bp, Artificial
  CRISPR gRNA sequence
caatgacaataattaggttg

SEQ ID NO: 635823 - DNA, 20 bp, Artificial
  CRISPR gRNA sequence
ggttgttttaattttaatta

SEQ ID NO: 635824 - DNA, 20 bp, Artificial
  CRISPR gRNA sequence
ttttaattttaattaacaaa

SEQ ID NO: 635825 - DNA, 20 bp, Artificial
  CRISPR gRNA sequence
taattttaattaacaaatga

SEQ ID NO: 635826 - DNA, 20 bp, Artificial
  CRISPR gRNA sequence
aattttaattaacaaatgaa

SEQ ID NO: 635827 - DNA, 20 bp, Artificial
  CRISPR gRNA sequence
attttaattaacaaatgaag

SEQ ID NO: 635828 - DNA, 20 bp, Artificial
  CRISPR gRNA sequence
taattaacaaatgaagaaat

SEQ ID NO: 635829 - DNA, 20 bp, Artificial
  CRISPR gRNA sequence
aattaacaaatgaagaaatt

SEQ ID NO: 635830 - DNA, 20 bp, Artificial
  CRISPR gRNA sequence
attaacaaatgaagaaatta

SEQ ID NO: 635831 - DNA, 20 bp, Artificial
  CRISPR gRNA sequence
acaaatgaagaaattaaagt

SEQ ID NO: 635832 - DNA, 20 bp, Artificial
  CRISPR gRNA sequence
aagtccatagatcaaactat

SEQ ID NO: 635833 - DNA, 20 bp, Artificial
  CRISPR gRNA sequence
ttttgttacacagagctaga

SEQ ID NO: 635834 - DNA, 20 bp, Artificial
  CRISPR gRNA sequence
tgttacacagagctagaaag

SEQ ID NO: 635835 - DNA, 20 bp, Artificial
  CRISPR gRNA sequence
gttacacagagctagaaagt

SEQ ID NO: 635836 - DNA, 20 bp, Artificial
  CRISPR gRNA sequence
ttacacagagctagaaagta

SEQ ID NO: 635837 - DNA, 20 bp, Artificial
  CRISPR gRNA sequence
cacagagctagaaagtagtc

SEQ ID NO: 635838 - DNA, 20 bp, Artificial
  CRISPR gRNA sequence
gaaagtagtcaaggtgagaa

SEQ ID NO: 635839 - DNA, 20 bp, Artificial
  CRISPR gRNA sequence
gtcagtttggctacaaaatc

SEQ ID NO: 635840 - DNA, 20 bp, Artificial
  CRISPR gRNA sequence
ggctacaaaatcttgttctc

SEQ ID NO: 635841 - DNA, 20 bp, Artificial
  CRISPR gRNA sequence
gctacaaaatcttgttctct

SEQ ID NO: 635842 - DNA, 20 bp, Artificial
  CRISPR gRNA sequence
caaaatcttgttctctttct

SEQ ID NO: 635843 - DNA, 20 bp, Artificial
  CRISPR gRNA sequence
gttctctttcttttaccatg

SEQ ID NO: 635844 - DNA, 20 bp, Artificial
  CRISPR gRNA sequence
ttctctttcttttaccatgc

SEQ ID NO: 635845 - DNA, 20 bp, Artificial
  CRISPR gRNA sequence
tctttcttttaccatgctat

SEQ ID NO: 635846 - DNA, 20 bp, Artificial
  CRISPR gRNA sequence
tttcttttaccatgctatct

SEQ ID NO: 635847 - DNA, 20 bp, Artificial
  CRISPR gRNA sequence
tcttttaccatgctatctct

SEQ ID NO: 635848 - DNA, 20 bp, Artificial
  CRISPR gRNA sequence
cttttaccatgctatctctt

SEQ ID NO: 635849 - DNA, 20 bp, Artificial
  CRISPR gRNA sequence
ttttaccatgctatctcttt

SEQ ID NO: 635850 - DNA, 20 bp, Artificial
  CRISPR gRNA sequence
ttaccatgctatctctttaa

SEQ ID NO: 635851 - DNA, 20 bp, Artificial
  CRISPR gRNA sequence
taccatgctatctctttaaa

SEQ ID NO: 635852 - DNA, 20 bp, Artificial
  CRISPR gRNA sequence
accatgctatctctttaaaa

SEQ ID NO: 635853 - DNA, 20 bp, Artificial
  CRISPR gRNA sequence
ccatgctatctctttaaaat

SEQ ID NO: 635854 - DNA, 20 bp, Artificial
  CRISPR gRNA sequence
tctctttaaaattggcagaa

SEQ ID NO: 635855 - DNA, 20 bp, Artificial
  CRISPR gRNA sequence
tttaaaattggcagaaaatt

SEQ ID NO: 635856 - DNA, 20 bp, Artificial
  CRISPR gRNA sequence
taaaattggcagaaaatttg

SEQ ID NO: 635857 - DNA, 20 bp, Artificial
  CRISPR gRNA sequence
aaaattggcagaaaatttga

SEQ ID NO: 635858 - DNA, 20 bp, Artificial
  CRISPR gRNA sequence
aaattggcagaaaatttgag

SEQ ID NO: 635859 - DNA, 20 bp, Artificial
  CRISPR gRNA sequence
gcagaaaatttgagctgaaa

SEQ ID NO: 635860 - DNA, 20 bp, Artificial
  CRISPR gRNA sequence
gagctgaaagagaccttcag

SEQ ID NO: 635861 - DNA, 20 bp, Artificial
  CRISPR gRNA sequence
agctgaaagagaccttcagt

SEQ ID NO: 635862 - DNA, 20 bp, Artificial
  CRISPR gRNA sequence
aaagagaccttcagtctaat

SEQ ID NO: 635863 - DNA, 20 bp, Artificial
  CRISPR gRNA sequence
cagtctaattccctcattta

SEQ ID NO: 635864 - DNA, 20 bp, Artificial
  CRISPR gRNA sequence
agtctaattccctcatttag

SEQ ID NO: 635865 - DNA, 20 bp, Artificial
  CRISPR gRNA sequence
attccctcatttagctgata

SEQ ID NO: 635866 - DNA, 20 bp, Artificial
  CRISPR gRNA sequence
cctcatttagctgatatgga

SEQ ID NO: 635867 - DNA, 20 bp, Artificial
  CRISPR gRNA sequence
atttagctgatatggaaagg

SEQ ID NO: 635868 - DNA, 20 bp, Artificial
  CRISPR gRNA sequence
agctgatatggaaaggggca

SEQ ID NO: 635869 - DNA, 20 bp, Artificial
  CRISPR gRNA sequence
gctgatatggaaaggggcaa

SEQ ID NO: 635870 - DNA, 20 bp, Artificial
  CRISPR gRNA sequence
atatggaaaggggcaactaa

SEQ ID NO: 635871 - DNA, 20 bp, Artificial
  CRISPR gRNA sequence
aaaggtacagcaaatgaacc

SEQ ID NO: 635872 - DNA, 20 bp, Artificial
  CRISPR gRNA sequence
acaaagctcattagtacaag

SEQ ID NO: 635873 - DNA, 20 bp, Artificial
  CRISPR gRNA sequence
caaagctcattagtacaaga

SEQ ID NO: 635874 - DNA, 20 bp, Artificial
  CRISPR gRNA sequence
attagtacaagattttcaaa

SEQ ID NO: 635875 - DNA, 20 bp, Artificial
  CRISPR gRNA sequence
gtacaagattttcaaatacg

SEQ ID NO: 635876 - DNA, 20 bp, Artificial
  CRISPR gRNA sequence
tcaaatacgggccaggtttc

SEQ ID NO: 635877 - DNA, 20 bp, Artificial
  CRISPR gRNA sequence
caaatacgggccaggtttct

SEQ ID NO: 635878 - DNA, 20 bp, Artificial
  CRISPR gRNA sequence
aaatacgggccaggtttctt

SEQ ID NO: 635879 - DNA, 20 bp, Artificial
  CRISPR gRNA sequence
cttgattctcctggtcacta

SEQ ID NO: 635880 - DNA, 20 bp, Artificial
  CRISPR gRNA sequence
ttgattctcctggtcactaa

SEQ ID NO: 635881 - DNA, 20 bp, Artificial
  CRISPR gRNA sequence
gattctcctggtcactaata

SEQ ID NO: 635882 - DNA, 20 bp, Artificial
  CRISPR gRNA sequence
attctcctggtcactaatag

SEQ ID NO: 635883 - DNA, 20 bp, Artificial
  CRISPR gRNA sequence
tcctggtcactaatagtaaa

SEQ ID NO: 635884 - DNA, 20 bp, Artificial
  CRISPR gRNA sequence
ctggtcactaatagtaaaac

SEQ ID NO: 635885 - DNA, 20 bp, Artificial
  CRISPR gRNA sequence
gtcactaatagtaaaacctt

SEQ ID NO: 635886 - DNA, 20 bp, Artificial
  CRISPR gRNA sequence
atagtaaaacctttagcaaa

SEQ ID NO: 635887 - DNA, 20 bp, Artificial
  CRISPR gRNA sequence
tagcaaaatttccaaataaa

SEQ ID NO: 635888 - DNA, 20 bp, Artificial
  CRISPR gRNA sequence
agcaaaatttccaaataaaa

SEQ ID NO: 635889 - DNA, 20 bp, Artificial
  CRISPR gRNA sequence
gcaaaatttccaaataaaat

SEQ ID NO: 635890 - DNA, 20 bp, Artificial
  CRISPR gRNA sequence
ccaaataaaattattcatcc

SEQ ID NO: 635891 - DNA, 20 bp, Artificial
  CRISPR gRNA sequence
caaataaaattattcatcca

SEQ ID NO: 635892 - DNA, 20 bp, Artificial
  CRISPR gRNA sequence
ttcatccagacatgtcctgt

SEQ ID NO: 635893 - DNA, 20 bp, Artificial
  CRISPR gRNA sequence
atccagacatgtcctgtaca

SEQ ID NO: 635894 - DNA, 20 bp, Artificial
  CRISPR gRNA sequence
tacatgttttttgtgaaact

SEQ ID NO: 635895 - DNA, 20 bp, Artificial
  CRISPR gRNA sequence
tttgtgaaacttattatttg

SEQ ID NO: 635896 - DNA, 20 bp, Artificial
  CRISPR gRNA sequence
ttgtgaaacttattatttga

SEQ ID NO: 635897 - DNA, 20 bp, Artificial
  CRISPR gRNA sequence
tgtgaaacttattatttgaa

SEQ ID NO: 635898 - DNA, 20 bp, Artificial
  CRISPR gRNA sequence
gtgaaacttattatttgaaa

SEQ ID NO: 635899 - DNA, 20 bp, Artificial
  CRISPR gRNA sequence
tgaaacttattatttgaaag

SEQ ID NO: 635900 - DNA, 20 bp, Artificial
  CRISPR gRNA sequence
attatttgaaaggaatcttt

SEQ ID NO: 635901 - DNA, 20 bp, Artificial
  CRISPR gRNA sequence
ttatttgaaaggaatctttt

SEQ ID NO: 635902 - DNA, 20 bp, Artificial
  CRISPR gRNA sequence
tttgaaaggaatcttttctc

SEQ ID NO: 635903 - DNA, 20 bp, Artificial
  CRISPR gRNA sequence
gaaaggaatcttttctcccc

SEQ ID NO: 635904 - DNA, 20 bp, Artificial
  CRISPR gRNA sequence
aaaggaatcttttctccccg

SEQ ID NO: 635905 - DNA, 20 bp, Artificial
  CRISPR gRNA sequence
ttctccccgtttttctatta

SEQ ID NO: 635906 - DNA, 20 bp, Artificial
  CRISPR gRNA sequence
tctccccgtttttctattac

SEQ ID NO: 635907 - DNA, 20 bp, Artificial
  CRISPR gRNA sequence
ctccccgtttttctattact

SEQ ID NO: 635908 - DNA, 20 bp, Artificial
  CRISPR gRNA sequence
tccccgtttttctattactg

SEQ ID NO: 635909 - DNA, 20 bp, Artificial
  CRISPR gRNA sequence
cccgtttttctattactgat

SEQ ID NO: 635910 - DNA, 20 bp, Artificial
  CRISPR gRNA sequence
ttctattactgatattgcta

SEQ ID NO: 635911 - DNA, 20 bp, Artificial
  CRISPR gRNA sequence
tctattactgatattgctat

SEQ ID NO: 635912 - DNA, 20 bp, Artificial
  CRISPR gRNA sequence
ctattactgatattgctatg

SEQ ID NO: 635913 - DNA, 20 bp, Artificial
  CRISPR gRNA sequence
tattactgatattgctatga

SEQ ID NO: 635914 - DNA, 20 bp, Artificial
  CRISPR gRNA sequence
ttactgatattgctatgaag

SEQ ID NO: 635915 - DNA, 20 bp, Artificial
  CRISPR gRNA sequence
ctgatattgctatgaagttt

SEQ ID NO: 635916 - DNA, 20 bp, Artificial
  CRISPR gRNA sequence
atattgctatgaagttttta

SEQ ID NO: 635917 - DNA, 20 bp, Artificial
  CRISPR gRNA sequence
ctatgaagtttttaagcctc

SEQ ID NO: 635918 - DNA, 20 bp, Artificial
  CRISPR gRNA sequence
tgaagtttttaagcctcaat

SEQ ID NO: 635919 - DNA, 20 bp, Artificial
  CRISPR gRNA sequence
ttaagcctcaattataagtt

SEQ ID NO: 635920 - DNA, 20 bp, Artificial
  CRISPR gRNA sequence
taagcctcaattataagttt

SEQ ID NO: 635921 - DNA, 20 bp, Artificial
  CRISPR gRNA sequence
aagcctcaattataagtttg

SEQ ID NO: 635922 - DNA, 20 bp, Artificial
  CRISPR gRNA sequence
agcctcaattataagtttgg

SEQ ID NO: 635923 - DNA, 20 bp, Artificial
  CRISPR gRNA sequence
aattataagtttggtctgtt

SEQ ID NO: 635924 - DNA, 20 bp, Artificial
  CRISPR gRNA sequence
taagtttggtctgttgccat

SEQ ID NO: 635925 - DNA, 20 bp, Artificial
  CRISPR gRNA sequence
ggtctgttgccatcaactga

SEQ ID NO: 635926 - DNA, 20 bp, Artificial
  CRISPR gRNA sequence
gtctgttgccatcaactgac

SEQ ID NO: 635927 - DNA, 20 bp, Artificial
  CRISPR gRNA sequence
ttgccatcaactgactcacc

SEQ ID NO: 635928 - DNA, 20 bp, Artificial
  CRISPR gRNA sequence
ccatcaactgactcaccaat

SEQ ID NO: 635929 - DNA, 20 bp, Artificial
  CRISPR gRNA sequence
actcaccaatgtcatcaaat

SEQ ID NO: 635930 - DNA, 20 bp, Artificial
  CRISPR gRNA sequence
accaatgtcatcaaatataa

SEQ ID NO: 635931 - DNA, 20 bp, Artificial
  CRISPR gRNA sequence
gcaagtaggatcaaattgat

SEQ ID NO: 635932 - DNA, 20 bp, Artificial
  CRISPR gRNA sequence
atagccttatcaaaccataa

SEQ ID NO: 635933 - DNA, 20 bp, Artificial
  CRISPR gRNA sequence
atcaaaccataaagaaaatg

SEQ ID NO: 635934 - DNA, 20 bp, Artificial
  CRISPR gRNA sequence
tcaaaccataaagaaaatgc

SEQ ID NO: 635935 - DNA, 20 bp, Artificial
  CRISPR gRNA sequence
ttattttaaattcacctatc

SEQ ID NO: 635936 - DNA, 20 bp, Artificial
  CRISPR gRNA sequence
ttttaaattcacctatcact

SEQ ID NO: 635937 - DNA, 20 bp, Artificial
  CRISPR gRNA sequence
taaattcacctatcactaaa

SEQ ID NO: 635938 - DNA, 20 bp, Artificial
  CRISPR gRNA sequence
aaattcacctatcactaaag

SEQ ID NO: 635939 - DNA, 20 bp, Artificial
  CRISPR gRNA sequence
aattcacctatcactaaaga

SEQ ID NO: 635940 - DNA, 20 bp, Artificial
  CRISPR gRNA sequence
acctatcactaaagatatac

SEQ ID NO: 635941 - DNA, 20 bp, Artificial
  CRISPR gRNA sequence
tcactaaagatatacatgaa

SEQ ID NO: 635942 - DNA, 20 bp, Artificial
  CRISPR gRNA sequence
aagatatacatgaaataaaa

SEQ ID NO: 635943 - DNA, 20 bp, Artificial
  CRISPR gRNA sequence
aaatataagtaaacagtaaa

SEQ ID NO: 635944 - DNA, 20 bp, Artificial
  CRISPR gRNA sequence
aagctctaagtttagaataa

SEQ ID NO: 635945 - DNA, 20 bp, Artificial
  CRISPR gRNA sequence
taagtttagaataaaaagaa

SEQ ID NO: 635946 - DNA, 20 bp, Artificial
  CRISPR gRNA sequence
agtttagaataaaaagaaca

SEQ ID NO: 635947 - DNA, 20 bp, Artificial
  CRISPR gRNA sequence
agaataaaaagaacattaca

SEQ ID NO: 635948 - DNA, 20 bp, Artificial
  CRISPR gRNA sequence
gaataaaaagaacattacaa

SEQ ID NO: 635949 - DNA, 20 bp, Artificial
  CRISPR gRNA sequence
caaaacaattcccttttggt

SEQ ID NO: 635950 - DNA, 20 bp, Artificial
  CRISPR gRNA sequence
ccttttggttgaactggacc

SEQ ID NO: 635951 - DNA, 20 bp, Artificial
  CRISPR gRNA sequence
ttggttgaactggaccattt

SEQ ID NO: 635952 - DNA, 20 bp, Artificial
  CRISPR gRNA sequence
tggttgaactggaccatttc

SEQ ID NO: 635953 - DNA, 20 bp, Artificial
  CRISPR gRNA sequence
ggttgaactggaccatttct

SEQ ID NO: 635954 - DNA, 20 bp, Artificial
  CRISPR gRNA sequence
gttgaactggaccatttctt

SEQ ID NO: 635955 - DNA, 20 bp, Artificial
  CRISPR gRNA sequence
aactggaccatttctttacc

SEQ ID NO: 635956 - DNA, 20 bp, Artificial
  CRISPR gRNA sequence
gaccatttctttacctgcag

SEQ ID NO: 635957 - DNA, 20 bp, Artificial
  CRISPR gRNA sequence
ctttacctgcagttagatga

SEQ ID NO: 635958 - DNA, 20 bp, Artificial
  CRISPR gRNA sequence
tttacctgcagttagatgat

SEQ ID NO: 635959 - DNA, 20 bp, Artificial
  CRISPR gRNA sequence
tacctgcagttagatgatga

SEQ ID NO: 635960 - DNA, 20 bp, Artificial
  CRISPR gRNA sequence
acctgcagttagatgatgat

SEQ ID NO: 635961 - DNA, 20 bp, Artificial
  CRISPR gRNA sequence
cctgcagttagatgatgatt

SEQ ID NO: 635962 - DNA, 20 bp, Artificial
  CRISPR gRNA sequence
cagttagatgatgattctaa

SEQ ID NO: 635963 - DNA, 20 bp, Artificial
  CRISPR gRNA sequence
gatgatgattctaattttaa

SEQ ID NO: 635964 - DNA, 20 bp, Artificial
  CRISPR gRNA sequence
taattttaatagtttttcaa

SEQ ID NO: 635965 - DNA, 20 bp, Artificial
  CRISPR gRNA sequence
attttaatagtttttcaaaa

SEQ ID NO: 635966 - DNA, 20 bp, Artificial
  CRISPR gRNA sequence
taatagtttttcaaaaagct

SEQ ID NO: 635967 - DNA, 20 bp, Artificial
  CRISPR gRNA sequence
aatagtttttcaaaaagctt

SEQ ID NO: 635968 - DNA, 20 bp, Artificial
  CRISPR gRNA sequence
atagtttttcaaaaagctta

SEQ ID NO: 635969 - DNA, 20 bp, Artificial
  CRISPR gRNA sequence
ttcaaaaagcttacattgaa

SEQ ID NO: 635970 - DNA, 20 bp, Artificial
  CRISPR gRNA sequence
tcaaaaagcttacattgaaa

SEQ ID NO: 635971 - DNA, 20 bp, Artificial
  CRISPR gRNA sequence
caaaaagcttacattgaaat

SEQ ID NO: 635972 - DNA, 20 bp, Artificial
  CRISPR gRNA sequence
aaaaagcttacattgaaatg

SEQ ID NO: 635973 - DNA, 20 bp, Artificial
  CRISPR gRNA sequence
acattgaaatgtcatgtttc

SEQ ID NO: 635974 - DNA, 20 bp, Artificial
  CRISPR gRNA sequence
cattgaaatgtcatgtttca

SEQ ID NO: 635975 - DNA, 20 bp, Artificial
  CRISPR gRNA sequence
aaatgtcatgtttcatatat

SEQ ID NO: 635976 - DNA, 20 bp, Artificial
  CRISPR gRNA sequence
catatatctttaactgaaac

SEQ ID NO: 635977 - DNA, 20 bp, Artificial
  CRISPR gRNA sequence
atatatctttaactgaaaca

SEQ ID NO: 635978 - DNA, 20 bp, Artificial
  CRISPR gRNA sequence
taactgaaacacacataata

SEQ ID NO: 635979 - DNA, 20 bp, Artificial
  CRISPR gRNA sequence
aactgaaacacacataataa

SEQ ID NO: 635980 - DNA, 20 bp, Artificial
  CRISPR gRNA sequence
actgaaacacacataataat

SEQ ID NO: 635981 - DNA, 20 bp, Artificial
  CRISPR gRNA sequence
aaacacacataataatgaat

SEQ ID NO: 635982 - DNA, 20 bp, Artificial
  CRISPR gRNA sequence
aaggttttttggccctttga

SEQ ID NO: 635983 - DNA, 20 bp, Artificial
  CRISPR gRNA sequence
tttggccctttgacataatg

SEQ ID NO: 635984 - DNA, 20 bp, Artificial
  CRISPR gRNA sequence
ttggccctttgacataatgc

SEQ ID NO: 635985 - DNA, 20 bp, Artificial
  CRISPR gRNA sequence
tggccctttgacataatgca

SEQ ID NO: 635986 - DNA, 20 bp, Artificial
  CRISPR gRNA sequence
ggccctttgacataatgcaa

SEQ ID NO: 635987 - DNA, 20 bp, Artificial
  CRISPR gRNA sequence
gccctttgacataatgcaaa

SEQ ID NO: 635988 - DNA, 20 bp, Artificial
  CRISPR gRNA sequence
tgacataatgcaaactcaat

SEQ ID NO: 635989 - DNA, 20 bp, Artificial
  CRISPR gRNA sequence
gacataatgcaaactcaatg

SEQ ID NO: 635990 - DNA, 20 bp, Artificial
  CRISPR gRNA sequence
acataatgcaaactcaatga

SEQ ID NO: 635991 - DNA, 20 bp, Artificial
  CRISPR gRNA sequence
aatgattcttttattaaaga

SEQ ID NO: 635992 - DNA, 20 bp, Artificial
  CRISPR gRNA sequence
ttttattaaagaaagctaag

SEQ ID NO: 635993 - DNA, 20 bp, Artificial
  CRISPR gRNA sequence
ttattaaagaaagctaagag

SEQ ID NO: 635994 - DNA, 20 bp, Artificial
  CRISPR gRNA sequence
tattaaagaaagctaagagg

SEQ ID NO: 635995 - DNA, 20 bp, Artificial
  CRISPR gRNA sequence
attaaagaaagctaagaggt

SEQ ID NO: 635996 - DNA, 20 bp, Artificial
  CRISPR gRNA sequence
ttaaagaaagctaagaggta

SEQ ID NO: 635997 - DNA, 20 bp, Artificial
  CRISPR gRNA sequence
aagaaagctaagaggtataa

SEQ ID NO: 635998 - DNA, 20 bp, Artificial
  CRISPR gRNA sequence
agaggtataaataagataaa

SEQ ID NO: 635999 - DNA, 20 bp, Artificial
  CRISPR gRNA sequence
tggtcactttctggcagcag

SEQ ID NO: 636000 - DNA, 20 bp, Artificial
  CRISPR gRNA sequence
tctggcagcagctattgaaa

SEQ ID NO: 636001 - DNA, 20 bp, Artificial
  CRISPR gRNA sequence
ctggcagcagctattgaaaa

SEQ ID NO: 636002 - DNA, 20 bp, Artificial
  CRISPR gRNA sequence
tggcagcagctattgaaaat

SEQ ID NO: 636003 - DNA, 20 bp, Artificial
  CRISPR gRNA sequence
gcagcagctattgaaaattc

SEQ ID NO: 636004 - DNA, 20 bp, Artificial
  CRISPR gRNA sequence
ttgaaaattctatcatatag

SEQ ID NO: 636005 - DNA, 20 bp, Artificial
  CRISPR gRNA sequence
aaaattctatcatatagatt

SEQ ID NO: 636006 - DNA, 20 bp, Artificial
  CRISPR gRNA sequence
tatcatatagatttgttata

SEQ ID NO: 636007 - DNA, 20 bp, Artificial
  CRISPR gRNA sequence
tcatatagatttgttataaa

SEQ ID NO: 636008 - DNA, 20 bp, Artificial
  CRISPR gRNA sequence
gttataaaacctagataaat

SEQ ID NO: 636009 - DNA, 20 bp, Artificial
  CRISPR gRNA sequence
ttataaaacctagataaatt

SEQ ID NO: 636010 - DNA, 20 bp, Artificial
  CRISPR gRNA sequence
taaaacctagataaatttaa

SEQ ID NO: 636011 - DNA, 20 bp, Artificial
  CRISPR gRNA sequence
gataaatttaaaaattggta

SEQ ID NO: 636012 - DNA, 20 bp, Artificial
  CRISPR gRNA sequence
aaaaattggtagatcaagta

SEQ ID NO: 636013 - DNA, 20 bp, Artificial
  CRISPR gRNA sequence
aaaattggtagatcaagtat

SEQ ID NO: 636014 - DNA, 20 bp, Artificial
  CRISPR gRNA sequence
gtagatcaagtatatctcaa

SEQ ID NO: 636015 - DNA, 20 bp, Artificial
  CRISPR gRNA sequence
aaattctgtagtatttagtg

SEQ ID NO: 636016 - DNA, 20 bp, Artificial
  CRISPR gRNA sequence
tgtagtatttagtgttttgg

SEQ ID NO: 636017 - DNA, 20 bp, Artificial
  CRISPR gRNA sequence
tagtatttagtgttttggga

SEQ ID NO: 636018 - DNA, 20 bp, Artificial
  CRISPR gRNA sequence
agtgttttgggagttaatga

SEQ ID NO: 636019 - DNA, 20 bp, Artificial
  CRISPR gRNA sequence
gtgttttgggagttaatgag

SEQ ID NO: 636020 - DNA, 20 bp, Artificial
  CRISPR gRNA sequence
tgggagttaatgaggtacat

SEQ ID NO: 636021 - DNA, 20 bp, Artificial
  CRISPR gRNA sequence
gggagttaatgaggtacata

SEQ ID NO: 636022 - DNA, 20 bp, Artificial
  CRISPR gRNA sequence
ggagttaatgaggtacatac

SEQ ID NO: 636023 - DNA, 20 bp, Artificial
  CRISPR gRNA sequence
atgaggtacataccaaaaag

SEQ ID NO: 636024 - DNA, 20 bp, Artificial
  CRISPR gRNA sequence
tgggtgtggtgggggttaag

SEQ ID NO: 636025 - DNA, 20 bp, Artificial
  CRISPR gRNA sequence
aggttttttcttaagaaatc

SEQ ID NO: 636026 - DNA, 20 bp, Artificial
  CRISPR gRNA sequence
tttcttaagaaatctggagc

SEQ ID NO: 636027 - DNA, 20 bp, Artificial
  CRISPR gRNA sequence
ttcttaagaaatctggagct

SEQ ID NO: 636028 - DNA, 20 bp, Artificial
  CRISPR gRNA sequence
tcttaagaaatctggagctc

SEQ ID NO: 636029 - DNA, 20 bp, Artificial
  CRISPR gRNA sequence
cttaagaaatctggagctct

SEQ ID NO: 636030 - DNA, 20 bp, Artificial
  CRISPR gRNA sequence
ttaagaaatctggagctctt

SEQ ID NO: 636031 - DNA, 20 bp, Artificial
  CRISPR gRNA sequence
aagaaatctggagctcttat

SEQ ID NO: 636032 - DNA, 20 bp, Artificial
  CRISPR gRNA sequence
agaaatctggagctcttatg

SEQ ID NO: 636033 - DNA, 20 bp, Artificial
  CRISPR gRNA sequence
gagctcttatgagctacatg

SEQ ID NO: 636034 - DNA, 20 bp, Artificial
  CRISPR gRNA sequence
ttatgagctacatgtacaag

SEQ ID NO: 636035 - DNA, 20 bp, Artificial
  CRISPR gRNA sequence
atgagctacatgtacaagag

SEQ ID NO: 636036 - DNA, 20 bp, Artificial
  CRISPR gRNA sequence
tgagctacatgtacaagagg

SEQ ID NO: 636037 - DNA, 20 bp, Artificial
  CRISPR gRNA sequence
catgtacaagaggtcctata

SEQ ID NO: 636038 - DNA, 20 bp, Artificial
  CRISPR gRNA sequence
tattgataatattggattga

SEQ ID NO: 636039 - DNA, 20 bp, Artificial
  CRISPR gRNA sequence
ataatattggattgaaaaaa

SEQ ID NO: 636040 - DNA, 20 bp, Artificial
  CRISPR gRNA sequence
gattgaaaaaaatctgtaat

SEQ ID NO: 636041 - DNA, 20 bp, Artificial
  CRISPR gRNA sequence
aaaaaaatctgtaatgttaa

SEQ ID NO: 636042 - DNA, 20 bp, Artificial
  CRISPR gRNA sequence
taatgttaaagttcccttaa

SEQ ID NO: 636043 - DNA, 20 bp, Artificial
  CRISPR gRNA sequence
aagttcccttaagtggtatc

SEQ ID NO: 636044 - DNA, 20 bp, Artificial
  CRISPR gRNA sequence
ccttaagtggtatcttctta

SEQ ID NO: 636045 - DNA, 20 bp, Artificial
  CRISPR gRNA sequence
aagtggtatcttcttagttt

SEQ ID NO: 636046 - DNA, 20 bp, Artificial
  CRISPR gRNA sequence
agtggtatcttcttagtttg

SEQ ID NO: 636047 - DNA, 20 bp, Artificial
  CRISPR gRNA sequence
cttagtttgattaacctggt

SEQ ID NO: 636048 - DNA, 20 bp, Artificial
  CRISPR gRNA sequence
ttagtttgattaacctggta

SEQ ID NO: 636049 - DNA, 20 bp, Artificial
  CRISPR gRNA sequence
agtttgattaacctggtaag

SEQ ID NO: 636050 - DNA, 20 bp, Artificial
  CRISPR gRNA sequence
gtttgattaacctggtaaga

SEQ ID NO: 636051 - DNA, 20 bp, Artificial
  CRISPR gRNA sequence
gattaacctggtaagatcta

SEQ ID NO: 636052 - DNA, 20 bp, Artificial
  CRISPR gRNA sequence
attaacctggtaagatctat

SEQ ID NO: 636053 - DNA, 20 bp, Artificial
  CRISPR gRNA sequence
acctggtaagatctatatct

SEQ ID NO: 636054 - DNA, 20 bp, Artificial
  CRISPR gRNA sequence
gtaagatctatatctcctca

SEQ ID NO: 636055 - DNA, 20 bp, Artificial
  CRISPR gRNA sequence
tatctcctcatataaagtct

SEQ ID NO: 636056 - DNA, 20 bp, Artificial
  CRISPR gRNA sequence
ctcatataaagtcttccaac

SEQ ID NO: 636057 - DNA, 20 bp, Artificial
  CRISPR gRNA sequence
atataaagtcttccaacata

SEQ ID NO: 636058 - DNA, 20 bp, Artificial
  CRISPR gRNA sequence
ccaacataaggttttaaaat

SEQ ID NO: 636059 - DNA, 20 bp, Artificial
  CRISPR gRNA sequence
caacataaggttttaaaata

SEQ ID NO: 636060 - DNA, 20 bp, Artificial
  CRISPR gRNA sequence
taaaataaattgaattttgg

SEQ ID NO: 636061 - DNA, 20 bp, Artificial
  CRISPR gRNA sequence
aaaataaattgaattttggc

SEQ ID NO: 636062 - DNA, 20 bp, Artificial
  CRISPR gRNA sequence
aaataaattgaattttggca

SEQ ID NO: 636063 - DNA, 20 bp, Artificial
  CRISPR gRNA sequence
aattttggcagatctttttt

SEQ ID NO: 636064 - DNA, 20 bp, Artificial
  CRISPR gRNA sequence
tggcagatcttttttacttt

SEQ ID NO: 636065 - DNA, 20 bp, Artificial
  CRISPR gRNA sequence
ggcagatcttttttactttt

SEQ ID NO: 636066 - DNA, 20 bp, Artificial
  CRISPR gRNA sequence
gcagatcttttttactttta

SEQ ID NO: 636067 - DNA, 20 bp, Artificial
  CRISPR gRNA sequence
ttttacttttacacacaata

SEQ ID NO: 636068 - DNA, 20 bp, Artificial
  CRISPR gRNA sequence
tttacttttacacacaatat

SEQ ID NO: 636069 - DNA, 20 bp, Artificial
  CRISPR gRNA sequence
ttacttttacacacaatata

SEQ ID NO: 636070 - DNA, 20 bp, Artificial
  CRISPR gRNA sequence
tacttttacacacaatatac

SEQ ID NO: 636071 - DNA, 20 bp, Artificial
  CRISPR gRNA sequence
acttttacacacaatataca

SEQ ID NO: 636072 - DNA, 20 bp, Artificial
  CRISPR gRNA sequence
cttttacacacaatatacaa

SEQ ID NO: 636073 - DNA, 20 bp, Artificial
  CRISPR gRNA sequence
ttacacacaatatacaactt

SEQ ID NO: 636074 - DNA, 20 bp, Artificial
  CRISPR gRNA sequence
tacacacaatatacaacttg

SEQ ID NO: 636075 - DNA, 20 bp, Artificial
  CRISPR gRNA sequence
acacacaatatacaacttga

SEQ ID NO: 636076 - DNA, 20 bp, Artificial
  CRISPR gRNA sequence
cacacaatatacaacttgat

SEQ ID NO: 636077 - DNA, 20 bp, Artificial
  CRISPR gRNA sequence
gattatttgattctctttcc

SEQ ID NO: 636078 - DNA, 20 bp, Artificial
  CRISPR gRNA sequence
attatttgattctctttcct

SEQ ID NO: 636079 - DNA, 20 bp, Artificial
  CRISPR gRNA sequence
tttgattctctttcctaatg

SEQ ID NO: 636080 - DNA, 20 bp, Artificial
  CRISPR gRNA sequence
gattctctttcctaatggaa

SEQ ID NO: 636081 - DNA, 20 bp, Artificial
  CRISPR gRNA sequence
attctctttcctaatggaat

SEQ ID NO: 636082 - DNA, 20 bp, Artificial
  CRISPR gRNA sequence
tctttcctaatggaatcaca

SEQ ID NO: 636083 - DNA, 20 bp, Artificial
  CRISPR gRNA sequence
tttcctaatggaatcacagg

SEQ ID NO: 636084 - DNA, 20 bp, Artificial
  CRISPR gRNA sequence
tcctaatggaatcacaggct

SEQ ID NO: 636085 - DNA, 20 bp, Artificial
  CRISPR gRNA sequence
cctaatggaatcacaggctg

SEQ ID NO: 636086 - DNA, 20 bp, Artificial
  CRISPR gRNA sequence
ctaatggaatcacaggctgc

SEQ ID NO: 636087 - DNA, 20 bp, Artificial
  CRISPR gRNA sequence
atggaatcacaggctgcaac

SEQ ID NO: 636088 - DNA, 20 bp, Artificial
  CRISPR gRNA sequence
caactttttaaatcaagaat

SEQ ID NO: 636089 - DNA, 20 bp, Artificial
  CRISPR gRNA sequence
tttaaatcaagaattttcca

SEQ ID NO: 636090 - DNA, 20 bp, Artificial
  CRISPR gRNA sequence
ttaaatcaagaattttccac

SEQ ID NO: 636091 - DNA, 20 bp, Artificial
  CRISPR gRNA sequence
taaatcaagaattttccact

SEQ ID NO: 636092 - DNA, 20 bp, Artificial
  CRISPR gRNA sequence
aaatcaagaattttccactc

SEQ ID NO: 636093 - DNA, 20 bp, Artificial
  CRISPR gRNA sequence
aatcaagaattttccactcc

SEQ ID NO: 636094 - DNA, 20 bp, Artificial
  CRISPR gRNA sequence
tccactcccaacccctgcca

SEQ ID NO: 636095 - DNA, 20 bp, Artificial
  CRISPR gRNA sequence
ccactcccaacccctgccat

SEQ ID NO: 636096 - DNA, 20 bp, Artificial
  CRISPR gRNA sequence
cactcccaacccctgccata

SEQ ID NO: 636097 - DNA, 20 bp, Artificial
  CRISPR gRNA sequence
ccaacccctgccatagtaat

SEQ ID NO: 636098 - DNA, 20 bp, Artificial
  CRISPR gRNA sequence
ccatagtaataaaaggaaag

SEQ ID NO: 636099 - DNA, 20 bp, Artificial
  CRISPR gRNA sequence
ctttcacaaattaaattttt

SEQ ID NO: 636100 - DNA, 20 bp, Artificial
  CRISPR gRNA sequence
tttcacaaattaaattttta

SEQ ID NO: 636101 - DNA, 20 bp, Artificial
  CRISPR gRNA sequence
tcacaaattaaatttttaaa

SEQ ID NO: 636102 - DNA, 20 bp, Artificial
  CRISPR gRNA sequence
cacaaattaaatttttaaag

SEQ ID NO: 636103 - DNA, 20 bp, Artificial
  CRISPR gRNA sequence
acaaattaaatttttaaaga

SEQ ID NO: 636104 - DNA, 20 bp, Artificial
  CRISPR gRNA sequence
aatttttaaagaaaaaggaa

SEQ ID NO: 636105 - DNA, 20 bp, Artificial
  CRISPR gRNA sequence
ttaaagaaaaaggaaaatag

SEQ ID NO: 636106 - DNA, 20 bp, Artificial
  CRISPR gRNA sequence
taaagaaaaaggaaaatagc

SEQ ID NO: 636107 - DNA, 20 bp, Artificial
  CRISPR gRNA sequence
aaagaaaaaggaaaatagca

SEQ ID NO: 636108 - DNA, 20 bp, Artificial
  CRISPR gRNA sequence
aagaaaaaggaaaatagcaa

SEQ ID NO: 636109 - DNA, 20 bp, Artificial
  CRISPR gRNA sequence
tacttttcactccaaaaatt

SEQ ID NO: 636110 - DNA, 20 bp, Artificial
  CRISPR gRNA sequence
ttcactccaaaaatttgatt

SEQ ID NO: 636111 - DNA, 20 bp, Artificial
  CRISPR gRNA sequence
tcactccaaaaatttgattt

SEQ ID NO: 636112 - DNA, 20 bp, Artificial
  CRISPR gRNA sequence
cactccaaaaatttgatttt

SEQ ID NO: 636113 - DNA, 20 bp, Artificial
  CRISPR gRNA sequence
actccaaaaatttgatttta

SEQ ID NO: 636114 - DNA, 20 bp, Artificial
  CRISPR gRNA sequence
caaaaatttgattttacttt

SEQ ID NO: 636115 - DNA, 20 bp, Artificial
  CRISPR gRNA sequence
gattttacttttaaaatatg

SEQ ID NO: 636116 - DNA, 20 bp, Artificial
  CRISPR gRNA sequence
attttacttttaaaatatgt

SEQ ID NO: 636117 - DNA, 20 bp, Artificial
  CRISPR gRNA sequence
tacttttaaaatatgtctac

SEQ ID NO: 636118 - DNA, 20 bp, Artificial
  CRISPR gRNA sequence
acttttaaaatatgtctacg

SEQ ID NO: 636119 - DNA, 20 bp, Artificial
  CRISPR gRNA sequence
cttttaaaatatgtctacgt

SEQ ID NO: 636120 - DNA, 20 bp, Artificial
  CRISPR gRNA sequence
ttaaaatatgtctacgtaag

SEQ ID NO: 636121 - DNA, 20 bp, Artificial
  CRISPR gRNA sequence
taaaatatgtctacgtaagg

SEQ ID NO: 636122 - DNA, 20 bp, Artificial
  CRISPR gRNA sequence
aaaatatgtctacgtaaggt

SEQ ID NO: 636123 - DNA, 20 bp, Artificial
  CRISPR gRNA sequence
aaatatgtctacgtaaggtt

SEQ ID NO: 636124 - DNA, 20 bp, Artificial
  CRISPR gRNA sequence
cgtaaggtttcccaagcaag

SEQ ID NO: 636125 - DNA, 20 bp, Artificial
  CRISPR gRNA sequence
cccaagcaagtaacaaattc

SEQ ID NO: 636126 - DNA, 20 bp, Artificial
  CRISPR gRNA sequence
ccaagcaagtaacaaattcg

SEQ ID NO: 636127 - DNA, 20 bp, Artificial
  CRISPR gRNA sequence
gttaacaataactttacaag

SEQ ID NO: 636128 - DNA, 20 bp, Artificial
  CRISPR gRNA sequence
acaataactttacaagagtt

SEQ ID NO: 636129 - DNA, 20 bp, Artificial
  CRISPR gRNA sequence
tacaagagttaaattactaa

SEQ ID NO: 636130 - DNA, 20 bp, Artificial
  CRISPR gRNA sequence
acaagagttaaattactaag

SEQ ID NO: 636131 - DNA, 20 bp, Artificial
  CRISPR gRNA sequence
caagagttaaattactaagt

SEQ ID NO: 636132 - DNA, 20 bp, Artificial
  CRISPR gRNA sequence
aattactaagtgtggtgaac

SEQ ID NO: 636133 - DNA, 20 bp, Artificial
  CRISPR gRNA sequence
ctaagtgtggtgaacaattt

SEQ ID NO: 636134 - DNA, 20 bp, Artificial
  CRISPR gRNA sequence
agtgtggtgaacaatttgaa

SEQ ID NO: 636135 - DNA, 20 bp, Artificial
  CRISPR gRNA sequence
gaagtcatgtctgcctttag

SEQ ID NO: 636136 - DNA, 20 bp, Artificial
  CRISPR gRNA sequence
aagtcatgtctgcctttaga

SEQ ID NO: 636137 - DNA, 20 bp, Artificial
  CRISPR gRNA sequence
cctttagataatactcctat

SEQ ID NO: 636138 - DNA, 20 bp, Artificial
  CRISPR gRNA sequence
tagataatactcctatagca

SEQ ID NO: 636139 - DNA, 20 bp, Artificial
  CRISPR gRNA sequence
agataatactcctatagcat

SEQ ID NO: 636140 - DNA, 20 bp, Artificial
  CRISPR gRNA sequence
gataatactcctatagcatg

SEQ ID NO: 636141 - DNA, 20 bp, Artificial
  CRISPR gRNA sequence
ctatagcatgctgactccaa

SEQ ID NO: 636142 - DNA, 20 bp, Artificial
  CRISPR gRNA sequence
tagcatgctgactccaattt

SEQ ID NO: 636143 - DNA, 20 bp, Artificial
  CRISPR gRNA sequence
actccaatttcctttaaacc

SEQ ID NO: 636144 - DNA, 20 bp, Artificial
  CRISPR gRNA sequence
caatttcctttaaacctcct

SEQ ID NO: 636145 - DNA, 20 bp, Artificial
  CRISPR gRNA sequence
cctttaaacctcctacaatg

SEQ ID NO: 636146 - DNA, 20 bp, Artificial
  CRISPR gRNA sequence
ctttaaacctcctacaatgt

SEQ ID NO: 636147 - DNA, 20 bp, Artificial
  CRISPR gRNA sequence
taaacctcctacaatgtttg

SEQ ID NO: 636148 - DNA, 20 bp, Artificial
  CRISPR gRNA sequence
aaacctcctacaatgtttga

SEQ ID NO: 636149 - DNA, 20 bp, Artificial
  CRISPR gRNA sequence
aacctcctacaatgtttgag

SEQ ID NO: 636150 - DNA, 20 bp, Artificial
  CRISPR gRNA sequence
ctacaatgtttgagttgaaa

SEQ ID NO: 636151 - DNA, 20 bp, Artificial
  CRISPR gRNA sequence
caatgtttgagttgaaatat

SEQ ID NO: 636152 - DNA, 20 bp, Artificial
  CRISPR gRNA sequence
gagttgaaatatttcaaaat

SEQ ID NO: 636153 - DNA, 20 bp, Artificial
  CRISPR gRNA sequence
agttgaaatatttcaaaatc

SEQ ID NO: 636154 - DNA, 20 bp, Artificial
  CRISPR gRNA sequence
aaatatttcaaaatccttaa

SEQ ID NO: 636155 - DNA, 20 bp, Artificial
  CRISPR gRNA sequence
caaaatccttaatttagagt

SEQ ID NO: 636156 - DNA, 20 bp, Artificial
  CRISPR gRNA sequence
aaaatccttaatttagagta

SEQ ID NO: 636157 - DNA, 20 bp, Artificial
  CRISPR gRNA sequence
aatttagagtagttcattct

SEQ ID NO: 636158 - DNA, 20 bp, Artificial
  CRISPR gRNA sequence
atttagagtagttcattctt

SEQ ID NO: 636159 - DNA, 20 bp, Artificial
  CRISPR gRNA sequence
agagtagttcattcttcaaa

SEQ ID NO: 636160 - DNA, 20 bp, Artificial
  CRISPR gRNA sequence
gagtagttcattcttcaaaa

SEQ ID NO: 636161 - DNA, 20 bp, Artificial
  CRISPR gRNA sequence
attcttcaaaaataatgcta

SEQ ID NO: 636162 - DNA, 20 bp, Artificial
  CRISPR gRNA sequence
ttcaaaaataatgctagtct

SEQ ID NO: 636163 - DNA, 20 bp, Artificial
  CRISPR gRNA sequence
caaaaataatgctagtctaa

SEQ ID NO: 636164 - DNA, 20 bp, Artificial
  CRISPR gRNA sequence
aaaaataatgctagtctaaa

SEQ ID NO: 636165 - DNA, 20 bp, Artificial
  CRISPR gRNA sequence
gtctaaaaatgaaacaatat

SEQ ID NO: 636166 - DNA, 20 bp, Artificial
  CRISPR gRNA sequence
aaaatgaaacaatatctttt

SEQ ID NO: 636167 - DNA, 20 bp, Artificial
  CRISPR gRNA sequence
ttttaaaaagaattttaaaa

SEQ ID NO: 636168 - DNA, 20 bp, Artificial
  CRISPR gRNA sequence
tttaaaaagaattttaaaat

SEQ ID NO: 636169 - DNA, 20 bp, Artificial
  CRISPR gRNA sequence
ttaaaaagaattttaaaatt

SEQ ID NO: 636170 - DNA, 20 bp, Artificial
  CRISPR gRNA sequence
taaaaagaattttaaaattc

SEQ ID NO: 636171 - DNA, 20 bp, Artificial
  CRISPR gRNA sequence
aaaaagaattttaaaattca

SEQ ID NO: 636172 - DNA, 20 bp, Artificial
  CRISPR gRNA sequence
aaaagaattttaaaattcac

SEQ ID NO: 636173 - DNA, 20 bp, Artificial
  CRISPR gRNA sequence
taaaattcacctaattgagt

SEQ ID NO: 636174 - DNA, 20 bp, Artificial
  CRISPR gRNA sequence
aaaattcacctaattgagtt

SEQ ID NO: 636175 - DNA, 20 bp, Artificial
  CRISPR gRNA sequence
aaattcacctaattgagttt

SEQ ID NO: 636176 - DNA, 20 bp, Artificial
  CRISPR gRNA sequence
acctaattgagttttatgcg

SEQ ID NO: 636177 - DNA, 20 bp, Artificial
  CRISPR gRNA sequence
attgagttttatgcgattaa

SEQ ID NO: 636178 - DNA, 20 bp, Artificial
  CRISPR gRNA sequence
agttttatgcgattaatgaa

SEQ ID NO: 636179 - DNA, 20 bp, Artificial
  CRISPR gRNA sequence
tatgcgattaatgaaagggt

SEQ ID NO: 636180 - DNA, 20 bp, Artificial
  CRISPR gRNA sequence
atgcgattaatgaaagggta

SEQ ID NO: 636181 - DNA, 20 bp, Artificial
  CRISPR gRNA sequence
tgcgattaatgaaagggtaa

SEQ ID NO: 636182 - DNA, 20 bp, Artificial
  CRISPR gRNA sequence
atgaaagggtaatttagttt

SEQ ID NO: 636183 - DNA, 20 bp, Artificial
  CRISPR gRNA sequence
agtttttacatttacaaaat

SEQ ID NO: 636184 - DNA, 20 bp, Artificial
  CRISPR gRNA sequence
gtttttacatttacaaaata

SEQ ID NO: 636185 - DNA, 20 bp, Artificial
  CRISPR gRNA sequence
ttacatttacaaaatactct

SEQ ID NO: 636186 - DNA, 20 bp, Artificial
  CRISPR gRNA sequence
tacatttacaaaatactcta

SEQ ID NO: 636187 - DNA, 20 bp, Artificial
  CRISPR gRNA sequence
acatttacaaaatactctag

SEQ ID NO: 636188 - DNA, 20 bp, Artificial
  CRISPR gRNA sequence
catttacaaaatactctaga

SEQ ID NO: 636189 - DNA, 20 bp, Artificial
  CRISPR gRNA sequence
acaaaatactctagatatct

SEQ ID NO: 636190 - DNA, 20 bp, Artificial
  CRISPR gRNA sequence
caaaatactctagatatctt

SEQ ID NO: 636191 - DNA, 20 bp, Artificial
  CRISPR gRNA sequence
tagatatcttcaaatctttt

SEQ ID NO: 636192 - DNA, 20 bp, Artificial
  CRISPR gRNA sequence
gatatcttcaaatcttttta

SEQ ID NO: 636193 - DNA, 20 bp, Artificial
  CRISPR gRNA sequence
caaatctttttaataagaaa

SEQ ID NO: 636194 - DNA, 20 bp, Artificial
  CRISPR gRNA sequence
aaatctttttaataagaaat

SEQ ID NO: 636195 - DNA, 20 bp, Artificial
  CRISPR gRNA sequence
tttaataagaaattacttct

SEQ ID NO: 636196 - DNA, 20 bp, Artificial
  CRISPR gRNA sequence
ttaataagaaattacttctg

SEQ ID NO: 636197 - DNA, 20 bp, Artificial
  CRISPR gRNA sequence
taataagaaattacttctga

SEQ ID NO: 636198 - DNA, 20 bp, Artificial
  CRISPR gRNA sequence
aataagaaattacttctgaa

SEQ ID NO: 636199 - DNA, 20 bp, Artificial
  CRISPR gRNA sequence
ataagaaattacttctgaat

SEQ ID NO: 636200 - DNA, 20 bp, Artificial
  CRISPR gRNA sequence
cttctgaatttatatgatca

SEQ ID NO: 636201 - DNA, 20 bp, Artificial
  CRISPR gRNA sequence
ctgaatttatatgatcatcc

SEQ ID NO: 636202 - DNA, 20 bp, Artificial
  CRISPR gRNA sequence
tgaatttatatgatcatccc

SEQ ID NO: 636203 - DNA, 20 bp, Artificial
  CRISPR gRNA sequence
aatttatatgatcatcccca

SEQ ID NO: 636204 - DNA, 20 bp, Artificial
  CRISPR gRNA sequence
atatgatcatccccaaatgg

SEQ ID NO: 636205 - DNA, 20 bp, Artificial
  CRISPR gRNA sequence
tatgatcatccccaaatggc

SEQ ID NO: 636206 - DNA, 20 bp, Artificial
  CRISPR gRNA sequence
ggtatatctggaaatattgt

SEQ ID NO: 636207 - DNA, 20 bp, Artificial
  CRISPR gRNA sequence
gaaatattgtcctgttgctg

SEQ ID NO: 636208 - DNA, 20 bp, Artificial
  CRISPR gRNA sequence
tcctgttgctgagtgtggaa

SEQ ID NO: 636209 - DNA, 20 bp, Artificial
  CRISPR gRNA sequence
ttgctgagtgtggaagtcat

SEQ ID NO: 636210 - DNA, 20 bp, Artificial
  CRISPR gRNA sequence
ctgagtgtggaagtcatact

SEQ ID NO: 636211 - DNA, 20 bp, Artificial
  CRISPR gRNA sequence
agtgtggaagtcatactatg

SEQ ID NO: 636212 - DNA, 20 bp, Artificial
  CRISPR gRNA sequence
tggaagtctttggtaagttc

SEQ ID NO: 636213 - DNA, 20 bp, Artificial
  CRISPR gRNA sequence
tggtaagttcccaaggacat

SEQ ID NO: 636214 - DNA, 20 bp, Artificial
  CRISPR gRNA sequence
ggtaagttcccaaggacatg

SEQ ID NO: 636215 - DNA, 20 bp, Artificial
  CRISPR gRNA sequence
gtaagttcccaaggacatgg

SEQ ID NO: 636216 - DNA, 20 bp, Artificial
  CRISPR gRNA sequence
ccaaggacatgggaagtaaa

SEQ ID NO: 636217 - DNA, 20 bp, Artificial
  CRISPR gRNA sequence
tcttcctttttttggtaaga

SEQ ID NO: 636218 - DNA, 20 bp, Artificial
  CRISPR gRNA sequence
cttcctttttttggtaagag

SEQ ID NO: 636219 - DNA, 20 bp, Artificial
  CRISPR gRNA sequence
ttcctttttttggtaagaga

SEQ ID NO: 636220 - DNA, 20 bp, Artificial
  CRISPR gRNA sequence
cctttttttggtaagagaaa

SEQ ID NO: 636221 - DNA, 20 bp, Artificial
  CRISPR gRNA sequence
ctttttttggtaagagaaaa

SEQ ID NO: 636222 - DNA, 20 bp, Artificial
  CRISPR gRNA sequence
tttttggtaagagaaaaggg

SEQ ID NO: 636223 - DNA, 20 bp, Artificial
  CRISPR gRNA sequence
ttttggtaagagaaaagggg

SEQ ID NO: 636224 - DNA, 20 bp, Artificial
  CRISPR gRNA sequence
tttggtaagagaaaaggggc

SEQ ID NO: 636225 - DNA, 20 bp, Artificial
  CRISPR gRNA sequence
ttggtaagagaaaaggggca

SEQ ID NO: 636226 - DNA, 20 bp, Artificial
  CRISPR gRNA sequence
tggtaagagaaaaggggcat

SEQ ID NO: 636227 - DNA, 20 bp, Artificial
  CRISPR gRNA sequence
ggtaagagaaaaggggcatt

SEQ ID NO: 636228 - DNA, 20 bp, Artificial
  CRISPR gRNA sequence
gtaagagaaaaggggcattg

SEQ ID NO: 636229 - DNA, 20 bp, Artificial
  CRISPR gRNA sequence
aaaataatacattttaattt

SEQ ID NO: 636230 - DNA, 20 bp, Artificial
  CRISPR gRNA sequence
taatttcaataagataaggc

SEQ ID NO: 636231 - DNA, 20 bp, Artificial
  CRISPR gRNA sequence
aatttcaataagataaggct

SEQ ID NO: 636232 - DNA, 20 bp, Artificial
  CRISPR gRNA sequence
atttcaataagataaggctt

SEQ ID NO: 636233 - DNA, 20 bp, Artificial
  CRISPR gRNA sequence
caataagataaggctttggg

SEQ ID NO: 636234 - DNA, 20 bp, Artificial
  CRISPR gRNA sequence
aataagataaggctttggga

SEQ ID NO: 636235 - DNA, 20 bp, Artificial
  CRISPR gRNA sequence
tgggagatattgatttgaat

SEQ ID NO: 636236 - DNA, 20 bp, Artificial
  CRISPR gRNA sequence
gggagatattgatttgaatt

SEQ ID NO: 636237 - DNA, 20 bp, Artificial
  CRISPR gRNA sequence
ggagatattgatttgaatta

SEQ ID NO: 636238 - DNA, 20 bp, Artificial
  CRISPR gRNA sequence
atttgaattatgaataagtc

SEQ ID NO: 636239 - DNA, 20 bp, Artificial
  CRISPR gRNA sequence
gaattatgaataagtcttga

SEQ ID NO: 636240 - DNA, 20 bp, Artificial
  CRISPR gRNA sequence
aattatgaataagtcttgat

SEQ ID NO: 636241 - DNA, 20 bp, Artificial
  CRISPR gRNA sequence
tgaataagtcttgatagatg

SEQ ID NO: 636242 - DNA, 20 bp, Artificial
  CRISPR gRNA sequence
gatagatgctttttacattt

SEQ ID NO: 636243 - DNA, 20 bp, Artificial
  CRISPR gRNA sequence
atagatgctttttacatttg

SEQ ID NO: 636244 - DNA, 20 bp, Artificial
  CRISPR gRNA sequence
tttacatttggatactaatt

SEQ ID NO: 636245 - DNA, 20 bp, Artificial
  CRISPR gRNA sequence
ttacatttggatactaattt

SEQ ID NO: 636246 - DNA, 20 bp, Artificial
  CRISPR gRNA sequence
tacatttggatactaatttt

SEQ ID NO: 636247 - DNA, 20 bp, Artificial
  CRISPR gRNA sequence
acatttggatactaatttta

SEQ ID NO: 636248 - DNA, 20 bp, Artificial
  CRISPR gRNA sequence
catttggatactaattttat

SEQ ID NO: 636249 - DNA, 20 bp, Artificial
  CRISPR gRNA sequence
ggatactaattttatggctt

SEQ ID NO: 636250 - DNA, 20 bp, Artificial
  CRISPR gRNA sequence
gatactaattttatggcttt

SEQ ID NO: 636251 - DNA, 20 bp, Artificial
  CRISPR gRNA sequence
attttatggctttcctcatt

SEQ ID NO: 636252 - DNA, 20 bp, Artificial
  CRISPR gRNA sequence
tatggctttcctcattttat

SEQ ID NO: 636253 - DNA, 20 bp, Artificial
  CRISPR gRNA sequence
atggctttcctcattttatt

SEQ ID NO: 636254 - DNA, 20 bp, Artificial
  CRISPR gRNA sequence
tggctttcctcattttattt

SEQ ID NO: 636255 - DNA, 20 bp, Artificial
  CRISPR gRNA sequence
tcctcattttatttgcctaa

SEQ ID NO: 636256 - DNA, 20 bp, Artificial
  CRISPR gRNA sequence
cctcattttatttgcctaac

SEQ ID NO: 636257 - DNA, 20 bp, Artificial
  CRISPR gRNA sequence
ctcattttatttgcctaact

SEQ ID NO: 636258 - DNA, 20 bp, Artificial
  CRISPR gRNA sequence
attttatttgcctaactcct

SEQ ID NO: 636259 - DNA, 20 bp, Artificial
  CRISPR gRNA sequence
tatttgcctaactcctgttg

SEQ ID NO: 636260 - DNA, 20 bp, Artificial
  CRISPR gRNA sequence
atttgcctaactcctgttga

SEQ ID NO: 636261 - DNA, 20 bp, Artificial
  CRISPR gRNA sequence
tttgcctaactcctgttgat

SEQ ID NO: 636262 - DNA, 20 bp, Artificial
  CRISPR gRNA sequence
gcctaactcctgttgatgtc

SEQ ID NO: 636263 - DNA, 20 bp, Artificial
  CRISPR gRNA sequence
cctaactcctgttgatgtct

SEQ ID NO: 636264 - DNA, 20 bp, Artificial
  CRISPR gRNA sequence
actcctgttgatgtcttgat

SEQ ID NO: 636265 - DNA, 20 bp, Artificial
  CRISPR gRNA sequence
ctgttgatgtcttgattata

SEQ ID NO: 636266 - DNA, 20 bp, Artificial
  CRISPR gRNA sequence
ttgatgtcttgattatatga

SEQ ID NO: 636267 - DNA, 20 bp, Artificial
  CRISPR gRNA sequence
atgtcttgattatatgaaaa

SEQ ID NO: 636268 - DNA, 20 bp, Artificial
  CRISPR gRNA sequence
gattatatgaaaagataatt

SEQ ID NO: 636269 - DNA, 20 bp, Artificial
  CRISPR gRNA sequence
attatatgaaaagataatta

SEQ ID NO: 636270 - DNA, 20 bp, Artificial
  CRISPR gRNA sequence
tatgaaaagataattatcat

SEQ ID NO: 636271 - DNA, 20 bp, Artificial
  CRISPR gRNA sequence
tcatttcaagagtccacttg

SEQ ID NO: 636272 - DNA, 20 bp, Artificial
  CRISPR gRNA sequence
caagagtccacttgttttat

SEQ ID NO: 636273 - DNA, 20 bp, Artificial
  CRISPR gRNA sequence
aagagtccacttgttttatt

SEQ ID NO: 636274 - DNA, 20 bp, Artificial
  CRISPR gRNA sequence
gttttattgtgttccaaact

SEQ ID NO: 636275 - DNA, 20 bp, Artificial
  CRISPR gRNA sequence
ttttattgtgttccaaacta

SEQ ID NO: 636276 - DNA, 20 bp, Artificial
  CRISPR gRNA sequence
tattgtgttccaaactaaag

SEQ ID NO: 636277 - DNA, 20 bp, Artificial
  CRISPR gRNA sequence
attgtgttccaaactaaagt

SEQ ID NO: 636278 - DNA, 20 bp, Artificial
  CRISPR gRNA sequence
ttgtgttccaaactaaagtt

SEQ ID NO: 636279 - DNA, 20 bp, Artificial
  CRISPR gRNA sequence
tgttccaaactaaagttagt

SEQ ID NO: 636280 - DNA, 20 bp, Artificial
  CRISPR gRNA sequence
caaactaaagttagttggaa

SEQ ID NO: 636281 - DNA, 20 bp, Artificial
  CRISPR gRNA sequence
aagttagttggaatcataat

SEQ ID NO: 636282 - DNA, 20 bp, Artificial
  CRISPR gRNA sequence
gttggaatcataatgaaacc

SEQ ID NO: 636283 - DNA, 20 bp, Artificial
  CRISPR gRNA sequence
gaatcataatgaaaccctca

SEQ ID NO: 636284 - DNA, 20 bp, Artificial
  CRISPR gRNA sequence
aaagacaatactgttagaaa

SEQ ID NO: 636285 - DNA, 20 bp, Artificial
  CRISPR gRNA sequence
ttagaaacaaggattaaaac

SEQ ID NO: 636286 - DNA, 20 bp, Artificial
  CRISPR gRNA sequence
gaaacaaggattaaaacaga

SEQ ID NO: 636287 - DNA, 20 bp, Artificial
  CRISPR gRNA sequence
aaacagagggtaatttatga

SEQ ID NO: 636288 - DNA, 20 bp, Artificial
  CRISPR gRNA sequence
atgagatttctaaaagtata

SEQ ID NO: 636289 - DNA, 20 bp, Artificial
  CRISPR gRNA sequence
tgagatttctaaaagtatac

SEQ ID NO: 636290 - DNA, 20 bp, Artificial
  CRISPR gRNA sequence
ctaaaagtatacatagttat

SEQ ID NO: 636291 - DNA, 20 bp, Artificial
  CRISPR gRNA sequence
taaaagtatacatagttata

SEQ ID NO: 636292 - DNA, 20 bp, Artificial
  CRISPR gRNA sequence
aaagtatacatagttatatt

SEQ ID NO: 636293 - DNA, 20 bp, Artificial
  CRISPR gRNA sequence
tattccaggaataatccaaa

SEQ ID NO: 636294 - DNA, 20 bp, Artificial
  CRISPR gRNA sequence
caggaataatccaaatatag

SEQ ID NO: 636295 - DNA, 20 bp, Artificial
  CRISPR gRNA sequence
tctaataacaaataaaaagt

SEQ ID NO: 636296 - DNA, 20 bp, Artificial
  CRISPR gRNA sequence
ataacaaataaaaagtgaat

SEQ ID NO: 636297 - DNA, 20 bp, Artificial
  CRISPR gRNA sequence
actcaatttttgataaagtt

SEQ ID NO: 636298 - DNA, 20 bp, Artificial
  CRISPR gRNA sequence
aatttttgataaagttattt

SEQ ID NO: 636299 - DNA, 20 bp, Artificial
  CRISPR gRNA sequence
ttgataaagttatttctata

SEQ ID NO: 636300 - DNA, 20 bp, Artificial
  CRISPR gRNA sequence
tgataaagttatttctataa

SEQ ID NO: 636301 - DNA, 20 bp, Artificial
  CRISPR gRNA sequence
gataaagttatttctataaa

SEQ ID NO: 636302 - DNA, 20 bp, Artificial
  CRISPR gRNA sequence
ataaagttatttctataaaa

SEQ ID NO: 636303 - DNA, 20 bp, Artificial
  CRISPR gRNA sequence
tttctataaaacattagcaa

SEQ ID NO: 636304 - DNA, 20 bp, Artificial
  CRISPR gRNA sequence
ctataaaacattagcaaccc

SEQ ID NO: 636305 - DNA, 20 bp, Artificial
  CRISPR gRNA sequence
tataaaacattagcaaccct

SEQ ID NO: 636306 - DNA, 20 bp, Artificial
  CRISPR gRNA sequence
taaaacattagcaacccttt

SEQ ID NO: 636307 - DNA, 20 bp, Artificial
  CRISPR gRNA sequence
gcaacccttttattgaatgt

SEQ ID NO: 636308 - DNA, 20 bp, Artificial
  CRISPR gRNA sequence
ttattgaatgtcgtggggta

SEQ ID NO: 636309 - DNA, 20 bp, Artificial
  CRISPR gRNA sequence
tattgaatgtcgtggggtat

SEQ ID NO: 636310 - DNA, 20 bp, Artificial
  CRISPR gRNA sequence
attgaatgtcgtggggtatt

SEQ ID NO: 636311 - DNA, 20 bp, Artificial
  CRISPR gRNA sequence
ttgaatgtcgtggggtattt

SEQ ID NO: 636312 - DNA, 20 bp, Artificial
  CRISPR gRNA sequence
aatgtcgtggggtatttcct

SEQ ID NO: 636313 - DNA, 20 bp, Artificial
  CRISPR gRNA sequence
cctggcctaggcattacaga

SEQ ID NO: 636314 - DNA, 20 bp, Artificial
  CRISPR gRNA sequence
ctggcctaggcattacagaa

SEQ ID NO: 636315 - DNA, 20 bp, Artificial
  CRISPR gRNA sequence
gcctaggcattacagaataa

SEQ ID NO: 636316 - DNA, 20 bp, Artificial
  CRISPR gRNA sequence
ggcattacagaataagtgta

SEQ ID NO: 636317 - DNA, 20 bp, Artificial
  CRISPR gRNA sequence
cagaataagtgtaaaattat

SEQ ID NO: 636318 - DNA, 20 bp, Artificial
  CRISPR gRNA sequence
tctgataattaagtaaaaga

SEQ ID NO: 636319 - DNA, 20 bp, Artificial
  CRISPR gRNA sequence
ataattaagtaaaagattca

SEQ ID NO: 636320 - DNA, 20 bp, Artificial
  CRISPR gRNA sequence
agtaaaagattcagttaact

SEQ ID NO: 636321 - DNA, 20 bp, Artificial
  CRISPR gRNA sequence
agttaactatcttttctcta

SEQ ID NO: 636322 - DNA, 20 bp, Artificial
  CRISPR gRNA sequence
actatcttttctctatgcaa

SEQ ID NO: 636323 - DNA, 20 bp, Artificial
  CRISPR gRNA sequence
tcttttctctatgcaaatgg

SEQ ID NO: 636324 - DNA, 20 bp, Artificial
  CRISPR gRNA sequence
ttctctatgcaaatggtaca

SEQ ID NO: 636325 - DNA, 20 bp, Artificial
  CRISPR gRNA sequence
tctctatgcaaatggtacat

SEQ ID NO: 636326 - DNA, 20 bp, Artificial
  CRISPR gRNA sequence
ctctatgcaaatggtacata

SEQ ID NO: 636327 - DNA, 20 bp, Artificial
  CRISPR gRNA sequence
tctatgcaaatggtacatat

SEQ ID NO: 636328 - DNA, 20 bp, Artificial
  CRISPR gRNA sequence
tatgcaaatggtacatatgc

SEQ ID NO: 636329 - DNA, 20 bp, Artificial
  CRISPR gRNA sequence
tgcaaatggtacatatgcaa

SEQ ID NO: 636330 - DNA, 20 bp, Artificial
  CRISPR gRNA sequence
catactgtctatgaaacttt

SEQ ID NO: 636331 - DNA, 20 bp, Artificial
  CRISPR gRNA sequence
tctatgaaactttaaaacaa

SEQ ID NO: 636332 - DNA, 20 bp, Artificial
  CRISPR gRNA sequence
tgaaactttaaaacaacata

SEQ ID NO: 636333 - DNA, 20 bp, Artificial
  CRISPR gRNA sequence
taaaacaacatatctcaatt

SEQ ID NO: 636334 - DNA, 20 bp, Artificial
  CRISPR gRNA sequence
aaaacaacatatctcaatta

SEQ ID NO: 636335 - DNA, 20 bp, Artificial
  CRISPR gRNA sequence
aaacaacatatctcaattat

SEQ ID NO: 636336 - DNA, 20 bp, Artificial
  CRISPR gRNA sequence
aattatttcttgtaaataat

SEQ ID NO: 636337 - DNA, 20 bp, Artificial
  CRISPR gRNA sequence
tttcttgtaaataatttgtt

SEQ ID NO: 636338 - DNA, 20 bp, Artificial
  CRISPR gRNA sequence
cttgtaaataatttgttctt

SEQ ID NO: 636339 - DNA, 20 bp, Artificial
  CRISPR gRNA sequence
ttgtaaataatttgttcttt

SEQ ID NO: 636340 - DNA, 20 bp, Artificial
  CRISPR gRNA sequence
gtaaataatttgttctttaa

SEQ ID NO: 636341 - DNA, 20 bp, Artificial
  CRISPR gRNA sequence
taaataatttgttctttaaa

SEQ ID NO: 636342 - DNA, 20 bp, Artificial
  CRISPR gRNA sequence
gttctttaaatggactgcat

SEQ ID NO: 636343 - DNA, 20 bp, Artificial
  CRISPR gRNA sequence
ttctttaaatggactgcatc

SEQ ID NO: 636344 - DNA, 20 bp, Artificial
  CRISPR gRNA sequence
tttaaatggactgcatcaat

SEQ ID NO: 636345 - DNA, 20 bp, Artificial
  CRISPR gRNA sequence
taaatggactgcatcaatgt

SEQ ID NO: 636346 - DNA, 20 bp, Artificial
  CRISPR gRNA sequence
aaatggactgcatcaatgtg

SEQ ID NO: 636347 - DNA, 20 bp, Artificial
  CRISPR gRNA sequence
aatggactgcatcaatgtgc

SEQ ID NO: 636348 - DNA, 20 bp, Artificial
  CRISPR gRNA sequence
catcaatgtgccctttttga

SEQ ID NO: 636349 - DNA, 20 bp, Artificial
  CRISPR gRNA sequence
tttgagtcagtttagacttt

SEQ ID NO: 636350 - DNA, 20 bp, Artificial
  CRISPR gRNA sequence
ttgagtcagtttagactttg

SEQ ID NO: 636351 - DNA, 20 bp, Artificial
  CRISPR gRNA sequence
tgagtcagtttagactttgt

SEQ ID NO: 636352 - DNA, 20 bp, Artificial
  CRISPR gRNA sequence
gagtcagtttagactttgtc

SEQ ID NO: 636353 - DNA, 20 bp, Artificial
  CRISPR gRNA sequence
agtcagtttagactttgtct

SEQ ID NO: 636354 - DNA, 20 bp, Artificial
  CRISPR gRNA sequence
agactttgtctgaaaaaaat

SEQ ID NO: 636355 - DNA, 20 bp, Artificial
  CRISPR gRNA sequence
gactttgtctgaaaaaaata

SEQ ID NO: 636356 - DNA, 20 bp, Artificial
  CRISPR gRNA sequence
tgtctgaaaaaaatattaat

SEQ ID NO: 636357 - DNA, 20 bp, Artificial
  CRISPR gRNA sequence
gtctgaaaaaaatattaatc

SEQ ID NO: 636358 - DNA, 20 bp, Artificial
  CRISPR gRNA sequence
tctgaaaaaaatattaatca

SEQ ID NO: 636359 - DNA, 20 bp, Artificial
  CRISPR gRNA sequence
aaaaaaatattaatcatgtt

SEQ ID NO: 636360 - DNA, 20 bp, Artificial
  CRISPR gRNA sequence
atcatgttcttcatatgtat

SEQ ID NO: 636361 - DNA, 20 bp, Artificial
  CRISPR gRNA sequence
ttcatatgtatatcaaagca

SEQ ID NO: 636362 - DNA, 20 bp, Artificial
  CRISPR gRNA sequence
catatgtatatcaaagcaaa

SEQ ID NO: 636363 - DNA, 20 bp, Artificial
  CRISPR gRNA sequence
atatgtatatcaaagcaaat

SEQ ID NO: 636364 - DNA, 20 bp, Artificial
  CRISPR gRNA sequence
taagaaaatctcacaaattt

SEQ ID NO: 636365 - DNA, 20 bp, Artificial
  CRISPR gRNA sequence
aagaaaatctcacaaattta

SEQ ID NO: 636366 - DNA, 20 bp, Artificial
  CRISPR gRNA sequence
agaaaatctcacaaatttac

SEQ ID NO: 636367 - DNA, 20 bp, Artificial
  CRISPR gRNA sequence
acaaatttactaactacatt

SEQ ID NO: 636368 - DNA, 20 bp, Artificial
  CRISPR gRNA sequence
actaactacattaatggagc

SEQ ID NO: 636369 - DNA, 20 bp, Artificial
  CRISPR gRNA sequence
ctaactacattaatggagca

SEQ ID NO: 636370 - DNA, 20 bp, Artificial
  CRISPR gRNA sequence
actacattaatggagcaatc

SEQ ID NO: 636371 - DNA, 20 bp, Artificial
  CRISPR gRNA sequence
cattaatggagcaatccaag

SEQ ID NO: 636372 - DNA, 20 bp, Artificial
  CRISPR gRNA sequence
atggagcaatccaagctgaa

SEQ ID NO: 636373 - DNA, 20 bp, Artificial
  CRISPR gRNA sequence
aaaacattaagtagtttgtt

SEQ ID NO: 636374 - DNA, 20 bp, Artificial
  CRISPR gRNA sequence
agtagtttgttataaccata

SEQ ID NO: 636375 - DNA, 20 bp, Artificial
  CRISPR gRNA sequence
gttataaccataatgactaa

SEQ ID NO: 636376 - DNA, 20 bp, Artificial
  CRISPR gRNA sequence
ttataaccataatgactaat

SEQ ID NO: 636377 - DNA, 20 bp, Artificial
  CRISPR gRNA sequence
taaccataatgactaatctt

SEQ ID NO: 636378 - DNA, 20 bp, Artificial
  CRISPR gRNA sequence
atctttcccctggtaggcac

SEQ ID NO: 636379 - DNA, 20 bp, Artificial
  CRISPR gRNA sequence
tcccctggtaggcacaaaaa

SEQ ID NO: 636380 - DNA, 20 bp, Artificial
  CRISPR gRNA sequence
cccctggtaggcacaaaaat

SEQ ID NO: 636381 - DNA, 20 bp, Artificial
  CRISPR gRNA sequence
ccctggtaggcacaaaaatc

SEQ ID NO: 636382 - DNA, 20 bp, Artificial
  CRISPR gRNA sequence
gtaggcacaaaaatctagac

SEQ ID NO: 636383 - DNA, 20 bp, Artificial
  CRISPR gRNA sequence
gactaacaaaactggatcga

SEQ ID NO: 636384 - DNA, 20 bp, Artificial
  CRISPR gRNA sequence
acaaaactggatcgaggaaa

SEQ ID NO: 636385 - DNA, 20 bp, Artificial
  CRISPR gRNA sequence
gatcgaggaaaataattaag

SEQ ID NO: 636386 - DNA, 20 bp, Artificial
  CRISPR gRNA sequence
agatatggtcatgtgtcctt

SEQ ID NO: 636387 - DNA, 20 bp, Artificial
  CRISPR gRNA sequence
catgtccatatctcaatctg

SEQ ID NO: 636388 - DNA, 20 bp, Artificial
  CRISPR gRNA sequence
atgtccatatctcaatctgt

SEQ ID NO: 636389 - DNA, 20 bp, Artificial
  CRISPR gRNA sequence
aatctgttgttttgttttta

SEQ ID NO: 636390 - DNA, 20 bp, Artificial
  CRISPR gRNA sequence
ttgttttgtttttattttta

SEQ ID NO: 636391 - DNA, 20 bp, Artificial
  CRISPR gRNA sequence
ttttgtttttatttttaaat

SEQ ID NO: 636392 - DNA, 20 bp, Artificial
  CRISPR gRNA sequence
tgtttttatttttaaataca

SEQ ID NO: 636393 - DNA, 20 bp, Artificial
  CRISPR gRNA sequence
gtttttatttttaaatacaa

SEQ ID NO: 636394 - DNA, 20 bp, Artificial
  CRISPR gRNA sequence
tttttatttttaaatacaat

SEQ ID NO: 636395 - DNA, 20 bp, Artificial
  CRISPR gRNA sequence
ttatttttaaatacaataga

SEQ ID NO: 636396 - DNA, 20 bp, Artificial
  CRISPR gRNA sequence
tatttttaaatacaatagaa

SEQ ID NO: 636397 - DNA, 20 bp, Artificial
  CRISPR gRNA sequence
atttttaaatacaatagaac

SEQ ID NO: 636398 - DNA, 20 bp, Artificial
  CRISPR gRNA sequence
tttttaaatacaatagaaca

SEQ ID NO: 636399 - DNA, 20 bp, Artificial
  CRISPR gRNA sequence
ttaaatacaatagaacaatc

SEQ ID NO: 636400 - DNA, 20 bp, Artificial
  CRISPR gRNA sequence
taaatacaatagaacaatct

SEQ ID NO: 636401 - DNA, 20 bp, Artificial
  CRISPR gRNA sequence
aaatacaatagaacaatcta

SEQ ID NO: 636402 - DNA, 20 bp, Artificial
  CRISPR gRNA sequence
aatacaatagaacaatctac

SEQ ID NO: 636403 - DNA, 20 bp, Artificial
  CRISPR gRNA sequence
ctggtccatttttatttatt

SEQ ID NO: 636404 - DNA, 20 bp, Artificial
  CRISPR gRNA sequence
gtccatttttatttattgac

SEQ ID NO: 636405 - DNA, 20 bp, Artificial
  CRISPR gRNA sequence
ttatttattgactgggtgag

SEQ ID NO: 636406 - DNA, 20 bp, Artificial
  CRISPR gRNA sequence
tatttattgactgggtgaga

SEQ ID NO: 636407 - DNA, 20 bp, Artificial
  CRISPR gRNA sequence
atttattgactgggtgagat

SEQ ID NO: 636408 - DNA, 20 bp, Artificial
  CRISPR gRNA sequence
tttattgactgggtgagatt

SEQ ID NO: 636409 - DNA, 20 bp, Artificial
  CRISPR gRNA sequence
attgactgggtgagattata

SEQ ID NO: 636410 - DNA, 20 bp, Artificial
  CRISPR gRNA sequence
ttgactgggtgagattatat

SEQ ID NO: 636411 - DNA, 20 bp, Artificial
  CRISPR gRNA sequence
actgggtgagattatatatt

SEQ ID NO: 636412 - DNA, 20 bp, Artificial
  CRISPR gRNA sequence
ggtgagattatatattattt

SEQ ID NO: 636413 - DNA, 20 bp, Artificial
  CRISPR gRNA sequence
tatattatttttattatgga

SEQ ID NO: 636414 - DNA, 20 bp, Artificial
  CRISPR gRNA sequence
tttttattatggaatatctt

SEQ ID NO: 636415 - DNA, 20 bp, Artificial
  CRISPR gRNA sequence
ttattatggaatatcttata

SEQ ID NO: 636416 - DNA, 20 bp, Artificial
  CRISPR gRNA sequence
tattatggaatatcttatat

SEQ ID NO: 636417 - DNA, 20 bp, Artificial
  CRISPR gRNA sequence
attatggaatatcttatatt

SEQ ID NO: 636418 - DNA, 20 bp, Artificial
  CRISPR gRNA sequence
ttatggaatatcttatattt

SEQ ID NO: 636419 - DNA, 20 bp, Artificial
  CRISPR gRNA sequence
tggaatatcttatatttcaa

SEQ ID NO: 636420 - DNA, 20 bp, Artificial
  CRISPR gRNA sequence
atatttcaatattttatgta

SEQ ID NO: 636421 - DNA, 20 bp, Artificial
  CRISPR gRNA sequence
tatttcaatattttatgtac

SEQ ID NO: 636422 - DNA, 20 bp, Artificial
  CRISPR gRNA sequence
caatattttatgtaccttca

SEQ ID NO: 636423 - DNA, 20 bp, Artificial
  CRISPR gRNA sequence
aatattttatgtaccttcat

SEQ ID NO: 636424 - DNA, 20 bp, Artificial
  CRISPR gRNA sequence
tatgtaccttcataaacacc

SEQ ID NO: 636425 - DNA, 20 bp, Artificial
  CRISPR gRNA sequence
atgtaccttcataaacacct

SEQ ID NO: 636426 - DNA, 20 bp, Artificial
  CRISPR gRNA sequence
tgtaccttcataaacaccta

SEQ ID NO: 636427 - DNA, 20 bp, Artificial
  CRISPR gRNA sequence
cataaacacctatttctaga

SEQ ID NO: 636428 - DNA, 20 bp, Artificial
  CRISPR gRNA sequence
ataaacacctatttctagac

SEQ ID NO: 636429 - DNA, 20 bp, Artificial
  CRISPR gRNA sequence
tttctagacctgcatttaaa

SEQ ID NO: 636430 - DNA, 20 bp, Artificial
  CRISPR gRNA sequence
ctagacctgcatttaaatat

SEQ ID NO: 636431 - DNA, 20 bp, Artificial
  CRISPR gRNA sequence
tagacctgcatttaaatatt

SEQ ID NO: 636432 - DNA, 20 bp, Artificial
  CRISPR gRNA sequence
gacctgcatttaaatattca

SEQ ID NO: 636433 - DNA, 20 bp, Artificial
  CRISPR gRNA sequence
catttaaatattcaattaaa

SEQ ID NO: 636434 - DNA, 20 bp, Artificial
  CRISPR gRNA sequence
aaatattcaattaaaatgca

SEQ ID NO: 636435 - DNA, 20 bp, Artificial
  CRISPR gRNA sequence
aatattcaattaaaatgcaa

SEQ ID NO: 636436 - DNA, 20 bp, Artificial
  CRISPR gRNA sequence
aattaaaatgcaaatatata

SEQ ID NO: 636437 - DNA, 20 bp, Artificial
  CRISPR gRNA sequence
aaatgcaaatatatatgcat

SEQ ID NO: 636438 - DNA, 20 bp, Artificial
  CRISPR gRNA sequence
gctttggtgaatcaaagaca

SEQ ID NO: 636439 - DNA, 20 bp, Artificial
  CRISPR gRNA sequence
ctttggtgaatcaaagacag

SEQ ID NO: 636440 - DNA, 20 bp, Artificial
  CRISPR gRNA sequence
tggtgaatcaaagacagagg

SEQ ID NO: 636441 - DNA, 20 bp, Artificial
  CRISPR gRNA sequence
ggtgaatcaaagacagaggg

SEQ ID NO: 636442 - DNA, 20 bp, Artificial
  CRISPR gRNA sequence
gtgaatcaaagacagagggt

SEQ ID NO: 636443 - DNA, 20 bp, Artificial
  CRISPR gRNA sequence
ctatgttgggtggaacaacc

SEQ ID NO: 636444 - DNA, 20 bp, Artificial
  CRISPR gRNA sequence
tgttgggtggaacaacctac

SEQ ID NO: 636445 - DNA, 20 bp, Artificial
  CRISPR gRNA sequence
ggtggaacaacctacaaata

SEQ ID NO: 636446 - DNA, 20 bp, Artificial
  CRISPR gRNA sequence
caaatatgcagaatctcaag

SEQ ID NO: 636447 - DNA, 20 bp, Artificial
  CRISPR gRNA sequence
aagcatctgctgagtgcctt

SEQ ID NO: 636448 - DNA, 20 bp, Artificial
  CRISPR gRNA sequence
ctgagtgcctttgagcaaga

SEQ ID NO: 636449 - DNA, 20 bp, Artificial
  CRISPR gRNA sequence
agtgcctttgagcaagagga

SEQ ID NO: 636450 - DNA, 20 bp, Artificial
  CRISPR gRNA sequence
tgagcaagaggatggctgca

SEQ ID NO: 636451 - DNA, 20 bp, Artificial
  CRISPR gRNA sequence
gagcaagaggatggctgcac

SEQ ID NO: 636452 - DNA, 20 bp, Artificial
  CRISPR gRNA sequence
agcaagaggatggctgcaca

SEQ ID NO: 636453 - DNA, 20 bp, Artificial
  CRISPR gRNA sequence
cacaaagctgcaatgtacaa

SEQ ID NO: 636454 - DNA, 20 bp, Artificial
  CRISPR gRNA sequence
caatgtacaaaatacggtgc

SEQ ID NO: 636455 - DNA, 20 bp, Artificial
  CRISPR gRNA sequence
aaaactgagttacaagatgg

SEQ ID NO: 636456 - DNA, 20 bp, Artificial
  CRISPR gRNA sequence
agttacaagatgggagtaga

SEQ ID NO: 636457 - DNA, 20 bp, Artificial
  CRISPR gRNA sequence
caagatgggagtagattaag

SEQ ID NO: 636458 - DNA, 20 bp, Artificial
  CRISPR gRNA sequence
aggagaggcaaaattaggga

SEQ ID NO: 636459 - DNA, 20 bp, Artificial
  CRISPR gRNA sequence
gggaattctatatgtataat

SEQ ID NO: 636460 - DNA, 20 bp, Artificial
  CRISPR gRNA sequence
tatatgtataatgtccaatc

SEQ ID NO: 636461 - DNA, 20 bp, Artificial
  CRISPR gRNA sequence
tatgtataatgtccaatcga

SEQ ID NO: 636462 - DNA, 20 bp, Artificial
  CRISPR gRNA sequence
atgcatgaattgatttactt

SEQ ID NO: 636463 - DNA, 20 bp, Artificial
  CRISPR gRNA sequence
atttactttccctatttgtt

SEQ ID NO: 636464 - DNA, 20 bp, Artificial
  CRISPR gRNA sequence
actttccctatttgtttact

SEQ ID NO: 636465 - DNA, 20 bp, Artificial
  CRISPR gRNA sequence
ctttccctatttgtttactc

SEQ ID NO: 636466 - DNA, 20 bp, Artificial
  CRISPR gRNA sequence
tccctatttgtttactcttc

SEQ ID NO: 636467 - DNA, 20 bp, Artificial
  CRISPR gRNA sequence
ccctatttgtttactcttct

SEQ ID NO: 636468 - DNA, 20 bp, Artificial
  CRISPR gRNA sequence
cctatttgtttactcttctc

SEQ ID NO: 636469 - DNA, 20 bp, Artificial
  CRISPR gRNA sequence
tttgtttactcttctctcta

SEQ ID NO: 636470 - DNA, 20 bp, Artificial
  CRISPR gRNA sequence
gtttactcttctctctatat

SEQ ID NO: 636471 - DNA, 20 bp, Artificial
  CRISPR gRNA sequence
tttactcttctctctatatt

SEQ ID NO: 636472 - DNA, 20 bp, Artificial
  CRISPR gRNA sequence
actcttctctctatattccc

SEQ ID NO: 636473 - DNA, 20 bp, Artificial
  CRISPR gRNA sequence
ctcttctctctatattccca

SEQ ID NO: 636474 - DNA, 20 bp, Artificial
  CRISPR gRNA sequence
ttctctctatattcccagtg

SEQ ID NO: 636475 - DNA, 20 bp, Artificial
  CRISPR gRNA sequence
ctctctatattcccagtgaa

SEQ ID NO: 636476 - DNA, 20 bp, Artificial
  CRISPR gRNA sequence
tctctatattcccagtgaag

SEQ ID NO: 636477 - DNA, 20 bp, Artificial
  CRISPR gRNA sequence
tctatattcccagtgaagag

SEQ ID NO: 636478 - DNA, 20 bp, Artificial
  CRISPR gRNA sequence
tatattcccagtgaagagtg

SEQ ID NO: 636479 - DNA, 20 bp, Artificial
  CRISPR gRNA sequence
tattcccagtgaagagtgcc

SEQ ID NO: 636480 - DNA, 20 bp, Artificial
  CRISPR gRNA sequence
ccagtgaagagtgcctggag

SEQ ID NO: 636481 - DNA, 20 bp, Artificial
  CRISPR gRNA sequence
gagtatccgatgacaatatt

SEQ ID NO: 636482 - DNA, 20 bp, Artificial
  CRISPR gRNA sequence
cctgattacttactaaagta

SEQ ID NO: 636483 - DNA, 20 bp, Artificial
  CRISPR gRNA sequence
attacttactaaagtagcaa

SEQ ID NO: 636484 - DNA, 20 bp, Artificial
  CRISPR gRNA sequence
cttactaaagtagcaatacc

SEQ ID NO: 636485 - DNA, 20 bp, Artificial
  CRISPR gRNA sequence
actaaagtagcaataccaaa

SEQ ID NO: 636486 - DNA, 20 bp, Artificial
  CRISPR gRNA sequence
ctaaagtagcaataccaaat

SEQ ID NO: 636487 - DNA, 20 bp, Artificial
  CRISPR gRNA sequence
aagtagcaataccaaatcaa

SEQ ID NO: 636488 - DNA, 20 bp, Artificial
  CRISPR gRNA sequence
ataagacactgcaattggta

SEQ ID NO: 636489 - DNA, 20 bp, Artificial
  CRISPR gRNA sequence
caattggtactttagtagag

SEQ ID NO: 636490 - DNA, 20 bp, Artificial
  CRISPR gRNA sequence
gtactttagtagagtatgac

SEQ ID NO: 636491 - DNA, 20 bp, Artificial
  CRISPR gRNA sequence
tagtagagtatgacagagaa

SEQ ID NO: 636492 - DNA, 20 bp, Artificial
  CRISPR gRNA sequence
agtagagtatgacagagaaa

SEQ ID NO: 636493 - DNA, 20 bp, Artificial
  CRISPR gRNA sequence
gtagagtatgacagagaaag

SEQ ID NO: 636494 - DNA, 20 bp, Artificial
  CRISPR gRNA sequence
gatctgatgctccatgatat

SEQ ID NO: 636495 - DNA, 20 bp, Artificial
  CRISPR gRNA sequence
atgctccatgatattgtaat

SEQ ID NO: 636496 - DNA, 20 bp, Artificial
  CRISPR gRNA sequence
catgatattgtaatgaattg

SEQ ID NO: 636497 - DNA, 20 bp, Artificial
  CRISPR gRNA sequence
taatgaattggatggttgtg

SEQ ID NO: 636498 - DNA, 20 bp, Artificial
  CRISPR gRNA sequence
gatggttgtgcatctttttt

SEQ ID NO: 636499 - DNA, 20 bp, Artificial
  CRISPR gRNA sequence
tgcatcttttttcactatca

SEQ ID NO: 636500 - DNA, 20 bp, Artificial
  CRISPR gRNA sequence
ttttcactatcaattttata

SEQ ID NO: 636501 - DNA, 20 bp, Artificial
  CRISPR gRNA sequence
tttcactatcaattttatat

SEQ ID NO: 636502 - DNA, 20 bp, Artificial
  CRISPR gRNA sequence
ttcactatcaattttatatt

SEQ ID NO: 636503 - DNA, 20 bp, Artificial
  CRISPR gRNA sequence
tcactatcaattttatatta

SEQ ID NO: 636504 - DNA, 20 bp, Artificial
  CRISPR gRNA sequence
cactatcaattttatattag

SEQ ID NO: 636505 - DNA, 20 bp, Artificial
  CRISPR gRNA sequence
actatcaattttatattaga

SEQ ID NO: 636506 - DNA, 20 bp, Artificial
  CRISPR gRNA sequence
tcaattttatattagaggct

SEQ ID NO: 636507 - DNA, 20 bp, Artificial
  CRISPR gRNA sequence
tatattagaggctgggcacg

SEQ ID NO: 636508 - DNA, 20 bp, Artificial
  CRISPR gRNA sequence
atattagaggctgggcacgg

SEQ ID NO: 636509 - DNA, 20 bp, Artificial
  CRISPR gRNA sequence
tattagaggctgggcacggt

SEQ ID NO: 636510 - DNA, 20 bp, Artificial
  CRISPR gRNA sequence
gaggctgggcacggtggctc

SEQ ID NO: 636511 - DNA, 20 bp, Artificial
  CRISPR gRNA sequence
ggcacggtggctcacgcctg

SEQ ID NO: 636512 - DNA, 20 bp, Artificial
  CRISPR gRNA sequence
acgcctgtaatcccagcact

SEQ ID NO: 636513 - DNA, 20 bp, Artificial
  CRISPR gRNA sequence
taatcccagcactttgagag

SEQ ID NO: 636514 - DNA, 20 bp, Artificial
  CRISPR gRNA sequence
tgagaggctagggtgggtgg

SEQ ID NO: 636515 - DNA, 20 bp, Artificial
  CRISPR gRNA sequence
gagaggctagggtgggtgga

SEQ ID NO: 636516 - DNA, 20 bp, Artificial
  CRISPR gRNA sequence
agaggctagggtgggtggaa

SEQ ID NO: 636517 - DNA, 20 bp, Artificial
  CRISPR gRNA sequence
gggtgggtggaacaactgag

SEQ ID NO: 636518 - DNA, 20 bp, Artificial
  CRISPR gRNA sequence
aggtcaggagtttgagacca

SEQ ID NO: 636519 - DNA, 20 bp, Artificial
  CRISPR gRNA sequence
gagaccaacatggtgaaacc

SEQ ID NO: 636520 - DNA, 20 bp, Artificial
  CRISPR gRNA sequence
agaccaacatggtgaaaccc

SEQ ID NO: 636521 - DNA, 20 bp, Artificial
  CRISPR gRNA sequence
tctctactaaaaatacagaa

SEQ ID NO: 636522 - DNA, 20 bp, Artificial
  CRISPR gRNA sequence
tactaaaaatacagaaatta

SEQ ID NO: 636523 - DNA, 20 bp, Artificial
  CRISPR gRNA sequence
ctaaaaatacagaaattagc

SEQ ID NO: 636524 - DNA, 20 bp, Artificial
  CRISPR gRNA sequence
aaaatacagaaattagctgg

SEQ ID NO: 636525 - DNA, 20 bp, Artificial
  CRISPR gRNA sequence
gctgggcctggtggtgggca

SEQ ID NO: 636526 - DNA, 20 bp, Artificial
  CRISPR gRNA sequence
ggcctggtggtgggcacatg

SEQ ID NO: 636527 - DNA, 20 bp, Artificial
  CRISPR gRNA sequence
gtggtgggcacatgtaattc

SEQ ID NO: 636528 - DNA, 20 bp, Artificial
  CRISPR gRNA sequence
cagctactttggaggctgag

SEQ ID NO: 636529 - DNA, 20 bp, Artificial
  CRISPR gRNA sequence
ctttggaggctgaggcagga

SEQ ID NO: 636530 - DNA, 20 bp, Artificial
  CRISPR gRNA sequence
tggaggctgaggcaggagga

SEQ ID NO: 636531 - DNA, 20 bp, Artificial
  CRISPR gRNA sequence
ggaggctgaggcaggaggat

SEQ ID NO: 636532 - DNA, 20 bp, Artificial
  CRISPR gRNA sequence
gaggctgaggcaggaggatc

SEQ ID NO: 636533 - DNA, 20 bp, Artificial
  CRISPR gRNA sequence
aggcaggaggatcgcttgaa

SEQ ID NO: 636534 - DNA, 20 bp, Artificial
  CRISPR gRNA sequence
gaacccaggaggtggagggt

SEQ ID NO: 636535 - DNA, 20 bp, Artificial
  CRISPR gRNA sequence
aacccaggaggtggagggtg

SEQ ID NO: 636536 - DNA, 20 bp, Artificial
  CRISPR gRNA sequence
caccactacactccagcctg

SEQ ID NO: 636537 - DNA, 20 bp, Artificial
  CRISPR gRNA sequence
cactccagcctgggcgacag

SEQ ID NO: 636538 - DNA, 20 bp, Artificial
  CRISPR gRNA sequence
cagcctgggcgacagagcaa

SEQ ID NO: 636539 - DNA, 20 bp, Artificial
  CRISPR gRNA sequence
ggcgacagagcaagactcca

SEQ ID NO: 636540 - DNA, 20 bp, Artificial
  CRISPR gRNA sequence
caactcaaaaaaaaaattat

SEQ ID NO: 636541 - DNA, 20 bp, Artificial
  CRISPR gRNA sequence
aaaaaaaaaattatattaga

SEQ ID NO: 636542 - DNA, 20 bp, Artificial
  CRISPR gRNA sequence
tattagatattctatgaact

SEQ ID NO: 636543 - DNA, 20 bp, Artificial
  CRISPR gRNA sequence
gatattctatgaactaaaaa

SEQ ID NO: 636544 - DNA, 20 bp, Artificial
  CRISPR gRNA sequence
tatgaactaaaaacactaaa

SEQ ID NO: 636545 - DNA, 20 bp, Artificial
  CRISPR gRNA sequence
tgaactaaaaacactaaaat

SEQ ID NO: 636546 - DNA, 20 bp, Artificial
  CRISPR gRNA sequence
aaaacactaaaatatatgtt

SEQ ID NO: 636547 - DNA, 20 bp, Artificial
  CRISPR gRNA sequence
aaatatatgtttctcaaagg

SEQ ID NO: 636548 - DNA, 20 bp, Artificial
  CRISPR gRNA sequence
ctcaaaggcattataaggtt

SEQ ID NO: 636549 - DNA, 20 bp, Artificial
  CRISPR gRNA sequence
tcaaaggcattataaggttt

SEQ ID NO: 636550 - DNA, 20 bp, Artificial
  CRISPR gRNA sequence
aaaggcattataaggtttta

SEQ ID NO: 636551 - DNA, 20 bp, Artificial
  CRISPR gRNA sequence
taaggttttaagacagtatc

SEQ ID NO: 636552 - DNA, 20 bp, Artificial
  CRISPR gRNA sequence
taagacagtatctttaatat

SEQ ID NO: 636553 - DNA, 20 bp, Artificial
  CRISPR gRNA sequence
aagacagtatctttaatatg

SEQ ID NO: 636554 - DNA, 20 bp, Artificial
  CRISPR gRNA sequence
agacagtatctttaatatga

SEQ ID NO: 636555 - DNA, 20 bp, Artificial
  CRISPR gRNA sequence
taatatgagagataaacaat

SEQ ID NO: 636556 - DNA, 20 bp, Artificial
  CRISPR gRNA sequence
aatatgagagataaacaatt

SEQ ID NO: 636557 - DNA, 20 bp, Artificial
  CRISPR gRNA sequence
atatgagagataaacaattg

SEQ ID NO: 636558 - DNA, 20 bp, Artificial
  CRISPR gRNA sequence
ataagagtgggaagttctaa

SEQ ID NO: 636559 - DNA, 20 bp, Artificial
  CRISPR gRNA sequence
taaaatgcagactagttcat

SEQ ID NO: 636560 - DNA, 20 bp, Artificial
  CRISPR gRNA sequence
aaatgcagactagttcatgg

SEQ ID NO: 636561 - DNA, 20 bp, Artificial
  CRISPR gRNA sequence
gttcatggtattaaggagaa

SEQ ID NO: 636562 - DNA, 20 bp, Artificial
  CRISPR gRNA sequence
atggtattaaggagaaaaca

SEQ ID NO: 636563 - DNA, 20 bp, Artificial
  CRISPR gRNA sequence
aggagaaaacatttggctaa

SEQ ID NO: 636564 - DNA, 20 bp, Artificial
  CRISPR gRNA sequence
ggctaatgactagattctga

SEQ ID NO: 636565 - DNA, 20 bp, Artificial
  CRISPR gRNA sequence
gctaatgactagattctgac

SEQ ID NO: 636566 - DNA, 20 bp, Artificial
  CRISPR gRNA sequence
atgactagattctgactaca

SEQ ID NO: 636567 - DNA, 20 bp, Artificial
  CRISPR gRNA sequence
gattctgactacatttttct

SEQ ID NO: 636568 - DNA, 20 bp, Artificial
  CRISPR gRNA sequence
tgactacatttttctcaatc

SEQ ID NO: 636569 - DNA, 20 bp, Artificial
  CRISPR gRNA sequence
actacatttttctcaatcta

SEQ ID NO: 636570 - DNA, 20 bp, Artificial
  CRISPR gRNA sequence
catttttctcaatctagttt

SEQ ID NO: 636571 - DNA, 20 bp, Artificial
  CRISPR gRNA sequence
ttctcaatctagtttaaatt

SEQ ID NO: 636572 - DNA, 20 bp, Artificial
  CRISPR gRNA sequence
tctcaatctagtttaaatta

SEQ ID NO: 636573 - DNA, 20 bp, Artificial
  CRISPR gRNA sequence
ctcaatctagtttaaattaa

SEQ ID NO: 636574 - DNA, 20 bp, Artificial
  CRISPR gRNA sequence
tcaatctagtttaaattaaa

SEQ ID NO: 636575 - DNA, 20 bp, Artificial
  CRISPR gRNA sequence
aatctagtttaaattaaaga

SEQ ID NO: 636576 - DNA, 20 bp, Artificial
  CRISPR gRNA sequence
gtttaaattaaagaaatgca

SEQ ID NO: 636577 - DNA, 20 bp, Artificial
  CRISPR gRNA sequence
aaattaaagaaatgcaaata

SEQ ID NO: 636578 - DNA, 20 bp, Artificial
  CRISPR gRNA sequence
aattaaagaaatgcaaatag

SEQ ID NO: 636579 - DNA, 20 bp, Artificial
  CRISPR gRNA sequence
aagaaatgcaaatagacttt

SEQ ID NO: 636580 - DNA, 20 bp, Artificial
  CRISPR gRNA sequence
tctagtctcaaaatggtatt

SEQ ID NO: 636581 - DNA, 20 bp, Artificial
  CRISPR gRNA sequence
ctagtctcaaaatggtatta

SEQ ID NO: 636582 - DNA, 20 bp, Artificial
  CRISPR gRNA sequence
tagtctcaaaatggtattaa

SEQ ID NO: 636583 - DNA, 20 bp, Artificial
  CRISPR gRNA sequence
gtctcaaaatggtattaaag

SEQ ID NO: 636584 - DNA, 20 bp, Artificial
  CRISPR gRNA sequence
aaaatggtattaaagtggtg

SEQ ID NO: 636585 - DNA, 20 bp, Artificial
  CRISPR gRNA sequence
aagtggtgttgaaaatggca

SEQ ID NO: 636586 - DNA, 20 bp, Artificial
  CRISPR gRNA sequence
aaaatggcaggacacactca

SEQ ID NO: 636587 - DNA, 20 bp, Artificial
  CRISPR gRNA sequence
agatgtataaactggatcat

SEQ ID NO: 636588 - DNA, 20 bp, Artificial
  CRISPR gRNA sequence
gatcatcagaaatatgttga

SEQ ID NO: 636589 - DNA, 20 bp, Artificial
  CRISPR gRNA sequence
aagtgtctagtttaatgata

SEQ ID NO: 636590 - DNA, 20 bp, Artificial
  CRISPR gRNA sequence
gtttaatgatatcatgtcca

SEQ ID NO: 636591 - DNA, 20 bp, Artificial
  CRISPR gRNA sequence
aatgatatcatgtccacaat

SEQ ID NO: 636592 - DNA, 20 bp, Artificial
  CRISPR gRNA sequence
atgatatcatgtccacaatt

SEQ ID NO: 636593 - DNA, 20 bp, Artificial
  CRISPR gRNA sequence
caaagttgacaaagcatgac

SEQ ID NO: 636594 - DNA, 20 bp, Artificial
  CRISPR gRNA sequence
aaagttgacaaagcatgaca

SEQ ID NO: 636595 - DNA, 20 bp, Artificial
  CRISPR gRNA sequence
acaaagcatgacaggtatca

SEQ ID NO: 636596 - DNA, 20 bp, Artificial
  CRISPR gRNA sequence
ctccgtaaatggctattaac

SEQ ID NO: 636597 - DNA, 20 bp, Artificial
  CRISPR gRNA sequence
tccgtaaatggctattaact

SEQ ID NO: 636598 - DNA, 20 bp, Artificial
  CRISPR gRNA sequence
cgtaaatggctattaacttt

SEQ ID NO: 636599 - DNA, 20 bp, Artificial
  CRISPR gRNA sequence
ttaactttaagaaaaatcta

SEQ ID NO: 636600 - DNA, 20 bp, Artificial
  CRISPR gRNA sequence
actttaagaaaaatctagat

SEQ ID NO: 636601 - DNA, 20 bp, Artificial
  CRISPR gRNA sequence
taagaaaaatctagatctga

SEQ ID NO: 636602 - DNA, 20 bp, Artificial
  CRISPR gRNA sequence
aagaaaaatctagatctgaa

SEQ ID NO: 636603 - DNA, 20 bp, Artificial
  CRISPR gRNA sequence
agaaaaatctagatctgaag

SEQ ID NO: 636604 - DNA, 20 bp, Artificial
  CRISPR gRNA sequence
gatctgaagaaagtataata

SEQ ID NO: 636605 - DNA, 20 bp, Artificial
  CRISPR gRNA sequence
aagaaagtataataatttgc

SEQ ID NO: 636606 - DNA, 20 bp, Artificial
  CRISPR gRNA sequence
gcacaatgctccaataaaca

SEQ ID NO: 636607 - DNA, 20 bp, Artificial
  CRISPR gRNA sequence
cacaatgctccaataaacac

SEQ ID NO: 636608 - DNA, 20 bp, Artificial
  CRISPR gRNA sequence
caataaacactgattgacaa

SEQ ID NO: 636609 - DNA, 20 bp, Artificial
  CRISPR gRNA sequence
attgacaaaaaaagatagtg

SEQ ID NO: 636610 - DNA, 20 bp, Artificial
  CRISPR gRNA sequence
acaaaaaaagatagtgttgc

SEQ ID NO: 636611 - DNA, 20 bp, Artificial
  CRISPR gRNA sequence
caagtgtactttaacatact

SEQ ID NO: 636612 - DNA, 20 bp, Artificial
  CRISPR gRNA sequence
taacatactccttgctgtta

SEQ ID NO: 636613 - DNA, 20 bp, Artificial
  CRISPR gRNA sequence
aacatactccttgctgttat

SEQ ID NO: 636614 - DNA, 20 bp, Artificial
  CRISPR gRNA sequence
acatactccttgctgttatg

SEQ ID NO: 636615 - DNA, 20 bp, Artificial
  CRISPR gRNA sequence
cttgctgttatgagttgagt

SEQ ID NO: 636616 - DNA, 20 bp, Artificial
  CRISPR gRNA sequence
gctgttatgagttgagtgag

SEQ ID NO: 636617 - DNA, 20 bp, Artificial
  CRISPR gRNA sequence
ctgttatgagttgagtgagt

SEQ ID NO: 636618 - DNA, 20 bp, Artificial
  CRISPR gRNA sequence
ttatgagttgagtgagtctc

SEQ ID NO: 636619 - DNA, 20 bp, Artificial
  CRISPR gRNA sequence
tgagttgagtgagtctcgta

SEQ ID NO: 636620 - DNA, 20 bp, Artificial
  CRISPR gRNA sequence
agtgagtctcgtattcctag

SEQ ID NO: 636621 - DNA, 20 bp, Artificial
  CRISPR gRNA sequence
gtattcctaggatttgtgga

SEQ ID NO: 636622 - DNA, 20 bp, Artificial
  CRISPR gRNA sequence
ctaggatttgtggaaatctg

SEQ ID NO: 636623 - DNA, 20 bp, Artificial
  CRISPR gRNA sequence
ggatttgtggaaatctgtat

SEQ ID NO: 636624 - DNA, 20 bp, Artificial
  CRISPR gRNA sequence
gtggaaatctgtataactgt

SEQ ID NO: 636625 - DNA, 20 bp, Artificial
  CRISPR gRNA sequence
tggaaatctgtataactgtt

SEQ ID NO: 636626 - DNA, 20 bp, Artificial
  CRISPR gRNA sequence
tataactgtttataaacttt

SEQ ID NO: 636627 - DNA, 20 bp, Artificial
  CRISPR gRNA sequence
tttataaactttattatgcc

SEQ ID NO: 636628 - DNA, 20 bp, Artificial
  CRISPR gRNA sequence
ataaactttattatgccaat

SEQ ID NO: 636629 - DNA, 20 bp, Artificial
  CRISPR gRNA sequence
taaactttattatgccaatt

SEQ ID NO: 636630 - DNA, 20 bp, Artificial
  CRISPR gRNA sequence
tattatgccaattagattat

SEQ ID NO: 636631 - DNA, 20 bp, Artificial
  CRISPR gRNA sequence
attatgccaattagattatt

SEQ ID NO: 636632 - DNA, 20 bp, Artificial
  CRISPR gRNA sequence
ttatgccaattagattattt

SEQ ID NO: 636633 - DNA, 20 bp, Artificial
  CRISPR gRNA sequence
tgccaattagattattttca

SEQ ID NO: 636634 - DNA, 20 bp, Artificial
  CRISPR gRNA sequence
gattattttcaaaaataaaa

SEQ ID NO: 636635 - DNA, 20 bp, Artificial
  CRISPR gRNA sequence
ttttcaaaaataaaataatt

SEQ ID NO: 636636 - DNA, 20 bp, Artificial
  CRISPR gRNA sequence
tcaaaaataaaataattcaa

SEQ ID NO: 636637 - DNA, 20 bp, Artificial
  CRISPR gRNA sequence
caaaaataaaataattcaac

SEQ ID NO: 636638 - DNA, 20 bp, Artificial
  CRISPR gRNA sequence
aaaaataaaataattcaact

SEQ ID NO: 636639 - DNA, 20 bp, Artificial
  CRISPR gRNA sequence
aactctaccacactagtaaa

SEQ ID NO: 636640 - DNA, 20 bp, Artificial
  CRISPR gRNA sequence
taccacactagtaaataaca

SEQ ID NO: 636641 - DNA, 20 bp, Artificial
  CRISPR gRNA sequence
ccacactagtaaataacaaa

SEQ ID NO: 636642 - DNA, 20 bp, Artificial
  CRISPR gRNA sequence
gtaaataacaaaaggacagt

SEQ ID NO: 636643 - DNA, 20 bp, Artificial
  CRISPR gRNA sequence
ttattttatttacaaattaa

SEQ ID NO: 636644 - DNA, 20 bp, Artificial
  CRISPR gRNA sequence
ttttatttacaaattaacaa

SEQ ID NO: 636645 - DNA, 20 bp, Artificial
  CRISPR gRNA sequence
tatttacaaattaacaatcc

SEQ ID NO: 636646 - DNA, 20 bp, Artificial
  CRISPR gRNA sequence
atttacaaattaacaatcct

SEQ ID NO: 636647 - DNA, 20 bp, Artificial
  CRISPR gRNA sequence
tttacaaattaacaatcctc

SEQ ID NO: 636648 - DNA, 20 bp, Artificial
  CRISPR gRNA sequence
acaaattaacaatcctcatg

SEQ ID NO: 636649 - DNA, 20 bp, Artificial
  CRISPR gRNA sequence
caaattaacaatcctcatga

SEQ ID NO: 636650 - DNA, 20 bp, Artificial
  CRISPR gRNA sequence
acaatcctcatgaatattat

SEQ ID NO: 636651 - DNA, 20 bp, Artificial
  CRISPR gRNA sequence
atgaatattattgtagctac

SEQ ID NO: 636652 - DNA, 20 bp, Artificial
  CRISPR gRNA sequence
ttgtagctacagtgaatcac

SEQ ID NO: 636653 - DNA, 20 bp, Artificial
  CRISPR gRNA sequence
tagctacagtgaatcactga

SEQ ID NO: 636654 - DNA, 20 bp, Artificial
  CRISPR gRNA sequence
cagtgaatcactgattaacc

SEQ ID NO: 636655 - DNA, 20 bp, Artificial
  CRISPR gRNA sequence
attaacctaaattttctaaa

SEQ ID NO: 636656 - DNA, 20 bp, Artificial
  CRISPR gRNA sequence
acctaaattttctaaaaact

SEQ ID NO: 636657 - DNA, 20 bp, Artificial
  CRISPR gRNA sequence
aattttctaaaaactgtact

SEQ ID NO: 636658 - DNA, 20 bp, Artificial
  CRISPR gRNA sequence
tctaaaaactgtactctggt

SEQ ID NO: 636659 - DNA, 20 bp, Artificial
  CRISPR gRNA sequence
ctaaaaactgtactctggtt

SEQ ID NO: 636660 - DNA, 20 bp, Artificial
  CRISPR gRNA sequence
taaaaactgtactctggttc

SEQ ID NO: 636661 - DNA, 20 bp, Artificial
  CRISPR gRNA sequence
aaaactgtactctggttctt

SEQ ID NO: 636662 - DNA, 20 bp, Artificial
  CRISPR gRNA sequence
tactctggttctttgaattt

SEQ ID NO: 636663 - DNA, 20 bp, Artificial
  CRISPR gRNA sequence
tggttctttgaattttctta

SEQ ID NO: 636664 - DNA, 20 bp, Artificial
  CRISPR gRNA sequence
gttctttgaattttcttaat

SEQ ID NO: 636665 - DNA, 20 bp, Artificial
  CRISPR gRNA sequence
tttgaattttcttaattcag

SEQ ID NO: 636666 - DNA, 20 bp, Artificial
  CRISPR gRNA sequence
tgaattttcttaattcagaa

SEQ ID NO: 636667 - DNA, 20 bp, Artificial
  CRISPR gRNA sequence
gaattttcttaattcagaac

SEQ ID NO: 636668 - DNA, 20 bp, Artificial
  CRISPR gRNA sequence
aattttcttaattcagaaca

SEQ ID NO: 636669 - DNA, 20 bp, Artificial
  CRISPR gRNA sequence
tcttaattcagaacataaaa

SEQ ID NO: 636670 - DNA, 20 bp, Artificial
  CRISPR gRNA sequence
cttaattcagaacataaaag

SEQ ID NO: 636671 - DNA, 20 bp, Artificial
  CRISPR gRNA sequence
ttaattcagaacataaaaga

SEQ ID NO: 636672 - DNA, 20 bp, Artificial
  CRISPR gRNA sequence
aattcagaacataaaagatc

SEQ ID NO: 636673 - DNA, 20 bp, Artificial
  CRISPR gRNA sequence
attcagaacataaaagatca

SEQ ID NO: 636674 - DNA, 20 bp, Artificial
  CRISPR gRNA sequence
agaacataaaagatcaatta

SEQ ID NO: 636675 - DNA, 20 bp, Artificial
  CRISPR gRNA sequence
aaaatcttctaaatactgtt

SEQ ID NO: 636676 - DNA, 20 bp, Artificial
  CRISPR gRNA sequence
ctaaatactgtttttagttt

SEQ ID NO: 636677 - DNA, 20 bp, Artificial
  CRISPR gRNA sequence
taaatactgtttttagttta

SEQ ID NO: 636678 - DNA, 20 bp, Artificial
  CRISPR gRNA sequence
aatactgtttttagtttatt

SEQ ID NO: 636679 - DNA, 20 bp, Artificial
  CRISPR gRNA sequence
tttttagtttattttttagc

SEQ ID NO: 636680 - DNA, 20 bp, Artificial
  CRISPR gRNA sequence
ttagtttattttttagctta

SEQ ID NO: 636681 - DNA, 20 bp, Artificial
  CRISPR gRNA sequence
tagtttattttttagcttaa

SEQ ID NO: 636682 - DNA, 20 bp, Artificial
  CRISPR gRNA sequence
agtttattttttagcttaaa

SEQ ID NO: 636683 - DNA, 20 bp, Artificial
  CRISPR gRNA sequence
gtttattttttagcttaaaa

SEQ ID NO: 636684 - DNA, 20 bp, Artificial
  CRISPR gRNA sequence
attttttagcttaaaattta

SEQ ID NO: 636685 - DNA, 20 bp, Artificial
  CRISPR gRNA sequence
ttttttagcttaaaatttaa

SEQ ID NO: 636686 - DNA, 20 bp, Artificial
  CRISPR gRNA sequence
tttagcttaaaatttaacat

SEQ ID NO: 636687 - DNA, 20 bp, Artificial
  CRISPR gRNA sequence
ttagcttaaaatttaacatt

SEQ ID NO: 636688 - DNA, 20 bp, Artificial
  CRISPR gRNA sequence
tagcttaaaatttaacattg

SEQ ID NO: 636689 - DNA, 20 bp, Artificial
  CRISPR gRNA sequence
agcttaaaatttaacattgc

SEQ ID NO: 636690 - DNA, 20 bp, Artificial
  CRISPR gRNA sequence
gcttaaaatttaacattgca

SEQ ID NO: 636691 - DNA, 20 bp, Artificial
  CRISPR gRNA sequence
aaaatttaacattgcatgca

SEQ ID NO: 636692 - DNA, 20 bp, Artificial
  CRISPR gRNA sequence
aaatttaacattgcatgcaa

SEQ ID NO: 636693 - DNA, 20 bp, Artificial
  CRISPR gRNA sequence
aacattgcatgcaattcaac

SEQ ID NO: 636694 - DNA, 20 bp, Artificial
  CRISPR gRNA sequence
acattgcatgcaattcaact

SEQ ID NO: 636695 - DNA, 20 bp, Artificial
  CRISPR gRNA sequence
catgcaattcaactgaaaag

SEQ ID NO: 636696 - DNA, 20 bp, Artificial
  CRISPR gRNA sequence
aactgaaaagccattagact

SEQ ID NO: 636697 - DNA, 20 bp, Artificial
  CRISPR gRNA sequence
aaaagccattagactgactg

SEQ ID NO: 636698 - DNA, 20 bp, Artificial
  CRISPR gRNA sequence
gactgactgtgttttgtttg

SEQ ID NO: 636699 - DNA, 20 bp, Artificial
  CRISPR gRNA sequence
actgtgttttgtttgtattt

SEQ ID NO: 636700 - DNA, 20 bp, Artificial
  CRISPR gRNA sequence
tgttttgtttgtattttact

SEQ ID NO: 636701 - DNA, 20 bp, Artificial
  CRISPR gRNA sequence
tgtttgtattttactagata

SEQ ID NO: 636702 - DNA, 20 bp, Artificial
  CRISPR gRNA sequence
gtttgtattttactagatag

SEQ ID NO: 636703 - DNA, 20 bp, Artificial
  CRISPR gRNA sequence
tttgtattttactagatagg

SEQ ID NO: 636704 - DNA, 20 bp, Artificial
  CRISPR gRNA sequence
gtattttactagataggaga

SEQ ID NO: 636705 - DNA, 20 bp, Artificial
  CRISPR gRNA sequence
tattttactagataggagaa

SEQ ID NO: 636706 - DNA, 20 bp, Artificial
  CRISPR gRNA sequence
tactagataggagaagttac

SEQ ID NO: 636707 - DNA, 20 bp, Artificial
  CRISPR gRNA sequence
actagataggagaagttaca

SEQ ID NO: 636708 - DNA, 20 bp, Artificial
  CRISPR gRNA sequence
ctagataggagaagttacac

SEQ ID NO: 636709 - DNA, 20 bp, Artificial
  CRISPR gRNA sequence
gataggagaagttacacatt

SEQ ID NO: 636710 - DNA, 20 bp, Artificial
  CRISPR gRNA sequence
cacatttgaatgagtgttat

SEQ ID NO: 636711 - DNA, 20 bp, Artificial
  CRISPR gRNA sequence
gaatgagtgttatcttcctt

SEQ ID NO: 636712 - DNA, 20 bp, Artificial
  CRISPR gRNA sequence
aatgagtgttatcttcctta

SEQ ID NO: 636713 - DNA, 20 bp, Artificial
  CRISPR gRNA sequence
tcttccttaatacaatcact

SEQ ID NO: 636714 - DNA, 20 bp, Artificial
  CRISPR gRNA sequence
ccttaatacaatcactctta

SEQ ID NO: 636715 - DNA, 20 bp, Artificial
  CRISPR gRNA sequence
cttaatacaatcactcttac

SEQ ID NO: 636716 - DNA, 20 bp, Artificial
  CRISPR gRNA sequence
aatacaatcactcttacata

SEQ ID NO: 636717 - DNA, 20 bp, Artificial
  CRISPR gRNA sequence
atacaatcactcttacataa

SEQ ID NO: 636718 - DNA, 20 bp, Artificial
  CRISPR gRNA sequence
ttacataatgaatatattat

SEQ ID NO: 636719 - DNA, 20 bp, Artificial
  CRISPR gRNA sequence
acataatgaatatattataa

SEQ ID NO: 636720 - DNA, 20 bp, Artificial
  CRISPR gRNA sequence
cataatgaatatattataac

SEQ ID NO: 636721 - DNA, 20 bp, Artificial
  CRISPR gRNA sequence
taactttgtggaacttgttt

SEQ ID NO: 636722 - DNA, 20 bp, Artificial
  CRISPR gRNA sequence
tgtggaacttgtttttagaa

SEQ ID NO: 636723 - DNA, 20 bp, Artificial
  CRISPR gRNA sequence
gtggaacttgtttttagaac

SEQ ID NO: 636724 - DNA, 20 bp, Artificial
  CRISPR gRNA sequence
tggaacttgtttttagaact

SEQ ID NO: 636725 - DNA, 20 bp, Artificial
  CRISPR gRNA sequence
gtttttagaactgtcgttag

SEQ ID NO: 636726 - DNA, 20 bp, Artificial
  CRISPR gRNA sequence
tttttagaactgtcgttaga

SEQ ID NO: 636727 - DNA, 20 bp, Artificial
  CRISPR gRNA sequence
ttagaactgtcgttagaatt

SEQ ID NO: 636728 - DNA, 20 bp, Artificial
  CRISPR gRNA sequence
tagaactgtcgttagaatta

SEQ ID NO: 636729 - DNA, 20 bp, Artificial
  CRISPR gRNA sequence
agaactgtcgttagaattag

SEQ ID NO: 636730 - DNA, 20 bp, Artificial
  CRISPR gRNA sequence
gaactgtcgttagaattagt

SEQ ID NO: 636731 - DNA, 20 bp, Artificial
  CRISPR gRNA sequence
tcgttagaattagttcatga

SEQ ID NO: 636732 - DNA, 20 bp, Artificial
  CRISPR gRNA sequence
gaattagttcatgagcgtag

SEQ ID NO: 636733 - DNA, 20 bp, Artificial
  CRISPR gRNA sequence
gttcatgagcgtagatgaaa

SEQ ID NO: 636734 - DNA, 20 bp, Artificial
  CRISPR gRNA sequence
atgagcgtagatgaaaagta

SEQ ID NO: 636735 - DNA, 20 bp, Artificial
  CRISPR gRNA sequence
ttttatagtcttttcccttt

SEQ ID NO: 636736 - DNA, 20 bp, Artificial
  CRISPR gRNA sequence
tatagtcttttccctttact

SEQ ID NO: 636737 - DNA, 20 bp, Artificial
  CRISPR gRNA sequence
atagtcttttccctttactt

SEQ ID NO: 636738 - DNA, 20 bp, Artificial
  CRISPR gRNA sequence
tagtcttttccctttacttt

SEQ ID NO: 636739 - DNA, 20 bp, Artificial
  CRISPR gRNA sequence
ttccctttactttttatcaa

SEQ ID NO: 636740 - DNA, 20 bp, Artificial
  CRISPR gRNA sequence
tccctttactttttatcaaa

SEQ ID NO: 636741 - DNA, 20 bp, Artificial
  CRISPR gRNA sequence
ccctttactttttatcaaat

SEQ ID NO: 636742 - DNA, 20 bp, Artificial
  CRISPR gRNA sequence
cctttactttttatcaaata

SEQ ID NO: 636743 - DNA, 20 bp, Artificial
  CRISPR gRNA sequence
tactttttatcaaatagata

SEQ ID NO: 636744 - DNA, 20 bp, Artificial
  CRISPR gRNA sequence
actttttatcaaatagatac

SEQ ID NO: 636745 - DNA, 20 bp, Artificial
  CRISPR gRNA sequence
ctttttatcaaatagatacc

SEQ ID NO: 636746 - DNA, 20 bp, Artificial
  CRISPR gRNA sequence
tttatcaaatagataccaag

SEQ ID NO: 636747 - DNA, 20 bp, Artificial
  CRISPR gRNA sequence
ttatcaaatagataccaagc

SEQ ID NO: 636748 - DNA, 20 bp, Artificial
  CRISPR gRNA sequence
tatcaaatagataccaagct

SEQ ID NO: 636749 - DNA, 20 bp, Artificial
  CRISPR gRNA sequence
atcaaatagataccaagctt

SEQ ID NO: 636750 - DNA, 20 bp, Artificial
  CRISPR gRNA sequence
tcaaatagataccaagcttg

SEQ ID NO: 636751 - DNA, 20 bp, Artificial
  CRISPR gRNA sequence
gatctttcaaccttttctaa

SEQ ID NO: 636752 - DNA, 20 bp, Artificial
  CRISPR gRNA sequence
atctttcaaccttttctaag

SEQ ID NO: 636753 - DNA, 20 bp, Artificial
  CRISPR gRNA sequence
tcaaccttttctaagacact

SEQ ID NO: 636754 - DNA, 20 bp, Artificial
  CRISPR gRNA sequence
caaccttttctaagacactt

SEQ ID NO: 636755 - DNA, 20 bp, Artificial
  CRISPR gRNA sequence
aaccttttctaagacactta

SEQ ID NO: 636756 - DNA, 20 bp, Artificial
  CRISPR gRNA sequence
ttctaagacacttaaaaatt

SEQ ID NO: 636757 - DNA, 20 bp, Artificial
  CRISPR gRNA sequence
tctaagacacttaaaaatta

SEQ ID NO: 636758 - DNA, 20 bp, Artificial
  CRISPR gRNA sequence
ctaagacacttaaaaattaa

SEQ ID NO: 636759 - DNA, 20 bp, Artificial
  CRISPR gRNA sequence
taagacacttaaaaattaaa

SEQ ID NO: 636760 - DNA, 20 bp, Artificial
  CRISPR gRNA sequence
agacacttaaaaattaaaga

SEQ ID NO: 636761 - DNA, 20 bp, Artificial
  CRISPR gRNA sequence
aaaaattaaagaaaaaagtt

SEQ ID NO: 636762 - DNA, 20 bp, Artificial
  CRISPR gRNA sequence
aaaattaaagaaaaaagtta

SEQ ID NO: 636763 - DNA, 20 bp, Artificial
  CRISPR gRNA sequence
aagaaaaaagttacactagt

SEQ ID NO: 636764 - DNA, 20 bp, Artificial
  CRISPR gRNA sequence
cactagtaatataaatattt

SEQ ID NO: 636765 - DNA, 20 bp, Artificial
  CRISPR gRNA sequence
gtaatataaatatttttaaa

SEQ ID NO: 636766 - DNA, 20 bp, Artificial
  CRISPR gRNA sequence
ttaaaacatcgtgctgttta

SEQ ID NO: 636767 - DNA, 20 bp, Artificial
  CRISPR gRNA sequence
taaaacatcgtgctgtttaa

SEQ ID NO: 636768 - DNA, 20 bp, Artificial
  CRISPR gRNA sequence
aaaacatcgtgctgtttaaa

SEQ ID NO: 636769 - DNA, 20 bp, Artificial
  CRISPR gRNA sequence
aaacatcgtgctgtttaaaa

SEQ ID NO: 636770 - DNA, 20 bp, Artificial
  CRISPR gRNA sequence
tttaaaaaggagataaaaaa

SEQ ID NO: 636771 - DNA, 20 bp, Artificial
  CRISPR gRNA sequence
aaaaaggagataaaaaacga

SEQ ID NO: 636772 - DNA, 20 bp, Artificial
  CRISPR gRNA sequence
aaaaggagataaaaaacgaa

SEQ ID NO: 636773 - DNA, 20 bp, Artificial
  CRISPR gRNA sequence
actgtatgattggaataagt

SEQ ID NO: 636774 - DNA, 20 bp, Artificial
  CRISPR gRNA sequence
tatgattggaataagtatat

SEQ ID NO: 636775 - DNA, 20 bp, Artificial
  CRISPR gRNA sequence
gaataagtatatatgttcta

SEQ ID NO: 636776 - DNA, 20 bp, Artificial
  CRISPR gRNA sequence
taaagctgatgattttgatt

SEQ ID NO: 636777 - DNA, 20 bp, Artificial
  CRISPR gRNA sequence
aagctgatgattttgattat

SEQ ID NO: 636778 - DNA, 20 bp, Artificial
  CRISPR gRNA sequence
atgattttgattatgataac

SEQ ID NO: 636779 - DNA, 20 bp, Artificial
  CRISPR gRNA sequence
tgattatgataacactgatt

SEQ ID NO: 636780 - DNA, 20 bp, Artificial
  CRISPR gRNA sequence
gattatgataacactgattt

SEQ ID NO: 636781 - DNA, 20 bp, Artificial
  CRISPR gRNA sequence
attatgataacactgatttt

SEQ ID NO: 636782 - DNA, 20 bp, Artificial
  CRISPR gRNA sequence
tgataacactgattttaatg

SEQ ID NO: 636783 - DNA, 20 bp, Artificial
  CRISPR gRNA sequence
attttaatgtataacttctc

SEQ ID NO: 636784 - DNA, 20 bp, Artificial
  CRISPR gRNA sequence
taatgtataacttctcactg

SEQ ID NO: 636785 - DNA, 20 bp, Artificial
  CRISPR gRNA sequence
aatgtataacttctcactgt

SEQ ID NO: 636786 - DNA, 20 bp, Artificial
  CRISPR gRNA sequence
atgtataacttctcactgta

SEQ ID NO: 636787 - DNA, 20 bp, Artificial
  CRISPR gRNA sequence
ctcactgtaatttttaagat

SEQ ID NO: 636788 - DNA, 20 bp, Artificial
  CRISPR gRNA sequence
tcactgtaatttttaagata

SEQ ID NO: 636789 - DNA, 20 bp, Artificial
  CRISPR gRNA sequence
actgtaatttttaagatatc

SEQ ID NO: 636790 - DNA, 20 bp, Artificial
  CRISPR gRNA sequence
taatttttaagatatcagcc

SEQ ID NO: 636791 - DNA, 20 bp, Artificial
  CRISPR gRNA sequence
ttaagatatcagccttagtt

SEQ ID NO: 636792 - DNA, 20 bp, Artificial
  CRISPR gRNA sequence
taagatatcagccttagttt

SEQ ID NO: 636793 - DNA, 20 bp, Artificial
  CRISPR gRNA sequence
aagatatcagccttagttta

SEQ ID NO: 636794 - DNA, 20 bp, Artificial
  CRISPR gRNA sequence
agatatcagccttagtttac

SEQ ID NO: 636795 - DNA, 20 bp, Artificial
  CRISPR gRNA sequence
agtttacagtcataccttat

SEQ ID NO: 636796 - DNA, 20 bp, Artificial
  CRISPR gRNA sequence
gtttacagtcataccttata

SEQ ID NO: 636797 - DNA, 20 bp, Artificial
  CRISPR gRNA sequence
acagtcataccttataataa

SEQ ID NO: 636798 - DNA, 20 bp, Artificial
  CRISPR gRNA sequence
cagtcataccttataataaa

SEQ ID NO: 636799 - DNA, 20 bp, Artificial
  CRISPR gRNA sequence
ataataaattcttggtatac

SEQ ID NO: 636800 - DNA, 20 bp, Artificial
  CRISPR gRNA sequence
taataaattcttggtatact

SEQ ID NO: 636801 - DNA, 20 bp, Artificial
  CRISPR gRNA sequence
ttggtatactgacataccaa

SEQ ID NO: 636802 - DNA, 20 bp, Artificial
  CRISPR gRNA sequence
ggtatactgacataccaagc

SEQ ID NO: 636803 - DNA, 20 bp, Artificial
  CRISPR gRNA sequence
gtatactgacataccaagca

SEQ ID NO: 636804 - DNA, 20 bp, Artificial
  CRISPR gRNA sequence
acataccaagcaatagtgtg

SEQ ID NO: 636805 - DNA, 20 bp, Artificial
  CRISPR gRNA sequence
aacaaaaccagtatgggcat

SEQ ID NO: 636806 - DNA, 20 bp, Artificial
  CRISPR gRNA sequence
gttctagcttcagcaatgcc

SEQ ID NO: 636807 - DNA, 20 bp, Artificial
  CRISPR gRNA sequence
tagcttcagcaatgccttta

SEQ ID NO: 636808 - DNA, 20 bp, Artificial
  CRISPR gRNA sequence
gcttcagcaatgcctttacc

SEQ ID NO: 636809 - DNA, 20 bp, Artificial
  CRISPR gRNA sequence
cagcaatgcctttacctaca

SEQ ID NO: 636810 - DNA, 20 bp, Artificial
  CRISPR gRNA sequence
agcaatgcctttacctacat

SEQ ID NO: 636811 - DNA, 20 bp, Artificial
  CRISPR gRNA sequence
tacctacataagggataatg

SEQ ID NO: 636812 - DNA, 20 bp, Artificial
  CRISPR gRNA sequence
acctacataagggataatgg

SEQ ID NO: 636813 - DNA, 20 bp, Artificial
  CRISPR gRNA sequence
cctacataagggataatgga

SEQ ID NO: 636814 - DNA, 20 bp, Artificial
  CRISPR gRNA sequence
cataagggataatggacaaa

SEQ ID NO: 636815 - DNA, 20 bp, Artificial
  CRISPR gRNA sequence
gactatttcttcatgtgtat

SEQ ID NO: 636816 - DNA, 20 bp, Artificial
  CRISPR gRNA sequence
actatttcttcatgtgtatt

SEQ ID NO: 636817 - DNA, 20 bp, Artificial
  CRISPR gRNA sequence
tttcttcatgtgtattatga

SEQ ID NO: 636818 - DNA, 20 bp, Artificial
  CRISPR gRNA sequence
cttcatgtgtattatgaaag

SEQ ID NO: 636819 - DNA, 20 bp, Artificial
  CRISPR gRNA sequence
ttcatgtgtattatgaaagg

SEQ ID NO: 636820 - DNA, 20 bp, Artificial
  CRISPR gRNA sequence
catgtgtattatgaaaggtt

SEQ ID NO: 636821 - DNA, 20 bp, Artificial
  CRISPR gRNA sequence
atgtgtattatgaaaggttc

SEQ ID NO: 636822 - DNA, 20 bp, Artificial
  CRISPR gRNA sequence
tgaaaggttcgtattaaaaa

SEQ ID NO: 636823 - DNA, 20 bp, Artificial
  CRISPR gRNA sequence
gtattaaaaaagactttgac

SEQ ID NO: 636824 - DNA, 20 bp, Artificial
  CRISPR gRNA sequence
aaaaagactttgacctacct

SEQ ID NO: 636825 - DNA, 20 bp, Artificial
  CRISPR gRNA sequence
tgacctaccttgtatcttta

SEQ ID NO: 636826 - DNA, 20 bp, Artificial
  CRISPR gRNA sequence
gacctaccttgtatctttaa

SEQ ID NO: 636827 - DNA, 20 bp, Artificial
  CRISPR gRNA sequence
acctaccttgtatctttaat

SEQ ID NO: 636828 - DNA, 20 bp, Artificial
  CRISPR gRNA sequence
ccttgtatctttaatgtttt

SEQ ID NO: 636829 - DNA, 20 bp, Artificial
  CRISPR gRNA sequence
gtatctttaatgttttaagc

SEQ ID NO: 636830 - DNA, 20 bp, Artificial
  CRISPR gRNA sequence
tatctttaatgttttaagca

SEQ ID NO: 636831 - DNA, 20 bp, Artificial
  CRISPR gRNA sequence
taatgttttaagcacgtaat

SEQ ID NO: 636832 - DNA, 20 bp, Artificial
  CRISPR gRNA sequence
aatgttttaagcacgtaatt

SEQ ID NO: 636833 - DNA, 20 bp, Artificial
  CRISPR gRNA sequence
atgttttaagcacgtaattg

SEQ ID NO: 636834 - DNA, 20 bp, Artificial
  CRISPR gRNA sequence
taagcacgtaattgttaaac

SEQ ID NO: 636835 - DNA, 20 bp, Artificial
  CRISPR gRNA sequence
aagcacgtaattgttaaact

SEQ ID NO: 636836 - DNA, 20 bp, Artificial
  CRISPR gRNA sequence
agcacgtaattgttaaacta

SEQ ID NO: 636837 - DNA, 20 bp, Artificial
  CRISPR gRNA sequence
ttaaactatttagaaataaa

SEQ ID NO: 636838 - DNA, 20 bp, Artificial
  CRISPR gRNA sequence
aactatttagaaataaaact

SEQ ID NO: 636839 - DNA, 20 bp, Artificial
  CRISPR gRNA sequence
tttagaaataaaacttttaa

SEQ ID NO: 636840 - DNA, 20 bp, Artificial
  CRISPR gRNA sequence
agaaataaaacttttaaata

SEQ ID NO: 636841 - DNA, 20 bp, Artificial
  CRISPR gRNA sequence
gaaataaaacttttaaataa

SEQ ID NO: 636842 - DNA, 20 bp, Artificial
  CRISPR gRNA sequence
ttaaataaatttattgtgat

SEQ ID NO: 636843 - DNA, 20 bp, Artificial
  CRISPR gRNA sequence
taaataaatttattgtgatt

SEQ ID NO: 636844 - DNA, 20 bp, Artificial
  CRISPR gRNA sequence
aaataaatttattgtgattt

SEQ ID NO: 636845 - DNA, 20 bp, Artificial
  CRISPR gRNA sequence
aataaatttattgtgattta

SEQ ID NO: 636846 - DNA, 20 bp, Artificial
  CRISPR gRNA sequence
attgtgatttatatttcttc

SEQ ID NO: 636847 - DNA, 20 bp, Artificial
  CRISPR gRNA sequence
ttgtgatttatatttcttcc

SEQ ID NO: 636848 - DNA, 20 bp, Artificial
  CRISPR gRNA sequence
tgatttatatttcttccaaa

SEQ ID NO: 636849 - DNA, 20 bp, Artificial
  CRISPR gRNA sequence
atatttcttccaaaaaagta

SEQ ID NO: 636850 - DNA, 20 bp, Artificial
  CRISPR gRNA sequence
tatttcttccaaaaaagtat

SEQ ID NO: 636851 - DNA, 20 bp, Artificial
  CRISPR gRNA sequence
cttccaaaaaagtatatttt

SEQ ID NO: 636852 - DNA, 20 bp, Artificial
  CRISPR gRNA sequence
ttccaaaaaagtatatttta

SEQ ID NO: 636853 - DNA, 20 bp, Artificial
  CRISPR gRNA sequence
ccaaaaaagtatattttaaa

SEQ ID NO: 636854 - DNA, 20 bp, Artificial
  CRISPR gRNA sequence
caaaaaagtatattttaaaa

SEQ ID NO: 636855 - DNA, 20 bp, Artificial
  CRISPR gRNA sequence
taaaactctgagaatattag

SEQ ID NO: 636856 - DNA, 20 bp, Artificial
  CRISPR gRNA sequence
aaaactctgagaatattagt

SEQ ID NO: 636857 - DNA, 20 bp, Artificial
  CRISPR gRNA sequence
aaactctgagaatattagtt

SEQ ID NO: 636858 - DNA, 20 bp, Artificial
  CRISPR gRNA sequence
tgagaatattagttattaat

SEQ ID NO: 636859 - DNA, 20 bp, Artificial
  CRISPR gRNA sequence
agaatattagttattaatat

SEQ ID NO: 636860 - DNA, 20 bp, Artificial
  CRISPR gRNA sequence
gttattaatattttactgta

SEQ ID NO: 636861 - DNA, 20 bp, Artificial
  CRISPR gRNA sequence
ttaatattttactgtacact

SEQ ID NO: 636862 - DNA, 20 bp, Artificial
  CRISPR gRNA sequence
atattttactgtacactaca

SEQ ID NO: 636863 - DNA, 20 bp, Artificial
  CRISPR gRNA sequence
tactgtacactacactactt

SEQ ID NO: 636864 - DNA, 20 bp, Artificial
  CRISPR gRNA sequence
actgtacactacactacttt

SEQ ID NO: 636865 - DNA, 20 bp, Artificial
  CRISPR gRNA sequence
ctgtacactacactactttg

SEQ ID NO: 636866 - DNA, 20 bp, Artificial
  CRISPR gRNA sequence
tacactacactactttgcat

SEQ ID NO: 636867 - DNA, 20 bp, Artificial
  CRISPR gRNA sequence
cactactttgcattatagtg

SEQ ID NO: 636868 - DNA, 20 bp, Artificial
  CRISPR gRNA sequence
ctttgcattatagtgaaagc

SEQ ID NO: 636869 - DNA, 20 bp, Artificial
  CRISPR gRNA sequence
tgcattatagtgaaagccat

SEQ ID NO: 636870 - DNA, 20 bp, Artificial
  CRISPR gRNA sequence
gcattatagtgaaagccatc

SEQ ID NO: 636871 - DNA, 20 bp, Artificial
  CRISPR gRNA sequence
cattatagtgaaagccatca

SEQ ID NO: 636872 - DNA, 20 bp, Artificial
  CRISPR gRNA sequence
tagtgaaagccatcattacc

SEQ ID NO: 636873 - DNA, 20 bp, Artificial
  CRISPR gRNA sequence
ccattaaaccaattttcata

SEQ ID NO: 636874 - DNA, 20 bp, Artificial
  CRISPR gRNA sequence
aaccaattttcatatgaact

SEQ ID NO: 636875 - DNA, 20 bp, Artificial
  CRISPR gRNA sequence
tcatatgaacttgaatcttt

SEQ ID NO: 636876 - DNA, 20 bp, Artificial
  CRISPR gRNA sequence
catatgaacttgaatctttt

SEQ ID NO: 636877 - DNA, 20 bp, Artificial
  CRISPR gRNA sequence
atatgaacttgaatcttttt

SEQ ID NO: 636878 - DNA, 20 bp, Artificial
  CRISPR gRNA sequence
gaatcttttttgttaagagt

SEQ ID NO: 636879 - DNA, 20 bp, Artificial
  CRISPR gRNA sequence
aatcttttttgttaagagtc

SEQ ID NO: 636880 - DNA, 20 bp, Artificial
  CRISPR gRNA sequence
ttttgttaagagtcaacgat

SEQ ID NO: 636881 - DNA, 20 bp, Artificial
  CRISPR gRNA sequence
tttgttaagagtcaacgatc

SEQ ID NO: 636882 - DNA, 20 bp, Artificial
  CRISPR gRNA sequence
ttgttaagagtcaacgatcc

SEQ ID NO: 636883 - DNA, 20 bp, Artificial
  CRISPR gRNA sequence
tgttaagagtcaacgatcct

SEQ ID NO: 636884 - DNA, 20 bp, Artificial
  CRISPR gRNA sequence
gttaagagtcaacgatcctc

SEQ ID NO: 636885 - DNA, 20 bp, Artificial
  CRISPR gRNA sequence
ttaagagtcaacgatcctcc

SEQ ID NO: 636886 - DNA, 20 bp, Artificial
  CRISPR gRNA sequence
agagtcaacgatcctcctag

SEQ ID NO: 636887 - DNA, 20 bp, Artificial
  CRISPR gRNA sequence
ctagcttaccacttactatc

SEQ ID NO: 636888 - DNA, 20 bp, Artificial
  CRISPR gRNA sequence
gcttaccacttactatctca

SEQ ID NO: 636889 - DNA, 20 bp, Artificial
  CRISPR gRNA sequence
accacttactatctcatttc

SEQ ID NO: 636890 - DNA, 20 bp, Artificial
  CRISPR gRNA sequence
ccacttactatctcatttct

SEQ ID NO: 636891 - DNA, 20 bp, Artificial
  CRISPR gRNA sequence
actatctcatttctgttgct

SEQ ID NO: 636892 - DNA, 20 bp, Artificial
  CRISPR gRNA sequence
ctatctcatttctgttgctt

SEQ ID NO: 636893 - DNA, 20 bp, Artificial
  CRISPR gRNA sequence
tctcatttctgttgcttttt

SEQ ID NO: 636894 - DNA, 20 bp, Artificial
  CRISPR gRNA sequence
atttctgttgctttttaaga

SEQ ID NO: 636895 - DNA, 20 bp, Artificial
  CRISPR gRNA sequence
ctgttgctttttaagaaaaa

SEQ ID NO: 636896 - DNA, 20 bp, Artificial
  CRISPR gRNA sequence
tgttgctttttaagaaaaaa

SEQ ID NO: 636897 - DNA, 20 bp, Artificial
  CRISPR gRNA sequence
ttgctttttaagaaaaaaaa

SEQ ID NO: 636898 - DNA, 20 bp, Artificial
  CRISPR gRNA sequence
ctttttaagaaaaaaaaatt

SEQ ID NO: 636899 - DNA, 20 bp, Artificial
  CRISPR gRNA sequence
tttaagaaaaaaaaattggc

SEQ ID NO: 636900 - DNA, 20 bp, Artificial
  CRISPR gRNA sequence
ttaagaaaaaaaaattggca

SEQ ID NO: 636901 - DNA, 20 bp, Artificial
  CRISPR gRNA sequence
taagaaaaaaaaattggcaa

SEQ ID NO: 636902 - DNA, 20 bp, Artificial
  CRISPR gRNA sequence
aagaaaaaaaaattggcaaa

SEQ ID NO: 636903 - DNA, 20 bp, Artificial
  CRISPR gRNA sequence
agaaaaaaaaattggcaaag

SEQ ID NO: 636904 - DNA, 20 bp, Artificial
  CRISPR gRNA sequence
gcaaagggtttaaaaagatt

SEQ ID NO: 636905 - DNA, 20 bp, Artificial
  CRISPR gRNA sequence
aaaaagatttaaataagacc

SEQ ID NO: 636906 - DNA, 20 bp, Artificial
  CRISPR gRNA sequence
aaaagatttaaataagacct

SEQ ID NO: 636907 - DNA, 20 bp, Artificial
  CRISPR gRNA sequence
aaataagaccttctcatttg

SEQ ID NO: 636908 - DNA, 20 bp, Artificial
  CRISPR gRNA sequence
aataagaccttctcatttgg

SEQ ID NO: 636909 - DNA, 20 bp, Artificial
  CRISPR gRNA sequence
ctcatttggttagttttcac

SEQ ID NO: 636910 - DNA, 20 bp, Artificial
  CRISPR gRNA sequence
tcatttggttagttttcaca

SEQ ID NO: 636911 - DNA, 20 bp, Artificial
  CRISPR gRNA sequence
atttggttagttttcacaaa

SEQ ID NO: 636912 - DNA, 20 bp, Artificial
  CRISPR gRNA sequence
ggttagttttcacaaaaaac

SEQ ID NO: 636913 - DNA, 20 bp, Artificial
  CRISPR gRNA sequence
gttagttttcacaaaaaact

SEQ ID NO: 636914 - DNA, 20 bp, Artificial
  CRISPR gRNA sequence
gttttcacaaaaaacttttc

SEQ ID NO: 636915 - DNA, 20 bp, Artificial
  CRISPR gRNA sequence
tcacaaaaaacttttcacct

SEQ ID NO: 636916 - DNA, 20 bp, Artificial
  CRISPR gRNA sequence
cacaaaaaacttttcacctc

SEQ ID NO: 636917 - DNA, 20 bp, Artificial
  CRISPR gRNA sequence
acaaaaaacttttcacctct

SEQ ID NO: 636918 - DNA, 20 bp, Artificial
  CRISPR gRNA sequence
ttcacctctcaaatgtttaa

SEQ ID NO: 636919 - DNA, 20 bp, Artificial
  CRISPR gRNA sequence
tcacctctcaaatgtttaaa

SEQ ID NO: 636920 - DNA, 20 bp, Artificial
  CRISPR gRNA sequence
cacctctcaaatgtttaaaa

SEQ ID NO: 636921 - DNA, 20 bp, Artificial
  CRISPR gRNA sequence
acctctcaaatgtttaaaaa

SEQ ID NO: 636922 - DNA, 20 bp, Artificial
  CRISPR gRNA sequence
tcaaatgtttaaaaatatag

SEQ ID NO: 636923 - DNA, 20 bp, Artificial
  CRISPR gRNA sequence
aaatgtttaaaaatatagta

SEQ ID NO: 636924 - DNA, 20 bp, Artificial
  CRISPR gRNA sequence
aaaaatatagtatgaattaa

SEQ ID NO: 636925 - DNA, 20 bp, Artificial
  CRISPR gRNA sequence
aaaatatagtatgaattaat

SEQ ID NO: 636926 - DNA, 20 bp, Artificial
  CRISPR gRNA sequence
atctgtgggctttttcctca

SEQ ID NO: 636927 - DNA, 20 bp, Artificial
  CRISPR gRNA sequence
tgggctttttcctcactcta

SEQ ID NO: 636928 - DNA, 20 bp, Artificial
  CRISPR gRNA sequence
tttcctcactctatcccaga

SEQ ID NO: 636929 - DNA, 20 bp, Artificial
  CRISPR gRNA sequence
ttcctcactctatcccagaa

SEQ ID NO: 636930 - DNA, 20 bp, Artificial
  CRISPR gRNA sequence
tcctcactctatcccagaat

SEQ ID NO: 636931 - DNA, 20 bp, Artificial
  CRISPR gRNA sequence
cctcactctatcccagaatt

SEQ ID NO: 636932 - DNA, 20 bp, Artificial
  CRISPR gRNA sequence
ctcactctatcccagaatta

SEQ ID NO: 636933 - DNA, 20 bp, Artificial
  CRISPR gRNA sequence
actctatcccagaattacat

SEQ ID NO: 636934 - DNA, 20 bp, Artificial
  CRISPR gRNA sequence
tatcccagaattacatattc

SEQ ID NO: 636935 - DNA, 20 bp, Artificial
  CRISPR gRNA sequence
tcccagaattacatattcca

SEQ ID NO: 636936 - DNA, 20 bp, Artificial
  CRISPR gRNA sequence
catattccaacctacacacc

SEQ ID NO: 636937 - DNA, 20 bp, Artificial
  CRISPR gRNA sequence
caacctacacaccagccact

SEQ ID NO: 636938 - DNA, 20 bp, Artificial
  CRISPR gRNA sequence
cacaccagccactatttgtc

SEQ ID NO: 636939 - DNA, 20 bp, Artificial
  CRISPR gRNA sequence
tttgtcatattcaatcctac

SEQ ID NO: 636940 - DNA, 20 bp, Artificial
  CRISPR gRNA sequence
gtcatattcaatcctacata

SEQ ID NO: 636941 - DNA, 20 bp, Artificial
  CRISPR gRNA sequence
tcatattcaatcctacatat

SEQ ID NO: 636942 - DNA, 20 bp, Artificial
  CRISPR gRNA sequence
aatcctacatatatccttgc

SEQ ID NO: 636943 - DNA, 20 bp, Artificial
  CRISPR gRNA sequence
catatatccttgcaggagtt

SEQ ID NO: 636944 - DNA, 20 bp, Artificial
  CRISPR gRNA sequence
gcaggagttataaccaacaa

SEQ ID NO: 636945 - DNA, 20 bp, Artificial
  CRISPR gRNA sequence
caggagttataaccaacaat

SEQ ID NO: 636946 - DNA, 20 bp, Artificial
  CRISPR gRNA sequence
taaccaacaattacagaaag

SEQ ID NO: 636947 - DNA, 20 bp, Artificial
  CRISPR gRNA sequence
cagaaagatggcagcatccc

SEQ ID NO: 636948 - DNA, 20 bp, Artificial
  CRISPR gRNA sequence
aactacaaaagcacctgcct

SEQ ID NO: 636949 - DNA, 20 bp, Artificial
  CRISPR gRNA sequence
caaaagcacctgcctgctac

SEQ ID NO: 636950 - DNA, 20 bp, Artificial
  CRISPR gRNA sequence
cctgctactgagacctgtgg

SEQ ID NO: 636951 - DNA, 20 bp, Artificial
  CRISPR gRNA sequence
ctactgagacctgtggtagg

SEQ ID NO: 636952 - DNA, 20 bp, Artificial
  CRISPR gRNA sequence
ctgagacctgtggtaggata

SEQ ID NO: 636953 - DNA, 20 bp, Artificial
  CRISPR gRNA sequence
agacctgtggtaggataggc

SEQ ID NO: 636954 - DNA, 20 bp, Artificial
  CRISPR gRNA sequence
tggtaggataggcagagatc

SEQ ID NO: 636955 - DNA, 20 bp, Artificial
  CRISPR gRNA sequence
tatttcaaggagttaactgg

SEQ ID NO: 636956 - DNA, 20 bp, Artificial
  CRISPR gRNA sequence
caaggagttaactggataaa

SEQ ID NO: 636957 - DNA, 20 bp, Artificial
  CRISPR gRNA sequence
aaggagttaactggataaag

SEQ ID NO: 636958 - DNA, 20 bp, Artificial
  CRISPR gRNA sequence
actggataaagtgaaaatta

SEQ ID NO: 636959 - DNA, 20 bp, Artificial
  CRISPR gRNA sequence
gataaagtgaaaattattca

SEQ ID NO: 636960 - DNA, 20 bp, Artificial
  CRISPR gRNA sequence
ttcacttacataaatgcatg

SEQ ID NO: 636961 - DNA, 20 bp, Artificial
  CRISPR gRNA sequence
acttacataaatgcatgagt

SEQ ID NO: 636962 - DNA, 20 bp, Artificial
  CRISPR gRNA sequence
acataaatgcatgagtgcca

SEQ ID NO: 636963 - DNA, 20 bp, Artificial
  CRISPR gRNA sequence
cataaatgcatgagtgccat

SEQ ID NO: 636964 - DNA, 20 bp, Artificial
  CRISPR gRNA sequence
tgtagtataaactcttatct

SEQ ID NO: 636965 - DNA, 20 bp, Artificial
  CRISPR gRNA sequence
gtagtataaactcttatcta

SEQ ID NO: 636966 - DNA, 20 bp, Artificial
  CRISPR gRNA sequence
tagtataaactcttatctag

SEQ ID NO: 636967 - DNA, 20 bp, Artificial
  CRISPR gRNA sequence
ttatctagcaaactatatta

SEQ ID NO: 636968 - DNA, 20 bp, Artificial
  CRISPR gRNA sequence
atctagcaaactatattacc

SEQ ID NO: 636969 - DNA, 20 bp, Artificial
  CRISPR gRNA sequence
tctagcaaactatattacct

SEQ ID NO: 636970 - DNA, 20 bp, Artificial
  CRISPR gRNA sequence
gcaaactatattacctgccc

SEQ ID NO: 636971 - DNA, 20 bp, Artificial
  CRISPR gRNA sequence
tattacctgcccatgggtat

SEQ ID NO: 636972 - DNA, 20 bp, Artificial
  CRISPR gRNA sequence
cctgcccatgggtatggtaa

SEQ ID NO: 636973 - DNA, 20 bp, Artificial
  CRISPR gRNA sequence
cccatgggtatggtaaaata

SEQ ID NO: 636974 - DNA, 20 bp, Artificial
  CRISPR gRNA sequence
agttacacaatgaaattctc

SEQ ID NO: 636975 - DNA, 20 bp, Artificial
  CRISPR gRNA sequence
cacaatgaaattctcctata

SEQ ID NO: 636976 - DNA, 20 bp, Artificial
  CRISPR gRNA sequence
tcctataccttttgaaccct

SEQ ID NO: 636977 - DNA, 20 bp, Artificial
  CRISPR gRNA sequence
ctataccttttgaaccctta

SEQ ID NO: 636978 - DNA, 20 bp, Artificial
  CRISPR gRNA sequence
taccttttgaacccttatca

SEQ ID NO: 636979 - DNA, 20 bp, Artificial
  CRISPR gRNA sequence
ttgaacccttatcatattat

SEQ ID NO: 636980 - DNA, 20 bp, Artificial
  CRISPR gRNA sequence
tgaacccttatcatattatt

SEQ ID NO: 636981 - DNA, 20 bp, Artificial
  CRISPR gRNA sequence
gaacccttatcatattattg

SEQ ID NO: 636982 - DNA, 20 bp, Artificial
  CRISPR gRNA sequence
aacccttatcatattattgc

SEQ ID NO: 636983 - DNA, 20 bp, Artificial
  CRISPR gRNA sequence
atcatattattgctatatta

SEQ ID NO: 636984 - DNA, 20 bp, Artificial
  CRISPR gRNA sequence
tcatattattgctatattaa

SEQ ID NO: 636985 - DNA, 20 bp, Artificial
  CRISPR gRNA sequence
ttgctatattaagaactgtg

SEQ ID NO: 636986 - DNA, 20 bp, Artificial
  CRISPR gRNA sequence
ctatattaagaactgtggaa

SEQ ID NO: 636987 - DNA, 20 bp, Artificial
  CRISPR gRNA sequence
tattaagaactgtggaaact

SEQ ID NO: 636988 - DNA, 20 bp, Artificial
  CRISPR gRNA sequence
agaactgtggaaactgaatc

SEQ ID NO: 636989 - DNA, 20 bp, Artificial
  CRISPR gRNA sequence
tggaaactgaatcccaaact

SEQ ID NO: 636990 - DNA, 20 bp, Artificial
  CRISPR gRNA sequence
aatcccaaacttcttttctg

SEQ ID NO: 636991 - DNA, 20 bp, Artificial
  CRISPR gRNA sequence
cttttctgatatgctattca

SEQ ID NO: 636992 - DNA, 20 bp, Artificial
  CRISPR gRNA sequence
ttttctgatatgctattcag

SEQ ID NO: 636993 - DNA, 20 bp, Artificial
  CRISPR gRNA sequence
ttctgatatgctattcagat

SEQ ID NO: 636994 - DNA, 20 bp, Artificial
  CRISPR gRNA sequence
tctgatatgctattcagatt

SEQ ID NO: 636995 - DNA, 20 bp, Artificial
  CRISPR gRNA sequence
ctgatatgctattcagattt

SEQ ID NO: 636996 - DNA, 20 bp, Artificial
  CRISPR gRNA sequence
tgatatgctattcagatttg

SEQ ID NO: 636997 - DNA, 20 bp, Artificial
  CRISPR gRNA sequence
atatgctattcagatttgaa

SEQ ID NO: 636998 - DNA, 20 bp, Artificial
  CRISPR gRNA sequence
ttcagatttgaaggctggaa

SEQ ID NO: 636999 - DNA, 20 bp, Artificial
  CRISPR gRNA sequence
agatttgaaggctggaagtc

SEQ ID NO: 637000 - DNA, 20 bp, Artificial
  CRISPR gRNA sequence
gaaggctggaagtcaagacc

SEQ ID NO: 637001 - DNA, 20 bp, Artificial
  CRISPR gRNA sequence
aaggctggaagtcaagaccc

SEQ ID NO: 637002 - DNA, 20 bp, Artificial
  CRISPR gRNA sequence
gaagtcaagacccaggctac

SEQ ID NO: 637003 - DNA, 20 bp, Artificial
  CRISPR gRNA sequence
ctctctgtttttctgcaatc

SEQ ID NO: 637004 - DNA, 20 bp, Artificial
  CRISPR gRNA sequence
tctgtttttctgcaatccaa

SEQ ID NO: 637005 - DNA, 20 bp, Artificial
  CRISPR gRNA sequence
tgtttttctgcaatccaata

SEQ ID NO: 637006 - DNA, 20 bp, Artificial
  CRISPR gRNA sequence
tttttctgcaatccaatact

SEQ ID NO: 637007 - DNA, 20 bp, Artificial
  CRISPR gRNA sequence
ttctgcaatccaatactagc

SEQ ID NO: 637008 - DNA, 20 bp, Artificial
  CRISPR gRNA sequence
tctgcaatccaatactagca

SEQ ID NO: 637009 - DNA, 20 bp, Artificial
  CRISPR gRNA sequence
ctgcaatccaatactagcag

SEQ ID NO: 637010 - DNA, 20 bp, Artificial
  CRISPR gRNA sequence
tgcaatccaatactagcaga

SEQ ID NO: 637011 - DNA, 20 bp, Artificial
  CRISPR gRNA sequence
caatccaatactagcagaat

SEQ ID NO: 637012 - DNA, 20 bp, Artificial
  CRISPR gRNA sequence
gcagaattctgaaaaggtag

SEQ ID NO: 637013 - DNA, 20 bp, Artificial
  CRISPR gRNA sequence
tgaaaaggtagttttcacca

SEQ ID NO: 637014 - DNA, 20 bp, Artificial
  CRISPR gRNA sequence
aaaaggtagttttcaccact

SEQ ID NO: 637015 - DNA, 20 bp, Artificial
  CRISPR gRNA sequence
tcaccactgccacccctgaa

SEQ ID NO: 637016 - DNA, 20 bp, Artificial
  CRISPR gRNA sequence
caccactgccacccctgaat

SEQ ID NO: 637017 - DNA, 20 bp, Artificial
  CRISPR gRNA sequence
accactgccacccctgaata

SEQ ID NO: 637018 - DNA, 20 bp, Artificial
  CRISPR gRNA sequence
ccacccctgaataaaaagga

SEQ ID NO: 637019 - DNA, 20 bp, Artificial
  CRISPR gRNA sequence
aataaaaaggaaagagaata

SEQ ID NO: 637020 - DNA, 20 bp, Artificial
  CRISPR gRNA sequence
ttctttcagctgcttaccag

SEQ ID NO: 637021 - DNA, 20 bp, Artificial
  CRISPR gRNA sequence
tttcagctgcttaccagtgt

SEQ ID NO: 637022 - DNA, 20 bp, Artificial
  CRISPR gRNA sequence
tcagctgcttaccagtgtga

SEQ ID NO: 637023 - DNA, 20 bp, Artificial
  CRISPR gRNA sequence
cagctgcttaccagtgtgac

SEQ ID NO: 637024 - DNA, 20 bp, Artificial
  CRISPR gRNA sequence
agctgcttaccagtgtgact

SEQ ID NO: 637025 - DNA, 20 bp, Artificial
  CRISPR gRNA sequence
cttaccagtgtgactccttt

SEQ ID NO: 637026 - DNA, 20 bp, Artificial
  CRISPR gRNA sequence
accagtgtgactccttttat

SEQ ID NO: 637027 - DNA, 20 bp, Artificial
  CRISPR gRNA sequence
ccagtgtgactccttttatg

SEQ ID NO: 637028 - DNA, 20 bp, Artificial
  CRISPR gRNA sequence
cttttatgtaccataagcac

SEQ ID NO: 637029 - DNA, 20 bp, Artificial
  CRISPR gRNA sequence
ttatgtaccataagcacatt

SEQ ID NO: 637030 - DNA, 20 bp, Artificial
  CRISPR gRNA sequence
tatgtaccataagcacattg

SEQ ID NO: 637031 - DNA, 20 bp, Artificial
  CRISPR gRNA sequence
atgtaccataagcacattgg

SEQ ID NO: 637032 - DNA, 20 bp, Artificial
  CRISPR gRNA sequence
tgtaccataagcacattggg

SEQ ID NO: 637033 - DNA, 20 bp, Artificial
  CRISPR gRNA sequence
ggcccaatgcaaaccatgcc

SEQ ID NO: 637034 - DNA, 20 bp, Artificial
  CRISPR gRNA sequence
cagtttaccattcggaagcc

SEQ ID NO: 637035 - DNA, 20 bp, Artificial
  CRISPR gRNA sequence
agtttaccattcggaagccg

SEQ ID NO: 637036 - DNA, 20 bp, Artificial
  CRISPR gRNA sequence
accattcggaagccggattc

SEQ ID NO: 637037 - DNA, 20 bp, Artificial
  CRISPR gRNA sequence
ccattcggaagccggattcc

SEQ ID NO: 637038 - DNA, 20 bp, Artificial
  CRISPR gRNA sequence
ggaagccggattcctccctc

SEQ ID NO: 637039 - DNA, 20 bp, Artificial
  CRISPR gRNA sequence
ctccctcgccttgaagctcc

SEQ ID NO: 637040 - DNA, 20 bp, Artificial
  CRISPR gRNA sequence
cctcgccttgaagctcctgg

SEQ ID NO: 637041 - DNA, 20 bp, Artificial
  CRISPR gRNA sequence
gccttgaagctcctggactt

SEQ ID NO: 637042 - DNA, 20 bp, Artificial
  CRISPR gRNA sequence
gaagctcctggactttcctg

SEQ ID NO: 637043 - DNA, 20 bp, Artificial
  CRISPR gRNA sequence
aagctcctggactttcctgt

SEQ ID NO: 637044 - DNA, 20 bp, Artificial
  CRISPR gRNA sequence
ctggactttcctgttgtcag

SEQ ID NO: 637045 - DNA, 20 bp, Artificial
  CRISPR gRNA sequence
gactttcctgttgtcagcca

SEQ ID NO: 637046 - DNA, 20 bp, Artificial
  CRISPR gRNA sequence
tcctgttgtcagccacctcg

SEQ ID NO: 637047 - DNA, 20 bp, Artificial
  CRISPR gRNA sequence
cctgttgtcagccacctcgc

SEQ ID NO: 637048 - DNA, 20 bp, Artificial
  CRISPR gRNA sequence
ctgttgtcagccacctcgct

SEQ ID NO: 637049 - DNA, 20 bp, Artificial
  CRISPR gRNA sequence
ttgtcagccacctcgctgct

SEQ ID NO: 637050 - DNA, 20 bp, Artificial
  CRISPR gRNA sequence
tcagccacctcgctgctctc

SEQ ID NO: 637051 - DNA, 20 bp, Artificial
  CRISPR gRNA sequence
gctgctctcaattaggggtt

SEQ ID NO: 637052 - DNA, 20 bp, Artificial
  CRISPR gRNA sequence
ctctcaattaggggttcttc

SEQ ID NO: 637053 - DNA, 20 bp, Artificial
  CRISPR gRNA sequence
tcaattaggggttcttctag

SEQ ID NO: 637054 - DNA, 20 bp, Artificial
  CRISPR gRNA sequence
aattaggggttcttctaggc

SEQ ID NO: 637055 - DNA, 20 bp, Artificial
  CRISPR gRNA sequence
ggggttcttctaggctgcta

SEQ ID NO: 637056 - DNA, 20 bp, Artificial
  CRISPR gRNA sequence
ttctaggctgctaccctcat

SEQ ID NO: 637057 - DNA, 20 bp, Artificial
  CRISPR gRNA sequence
ctaggctgctaccctcatca

SEQ ID NO: 637058 - DNA, 20 bp, Artificial
  CRISPR gRNA sequence
taggctgctaccctcatcat

SEQ ID NO: 637059 - DNA, 20 bp, Artificial
  CRISPR gRNA sequence
ggctgctaccctcatcatgg

SEQ ID NO: 637060 - DNA, 20 bp, Artificial
  CRISPR gRNA sequence
ctaccctcatcatggcccct

SEQ ID NO: 637061 - DNA, 20 bp, Artificial
  CRISPR gRNA sequence
ccctcatcatggcccctgat

SEQ ID NO: 637062 - DNA, 20 bp, Artificial
  CRISPR gRNA sequence
atcatggcccctgatctcat

SEQ ID NO: 637063 - DNA, 20 bp, Artificial
  CRISPR gRNA sequence
atctcatcttcacggctcag

SEQ ID NO: 637064 - DNA, 20 bp, Artificial
  CRISPR gRNA sequence
atcttcacggctcaggggtt

SEQ ID NO: 637065 - DNA, 20 bp, Artificial
  CRISPR gRNA sequence
cacggctcaggggtttcctg

SEQ ID NO: 637066 - DNA, 20 bp, Artificial
  CRISPR gRNA sequence
acggctcaggggtttcctgt

SEQ ID NO: 637067 - DNA, 20 bp, Artificial
  CRISPR gRNA sequence
aggggtttcctgtcacactc

SEQ ID NO: 637068 - DNA, 20 bp, Artificial
  CRISPR gRNA sequence
cctgtcacactcttcatcac

SEQ ID NO: 637069 - DNA, 20 bp, Artificial
  CRISPR gRNA sequence
ctgtcacactcttcatcact

SEQ ID NO: 637070 - DNA, 20 bp, Artificial
  CRISPR gRNA sequence
tcacactcttcatcactctg

SEQ ID NO: 637071 - DNA, 20 bp, Artificial
  CRISPR gRNA sequence
ttcatcactctgcatttcta

SEQ ID NO: 637072 - DNA, 20 bp, Artificial
  CRISPR gRNA sequence
catcactctgcatttctagc

SEQ ID NO: 637073 - DNA, 20 bp, Artificial
  CRISPR gRNA sequence
atcactctgcatttctagct

SEQ ID NO: 637074 - DNA, 20 bp, Artificial
  CRISPR gRNA sequence
tgcatttctagctttactga

SEQ ID NO: 637075 - DNA, 20 bp, Artificial
  CRISPR gRNA sequence
catttctagctttactgaat

SEQ ID NO: 637076 - DNA, 20 bp, Artificial
  CRISPR gRNA sequence
ctagctttactgaatttgct

SEQ ID NO: 637077 - DNA, 20 bp, Artificial
  CRISPR gRNA sequence
tagctttactgaatttgctg

SEQ ID NO: 637078 - DNA, 20 bp, Artificial
  CRISPR gRNA sequence
gctttactgaatttgctgta

SEQ ID NO: 637079 - DNA, 20 bp, Artificial
  CRISPR gRNA sequence
tactgaatttgctgtaattt

SEQ ID NO: 637080 - DNA, 20 bp, Artificial
  CRISPR gRNA sequence
actgaatttgctgtaatttg

SEQ ID NO: 637081 - DNA, 20 bp, Artificial
  CRISPR gRNA sequence
ctgaatttgctgtaatttga

SEQ ID NO: 637082 - DNA, 20 bp, Artificial
  CRISPR gRNA sequence
aatttgctgtaatttgaaaa

SEQ ID NO: 637083 - DNA, 20 bp, Artificial
  CRISPR gRNA sequence
gctgtaatttgaaaagaaga

SEQ ID NO: 637084 - DNA, 20 bp, Artificial
  CRISPR gRNA sequence
ctgtaatttgaaaagaagaa

SEQ ID NO: 637085 - DNA, 20 bp, Artificial
  CRISPR gRNA sequence
taatttgaaaagaagaaaat

SEQ ID NO: 637086 - DNA, 20 bp, Artificial
  CRISPR gRNA sequence
gaaaagaagaaaataaattt

SEQ ID NO: 637087 - DNA, 20 bp, Artificial
  CRISPR gRNA sequence
aaaagaagaaaataaatttt

SEQ ID NO: 637088 - DNA, 20 bp, Artificial
  CRISPR gRNA sequence
taaatacatgttatgtattc

SEQ ID NO: 637089 - DNA, 20 bp, Artificial
  CRISPR gRNA sequence
aaatacatgttatgtattct

SEQ ID NO: 637090 - DNA, 20 bp, Artificial
  CRISPR gRNA sequence
aatacatgttatgtattctc

SEQ ID NO: 637091 - DNA, 20 bp, Artificial
  CRISPR gRNA sequence
tgtattctcacctacatctc

SEQ ID NO: 637092 - DNA, 20 bp, Artificial
  CRISPR gRNA sequence
tcacctacatctcttttcta

SEQ ID NO: 637093 - DNA, 20 bp, Artificial
  CRISPR gRNA sequence
acctacatctcttttctact

SEQ ID NO: 637094 - DNA, 20 bp, Artificial
  CRISPR gRNA sequence
catctcttttctactcattg

SEQ ID NO: 637095 - DNA, 20 bp, Artificial
  CRISPR gRNA sequence
ttttctactcattgtcatcc

SEQ ID NO: 637096 - DNA, 20 bp, Artificial
  CRISPR gRNA sequence
ttctactcattgtcatccta

SEQ ID NO: 637097 - DNA, 20 bp, Artificial
  CRISPR gRNA sequence
tctactcattgtcatcctac

SEQ ID NO: 637098 - DNA, 20 bp, Artificial
  CRISPR gRNA sequence
ctactcattgtcatcctact

SEQ ID NO: 637099 - DNA, 20 bp, Artificial
  CRISPR gRNA sequence
tactcattgtcatcctacta

SEQ ID NO: 637100 - DNA, 20 bp, Artificial
  CRISPR gRNA sequence
ctcattgtcatcctactaaa

SEQ ID NO: 637101 - DNA, 20 bp, Artificial
  CRISPR gRNA sequence
attgtcatcctactaaatgg

SEQ ID NO: 637102 - DNA, 20 bp, Artificial
  CRISPR gRNA sequence
tcatcctactaaatggatga

SEQ ID NO: 637103 - DNA, 20 bp, Artificial
  CRISPR gRNA sequence
ctaaatggatgaaaatgata

SEQ ID NO: 637104 - DNA, 20 bp, Artificial
  CRISPR gRNA sequence
aatggatgaaaatgatatat

SEQ ID NO: 637105 - DNA, 20 bp, Artificial
  CRISPR gRNA sequence
atcatcgaatgccatgttaa

SEQ ID NO: 637106 - DNA, 20 bp, Artificial
  CRISPR gRNA sequence
atacatactgtgttctatga

SEQ ID NO: 637107 - DNA, 20 bp, Artificial
  CRISPR gRNA sequence
tgttctatgatattttagtg

SEQ ID NO: 637108 - DNA, 20 bp, Artificial
  CRISPR gRNA sequence
tatgatattttagtgaaatg

SEQ ID NO: 637109 - DNA, 20 bp, Artificial
  CRISPR gRNA sequence
tgatattttagtgaaatgtc

SEQ ID NO: 637110 - DNA, 20 bp, Artificial
  CRISPR gRNA sequence
tagtgaaatgtcatggaagt

SEQ ID NO: 637111 - DNA, 20 bp, Artificial
  CRISPR gRNA sequence
agtgaaatgtcatggaagtg

SEQ ID NO: 637112 - DNA, 20 bp, Artificial
  CRISPR gRNA sequence
gtgaaatgtcatggaagtga

SEQ ID NO: 637113 - DNA, 20 bp, Artificial
  CRISPR gRNA sequence
aggaaaactctaggtaaaca

SEQ ID NO: 637114 - DNA, 20 bp, Artificial
  CRISPR gRNA sequence
taggtaaacagaatgactat

SEQ ID NO: 637115 - DNA, 20 bp, Artificial
  CRISPR gRNA sequence
ggtaaacagaatgactattt

SEQ ID NO: 637116 - DNA, 20 bp, Artificial
  CRISPR gRNA sequence
tttcctcacatatttgtttc

SEQ ID NO: 637117 - DNA, 20 bp, Artificial
  CRISPR gRNA sequence
cctcacatatttgtttcttt

SEQ ID NO: 637118 - DNA, 20 bp, Artificial
  CRISPR gRNA sequence
ctcacatatttgtttctttc

SEQ ID NO: 637119 - DNA, 20 bp, Artificial
  CRISPR gRNA sequence
acatatttgtttctttcact

SEQ ID NO: 637120 - DNA, 20 bp, Artificial
  CRISPR gRNA sequence
gtttctttcacttagacatt

SEQ ID NO: 637121 - DNA, 20 bp, Artificial
  CRISPR gRNA sequence
tttctttcacttagacattt

SEQ ID NO: 637122 - DNA, 20 bp, Artificial
  CRISPR gRNA sequence
ctttcacttagacatttgct

SEQ ID NO: 637123 - DNA, 20 bp, Artificial
  CRISPR gRNA sequence
tttcacttagacatttgctt

SEQ ID NO: 637124 - DNA, 20 bp, Artificial
  CRISPR gRNA sequence
tcacttagacatttgctttt

SEQ ID NO: 637125 - DNA, 20 bp, Artificial
  CRISPR gRNA sequence
cacttagacatttgcttttt

SEQ ID NO: 637126 - DNA, 20 bp, Artificial
  CRISPR gRNA sequence
acttagacatttgcttttta

SEQ ID NO: 637127 - DNA, 20 bp, Artificial
  CRISPR gRNA sequence
agacatttgctttttaaaca

SEQ ID NO: 637128 - DNA, 20 bp, Artificial
  CRISPR gRNA sequence
gacatttgctttttaaacaa

SEQ ID NO: 637129 - DNA, 20 bp, Artificial
  CRISPR gRNA sequence
gctttttaaacaagtttttt

SEQ ID NO: 637130 - DNA, 20 bp, Artificial
  CRISPR gRNA sequence
ctttttaaacaagttttttt

SEQ ID NO: 637131 - DNA, 20 bp, Artificial
  CRISPR gRNA sequence
tttaaacaagtttttttaat

SEQ ID NO: 637132 - DNA, 20 bp, Artificial
  CRISPR gRNA sequence
ttaaacaagtttttttaata

SEQ ID NO: 637133 - DNA, 20 bp, Artificial
  CRISPR gRNA sequence
taaacaagtttttttaataa

SEQ ID NO: 637134 - DNA, 20 bp, Artificial
  CRISPR gRNA sequence
aaacaagtttttttaataat

SEQ ID NO: 637135 - DNA, 20 bp, Artificial
  CRISPR gRNA sequence
aacaagtttttttaataatc

SEQ ID NO: 637136 - DNA, 20 bp, Artificial
  CRISPR gRNA sequence
ttttaataatcctggtattg

SEQ ID NO: 637137 - DNA, 20 bp, Artificial
  CRISPR gRNA sequence
tttaataatcctggtattgg

SEQ ID NO: 637138 - DNA, 20 bp, Artificial
  CRISPR gRNA sequence
ttaataatcctggtattggc

SEQ ID NO: 637139 - DNA, 20 bp, Artificial
  CRISPR gRNA sequence
taataatcctggtattggct

SEQ ID NO: 637140 - DNA, 20 bp, Artificial
  CRISPR gRNA sequence
aataatcctggtattggctt

SEQ ID NO: 637141 - DNA, 20 bp, Artificial
  CRISPR gRNA sequence
ataatcctggtattggcttt

SEQ ID NO: 637142 - DNA, 20 bp, Artificial
  CRISPR gRNA sequence
gtattggcttttgagtctgt

SEQ ID NO: 637143 - DNA, 20 bp, Artificial
  CRISPR gRNA sequence
gcttttgagtctgtcactaa

SEQ ID NO: 637144 - DNA, 20 bp, Artificial
  CRISPR gRNA sequence
ttgagtctgtcactaagact

SEQ ID NO: 637145 - DNA, 20 bp, Artificial
  CRISPR gRNA sequence
tgagtctgtcactaagactc

SEQ ID NO: 637146 - DNA, 20 bp, Artificial
  CRISPR gRNA sequence
gagtctgtcactaagactcc

SEQ ID NO: 637147 - DNA, 20 bp, Artificial
  CRISPR gRNA sequence
agtctgtcactaagactcct

SEQ ID NO: 637148 - DNA, 20 bp, Artificial
  CRISPR gRNA sequence
tcactaagactcctaggact

SEQ ID NO: 637149 - DNA, 20 bp, Artificial
  CRISPR gRNA sequence
agactcctaggactgagata

SEQ ID NO: 637150 - DNA, 20 bp, Artificial
  CRISPR gRNA sequence
ctaggactgagataggatta

SEQ ID NO: 637151 - DNA, 20 bp, Artificial
  CRISPR gRNA sequence
ggactgagataggattatgg

SEQ ID NO: 637152 - DNA, 20 bp, Artificial
  CRISPR gRNA sequence
agataggattatggaagaaa

SEQ ID NO: 637153 - DNA, 20 bp, Artificial
  CRISPR gRNA sequence
tggaagaaacaagattaaat

SEQ ID NO: 637154 - DNA, 20 bp, Artificial
  CRISPR gRNA sequence
aatattgcttaacacactga

SEQ ID NO: 637155 - DNA, 20 bp, Artificial
  CRISPR gRNA sequence
cttaacacactgaactatgc

SEQ ID NO: 637156 - DNA, 20 bp, Artificial
  CRISPR gRNA sequence
aacacactgaactatgcctc

SEQ ID NO: 637157 - DNA, 20 bp, Artificial
  CRISPR gRNA sequence
acacactgaactatgcctcc

SEQ ID NO: 637158 - DNA, 20 bp, Artificial
  CRISPR gRNA sequence
aactatgcctcctcttaatt

SEQ ID NO: 637159 - DNA, 20 bp, Artificial
  CRISPR gRNA sequence
tgcctcctcttaatttaatg

SEQ ID NO: 637160 - DNA, 20 bp, Artificial
  CRISPR gRNA sequence
ctcttaatttaatgatcatt

SEQ ID NO: 637161 - DNA, 20 bp, Artificial
  CRISPR gRNA sequence
ttaatttaatgatcattatg

SEQ ID NO: 637162 - DNA, 20 bp, Artificial
  CRISPR gRNA sequence
aatttaatgatcattatgta

SEQ ID NO: 637163 - DNA, 20 bp, Artificial
  CRISPR gRNA sequence
atttaatgatcattatgtat

SEQ ID NO: 637164 - DNA, 20 bp, Artificial
  CRISPR gRNA sequence
aatgatcattatgtatactt

SEQ ID NO: 637165 - DNA, 20 bp, Artificial
  CRISPR gRNA sequence
atgatcattatgtatacttc

SEQ ID NO: 637166 - DNA, 20 bp, Artificial
  CRISPR gRNA sequence
tgtatacttcatattctctg

SEQ ID NO: 637167 - DNA, 20 bp, Artificial
  CRISPR gRNA sequence
catattctctgtttcacatc

SEQ ID NO: 637168 - DNA, 20 bp, Artificial
  CRISPR gRNA sequence
atattctctgtttcacatca

SEQ ID NO: 637169 - DNA, 20 bp, Artificial
  CRISPR gRNA sequence
tctgtttcacatcagagtac

SEQ ID NO: 637170 - DNA, 20 bp, Artificial
  CRISPR gRNA sequence
tgtttcacatcagagtactt

SEQ ID NO: 637171 - DNA, 20 bp, Artificial
  CRISPR gRNA sequence
tttcacatcagagtacttgt

SEQ ID NO: 637172 - DNA, 20 bp, Artificial
  CRISPR gRNA sequence
cacatcagagtacttgtata

SEQ ID NO: 637173 - DNA, 20 bp, Artificial
  CRISPR gRNA sequence
acatcagagtacttgtataa

SEQ ID NO: 637174 - DNA, 20 bp, Artificial
  CRISPR gRNA sequence
gtataaacctgcttctgaac

SEQ ID NO: 637175 - DNA, 20 bp, Artificial
  CRISPR gRNA sequence
tataaacctgcttctgaaca

SEQ ID NO: 637176 - DNA, 20 bp, Artificial
  CRISPR gRNA sequence
cttctgaacagggcaagaga

SEQ ID NO: 637177 - DNA, 20 bp, Artificial
  CRISPR gRNA sequence
ctgaacagggcaagagaaac

SEQ ID NO: 637178 - DNA, 20 bp, Artificial
  CRISPR gRNA sequence
tgaacagggcaagagaaaca

SEQ ID NO: 637179 - DNA, 20 bp, Artificial
  CRISPR gRNA sequence
aacagggcaagagaaacaat

SEQ ID NO: 637180 - DNA, 20 bp, Artificial
  CRISPR gRNA sequence
aggatcttaatccagcaaat

SEQ ID NO: 637181 - DNA, 20 bp, Artificial
  CRISPR gRNA sequence
aatccagcaaatgtctttga

SEQ ID NO: 637182 - DNA, 20 bp, Artificial
  CRISPR gRNA sequence
atccagcaaatgtctttgac

SEQ ID NO: 637183 - DNA, 20 bp, Artificial
  CRISPR gRNA sequence
tgacatatgaagatacactg

SEQ ID NO: 637184 - DNA, 20 bp, Artificial
  CRISPR gRNA sequence
gacatatgaagatacactgt

SEQ ID NO: 637185 - DNA, 20 bp, Artificial
  CRISPR gRNA sequence
acatatgaagatacactgtc

SEQ ID NO: 637186 - DNA, 20 bp, Artificial
  CRISPR gRNA sequence
tcaaggcaatgttctaaaat

SEQ ID NO: 637187 - DNA, 20 bp, Artificial
  CRISPR gRNA sequence
taaaatcaaactaaacacat

SEQ ID NO: 637188 - DNA, 20 bp, Artificial
  CRISPR gRNA sequence
aaatcaaactaaacacatat

SEQ ID NO: 637189 - DNA, 20 bp, Artificial
  CRISPR gRNA sequence
aacacatatattcagtttcg

SEQ ID NO: 637190 - DNA, 20 bp, Artificial
  CRISPR gRNA sequence
agtttcgagctatataaatg

SEQ ID NO: 637191 - DNA, 20 bp, Artificial
  CRISPR gRNA sequence
cgagctatataaatgtagta

SEQ ID NO: 637192 - DNA, 20 bp, Artificial
  CRISPR gRNA sequence
gagctatataaatgtagtac

SEQ ID NO: 637193 - DNA, 20 bp, Artificial
  CRISPR gRNA sequence
tataaatgtagtacacagac

SEQ ID NO: 637194 - DNA, 20 bp, Artificial
  CRISPR gRNA sequence
acatgctcttaagttactct

SEQ ID NO: 637195 - DNA, 20 bp, Artificial
  CRISPR gRNA sequence
ttaagttactctgcctattt

SEQ ID NO: 637196 - DNA, 20 bp, Artificial
  CRISPR gRNA sequence
aagttactctgcctattttt

SEQ ID NO: 637197 - DNA, 20 bp, Artificial
  CRISPR gRNA sequence
agttactctgcctatttttt

SEQ ID NO: 637198 - DNA, 20 bp, Artificial
  CRISPR gRNA sequence
ctctgcctattttttctatc

SEQ ID NO: 637199 - DNA, 20 bp, Artificial
  CRISPR gRNA sequence
tgcctattttttctatctaa

SEQ ID NO: 637200 - DNA, 20 bp, Artificial
  CRISPR gRNA sequence
cctattttttctatctaaaa

SEQ ID NO: 637201 - DNA, 20 bp, Artificial
  CRISPR gRNA sequence
ttttttctatctaaaaaatt

SEQ ID NO: 637202 - DNA, 20 bp, Artificial
  CRISPR gRNA sequence
tttctatctaaaaaattacc

SEQ ID NO: 637203 - DNA, 20 bp, Artificial
  CRISPR gRNA sequence
ttctatctaaaaaattacct

SEQ ID NO: 637204 - DNA, 20 bp, Artificial
  CRISPR gRNA sequence
tctatctaaaaaattaccta

SEQ ID NO: 637205 - DNA, 20 bp, Artificial
  CRISPR gRNA sequence
ctatctaaaaaattacctat

SEQ ID NO: 637206 - DNA, 20 bp, Artificial
  CRISPR gRNA sequence
tatctaaaaaattacctatg

SEQ ID NO: 637207 - DNA, 20 bp, Artificial
  CRISPR gRNA sequence
tctaaaaaattacctatgga

SEQ ID NO: 637208 - DNA, 20 bp, Artificial
  CRISPR gRNA sequence
aaaaattacctatggaacat

SEQ ID NO: 637209 - DNA, 20 bp, Artificial
  CRISPR gRNA sequence
cctatggaacatgttgtttg

SEQ ID NO: 637210 - DNA, 20 bp, Artificial
  CRISPR gRNA sequence
tggaacatgttgtttgaaaa

SEQ ID NO: 637211 - DNA, 20 bp, Artificial
  CRISPR gRNA sequence
tttgaaaatcaaagtattcc

SEQ ID NO: 637212 - DNA, 20 bp, Artificial
  CRISPR gRNA sequence
gaaaatcaaagtattccaac

SEQ ID NO: 637213 - DNA, 20 bp, Artificial
  CRISPR gRNA sequence
aaaatcaaagtattccaact

SEQ ID NO: 637214 - DNA, 20 bp, Artificial
  CRISPR gRNA sequence
caactctaatctatgcacac

SEQ ID NO: 637215 - DNA, 20 bp, Artificial
  CRISPR gRNA sequence
taatctatgcacaccaaaaa

SEQ ID NO: 637216 - DNA, 20 bp, Artificial
  CRISPR gRNA sequence
atctatgcacaccaaaaagc

SEQ ID NO: 637217 - DNA, 20 bp, Artificial
  CRISPR gRNA sequence
tgcacaccaaaaagcagcta

SEQ ID NO: 637218 - DNA, 20 bp, Artificial
  CRISPR gRNA sequence
atcacagtaatggcatagca

SEQ ID NO: 637219 - DNA, 20 bp, Artificial
  CRISPR gRNA sequence
gccactgttaagaaatttaa

SEQ ID NO: 637220 - DNA, 20 bp, Artificial
  CRISPR gRNA sequence
ccactgttaagaaatttaat

SEQ ID NO: 637221 - DNA, 20 bp, Artificial
  CRISPR gRNA sequence
ttaagaaatttaatgccttc

SEQ ID NO: 637222 - DNA, 20 bp, Artificial
  CRISPR gRNA sequence
agaaatttaatgccttctgt

SEQ ID NO: 637223 - DNA, 20 bp, Artificial
  CRISPR gRNA sequence
aatgccttctgtttgctgtt

SEQ ID NO: 637224 - DNA, 20 bp, Artificial
  CRISPR gRNA sequence
atgccttctgtttgctgttt

SEQ ID NO: 637225 - DNA, 20 bp, Artificial
  CRISPR gRNA sequence
ctgtttgctgtttttggatc

SEQ ID NO: 637226 - DNA, 20 bp, Artificial
  CRISPR gRNA sequence
tgtttgctgtttttggatca

SEQ ID NO: 637227 - DNA, 20 bp, Artificial
  CRISPR gRNA sequence
tttgctgtttttggatcatc

SEQ ID NO: 637228 - DNA, 20 bp, Artificial
  CRISPR gRNA sequence
gctgtttttggatcatccca

SEQ ID NO: 637229 - DNA, 20 bp, Artificial
  CRISPR gRNA sequence
ctgtttttggatcatcccac

SEQ ID NO: 637230 - DNA, 20 bp, Artificial
  CRISPR gRNA sequence
tttttggatcatcccacaga

SEQ ID NO: 637231 - DNA, 20 bp, Artificial
  CRISPR gRNA sequence
ttggatcatcccacagaaaa

SEQ ID NO: 637232 - DNA, 20 bp, Artificial
  CRISPR gRNA sequence
tggatcatcccacagaaaag

SEQ ID NO: 637233 - DNA, 20 bp, Artificial
  CRISPR gRNA sequence
ggatcatcccacagaaaagt

SEQ ID NO: 637234 - DNA, 20 bp, Artificial
  CRISPR gRNA sequence
gatcatcccacagaaaagtt

SEQ ID NO: 637235 - DNA, 20 bp, Artificial
  CRISPR gRNA sequence
gaattttgttagcacagcct

SEQ ID NO: 637236 - DNA, 20 bp, Artificial
  CRISPR gRNA sequence
tgttagcacagccttcattc

SEQ ID NO: 637237 - DNA, 20 bp, Artificial
  CRISPR gRNA sequence
gttagcacagccttcattct

SEQ ID NO: 637238 - DNA, 20 bp, Artificial
  CRISPR gRNA sequence
ttagcacagccttcattctg

SEQ ID NO: 637239 - DNA, 20 bp, Artificial
  CRISPR gRNA sequence
gcacagccttcattctggat

SEQ ID NO: 637240 - DNA, 20 bp, Artificial
  CRISPR gRNA sequence
cattctggattgctgacaga

SEQ ID NO: 637241 - DNA, 20 bp, Artificial
  CRISPR gRNA sequence
attctggattgctgacagag

SEQ ID NO: 637242 - DNA, 20 bp, Artificial
  CRISPR gRNA sequence
tggattgctgacagagtctt

SEQ ID NO: 637243 - DNA, 20 bp, Artificial
  CRISPR gRNA sequence
gattgctgacagagtctttt

SEQ ID NO: 637244 - DNA, 20 bp, Artificial
  CRISPR gRNA sequence
ctgacagagtcttttcataa

SEQ ID NO: 637245 - DNA, 20 bp, Artificial
  CRISPR gRNA sequence
acagagtcttttcataaagc

SEQ ID NO: 637246 - DNA, 20 bp, Artificial
  CRISPR gRNA sequence
ttcataaagcagaaacaagc

SEQ ID NO: 637247 - DNA, 20 bp, Artificial
  CRISPR gRNA sequence
tcataaagcagaaacaagct

SEQ ID NO: 637248 - DNA, 20 bp, Artificial
  CRISPR gRNA sequence
cataaagcagaaacaagctt

SEQ ID NO: 637249 - DNA, 20 bp, Artificial
  CRISPR gRNA sequence
ataaagcagaaacaagcttt

SEQ ID NO: 637250 - DNA, 20 bp, Artificial
  CRISPR gRNA sequence
taagtgagtatcagtttttt

SEQ ID NO: 637251 - DNA, 20 bp, Artificial
  CRISPR gRNA sequence
aagtgagtatcagtttttta

SEQ ID NO: 637252 - DNA, 20 bp, Artificial
  CRISPR gRNA sequence
agtgagtatcagttttttat

SEQ ID NO: 637253 - DNA, 20 bp, Artificial
  CRISPR gRNA sequence
tttatccagtaatatagaaa

SEQ ID NO: 637254 - DNA, 20 bp, Artificial
  CRISPR gRNA sequence
ttatccagtaatatagaaaa

SEQ ID NO: 637255 - DNA, 20 bp, Artificial
  CRISPR gRNA sequence
tatccagtaatatagaaaat

SEQ ID NO: 637256 - DNA, 20 bp, Artificial
  CRISPR gRNA sequence
atccagtaatatagaaaatt

SEQ ID NO: 637257 - DNA, 20 bp, Artificial
  CRISPR gRNA sequence
tccagtaatatagaaaattt

SEQ ID NO: 637258 - DNA, 20 bp, Artificial
  CRISPR gRNA sequence
cttaagaagtcatatcaaag

SEQ ID NO: 637259 - DNA, 20 bp, Artificial
  CRISPR gRNA sequence
ttaagaagtcatatcaaagt

SEQ ID NO: 637260 - DNA, 20 bp, Artificial
  CRISPR gRNA sequence
aagaagtcatatcaaagtta

SEQ ID NO: 637261 - DNA, 20 bp, Artificial
  CRISPR gRNA sequence
agaagtcatatcaaagttac

SEQ ID NO: 637262 - DNA, 20 bp, Artificial
  CRISPR gRNA sequence
ctaagcaaaacaacttattt

SEQ ID NO: 637263 - DNA, 20 bp, Artificial
  CRISPR gRNA sequence
agcaaaacaacttatttggt

SEQ ID NO: 637264 - DNA, 20 bp, Artificial
  CRISPR gRNA sequence
atttggtactacttgattag

SEQ ID NO: 637265 - DNA, 20 bp, Artificial
  CRISPR gRNA sequence
tttggtactacttgattaga

SEQ ID NO: 637266 - DNA, 20 bp, Artificial
  CRISPR gRNA sequence
ggtactacttgattagagga

SEQ ID NO: 637267 - DNA, 20 bp, Artificial
  CRISPR gRNA sequence
gtactacttgattagaggaa

SEQ ID NO: 637268 - DNA, 20 bp, Artificial
  CRISPR gRNA sequence
cttgattagaggaaatattt

SEQ ID NO: 637269 - DNA, 20 bp, Artificial
  CRISPR gRNA sequence
gattagaggaaatattttca

SEQ ID NO: 637270 - DNA, 20 bp, Artificial
  CRISPR gRNA sequence
attagaggaaatattttcat

SEQ ID NO: 637271 - DNA, 20 bp, Artificial
  CRISPR gRNA sequence
gaggaaatattttcataaaa

SEQ ID NO: 637272 - DNA, 20 bp, Artificial
  CRISPR gRNA sequence
tcataaaaaggaagtaagtt

SEQ ID NO: 637273 - DNA, 20 bp, Artificial
  CRISPR gRNA sequence
cataaaaaggaagtaagttc

SEQ ID NO: 637274 - DNA, 20 bp, Artificial
  CRISPR gRNA sequence
ataaaaaggaagtaagttct

SEQ ID NO: 637275 - DNA, 20 bp, Artificial
  CRISPR gRNA sequence
ttttcattgccgttgttttc

SEQ ID NO: 637276 - DNA, 20 bp, Artificial
  CRISPR gRNA sequence
ttcattgccgttgttttctt

SEQ ID NO: 637277 - DNA, 20 bp, Artificial
  CRISPR gRNA sequence
tcattgccgttgttttctta

SEQ ID NO: 637278 - DNA, 20 bp, Artificial
  CRISPR gRNA sequence
cattgccgttgttttcttag

SEQ ID NO: 637279 - DNA, 20 bp, Artificial
  CRISPR gRNA sequence
attgccgttgttttcttaga

SEQ ID NO: 637280 - DNA, 20 bp, Artificial
  CRISPR gRNA sequence
ccgttgttttcttagagaaa

SEQ ID NO: 637281 - DNA, 20 bp, Artificial
  CRISPR gRNA sequence
ttttcttagagaaaccacac

SEQ ID NO: 637282 - DNA, 20 bp, Artificial
  CRISPR gRNA sequence
tcttagagaaaccacacagt

SEQ ID NO: 637283 - DNA, 20 bp, Artificial
  CRISPR gRNA sequence
cttagagaaaccacacagtc

SEQ ID NO: 637284 - DNA, 20 bp, Artificial
  CRISPR gRNA sequence
ttagagaaaccacacagtct

SEQ ID NO: 637285 - DNA, 20 bp, Artificial
  CRISPR gRNA sequence
agagaaaccacacagtctgt

SEQ ID NO: 637286 - DNA, 20 bp, Artificial
  CRISPR gRNA sequence
gagaaaccacacagtctgtg

SEQ ID NO: 637287 - DNA, 20 bp, Artificial
  CRISPR gRNA sequence
tgatttgtcattagtactta

SEQ ID NO: 637288 - DNA, 20 bp, Artificial
  CRISPR gRNA sequence
gtcattagtacttatcacaa

SEQ ID NO: 637289 - DNA, 20 bp, Artificial
  CRISPR gRNA sequence
tcattagtacttatcacaag

SEQ ID NO: 637290 - DNA, 20 bp, Artificial
  CRISPR gRNA sequence
gtacttatcacaagagggtg

SEQ ID NO: 637291 - DNA, 20 bp, Artificial
  CRISPR gRNA sequence
atcacaagagggtgcactat

SEQ ID NO: 637292 - DNA, 20 bp, Artificial
  CRISPR gRNA sequence
tcacaagagggtgcactatc

SEQ ID NO: 637293 - DNA, 20 bp, Artificial
  CRISPR gRNA sequence
tcaaaatggctctgtggtag

SEQ ID NO: 637294 - DNA, 20 bp, Artificial
  CRISPR gRNA sequence
tgtggtagaaaagtactggc

SEQ ID NO: 637295 - DNA, 20 bp, Artificial
  CRISPR gRNA sequence
tggtagaaaagtactggcat

SEQ ID NO: 637296 - DNA, 20 bp, Artificial
  CRISPR gRNA sequence
gcattataatcttgaactaa

SEQ ID NO: 637297 - DNA, 20 bp, Artificial
  CRISPR gRNA sequence
taatcttgaactaattattt

SEQ ID NO: 637298 - DNA, 20 bp, Artificial
  CRISPR gRNA sequence
gaactaattatttaaactga

SEQ ID NO: 637299 - DNA, 20 bp, Artificial
  CRISPR gRNA sequence
aactaattatttaaactgag

SEQ ID NO: 637300 - DNA, 20 bp, Artificial
  CRISPR gRNA sequence
attatttaaactgagtctca

SEQ ID NO: 637301 - DNA, 20 bp, Artificial
  CRISPR gRNA sequence
tttaaactgagtctcatgtt

SEQ ID NO: 637302 - DNA, 20 bp, Artificial
  CRISPR gRNA sequence
aaactgagtctcatgtttgc

SEQ ID NO: 637303 - DNA, 20 bp, Artificial
  CRISPR gRNA sequence
aactgagtctcatgtttgca

SEQ ID NO: 637304 - DNA, 20 bp, Artificial
  CRISPR gRNA sequence
agtctcatgtttgcaaagta

SEQ ID NO: 637305 - DNA, 20 bp, Artificial
  CRISPR gRNA sequence
atgtttgcaaagtacagatg

SEQ ID NO: 637306 - DNA, 20 bp, Artificial
  CRISPR gRNA sequence
gcaaagtacagatgaactca

SEQ ID NO: 637307 - DNA, 20 bp, Artificial
  CRISPR gRNA sequence
caaagtacagatgaactcag

SEQ ID NO: 637308 - DNA, 20 bp, Artificial
  CRISPR gRNA sequence
agattactgaataaagttcg

SEQ ID NO: 637309 - DNA, 20 bp, Artificial
  CRISPR gRNA sequence
ctgaataaagttcgagcaga

SEQ ID NO: 637310 - DNA, 20 bp, Artificial
  CRISPR gRNA sequence
aataaagttcgagcagaaca

SEQ ID NO: 637311 - DNA, 20 bp, Artificial
  CRISPR gRNA sequence
gagcagaacagtttaggtat

SEQ ID NO: 637312 - DNA, 20 bp, Artificial
  CRISPR gRNA sequence
aggtattaagaacgaggata

SEQ ID NO: 637313 - DNA, 20 bp, Artificial
  CRISPR gRNA sequence
ggtattaagaacgaggatag

SEQ ID NO: 637314 - DNA, 20 bp, Artificial
  CRISPR gRNA sequence
agaacgaggatagtgaggaa

SEQ ID NO: 637315 - DNA, 20 bp, Artificial
  CRISPR gRNA sequence
aggtttaatttcaccatgtc

SEQ ID NO: 637316 - DNA, 20 bp, Artificial
  CRISPR gRNA sequence
ggtttaatttcaccatgtcc

SEQ ID NO: 637317 - DNA, 20 bp, Artificial
  CRISPR gRNA sequence
aatttcaccatgtcctttat

SEQ ID NO: 637318 - DNA, 20 bp, Artificial
  CRISPR gRNA sequence
atttcaccatgtcctttata

SEQ ID NO: 637319 - DNA, 20 bp, Artificial
  CRISPR gRNA sequence
caccatgtcctttataaaac

SEQ ID NO: 637320 - DNA, 20 bp, Artificial
  CRISPR gRNA sequence
accatgtcctttataaaacg

SEQ ID NO: 637321 - DNA, 20 bp, Artificial
  CRISPR gRNA sequence
tataaaacggggatgataat

SEQ ID NO: 637322 - DNA, 20 bp, Artificial
  CRISPR gRNA sequence
ataaaacggggatgataatg

SEQ ID NO: 637323 - DNA, 20 bp, Artificial
  CRISPR gRNA sequence
taaaacggggatgataatgg

SEQ ID NO: 637324 - DNA, 20 bp, Artificial
  CRISPR gRNA sequence
cctatggttgctgtgagcat

SEQ ID NO: 637325 - DNA, 20 bp, Artificial
  CRISPR gRNA sequence
ctatggttgctgtgagcatt

SEQ ID NO: 637326 - DNA, 20 bp, Artificial
  CRISPR gRNA sequence
tggttgctgtgagcattaaa

SEQ ID NO: 637327 - DNA, 20 bp, Artificial
  CRISPR gRNA sequence
ctgtgagcattaaatgagta

SEQ ID NO: 637328 - DNA, 20 bp, Artificial
  CRISPR gRNA sequence
tgagcattaaatgagtaaat

SEQ ID NO: 637329 - DNA, 20 bp, Artificial
  CRISPR gRNA sequence
aatgagtaaatacaggaaat

SEQ ID NO: 637330 - DNA, 20 bp, Artificial
  CRISPR gRNA sequence
atcttttttttcctggatat

SEQ ID NO: 637331 - DNA, 20 bp, Artificial
  CRISPR gRNA sequence
tcttttttttcctggatata

SEQ ID NO: 637332 - DNA, 20 bp, Artificial
  CRISPR gRNA sequence
ttttttcctggatatatagt

SEQ ID NO: 637333 - DNA, 20 bp, Artificial
  CRISPR gRNA sequence
tttttcctggatatatagtg

SEQ ID NO: 637334 - DNA, 20 bp, Artificial
  CRISPR gRNA sequence
ttttcctggatatatagtgc

SEQ ID NO: 637335 - DNA, 20 bp, Artificial
  CRISPR gRNA sequence
tttcctggatatatagtgct

SEQ ID NO: 637336 - DNA, 20 bp, Artificial
  CRISPR gRNA sequence
ttcctggatatatagtgctc

SEQ ID NO: 637337 - DNA, 20 bp, Artificial
  CRISPR gRNA sequence
tcctggatatatagtgctct

SEQ ID NO: 637338 - DNA, 20 bp, Artificial
  CRISPR gRNA sequence
cctggatatatagtgctcta

SEQ ID NO: 637339 - DNA, 20 bp, Artificial
  CRISPR gRNA sequence
ctggatatatagtgctctat

SEQ ID NO: 637340 - DNA, 20 bp, Artificial
  CRISPR gRNA sequence
gatatatagtgctctatttc

SEQ ID NO: 637341 - DNA, 20 bp, Artificial
  CRISPR gRNA sequence
tatttcatagggtttttatg

SEQ ID NO: 637342 - DNA, 20 bp, Artificial
  CRISPR gRNA sequence
tttcatagggtttttatgaa

SEQ ID NO: 637343 - DNA, 20 bp, Artificial
  CRISPR gRNA sequence
catagggtttttatgaagat

SEQ ID NO: 637344 - DNA, 20 bp, Artificial
  CRISPR gRNA sequence
atagggtttttatgaagatc

SEQ ID NO: 637345 - DNA, 20 bp, Artificial
  CRISPR gRNA sequence
ttatgaagatcaatcaactt

SEQ ID NO: 637346 - DNA, 20 bp, Artificial
  CRISPR gRNA sequence
tatgaagatcaatcaactta

SEQ ID NO: 637347 - DNA, 20 bp, Artificial
  CRISPR gRNA sequence
atgaagatcaatcaacttat

SEQ ID NO: 637348 - DNA, 20 bp, Artificial
  CRISPR gRNA sequence
tgaagatcaatcaacttatg

SEQ ID NO: 637349 - DNA, 20 bp, Artificial
  CRISPR gRNA sequence
atggtacataaactactctg

SEQ ID NO: 637350 - DNA, 20 bp, Artificial
  CRISPR gRNA sequence
tggtacataaactactctga

SEQ ID NO: 637351 - DNA, 20 bp, Artificial
  CRISPR gRNA sequence
ctctgagatctacaaagtga

SEQ ID NO: 637352 - DNA, 20 bp, Artificial
  CRISPR gRNA sequence
tgagatctacaaagtgatat

SEQ ID NO: 637353 - DNA, 20 bp, Artificial
  CRISPR gRNA sequence
agatctacaaagtgatatgc

SEQ ID NO: 637354 - DNA, 20 bp, Artificial
  CRISPR gRNA sequence
caaagtgatatgcatccttc

SEQ ID NO: 637355 - DNA, 20 bp, Artificial
  CRISPR gRNA sequence
cctggacccatttctaacag

SEQ ID NO: 637356 - DNA, 20 bp, Artificial
  CRISPR gRNA sequence
ctggacccatttctaacaga

SEQ ID NO: 637357 - DNA, 20 bp, Artificial
  CRISPR gRNA sequence
gacccatttctaacagagta

SEQ ID NO: 637358 - DNA, 20 bp, Artificial
  CRISPR gRNA sequence
ctaacagagtaccaactata

SEQ ID NO: 637359 - DNA, 20 bp, Artificial
  CRISPR gRNA sequence
taacagagtaccaactatat

SEQ ID NO: 637360 - DNA, 20 bp, Artificial
  CRISPR gRNA sequence
acagagtaccaactatattg

SEQ ID NO: 637361 - DNA, 20 bp, Artificial
  CRISPR gRNA sequence
tattgagttttaccctattt

SEQ ID NO: 637362 - DNA, 20 bp, Artificial
  CRISPR gRNA sequence
agttttaccctatttacaaa

SEQ ID NO: 637363 - DNA, 20 bp, Artificial
  CRISPR gRNA sequence
taccctatttacaaattgtt

SEQ ID NO: 637364 - DNA, 20 bp, Artificial
  CRISPR gRNA sequence
accctatttacaaattgtta

SEQ ID NO: 637365 - DNA, 20 bp, Artificial
  CRISPR gRNA sequence
ccctatttacaaattgttac

SEQ ID NO: 637366 - DNA, 20 bp, Artificial
  CRISPR gRNA sequence
tttacaaattgttactccct

SEQ ID NO: 637367 - DNA, 20 bp, Artificial
  CRISPR gRNA sequence
acaaattgttactcccttac

SEQ ID NO: 637368 - DNA, 20 bp, Artificial
  CRISPR gRNA sequence
caaattgttactcccttact

SEQ ID NO: 637369 - DNA, 20 bp, Artificial
  CRISPR gRNA sequence
ttactcccttactagttttt

SEQ ID NO: 637370 - DNA, 20 bp, Artificial
  CRISPR gRNA sequence
ctcccttactagtttttaaa

SEQ ID NO: 637371 - DNA, 20 bp, Artificial
  CRISPR gRNA sequence
ccttactagtttttaaaaag

SEQ ID NO: 637372 - DNA, 20 bp, Artificial
  CRISPR gRNA sequence
actagtttttaaaaagagtt

SEQ ID NO: 637373 - DNA, 20 bp, Artificial
  CRISPR gRNA sequence
ctagtttttaaaaagagttg

SEQ ID NO: 637374 - DNA, 20 bp, Artificial
  CRISPR gRNA sequence
gtttttaaaaagagttggga

SEQ ID NO: 637375 - DNA, 20 bp, Artificial
  CRISPR gRNA sequence
ttaaaaagagttgggacagt

SEQ ID NO: 637376 - DNA, 20 bp, Artificial
  CRISPR gRNA sequence
taaaaagagttgggacagta

SEQ ID NO: 637377 - DNA, 20 bp, Artificial
  CRISPR gRNA sequence
aaaaagagttgggacagtat

SEQ ID NO: 637378 - DNA, 20 bp, Artificial
  CRISPR gRNA sequence
aaaagagttgggacagtatt

SEQ ID NO: 637379 - DNA, 20 bp, Artificial
  CRISPR gRNA sequence
ggacagtattttatccatct

SEQ ID NO: 637380 - DNA, 20 bp, Artificial
  CRISPR gRNA sequence
tatccatctttatattgcca

SEQ ID NO: 637381 - DNA, 20 bp, Artificial
  CRISPR gRNA sequence
atccatctttatattgccag

SEQ ID NO: 637382 - DNA, 20 bp, Artificial
  CRISPR gRNA sequence
tccatctttatattgccagc

SEQ ID NO: 637383 - DNA, 20 bp, Artificial
  CRISPR gRNA sequence
tatattgccagcatgctcaa

SEQ ID NO: 637384 - DNA, 20 bp, Artificial
  CRISPR gRNA sequence
atattgccagcatgctcaag

SEQ ID NO: 637385 - DNA, 20 bp, Artificial
  CRISPR gRNA sequence
tattgccagcatgctcaaga

SEQ ID NO: 637386 - DNA, 20 bp, Artificial
  CRISPR gRNA sequence
ccagcatgctcaagaatgtt

SEQ ID NO: 637387 - DNA, 20 bp, Artificial
  CRISPR gRNA sequence
aagaatgttgtggtatatag

SEQ ID NO: 637388 - DNA, 20 bp, Artificial
  CRISPR gRNA sequence
tggtatataggagatgttca

SEQ ID NO: 637389 - DNA, 20 bp, Artificial
  CRISPR gRNA sequence
aagtagtattcactgagatg

SEQ ID NO: 637390 - DNA, 20 bp, Artificial
  CRISPR gRNA sequence
actgagatgttttactaact

SEQ ID NO: 637391 - DNA, 20 bp, Artificial
  CRISPR gRNA sequence
agatgttttactaacttaag

SEQ ID NO: 637392 - DNA, 20 bp, Artificial
  CRISPR gRNA sequence
tactaacttaagagttttat

SEQ ID NO: 637393 - DNA, 20 bp, Artificial
  CRISPR gRNA sequence
actaacttaagagttttatt

SEQ ID NO: 637394 - DNA, 20 bp, Artificial
  CRISPR gRNA sequence
ctaacttaagagttttattg

SEQ ID NO: 637395 - DNA, 20 bp, Artificial
  CRISPR gRNA sequence
acttaagagttttattgctt

SEQ ID NO: 637396 - DNA, 20 bp, Artificial
  CRISPR gRNA sequence
aagagttttattgctttaaa

SEQ ID NO: 637397 - DNA, 20 bp, Artificial
  CRISPR gRNA sequence
agagttttattgctttaaac

SEQ ID NO: 637398 - DNA, 20 bp, Artificial
  CRISPR gRNA sequence
tattgctttaaacttgcttt

SEQ ID NO: 637399 - DNA, 20 bp, Artificial
  CRISPR gRNA sequence
attgctttaaacttgctttg

SEQ ID NO: 637400 - DNA, 20 bp, Artificial
  CRISPR gRNA sequence
ttgctttaaacttgctttgt

SEQ ID NO: 637401 - DNA, 20 bp, Artificial
  CRISPR gRNA sequence
ctttaaacttgctttgtatg

SEQ ID NO: 637402 - DNA, 20 bp, Artificial
  CRISPR gRNA sequence
taaacttgctttgtatgttt

SEQ ID NO: 637403 - DNA, 20 bp, Artificial
  CRISPR gRNA sequence
aaacttgctttgtatgttta

SEQ ID NO: 637404 - DNA, 20 bp, Artificial
  CRISPR gRNA sequence
aacttgctttgtatgtttaa

SEQ ID NO: 637405 - DNA, 20 bp, Artificial
  CRISPR gRNA sequence
gctttgtatgtttaaagaac

SEQ ID NO: 637406 - DNA, 20 bp, Artificial
  CRISPR gRNA sequence
ctttgtatgtttaaagaacc

SEQ ID NO: 637407 - DNA, 20 bp, Artificial
  CRISPR gRNA sequence
tgtatgtttaaagaacccat

SEQ ID NO: 637408 - DNA, 20 bp, Artificial
  CRISPR gRNA sequence
gtatgtttaaagaacccata

SEQ ID NO: 637409 - DNA, 20 bp, Artificial
  CRISPR gRNA sequence
tatgtttaaagaacccataa

SEQ ID NO: 637410 - DNA, 20 bp, Artificial
  CRISPR gRNA sequence
aaagaacccataaacatggc

SEQ ID NO: 637411 - DNA, 20 bp, Artificial
  CRISPR gRNA sequence
aagaacccataaacatggca

SEQ ID NO: 637412 - DNA, 20 bp, Artificial
  CRISPR gRNA sequence
catatgaagttcttttgtaa

SEQ ID NO: 637413 - DNA, 20 bp, Artificial
  CRISPR gRNA sequence
ttttgtaaccaagctcacta

SEQ ID NO: 637414 - DNA, 20 bp, Artificial
  CRISPR gRNA sequence
ttgtaaccaagctcactatc

SEQ ID NO: 637415 - DNA, 20 bp, Artificial
  CRISPR gRNA sequence
tgtaaccaagctcactatct

SEQ ID NO: 637416 - DNA, 20 bp, Artificial
  CRISPR gRNA sequence
gtaaccaagctcactatctt

SEQ ID NO: 637417 - DNA, 20 bp, Artificial
  CRISPR gRNA sequence
taaccaagctcactatcttt

SEQ ID NO: 637418 - DNA, 20 bp, Artificial
  CRISPR gRNA sequence
actatctttcaggccctatc

SEQ ID NO: 637419 - DNA, 20 bp, Artificial
  CRISPR gRNA sequence
tctttcaggccctatctcaa

SEQ ID NO: 637420 - DNA, 20 bp, Artificial
  CRISPR gRNA sequence
tcaggccctatctcaaaagc

SEQ ID NO: 637421 - DNA, 20 bp, Artificial
  CRISPR gRNA sequence
caggccctatctcaaaagca

SEQ ID NO: 637422 - DNA, 20 bp, Artificial
  CRISPR gRNA sequence
aggccctatctcaaaagcaa

SEQ ID NO: 637423 - DNA, 20 bp, Artificial
  CRISPR gRNA sequence
tctcaaaagcaaccagtatc

SEQ ID NO: 637424 - DNA, 20 bp, Artificial
  CRISPR gRNA sequence
aaaagcaaccagtatcataa

SEQ ID NO: 637425 - DNA, 20 bp, Artificial
  CRISPR gRNA sequence
tcaaattccaaatagtctga

SEQ ID NO: 637426 - DNA, 20 bp, Artificial
  CRISPR gRNA sequence
caaattccaaatagtctgaa

SEQ ID NO: 637427 - DNA, 20 bp, Artificial
  CRISPR gRNA sequence
aaattccaaatagtctgaat

SEQ ID NO: 637428 - DNA, 20 bp, Artificial
  CRISPR gRNA sequence
caaatagtctgaatccattt

SEQ ID NO: 637429 - DNA, 20 bp, Artificial
  CRISPR gRNA sequence
aatccattttataaatctag

SEQ ID NO: 637430 - DNA, 20 bp, Artificial
  CRISPR gRNA sequence
tataaatctagcatcatttg

SEQ ID NO: 637431 - DNA, 20 bp, Artificial
  CRISPR gRNA sequence
ataaatctagcatcatttgt

SEQ ID NO: 637432 - DNA, 20 bp, Artificial
  CRISPR gRNA sequence
taaatctagcatcatttgtt

SEQ ID NO: 637433 - DNA, 20 bp, Artificial
  CRISPR gRNA sequence
gcatcatttgttcatccagt

SEQ ID NO: 637434 - DNA, 20 bp, Artificial
  CRISPR gRNA sequence
gttcatccagttaatcattg

SEQ ID NO: 637435 - DNA, 20 bp, Artificial
  CRISPR gRNA sequence
ttcatccagttaatcattgg

SEQ ID NO: 637436 - DNA, 20 bp, Artificial
  CRISPR gRNA sequence
atccagttaatcattggaaa

SEQ ID NO: 637437 - DNA, 20 bp, Artificial
  CRISPR gRNA sequence
atcattggaaatttgaaatt

SEQ ID NO: 637438 - DNA, 20 bp, Artificial
  CRISPR gRNA sequence
gaaatttgaaattatttctt

SEQ ID NO: 637439 - DNA, 20 bp, Artificial
  CRISPR gRNA sequence
gaaattatttcttgtttctt

SEQ ID NO: 637440 - DNA, 20 bp, Artificial
  CRISPR gRNA sequence
aaattatttcttgtttcttg

SEQ ID NO: 637441 - DNA, 20 bp, Artificial
  CRISPR gRNA sequence
tttcttgtttcttgctatta

SEQ ID NO: 637442 - DNA, 20 bp, Artificial
  CRISPR gRNA sequence
cttgtttcttgctattacag

SEQ ID NO: 637443 - DNA, 20 bp, Artificial
  CRISPR gRNA sequence
ttgtttcttgctattacaga

SEQ ID NO: 637444 - DNA, 20 bp, Artificial
  CRISPR gRNA sequence
gtttcttgctattacagaca

SEQ ID NO: 637445 - DNA, 20 bp, Artificial
  CRISPR gRNA sequence
tttcttgctattacagacat

SEQ ID NO: 637446 - DNA, 20 bp, Artificial
  CRISPR gRNA sequence
cttgctattacagacattat

SEQ ID NO: 637447 - DNA, 20 bp, Artificial
  CRISPR gRNA sequence
ttgctattacagacattatt

SEQ ID NO: 637448 - DNA, 20 bp, Artificial
  CRISPR gRNA sequence
gctattacagacattatttt

SEQ ID NO: 637449 - DNA, 20 bp, Artificial
  CRISPR gRNA sequence
ctattacagacattatttta

SEQ ID NO: 637450 - DNA, 20 bp, Artificial
  CRISPR gRNA sequence
ttacagacattattttacaa

SEQ ID NO: 637451 - DNA, 20 bp, Artificial
  CRISPR gRNA sequence
cagacattattttacaatac

SEQ ID NO: 637452 - DNA, 20 bp, Artificial
  CRISPR gRNA sequence
ttttacaataccacatagtt

SEQ ID NO: 637453 - DNA, 20 bp, Artificial
  CRISPR gRNA sequence
tacaataccacatagttctg

SEQ ID NO: 637454 - DNA, 20 bp, Artificial
  CRISPR gRNA sequence
acaataccacatagttctgt

SEQ ID NO: 637455 - DNA, 20 bp, Artificial
  CRISPR gRNA sequence
caataccacatagttctgtc

SEQ ID NO: 637456 - DNA, 20 bp, Artificial
  CRISPR gRNA sequence
tgtcaatctgacagattaaa

SEQ ID NO: 637457 - DNA, 20 bp, Artificial
  CRISPR gRNA sequence
tcaatctgacagattaaaac

SEQ ID NO: 637458 - DNA, 20 bp, Artificial
  CRISPR gRNA sequence
acagattaaaactggtattt

SEQ ID NO: 637459 - DNA, 20 bp, Artificial
  CRISPR gRNA sequence
aaactggtattttattatgg

SEQ ID NO: 637460 - DNA, 20 bp, Artificial
  CRISPR gRNA sequence
gtattttattatggttttta

SEQ ID NO: 637461 - DNA, 20 bp, Artificial
  CRISPR gRNA sequence
tattatggtttttaaaaagc

SEQ ID NO: 637462 - DNA, 20 bp, Artificial
  CRISPR gRNA sequence
attatggtttttaaaaagca

SEQ ID NO: 637463 - DNA, 20 bp, Artificial
  CRISPR gRNA sequence
ttatggtttttaaaaagcat

SEQ ID NO: 637464 - DNA, 20 bp, Artificial
  CRISPR gRNA sequence
tggtttttaaaaagcatttt

SEQ ID NO: 637465 - DNA, 20 bp, Artificial
  CRISPR gRNA sequence
ttaaaaagcattttaaaatt

SEQ ID NO: 637466 - DNA, 20 bp, Artificial
  CRISPR gRNA sequence
taaaaagcattttaaaatta

SEQ ID NO: 637467 - DNA, 20 bp, Artificial
  CRISPR gRNA sequence
aaaaagcattttaaaattat

SEQ ID NO: 637468 - DNA, 20 bp, Artificial
  CRISPR gRNA sequence
aaaagcattttaaaattatg

SEQ ID NO: 637469 - DNA, 20 bp, Artificial
  CRISPR gRNA sequence
taaaattatgagtgaagtta

SEQ ID NO: 637470 - DNA, 20 bp, Artificial
  CRISPR gRNA sequence
aaaattatgagtgaagttag

SEQ ID NO: 637471 - DNA, 20 bp, Artificial
  CRISPR gRNA sequence
aaattatgagtgaagttaga

SEQ ID NO: 637472 - DNA, 20 bp, Artificial
  CRISPR gRNA sequence
tgagtgaagttagacatctt

SEQ ID NO: 637473 - DNA, 20 bp, Artificial
  CRISPR gRNA sequence
gacatctttttccatgttga

SEQ ID NO: 637474 - DNA, 20 bp, Artificial
  CRISPR gRNA sequence
tttccatgttgaaacgttct

SEQ ID NO: 637475 - DNA, 20 bp, Artificial
  CRISPR gRNA sequence
ttccatgttgaaacgttctt

SEQ ID NO: 637476 - DNA, 20 bp, Artificial
  CRISPR gRNA sequence
tccatgttgaaacgttcttt

SEQ ID NO: 637477 - DNA, 20 bp, Artificial
  CRISPR gRNA sequence
ccatgttgaaacgttcttta

SEQ ID NO: 637478 - DNA, 20 bp, Artificial
  CRISPR gRNA sequence
catgttgaaacgttctttat

SEQ ID NO: 637479 - DNA, 20 bp, Artificial
  CRISPR gRNA sequence
aaacgttctttattttttct

SEQ ID NO: 637480 - DNA, 20 bp, Artificial
  CRISPR gRNA sequence
tttattttttctcagaatta

SEQ ID NO: 637481 - DNA, 20 bp, Artificial
  CRISPR gRNA sequence
tattttttctcagaattatt

SEQ ID NO: 637482 - DNA, 20 bp, Artificial
  CRISPR gRNA sequence
attttttctcagaattattt

SEQ ID NO: 637483 - DNA, 20 bp, Artificial
  CRISPR gRNA sequence
ttttttctcagaattattta

SEQ ID NO: 637484 - DNA, 20 bp, Artificial
  CRISPR gRNA sequence
tttctcagaattatttatca

SEQ ID NO: 637485 - DNA, 20 bp, Artificial
  CRISPR gRNA sequence
ttctcagaattatttatcaa

SEQ ID NO: 637486 - DNA, 20 bp, Artificial
  CRISPR gRNA sequence
tctcagaattatttatcaaa

SEQ ID NO: 637487 - DNA, 20 bp, Artificial
  CRISPR gRNA sequence
ctcagaattatttatcaaag

SEQ ID NO: 637488 - DNA, 20 bp, Artificial
  CRISPR gRNA sequence
tcagaattatttatcaaagt

SEQ ID NO: 637489 - DNA, 20 bp, Artificial
  CRISPR gRNA sequence
agaattatttatcaaagttg

SEQ ID NO: 637490 - DNA, 20 bp, Artificial
  CRISPR gRNA sequence
tttatcaaagttgtctgccc

SEQ ID NO: 637491 - DNA, 20 bp, Artificial
  CRISPR gRNA sequence
atcaaagttgtctgcccatt

SEQ ID NO: 637492 - DNA, 20 bp, Artificial
  CRISPR gRNA sequence
tcaaagttgtctgcccattt

SEQ ID NO: 637493 - DNA, 20 bp, Artificial
  CRISPR gRNA sequence
tctgcccatttttctatcag

SEQ ID NO: 637494 - DNA, 20 bp, Artificial
  CRISPR gRNA sequence
cccatttttctatcaggttg

SEQ ID NO: 637495 - DNA, 20 bp, Artificial
  CRISPR gRNA sequence
ttctatcaggttgtcagtct

SEQ ID NO: 637496 - DNA, 20 bp, Artificial
  CRISPR gRNA sequence
tctatcaggttgtcagtctt

SEQ ID NO: 637497 - DNA, 20 bp, Artificial
  CRISPR gRNA sequence
ctatcaggttgtcagtcttt

SEQ ID NO: 637498 - DNA, 20 bp, Artificial
  CRISPR gRNA sequence
tatcaggttgtcagtctttt

SEQ ID NO: 637499 - DNA, 20 bp, Artificial
  CRISPR gRNA sequence
tcaggttgtcagtcttttct

SEQ ID NO: 637500 - DNA, 20 bp, Artificial
  CRISPR gRNA sequence
tcagtcttttctcactgaat

SEQ ID NO: 637501 - DNA, 20 bp, Artificial
  CRISPR gRNA sequence
ttctcactgaatttaaatgc

SEQ ID NO: 637502 - DNA, 20 bp, Artificial
  CRISPR gRNA sequence
tctcactgaatttaaatgct

SEQ ID NO: 637503 - DNA, 20 bp, Artificial
  CRISPR gRNA sequence
ctcactgaatttaaatgctc

SEQ ID NO: 637504 - DNA, 20 bp, Artificial
  CRISPR gRNA sequence
tcactgaatttaaatgctct

SEQ ID NO: 637505 - DNA, 20 bp, Artificial
  CRISPR gRNA sequence
actgaatttaaatgctcttt

SEQ ID NO: 637506 - DNA, 20 bp, Artificial
  CRISPR gRNA sequence
aatttaaatgctctttatat

SEQ ID NO: 637507 - DNA, 20 bp, Artificial
  CRISPR gRNA sequence
aaatgctctttatatattaa

SEQ ID NO: 637508 - DNA, 20 bp, Artificial
  CRISPR gRNA sequence
aatgctctttatatattaag

SEQ ID NO: 637509 - DNA, 20 bp, Artificial
  CRISPR gRNA sequence
tttatatattaaggaactta

SEQ ID NO: 637510 - DNA, 20 bp, Artificial
  CRISPR gRNA sequence
tatatattaaggaacttagc

SEQ ID NO: 637511 - DNA, 20 bp, Artificial
  CRISPR gRNA sequence
atatattaaggaacttagcc

SEQ ID NO: 637512 - DNA, 20 bp, Artificial
  CRISPR gRNA sequence
tatattaaggaacttagccc

SEQ ID NO: 637513 - DNA, 20 bp, Artificial
  CRISPR gRNA sequence
aggaacttagcccagtgttt

SEQ ID NO: 637514 - DNA, 20 bp, Artificial
  CRISPR gRNA sequence
agcccagtgtttatgatatc

SEQ ID NO: 637515 - DNA, 20 bp, Artificial
  CRISPR gRNA sequence
gcccagtgtttatgatatct

SEQ ID NO: 637516 - DNA, 20 bp, Artificial
  CRISPR gRNA sequence
atgatatcttttgcaaacat

SEQ ID NO: 637517 - DNA, 20 bp, Artificial
  CRISPR gRNA sequence
tgatatcttttgcaaacatt

SEQ ID NO: 637518 - DNA, 20 bp, Artificial
  CRISPR gRNA sequence
ttgcaaacattttggtttat

SEQ ID NO: 637519 - DNA, 20 bp, Artificial
  CRISPR gRNA sequence
tgcaaacattttggtttatc

SEQ ID NO: 637520 - DNA, 20 bp, Artificial
  CRISPR gRNA sequence
gcaaacattttggtttatct

SEQ ID NO: 637521 - DNA, 20 bp, Artificial
  CRISPR gRNA sequence
caaacattttggtttatctc

SEQ ID NO: 637522 - DNA, 20 bp, Artificial
  CRISPR gRNA sequence
tggtttatctctttactcaa

SEQ ID NO: 637523 - DNA, 20 bp, Artificial
  CRISPR gRNA sequence
ggtttatctctttactcaag

SEQ ID NO: 637524 - DNA, 20 bp, Artificial
  CRISPR gRNA sequence
gtttatctctttactcaagg

SEQ ID NO: 637525 - DNA, 20 bp, Artificial
  CRISPR gRNA sequence
atctctttactcaagggcat

SEQ ID NO: 637526 - DNA, 20 bp, Artificial
  CRISPR gRNA sequence
tctctttactcaagggcatt

SEQ ID NO: 637527 - DNA, 20 bp, Artificial
  CRISPR gRNA sequence
tttactcaagggcatttttt

SEQ ID NO: 637528 - DNA, 20 bp, Artificial
  CRISPR gRNA sequence
tactcaagggcattttttgg

SEQ ID NO: 637529 - DNA, 20 bp, Artificial
  CRISPR gRNA sequence
actcaagggcattttttggc

SEQ ID NO: 637530 - DNA, 20 bp, Artificial
  CRISPR gRNA sequence
ctcaagggcattttttggca

SEQ ID NO: 637531 - DNA, 20 bp, Artificial
  CRISPR gRNA sequence
aagggcattttttggcatat

SEQ ID NO: 637532 - DNA, 20 bp, Artificial
  CRISPR gRNA sequence
tttggcatatatgctaattt

SEQ ID NO: 637533 - DNA, 20 bp, Artificial
  CRISPR gRNA sequence
ttggcatatatgctaatttc

SEQ ID NO: 637534 - DNA, 20 bp, Artificial
  CRISPR gRNA sequence
tggcatatatgctaatttca

SEQ ID NO: 637535 - DNA, 20 bp, Artificial
  CRISPR gRNA sequence
ggcatatatgctaatttcac

SEQ ID NO: 637536 - DNA, 20 bp, Artificial
  CRISPR gRNA sequence
gcatatatgctaatttcaca

SEQ ID NO: 637537 - DNA, 20 bp, Artificial
  CRISPR gRNA sequence
atttcacatgttgaattttt

SEQ ID NO: 637538 - DNA, 20 bp, Artificial
  CRISPR gRNA sequence
cacatgttgaatttttaaag

SEQ ID NO: 637539 - DNA, 20 bp, Artificial
  CRISPR gRNA sequence
acatgttgaatttttaaagt

SEQ ID NO: 637540 - DNA, 20 bp, Artificial
  CRISPR gRNA sequence
aatttttaaagtcttcagtt

SEQ ID NO: 637541 - DNA, 20 bp, Artificial
  CRISPR gRNA sequence
ttaaagtcttcagttatggc

SEQ ID NO: 637542 - DNA, 20 bp, Artificial
  CRISPR gRNA sequence
taaagtcttcagttatggct

SEQ ID NO: 637543 - DNA, 20 bp, Artificial
  CRISPR gRNA sequence
aaagtcttcagttatggctc

SEQ ID NO: 637544 - DNA, 20 bp, Artificial
  CRISPR gRNA sequence
aagtcttcagttatggctcc

SEQ ID NO: 637545 - DNA, 20 bp, Artificial
  CRISPR gRNA sequence
cagttatggctcctggattc

SEQ ID NO: 637546 - DNA, 20 bp, Artificial
  CRISPR gRNA sequence
agttatggctcctggattct

SEQ ID NO: 637547 - DNA, 20 bp, Artificial
  CRISPR gRNA sequence
tggctcctggattctatatc

SEQ ID NO: 637548 - DNA, 20 bp, Artificial
  CRISPR gRNA sequence
ctggattctatatcttgcat

SEQ ID NO: 637549 - DNA, 20 bp, Artificial
  CRISPR gRNA sequence
gattctatatcttgcatcaa

SEQ ID NO: 637550 - DNA, 20 bp, Artificial
  CRISPR gRNA sequence
tatatcttgcatcaacaggt

SEQ ID NO: 637551 - DNA, 20 bp, Artificial
  CRISPR gRNA sequence
tatcttgcatcaacaggttt

SEQ ID NO: 637552 - DNA, 20 bp, Artificial
  CRISPR gRNA sequence
gcatcaacaggtttttccat

SEQ ID NO: 637553 - DNA, 20 bp, Artificial
  CRISPR gRNA sequence
catcaacaggtttttccata

SEQ ID NO: 637554 - DNA, 20 bp, Artificial
  CRISPR gRNA sequence
ttccataatctaagtaattc

SEQ ID NO: 637555 - DNA, 20 bp, Artificial
  CRISPR gRNA sequence
tccataatctaagtaattct

SEQ ID NO: 637556 - DNA, 20 bp, Artificial
  CRISPR gRNA sequence
ccataatctaagtaattctt

SEQ ID NO: 637557 - DNA, 20 bp, Artificial
  CRISPR gRNA sequence
cataatctaagtaattcttc

SEQ ID NO: 637558 - DNA, 20 bp, Artificial
  CRISPR gRNA sequence
agtaattcttccatggtatt

SEQ ID NO: 637559 - DNA, 20 bp, Artificial
  CRISPR gRNA sequence
ttccatggtattttttctgg

SEQ ID NO: 637560 - DNA, 20 bp, Artificial
  CRISPR gRNA sequence
ccatggtattttttctggta

SEQ ID NO: 637561 - DNA, 20 bp, Artificial
  CRISPR gRNA sequence
catggtattttttctggtaa

SEQ ID NO: 637562 - DNA, 20 bp, Artificial
  CRISPR gRNA sequence
tttctggtaagggagacttt

SEQ ID NO: 637563 - DNA, 20 bp, Artificial
  CRISPR gRNA sequence
ttctggtaagggagactttt

SEQ ID NO: 637564 - DNA, 20 bp, Artificial
  CRISPR gRNA sequence
tctggtaagggagactttta

SEQ ID NO: 637565 - DNA, 20 bp, Artificial
  CRISPR gRNA sequence
ctggtaagggagacttttaa

SEQ ID NO: 637566 - DNA, 20 bp, Artificial
  CRISPR gRNA sequence
tggtaagggagacttttaaa

SEQ ID NO: 637567 - DNA, 20 bp, Artificial
  CRISPR gRNA sequence
gtaagggagacttttaaaat

SEQ ID NO: 637568 - DNA, 20 bp, Artificial
  CRISPR gRNA sequence
ttaaaatcaatgcgaaatgc

SEQ ID NO: 637569 - DNA, 20 bp, Artificial
  CRISPR gRNA sequence
taaaatcaatgcgaaatgct

SEQ ID NO: 637570 - DNA, 20 bp, Artificial
  CRISPR gRNA sequence
aaaatcaatgcgaaatgcta

SEQ ID NO: 637571 - DNA, 20 bp, Artificial
  CRISPR gRNA sequence
aaatcaatgcgaaatgctat

SEQ ID NO: 637572 - DNA, 20 bp, Artificial
  CRISPR gRNA sequence
ttggttatcccatatagtgt

SEQ ID NO: 637573 - DNA, 20 bp, Artificial
  CRISPR gRNA sequence
gttatcccatatagtgttat

SEQ ID NO: 637574 - DNA, 20 bp, Artificial
  CRISPR gRNA sequence
tcccatatagtgttatattc

SEQ ID NO: 637575 - DNA, 20 bp, Artificial
  CRISPR gRNA sequence
tattccattcataattgcca

SEQ ID NO: 637576 - DNA, 20 bp, Artificial
  CRISPR gRNA sequence
cattcataattgccatttaa

SEQ ID NO: 637577 - DNA, 20 bp, Artificial
  CRISPR gRNA sequence
ataattgccatttaaaatta

SEQ ID NO: 637578 - DNA, 20 bp, Artificial
  CRISPR gRNA sequence
ccatttaaaattaaaattaa

SEQ ID NO: 637579 - DNA, 20 bp, Artificial
  CRISPR gRNA sequence
aaaattaaaattaagaaaga

SEQ ID NO: 637580 - DNA, 20 bp, Artificial
  CRISPR gRNA sequence
aaattaaaattaagaaagaa

SEQ ID NO: 637581 - DNA, 20 bp, Artificial
  CRISPR gRNA sequence
aaattaagaaagaaaatcac

SEQ ID NO: 637582 - DNA, 20 bp, Artificial
  CRISPR gRNA sequence
agaaagaaaatcactgaaaa

SEQ ID NO: 637583 - DNA, 20 bp, Artificial
  CRISPR gRNA sequence
aaaagtgtaactttatacag

SEQ ID NO: 637584 - DNA, 20 bp, Artificial
  CRISPR gRNA sequence
tatacagcatgactttatac

SEQ ID NO: 637585 - DNA, 20 bp, Artificial
  CRISPR gRNA sequence
atacagcatgactttatacc

SEQ ID NO: 637586 - DNA, 20 bp, Artificial
  CRISPR gRNA sequence
tacagcatgactttatacca

SEQ ID NO: 637587 - DNA, 20 bp, Artificial
  CRISPR gRNA sequence
tataccacttagtgtgcata

SEQ ID NO: 637588 - DNA, 20 bp, Artificial
  CRISPR gRNA sequence
ataccacttagtgtgcataa

SEQ ID NO: 637589 - DNA, 20 bp, Artificial
  CRISPR gRNA sequence
taccacttagtgtgcataaa

SEQ ID NO: 637590 - DNA, 20 bp, Artificial
  CRISPR gRNA sequence
agtgtgcataaagtgtatca

SEQ ID NO: 637591 - DNA, 20 bp, Artificial
  CRISPR gRNA sequence
gtgtgcataaagtgtatcag

SEQ ID NO: 637592 - DNA, 20 bp, Artificial
  CRISPR gRNA sequence
catttcaggaatgaagaaat

SEQ ID NO: 637593 - DNA, 20 bp, Artificial
  CRISPR gRNA sequence
caggaatgaagaaatacata

SEQ ID NO: 637594 - DNA, 20 bp, Artificial
  CRISPR gRNA sequence
aggaatgaagaaatacataa

SEQ ID NO: 637595 - DNA, 20 bp, Artificial
  CRISPR gRNA sequence
aaagtgtagttttagaacct

SEQ ID NO: 637596 - DNA, 20 bp, Artificial
  CRISPR gRNA sequence
tagaacctgaaactatgagt

SEQ ID NO: 637597 - DNA, 20 bp, Artificial
  CRISPR gRNA sequence
agaacctgaaactatgagtc

SEQ ID NO: 637598 - DNA, 20 bp, Artificial
  CRISPR gRNA sequence
gaacctgaaactatgagtct

SEQ ID NO: 637599 - DNA, 20 bp, Artificial
  CRISPR gRNA sequence
aaactatgagtcttttaaat

SEQ ID NO: 637600 - DNA, 20 bp, Artificial
  CRISPR gRNA sequence
tgagtcttttaaatttcaaa

SEQ ID NO: 637601 - DNA, 20 bp, Artificial
  CRISPR gRNA sequence
ttaaatttcaaaatagctca

SEQ ID NO: 637602 - DNA, 20 bp, Artificial
  CRISPR gRNA sequence
taaatttcaaaatagctcag

SEQ ID NO: 637603 - DNA, 20 bp, Artificial
  CRISPR gRNA sequence
aaatttcaaaatagctcaga

SEQ ID NO: 637604 - DNA, 20 bp, Artificial
  CRISPR gRNA sequence
aatttcaaaatagctcagaa

SEQ ID NO: 637605 - DNA, 20 bp, Artificial
  CRISPR gRNA sequence
caaaatagctcagaattatg

SEQ ID NO: 637606 - DNA, 20 bp, Artificial
  CRISPR gRNA sequence
aaaatagctcagaattatga

SEQ ID NO: 637607 - DNA, 20 bp, Artificial
  CRISPR gRNA sequence
agaattatgaagaatatgac

SEQ ID NO: 637608 - DNA, 20 bp, Artificial
  CRISPR gRNA sequence
tgaagaatatgactgacatt

SEQ ID NO: 637609 - DNA, 20 bp, Artificial
  CRISPR gRNA sequence
acattacactactaagttta

SEQ ID NO: 637610 - DNA, 20 bp, Artificial
  CRISPR gRNA sequence
cactactaagtttaattggg

SEQ ID NO: 637611 - DNA, 20 bp, Artificial
  CRISPR gRNA sequence
ctaagtttaattgggaaatt

SEQ ID NO: 637612 - DNA, 20 bp, Artificial
  CRISPR gRNA sequence
agtttaattgggaaattaaa

SEQ ID NO: 637613 - DNA, 20 bp, Artificial
  CRISPR gRNA sequence
aattgggaaattaaaacata

SEQ ID NO: 637614 - DNA, 20 bp, Artificial
  CRISPR gRNA sequence
attgggaaattaaaacataa

SEQ ID NO: 637615 - DNA, 20 bp, Artificial
  CRISPR gRNA sequence
ggaaattaaaacataacatg

SEQ ID NO: 637616 - DNA, 20 bp, Artificial
  CRISPR gRNA sequence
aaacataacatgaaacagat

SEQ ID NO: 637617 - DNA, 20 bp, Artificial
  CRISPR gRNA sequence
ttaaaagtgtgagatattac

SEQ ID NO: 637618 - DNA, 20 bp, Artificial
  CRISPR gRNA sequence
taaaagtgtgagatattaca

SEQ ID NO: 637619 - DNA, 20 bp, Artificial
  CRISPR gRNA sequence
aaaagtgtgagatattacaa

SEQ ID NO: 637620 - DNA, 20 bp, Artificial
  CRISPR gRNA sequence
aaagtgtgagatattacaaa

SEQ ID NO: 637621 - DNA, 20 bp, Artificial
  CRISPR gRNA sequence
caaatatagttagaactttt

SEQ ID NO: 637622 - DNA, 20 bp, Artificial
  CRISPR gRNA sequence
gaactttttatctatagaag

SEQ ID NO: 637623 - DNA, 20 bp, Artificial
  CRISPR gRNA sequence
tttatctatagaagaatata

SEQ ID NO: 637624 - DNA, 20 bp, Artificial
  CRISPR gRNA sequence
ttatctatagaagaatatac

SEQ ID NO: 637625 - DNA, 20 bp, Artificial
  CRISPR gRNA sequence
tatctatagaagaatatact

SEQ ID NO: 637626 - DNA, 20 bp, Artificial
  CRISPR gRNA sequence
atctatagaagaatatacta

SEQ ID NO: 637627 - DNA, 20 bp, Artificial
  CRISPR gRNA sequence
tctatagaagaatatactac

SEQ ID NO: 637628 - DNA, 20 bp, Artificial
  CRISPR gRNA sequence
tagaagaatatactacaaat

SEQ ID NO: 637629 - DNA, 20 bp, Artificial
  CRISPR gRNA sequence
caaataaatacagaaaaaat

SEQ ID NO: 637630 - DNA, 20 bp, Artificial
  CRISPR gRNA sequence
tgctaaaaccgaaatagaca

SEQ ID NO: 637631 - DNA, 20 bp, Artificial
  CRISPR gRNA sequence
gctaaaaccgaaatagacaa

SEQ ID NO: 637632 - DNA, 20 bp, Artificial
  CRISPR gRNA sequence
ctaaaaccgaaatagacaag

SEQ ID NO: 637633 - DNA, 20 bp, Artificial
  CRISPR gRNA sequence
aaaccgaaatagacaagaaa

SEQ ID NO: 637634 - DNA, 20 bp, Artificial
  CRISPR gRNA sequence
ttctctaacaatactataaa

SEQ ID NO: 637635 - DNA, 20 bp, Artificial
  CRISPR gRNA sequence
tctaacaatactataaagaa

SEQ ID NO: 637636 - DNA, 20 bp, Artificial
  CRISPR gRNA sequence
taacaatactataaagaagt

SEQ ID NO: 637637 - DNA, 20 bp, Artificial
  CRISPR gRNA sequence
acaatactataaagaagtat

SEQ ID NO: 637638 - DNA, 20 bp, Artificial
  CRISPR gRNA sequence
taaagaagtatgtttagaat

SEQ ID NO: 637639 - DNA, 20 bp, Artificial
  CRISPR gRNA sequence
agaatatatgaatgtatata

SEQ ID NO: 637640 - DNA, 20 bp, Artificial
  CRISPR gRNA sequence
gaatatatgaatgtatataa

SEQ ID NO: 637641 - DNA, 20 bp, Artificial
  CRISPR gRNA sequence
tgctgtatttatacagtaaa

SEQ ID NO: 637642 - DNA, 20 bp, Artificial
  CRISPR gRNA sequence
gctgtatttatacagtaaat

SEQ ID NO: 637643 - DNA, 20 bp, Artificial
  CRISPR gRNA sequence
ctgtatttatacagtaaatc

SEQ ID NO: 637644 - DNA, 20 bp, Artificial
  CRISPR gRNA sequence
tatttatacagtaaatcaat

SEQ ID NO: 637645 - DNA, 20 bp, Artificial
  CRISPR gRNA sequence
atacagtaaatcaataaagt

SEQ ID NO: 637646 - DNA, 20 bp, Artificial
  CRISPR gRNA sequence
tacagtaaatcaataaagtg

SEQ ID NO: 637647 - DNA, 20 bp, Artificial
  CRISPR gRNA sequence
taatatacgcatgtcataca

SEQ ID NO: 637648 - DNA, 20 bp, Artificial
  CRISPR gRNA sequence
aatatacgcatgtcatacat

SEQ ID NO: 637649 - DNA, 20 bp, Artificial
  CRISPR gRNA sequence
atatacgcatgtcatacatt

SEQ ID NO: 637650 - DNA, 20 bp, Artificial
  CRISPR gRNA sequence
aattttgcatttacatgatg

SEQ ID NO: 637651 - DNA, 20 bp, Artificial
  CRISPR gRNA sequence
tgcatttacatgatgcatat

SEQ ID NO: 637652 - DNA, 20 bp, Artificial
  CRISPR gRNA sequence
gcatttacatgatgcatata

SEQ ID NO: 637653 - DNA, 20 bp, Artificial
  CRISPR gRNA sequence
catttacatgatgcatatat

SEQ ID NO: 637654 - DNA, 20 bp, Artificial
  CRISPR gRNA sequence
acatgatgcatatatacaaa

SEQ ID NO: 637655 - DNA, 20 bp, Artificial
  CRISPR gRNA sequence
catgatgcatatatacaaac

SEQ ID NO: 637656 - DNA, 20 bp, Artificial
  CRISPR gRNA sequence
atctttcacccatctcacta

SEQ ID NO: 637657 - DNA, 20 bp, Artificial
  CRISPR gRNA sequence
tcacccatctcactacaatt

SEQ ID NO: 637658 - DNA, 20 bp, Artificial
  CRISPR gRNA sequence
cacccatctcactacaatta

SEQ ID NO: 637659 - DNA, 20 bp, Artificial
  CRISPR gRNA sequence
acccatctcactacaattag

SEQ ID NO: 637660 - DNA, 20 bp, Artificial
  CRISPR gRNA sequence
actacaattaggttgaaatt

SEQ ID NO: 637661 - DNA, 20 bp, Artificial
  CRISPR gRNA sequence
caattaggttgaaattctag

SEQ ID NO: 637662 - DNA, 20 bp, Artificial
  CRISPR gRNA sequence
ggttgaaattctagaataaa

SEQ ID NO: 637663 - DNA, 20 bp, Artificial
  CRISPR gRNA sequence
aaattctagaataaaagcaa

SEQ ID NO: 637664 - DNA, 20 bp, Artificial
  CRISPR gRNA sequence
tagaataaaagcaattattc

SEQ ID NO: 637665 - DNA, 20 bp, Artificial
  CRISPR gRNA sequence
gaataaaagcaattattctt

SEQ ID NO: 637666 - DNA, 20 bp, Artificial
  CRISPR gRNA sequence
ttctttgaatcttaactatt

SEQ ID NO: 637667 - DNA, 20 bp, Artificial
  CRISPR gRNA sequence
tttgaatcttaactattaca

SEQ ID NO: 637668 - DNA, 20 bp, Artificial
  CRISPR gRNA sequence
tgaatcttaactattacata

SEQ ID NO: 637669 - DNA, 20 bp, Artificial
  CRISPR gRNA sequence
gaatcttaactattacatag

SEQ ID NO: 637670 - DNA, 20 bp, Artificial
  CRISPR gRNA sequence
aatcttaactattacataga

SEQ ID NO: 637671 - DNA, 20 bp, Artificial
  CRISPR gRNA sequence
aactattacatagaaaagtt

SEQ ID NO: 637672 - DNA, 20 bp, Artificial
  CRISPR gRNA sequence
actattacatagaaaagttt

SEQ ID NO: 637673 - DNA, 20 bp, Artificial
  CRISPR gRNA sequence
ttacatagaaaagttttctc

SEQ ID NO: 637674 - DNA, 20 bp, Artificial
  CRISPR gRNA sequence
catagaaaagttttctccac

SEQ ID NO: 637675 - DNA, 20 bp, Artificial
  CRISPR gRNA sequence
tctccactcatagaaactct

SEQ ID NO: 637676 - DNA, 20 bp, Artificial
  CRISPR gRNA sequence
ctccactcatagaaactctc

SEQ ID NO: 637677 - DNA, 20 bp, Artificial
  CRISPR gRNA sequence
tccactcatagaaactctcc

SEQ ID NO: 637678 - DNA, 20 bp, Artificial
  CRISPR gRNA sequence
cactcatagaaactctccca

SEQ ID NO: 637679 - DNA, 20 bp, Artificial
  CRISPR gRNA sequence
atagaaactctcccatggtt

SEQ ID NO: 637680 - DNA, 20 bp, Artificial
  CRISPR gRNA sequence
tcccatggtttattttcact

SEQ ID NO: 637681 - DNA, 20 bp, Artificial
  CRISPR gRNA sequence
ccatggtttattttcactat

SEQ ID NO: 637682 - DNA, 20 bp, Artificial
  CRISPR gRNA sequence
attttcactatttaagatgt

SEQ ID NO: 637683 - DNA, 20 bp, Artificial
  CRISPR gRNA sequence
ttttcactatttaagatgtt

SEQ ID NO: 637684 - DNA, 20 bp, Artificial
  CRISPR gRNA sequence
tcactatttaagatgtttgc

SEQ ID NO: 637685 - DNA, 20 bp, Artificial
  CRISPR gRNA sequence
cactatttaagatgtttgca

SEQ ID NO: 637686 - DNA, 20 bp, Artificial
  CRISPR gRNA sequence
actatttaagatgtttgcaa

SEQ ID NO: 637687 - DNA, 20 bp, Artificial
  CRISPR gRNA sequence
tttaagatgtttgcaattaa

SEQ ID NO: 637688 - DNA, 20 bp, Artificial
  CRISPR gRNA sequence
aagatgtttgcaattaatgt

SEQ ID NO: 637689 - DNA, 20 bp, Artificial
  CRISPR gRNA sequence
agatgtttgcaattaatgta

SEQ ID NO: 637690 - DNA, 20 bp, Artificial
  CRISPR gRNA sequence
gcaattaatgtagaacacct

SEQ ID NO: 637691 - DNA, 20 bp, Artificial
  CRISPR gRNA sequence
caattaatgtagaacaccta

SEQ ID NO: 637692 - DNA, 20 bp, Artificial
  CRISPR gRNA sequence
atgtagaacacctaatattt

SEQ ID NO: 637693 - DNA, 20 bp, Artificial
  CRISPR gRNA sequence
atattttaacttattaatga

SEQ ID NO: 637694 - DNA, 20 bp, Artificial
  CRISPR gRNA sequence
taacttattaatgattaaat

SEQ ID NO: 637695 - DNA, 20 bp, Artificial
  CRISPR gRNA sequence
aacttattaatgattaaatg

SEQ ID NO: 637696 - DNA, 20 bp, Artificial
  CRISPR gRNA sequence
acttattaatgattaaatgt

SEQ ID NO: 637697 - DNA, 20 bp, Artificial
  CRISPR gRNA sequence
attaatgattaaatgtaagt

SEQ ID NO: 637698 - DNA, 20 bp, Artificial
  CRISPR gRNA sequence
ttaatgattaaatgtaagta

SEQ ID NO: 637699 - DNA, 20 bp, Artificial
  CRISPR gRNA sequence
atgattaaatgtaagtagta

SEQ ID NO: 637700 - DNA, 20 bp, Artificial
  CRISPR gRNA sequence
aatgtaagtagtaaacttaa

SEQ ID NO: 637701 - DNA, 20 bp, Artificial
  CRISPR gRNA sequence
aagtgtattctaaattataa

SEQ ID NO: 637702 - DNA, 20 bp, Artificial
  CRISPR gRNA sequence
agtgtattctaaattataac

SEQ ID NO: 637703 - DNA, 20 bp, Artificial
  CRISPR gRNA sequence
taaattataacttatatata

SEQ ID NO: 637704 - DNA, 20 bp, Artificial
  CRISPR gRNA sequence
aattataacttatatatata

SEQ ID NO: 637705 - DNA, 20 bp, Artificial
  CRISPR gRNA sequence
taacttatatatatataaga

SEQ ID NO: 637706 - DNA, 20 bp, Artificial
  CRISPR gRNA sequence
atatatatataagacttttg

SEQ ID NO: 637707 - DNA, 20 bp, Artificial
  CRISPR gRNA sequence
tatatatataagacttttgt

SEQ ID NO: 637708 - DNA, 20 bp, Artificial
  CRISPR gRNA sequence
ttgttataatattcgtagct

SEQ ID NO: 637709 - DNA, 20 bp, Artificial
  CRISPR gRNA sequence
tgttataatattcgtagcta

SEQ ID NO: 637710 - DNA, 20 bp, Artificial
  CRISPR gRNA sequence
gttataatattcgtagctac

SEQ ID NO: 637711 - DNA, 20 bp, Artificial
  CRISPR gRNA sequence
ttataatattcgtagctaca

SEQ ID NO: 637712 - DNA, 20 bp, Artificial
  CRISPR gRNA sequence
taatattcgtagctacacta

SEQ ID NO: 637713 - DNA, 20 bp, Artificial
  CRISPR gRNA sequence
gtagctacactatatgatgc

SEQ ID NO: 637714 - DNA, 20 bp, Artificial
  CRISPR gRNA sequence
cactatatgatgccacaact

SEQ ID NO: 637715 - DNA, 20 bp, Artificial
  CRISPR gRNA sequence
tatgatgccacaactattga

SEQ ID NO: 637716 - DNA, 20 bp, Artificial
  CRISPR gRNA sequence
ttgaattacaactattaacc

SEQ ID NO: 637717 - DNA, 20 bp, Artificial
  CRISPR gRNA sequence
aattacaactattaaccact

SEQ ID NO: 637718 - DNA, 20 bp, Artificial
  CRISPR gRNA sequence
caactattaaccactgtaca

SEQ ID NO: 637719 - DNA, 20 bp, Artificial
  CRISPR gRNA sequence
ttaaccactgtacaataata

SEQ ID NO: 637720 - DNA, 20 bp, Artificial
  CRISPR gRNA sequence
accactgtacaataatattc

SEQ ID NO: 637721 - DNA, 20 bp, Artificial
  CRISPR gRNA sequence
tacaataatattcagagtgc

SEQ ID NO: 637722 - DNA, 20 bp, Artificial
  CRISPR gRNA sequence
agagtgctttacttttcaaa

SEQ ID NO: 637723 - DNA, 20 bp, Artificial
  CRISPR gRNA sequence
tacttttcaaatatttgaaa

SEQ ID NO: 637724 - DNA, 20 bp, Artificial
  CRISPR gRNA sequence
acttttcaaatatttgaaat

SEQ ID NO: 637725 - DNA, 20 bp, Artificial
  CRISPR gRNA sequence
cttttcaaatatttgaaatt

SEQ ID NO: 637726 - DNA, 20 bp, Artificial
  CRISPR gRNA sequence
ttcaaatatttgaaattaga

SEQ ID NO: 637727 - DNA, 20 bp, Artificial
  CRISPR gRNA sequence
tcaaatatttgaaattagat

SEQ ID NO: 637728 - DNA, 20 bp, Artificial
  CRISPR gRNA sequence
caaatatttgaaattagatt

SEQ ID NO: 637729 - DNA, 20 bp, Artificial
  CRISPR gRNA sequence
aaatatttgaaattagattt

SEQ ID NO: 637730 - DNA, 20 bp, Artificial
  CRISPR gRNA sequence
gaaattagatttatatgaaa

SEQ ID NO: 637731 - DNA, 20 bp, Artificial
  CRISPR gRNA sequence
aaattagatttatatgaaat

SEQ ID NO: 637732 - DNA, 20 bp, Artificial
  CRISPR gRNA sequence
gatttatatgaaatttattt

SEQ ID NO: 637733 - DNA, 20 bp, Artificial
  CRISPR gRNA sequence
atatgaaatttattttacaa

SEQ ID NO: 637734 - DNA, 20 bp, Artificial
  CRISPR gRNA sequence
tatgaaatttattttacaat

SEQ ID NO: 637735 - DNA, 20 bp, Artificial
  CRISPR gRNA sequence
attttacaatttggtaacac

SEQ ID NO: 637736 - DNA, 20 bp, Artificial
  CRISPR gRNA sequence
ttttacaatttggtaacaca

SEQ ID NO: 637737 - DNA, 20 bp, Artificial
  CRISPR gRNA sequence
tacaatttggtaacacaaag

SEQ ID NO: 637738 - DNA, 20 bp, Artificial
  CRISPR gRNA sequence
acaatttggtaacacaaaga

SEQ ID NO: 637739 - DNA, 20 bp, Artificial
  CRISPR gRNA sequence
caatttggtaacacaaagac

SEQ ID NO: 637740 - DNA, 20 bp, Artificial
  CRISPR gRNA sequence
ggtaacacaaagacatcctc

SEQ ID NO: 637741 - DNA, 20 bp, Artificial
  CRISPR gRNA sequence
gtaacacaaagacatcctca

SEQ ID NO: 637742 - DNA, 20 bp, Artificial
  CRISPR gRNA sequence
ataaatgggctataaagatg

SEQ ID NO: 637743 - DNA, 20 bp, Artificial
  CRISPR gRNA sequence
taaagatgaaaacttgttca

SEQ ID NO: 637744 - DNA, 20 bp, Artificial
  CRISPR gRNA sequence
gttcatttgagtaaaatgaa

SEQ ID NO: 637745 - DNA, 20 bp, Artificial
  CRISPR gRNA sequence
ttcatttgagtaaaatgaaa

SEQ ID NO: 637746 - DNA, 20 bp, Artificial
  CRISPR gRNA sequence
atttgagtaaaatgaaaaat

SEQ ID NO: 637747 - DNA, 20 bp, Artificial
  CRISPR gRNA sequence
gagtaaaatgaaaaatcact

SEQ ID NO: 637748 - DNA, 20 bp, Artificial
  CRISPR gRNA sequence
agtaaaatgaaaaatcactg

SEQ ID NO: 637749 - DNA, 20 bp, Artificial
  CRISPR gRNA sequence
ttacaattctcaataccaag

SEQ ID NO: 637750 - DNA, 20 bp, Artificial
  CRISPR gRNA sequence
caattctcaataccaagagt

SEQ ID NO: 637751 - DNA, 20 bp, Artificial
  CRISPR gRNA sequence
tcaataccaagagttatttt

SEQ ID NO: 637752 - DNA, 20 bp, Artificial
  CRISPR gRNA sequence
aataccaagagttatttttc

SEQ ID NO: 637753 - DNA, 20 bp, Artificial
  CRISPR gRNA sequence
tttttcaagcttgtttctct

SEQ ID NO: 637754 - DNA, 20 bp, Artificial
  CRISPR gRNA sequence
ttcaagcttgtttctctgat

SEQ ID NO: 637755 - DNA, 20 bp, Artificial
  CRISPR gRNA sequence
tcaagcttgtttctctgata

SEQ ID NO: 637756 - DNA, 20 bp, Artificial
  CRISPR gRNA sequence
caagcttgtttctctgatat

SEQ ID NO: 637757 - DNA, 20 bp, Artificial
  CRISPR gRNA sequence
aagcttgtttctctgatatg

SEQ ID NO: 637758 - DNA, 20 bp, Artificial
  CRISPR gRNA sequence
gtttctctgatatgaaataa

SEQ ID NO: 637759 - DNA, 20 bp, Artificial
  CRISPR gRNA sequence
tttctctgatatgaaataaa

SEQ ID NO: 637760 - DNA, 20 bp, Artificial
  CRISPR gRNA sequence
ctctgatatgaaataaagaa

SEQ ID NO: 637761 - DNA, 20 bp, Artificial
  CRISPR gRNA sequence
tctgatatgaaataaagaat

SEQ ID NO: 637762 - DNA, 20 bp, Artificial
  CRISPR gRNA sequence
tgatatgaaataaagaatgt

SEQ ID NO: 637763 - DNA, 20 bp, Artificial
  CRISPR gRNA sequence
atatgaaataaagaatgtaa

SEQ ID NO: 637764 - DNA, 20 bp, Artificial
  CRISPR gRNA sequence
gggcatatctgtggaaatgt

SEQ ID NO: 637765 - DNA, 20 bp, Artificial
  CRISPR gRNA sequence
ggcatatctgtggaaatgta

SEQ ID NO: 637766 - DNA, 20 bp, Artificial
  CRISPR gRNA sequence
tggaaatgtacacacgttat

SEQ ID NO: 637767 - DNA, 20 bp, Artificial
  CRISPR gRNA sequence
tcatatgctaataagcaata

SEQ ID NO: 637768 - DNA, 20 bp, Artificial
  CRISPR gRNA sequence
ataagcaataatggtttaat

SEQ ID NO: 637769 - DNA, 20 bp, Artificial
  CRISPR gRNA sequence
aatttaaaaagaattttgcc

SEQ ID NO: 637770 - DNA, 20 bp, Artificial
  CRISPR gRNA sequence
atttaaaaagaattttgcca

SEQ ID NO: 637771 - DNA, 20 bp, Artificial
  CRISPR gRNA sequence
aaaaagaattttgccagaac

SEQ ID NO: 637772 - DNA, 20 bp, Artificial
  CRISPR gRNA sequence
aaaagaattttgccagaaca

SEQ ID NO: 637773 - DNA, 20 bp, Artificial
  CRISPR gRNA sequence
tgccagaacaaactgttagc

SEQ ID NO: 637774 - DNA, 20 bp, Artificial
  CRISPR gRNA sequence
gccagaacaaactgttagca

SEQ ID NO: 637775 - DNA, 20 bp, Artificial
  CRISPR gRNA sequence
ccagaacaaactgttagcaa

SEQ ID NO: 637776 - DNA, 20 bp, Artificial
  CRISPR gRNA sequence
ttagcaatgaaaaggggata

SEQ ID NO: 637777 - DNA, 20 bp, Artificial
  CRISPR gRNA sequence
gcaatgaaaaggggatatga

SEQ ID NO: 637778 - DNA, 20 bp, Artificial
  CRISPR gRNA sequence
tagttttgatgataaagatg

SEQ ID NO: 637779 - DNA, 20 bp, Artificial
  CRISPR gRNA sequence
agttttgatgataaagatgt

SEQ ID NO: 637780 - DNA, 20 bp, Artificial
  CRISPR gRNA sequence
gttttgatgataaagatgtt

SEQ ID NO: 637781 - DNA, 20 bp, Artificial
  CRISPR gRNA sequence
tgatgataaagatgtttctt

SEQ ID NO: 637782 - DNA, 20 bp, Artificial
  CRISPR gRNA sequence
gatgataaagatgtttctta

SEQ ID NO: 637783 - DNA, 20 bp, Artificial
  CRISPR gRNA sequence
atgataaagatgtttcttat

SEQ ID NO: 637784 - DNA, 20 bp, Artificial
  CRISPR gRNA sequence
cttatacttcagttgtaatg

SEQ ID NO: 637785 - DNA, 20 bp, Artificial
  CRISPR gRNA sequence
ttatacttcagttgtaatgg

SEQ ID NO: 637786 - DNA, 20 bp, Artificial
  CRISPR gRNA sequence
atacttcagttgtaatggca

SEQ ID NO: 637787 - DNA, 20 bp, Artificial
  CRISPR gRNA sequence
tacttcagttgtaatggcac

SEQ ID NO: 637788 - DNA, 20 bp, Artificial
  CRISPR gRNA sequence
cagttgtaatggcacttcta

SEQ ID NO: 637789 - DNA, 20 bp, Artificial
  CRISPR gRNA sequence
agttgtaatggcacttctat

SEQ ID NO: 637790 - DNA, 20 bp, Artificial
  CRISPR gRNA sequence
taatggcacttctatttagc

SEQ ID NO: 637791 - DNA, 20 bp, Artificial
  CRISPR gRNA sequence
ctatttagcatttatattta

SEQ ID NO: 637792 - DNA, 20 bp, Artificial
  CRISPR gRNA sequence
tatttagcatttatatttat

SEQ ID NO: 637793 - DNA, 20 bp, Artificial
  CRISPR gRNA sequence
tttagcatttatatttataa

SEQ ID NO: 637794 - DNA, 20 bp, Artificial
  CRISPR gRNA sequence
agcatttatatttataactg

SEQ ID NO: 637795 - DNA, 20 bp, Artificial
  CRISPR gRNA sequence
gcatttatatttataactgt

SEQ ID NO: 637796 - DNA, 20 bp, Artificial
  CRISPR gRNA sequence
atatttataactgttacatc

SEQ ID NO: 637797 - DNA, 20 bp, Artificial
  CRISPR gRNA sequence
tatttataactgttacatcc

SEQ ID NO: 637798 - DNA, 20 bp, Artificial
  CRISPR gRNA sequence
ataactgttacatccatatt

SEQ ID NO: 637799 - DNA, 20 bp, Artificial
  CRISPR gRNA sequence
taactgttacatccatattt

SEQ ID NO: 637800 - DNA, 20 bp, Artificial
  CRISPR gRNA sequence
ttacatccatattttagtag

SEQ ID NO: 637801 - DNA, 20 bp, Artificial
  CRISPR gRNA sequence
catccatattttagtagact

SEQ ID NO: 637802 - DNA, 20 bp, Artificial
  CRISPR gRNA sequence
tagtagactcaggtttgtga

SEQ ID NO: 637803 - DNA, 20 bp, Artificial
  CRISPR gRNA sequence
agtagactcaggtttgtgaa

SEQ ID NO: 637804 - DNA, 20 bp, Artificial
  CRISPR gRNA sequence
gtagactcaggtttgtgaac

SEQ ID NO: 637805 - DNA, 20 bp, Artificial
  CRISPR gRNA sequence
aggtttgtgaacacaaggaa

SEQ ID NO: 637806 - DNA, 20 bp, Artificial
  CRISPR gRNA sequence
gtgaacacaaggaaagaata

SEQ ID NO: 637807 - DNA, 20 bp, Artificial
  CRISPR gRNA sequence
tgaacacaaggaaagaataa

SEQ ID NO: 637808 - DNA, 20 bp, Artificial
  CRISPR gRNA sequence
atagaaaaaaactgttatgg

SEQ ID NO: 637809 - DNA, 20 bp, Artificial
  CRISPR gRNA sequence
ttatggtcaagtttatgtag

SEQ ID NO: 637810 - DNA, 20 bp, Artificial
  CRISPR gRNA sequence
tggtcaagtttatgtagaaa

SEQ ID NO: 637811 - DNA, 20 bp, Artificial
  CRISPR gRNA sequence
atgtagaaaaagctttgaag

SEQ ID NO: 637812 - DNA, 20 bp, Artificial
  CRISPR gRNA sequence
tgtagaaaaagctttgaaga

SEQ ID NO: 637813 - DNA, 20 bp, Artificial
  CRISPR gRNA sequence
tgaagatatttcatgataaa

SEQ ID NO: 637814 - DNA, 20 bp, Artificial
  CRISPR gRNA sequence
gaagatatttcatgataaaa

SEQ ID NO: 637815 - DNA, 20 bp, Artificial
  CRISPR gRNA sequence
aagatatttcatgataaaaa

SEQ ID NO: 637816 - DNA, 20 bp, Artificial
  CRISPR gRNA sequence
catgataaaaagtgccacat

SEQ ID NO: 637817 - DNA, 20 bp, Artificial
  CRISPR gRNA sequence
atgataaaaagtgccacata

SEQ ID NO: 637818 - DNA, 20 bp, Artificial
  CRISPR gRNA sequence
ttccaaacaaaaaaaagctt

SEQ ID NO: 637819 - DNA, 20 bp, Artificial
  CRISPR gRNA sequence
tccaaacaaaaaaaagcttc

SEQ ID NO: 637820 - DNA, 20 bp, Artificial
  CRISPR gRNA sequence
ccaaacaaaaaaaagcttca

SEQ ID NO: 637821 - DNA, 20 bp, Artificial
  CRISPR gRNA sequence
caaacaaaaaaaagcttcag

SEQ ID NO: 637822 - DNA, 20 bp, Artificial
  CRISPR gRNA sequence
caggatataaacattttcat

SEQ ID NO: 637823 - DNA, 20 bp, Artificial
  CRISPR gRNA sequence
aggatataaacattttcatg

SEQ ID NO: 637824 - DNA, 20 bp, Artificial
  CRISPR gRNA sequence
tcatgaattcaagcttttcc

SEQ ID NO: 637825 - DNA, 20 bp, Artificial
  CRISPR gRNA sequence
catgaattcaagcttttccc

SEQ ID NO: 637826 - DNA, 20 bp, Artificial
  CRISPR gRNA sequence
atgaattcaagcttttcccc

SEQ ID NO: 637827 - DNA, 20 bp, Artificial
  CRISPR gRNA sequence
aagcttttcccctcttcttc

SEQ ID NO: 637828 - DNA, 20 bp, Artificial
  CRISPR gRNA sequence
ttcccctcttcttctttatg

SEQ ID NO: 637829 - DNA, 20 bp, Artificial
  CRISPR gRNA sequence
tcccctcttcttctttatgc

SEQ ID NO: 637830 - DNA, 20 bp, Artificial
  CRISPR gRNA sequence
cccctcttcttctttatgct

SEQ ID NO: 637831 - DNA, 20 bp, Artificial
  CRISPR gRNA sequence
ccctcttcttctttatgctt

SEQ ID NO: 637832 - DNA, 20 bp, Artificial
  CRISPR gRNA sequence
ttcttctttatgctttcaaa

SEQ ID NO: 637833 - DNA, 20 bp, Artificial
  CRISPR gRNA sequence
cttctttatgctttcaaaat

SEQ ID NO: 637834 - DNA, 20 bp, Artificial
  CRISPR gRNA sequence
ttctttatgctttcaaaata

SEQ ID NO: 637835 - DNA, 20 bp, Artificial
  CRISPR gRNA sequence
ctttatgctttcaaaatact

SEQ ID NO: 637836 - DNA, 20 bp, Artificial
  CRISPR gRNA sequence
tttatgctttcaaaatacta

SEQ ID NO: 637837 - DNA, 20 bp, Artificial
  CRISPR gRNA sequence
tatgctttcaaaatactatt

SEQ ID NO: 637838 - DNA, 20 bp, Artificial
  CRISPR gRNA sequence
atgctttcaaaatactattt

SEQ ID NO: 637839 - DNA, 20 bp, Artificial
  CRISPR gRNA sequence
tgctttcaaaatactattta

SEQ ID NO: 637840 - DNA, 20 bp, Artificial
  CRISPR gRNA sequence
tcaaaatactatttataaac

SEQ ID NO: 637841 - DNA, 20 bp, Artificial
  CRISPR gRNA sequence
caaaatactatttataaaca

SEQ ID NO: 637842 - DNA, 20 bp, Artificial
  CRISPR gRNA sequence
aaaatactatttataaacac

SEQ ID NO: 637843 - DNA, 20 bp, Artificial
  CRISPR gRNA sequence
tttataaacactagaatgta

SEQ ID NO: 637844 - DNA, 20 bp, Artificial
  CRISPR gRNA sequence
ataaacactagaatgtaatc

SEQ ID NO: 637845 - DNA, 20 bp, Artificial
  CRISPR gRNA sequence
taaacactagaatgtaatct

SEQ ID NO: 637846 - DNA, 20 bp, Artificial
  CRISPR gRNA sequence
gaatgtaatcttgatgccat

SEQ ID NO: 637847 - DNA, 20 bp, Artificial
  CRISPR gRNA sequence
gatgccataaaaacacctag

SEQ ID NO: 637848 - DNA, 20 bp, Artificial
  CRISPR gRNA sequence
atgccataaaaacacctagt

SEQ ID NO: 637849 - DNA, 20 bp, Artificial
  CRISPR gRNA sequence
gtttaagcaattccacttac

SEQ ID NO: 637850 - DNA, 20 bp, Artificial
  CRISPR gRNA sequence
aagcaattccacttacaaat

SEQ ID NO: 637851 - DNA, 20 bp, Artificial
  CRISPR gRNA sequence
agcaattccacttacaaatt

SEQ ID NO: 637852 - DNA, 20 bp, Artificial
  CRISPR gRNA sequence
cacttacaaattacaagaag

SEQ ID NO: 637853 - DNA, 20 bp, Artificial
  CRISPR gRNA sequence
acaaattacaagaagtaaag

SEQ ID NO: 637854 - DNA, 20 bp, Artificial
  CRISPR gRNA sequence
caaattacaagaagtaaaga

SEQ ID NO: 637855 - DNA, 20 bp, Artificial
  CRISPR gRNA sequence
caagaagtaaagacacttgc

SEQ ID NO: 637856 - DNA, 20 bp, Artificial
  CRISPR gRNA sequence
gcacagatactcttttttaa

SEQ ID NO: 637857 - DNA, 20 bp, Artificial
  CRISPR gRNA sequence
cacagatactcttttttaaa

SEQ ID NO: 637858 - DNA, 20 bp, Artificial
  CRISPR gRNA sequence
ttttttaaagtgaatttcaa

SEQ ID NO: 637859 - DNA, 20 bp, Artificial
  CRISPR gRNA sequence
ttttaaagtgaatttcaagc

SEQ ID NO: 637860 - DNA, 20 bp, Artificial
  CRISPR gRNA sequence
tttaaagtgaatttcaagcc

SEQ ID NO: 637861 - DNA, 20 bp, Artificial
  CRISPR gRNA sequence
ttaaagtgaatttcaagcca

SEQ ID NO: 637862 - DNA, 20 bp, Artificial
  CRISPR gRNA sequence
taaagtgaatttcaagccaa

SEQ ID NO: 637863 - DNA, 20 bp, Artificial
  CRISPR gRNA sequence
aaagtgaatttcaagccaaa

SEQ ID NO: 637864 - DNA, 20 bp, Artificial
  CRISPR gRNA sequence
aagtgaatttcaagccaaac

SEQ ID NO: 637865 - DNA, 20 bp, Artificial
  CRISPR gRNA sequence
caagccaaacaattttcaat

SEQ ID NO: 637866 - DNA, 20 bp, Artificial
  CRISPR gRNA sequence
aagccaaacaattttcaatt

SEQ ID NO: 637867 - DNA, 20 bp, Artificial
  CRISPR gRNA sequence
tcaattataaaagttccttc

SEQ ID NO: 637868 - DNA, 20 bp, Artificial
  CRISPR gRNA sequence
caattataaaagttccttca

SEQ ID NO: 637869 - DNA, 20 bp, Artificial
  CRISPR gRNA sequence
aattataaaagttccttcag

SEQ ID NO: 637870 - DNA, 20 bp, Artificial
  CRISPR gRNA sequence
taaaagttccttcagtaacc

SEQ ID NO: 637871 - DNA, 20 bp, Artificial
  CRISPR gRNA sequence
cttcagtaaccattctaggc

SEQ ID NO: 637872 - DNA, 20 bp, Artificial
  CRISPR gRNA sequence
cagtaaccattctaggctct

SEQ ID NO: 637873 - DNA, 20 bp, Artificial
  CRISPR gRNA sequence
agtaaccattctaggctctc

SEQ ID NO: 637874 - DNA, 20 bp, Artificial
  CRISPR gRNA sequence
taggctctctacaatcaaag

SEQ ID NO: 637875 - DNA, 20 bp, Artificial
  CRISPR gRNA sequence
ggctctctacaatcaaaggc

SEQ ID NO: 637876 - DNA, 20 bp, Artificial
  CRISPR gRNA sequence
tctacaatcaaaggcttcac

SEQ ID NO: 637877 - DNA, 20 bp, Artificial
  CRISPR gRNA sequence
tacaatcaaaggcttcacaa

SEQ ID NO: 637878 - DNA, 20 bp, Artificial
  CRISPR gRNA sequence
caatcaaaggcttcacaata

SEQ ID NO: 637879 - DNA, 20 bp, Artificial
  CRISPR gRNA sequence
cacaatagtcattgcttcca

SEQ ID NO: 637880 - DNA, 20 bp, Artificial
  CRISPR gRNA sequence
acaatagtcattgcttccag

SEQ ID NO: 637881 - DNA, 20 bp, Artificial
  CRISPR gRNA sequence
cttccagatacataatagtg

SEQ ID NO: 637882 - DNA, 20 bp, Artificial
  CRISPR gRNA sequence
ccagatacataatagtgaat

SEQ ID NO: 637883 - DNA, 20 bp, Artificial
  CRISPR gRNA sequence
cagatacataatagtgaatg

SEQ ID NO: 637884 - DNA, 20 bp, Artificial
  CRISPR gRNA sequence
cactagacttgcctttaatt

SEQ ID NO: 637885 - DNA, 20 bp, Artificial
  CRISPR gRNA sequence
gacttgcctttaattcacta

SEQ ID NO: 637886 - DNA, 20 bp, Artificial
  CRISPR gRNA sequence
gcctttaattcactaatatg

SEQ ID NO: 637887 - DNA, 20 bp, Artificial
  CRISPR gRNA sequence
cctttaattcactaatatga

SEQ ID NO: 637888 - DNA, 20 bp, Artificial
  CRISPR gRNA sequence
taattcactaatatgataat

SEQ ID NO: 637889 - DNA, 20 bp, Artificial
  CRISPR gRNA sequence
aattcactaatatgataata

SEQ ID NO: 637890 - DNA, 20 bp, Artificial
  CRISPR gRNA sequence
attcactaatatgataataa

SEQ ID NO: 637891 - DNA, 20 bp, Artificial
  CRISPR gRNA sequence
actaatatgataataaaagg

SEQ ID NO: 637892 - DNA, 20 bp, Artificial
  CRISPR gRNA sequence
atatgataataaaaggataa

SEQ ID NO: 637893 - DNA, 20 bp, Artificial
  CRISPR gRNA sequence
aataaaggcctttacacagg

SEQ ID NO: 637894 - DNA, 20 bp, Artificial
  CRISPR gRNA sequence
tacacaggtaaacaggtata

SEQ ID NO: 637895 - DNA, 20 bp, Artificial
  CRISPR gRNA sequence
acacaggtaaacaggtatag

SEQ ID NO: 637896 - DNA, 20 bp, Artificial
  CRISPR gRNA sequence
cacaggtaaacaggtataga

SEQ ID NO: 637897 - DNA, 20 bp, Artificial
  CRISPR gRNA sequence
tgaaaaaaaagtagaatcta

SEQ ID NO: 637898 - DNA, 20 bp, Artificial
  CRISPR gRNA sequence
aaaccaaatggagcaaaatc

SEQ ID NO: 637899 - DNA, 20 bp, Artificial
  CRISPR gRNA sequence
ttttgtgaatctattaaaaa

SEQ ID NO: 637900 - DNA, 20 bp, Artificial
  CRISPR gRNA sequence
tgtgaatctattaaaaacaa

SEQ ID NO: 637901 - DNA, 20 bp, Artificial
  CRISPR gRNA sequence
gtgaatctattaaaaacaaa

SEQ ID NO: 637902 - DNA, 20 bp, Artificial
  CRISPR gRNA sequence
tgaatctattaaaaacaaat

SEQ ID NO: 637903 - DNA, 20 bp, Artificial
  CRISPR gRNA sequence
ttaaaaacaaattaatttaa

SEQ ID NO: 637904 - DNA, 20 bp, Artificial
  CRISPR gRNA sequence
aaaacaaattaatttaatcc

SEQ ID NO: 637905 - DNA, 20 bp, Artificial
  CRISPR gRNA sequence
atttaatccaatcaatgtca

SEQ ID NO: 637906 - DNA, 20 bp, Artificial
  CRISPR gRNA sequence
aatccaatcaatgtcataat

SEQ ID NO: 637907 - DNA, 20 bp, Artificial
  CRISPR gRNA sequence
atccaatcaatgtcataatg

SEQ ID NO: 637908 - DNA, 20 bp, Artificial
  CRISPR gRNA sequence
tctttgccaccattgtactt

SEQ ID NO: 637909 - DNA, 20 bp, Artificial
  CRISPR gRNA sequence
ctttgccaccattgtacttg

SEQ ID NO: 637910 - DNA, 20 bp, Artificial
  CRISPR gRNA sequence
tttgccaccattgtacttga

SEQ ID NO: 637911 - DNA, 20 bp, Artificial
  CRISPR gRNA sequence
tgccaccattgtacttgaaa

SEQ ID NO: 637912 - DNA, 20 bp, Artificial
  CRISPR gRNA sequence
gccaccattgtacttgaaaa

SEQ ID NO: 637913 - DNA, 20 bp, Artificial
  CRISPR gRNA sequence
ccaccattgtacttgaaaaa

SEQ ID NO: 637914 - DNA, 20 bp, Artificial
  CRISPR gRNA sequence
tacttgaaaaagtaaaaaaa

SEQ ID NO: 637915 - DNA, 20 bp, Artificial
  CRISPR gRNA sequence
gaaaaagtaaaaaaaaaaaa

SEQ ID NO: 637916 - DNA, 20 bp, Artificial
  CRISPR gRNA sequence
aaaaagtaaaaaaaaaaaat

SEQ ID NO: 637917 - DNA, 20 bp, Artificial
  CRISPR gRNA sequence
aaattttactcacataagaa

SEQ ID NO: 637918 - DNA, 20 bp, Artificial
  CRISPR gRNA sequence
tactcacataagaatgaaaa

SEQ ID NO: 637919 - DNA, 20 bp, Artificial
  CRISPR gRNA sequence
actcacataagaatgaaaag

SEQ ID NO: 637920 - DNA, 20 bp, Artificial
  CRISPR gRNA sequence
ctcacataagaatgaaaagg

SEQ ID NO: 637921 - DNA, 20 bp, Artificial
  CRISPR gRNA sequence
acataagaatgaaaaggata

SEQ ID NO: 637922 - DNA, 20 bp, Artificial
  CRISPR gRNA sequence
catacatttgtagaccttac

SEQ ID NO: 637923 - DNA, 20 bp, Artificial
  CRISPR gRNA sequence
gtagaccttacattcattta

SEQ ID NO: 637924 - DNA, 20 bp, Artificial
  CRISPR gRNA sequence
tagaccttacattcatttat

SEQ ID NO: 637925 - DNA, 20 bp, Artificial
  CRISPR gRNA sequence
acattcatttatagaactca

SEQ ID NO: 637926 - DNA, 20 bp, Artificial
  CRISPR gRNA sequence
cattcatttatagaactcat

SEQ ID NO: 637927 - DNA, 20 bp, Artificial
  CRISPR gRNA sequence
atttatagaactcatctacc

SEQ ID NO: 637928 - DNA, 20 bp, Artificial
  CRISPR gRNA sequence
atagaactcatctaccttag

SEQ ID NO: 637929 - DNA, 20 bp, Artificial
  CRISPR gRNA sequence
tagaactcatctaccttagc

SEQ ID NO: 637930 - DNA, 20 bp, Artificial
  CRISPR gRNA sequence
atctaccttagccaataaag

SEQ ID NO: 637931 - DNA, 20 bp, Artificial
  CRISPR gRNA sequence
ccttagccaataaagaacaa

SEQ ID NO: 637932 - DNA, 20 bp, Artificial
  CRISPR gRNA sequence
agccaataaagaacaaagac

SEQ ID NO: 637933 - DNA, 20 bp, Artificial
  CRISPR gRNA sequence
gccaataaagaacaaagaca

SEQ ID NO: 637934 - DNA, 20 bp, Artificial
  CRISPR gRNA sequence
aattctcttaaaaaatcatt

SEQ ID NO: 637935 - DNA, 20 bp, Artificial
  CRISPR gRNA sequence
tcttaaaaaatcattaaacc

SEQ ID NO: 637936 - DNA, 20 bp, Artificial
  CRISPR gRNA sequence
ttaaaaaatcattaaaccag

SEQ ID NO: 637937 - DNA, 20 bp, Artificial
  CRISPR gRNA sequence
aaaaaatcattaaaccagta

SEQ ID NO: 637938 - DNA, 20 bp, Artificial
  CRISPR gRNA sequence
aaaaatcattaaaccagtaa

SEQ ID NO: 637939 - DNA, 20 bp, Artificial
  CRISPR gRNA sequence
aaccagtaaatatttattaa

SEQ ID NO: 637940 - DNA, 20 bp, Artificial
  CRISPR gRNA sequence
attaagtatctactacttgc

SEQ ID NO: 637941 - DNA, 20 bp, Artificial
  CRISPR gRNA sequence
ttaagtatctactacttgcc

SEQ ID NO: 637942 - DNA, 20 bp, Artificial
  CRISPR gRNA sequence
agtatctactacttgcctaa

SEQ ID NO: 637943 - DNA, 20 bp, Artificial
  CRISPR gRNA sequence
ctacttgcctaatactttgt

SEQ ID NO: 637944 - DNA, 20 bp, Artificial
  CRISPR gRNA sequence
cttgcctaatactttgtcaa

SEQ ID NO: 637945 - DNA, 20 bp, Artificial
  CRISPR gRNA sequence
gcctaatactttgtcaataa

SEQ ID NO: 637946 - DNA, 20 bp, Artificial
  CRISPR gRNA sequence
cctaatactttgtcaataat

SEQ ID NO: 637947 - DNA, 20 bp, Artificial
  CRISPR gRNA sequence
atactttgtcaataataata

SEQ ID NO: 637948 - DNA, 20 bp, Artificial
  CRISPR gRNA sequence
tgtcaataataatagtaaag

SEQ ID NO: 637949 - DNA, 20 bp, Artificial
  CRISPR gRNA sequence
gtcaataataatagtaaagg

SEQ ID NO: 637950 - DNA, 20 bp, Artificial
  CRISPR gRNA sequence
tcaataataatagtaaaggt

SEQ ID NO: 637951 - DNA, 20 bp, Artificial
  CRISPR gRNA sequence
aaagctaaagcaaaaaaaat

SEQ ID NO: 637952 - DNA, 20 bp, Artificial
  CRISPR gRNA sequence
aagctaaagcaaaaaaaata

SEQ ID NO: 637953 - DNA, 20 bp, Artificial
  CRISPR gRNA sequence
aagcaaaaaaaatactatta

SEQ ID NO: 637954 - DNA, 20 bp, Artificial
  CRISPR gRNA sequence
ttaacttaaataagtaaccc

SEQ ID NO: 637955 - DNA, 20 bp, Artificial
  CRISPR gRNA sequence
acttaaataagtaacccata

SEQ ID NO: 637956 - DNA, 20 bp, Artificial
  CRISPR gRNA sequence
aaataagtaacccatattaa

SEQ ID NO: 637957 - DNA, 20 bp, Artificial
  CRISPR gRNA sequence
aataagtaacccatattaac

SEQ ID NO: 637958 - DNA, 20 bp, Artificial
  CRISPR gRNA sequence
acacaagagtatgtactcca

SEQ ID NO: 637959 - DNA, 20 bp, Artificial
  CRISPR gRNA sequence
caaaaatggccataaaagag

SEQ ID NO: 637960 - DNA, 20 bp, Artificial
  CRISPR gRNA sequence
atgagttagaatacaggaaa

SEQ ID NO: 637961 - DNA, 20 bp, Artificial
  CRISPR gRNA sequence
gaatacaggaaatattttac

SEQ ID NO: 637962 - DNA, 20 bp, Artificial
  CRISPR gRNA sequence
tacaaacatatgtaatttgg

SEQ ID NO: 637963 - DNA, 20 bp, Artificial
  CRISPR gRNA sequence
acaaacatatgtaatttggt

SEQ ID NO: 637964 - DNA, 20 bp, Artificial
  CRISPR gRNA sequence
caaacatatgtaatttggtt

SEQ ID NO: 637965 - DNA, 20 bp, Artificial
  CRISPR gRNA sequence
ggttacataataaatttatt

SEQ ID NO: 637966 - DNA, 20 bp, Artificial
  CRISPR gRNA sequence
gttacataataaatttattg

SEQ ID NO: 637967 - DNA, 20 bp, Artificial
  CRISPR gRNA sequence
cataataaatttattgaact

SEQ ID NO: 637968 - DNA, 20 bp, Artificial
  CRISPR gRNA sequence
attgaactgaacaatatata

SEQ ID NO: 637969 - DNA, 20 bp, Artificial
  CRISPR gRNA sequence
ttgaactgaacaatatataa

SEQ ID NO: 637970 - DNA, 20 bp, Artificial
  CRISPR gRNA sequence
aactgaacaatatataaatg

SEQ ID NO: 637971 - DNA, 20 bp, Artificial
  CRISPR gRNA sequence
aacaatatataaatgtaaaa

SEQ ID NO: 637972 - DNA, 20 bp, Artificial
  CRISPR gRNA sequence
ctttaaaacctggacatttt

SEQ ID NO: 637973 - DNA, 20 bp, Artificial
  CRISPR gRNA sequence
tttaaaacctggacatttta

SEQ ID NO: 637974 - DNA, 20 bp, Artificial
  CRISPR gRNA sequence
taaaacctggacattttact

SEQ ID NO: 637975 - DNA, 20 bp, Artificial
  CRISPR gRNA sequence
aaaacctggacattttactt

SEQ ID NO: 637976 - DNA, 20 bp, Artificial
  CRISPR gRNA sequence
aaacctggacattttacttt

SEQ ID NO: 637977 - DNA, 20 bp, Artificial
  CRISPR gRNA sequence
gacattttactttactactt

SEQ ID NO: 637978 - DNA, 20 bp, Artificial
  CRISPR gRNA sequence
tactttactactttttatgc

SEQ ID NO: 637979 - DNA, 20 bp, Artificial
  CRISPR gRNA sequence
actttactactttttatgct

SEQ ID NO: 637980 - DNA, 20 bp, Artificial
  CRISPR gRNA sequence
ctttactactttttatgcta

SEQ ID NO: 637981 - DNA, 20 bp, Artificial
  CRISPR gRNA sequence
tactactttttatgctataa

SEQ ID NO: 637982 - DNA, 20 bp, Artificial
  CRISPR gRNA sequence
actactttttatgctataac

SEQ ID NO: 637983 - DNA, 20 bp, Artificial
  CRISPR gRNA sequence
ctactttttatgctataact

SEQ ID NO: 637984 - DNA, 20 bp, Artificial
  CRISPR gRNA sequence
ctttttatgctataacttca

SEQ ID NO: 637985 - DNA, 20 bp, Artificial
  CRISPR gRNA sequence
tttatgctataacttcacaa

SEQ ID NO: 637986 - DNA, 20 bp, Artificial
  CRISPR gRNA sequence
ttatgctataacttcacaaa

SEQ ID NO: 637987 - DNA, 20 bp, Artificial
  CRISPR gRNA sequence
tatgctataacttcacaaag

SEQ ID NO: 637988 - DNA, 20 bp, Artificial
  CRISPR gRNA sequence
atgctataacttcacaaagt

SEQ ID NO: 637989 - DNA, 20 bp, Artificial
  CRISPR gRNA sequence
tgctataacttcacaaagtc

SEQ ID NO: 637990 - DNA, 20 bp, Artificial
  CRISPR gRNA sequence
taacttcacaaagtcaccca

SEQ ID NO: 637991 - DNA, 20 bp, Artificial
  CRISPR gRNA sequence
cacaaagtcacccatttgtg

SEQ ID NO: 637992 - DNA, 20 bp, Artificial
  CRISPR gRNA sequence
acaaagtcacccatttgtgc

SEQ ID NO: 637993 - DNA, 20 bp, Artificial
  CRISPR gRNA sequence
gtgcaagacagcatatgatt

SEQ ID NO: 637994 - DNA, 20 bp, Artificial
  CRISPR gRNA sequence
tgcaagacagcatatgattt

SEQ ID NO: 637995 - DNA, 20 bp, Artificial
  CRISPR gRNA sequence
tgcagtctggaaatttattt

SEQ ID NO: 637996 - DNA, 20 bp, Artificial
  CRISPR gRNA sequence
gcagtctggaaatttatttc

SEQ ID NO: 637997 - DNA, 20 bp, Artificial
  CRISPR gRNA sequence
cagtctggaaatttatttct

SEQ ID NO: 637998 - DNA, 20 bp, Artificial
  CRISPR gRNA sequence
gaaatttatttcttcaataa

SEQ ID NO: 637999 - DNA, 20 bp, Artificial
  CRISPR gRNA sequence
atttcttcaataatatgaat

SEQ ID NO: 638000 - DNA, 20 bp, Artificial
  CRISPR gRNA sequence
tttcttcaataatatgaatt

SEQ ID NO: 638001 - DNA, 20 bp, Artificial
  CRISPR gRNA sequence
cttcaataatatgaattctc

SEQ ID NO: 638002 - DNA, 20 bp, Artificial
  CRISPR gRNA sequence
ttcaataatatgaattctca

SEQ ID NO: 638003 - DNA, 20 bp, Artificial
  CRISPR gRNA sequence
caataatatgaattctcaat

SEQ ID NO: 638004 - DNA, 20 bp, Artificial
  CRISPR gRNA sequence
aataatatgaattctcaatt

SEQ ID NO: 638005 - DNA, 20 bp, Artificial
  CRISPR gRNA sequence
tcaatttttaaaatttttaa

SEQ ID NO: 638006 - DNA, 20 bp, Artificial
  CRISPR gRNA sequence
aatttttaaaatttttaaga

SEQ ID NO: 638007 - DNA, 20 bp, Artificial
  CRISPR gRNA sequence
ttaaaatttttaagaaaaag

SEQ ID NO: 638008 - DNA, 20 bp, Artificial
  CRISPR gRNA sequence
taaaatttttaagaaaaaga

SEQ ID NO: 638009 - DNA, 20 bp, Artificial
  CRISPR gRNA sequence
aaaatttttaagaaaaagat

SEQ ID NO: 638010 - DNA, 20 bp, Artificial
  CRISPR gRNA sequence
aaatttttaagaaaaagatc

SEQ ID NO: 638011 - DNA, 20 bp, Artificial
  CRISPR gRNA sequence
ttaagaaaaagatcacttta

SEQ ID NO: 638012 - DNA, 20 bp, Artificial
  CRISPR gRNA sequence
taagaaaaagatcactttat

SEQ ID NO: 638013 - DNA, 20 bp, Artificial
  CRISPR gRNA sequence
aagaaaaagatcactttata

SEQ ID NO: 638014 - DNA, 20 bp, Artificial
  CRISPR gRNA sequence
agaaaaagatcactttatat

SEQ ID NO: 638015 - DNA, 20 bp, Artificial
  CRISPR gRNA sequence
tatatgcatgataaatatat

SEQ ID NO: 638016 - DNA, 20 bp, Artificial
  CRISPR gRNA sequence
atatgcatgataaatatatt

SEQ ID NO: 638017 - DNA, 20 bp, Artificial
  CRISPR gRNA sequence
tatgcatgataaatatatta

SEQ ID NO: 638018 - DNA, 20 bp, Artificial
  CRISPR gRNA sequence
attttaaattttcaaattaa

SEQ ID NO: 638019 - DNA, 20 bp, Artificial
  CRISPR gRNA sequence
taaattttcaaattaagata

SEQ ID NO: 638020 - DNA, 20 bp, Artificial
  CRISPR gRNA sequence
aaattttcaaattaagataa

SEQ ID NO: 638021 - DNA, 20 bp, Artificial
  CRISPR gRNA sequence
aattttcaaattaagataat

SEQ ID NO: 638022 - DNA, 20 bp, Artificial
  CRISPR gRNA sequence
tcaaattaagataataaatt

SEQ ID NO: 638023 - DNA, 20 bp, Artificial
  CRISPR gRNA sequence
caaattaagataataaattc

SEQ ID NO: 638024 - DNA, 20 bp, Artificial
  CRISPR gRNA sequence
aaattaagataataaattct

SEQ ID NO: 638025 - DNA, 20 bp, Artificial
  CRISPR gRNA sequence
agataataaattctaccctc

SEQ ID NO: 638026 - DNA, 20 bp, Artificial
  CRISPR gRNA sequence
taccctcatcattagaattt

SEQ ID NO: 638027 - DNA, 20 bp, Artificial
  CRISPR gRNA sequence
ccctcatcattagaatttta

SEQ ID NO: 638028 - DNA, 20 bp, Artificial
  CRISPR gRNA sequence
atcattagaattttattttc

SEQ ID NO: 638029 - DNA, 20 bp, Artificial
  CRISPR gRNA sequence
gaattttattttcacaaact

SEQ ID NO: 638030 - DNA, 20 bp, Artificial
  CRISPR gRNA sequence
tattttcacaaactgctata

SEQ ID NO: 638031 - DNA, 20 bp, Artificial
  CRISPR gRNA sequence
attttcacaaactgctataa

SEQ ID NO: 638032 - DNA, 20 bp, Artificial
  CRISPR gRNA sequence
ttttcacaaactgctataat

SEQ ID NO: 638033 - DNA, 20 bp, Artificial
  CRISPR gRNA sequence
tcacaaactgctataatttt

SEQ ID NO: 638034 - DNA, 20 bp, Artificial
  CRISPR gRNA sequence
cacaaactgctataattttt

SEQ ID NO: 638035 - DNA, 20 bp, Artificial
  CRISPR gRNA sequence
acaaactgctataattttta

SEQ ID NO: 638036 - DNA, 20 bp, Artificial
  CRISPR gRNA sequence
ctataatttttaaatgtcaa

SEQ ID NO: 638037 - DNA, 20 bp, Artificial
  CRISPR gRNA sequence
taatttttaaatgtcaagtt

SEQ ID NO: 638038 - DNA, 20 bp, Artificial
  CRISPR gRNA sequence
ttaaatgtcaagttctggaa

SEQ ID NO: 638039 - DNA, 20 bp, Artificial
  CRISPR gRNA sequence
taaatgtcaagttctggaaa

SEQ ID NO: 638040 - DNA, 20 bp, Artificial
  CRISPR gRNA sequence
aaatgtcaagttctggaaac

SEQ ID NO: 638041 - DNA, 20 bp, Artificial
  CRISPR gRNA sequence
aatgtcaagttctggaaaca

SEQ ID NO: 638042 - DNA, 20 bp, Artificial
  CRISPR gRNA sequence
tggaaacaccatacatagta

SEQ ID NO: 638043 - DNA, 20 bp, Artificial
  CRISPR gRNA sequence
gaaacaccatacatagtaat

SEQ ID NO: 638044 - DNA, 20 bp, Artificial
  CRISPR gRNA sequence
aaaatatcaatttaagacat

SEQ ID NO: 638045 - DNA, 20 bp, Artificial
  CRISPR gRNA sequence
aagacatttttaaatataca

SEQ ID NO: 638046 - DNA, 20 bp, Artificial
  CRISPR gRNA sequence
agacatttttaaatatacat

SEQ ID NO: 638047 - DNA, 20 bp, Artificial
  CRISPR gRNA sequence
ttaaatatacatattaaact

SEQ ID NO: 638048 - DNA, 20 bp, Artificial
  CRISPR gRNA sequence
taaatatacatattaaactt

SEQ ID NO: 638049 - DNA, 20 bp, Artificial
  CRISPR gRNA sequence
aaatatacatattaaacttt

SEQ ID NO: 638050 - DNA, 20 bp, Artificial
  CRISPR gRNA sequence
aatatacatattaaactttc

SEQ ID NO: 638051 - DNA, 20 bp, Artificial
  CRISPR gRNA sequence
aactttctacaagttaaaac

SEQ ID NO: 638052 - DNA, 20 bp, Artificial
  CRISPR gRNA sequence
tctacaagttaaaactttat

SEQ ID NO: 638053 - DNA, 20 bp, Artificial
  CRISPR gRNA sequence
ctacaagttaaaactttatt

SEQ ID NO: 638054 - DNA, 20 bp, Artificial
  CRISPR gRNA sequence
tacaagttaaaactttatta

SEQ ID NO: 638055 - DNA, 20 bp, Artificial
  CRISPR gRNA sequence
caagttaaaactttattatt

SEQ ID NO: 638056 - DNA, 20 bp, Artificial
  CRISPR gRNA sequence
aaactttattattaatatga

SEQ ID NO: 638057 - DNA, 20 bp, Artificial
  CRISPR gRNA sequence
tattattaatatgacctgat

SEQ ID NO: 638058 - DNA, 20 bp, Artificial
  CRISPR gRNA sequence
attattaatatgacctgatt

SEQ ID NO: 638059 - DNA, 20 bp, Artificial
  CRISPR gRNA sequence
ttattaatatgacctgattc

SEQ ID NO: 638060 - DNA, 20 bp, Artificial
  CRISPR gRNA sequence
ttaatatgacctgattctac

SEQ ID NO: 638061 - DNA, 20 bp, Artificial
  CRISPR gRNA sequence
atatgacctgattctactaa

SEQ ID NO: 638062 - DNA, 20 bp, Artificial
  CRISPR gRNA sequence
attctactaatctacaaaca

SEQ ID NO: 638063 - DNA, 20 bp, Artificial
  CRISPR gRNA sequence
tactaatctacaaacaagtt

SEQ ID NO: 638064 - DNA, 20 bp, Artificial
  CRISPR gRNA sequence
ctaatctacaaacaagttag

SEQ ID NO: 638065 - DNA, 20 bp, Artificial
  CRISPR gRNA sequence
atctacaaacaagttagtca

SEQ ID NO: 638066 - DNA, 20 bp, Artificial
  CRISPR gRNA sequence
caaacaagttagtcaagttt

SEQ ID NO: 638067 - DNA, 20 bp, Artificial
  CRISPR gRNA sequence
gtcaagtttcctaaccagga

SEQ ID NO: 638068 - DNA, 20 bp, Artificial
  CRISPR gRNA sequence
cctaaccaggaaaataatgc

SEQ ID NO: 638069 - DNA, 20 bp, Artificial
  CRISPR gRNA sequence
ctaaccaggaaaataatgca

SEQ ID NO: 638070 - DNA, 20 bp, Artificial
  CRISPR gRNA sequence
accaggaaaataatgcagag

SEQ ID NO: 638071 - DNA, 20 bp, Artificial
  CRISPR gRNA sequence
tgatttattttctctattta

SEQ ID NO: 638072 - DNA, 20 bp, Artificial
  CRISPR gRNA sequence
attttctctatttaaagtga

SEQ ID NO: 638073 - DNA, 20 bp, Artificial
  CRISPR gRNA sequence
ttttctctatttaaagtgat

SEQ ID NO: 638074 - DNA, 20 bp, Artificial
  CRISPR gRNA sequence
tctctatttaaagtgatgta

SEQ ID NO: 638075 - DNA, 20 bp, Artificial
  CRISPR gRNA sequence
ctctatttaaagtgatgtat

SEQ ID NO: 638076 - DNA, 20 bp, Artificial
  CRISPR gRNA sequence
tctatttaaagtgatgtatt

SEQ ID NO: 638077 - DNA, 20 bp, Artificial
  CRISPR gRNA sequence
tatttaaagtgatgtattta

SEQ ID NO: 638078 - DNA, 20 bp, Artificial
  CRISPR gRNA sequence
tttaaagtgatgtatttatt

SEQ ID NO: 638079 - DNA, 20 bp, Artificial
  CRISPR gRNA sequence
aaagtgatgtatttattgat

SEQ ID NO: 638080 - DNA, 20 bp, Artificial
  CRISPR gRNA sequence
aagtgatgtatttattgatc

SEQ ID NO: 638081 - DNA, 20 bp, Artificial
  CRISPR gRNA sequence
attgatcttatagagtataa

SEQ ID NO: 638082 - DNA, 20 bp, Artificial
  CRISPR gRNA sequence
ttgatcttatagagtataaa

SEQ ID NO: 638083 - DNA, 20 bp, Artificial
  CRISPR gRNA sequence
atcttatagagtataaaata

SEQ ID NO: 638084 - DNA, 20 bp, Artificial
  CRISPR gRNA sequence
atagagtataaaataagctt

SEQ ID NO: 638085 - DNA, 20 bp, Artificial
  CRISPR gRNA sequence
tagagtataaaataagcttt

SEQ ID NO: 638086 - DNA, 20 bp, Artificial
  CRISPR gRNA sequence
tctagtttaatttctatgaa

SEQ ID NO: 638087 - DNA, 20 bp, Artificial
  CRISPR gRNA sequence
ctagtttaatttctatgaaa

SEQ ID NO: 638088 - DNA, 20 bp, Artificial
  CRISPR gRNA sequence
tagtttaatttctatgaaat

SEQ ID NO: 638089 - DNA, 20 bp, Artificial
  CRISPR gRNA sequence
gtttaatttctatgaaattg

SEQ ID NO: 638090 - DNA, 20 bp, Artificial
  CRISPR gRNA sequence
aatttctatgaaattggtga

SEQ ID NO: 638091 - DNA, 20 bp, Artificial
  CRISPR gRNA sequence
atttctatgaaattggtgac

SEQ ID NO: 638092 - DNA, 20 bp, Artificial
  CRISPR gRNA sequence
ctatgaaattggtgacttat

SEQ ID NO: 638093 - DNA, 20 bp, Artificial
  CRISPR gRNA sequence
tatgaaattggtgacttatt

SEQ ID NO: 638094 - DNA, 20 bp, Artificial
  CRISPR gRNA sequence
tgaaattggtgacttatttt

SEQ ID NO: 638095 - DNA, 20 bp, Artificial
  CRISPR gRNA sequence
gtgacttatttttgtttagt

SEQ ID NO: 638096 - DNA, 20 bp, Artificial
  CRISPR gRNA sequence
atttttgtttagttgccaaa

SEQ ID NO: 638097 - DNA, 20 bp, Artificial
  CRISPR gRNA sequence
tttttgtttagttgccaaag

SEQ ID NO: 638098 - DNA, 20 bp, Artificial
  CRISPR gRNA sequence
ttgtttagttgccaaagtgt

SEQ ID NO: 638099 - DNA, 20 bp, Artificial
  CRISPR gRNA sequence
tgtttagttgccaaagtgta

SEQ ID NO: 638100 - DNA, 20 bp, Artificial
  CRISPR gRNA sequence
gtttagttgccaaagtgtat

SEQ ID NO: 638101 - DNA, 20 bp, Artificial
  CRISPR gRNA sequence
tttagttgccaaagtgtata

SEQ ID NO: 638102 - DNA, 20 bp, Artificial
  CRISPR gRNA sequence
agttgccaaagtgtatattt

SEQ ID NO: 638103 - DNA, 20 bp, Artificial
  CRISPR gRNA sequence
gttgccaaagtgtatatttt

SEQ ID NO: 638104 - DNA, 20 bp, Artificial
  CRISPR gRNA sequence
ccaaagtgtatattttaatt

SEQ ID NO: 638105 - DNA, 20 bp, Artificial
  CRISPR gRNA sequence
taattttaatttttaatttt

SEQ ID NO: 638106 - DNA, 20 bp, Artificial
  CRISPR gRNA sequence
aattttaatttttaattttt

SEQ ID NO: 638107 - DNA, 20 bp, Artificial
  CRISPR gRNA sequence
attttaatttttaatttttc

SEQ ID NO: 638108 - DNA, 20 bp, Artificial
  CRISPR gRNA sequence
taatttttaatttttcaagg

SEQ ID NO: 638109 - DNA, 20 bp, Artificial
  CRISPR gRNA sequence
aatttttaatttttcaagga

SEQ ID NO: 638110 - DNA, 20 bp, Artificial
  CRISPR gRNA sequence
atttttaatttttcaaggaa

SEQ ID NO: 638111 - DNA, 20 bp, Artificial
  CRISPR gRNA sequence
ttaatttttcaaggaagtaa

SEQ ID NO: 638112 - DNA, 20 bp, Artificial
  CRISPR gRNA sequence
taatttttcaaggaagtaaa

SEQ ID NO: 638113 - DNA, 20 bp, Artificial
  CRISPR gRNA sequence
aatttttcaaggaagtaaat

SEQ ID NO: 638114 - DNA, 20 bp, Artificial
  CRISPR gRNA sequence
atttttcaaggaagtaaata

SEQ ID NO: 638115 - DNA, 20 bp, Artificial
  CRISPR gRNA sequence
ttcaaggaagtaaatattat

SEQ ID NO: 638116 - DNA, 20 bp, Artificial
  CRISPR gRNA sequence
tcaaggaagtaaatattatg

SEQ ID NO: 638117 - DNA, 20 bp, Artificial
  CRISPR gRNA sequence
caaggaagtaaatattatgg

SEQ ID NO: 638118 - DNA, 20 bp, Artificial
  CRISPR gRNA sequence
aaggaagtaaatattatggg

SEQ ID NO: 638119 - DNA, 20 bp, Artificial
  CRISPR gRNA sequence
tgggaattaaatattttttt

SEQ ID NO: 638120 - DNA, 20 bp, Artificial
  CRISPR gRNA sequence
aatatttttttcacagtgtg

SEQ ID NO: 638121 - DNA, 20 bp, Artificial
  CRISPR gRNA sequence
ttttcacagtgtggaacaga

SEQ ID NO: 638122 - DNA, 20 bp, Artificial
  CRISPR gRNA sequence
tttcacagtgtggaacagaa

SEQ ID NO: 638123 - DNA, 20 bp, Artificial
  CRISPR gRNA sequence
ttcacagtgtggaacagaag

SEQ ID NO: 638124 - DNA, 20 bp, Artificial
  CRISPR gRNA sequence
tcacagtgtggaacagaaga

SEQ ID NO: 638125 - DNA, 20 bp, Artificial
  CRISPR gRNA sequence
cacagtgtggaacagaagat

SEQ ID NO: 638126 - DNA, 20 bp, Artificial
  CRISPR gRNA sequence
acagtgtggaacagaagata

SEQ ID NO: 638127 - DNA, 20 bp, Artificial
  CRISPR gRNA sequence
ttacttaccaaatgaaaaaa

SEQ ID NO: 638128 - DNA, 20 bp, Artificial
  CRISPR gRNA sequence
acttaccaaatgaaaaaaag

SEQ ID NO: 638129 - DNA, 20 bp, Artificial
  CRISPR gRNA sequence
cttaccaaatgaaaaaaagt

SEQ ID NO: 638130 - DNA, 20 bp, Artificial
  CRISPR gRNA sequence
accaaatgaaaaaaagtgta

SEQ ID NO: 638131 - DNA, 20 bp, Artificial
  CRISPR gRNA sequence
ccaaatgaaaaaaagtgtat

SEQ ID NO: 638132 - DNA, 20 bp, Artificial
  CRISPR gRNA sequence
caggtgtgatgtgtaagtgg

SEQ ID NO: 638133 - DNA, 20 bp, Artificial
  CRISPR gRNA sequence
aggtgtgatgtgtaagtgga

SEQ ID NO: 638134 - DNA, 20 bp, Artificial
  CRISPR gRNA sequence
tttatatggttggtttctgt

SEQ ID NO: 638135 - DNA, 20 bp, Artificial
  CRISPR gRNA sequence
ttatatggttggtttctgtt

SEQ ID NO: 638136 - DNA, 20 bp, Artificial
  CRISPR gRNA sequence
tatatggttggtttctgttc

SEQ ID NO: 638137 - DNA, 20 bp, Artificial
  CRISPR gRNA sequence
atatggttggtttctgttcc

SEQ ID NO: 638138 - DNA, 20 bp, Artificial
  CRISPR gRNA sequence
tatggttggtttctgttccc

SEQ ID NO: 638139 - DNA, 20 bp, Artificial
  CRISPR gRNA sequence
gtttctgttccctggcaatt

SEQ ID NO: 638140 - DNA, 20 bp, Artificial
  CRISPR gRNA sequence
ctgttccctggcaattcaag

SEQ ID NO: 638141 - DNA, 20 bp, Artificial
  CRISPR gRNA sequence
tgttccctggcaattcaagt

SEQ ID NO: 638142 - DNA, 20 bp, Artificial
  CRISPR gRNA sequence
ttccctggcaattcaagtgg

SEQ ID NO: 638143 - DNA, 20 bp, Artificial
  CRISPR gRNA sequence
cctggcaattcaagtgggca

SEQ ID NO: 638144 - DNA, 20 bp, Artificial
  CRISPR gRNA sequence
gcaattcaagtgggcactta

SEQ ID NO: 638145 - DNA, 20 bp, Artificial
  CRISPR gRNA sequence
aagtgggcacttaagggatt

SEQ ID NO: 638146 - DNA, 20 bp, Artificial
  CRISPR gRNA sequence
aagggattttataacttata

SEQ ID NO: 638147 - DNA, 20 bp, Artificial
  CRISPR gRNA sequence
agggattttataacttataa

SEQ ID NO: 638148 - DNA, 20 bp, Artificial
  CRISPR gRNA sequence
tataacttataagcatgaac

SEQ ID NO: 638149 - DNA, 20 bp, Artificial
  CRISPR gRNA sequence
ataacttataagcatgaaca

SEQ ID NO: 638150 - DNA, 20 bp, Artificial
  CRISPR gRNA sequence
taacttataagcatgaacat

SEQ ID NO: 638151 - DNA, 20 bp, Artificial
  CRISPR gRNA sequence
ataagcatgaacatttccca

SEQ ID NO: 638152 - DNA, 20 bp, Artificial
  CRISPR gRNA sequence
taagcatgaacatttcccag

SEQ ID NO: 638153 - DNA, 20 bp, Artificial
  CRISPR gRNA sequence
cccagtctatgccagacact

SEQ ID NO: 638154 - DNA, 20 bp, Artificial
  CRISPR gRNA sequence
ccagtctatgccagacactt

SEQ ID NO: 638155 - DNA, 20 bp, Artificial
  CRISPR gRNA sequence
tgccagacacttgaaatggt

SEQ ID NO: 638156 - DNA, 20 bp, Artificial
  CRISPR gRNA sequence
gaaatggtgttatatacact

SEQ ID NO: 638157 - DNA, 20 bp, Artificial
  CRISPR gRNA sequence
aaatggtgttatatacacta

SEQ ID NO: 638158 - DNA, 20 bp, Artificial
  CRISPR gRNA sequence
tatacactaattgaaccaat

SEQ ID NO: 638159 - DNA, 20 bp, Artificial
  CRISPR gRNA sequence
attgaaccaatatggctatc

SEQ ID NO: 638160 - DNA, 20 bp, Artificial
  CRISPR gRNA sequence
aaccaatatggctatctaat

SEQ ID NO: 638161 - DNA, 20 bp, Artificial
  CRISPR gRNA sequence
tctaataatttattgaagtt

SEQ ID NO: 638162 - DNA, 20 bp, Artificial
  CRISPR gRNA sequence
ataatttattgaagttgctt

SEQ ID NO: 638163 - DNA, 20 bp, Artificial
  CRISPR gRNA sequence
attgaagttgcttctacact

SEQ ID NO: 638164 - DNA, 20 bp, Artificial
  CRISPR gRNA sequence
ttgaagttgcttctacacta

SEQ ID NO: 638165 - DNA, 20 bp, Artificial
  CRISPR gRNA sequence
aagttgcttctacactaata

SEQ ID NO: 638166 - DNA, 20 bp, Artificial
  CRISPR gRNA sequence
cttctacactaatataactc

SEQ ID NO: 638167 - DNA, 20 bp, Artificial
  CRISPR gRNA sequence
ctacactaatataactctct

SEQ ID NO: 638168 - DNA, 20 bp, Artificial
  CRISPR gRNA sequence
tacactaatataactctctc

SEQ ID NO: 638169 - DNA, 20 bp, Artificial
  CRISPR gRNA sequence
cactaatataactctctctc

SEQ ID NO: 638170 - DNA, 20 bp, Artificial
  CRISPR gRNA sequence
atataactctctctcacgta

SEQ ID NO: 638171 - DNA, 20 bp, Artificial
  CRISPR gRNA sequence
tctctcacgtaaactttcta

SEQ ID NO: 638172 - DNA, 20 bp, Artificial
  CRISPR gRNA sequence
tctcacgtaaactttctaaa

SEQ ID NO: 638173 - DNA, 20 bp, Artificial
  CRISPR gRNA sequence
tcacgtaaactttctaaaca

SEQ ID NO: 638174 - DNA, 20 bp, Artificial
  CRISPR gRNA sequence
acgtaaactttctaaacaga

SEQ ID NO: 638175 - DNA, 20 bp, Artificial
  CRISPR gRNA sequence
tctaaacagaaacaccaaac

SEQ ID NO: 638176 - DNA, 20 bp, Artificial
  CRISPR gRNA sequence
ctaaacagaaacaccaaaca

SEQ ID NO: 638177 - DNA, 20 bp, Artificial
  CRISPR gRNA sequence
taaacagaaacaccaaacat

SEQ ID NO: 638178 - DNA, 20 bp, Artificial
  CRISPR gRNA sequence
aacagaaacaccaaacatga

SEQ ID NO: 638179 - DNA, 20 bp, Artificial
  CRISPR gRNA sequence
aatccatgttaatatcccaa

SEQ ID NO: 638180 - DNA, 20 bp, Artificial
  CRISPR gRNA sequence
atatcccaacagctgtttaa

SEQ ID NO: 638181 - DNA, 20 bp, Artificial
  CRISPR gRNA sequence
tttaaataatgtgttaggaa

SEQ ID NO: 638182 - DNA, 20 bp, Artificial
  CRISPR gRNA sequence
aaataatgtgttaggaaaac

SEQ ID NO: 638183 - DNA, 20 bp, Artificial
  CRISPR gRNA sequence
aataatgtgttaggaaaaca

SEQ ID NO: 638184 - DNA, 20 bp, Artificial
  CRISPR gRNA sequence
ggaaaacaaagtgccttcaa

SEQ ID NO: 638185 - DNA, 20 bp, Artificial
  CRISPR gRNA sequence
caaaactgtgatgtaaagcc

SEQ ID NO: 638186 - DNA, 20 bp, Artificial
  CRISPR gRNA sequence
aaaactgtgatgtaaagccc

SEQ ID NO: 638187 - DNA, 20 bp, Artificial
  CRISPR gRNA sequence
tgatgtaaagcccaattatt

SEQ ID NO: 638188 - DNA, 20 bp, Artificial
  CRISPR gRNA sequence
tttactaagaatttaccaac

SEQ ID NO: 638189 - DNA, 20 bp, Artificial
  CRISPR gRNA sequence
actaagaatttaccaacagt

SEQ ID NO: 638190 - DNA, 20 bp, Artificial
  CRISPR gRNA sequence
ctaagaatttaccaacagtc

SEQ ID NO: 638191 - DNA, 20 bp, Artificial
  CRISPR gRNA sequence
agaatttaccaacagtctaa

SEQ ID NO: 638192 - DNA, 20 bp, Artificial
  CRISPR gRNA sequence
accaacagtctaaacaatta

SEQ ID NO: 638193 - DNA, 20 bp, Artificial
  CRISPR gRNA sequence
ccaacagtctaaacaattaa

SEQ ID NO: 638194 - DNA, 20 bp, Artificial
  CRISPR gRNA sequence
aacaattaaagtaaaaccac

SEQ ID NO: 638195 - DNA, 20 bp, Artificial
  CRISPR gRNA sequence
aagtaaaaccacaacaaagg

SEQ ID NO: 638196 - DNA, 20 bp, Artificial
  CRISPR gRNA sequence
tttaatatcctcagcaaaat

SEQ ID NO: 638197 - DNA, 20 bp, Artificial
  CRISPR gRNA sequence
ttaatatcctcagcaaaatt

SEQ ID NO: 638198 - DNA, 20 bp, Artificial
  CRISPR gRNA sequence
taatatcctcagcaaaattt

SEQ ID NO: 638199 - DNA, 20 bp, Artificial
  CRISPR gRNA sequence
aatatcctcagcaaaatttc

SEQ ID NO: 638200 - DNA, 20 bp, Artificial
  CRISPR gRNA sequence
atatcctcagcaaaatttca

SEQ ID NO: 638201 - DNA, 20 bp, Artificial
  CRISPR gRNA sequence
agcaaaatttcatgcaatgt

SEQ ID NO: 638202 - DNA, 20 bp, Artificial
  CRISPR gRNA sequence
catgcaatgtatttgttcct

SEQ ID NO: 638203 - DNA, 20 bp, Artificial
  CRISPR gRNA sequence
atgcaatgtatttgttcctt

SEQ ID NO: 638204 - DNA, 20 bp, Artificial
  CRISPR gRNA sequence
gttccttttgactgtggata

SEQ ID NO: 638205 - DNA, 20 bp, Artificial
  CRISPR gRNA sequence
ttccttttgactgtggataa

SEQ ID NO: 638206 - DNA, 20 bp, Artificial
  CRISPR gRNA sequence
cttttgactgtggataaata

SEQ ID NO: 638207 - DNA, 20 bp, Artificial
  CRISPR gRNA sequence
ttgactgtggataaataaat

SEQ ID NO: 638208 - DNA, 20 bp, Artificial
  CRISPR gRNA sequence
tgactgtggataaataaatg

SEQ ID NO: 638209 - DNA, 20 bp, Artificial
  CRISPR gRNA sequence
gactgtggataaataaatgg

SEQ ID NO: 638210 - DNA, 20 bp, Artificial
  CRISPR gRNA sequence
actgtggataaataaatgga

SEQ ID NO: 638211 - DNA, 20 bp, Artificial
  CRISPR gRNA sequence
tggataaataaatggatgag

SEQ ID NO: 638212 - DNA, 20 bp, Artificial
  CRISPR gRNA sequence
gaaaaacagtttcttcacaa

SEQ ID NO: 638213 - DNA, 20 bp, Artificial
  CRISPR gRNA sequence
aaaaacagtttcttcacaac

SEQ ID NO: 638214 - DNA, 20 bp, Artificial
  CRISPR gRNA sequence
cttcacaacatccttaaaga

SEQ ID NO: 638215 - DNA, 20 bp, Artificial
  CRISPR gRNA sequence
ttcacaacatccttaaagaa

SEQ ID NO: 638216 - DNA, 20 bp, Artificial
  CRISPR gRNA sequence
cacaacatccttaaagaatt

SEQ ID NO: 638217 - DNA, 20 bp, Artificial
  CRISPR gRNA sequence
acaacatccttaaagaattt

SEQ ID NO: 638218 - DNA, 20 bp, Artificial
  CRISPR gRNA sequence
aaagaatttgttttataaac

SEQ ID NO: 638219 - DNA, 20 bp, Artificial
  CRISPR gRNA sequence
aagaatttgttttataaacg

SEQ ID NO: 638220 - DNA, 20 bp, Artificial
  CRISPR gRNA sequence
gttttataaacggtgggaca

SEQ ID NO: 638221 - DNA, 20 bp, Artificial
  CRISPR gRNA sequence
ttttataaacggtgggacat

SEQ ID NO: 638222 - DNA, 20 bp, Artificial
  CRISPR gRNA sequence
tataaacggtgggacatgtc

SEQ ID NO: 638223 - DNA, 20 bp, Artificial
  CRISPR gRNA sequence
ataaacggtgggacatgtcc

SEQ ID NO: 638224 - DNA, 20 bp, Artificial
  CRISPR gRNA sequence
taaacggtgggacatgtcca

SEQ ID NO: 638225 - DNA, 20 bp, Artificial
  CRISPR gRNA sequence
gtgtcactgagctgcagctg

SEQ ID NO: 638226 - DNA, 20 bp, Artificial
  CRISPR gRNA sequence
agctgcagctgagccacttc

SEQ ID NO: 638227 - DNA, 20 bp, Artificial
  CRISPR gRNA sequence
cagctgagccacttctgggt

SEQ ID NO: 638228 - DNA, 20 bp, Artificial
  CRISPR gRNA sequence
agccacttctgggtagcatt

SEQ ID NO: 638229 - DNA, 20 bp, Artificial
  CRISPR gRNA sequence
ctgggtagcattctaaatct

SEQ ID NO: 638230 - DNA, 20 bp, Artificial
  CRISPR gRNA sequence
tgggtagcattctaaatctg

SEQ ID NO: 638231 - DNA, 20 bp, Artificial
  CRISPR gRNA sequence
ggtagcattctaaatctgta

SEQ ID NO: 638232 - DNA, 20 bp, Artificial
  CRISPR gRNA sequence
taaatctgtatatcacatca

SEQ ID NO: 638233 - DNA, 20 bp, Artificial
  CRISPR gRNA sequence
aatctgtatatcacatcacc

SEQ ID NO: 638234 - DNA, 20 bp, Artificial
  CRISPR gRNA sequence
tatatcacatcacctcactt

SEQ ID NO: 638235 - DNA, 20 bp, Artificial
  CRISPR gRNA sequence
acttttctctccatcctctt

SEQ ID NO: 638236 - DNA, 20 bp, Artificial
  CRISPR gRNA sequence
ttctctccatcctctttctt

SEQ ID NO: 638237 - DNA, 20 bp, Artificial
  CRISPR gRNA sequence
tctctccatcctctttcttc

SEQ ID NO: 638238 - DNA, 20 bp, Artificial
  CRISPR gRNA sequence
ctctccatcctctttcttct

SEQ ID NO: 638239 - DNA, 20 bp, Artificial
  CRISPR gRNA sequence
tctccatcctctttcttctc

SEQ ID NO: 638240 - DNA, 20 bp, Artificial
  CRISPR gRNA sequence
tccatcctctttcttctctg

SEQ ID NO: 638241 - DNA, 20 bp, Artificial
  CRISPR gRNA sequence
catcctctttcttctctgtt

SEQ ID NO: 638242 - DNA, 20 bp, Artificial
  CRISPR gRNA sequence
tttcttctctgttcaatata

SEQ ID NO: 638243 - DNA, 20 bp, Artificial
  CRISPR gRNA sequence
tcttctctgttcaatatagc

SEQ ID NO: 638244 - DNA, 20 bp, Artificial
  CRISPR gRNA sequence
cttctctgttcaatatagct

SEQ ID NO: 638245 - DNA, 20 bp, Artificial
  CRISPR gRNA sequence
ttctctgttcaatatagcta

SEQ ID NO: 638246 - DNA, 20 bp, Artificial
  CRISPR gRNA sequence
ctctgttcaatatagctata

SEQ ID NO: 638247 - DNA, 20 bp, Artificial
  CRISPR gRNA sequence
tctgttcaatatagctatat

SEQ ID NO: 638248 - DNA, 20 bp, Artificial
  CRISPR gRNA sequence
tgttcaatatagctatatta

SEQ ID NO: 638249 - DNA, 20 bp, Artificial
  CRISPR gRNA sequence
ttcaatatagctatattatg

SEQ ID NO: 638250 - DNA, 20 bp, Artificial
  CRISPR gRNA sequence
aatatagctatattatgtat

SEQ ID NO: 638251 - DNA, 20 bp, Artificial
  CRISPR gRNA sequence
tattatgtatttcttaaacc

SEQ ID NO: 638252 - DNA, 20 bp, Artificial
  CRISPR gRNA sequence
tgtatttcttaaacccactg

SEQ ID NO: 638253 - DNA, 20 bp, Artificial
  CRISPR gRNA sequence
cttaaacccactggagttac

SEQ ID NO: 638254 - DNA, 20 bp, Artificial
  CRISPR gRNA sequence
ttaaacccactggagttact

SEQ ID NO: 638255 - DNA, 20 bp, Artificial
  CRISPR gRNA sequence
aaacccactggagttactcc

SEQ ID NO: 638256 - DNA, 20 bp, Artificial
  CRISPR gRNA sequence
aacccactggagttactcca

SEQ ID NO: 638257 - DNA, 20 bp, Artificial
  CRISPR gRNA sequence
gagttactccagatcaagac

SEQ ID NO: 638258 - DNA, 20 bp, Artificial
  CRISPR gRNA sequence
ctccagatcaagacagtact

SEQ ID NO: 638259 - DNA, 20 bp, Artificial
  CRISPR gRNA sequence
cagatcaagacagtactgat

SEQ ID NO: 638260 - DNA, 20 bp, Artificial
  CRISPR gRNA sequence
atttctgaaatactgttatt

SEQ ID NO: 638261 - DNA, 20 bp, Artificial
  CRISPR gRNA sequence
ctgaaatactgttattattc

SEQ ID NO: 638262 - DNA, 20 bp, Artificial
  CRISPR gRNA sequence
tgaaatactgttattattcc

SEQ ID NO: 638263 - DNA, 20 bp, Artificial
  CRISPR gRNA sequence
aaatactgttattattccaa

SEQ ID NO: 638264 - DNA, 20 bp, Artificial
  CRISPR gRNA sequence
ttattattccaacaatagtg

SEQ ID NO: 638265 - DNA, 20 bp, Artificial
  CRISPR gRNA sequence
ttattccaacaatagtgtag

SEQ ID NO: 638266 - DNA, 20 bp, Artificial
  CRISPR gRNA sequence
ttccaacaatagtgtagtaa

SEQ ID NO: 638267 - DNA, 20 bp, Artificial
  CRISPR gRNA sequence
caacaatagtgtagtaaagt

SEQ ID NO: 638268 - DNA, 20 bp, Artificial
  CRISPR gRNA sequence
ccctgcacctgaaggcagaa

SEQ ID NO: 638269 - DNA, 20 bp, Artificial
  CRISPR gRNA sequence
cacctgaaggcagaaaacca

SEQ ID NO: 638270 - DNA, 20 bp, Artificial
  CRISPR gRNA sequence
aaggcagaaaaccagggtct

SEQ ID NO: 638271 - DNA, 20 bp, Artificial
  CRISPR gRNA sequence
taccacctcttctgccattt

SEQ ID NO: 638272 - DNA, 20 bp, Artificial
  CRISPR gRNA sequence
ccacctcttctgccatttaa

SEQ ID NO: 638273 - DNA, 20 bp, Artificial
  CRISPR gRNA sequence
ttctgccatttaacttgtta

SEQ ID NO: 638274 - DNA, 20 bp, Artificial
  CRISPR gRNA sequence
ctgccatttaacttgttatg

SEQ ID NO: 638275 - DNA, 20 bp, Artificial
  CRISPR gRNA sequence
tgccatttaacttgttatgg

SEQ ID NO: 638276 - DNA, 20 bp, Artificial
  CRISPR gRNA sequence
ccatttaacttgttatggga

SEQ ID NO: 638277 - DNA, 20 bp, Artificial
  CRISPR gRNA sequence
aacttgttatgggaccttgg

SEQ ID NO: 638278 - DNA, 20 bp, Artificial
  CRISPR gRNA sequence
acttgttatgggaccttggg

SEQ ID NO: 638279 - DNA, 20 bp, Artificial
  CRISPR gRNA sequence
gttatgggaccttgggaaat

SEQ ID NO: 638280 - DNA, 20 bp, Artificial
  CRISPR gRNA sequence
ttatgggaccttgggaaatt

SEQ ID NO: 638281 - DNA, 20 bp, Artificial
  CRISPR gRNA sequence
tgggaccttgggaaatttgt

SEQ ID NO: 638282 - DNA, 20 bp, Artificial
  CRISPR gRNA sequence
gggaaatttgtttatcctga

SEQ ID NO: 638283 - DNA, 20 bp, Artificial
  CRISPR gRNA sequence
ggaaatttgtttatcctgac

SEQ ID NO: 638284 - DNA, 20 bp, Artificial
  CRISPR gRNA sequence
gtttatcctgactcagccac

SEQ ID NO: 638285 - DNA, 20 bp, Artificial
  CRISPR gRNA sequence
tttatcctgactcagccact

SEQ ID NO: 638286 - DNA, 20 bp, Artificial
  CRISPR gRNA sequence
atcctgactcagccactagt

SEQ ID NO: 638287 - DNA, 20 bp, Artificial
  CRISPR gRNA sequence
tcctgactcagccactagta

SEQ ID NO: 638288 - DNA, 20 bp, Artificial
  CRISPR gRNA sequence
actcagccactagtaccatc

SEQ ID NO: 638289 - DNA, 20 bp, Artificial
  CRISPR gRNA sequence
agccactagtaccatctaaa

SEQ ID NO: 638290 - DNA, 20 bp, Artificial
  CRISPR gRNA sequence
gtaccatctaaaatatgggg

SEQ ID NO: 638291 - DNA, 20 bp, Artificial
  CRISPR gRNA sequence
aaatatggggggaaataaca

SEQ ID NO: 638292 - DNA, 20 bp, Artificial
  CRISPR gRNA sequence
gatgtttctgaaaacagcag

SEQ ID NO: 638293 - DNA, 20 bp, Artificial
  CRISPR gRNA sequence
atgtttctgaaaacagcagg

SEQ ID NO: 638294 - DNA, 20 bp, Artificial
  CRISPR gRNA sequence
ctgaaaacagcaggctagat

SEQ ID NO: 638295 - DNA, 20 bp, Artificial
  CRISPR gRNA sequence
tgaaaacagcaggctagata

SEQ ID NO: 638296 - DNA, 20 bp, Artificial
  CRISPR gRNA sequence
aaaacagcaggctagataaa

SEQ ID NO: 638297 - DNA, 20 bp, Artificial
  CRISPR gRNA sequence
gataaaataatctctggtag

SEQ ID NO: 638298 - DNA, 20 bp, Artificial
  CRISPR gRNA sequence
tggtagactacagatttaga

SEQ ID NO: 638299 - DNA, 20 bp, Artificial
  CRISPR gRNA sequence
gtagactacagatttagaat

SEQ ID NO: 638300 - DNA, 20 bp, Artificial
  CRISPR gRNA sequence
cagatttagaatccttttaa

SEQ ID NO: 638301 - DNA, 20 bp, Artificial
  CRISPR gRNA sequence
agaatccttttaatgataat

SEQ ID NO: 638302 - DNA, 20 bp, Artificial
  CRISPR gRNA sequence
gaatccttttaatgataata

SEQ ID NO: 638303 - DNA, 20 bp, Artificial
  CRISPR gRNA sequence
ttaatgataatagtaatgat

SEQ ID NO: 638304 - DNA, 20 bp, Artificial
  CRISPR gRNA sequence
taatgataatagtaatgata

SEQ ID NO: 638305 - DNA, 20 bp, Artificial
  CRISPR gRNA sequence
aatgataatagtaatgataa

SEQ ID NO: 638306 - DNA, 20 bp, Artificial
  CRISPR gRNA sequence
atgataatagtaatgataat

SEQ ID NO: 638307 - DNA, 20 bp, Artificial
  CRISPR gRNA sequence
ttatgatttataaaatactg

SEQ ID NO: 638308 - DNA, 20 bp, Artificial
  CRISPR gRNA sequence
tatgatttataaaatactga

SEQ ID NO: 638309 - DNA, 20 bp, Artificial
  CRISPR gRNA sequence
atgatttataaaatactgac

SEQ ID NO: 638310 - DNA, 20 bp, Artificial
  CRISPR gRNA sequence
tgatttataaaatactgaca

SEQ ID NO: 638311 - DNA, 20 bp, Artificial
  CRISPR gRNA sequence
ataaaatactgacatattct

SEQ ID NO: 638312 - DNA, 20 bp, Artificial
  CRISPR gRNA sequence
taaaatactgacatattctt

SEQ ID NO: 638313 - DNA, 20 bp, Artificial
  CRISPR gRNA sequence
acatattcttttttgatact

SEQ ID NO: 638314 - DNA, 20 bp, Artificial
  CRISPR gRNA sequence
ttttttgatactcagaatga

SEQ ID NO: 638315 - DNA, 20 bp, Artificial
  CRISPR gRNA sequence
ttttgatactcagaatgact

SEQ ID NO: 638316 - DNA, 20 bp, Artificial
  CRISPR gRNA sequence
tttgatactcagaatgactg

SEQ ID NO: 638317 - DNA, 20 bp, Artificial
  CRISPR gRNA sequence
ttgatactcagaatgactgc

SEQ ID NO: 638318 - DNA, 20 bp, Artificial
  CRISPR gRNA sequence
tgatactcagaatgactgca

SEQ ID NO: 638319 - DNA, 20 bp, Artificial
  CRISPR gRNA sequence
gatactcagaatgactgcat

SEQ ID NO: 638320 - DNA, 20 bp, Artificial
  CRISPR gRNA sequence
atactcagaatgactgcatt

SEQ ID NO: 638321 - DNA, 20 bp, Artificial
  CRISPR gRNA sequence
agaatgactgcattgtagga

SEQ ID NO: 638322 - DNA, 20 bp, Artificial
  CRISPR gRNA sequence
cattgtaggaagggtagcca

SEQ ID NO: 638323 - DNA, 20 bp, Artificial
  CRISPR gRNA sequence
taggaagggtagccacagat

SEQ ID NO: 638324 - DNA, 20 bp, Artificial
  CRISPR gRNA sequence
aagcatggttgttaagtggc

SEQ ID NO: 638325 - DNA, 20 bp, Artificial
  CRISPR gRNA sequence
ttaagtggctattgaaagga

SEQ ID NO: 638326 - DNA, 20 bp, Artificial
  CRISPR gRNA sequence
agtggctattgaaaggatac

SEQ ID NO: 638327 - DNA, 20 bp, Artificial
  CRISPR gRNA sequence
ttgaaaggatacaagttagt

SEQ ID NO: 638328 - DNA, 20 bp, Artificial
  CRISPR gRNA sequence
aaaggatacaagttagtaaa

SEQ ID NO: 638329 - DNA, 20 bp, Artificial
  CRISPR gRNA sequence
gtaaatgtgaacttgatatc

SEQ ID NO: 638330 - DNA, 20 bp, Artificial
  CRISPR gRNA sequence
gatatcaattcaagatcttt

SEQ ID NO: 638331 - DNA, 20 bp, Artificial
  CRISPR gRNA sequence
atatcaattcaagatctttt

SEQ ID NO: 638332 - DNA, 20 bp, Artificial
  CRISPR gRNA sequence
aagatcttttgactcgtagc

SEQ ID NO: 638333 - DNA, 20 bp, Artificial
  CRISPR gRNA sequence
ttgactcgtagcctatccat

SEQ ID NO: 638334 - DNA, 20 bp, Artificial
  CRISPR gRNA sequence
tgactcgtagcctatccatc

SEQ ID NO: 638335 - DNA, 20 bp, Artificial
  CRISPR gRNA sequence
gactcgtagcctatccatcc

SEQ ID NO: 638336 - DNA, 20 bp, Artificial
  CRISPR gRNA sequence
actcgtagcctatccatcct

SEQ ID NO: 638337 - DNA, 20 bp, Artificial
  CRISPR gRNA sequence
gtagcctatccatccttcta

SEQ ID NO: 638338 - DNA, 20 bp, Artificial
  CRISPR gRNA sequence
tccatccttctatgacatga

SEQ ID NO: 638339 - DNA, 20 bp, Artificial
  CRISPR gRNA sequence
ctatgacatgatactggctc

SEQ ID NO: 638340 - DNA, 20 bp, Artificial
  CRISPR gRNA sequence
tatgacatgatactggctct

SEQ ID NO: 638341 - DNA, 20 bp, Artificial
  CRISPR gRNA sequence
tgacatgatactggctctcc

SEQ ID NO: 638342 - DNA, 20 bp, Artificial
  CRISPR gRNA sequence
gctctccaatgaaacaagta

SEQ ID NO: 638343 - DNA, 20 bp, Artificial
  CRISPR gRNA sequence
tccaatgaaacaagtaactt

SEQ ID NO: 638344 - DNA, 20 bp, Artificial
  CRISPR gRNA sequence
caatgaaacaagtaacttac

SEQ ID NO: 638345 - DNA, 20 bp, Artificial
  CRISPR gRNA sequence
acattagtattatatttagg

SEQ ID NO: 638346 - DNA, 20 bp, Artificial
  CRISPR gRNA sequence
cattagtattatatttagga

SEQ ID NO: 638347 - DNA, 20 bp, Artificial
  CRISPR gRNA sequence
gtattatatttaggacaaaa

SEQ ID NO: 638348 - DNA, 20 bp, Artificial
  CRISPR gRNA sequence
tatttaggacaaaaatcagt

SEQ ID NO: 638349 - DNA, 20 bp, Artificial
  CRISPR gRNA sequence
aggacaaaaatcagtcatag

SEQ ID NO: 638350 - DNA, 20 bp, Artificial
  CRISPR gRNA sequence
ggacaaaaatcagtcatagg

SEQ ID NO: 638351 - DNA, 20 bp, Artificial
  CRISPR gRNA sequence
ttacggtagctgtaaaacta

SEQ ID NO: 638352 - DNA, 20 bp, Artificial
  CRISPR gRNA sequence
acggtagctgtaaaactatg

SEQ ID NO: 638353 - DNA, 20 bp, Artificial
  CRISPR gRNA sequence
cggtagctgtaaaactatgt

SEQ ID NO: 638354 - DNA, 20 bp, Artificial
  CRISPR gRNA sequence
taaaactatgtccaccagtt

SEQ ID NO: 638355 - DNA, 20 bp, Artificial
  CRISPR gRNA sequence
tgtccaccagttgaagagga

SEQ ID NO: 638356 - DNA, 20 bp, Artificial
  CRISPR gRNA sequence
aagaggataccagaaactta

SEQ ID NO: 638357 - DNA, 20 bp, Artificial
  CRISPR gRNA sequence
aagtcccgaatggtcagata

SEQ ID NO: 638358 - DNA, 20 bp, Artificial
  CRISPR gRNA sequence
agtcccgaatggtcagataa

SEQ ID NO: 638359 - DNA, 20 bp, Artificial
  CRISPR gRNA sequence
agtttccataaaccaaacta

SEQ ID NO: 638360 - DNA, 20 bp, Artificial
  CRISPR gRNA sequence
ccataaaccaaactattgaa

SEQ ID NO: 638361 - DNA, 20 bp, Artificial
  CRISPR gRNA sequence
cataaaccaaactattgaat

SEQ ID NO: 638362 - DNA, 20 bp, Artificial
  CRISPR gRNA sequence
ttgaattatgactttctatc

SEQ ID NO: 638363 - DNA, 20 bp, Artificial
  CRISPR gRNA sequence
aattatgactttctatcaaa

SEQ ID NO: 638364 - DNA, 20 bp, Artificial
  CRISPR gRNA sequence
tgactttctatcaaaactgg

SEQ ID NO: 638365 - DNA, 20 bp, Artificial
  CRISPR gRNA sequence
tctatcaaaactgggatgca

SEQ ID NO: 638366 - DNA, 20 bp, Artificial
  CRISPR gRNA sequence
ctatcaaaactgggatgcat

SEQ ID NO: 638367 - DNA, 20 bp, Artificial
  CRISPR gRNA sequence
tatcaaaactgggatgcatg

SEQ ID NO: 638368 - DNA, 20 bp, Artificial
  CRISPR gRNA sequence
tcaaaactgggatgcatgtc

SEQ ID NO: 638369 - DNA, 20 bp, Artificial
  CRISPR gRNA sequence
ggatgcatgtctcactcaaa

SEQ ID NO: 638370 - DNA, 20 bp, Artificial
  CRISPR gRNA sequence
actcaaaacaactacctcat

SEQ ID NO: 638371 - DNA, 20 bp, Artificial
  CRISPR gRNA sequence
aaaacaactacctcataatt

SEQ ID NO: 638372 - DNA, 20 bp, Artificial
  CRISPR gRNA sequence
cctcataattttaaaatttg

SEQ ID NO: 638373 - DNA, 20 bp, Artificial
  CRISPR gRNA sequence
ataattttaaaatttgcttt

SEQ ID NO: 638374 - DNA, 20 bp, Artificial
  CRISPR gRNA sequence
taaaatttgctttgctgttg

SEQ ID NO: 638375 - DNA, 20 bp, Artificial
  CRISPR gRNA sequence
aaaatttgctttgctgttgt

SEQ ID NO: 638376 - DNA, 20 bp, Artificial
  CRISPR gRNA sequence
aaatttgctttgctgttgtc

SEQ ID NO: 638377 - DNA, 20 bp, Artificial
  CRISPR gRNA sequence
gctttgctgttgtcaagggt

SEQ ID NO: 638378 - DNA, 20 bp, Artificial
  CRISPR gRNA sequence
ctttgctgttgtcaagggta

SEQ ID NO: 638379 - DNA, 20 bp, Artificial
  CRISPR gRNA sequence
tgctgttgtcaagggtatgt

SEQ ID NO: 638380 - DNA, 20 bp, Artificial
  CRISPR gRNA sequence
gctgttgtcaagggtatgtc

SEQ ID NO: 638381 - DNA, 20 bp, Artificial
  CRISPR gRNA sequence
ctgttgtcaagggtatgtcc

SEQ ID NO: 638382 - DNA, 20 bp, Artificial
  CRISPR gRNA sequence
ttgtcaagggtatgtccatg

SEQ ID NO: 638383 - DNA, 20 bp, Artificial
  CRISPR gRNA sequence
tcaagggtatgtccatgcag

SEQ ID NO: 638384 - DNA, 20 bp, Artificial
  CRISPR gRNA sequence
gttgctgaagaatctgtcaa

SEQ ID NO: 638385 - DNA, 20 bp, Artificial
  CRISPR gRNA sequence
ctgaagaatctgtcaatatt

SEQ ID NO: 638386 - DNA, 20 bp, Artificial
  CRISPR gRNA sequence
aagaatctgtcaatattcaa

SEQ ID NO: 638387 - DNA, 20 bp, Artificial
  CRISPR gRNA sequence
tcaatattcaatcttttcct

SEQ ID NO: 638388 - DNA, 20 bp, Artificial
  CRISPR gRNA sequence
aatcttttcctcctcctctc

SEQ ID NO: 638389 - DNA, 20 bp, Artificial
  CRISPR gRNA sequence
ttcctcctcctctctatttt

SEQ ID NO: 638390 - DNA, 20 bp, Artificial
  CRISPR gRNA sequence
tcctcctcctctctattttt

SEQ ID NO: 638391 - DNA, 20 bp, Artificial
  CRISPR gRNA sequence
cctcctcctctctatttttt

SEQ ID NO: 638392 - DNA, 20 bp, Artificial
  CRISPR gRNA sequence
ctcctcctctctattttttt

SEQ ID NO: 638393 - DNA, 20 bp, Artificial
  CRISPR gRNA sequence
ctcctctctatttttttaac

SEQ ID NO: 638394 - DNA, 20 bp, Artificial
  CRISPR gRNA sequence
ctctctatttttttaacatt

SEQ ID NO: 638395 - DNA, 20 bp, Artificial
  CRISPR gRNA sequence
tctatttttttaacattaat

SEQ ID NO: 638396 - DNA, 20 bp, Artificial
  CRISPR gRNA sequence
tatttttttaacattaattt

SEQ ID NO: 638397 - DNA, 20 bp, Artificial
  CRISPR gRNA sequence
tttttttaacattaatttct

SEQ ID NO: 638398 - DNA, 20 bp, Artificial
  CRISPR gRNA sequence
ttttaacattaatttctata

SEQ ID NO: 638399 - DNA, 20 bp, Artificial
  CRISPR gRNA sequence
tttaacattaatttctatac

SEQ ID NO: 638400 - DNA, 20 bp, Artificial
  CRISPR gRNA sequence
ttaacattaatttctatact

SEQ ID NO: 638401 - DNA, 20 bp, Artificial
  CRISPR gRNA sequence
taacattaatttctatactc

SEQ ID NO: 638402 - DNA, 20 bp, Artificial
  CRISPR gRNA sequence
aacattaatttctatactcc

SEQ ID NO: 638403 - DNA, 20 bp, Artificial
  CRISPR gRNA sequence
acattaatttctatactcct

SEQ ID NO: 638404 - DNA, 20 bp, Artificial
  CRISPR gRNA sequence
atttctatactccttgtcct

SEQ ID NO: 638405 - DNA, 20 bp, Artificial
  CRISPR gRNA sequence
ctatactccttgtcctgcta

SEQ ID NO: 638406 - DNA, 20 bp, Artificial
  CRISPR gRNA sequence
tatactccttgtcctgctat

SEQ ID NO: 638407 - DNA, 20 bp, Artificial
  CRISPR gRNA sequence
tactccttgtcctgctatga

SEQ ID NO: 638408 - DNA, 20 bp, Artificial
  CRISPR gRNA sequence
cttgtcctgctatgaattat

SEQ ID NO: 638409 - DNA, 20 bp, Artificial
  CRISPR gRNA sequence
gtcctgctatgaattatcgg

SEQ ID NO: 638410 - DNA, 20 bp, Artificial
  CRISPR gRNA sequence
tcctgctatgaattatcggt

SEQ ID NO: 638411 - DNA, 20 bp, Artificial
  CRISPR gRNA sequence
ctatgaattatcggtggtag

SEQ ID NO: 638412 - DNA, 20 bp, Artificial
  CRISPR gRNA sequence
tgaattatcggtggtaggtt

SEQ ID NO: 638413 - DNA, 20 bp, Artificial
  CRISPR gRNA sequence
tcggtggtaggttaaggcag

SEQ ID NO: 638414 - DNA, 20 bp, Artificial
  CRISPR gRNA sequence
aggcagcaatttgagcagta

SEQ ID NO: 638415 - DNA, 20 bp, Artificial
  CRISPR gRNA sequence
gagcagtaagtcaatattat

SEQ ID NO: 638416 - DNA, 20 bp, Artificial
  CRISPR gRNA sequence
agcagtaagtcaatattatc

SEQ ID NO: 638417 - DNA, 20 bp, Artificial
  CRISPR gRNA sequence
tcaattttaatctctaaacc

SEQ ID NO: 638418 - DNA, 20 bp, Artificial
  CRISPR gRNA sequence
taatctctaaaccaatagtt

SEQ ID NO: 638419 - DNA, 20 bp, Artificial
  CRISPR gRNA sequence
aatctctaaaccaatagttt

SEQ ID NO: 638420 - DNA, 20 bp, Artificial
  CRISPR gRNA sequence
atctctaaaccaatagttta

SEQ ID NO: 638421 - DNA, 20 bp, Artificial
  CRISPR gRNA sequence
taaaccaatagtttatgaag

SEQ ID NO: 638422 - DNA, 20 bp, Artificial
  CRISPR gRNA sequence
aaccaatagtttatgaagga

SEQ ID NO: 638423 - DNA, 20 bp, Artificial
  CRISPR gRNA sequence
atgaaggatagcatttcagg

SEQ ID NO: 638424 - DNA, 20 bp, Artificial
  CRISPR gRNA sequence
tgaaggatagcatttcagga

SEQ ID NO: 638425 - DNA, 20 bp, Artificial
  CRISPR gRNA sequence
caggatttcctttgtggtca

SEQ ID NO: 638426 - DNA, 20 bp, Artificial
  CRISPR gRNA sequence
aggatttcctttgtggtcaa

SEQ ID NO: 638427 - DNA, 20 bp, Artificial
  CRISPR gRNA sequence
cctttgtggtcaagttttga

SEQ ID NO: 638428 - DNA, 20 bp, Artificial
  CRISPR gRNA sequence
ctttgtggtcaagttttgac

SEQ ID NO: 638429 - DNA, 20 bp, Artificial
  CRISPR gRNA sequence
tgtggtcaagttttgacagt

SEQ ID NO: 638430 - DNA, 20 bp, Artificial
  CRISPR gRNA sequence
gtggtcaagttttgacagtc

SEQ ID NO: 638431 - DNA, 20 bp, Artificial
  CRISPR gRNA sequence
tggtcaagttttgacagtct

SEQ ID NO: 638432 - DNA, 20 bp, Artificial
  CRISPR gRNA sequence
tgacagtcttgtgtcaatta

SEQ ID NO: 638433 - DNA, 20 bp, Artificial
  CRISPR gRNA sequence
gacagtcttgtgtcaattat

SEQ ID NO: 638434 - DNA, 20 bp, Artificial
  CRISPR gRNA sequence
acagtcttgtgtcaattatt

SEQ ID NO: 638435 - DNA, 20 bp, Artificial
  CRISPR gRNA sequence
gtgtcaattattgatataaa

SEQ ID NO: 638436 - DNA, 20 bp, Artificial
  CRISPR gRNA sequence
tgtcaattattgatataaag

SEQ ID NO: 638437 - DNA, 20 bp, Artificial
  CRISPR gRNA sequence
ttgatataaagataaatcac

SEQ ID NO: 638438 - DNA, 20 bp, Artificial
  CRISPR gRNA sequence
atataaagataaatcacacc

SEQ ID NO: 638439 - DNA, 20 bp, Artificial
  CRISPR gRNA sequence
tgagttggtaatgtagaatt

SEQ ID NO: 638440 - DNA, 20 bp, Artificial
  CRISPR gRNA sequence
gtaatgtagaattttatcta

SEQ ID NO: 638441 - DNA, 20 bp, Artificial
  CRISPR gRNA sequence
tatctacatttaaacagatc

SEQ ID NO: 638442 - DNA, 20 bp, Artificial
  CRISPR gRNA sequence
atctacatttaaacagatct

SEQ ID NO: 638443 - DNA, 20 bp, Artificial
  CRISPR gRNA sequence
tctacatttaaacagatctt

SEQ ID NO: 638444 - DNA, 20 bp, Artificial
  CRISPR gRNA sequence
catttaaacagatcttggca

SEQ ID NO: 638445 - DNA, 20 bp, Artificial
  CRISPR gRNA sequence
aaacagatcttggcaacaaa

SEQ ID NO: 638446 - DNA, 20 bp, Artificial
  CRISPR gRNA sequence
aacagatcttggcaacaaaa

SEQ ID NO: 638447 - DNA, 20 bp, Artificial
  CRISPR gRNA sequence
ggcaacaaaataaagaccaa

SEQ ID NO: 638448 - DNA, 20 bp, Artificial
  CRISPR gRNA sequence
gcaacaaaataaagaccaaa

SEQ ID NO: 638449 - DNA, 20 bp, Artificial
  CRISPR gRNA sequence
cctccctactttcatggaaa

SEQ ID NO: 638450 - DNA, 20 bp, Artificial
  CRISPR gRNA sequence
ctccctactttcatggaaaa

SEQ ID NO: 638451 - DNA, 20 bp, Artificial
  CRISPR gRNA sequence
cctactttcatggaaaaaaa

SEQ ID NO: 638452 - DNA, 20 bp, Artificial
  CRISPR gRNA sequence
ctttcatggaaaaaaaatgt

SEQ ID NO: 638453 - DNA, 20 bp, Artificial
  CRISPR gRNA sequence
tcatggaaaaaaaatgtaaa

SEQ ID NO: 638454 - DNA, 20 bp, Artificial
  CRISPR gRNA sequence
catggaaaaaaaatgtaaac

SEQ ID NO: 638455 - DNA, 20 bp, Artificial
  CRISPR gRNA sequence
atggaaaaaaaatgtaaacg

SEQ ID NO: 638456 - DNA, 20 bp, Artificial
  CRISPR gRNA sequence
acttcctgatgatcctgcac

SEQ ID NO: 638457 - DNA, 20 bp, Artificial
  CRISPR gRNA sequence
cctgatgatcctgcacactc

SEQ ID NO: 638458 - DNA, 20 bp, Artificial
  CRISPR gRNA sequence
ctgatgatcctgcacactcc

SEQ ID NO: 638459 - DNA, 20 bp, Artificial
  CRISPR gRNA sequence
atgatcctgcacactccatg

SEQ ID NO: 638460 - DNA, 20 bp, Artificial
  CRISPR gRNA sequence
cacactccatgaaaccttgt

SEQ ID NO: 638461 - DNA, 20 bp, Artificial
  CRISPR gRNA sequence
catgaaaccttgtatagcgt

SEQ ID NO: 638462 - DNA, 20 bp, Artificial
  CRISPR gRNA sequence
gtatagcgtgcacatcatca

SEQ ID NO: 638463 - DNA, 20 bp, Artificial
  CRISPR gRNA sequence
tatagcgtgcacatcatcaa

SEQ ID NO: 638464 - DNA, 20 bp, Artificial
  CRISPR gRNA sequence
tattagctaacacagtagca

SEQ ID NO: 638465 - DNA, 20 bp, Artificial
  CRISPR gRNA sequence
attagctaacacagtagcac

SEQ ID NO: 638466 - DNA, 20 bp, Artificial
  CRISPR gRNA sequence
ttagctaacacagtagcacc

SEQ ID NO: 638467 - DNA, 20 bp, Artificial
  CRISPR gRNA sequence
gctaacacagtagcaccatt

SEQ ID NO: 638468 - DNA, 20 bp, Artificial
  CRISPR gRNA sequence
acacagtagcaccattgtgg

SEQ ID NO: 638469 - DNA, 20 bp, Artificial
  CRISPR gRNA sequence
tggcccacagacggagtttc

SEQ ID NO: 638470 - DNA, 20 bp, Artificial
  CRISPR gRNA sequence
ctattttttggcggacaact

SEQ ID NO: 638471 - DNA, 20 bp, Artificial
  CRISPR gRNA sequence
tattttttggcggacaacta

SEQ ID NO: 638472 - DNA, 20 bp, Artificial
  CRISPR gRNA sequence
ttttttggcggacaactagt

SEQ ID NO: 638473 - DNA, 20 bp, Artificial
  CRISPR gRNA sequence
tttggcggacaactagttca

SEQ ID NO: 638474 - DNA, 20 bp, Artificial
  CRISPR gRNA sequence
ttggcggacaactagttcat

SEQ ID NO: 638475 - DNA, 20 bp, Artificial
  CRISPR gRNA sequence
tggcggacaactagttcatg

SEQ ID NO: 638476 - DNA, 20 bp, Artificial
  CRISPR gRNA sequence
ggcggacaactagttcatga

SEQ ID NO: 638477 - DNA, 20 bp, Artificial
  CRISPR gRNA sequence
gcggacaactagttcatgag

SEQ ID NO: 638478 - DNA, 20 bp, Artificial
  CRISPR gRNA sequence
gttcatgagaattatacaat

SEQ ID NO: 638479 - DNA, 20 bp, Artificial
  CRISPR gRNA sequence
atgagaattatacaatgcag

SEQ ID NO: 638480 - DNA, 20 bp, Artificial
  CRISPR gRNA sequence
tacaatgcagagaaaataaa

SEQ ID NO: 638481 - DNA, 20 bp, Artificial
  CRISPR gRNA sequence
ctttaaatagaaatgcctca

SEQ ID NO: 638482 - DNA, 20 bp, Artificial
  CRISPR gRNA sequence
taaatagaaatgcctcagcc

SEQ ID NO: 638483 - DNA, 20 bp, Artificial
  CRISPR gRNA sequence
aaatagaaatgcctcagcca

SEQ ID NO: 638484 - DNA, 20 bp, Artificial
  CRISPR gRNA sequence
aatagaaatgcctcagccaa

SEQ ID NO: 638485 - DNA, 20 bp, Artificial
  CRISPR gRNA sequence
agccaaacagcagtctatcc

SEQ ID NO: 638486 - DNA, 20 bp, Artificial
  CRISPR gRNA sequence
tccctttatccaacctttcg

SEQ ID NO: 638487 - DNA, 20 bp, Artificial
  CRISPR gRNA sequence
tatccaacctttcgatgaat

SEQ ID NO: 638488 - DNA, 20 bp, Artificial
  CRISPR gRNA sequence
atccaacctttcgatgaatg

SEQ ID NO: 638489 - DNA, 20 bp, Artificial
  CRISPR gRNA sequence
tccaacctttcgatgaatga

SEQ ID NO: 638490 - DNA, 20 bp, Artificial
  CRISPR gRNA sequence
tcgatgaatgatttcatttg

SEQ ID NO: 638491 - DNA, 20 bp, Artificial
  CRISPR gRNA sequence
cgatgaatgatttcatttgc

SEQ ID NO: 638492 - DNA, 20 bp, Artificial
  CRISPR gRNA sequence
gatgaatgatttcatttgcc

SEQ ID NO: 638493 - DNA, 20 bp, Artificial
  CRISPR gRNA sequence
catttgccaagtcctaaagg

SEQ ID NO: 638494 - DNA, 20 bp, Artificial
  CRISPR gRNA sequence
atttgccaagtcctaaaggt

SEQ ID NO: 638495 - DNA, 20 bp, Artificial
  CRISPR gRNA sequence
gccaagtcctaaaggttcaa

SEQ ID NO: 638496 - DNA, 20 bp, Artificial
  CRISPR gRNA sequence
ccaagtcctaaaggttcaat

SEQ ID NO: 638497 - DNA, 20 bp, Artificial
  CRISPR gRNA sequence
aaggttcaatatcttctatg

SEQ ID NO: 638498 - DNA, 20 bp, Artificial
  CRISPR gRNA sequence
aatatcttctatgtcttgca

SEQ ID NO: 638499 - DNA, 20 bp, Artificial
  CRISPR gRNA sequence
ctatgtcttgcacatctgtt

SEQ ID NO: 638500 - DNA, 20 bp, Artificial
  CRISPR gRNA sequence
tatgtcttgcacatctgttt

SEQ ID NO: 638501 - DNA, 20 bp, Artificial
  CRISPR gRNA sequence
tgtcttgcacatctgttttt

SEQ ID NO: 638502 - DNA, 20 bp, Artificial
  CRISPR gRNA sequence
gcacatctgtttttgcatct

SEQ ID NO: 638503 - DNA, 20 bp, Artificial
  CRISPR gRNA sequence
cacatctgtttttgcatctt

SEQ ID NO: 638504 - DNA, 20 bp, Artificial
  CRISPR gRNA sequence
tttttgcatcttcttgggca

SEQ ID NO: 638505 - DNA, 20 bp, Artificial
  CRISPR gRNA sequence
ttgcatcttcttgggcaata

SEQ ID NO: 638506 - DNA, 20 bp, Artificial
  CRISPR gRNA sequence
tgcatcttcttgggcaatac

SEQ ID NO: 638507 - DNA, 20 bp, Artificial
  CRISPR gRNA sequence
gcatcttcttgggcaataca

SEQ ID NO: 638508 - DNA, 20 bp, Artificial
  CRISPR gRNA sequence
catcttcttgggcaatacaa

SEQ ID NO: 638509 - DNA, 20 bp, Artificial
  CRISPR gRNA sequence
cttgggcaatacaactactt

SEQ ID NO: 638510 - DNA, 20 bp, Artificial
  CRISPR gRNA sequence
ttgggcaatacaactacttt

SEQ ID NO: 638511 - DNA, 20 bp, Artificial
  CRISPR gRNA sequence
gggcaatacaactactttaa

SEQ ID NO: 638512 - DNA, 20 bp, Artificial
  CRISPR gRNA sequence
ggcaatacaactactttaag

SEQ ID NO: 638513 - DNA, 20 bp, Artificial
  CRISPR gRNA sequence
ctttaagatccccatgacct

SEQ ID NO: 638514 - DNA, 20 bp, Artificial
  CRISPR gRNA sequence
taagatccccatgacctctc

SEQ ID NO: 638515 - DNA, 20 bp, Artificial
  CRISPR gRNA sequence
aagatccccatgacctctca

SEQ ID NO: 638516 - DNA, 20 bp, Artificial
  CRISPR gRNA sequence
agatccccatgacctctcac

SEQ ID NO: 638517 - DNA, 20 bp, Artificial
  CRISPR gRNA sequence
tcacctggaacaatatcaga

SEQ ID NO: 638518 - DNA, 20 bp, Artificial
  CRISPR gRNA sequence
acctggaacaatatcagaaa

SEQ ID NO: 638519 - DNA, 20 bp, Artificial
  CRISPR gRNA sequence
gaacaatatcagaaactttc

SEQ ID NO: 638520 - DNA, 20 bp, Artificial
  CRISPR gRNA sequence
tctaactggtctctttcctt

SEQ ID NO: 638521 - DNA, 20 bp, Artificial
  CRISPR gRNA sequence
ctaactggtctctttccttc

SEQ ID NO: 638522 - DNA, 20 bp, Artificial
  CRISPR gRNA sequence
taactggtctctttccttca

SEQ ID NO: 638523 - DNA, 20 bp, Artificial
  CRISPR gRNA sequence
actggtctctttccttcaaa

SEQ ID NO: 638524 - DNA, 20 bp, Artificial
  CRISPR gRNA sequence
gtctctttccttcaaacttt

SEQ ID NO: 638525 - DNA, 20 bp, Artificial
  CRISPR gRNA sequence
tttccttcaaacttttgcca

SEQ ID NO: 638526 - DNA, 20 bp, Artificial
  CRISPR gRNA sequence
tccttcaaacttttgccaca

SEQ ID NO: 638527 - DNA, 20 bp, Artificial
  CRISPR gRNA sequence
ccttcaaacttttgccacac

SEQ ID NO: 638528 - DNA, 20 bp, Artificial
  CRISPR gRNA sequence
cttcaaacttttgccacact

SEQ ID NO: 638529 - DNA, 20 bp, Artificial
  CRISPR gRNA sequence
caaacttttgccacactctt

SEQ ID NO: 638530 - DNA, 20 bp, Artificial
  CRISPR gRNA sequence
aaacttttgccacactcttc

SEQ ID NO: 638531 - DNA, 20 bp, Artificial
  CRISPR gRNA sequence
ttgccacactcttctccccc

SEQ ID NO: 638532 - DNA, 20 bp, Artificial
  CRISPR gRNA sequence
tgccacactcttctccccca

SEQ ID NO: 638533 - DNA, 20 bp, Artificial
  CRISPR gRNA sequence
gccacactcttctcccccaa

SEQ ID NO: 638534 - DNA, 20 bp, Artificial
  CRISPR gRNA sequence
ccacactcttctcccccaat

SEQ ID NO: 638535 - DNA, 20 bp, Artificial
  CRISPR gRNA sequence
ttctcccccaattcatctat

SEQ ID NO: 638536 - DNA, 20 bp, Artificial
  CRISPR gRNA sequence
ctcccccaattcatctatat

SEQ ID NO: 638537 - DNA, 20 bp, Artificial
  CRISPR gRNA sequence
tcccccaattcatctatatt

SEQ ID NO: 638538 - DNA, 20 bp, Artificial
  CRISPR gRNA sequence
ccccaattcatctatattca

SEQ ID NO: 638539 - DNA, 20 bp, Artificial
  CRISPR gRNA sequence
atctatattcagttgttaga

SEQ ID NO: 638540 - DNA, 20 bp, Artificial
  CRISPR gRNA sequence
tattcagttgttagattaat

SEQ ID NO: 638541 - DNA, 20 bp, Artificial
  CRISPR gRNA sequence
agttgttagattaatcttcc

SEQ ID NO: 638542 - DNA, 20 bp, Artificial
  CRISPR gRNA sequence
ttagattaatcttcctattg

SEQ ID NO: 638543 - DNA, 20 bp, Artificial
  CRISPR gRNA sequence
gattaatcttcctattgcag

SEQ ID NO: 638544 - DNA, 20 bp, Artificial
  CRISPR gRNA sequence
atcttcctattgcagagttc

SEQ ID NO: 638545 - DNA, 20 bp, Artificial
  CRISPR gRNA sequence
cctattgcagagttcatatt

SEQ ID NO: 638546 - DNA, 20 bp, Artificial
  CRISPR gRNA sequence
ctattgcagagttcatatta

SEQ ID NO: 638547 - DNA, 20 bp, Artificial
  CRISPR gRNA sequence
ttgcagagttcatattactc

SEQ ID NO: 638548 - DNA, 20 bp, Artificial
  CRISPR gRNA sequence
cagagttcatattactcttc

SEQ ID NO: 638549 - DNA, 20 bp, Artificial
  CRISPR gRNA sequence
atattactcttctaaatgtc

SEQ ID NO: 638550 - DNA, 20 bp, Artificial
  CRISPR gRNA sequence
ctcttctaaatgtcttcaag

SEQ ID NO: 638551 - DNA, 20 bp, Artificial
  CRISPR gRNA sequence
ttctaaatgtcttcaagaac

SEQ ID NO: 638552 - DNA, 20 bp, Artificial
  CRISPR gRNA sequence
ctaaatgtcttcaagaactg

SEQ ID NO: 638553 - DNA, 20 bp, Artificial
  CRISPR gRNA sequence
taaatgtcttcaagaactgc

SEQ ID NO: 638554 - DNA, 20 bp, Artificial
  CRISPR gRNA sequence
aatgtcttcaagaactgcct

SEQ ID NO: 638555 - DNA, 20 bp, Artificial
  CRISPR gRNA sequence
caagaactgcctactgccta

SEQ ID NO: 638556 - DNA, 20 bp, Artificial
  CRISPR gRNA sequence
aagaactgcctactgcctac

SEQ ID NO: 638557 - DNA, 20 bp, Artificial
  CRISPR gRNA sequence
cctactgcctacacattaaa

SEQ ID NO: 638558 - DNA, 20 bp, Artificial
  CRISPR gRNA sequence
ctgcctacacattaaataca

SEQ ID NO: 638559 - DNA, 20 bp, Artificial
  CRISPR gRNA sequence
cctacacattaaatacaaag

SEQ ID NO: 638560 - DNA, 20 bp, Artificial
  CRISPR gRNA sequence
cacattaaatacaaaggtat

SEQ ID NO: 638561 - DNA, 20 bp, Artificial
  CRISPR gRNA sequence
aatacaaaggtattggtatg

SEQ ID NO: 638562 - DNA, 20 bp, Artificial
  CRISPR gRNA sequence
gtatggaatttaagaatatc

SEQ ID NO: 638563 - DNA, 20 bp, Artificial
  CRISPR gRNA sequence
aagaatatccaaagtgtagt

SEQ ID NO: 638564 - DNA, 20 bp, Artificial
  CRISPR gRNA sequence
agaatatccaaagtgtagtc

SEQ ID NO: 638565 - DNA, 20 bp, Artificial
  CRISPR gRNA sequence
cagccatatgtcctatgagt

SEQ ID NO: 638566 - DNA, 20 bp, Artificial
  CRISPR gRNA sequence
agccatatgtcctatgagtc

SEQ ID NO: 638567 - DNA, 20 bp, Artificial
  CRISPR gRNA sequence
tgagtcttttagttactcat

SEQ ID NO: 638568 - DNA, 20 bp, Artificial
  CRISPR gRNA sequence
ttagttactcatgccttttc

SEQ ID NO: 638569 - DNA, 20 bp, Artificial
  CRISPR gRNA sequence
tagttactcatgccttttcc

SEQ ID NO: 638570 - DNA, 20 bp, Artificial
  CRISPR gRNA sequence
agttactcatgccttttcca

SEQ ID NO: 638571 - DNA, 20 bp, Artificial
  CRISPR gRNA sequence
gttactcatgccttttccag

SEQ ID NO: 638572 - DNA, 20 bp, Artificial
  CRISPR gRNA sequence
ctcatgccttttccagtgaa

SEQ ID NO: 638573 - DNA, 20 bp, Artificial
  CRISPR gRNA sequence
atgccttttccagtgaaacc

SEQ ID NO: 638574 - DNA, 20 bp, Artificial
  CRISPR gRNA sequence
ttccagtgaaaccactgtcc

SEQ ID NO: 638575 - DNA, 20 bp, Artificial
  CRISPR gRNA sequence
tccagtgaaaccactgtcct

SEQ ID NO: 638576 - DNA, 20 bp, Artificial
  CRISPR gRNA sequence
ccagtgaaaccactgtcctc

SEQ ID NO: 638577 - DNA, 20 bp, Artificial
  CRISPR gRNA sequence
cagtgaaaccactgtcctca

SEQ ID NO: 638578 - DNA, 20 bp, Artificial
  CRISPR gRNA sequence
tcctcagttttccagaaaca

SEQ ID NO: 638579 - DNA, 20 bp, Artificial
  CRISPR gRNA sequence
agttttccagaaacacattt

SEQ ID NO: 638580 - DNA, 20 bp, Artificial
  CRISPR gRNA sequence
tccagaaacacatttataca

SEQ ID NO: 638581 - DNA, 20 bp, Artificial
  CRISPR gRNA sequence
ccagaaacacatttatacat

SEQ ID NO: 638582 - DNA, 20 bp, Artificial
  CRISPR gRNA sequence
cagaaacacatttatacatc

SEQ ID NO: 638583 - DNA, 20 bp, Artificial
  CRISPR gRNA sequence
atacatctctacttactagg

SEQ ID NO: 638584 - DNA, 20 bp, Artificial
  CRISPR gRNA sequence
tacatctctacttactaggt

SEQ ID NO: 638585 - DNA, 20 bp, Artificial
  CRISPR gRNA sequence
tacttactaggtttttttgt

SEQ ID NO: 638586 - DNA, 20 bp, Artificial
  CRISPR gRNA sequence
cttactaggtttttttgttt

SEQ ID NO: 638587 - DNA, 20 bp, Artificial
  CRISPR gRNA sequence
actaggtttttttgtttttt

SEQ ID NO: 638588 - DNA, 20 bp, Artificial
  CRISPR gRNA sequence
ctaggtttttttgttttttc

SEQ ID NO: 638589 - DNA, 20 bp, Artificial
  CRISPR gRNA sequence
ggtttttttgttttttctca

SEQ ID NO: 638590 - DNA, 20 bp, Artificial
  CRISPR gRNA sequence
ttttgttttttctcaagcac

SEQ ID NO: 638591 - DNA, 20 bp, Artificial
  CRISPR gRNA sequence
tttgttttttctcaagcacc

SEQ ID NO: 638592 - DNA, 20 bp, Artificial
  CRISPR gRNA sequence
ttgttttttctcaagcacct

SEQ ID NO: 638593 - DNA, 20 bp, Artificial
  CRISPR gRNA sequence
tgttttttctcaagcacctg

SEQ ID NO: 638594 - DNA, 20 bp, Artificial
  CRISPR gRNA sequence
gttttttctcaagcacctgc

SEQ ID NO: 638595 - DNA, 20 bp, Artificial
  CRISPR gRNA sequence
ttttttctcaagcacctgct

SEQ ID NO: 638596 - DNA, 20 bp, Artificial
  CRISPR gRNA sequence
tttctcaagcacctgctttt

SEQ ID NO: 638597 - DNA, 20 bp, Artificial
  CRISPR gRNA sequence
ttctcaagcacctgctttta

SEQ ID NO: 638598 - DNA, 20 bp, Artificial
  CRISPR gRNA sequence
tctcaagcacctgcttttat

SEQ ID NO: 638599 - DNA, 20 bp, Artificial
  CRISPR gRNA sequence
ctcaagcacctgcttttatt

SEQ ID NO: 638600 - DNA, 20 bp, Artificial
  CRISPR gRNA sequence
tcaagcacctgcttttattt

SEQ ID NO: 638601 - DNA, 20 bp, Artificial
  CRISPR gRNA sequence
aagcacctgcttttattttc

SEQ ID NO: 638602 - DNA, 20 bp, Artificial
  CRISPR gRNA sequence
cttttattttctgggatact

SEQ ID NO: 638603 - DNA, 20 bp, Artificial
  CRISPR gRNA sequence
ttattttctgggatacttcc

SEQ ID NO: 638604 - DNA, 20 bp, Artificial
  CRISPR gRNA sequence
tattttctgggatacttccc

SEQ ID NO: 638605 - DNA, 20 bp, Artificial
  CRISPR gRNA sequence
attttctgggatacttcccc

SEQ ID NO: 638606 - DNA, 20 bp, Artificial
  CRISPR gRNA sequence
ttttctgggatacttcccct

SEQ ID NO: 638607 - DNA, 20 bp, Artificial
  CRISPR gRNA sequence
tctgggatacttcccctatt

SEQ ID NO: 638608 - DNA, 20 bp, Artificial
  CRISPR gRNA sequence
ctgggatacttcccctattt

SEQ ID NO: 638609 - DNA, 20 bp, Artificial
  CRISPR gRNA sequence
tgggatacttcccctatttc

SEQ ID NO: 638610 - DNA, 20 bp, Artificial
  CRISPR gRNA sequence
ggatacttcccctatttcta

SEQ ID NO: 638611 - DNA, 20 bp, Artificial
  CRISPR gRNA sequence
cccctatttctataaaaatt

SEQ ID NO: 638612 - DNA, 20 bp, Artificial
  CRISPR gRNA sequence
ccctatttctataaaaatta

SEQ ID NO: 638613 - DNA, 20 bp, Artificial
  CRISPR gRNA sequence
tttctataaaaattagcaca

SEQ ID NO: 638614 - DNA, 20 bp, Artificial
  CRISPR gRNA sequence
ctataaaaattagcacatca

SEQ ID NO: 638615 - DNA, 20 bp, Artificial
  CRISPR gRNA sequence
tataaaaattagcacatcat

SEQ ID NO: 638616 - DNA, 20 bp, Artificial
  CRISPR gRNA sequence
taaaaattagcacatcatta

SEQ ID NO: 638617 - DNA, 20 bp, Artificial
  CRISPR gRNA sequence
gcacatcattaaaggatcac

SEQ ID NO: 638618 - DNA, 20 bp, Artificial
  CRISPR gRNA sequence
aaggatcacttatctgctac

SEQ ID NO: 638619 - DNA, 20 bp, Artificial
  CRISPR gRNA sequence
atctgctaccttttttcatg

SEQ ID NO: 638620 - DNA, 20 bp, Artificial
  CRISPR gRNA sequence
tctgctaccttttttcatga

SEQ ID NO: 638621 - DNA, 20 bp, Artificial
  CRISPR gRNA sequence
ctaccttttttcatgagtgt

SEQ ID NO: 638622 - DNA, 20 bp, Artificial
  CRISPR gRNA sequence
ccttttttcatgagtgtttt

SEQ ID NO: 638623 - DNA, 20 bp, Artificial
  CRISPR gRNA sequence
ttttcatgagtgttttctga

SEQ ID NO: 638624 - DNA, 20 bp, Artificial
  CRISPR gRNA sequence
tttcatgagtgttttctgag

SEQ ID NO: 638625 - DNA, 20 bp, Artificial
  CRISPR gRNA sequence
ttcatgagtgttttctgagc

SEQ ID NO: 638626 - DNA, 20 bp, Artificial
  CRISPR gRNA sequence
tcatgagtgttttctgagca

SEQ ID NO: 638627 - DNA, 20 bp, Artificial
  CRISPR gRNA sequence
catgagtgttttctgagcaa

SEQ ID NO: 638628 - DNA, 20 bp, Artificial
  CRISPR gRNA sequence
atgagtgttttctgagcaaa

SEQ ID NO: 638629 - DNA, 20 bp, Artificial
  CRISPR gRNA sequence
tctgagcaaaaagttcttct

SEQ ID NO: 638630 - DNA, 20 bp, Artificial
  CRISPR gRNA sequence
ctgagcaaaaagttcttctc

SEQ ID NO: 638631 - DNA, 20 bp, Artificial
  CRISPR gRNA sequence
tgagcaaaaagttcttctcc

SEQ ID NO: 638632 - DNA, 20 bp, Artificial
  CRISPR gRNA sequence
agcaaaaagttcttctccta

SEQ ID NO: 638633 - DNA, 20 bp, Artificial
  CRISPR gRNA sequence
ttctcctatgaaatttactt

SEQ ID NO: 638634 - DNA, 20 bp, Artificial
  CRISPR gRNA sequence
ctcctatgaaatttacttca

SEQ ID NO: 638635 - DNA, 20 bp, Artificial
  CRISPR gRNA sequence
tcctatgaaatttacttcac

SEQ ID NO: 638636 - DNA, 20 bp, Artificial
  CRISPR gRNA sequence
ctatgaaatttacttcactt

SEQ ID NO: 638637 - DNA, 20 bp, Artificial
  CRISPR gRNA sequence
tgaaatttacttcactttac

SEQ ID NO: 638638 - DNA, 20 bp, Artificial
  CRISPR gRNA sequence
acttcactttacattacagt

SEQ ID NO: 638639 - DNA, 20 bp, Artificial
  CRISPR gRNA sequence
cttcactttacattacagtg

SEQ ID NO: 638640 - DNA, 20 bp, Artificial
  CRISPR gRNA sequence
cactttacattacagtgatt

SEQ ID NO: 638641 - DNA, 20 bp, Artificial
  CRISPR gRNA sequence
actttacattacagtgattt

SEQ ID NO: 638642 - DNA, 20 bp, Artificial
  CRISPR gRNA sequence
tacattacagtgatttcatc

SEQ ID NO: 638643 - DNA, 20 bp, Artificial
  CRISPR gRNA sequence
acattacagtgatttcatca

SEQ ID NO: 638644 - DNA, 20 bp, Artificial
  CRISPR gRNA sequence
cattacagtgatttcatcag

SEQ ID NO: 638645 - DNA, 20 bp, Artificial
  CRISPR gRNA sequence
cagtgatttcatcagaacat

SEQ ID NO: 638646 - DNA, 20 bp, Artificial
  CRISPR gRNA sequence
catcagaacatttgccttac

SEQ ID NO: 638647 - DNA, 20 bp, Artificial
  CRISPR gRNA sequence
atcagaacatttgccttacc

SEQ ID NO: 638648 - DNA, 20 bp, Artificial
  CRISPR gRNA sequence
gccttacctctacactgcct

SEQ ID NO: 638649 - DNA, 20 bp, Artificial
  CRISPR gRNA sequence
ccttacctctacactgccta

SEQ ID NO: 638650 - DNA, 20 bp, Artificial
  CRISPR gRNA sequence
acctctacactgcctatagt

SEQ ID NO: 638651 - DNA, 20 bp, Artificial
  CRISPR gRNA sequence
cctctacactgcctatagtg

SEQ ID NO: 638652 - DNA, 20 bp, Artificial
  CRISPR gRNA sequence
tacactgcctatagtgtaag

SEQ ID NO: 638653 - DNA, 20 bp, Artificial
  CRISPR gRNA sequence
cactgcctatagtgtaaggt

SEQ ID NO: 638654 - DNA, 20 bp, Artificial
  CRISPR gRNA sequence
cctatagtgtaaggtccttg

SEQ ID NO: 638655 - DNA, 20 bp, Artificial
  CRISPR gRNA sequence
tagtgtaaggtccttgagag

SEQ ID NO: 638656 - DNA, 20 bp, Artificial
  CRISPR gRNA sequence
gagaggaaatactgccttta

SEQ ID NO: 638657 - DNA, 20 bp, Artificial
  CRISPR gRNA sequence
agaggaaatactgcctttat

SEQ ID NO: 638658 - DNA, 20 bp, Artificial
  CRISPR gRNA sequence
cctttattcatagttgtaaa

SEQ ID NO: 638659 - DNA, 20 bp, Artificial
  CRISPR gRNA sequence
tattcatagttgtaaaatca

SEQ ID NO: 638660 - DNA, 20 bp, Artificial
  CRISPR gRNA sequence
attcatagttgtaaaatcat

SEQ ID NO: 638661 - DNA, 20 bp, Artificial
  CRISPR gRNA sequence
ttcatagttgtaaaatcatt

SEQ ID NO: 638662 - DNA, 20 bp, Artificial
  CRISPR gRNA sequence
atagttgtaaaatcattcta

SEQ ID NO: 638663 - DNA, 20 bp, Artificial
  CRISPR gRNA sequence
taaaatcattctatccttac

SEQ ID NO: 638664 - DNA, 20 bp, Artificial
  CRISPR gRNA sequence
tatccttacacatacaaagc

SEQ ID NO: 638665 - DNA, 20 bp, Artificial
  CRISPR gRNA sequence
tccttacacatacaaagcac

SEQ ID NO: 638666 - DNA, 20 bp, Artificial
  CRISPR gRNA sequence
acacatacaaagcacccaat

SEQ ID NO: 638667 - DNA, 20 bp, Artificial
  CRISPR gRNA sequence
cacatacaaagcacccaata

SEQ ID NO: 638668 - DNA, 20 bp, Artificial
  CRISPR gRNA sequence
gttgaaccagtgctgctgat

SEQ ID NO: 638669 - DNA, 20 bp, Artificial
  CRISPR gRNA sequence
ttgaaccagtgctgctgatt

SEQ ID NO: 638670 - DNA, 20 bp, Artificial
  CRISPR gRNA sequence
aaccagtgctgctgatttac

SEQ ID NO: 638671 - DNA, 20 bp, Artificial
  CRISPR gRNA sequence
ctgatttacgtatgatattt

SEQ ID NO: 638672 - DNA, 20 bp, Artificial
  CRISPR gRNA sequence
atttacgtatgatatttctg

SEQ ID NO: 638673 - DNA, 20 bp, Artificial
  CRISPR gRNA sequence
acgtatgatatttctgtttt

SEQ ID NO: 638674 - DNA, 20 bp, Artificial
  CRISPR gRNA sequence
cgtatgatatttctgttttt

SEQ ID NO: 638675 - DNA, 20 bp, Artificial
  CRISPR gRNA sequence
ctgtttttaaattacgaaga

SEQ ID NO: 638676 - DNA, 20 bp, Artificial
  CRISPR gRNA sequence
tgtttttaaattacgaagac

SEQ ID NO: 638677 - DNA, 20 bp, Artificial
  CRISPR gRNA sequence
tttttaaattacgaagacct

SEQ ID NO: 638678 - DNA, 20 bp, Artificial
  CRISPR gRNA sequence
ttaaattacgaagacctcac

SEQ ID NO: 638679 - DNA, 20 bp, Artificial
  CRISPR gRNA sequence
taaattacgaagacctcaca

SEQ ID NO: 638680 - DNA, 20 bp, Artificial
  CRISPR gRNA sequence
aaattacgaagacctcacat

SEQ ID NO: 638681 - DNA, 20 bp, Artificial
  CRISPR gRNA sequence
aattacgaagacctcacata

SEQ ID NO: 638682 - DNA, 20 bp, Artificial
  CRISPR gRNA sequence
cgaagacctcacataaatca

SEQ ID NO: 638683 - DNA, 20 bp, Artificial
  CRISPR gRNA sequence
acataaatcaaatacacatg

SEQ ID NO: 638684 - DNA, 20 bp, Artificial
  CRISPR gRNA sequence
aggttttaaacacaaatcat

SEQ ID NO: 638685 - DNA, 20 bp, Artificial
  CRISPR gRNA sequence
ggttttaaacacaaatcatc

SEQ ID NO: 638686 - DNA, 20 bp, Artificial
  CRISPR gRNA sequence
taaacacaaatcatcaatat

SEQ ID NO: 638687 - DNA, 20 bp, Artificial
  CRISPR gRNA sequence
aaacacaaatcatcaatatc

SEQ ID NO: 638688 - DNA, 20 bp, Artificial
  CRISPR gRNA sequence
aacacaaatcatcaatatca

SEQ ID NO: 638689 - DNA, 20 bp, Artificial
  CRISPR gRNA sequence
attaaagaaccattaatgac

SEQ ID NO: 638690 - DNA, 20 bp, Artificial
  CRISPR gRNA sequence
aagaaccattaatgacagga

SEQ ID NO: 638691 - DNA, 20 bp, Artificial
  CRISPR gRNA sequence
atgacaggaaagaatttagg

SEQ ID NO: 638692 - DNA, 20 bp, Artificial
  CRISPR gRNA sequence
aggtgcgttatatatatcaa

SEQ ID NO: 638693 - DNA, 20 bp, Artificial
  CRISPR gRNA sequence
ggtgcgttatatatatcaac

SEQ ID NO: 638694 - DNA, 20 bp, Artificial
  CRISPR gRNA sequence
tatatatcaactgaattaat

SEQ ID NO: 638695 - DNA, 20 bp, Artificial
  CRISPR gRNA sequence
aattaatcaaaatagccact

SEQ ID NO: 638696 - DNA, 20 bp, Artificial
  CRISPR gRNA sequence
atcaaaatagccactccatg

SEQ ID NO: 638697 - DNA, 20 bp, Artificial
  CRISPR gRNA sequence
catgaagtacgtaattttat

SEQ ID NO: 638698 - DNA, 20 bp, Artificial
  CRISPR gRNA sequence
tatcctcattttacaaatga

SEQ ID NO: 638699 - DNA, 20 bp, Artificial
  CRISPR gRNA sequence
atcctcattttacaaatgag

SEQ ID NO: 638700 - DNA, 20 bp, Artificial
  CRISPR gRNA sequence
tcctcattttacaaatgagg

SEQ ID NO: 638701 - DNA, 20 bp, Artificial
  CRISPR gRNA sequence
attttacaaatgaggaaact

SEQ ID NO: 638702 - DNA, 20 bp, Artificial
  CRISPR gRNA sequence
tacaaatgaggaaactgaag

SEQ ID NO: 638703 - DNA, 20 bp, Artificial
  CRISPR gRNA sequence
acaaatgaggaaactgaagc

SEQ ID NO: 638704 - DNA, 20 bp, Artificial
  CRISPR gRNA sequence
caaatgaggaaactgaagct

SEQ ID NO: 638705 - DNA, 20 bp, Artificial
  CRISPR gRNA sequence
aagcttaaaatcagtgaagt

SEQ ID NO: 638706 - DNA, 20 bp, Artificial
  CRISPR gRNA sequence
aaaatcagtgaagtaacaca

SEQ ID NO: 638707 - DNA, 20 bp, Artificial
  CRISPR gRNA sequence
aaatcagtgaagtaacacat

SEQ ID NO: 638708 - DNA, 20 bp, Artificial
  CRISPR gRNA sequence
aattcatacaaatattgaga

SEQ ID NO: 638709 - DNA, 20 bp, Artificial
  CRISPR gRNA sequence
atacaaatattgagagtcag

SEQ ID NO: 638710 - DNA, 20 bp, Artificial
  CRISPR gRNA sequence
agagtcagagctgtgactgg

SEQ ID NO: 638711 - DNA, 20 bp, Artificial
  CRISPR gRNA sequence
tgactggaactcagaactga

SEQ ID NO: 638712 - DNA, 20 bp, Artificial
  CRISPR gRNA sequence
gaactcagaactgatgacca

SEQ ID NO: 638713 - DNA, 20 bp, Artificial
  CRISPR gRNA sequence
agaactgatgaccaaattct

SEQ ID NO: 638714 - DNA, 20 bp, Artificial
  CRISPR gRNA sequence
atgaccaaattcttgctatt

SEQ ID NO: 638715 - DNA, 20 bp, Artificial
  CRISPR gRNA sequence
ttgctatttccctatgatgc

SEQ ID NO: 638716 - DNA, 20 bp, Artificial
  CRISPR gRNA sequence
gctatttccctatgatgcca

SEQ ID NO: 638717 - DNA, 20 bp, Artificial
  CRISPR gRNA sequence
ctatttccctatgatgccaa

SEQ ID NO: 638718 - DNA, 20 bp, Artificial
  CRISPR gRNA sequence
tttccctatgatgccaaaag

SEQ ID NO: 638719 - DNA, 20 bp, Artificial
  CRISPR gRNA sequence
ccctatgatgccaaaagcaa

SEQ ID NO: 638720 - DNA, 20 bp, Artificial
  CRISPR gRNA sequence
cctatgatgccaaaagcaaa

SEQ ID NO: 638721 - DNA, 20 bp, Artificial
  CRISPR gRNA sequence
tgatgccaaaagcaaagtag

SEQ ID NO: 638722 - DNA, 20 bp, Artificial
  CRISPR gRNA sequence
gtaatagtaaagaaaaaaaa

SEQ ID NO: 638723 - DNA, 20 bp, Artificial
  CRISPR gRNA sequence
aagaatgatacctttgaatc

SEQ ID NO: 638724 - DNA, 20 bp, Artificial
  CRISPR gRNA sequence
tgaatcagtgtatacaatct

SEQ ID NO: 638725 - DNA, 20 bp, Artificial
  CRISPR gRNA sequence
gaatcagtgtatacaatctg

SEQ ID NO: 638726 - DNA, 20 bp, Artificial
  CRISPR gRNA sequence
aatcagtgtatacaatctga

SEQ ID NO: 638727 - DNA, 20 bp, Artificial
  CRISPR gRNA sequence
atatgttttttactccacag

SEQ ID NO: 638728 - DNA, 20 bp, Artificial
  CRISPR gRNA sequence
tttactccacagtggaatac

SEQ ID NO: 638729 - DNA, 20 bp, Artificial
  CRISPR gRNA sequence
ttactccacagtggaataca

SEQ ID NO: 638730 - DNA, 20 bp, Artificial
  CRISPR gRNA sequence
tactccacagtggaatacag

SEQ ID NO: 638731 - DNA, 20 bp, Artificial
  CRISPR gRNA sequence
actccacagtggaatacagg

SEQ ID NO: 638732 - DNA, 20 bp, Artificial
  CRISPR gRNA sequence
ctccacagtggaatacaggt

SEQ ID NO: 638733 - DNA, 20 bp, Artificial
  CRISPR gRNA sequence
cacagtggaatacaggtgta

SEQ ID NO: 638734 - DNA, 20 bp, Artificial
  CRISPR gRNA sequence
ccagtctgaggtaaagagaa

SEQ ID NO: 638735 - DNA, 20 bp, Artificial
  CRISPR gRNA sequence
aggtaaagagaaagttgtct

SEQ ID NO: 638736 - DNA, 20 bp, Artificial
  CRISPR gRNA sequence
tctgagtaagcctgttttgg

SEQ ID NO: 638737 - DNA, 20 bp, Artificial
  CRISPR gRNA sequence
agtaagcctgttttggaaga

SEQ ID NO: 638738 - DNA, 20 bp, Artificial
  CRISPR gRNA sequence
ttttggaagaagaccagctt

SEQ ID NO: 638739 - DNA, 20 bp, Artificial
  CRISPR gRNA sequence
tggaagaagaccagcttaca

SEQ ID NO: 638740 - DNA, 20 bp, Artificial
  CRISPR gRNA sequence
ggaagaagaccagcttacac

SEQ ID NO: 638741 - DNA, 20 bp, Artificial
  CRISPR gRNA sequence
gaagaagaccagcttacact

SEQ ID NO: 638742 - DNA, 20 bp, Artificial
  CRISPR gRNA sequence
acactgccaaatttcctgag

SEQ ID NO: 638743 - DNA, 20 bp, Artificial
  CRISPR gRNA sequence
cactgccaaatttcctgagc

SEQ ID NO: 638744 - DNA, 20 bp, Artificial
  CRISPR gRNA sequence
ccaaatttcctgagcgtgga

SEQ ID NO: 638745 - DNA, 20 bp, Artificial
  CRISPR gRNA sequence
cctgagcgtggattttattt

SEQ ID NO: 638746 - DNA, 20 bp, Artificial
  CRISPR gRNA sequence
ctgagcgtggattttatttc

SEQ ID NO: 638747 - DNA, 20 bp, Artificial
  CRISPR gRNA sequence
agcgtggattttatttcata

SEQ ID NO: 638748 - DNA, 20 bp, Artificial
  CRISPR gRNA sequence
tatttcatataagagcaatc

SEQ ID NO: 638749 - DNA, 20 bp, Artificial
  CRISPR gRNA sequence
atttcatataagagcaatct

SEQ ID NO: 638750 - DNA, 20 bp, Artificial
  CRISPR gRNA sequence
tttcatataagagcaatcta

SEQ ID NO: 638751 - DNA, 20 bp, Artificial
  CRISPR gRNA sequence
catataagagcaatctactt

SEQ ID NO: 638752 - DNA, 20 bp, Artificial
  CRISPR gRNA sequence
atataagagcaatctacttt

SEQ ID NO: 638753 - DNA, 20 bp, Artificial
  CRISPR gRNA sequence
ctttgaactggtgtttggca

SEQ ID NO: 638754 - DNA, 20 bp, Artificial
  CRISPR gRNA sequence
tgaactggtgtttggcaacc

SEQ ID NO: 638755 - DNA, 20 bp, Artificial
  CRISPR gRNA sequence
gaactggtgtttggcaacca

SEQ ID NO: 638756 - DNA, 20 bp, Artificial
  CRISPR gRNA sequence
aactggtgtttggcaaccat

SEQ ID NO: 638757 - DNA, 20 bp, Artificial
  CRISPR gRNA sequence
gtgtttggcaaccatctgct

SEQ ID NO: 638758 - DNA, 20 bp, Artificial
  CRISPR gRNA sequence
ggcaaccatctgcttaacgt

SEQ ID NO: 638759 - DNA, 20 bp, Artificial
  CRISPR gRNA sequence
gcaaccatctgcttaacgta

SEQ ID NO: 638760 - DNA, 20 bp, Artificial
  CRISPR gRNA sequence
cttaacgtaactgtaagagg

SEQ ID NO: 638761 - DNA, 20 bp, Artificial
  CRISPR gRNA sequence
aacgtaactgtaagaggctt

SEQ ID NO: 638762 - DNA, 20 bp, Artificial
  CRISPR gRNA sequence
acgtaactgtaagaggcttg

SEQ ID NO: 638763 - DNA, 20 bp, Artificial
  CRISPR gRNA sequence
taagaggcttgtgaagcaaa

SEQ ID NO: 638764 - DNA, 20 bp, Artificial
  CRISPR gRNA sequence
gtgaagcaaattacattgtg

SEQ ID NO: 638765 - DNA, 20 bp, Artificial
  CRISPR gRNA sequence
tgaagcaaattacattgtga

SEQ ID NO: 638766 - DNA, 20 bp, Artificial
  CRISPR gRNA sequence
cattgtgaaattatcttttt

SEQ ID NO: 638767 - DNA, 20 bp, Artificial
  CRISPR gRNA sequence
tgaaattatctttttaataa

SEQ ID NO: 638768 - DNA, 20 bp, Artificial
  CRISPR gRNA sequence
tctttttaataagagcagta

SEQ ID NO: 638769 - DNA, 20 bp, Artificial
  CRISPR gRNA sequence
tttaataagagcagtacaaa

SEQ ID NO: 638770 - DNA, 20 bp, Artificial
  CRISPR gRNA sequence
ttaataagagcagtacaaaa

SEQ ID NO: 638771 - DNA, 20 bp, Artificial
  CRISPR gRNA sequence
taataagagcagtacaaaat

SEQ ID NO: 638772 - DNA, 20 bp, Artificial
  CRISPR gRNA sequence
aataagagcagtacaaaatt

SEQ ID NO: 638773 - DNA, 20 bp, Artificial
  CRISPR gRNA sequence
ataagagcagtacaaaattc

SEQ ID NO: 638774 - DNA, 20 bp, Artificial
  CRISPR gRNA sequence
ttaacctaacttctgtaaga

SEQ ID NO: 638775 - DNA, 20 bp, Artificial
  CRISPR gRNA sequence
aacctaacttctgtaagaag

SEQ ID NO: 638776 - DNA, 20 bp, Artificial
  CRISPR gRNA sequence
acctaacttctgtaagaagt

SEQ ID NO: 638777 - DNA, 20 bp, Artificial
  CRISPR gRNA sequence
acttctgtaagaagtaaaat

SEQ ID NO: 638778 - DNA, 20 bp, Artificial
  CRISPR gRNA sequence
ctgtaagaagtaaaatccag

SEQ ID NO: 638779 - DNA, 20 bp, Artificial
  CRISPR gRNA sequence
tgtaagaagtaaaatccagc

SEQ ID NO: 638780 - DNA, 20 bp, Artificial
  CRISPR gRNA sequence
taagaagtaaaatccagctg

SEQ ID NO: 638781 - DNA, 20 bp, Artificial
  CRISPR gRNA sequence
agtgggtatgttcccaaagg

SEQ ID NO: 638782 - DNA, 20 bp, Artificial
  CRISPR gRNA sequence
ccaaagggacccacaaggat

SEQ ID NO: 638783 - DNA, 20 bp, Artificial
  CRISPR gRNA sequence
ccagaggtcactaaggacgc

SEQ ID NO: 638784 - DNA, 20 bp, Artificial
  CRISPR gRNA sequence
aggacgcttaaacaaggtca

SEQ ID NO: 638785 - DNA, 20 bp, Artificial
  CRISPR gRNA sequence
aaacaaggtcagaaggcaag

SEQ ID NO: 638786 - DNA, 20 bp, Artificial
  CRISPR gRNA sequence
aacaaggtcagaaggcaagg

SEQ ID NO: 638787 - DNA, 20 bp, Artificial
  CRISPR gRNA sequence
ctggcggctcaacagaaaga

SEQ ID NO: 638788 - DNA, 20 bp, Artificial
  CRISPR gRNA sequence
gcggctcaacagaaagagat

SEQ ID NO: 638789 - DNA, 20 bp, Artificial
  CRISPR gRNA sequence
aacagaaagagataaggaag

SEQ ID NO: 638790 - DNA, 20 bp, Artificial
  CRISPR gRNA sequence
ctatcactgggcaacggcaa

SEQ ID NO: 638791 - DNA, 20 bp, Artificial
  CRISPR gRNA sequence
tatcactgggcaacggcaac

SEQ ID NO: 638792 - DNA, 20 bp, Artificial
  CRISPR gRNA sequence
tcactgggcaacggcaacag

SEQ ID NO: 638793 - DNA, 20 bp, Artificial
  CRISPR gRNA sequence
ggcaacggcaacagagggag

SEQ ID NO: 638794 - DNA, 20 bp, Artificial
  CRISPR gRNA sequence
cagcagctttaccgggtctc

SEQ ID NO: 638795 - DNA, 20 bp, Artificial
  CRISPR gRNA sequence
agcagctttaccgggtctct

SEQ ID NO: 638796 - DNA, 20 bp, Artificial
  CRISPR gRNA sequence
taccgggtctctgaagtgaa

SEQ ID NO: 638797 - DNA, 20 bp, Artificial
  CRISPR gRNA sequence
accgggtctctgaagtgaag

SEQ ID NO: 638798 - DNA, 20 bp, Artificial
  CRISPR gRNA sequence
ccgggtctctgaagtgaagc

SEQ ID NO: 638799 - DNA, 20 bp, Artificial
  CRISPR gRNA sequence
tgaagtgaagcaacagggga

SEQ ID NO: 638800 - DNA, 20 bp, Artificial
  CRISPR gRNA sequence
aagtgaagcaacaggggaac

SEQ ID NO: 638801 - DNA, 20 bp, Artificial
  CRISPR gRNA sequence
ccataccccaggttcaaaca

SEQ ID NO: 638802 - DNA, 20 bp, Artificial
  CRISPR gRNA sequence
cataccccaggttcaaacat

SEQ ID NO: 638803 - DNA, 20 bp, Artificial
  CRISPR gRNA sequence
aaacatccctgggtcataca

SEQ ID NO: 638804 - DNA, 20 bp, Artificial
  CRISPR gRNA sequence
ggtcatacacattgacatcg

SEQ ID NO: 638805 - DNA, 20 bp, Artificial
  CRISPR gRNA sequence
acatcgaggctacaaaagtt

SEQ ID NO: 638806 - DNA, 20 bp, Artificial
  CRISPR gRNA sequence
caaaagttctttccctgctg

SEQ ID NO: 638807 - DNA, 20 bp, Artificial
  CRISPR gRNA sequence
tttccctgctgttcttccat

SEQ ID NO: 638808 - DNA, 20 bp, Artificial
  CRISPR gRNA sequence
tccctgctgttcttccataa

SEQ ID NO: 638809 - DNA, 20 bp, Artificial
  CRISPR gRNA sequence
ccctgctgttcttccataaa

SEQ ID NO: 638810 - DNA, 20 bp, Artificial
  CRISPR gRNA sequence
cctgctgttcttccataaac

SEQ ID NO: 638811 - DNA, 20 bp, Artificial
  CRISPR gRNA sequence
ctgttcttccataaacactg

SEQ ID NO: 638812 - DNA, 20 bp, Artificial
  CRISPR gRNA sequence
ttcttccataaacactgtac

SEQ ID NO: 638813 - DNA, 20 bp, Artificial
  CRISPR gRNA sequence
ttccataaacactgtactac

SEQ ID NO: 638814 - DNA, 20 bp, Artificial
  CRISPR gRNA sequence
ccataaacactgtactactg

SEQ ID NO: 638815 - DNA, 20 bp, Artificial
  CRISPR gRNA sequence
cataaacactgtactactgg

SEQ ID NO: 638816 - DNA, 20 bp, Artificial
  CRISPR gRNA sequence
tactactggtctgagtcaaa

SEQ ID NO: 638817 - DNA, 20 bp, Artificial
  CRISPR gRNA sequence
ctggtctgagtcaaataaac

SEQ ID NO: 638818 - DNA, 20 bp, Artificial
  CRISPR gRNA sequence
gtctgagtcaaataaacaga

SEQ ID NO: 638819 - DNA, 20 bp, Artificial
  CRISPR gRNA sequence
agtcaaataaacagagtctg

SEQ ID NO: 638820 - DNA, 20 bp, Artificial
  CRISPR gRNA sequence
catttggccctcagatgcag

SEQ ID NO: 638821 - DNA, 20 bp, Artificial
  CRISPR gRNA sequence
ggccctcagatgcaggattg

SEQ ID NO: 638822 - DNA, 20 bp, Artificial
  CRISPR gRNA sequence
gccctcagatgcaggattgg

SEQ ID NO: 638823 - DNA, 20 bp, Artificial
  CRISPR gRNA sequence
agatgcaggattggtcagtt

SEQ ID NO: 638824 - DNA, 20 bp, Artificial
  CRISPR gRNA sequence
gtcagttagaaattaataac

SEQ ID NO: 638825 - DNA, 20 bp, Artificial
  CRISPR gRNA sequence
gaaattaataaccagtaaga

SEQ ID NO: 638826 - DNA, 20 bp, Artificial
  CRISPR gRNA sequence
ataaccagtaagatctatca

SEQ ID NO: 638827 - DNA, 20 bp, Artificial
  CRISPR gRNA sequence
tcaagtagtgagaaagagaa

SEQ ID NO: 638828 - DNA, 20 bp, Artificial
  CRISPR gRNA sequence
gtggtgattaaggggaatta

SEQ ID NO: 638829 - DNA, 20 bp, Artificial
  CRISPR gRNA sequence
tggtgattaaggggaattaa

SEQ ID NO: 638830 - DNA, 20 bp, Artificial
  CRISPR gRNA sequence
aggggaattaaagcaatttt

SEQ ID NO: 638831 - DNA, 20 bp, Artificial
  CRISPR gRNA sequence
aagcaatttttgacagatca

SEQ ID NO: 638832 - DNA, 20 bp, Artificial
  CRISPR gRNA sequence
ttgacagatcagtgccagat

SEQ ID NO: 638833 - DNA, 20 bp, Artificial
  CRISPR gRNA sequence
tgacagatcagtgccagata

SEQ ID NO: 638834 - DNA, 20 bp, Artificial
  CRISPR gRNA sequence
gacagatcagtgccagatac

SEQ ID NO: 638835 - DNA, 20 bp, Artificial
  CRISPR gRNA sequence
acagatcagtgccagatact

SEQ ID NO: 638836 - DNA, 20 bp, Artificial
  CRISPR gRNA sequence
attttccacaatgtagcagc

SEQ ID NO: 638837 - DNA, 20 bp, Artificial
  CRISPR gRNA sequence
ttttccacaatgtagcagca

SEQ ID NO: 638838 - DNA, 20 bp, Artificial
  CRISPR gRNA sequence
tccacaatgtagcagcagca

SEQ ID NO: 638839 - DNA, 20 bp, Artificial
  CRISPR gRNA sequence
ccacaatgtagcagcagcag

SEQ ID NO: 638840 - DNA, 20 bp, Artificial
  CRISPR gRNA sequence
cacaatgtagcagcagcagt

SEQ ID NO: 638841 - DNA, 20 bp, Artificial
  CRISPR gRNA sequence
gttgttgttgttgttgttct

SEQ ID NO: 638842 - DNA, 20 bp, Artificial
  CRISPR gRNA sequence
ttgttgttgttgttgttctt

SEQ ID NO: 638843 - DNA, 20 bp, Artificial
  CRISPR gRNA sequence
ttgttgttgttgttcttctt

SEQ ID NO: 638844 - DNA, 20 bp, Artificial
  CRISPR gRNA sequence
ttgttgttgttcttcttctt

SEQ ID NO: 638845 - DNA, 20 bp, Artificial
  CRISPR gRNA sequence
ttgttgttcttcttctttac

SEQ ID NO: 638846 - DNA, 20 bp, Artificial
  CRISPR gRNA sequence
ttgttcttcttctttacaat

SEQ ID NO: 638847 - DNA, 20 bp, Artificial
  CRISPR gRNA sequence
ttcttcttctttacaatgct

SEQ ID NO: 638848 - DNA, 20 bp, Artificial
  CRISPR gRNA sequence
ttcttctttacaatgctcat

SEQ ID NO: 638849 - DNA, 20 bp, Artificial
  CRISPR gRNA sequence
cttctttacaatgctcatac

SEQ ID NO: 638850 - DNA, 20 bp, Artificial
  CRISPR gRNA sequence
ttctttacaatgctcatacc

SEQ ID NO: 638851 - DNA, 20 bp, Artificial
  CRISPR gRNA sequence
ctttacaatgctcataccta

SEQ ID NO: 638852 - DNA, 20 bp, Artificial
  CRISPR gRNA sequence
tttacaatgctcatacctag

SEQ ID NO: 638853 - DNA, 20 bp, Artificial
  CRISPR gRNA sequence
tacaatgctcatacctagtt

SEQ ID NO: 638854 - DNA, 20 bp, Artificial
  CRISPR gRNA sequence
acaatgctcatacctagttt

SEQ ID NO: 638855 - DNA, 20 bp, Artificial
  CRISPR gRNA sequence
caatgctcatacctagtttt

SEQ ID NO: 638856 - DNA, 20 bp, Artificial
  CRISPR gRNA sequence
atacctagttttctactcct

SEQ ID NO: 638857 - DNA, 20 bp, Artificial
  CRISPR gRNA sequence
gttttctactcctaatgaat

SEQ ID NO: 638858 - DNA, 20 bp, Artificial
  CRISPR gRNA sequence
tctactcctaatgaatgaat

SEQ ID NO: 638859 - DNA, 20 bp, Artificial
  CRISPR gRNA sequence
ctactcctaatgaatgaatg

SEQ ID NO: 638860 - DNA, 20 bp, Artificial
  CRISPR gRNA sequence
tactcctaatgaatgaatga

SEQ ID NO: 638861 - DNA, 20 bp, Artificial
  CRISPR gRNA sequence
ctcctaatgaatgaatgagc

SEQ ID NO: 638862 - DNA, 20 bp, Artificial
  CRISPR gRNA sequence
ctaatgaatgaatgagcatt

SEQ ID NO: 638863 - DNA, 20 bp, Artificial
  CRISPR gRNA sequence
atgaatgaatgagcatttta

SEQ ID NO: 638864 - DNA, 20 bp, Artificial
  CRISPR gRNA sequence
taagtaggattacagaatgc

SEQ ID NO: 638865 - DNA, 20 bp, Artificial
  CRISPR gRNA sequence
aagtaggattacagaatgca

SEQ ID NO: 638866 - DNA, 20 bp, Artificial
  CRISPR gRNA sequence
agtaggattacagaatgcat

SEQ ID NO: 638867 - DNA, 20 bp, Artificial
  CRISPR gRNA sequence
cagaatgcatataattaaag

SEQ ID NO: 638868 - DNA, 20 bp, Artificial
  CRISPR gRNA sequence
aaggcaaaaacatttacaaa

SEQ ID NO: 638869 - DNA, 20 bp, Artificial
  CRISPR gRNA sequence
acaaagcatcctatgaagta

SEQ ID NO: 638870 - DNA, 20 bp, Artificial
  CRISPR gRNA sequence
caaagcatcctatgaagtat

SEQ ID NO: 638871 - DNA, 20 bp, Artificial
  CRISPR gRNA sequence
tgaagtatttaaatcatgga

SEQ ID NO: 638872 - DNA, 20 bp, Artificial
  CRISPR gRNA sequence
aaatcatggaaataccagat

SEQ ID NO: 638873 - DNA, 20 bp, Artificial
  CRISPR gRNA sequence
aatcatggaaataccagatt

SEQ ID NO: 638874 - DNA, 20 bp, Artificial
  CRISPR gRNA sequence
taacatctatgtttaaatgc

SEQ ID NO: 638875 - DNA, 20 bp, Artificial
  CRISPR gRNA sequence
tgtttaaatgcttacttata

SEQ ID NO: 638876 - DNA, 20 bp, Artificial
  CRISPR gRNA sequence
aaatgcttacttatataaat

SEQ ID NO: 638877 - DNA, 20 bp, Artificial
  CRISPR gRNA sequence
aatgcttacttatataaatg

SEQ ID NO: 638878 - DNA, 20 bp, Artificial
  CRISPR gRNA sequence
acttatataaatgttggaag

SEQ ID NO: 638879 - DNA, 20 bp, Artificial
  CRISPR gRNA sequence
cttatataaatgttggaagc

SEQ ID NO: 638880 - DNA, 20 bp, Artificial
  CRISPR gRNA sequence
atataaatgttggaagccac

SEQ ID NO: 638881 - DNA, 20 bp, Artificial
  CRISPR gRNA sequence
tataaatgttggaagccact

SEQ ID NO: 638882 - DNA, 20 bp, Artificial
  CRISPR gRNA sequence
gaagccacttgctagctccc

SEQ ID NO: 638883 - DNA, 20 bp, Artificial
  CRISPR gRNA sequence
gctagctccctgcttcctac

SEQ ID NO: 638884 - DNA, 20 bp, Artificial
  CRISPR gRNA sequence
ctagctccctgcttcctact

SEQ ID NO: 638885 - DNA, 20 bp, Artificial
  CRISPR gRNA sequence
gctccctgcttcctactgta

SEQ ID NO: 638886 - DNA, 20 bp, Artificial
  CRISPR gRNA sequence
cctgcttcctactgtatgaa

SEQ ID NO: 638887 - DNA, 20 bp, Artificial
  CRISPR gRNA sequence
cttcctactgtatgaagtga

SEQ ID NO: 638888 - DNA, 20 bp, Artificial
  CRISPR gRNA sequence
cctactgtatgaagtgaaga

SEQ ID NO: 638889 - DNA, 20 bp, Artificial
  CRISPR gRNA sequence
ctactgtatgaagtgaagat

SEQ ID NO: 638890 - DNA, 20 bp, Artificial
  CRISPR gRNA sequence
ctgtatgaagtgaagataat

SEQ ID NO: 638891 - DNA, 20 bp, Artificial
  CRISPR gRNA sequence
tatgaagtgaagataatatc

SEQ ID NO: 638892 - DNA, 20 bp, Artificial
  CRISPR gRNA sequence
tacattaaaactgtgaagac

SEQ ID NO: 638893 - DNA, 20 bp, Artificial
  CRISPR gRNA sequence
cattaaaactgtgaagactg

SEQ ID NO: 638894 - DNA, 20 bp, Artificial
  CRISPR gRNA sequence
aaactgtgaagactggaaaa

SEQ ID NO: 638895 - DNA, 20 bp, Artificial
  CRISPR gRNA sequence
tgaagactggaaaagcatgc

SEQ ID NO: 638896 - DNA, 20 bp, Artificial
  CRISPR gRNA sequence
gaaaagcatgcaatcactta

SEQ ID NO: 638897 - DNA, 20 bp, Artificial
  CRISPR gRNA sequence
aaagcaagcaacatagccct

SEQ ID NO: 638898 - DNA, 20 bp, Artificial
  CRISPR gRNA sequence
aagcaagcaacatagccctg

SEQ ID NO: 638899 - DNA, 20 bp, Artificial
  CRISPR gRNA sequence
tggttaaagagcaagggctc

SEQ ID NO: 638900 - DNA, 20 bp, Artificial
  CRISPR gRNA sequence
aagagcaagggctctaggtc

SEQ ID NO: 638901 - DNA, 20 bp, Artificial
  CRISPR gRNA sequence
taggtccagcaccctggagt

SEQ ID NO: 638902 - DNA, 20 bp, Artificial
  CRISPR gRNA sequence
ggtccagcaccctggagttt

SEQ ID NO: 638903 - DNA, 20 bp, Artificial
  CRISPR gRNA sequence
gagtttaaggccaggttcgt

SEQ ID NO: 638904 - DNA, 20 bp, Artificial
  CRISPR gRNA sequence
aaggccaggttcgttcattt

SEQ ID NO: 638905 - DNA, 20 bp, Artificial
  CRISPR gRNA sequence
aggccaggttcgttcattta

SEQ ID NO: 638906 - DNA, 20 bp, Artificial
  CRISPR gRNA sequence
gttcatttataagtcacatg

SEQ ID NO: 638907 - DNA, 20 bp, Artificial
  CRISPR gRNA sequence
atttataagtcacatgacct

SEQ ID NO: 638908 - DNA, 20 bp, Artificial
  CRISPR gRNA sequence
ataagtcacatgaccttagg

SEQ ID NO: 638909 - DNA, 20 bp, Artificial
  CRISPR gRNA sequence
taagtcacatgaccttagga

SEQ ID NO: 638910 - DNA, 20 bp, Artificial
  CRISPR gRNA sequence
aggaaacctaagtttcaatt

SEQ ID NO: 638911 - DNA, 20 bp, Artificial
  CRISPR gRNA sequence
ggaaacctaagtttcaattt

SEQ ID NO: 638912 - DNA, 20 bp, Artificial
  CRISPR gRNA sequence
agtttcaattttctcatcta

SEQ ID NO: 638913 - DNA, 20 bp, Artificial
  CRISPR gRNA sequence
caattttctcatctataaaa

SEQ ID NO: 638914 - DNA, 20 bp, Artificial
  CRISPR gRNA sequence
aattttctcatctataaaat

SEQ ID NO: 638915 - DNA, 20 bp, Artificial
  CRISPR gRNA sequence
tctcatctataaaatcaaaa

SEQ ID NO: 638916 - DNA, 20 bp, Artificial
  CRISPR gRNA sequence
ctcatctataaaatcaaaat

SEQ ID NO: 638917 - DNA, 20 bp, Artificial
  CRISPR gRNA sequence
tcatctataaaatcaaaata

SEQ ID NO: 638918 - DNA, 20 bp, Artificial
  CRISPR gRNA sequence
atctataaaatcaaaataat

SEQ ID NO: 638919 - DNA, 20 bp, Artificial
  CRISPR gRNA sequence
taaaatcaaaataatgacaa

SEQ ID NO: 638920 - DNA, 20 bp, Artificial
  CRISPR gRNA sequence
cctcctagggttgtcctgag

SEQ ID NO: 638921 - DNA, 20 bp, Artificial
  CRISPR gRNA sequence
ctagggttgtcctgagtatt

SEQ ID NO: 638922 - DNA, 20 bp, Artificial
  CRISPR gRNA sequence
gggttgtcctgagtattaaa

SEQ ID NO: 638923 - DNA, 20 bp, Artificial
  CRISPR gRNA sequence
tcctgagtattaaataaaat

SEQ ID NO: 638924 - DNA, 20 bp, Artificial
  CRISPR gRNA sequence
agtattaaataaaattgtat

SEQ ID NO: 638925 - DNA, 20 bp, Artificial
  CRISPR gRNA sequence
aataaaattgtataaacaat

SEQ ID NO: 638926 - DNA, 20 bp, Artificial
  CRISPR gRNA sequence
tataaacaatacacttggaa

SEQ ID NO: 638927 - DNA, 20 bp, Artificial
  CRISPR gRNA sequence
ggaactacttgcttcttatt

SEQ ID NO: 638928 - DNA, 20 bp, Artificial
  CRISPR gRNA sequence
gaactacttgcttcttatta

SEQ ID NO: 638929 - DNA, 20 bp, Artificial
  CRISPR gRNA sequence
cttgcttcttattaatatat

SEQ ID NO: 638930 - DNA, 20 bp, Artificial
  CRISPR gRNA sequence
gcttcttattaatatatcta

SEQ ID NO: 638931 - DNA, 20 bp, Artificial
  CRISPR gRNA sequence
cttcttattaatatatctat

SEQ ID NO: 638932 - DNA, 20 bp, Artificial
  CRISPR gRNA sequence
cttattaatatatctatgtg

SEQ ID NO: 638933 - DNA, 20 bp, Artificial
  CRISPR gRNA sequence
ttattaatatatctatgtga

SEQ ID NO: 638934 - DNA, 20 bp, Artificial
  CRISPR gRNA sequence
attaatatatctatgtgaaa

SEQ ID NO: 638935 - DNA, 20 bp, Artificial
  CRISPR gRNA sequence
ttaatatatctatgtgaaag

SEQ ID NO: 638936 - DNA, 20 bp, Artificial
  CRISPR gRNA sequence
atatatctatgtgaaagcat

SEQ ID NO: 638937 - DNA, 20 bp, Artificial
  CRISPR gRNA sequence
tgtgaaagcatttcataagt

SEQ ID NO: 638938 - DNA, 20 bp, Artificial
  CRISPR gRNA sequence
cataagtatcaacatcaaac

SEQ ID NO: 638939 - DNA, 20 bp, Artificial
  CRISPR gRNA sequence
ataagtatcaacatcaaaca

SEQ ID NO: 638940 - DNA, 20 bp, Artificial
  CRISPR gRNA sequence
gggttatgtttactacatgg

SEQ ID NO: 638941 - DNA, 20 bp, Artificial
  CRISPR gRNA sequence
tgtttactacatggaagtac

SEQ ID NO: 638942 - DNA, 20 bp, Artificial
  CRISPR gRNA sequence
actacatggaagtacaggga

SEQ ID NO: 638943 - DNA, 20 bp, Artificial
  CRISPR gRNA sequence
ctacatggaagtacagggaa

SEQ ID NO: 638944 - DNA, 20 bp, Artificial
  CRISPR gRNA sequence
catggaagtacagggaagat

SEQ ID NO: 638945 - DNA, 20 bp, Artificial
  CRISPR gRNA sequence
tatgaaggaaatggcatgta

SEQ ID NO: 638946 - DNA, 20 bp, Artificial
  CRISPR gRNA sequence
atgaaggaaatggcatgtaa

SEQ ID NO: 638947 - DNA, 20 bp, Artificial
  CRISPR gRNA sequence
tgaaggaaatggcatgtaaa

SEQ ID NO: 638948 - DNA, 20 bp, Artificial
  CRISPR gRNA sequence
aaagttggatatgacttata

SEQ ID NO: 638949 - DNA, 20 bp, Artificial
  CRISPR gRNA sequence
gatatgacttatataaaaga

SEQ ID NO: 638950 - DNA, 20 bp, Artificial
  CRISPR gRNA sequence
atataaaagaagaactagat

SEQ ID NO: 638951 - DNA, 20 bp, Artificial
  CRISPR gRNA sequence
tataaaagaagaactagatg

SEQ ID NO: 638952 - DNA, 20 bp, Artificial
  CRISPR gRNA sequence
gatggcactcaagatagggg

SEQ ID NO: 638953 - DNA, 20 bp, Artificial
  CRISPR gRNA sequence
aagataggggcaagcatgaa

SEQ ID NO: 638954 - DNA, 20 bp, Artificial
  CRISPR gRNA sequence
gttgtgaatgacaccatttt

SEQ ID NO: 638955 - DNA, 20 bp, Artificial
  CRISPR gRNA sequence
tgaatgacaccattttttcc

SEQ ID NO: 638956 - DNA, 20 bp, Artificial
  CRISPR gRNA sequence
tttccagaatggatacactc

SEQ ID NO: 638957 - DNA, 20 bp, Artificial
  CRISPR gRNA sequence
ttccagaatggatacactca

SEQ ID NO: 638958 - DNA, 20 bp, Artificial
  CRISPR gRNA sequence
tccagaatggatacactcaa

SEQ ID NO: 638959 - DNA, 20 bp, Artificial
  CRISPR gRNA sequence
ccagaatggatacactcaat

SEQ ID NO: 638960 - DNA, 20 bp, Artificial
  CRISPR gRNA sequence
cagaatggatacactcaatg

SEQ ID NO: 638961 - DNA, 20 bp, Artificial
  CRISPR gRNA sequence
aatggataatatacaataga

SEQ ID NO: 638962 - DNA, 20 bp, Artificial
  CRISPR gRNA sequence
aaaccacagagcatttaaaa

SEQ ID NO: 638963 - DNA, 20 bp, Artificial
  CRISPR gRNA sequence
aaaattgagcaaagtacaag

SEQ ID NO: 638964 - DNA, 20 bp, Artificial
  CRISPR gRNA sequence
aaattgagcaaagtacaaga

SEQ ID NO: 638965 - DNA, 20 bp, Artificial
  CRISPR gRNA sequence
agcaaagtacaagagaatta

SEQ ID NO: 638966 - DNA, 20 bp, Artificial
  CRISPR gRNA sequence
atgcttgaatggcagtaatt

SEQ ID NO: 638967 - DNA, 20 bp, Artificial
  CRISPR gRNA sequence
gaatggcagtaatttcaaaa

SEQ ID NO: 638968 - DNA, 20 bp, Artificial
  CRISPR gRNA sequence
aatggcagtaatttcaaaag

SEQ ID NO: 638969 - DNA, 20 bp, Artificial
  CRISPR gRNA sequence
caaaagacaaatgctgttaa

SEQ ID NO: 638970 - DNA, 20 bp, Artificial
  CRISPR gRNA sequence
aaaagacaaatgctgttaac

SEQ ID NO: 638971 - DNA, 20 bp, Artificial
  CRISPR gRNA sequence
ttaacttattaataggacaa

SEQ ID NO: 638972 - DNA, 20 bp, Artificial
  CRISPR gRNA sequence
acttattaataggacaacca

SEQ ID NO: 638973 - DNA, 20 bp, Artificial
  CRISPR gRNA sequence
attaataggacaaccaagta

SEQ ID NO: 638974 - DNA, 20 bp, Artificial
  CRISPR gRNA sequence
ttaataggacaaccaagtat

SEQ ID NO: 638975 - DNA, 20 bp, Artificial
  CRISPR gRNA sequence
ataggacaaccaagtatgaa

SEQ ID NO: 638976 - DNA, 20 bp, Artificial
  CRISPR gRNA sequence
ttaagaaatcattcaaaatt

SEQ ID NO: 638977 - DNA, 20 bp, Artificial
  CRISPR gRNA sequence
aagaaatcattcaaaattac

SEQ ID NO: 638978 - DNA, 20 bp, Artificial
  CRISPR gRNA sequence
agaaatcattcaaaattact

SEQ ID NO: 638979 - DNA, 20 bp, Artificial
  CRISPR gRNA sequence
aaaattactcactgagcacc

SEQ ID NO: 638980 - DNA, 20 bp, Artificial
  CRISPR gRNA sequence
ctcactgagcacctgctctg

SEQ ID NO: 638981 - DNA, 20 bp, Artificial
  CRISPR gRNA sequence
actgagcacctgctctgtac

SEQ ID NO: 638982 - DNA, 20 bp, Artificial
  CRISPR gRNA sequence
agcacctgctctgtaccagg

SEQ ID NO: 638983 - DNA, 20 bp, Artificial
  CRISPR gRNA sequence
ctctgtaccaggcaccacga

SEQ ID NO: 638984 - DNA, 20 bp, Artificial
  CRISPR gRNA sequence
tgtaccaggcaccacgaagc

SEQ ID NO: 638985 - DNA, 20 bp, Artificial
  CRISPR gRNA sequence
taccaggcaccacgaagcag

SEQ ID NO: 638986 - DNA, 20 bp, Artificial
  CRISPR gRNA sequence
cctgcttttatggcactagt

SEQ ID NO: 638987 - DNA, 20 bp, Artificial
  CRISPR gRNA sequence
cttttatggcactagtgaaa

SEQ ID NO: 638988 - DNA, 20 bp, Artificial
  CRISPR gRNA sequence
ttatggcactagtgaaaggt

SEQ ID NO: 638989 - DNA, 20 bp, Artificial
  CRISPR gRNA sequence
tatggcactagtgaaaggta

SEQ ID NO: 638990 - DNA, 20 bp, Artificial
  CRISPR gRNA sequence
atggcactagtgaaaggtat

SEQ ID NO: 638991 - DNA, 20 bp, Artificial
  CRISPR gRNA sequence
tggcactagtgaaaggtatg

SEQ ID NO: 638992 - DNA, 20 bp, Artificial
  CRISPR gRNA sequence
gtgaaaggtatgcatataga

SEQ ID NO: 638993 - DNA, 20 bp, Artificial
  CRISPR gRNA sequence
tctttttatatatataagca

SEQ ID NO: 638994 - DNA, 20 bp, Artificial
  CRISPR gRNA sequence
tttatatatataagcaacta

SEQ ID NO: 638995 - DNA, 20 bp, Artificial
  CRISPR gRNA sequence
ttatatatataagcaactat

SEQ ID NO: 638996 - DNA, 20 bp, Artificial
  CRISPR gRNA sequence
tatatatataagcaactatg

SEQ ID NO: 638997 - DNA, 20 bp, Artificial
  CRISPR gRNA sequence
atatatataagcaactatgc

SEQ ID NO: 638998 - DNA, 20 bp, Artificial
  CRISPR gRNA sequence
tatatataagcaactatgca

SEQ ID NO: 638999 - DNA, 20 bp, Artificial
  CRISPR gRNA sequence
tgcactgtaaaatatttaat

SEQ ID NO: 639000 - DNA, 20 bp, Artificial
  CRISPR gRNA sequence
taaaatatttaatgagcaat

SEQ ID NO: 639001 - DNA, 20 bp, Artificial
  CRISPR gRNA sequence
aatgagcaatacaaggattc

SEQ ID NO: 639002 - DNA, 20 bp, Artificial
  CRISPR gRNA sequence
atgagcaatacaaggattca

SEQ ID NO: 639003 - DNA, 20 bp, Artificial
  CRISPR gRNA sequence
ataagccccacaccaccatg

SEQ ID NO: 639004 - DNA, 20 bp, Artificial
  CRISPR gRNA sequence
agctactataaaacctcagt

SEQ ID NO: 639005 - DNA, 20 bp, Artificial
  CRISPR gRNA sequence
ctataaaacctcagtgcaaa

SEQ ID NO: 639006 - DNA, 20 bp, Artificial
  CRISPR gRNA sequence
taaaacctcagtgcaaaata

SEQ ID NO: 639007 - DNA, 20 bp, Artificial
  CRISPR gRNA sequence
agtgcaaaatatagagcata

SEQ ID NO: 639008 - DNA, 20 bp, Artificial
  CRISPR gRNA sequence
tcataagatcactaattcaa

SEQ ID NO: 639009 - DNA, 20 bp, Artificial
  CRISPR gRNA sequence
ataagatcactaattcaaaa

SEQ ID NO: 639010 - DNA, 20 bp, Artificial
  CRISPR gRNA sequence
attcaaaaagataacttctc
